United States Patent 7,888,497 (BIOINFORMATICALLY DETECTABLE GROUP OF NOVEL REGULATORY OLIGONUCLEOTIDES AND USES THEREOF) - sequence listing, part 107

SEQ ID NO: 4527661 - DNA, 20 bp, Homo sapiens
ctgccctgcacgtcatggga

SEQ ID NO: 4527662 - DNA, 12 bp, Homo sapiens
ctgccctggctg

SEQ ID NO: 4527663 - DNA, 18 bp, Homo sapiens
ctgccctggctgctgccc

SEQ ID NO: 4527664 - DNA, 21 bp, Homo sapiens
ctgccctggctgctgccccca

SEQ ID NO: 4527665 - DNA, 20 bp, Homo sapiens
ctgccctggtccagggaagc

SEQ ID NO: 4527666 - DNA, 23 bp, Homo sapiens
ctgccctggtccagggaagctgg

SEQ ID NO: 4527667 - DNA, 17 bp, Homo sapiens
ctgccctgtcaagcttc

SEQ ID NO: 4527668 - DNA, 20 bp, Homo sapiens
ctgccctgtcaagcttctct

SEQ ID NO: 4527669 - DNA, 20 bp, Homo sapiens
ctgccctgtgatatgtctgc

SEQ ID NO: 4527670 - DNA, 14 bp, Homo sapiens
ctgccctgtggaca

SEQ ID NO: 4527671 - DNA, 15 bp, Homo sapiens
ctgcccttaggccac

SEQ ID NO: 4527672 - DNA, 17 bp, Homo sapiens
ctgcccttcaccccagt

SEQ ID NO: 4527673 - DNA, 14 bp, Homo sapiens
ctgcccttccctct

SEQ ID NO: 4527674 - DNA, 17 bp, Homo sapiens
ctgcccttccctctggg

SEQ ID NO: 4527675 - DNA, 15 bp, Homo sapiens
ctgcccttgctgccc

SEQ ID NO: 4527676 - DNA, 23 bp, Homo sapiens
ctgccctttcccaggtaatttaa

SEQ ID NO: 4527677 - DNA, 13 bp, Homo sapiens
ctgccctttctca

SEQ ID NO: 4527678 - DNA, 15 bp, Homo sapiens
ctgccctttctcagg

SEQ ID NO: 4527679 - DNA, 21 bp, Homo sapiens
ctgcccttttttctgcctcct

SEQ ID NO: 4527680 - DNA, 23 bp, Homo sapiens
ctgccgagagtccatcagcctcc

SEQ ID NO: 4527681 - DNA, 17 bp, Homo sapiens
ctgccgattttgtaaat

SEQ ID NO: 4527682 - DNA, 18 bp, Homo sapiens
ctgccgcagagctggccg

SEQ ID NO: 4527683 - DNA, 14 bp, Homo sapiens
ctgccgccctgtgg

SEQ ID NO: 4527684 - DNA, 15 bp, Homo sapiens
ctgccgccctgtggg

SEQ ID NO: 4527685 - DNA, 15 bp, Homo sapiens
ctgccgcgcagtgtg

SEQ ID NO: 4527686 - DNA, 13 bp, Homo sapiens
ctgccgctgcacc

SEQ ID NO: 4527687 - DNA, 13 bp, Homo sapiens
ctgccgctgccat

SEQ ID NO: 4527688 - DNA, 14 bp, Homo sapiens
ctgccgctgccatg

SEQ ID NO: 4527689 - DNA, 14 bp, Homo sapiens
ctgccgctggaggc

SEQ ID NO: 4527690 - DNA, 20 bp, Homo sapiens
ctgccggtcgggcagccagc

SEQ ID NO: 4527691 - DNA, 21 bp, Homo sapiens
ctgccggtgggaccctgtccg

SEQ ID NO: 4527692 - DNA, 20 bp, Homo sapiens
ctgccgtgcatggctcctgt

SEQ ID NO: 4527693 - DNA, 14 bp, Homo sapiens
ctgcctaagtggct

SEQ ID NO: 4527694 - DNA, 14 bp, Homo sapiens
ctgcctaataaaga

SEQ ID NO: 4527695 - DNA, 15 bp, Homo sapiens
ctgcctaataaagag

SEQ ID NO: 4527696 - DNA, 18 bp, Homo sapiens
ctgcctaataaagagact

SEQ ID NO: 4527697 - DNA, 16 bp, Homo sapiens
ctgcctacagccaggt

SEQ ID NO: 4527698 - DNA, 13 bp, Homo sapiens
ctgcctactcacg

SEQ ID NO: 4527699 - DNA, 14 bp, Homo sapiens
ctgcctatgcactg

SEQ ID NO: 4527700 - DNA, 20 bp, Homo sapiens
ctgcctatgcactgaagagc

SEQ ID NO: 4527701 - DNA, 23 bp, Homo sapiens
ctgcctatgcactgaagagctct

SEQ ID NO: 4527702 - DNA, 17 bp, Homo sapiens
ctgcctattatctgtca

SEQ ID NO: 4527703 - DNA, 23 bp, Homo sapiens
ctgcctattatctgtcagctgca

SEQ ID NO: 4527704 - DNA, 13 bp, Homo sapiens
ctgcctcactcct

SEQ ID NO: 4527705 - DNA, 21 bp, Homo sapiens
ctgcctcactcctccgtgagc

SEQ ID NO: 4527706 - DNA, 22 bp, Homo sapiens
ctgcctcactcctccgtgagca

SEQ ID NO: 4527707 - DNA, 14 bp, Homo sapiens
ctgcctcacttcct

SEQ ID NO: 4527708 - DNA, 13 bp, Homo sapiens
ctgcctcagcctc

SEQ ID NO: 4527709 - DNA, 17 bp, Homo sapiens
ctgcctcagcctcccat

SEQ ID NO: 4527710 - DNA, 15 bp, Homo sapiens
ctgcctcagccttcc

SEQ ID NO: 4527711 - DNA, 21 bp, Homo sapiens
ctgcctccaccctctgagctt

SEQ ID NO: 4527712 - DNA, 16 bp, Homo sapiens
ctgcctccagggctgg

SEQ ID NO: 4527713 - DNA, 15 bp, Homo sapiens
ctgcctcccacttca

SEQ ID NO: 4527714 - DNA, 18 bp, Homo sapiens
ctgcctcccacttcactg

SEQ ID NO: 4527715 - DNA, 16 bp, Homo sapiens
ctgcctcccattctgc

SEQ ID NO: 4527716 - DNA, 23 bp, Homo sapiens
ctgcctccctctccatatctcct

SEQ ID NO: 4527717 - DNA, 11 bp, Homo sapiens
ctgcctcctgc

SEQ ID NO: 4527718 - DNA, 14 bp, Homo sapiens
ctgcctcctgccta

SEQ ID NO: 4527719 - DNA, 22 bp, Homo sapiens
ctgcctcctggccaagcaggct

SEQ ID NO: 4527720 - DNA, 12 bp, Homo sapiens
ctgcctccttta

SEQ ID NO: 4527721 - DNA, 16 bp, Homo sapiens
ctgcctcgtagagtga

SEQ ID NO: 4527722 - DNA, 22 bp, Homo sapiens
ctgcctctcatcaactgaatga

SEQ ID NO: 4527723 - DNA, 12 bp, Homo sapiens
ctgcctctgacc

SEQ ID NO: 4527724 - DNA, 14 bp, Homo sapiens
ctgcctctgacccc

SEQ ID NO: 4527725 - DNA, 12 bp, Homo sapiens
ctgcctctgctc

SEQ ID NO: 4527726 - DNA, 13 bp, Homo sapiens
ctgcctctgctcc

SEQ ID NO: 4527727 - DNA, 14 bp, Homo sapiens
ctgcctctgctccc

SEQ ID NO: 4527728 - DNA, 20 bp, Homo sapiens
ctgcctgacatttggagtgt

SEQ ID NO: 4527729 - DNA, 16 bp, Homo sapiens
ctgcctgcagcaggca

SEQ ID NO: 4527730 - DNA, 18 bp, Homo sapiens
ctgcctgcagcaggcagc

SEQ ID NO: 4527731 - DNA, 20 bp, Homo sapiens
ctgcctgcagccagggctgg

SEQ ID NO: 4527732 - DNA, 15 bp, Homo sapiens
ctgcctgcggcccag

SEQ ID NO: 4527733 - DNA, 12 bp, Homo sapiens
ctgcctgctcct

SEQ ID NO: 4527734 - DNA, 15 bp, Homo sapiens
ctgcctgctccttgg

SEQ ID NO: 4527735 - DNA, 16 bp, Homo sapiens
ctgcctgctccttggc

SEQ ID NO: 4527736 - DNA, 15 bp, Homo sapiens
ctgcctgctgagatg

SEQ ID NO: 4527737 - DNA, 11 bp, Homo sapiens
ctgcctggagc

SEQ ID NO: 4527738 - DNA, 12 bp, Homo sapiens
ctgcctggcagg

SEQ ID NO: 4527739 - DNA, 13 bp, Homo sapiens
ctgcctggccagg

SEQ ID NO: 4527740 - DNA, 16 bp, Homo sapiens
ctgcctggccaggcag

SEQ ID NO: 4527741 - DNA, 12 bp, Homo sapiens
ctgcctggcccc

SEQ ID NO: 4527742 - DNA, 22 bp, Homo sapiens
ctgcctggcccccaacctcagg

SEQ ID NO: 4527743 - DNA, 19 bp, Homo sapiens
ctgcctggccctccccaca

SEQ ID NO: 4527744 - DNA, 20 bp, Homo sapiens
ctgcctgggttttgttccct

SEQ ID NO: 4527745 - DNA, 20 bp, Homo sapiens
ctgcctggttccctccccaa

SEQ ID NO: 4527746 - DNA, 21 bp, Homo sapiens
ctgcctggttccctccccaag

SEQ ID NO: 4527747 - DNA, 21 bp, Homo sapiens
ctgcctgtccccaaacaggac

SEQ ID NO: 4527748 - DNA, 17 bp, Homo sapiens
ctgcctgtctgcttgca

SEQ ID NO: 4527749 - DNA, 23 bp, Homo sapiens
ctgcctgtggcccctcccctgca

SEQ ID NO: 4527750 - DNA, 22 bp, Homo sapiens
ctgcctgttataactctgcact

SEQ ID NO: 4527751 - DNA, 16 bp, Homo sapiens
ctgcctgttggcaggc

SEQ ID NO: 4527752 - DNA, 19 bp, Homo sapiens
ctgcctgttggcaggccca

SEQ ID NO: 4527753 - DNA, 19 bp, Homo sapiens
ctgccttaaaaccaaagag

SEQ ID NO: 4527754 - DNA, 15 bp, Homo sapiens
ctgccttagcttcag

SEQ ID NO: 4527755 - DNA, 16 bp, Homo sapiens
ctgccttagcttcagg

SEQ ID NO: 4527756 - DNA, 14 bp, Homo sapiens
ctgccttcccccaa

SEQ ID NO: 4527757 - DNA, 15 bp, Homo sapiens
ctgccttccctagct

SEQ ID NO: 4527758 - DNA, 15 bp, Homo sapiens
ctgccttcctcctgg

SEQ ID NO: 4527759 - DNA, 16 bp, Homo sapiens
ctgccttcctcctggg

SEQ ID NO: 4527760 - DNA, 18 bp, Homo sapiens
ctgccttctggccttgta

SEQ ID NO: 4527761 - DNA, 24 bp, Homo sapiens
ctgccttcttcggggaactcctgg

SEQ ID NO: 4527762 - DNA, 23 bp, Homo sapiens
ctgccttctttccatcaactccc

SEQ ID NO: 4527763 - DNA, 15 bp, Homo sapiens
ctgccttgccctcct

SEQ ID NO: 4527764 - DNA, 16 bp, Homo sapiens
ctgccttgccctcctg

SEQ ID NO: 4527765 - DNA, 17 bp, Homo sapiens
ctgccttgccctcctgg

SEQ ID NO: 4527766 - DNA, 15 bp, Homo sapiens
ctgccttggcctccc

SEQ ID NO: 4527767 - DNA, 16 bp, Homo sapiens
ctgccttggcctccca

SEQ ID NO: 4527768 - DNA, 23 bp, Homo sapiens
ctgcctttgcagttggactctca

SEQ ID NO: 4527769 - DNA, 20 bp, Homo sapiens
ctgcgaagaccctcttgccc

SEQ ID NO: 4527770 - DNA, 21 bp, Homo sapiens
ctgcgaagaccctcttgccca

SEQ ID NO: 4527771 - DNA, 15 bp, Homo sapiens
ctgcgcccaccccgc

SEQ ID NO: 4527772 - DNA, 16 bp, Homo sapiens
ctgcgccctgtgcccg

SEQ ID NO: 4527773 - DNA, 13 bp, Homo sapiens
ctgcgcctgcagg

SEQ ID NO: 4527774 - DNA, 17 bp, Homo sapiens
ctgcgcctgcaggcaga

SEQ ID NO: 4527775 - DNA, 17 bp, Homo sapiens
ctgcgcctgctgcctgc

SEQ ID NO: 4527776 - DNA, 16 bp, Homo sapiens
ctgcggccaggcctgc

SEQ ID NO: 4527777 - DNA, 13 bp, Homo sapiens
ctgcgggagccag

SEQ ID NO: 4527778 - DNA, 21 bp, Homo sapiens
ctgcgggagccagactgtcca

SEQ ID NO: 4527779 - DNA, 17 bp, Homo sapiens
ctgcgggagctctgtat

SEQ ID NO: 4527780 - DNA, 18 bp, Homo sapiens
ctgcgggaggctggggcc

SEQ ID NO: 4527781 - DNA, 14 bp, Homo sapiens
ctgcgggcccctgg

SEQ ID NO: 4527782 - DNA, 17 bp, Homo sapiens
ctgcgggcccctggtga

SEQ ID NO: 4527783 - DNA, 20 bp, Homo sapiens
ctgcgggcgcgggcagccac

SEQ ID NO: 4527784 - DNA, 22 bp, Homo sapiens
ctgcgggcgcgggcagccaccc

SEQ ID NO: 4527785 - DNA, 23 bp, Homo sapiens
ctgcgggcgcgggcagccaccca

SEQ ID NO: 4527786 - DNA, 13 bp, Homo sapiens
ctgcgtccaccct

SEQ ID NO: 4527787 - DNA, 19 bp, Homo sapiens
ctgcgtccaccctgagctc

SEQ ID NO: 4527788 - DNA, 13 bp, Homo sapiens
ctgcgtcctcctc

SEQ ID NO: 4527789 - DNA, 17 bp, Homo sapiens
ctgcgtcctcctcacct

SEQ ID NO: 4527790 - DNA, 18 bp, Homo sapiens
ctgcgtcctcctcacctc

SEQ ID NO: 4527791 - DNA, 14 bp, Homo sapiens
ctgcgtgggtcaga

SEQ ID NO: 4527792 - DNA, 21 bp, Homo sapiens
ctgcgttttcctagctgtgtt

SEQ ID NO: 4527793 - DNA, 21 bp, Homo sapiens
ctgctaaagggagaaatgcca

SEQ ID NO: 4527794 - DNA, 12 bp, Homo sapiens
ctgctaaatctc

SEQ ID NO: 4527795 - DNA, 17 bp, Homo sapiens
ctgctaaatctcctatt

SEQ ID NO: 4527796 - DNA, 18 bp, Homo sapiens
ctgctaaatctcctattt

SEQ ID NO: 4527797 - DNA, 17 bp, Homo sapiens
ctgctaaccatttatat

SEQ ID NO: 4527798 - DNA, 17 bp, Homo sapiens
ctgctaaggctcctcct

SEQ ID NO: 4527799 - DNA, 15 bp, Homo sapiens
ctgctactcctgtgc

SEQ ID NO: 4527800 - DNA, 17 bp, Homo sapiens
ctgctactcctgtgctc

SEQ ID NO: 4527801 - DNA, 20 bp, Homo sapiens
ctgctacttcactgtcatct

SEQ ID NO: 4527802 - DNA, 12 bp, Homo sapiens
ctgctagaacct

SEQ ID NO: 4527803 - DNA, 22 bp, Homo sapiens
ctgctagagcagacaggcctgg

SEQ ID NO: 4527804 - DNA, 14 bp, Homo sapiens
ctgctagcacagag

SEQ ID NO: 4527805 - DNA, 15 bp, Homo sapiens
ctgctagcacagagg

SEQ ID NO: 4527806 - DNA, 16 bp, Homo sapiens
ctgctagcacagaggc

SEQ ID NO: 4527807 - DNA, 16 bp, Homo sapiens
ctgctaggcgctgggg

SEQ ID NO: 4527808 - DNA, 18 bp, Homo sapiens
ctgctataaagttaaagt

SEQ ID NO: 4527809 - DNA, 16 bp, Homo sapiens
ctgctatccccatctc

SEQ ID NO: 4527810 - DNA, 21 bp, Homo sapiens
ctgctatccccatctccctgc

SEQ ID NO: 4527811 - DNA, 23 bp, Homo sapiens
ctgctatccccatctccctgcct

SEQ ID NO: 4527812 - DNA, 21 bp, Homo sapiens
ctgctcaactctacccctgct

SEQ ID NO: 4527813 - DNA, 22 bp, Homo sapiens
ctgctcaactctacccctgctc

SEQ ID NO: 4527814 - DNA, 16 bp, Homo sapiens
ctgctcaagatatgga

SEQ ID NO: 4527815 - DNA, 16 bp, Homo sapiens
ctgctcaaggccacag

SEQ ID NO: 4527816 - DNA, 15 bp, Homo sapiens
ctgctcacaagttct

SEQ ID NO: 4527817 - DNA, 15 bp, Homo sapiens
ctgctcaccgcccat

SEQ ID NO: 4527818 - DNA, 19 bp, Homo sapiens
ctgctcaccgcccatcagg

SEQ ID NO: 4527819 - DNA, 22 bp, Homo sapiens
ctgctcagcaattcagacccct

SEQ ID NO: 4527820 - DNA, 21 bp, Homo sapiens
ctgctcaggcgtcgctggatt

SEQ ID NO: 4527821 - DNA, 22 bp, Homo sapiens
ctgctcaggcgtcgctggattt

SEQ ID NO: 4527822 - DNA, 20 bp, Homo sapiens
ctgctcagtgcttgggctcc

SEQ ID NO: 4527823 - DNA, 23 bp, Homo sapiens
ctgctcagtgcttgggctccacg

SEQ ID NO: 4527824 - DNA, 14 bp, Homo sapiens
ctgcactttgttta

SEQ ID NO: 4527825 - DNA, 15 bp, Homo sapiens
ctgcactttgtttag

SEQ ID NO: 4527826 - DNA, 18 bp, Homo sapiens
ctgcactttgtttagaaa

SEQ ID NO: 4527827 - DNA, 20 bp, Homo sapiens
ctgcactttgtttagaaaaa

SEQ ID NO: 4527828 - DNA, 15 bp, Homo sapiens
ctgcagaacccacca

SEQ ID NO: 4527829 - DNA, 20 bp, Homo sapiens
ctgcagaacgtattggtcca

SEQ ID NO: 4527830 - DNA, 17 bp, Homo sapiens
ctgcagacacctggact

SEQ ID NO: 4527831 - DNA, 18 bp, Homo sapiens
ctgcagacacctggactg

SEQ ID NO: 4527832 - DNA, 22 bp, Homo sapiens
ctgcagacacctggactgagcc

SEQ ID NO: 4527833 - DNA, 17 bp, Homo sapiens
ctgcagacctggttccc

SEQ ID NO: 4527834 - DNA, 20 bp, Homo sapiens
ctgcagacctgtcctcctgg

SEQ ID NO: 4527835 - DNA, 22 bp, Homo sapiens
ctgcagacctgtcctcctggtg

SEQ ID NO: 4527836 - DNA, 23 bp, Homo sapiens
ctgcagacggatgcccattcctg

SEQ ID NO: 4527837 - DNA, 16 bp, Homo sapiens
ctgcagacttcccagc

SEQ ID NO: 4527838 - DNA, 21 bp, Homo sapiens
ctgcagatgtgcggagcggga

SEQ ID NO: 4527839 - DNA, 24 bp, Homo sapiens
ctgcagattagttctttttgccag

SEQ ID NO: 4527840 - DNA, 21 bp, Homo sapiens
ctgcagattctgagcaaaggc

SEQ ID NO: 4527841 - DNA, 12 bp, Homo sapiens
ctgcagcaactc

SEQ ID NO: 4527842 - DNA, 14 bp, Homo sapiens
ctgcagcaactccc

SEQ ID NO: 4527843 - DNA, 15 bp, Homo sapiens
ctgcagcaactccca

SEQ ID NO: 4527844 - DNA, 16 bp, Homo sapiens
ctgcagcaactcccac

SEQ ID NO: 4527845 - DNA, 14 bp, Homo sapiens
ctgcagcaggcagc

SEQ ID NO: 4527846 - DNA, 15 bp, Homo sapiens
ctgcagcaggcagct

SEQ ID NO: 4527847 - DNA, 15 bp, Homo sapiens
ctgcagccagcccag

SEQ ID NO: 4527848 - DNA, 22 bp, Homo sapiens
ctgcagccagcccagcccagct

SEQ ID NO: 4527849 - DNA, 13 bp, Homo sapiens
ctgcagccagggc

SEQ ID NO: 4527850 - DNA, 15 bp, Homo sapiens
ctgcagccagggctg

SEQ ID NO: 4527851 - DNA, 16 bp, Homo sapiens
ctgcagccagggctgg

SEQ ID NO: 4527852 - DNA, 17 bp, Homo sapiens
ctgcagccagggctggg

SEQ ID NO: 4527853 - DNA, 15 bp, Homo sapiens
ctgcagcctcatact

SEQ ID NO: 4527854 - DNA, 20 bp, Homo sapiens
ctgcagcggctgccctctgg

SEQ ID NO: 4527855 - DNA, 18 bp, Homo sapiens
ctgcaggaatcacccctc

SEQ ID NO: 4527856 - DNA, 13 bp, Homo sapiens
ctgcaggacagag

SEQ ID NO: 4527857 - DNA, 16 bp, Homo sapiens
ctgcaggacagaggga

SEQ ID NO: 4527858 - DNA, 17 bp, Homo sapiens
ctgcaggagagagcagc

SEQ ID NO: 4527859 - DNA, 14 bp, Homo sapiens
ctgcaggcaggaac

SEQ ID NO: 4527860 - DNA, 12 bp, Homo sapiens
ctgcaggctggg

SEQ ID NO: 4527861 - DNA, 14 bp, Homo sapiens
ctgcaggctgggga

SEQ ID NO: 4527862 - DNA, 20 bp, Homo sapiens
ctgcaggctggggaggtgct

SEQ ID NO: 4527863 - DNA, 12 bp, Homo sapiens
ctgcagggaaaa

SEQ ID NO: 4527864 - DNA, 23 bp, Homo sapiens
ctgcagggaaaattatttgcata

SEQ ID NO: 4527865 - DNA, 21 bp, Homo sapiens
ctgcagggagccttctgccac

SEQ ID NO: 4527866 - DNA, 16 bp, Homo sapiens
ctgcagggcttctcct

SEQ ID NO: 4527867 - DNA, 20 bp, Homo sapiens
ctgcaggtcagttgtaataa

SEQ ID NO: 4527868 - DNA, 14 bp, Homo sapiens
ctgcaggttgttca

SEQ ID NO: 4527869 - DNA, 16 bp, Homo sapiens
ctgcagtaaaacacat

SEQ ID NO: 4527870 - DNA, 14 bp, Homo sapiens
ctgcagtaaatctt

SEQ ID NO: 4527871 - DNA, 17 bp, Homo sapiens
ctgcagtaaatctttta

SEQ ID NO: 4527872 - DNA, 23 bp, Homo sapiens
ctgcagtcagccctgattgtgcc

SEQ ID NO: 4527873 - DNA, 18 bp, Homo sapiens
ctgcagtctcatttctca

SEQ ID NO: 4527874 - DNA, 14 bp, Homo sapiens
ctgcagtggctccc

SEQ ID NO: 4527875 - DNA, 16 bp, Homo sapiens
ctgcagttttgctatc

SEQ ID NO: 4527876 - DNA, 15 bp, Homo sapiens
ctgcataatgtttct

SEQ ID NO: 4527877 - DNA, 17 bp, Homo sapiens
ctgcatacaggggaggg

SEQ ID NO: 4527878 - DNA, 18 bp, Homo sapiens
ctgcatacaggggagggg

SEQ ID NO: 4527879 - DNA, 21 bp, Homo sapiens
ctgcatatgttgaatactttt

SEQ ID NO: 4527880 - DNA, 21 bp, Homo sapiens
ctgcatccagagattcatttt

SEQ ID NO: 4527881 - DNA, 19 bp, Homo sapiens
ctgcatcccacgttctgtt

SEQ ID NO: 4527882 - DNA, 19 bp, Homo sapiens
ctgcatccgtagttccctg

SEQ ID NO: 4527883 - DNA, 21 bp, Homo sapiens
ctgcatcctggcttgaaaaac

SEQ ID NO: 4527884 - DNA, 15 bp, Homo sapiens
ctgcatgacctacca

SEQ ID NO: 4527885 - DNA, 20 bp, Homo sapiens
ctgcatgacctaccaggaca

SEQ ID NO: 4527886 - DNA, 16 bp, Homo sapiens
ctgcatgcggcccagc

SEQ ID NO: 4527887 - DNA, 17 bp, Homo sapiens
ctgcatgcggcccagcc

SEQ ID NO: 4527888 - DNA, 20 bp, Homo sapiens
ctgcatgcggcccagcccgg

SEQ ID NO: 4527889 - DNA, 15 bp, Homo sapiens
ctgcatggtaattta

SEQ ID NO: 4527890 - DNA, 19 bp, Homo sapiens
ctgcatggtaatttatagt

SEQ ID NO: 4527891 - DNA, 20 bp, Homo sapiens
ctgcatggtaatttatagtt

SEQ ID NO: 4527892 - DNA, 23 bp, Homo sapiens
ctgcattactattaactctgcat

SEQ ID NO: 4527893 - DNA, 16 bp, Homo sapiens
ctgcattcctgtgccc

SEQ ID NO: 4527894 - DNA, 23 bp, Homo sapiens
ctgcattgagcttgcatgcttgc

SEQ ID NO: 4527895 - DNA, 15 bp, Homo sapiens
ctgcatttacagtgt

SEQ ID NO: 4527896 - DNA, 20 bp, Homo sapiens
ctgcatttaccactgtatat

SEQ ID NO: 4527897 - DNA, 15 bp, Homo sapiens
ctgcatttcatatta

SEQ ID NO: 4527898 - DNA, 17 bp, Homo sapiens
ctgcatttgcctgcttc

SEQ ID NO: 4527899 - DNA, 18 bp, Homo sapiens
ctgcatttgcctgcttct

SEQ ID NO: 4527900 - DNA, 19 bp, Homo sapiens
ctgcatttgcctgcttctt

SEQ ID NO: 4527901 - DNA, 14 bp, Homo sapiens
ctgccaaaatgcaa

SEQ ID NO: 4527902 - DNA, 15 bp, Homo sapiens
ctgccaaaatgcaac

SEQ ID NO: 4527903 - DNA, 16 bp, Homo sapiens
ctgccaaacctcctgt

SEQ ID NO: 4527904 - DNA, 19 bp, Homo sapiens
ctgccaaacctcctgtcag

SEQ ID NO: 4527905 - DNA, 17 bp, Homo sapiens
ctgccaaagtaaaacaa

SEQ ID NO: 4527906 - DNA, 16 bp, Homo sapiens
ctgccaacctaaaact

SEQ ID NO: 4527907 - DNA, 21 bp, Homo sapiens
ctgccaaggccagagtggcct

SEQ ID NO: 4527908 - DNA, 16 bp, Homo sapiens
ctgccaagtcagttct

SEQ ID NO: 4527909 - DNA, 17 bp, Homo sapiens
ctgccaataacattctt

SEQ ID NO: 4527910 - DNA, 23 bp, Homo sapiens
ctgccaattgctaccgagaaggt

SEQ ID NO: 4527911 - DNA, 19 bp, Homo sapiens
ctgccacaaaccaccagga

SEQ ID NO: 4527912 - DNA, 22 bp, Homo sapiens
ctgccacacggaagcaagcaga

SEQ ID NO: 4527913 - DNA, 14 bp, Homo sapiens
ctgccacagccaga

SEQ ID NO: 4527914 - DNA, 22 bp, Homo sapiens
ctgccacagcctcccctgccag

SEQ ID NO: 4527915 - DNA, 14 bp, Homo sapiens
ctgccacatggagc

SEQ ID NO: 4527916 - DNA, 19 bp, Homo sapiens
ctgccacatggagccccct

SEQ ID NO: 4527917 - DNA, 23 bp, Homo sapiens
ctgccaccggaggtcactccacc

SEQ ID NO: 4527918 - DNA, 22 bp, Homo sapiens
ctgccacctcccctatccaccc

SEQ ID NO: 4527919 - DNA, 17 bp, Homo sapiens
ctgccacctctccatcc

SEQ ID NO: 4527920 - DNA, 15 bp, Homo sapiens
ctgccactcacacag

SEQ ID NO: 4527921 - DNA, 18 bp, Homo sapiens
ctgccactcacacagcca

SEQ ID NO: 4527922 - DNA, 16 bp, Homo sapiens
ctgccactctctggga

SEQ ID NO: 4527923 - DNA, 17 bp, Homo sapiens
ctgccactctctgggac

SEQ ID NO: 4527924 - DNA, 18 bp, Homo sapiens
ctgccactctctgggact

SEQ ID NO: 4527925 - DNA, 23 bp, Homo sapiens
ctgccactctctgggactctcct

SEQ ID NO: 4527926 - DNA, 21 bp, Homo sapiens
ctgccagaagatcccctcagg

SEQ ID NO: 4527927 - DNA, 16 bp, Homo sapiens
ctgccagaatctagag

SEQ ID NO: 4527928 - DNA, 15 bp, Homo sapiens
ctgccagcaacgcag

SEQ ID NO: 4527929 - DNA, 16 bp, Homo sapiens
ctgccagccactgtca

SEQ ID NO: 4527930 - DNA, 19 bp, Homo sapiens
ctgccagcccacccccttt

SEQ ID NO: 4527931 - DNA, 15 bp, Homo sapiens
ctgccagccttgagc

SEQ ID NO: 4527932 - DNA, 17 bp, Homo sapiens
ctgccagccttgagccc

SEQ ID NO: 4527933 - DNA, 22 bp, Homo sapiens
ctgccagccttgagccctggct

SEQ ID NO: 4527934 - DNA, 19 bp, Homo sapiens
ctgccagctggatcgctgc

SEQ ID NO: 4527935 - DNA, 20 bp, Homo sapiens
ctgccagctggatcgctgca

SEQ ID NO: 4527936 - DNA, 21 bp, Homo sapiens
ctgccagctggatcgctgcac

SEQ ID NO: 4527937 - DNA, 16 bp, Homo sapiens
ctgccaggagacaggt

SEQ ID NO: 4527938 - DNA, 20 bp, Homo sapiens
ctgccaggcaggggtggggg

SEQ ID NO: 4527939 - DNA, 17 bp, Homo sapiens
ctgccaggccagcctcc

SEQ ID NO: 4527940 - DNA, 20 bp, Homo sapiens
ctgccaggccagcctccgag

SEQ ID NO: 4527941 - DNA, 23 bp, Homo sapiens
ctgccaggccagcctccgagagg

SEQ ID NO: 4527942 - DNA, 16 bp, Homo sapiens
ctgccaggctgcctcc

SEQ ID NO: 4527943 - DNA, 20 bp, Homo sapiens
ctgccaggctgcctcctgcc

SEQ ID NO: 4527944 - DNA, 23 bp, Homo sapiens
ctggcaaacagggcctctgcgga

SEQ ID NO: 4527945 - DNA, 16 bp, Homo sapiens
ctggcaaagaactcat

SEQ ID NO: 4527946 - DNA, 16 bp, Homo sapiens
ctggcaacacagaggc

SEQ ID NO: 4527947 - DNA, 14 bp, Homo sapiens
ctggcaacatcttt

SEQ ID NO: 4527948 - DNA, 17 bp, Homo sapiens
ctggcaacatctttatc

SEQ ID NO: 4527949 - DNA, 20 bp, Homo sapiens
ctggcaaggactttgtacat

SEQ ID NO: 4527950 - DNA, 14 bp, Homo sapiens
ctggcacagcccct

SEQ ID NO: 4527951 - DNA, 15 bp, Homo sapiens
ctggcacagcccctg

SEQ ID NO: 4527952 - DNA, 16 bp, Homo sapiens
ctggcacagcctggct

SEQ ID NO: 4527953 - DNA, 23 bp, Homo sapiens
ctggcacagcctggctgtggcct

SEQ ID NO: 4527954 - DNA, 21 bp, Homo sapiens
ctggcacattgcccctctgcc

SEQ ID NO: 4527955 - DNA, 15 bp, Homo sapiens
ctggcactattataa

SEQ ID NO: 4527956 - DNA, 19 bp, Homo sapiens
ctggcacttagcccaagag

SEQ ID NO: 4527957 - DNA, 23 bp, Homo sapiens
ctggcacttagcccaagaggtct

SEQ ID NO: 4527958 - DNA, 20 bp, Homo sapiens
ctggcagagaggtaaagggt

SEQ ID NO: 4527959 - DNA, 12 bp, Homo sapiens
ctggcagctgag

SEQ ID NO: 4527960 - DNA, 12 bp, Homo sapiens
ctggcagctgct

SEQ ID NO: 4527961 - DNA, 19 bp, Homo sapiens
ctggcaggggagacaggag

SEQ ID NO: 4527962 - DNA, 19 bp, Homo sapiens
ctggcagtccgtgggacgg

SEQ ID NO: 4527963 - DNA, 17 bp, Homo sapiens
ctggcatcgcagcttcc

SEQ ID NO: 4527964 - DNA, 20 bp, Homo sapiens
ctggcatcgtgtattccata

SEQ ID NO: 4527965 - DNA, 21 bp, Homo sapiens
ctggcatcgtgtattccatat

SEQ ID NO: 4527966 - DNA, 17 bp, Homo sapiens
ctggcatgtcatttgca

SEQ ID NO: 4527967 - DNA, 17 bp, Homo sapiens
ctggccacccctcccca

SEQ ID NO: 4527968 - DNA, 14 bp, Homo sapiens
ctggccagacgctg

SEQ ID NO: 4527969 - DNA, 21 bp, Homo sapiens
ctggccagcaccctctcctgg

SEQ ID NO: 4527970 - DNA, 13 bp, Homo sapiens
ctggccaggcaga

SEQ ID NO: 4527971 - DNA, 14 bp, Homo sapiens
ctggccaggcagat

SEQ ID NO: 4527972 - DNA, 23 bp, Homo sapiens
ctggccagggccacgctccagct

SEQ ID NO: 4527973 - DNA, 17 bp, Homo sapiens
ctggccagtgctgccca

SEQ ID NO: 4527974 - DNA, 21 bp, Homo sapiens
ctggccagtggctggatctgt

SEQ ID NO: 4527975 - DNA, 13 bp, Homo sapiens
ctggccagtgttt

SEQ ID NO: 4527976 - DNA, 17 bp, Homo sapiens
ctggcccacccagtcca

SEQ ID NO: 4527977 - DNA, 17 bp, Homo sapiens
ctggcccagccctgctg

SEQ ID NO: 4527978 - DNA, 19 bp, Homo sapiens
ctggcccagccctgctggc

SEQ ID NO: 4527979 - DNA, 17 bp, Homo sapiens
ctggcccagggcatctg

SEQ ID NO: 4527980 - DNA, 18 bp, Homo sapiens
ctggcccagggcatctgg

SEQ ID NO: 4527981 - DNA, 13 bp, Homo sapiens
ctggcccaggtgc

SEQ ID NO: 4527982 - DNA, 13 bp, Homo sapiens
ctggccccagcct

SEQ ID NO: 4527983 - DNA, 14 bp, Homo sapiens
ctggccccagcctg

SEQ ID NO: 4527984 - DNA, 18 bp, Homo sapiens
ctggccccagcctgggcc

SEQ ID NO: 4527985 - DNA, 21 bp, Homo sapiens
ctggccccaggccccagacag

SEQ ID NO: 4527986 - DNA, 13 bp, Homo sapiens
ctggcccccacag

SEQ ID NO: 4527987 - DNA, 16 bp, Homo sapiens
ctggcccccatcagcc

SEQ ID NO: 4527988 - DNA, 19 bp, Homo sapiens
ctggcccccatcagccctg

SEQ ID NO: 4527989 - DNA, 21 bp, Homo sapiens
ctggcccccatcagccctgct

SEQ ID NO: 4527990 - DNA, 21 bp, Homo sapiens
ctggccctccactcctcatcc

SEQ ID NO: 4527991 - DNA, 12 bp, Homo sapiens
ctggccctgctt

SEQ ID NO: 4527992 - DNA, 13 bp, Homo sapiens
ctggcccttagag

SEQ ID NO: 4527993 - DNA, 15 bp, Homo sapiens
ctggccgacccactg

SEQ ID NO: 4527994 - DNA, 17 bp, Homo sapiens
ctggccgacccactgac

SEQ ID NO: 4527995 - DNA, 13 bp, Homo sapiens
ctggccgcagagg

SEQ ID NO: 4527996 - DNA, 14 bp, Homo sapiens
ctggccgcctcacc

SEQ ID NO: 4527997 - DNA, 18 bp, Homo sapiens
ctggccgcgccaaataat

SEQ ID NO: 4527998 - DNA, 15 bp, Homo sapiens
ctggccgctgagcgc

SEQ ID NO: 4527999 - DNA, 20 bp, Homo sapiens
ctggccgggactgctgctct

SEQ ID NO: 4528000 - DNA, 21 bp, Homo sapiens
ctggccgggactgctgctctc

SEQ ID NO: 4528001 - DNA, 20 bp, Homo sapiens
ctggcctcatctcagaccct

SEQ ID NO: 4528002 - DNA, 18 bp, Homo sapiens
ctggcctcccgccactcg

SEQ ID NO: 4528003 - DNA, 16 bp, Homo sapiens
ctggcctccgcctggg

SEQ ID NO: 4528004 - DNA, 17 bp, Homo sapiens
ctggcctgaactgagga

SEQ ID NO: 4528005 - DNA, 16 bp, Homo sapiens
ctggcctgccagtctg

SEQ ID NO: 4528006 - DNA, 15 bp, Homo sapiens
ctggcctgctgggct

SEQ ID NO: 4528007 - DNA, 19 bp, Homo sapiens
ctggccttctgaactccat

SEQ ID NO: 4528008 - DNA, 14 bp, Homo sapiens
ctggcctttcatgg

SEQ ID NO: 4528009 - DNA, 19 bp, Homo sapiens
ctggcctttttcatttatc

SEQ ID NO: 4528010 - DNA, 22 bp, Homo sapiens
ctggcgacacgtagcagcttag

SEQ ID NO: 4528011 - DNA, 16 bp, Homo sapiens
ctggcgcccctgcctg

SEQ ID NO: 4528012 - DNA, 14 bp, Homo sapiens
ctggcgcctctgca

SEQ ID NO: 4528013 - DNA, 20 bp, Homo sapiens
ctggcgcctctgcaagggca

SEQ ID NO: 4528014 - DNA, 13 bp, Homo sapiens
ctggcgctcagca

SEQ ID NO: 4528015 - DNA, 16 bp, Homo sapiens
ctggcgcttggatctg

SEQ ID NO: 4528016 - DNA, 16 bp, Homo sapiens
ctggcggctactcagc

SEQ ID NO: 4528017 - DNA, 17 bp, Homo sapiens
ctggcggctactcagca

SEQ ID NO: 4528018 - DNA, 18 bp, Homo sapiens
ctggcgggcctttttcct

SEQ ID NO: 4528019 - DNA, 22 bp, Homo sapiens
ctggcgttctcaagaatctaga

SEQ ID NO: 4528020 - DNA, 13 bp, Homo sapiens
ctggctaaagctc

SEQ ID NO: 4528021 - DNA, 17 bp, Homo sapiens
ctggctagagtcctcac

SEQ ID NO: 4528022 - DNA, 19 bp, Homo sapiens
ctggctagagtcctcactc

SEQ ID NO: 4528023 - DNA, 20 bp, Homo sapiens
ctggctagagtcctcactcc

SEQ ID NO: 4528024 - DNA, 22 bp, Homo sapiens
ctggctagagtcctcactccca

SEQ ID NO: 4528025 - DNA, 13 bp, Homo sapiens
ctggctcacccag

SEQ ID NO: 4528026 - DNA, 14 bp, Homo sapiens
ctggctcaggagga

SEQ ID NO: 4528027 - DNA, 14 bp, Homo sapiens
ctggctccactctt

SEQ ID NO: 4528028 - DNA, 22 bp, Homo sapiens
ctggctccagtctcatcctccc

SEQ ID NO: 4528029 - DNA, 17 bp, Homo sapiens
ctggctccagtgaaact

SEQ ID NO: 4528030 - DNA, 17 bp, Homo sapiens
ctggctccccctcccca

SEQ ID NO: 4528031 - DNA, 20 bp, Homo sapiens
ctggctccccctccccaggc

SEQ ID NO: 4528032 - DNA, 21 bp, Homo sapiens
ctggctccccctccccaggct

SEQ ID NO: 4528033 - DNA, 22 bp, Homo sapiens
ctggctccccctccccaggctg

SEQ ID NO: 4528034 - DNA, 22 bp, Homo sapiens
ctggctccctcctccaggcctg

SEQ ID NO: 4528035 - DNA, 23 bp, Homo sapiens
ctggctcggacccaccccaactc

SEQ ID NO: 4528036 - DNA, 15 bp, Homo sapiens
ctggctctaattcac

SEQ ID NO: 4528037 - DNA, 17 bp, Homo sapiens
ctggctctaccttcctg

SEQ ID NO: 4528038 - DNA, 14 bp, Homo sapiens
ctggctctgccccc

SEQ ID NO: 4528039 - DNA, 18 bp, Homo sapiens
ctggctctgccccctccc

SEQ ID NO: 4528040 - DNA, 20 bp, Homo sapiens
ctggctctgccccctccccc

SEQ ID NO: 4528041 - DNA, 16 bp, Homo sapiens
ctggctctgcctcagg

SEQ ID NO: 4528042 - DNA, 13 bp, Homo sapiens
ctggctctgtggc

SEQ ID NO: 4528043 - DNA, 15 bp, Homo sapiens
ctggctgctgccccc

SEQ ID NO: 4528044 - DNA, 16 bp, Homo sapiens
ctggctgctgccccca

SEQ ID NO: 4528045 - DNA, 19 bp, Homo sapiens
ctggctgctgcccccaccc

SEQ ID NO: 4528046 - DNA, 21 bp, Homo sapiens
ctggctggaggagcagcagct

SEQ ID NO: 4528047 - DNA, 17 bp, Homo sapiens
ctggctggcctcaccca

SEQ ID NO: 4528048 - DNA, 18 bp, Homo sapiens
ctggctggtgggccccca

SEQ ID NO: 4528049 - DNA, 19 bp, Homo sapiens
ctggctgtcagtatgacat

SEQ ID NO: 4528050 - DNA, 14 bp, Homo sapiens
ctggctgtcctacc

SEQ ID NO: 4528051 - DNA, 18 bp, Homo sapiens
ctggctgtgaatgccaaa

SEQ ID NO: 4528052 - DNA, 21 bp, Homo sapiens
ctggctgtttggactttgtat

SEQ ID NO: 4528053 - DNA, 21 bp, Homo sapiens
ctggcttctgtggggcccctc

SEQ ID NO: 4528054 - DNA, 16 bp, Homo sapiens
ctggctttcccaggag

SEQ ID NO: 4528055 - DNA, 19 bp, Homo sapiens
ctggctttgaaacctcagg

SEQ ID NO: 4528056 - DNA, 12 bp, Homo sapiens
ctggctttgcct

SEQ ID NO: 4528057 - DNA, 17 bp, Homo sapiens
ctggctttgcctcttct

SEQ ID NO: 4528058 - DNA, 15 bp, Homo sapiens
ctggctttggcactc

SEQ ID NO: 4528059 - DNA, 22 bp, Homo sapiens
ctggctttggcactctctgcca

SEQ ID NO: 4528060 - DNA, 21 bp, Homo sapiens
ctggcttttgcctgtaagaaa

SEQ ID NO: 4528061 - DNA, 19 bp, Homo sapiens
ctgggaaaatccactatga

SEQ ID NO: 4528062 - DNA, 16 bp, Homo sapiens
ctgggaaatgaggttt

SEQ ID NO: 4528063 - DNA, 22 bp, Homo sapiens
ctgggaacccaagtccaagcat

SEQ ID NO: 4528064 - DNA, 21 bp, Homo sapiens
ctgggaactgcagacctgtcc

SEQ ID NO: 4528065 - DNA, 23 bp, Homo sapiens
ctgggaactgcagacctgtcctc

SEQ ID NO: 4528066 - DNA, 22 bp, Homo sapiens
ctgggaagagaagagggcccag

SEQ ID NO: 4528067 - DNA, 13 bp, Homo sapiens
ctgggaaggcctc

SEQ ID NO: 4528068 - DNA, 15 bp, Homo sapiens
ctgggaatgggagag

SEQ ID NO: 4528069 - DNA, 16 bp, Homo sapiens
ctgggaatgggagagg

SEQ ID NO: 4528070 - DNA, 15 bp, Homo sapiens
ctgggaatttatata

SEQ ID NO: 4528071 - DNA, 19 bp, Homo sapiens
ctgggacacagacccagga

SEQ ID NO: 4528072 - DNA, 23 bp, Homo sapiens
ctgggacagtttatcatgaagcc

SEQ ID NO: 4528073 - DNA, 19 bp, Homo sapiens
ctgggacccttaggatggg

SEQ ID NO: 4528074 - DNA, 20 bp, Homo sapiens
ctgggaccctttccttcctt

SEQ ID NO: 4528075 - DNA, 19 bp, Homo sapiens
ctgggacctgccaggcagg

SEQ ID NO: 4528076 - DNA, 19 bp, Homo sapiens
ctgggacggaccagcatct

SEQ ID NO: 4528077 - DNA, 21 bp, Homo sapiens
ctgggactacaggcgcccgcc

SEQ ID NO: 4528078 - DNA, 22 bp, Homo sapiens
ctgggactacaggctcatgcca

SEQ ID NO: 4528079 - DNA, 16 bp, Homo sapiens
ctgggactacaggtgc

SEQ ID NO: 4528080 - DNA, 21 bp, Homo sapiens
ctgggactctcctcctcccct

SEQ ID NO: 4528081 - DNA, 15 bp, Homo sapiens
ctgggactgtgcctg

SEQ ID NO: 4528082 - DNA, 16 bp, Homo sapiens
ctgggactgtgcctgg

SEQ ID NO: 4528083 - DNA, 18 bp, Homo sapiens
ctgggactgtgcctggct

SEQ ID NO: 4528084 - DNA, 23 bp, Homo sapiens
ctgggactgtgcctggctccctg

SEQ ID NO: 4528085 - DNA, 17 bp, Homo sapiens
ctgggacttgaacaaag

SEQ ID NO: 4528086 - DNA, 23 bp, Homo sapiens
ctgggacttgaacaaagacattt

SEQ ID NO: 4528087 - DNA, 13 bp, Homo sapiens
ctgggagagaagt

SEQ ID NO: 4528088 - DNA, 17 bp, Homo sapiens
ctgggagccacttctcc

SEQ ID NO: 4528089 - DNA, 18 bp, Homo sapiens
ctgggagccacttctccc

SEQ ID NO: 4528090 - DNA, 19 bp, Homo sapiens
ctgggagccacttctcccc

SEQ ID NO: 4528091 - DNA, 15 bp, Homo sapiens
ctgggagccagtcct

SEQ ID NO: 4528092 - DNA, 18 bp, Homo sapiens
ctgggaggaaccgagggg

SEQ ID NO: 4528093 - DNA, 14 bp, Homo sapiens
ctgggaggacaggc

SEQ ID NO: 4528094 - DNA, 15 bp, Homo sapiens
ctgggaggagggaga

SEQ ID NO: 4528095 - DNA, 20 bp, Homo sapiens
ctgggaggagggagagggag

SEQ ID NO: 4528096 - DNA, 13 bp, Homo sapiens
ctgggagggcagc

SEQ ID NO: 4528097 - DNA, 15 bp, Homo sapiens
ctgggagggcagcag

SEQ ID NO: 4528098 - DNA, 17 bp, Homo sapiens
ctgggagggcagcaggg

SEQ ID NO: 4528099 - DNA, 14 bp, Homo sapiens
ctgggagtcacaca

SEQ ID NO: 4528100 - DNA, 16 bp, Homo sapiens
ctgggagtcacacagt

SEQ ID NO: 4528101 - DNA, 15 bp, Homo sapiens
ctgggatatggctgc

SEQ ID NO: 4528102 - DNA, 21 bp, Homo sapiens
ctgggatcctgactaagcctt

SEQ ID NO: 4528103 - DNA, 22 bp, Homo sapiens
ctgggatgacaggcgcctgcca

SEQ ID NO: 4528104 - DNA, 18 bp, Homo sapiens
ctgggatggtgactcctg

SEQ ID NO: 4528105 - DNA, 14 bp, Homo sapiens
ctgggattaagaaa

SEQ ID NO: 4528106 - DNA, 19 bp, Homo sapiens
ctgggattaagaaaccttg

SEQ ID NO: 4528107 - DNA, 21 bp, Homo sapiens
ctgggattaaggcgtgagcca

SEQ ID NO: 4528108 - DNA, 13 bp, Homo sapiens
ctgggattacagg

SEQ ID NO: 4528109 - DNA, 17 bp, Homo sapiens
ctgggcaaggaaaaaga

SEQ ID NO: 4528110 - DNA, 18 bp, Homo sapiens
ctgggcaccacaaaatat

SEQ ID NO: 4528111 - DNA, 19 bp, Homo sapiens
ctgggcacgcctgctggcc

SEQ ID NO: 4528112 - DNA, 21 bp, Homo sapiens
ctgggcacgcctgctggccga

SEQ ID NO: 4528113 - DNA, 19 bp, Homo sapiens
ctgggcactggggcctcag

SEQ ID NO: 4528114 - DNA, 13 bp, Homo sapiens
ctgggcagaggga

SEQ ID NO: 4528115 - DNA, 18 bp, Homo sapiens
ctgggcagcacctctggt

SEQ ID NO: 4528116 - DNA, 15 bp, Homo sapiens
ctgggcagccaggct

SEQ ID NO: 4528117 - DNA, 21 bp, Homo sapiens
ctgggcagtgagtgccatgct

SEQ ID NO: 4528118 - DNA, 18 bp, Homo sapiens
ctgggcattttcctcctc

SEQ ID NO: 4528119 - DNA, 19 bp, Homo sapiens
ctgggcattttcctcctct

SEQ ID NO: 4528120 - DNA, 22 bp, Homo sapiens
ctgggccaattcaatacaaaca

SEQ ID NO: 4528121 - DNA, 12 bp, Homo sapiens
ctgggccactgg

SEQ ID NO: 4528122 - DNA, 18 bp, Homo sapiens
ctgggccacttctgggtg

SEQ ID NO: 4528123 - DNA, 12 bp, Homo sapiens
ctgggccagtca

SEQ ID NO: 4528124 - DNA, 21 bp, Homo sapiens
ctgggccagtcaacggggggc

SEQ ID NO: 4528125 - DNA, 13 bp, Homo sapiens
ctgggccatctct

SEQ ID NO: 4528126 - DNA, 18 bp, Homo sapiens
ctgggccatgtccaaaga

SEQ ID NO: 4528127 - DNA, 19 bp, Homo sapiens
ctgggcccaaccctgtctg

SEQ ID NO: 4528128 - DNA, 18 bp, Homo sapiens
ctgggccccaccacctag

SEQ ID NO: 4528129 - DNA, 15 bp, Homo sapiens
ctgggccccagccca

SEQ ID NO: 4528130 - DNA, 18 bp, Homo sapiens
ctgggccccagcccaccc

SEQ ID NO: 4528131 - DNA, 20 bp, Homo sapiens
ctgggccccagcccaccctc

SEQ ID NO: 4528132 - DNA, 21 bp, Homo sapiens
ctgggccccagcccaccctcc

SEQ ID NO: 4528133 - DNA, 17 bp, Homo sapiens
ctgggcccctccacgcc

SEQ ID NO: 4528134 - DNA, 21 bp, Homo sapiens
ctgggcccctccacgcctcct

SEQ ID NO: 4528135 - DNA, 17 bp, Homo sapiens
ctgggcccctgggatgg

SEQ ID NO: 4528136 - DNA, 14 bp, Homo sapiens
ctgggcccgagcct

SEQ ID NO: 4528137 - DNA, 13 bp, Homo sapiens
ctgggccctctct

SEQ ID NO: 4528138 - DNA, 15 bp, Homo sapiens
ctgggccctctctgc

SEQ ID NO: 4528139 - DNA, 16 bp, Homo sapiens
ctgggccctctttccc

SEQ ID NO: 4528140 - DNA, 20 bp, Homo sapiens
ctgggccctctttccctgcg

SEQ ID NO: 4528141 - DNA, 23 bp, Homo sapiens
ctgggccctctttccctgcgaga

SEQ ID NO: 4528142 - DNA, 13 bp, Homo sapiens
ctgggccctgcct

SEQ ID NO: 4528143 - DNA, 14 bp, Homo sapiens
ctgggccctgcctg

SEQ ID NO: 4528144 - DNA, 19 bp, Homo sapiens
ctgggccctgcctgcagcc

SEQ ID NO: 4528145 - DNA, 12 bp, Homo sapiens
ctgggccctggg

SEQ ID NO: 4528146 - DNA, 19 bp, Homo sapiens
ctgggccctgggctggcac

SEQ ID NO: 4528147 - DNA, 17 bp, Homo sapiens
ctgggccctgtcgcccc

SEQ ID NO: 4528148 - DNA, 22 bp, Homo sapiens
ctgggccctgtcgcccctcctt

SEQ ID NO: 4528149 - DNA, 16 bp, Homo sapiens
ctgggcctttgcaaga

SEQ ID NO: 4528150 - DNA, 17 bp, Homo sapiens
ctgggcctttgcaagat

SEQ ID NO: 4528151 - DNA, 14 bp, Homo sapiens
ctgggccttttaac

SEQ ID NO: 4528152 - DNA, 23 bp, Homo sapiens
ctgggctcaaatgatcctcccac

SEQ ID NO: 4528153 - DNA, 21 bp, Homo sapiens
ctgggctcaagcaatcctcct

SEQ ID NO: 4528154 - DNA, 21 bp, Homo sapiens
ctgggctcggaggctgccccc

SEQ ID NO: 4528155 - DNA, 12 bp, Homo sapiens
ctgggctctcca

SEQ ID NO: 4528156 - DNA, 15 bp, Homo sapiens
ctgggctctccacct

SEQ ID NO: 4528157 - DNA, 16 bp, Homo sapiens
ctgggctctccacctc

SEQ ID NO: 4528158 - DNA, 21 bp, Homo sapiens
ctgggctctccacctcagcct

SEQ ID NO: 4528159 - DNA, 12 bp, Homo sapiens
ctgggctctgtc

SEQ ID NO: 4528160 - DNA, 12 bp, Homo sapiens
ctgggctgaggg

SEQ ID NO: 4528161 - DNA, 13 bp, Homo sapiens
ctgggctgaggga

SEQ ID NO: 4528162 - DNA, 19 bp, Homo sapiens
ctgggctgagggagcctgg

SEQ ID NO: 4528163 - DNA, 23 bp, Homo sapiens
ctgggctgagggagcctggcccc

SEQ ID NO: 4528164 - DNA, 15 bp, Homo sapiens
ctgggctgccaccag

SEQ ID NO: 4528165 - DNA, 12 bp, Homo sapiens
ctgggctggcac

SEQ ID NO: 4528166 - DNA, 18 bp, Homo sapiens
ctgggctggcacagcccc

SEQ ID NO: 4528167 - DNA, 21 bp, Homo sapiens
ctgggctggcacagcccctgg

SEQ ID NO: 4528168 - DNA, 21 bp, Homo sapiens
ctgggctgggccctctttccc

SEQ ID NO: 4528169 - DNA, 12 bp, Homo sapiens
ctgggctggggc

SEQ ID NO: 4528170 - DNA, 13 bp, Homo sapiens
ctgggctggggcc

SEQ ID NO: 4528171 - DNA, 21 bp, Homo sapiens
ctgggctggggccacctttgt

SEQ ID NO: 4528172 - DNA, 13 bp, Homo sapiens
ctgggctgtctgt

SEQ ID NO: 4528173 - DNA, 18 bp, Homo sapiens
ctgggctgtctgtcacca

SEQ ID NO: 4528174 - DNA, 15 bp, Homo sapiens
ctgggctgtgggcaa

SEQ ID NO: 4528175 - DNA, 19 bp, Homo sapiens
ctgggcttcatctggcaac

SEQ ID NO: 4528176 - DNA, 18 bp, Homo sapiens
ctgggcttggcctgctgt

SEQ ID NO: 4528177 - DNA, 17 bp, Homo sapiens
ctgggcttggggtgtgg

SEQ ID NO: 4528178 - DNA, 15 bp, Homo sapiens
ctggggaagaacagc

SEQ ID NO: 4528179 - DNA, 16 bp, Homo sapiens
ctggggaatgctccca

SEQ ID NO: 4528180 - DNA, 19 bp, Homo sapiens
ctggggacacacattctgc

SEQ ID NO: 4528181 - DNA, 22 bp, Homo sapiens
ctggggacacacattctgcctt

SEQ ID NO: 4528182 - DNA, 17 bp, Homo sapiens
ctggggacggggggccc

SEQ ID NO: 4528183 - DNA, 19 bp, Homo sapiens
ctggggacggggggcccca

SEQ ID NO: 4528184 - DNA, 23 bp, Homo sapiens
ctggggacggggggccccagtca

SEQ ID NO: 4528185 - DNA, 23 bp, Homo sapiens
ctggggacgttgctgagccagct

SEQ ID NO: 4528186 - DNA, 14 bp, Homo sapiens
ctggggactcaggg

SEQ ID NO: 4528187 - DNA, 20 bp, Homo sapiens
ctggggactgctacctctga

SEQ ID NO: 4528188 - DNA, 13 bp, Homo sapiens
ctggggacttgtg

SEQ ID NO: 4528189 - DNA, 17 bp, Homo sapiens
ctggggacttgtgtctg

SEQ ID NO: 4528190 - DNA, 21 bp, Homo sapiens
ctggggactttatttatttct

SEQ ID NO: 4528191 - DNA, 23 bp, Homo sapiens
ctggggactttatttatttctag

SEQ ID NO: 4528192 - DNA, 14 bp, Homo sapiens
ctggggagctcctg

SEQ ID NO: 4528193 - DNA, 17 bp, Homo sapiens
ctggggagctcctggga

SEQ ID NO: 4528194 - DNA, 22 bp, Homo sapiens
ctggggaggaatcctggaccaa

SEQ ID NO: 4528195 - DNA, 22 bp, Homo sapiens
ctggggaggccctaggggagca

SEQ ID NO: 4528196 - DNA, 21 bp, Homo sapiens
ctggggagtaaacggcccagg

SEQ ID NO: 4528197 - DNA, 20 bp, Homo sapiens
ctggggagtggttaggcagc

SEQ ID NO: 4528198 - DNA, 17 bp, Homo sapiens
ctggggatcttcccaca

SEQ ID NO: 4528199 - DNA, 19 bp, Homo sapiens
ctggggatcttcccacagg

SEQ ID NO: 4528200 - DNA, 22 bp, Homo sapiens
ctggggatgtctctcatgacca

SEQ ID NO: 4528201 - DNA, 21 bp, Homo sapiens
ctggggcaggctgggccatgt

SEQ ID NO: 4528202 - DNA, 20 bp, Homo sapiens
ctggggccacctttgtgcag

SEQ ID NO: 4528203 - DNA, 13 bp, Homo sapiens
ctggggccccatc

SEQ ID NO: 4528204 - DNA, 14 bp, Homo sapiens
ctggggccctgggc

SEQ ID NO: 4528205 - DNA, 13 bp, Homo sapiens
ctggggctgagtc

SEQ ID NO: 4528206 - DNA, 16 bp, Homo sapiens
ctgggggaagccctgg

SEQ ID NO: 4528207 - DNA, 14 bp, Homo sapiens
ctgggggcaggagg

SEQ ID NO: 4528208 - DNA, 19 bp, Homo sapiens
ctggggggcaattttgcac

SEQ ID NO: 4528209 - DNA, 14 bp, Homo sapiens
ctgggggtgccagg

SEQ ID NO: 4528210 - DNA, 13 bp, Homo sapiens
ctgggggtggcag

SEQ ID NO: 4528211 - DNA, 14 bp, Homo sapiens
ctgggggtgggaag

SEQ ID NO: 4528212 - DNA, 16 bp, Homo sapiens
ctggggtgcagcttca

SEQ ID NO: 4528213 - DNA, 17 bp, Homo sapiens
ctggggtgccgcctgcc

SEQ ID NO: 4528214 - DNA, 16 bp, Homo sapiens
ctggggtggccaccag

SEQ ID NO: 4528215 - DNA, 22 bp, Homo sapiens
ctggggtgggagtaacagggca

SEQ ID NO: 4528216 - DNA, 18 bp, Homo sapiens
ctggggtgggcagttttt

SEQ ID NO: 4528217 - DNA, 10 bp, Homo sapiens
ctggggtgtc

SEQ ID NO: 4528218 - DNA, 19 bp, Homo sapiens
ctggggttcagcccctcct

SEQ ID NO: 4528219 - DNA, 15 bp, Homo sapiens
ctggggttgccagag

SEQ ID NO: 4528220 - DNA, 16 bp, Homo sapiens
ctggggttgccagagg

SEQ ID NO: 4528221 - DNA, 14 bp, Homo sapiens
ctgggtaagaagaa

SEQ ID NO: 4528222 - DNA, 17 bp, Homo sapiens
ctgggtaagaagaaagc

SEQ ID NO: 4528223 - DNA, 17 bp, Homo sapiens
ctgggtaagaagggtgg

SEQ ID NO: 4528224 - DNA, 21 bp, Homo sapiens
ctgggtcagtctggtgggagg

SEQ ID NO: 4528225 - DNA, 15 bp, Homo sapiens
ctgggtcatgggcct

SEQ ID NO: 4528226 - DNA, 14 bp, Homo sapiens
ctgggtccagggag

SEQ ID NO: 4528227 - DNA, 17 bp, Homo sapiens
ctgggtccatatcacac

SEQ ID NO: 4528228 - DNA, 17 bp, Homo sapiens
ctgggtcctgccagctg

SEQ ID NO: 4528229 - DNA, 14 bp, Homo sapiens
ctgggtctgaggcc

SEQ ID NO: 4528230 - DNA, 20 bp, Homo sapiens
ctgggtctgaggcccctgcc

SEQ ID NO: 4528231 - DNA, 14 bp, Homo sapiens
ctgggtctggccag

SEQ ID NO: 4528232 - DNA, 15 bp, Homo sapiens
ctgggtctggccagg

SEQ ID NO: 4528233 - DNA, 17 bp, Homo sapiens
ctgggtcttcagcttta

SEQ ID NO: 4528234 - DNA, 18 bp, Homo sapiens
ctgggtgagagaggaata

SEQ ID NO: 4528235 - DNA, 18 bp, Homo sapiens
ctgggtgataattttgaa

SEQ ID NO: 4528236 - DNA, 16 bp, Homo sapiens
ctgggtgctgatcctt

SEQ ID NO: 4528237 - DNA, 13 bp, Homo sapiens
ctgggtgctggga

SEQ ID NO: 4528238 - DNA, 14 bp, Homo sapiens
ctgggtgggctctg

SEQ ID NO: 4528239 - DNA, 15 bp, Homo sapiens
ctgggtggggcagtg

SEQ ID NO: 4528240 - DNA, 18 bp, Homo sapiens
ctgggtggggctgctcct

SEQ ID NO: 4528241 - DNA, 22 bp, Homo sapiens
ctgggtggggctgctcctccag

SEQ ID NO: 4528242 - DNA, 14 bp, Homo sapiens
ctgggtggtggcct

SEQ ID NO: 4528243 - DNA, 19 bp, Homo sapiens
ctgggtgtcaagtgcctgc

SEQ ID NO: 4528244 - DNA, 16 bp, Homo sapiens
ctgggttccctttcct

SEQ ID NO: 4528245 - DNA, 21 bp, Homo sapiens
ctgggttccctttccttccat

SEQ ID NO: 4528246 - DNA, 15 bp, Homo sapiens
ctggtaagactgctg

SEQ ID NO: 4528247 - DNA, 17 bp, Homo sapiens
ctggtaagactgctggt

SEQ ID NO: 4528248 - DNA, 18 bp, Homo sapiens
ctggtaagactgctggtt

SEQ ID NO: 4528249 - DNA, 20 bp, Homo sapiens
ctggtaagattgttattaaa

SEQ ID NO: 4528250 - DNA, 23 bp, Homo sapiens
ctggtaagattgttattaaatgt

SEQ ID NO: 4528251 - DNA, 15 bp, Homo sapiens
ctggtagagaccccc

SEQ ID NO: 4528252 - DNA, 17 bp, Homo sapiens
ctggtagagacccccag

SEQ ID NO: 4528253 - DNA, 13 bp, Homo sapiens
ctggtagcagcag

SEQ ID NO: 4528254 - DNA, 18 bp, Homo sapiens
ctggtagcagcaggctca

SEQ ID NO: 4528255 - DNA, 20 bp, Homo sapiens
ctggtagcagcaggctcagg

SEQ ID NO: 4528256 - DNA, 18 bp, Homo sapiens
ctggtatatccaaaagct

SEQ ID NO: 4528257 - DNA, 22 bp, Homo sapiens
ctggtatgtaaaagaaaatcca

SEQ ID NO: 4528258 - DNA, 11 bp, Homo sapiens
ctggtattaaa

SEQ ID NO: 4528259 - DNA, 12 bp, Homo sapiens
ctggtattaaat

SEQ ID NO: 4528260 - DNA, 13 bp, Homo sapiens
ctggtattaaatg

SEQ ID NO: 4528261 - DNA, 16 bp, Homo sapiens
ctggtattaaatgcca

SEQ ID NO: 4528262 - DNA, 15 bp, Homo sapiens
ctggtattgttctca

SEQ ID NO: 4528263 - DNA, 14 bp, Homo sapiens
ctggtattttatct

SEQ ID NO: 4528264 - DNA, 18 bp, Homo sapiens
ctggtcagagagacctca

SEQ ID NO: 4528265 - DNA, 17 bp, Homo sapiens
ctggtccagggaagctg

SEQ ID NO: 4528266 - DNA, 21 bp, Homo sapiens
ctggtccagggaagctggccg

SEQ ID NO: 4528267 - DNA, 20 bp, Homo sapiens
ctggtccaggtcttcagttt

SEQ ID NO: 4528268 - DNA, 20 bp, Homo sapiens
ctggtcccggggccagcact

SEQ ID NO: 4528269 - DNA, 17 bp, Homo sapiens
ctggtcccttgcagcta

SEQ ID NO: 4528270 - DNA, 16 bp, Homo sapiens
ctggtccggacactcc

SEQ ID NO: 4528271 - DNA, 14 bp, Homo sapiens
ctggtccttattta

SEQ ID NO: 4528272 - DNA, 19 bp, Homo sapiens
ctggtccttccactgtgca

SEQ ID NO: 4528273 - DNA, 23 bp, Homo sapiens
ctggtctcaaacttgtggcctca

SEQ ID NO: 4528274 - DNA, 13 bp, Homo sapiens
ctggtctcagcag

SEQ ID NO: 4528275 - DNA, 12 bp, Homo sapiens
ctggtctctggt

SEQ ID NO: 4528276 - DNA, 19 bp, Homo sapiens
ctggtctgctgttccagtg

SEQ ID NO: 4528277 - DNA, 11 bp, Homo sapiens
ctggtctgtga

SEQ ID NO: 4528278 - DNA, 20 bp, Homo sapiens
ctggtgaagctcacttctgg

SEQ ID NO: 4528279 - DNA, 21 bp, Homo sapiens
ctggtgagcaggggaagcagg

SEQ ID NO: 4528280 - DNA, 16 bp, Homo sapiens
ctggtgcaaattcaga

SEQ ID NO: 4528281 - DNA, 17 bp, Homo sapiens
ctggtgcactttgtaaa

SEQ ID NO: 4528282 - DNA, 17 bp, Homo sapiens
ctggtgcaggtctccac

SEQ ID NO: 4528283 - DNA, 15 bp, Homo sapiens
ctggtgccatttctg

SEQ ID NO: 4528284 - DNA, 12 bp, Homo sapiens
ctggtgcctcac

SEQ ID NO: 4528285 - DNA, 12 bp, Homo sapiens
ctggtgcctcct

SEQ ID NO: 4528286 - DNA, 13 bp, Homo sapiens
ctggtgcctcctc

SEQ ID NO: 4528287 - DNA, 15 bp, Homo sapiens
ctggtgcctcctcaa

SEQ ID NO: 4528288 - DNA, 19 bp, Homo sapiens
ctggtgcctctcacttcgt

SEQ ID NO: 4528289 - DNA, 14 bp, Homo sapiens
ctggtgctgccgag

SEQ ID NO: 4528290 - DNA, 17 bp, Homo sapiens
ctggtgctgccgagggc

SEQ ID NO: 4528291 - DNA, 18 bp, Homo sapiens
ctggtgctgccgagggct

SEQ ID NO: 4528292 - DNA, 12 bp, Homo sapiens
ctggtggcacca

SEQ ID NO: 4528293 - DNA, 14 bp, Homo sapiens
ctggtggcaccaga

SEQ ID NO: 4528294 - DNA, 16 bp, Homo sapiens
ctggtggcaggggctt

SEQ ID NO: 4528295 - DNA, 22 bp, Homo sapiens
ctggtggcccactgactaagaa

SEQ ID NO: 4528296 - DNA, 17 bp, Homo sapiens
ctggtggtgcagccttc

SEQ ID NO: 4528297 - DNA, 22 bp, Homo sapiens
ctggtggtggctcgggaggcga

SEQ ID NO: 4528298 - DNA, 17 bp, Homo sapiens
ctggtgtccccttcccc

SEQ ID NO: 4528299 - DNA, 23 bp, Homo sapiens
ctggtgtccccttcccctgctga

SEQ ID NO: 4528300 - DNA, 17 bp, Homo sapiens
ctggttatttttctctt

SEQ ID NO: 4528301 - DNA, 20 bp, Homo sapiens
ctggttcacactgaccaaga

SEQ ID NO: 4528302 - DNA, 13 bp, Homo sapiens
ctggttcctgtgt

SEQ ID NO: 4528303 - DNA, 15 bp, Homo sapiens
ctggttctcatcttt

SEQ ID NO: 4528304 - DNA, 20 bp, Homo sapiens
ctggttctcatctttcttga

SEQ ID NO: 4528305 - DNA, 16 bp, Homo sapiens
ctctataaagggtcag

SEQ ID NO: 4528306 - DNA, 14 bp, Homo sapiens
ctctatatgtaata

SEQ ID NO: 4528307 - DNA, 23 bp, Homo sapiens
ctctatcatctgctaagtaattt

SEQ ID NO: 4528308 - DNA, 21 bp, Homo sapiens
ctctatcatggtgaaaagctc

SEQ ID NO: 4528309 - DNA, 14 bp, Homo sapiens
ctctattaaaatgc

SEQ ID NO: 4528310 - DNA, 17 bp, Homo sapiens
ctctattccctcagcct

SEQ ID NO: 4528311 - DNA, 19 bp, Homo sapiens
ctctattgggcacagccta

SEQ ID NO: 4528312 - DNA, 12 bp, Homo sapiens
ctctatttaaat

SEQ ID NO: 4528313 - DNA, 14 bp, Homo sapiens
ctctatttgagaat

SEQ ID NO: 4528314 - DNA, 22 bp, Homo sapiens
ctctattttacttttctgccaa

SEQ ID NO: 4528315 - DNA, 12 bp, Homo sapiens
ctctcaaaacaa

SEQ ID NO: 4528316 - DNA, 16 bp, Homo sapiens
ctctcaaattcagctc

SEQ ID NO: 4528317 - DNA, 19 bp, Homo sapiens
ctctcaaattcagctctga

SEQ ID NO: 4528318 - DNA, 19 bp, Homo sapiens
ctctcaccatgatgtgaag

SEQ ID NO: 4528319 - DNA, 14 bp, Homo sapiens
ctctcacccccatc

SEQ ID NO: 4528320 - DNA, 13 bp, Homo sapiens
ctctcacctgctc

SEQ ID NO: 4528321 - DNA, 19 bp, Homo sapiens
ctctcacctgctcccagtc

SEQ ID NO: 4528322 - DNA, 14 bp, Homo sapiens
ctctcactcccctc

SEQ ID NO: 4528323 - DNA, 15 bp, Homo sapiens
ctctcagagtgacag

SEQ ID NO: 4528324 - DNA, 14 bp, Homo sapiens
ctctcagcccagaa

SEQ ID NO: 4528325 - DNA, 14 bp, Homo sapiens
ctctcagcctccca

SEQ ID NO: 4528326 - DNA, 15 bp, Homo sapiens
ctctcagctgctgga

SEQ ID NO: 4528327 - DNA, 19 bp, Homo sapiens
ctctcagctgctggatgac

SEQ ID NO: 4528328 - DNA, 17 bp, Homo sapiens
ctctcaggaccaaagct

SEQ ID NO: 4528329 - DNA, 15 bp, Homo sapiens
ctctcagtctctgag

SEQ ID NO: 4528330 - DNA, 17 bp, Homo sapiens
ctctcagtctctgagca

SEQ ID NO: 4528331 - DNA, 17 bp, Homo sapiens
ctctcatagaacattga

SEQ ID NO: 4528332 - DNA, 16 bp, Homo sapiens
ctctcatcaactgaat

SEQ ID NO: 4528333 - DNA, 17 bp, Homo sapiens
ctctcatcaactgaatg

SEQ ID NO: 4528334 - DNA, 13 bp, Homo sapiens
ctctcatgcctcc

SEQ ID NO: 4528335 - DNA, 21 bp, Homo sapiens
ctctcattccccaggtggctg

SEQ ID NO: 4528336 - DNA, 14 bp, Homo sapiens
ctctcattttcctg

SEQ ID NO: 4528337 - DNA, 14 bp, Homo sapiens
ctctccaacctgga

SEQ ID NO: 4528338 - DNA, 16 bp, Homo sapiens
ctctccaacctggaca

SEQ ID NO: 4528339 - DNA, 16 bp, Homo sapiens
ctctccaagacagcag

SEQ ID NO: 4528340 - DNA, 17 bp, Homo sapiens
ctctccaagacagcagc

SEQ ID NO: 4528341 - DNA, 21 bp, Homo sapiens
ctctccaagacagcagcagcc

SEQ ID NO: 4528342 - DNA, 22 bp, Homo sapiens
ctctccaagacagcagcagcct

SEQ ID NO: 4528343 - DNA, 20 bp, Homo sapiens
ctctccaagtctcagtggct

SEQ ID NO: 4528344 - DNA, 10 bp, Homo sapiens
ctctccacct

SEQ ID NO: 4528345 - DNA, 16 bp, Homo sapiens
ctctccacctcagcct

SEQ ID NO: 4528346 - DNA, 17 bp, Homo sapiens
ctctccacctcagcctt

SEQ ID NO: 4528347 - DNA, 13 bp, Homo sapiens
ctctccacggtag

SEQ ID NO: 4528348 - DNA, 19 bp, Homo sapiens
ctctccactcatgtgactc

SEQ ID NO: 4528349 - DNA, 15 bp, Homo sapiens
ctctccagctgacta

SEQ ID NO: 4528350 - DNA, 18 bp, Homo sapiens
ctctccagctgactaaac

SEQ ID NO: 4528351 - DNA, 13 bp, Homo sapiens
ctctcccacagag

SEQ ID NO: 4528352 - DNA, 19 bp, Homo sapiens
ctctcccacccggccacag

SEQ ID NO: 4528353 - DNA, 20 bp, Homo sapiens
ctctcccagtctacccagag

SEQ ID NO: 4528354 - DNA, 13 bp, Homo sapiens
ctctcccagtgaa

SEQ ID NO: 4528355 - DNA, 18 bp, Homo sapiens
ctctcccatggagcccca

SEQ ID NO: 4528356 - DNA, 18 bp, Homo sapiens
ctctccccaatccatgct

SEQ ID NO: 4528357 - DNA, 14 bp, Homo sapiens
ctctccccacacta

SEQ ID NO: 4528358 - DNA, 15 bp, Homo sapiens
ctctccccacactaa

SEQ ID NO: 4528359 - DNA, 19 bp, Homo sapiens
ctctccccacgagggctgg

SEQ ID NO: 4528360 - DNA, 21 bp, Homo sapiens
ctctccccacgagggctggct

SEQ ID NO: 4528361 - DNA, 22 bp, Homo sapiens
ctctccccagccccctcccacc

SEQ ID NO: 4528362 - DNA, 13 bp, Homo sapiens
ctctccccaggaa

SEQ ID NO: 4528363 - DNA, 16 bp, Homo sapiens
ctctccccagtgcctg

SEQ ID NO: 4528364 - DNA, 16 bp, Homo sapiens
ctctcccccaccccct

SEQ ID NO: 4528365 - DNA, 16 bp, Homo sapiens
ctctccccctcctcca

SEQ ID NO: 4528366 - DNA, 12 bp, Homo sapiens
ctctccctctgg

SEQ ID NO: 4528367 - DNA, 13 bp, Homo sapiens
ctctccctctggc

SEQ ID NO: 4528368 - DNA, 18 bp, Homo sapiens
ctctccctctggccctgc

SEQ ID NO: 4528369 - DNA, 19 bp, Homo sapiens
ctctccctctggccctgcc

SEQ ID NO: 4528370 - DNA, 22 bp, Homo sapiens
ctctccctctggccctgccttc

SEQ ID NO: 4528371 - DNA, 13 bp, Homo sapiens
ctctccctgccaa

SEQ ID NO: 4528372 - DNA, 19 bp, Homo sapiens
ctctccctgtgttctgggc

SEQ ID NO: 4528373 - DNA, 20 bp, Homo sapiens
ctctccctgtgttctgggct

SEQ ID NO: 4528374 - DNA, 23 bp, Homo sapiens
ctctccgactctgcacccgcctc

SEQ ID NO: 4528375 - DNA, 15 bp, Homo sapiens
ctctccgcgcctacc

SEQ ID NO: 4528376 - DNA, 20 bp, Homo sapiens
ctctcctatctctctgtctt

SEQ ID NO: 4528377 - DNA, 11 bp, Homo sapiens
ctctcctcccc

SEQ ID NO: 4528378 - DNA, 15 bp, Homo sapiens
ctctcctccccaaat

SEQ ID NO: 4528379 - DNA, 16 bp, Homo sapiens
ctctcctccccttcct

SEQ ID NO: 4528380 - DNA, 17 bp, Homo sapiens
ctctcctcctcccctcc

SEQ ID NO: 4528381 - DNA, 13 bp, Homo sapiens
ctctcctctctgc

SEQ ID NO: 4528382 - DNA, 16 bp, Homo sapiens
ctctcctgacccctgc

SEQ ID NO: 4528383 - DNA, 13 bp, Homo sapiens
ctctcctgccctg

SEQ ID NO: 4528384 - DNA, 13 bp, Homo sapiens
ctctcctgcctac

SEQ ID NO: 4528385 - DNA, 13 bp, Homo sapiens
ctctcctgctgca

SEQ ID NO: 4528386 - DNA, 13 bp, Homo sapiens
ctctcctggccta

SEQ ID NO: 4528387 - DNA, 20 bp, Homo sapiens
ctctcctggcctatccgctg

SEQ ID NO: 4528388 - DNA, 13 bp, Homo sapiens
ctctcctgggccc

SEQ ID NO: 4528389 - DNA, 17 bp, Homo sapiens
ctctcctgggcccctcc

SEQ ID NO: 4528390 - DNA, 19 bp, Homo sapiens
ctctcctgggcccctccct

SEQ ID NO: 4528391 - DNA, 22 bp, Homo sapiens
ctctcctgggcccctccctacc

SEQ ID NO: 4528392 - DNA, 20 bp, Homo sapiens
ctctcctgtaagccaaagaa

SEQ ID NO: 4528393 - DNA, 12 bp, Homo sapiens
ctctcctgtcca

SEQ ID NO: 4528394 - DNA, 16 bp, Homo sapiens
ctctcctgtcctccct

SEQ ID NO: 4528395 - DNA, 17 bp, Homo sapiens
ctctcctgtctccctcc

SEQ ID NO: 4528396 - DNA, 22 bp, Homo sapiens
ctctccttaacctccagcagac

SEQ ID NO: 4528397 - DNA, 23 bp, Homo sapiens
ctctccttcactctgacagtatt

SEQ ID NO: 4528398 - DNA, 16 bp, Homo sapiens
ctctccttcctggagc

SEQ ID NO: 4528399 - DNA, 15 bp, Homo sapiens
ctctccttggaaggt

SEQ ID NO: 4528400 - DNA, 16 bp, Homo sapiens
ctctccttggccacag

SEQ ID NO: 4528401 - DNA, 18 bp, Homo sapiens
ctctccttggccacagac

SEQ ID NO: 4528402 - DNA, 14 bp, Homo sapiens
ctctcctttctttt

SEQ ID NO: 4528403 - DNA, 13 bp, Homo sapiens
ctctcctttgaaa

SEQ ID NO: 4528404 - DNA, 13 bp, Homo sapiens
ctctcctttgtag

SEQ ID NO: 4528405 - DNA, 19 bp, Homo sapiens
ctctcgccccatccctgct

SEQ ID NO: 4528406 - DNA, 21 bp, Homo sapiens
ctctcgccccatccctgcttg

SEQ ID NO: 4528407 - DNA, 21 bp, Homo sapiens
ctctcgctgccctgtggacag

SEQ ID NO: 4528408 - DNA, 15 bp, Homo sapiens
ctctcggccaggcat

SEQ ID NO: 4528409 - DNA, 11 bp, Homo sapiens
ctctcggcccc

SEQ ID NO: 4528410 - DNA, 14 bp, Homo sapiens
ctctcggcccctgt

SEQ ID NO: 4528411 - DNA, 15 bp, Homo sapiens
ctctcggcccctgtc

SEQ ID NO: 4528412 - DNA, 16 bp, Homo sapiens
ctctcggcccctgtct

SEQ ID NO: 4528413 - DNA, 19 bp, Homo sapiens
ctctcggtgctccatctcc

SEQ ID NO: 4528414 - DNA, 21 bp, Homo sapiens
ctctctaccttttaaaattga

SEQ ID NO: 4528415 - DNA, 20 bp, Homo sapiens
ctctctattccctcagccta

SEQ ID NO: 4528416 - DNA, 13 bp, Homo sapiens
ctctctcacctgc

SEQ ID NO: 4528417 - DNA, 21 bp, Homo sapiens
ctctctcataccctccctccc

SEQ ID NO: 4528418 - DNA, 23 bp, Homo sapiens
ctctctcccagtctacccagaga

SEQ ID NO: 4528419 - DNA, 16 bp, Homo sapiens
ctctctccctgcctca

SEQ ID NO: 4528420 - DNA, 19 bp, Homo sapiens
ctctctcggcccctgtctg

SEQ ID NO: 4528421 - DNA, 17 bp, Homo sapiens
ctctctctaccttttaa

SEQ ID NO: 4528422 - DNA, 13 bp, Homo sapiens
ctctctctcactc

SEQ ID NO: 4528423 - DNA, 12 bp, Homo sapiens
ctctctctgggc

SEQ ID NO: 4528424 - DNA, 14 bp, Homo sapiens
ctctctcttttcta

SEQ ID NO: 4528425 - DNA, 15 bp, Homo sapiens
ctctctcttttctac

SEQ ID NO: 4528426 - DNA, 15 bp, Homo sapiens
ctctctcttttttct

SEQ ID NO: 4528427 - DNA, 14 bp, Homo sapiens
ctccttccatctct

SEQ ID NO: 4528428 - DNA, 20 bp, Homo sapiens
ctccttccatctcttccttc

SEQ ID NO: 4528429 - DNA, 21 bp, Homo sapiens
ctccttccccagacccagagg

SEQ ID NO: 4528430 - DNA, 23 bp, Homo sapiens
ctccttccccagacccagaggtc

SEQ ID NO: 4528431 - DNA, 23 bp, Homo sapiens
ctccttcccctacacctccctcc

SEQ ID NO: 4528432 - DNA, 23 bp, Homo sapiens
ctccttcctggagcccagaggag

SEQ ID NO: 4528433 - DNA, 18 bp, Homo sapiens
ctccttccttcaggactc

SEQ ID NO: 4528434 - DNA, 19 bp, Homo sapiens
ctccttccttcaggactct

SEQ ID NO: 4528435 - DNA, 22 bp, Homo sapiens
ctccttctgctgtgtatcatgg

SEQ ID NO: 4528436 - DNA, 20 bp, Homo sapiens
ctccttgccccccgccctca

SEQ ID NO: 4528437 - DNA, 21 bp, Homo sapiens
ctccttgccccccgccctcat

SEQ ID NO: 4528438 - DNA, 15 bp, Homo sapiens
ctccttggcaccccc

SEQ ID NO: 4528439 - DNA, 21 bp, Homo sapiens
ctccttggcacccccatgctg

SEQ ID NO: 4528440 - DNA, 14 bp, Homo sapiens
ctccttggccacag

SEQ ID NO: 4528441 - DNA, 15 bp, Homo sapiens
ctccttggccacaga

SEQ ID NO: 4528442 - DNA, 16 bp, Homo sapiens
ctccttgggccctttg

SEQ ID NO: 4528443 - DNA, 18 bp, Homo sapiens
ctccttgggccctttgag

SEQ ID NO: 4528444 - DNA, 19 bp, Homo sapiens
ctccttgggccctttgagt

SEQ ID NO: 4528445 - DNA, 16 bp, Homo sapiens
ctccttggtgcctctg

SEQ ID NO: 4528446 - DNA, 17 bp, Homo sapiens
ctccttggttatatttt

SEQ ID NO: 4528447 - DNA, 21 bp, Homo sapiens
ctccttgtcaacaaagtgctt

SEQ ID NO: 4528448 - DNA, 22 bp, Homo sapiens
ctccttgtcaacaaagtgcttt

SEQ ID NO: 4528449 - DNA, 11 bp, Homo sapiens
ctcctttacca

SEQ ID NO: 4528450 - DNA, 16 bp, Homo sapiens
ctcctttatctgtaat

SEQ ID NO: 4528451 - DNA, 22 bp, Homo sapiens
ctcctttatctgtaattgtaat

SEQ ID NO: 4528452 - DNA, 23 bp, Homo sapiens
ctcctttatctgtaattgtaatt

SEQ ID NO: 4528453 - DNA, 15 bp, Homo sapiens
ctcctttctcctgtg

SEQ ID NO: 4528454 - DNA, 19 bp, Homo sapiens
ctcctttgaaacctgctct

SEQ ID NO: 4528455 - DNA, 16 bp, Homo sapiens
ctccttttatctggtg

SEQ ID NO: 4528456 - DNA, 23 bp, Homo sapiens
ctccttttatctggtgcctcctc

SEQ ID NO: 4528457 - DNA, 19 bp, Homo sapiens
ctcgaaacacagaaacctt

SEQ ID NO: 4528458 - DNA, 19 bp, Homo sapiens
ctcgacaaaggccacaggc

SEQ ID NO: 4528459 - DNA, 19 bp, Homo sapiens
ctcgacccagaatggagcc

SEQ ID NO: 4528460 - DNA, 19 bp, Homo sapiens
ctcgagaactttcattttt

SEQ ID NO: 4528461 - DNA, 17 bp, Homo sapiens
ctcgagcccagatggaa

SEQ ID NO: 4528462 - DNA, 12 bp, Homo sapiens
ctcgaggcctgc

SEQ ID NO: 4528463 - DNA, 13 bp, Homo sapiens
ctcgaggcctgca

SEQ ID NO: 4528464 - DNA, 13 bp, Homo sapiens
ctcgagtactgtg

SEQ ID NO: 4528465 - DNA, 22 bp, Homo sapiens
ctcgagtactgtgggcaattta

SEQ ID NO: 4528466 - DNA, 14 bp, Homo sapiens
ctcgatccaaattg

SEQ ID NO: 4528467 - DNA, 15 bp, Homo sapiens
ctcgatccaaattgt

SEQ ID NO: 4528468 - DNA, 21 bp, Homo sapiens
ctcgatccaaattgtgcttct

SEQ ID NO: 4528469 - DNA, 17 bp, Homo sapiens
ctcgatggacctcagca

SEQ ID NO: 4528470 - DNA, 20 bp, Homo sapiens
ctcgatgtggtcacagctgt

SEQ ID NO: 4528471 - DNA, 24 bp, Homo sapiens
ctcgatgtggtcacagctgtatag

SEQ ID NO: 4528472 - DNA, 20 bp, Homo sapiens
ctcgcagggaatgcagcagg

SEQ ID NO: 4528473 - DNA, 16 bp, Homo sapiens
ctcgcatccagacagt

SEQ ID NO: 4528474 - DNA, 22 bp, Homo sapiens
ctcgcatttgtcaatgacagtt

SEQ ID NO: 4528475 - DNA, 22 bp, Homo sapiens
ctcgccaagcaggacagtgctt

SEQ ID NO: 4528476 - DNA, 12 bp, Homo sapiens
ctcgcccagcag

SEQ ID NO: 4528477 - DNA, 13 bp, Homo sapiens
ctcgcccagcagg

SEQ ID NO: 4528478 - DNA, 12 bp, Homo sapiens
ctcgccctgggt

SEQ ID NO: 4528479 - DNA, 15 bp, Homo sapiens
ctcgccctgggtcta

SEQ ID NO: 4528480 - DNA, 18 bp, Homo sapiens
ctcgccggatctgaggga

SEQ ID NO: 4528481 - DNA, 22 bp, Homo sapiens
ctcgctcaccgctggcccttag

SEQ ID NO: 4528482 - DNA, 15 bp, Homo sapiens
ctcgctccctgtagc

SEQ ID NO: 4528483 - DNA, 19 bp, Homo sapiens
ctcgctgccagctctgtat

SEQ ID NO: 4528484 - DNA, 19 bp, Homo sapiens
ctcgctgcgcagcctccag

SEQ ID NO: 4528485 - DNA, 15 bp, Homo sapiens
ctcgctggactctca

SEQ ID NO: 4528486 - DNA, 19 bp, Homo sapiens
ctcgctggactctcagtct

SEQ ID NO: 4528487 - DNA, 20 bp, Homo sapiens
ctcgctgtgattttaagaca

SEQ ID NO: 4528488 - DNA, 19 bp, Homo sapiens
ctcgcttgctggaacacag

SEQ ID NO: 4528489 - DNA, 21 bp, Homo sapiens
ctcggaattcataataaattt

SEQ ID NO: 4528490 - DNA, 13 bp, Homo sapiens
ctcggacacagtt

SEQ ID NO: 4528491 - DNA, 18 bp, Homo sapiens
ctcggacagagcccccct

SEQ ID NO: 4528492 - DNA, 15 bp, Homo sapiens
ctcggacccacccca

SEQ ID NO: 4528493 - DNA, 17 bp, Homo sapiens
ctcggacccaccccaac

SEQ ID NO: 4528494 - DNA, 22 bp, Homo sapiens
ctcggactaagcctacctgctc

SEQ ID NO: 4528495 - DNA, 20 bp, Homo sapiens
ctcggagagcagcagcacca

SEQ ID NO: 4528496 - DNA, 20 bp, Homo sapiens
ctcggatcaccgagagtagc

SEQ ID NO: 4528497 - DNA, 21 bp, Homo sapiens
ctcggatgaccatactcagac

SEQ ID NO: 4528498 - DNA, 24 bp, Homo sapiens
ctcggatggaccaacctgctctgt

SEQ ID NO: 4528499 - DNA, 15 bp, Homo sapiens
ctcggcaccaactaa

SEQ ID NO: 4528500 - DNA, 11 bp, Homo sapiens
ctcggcccctg

SEQ ID NO: 4528501 - DNA, 12 bp, Homo sapiens
ctcggcccctgt

SEQ ID NO: 4528502 - DNA, 15 bp, Homo sapiens
ctcggcctcccaaag

SEQ ID NO: 4528503 - DNA, 18 bp, Homo sapiens
ctcggcctcccaaagtgc

SEQ ID NO: 4528504 - DNA, 21 bp, Homo sapiens
ctcggcctccgaggctccccg

SEQ ID NO: 4528505 - DNA, 16 bp, Homo sapiens
ctcgggcccagccccc

SEQ ID NO: 4528506 - DNA, 14 bp, Homo sapiens
ctcggggtccctgg

SEQ ID NO: 4528507 - DNA, 24 bp, Homo sapiens
ctcgtcaagagcatgcacatgctg

SEQ ID NO: 4528508 - DNA, 15 bp, Homo sapiens
ctcgtcctccccctg

SEQ ID NO: 4528509 - DNA, 15 bp, Homo sapiens
ctcgtgagtcattta

SEQ ID NO: 4528510 - DNA, 20 bp, Homo sapiens
ctcgtgagtcatttaaatgt

SEQ ID NO: 4528511 - DNA, 16 bp, Homo sapiens
ctcgtgatgggcccgc

SEQ ID NO: 4528512 - DNA, 18 bp, Homo sapiens
ctcgtgatgggcccgcct

SEQ ID NO: 4528513 - DNA, 21 bp, Homo sapiens
ctcgtgcattaaaatttctta

SEQ ID NO: 4528514 - DNA, 15 bp, Homo sapiens
ctcgtggactgtgct

SEQ ID NO: 4528515 - DNA, 12 bp, Homo sapiens
ctcgtgtttgct

SEQ ID NO: 4528516 - DNA, 20 bp, Homo sapiens
ctcgttgactggctgtgtgt

SEQ ID NO: 4528517 - DNA, 23 bp, Homo sapiens
ctcgttgactggctgtgtgttgg

SEQ ID NO: 4528518 - DNA, 16 bp, Homo sapiens
ctcgttgtcacaccca

SEQ ID NO: 4528519 - DNA, 22 bp, Homo sapiens
ctctaaacagacaggaatttag

SEQ ID NO: 4528520 - DNA, 14 bp, Homo sapiens
ctctaacagccctc

SEQ ID NO: 4528521 - DNA, 17 bp, Homo sapiens
ctctaaccccaggcccc

SEQ ID NO: 4528522 - DNA, 18 bp, Homo sapiens
ctctaaccccaggccccg

SEQ ID NO: 4528523 - DNA, 19 bp, Homo sapiens
ctctaaccccaggccccga

SEQ ID NO: 4528524 - DNA, 16 bp, Homo sapiens
ctctaactcctgccat

SEQ ID NO: 4528525 - DNA, 16 bp, Homo sapiens
ctctaactgtatattt

SEQ ID NO: 4528526 - DNA, 21 bp, Homo sapiens
ctctaactgtatatttgtatg

SEQ ID NO: 4528527 - DNA, 19 bp, Homo sapiens
ctctaatatgattatacaa

SEQ ID NO: 4528528 - DNA, 14 bp, Homo sapiens
ctctaatattgctt

SEQ ID NO: 4528529 - DNA, 17 bp, Homo sapiens
ctctaatattgcttctt

SEQ ID NO: 4528530 - DNA, 16 bp, Homo sapiens
ctctaatgttgtatca

SEQ ID NO: 4528531 - DNA, 14 bp, Homo sapiens
ctctacagccgtcc

SEQ ID NO: 4528532 - DNA, 19 bp, Homo sapiens
ctctacaggtccgtttcct

SEQ ID NO: 4528533 - DNA, 18 bp, Homo sapiens
ctctaccaaaaaaaggaa

SEQ ID NO: 4528534 - DNA, 20 bp, Homo sapiens
ctctaccaaaaaaaggaagg

SEQ ID NO: 4528535 - DNA, 23 bp, Homo sapiens
ctctaccatggttctgcctcctg

SEQ ID NO: 4528536 - DNA, 17 bp, Homo sapiens
ctctaccctcccacccc

SEQ ID NO: 4528537 - DNA, 22 bp, Homo sapiens
ctctaccctcccacccccttct

SEQ ID NO: 4528538 - DNA, 21 bp, Homo sapiens
ctctaccttcctgtccctgag

SEQ ID NO: 4528539 - DNA, 23 bp, Homo sapiens
ctctaccttcctgtccctgaggt

SEQ ID NO: 4528540 - DNA, 23 bp, Homo sapiens
ctctacgtttccccaataaagcc

SEQ ID NO: 4528541 - DNA, 19 bp, Homo sapiens
ctctactaaaaatacaaaa

SEQ ID NO: 4528542 - DNA, 15 bp, Homo sapiens
ctctagagccttcag

SEQ ID NO: 4528543 - DNA, 15 bp, Homo sapiens
ctctaggctgttctg

SEQ ID NO: 4528544 - DNA, 18 bp, Homo sapiens
ctctaggctgttctgtag

SEQ ID NO: 4528545 - DNA, 14 bp, Homo sapiens
ctctataaagggtc

SEQ ID NO: 4528546 - DNA, 15 bp, Homo sapiens
ctcctccatgggaga

SEQ ID NO: 4528547 - DNA, 17 bp, Homo sapiens
ctcctccccaaatcaat

SEQ ID NO: 4528548 - DNA, 15 bp, Homo sapiens
ctcctccccagagct

SEQ ID NO: 4528549 - DNA, 11 bp, Homo sapiens
ctcctccccca

SEQ ID NO: 4528550 - DNA, 12 bp, Homo sapiens
ctcctcccccag

SEQ ID NO: 4528551 - DNA, 14 bp, Homo sapiens
ctcctcccccagtg

SEQ ID NO: 4528552 - DNA, 14 bp, Homo sapiens
ctcctccccttcct

SEQ ID NO: 4528553 - DNA, 17 bp, Homo sapiens
ctcctccccttcctgtt

SEQ ID NO: 4528554 - DNA, 19 bp, Homo sapiens
ctcctccccttcctgtttc

SEQ ID NO: 4528555 - DNA, 17 bp, Homo sapiens
ctcctcccgaaaaatgt

SEQ ID NO: 4528556 - DNA, 21 bp, Homo sapiens
ctcctcccgccccgcccctcc

SEQ ID NO: 4528557 - DNA, 11 bp, Homo sapiens
ctcctccctca

SEQ ID NO: 4528558 - DNA, 12 bp, Homo sapiens
ctcctccctcaa

SEQ ID NO: 4528559 - DNA, 17 bp, Homo sapiens
ctcctccctcagaccca

SEQ ID NO: 4528560 - DNA, 18 bp, Homo sapiens
ctcctccctcagactcag

SEQ ID NO: 4528561 - DNA, 20 bp, Homo sapiens
ctcctccctcaggcccagga

SEQ ID NO: 4528562 - DNA, 13 bp, Homo sapiens
ctcctcccttcct

SEQ ID NO: 4528563 - DNA, 14 bp, Homo sapiens
ctcctcccttcctt

SEQ ID NO: 4528564 - DNA, 15 bp, Homo sapiens
ctcctcccttccttt

SEQ ID NO: 4528565 - DNA, 18 bp, Homo sapiens
ctcctccttgcccagact

SEQ ID NO: 4528566 - DNA, 21 bp, Homo sapiens
ctcctcgagatcccaacactg

SEQ ID NO: 4528567 - DNA, 21 bp, Homo sapiens
ctcctcggagagcagcagcac

SEQ ID NO: 4528568 - DNA, 22 bp, Homo sapiens
ctcctctcccacagagtgctgg

SEQ ID NO: 4528569 - DNA, 13 bp, Homo sapiens
ctcctctcctgga

SEQ ID NO: 4528570 - DNA, 9 bp, Homo sapiens
ctcctctct

SEQ ID NO: 4528571 - DNA, 11 bp, Homo sapiens
ctcctctctgc

SEQ ID NO: 4528572 - DNA, 11 bp, Homo sapiens
ctcctctgaaa

SEQ ID NO: 4528573 - DNA, 12 bp, Homo sapiens
ctcctctgaaac

SEQ ID NO: 4528574 - DNA, 13 bp, Homo sapiens
ctcctctgaaaca

SEQ ID NO: 4528575 - DNA, 14 bp, Homo sapiens
ctcctctgaaacag

SEQ ID NO: 4528576 - DNA, 15 bp, Homo sapiens
ctcctctgaaacagc

SEQ ID NO: 4528577 - DNA, 19 bp, Homo sapiens
ctcctctgaaacagctgcc

SEQ ID NO: 4528578 - DNA, 20 bp, Homo sapiens
ctcctctgaaacagctgcct

SEQ ID NO: 4528579 - DNA, 21 bp, Homo sapiens
ctcctctgaaacagctgcctt

SEQ ID NO: 4528580 - DNA, 13 bp, Homo sapiens
ctcctctgactca

SEQ ID NO: 4528581 - DNA, 18 bp, Homo sapiens
ctcctctgactcagggct

SEQ ID NO: 4528582 - DNA, 17 bp, Homo sapiens
ctcctctgcagtgcctt

SEQ ID NO: 4528583 - DNA, 12 bp, Homo sapiens
ctcctctgccta

SEQ ID NO: 4528584 - DNA, 13 bp, Homo sapiens
ctcctctgcctac

SEQ ID NO: 4528585 - DNA, 20 bp, Homo sapiens
ctcctctgcctacagccagg

SEQ ID NO: 4528586 - DNA, 12 bp, Homo sapiens
ctcctctggctt

SEQ ID NO: 4528587 - DNA, 17 bp, Homo sapiens
ctcctctggctttccca

SEQ ID NO: 4528588 - DNA, 22 bp, Homo sapiens
ctcctctggctttcccaggaga

SEQ ID NO: 4528589 - DNA, 16 bp, Homo sapiens
ctcctctgtctgccct

SEQ ID NO: 4528590 - DNA, 13 bp, Homo sapiens
ctcctctttaaaa

SEQ ID NO: 4528591 - DNA, 16 bp, Homo sapiens
ctcctctttaaaacaa

SEQ ID NO: 4528592 - DNA, 19 bp, Homo sapiens
ctcctctttaaaacaaaac

SEQ ID NO: 4528593 - DNA, 18 bp, Homo sapiens
ctcctgaaacctcttcct

SEQ ID NO: 4528594 - DNA, 18 bp, Homo sapiens
ctcctgacccccatgtaa

SEQ ID NO: 4528595 - DNA, 20 bp, Homo sapiens
ctcctgacccccatgtaaat

SEQ ID NO: 4528596 - DNA, 17 bp, Homo sapiens
ctcctgagacccctggc

SEQ ID NO: 4528597 - DNA, 20 bp, Homo sapiens
ctcctgagacccctggcctc

SEQ ID NO: 4528598 - DNA, 16 bp, Homo sapiens
ctcctgaggctgtttt

SEQ ID NO: 4528599 - DNA, 23 bp, Homo sapiens
ctcctgaggctgtttttggctgt

SEQ ID NO: 4528600 - DNA, 16 bp, Homo sapiens
ctcctgaggctttgga

SEQ ID NO: 4528601 - DNA, 16 bp, Homo sapiens
ctcctgaggggcatct

SEQ ID NO: 4528602 - DNA, 21 bp, Homo sapiens
ctcctgaggggcatctgcccc

SEQ ID NO: 4528603 - DNA, 14 bp, Homo sapiens
ctcctgcactgttt

SEQ ID NO: 4528604 - DNA, 14 bp, Homo sapiens
ctcctgccaggcac

SEQ ID NO: 4528605 - DNA, 12 bp, Homo sapiens
ctcctgcccagg

SEQ ID NO: 4528606 - DNA, 14 bp, Homo sapiens
ctcctgcccaggag

SEQ ID NO: 4528607 - DNA, 13 bp, Homo sapiens
ctcctgcccaggc

SEQ ID NO: 4528608 - DNA, 15 bp, Homo sapiens
ctcctgcccaggcca

SEQ ID NO: 4528609 - DNA, 16 bp, Homo sapiens
ctcctgcccaggccac

SEQ ID NO: 4528610 - DNA, 19 bp, Homo sapiens
ctcctgcccaggccacaga

SEQ ID NO: 4528611 - DNA, 16 bp, Homo sapiens
ctcctgccccctgcca

SEQ ID NO: 4528612 - DNA, 17 bp, Homo sapiens
ctcctgccccctgccag

SEQ ID NO: 4528613 - DNA, 13 bp, Homo sapiens
ctcctgccctgtg

SEQ ID NO: 4528614 - DNA, 14 bp, Homo sapiens
ctcctgccctgtga

SEQ ID NO: 4528615 - DNA, 14 bp, Homo sapiens
ctcctgccgcagag

SEQ ID NO: 4528616 - DNA, 18 bp, Homo sapiens
ctcctgccgcagagctgg

SEQ ID NO: 4528617 - DNA, 13 bp, Homo sapiens
ctcctgcctactc

SEQ ID NO: 4528618 - DNA, 16 bp, Homo sapiens
ctcctgcctactcacg

SEQ ID NO: 4528619 - DNA, 12 bp, Homo sapiens
ctcctgcctcag

SEQ ID NO: 4528620 - DNA, 14 bp, Homo sapiens
ctcctgctctctat

SEQ ID NO: 4528621 - DNA, 21 bp, Homo sapiens
ctcctgctgcctaataaagag

SEQ ID NO: 4528622 - DNA, 12 bp, Homo sapiens
ctcctggaaact

SEQ ID NO: 4528623 - DNA, 18 bp, Homo sapiens
ctcctggccaagcaggct

SEQ ID NO: 4528624 - DNA, 12 bp, Homo sapiens
ctcctggccaga

SEQ ID NO: 4528625 - DNA, 13 bp, Homo sapiens
ctcctggcctatc

SEQ ID NO: 4528626 - DNA, 20 bp, Homo sapiens
ctcctggcctggccatctcc

SEQ ID NO: 4528627 - DNA, 18 bp, Homo sapiens
ctcctgggacccttggct

SEQ ID NO: 4528628 - DNA, 19 bp, Homo sapiens
ctcctgggacccttggcta

SEQ ID NO: 4528629 - DNA, 14 bp, Homo sapiens
ctcctgggccctgg

SEQ ID NO: 4528630 - DNA, 17 bp, Homo sapiens
ctcctgggccctgggct

SEQ ID NO: 4528631 - DNA, 18 bp, Homo sapiens
ctcctggggagctcctgg

SEQ ID NO: 4528632 - DNA, 21 bp, Homo sapiens
ctcctggggagctcctgggac

SEQ ID NO: 4528633 - DNA, 16 bp, Homo sapiens
ctcctgggggtggcag

SEQ ID NO: 4528634 - DNA, 20 bp, Homo sapiens
ctcctgggggtggcaggcac

SEQ ID NO: 4528635 - DNA, 21 bp, Homo sapiens
ctcctgggttttgtattctct

SEQ ID NO: 4528636 - DNA, 22 bp, Homo sapiens
ctcctggtagaggggccggctg

SEQ ID NO: 4528637 - DNA, 16 bp, Homo sapiens
ctcctggtctgtgaag

SEQ ID NO: 4528638 - DNA, 14 bp, Homo sapiens
ctcctggtgggtcc

SEQ ID NO: 4528639 - DNA, 20 bp, Homo sapiens
ctcctgtaagccaaagaaat

SEQ ID NO: 4528640 - DNA, 17 bp, Homo sapiens
ctcctgtacctcagtgg

SEQ ID NO: 4528641 - DNA, 18 bp, Homo sapiens
ctcctgtacctcagtgga

SEQ ID NO: 4528642 - DNA, 16 bp, Homo sapiens
ctcctgtcagtgagga

SEQ ID NO: 4528643 - DNA, 14 bp, Homo sapiens
ctcctgtccctttt

SEQ ID NO: 4528644 - DNA, 20 bp, Homo sapiens
ctcctgtcccttttccctta

SEQ ID NO: 4528645 - DNA, 12 bp, Homo sapiens
ctcctgtcctcc

SEQ ID NO: 4528646 - DNA, 18 bp, Homo sapiens
ctcctgtcctccctcacc

SEQ ID NO: 4528647 - DNA, 10 bp, Homo sapiens
ctcctgtctt

SEQ ID NO: 4528648 - DNA, 14 bp, Homo sapiens
ctcctgtcttccca

SEQ ID NO: 4528649 - DNA, 19 bp, Homo sapiens
ctcctgtcttcccagggta

SEQ ID NO: 4528650 - DNA, 17 bp, Homo sapiens
ctcctgtgaatggaggc

SEQ ID NO: 4528651 - DNA, 20 bp, Homo sapiens
ctcctgtgaatggaggcaga

SEQ ID NO: 4528652 - DNA, 11 bp, Homo sapiens
ctcctgtgacc

SEQ ID NO: 4528653 - DNA, 16 bp, Homo sapiens
ctcctgtgcctggccc

SEQ ID NO: 4528654 - DNA, 17 bp, Homo sapiens
ctcctgtgcctggcccc

SEQ ID NO: 4528655 - DNA, 19 bp, Homo sapiens
ctcctgtgctcaccctctc

SEQ ID NO: 4528656 - DNA, 14 bp, Homo sapiens
ctcctgtgctctgg

SEQ ID NO: 4528657 - DNA, 21 bp, Homo sapiens
ctcctgtgctctggaggctgc

SEQ ID NO: 4528658 - DNA, 17 bp, Homo sapiens
ctcctgttgcacccagc

SEQ ID NO: 4528659 - DNA, 19 bp, Homo sapiens
ctcctgttgcacccagccc

SEQ ID NO: 4528660 - DNA, 13 bp, Homo sapiens
ctccttaaggctc

SEQ ID NO: 4528661 - DNA, 22 bp, Homo sapiens
ctccttagccctgtctgctagg

SEQ ID NO: 4528662 - DNA, 20 bp, Homo sapiens
ctccttatagacacttgctc

SEQ ID NO: 4528663 - DNA, 21 bp, Homo sapiens
ctccttcaacaattctaaaat

SEQ ID NO: 4528664 - DNA, 16 bp, Homo sapiens
ctccttcactctgaca

SEQ ID NO: 4528665 - DNA, 17 bp, Homo sapiens
ctccttcactctgacag

SEQ ID NO: 4528666 - DNA, 13 bp, Homo sapiens
ctccttcactgtt

SEQ ID NO: 4528667 - DNA, 15 bp, Homo sapiens
ctccttcactgtttc

SEQ ID NO: 4528668 - DNA, 20 bp, Homo sapiens
ctccttcagctctggggcag

SEQ ID NO: 4528669 - DNA, 12 bp, Homo sapiens
ctccctccaccc

SEQ ID NO: 4528670 - DNA, 15 bp, Homo sapiens
ctccctccaccccag

SEQ ID NO: 4528671 - DNA, 13 bp, Homo sapiens
ctccctccagctg

SEQ ID NO: 4528672 - DNA, 22 bp, Homo sapiens
ctccctccccacacctccctac

SEQ ID NO: 4528673 - DNA, 12 bp, Homo sapiens
ctccctccccag

SEQ ID NO: 4528674 - DNA, 21 bp, Homo sapiens
ctccctcctcacctctggact

SEQ ID NO: 4528675 - DNA, 15 bp, Homo sapiens
ctccctcctccaggc

SEQ ID NO: 4528676 - DNA, 16 bp, Homo sapiens
ctccctcctccaggcc

SEQ ID NO: 4528677 - DNA, 13 bp, Homo sapiens
ctccctctccaag

SEQ ID NO: 4528678 - DNA, 14 bp, Homo sapiens
ctccctctccaaga

SEQ ID NO: 4528679 - DNA, 19 bp, Homo sapiens
ctccctctccaagacagca

SEQ ID NO: 4528680 - DNA, 22 bp, Homo sapiens
ctccctctccaagacagcagca

SEQ ID NO: 4528681 - DNA, 20 bp, Homo sapiens
ctccctctctcttctgctcc

SEQ ID NO: 4528682 - DNA, 15 bp, Homo sapiens
ctccctctggccctg

SEQ ID NO: 4528683 - DNA, 19 bp, Homo sapiens
ctccctctggccctgcctt

SEQ ID NO: 4528684 - DNA, 20 bp, Homo sapiens
ctccctctggccctgccttc

SEQ ID NO: 4528685 - DNA, 22 bp, Homo sapiens
ctccctgaccttagcgttctgg

SEQ ID NO: 4528686 - DNA, 10 bp, Homo sapiens
ctccctgcct

SEQ ID NO: 4528687 - DNA, 13 bp, Homo sapiens
ctccctgcctgag

SEQ ID NO: 4528688 - DNA, 14 bp, Homo sapiens
ctccctgcctgctc

SEQ ID NO: 4528689 - DNA, 15 bp, Homo sapiens
ctccctgcctggccc

SEQ ID NO: 4528690 - DNA, 12 bp, Homo sapiens
ctccctgcctgt

SEQ ID NO: 4528691 - DNA, 18 bp, Homo sapiens
ctccctgctagcacagag

SEQ ID NO: 4528692 - DNA, 20 bp, Homo sapiens
ctccctgctagcacagaggc

SEQ ID NO: 4528693 - DNA, 23 bp, Homo sapiens
ctccctgctgtgccatgctgggc

SEQ ID NO: 4528694 - DNA, 11 bp, Homo sapiens
ctccctggctc

SEQ ID NO: 4528695 - DNA, 16 bp, Homo sapiens
ctccctggctccctcc

SEQ ID NO: 4528696 - DNA, 15 bp, Homo sapiens
ctccctggcttctgt

SEQ ID NO: 4528697 - DNA, 18 bp, Homo sapiens
ctccctggcttctgtggg

SEQ ID NO: 4528698 - DNA, 19 bp, Homo sapiens
ctccctgggacacagaccc

SEQ ID NO: 4528699 - DNA, 20 bp, Homo sapiens
ctccctggggttctctacag

SEQ ID NO: 4528700 - DNA, 15 bp, Homo sapiens
ctccctggtcccctc

SEQ ID NO: 4528701 - DNA, 16 bp, Homo sapiens
ctccctggtcccctcc

SEQ ID NO: 4528702 - DNA, 19 bp, Homo sapiens
ctccctgtaacctcttcag

SEQ ID NO: 4528703 - DNA, 11 bp, Homo sapiens
ctccctgtcct

SEQ ID NO: 4528704 - DNA, 13 bp, Homo sapiens
ctccctgtcctcc

SEQ ID NO: 4528705 - DNA, 15 bp, Homo sapiens
ctccctgtcctcctc

SEQ ID NO: 4528706 - DNA, 15 bp, Homo sapiens
ctccctgtctccagg

SEQ ID NO: 4528707 - DNA, 22 bp, Homo sapiens
ctccctgtggcactcagggagc

SEQ ID NO: 4528708 - DNA, 21 bp, Homo sapiens
ctccctgtgggggtggccatc

SEQ ID NO: 4528709 - DNA, 18 bp, Homo sapiens
ctccctgtgttctgggct

SEQ ID NO: 4528710 - DNA, 20 bp, Homo sapiens
ctccctgtgttctgggctgg

SEQ ID NO: 4528711 - DNA, 21 bp, Homo sapiens
ctccctgtgttctgggctggg

SEQ ID NO: 4528712 - DNA, 18 bp, Homo sapiens
ctcccttaagcagcaaca

SEQ ID NO: 4528713 - DNA, 17 bp, Homo sapiens
ctcccttaaggtctcca

SEQ ID NO: 4528714 - DNA, 19 bp, Homo sapiens
ctcccttccttttccctgc

SEQ ID NO: 4528715 - DNA, 15 bp, Homo sapiens
ctcccttctacctgc

SEQ ID NO: 4528716 - DNA, 18 bp, Homo sapiens
ctcccttctcatctcccc

SEQ ID NO: 4528717 - DNA, 19 bp, Homo sapiens
ctcccttctcgtgtttgct

SEQ ID NO: 4528718 - DNA, 21 bp, Homo sapiens
ctcccttctctacactcttgt

SEQ ID NO: 4528719 - DNA, 13 bp, Homo sapiens
ctcccttctgtag

SEQ ID NO: 4528720 - DNA, 19 bp, Homo sapiens
ctcccttggcccagagacg

SEQ ID NO: 4528721 - DNA, 14 bp, Homo sapiens
ctcccttgggctcc

SEQ ID NO: 4528722 - DNA, 14 bp, Homo sapiens
ctccctttctcagg

SEQ ID NO: 4528723 - DNA, 12 bp, Homo sapiens
ctccctttctcc

SEQ ID NO: 4528724 - DNA, 18 bp, Homo sapiens
ctccctttctctctcctc

SEQ ID NO: 4528725 - DNA, 15 bp, Homo sapiens
ctcccttttctcctc

SEQ ID NO: 4528726 - DNA, 15 bp, Homo sapiens
ctccgaagaaaagaa

SEQ ID NO: 4528727 - DNA, 19 bp, Homo sapiens
ctccgactctgcacccgcc

SEQ ID NO: 4528728 - DNA, 13 bp, Homo sapiens
ctccgaggccagt

SEQ ID NO: 4528729 - DNA, 23 bp, Homo sapiens
ctccgagtgaactggtcttcctt

SEQ ID NO: 4528730 - DNA, 18 bp, Homo sapiens
ctccgcatcacctcacca

SEQ ID NO: 4528731 - DNA, 15 bp, Homo sapiens
ctccgccagcctcct

SEQ ID NO: 4528732 - DNA, 18 bp, Homo sapiens
ctccgccagcctcctctg

SEQ ID NO: 4528733 - DNA, 13 bp, Homo sapiens
ctccgcctccaca

SEQ ID NO: 4528734 - DNA, 14 bp, Homo sapiens
ctccgcctcccggg

SEQ ID NO: 4528735 - DNA, 22 bp, Homo sapiens
ctccgcctgggtcatgggcctg

SEQ ID NO: 4528736 - DNA, 16 bp, Homo sapiens
ctccgcgccgatgcca

SEQ ID NO: 4528737 - DNA, 19 bp, Homo sapiens
ctccgcttgtccaagacag

SEQ ID NO: 4528738 - DNA, 13 bp, Homo sapiens
ctccggaggactg

SEQ ID NO: 4528739 - DNA, 19 bp, Homo sapiens
ctccggaggactgagcccc

SEQ ID NO: 4528740 - DNA, 19 bp, Homo sapiens
ctccggccatactgccttt

SEQ ID NO: 4528741 - DNA, 19 bp, Homo sapiens
ctccggccctccagagccc

SEQ ID NO: 4528742 - DNA, 18 bp, Homo sapiens
ctccggcctgggtgacag

SEQ ID NO: 4528743 - DNA, 23 bp, Homo sapiens
ctccggcgtcagcctccagcctc

SEQ ID NO: 4528744 - DNA, 17 bp, Homo sapiens
ctccggctgtgctggga

SEQ ID NO: 4528745 - DNA, 15 bp, Homo sapiens
ctccgggacctggtg

SEQ ID NO: 4528746 - DNA, 16 bp, Homo sapiens
ctccgggtgtggcctc

SEQ ID NO: 4528747 - DNA, 17 bp, Homo sapiens
ctccgggtgtggcctca

SEQ ID NO: 4528748 - DNA, 20 bp, Homo sapiens
ctccgggtgtggcctcagcc

SEQ ID NO: 4528749 - DNA, 21 bp, Homo sapiens
ctccgggtgtggcctcagccc

SEQ ID NO: 4528750 - DNA, 14 bp, Homo sapiens
ctccgtcaagctgg

SEQ ID NO: 4528751 - DNA, 18 bp, Homo sapiens
ctccgtcagcttctccca

SEQ ID NO: 4528752 - DNA, 22 bp, Homo sapiens
ctccgtcttagaagtggaccag

SEQ ID NO: 4528753 - DNA, 14 bp, Homo sapiens
ctccgtgtggagca

SEQ ID NO: 4528754 - DNA, 20 bp, Homo sapiens
ctccgtgtggagcacgtgga

SEQ ID NO: 4528755 - DNA, 13 bp, Homo sapiens
ctcctaccctccc

SEQ ID NO: 4528756 - DNA, 17 bp, Homo sapiens
ctcctaccctcccacca

SEQ ID NO: 4528757 - DNA, 18 bp, Homo sapiens
ctcctaccctcccaccag

SEQ ID NO: 4528758 - DNA, 13 bp, Homo sapiens
ctcctagaagaac

SEQ ID NO: 4528759 - DNA, 22 bp, Homo sapiens
ctcctagaagaaccaaatacct

SEQ ID NO: 4528760 - DNA, 13 bp, Homo sapiens
ctcctagaagtct

SEQ ID NO: 4528761 - DNA, 14 bp, Homo sapiens
ctcctagaagtctt

SEQ ID NO: 4528762 - DNA, 21 bp, Homo sapiens
ctcctagagaacgcagcccta

SEQ ID NO: 4528763 - DNA, 12 bp, Homo sapiens
ctcctagctctc

SEQ ID NO: 4528764 - DNA, 22 bp, Homo sapiens
ctcctaggacccgtctccagct

SEQ ID NO: 4528765 - DNA, 19 bp, Homo sapiens
ctcctagtgtttctttgtg

SEQ ID NO: 4528766 - DNA, 15 bp, Homo sapiens
ctcctatatatttct

SEQ ID NO: 4528767 - DNA, 13 bp, Homo sapiens
ctcctatctgtgt

SEQ ID NO: 4528768 - DNA, 13 bp, Homo sapiens
ctcctatggtcac

SEQ ID NO: 4528769 - DNA, 16 bp, Homo sapiens
ctcctcaaacccagtc

SEQ ID NO: 4528770 - DNA, 18 bp, Homo sapiens
ctcctcaccccgtctggg

SEQ ID NO: 4528771 - DNA, 15 bp, Homo sapiens
ctcctcacccttccc

SEQ ID NO: 4528772 - DNA, 17 bp, Homo sapiens
ctcctcacctcatgccc

SEQ ID NO: 4528773 - DNA, 13 bp, Homo sapiens
ctcctcacctctg

SEQ ID NO: 4528774 - DNA, 16 bp, Homo sapiens
ctcctcactcccttct

SEQ ID NO: 4528775 - DNA, 19 bp, Homo sapiens
ctcctcactgtatccaggt

SEQ ID NO: 4528776 - DNA, 17 bp, Homo sapiens
ctcctcagagcgccagg

SEQ ID NO: 4528777 - DNA, 16 bp, Homo sapiens
ctcctcagccagcctc

SEQ ID NO: 4528778 - DNA, 21 bp, Homo sapiens
ctcctcaggcacacagctact

SEQ ID NO: 4528779 - DNA, 23 bp, Homo sapiens
ctcctcaggcccagctgctcccc

SEQ ID NO: 4528780 - DNA, 11 bp, Homo sapiens
ctcctcagggt

SEQ ID NO: 4528781 - DNA, 16 bp, Homo sapiens
ctcctcagggtggggg

SEQ ID NO: 4528782 - DNA, 13 bp, Homo sapiens
ctcctcagtggct

SEQ ID NO: 4528783 - DNA, 19 bp, Homo sapiens
ctcctcagtggcttctcca

SEQ ID NO: 4528784 - DNA, 23 bp, Homo sapiens
ctcctcagtggcttctccaggga

SEQ ID NO: 4528785 - DNA, 16 bp, Homo sapiens
ctcctccactctcccc

SEQ ID NO: 4528786 - DNA, 17 bp, Homo sapiens
ctcctccaggcctgcct

SEQ ID NO: 4528787 - DNA, 23 bp, Homo sapiens
ctcctccaggcctgcctcccact

SEQ ID NO: 4528788 - DNA, 14 bp, Homo sapiens
ctcctccagggcca

SEQ ID NO: 4528789 - DNA, 20 bp, Homo sapiens
ctcctccagggccacgtgcc

SEQ ID NO: 4528790 - DNA, 14 bp, Homo sapiens
ctcccaacagtggg

SEQ ID NO: 4528791 - DNA, 14 bp, Homo sapiens
ctcccaacttcttc

SEQ ID NO: 4528792 - DNA, 16 bp, Homo sapiens
ctcccaacttcttcct

SEQ ID NO: 4528793 - DNA, 20 bp, Homo sapiens
ctcccaacttcttcctgtga

SEQ ID NO: 4528794 - DNA, 18 bp, Homo sapiens
ctcccaagcgttcctggc

SEQ ID NO: 4528795 - DNA, 22 bp, Homo sapiens
ctcccaagcgttcctggccttc

SEQ ID NO: 4528796 - DNA, 17 bp, Homo sapiens
ctcccaaggagaacaaa

SEQ ID NO: 4528797 - DNA, 22 bp, Homo sapiens
ctcccaagtagctgggattaca

SEQ ID NO: 4528798 - DNA, 13 bp, Homo sapiens
ctcccaagtggtg

SEQ ID NO: 4528799 - DNA, 18 bp, Homo sapiens
ctcccaagtggtgcctaa

SEQ ID NO: 4528800 - DNA, 15 bp, Homo sapiens
ctcccaatcagcttt

SEQ ID NO: 4528801 - DNA, 23 bp, Homo sapiens
ctcccacaccgcgtcccagctcc

SEQ ID NO: 4528802 - DNA, 12 bp, Homo sapiens
ctcccaccccac

SEQ ID NO: 4528803 - DNA, 11 bp, Homo sapiens
ctcccaccccc

SEQ ID NO: 4528804 - DNA, 13 bp, Homo sapiens
ctcccacccccag

SEQ ID NO: 4528805 - DNA, 16 bp, Homo sapiens
ctcccacccccagccc

SEQ ID NO: 4528806 - DNA, 18 bp, Homo sapiens
ctcccacccccttctctg

SEQ ID NO: 4528807 - DNA, 22 bp, Homo sapiens
ctcccacccccttctctgctcc

SEQ ID NO: 4528808 - DNA, 15 bp, Homo sapiens
ctcccacccggccac

SEQ ID NO: 4528809 - DNA, 19 bp, Homo sapiens
ctcccacccggccacagct

SEQ ID NO: 4528810 - DNA, 20 bp, Homo sapiens
ctcccacccggccacagctg

SEQ ID NO: 4528811 - DNA, 14 bp, Homo sapiens
ctcccacctggctc

SEQ ID NO: 4528812 - DNA, 22 bp, Homo sapiens
ctcccacctggctctgtggcga

SEQ ID NO: 4528813 - DNA, 18 bp, Homo sapiens
ctcccacctgtttctgga

SEQ ID NO: 4528814 - DNA, 21 bp, Homo sapiens
ctcccacgcctcaccagcccc

SEQ ID NO: 4528815 - DNA, 13 bp, Homo sapiens
ctcccagacaggc

SEQ ID NO: 4528816 - DNA, 22 bp, Homo sapiens
ctcccagagcttgttgtctcca

SEQ ID NO: 4528817 - DNA, 23 bp, Homo sapiens
ctcccagaggagccaccagttct

SEQ ID NO: 4528818 - DNA, 14 bp, Homo sapiens
ctcccagccaggcc

SEQ ID NO: 4528819 - DNA, 16 bp, Homo sapiens
ctcccagccaggccct

SEQ ID NO: 4528820 - DNA, 20 bp, Homo sapiens
ctcccagcccatctgaacac

SEQ ID NO: 4528821 - DNA, 15 bp, Homo sapiens
ctcccagctcctttc

SEQ ID NO: 4528822 - DNA, 18 bp, Homo sapiens
ctcccagctgtgctgtgg

SEQ ID NO: 4528823 - DNA, 20 bp, Homo sapiens
ctcccaggccccaggggaga

SEQ ID NO: 4528824 - DNA, 13 bp, Homo sapiens
ctcccaggggtct

SEQ ID NO: 4528825 - DNA, 21 bp, Homo sapiens
ctcccaggggtctccctggct

SEQ ID NO: 4528826 - DNA, 17 bp, Homo sapiens
ctcccagggtccctgcc

SEQ ID NO: 4528827 - DNA, 16 bp, Homo sapiens
ctcccaggtcccataa

SEQ ID NO: 4528828 - DNA, 16 bp, Homo sapiens
ctcccagtatgtttta

SEQ ID NO: 4528829 - DNA, 19 bp, Homo sapiens
ctcccagtctacccagaga

SEQ ID NO: 4528830 - DNA, 15 bp, Homo sapiens
ctcccagtgaactcc

SEQ ID NO: 4528831 - DNA, 18 bp, Homo sapiens
ctcccagtgaactcctgc

SEQ ID NO: 4528832 - DNA, 22 bp, Homo sapiens
ctcccagtgaactcctgccagg

SEQ ID NO: 4528833 - DNA, 16 bp, Homo sapiens
ctcccatagctgggac

SEQ ID NO: 4528834 - DNA, 17 bp, Homo sapiens
ctcccatgaagcctttt

SEQ ID NO: 4528835 - DNA, 16 bp, Homo sapiens
ctcccatgaccatact

SEQ ID NO: 4528836 - DNA, 22 bp, Homo sapiens
ctcccatgagggagatgccatg

SEQ ID NO: 4528837 - DNA, 24 bp, Homo sapiens
ctcccatgagggagatgccatgag

SEQ ID NO: 4528838 - DNA, 18 bp, Homo sapiens
ctcccatggagccccagc

SEQ ID NO: 4528839 - DNA, 19 bp, Homo sapiens
ctcccatggagccccagcc

SEQ ID NO: 4528840 - DNA, 14 bp, Homo sapiens
ctcccattgcccag

SEQ ID NO: 4528841 - DNA, 20 bp, Homo sapiens
ctcccattgcccagtgagcc

SEQ ID NO: 4528842 - DNA, 22 bp, Homo sapiens
ctcccattgcccagtgagccct

SEQ ID NO: 4528843 - DNA, 23 bp, Homo sapiens
ctccccaaagtgctgggattaca

SEQ ID NO: 4528844 - DNA, 21 bp, Homo sapiens
ctccccaacacctgcctctga

SEQ ID NO: 4528845 - DNA, 19 bp, Homo sapiens
ctccccaatccatgcttca

SEQ ID NO: 4528846 - DNA, 21 bp, Homo sapiens
ctccccacactaacctgggtt

SEQ ID NO: 4528847 - DNA, 19 bp, Homo sapiens
ctccccaccctcctcttgg

SEQ ID NO: 4528848 - DNA, 16 bp, Homo sapiens
ctccccacgagggctg

SEQ ID NO: 4528849 - DNA, 23 bp, Homo sapiens
ctccccacttcactttcttcaaa

SEQ ID NO: 4528850 - DNA, 23 bp, Homo sapiens
ctccccagaattcacgcctctcc

SEQ ID NO: 4528851 - DNA, 14 bp, Homo sapiens
ctccccagagctgg

SEQ ID NO: 4528852 - DNA, 15 bp, Homo sapiens
ctccccagccagccc

SEQ ID NO: 4528853 - DNA, 16 bp, Homo sapiens
ctccccagccagccct

SEQ ID NO: 4528854 - DNA, 21 bp, Homo sapiens
ctccccagccagcccttccct

SEQ ID NO: 4528855 - DNA, 15 bp, Homo sapiens
ctccccagccccagc

SEQ ID NO: 4528856 - DNA, 13 bp, Homo sapiens
ctccccagccccc

SEQ ID NO: 4528857 - DNA, 11 bp, Homo sapiens
ctccccagggg

SEQ ID NO: 4528858 - DNA, 21 bp, Homo sapiens
ctccccagtacaggggtgctg

SEQ ID NO: 4528859 - DNA, 13 bp, Homo sapiens
ctccccagtgcct

SEQ ID NO: 4528860 - DNA, 20 bp, Homo sapiens
ctccccagtgcctgccactc

SEQ ID NO: 4528861 - DNA, 22 bp, Homo sapiens
ctccccagtgcctgccactctc

SEQ ID NO: 4528862 - DNA, 17 bp, Homo sapiens
ctccccagttccacagc

SEQ ID NO: 4528863 - DNA, 21 bp, Homo sapiens
ctccccagttccacagcagtg

SEQ ID NO: 4528864 - DNA, 20 bp, Homo sapiens
ctccccatttcccatctgca

SEQ ID NO: 4528865 - DNA, 23 bp, Homo sapiens
ctcccccaacccccaccccacac

SEQ ID NO: 4528866 - DNA, 22 bp, Homo sapiens
ctcccccagttcctcccaggaa

SEQ ID NO: 4528867 - DNA, 23 bp, Homo sapiens
ctcccccctcctctgaaacagct

SEQ ID NO: 4528868 - DNA, 20 bp, Homo sapiens
ctcccccgtggtgcctgcac

SEQ ID NO: 4528869 - DNA, 22 bp, Homo sapiens
ctcccccgtttctccttttcct

SEQ ID NO: 4528870 - DNA, 12 bp, Homo sapiens
ctccccctcaga

SEQ ID NO: 4528871 - DNA, 15 bp, Homo sapiens
ctccccctcctccag

SEQ ID NO: 4528872 - DNA, 16 bp, Homo sapiens
ctccccctccttgtgc

SEQ ID NO: 4528873 - DNA, 13 bp, Homo sapiens
ctccccctgcaac

SEQ ID NO: 4528874 - DNA, 17 bp, Homo sapiens
ctccccctgccagtgcc

SEQ ID NO: 4528875 - DNA, 13 bp, Homo sapiens
ctccccctgcgcc

SEQ ID NO: 4528876 - DNA, 23 bp, Homo sapiens
ctcccccttccccttctgtgtca

SEQ ID NO: 4528877 - DNA, 22 bp, Homo sapiens
ctccccctttcacactggatcc

SEQ ID NO: 4528878 - DNA, 20 bp, Homo sapiens
ctccccgcagcccgcctgcc

SEQ ID NO: 4528879 - DNA, 15 bp, Homo sapiens
ctccccgcctccact

SEQ ID NO: 4528880 - DNA, 14 bp, Homo sapiens
ctccccgctctgga

SEQ ID NO: 4528881 - DNA, 23 bp, Homo sapiens
ctcccctatccacccagcccatt

SEQ ID NO: 4528882 - DNA, 14 bp, Homo sapiens
ctcccctattttaa

SEQ ID NO: 4528883 - DNA, 15 bp, Homo sapiens
ctcccctattttaag

SEQ ID NO: 4528884 - DNA, 13 bp, Homo sapiens
ctcccctctcctc

SEQ ID NO: 4528885 - DNA, 16 bp, Homo sapiens
ctcccctgcccccagg

SEQ ID NO: 4528886 - DNA, 20 bp, Homo sapiens
ctcccctgcccccaggactg

SEQ ID NO: 4528887 - DNA, 12 bp, Homo sapiens
ctcccctggctg

SEQ ID NO: 4528888 - DNA, 18 bp, Homo sapiens
ctcccctggctggctcct

SEQ ID NO: 4528889 - DNA, 20 bp, Homo sapiens
ctcccctggctggctcctag

SEQ ID NO: 4528890 - DNA, 13 bp, Homo sapiens
ctccccttcctgt

SEQ ID NO: 4528891 - DNA, 20 bp, Homo sapiens
ctcccgaaaaatgtgtggtt

SEQ ID NO: 4528892 - DNA, 19 bp, Homo sapiens
ctcccgccactcgccttct

SEQ ID NO: 4528893 - DNA, 14 bp, Homo sapiens
ctcccgccccgccc

SEQ ID NO: 4528894 - DNA, 18 bp, Homo sapiens
ctcccgccccgcccctcc

SEQ ID NO: 4528895 - DNA, 22 bp, Homo sapiens
ctcccgcccttccatgtgcctt

SEQ ID NO: 4528896 - DNA, 13 bp, Homo sapiens
ctcccgctcccag

SEQ ID NO: 4528897 - DNA, 15 bp, Homo sapiens
ctcccggggcctgga

SEQ ID NO: 4528898 - DNA, 19 bp, Homo sapiens
ctccctaaactttggcctt

SEQ ID NO: 4528899 - DNA, 18 bp, Homo sapiens
ctccctaatttatgtgct

SEQ ID NO: 4528900 - DNA, 13 bp, Homo sapiens
ctccctaccctaa

SEQ ID NO: 4528901 - DNA, 19 bp, Homo sapiens
ctccctcaccccctccttc

SEQ ID NO: 4528902 - DNA, 17 bp, Homo sapiens
ctccctcagacccagcg

SEQ ID NO: 4528903 - DNA, 12 bp, Homo sapiens
ctccctcagact

SEQ ID NO: 4528904 - DNA, 14 bp, Homo sapiens
ctccctcagactca

SEQ ID NO: 4528905 - DNA, 15 bp, Homo sapiens
ctccctcagactcag

SEQ ID NO: 4528906 - DNA, 17 bp, Homo sapiens
ctccctcagctctctgg

SEQ ID NO: 4528907 - DNA, 18 bp, Homo sapiens
ctccctcagctctctggg

SEQ ID NO: 4528908 - DNA, 10 bp, Homo sapiens
ctccctcagg

SEQ ID NO: 4528909 - DNA, 13 bp, Homo sapiens
ctccctcaggccc

SEQ ID NO: 4528910 - DNA, 13 bp, Homo sapiens
ctcattttttaaa

SEQ ID NO: 4528911 - DNA, 15 bp, Homo sapiens
ctccaaaacatttct

SEQ ID NO: 4528912 - DNA, 22 bp, Homo sapiens
ctccaaaatgttggtcatttta

SEQ ID NO: 4528913 - DNA, 13 bp, Homo sapiens
ctccaaagaaatg

SEQ ID NO: 4528914 - DNA, 20 bp, Homo sapiens
ctccaaagagccttcagaat

SEQ ID NO: 4528915 - DNA, 19 bp, Homo sapiens
ctccaaatccaaggaaaca

SEQ ID NO: 4528916 - DNA, 13 bp, Homo sapiens
ctccaaatgtcct

SEQ ID NO: 4528917 - DNA, 21 bp, Homo sapiens
ctccaacacagtgcatctcag

SEQ ID NO: 4528918 - DNA, 19 bp, Homo sapiens
ctccaagacagcagcagcc

SEQ ID NO: 4528919 - DNA, 20 bp, Homo sapiens
ctccaagacagcagcagcct

SEQ ID NO: 4528920 - DNA, 21 bp, Homo sapiens
ctccaagacagcagcagcctg

SEQ ID NO: 4528921 - DNA, 20 bp, Homo sapiens
ctccaagagctacataattt

SEQ ID NO: 4528922 - DNA, 16 bp, Homo sapiens
ctccaagcacagagcc

SEQ ID NO: 4528923 - DNA, 19 bp, Homo sapiens
ctccaagcacagagcctgg

SEQ ID NO: 4528924 - DNA, 14 bp, Homo sapiens
ctccaagcctgcct

SEQ ID NO: 4528925 - DNA, 18 bp, Homo sapiens
ctccaagcctgcctccca

SEQ ID NO: 4528926 - DNA, 19 bp, Homo sapiens
ctccaagcctgcctcccaa

SEQ ID NO: 4528927 - DNA, 22 bp, Homo sapiens
ctccaagtagtccaccttcatt

SEQ ID NO: 4528928 - DNA, 16 bp, Homo sapiens
ctccaagtctcagtgg

SEQ ID NO: 4528929 - DNA, 22 bp, Homo sapiens
ctccaataaagtgccttctggg

SEQ ID NO: 4528930 - DNA, 14 bp, Homo sapiens
ctccaatggaaagc

SEQ ID NO: 4528931 - DNA, 11 bp, Homo sapiens
ctccaatgtcg

SEQ ID NO: 4528932 - DNA, 18 bp, Homo sapiens
ctccaattctgaaatact

SEQ ID NO: 4528933 - DNA, 22 bp, Homo sapiens
ctccacacaggtgttccgtggg

SEQ ID NO: 4528934 - DNA, 16 bp, Homo sapiens
ctccacacgccccggt

SEQ ID NO: 4528935 - DNA, 17 bp, Homo sapiens
ctccacacgccccggtc

SEQ ID NO: 4528936 - DNA, 14 bp, Homo sapiens
ctccacactgacca

SEQ ID NO: 4528937 - DNA, 22 bp, Homo sapiens
ctccacactgaccaagtgctgg

SEQ ID NO: 4528938 - DNA, 14 bp, Homo sapiens
ctccacagagagga

SEQ ID NO: 4528939 - DNA, 22 bp, Homo sapiens
ctccacatcaacattccaggga

SEQ ID NO: 4528940 - DNA, 17 bp, Homo sapiens
ctccacatcctccacgt

SEQ ID NO: 4528941 - DNA, 17 bp, Homo sapiens
ctccacatctgccttaa

SEQ ID NO: 4528942 - DNA, 20 bp, Homo sapiens
ctccaccaacccatcagaag

SEQ ID NO: 4528943 - DNA, 16 bp, Homo sapiens
ctccaccacccaaaag

SEQ ID NO: 4528944 - DNA, 15 bp, Homo sapiens
ctccaccagcagcat

SEQ ID NO: 4528945 - DNA, 11 bp, Homo sapiens
ctccaccccag

SEQ ID NO: 4528946 - DNA, 13 bp, Homo sapiens
ctccaccctctga

SEQ ID NO: 4528947 - DNA, 17 bp, Homo sapiens
ctccacccttggcctgt

SEQ ID NO: 4528948 - DNA, 12 bp, Homo sapiens
ctccacctcagc

SEQ ID NO: 4528949 - DNA, 16 bp, Homo sapiens
ctccacgcctcctggc

SEQ ID NO: 4528950 - DNA, 21 bp, Homo sapiens
ctccacgcctcctggccagac

SEQ ID NO: 4528951 - DNA, 13 bp, Homo sapiens
ctccactccttcc

SEQ ID NO: 4528952 - DNA, 20 bp, Homo sapiens
ctccactctagttctagatg

SEQ ID NO: 4528953 - DNA, 16 bp, Homo sapiens
ctccactctcccccac

SEQ ID NO: 4528954 - DNA, 24 bp, Homo sapiens
ctccactcttgatctctcttgtcc

SEQ ID NO: 4528955 - DNA, 11 bp, Homo sapiens
ctccactgctg

SEQ ID NO: 4528956 - DNA, 12 bp, Homo sapiens
ctccactgctgg

SEQ ID NO: 4528957 - DNA, 18 bp, Homo sapiens
ctccagaagcctctggct

SEQ ID NO: 4528958 - DNA, 19 bp, Homo sapiens
ctccagaagcctctggcta

SEQ ID NO: 4528959 - DNA, 13 bp, Homo sapiens
ctccagagacact

SEQ ID NO: 4528960 - DNA, 23 bp, Homo sapiens
ctccagcaccttctttctggact

SEQ ID NO: 4528961 - DNA, 13 bp, Homo sapiens
ctccagccagcgc

SEQ ID NO: 4528962 - DNA, 20 bp, Homo sapiens
ctccagccagcgcctccctc

SEQ ID NO: 4528963 - DNA, 22 bp, Homo sapiens
ctccagccagcgcctccctcca

SEQ ID NO: 4528964 - DNA, 16 bp, Homo sapiens
ctccagcctcccctcc

SEQ ID NO: 4528965 - DNA, 14 bp, Homo sapiens
ctccagcctctgcc

SEQ ID NO: 4528966 - DNA, 15 bp, Homo sapiens
ctccagcctctgccg

SEQ ID NO: 4528967 - DNA, 17 bp, Homo sapiens
ctccagcctctgccgct

SEQ ID NO: 4528968 - DNA, 23 bp, Homo sapiens
ctccagcctgggcaacaagagca

SEQ ID NO: 4528969 - DNA, 16 bp, Homo sapiens
ctccagcctgggggac

SEQ ID NO: 4528970 - DNA, 21 bp, Homo sapiens
ctccagcctgggtcacagagt

SEQ ID NO: 4528971 - DNA, 23 bp, Homo sapiens
ctccagcgatggtgctgcccagg

SEQ ID NO: 4528972 - DNA, 21 bp, Homo sapiens
ctccagctcgtgtgtcctcat

SEQ ID NO: 4528973 - DNA, 16 bp, Homo sapiens
ctccagctctggcaca

SEQ ID NO: 4528974 - DNA, 13 bp, Homo sapiens
ctccagctgcccc

SEQ ID NO: 4528975 - DNA, 12 bp, Homo sapiens
ctccagctgcga

SEQ ID NO: 4528976 - DNA, 21 bp, Homo sapiens
ctccagctgctgagatcctgg

SEQ ID NO: 4528977 - DNA, 23 bp, Homo sapiens
ctccagctgctgagatcctggac

SEQ ID NO: 4528978 - DNA, 16 bp, Homo sapiens
ctccaggaaagagcag

SEQ ID NO: 4528979 - DNA, 20 bp, Homo sapiens
ctccaggaaagagcagtcag

SEQ ID NO: 4528980 - DNA, 15 bp, Homo sapiens
ctccaggaagaaaga

SEQ ID NO: 4528981 - DNA, 15 bp, Homo sapiens
ctccaggatctttga

SEQ ID NO: 4528982 - DNA, 22 bp, Homo sapiens
ctccaggatctttgactgaaaa

SEQ ID NO: 4528983 - DNA, 18 bp, Homo sapiens
ctccaggattttaatttc

SEQ ID NO: 4528984 - DNA, 20 bp, Homo sapiens
ctccaggcatttagccctca

SEQ ID NO: 4528985 - DNA, 11 bp, Homo sapiens
ctccaggccca

SEQ ID NO: 4528986 - DNA, 12 bp, Homo sapiens
ctccaggcccaa

SEQ ID NO: 4528987 - DNA, 17 bp, Homo sapiens
ctccaggcccaaggctc

SEQ ID NO: 4528988 - DNA, 16 bp, Homo sapiens
ctccaggcccccaact

SEQ ID NO: 4528989 - DNA, 13 bp, Homo sapiens
ctccaggcctgcc

SEQ ID NO: 4528990 - DNA, 22 bp, Homo sapiens
ctccagggaaggtggccacagc

SEQ ID NO: 4528991 - DNA, 22 bp, Homo sapiens
ctccagggatgattcaagccat

SEQ ID NO: 4528992 - DNA, 18 bp, Homo sapiens
ctccagggccacgtgcca

SEQ ID NO: 4528993 - DNA, 19 bp, Homo sapiens
ctccagggccacgtgccag

SEQ ID NO: 4528994 - DNA, 18 bp, Homo sapiens
ctccagggcccccaccga

SEQ ID NO: 4528995 - DNA, 21 bp, Homo sapiens
ctccagggcctctccttggaa

SEQ ID NO: 4528996 - DNA, 23 bp, Homo sapiens
ctccagggcctctccttggaagg

SEQ ID NO: 4528997 - DNA, 17 bp, Homo sapiens
ctccagggctggactga

SEQ ID NO: 4528998 - DNA, 18 bp, Homo sapiens
ctccagggctggactgag

SEQ ID NO: 4528999 - DNA, 14 bp, Homo sapiens
ctccaggggcacct

SEQ ID NO: 4529000 - DNA, 19 bp, Homo sapiens
ctccaggggggacaatatg

SEQ ID NO: 4529001 - DNA, 16 bp, Homo sapiens
ctccagtcatggtact

SEQ ID NO: 4529002 - DNA, 12 bp, Homo sapiens
ctccagtgcagt

SEQ ID NO: 4529003 - DNA, 13 bp, Homo sapiens
ctccagtgcagtc

SEQ ID NO: 4529004 - DNA, 22 bp, Homo sapiens
ctccagtgggctgatgctggga

SEQ ID NO: 4529005 - DNA, 21 bp, Homo sapiens
ctccagtttttgtttttgcat

SEQ ID NO: 4529006 - DNA, 14 bp, Homo sapiens
ctccatacagcctc

SEQ ID NO: 4529007 - DNA, 18 bp, Homo sapiens
ctccataccttttctctt

SEQ ID NO: 4529008 - DNA, 19 bp, Homo sapiens
ctccatactgggctaagga

SEQ ID NO: 4529009 - DNA, 20 bp, Homo sapiens
ctccatatctccatggccct

SEQ ID NO: 4529010 - DNA, 16 bp, Homo sapiens
ctccatcagaaaacca

SEQ ID NO: 4529011 - DNA, 20 bp, Homo sapiens
ctccatccacatgggagccg

SEQ ID NO: 4529012 - DNA, 14 bp, Homo sapiens
ctccatcccctccc

SEQ ID NO: 4529013 - DNA, 19 bp, Homo sapiens
ctccatcccctccctgcct

SEQ ID NO: 4529014 - DNA, 23 bp, Homo sapiens
ctccatcccctccctgcctgctc

SEQ ID NO: 4529015 - DNA, 23 bp, Homo sapiens
ctccatcctaccccctgtgcctt

SEQ ID NO: 4529016 - DNA, 13 bp, Homo sapiens
ctccatcctgctg

SEQ ID NO: 4529017 - DNA, 17 bp, Homo sapiens
ctccatctccgcctcca

SEQ ID NO: 4529018 - DNA, 19 bp, Homo sapiens
ctccatctccgcctccaca

SEQ ID NO: 4529019 - DNA, 20 bp, Homo sapiens
ctccatcttggtagttctgt

SEQ ID NO: 4529020 - DNA, 22 bp, Homo sapiens
ctccatcttggtagttctgtgc

SEQ ID NO: 4529021 - DNA, 14 bp, Homo sapiens
ctccatgctcctca

SEQ ID NO: 4529022 - DNA, 17 bp, Homo sapiens
ctccatggggttcgaga

SEQ ID NO: 4529023 - DNA, 23 bp, Homo sapiens
ctccatggggttcgagactccat

SEQ ID NO: 4529024 - DNA, 14 bp, Homo sapiens
ctccatgtgtgtgc

SEQ ID NO: 4529025 - DNA, 17 bp, Homo sapiens
ctccattctattttaga

SEQ ID NO: 4529026 - DNA, 20 bp, Homo sapiens
ctcccaaacgccctttcctc

SEQ ID NO: 4529027 - DNA, 17 bp, Homo sapiens
ctcccaaagctcagact

SEQ ID NO: 4529028 - DNA, 15 bp, Homo sapiens
ctcccaaagtgctga

SEQ ID NO: 4529029 - DNA, 22 bp, Homo sapiens
ctcccaaagtgttgggattaca

SEQ ID NO: 4529030 - DNA, 15 bp, Homo sapiens
ctcaggcacacagct

SEQ ID NO: 4529031 - DNA, 13 bp, Homo sapiens
ctcaggcccagga

SEQ ID NO: 4529032 - DNA, 19 bp, Homo sapiens
ctcaggcccaggagtccag

SEQ ID NO: 4529033 - DNA, 12 bp, Homo sapiens
ctcaggccgaga

SEQ ID NO: 4529034 - DNA, 20 bp, Homo sapiens
ctcaggctcctaaagagaca

SEQ ID NO: 4529035 - DNA, 20 bp, Homo sapiens
ctcagggacagagacacctg

SEQ ID NO: 4529036 - DNA, 23 bp, Homo sapiens
ctcagggacagagacacctgcac

SEQ ID NO: 4529037 - DNA, 21 bp, Homo sapiens
ctcagggaccggtgctgcagg

SEQ ID NO: 4529038 - DNA, 23 bp, Homo sapiens
ctcagggaccggtgctgcaggag

SEQ ID NO: 4529039 - DNA, 18 bp, Homo sapiens
ctcagggagcagggaagg

SEQ ID NO: 4529040 - DNA, 21 bp, Homo sapiens
ctcagggagcagggaaggcct

SEQ ID NO: 4529041 - DNA, 22 bp, Homo sapiens
ctcagggagcagggaaggcctg

SEQ ID NO: 4529042 - DNA, 14 bp, Homo sapiens
ctcagggagcctcc

SEQ ID NO: 4529043 - DNA, 15 bp, Homo sapiens
ctcagggagcctccc

SEQ ID NO: 4529044 - DNA, 18 bp, Homo sapiens
ctcagggattctgggctt

SEQ ID NO: 4529045 - DNA, 17 bp, Homo sapiens
ctcagggcctcaggcac

SEQ ID NO: 4529046 - DNA, 18 bp, Homo sapiens
ctcagggcctcaggcacc

SEQ ID NO: 4529047 - DNA, 14 bp, Homo sapiens
ctcagggctcctgg

SEQ ID NO: 4529048 - DNA, 17 bp, Homo sapiens
ctcagggctcctgggtt

SEQ ID NO: 4529049 - DNA, 13 bp, Homo sapiens
ctcagggctgtcc

SEQ ID NO: 4529050 - DNA, 22 bp, Homo sapiens
ctcagggctgtcccagccccgg

SEQ ID NO: 4529051 - DNA, 14 bp, Homo sapiens
ctcaggggcctctc

SEQ ID NO: 4529052 - DNA, 13 bp, Homo sapiens
ctcagggtggggg

SEQ ID NO: 4529053 - DNA, 12 bp, Homo sapiens
ctcaggttccag

SEQ ID NO: 4529054 - DNA, 13 bp, Homo sapiens
ctcaggttccaga

SEQ ID NO: 4529055 - DNA, 14 bp, Homo sapiens
ctcaggttccagaa

SEQ ID NO: 4529056 - DNA, 16 bp, Homo sapiens
ctcaggttccagaaca

SEQ ID NO: 4529057 - DNA, 17 bp, Homo sapiens
ctcaggtttttgaggaa

SEQ ID NO: 4529058 - DNA, 18 bp, Homo sapiens
ctcagtaatttagaaatc

SEQ ID NO: 4529059 - DNA, 17 bp, Homo sapiens
ctcagtacccagaacag

SEQ ID NO: 4529060 - DNA, 18 bp, Homo sapiens
ctcagtcattagactcct

SEQ ID NO: 4529061 - DNA, 14 bp, Homo sapiens
ctcagtctctgagc

SEQ ID NO: 4529062 - DNA, 21 bp, Homo sapiens
ctcagtctgttcactgcattc

SEQ ID NO: 4529063 - DNA, 15 bp, Homo sapiens
ctcagtgaagaatac

SEQ ID NO: 4529064 - DNA, 14 bp, Homo sapiens
ctcagtgaccagtg

SEQ ID NO: 4529065 - DNA, 15 bp, Homo sapiens
ctcagtgagcctcct

SEQ ID NO: 4529066 - DNA, 17 bp, Homo sapiens
ctcagtgagcctcctgt

SEQ ID NO: 4529067 - DNA, 18 bp, Homo sapiens
ctcagtgagcctcctgtg

SEQ ID NO: 4529068 - DNA, 22 bp, Homo sapiens
ctcagtgcatttgtgctagaaa

SEQ ID NO: 4529069 - DNA, 12 bp, Homo sapiens
ctcagtgctcct

SEQ ID NO: 4529070 - DNA, 14 bp, Homo sapiens
ctcagtgctcctgg

SEQ ID NO: 4529071 - DNA, 21 bp, Homo sapiens
ctcagtggcttcatctgtcaa

SEQ ID NO: 4529072 - DNA, 13 bp, Homo sapiens
ctcagtggcttct

SEQ ID NO: 4529073 - DNA, 16 bp, Homo sapiens
ctcagtggcttctcca

SEQ ID NO: 4529074 - DNA, 21 bp, Homo sapiens
ctcagttcaacctggtggcac

SEQ ID NO: 4529075 - DNA, 22 bp, Homo sapiens
ctcagttcaacctggtggcacc

SEQ ID NO: 4529076 - DNA, 15 bp, Homo sapiens
ctcagttcccttggc

SEQ ID NO: 4529077 - DNA, 22 bp, Homo sapiens
ctcagttcccttggcctcagaa

SEQ ID NO: 4529078 - DNA, 13 bp, Homo sapiens
ctcagttccttca

SEQ ID NO: 4529079 - DNA, 14 bp, Homo sapiens
ctcagttttcataa

SEQ ID NO: 4529080 - DNA, 15 bp, Homo sapiens
ctcataagcatatgt

SEQ ID NO: 4529081 - DNA, 21 bp, Homo sapiens
ctcataattcctacagcacta

SEQ ID NO: 4529082 - DNA, 21 bp, Homo sapiens
ctcatactacattgagtagac

SEQ ID NO: 4529083 - DNA, 15 bp, Homo sapiens
ctcataggttaaaaa

SEQ ID NO: 4529084 - DNA, 16 bp, Homo sapiens
ctcataggttgagcaa

SEQ ID NO: 4529085 - DNA, 19 bp, Homo sapiens
ctcatattgtgattctgcc

SEQ ID NO: 4529086 - DNA, 13 bp, Homo sapiens
ctcatcaactgaa

SEQ ID NO: 4529087 - DNA, 17 bp, Homo sapiens
ctcatcacataaagaaa

SEQ ID NO: 4529088 - DNA, 16 bp, Homo sapiens
ctcatcacccttccga

SEQ ID NO: 4529089 - DNA, 14 bp, Homo sapiens
ctcatcatattttg

SEQ ID NO: 4529090 - DNA, 17 bp, Homo sapiens
ctcatcatgtctattgt

SEQ ID NO: 4529091 - DNA, 14 bp, Homo sapiens
ctcatcattctctg

SEQ ID NO: 4529092 - DNA, 13 bp, Homo sapiens
ctcatcatttttt

SEQ ID NO: 4529093 - DNA, 15 bp, Homo sapiens
ctcatccagcctcag

SEQ ID NO: 4529094 - DNA, 16 bp, Homo sapiens
ctcatccatcatcatg

SEQ ID NO: 4529095 - DNA, 13 bp, Homo sapiens
ctcatccccaggg

SEQ ID NO: 4529096 - DNA, 14 bp, Homo sapiens
ctcatccctggact

SEQ ID NO: 4529097 - DNA, 13 bp, Homo sapiens
ctcatcctcccat

SEQ ID NO: 4529098 - DNA, 22 bp, Homo sapiens
ctcatcctcccattgcccagtg

SEQ ID NO: 4529099 - DNA, 23 bp, Homo sapiens
ctcatcctcccattgcccagtga

SEQ ID NO: 4529100 - DNA, 18 bp, Homo sapiens
ctcatcctgatttttact

SEQ ID NO: 4529101 - DNA, 14 bp, Homo sapiens
ctcatcctgctctt

SEQ ID NO: 4529102 - DNA, 16 bp, Homo sapiens
ctcatcctgctctttt

SEQ ID NO: 4529103 - DNA, 23 bp, Homo sapiens
ctcatcctgctcttttgtgatga

SEQ ID NO: 4529104 - DNA, 24 bp, Homo sapiens
ctcatcctgctcttttgtgatgaa

SEQ ID NO: 4529105 - DNA, 16 bp, Homo sapiens
ctcatctcagaccctg

SEQ ID NO: 4529106 - DNA, 14 bp, Homo sapiens
ctcatctcccaggc

SEQ ID NO: 4529107 - DNA, 15 bp, Homo sapiens
ctcatctcccaggcc

SEQ ID NO: 4529108 - DNA, 16 bp, Homo sapiens
ctcatctcccaggccc

SEQ ID NO: 4529109 - DNA, 22 bp, Homo sapiens
ctcatctcttagctcccctcca

SEQ ID NO: 4529110 - DNA, 13 bp, Homo sapiens
ctcatctgcaaaa

SEQ ID NO: 4529111 - DNA, 18 bp, Homo sapiens
ctcatctgcaggacagag

SEQ ID NO: 4529112 - DNA, 18 bp, Homo sapiens
ctcatcttagttctgtat

SEQ ID NO: 4529113 - DNA, 14 bp, Homo sapiens
ctcatcttgtgaaa

SEQ ID NO: 4529114 - DNA, 14 bp, Homo sapiens
ctcatctttctcct

SEQ ID NO: 4529115 - DNA, 12 bp, Homo sapiens
ctcatctttctt

SEQ ID NO: 4529116 - DNA, 14 bp, Homo sapiens
ctcatgactttata

SEQ ID NO: 4529117 - DNA, 21 bp, Homo sapiens
ctcatgagctgtgttcacaga

SEQ ID NO: 4529118 - DNA, 18 bp, Homo sapiens
ctcatgagtgtgccccat

SEQ ID NO: 4529119 - DNA, 16 bp, Homo sapiens
ctcatgatcaagatat

SEQ ID NO: 4529120 - DNA, 22 bp, Homo sapiens
ctcatgatcaagatatatgtgt

SEQ ID NO: 4529121 - DNA, 18 bp, Homo sapiens
ctcatgcacccctgagcc

SEQ ID NO: 4529122 - DNA, 18 bp, Homo sapiens
ctcatgccagtgccttat

SEQ ID NO: 4529123 - DNA, 17 bp, Homo sapiens
ctcatgccccctttcag

SEQ ID NO: 4529124 - DNA, 18 bp, Homo sapiens
ctcatgcgtacgtcccac

SEQ ID NO: 4529125 - DNA, 15 bp, Homo sapiens
ctcatgctaatataa

SEQ ID NO: 4529126 - DNA, 14 bp, Homo sapiens
ctcatgctgttgct

SEQ ID NO: 4529127 - DNA, 22 bp, Homo sapiens
ctcatgggtcctagcccttccc

SEQ ID NO: 4529128 - DNA, 14 bp, Homo sapiens
ctcatgggtggcac

SEQ ID NO: 4529129 - DNA, 14 bp, Homo sapiens
ctcatgtgactctt

SEQ ID NO: 4529130 - DNA, 15 bp, Homo sapiens
ctcatgtttacaggg

SEQ ID NO: 4529131 - DNA, 19 bp, Homo sapiens
ctcattaaactctaaagat

SEQ ID NO: 4529132 - DNA, 20 bp, Homo sapiens
ctcattaaactctaaagatt

SEQ ID NO: 4529133 - DNA, 19 bp, Homo sapiens
ctcattagaattaccattt

SEQ ID NO: 4529134 - DNA, 17 bp, Homo sapiens
ctcattaggatggctag

SEQ ID NO: 4529135 - DNA, 17 bp, Homo sapiens
ctcattatttcaaaatg

SEQ ID NO: 4529136 - DNA, 17 bp, Homo sapiens
ctcattccagaggaagg

SEQ ID NO: 4529137 - DNA, 12 bp, Homo sapiens
ctcattccagat

SEQ ID NO: 4529138 - DNA, 12 bp, Homo sapiens
ctcattccccag

SEQ ID NO: 4529139 - DNA, 17 bp, Homo sapiens
ctcattccccattctgt

SEQ ID NO: 4529140 - DNA, 15 bp, Homo sapiens
ctcattgaaatgtaa

SEQ ID NO: 4529141 - DNA, 23 bp, Homo sapiens
ctcattgaaatgtaatttcagtt

SEQ ID NO: 4529142 - DNA, 21 bp, Homo sapiens
ctcattgagaattcaaatcct

SEQ ID NO: 4529143 - DNA, 13 bp, Homo sapiens
ctcattggaccct

SEQ ID NO: 4529144 - DNA, 15 bp, Homo sapiens
ctcattgtttttccc

SEQ ID NO: 4529145 - DNA, 14 bp, Homo sapiens
ctcatttaaatatc

SEQ ID NO: 4529146 - DNA, 14 bp, Homo sapiens
ctcatttcacccct

SEQ ID NO: 4529147 - DNA, 17 bp, Homo sapiens
ctcatttcacccctccc

SEQ ID NO: 4529148 - DNA, 13 bp, Homo sapiens
ctcatttcatctc

SEQ ID NO: 4529149 - DNA, 16 bp, Homo sapiens
ctcatttcatctcatt

SEQ ID NO: 4529150 - DNA, 15 bp, Homo sapiens
ctcattttaatgtaa

SEQ ID NO: 4529151 - DNA, 16 bp, Homo sapiens
ctcattttagttgcct

SEQ ID NO: 4529152 - DNA, 15 bp, Homo sapiens
ctcactcctccgtga

SEQ ID NO: 4529153 - DNA, 14 bp, Homo sapiens
ctcactcctgagac

SEQ ID NO: 4529154 - DNA, 20 bp, Homo sapiens
ctcactcctgagacccctgg

SEQ ID NO: 4529155 - DNA, 22 bp, Homo sapiens
ctcactcctgagacccctggcc

SEQ ID NO: 4529156 - DNA, 23 bp, Homo sapiens
ctcactctgtccctgtccttccc

SEQ ID NO: 4529157 - DNA, 22 bp, Homo sapiens
ctcactgcatcctctgcctccc

SEQ ID NO: 4529158 - DNA, 14 bp, Homo sapiens
ctcactgccaggcc

SEQ ID NO: 4529159 - DNA, 22 bp, Homo sapiens
ctcactgccaggccagcctccg

SEQ ID NO: 4529160 - DNA, 16 bp, Homo sapiens
ctcactgcttgaacta

SEQ ID NO: 4529161 - DNA, 18 bp, Homo sapiens
ctcactgcttgaactagg

SEQ ID NO: 4529162 - DNA, 19 bp, Homo sapiens
ctcactgggcccgagcctg

SEQ ID NO: 4529163 - DNA, 22 bp, Homo sapiens
ctcactgtccaatatgaaaacc

SEQ ID NO: 4529164 - DNA, 20 bp, Homo sapiens
ctcactgtctatttaagtgc

SEQ ID NO: 4529165 - DNA, 23 bp, Homo sapiens
ctcactgtgggaaggccagctgc

SEQ ID NO: 4529166 - DNA, 19 bp, Homo sapiens
ctcactgtgtataggaatt

SEQ ID NO: 4529167 - DNA, 16 bp, Homo sapiens
ctcactgtttataaat

SEQ ID NO: 4529168 - DNA, 14 bp, Homo sapiens
ctcacttagtcctt

SEQ ID NO: 4529169 - DNA, 15 bp, Homo sapiens
ctcacttatctgata

SEQ ID NO: 4529170 - DNA, 16 bp, Homo sapiens
ctcacttatctgatac

SEQ ID NO: 4529171 - DNA, 17 bp, Homo sapiens
ctcacttcgcttcctgg

SEQ ID NO: 4529172 - DNA, 13 bp, Homo sapiens
ctcacttctaaat

SEQ ID NO: 4529173 - DNA, 24 bp, Homo sapiens
ctcacttctagatctcagccattc

SEQ ID NO: 4529174 - DNA, 20 bp, Homo sapiens
ctcacttctgggcttcatct

SEQ ID NO: 4529175 - DNA, 16 bp, Homo sapiens
ctcactttactttcaa

SEQ ID NO: 4529176 - DNA, 17 bp, Homo sapiens
ctcactttactttcaag

SEQ ID NO: 4529177 - DNA, 20 bp, Homo sapiens
ctcactttcctcctgaggct

SEQ ID NO: 4529178 - DNA, 15 bp, Homo sapiens
ctcactttgtaaata

SEQ ID NO: 4529179 - DNA, 22 bp, Homo sapiens
ctcagaaagatttgatgggcca

SEQ ID NO: 4529180 - DNA, 17 bp, Homo sapiens
ctcagaaatctgtttga

SEQ ID NO: 4529181 - DNA, 15 bp, Homo sapiens
ctcagaaggccccag

SEQ ID NO: 4529182 - DNA, 20 bp, Homo sapiens
ctcagaaggccccagagaga

SEQ ID NO: 4529183 - DNA, 20 bp, Homo sapiens
ctcagaattcggtgtgctgc

SEQ ID NO: 4529184 - DNA, 14 bp, Homo sapiens
ctcagacatttata

SEQ ID NO: 4529185 - DNA, 14 bp, Homo sapiens
ctcagacccaacag

SEQ ID NO: 4529186 - DNA, 11 bp, Homo sapiens
ctcagacccag

SEQ ID NO: 4529187 - DNA, 23 bp, Homo sapiens
ctcagacccagcggtccaatgcc

SEQ ID NO: 4529188 - DNA, 12 bp, Homo sapiens
ctcagacccagg

SEQ ID NO: 4529189 - DNA, 13 bp, Homo sapiens
ctcagacccagga

SEQ ID NO: 4529190 - DNA, 18 bp, Homo sapiens
ctcagacccaggagtcca

SEQ ID NO: 4529191 - DNA, 22 bp, Homo sapiens
ctcagacccaggagtccagacc

SEQ ID NO: 4529192 - DNA, 20 bp, Homo sapiens
ctcagacccaggggtccagg

SEQ ID NO: 4529193 - DNA, 13 bp, Homo sapiens
ctcagacccccac

SEQ ID NO: 4529194 - DNA, 16 bp, Homo sapiens
ctcagacccccactct

SEQ ID NO: 4529195 - DNA, 19 bp, Homo sapiens
ctcagacgggctgagagga

SEQ ID NO: 4529196 - DNA, 19 bp, Homo sapiens
ctcagacgtgtgacctcca

SEQ ID NO: 4529197 - DNA, 17 bp, Homo sapiens
ctcagacgttgcctgag

SEQ ID NO: 4529198 - DNA, 22 bp, Homo sapiens
ctcagacgttgcctgagaagaa

SEQ ID NO: 4529199 - DNA, 14 bp, Homo sapiens
ctcagactcagagg

SEQ ID NO: 4529200 - DNA, 20 bp, Homo sapiens
ctcagagatgtgcacccatg

SEQ ID NO: 4529201 - DNA, 19 bp, Homo sapiens
ctcagagcgccaggaagcc

SEQ ID NO: 4529202 - DNA, 22 bp, Homo sapiens
ctcagagcgccaggaagccaga

SEQ ID NO: 4529203 - DNA, 11 bp, Homo sapiens
ctcagagcttt

SEQ ID NO: 4529204 - DNA, 22 bp, Homo sapiens
ctcagaggcctgctgccagtgc

SEQ ID NO: 4529205 - DNA, 17 bp, Homo sapiens
ctcagaggtccaggccc

SEQ ID NO: 4529206 - DNA, 22 bp, Homo sapiens
ctcagattcttcattgaggatt

SEQ ID NO: 4529207 - DNA, 22 bp, Homo sapiens
ctcagcaactgttagctgggaa

SEQ ID NO: 4529208 - DNA, 22 bp, Homo sapiens
ctcagcacattcgggaccaata

SEQ ID NO: 4529209 - DNA, 19 bp, Homo sapiens
ctcagcagcagagagccct

SEQ ID NO: 4529210 - DNA, 14 bp, Homo sapiens
ctcagcagccctcc

SEQ ID NO: 4529211 - DNA, 21 bp, Homo sapiens
ctcagcagccctcctcacccc

SEQ ID NO: 4529212 - DNA, 19 bp, Homo sapiens
ctcagcagcgaccacccct

SEQ ID NO: 4529213 - DNA, 20 bp, Homo sapiens
ctcagcagcgaccacccctg

SEQ ID NO: 4529214 - DNA, 13 bp, Homo sapiens
ctcagcagctctg

SEQ ID NO: 4529215 - DNA, 14 bp, Homo sapiens
ctcagcagctctgg

SEQ ID NO: 4529216 - DNA, 22 bp, Homo sapiens
ctcagcagctctggctctgcct

SEQ ID NO: 4529217 - DNA, 12 bp, Homo sapiens
ctcagcagggca

SEQ ID NO: 4529218 - DNA, 17 bp, Homo sapiens
ctcagccaaatttcctg

SEQ ID NO: 4529219 - DNA, 14 bp, Homo sapiens
ctcagccacaaagc

SEQ ID NO: 4529220 - DNA, 21 bp, Homo sapiens
ctcagccacaaagccccccag

SEQ ID NO: 4529221 - DNA, 19 bp, Homo sapiens
ctcagccactgtcacaggc

SEQ ID NO: 4529222 - DNA, 21 bp, Homo sapiens
ctcagccactgtcacaggcat

SEQ ID NO: 4529223 - DNA, 13 bp, Homo sapiens
ctcagccagcctc

SEQ ID NO: 4529224 - DNA, 11 bp, Homo sapiens
ctcagccaggc

SEQ ID NO: 4529225 - DNA, 13 bp, Homo sapiens
ctcagccaggccc

SEQ ID NO: 4529226 - DNA, 15 bp, Homo sapiens
ctcagccaggccctg

SEQ ID NO: 4529227 - DNA, 17 bp, Homo sapiens
ctcagccccaactcttt

SEQ ID NO: 4529228 - DNA, 14 bp, Homo sapiens
ctcagccccagccc

SEQ ID NO: 4529229 - DNA, 17 bp, Homo sapiens
ctcagccccagcccaga

SEQ ID NO: 4529230 - DNA, 13 bp, Homo sapiens
ctcagccccaggc

SEQ ID NO: 4529231 - DNA, 18 bp, Homo sapiens
ctcagccccaggccagct

SEQ ID NO: 4529232 - DNA, 19 bp, Homo sapiens
ctcagccccaggccagctg

SEQ ID NO: 4529233 - DNA, 21 bp, Homo sapiens
ctcagccccaggccagctgcg

SEQ ID NO: 4529234 - DNA, 19 bp, Homo sapiens
ctcagccctgaaaataaca

SEQ ID NO: 4529235 - DNA, 18 bp, Homo sapiens
ctcagccctgctccctgc

SEQ ID NO: 4529236 - DNA, 21 bp, Homo sapiens
ctcagccctgggccccaccac

SEQ ID NO: 4529237 - DNA, 13 bp, Homo sapiens
ctcagcctcccat

SEQ ID NO: 4529238 - DNA, 15 bp, Homo sapiens
ctcagcctccctagt

SEQ ID NO: 4529239 - DNA, 13 bp, Homo sapiens
ctcagcctcctga

SEQ ID NO: 4529240 - DNA, 20 bp, Homo sapiens
ctcagcctctgccagcgcca

SEQ ID NO: 4529241 - DNA, 14 bp, Homo sapiens
ctcagcctctgctg

SEQ ID NO: 4529242 - DNA, 15 bp, Homo sapiens
ctcagcctctgctgg

SEQ ID NO: 4529243 - DNA, 23 bp, Homo sapiens
ctcagcctctgctggagaaagcc

SEQ ID NO: 4529244 - DNA, 20 bp, Homo sapiens
ctcagccttccaactagctg

SEQ ID NO: 4529245 - DNA, 22 bp, Homo sapiens
ctcagccttccaactagctggg

SEQ ID NO: 4529246 - DNA, 17 bp, Homo sapiens
ctcagccttcctcctca

SEQ ID NO: 4529247 - DNA, 14 bp, Homo sapiens
ctcagcgaggtgta

SEQ ID NO: 4529248 - DNA, 23 bp, Homo sapiens
ctcagctagttggggagctaagg

SEQ ID NO: 4529249 - DNA, 14 bp, Homo sapiens
ctcagctcatccat

SEQ ID NO: 4529250 - DNA, 17 bp, Homo sapiens
ctcagctctaggctgtt

SEQ ID NO: 4529251 - DNA, 19 bp, Homo sapiens
ctcagctgcctcctgcgcc

SEQ ID NO: 4529252 - DNA, 14 bp, Homo sapiens
ctcagctgctggat

SEQ ID NO: 4529253 - DNA, 16 bp, Homo sapiens
ctcagcttcctaccca

SEQ ID NO: 4529254 - DNA, 22 bp, Homo sapiens
ctcagcttcctacccacacctc

SEQ ID NO: 4529255 - DNA, 19 bp, Homo sapiens
ctcagcttcttctttcatt

SEQ ID NO: 4529256 - DNA, 19 bp, Homo sapiens
ctcaggaaccgaggcaggg

SEQ ID NO: 4529257 - DNA, 14 bp, Homo sapiens
ctcaggaagtccag

SEQ ID NO: 4529258 - DNA, 16 bp, Homo sapiens
ctcaggaagtccagcc

SEQ ID NO: 4529259 - DNA, 19 bp, Homo sapiens
ctcaggaagtccagccact

SEQ ID NO: 4529260 - DNA, 20 bp, Homo sapiens
ctcaggaccaaagctttcat

SEQ ID NO: 4529261 - DNA, 16 bp, Homo sapiens
ctcaggactgcaacag

SEQ ID NO: 4529262 - DNA, 17 bp, Homo sapiens
ctcaggactgcaacagg

SEQ ID NO: 4529263 - DNA, 19 bp, Homo sapiens
ctcaggactgcaacaggct

SEQ ID NO: 4529264 - DNA, 20 bp, Homo sapiens
ctcaggagatggagggcttg

SEQ ID NO: 4529265 - DNA, 14 bp, Homo sapiens
ctcaggagcttggg

SEQ ID NO: 4529266 - DNA, 18 bp, Homo sapiens
ctcaggaggcgaataaat

SEQ ID NO: 4529267 - DNA, 18 bp, Homo sapiens
ctcaggaggctgagacag

SEQ ID NO: 4529268 - DNA, 18 bp, Homo sapiens
ctcaggaggctgaggcag

SEQ ID NO: 4529269 - DNA, 19 bp, Homo sapiens
ctcaggaggctgaggcaga

SEQ ID NO: 4529270 - DNA, 18 bp, Homo sapiens
ctcaggaggtcacctgcc

SEQ ID NO: 4529271 - DNA, 20 bp, Homo sapiens
ctcaggagtttgagaccagg

SEQ ID NO: 4529272 - DNA, 21 bp, Homo sapiens
ctgacaaaatggggcagaaga

SEQ ID NO: 4529273 - DNA, 22 bp, Homo sapiens
ctgacaacatttctatagccaa

SEQ ID NO: 4529274 - DNA, 19 bp, Homo sapiens
ctgacaaccattaaagtca

SEQ ID NO: 4529275 - DNA, 20 bp, Homo sapiens
ctgacaaccattaaagtcag

SEQ ID NO: 4529276 - DNA, 13 bp, Homo sapiens
ctgacaatgaagg

SEQ ID NO: 4529277 - DNA, 15 bp, Homo sapiens
ctgacaatgaaggga

SEQ ID NO: 4529278 - DNA, 14 bp, Homo sapiens
ctgacacaccaggc

SEQ ID NO: 4529279 - DNA, 18 bp, Homo sapiens
ctgacacattgctgatat

SEQ ID NO: 4529280 - DNA, 17 bp, Homo sapiens
ctgacactcccttgggc

SEQ ID NO: 4529281 - DNA, 17 bp, Homo sapiens
ctgacagaagttatttc

SEQ ID NO: 4529282 - DNA, 15 bp, Homo sapiens
ctgacagatgcctgg

SEQ ID NO: 4529283 - DNA, 18 bp, Homo sapiens
ctgacagatgcctggtga

SEQ ID NO: 4529284 - DNA, 20 bp, Homo sapiens
ctgacagccctgcggagacc

SEQ ID NO: 4529285 - DNA, 13 bp, Homo sapiens
ctgacagctctgt

SEQ ID NO: 4529286 - DNA, 21 bp, Homo sapiens
ctgacagggacatgccctgtg

SEQ ID NO: 4529287 - DNA, 21 bp, Homo sapiens
ctgacaggtgaattggatggt

SEQ ID NO: 4529288 - DNA, 19 bp, Homo sapiens
ctgacagtccacaggggcc

SEQ ID NO: 4529289 - DNA, 16 bp, Homo sapiens
ctgacattcactgagt

SEQ ID NO: 4529290 - DNA, 17 bp, Homo sapiens
ctgacattgccaaaaag

SEQ ID NO: 4529291 - DNA, 16 bp, Homo sapiens
ctgaccaacatggaga

SEQ ID NO: 4529292 - DNA, 19 bp, Homo sapiens
ctgaccaagtgctggccca

SEQ ID NO: 4529293 - DNA, 18 bp, Homo sapiens
ctgaccaatattgtacag

SEQ ID NO: 4529294 - DNA, 19 bp, Homo sapiens
ctgaccaatattgtacagt

SEQ ID NO: 4529295 - DNA, 19 bp, Homo sapiens
ctgaccagctgctccgagg

SEQ ID NO: 4529296 - DNA, 14 bp, Homo sapiens
ctgaccagtcagat

SEQ ID NO: 4529297 - DNA, 19 bp, Homo sapiens
ctgaccatccactctaccc

SEQ ID NO: 4529298 - DNA, 20 bp, Homo sapiens
ctgacccagagtggagtctg

SEQ ID NO: 4529299 - DNA, 15 bp, Homo sapiens
ctgacccccatgtaa

SEQ ID NO: 4529300 - DNA, 18 bp, Homo sapiens
ctgacccccatgtaaata

SEQ ID NO: 4529301 - DNA, 22 bp, Homo sapiens
ctgacccctgcctgttggcagg

SEQ ID NO: 4529302 - DNA, 14 bp, Homo sapiens
ctgacccctgctca

SEQ ID NO: 4529303 - DNA, 16 bp, Homo sapiens
ctgacccctgctcagt

SEQ ID NO: 4529304 - DNA, 18 bp, Homo sapiens
ctgaccctcatctttctt

SEQ ID NO: 4529305 - DNA, 13 bp, Homo sapiens
ctgaccctcctgt

SEQ ID NO: 4529306 - DNA, 17 bp, Homo sapiens
ctgaccctcctgttgca

SEQ ID NO: 4529307 - DNA, 17 bp, Homo sapiens
ctgaccctgcccccact

SEQ ID NO: 4529308 - DNA, 16 bp, Homo sapiens
ctgaccctgctcctag

SEQ ID NO: 4529309 - DNA, 17 bp, Homo sapiens
ctgaccctgctcctagc

SEQ ID NO: 4529310 - DNA, 18 bp, Homo sapiens
ctgaccgggctcacttgc

SEQ ID NO: 4529311 - DNA, 15 bp, Homo sapiens
ctgacctcctctggg

SEQ ID NO: 4529312 - DNA, 16 bp, Homo sapiens
ctgacctcctctgggc

SEQ ID NO: 4529313 - DNA, 20 bp, Homo sapiens
ctgacctcctctgggccctg

SEQ ID NO: 4529314 - DNA, 21 bp, Homo sapiens
ctgacctcctctgggccctgt

SEQ ID NO: 4529315 - DNA, 17 bp, Homo sapiens
ctgaccttagcgttctg

SEQ ID NO: 4529316 - DNA, 22 bp, Homo sapiens
ctgaccttagcgttctggactc

SEQ ID NO: 4529317 - DNA, 20 bp, Homo sapiens
ctgaccttggaggaatgaca

SEQ ID NO: 4529318 - DNA, 21 bp, Homo sapiens
ctgaccttggaggaatgacaa

SEQ ID NO: 4529319 - DNA, 14 bp, Homo sapiens
ctgaccttgtgatc

SEQ ID NO: 4529320 - DNA, 15 bp, Homo sapiens
ctgacgctcagcccc

SEQ ID NO: 4529321 - DNA, 21 bp, Homo sapiens
ctgacgctcagccccaggcca

SEQ ID NO: 4529322 - DNA, 15 bp, Homo sapiens
ctgactaaacttttt

SEQ ID NO: 4529323 - DNA, 15 bp, Homo sapiens
ctgactaagcctttg

SEQ ID NO: 4529324 - DNA, 18 bp, Homo sapiens
ctgactaagcctttgact

SEQ ID NO: 4529325 - DNA, 23 bp, Homo sapiens
ctgactagaagggccagtcctgc

SEQ ID NO: 4529326 - DNA, 16 bp, Homo sapiens
ctgactcagctaatgt

SEQ ID NO: 4529327 - DNA, 12 bp, Homo sapiens
ctgactcagggc

SEQ ID NO: 4529328 - DNA, 14 bp, Homo sapiens
ctgactcagggctc

SEQ ID NO: 4529329 - DNA, 21 bp, Homo sapiens
ctgactcagggctcctgggtt

SEQ ID NO: 4529330 - DNA, 16 bp, Homo sapiens
ctgactccctgtgggg

SEQ ID NO: 4529331 - DNA, 12 bp, Homo sapiens
ctgactcctctg

SEQ ID NO: 4529332 - DNA, 14 bp, Homo sapiens
ctgactcctctggc

SEQ ID NO: 4529333 - DNA, 17 bp, Homo sapiens
ctgactcctctggcttt

SEQ ID NO: 4529334 - DNA, 16 bp, Homo sapiens
ctgactcctggactcc

SEQ ID NO: 4529335 - DNA, 20 bp, Homo sapiens
ctgactctgccccctgctgg

SEQ ID NO: 4529336 - DNA, 16 bp, Homo sapiens
ctgactctgttattga

SEQ ID NO: 4529337 - DNA, 16 bp, Homo sapiens
ctgactggccaaaccc

SEQ ID NO: 4529338 - DNA, 21 bp, Homo sapiens
ctgactggtttctcctggtag

SEQ ID NO: 4529339 - DNA, 17 bp, Homo sapiens
ctgactgtccaggagct

SEQ ID NO: 4529340 - DNA, 22 bp, Homo sapiens
ctgactgttcttggtaactgat

SEQ ID NO: 4529341 - DNA, 16 bp, Homo sapiens
ctgacttgagccactc

SEQ ID NO: 4529342 - DNA, 17 bp, Homo sapiens
ctgacttgagccactcc

SEQ ID NO: 4529343 - DNA, 22 bp, Homo sapiens
ctgacttgagccactccttcct

SEQ ID NO: 4529344 - DNA, 19 bp, Homo sapiens
ctgacttggggaccttttg

SEQ ID NO: 4529345 - DNA, 20 bp, Homo sapiens
ctgactttccgagcctccag

SEQ ID NO: 4529346 - DNA, 12 bp, Homo sapiens
ctgagaaagact

SEQ ID NO: 4529347 - DNA, 20 bp, Homo sapiens
ctgagaaagactattcaaac

SEQ ID NO: 4529348 - DNA, 23 bp, Homo sapiens
ctgagaaagactattcaaacagt

SEQ ID NO: 4529349 - DNA, 20 bp, Homo sapiens
ctgagaactcgttcacctcc

SEQ ID NO: 4529350 - DNA, 18 bp, Homo sapiens
ctgagaagaagtggctgc

SEQ ID NO: 4529351 - DNA, 14 bp, Homo sapiens
ctgagaatatacaa

SEQ ID NO: 4529352 - DNA, 14 bp, Homo sapiens
ctgagaccagggtg

SEQ ID NO: 4529353 - DNA, 16 bp, Homo sapiens
ctgagaccagggtggc

SEQ ID NO: 4529354 - DNA, 17 bp, Homo sapiens
ctgagaccagggtggcc

SEQ ID NO: 4529355 - DNA, 20 bp, Homo sapiens
ctgagaccagggtggccaca

SEQ ID NO: 4529356 - DNA, 13 bp, Homo sapiens
ctgagacccctgg

SEQ ID NO: 4529357 - DNA, 22 bp, Homo sapiens
ctgagacgccggcttcctcctt

SEQ ID NO: 4529358 - DNA, 21 bp, Homo sapiens
ctgagactctcttaggagcag

SEQ ID NO: 4529359 - DNA, 15 bp, Homo sapiens
ctgagagacccaagg

SEQ ID NO: 4529360 - DNA, 17 bp, Homo sapiens
ctgagagacccaaggag

SEQ ID NO: 4529361 - DNA, 13 bp, Homo sapiens
ctgagagaggcca

SEQ ID NO: 4529362 - DNA, 14 bp, Homo sapiens
ctgagagccctgct

SEQ ID NO: 4529363 - DNA, 16 bp, Homo sapiens
ctgagagccctgctgt

SEQ ID NO: 4529364 - DNA, 21 bp, Homo sapiens
ctgagagccctgctgtgggag

SEQ ID NO: 4529365 - DNA, 21 bp, Homo sapiens
ctgagagccggccgtggaagg

SEQ ID NO: 4529366 - DNA, 12 bp, Homo sapiens
ctgagagcctgt

SEQ ID NO: 4529367 - DNA, 13 bp, Homo sapiens
ctgagagcctgtg

SEQ ID NO: 4529368 - DNA, 21 bp, Homo sapiens
ctgagagcctgtggaggggct

SEQ ID NO: 4529369 - DNA, 15 bp, Homo sapiens
ctgagaggaagcaag

SEQ ID NO: 4529370 - DNA, 19 bp, Homo sapiens
ctgagaggcaccagtccag

SEQ ID NO: 4529371 - DNA, 23 bp, Homo sapiens
ctgagaggcaccagtccagcaaa

SEQ ID NO: 4529372 - DNA, 15 bp, Homo sapiens
ctgagagtcaggagt

SEQ ID NO: 4529373 - DNA, 20 bp, Homo sapiens
ctgagatacaaggcccagaa

SEQ ID NO: 4529374 - DNA, 21 bp, Homo sapiens
ctgagatacaaggcccagaag

SEQ ID NO: 4529375 - DNA, 23 bp, Homo sapiens
ctgagatatgaacatattgttga

SEQ ID NO: 4529376 - DNA, 15 bp, Homo sapiens
ctgagatattatttt

SEQ ID NO: 4529377 - DNA, 14 bp, Homo sapiens
ctgagatctgctgt

SEQ ID NO: 4529378 - DNA, 18 bp, Homo sapiens
ctgagattcaatattgaa

SEQ ID NO: 4529379 - DNA, 21 bp, Homo sapiens
ctgagattgcagatgtgagcc

SEQ ID NO: 4529380 - DNA, 16 bp, Homo sapiens
ctgagatttcatctgc

SEQ ID NO: 4529381 - DNA, 19 bp, Homo sapiens
ctgagatttcatctgctct

SEQ ID NO: 4529382 - DNA, 16 bp, Homo sapiens
ctgagcaaaggccctg

SEQ ID NO: 4529383 - DNA, 19 bp, Homo sapiens
ctgagcaaaggccctgggt

SEQ ID NO: 4529384 - DNA, 24 bp, Homo sapiens
ctgagcaaggagtttaaatgagac

SEQ ID NO: 4529385 - DNA, 17 bp, Homo sapiens
ctgagcaatctgaccct

SEQ ID NO: 4529386 - DNA, 12 bp, Homo sapiens
ctgagcacttag

SEQ ID NO: 4529387 - DNA, 18 bp, Homo sapiens
ctgagcagccgccagctg

SEQ ID NO: 4529388 - DNA, 16 bp, Homo sapiens
ctgagcagcctctgga

SEQ ID NO: 4529389 - DNA, 17 bp, Homo sapiens
ctgagcagcctctggac

SEQ ID NO: 4529390 - DNA, 16 bp, Homo sapiens
ctgagcaggggcccct

SEQ ID NO: 4529391 - DNA, 21 bp, Homo sapiens
ctgagcaggggcccctgggga

SEQ ID NO: 4529392 - DNA, 14 bp, Homo sapiens
ctctttccctgcga

SEQ ID NO: 4529393 - DNA, 18 bp, Homo sapiens
ctctttccgactgcccag

SEQ ID NO: 4529394 - DNA, 20 bp, Homo sapiens
ctctttccgactgcccagaa

SEQ ID NO: 4529395 - DNA, 13 bp, Homo sapiens
ctctttctcacct

SEQ ID NO: 4529396 - DNA, 23 bp, Homo sapiens
ctctttctgagtgccttctgtgg

SEQ ID NO: 4529397 - DNA, 13 bp, Homo sapiens
ctctttctgtata

SEQ ID NO: 4529398 - DNA, 15 bp, Homo sapiens
ctctttcttcccatg

SEQ ID NO: 4529399 - DNA, 10 bp, Homo sapiens
ctctttgaga

SEQ ID NO: 4529400 - DNA, 21 bp, Homo sapiens
ctctttggcgacctcctttca

SEQ ID NO: 4529401 - DNA, 14 bp, Homo sapiens
ctcttttacctgct

SEQ ID NO: 4529402 - DNA, 13 bp, Homo sapiens
ctcttttattctg

SEQ ID NO: 4529403 - DNA, 16 bp, Homo sapiens
ctcttttattctgtta

SEQ ID NO: 4529404 - DNA, 16 bp, Homo sapiens
ctcttttcctggcagc

SEQ ID NO: 4529405 - DNA, 21 bp, Homo sapiens
ctcttttcctggcagctgctg

SEQ ID NO: 4529406 - DNA, 12 bp, Homo sapiens
ctcttttctttc

SEQ ID NO: 4529407 - DNA, 24 bp, Homo sapiens
ctcttttgtattgtttctacaata

SEQ ID NO: 4529408 - DNA, 13 bp, Homo sapiens
ctcttttgtgatg

SEQ ID NO: 4529409 - DNA, 18 bp, Homo sapiens
ctcttttgtgatgaacat

SEQ ID NO: 4529410 - DNA, 13 bp, Homo sapiens
ctctttttcctcc

SEQ ID NO: 4529411 - DNA, 14 bp, Homo sapiens
ctctttttcctcct

SEQ ID NO: 4529412 - DNA, 17 bp, Homo sapiens
ctcttttttcgtttgtt

SEQ ID NO: 4529413 - DNA, 19 bp, Homo sapiens
ctcttttttgtttgtttct

SEQ ID NO: 4529414 - DNA, 18 bp, Homo sapiens
ctgaaaaaaaaaaagaag

SEQ ID NO: 4529415 - DNA, 21 bp, Homo sapiens
ctgaaaaaaaaaaagaagaag

SEQ ID NO: 4529416 - DNA, 19 bp, Homo sapiens
ctgaaaaaaacatatccaa

SEQ ID NO: 4529417 - DNA, 15 bp, Homo sapiens
ctgaaaaaatatatg

SEQ ID NO: 4529418 - DNA, 13 bp, Homo sapiens
ctgaaaaatggga

SEQ ID NO: 4529419 - DNA, 14 bp, Homo sapiens
ctgaaaacctacca

SEQ ID NO: 4529420 - DNA, 12 bp, Homo sapiens
ctgaaaagaagg

SEQ ID NO: 4529421 - DNA, 20 bp, Homo sapiens
ctgaaaataacagaattctg

SEQ ID NO: 4529422 - DNA, 13 bp, Homo sapiens
ctgaaaatgaaag

SEQ ID NO: 4529423 - DNA, 22 bp, Homo sapiens
ctgaaaatgtttttctgccagg

SEQ ID NO: 4529424 - DNA, 17 bp, Homo sapiens
ctgaaaattatttaaac

SEQ ID NO: 4529425 - DNA, 13 bp, Homo sapiens
ctgaaaatttaac

SEQ ID NO: 4529426 - DNA, 15 bp, Homo sapiens
ctgaaaatttaacag

SEQ ID NO: 4529427 - DNA, 11 bp, Homo sapiens
ctgaaacagct

SEQ ID NO: 4529428 - DNA, 13 bp, Homo sapiens
ctgaaacagctgc

SEQ ID NO: 4529429 - DNA, 19 bp, Homo sapiens
ctgaaacagctgccttagc

SEQ ID NO: 4529430 - DNA, 22 bp, Homo sapiens
ctgaaactggcttccccactcc

SEQ ID NO: 4529431 - DNA, 23 bp, Homo sapiens
ctgaaagaagaaaacagtacaga

SEQ ID NO: 4529432 - DNA, 16 bp, Homo sapiens
ctgaaagtagggggct

SEQ ID NO: 4529433 - DNA, 16 bp, Homo sapiens
ctgaaagtcctgcttt

SEQ ID NO: 4529434 - DNA, 19 bp, Homo sapiens
ctgaaagtcctgctttcct

SEQ ID NO: 4529435 - DNA, 18 bp, Homo sapiens
ctgaaagttttgtaaaag

SEQ ID NO: 4529436 - DNA, 19 bp, Homo sapiens
ctgaaataatatatttctt

SEQ ID NO: 4529437 - DNA, 16 bp, Homo sapiens
ctgaaatgacatttca

SEQ ID NO: 4529438 - DNA, 23 bp, Homo sapiens
ctgaaattgagaatccagtttct

SEQ ID NO: 4529439 - DNA, 14 bp, Homo sapiens
ctgaaatttcacca

SEQ ID NO: 4529440 - DNA, 13 bp, Homo sapiens
ctgaaattttaga

SEQ ID NO: 4529441 - DNA, 18 bp, Homo sapiens
ctgaaattttagaaatat

SEQ ID NO: 4529442 - DNA, 22 bp, Homo sapiens
ctgaaattttagaaatattcac

SEQ ID NO: 4529443 - DNA, 14 bp, Homo sapiens
ctgaacaatatttt

SEQ ID NO: 4529444 - DNA, 11 bp, Homo sapiens
ctgaacaccat

SEQ ID NO: 4529445 - DNA, 20 bp, Homo sapiens
ctgaacaccattgaaggctt

SEQ ID NO: 4529446 - DNA, 14 bp, Homo sapiens
ctgaaccacagaaa

SEQ ID NO: 4529447 - DNA, 23 bp, Homo sapiens
ctgaaccaggccagagcaaacag

SEQ ID NO: 4529448 - DNA, 16 bp, Homo sapiens
ctgaaccccagaggca

SEQ ID NO: 4529449 - DNA, 13 bp, Homo sapiens
ctgaacggggaga

SEQ ID NO: 4529450 - DNA, 19 bp, Homo sapiens
ctgaactaaagtgctgcac

SEQ ID NO: 4529451 - DNA, 18 bp, Homo sapiens
ctgaactcaaactgagga

SEQ ID NO: 4529452 - DNA, 21 bp, Homo sapiens
ctgaactccatacagcctcta

SEQ ID NO: 4529453 - DNA, 13 bp, Homo sapiens
ctgaactgagccc

SEQ ID NO: 4529454 - DNA, 14 bp, Homo sapiens
ctgaactgagcccc

SEQ ID NO: 4529455 - DNA, 17 bp, Homo sapiens
ctgaactgagccccagc

SEQ ID NO: 4529456 - DNA, 12 bp, Homo sapiens
ctgaactgagga

SEQ ID NO: 4529457 - DNA, 13 bp, Homo sapiens
ctgaactgaggag

SEQ ID NO: 4529458 - DNA, 14 bp, Homo sapiens
ctgaactgctttta

SEQ ID NO: 4529459 - DNA, 17 bp, Homo sapiens
ctgaactggtagaaaaa

SEQ ID NO: 4529460 - DNA, 20 bp, Homo sapiens
ctgaacttaataactgtgta

SEQ ID NO: 4529461 - DNA, 23 bp, Homo sapiens
ctgaagaaggaaggcctgagccc

SEQ ID NO: 4529462 - DNA, 20 bp, Homo sapiens
ctgaagagctattatataaa

SEQ ID NO: 4529463 - DNA, 12 bp, Homo sapiens
ctgaagagctct

SEQ ID NO: 4529464 - DNA, 15 bp, Homo sapiens
ctgaagagctcttgg

SEQ ID NO: 4529465 - DNA, 22 bp, Homo sapiens
ctgaagagctcttggcccggca

SEQ ID NO: 4529466 - DNA, 17 bp, Homo sapiens
ctgaagaggcttctcct

SEQ ID NO: 4529467 - DNA, 19 bp, Homo sapiens
ctgaagaggcttctcctgt

SEQ ID NO: 4529468 - DNA, 15 bp, Homo sapiens
ctgaagatggagggg

SEQ ID NO: 4529469 - DNA, 21 bp, Homo sapiens
ctgaagatggagggggctggg

SEQ ID NO: 4529470 - DNA, 15 bp, Homo sapiens
ctgaagcctctggga

SEQ ID NO: 4529471 - DNA, 22 bp, Homo sapiens
ctgaagctcgcatccagacagt

SEQ ID NO: 4529472 - DNA, 17 bp, Homo sapiens
ctgaagctgacagcact

SEQ ID NO: 4529473 - DNA, 14 bp, Homo sapiens
ctgaagctgctgtg

SEQ ID NO: 4529474 - DNA, 15 bp, Homo sapiens
ctgaagctgctgtgt

SEQ ID NO: 4529475 - DNA, 16 bp, Homo sapiens
ctgaagctgctgtgtc

SEQ ID NO: 4529476 - DNA, 17 bp, Homo sapiens
ctgaagctgctgtgtcc

SEQ ID NO: 4529477 - DNA, 18 bp, Homo sapiens
ctgaaggaaaaacacaag

SEQ ID NO: 4529478 - DNA, 12 bp, Homo sapiens
ctgaaggagaag

SEQ ID NO: 4529479 - DNA, 13 bp, Homo sapiens
ctgaaggcacagc

SEQ ID NO: 4529480 - DNA, 20 bp, Homo sapiens
ctgaagggcattctttccca

SEQ ID NO: 4529481 - DNA, 20 bp, Homo sapiens
ctgaagggtggatgtgctgg

SEQ ID NO: 4529482 - DNA, 22 bp, Homo sapiens
ctgaaggtgttgggtcagtggc

SEQ ID NO: 4529483 - DNA, 23 bp, Homo sapiens
ctgaaggtgttgggtcagtggcc

SEQ ID NO: 4529484 - DNA, 17 bp, Homo sapiens
ctgaagtacaaacatga

SEQ ID NO: 4529485 - DNA, 15 bp, Homo sapiens
ctgaagtcaaaatat

SEQ ID NO: 4529486 - DNA, 18 bp, Homo sapiens
ctgaagttgctgctgtga

SEQ ID NO: 4529487 - DNA, 14 bp, Homo sapiens
ctgaataaagcaat

SEQ ID NO: 4529488 - DNA, 13 bp, Homo sapiens
ctgaatacacagt

SEQ ID NO: 4529489 - DNA, 15 bp, Homo sapiens
ctgaatagatatgaa

SEQ ID NO: 4529490 - DNA, 15 bp, Homo sapiens
ctgaatagcagaagg

SEQ ID NO: 4529491 - DNA, 11 bp, Homo sapiens
ctgaatatttt

SEQ ID NO: 4529492 - DNA, 17 bp, Homo sapiens
ctgaatcaccaattaaa

SEQ ID NO: 4529493 - DNA, 23 bp, Homo sapiens
ctgaatcccggcggaaagcctct

SEQ ID NO: 4529494 - DNA, 17 bp, Homo sapiens
ctgaatctgctaccaaa

SEQ ID NO: 4529495 - DNA, 22 bp, Homo sapiens
ctgaatctgctaccaaaacagt

SEQ ID NO: 4529496 - DNA, 21 bp, Homo sapiens
ctgaatgccgcgatgggtcag

SEQ ID NO: 4529497 - DNA, 22 bp, Homo sapiens
ctgaatgccgcgatgggtcagg

SEQ ID NO: 4529498 - DNA, 18 bp, Homo sapiens
ctgaatggactttgcaca

SEQ ID NO: 4529499 - DNA, 15 bp, Homo sapiens
ctgaatgtatgtaaa

SEQ ID NO: 4529500 - DNA, 20 bp, Homo sapiens
ctgaatgttcttgaattata

SEQ ID NO: 4529501 - DNA, 21 bp, Homo sapiens
ctgaatgttcttgaattatat

SEQ ID NO: 4529502 - DNA, 15 bp, Homo sapiens
ctgaatgttgggact

SEQ ID NO: 4529503 - DNA, 16 bp, Homo sapiens
ctgaatgttgggactg

SEQ ID NO: 4529504 - DNA, 18 bp, Homo sapiens
ctgaattatctatttcat

SEQ ID NO: 4529505 - DNA, 14 bp, Homo sapiens
ctgaattgctttct

SEQ ID NO: 4529506 - DNA, 19 bp, Homo sapiens
ctgaattggctaaaagaca

SEQ ID NO: 4529507 - DNA, 19 bp, Homo sapiens
ctgaatttaattctttcaa

SEQ ID NO: 4529508 - DNA, 12 bp, Homo sapiens
ctgaatttgcaa

SEQ ID NO: 4529509 - DNA, 13 bp, Homo sapiens
ctgaatttgcaaa

SEQ ID NO: 4529510 - DNA, 17 bp, Homo sapiens
ctgaattttataaataa

SEQ ID NO: 4529511 - DNA, 12 bp, Homo sapiens
ctgaatttttaa

SEQ ID NO: 4529512 - DNA, 15 bp, Homo sapiens
ctgaatttttttgta

SEQ ID NO: 4529513 - DNA, 23 bp, Homo sapiens
ctgaatttttttgtaataagcaa

SEQ ID NO: 4529514 - DNA, 16 bp, Homo sapiens
ctgagcattcaggcag

SEQ ID NO: 4529515 - DNA, 15 bp, Homo sapiens
ctgagccaaggaggc

SEQ ID NO: 4529516 - DNA, 16 bp, Homo sapiens
ctgagccaaggaggcc

SEQ ID NO: 4529517 - DNA, 18 bp, Homo sapiens
ctgagccacagccgtgct

SEQ ID NO: 4529518 - DNA, 13 bp, Homo sapiens
ctgagccagatta

SEQ ID NO: 4529519 - DNA, 14 bp, Homo sapiens
ctgagccagcaggg

SEQ ID NO: 4529520 - DNA, 14 bp, Homo sapiens
ctgagccagctgca

SEQ ID NO: 4529521 - DNA, 21 bp, Homo sapiens
ctgagccaggcttttctcagg

SEQ ID NO: 4529522 - DNA, 12 bp, Homo sapiens
ctgagccccagc

SEQ ID NO: 4529523 - DNA, 14 bp, Homo sapiens
ctgagcccccaccg

SEQ ID NO: 4529524 - DNA, 16 bp, Homo sapiens
ctgagcccccaccgga

SEQ ID NO: 4529525 - DNA, 15 bp, Homo sapiens
ctgagccctcctgag

SEQ ID NO: 4529526 - DNA, 13 bp, Homo sapiens
ctgagccctggtg

SEQ ID NO: 4529527 - DNA, 18 bp, Homo sapiens
ctgagccctggtgtgttt

SEQ ID NO: 4529528 - DNA, 19 bp, Homo sapiens
ctgagccggccccaggctc

SEQ ID NO: 4529529 - DNA, 20 bp, Homo sapiens
ctgagcgacagtgagactct

SEQ ID NO: 4529530 - DNA, 19 bp, Homo sapiens
ctgagcgcccccgagccct

SEQ ID NO: 4529531 - DNA, 23 bp, Homo sapiens
ctgagcgggagtcagggacctgc

SEQ ID NO: 4529532 - DNA, 19 bp, Homo sapiens
ctgagctattttcctctgg

SEQ ID NO: 4529533 - DNA, 15 bp, Homo sapiens
ctgagctcacatggg

SEQ ID NO: 4529534 - DNA, 22 bp, Homo sapiens
ctgagctcacatgggactggga

SEQ ID NO: 4529535 - DNA, 17 bp, Homo sapiens
ctgagctcggggacagg

SEQ ID NO: 4529536 - DNA, 13 bp, Homo sapiens
ctgagctgaggca

SEQ ID NO: 4529537 - DNA, 18 bp, Homo sapiens
ctgagctgaggcagcagt

SEQ ID NO: 4529538 - DNA, 19 bp, Homo sapiens
ctgagctgtccagtggagg

SEQ ID NO: 4529539 - DNA, 16 bp, Homo sapiens
ctgagctgtgacccag

SEQ ID NO: 4529540 - DNA, 13 bp, Homo sapiens
ctgagctgtgcag

SEQ ID NO: 4529541 - DNA, 11 bp, Homo sapiens
ctgagctttat

SEQ ID NO: 4529542 - DNA, 12 bp, Homo sapiens
ctgagctttgca

SEQ ID NO: 4529543 - DNA, 15 bp, Homo sapiens
ctgaggaagaacggg

SEQ ID NO: 4529544 - DNA, 18 bp, Homo sapiens
ctgaggaagagggactgt

SEQ ID NO: 4529545 - DNA, 23 bp, Homo sapiens
ctgaggaagagggactgttcttt

SEQ ID NO: 4529546 - DNA, 19 bp, Homo sapiens
ctgaggaggcctccatctc

SEQ ID NO: 4529547 - DNA, 16 bp, Homo sapiens
ctgaggagtaaaaaga

SEQ ID NO: 4529548 - DNA, 14 bp, Homo sapiens
ctgaggcaggagga

SEQ ID NO: 4529549 - DNA, 12 bp, Homo sapiens
ctgaggccagag

SEQ ID NO: 4529550 - DNA, 15 bp, Homo sapiens
ctgaggccagagtca

SEQ ID NO: 4529551 - DNA, 18 bp, Homo sapiens
ctgaggccagagtcacct

SEQ ID NO: 4529552 - DNA, 23 bp, Homo sapiens
ctgaggccagagtcaccttttct

SEQ ID NO: 4529553 - DNA, 12 bp, Homo sapiens
ctgaggcccctg

SEQ ID NO: 4529554 - DNA, 15 bp, Homo sapiens
ctgaggccctgggct

SEQ ID NO: 4529555 - DNA, 17 bp, Homo sapiens
ctgaggcctagactctg

SEQ ID NO: 4529556 - DNA, 19 bp, Homo sapiens
ctgaggcctagactctgtc

SEQ ID NO: 4529557 - DNA, 14 bp, Homo sapiens
ctgaggcctccaag

SEQ ID NO: 4529558 - DNA, 18 bp, Homo sapiens
ctgaggcctgagcgctcc

SEQ ID NO: 4529559 - DNA, 22 bp, Homo sapiens
ctgaggcctgagcgctcctgcc

SEQ ID NO: 4529560 - DNA, 17 bp, Homo sapiens
ctgaggcggaggctgtg

SEQ ID NO: 4529561 - DNA, 20 bp, Homo sapiens
ctgaggctgtttttggctgt

SEQ ID NO: 4529562 - DNA, 15 bp, Homo sapiens
ctgaggctttggatt

SEQ ID NO: 4529563 - DNA, 17 bp, Homo sapiens
ctgaggctttggatttg

SEQ ID NO: 4529564 - DNA, 21 bp, Homo sapiens
ctgaggctttggatttgacat

SEQ ID NO: 4529565 - DNA, 12 bp, Homo sapiens
ctgagggaccaa

SEQ ID NO: 4529566 - DNA, 16 bp, Homo sapiens
ctgagggaccaactgg

SEQ ID NO: 4529567 - DNA, 20 bp, Homo sapiens
ctgagggaccaactgggccc

SEQ ID NO: 4529568 - DNA, 14 bp, Homo sapiens
ctgagggactctga

SEQ ID NO: 4529569 - DNA, 21 bp, Homo sapiens
ctgagggactctgaagcctct

SEQ ID NO: 4529570 - DNA, 15 bp, Homo sapiens
ctgagggatctttac

SEQ ID NO: 4529571 - DNA, 13 bp, Homo sapiens
ctgagggcaaatc

SEQ ID NO: 4529572 - DNA, 21 bp, Homo sapiens
ctgagggctaattctgggaag

SEQ ID NO: 4529573 - DNA, 16 bp, Homo sapiens
ctgaggggcatctgcc

SEQ ID NO: 4529574 - DNA, 17 bp, Homo sapiens
ctgaggggcatctgccc

SEQ ID NO: 4529575 - DNA, 18 bp, Homo sapiens
ctgaggggcatctgcccc

SEQ ID NO: 4529576 - DNA, 14 bp, Homo sapiens
ctgaggggccaggg

SEQ ID NO: 4529577 - DNA, 18 bp, Homo sapiens
ctgaggttcctctgcctg

SEQ ID NO: 4529578 - DNA, 20 bp, Homo sapiens
ctgaggttcctctgcctgcc

SEQ ID NO: 4529579 - DNA, 23 bp, Homo sapiens
ctgaggttcctctgcctgccccg

SEQ ID NO: 4529580 - DNA, 20 bp, Homo sapiens
ctgagtaaacataaaaactg

SEQ ID NO: 4529581 - DNA, 16 bp, Homo sapiens
ctgagtactctttctc

SEQ ID NO: 4529582 - DNA, 22 bp, Homo sapiens
ctgagtcacacaagggaagtgg

SEQ ID NO: 4529583 - DNA, 14 bp, Homo sapiens
ctgagtcaccagga

SEQ ID NO: 4529584 - DNA, 14 bp, Homo sapiens
ctgagtcactcaca

SEQ ID NO: 4529585 - DNA, 13 bp, Homo sapiens
ctgagtcctgtct

SEQ ID NO: 4529586 - DNA, 18 bp, Homo sapiens
ctgagtcctgtctctgcc

SEQ ID NO: 4529587 - DNA, 21 bp, Homo sapiens
ctgagtcctgtctctgcctgc

SEQ ID NO: 4529588 - DNA, 20 bp, Homo sapiens
ctgagtcctttccaggggcc

SEQ ID NO: 4529589 - DNA, 18 bp, Homo sapiens
ctgagtcgtacagaaagc

SEQ ID NO: 4529590 - DNA, 19 bp, Homo sapiens
ctgagtcgtacagaaagct

SEQ ID NO: 4529591 - DNA, 14 bp, Homo sapiens
ctgagtctccaggg

SEQ ID NO: 4529592 - DNA, 15 bp, Homo sapiens
ctgagtctccagggc

SEQ ID NO: 4529593 - DNA, 22 bp, Homo sapiens
ctgagtctccagggccccccaa

SEQ ID NO: 4529594 - DNA, 18 bp, Homo sapiens
ctgagtctgagtcctgtc

SEQ ID NO: 4529595 - DNA, 13 bp, Homo sapiens
ctgagtgccttct

SEQ ID NO: 4529596 - DNA, 20 bp, Homo sapiens
ctgagtgcgggctgaggcca

SEQ ID NO: 4529597 - DNA, 22 bp, Homo sapiens
ctgagtgcgggctgaggccaga

SEQ ID NO: 4529598 - DNA, 15 bp, Homo sapiens
ctgagtgggaagccc

SEQ ID NO: 4529599 - DNA, 17 bp, Homo sapiens
ctgagtgggaagcccat

SEQ ID NO: 4529600 - DNA, 21 bp, Homo sapiens
ctgagtgggaagcccatcctg

SEQ ID NO: 4529601 - DNA, 18 bp, Homo sapiens
ctgagttatcaggtgcag

SEQ ID NO: 4529602 - DNA, 15 bp, Homo sapiens
ctgagttcccgggag

SEQ ID NO: 4529603 - DNA, 21 bp, Homo sapiens
ctgagttcccgggagctgggc

SEQ ID NO: 4529604 - DNA, 23 bp, Homo sapiens
ctgagttcccgggagctgggccc

SEQ ID NO: 4529605 - DNA, 19 bp, Homo sapiens
ctgagttctgggtttctag

SEQ ID NO: 4529606 - DNA, 23 bp, Homo sapiens
ctgagttgggggtgtggctctgc

SEQ ID NO: 4529607 - DNA, 13 bp, Homo sapiens
ctgagttttgtgt

SEQ ID NO: 4529608 - DNA, 14 bp, Homo sapiens
ctgagttttgtgtt

SEQ ID NO: 4529609 - DNA, 17 bp, Homo sapiens
ctgagttttgtgtttgt

SEQ ID NO: 4529610 - DNA, 19 bp, Homo sapiens
ctgagttttgtgtttgttg

SEQ ID NO: 4529611 - DNA, 19 bp, Homo sapiens
ctgagttttgtttcacttt

SEQ ID NO: 4529612 - DNA, 19 bp, Homo sapiens
ctgataaaaccatgtagaa

SEQ ID NO: 4529613 - DNA, 17 bp, Homo sapiens
ctgataacttggggagg

SEQ ID NO: 4529614 - DNA, 20 bp, Homo sapiens
ctgataacttggggaggcaa

SEQ ID NO: 4529615 - DNA, 15 bp, Homo sapiens
ctgataattttaaat

SEQ ID NO: 4529616 - DNA, 12 bp, Homo sapiens
ctgatacacagt

SEQ ID NO: 4529617 - DNA, 18 bp, Homo sapiens
ctgatacacagtaattgt

SEQ ID NO: 4529618 - DNA, 23 bp, Homo sapiens
ctgatacacagtaattgtgacaa

SEQ ID NO: 4529619 - DNA, 21 bp, Homo sapiens
ctgatatcatggggagtaata

SEQ ID NO: 4529620 - DNA, 20 bp, Homo sapiens
ctgatcagagccgtggtcct

SEQ ID NO: 4529621 - DNA, 18 bp, Homo sapiens
ctgatcccaccccctcct

SEQ ID NO: 4529622 - DNA, 20 bp, Homo sapiens
ctgatcccaccccctcctcc

SEQ ID NO: 4529623 - DNA, 20 bp, Homo sapiens
ctgatcccccagatgcaggg

SEQ ID NO: 4529624 - DNA, 15 bp, Homo sapiens
ctgatctctgctccc

SEQ ID NO: 4529625 - DNA, 17 bp, Homo sapiens
ctgatctgtactttgtg

SEQ ID NO: 4529626 - DNA, 21 bp, Homo sapiens
ctgatctgtgctttccagctc

SEQ ID NO: 4529627 - DNA, 23 bp, Homo sapiens
ctgatctgtgctttccagctcac

SEQ ID NO: 4529628 - DNA, 20 bp, Homo sapiens
ctgatctttgggcatcagaa

SEQ ID NO: 4529629 - DNA, 22 bp, Homo sapiens
ctgatctttgggcatcagaaaa

SEQ ID NO: 4529630 - DNA, 14 bp, Homo sapiens
ctgatgaatctcaa

SEQ ID NO: 4529631 - DNA, 20 bp, Homo sapiens
ctgatgagtaaactgaggcc

SEQ ID NO: 4529632 - DNA, 21 bp, Homo sapiens
ctgatgagtaaactgaggccc

SEQ ID NO: 4529633 - DNA, 14 bp, Homo sapiens
ctgatgattttcct

SEQ ID NO: 4529634 - DNA, 18 bp, Homo sapiens
ctctctgatgtcccagtg

SEQ ID NO: 4529635 - DNA, 21 bp, Homo sapiens
ctctctgatgtcccagtgctc

SEQ ID NO: 4529636 - DNA, 16 bp, Homo sapiens
ctctctgcagccagcc

SEQ ID NO: 4529637 - DNA, 14 bp, Homo sapiens
ctctctgccattct

SEQ ID NO: 4529638 - DNA, 14 bp, Homo sapiens
ctctctgccctctc

SEQ ID NO: 4529639 - DNA, 12 bp, Homo sapiens
ctctctgctcca

SEQ ID NO: 4529640 - DNA, 13 bp, Homo sapiens
ctctctgctccat

SEQ ID NO: 4529641 - DNA, 14 bp, Homo sapiens
ctctctgctctgcg

SEQ ID NO: 4529642 - DNA, 13 bp, Homo sapiens
ctctctgctgtac

SEQ ID NO: 4529643 - DNA, 17 bp, Homo sapiens
ctctctgggacctcctt

SEQ ID NO: 4529644 - DNA, 20 bp, Homo sapiens
ctctctgggactctcctcct

SEQ ID NO: 4529645 - DNA, 17 bp, Homo sapiens
ctctctggggccctggg

SEQ ID NO: 4529646 - DNA, 23 bp, Homo sapiens
ctctctggggccctgggcctcag

SEQ ID NO: 4529647 - DNA, 15 bp, Homo sapiens
ctctcttcaataaac

SEQ ID NO: 4529648 - DNA, 17 bp, Homo sapiens
ctctcttcaataaacca

SEQ ID NO: 4529649 - DNA, 22 bp, Homo sapiens
ctctcttcagactctcagccca

SEQ ID NO: 4529650 - DNA, 15 bp, Homo sapiens
ctctcttccacagtg

SEQ ID NO: 4529651 - DNA, 13 bp, Homo sapiens
ctctcttcccctt

SEQ ID NO: 4529652 - DNA, 13 bp, Homo sapiens
ctctcttggaccc

SEQ ID NO: 4529653 - DNA, 17 bp, Homo sapiens
ctctcttggacccacct

SEQ ID NO: 4529654 - DNA, 17 bp, Homo sapiens
ctctcttggggcgccca

SEQ ID NO: 4529655 - DNA, 13 bp, Homo sapiens
ctctcttttaaag

SEQ ID NO: 4529656 - DNA, 18 bp, Homo sapiens
ctctcttttctacacact

SEQ ID NO: 4529657 - DNA, 20 bp, Homo sapiens
ctctcttttctacacactca

SEQ ID NO: 4529658 - DNA, 22 bp, Homo sapiens
ctctcttttctacacactcagc

SEQ ID NO: 4529659 - DNA, 17 bp, Homo sapiens
ctctcttttctgtactt

SEQ ID NO: 4529660 - DNA, 19 bp, Homo sapiens
ctctcttttctgtacttcc

SEQ ID NO: 4529661 - DNA, 14 bp, Homo sapiens
ctctcttttgttta

SEQ ID NO: 4529662 - DNA, 16 bp, Homo sapiens
ctctgaaacagctgcc

SEQ ID NO: 4529663 - DNA, 19 bp, Homo sapiens
ctctgaaacagctgcctta

SEQ ID NO: 4529664 - DNA, 19 bp, Homo sapiens
ctctgaagaactctctgga

SEQ ID NO: 4529665 - DNA, 15 bp, Homo sapiens
ctctgaagggacccc

SEQ ID NO: 4529666 - DNA, 15 bp, Homo sapiens
ctctgaatacacagt

SEQ ID NO: 4529667 - DNA, 18 bp, Homo sapiens
ctctgaatacacagtatt

SEQ ID NO: 4529668 - DNA, 16 bp, Homo sapiens
ctctgaatagttaaaa

SEQ ID NO: 4529669 - DNA, 17 bp, Homo sapiens
ctctgaattttcagaga

SEQ ID NO: 4529670 - DNA, 18 bp, Homo sapiens
ctctgaattttcagagac

SEQ ID NO: 4529671 - DNA, 22 bp, Homo sapiens
ctctgacagccctgcggagacc

SEQ ID NO: 4529672 - DNA, 12 bp, Homo sapiens
ctctgacagctc

SEQ ID NO: 4529673 - DNA, 13 bp, Homo sapiens
ctctgacagtatt

SEQ ID NO: 4529674 - DNA, 22 bp, Homo sapiens
ctctgacagtccacaggggcca

SEQ ID NO: 4529675 - DNA, 16 bp, Homo sapiens
ctctgaccgattcctt

SEQ ID NO: 4529676 - DNA, 17 bp, Homo sapiens
ctctgacctcctctggg

SEQ ID NO: 4529677 - DNA, 16 bp, Homo sapiens
ctctgactcagggctc

SEQ ID NO: 4529678 - DNA, 20 bp, Homo sapiens
ctctgactcagggctcctgg

SEQ ID NO: 4529679 - DNA, 14 bp, Homo sapiens
ctctgagcagtcag

SEQ ID NO: 4529680 - DNA, 14 bp, Homo sapiens
ctctgagccagatt

SEQ ID NO: 4529681 - DNA, 20 bp, Homo sapiens
ctctgagccagattacagga

SEQ ID NO: 4529682 - DNA, 13 bp, Homo sapiens
ctctgagctttgc

SEQ ID NO: 4529683 - DNA, 17 bp, Homo sapiens
ctctgagctttgcatgt

SEQ ID NO: 4529684 - DNA, 18 bp, Homo sapiens
ctctgatacacagtaatt

SEQ ID NO: 4529685 - DNA, 22 bp, Homo sapiens
ctctgatacacagtaattgtga

SEQ ID NO: 4529686 - DNA, 23 bp, Homo sapiens
ctctgatagctgtttcaaatgtg

SEQ ID NO: 4529687 - DNA, 15 bp, Homo sapiens
ctctgatcaagtatt

SEQ ID NO: 4529688 - DNA, 12 bp, Homo sapiens
ctctgatccctc

SEQ ID NO: 4529689 - DNA, 17 bp, Homo sapiens
ctctgattctacagtga

SEQ ID NO: 4529690 - DNA, 14 bp, Homo sapiens
ctctgcacccagaa

SEQ ID NO: 4529691 - DNA, 16 bp, Homo sapiens
ctctgcacccagaaca

SEQ ID NO: 4529692 - DNA, 14 bp, Homo sapiens
ctctgcacccagtg

SEQ ID NO: 4529693 - DNA, 23 bp, Homo sapiens
ctctgcacccgcctcgacctccc

SEQ ID NO: 4529694 - DNA, 13 bp, Homo sapiens
ctctgcactactc

SEQ ID NO: 4529695 - DNA, 23 bp, Homo sapiens
ctctgcactactcctctgcagtg

SEQ ID NO: 4529696 - DNA, 22 bp, Homo sapiens
ctctgcagacttcccagctagg

SEQ ID NO: 4529697 - DNA, 13 bp, Homo sapiens
ctctgcagccagc

SEQ ID NO: 4529698 - DNA, 15 bp, Homo sapiens
ctctgcagccagccc

SEQ ID NO: 4529699 - DNA, 16 bp, Homo sapiens
ctctgcagccagccca

SEQ ID NO: 4529700 - DNA, 18 bp, Homo sapiens
ctctgcagccagcccagc

SEQ ID NO: 4529701 - DNA, 14 bp, Homo sapiens
ctctgcaggctggg

SEQ ID NO: 4529702 - DNA, 16 bp, Homo sapiens
ctctgcaggctgggga

SEQ ID NO: 4529703 - DNA, 18 bp, Homo sapiens
ctctgcaggctggggagg

SEQ ID NO: 4529704 - DNA, 20 bp, Homo sapiens
ctctgcatagacaaaggcct

SEQ ID NO: 4529705 - DNA, 21 bp, Homo sapiens
ctctgcatgcggcccagcccg

SEQ ID NO: 4529706 - DNA, 20 bp, Homo sapiens
ctctgcatgttttttttaaa

SEQ ID NO: 4529707 - DNA, 14 bp, Homo sapiens
ctctgcatttgtct

SEQ ID NO: 4529708 - DNA, 12 bp, Homo sapiens
ctctgccacctc

SEQ ID NO: 4529709 - DNA, 13 bp, Homo sapiens
ctctgccacctcc

SEQ ID NO: 4529710 - DNA, 17 bp, Homo sapiens
ctctgccagaagatccc

SEQ ID NO: 4529711 - DNA, 15 bp, Homo sapiens
ctctgccattctgtg

SEQ ID NO: 4529712 - DNA, 11 bp, Homo sapiens
ctctgcccact

SEQ ID NO: 4529713 - DNA, 12 bp, Homo sapiens
ctctgccccaat

SEQ ID NO: 4529714 - DNA, 21 bp, Homo sapiens
ctctgcccccatttccccgat

SEQ ID NO: 4529715 - DNA, 14 bp, Homo sapiens
ctctgcccctgcag

SEQ ID NO: 4529716 - DNA, 15 bp, Homo sapiens
ctctgcccctggacc

SEQ ID NO: 4529717 - DNA, 20 bp, Homo sapiens
ctctgcccctggacctggga

SEQ ID NO: 4529718 - DNA, 14 bp, Homo sapiens
ctctgcccgggagc

SEQ ID NO: 4529719 - DNA, 17 bp, Homo sapiens
ctctgccctctccctgt

SEQ ID NO: 4529720 - DNA, 14 bp, Homo sapiens
ctctgccctggaaa

SEQ ID NO: 4529721 - DNA, 13 bp, Homo sapiens
ctctgccctggat

SEQ ID NO: 4529722 - DNA, 14 bp, Homo sapiens
ctctgccctggatt

SEQ ID NO: 4529723 - DNA, 15 bp, Homo sapiens
ctctgccctggattg

SEQ ID NO: 4529724 - DNA, 15 bp, Homo sapiens
ctctgccgctgccat

SEQ ID NO: 4529725 - DNA, 17 bp, Homo sapiens
ctctgccgctgccatgc

SEQ ID NO: 4529726 - DNA, 24 bp, Homo sapiens
ctctgccggtcgggcagccagcag

SEQ ID NO: 4529727 - DNA, 15 bp, Homo sapiens
ctctgcctcccaggt

SEQ ID NO: 4529728 - DNA, 13 bp, Homo sapiens
ctctgcctccctc

SEQ ID NO: 4529729 - DNA, 12 bp, Homo sapiens
ctctgcctgccc

SEQ ID NO: 4529730 - DNA, 20 bp, Homo sapiens
ctctgcctgccccgccccca

SEQ ID NO: 4529731 - DNA, 15 bp, Homo sapiens
ctctgccttgccctc

SEQ ID NO: 4529732 - DNA, 17 bp, Homo sapiens
ctctgccttgccctcct

SEQ ID NO: 4529733 - DNA, 20 bp, Homo sapiens
ctctgccttgccctcctggg

SEQ ID NO: 4529734 - DNA, 21 bp, Homo sapiens
ctctgccttgccctcctgggc

SEQ ID NO: 4529735 - DNA, 20 bp, Homo sapiens
ctctgcctttgtgatcctga

SEQ ID NO: 4529736 - DNA, 18 bp, Homo sapiens
ctctgcggagcacactgg

SEQ ID NO: 4529737 - DNA, 19 bp, Homo sapiens
ctctgcggagcacactggc

SEQ ID NO: 4529738 - DNA, 16 bp, Homo sapiens
ctctgcgggaggctgg

SEQ ID NO: 4529739 - DNA, 18 bp, Homo sapiens
ctctgcgggaggctgggg

SEQ ID NO: 4529740 - DNA, 20 bp, Homo sapiens
ctctgcgggaggctggggcc

SEQ ID NO: 4529741 - DNA, 22 bp, Homo sapiens
ctctgcgtgtcacctgtgcttc

SEQ ID NO: 4529742 - DNA, 15 bp, Homo sapiens
ctctgctatgagtgt

SEQ ID NO: 4529743 - DNA, 15 bp, Homo sapiens
ctctgctccaccaca

SEQ ID NO: 4529744 - DNA, 18 bp, Homo sapiens
ctctgctccaccacatcc

SEQ ID NO: 4529745 - DNA, 14 bp, Homo sapiens
ctctgctccctgca

SEQ ID NO: 4529746 - DNA, 16 bp, Homo sapiens
ctctgctgctctgacc

SEQ ID NO: 4529747 - DNA, 12 bp, Homo sapiens
ctctgctgcttt

SEQ ID NO: 4529748 - DNA, 21 bp, Homo sapiens
ctctgctggagaaagccacgc

SEQ ID NO: 4529749 - DNA, 20 bp, Homo sapiens
ctctgctggctcaggaggag

SEQ ID NO: 4529750 - DNA, 19 bp, Homo sapiens
ctctggaataaagttgcag

SEQ ID NO: 4529751 - DNA, 19 bp, Homo sapiens
ctctggacactctatatgt

SEQ ID NO: 4529752 - DNA, 17 bp, Homo sapiens
ctctggacagcagaagc

SEQ ID NO: 4529753 - DNA, 18 bp, Homo sapiens
ctctggacagcagaagcc

SEQ ID NO: 4529754 - DNA, 16 bp, Homo sapiens
ctctggacagccagtg

SEQ ID NO: 4529755 - DNA, 17 bp, Homo sapiens
ctctggacagccagtga

SEQ ID NO: 4529756 - DNA, 15 bp, Homo sapiens
ctctggacggcaggc

SEQ ID NO: 4529757 - DNA, 16 bp, Homo sapiens
ctctggacggcaggct

SEQ ID NO: 4529758 - DNA, 19 bp, Homo sapiens
ctctggactggctagagtc

SEQ ID NO: 4529759 - DNA, 17 bp, Homo sapiens
ctctggaggctgcagag

SEQ ID NO: 4529760 - DNA, 21 bp, Homo sapiens
ctctggatgatggattccaca

SEQ ID NO: 4529761 - DNA, 15 bp, Homo sapiens
ctctggcaaactttt

SEQ ID NO: 4529762 - DNA, 12 bp, Homo sapiens
ctctggcacagt

SEQ ID NO: 4529763 - DNA, 13 bp, Homo sapiens
ctctggcaccaca

SEQ ID NO: 4529764 - DNA, 15 bp, Homo sapiens
ctctggccctgcctt

SEQ ID NO: 4529765 - DNA, 18 bp, Homo sapiens
ctctggccctgccttctt

SEQ ID NO: 4529766 - DNA, 16 bp, Homo sapiens
ctctggctagaggcca

SEQ ID NO: 4529767 - DNA, 19 bp, Homo sapiens
ctctggctagaggccagcc

SEQ ID NO: 4529768 - DNA, 23 bp, Homo sapiens
ctctggctggctaactggaagca

SEQ ID NO: 4529769 - DNA, 15 bp, Homo sapiens
ctctggctttcccag

SEQ ID NO: 4529770 - DNA, 17 bp, Homo sapiens
ctctggctttcccagga

SEQ ID NO: 4529771 - DNA, 18 bp, Homo sapiens
ctctggctttcccaggag

SEQ ID NO: 4529772 - DNA, 20 bp, Homo sapiens
ctctgggactctcctcctcc

SEQ ID NO: 4529773 - DNA, 22 bp, Homo sapiens
ctctgggatttatgctcatgaa

SEQ ID NO: 4529774 - DNA, 17 bp, Homo sapiens
ctctgggccacttggag

SEQ ID NO: 4529775 - DNA, 22 bp, Homo sapiens
ctctgggcccaggggctgtggc

SEQ ID NO: 4529776 - DNA, 19 bp, Homo sapiens
ctctggggatttctgggat

SEQ ID NO: 4529777 - DNA, 15 bp, Homo sapiens
ctctggggccctggg

SEQ ID NO: 4529778 - DNA, 22 bp, Homo sapiens
ctctggggccctgggcctcagt

SEQ ID NO: 4529779 - DNA, 15 bp, Homo sapiens
ctctggggtgggcag

SEQ ID NO: 4529780 - DNA, 15 bp, Homo sapiens
ctctgggtctggcca

SEQ ID NO: 4529781 - DNA, 20 bp, Homo sapiens
ctctggtaaacattcctcca

SEQ ID NO: 4529782 - DNA, 21 bp, Homo sapiens
ctctggtaaacattcctccag

SEQ ID NO: 4529783 - DNA, 21 bp, Homo sapiens
ctctggtgataaaaataaagc

SEQ ID NO: 4529784 - DNA, 22 bp, Homo sapiens
ctctggtgataaaaataaagct

SEQ ID NO: 4529785 - DNA, 22 bp, Homo sapiens
ctctggttatttttctcttgta

SEQ ID NO: 4529786 - DNA, 12 bp, Homo sapiens
ctctgtactttt

SEQ ID NO: 4529787 - DNA, 17 bp, Homo sapiens
ctctgtagtttatggca

SEQ ID NO: 4529788 - DNA, 18 bp, Homo sapiens
ctctgtagtttatggcag

SEQ ID NO: 4529789 - DNA, 20 bp, Homo sapiens
ctctgtcagccagccgccct

SEQ ID NO: 4529790 - DNA, 21 bp, Homo sapiens
ctctgtcagccagccgccctg

SEQ ID NO: 4529791 - DNA, 23 bp, Homo sapiens
ctctgtcagccagccgccctggg

SEQ ID NO: 4529792 - DNA, 17 bp, Homo sapiens
ctctgtccccttctctc

SEQ ID NO: 4529793 - DNA, 23 bp, Homo sapiens
ctctgtccccttctctcatctct

SEQ ID NO: 4529794 - DNA, 14 bp, Homo sapiens
ctctgtccctgtcc

SEQ ID NO: 4529795 - DNA, 15 bp, Homo sapiens
ctctgtcgcccaggc

SEQ ID NO: 4529796 - DNA, 16 bp, Homo sapiens
ctctgtcgcccaggct

SEQ ID NO: 4529797 - DNA, 16 bp, Homo sapiens
ctctgtctacctggtc

SEQ ID NO: 4529798 - DNA, 17 bp, Homo sapiens
ctctgtctgcccttcac

SEQ ID NO: 4529799 - DNA, 22 bp, Homo sapiens
ctctgtgaactgtgtgtgaatc

SEQ ID NO: 4529800 - DNA, 17 bp, Homo sapiens
ctctgtgaccaatgtct

SEQ ID NO: 4529801 - DNA, 17 bp, Homo sapiens
ctctgtgagactcgaga

SEQ ID NO: 4529802 - DNA, 18 bp, Homo sapiens
ctctgtgagactcgagaa

SEQ ID NO: 4529803 - DNA, 14 bp, Homo sapiens
ctctgtgctgtgga

SEQ ID NO: 4529804 - DNA, 18 bp, Homo sapiens
ctctgtgctgtggaagca

SEQ ID NO: 4529805 - DNA, 16 bp, Homo sapiens
ctctgtggcgagccat

SEQ ID NO: 4529806 - DNA, 13 bp, Homo sapiens
ctctgtggtccct

SEQ ID NO: 4529807 - DNA, 15 bp, Homo sapiens
ctctgtgtatatctc

SEQ ID NO: 4529808 - DNA, 21 bp, Homo sapiens
ctctgtgtggctgtgcaattt

SEQ ID NO: 4529809 - DNA, 13 bp, Homo sapiens
ctctgttaatgtg

SEQ ID NO: 4529810 - DNA, 23 bp, Homo sapiens
ctctgttccatgcaactggagtt

SEQ ID NO: 4529811 - DNA, 14 bp, Homo sapiens
ctctgttcccctag

SEQ ID NO: 4529812 - DNA, 17 bp, Homo sapiens
ctctgtttagaggaggc

SEQ ID NO: 4529813 - DNA, 18 bp, Homo sapiens
ctctgtttgtgggactgg

SEQ ID NO: 4529814 - DNA, 14 bp, Homo sapiens
ctctgtttgtgggg

SEQ ID NO: 4529815 - DNA, 14 bp, Homo sapiens
ctctgttttctctc

SEQ ID NO: 4529816 - DNA, 18 bp, Homo sapiens
ctcttaaattatatattt

SEQ ID NO: 4529817 - DNA, 20 bp, Homo sapiens
ctcttaaattatatatttat

SEQ ID NO: 4529818 - DNA, 14 bp, Homo sapiens
ctcttacttgccaa

SEQ ID NO: 4529819 - DNA, 14 bp, Homo sapiens
ctcttagaatttgt

SEQ ID NO: 4529820 - DNA, 15 bp, Homo sapiens
ctcttagctcccctc

SEQ ID NO: 4529821 - DNA, 19 bp, Homo sapiens
ctcttatagaagcttcagc

SEQ ID NO: 4529822 - DNA, 17 bp, Homo sapiens
ctcttattgttctttca

SEQ ID NO: 4529823 - DNA, 23 bp, Homo sapiens
ctcttatttctttcctttaaaaa

SEQ ID NO: 4529824 - DNA, 16 bp, Homo sapiens
ctcttcaataaaccac

SEQ ID NO: 4529825 - DNA, 17 bp, Homo sapiens
ctcttcagactctcagc

SEQ ID NO: 4529826 - DNA, 17 bp, Homo sapiens
ctcttcaggcctccctc

SEQ ID NO: 4529827 - DNA, 19 bp, Homo sapiens
ctcttcaggcctccctctc

SEQ ID NO: 4529828 - DNA, 20 bp, Homo sapiens
ctcttcaggcctccctctct

SEQ ID NO: 4529829 - DNA, 21 bp, Homo sapiens
ctcttcatgcttgacatacct

SEQ ID NO: 4529830 - DNA, 18 bp, Homo sapiens
ctcttcattattctctgc

SEQ ID NO: 4529831 - DNA, 14 bp, Homo sapiens
ctcttccacagtgg

SEQ ID NO: 4529832 - DNA, 12 bp, Homo sapiens
ctcttccccaga

SEQ ID NO: 4529833 - DNA, 19 bp, Homo sapiens
ctcttccccagagaggcac

SEQ ID NO: 4529834 - DNA, 16 bp, Homo sapiens
ctcttccccttccctt

SEQ ID NO: 4529835 - DNA, 17 bp, Homo sapiens
ctcttccctttgtgtat

SEQ ID NO: 4529836 - DNA, 16 bp, Homo sapiens
ctcttccttttatcag

SEQ ID NO: 4529837 - DNA, 13 bp, Homo sapiens
ctcttctacttgt

SEQ ID NO: 4529838 - DNA, 22 bp, Homo sapiens
ctcttctagatggaccccagca

SEQ ID NO: 4529839 - DNA, 23 bp, Homo sapiens
ctcttctagatggaccccagcat

SEQ ID NO: 4529840 - DNA, 15 bp, Homo sapiens
ctcttctcatttcac

SEQ ID NO: 4529841 - DNA, 13 bp, Homo sapiens
ctcttctctccag

SEQ ID NO: 4529842 - DNA, 14 bp, Homo sapiens
ctcttctctccagc

SEQ ID NO: 4529843 - DNA, 15 bp, Homo sapiens
ctcttctctccagct

SEQ ID NO: 4529844 - DNA, 13 bp, Homo sapiens
ctcttctctcccc

SEQ ID NO: 4529845 - DNA, 14 bp, Homo sapiens
ctcttctctcccca

SEQ ID NO: 4529846 - DNA, 15 bp, Homo sapiens
ctcttctctccccag

SEQ ID NO: 4529847 - DNA, 17 bp, Homo sapiens
ctcttctctccccagcc

SEQ ID NO: 4529848 - DNA, 22 bp, Homo sapiens
ctcttctcttgacagtctgaag

SEQ ID NO: 4529849 - DNA, 10 bp, Homo sapiens
ctcttctgaa

SEQ ID NO: 4529850 - DNA, 20 bp, Homo sapiens
ctcttctgaataaagcaatt

SEQ ID NO: 4529851 - DNA, 13 bp, Homo sapiens
ctcttctgctcca

SEQ ID NO: 4529852 - DNA, 16 bp, Homo sapiens
ctcttctgctccaccc

SEQ ID NO: 4529853 - DNA, 21 bp, Homo sapiens
ctcttctgggagggcagcagg

SEQ ID NO: 4529854 - DNA, 17 bp, Homo sapiens
ctcttctttaagccata

SEQ ID NO: 4529855 - DNA, 19 bp, Homo sapiens
ctcttctttaagccataga

SEQ ID NO: 4529856 - DNA, 16 bp, Homo sapiens
ctcttctttgtgcctt

SEQ ID NO: 4529857 - DNA, 21 bp, Homo sapiens
ctcttgaaatattcagaaatt

SEQ ID NO: 4529858 - DNA, 23 bp, Homo sapiens
ctcttgatctctcttgtcctctt

SEQ ID NO: 4529859 - DNA, 14 bp, Homo sapiens
ctcttgcaggctga

SEQ ID NO: 4529860 - DNA, 17 bp, Homo sapiens
ctcttgcaggctgagtc

SEQ ID NO: 4529861 - DNA, 21 bp, Homo sapiens
ctcttgccatttgtagctttg

SEQ ID NO: 4529862 - DNA, 15 bp, Homo sapiens
ctcttgcccatcctg

SEQ ID NO: 4529863 - DNA, 19 bp, Homo sapiens
ctcttgcccatcctgactg

SEQ ID NO: 4529864 - DNA, 20 bp, Homo sapiens
ctcttgcccatcctgactga

SEQ ID NO: 4529865 - DNA, 18 bp, Homo sapiens
ctcttgcctcgaggggcc

SEQ ID NO: 4529866 - DNA, 21 bp, Homo sapiens
ctcttggggagtttagggtgg

SEQ ID NO: 4529867 - DNA, 16 bp, Homo sapiens
ctcttgggtcagagaa

SEQ ID NO: 4529868 - DNA, 21 bp, Homo sapiens
ctcttggttcgatacctggag

SEQ ID NO: 4529869 - DNA, 17 bp, Homo sapiens
ctcttgtgatttcttta

SEQ ID NO: 4529870 - DNA, 22 bp, Homo sapiens
ctcttgtgatttctttaaaaga

SEQ ID NO: 4529871 - DNA, 12 bp, Homo sapiens
ctctttaaaaca

SEQ ID NO: 4529872 - DNA, 15 bp, Homo sapiens
ctctttaaaacaaaa

SEQ ID NO: 4529873 - DNA, 15 bp, Homo sapiens
ctctttacatttctt

SEQ ID NO: 4529874 - DNA, 16 bp, Homo sapiens
ctctttacctttgccc

SEQ ID NO: 4529875 - DNA, 12 bp, Homo sapiens
ctctttcaaaac

SEQ ID NO: 4529876 - DNA, 18 bp, Homo sapiens
ctctttccatgacatcaa

SEQ ID NO: 4529877 - DNA, 16 bp, Homo sapiens
ctatttgtataaaaat

SEQ ID NO: 4529878 - DNA, 18 bp, Homo sapiens
ctatttgtataaaaatta

SEQ ID NO: 4529879 - DNA, 12 bp, Homo sapiens
ctatttgtctct

SEQ ID NO: 4529880 - DNA, 22 bp, Homo sapiens
ctattttacttttctgccaaaa

SEQ ID NO: 4529881 - DNA, 12 bp, Homo sapiens
ctattttcagaa

SEQ ID NO: 4529882 - DNA, 15 bp, Homo sapiens
ctattttcagaatct

SEQ ID NO: 4529883 - DNA, 19 bp, Homo sapiens
ctattttcatcacagttgc

SEQ ID NO: 4529884 - DNA, 12 bp, Homo sapiens
ctattttctatt

SEQ ID NO: 4529885 - DNA, 15 bp, Homo sapiens
ctattttgatgcagc

SEQ ID NO: 4529886 - DNA, 19 bp, Homo sapiens
ctatttttaatgtttgtac

SEQ ID NO: 4529887 - DNA, 20 bp, Homo sapiens
ctatttttattttaaaataa

SEQ ID NO: 4529888 - DNA, 14 bp, Homo sapiens
ctatttttctctcc

SEQ ID NO: 4529889 - DNA, 20 bp, Homo sapiens
ctatttttctctcctgtcct

SEQ ID NO: 4529890 - DNA, 16 bp, Homo sapiens
ctatttttctttccaa

SEQ ID NO: 4529891 - DNA, 22 bp, Homo sapiens
ctatttttgacatggaaatgaa

SEQ ID NO: 4529892 - DNA, 14 bp, Homo sapiens
ctatttttgactgt

SEQ ID NO: 4529893 - DNA, 18 bp, Homo sapiens
ctatttttggcagtctga

SEQ ID NO: 4529894 - DNA, 22 bp, Homo sapiens
ctatttttggcagtctgaattt

SEQ ID NO: 4529895 - DNA, 21 bp, Homo sapiens
ctatttttttaaaatcactaa

SEQ ID NO: 4529896 - DNA, 14 bp, Homo sapiens
ctatttttttcaaa

SEQ ID NO: 4529897 - DNA, 22 bp, Homo sapiens
ctatttttttcctaagacattt

SEQ ID NO: 4529898 - DNA, 19 bp, Homo sapiens
ctcaaaaaaaaaaagaaaa

SEQ ID NO: 4529899 - DNA, 14 bp, Homo sapiens
ctcaaaaagaaatc

SEQ ID NO: 4529900 - DNA, 21 bp, Homo sapiens
ctcaaaacacttccagtctgg

SEQ ID NO: 4529901 - DNA, 20 bp, Homo sapiens
ctcaaaagagaaaaacaaaa

SEQ ID NO: 4529902 - DNA, 22 bp, Homo sapiens
ctcaaaccaagggtacagatcc

SEQ ID NO: 4529903 - DNA, 15 bp, Homo sapiens
ctcaaaccatatttt

SEQ ID NO: 4529904 - DNA, 23 bp, Homo sapiens
ctcaaactcattgcagcagataa

SEQ ID NO: 4529905 - DNA, 17 bp, Homo sapiens
ctcaaagaagtcggaat

SEQ ID NO: 4529906 - DNA, 15 bp, Homo sapiens
ctcaaatacatgcac

SEQ ID NO: 4529907 - DNA, 18 bp, Homo sapiens
ctcaaatacatgcacagt

SEQ ID NO: 4529908 - DNA, 21 bp, Homo sapiens
ctcaaatcagtgataattggt

SEQ ID NO: 4529909 - DNA, 21 bp, Homo sapiens
ctcaacaaaaaaccgaggccc

SEQ ID NO: 4529910 - DNA, 20 bp, Homo sapiens
ctcaacacccaactgtctcg

SEQ ID NO: 4529911 - DNA, 14 bp, Homo sapiens
ctcaacagagagga

SEQ ID NO: 4529912 - DNA, 14 bp, Homo sapiens
ctcaacccccctcc

SEQ ID NO: 4529913 - DNA, 22 bp, Homo sapiens
ctcaacccccctcccagacagg

SEQ ID NO: 4529914 - DNA, 15 bp, Homo sapiens
ctcaacctgtaaatt

SEQ ID NO: 4529915 - DNA, 22 bp, Homo sapiens
ctcaacgcctccccctccccca

SEQ ID NO: 4529916 - DNA, 14 bp, Homo sapiens
ctcaactactcagc

SEQ ID NO: 4529917 - DNA, 23 bp, Homo sapiens
ctcaactccgtgcttaaccaaag

SEQ ID NO: 4529918 - DNA, 14 bp, Homo sapiens
ctcaactcctccca

SEQ ID NO: 4529919 - DNA, 17 bp, Homo sapiens
ctcaactttctgttgga

SEQ ID NO: 4529920 - DNA, 21 bp, Homo sapiens
ctcaagaatctagaagatgtg

SEQ ID NO: 4529921 - DNA, 12 bp, Homo sapiens
ctcaagaccccc

SEQ ID NO: 4529922 - DNA, 22 bp, Homo sapiens
ctcaagacccccatttgtccca

SEQ ID NO: 4529923 - DNA, 18 bp, Homo sapiens
ctcaagccccatttcctc

SEQ ID NO: 4529924 - DNA, 15 bp, Homo sapiens
ctcaaggacaggagc

SEQ ID NO: 4529925 - DNA, 16 bp, Homo sapiens
ctcaaggacaggagcc

SEQ ID NO: 4529926 - DNA, 19 bp, Homo sapiens
ctcaaggacaggagcctgg

SEQ ID NO: 4529927 - DNA, 22 bp, Homo sapiens
ctcaaggagaggcaaagaaagg

SEQ ID NO: 4529928 - DNA, 22 bp, Homo sapiens
ctcaagtgggaacgactgggca

SEQ ID NO: 4529929 - DNA, 16 bp, Homo sapiens
ctcaatcagtctcaga

SEQ ID NO: 4529930 - DNA, 20 bp, Homo sapiens
ctcaatcctaatttctcctc

SEQ ID NO: 4529931 - DNA, 20 bp, Homo sapiens
ctcaatgtgaatcagaccct

SEQ ID NO: 4529932 - DNA, 21 bp, Homo sapiens
ctcaatgtgaatcagacccta

SEQ ID NO: 4529933 - DNA, 23 bp, Homo sapiens
ctcaatttttgtttttgagtact

SEQ ID NO: 4529934 - DNA, 22 bp, Homo sapiens
ctcacaaaaaggcaaatattga

SEQ ID NO: 4529935 - DNA, 15 bp, Homo sapiens
ctcacaatgaggcta

SEQ ID NO: 4529936 - DNA, 15 bp, Homo sapiens
ctcacacagccaggt

SEQ ID NO: 4529937 - DNA, 16 bp, Homo sapiens
ctcacacctcactctt

SEQ ID NO: 4529938 - DNA, 20 bp, Homo sapiens
ctcacacgtttaatcccagc

SEQ ID NO: 4529939 - DNA, 14 bp, Homo sapiens
ctcacactgagaat

SEQ ID NO: 4529940 - DNA, 20 bp, Homo sapiens
ctcacactgagaatgtaaga

SEQ ID NO: 4529941 - DNA, 17 bp, Homo sapiens
ctcacagccgcattggt

SEQ ID NO: 4529942 - DNA, 17 bp, Homo sapiens
ctcacagtcccactgtg

SEQ ID NO: 4529943 - DNA, 19 bp, Homo sapiens
ctcacagttcctcgccctg

SEQ ID NO: 4529944 - DNA, 21 bp, Homo sapiens
ctcacagttcctcgccctggg

SEQ ID NO: 4529945 - DNA, 22 bp, Homo sapiens
ctcacagttcctcgccctgggt

SEQ ID NO: 4529946 - DNA, 21 bp, Homo sapiens
ctcacataagcccagttcatc

SEQ ID NO: 4529947 - DNA, 21 bp, Homo sapiens
ctcacatagccaactctccca

SEQ ID NO: 4529948 - DNA, 12 bp, Homo sapiens
ctcacatgggac

SEQ ID NO: 4529949 - DNA, 19 bp, Homo sapiens
ctcacatgggactgggata

SEQ ID NO: 4529950 - DNA, 18 bp, Homo sapiens
ctcaccactaccagccag

SEQ ID NO: 4529951 - DNA, 23 bp, Homo sapiens
ctcaccactaccagccagcctca

SEQ ID NO: 4529952 - DNA, 15 bp, Homo sapiens
ctcaccagccctgca

SEQ ID NO: 4529953 - DNA, 12 bp, Homo sapiens
ctcaccagctgc

SEQ ID NO: 4529954 - DNA, 13 bp, Homo sapiens
ctcaccagctgca

SEQ ID NO: 4529955 - DNA, 15 bp, Homo sapiens
ctcaccagctgcaaa

SEQ ID NO: 4529956 - DNA, 16 bp, Homo sapiens
ctcaccagctgcaaag

SEQ ID NO: 4529957 - DNA, 17 bp, Homo sapiens
ctcaccagctgcaaagt

SEQ ID NO: 4529958 - DNA, 18 bp, Homo sapiens
ctcaccagctgcaaagtg

SEQ ID NO: 4529959 - DNA, 20 bp, Homo sapiens
ctcaccagctgcaaagtgtt

SEQ ID NO: 4529960 - DNA, 17 bp, Homo sapiens
ctcacccatcctagagg

SEQ ID NO: 4529961 - DNA, 14 bp, Homo sapiens
ctcacccccatccc

SEQ ID NO: 4529962 - DNA, 14 bp, Homo sapiens
ctcaccccctccca

SEQ ID NO: 4529963 - DNA, 18 bp, Homo sapiens
ctcaccccctcccacccc

SEQ ID NO: 4529964 - DNA, 22 bp, Homo sapiens
ctcaccccctcccacccccagc

SEQ ID NO: 4529965 - DNA, 13 bp, Homo sapiens
ctcaccccctcgg

SEQ ID NO: 4529966 - DNA, 21 bp, Homo sapiens
ctcaccccctcgggtctcctc

SEQ ID NO: 4529967 - DNA, 14 bp, Homo sapiens
ctcacccctcgcca

SEQ ID NO: 4529968 - DNA, 17 bp, Homo sapiens
ctcacccctggttctca

SEQ ID NO: 4529969 - DNA, 16 bp, Homo sapiens
ctcaccctctcttggt

SEQ ID NO: 4529970 - DNA, 15 bp, Homo sapiens
ctcaccctgctacac

SEQ ID NO: 4529971 - DNA, 13 bp, Homo sapiens
ctcaccctgggag

SEQ ID NO: 4529972 - DNA, 15 bp, Homo sapiens
ctcaccctgggagcc

SEQ ID NO: 4529973 - DNA, 14 bp, Homo sapiens
ctcaccgcccatca

SEQ ID NO: 4529974 - DNA, 15 bp, Homo sapiens
ctcacctagcctgat

SEQ ID NO: 4529975 - DNA, 15 bp, Homo sapiens
ctcacctcatgccca

SEQ ID NO: 4529976 - DNA, 17 bp, Homo sapiens
ctcacctcatgcccacc

SEQ ID NO: 4529977 - DNA, 23 bp, Homo sapiens
ctcacctcatgcccaccccctgc

SEQ ID NO: 4529978 - DNA, 15 bp, Homo sapiens
ctcacctctctctaa

SEQ ID NO: 4529979 - DNA, 16 bp, Homo sapiens
ctcacctctgcctcaa

SEQ ID NO: 4529980 - DNA, 19 bp, Homo sapiens
ctcacctctgcctcaatgt

SEQ ID NO: 4529981 - DNA, 12 bp, Homo sapiens
ctcacctgacct

SEQ ID NO: 4529982 - DNA, 20 bp, Homo sapiens
ctcacctgcactaacagagt

SEQ ID NO: 4529983 - DNA, 23 bp, Homo sapiens
ctcacctgctcccagtcctgcct

SEQ ID NO: 4529984 - DNA, 16 bp, Homo sapiens
ctcacgaaagtattta

SEQ ID NO: 4529985 - DNA, 17 bp, Homo sapiens
ctcacgaaagtatttac

SEQ ID NO: 4529986 - DNA, 21 bp, Homo sapiens
ctcacgcctgtaatcccagca

SEQ ID NO: 4529987 - DNA, 22 bp, Homo sapiens
ctcacgcctgtaatcccagcac

SEQ ID NO: 4529988 - DNA, 16 bp, Homo sapiens
ctcacgctttgtttac

SEQ ID NO: 4529989 - DNA, 19 bp, Homo sapiens
ctcacgggcagtagctgtg

SEQ ID NO: 4529990 - DNA, 20 bp, Homo sapiens
ctcacggggttggctgttcc

SEQ ID NO: 4529991 - DNA, 21 bp, Homo sapiens
ctcacggggttggctgttcca

SEQ ID NO: 4529992 - DNA, 17 bp, Homo sapiens
ctcactaatttttgtat

SEQ ID NO: 4529993 - DNA, 17 bp, Homo sapiens
ctcactataccagtata

SEQ ID NO: 4529994 - DNA, 21 bp, Homo sapiens
ctcactatggtatgctggcca

SEQ ID NO: 4529995 - DNA, 12 bp, Homo sapiens
ctcactccacca

SEQ ID NO: 4529996 - DNA, 17 bp, Homo sapiens
ctcactcccctctcctc

SEQ ID NO: 4529997 - DNA, 15 bp, Homo sapiens
ctatccacccagccc

SEQ ID NO: 4529998 - DNA, 17 bp, Homo sapiens
ctatccacccagcccat

SEQ ID NO: 4529999 - DNA, 17 bp, Homo sapiens
ctatccccatctccctg

SEQ ID NO: 4530000 - DNA, 18 bp, Homo sapiens
ctatccctaggcacttaa

SEQ ID NO: 4530001 - DNA, 15 bp, Homo sapiens
ctatccgctgccagc

SEQ ID NO: 4530002 - DNA, 15 bp, Homo sapiens
ctatccgtgttgcag

SEQ ID NO: 4530003 - DNA, 18 bp, Homo sapiens
ctatcctacaaggcctat

SEQ ID NO: 4530004 - DNA, 12 bp, Homo sapiens
ctatcctctgta

SEQ ID NO: 4530005 - DNA, 18 bp, Homo sapiens
ctatcctgtaaatatatc

SEQ ID NO: 4530006 - DNA, 19 bp, Homo sapiens
ctatccttccagtggctcg

SEQ ID NO: 4530007 - DNA, 14 bp, Homo sapiens
ctatcctttcaaac

SEQ ID NO: 4530008 - DNA, 21 bp, Homo sapiens
ctatccttttgcctgcaggtc

SEQ ID NO: 4530009 - DNA, 15 bp, Homo sapiens
ctatctaatgacatg

SEQ ID NO: 4530010 - DNA, 20 bp, Homo sapiens
ctatctacaaagaaaaatta

SEQ ID NO: 4530011 - DNA, 17 bp, Homo sapiens
ctatctagcatttattt

SEQ ID NO: 4530012 - DNA, 18 bp, Homo sapiens
ctatctcaatcctaattt

SEQ ID NO: 4530013 - DNA, 21 bp, Homo sapiens
ctatctcatctatctcaatcc

SEQ ID NO: 4530014 - DNA, 23 bp, Homo sapiens
ctatctccgttccatctgggctt

SEQ ID NO: 4530015 - DNA, 23 bp, Homo sapiens
ctatctctctgtcttttttctct

SEQ ID NO: 4530016 - DNA, 18 bp, Homo sapiens
ctatctgaaagtaaagtt

SEQ ID NO: 4530017 - DNA, 21 bp, Homo sapiens
ctatctggtattaaatgccaa

SEQ ID NO: 4530018 - DNA, 17 bp, Homo sapiens
ctatctggtgatttcta

SEQ ID NO: 4530019 - DNA, 14 bp, Homo sapiens
ctatctgtgattcc

SEQ ID NO: 4530020 - DNA, 16 bp, Homo sapiens
ctatctgttcctatct

SEQ ID NO: 4530021 - DNA, 14 bp, Homo sapiens
ctatcttcatgtaa

SEQ ID NO: 4530022 - DNA, 14 bp, Homo sapiens
ctatctttgctgca

SEQ ID NO: 4530023 - DNA, 21 bp, Homo sapiens
ctatgaaaagctagaattgag

SEQ ID NO: 4530024 - DNA, 18 bp, Homo sapiens
ctatgaaaatgagccctg

SEQ ID NO: 4530025 - DNA, 17 bp, Homo sapiens
ctatgaaataatgtgaa

SEQ ID NO: 4530026 - DNA, 11 bp, Homo sapiens
ctatgaacaga

SEQ ID NO: 4530027 - DNA, 20 bp, Homo sapiens
ctatgaagagctagagaaat

SEQ ID NO: 4530028 - DNA, 23 bp, Homo sapiens
ctatgacctaggggtttctgttg

SEQ ID NO: 4530029 - DNA, 19 bp, Homo sapiens
ctatgagatggccatgctc

SEQ ID NO: 4530030 - DNA, 22 bp, Homo sapiens
ctatgagatggccatgctcaac

SEQ ID NO: 4530031 - DNA, 23 bp, Homo sapiens
ctatgaggaaactgagtcactca

SEQ ID NO: 4530032 - DNA, 20 bp, Homo sapiens
ctatgagggtgtttcctcta

SEQ ID NO: 4530033 - DNA, 23 bp, Homo sapiens
ctatgatattttctgtgcctgaa

SEQ ID NO: 4530034 - DNA, 18 bp, Homo sapiens
ctatgatgagaggccagc

SEQ ID NO: 4530035 - DNA, 16 bp, Homo sapiens
ctatgcactgaagagc

SEQ ID NO: 4530036 - DNA, 17 bp, Homo sapiens
ctatgcactgaagagct

SEQ ID NO: 4530037 - DNA, 18 bp, Homo sapiens
ctatgcactgaagagctc

SEQ ID NO: 4530038 - DNA, 20 bp, Homo sapiens
ctatgcactgaagagctctt

SEQ ID NO: 4530039 - DNA, 15 bp, Homo sapiens
ctatgcaggcagcac

SEQ ID NO: 4530040 - DNA, 21 bp, Homo sapiens
ctatgcctgtggtgaagtgtg

SEQ ID NO: 4530041 - DNA, 18 bp, Homo sapiens
ctatgctgtttgtagtga

SEQ ID NO: 4530042 - DNA, 15 bp, Homo sapiens
ctatggaaagatggc

SEQ ID NO: 4530043 - DNA, 18 bp, Homo sapiens
ctatggaacataaagttg

SEQ ID NO: 4530044 - DNA, 22 bp, Homo sapiens
ctatggaacataaagttgtatt

SEQ ID NO: 4530045 - DNA, 18 bp, Homo sapiens
ctatggagactttgctgt

SEQ ID NO: 4530046 - DNA, 19 bp, Homo sapiens
ctatggagactttgctgtt

SEQ ID NO: 4530047 - DNA, 17 bp, Homo sapiens
ctatggagtcttgtgaa

SEQ ID NO: 4530048 - DNA, 19 bp, Homo sapiens
ctatggagtcttgtgaaag

SEQ ID NO: 4530049 - DNA, 17 bp, Homo sapiens
ctatggattcacttcta

SEQ ID NO: 4530050 - DNA, 20 bp, Homo sapiens
ctatggattcacttctattt

SEQ ID NO: 4530051 - DNA, 22 bp, Homo sapiens
ctatggattcacttctatttat

SEQ ID NO: 4530052 - DNA, 19 bp, Homo sapiens
ctatggctttaaataaatt

SEQ ID NO: 4530053 - DNA, 13 bp, Homo sapiens
ctatggctttcaa

SEQ ID NO: 4530054 - DNA, 14 bp, Homo sapiens
ctatggctttcaaa

SEQ ID NO: 4530055 - DNA, 15 bp, Homo sapiens
ctatggctttcaaag

SEQ ID NO: 4530056 - DNA, 18 bp, Homo sapiens
ctatggctttcaaagcta

SEQ ID NO: 4530057 - DNA, 21 bp, Homo sapiens
ctatgggagattaaaaccaga

SEQ ID NO: 4530058 - DNA, 16 bp, Homo sapiens
ctatgggagccccagg

SEQ ID NO: 4530059 - DNA, 19 bp, Homo sapiens
ctatgggtctaggacacag

SEQ ID NO: 4530060 - DNA, 21 bp, Homo sapiens
ctatgggtttagttactttag

SEQ ID NO: 4530061 - DNA, 17 bp, Homo sapiens
ctatggtatgctggcca

SEQ ID NO: 4530062 - DNA, 22 bp, Homo sapiens
ctatgtaataatgtacagagga

SEQ ID NO: 4530063 - DNA, 23 bp, Homo sapiens
ctatgtaataatgtacagaggaa

SEQ ID NO: 4530064 - DNA, 18 bp, Homo sapiens
ctatgtattttcctaatg

SEQ ID NO: 4530065 - DNA, 15 bp, Homo sapiens
ctatgtctgccttcg

SEQ ID NO: 4530066 - DNA, 12 bp, Homo sapiens
ctatgtgacaat

SEQ ID NO: 4530067 - DNA, 21 bp, Homo sapiens
ctatgtgacatttctcttccc

SEQ ID NO: 4530068 - DNA, 18 bp, Homo sapiens
ctatgtgattctggaagc

SEQ ID NO: 4530069 - DNA, 20 bp, Homo sapiens
ctatgtgattctggaagcaa

SEQ ID NO: 4530070 - DNA, 17 bp, Homo sapiens
ctatgtgtttttctcat

SEQ ID NO: 4530071 - DNA, 14 bp, Homo sapiens
ctatgttaatattt

SEQ ID NO: 4530072 - DNA, 15 bp, Homo sapiens
ctatgttaatatttt

SEQ ID NO: 4530073 - DNA, 21 bp, Homo sapiens
ctatgttaatattttaggtgt

SEQ ID NO: 4530074 - DNA, 19 bp, Homo sapiens
ctatgttccaataaaactt

SEQ ID NO: 4530075 - DNA, 21 bp, Homo sapiens
ctatgtttatttttgtacatt

SEQ ID NO: 4530076 - DNA, 14 bp, Homo sapiens
ctatgtttcatctt

SEQ ID NO: 4530077 - DNA, 16 bp, Homo sapiens
ctatgtttttaatgta

SEQ ID NO: 4530078 - DNA, 22 bp, Homo sapiens
ctatgtttttgttcaaagccag

SEQ ID NO: 4530079 - DNA, 19 bp, Homo sapiens
ctattaacaattaattgtc

SEQ ID NO: 4530080 - DNA, 20 bp, Homo sapiens
ctattaacaattaattgtct

SEQ ID NO: 4530081 - DNA, 22 bp, Homo sapiens
ctattaatatttgtttagttca

SEQ ID NO: 4530082 - DNA, 15 bp, Homo sapiens
ctattacttgaactt

SEQ ID NO: 4530083 - DNA, 18 bp, Homo sapiens
ctattacttgaactttcc

SEQ ID NO: 4530084 - DNA, 20 bp, Homo sapiens
ctattacttgaactttccaa

SEQ ID NO: 4530085 - DNA, 13 bp, Homo sapiens
ctattacttttct

SEQ ID NO: 4530086 - DNA, 17 bp, Homo sapiens
ctattacttttctgttt

SEQ ID NO: 4530087 - DNA, 20 bp, Homo sapiens
ctattagtattattaacact

SEQ ID NO: 4530088 - DNA, 17 bp, Homo sapiens
ctattatagtgaaacat

SEQ ID NO: 4530089 - DNA, 17 bp, Homo sapiens
ctattatggaaaactgt

SEQ ID NO: 4530090 - DNA, 16 bp, Homo sapiens
ctattcaaacagtctc

SEQ ID NO: 4530091 - DNA, 23 bp, Homo sapiens
ctattcaaacagtctcaggaaat

SEQ ID NO: 4530092 - DNA, 16 bp, Homo sapiens
ctattcacaattattc

SEQ ID NO: 4530093 - DNA, 23 bp, Homo sapiens
ctattcagcttcgtttattttca

SEQ ID NO: 4530094 - DNA, 13 bp, Homo sapiens
ctattcatggcta

SEQ ID NO: 4530095 - DNA, 16 bp, Homo sapiens
ctattccttcacacag

SEQ ID NO: 4530096 - DNA, 21 bp, Homo sapiens
ctattctgatgaatctcaaag

SEQ ID NO: 4530097 - DNA, 23 bp, Homo sapiens
ctattcttgatttatttgcttct

SEQ ID NO: 4530098 - DNA, 23 bp, Homo sapiens
ctattcttggaccatgccagatt

SEQ ID NO: 4530099 - DNA, 12 bp, Homo sapiens
ctattgacaata

SEQ ID NO: 4530100 - DNA, 21 bp, Homo sapiens
ctattgatgtacagtctgtca

SEQ ID NO: 4530101 - DNA, 14 bp, Homo sapiens
ctattgcatttata

SEQ ID NO: 4530102 - DNA, 17 bp, Homo sapiens
ctattgcatttatatgt

SEQ ID NO: 4530103 - DNA, 18 bp, Homo sapiens
ctattgctgctgcccctt

SEQ ID NO: 4530104 - DNA, 16 bp, Homo sapiens
ctattgtgccaactgc

SEQ ID NO: 4530105 - DNA, 17 bp, Homo sapiens
ctatttaacaagatgtt

SEQ ID NO: 4530106 - DNA, 13 bp, Homo sapiens
ctatttaacattt

SEQ ID NO: 4530107 - DNA, 16 bp, Homo sapiens
ctatttaacattttac

SEQ ID NO: 4530108 - DNA, 21 bp, Homo sapiens
ctatttataatacagaatctt

SEQ ID NO: 4530109 - DNA, 11 bp, Homo sapiens
ctatttcaata

SEQ ID NO: 4530110 - DNA, 13 bp, Homo sapiens
ctatttctatgtc

SEQ ID NO: 4530111 - DNA, 14 bp, Homo sapiens
ctatttctatgtca

SEQ ID NO: 4530112 - DNA, 15 bp, Homo sapiens
ctatttctcctccat

SEQ ID NO: 4530113 - DNA, 16 bp, Homo sapiens
ctatttctcctccatg

SEQ ID NO: 4530114 - DNA, 16 bp, Homo sapiens
ctatttcttgaagaat

SEQ ID NO: 4530115 - DNA, 12 bp, Homo sapiens
ctatttgtacaa

SEQ ID NO: 4530116 - DNA, 21 bp, Homo sapiens
ctatttgtacaattttaaagt

SEQ ID NO: 4530117 - DNA, 19 bp, Homo sapiens
ctagcctgcattgagcttg

SEQ ID NO: 4530118 - DNA, 22 bp, Homo sapiens
ctagcgctgccgcaccccagag

SEQ ID NO: 4530119 - DNA, 15 bp, Homo sapiens
ctagcggagcccagc

SEQ ID NO: 4530120 - DNA, 17 bp, Homo sapiens
ctagctgcacagggcag

SEQ ID NO: 4530121 - DNA, 20 bp, Homo sapiens
ctagctgcacagggcagctg

SEQ ID NO: 4530122 - DNA, 23 bp, Homo sapiens
ctagctgtgtgaatacctgctca

SEQ ID NO: 4530123 - DNA, 20 bp, Homo sapiens
ctagcttaagtgtaaatgaa

SEQ ID NO: 4530124 - DNA, 16 bp, Homo sapiens
ctagcttctgcttttc

SEQ ID NO: 4530125 - DNA, 18 bp, Homo sapiens
ctagcttctgcttttctg

SEQ ID NO: 4530126 - DNA, 19 bp, Homo sapiens
ctaggacacagttcctggg

SEQ ID NO: 4530127 - DNA, 21 bp, Homo sapiens
ctaggacccgtctccagctgc

SEQ ID NO: 4530128 - DNA, 22 bp, Homo sapiens
ctaggacccgtctccagctgct

SEQ ID NO: 4530129 - DNA, 13 bp, Homo sapiens
ctaggacttaaaa

SEQ ID NO: 4530130 - DNA, 22 bp, Homo sapiens
ctaggacttaaccttgaaatgg

SEQ ID NO: 4530131 - DNA, 20 bp, Homo sapiens
ctaggagaagagttgaggaa

SEQ ID NO: 4530132 - DNA, 19 bp, Homo sapiens
ctaggagctgggaggaaaa

SEQ ID NO: 4530133 - DNA, 17 bp, Homo sapiens
ctaggatgaacaatgta

SEQ ID NO: 4530134 - DNA, 20 bp, Homo sapiens
ctaggatgaacaatgtatac

SEQ ID NO: 4530135 - DNA, 14 bp, Homo sapiens
ctaggatggttctg

SEQ ID NO: 4530136 - DNA, 15 bp, Homo sapiens
ctaggcaggacctgt

SEQ ID NO: 4530137 - DNA, 14 bp, Homo sapiens
ctaggcatttcatt

SEQ ID NO: 4530138 - DNA, 18 bp, Homo sapiens
ctaggccacgtccaggtc

SEQ ID NO: 4530139 - DNA, 14 bp, Homo sapiens
ctaggccactcctc

SEQ ID NO: 4530140 - DNA, 16 bp, Homo sapiens
ctaggccactcctcca

SEQ ID NO: 4530141 - DNA, 16 bp, Homo sapiens
ctaggcctgaaatgac

SEQ ID NO: 4530142 - DNA, 20 bp, Homo sapiens
ctaggcttcaggttgcattg

SEQ ID NO: 4530143 - DNA, 21 bp, Homo sapiens
ctaggcttcaggttgcattgg

SEQ ID NO: 4530144 - DNA, 22 bp, Homo sapiens
ctagggacccctcgccccagcc

SEQ ID NO: 4530145 - DNA, 17 bp, Homo sapiens
ctagggattcaggctgc

SEQ ID NO: 4530146 - DNA, 18 bp, Homo sapiens
ctaggggtttcacctgca

SEQ ID NO: 4530147 - DNA, 20 bp, Homo sapiens
ctaggtacgatgacagtgtt

SEQ ID NO: 4530148 - DNA, 15 bp, Homo sapiens
ctaggtagaaaaagg

SEQ ID NO: 4530149 - DNA, 17 bp, Homo sapiens
ctaggtagaaaaagggt

SEQ ID NO: 4530150 - DNA, 18 bp, Homo sapiens
ctaggtagaaaaagggtc

SEQ ID NO: 4530151 - DNA, 22 bp, Homo sapiens
ctaggtatcattcaactctcca

SEQ ID NO: 4530152 - DNA, 17 bp, Homo sapiens
ctaggtctcctcagggt

SEQ ID NO: 4530153 - DNA, 13 bp, Homo sapiens
ctaggtgtcccca

SEQ ID NO: 4530154 - DNA, 16 bp, Homo sapiens
ctaggtgtccccaacg

SEQ ID NO: 4530155 - DNA, 17 bp, Homo sapiens
ctaggtgtttcaacaga

SEQ ID NO: 4530156 - DNA, 14 bp, Homo sapiens
ctaggttaaagcta

SEQ ID NO: 4530157 - DNA, 16 bp, Homo sapiens
ctagtaaatgttaact

SEQ ID NO: 4530158 - DNA, 17 bp, Homo sapiens
ctagtaacaatacatga

SEQ ID NO: 4530159 - DNA, 22 bp, Homo sapiens
ctagtaacaatacatgagaaag

SEQ ID NO: 4530160 - DNA, 18 bp, Homo sapiens
ctagtaagtgccttccat

SEQ ID NO: 4530161 - DNA, 13 bp, Homo sapiens
ctagtactattac

SEQ ID NO: 4530162 - DNA, 14 bp, Homo sapiens
ctagtagcaatgtg

SEQ ID NO: 4530163 - DNA, 18 bp, Homo sapiens
ctagtagcaatgtgcctt

SEQ ID NO: 4530164 - DNA, 18 bp, Homo sapiens
ctagtaggaatgtacatg

SEQ ID NO: 4530165 - DNA, 23 bp, Homo sapiens
ctagtaggcagcaaaagaccaaa

SEQ ID NO: 4530166 - DNA, 20 bp, Homo sapiens
ctagtagttagaaattaaat

SEQ ID NO: 4530167 - DNA, 22 bp, Homo sapiens
ctagtagttagaaattaaatct

SEQ ID NO: 4530168 - DNA, 18 bp, Homo sapiens
ctagtataagtctgggca

SEQ ID NO: 4530169 - DNA, 17 bp, Homo sapiens
ctagtatcaaaagaaag

SEQ ID NO: 4530170 - DNA, 22 bp, Homo sapiens
ctagtcattaacccatctctga

SEQ ID NO: 4530171 - DNA, 17 bp, Homo sapiens
ctagtcccttcccctcc

SEQ ID NO: 4530172 - DNA, 14 bp, Homo sapiens
ctagtctatcagca

SEQ ID NO: 4530173 - DNA, 19 bp, Homo sapiens
ctagtctatcagcatctga

SEQ ID NO: 4530174 - DNA, 12 bp, Homo sapiens
ctagtctctcct

SEQ ID NO: 4530175 - DNA, 20 bp, Homo sapiens
ctagtctgtgtgggactgta

SEQ ID NO: 4530176 - DNA, 21 bp, Homo sapiens
ctagtgaaggcttctctctgt

SEQ ID NO: 4530177 - DNA, 17 bp, Homo sapiens
ctagtggggtctccctc

SEQ ID NO: 4530178 - DNA, 23 bp, Homo sapiens
ctagtggggtctccctctcctgc

SEQ ID NO: 4530179 - DNA, 14 bp, Homo sapiens
ctagtgtttaagtc

SEQ ID NO: 4530180 - DNA, 16 bp, Homo sapiens
ctagttctcagcttgc

SEQ ID NO: 4530181 - DNA, 16 bp, Homo sapiens
ctagttctgccaggag

SEQ ID NO: 4530182 - DNA, 16 bp, Homo sapiens
ctagttctttcctccc

SEQ ID NO: 4530183 - DNA, 21 bp, Homo sapiens
ctagttctttcctccccctgc

SEQ ID NO: 4530184 - DNA, 22 bp, Homo sapiens
ctagttctttcctccccctgca

SEQ ID NO: 4530185 - DNA, 15 bp, Homo sapiens
ctagttttcagcctt

SEQ ID NO: 4530186 - DNA, 16 bp, Homo sapiens
ctataaaactttctgt

SEQ ID NO: 4530187 - DNA, 12 bp, Homo sapiens
ctataaaatgcc

SEQ ID NO: 4530188 - DNA, 14 bp, Homo sapiens
ctataaagcagtat

SEQ ID NO: 4530189 - DNA, 18 bp, Homo sapiens
ctataaagcagtattttt

SEQ ID NO: 4530190 - DNA, 19 bp, Homo sapiens
ctataaagcagtatttttc

SEQ ID NO: 4530191 - DNA, 14 bp, Homo sapiens
ctataaagggtcag

SEQ ID NO: 4530192 - DNA, 18 bp, Homo sapiens
ctataaagggtcaggccc

SEQ ID NO: 4530193 - DNA, 13 bp, Homo sapiens
ctataagaataag

SEQ ID NO: 4530194 - DNA, 20 bp, Homo sapiens
ctataagatacaataaaaca

SEQ ID NO: 4530195 - DNA, 23 bp, Homo sapiens
ctataagattccaaaaagcacat

SEQ ID NO: 4530196 - DNA, 23 bp, Homo sapiens
ctataaggtgctctctttctgtc

SEQ ID NO: 4530197 - DNA, 12 bp, Homo sapiens
ctataagtgctc

SEQ ID NO: 4530198 - DNA, 18 bp, Homo sapiens
ctataatcaaatgatttc

SEQ ID NO: 4530199 - DNA, 19 bp, Homo sapiens
ctataatcaaatgatttca

SEQ ID NO: 4530200 - DNA, 23 bp, Homo sapiens
ctataatcaaatgatttcatatt

SEQ ID NO: 4530201 - DNA, 14 bp, Homo sapiens
ctataatcccagct

SEQ ID NO: 4530202 - DNA, 13 bp, Homo sapiens
ctataatgtgaaa

SEQ ID NO: 4530203 - DNA, 17 bp, Homo sapiens
ctataattctgttatat

SEQ ID NO: 4530204 - DNA, 17 bp, Homo sapiens
ctatacaacctaactta

SEQ ID NO: 4530205 - DNA, 21 bp, Homo sapiens
ctatacatgttggaaatgtgt

SEQ ID NO: 4530206 - DNA, 17 bp, Homo sapiens
ctatactgcatactttt

SEQ ID NO: 4530207 - DNA, 11 bp, Homo sapiens
ctatacttgaa

SEQ ID NO: 4530208 - DNA, 22 bp, Homo sapiens
ctatagctgttctaatggatta

SEQ ID NO: 4530209 - DNA, 20 bp, Homo sapiens
ctataggtgctacaaaaaca

SEQ ID NO: 4530210 - DNA, 22 bp, Homo sapiens
ctatagtatttgattcaaaata

SEQ ID NO: 4530211 - DNA, 14 bp, Homo sapiens
ctatataaaataac

SEQ ID NO: 4530212 - DNA, 17 bp, Homo sapiens
ctatataaaataactaa

SEQ ID NO: 4530213 - DNA, 22 bp, Homo sapiens
ctatataaaataactaaaatgt

SEQ ID NO: 4530214 - DNA, 22 bp, Homo sapiens
ctatatagaatttcctgtaata

SEQ ID NO: 4530215 - DNA, 13 bp, Homo sapiens
ctatatatttcta

SEQ ID NO: 4530216 - DNA, 14 bp, Homo sapiens
ctatatatttctat

SEQ ID NO: 4530217 - DNA, 22 bp, Homo sapiens
ctatatcataactatacttgat

SEQ ID NO: 4530218 - DNA, 19 bp, Homo sapiens
ctatatgtgaaacattttt

SEQ ID NO: 4530219 - DNA, 17 bp, Homo sapiens
ctatattagatcaaata

SEQ ID NO: 4530220 - DNA, 22 bp, Homo sapiens
ctatattgcttagtaagtattt

SEQ ID NO: 4530221 - DNA, 16 bp, Homo sapiens
ctatattgttcagcat

SEQ ID NO: 4530222 - DNA, 15 bp, Homo sapiens
ctatcaacaataaaa

SEQ ID NO: 4530223 - DNA, 19 bp, Homo sapiens
ctatcaacaataaaatttt

SEQ ID NO: 4530224 - DNA, 18 bp, Homo sapiens
ctatcaatatttaagttt

SEQ ID NO: 4530225 - DNA, 17 bp, Homo sapiens
ctatcacctatttccat

SEQ ID NO: 4530226 - DNA, 19 bp, Homo sapiens
ctatcagagttgctgcaaa

SEQ ID NO: 4530227 - DNA, 20 bp, Homo sapiens
ctatcagttgatttttctta

SEQ ID NO: 4530228 - DNA, 21 bp, Homo sapiens
ctatcagttgatttttcttat

SEQ ID NO: 4530229 - DNA, 16 bp, Homo sapiens
ctatcatagttaacat

SEQ ID NO: 4530230 - DNA, 13 bp, Homo sapiens
ctatcatggcata

SEQ ID NO: 4530231 - DNA, 22 bp, Homo sapiens
ctatcatggtgaaaagctccat

SEQ ID NO: 4530232 - DNA, 16 bp, Homo sapiens
ctatcatttttacact

SEQ ID NO: 4530233 - DNA, 17 bp, Homo sapiens
ctatccaaaataaagat

SEQ ID NO: 4530234 - DNA, 18 bp, Homo sapiens
ctatccacagaacctttg

SEQ ID NO: 4530235 - DNA, 21 bp, Homo sapiens
ctatccacagaacctttgtca

SEQ ID NO: 4530236 - DNA, 19 bp, Homo sapiens
ctacctgctctccaagtct

SEQ ID NO: 4530237 - DNA, 14 bp, Homo sapiens
ctacctgtttgaag

SEQ ID NO: 4530238 - DNA, 13 bp, Homo sapiens
ctaccttgctttt

SEQ ID NO: 4530239 - DNA, 19 bp, Homo sapiens
ctaccttttaaaattgaat

SEQ ID NO: 4530240 - DNA, 16 bp, Homo sapiens
ctacgcactggacagc

SEQ ID NO: 4530241 - DNA, 21 bp, Homo sapiens
ctacgccaatgttatgccagc

SEQ ID NO: 4530242 - DNA, 16 bp, Homo sapiens
ctacgctgtccagaaa

SEQ ID NO: 4530243 - DNA, 17 bp, Homo sapiens
ctacgtacatgtgaggc

SEQ ID NO: 4530244 - DNA, 14 bp, Homo sapiens
ctacgtatttaata

SEQ ID NO: 4530245 - DNA, 13 bp, Homo sapiens
ctacgtccaaggt

SEQ ID NO: 4530246 - DNA, 21 bp, Homo sapiens
ctacgtttccccaataaagcc

SEQ ID NO: 4530247 - DNA, 14 bp, Homo sapiens
ctactaaaattcaa

SEQ ID NO: 4530248 - DNA, 13 bp, Homo sapiens
ctactaaggcctt

SEQ ID NO: 4530249 - DNA, 22 bp, Homo sapiens
ctactaaggccttttatgtaat

SEQ ID NO: 4530250 - DNA, 12 bp, Homo sapiens
ctactaattcca

SEQ ID NO: 4530251 - DNA, 15 bp, Homo sapiens
ctactaattccacac

SEQ ID NO: 4530252 - DNA, 13 bp, Homo sapiens
ctactataatcaa

SEQ ID NO: 4530253 - DNA, 22 bp, Homo sapiens
ctactataatcaaatgatttca

SEQ ID NO: 4530254 - DNA, 23 bp, Homo sapiens
ctactataatcaaatgatttcat

SEQ ID NO: 4530255 - DNA, 13 bp, Homo sapiens
ctactatttttct

SEQ ID NO: 4530256 - DNA, 15 bp, Homo sapiens
ctactcagcagccct

SEQ ID NO: 4530257 - DNA, 18 bp, Homo sapiens
ctactcagcagccctcct

SEQ ID NO: 4530258 - DNA, 21 bp, Homo sapiens
ctactcagcagccctcctcac

SEQ ID NO: 4530259 - DNA, 17 bp, Homo sapiens
ctactcagctctcctgc

SEQ ID NO: 4530260 - DNA, 20 bp, Homo sapiens
ctactcagctctcctgctgc

SEQ ID NO: 4530261 - DNA, 13 bp, Homo sapiens
ctactcccctggg

SEQ ID NO: 4530262 - DNA, 18 bp, Homo sapiens
ctactcctagaagaacca

SEQ ID NO: 4530263 - DNA, 14 bp, Homo sapiens
ctactcctgtgctc

SEQ ID NO: 4530264 - DNA, 14 bp, Homo sapiens
ctactctttgattt

SEQ ID NO: 4530265 - DNA, 14 bp, Homo sapiens
ctactgaaaatgca

SEQ ID NO: 4530266 - DNA, 20 bp, Homo sapiens
ctactgcatttataggacct

SEQ ID NO: 4530267 - DNA, 15 bp, Homo sapiens
ctactgccatcctgg

SEQ ID NO: 4530268 - DNA, 17 bp, Homo sapiens
ctactgccatcctggcc

SEQ ID NO: 4530269 - DNA, 16 bp, Homo sapiens
ctactgctcagcttct

SEQ ID NO: 4530270 - DNA, 15 bp, Homo sapiens
ctactggattcttat

SEQ ID NO: 4530271 - DNA, 18 bp, Homo sapiens
ctactggggaggctgagg

SEQ ID NO: 4530272 - DNA, 19 bp, Homo sapiens
ctactggggaggctgaggc

SEQ ID NO: 4530273 - DNA, 21 bp, Homo sapiens
ctactggggaggctgaggcag

SEQ ID NO: 4530274 - DNA, 14 bp, Homo sapiens
ctactgggtgtcat

SEQ ID NO: 4530275 - DNA, 16 bp, Homo sapiens
ctactgggtgtcattt

SEQ ID NO: 4530276 - DNA, 18 bp, Homo sapiens
ctactgggtgtcatttca

SEQ ID NO: 4530277 - DNA, 20 bp, Homo sapiens
ctactgtacataaacaatga

SEQ ID NO: 4530278 - DNA, 19 bp, Homo sapiens
ctactgtatcaataaaatt

SEQ ID NO: 4530279 - DNA, 15 bp, Homo sapiens
ctactgtgtgtgtga

SEQ ID NO: 4530280 - DNA, 17 bp, Homo sapiens
ctacttacccaggtggg

SEQ ID NO: 4530281 - DNA, 14 bp, Homo sapiens
ctacttccaggatg

SEQ ID NO: 4530282 - DNA, 22 bp, Homo sapiens
ctacttccctgccggaatgaac

SEQ ID NO: 4530283 - DNA, 23 bp, Homo sapiens
ctacttggcaaggtcatagacaa

SEQ ID NO: 4530284 - DNA, 13 bp, Homo sapiens
ctacttgggaggc

SEQ ID NO: 4530285 - DNA, 18 bp, Homo sapiens
ctacttgggaggctgaga

SEQ ID NO: 4530286 - DNA, 13 bp, Homo sapiens
ctactttctctct

SEQ ID NO: 4530287 - DNA, 20 bp, Homo sapiens
ctactttgactttttgcatt

SEQ ID NO: 4530288 - DNA, 20 bp, Homo sapiens
ctactttgttaggattttca

SEQ ID NO: 4530289 - DNA, 13 bp, Homo sapiens
ctacttttctaaa

SEQ ID NO: 4530290 - DNA, 21 bp, Homo sapiens
ctagaaaaaagggctgagagg

SEQ ID NO: 4530291 - DNA, 19 bp, Homo sapiens
ctagaaatatatcctgtgt

SEQ ID NO: 4530292 - DNA, 18 bp, Homo sapiens
ctagaaattgaacaaaaa

SEQ ID NO: 4530293 - DNA, 16 bp, Homo sapiens
ctagaaattgggcagt

SEQ ID NO: 4530294 - DNA, 12 bp, Homo sapiens
ctagaaattttc

SEQ ID NO: 4530295 - DNA, 18 bp, Homo sapiens
ctagaacctagaagggct

SEQ ID NO: 4530296 - DNA, 22 bp, Homo sapiens
ctagaagaaccaaatacctcaa

SEQ ID NO: 4530297 - DNA, 16 bp, Homo sapiens
ctagaagagtctattg

SEQ ID NO: 4530298 - DNA, 17 bp, Homo sapiens
ctagaagatgtgtaaac

SEQ ID NO: 4530299 - DNA, 18 bp, Homo sapiens
ctagaagattagaaacta

SEQ ID NO: 4530300 - DNA, 22 bp, Homo sapiens
ctagaaggcgtccatgtttatt

SEQ ID NO: 4530301 - DNA, 23 bp, Homo sapiens
ctagaagggccagtcctgcctgg

SEQ ID NO: 4530302 - DNA, 22 bp, Homo sapiens
ctagaagggctagaacctggag

SEQ ID NO: 4530303 - DNA, 15 bp, Homo sapiens
ctagaagtcttaatt

SEQ ID NO: 4530304 - DNA, 22 bp, Homo sapiens
ctagaatcaccgcatttcagtg

SEQ ID NO: 4530305 - DNA, 23 bp, Homo sapiens
ctagaatgtctgaagtacaaaca

SEQ ID NO: 4530306 - DNA, 14 bp, Homo sapiens
ctagacaaaatcaa

SEQ ID NO: 4530307 - DNA, 18 bp, Homo sapiens
ctagacacaatttcattt

SEQ ID NO: 4530308 - DNA, 23 bp, Homo sapiens
ctagacacaatttcatttccagc

SEQ ID NO: 4530309 - DNA, 21 bp, Homo sapiens
ctagacatcattgtcagcctt

SEQ ID NO: 4530310 - DNA, 22 bp, Homo sapiens
ctagacatcattgtcagccttg

SEQ ID NO: 4530311 - DNA, 16 bp, Homo sapiens
ctagacgcccctccca

SEQ ID NO: 4530312 - DNA, 17 bp, Homo sapiens
ctagacgcccctcccaa

SEQ ID NO: 4530313 - DNA, 17 bp, Homo sapiens
ctagactgttactttgg

SEQ ID NO: 4530314 - DNA, 18 bp, Homo sapiens
ctagactgttactttggc

SEQ ID NO: 4530315 - DNA, 18 bp, Homo sapiens
ctagagaaatcagctgct

SEQ ID NO: 4530316 - DNA, 16 bp, Homo sapiens
ctagagaaattcttgt

SEQ ID NO: 4530317 - DNA, 18 bp, Homo sapiens
ctagagaaattcttgtta

SEQ ID NO: 4530318 - DNA, 16 bp, Homo sapiens
ctagagaacgcagccc

SEQ ID NO: 4530319 - DNA, 17 bp, Homo sapiens
ctagagatattttgtaa

SEQ ID NO: 4530320 - DNA, 18 bp, Homo sapiens
ctagagatattttgtaaa

SEQ ID NO: 4530321 - DNA, 16 bp, Homo sapiens
ctagagcctgcctgga

SEQ ID NO: 4530322 - DNA, 18 bp, Homo sapiens
ctagagcctgcctggagc

SEQ ID NO: 4530323 - DNA, 20 bp, Homo sapiens
ctagaggccagccccaccca

SEQ ID NO: 4530324 - DNA, 22 bp, Homo sapiens
ctagaggccagccccacccagg

SEQ ID NO: 4530325 - DNA, 21 bp, Homo sapiens
ctagagtgactctacctgcaa

SEQ ID NO: 4530326 - DNA, 13 bp, Homo sapiens
ctagagttatctt

SEQ ID NO: 4530327 - DNA, 20 bp, Homo sapiens
ctagagttatcttctttatt

SEQ ID NO: 4530328 - DNA, 14 bp, Homo sapiens
ctagatacaataaa

SEQ ID NO: 4530329 - DNA, 23 bp, Homo sapiens
ctagatacaataaattgctaatg

SEQ ID NO: 4530330 - DNA, 24 bp, Homo sapiens
ctagatatgaatatatggcatttg

SEQ ID NO: 4530331 - DNA, 14 bp, Homo sapiens
ctagatcctgcacc

SEQ ID NO: 4530332 - DNA, 20 bp, Homo sapiens
ctagatgattttttgaaagt

SEQ ID NO: 4530333 - DNA, 14 bp, Homo sapiens
ctagatgggttctt

SEQ ID NO: 4530334 - DNA, 17 bp, Homo sapiens
ctagatgggttcttagc

SEQ ID NO: 4530335 - DNA, 15 bp, Homo sapiens
ctagcaagtgagaga

SEQ ID NO: 4530336 - DNA, 15 bp, Homo sapiens
ctagcacagaggcct

SEQ ID NO: 4530337 - DNA, 16 bp, Homo sapiens
ctagcacagaggcctg

SEQ ID NO: 4530338 - DNA, 21 bp, Homo sapiens
ctagcacagaggcctgactga

SEQ ID NO: 4530339 - DNA, 22 bp, Homo sapiens
ctagcaccattttaagtccctg

SEQ ID NO: 4530340 - DNA, 12 bp, Homo sapiens
ctagcaccctgg

SEQ ID NO: 4530341 - DNA, 15 bp, Homo sapiens
ctagcaccctggaga

SEQ ID NO: 4530342 - DNA, 17 bp, Homo sapiens
ctagcactgccccacat

SEQ ID NO: 4530343 - DNA, 19 bp, Homo sapiens
ctagcactgccccacatgc

SEQ ID NO: 4530344 - DNA, 16 bp, Homo sapiens
ctagcactggcctgca

SEQ ID NO: 4530345 - DNA, 16 bp, Homo sapiens
ctagcaggctgttcca

SEQ ID NO: 4530346 - DNA, 17 bp, Homo sapiens
ctagcaggctgttccat

SEQ ID NO: 4530347 - DNA, 22 bp, Homo sapiens
ctagcattgtaaaattatttca

SEQ ID NO: 4530348 - DNA, 16 bp, Homo sapiens
ctagcatttatttctc

SEQ ID NO: 4530349 - DNA, 15 bp, Homo sapiens
ctagccactcctgcc

SEQ ID NO: 4530350 - DNA, 18 bp, Homo sapiens
ctagcccaatgaaatgaa

SEQ ID NO: 4530351 - DNA, 14 bp, Homo sapiens
ctagcccacccccc

SEQ ID NO: 4530352 - DNA, 13 bp, Homo sapiens
ctagcccagtgct

SEQ ID NO: 4530353 - DNA, 15 bp, Homo sapiens
ctagcccagtgcttc

SEQ ID NO: 4530354 - DNA, 19 bp, Homo sapiens
ctagcccttccctgagtgc

SEQ ID NO: 4530355 - DNA, 19 bp, Homo sapiens
ctagcctgcactttgatgt

SEQ ID NO: 4530356 - DNA, 16 bp, Homo sapiens
cgggcatgatggtgca

SEQ ID NO: 4530357 - DNA, 20 bp, Homo sapiens
cgggcatggtggctcatgcc

SEQ ID NO: 4530358 - DNA, 16 bp, Homo sapiens
cgggccaggaggctgc

SEQ ID NO: 4530359 - DNA, 19 bp, Homo sapiens
cgggccccatcctcatccc

SEQ ID NO: 4530360 - DNA, 21 bp, Homo sapiens
cgggcccctctctagggaccc

SEQ ID NO: 4530361 - DNA, 15 bp, Homo sapiens
cgggcccctgggctt

SEQ ID NO: 4530362 - DNA, 15 bp, Homo sapiens
cgggcccctggtgat

SEQ ID NO: 4530363 - DNA, 21 bp, Homo sapiens
cgggcccttcccacaggacat

SEQ ID NO: 4530364 - DNA, 15 bp, Homo sapiens
cgggcctttttcctg

SEQ ID NO: 4530365 - DNA, 14 bp, Homo sapiens
cgggcgcgggcagc

SEQ ID NO: 4530366 - DNA, 23 bp, Homo sapiens
cgggcgcgggcagccacccaagc

SEQ ID NO: 4530367 - DNA, 12 bp, Homo sapiens
cgggctcagagc

SEQ ID NO: 4530368 - DNA, 15 bp, Homo sapiens
cgggctcagagcttt

SEQ ID NO: 4530369 - DNA, 15 bp, Homo sapiens
cgggctcggaggcta

SEQ ID NO: 4530370 - DNA, 17 bp, Homo sapiens
cgggctcggaggctacc

SEQ ID NO: 4530371 - DNA, 19 bp, Homo sapiens
cgggctcgggtctgggcag

SEQ ID NO: 4530372 - DNA, 15 bp, Homo sapiens
cgggctctctgctgt

SEQ ID NO: 4530373 - DNA, 22 bp, Homo sapiens
cgggctggcgggcctttttcct

SEQ ID NO: 4530374 - DNA, 20 bp, Homo sapiens
cgggctgggcccctccagga

SEQ ID NO: 4530375 - DNA, 16 bp, Homo sapiens
cgggcttccctggcct

SEQ ID NO: 4530376 - DNA, 15 bp, Homo sapiens
cgggcttttccccgg

SEQ ID NO: 4530377 - DNA, 16 bp, Homo sapiens
cggggaactcctggaa

SEQ ID NO: 4530378 - DNA, 14 bp, Homo sapiens
cggggacagaggcc

SEQ ID NO: 4530379 - DNA, 17 bp, Homo sapiens
cggggacagaggcctgc

SEQ ID NO: 4530380 - DNA, 16 bp, Homo sapiens
cggggacaggtgacag

SEQ ID NO: 4530381 - DNA, 13 bp, Homo sapiens
cggggcctggaca

SEQ ID NO: 4530382 - DNA, 15 bp, Homo sapiens
cggggcctggacagg

SEQ ID NO: 4530383 - DNA, 18 bp, Homo sapiens
cggggcctggacaggcgg

SEQ ID NO: 4530384 - DNA, 17 bp, Homo sapiens
cggggcctgggcaggag

SEQ ID NO: 4530385 - DNA, 19 bp, Homo sapiens
cggggcctgggcaggaggg

SEQ ID NO: 4530386 - DNA, 22 bp, Homo sapiens
cggggccttgcggtatccgccc

SEQ ID NO: 4530387 - DNA, 23 bp, Homo sapiens
cggggctcttctcatttcacccc

SEQ ID NO: 4530388 - DNA, 23 bp, Homo sapiens
cggggcttctgcggggctgagac

SEQ ID NO: 4530389 - DNA, 17 bp, Homo sapiens
cgggggagtgagacagg

SEQ ID NO: 4530390 - DNA, 22 bp, Homo sapiens
cggggggccccagtcagcctct

SEQ ID NO: 4530391 - DNA, 19 bp, Homo sapiens
cggggggctcctgcccagg

SEQ ID NO: 4530392 - DNA, 23 bp, Homo sapiens
cggggtgagtccattctcccagg

SEQ ID NO: 4530393 - DNA, 17 bp, Homo sapiens
cgggtccagagaccaca

SEQ ID NO: 4530394 - DNA, 21 bp, Homo sapiens
cgggtccatagagatgagccc

SEQ ID NO: 4530395 - DNA, 19 bp, Homo sapiens
cgggtccggcctctccctg

SEQ ID NO: 4530396 - DNA, 13 bp, Homo sapiens
cgggtctgcctct

SEQ ID NO: 4530397 - DNA, 14 bp, Homo sapiens
cgggtgcaagcact

SEQ ID NO: 4530398 - DNA, 15 bp, Homo sapiens
cgggtggatcacctg

SEQ ID NO: 4530399 - DNA, 14 bp, Homo sapiens
cgggtgtggcctca

SEQ ID NO: 4530400 - DNA, 18 bp, Homo sapiens
cgggtgtggcctcagccc

SEQ ID NO: 4530401 - DNA, 19 bp, Homo sapiens
cgggtgtggcctcagccct

SEQ ID NO: 4530402 - DNA, 13 bp, Homo sapiens
cgggttctagacg

SEQ ID NO: 4530403 - DNA, 21 bp, Homo sapiens
cgggttttattgtttaaaatc

SEQ ID NO: 4530404 - DNA, 13 bp, Homo sapiens
cggtacacagcca

SEQ ID NO: 4530405 - DNA, 16 bp, Homo sapiens
cggtacacagccagta

SEQ ID NO: 4530406 - DNA, 13 bp, Homo sapiens
cggtcagtgcctt

SEQ ID NO: 4530407 - DNA, 23 bp, Homo sapiens
cggtccaatgccacctagactct

SEQ ID NO: 4530408 - DNA, 17 bp, Homo sapiens
cggtccacaggtccaag

SEQ ID NO: 4530409 - DNA, 20 bp, Homo sapiens
cggtccacaggtccaaggac

SEQ ID NO: 4530410 - DNA, 15 bp, Homo sapiens
cggtcccccagagca

SEQ ID NO: 4530411 - DNA, 14 bp, Homo sapiens
cggtccctgtccct

SEQ ID NO: 4530412 - DNA, 19 bp, Homo sapiens
cggtcccttgagacctcag

SEQ ID NO: 4530413 - DNA, 23 bp, Homo sapiens
cggtcccttgagacctcagccat

SEQ ID NO: 4530414 - DNA, 16 bp, Homo sapiens
cggtcgggcagccagc

SEQ ID NO: 4530415 - DNA, 16 bp, Homo sapiens
cggtctccaccccagg

SEQ ID NO: 4530416 - DNA, 20 bp, Homo sapiens
cggtctccaccccagggtca

SEQ ID NO: 4530417 - DNA, 13 bp, Homo sapiens
cggtcttgggcac

SEQ ID NO: 4530418 - DNA, 16 bp, Homo sapiens
cggtgaccactcttct

SEQ ID NO: 4530419 - DNA, 13 bp, Homo sapiens
cggtgccagctgc

SEQ ID NO: 4530420 - DNA, 15 bp, Homo sapiens
cggtgccagctgccc

SEQ ID NO: 4530421 - DNA, 17 bp, Homo sapiens
cggtgccagctgccctt

SEQ ID NO: 4530422 - DNA, 17 bp, Homo sapiens
cggtgcccatcctgcca

SEQ ID NO: 4530423 - DNA, 21 bp, Homo sapiens
cggtgcctttatttccactgt

SEQ ID NO: 4530424 - DNA, 23 bp, Homo sapiens
cggtgcctttatttccactgtgc

SEQ ID NO: 4530425 - DNA, 15 bp, Homo sapiens
cggtgctgcaggagt

SEQ ID NO: 4530426 - DNA, 18 bp, Homo sapiens
cggtgctgtgagggaggg

SEQ ID NO: 4530427 - DNA, 20 bp, Homo sapiens
cggtggctcacgcctgtaat

SEQ ID NO: 4530428 - DNA, 19 bp, Homo sapiens
cggtgggaccctgtccggc

SEQ ID NO: 4530429 - DNA, 14 bp, Homo sapiens
cggtggtgcccgtg

SEQ ID NO: 4530430 - DNA, 14 bp, Homo sapiens
cggtgtgctgccaa

SEQ ID NO: 4530431 - DNA, 14 bp, Homo sapiens
cggttccagacact

SEQ ID NO: 4530432 - DNA, 14 bp, Homo sapiens
cggttgttctttcc

SEQ ID NO: 4530433 - DNA, 16 bp, Homo sapiens
cggttttcctcagctc

SEQ ID NO: 4530434 - DNA, 18 bp, Homo sapiens
cggttttcctcagctcta

SEQ ID NO: 4530435 - DNA, 13 bp, Homo sapiens
cgtaaagaatttt

SEQ ID NO: 4530436 - DNA, 17 bp, Homo sapiens
cgtaaagctagaaatga

SEQ ID NO: 4530437 - DNA, 14 bp, Homo sapiens
cgtaatcccagcta

SEQ ID NO: 4530438 - DNA, 16 bp, Homo sapiens
cgtacattatgtgttt

SEQ ID NO: 4530439 - DNA, 14 bp, Homo sapiens
cgtactcctcagac

SEQ ID NO: 4530440 - DNA, 22 bp, Homo sapiens
cgtagttccctgaaaacccaga

SEQ ID NO: 4530441 - DNA, 21 bp, Homo sapiens
cgtataaatatcagtattctg

SEQ ID NO: 4530442 - DNA, 22 bp, Homo sapiens
cgtataaatatcagtattctga

SEQ ID NO: 4530443 - DNA, 17 bp, Homo sapiens
cgtataatgctttctga

SEQ ID NO: 4530444 - DNA, 20 bp, Homo sapiens
cgtatgcagtgtagatttta

SEQ ID NO: 4530445 - DNA, 15 bp, Homo sapiens
cgtatttaatagcaa

SEQ ID NO: 4530446 - DNA, 23 bp, Homo sapiens
cgtatttaatagcaaagaattga

SEQ ID NO: 4530447 - DNA, 16 bp, Homo sapiens
cgtcaagacatttgct

SEQ ID NO: 4530448 - DNA, 18 bp, Homo sapiens
cgtcactttttggccatg

SEQ ID NO: 4530449 - DNA, 17 bp, Homo sapiens
cgtcagcatcactgatg

SEQ ID NO: 4530450 - DNA, 22 bp, Homo sapiens
cgtcagcatcactgatgggaat

SEQ ID NO: 4530451 - DNA, 13 bp, Homo sapiens
cgtcagcctccag

SEQ ID NO: 4530452 - DNA, 16 bp, Homo sapiens
cgtcagcctccagcct

SEQ ID NO: 4530453 - DNA, 14 bp, Homo sapiens
cgtcaggccctgac

SEQ ID NO: 4530454 - DNA, 17 bp, Homo sapiens
cgtcaggcctggcctca

SEQ ID NO: 4530455 - DNA, 18 bp, Homo sapiens
cgtcatcggaggctgggc

SEQ ID NO: 4530456 - DNA, 20 bp, Homo sapiens
cgtcatcggaggctgggccc

SEQ ID NO: 4530457 - DNA, 13 bp, Homo sapiens
cgtcatttgtgca

SEQ ID NO: 4530458 - DNA, 21 bp, Homo sapiens
cgtccaccctgagctcgggga

SEQ ID NO: 4530459 - DNA, 18 bp, Homo sapiens
cgtcccagcatccctgga

SEQ ID NO: 4530460 - DNA, 11 bp, Homo sapiens
cgtcccagcct

SEQ ID NO: 4530461 - DNA, 11 bp, Homo sapiens
cgtcccagctc

SEQ ID NO: 4530462 - DNA, 12 bp, Homo sapiens
cgtcccagctcc

SEQ ID NO: 4530463 - DNA, 17 bp, Homo sapiens
cgtccccccccaacctt

SEQ ID NO: 4530464 - DNA, 22 bp, Homo sapiens
cgtcccctccgccgtgccggcg

SEQ ID NO: 4530465 - DNA, 11 bp, Homo sapiens
cgtccctggcg

SEQ ID NO: 4530466 - DNA, 15 bp, Homo sapiens
cgtcctccccctgcc

SEQ ID NO: 4530467 - DNA, 15 bp, Homo sapiens
cgtcctcctctgtga

SEQ ID NO: 4530468 - DNA, 23 bp, Homo sapiens
cgtcctgtccacacccagctcag

SEQ ID NO: 4530469 - DNA, 22 bp, Homo sapiens
cgtcggactgcccccagaaagc

SEQ ID NO: 4530470 - DNA, 20 bp, Homo sapiens
cgtctcccttggcccagaga

SEQ ID NO: 4530471 - DNA, 13 bp, Homo sapiens
cgtctcctccctc

SEQ ID NO: 4530472 - DNA, 19 bp, Homo sapiens
cgtctctactaaaaatgca

SEQ ID NO: 4530473 - DNA, 13 bp, Homo sapiens
cgtctctctccca

SEQ ID NO: 4530474 - DNA, 21 bp, Homo sapiens
cgtctctcttggacccacctg

SEQ ID NO: 4530475 - DNA, 19 bp, Homo sapiens
cgtctgccttggcatcctc

SEQ ID NO: 4530476 - DNA, 21 bp, Homo sapiens
cgtcttaagtcagatttttat

SEQ ID NO: 4530477 - DNA, 16 bp, Homo sapiens
cgtcttccctgcttca

SEQ ID NO: 4530478 - DNA, 22 bp, Homo sapiens
cgtgaactctggtgctcctgca

SEQ ID NO: 4530479 - DNA, 13 bp, Homo sapiens
cgtgactcaccca

SEQ ID NO: 4530480 - DNA, 22 bp, Homo sapiens
cgtgactgccccaactcctgga

SEQ ID NO: 4530481 - DNA, 13 bp, Homo sapiens
cgtgagcatgcac

SEQ ID NO: 4530482 - DNA, 20 bp, Homo sapiens
cgtgagcatgcacactgaga

SEQ ID NO: 4530483 - DNA, 18 bp, Homo sapiens
cgtgagctggggactcag

SEQ ID NO: 4530484 - DNA, 19 bp, Homo sapiens
cgtgagctggggactcagg

SEQ ID NO: 4530485 - DNA, 18 bp, Homo sapiens
cgtgatgtggaggaagag

SEQ ID NO: 4530486 - DNA, 22 bp, Homo sapiens
cgtgatgtggaggaagagccac

SEQ ID NO: 4530487 - DNA, 21 bp, Homo sapiens
cgtgcacgtggagagctggtg

SEQ ID NO: 4530488 - DNA, 21 bp, Homo sapiens
cgtgcatcccccctgctcagc

SEQ ID NO: 4530489 - DNA, 20 bp, Homo sapiens
cgtgcatggctcctgtctgg

SEQ ID NO: 4530490 - DNA, 22 bp, Homo sapiens
cgtgcatggctcctgtctggct

SEQ ID NO: 4530491 - DNA, 17 bp, Homo sapiens
cgtgccagatataactg

SEQ ID NO: 4530492 - DNA, 19 bp, Homo sapiens
cgtgccagatataactgtc

SEQ ID NO: 4530493 - DNA, 22 bp, Homo sapiens
cgtgccagatataactgtcttg

SEQ ID NO: 4530494 - DNA, 17 bp, Homo sapiens
cgtgccagctctagttt

SEQ ID NO: 4530495 - DNA, 13 bp, Homo sapiens
cgtgccaggcccg

SEQ ID NO: 4530496 - DNA, 16 bp, Homo sapiens
cgtgcccccctcctcc

SEQ ID NO: 4530497 - DNA, 19 bp, Homo sapiens
cgtgcccccgcctgccacc

SEQ ID NO: 4530498 - DNA, 20 bp, Homo sapiens
cgtgcccccgcctgccaccg

SEQ ID NO: 4530499 - DNA, 15 bp, Homo sapiens
cgtgcccgcaggaac

SEQ ID NO: 4530500 - DNA, 21 bp, Homo sapiens
cgtgccggcggcagccccact

SEQ ID NO: 4530501 - DNA, 16 bp, Homo sapiens
cgtgcctgagaccagg

SEQ ID NO: 4530502 - DNA, 13 bp, Homo sapiens
cgtgcctggccag

SEQ ID NO: 4530503 - DNA, 14 bp, Homo sapiens
cgtgcctggccaga

SEQ ID NO: 4530504 - DNA, 15 bp, Homo sapiens
cgtgcctgggagagt

SEQ ID NO: 4530505 - DNA, 13 bp, Homo sapiens
cgtgcctgtagtc

SEQ ID NO: 4530506 - DNA, 13 bp, Homo sapiens
cgtgcgcactgca

SEQ ID NO: 4530507 - DNA, 15 bp, Homo sapiens
cgtggaacgtttttc

SEQ ID NO: 4530508 - DNA, 19 bp, Homo sapiens
cgtggactgagtgggaagc

SEQ ID NO: 4530509 - DNA, 13 bp, Homo sapiens
cgtggactgtgct

SEQ ID NO: 4530510 - DNA, 15 bp, Homo sapiens
cgtggagatagtgcc

SEQ ID NO: 4530511 - DNA, 18 bp, Homo sapiens
cgtggagatagtgccagg

SEQ ID NO: 4530512 - DNA, 23 bp, Homo sapiens
cgtggagatagtgccaggtggct

SEQ ID NO: 4530513 - DNA, 17 bp, Homo sapiens
cgtggagcagaatcagt

SEQ ID NO: 4530514 - DNA, 18 bp, Homo sapiens
cgtggagcagaatcagta

SEQ ID NO: 4530515 - DNA, 17 bp, Homo sapiens
cgtggccatccctgtga

SEQ ID NO: 4530516 - DNA, 19 bp, Homo sapiens
cgtggccatccctgtgagg

SEQ ID NO: 4530517 - DNA, 21 bp, Homo sapiens
cgtggcctcccaaagtgctgg

SEQ ID NO: 4530518 - DNA, 17 bp, Homo sapiens
cgtggctctgggtgagg

SEQ ID NO: 4530519 - DNA, 16 bp, Homo sapiens
cgtggcttccctgtcc

SEQ ID NO: 4530520 - DNA, 19 bp, Homo sapiens
cgtgggaccctcagcagct

SEQ ID NO: 4530521 - DNA, 18 bp, Homo sapiens
cgtgggccagtccccgag

SEQ ID NO: 4530522 - DNA, 23 bp, Homo sapiens
cgtgggccagtccccgaggagct

SEQ ID NO: 4530523 - DNA, 18 bp, Homo sapiens
cgtgggcttaaagcagaa

SEQ ID NO: 4530524 - DNA, 13 bp, Homo sapiens
cgtggggcccact

SEQ ID NO: 4530525 - DNA, 15 bp, Homo sapiens
cgtggggtgctgccc

SEQ ID NO: 4530526 - DNA, 12 bp, Homo sapiens
cgtggtgcctgc

SEQ ID NO: 4530527 - DNA, 19 bp, Homo sapiens
cgtggtggcggtggctgcc

SEQ ID NO: 4530528 - DNA, 13 bp, Homo sapiens
cgtggtttctcat

SEQ ID NO: 4530529 - DNA, 19 bp, Homo sapiens
cgtggtttgcctgaggctg

SEQ ID NO: 4530530 - DNA, 13 bp, Homo sapiens
cgtgtctggcaca

SEQ ID NO: 4530531 - DNA, 19 bp, Homo sapiens
cgtgtctgggtatctttgt

SEQ ID NO: 4530532 - DNA, 19 bp, Homo sapiens
cgtgtgtagatagtatgca

SEQ ID NO: 4530533 - DNA, 16 bp, Homo sapiens
cgtgtgtgtggccggc

SEQ ID NO: 4530534 - DNA, 22 bp, Homo sapiens
cgtgttccagccaaagcatgcc

SEQ ID NO: 4530535 - DNA, 15 bp, Homo sapiens
cgtgtttctgactct

SEQ ID NO: 4530536 - DNA, 21 bp, Homo sapiens
cgtgtttgggtttttttcctt

SEQ ID NO: 4530537 - DNA, 14 bp, Homo sapiens
cgttagaggaaaaa

SEQ ID NO: 4530538 - DNA, 17 bp, Homo sapiens
cgttagaggaaaaatat

SEQ ID NO: 4530539 - DNA, 15 bp, Homo sapiens
cgttatatattgtat

SEQ ID NO: 4530540 - DNA, 16 bp, Homo sapiens
cgttcacctccctgct

SEQ ID NO: 4530541 - DNA, 21 bp, Homo sapiens
cgttccagccggcatggctgg

SEQ ID NO: 4530542 - DNA, 16 bp, Homo sapiens
cgttcctggccttctg

SEQ ID NO: 4530543 - DNA, 16 bp, Homo sapiens
cgttctcaagaatcta

SEQ ID NO: 4530544 - DNA, 18 bp, Homo sapiens
cgttctcaagaatctaga

SEQ ID NO: 4530545 - DNA, 16 bp, Homo sapiens
cgttctgatatgtgaa

SEQ ID NO: 4530546 - DNA, 19 bp, Homo sapiens
cgttctggactctgcccca

SEQ ID NO: 4530547 - DNA, 15 bp, Homo sapiens
cgttgctgagccagc

SEQ ID NO: 4530548 - DNA, 21 bp, Homo sapiens
cgttgctgagccagctgcaga

SEQ ID NO: 4530549 - DNA, 19 bp, Homo sapiens
cgttggagtttgggctgga

SEQ ID NO: 4530550 - DNA, 20 bp, Homo sapiens
cgttggagtttgggctggag

SEQ ID NO: 4530551 - DNA, 20 bp, Homo sapiens
cgttggtgaccagtttctta

SEQ ID NO: 4530552 - DNA, 18 bp, Homo sapiens
cgttgtgttttttaagat

SEQ ID NO: 4530553 - DNA, 13 bp, Homo sapiens
cgtttaaagttct

SEQ ID NO: 4530554 - DNA, 17 bp, Homo sapiens
cgtttaaagttctgtgt

SEQ ID NO: 4530555 - DNA, 14 bp, Homo sapiens
cgtttattttcaag

SEQ ID NO: 4530556 - DNA, 15 bp, Homo sapiens
cgtttattttcaaga

SEQ ID NO: 4530557 - DNA, 18 bp, Homo sapiens
cgtttccccaataaagcc

SEQ ID NO: 4530558 - DNA, 21 bp, Homo sapiens
cgtttccccaataaagccttt

SEQ ID NO: 4530559 - DNA, 12 bp, Homo sapiens
cgtttctccttt

SEQ ID NO: 4530560 - DNA, 13 bp, Homo sapiens
cgtttctcctttt

SEQ ID NO: 4530561 - DNA, 17 bp, Homo sapiens
cgtttctccttttccta

SEQ ID NO: 4530562 - DNA, 15 bp, Homo sapiens
cgtttcttgcaaggg

SEQ ID NO: 4530563 - DNA, 19 bp, Homo sapiens
cgttttccaaactgactca

SEQ ID NO: 4530564 - DNA, 13 bp, Homo sapiens
cgttttgaagcta

SEQ ID NO: 4530565 - DNA, 22 bp, Homo sapiens
cgtttttgtgctgtgggcagca

SEQ ID NO: 4530566 - DNA, 20 bp, Homo sapiens
ctaaaaacatttactgacca

SEQ ID NO: 4530567 - DNA, 17 bp, Homo sapiens
ctaaaaagttgaaccat

SEQ ID NO: 4530568 - DNA, 21 bp, Homo sapiens
ctaaaacacaacaagaaactg

SEQ ID NO: 4530569 - DNA, 17 bp, Homo sapiens
ctaaaacattcccctcc

SEQ ID NO: 4530570 - DNA, 17 bp, Homo sapiens
ctaaaactctttcggta

SEQ ID NO: 4530571 - DNA, 23 bp, Homo sapiens
ctaaaactgggattaagaaacct

SEQ ID NO: 4530572 - DNA, 13 bp, Homo sapiens
ctaaaagaaactt

SEQ ID NO: 4530573 - DNA, 12 bp, Homo sapiens
ctaaaagcaaaa

SEQ ID NO: 4530574 - DNA, 15 bp, Homo sapiens
ctaaaagctctgttc

SEQ ID NO: 4530575 - DNA, 15 bp, Homo sapiens
ctaaaaggcttccag

SEQ ID NO: 4530576 - DNA, 21 bp, Homo sapiens
ctaaaaggtgttgtaatggtg

SEQ ID NO: 4530577 - DNA, 19 bp, Homo sapiens
ctaaaagtgggcttgattc

SEQ ID NO: 4530578 - DNA, 18 bp, Homo sapiens
ctaaaagttcataacagt

SEQ ID NO: 4530579 - DNA, 22 bp, Homo sapiens
ctaaaatagcaataactgaaaa

SEQ ID NO: 4530580 - DNA, 23 bp, Homo sapiens
ctaaaatagttagatctttgtaa

SEQ ID NO: 4530581 - DNA, 22 bp, Homo sapiens
ctaaaattaaaaagaaaatatt

SEQ ID NO: 4530582 - DNA, 16 bp, Homo sapiens
ctaaaattatgttact

SEQ ID NO: 4530583 - DNA, 18 bp, Homo sapiens
ctaaaattatgttactgt

SEQ ID NO: 4530584 - DNA, 18 bp, Homo sapiens
ctaaaattcaaaaacaaa

SEQ ID NO: 4530585 - DNA, 21 bp, Homo sapiens
ctaaaatttcataattctgaa

SEQ ID NO: 4530586 - DNA, 18 bp, Homo sapiens
ctaaacagttatttctgt

SEQ ID NO: 4530587 - DNA, 12 bp, Homo sapiens
ctaaacctcagt

SEQ ID NO: 4530588 - DNA, 16 bp, Homo sapiens
ctaaactagtttttcc

SEQ ID NO: 4530589 - DNA, 14 bp, Homo sapiens
ctaaactttagact

SEQ ID NO: 4530590 - DNA, 18 bp, Homo sapiens
ctaaactttttttctgta

SEQ ID NO: 4530591 - DNA, 14 bp, Homo sapiens
ctaaagaagataaa

SEQ ID NO: 4530592 - DNA, 19 bp, Homo sapiens
ctaaagaagataaacacaa

SEQ ID NO: 4530593 - DNA, 16 bp, Homo sapiens
ctaaagagcccttgcc

SEQ ID NO: 4530594 - DNA, 17 bp, Homo sapiens
ctaaagagcccttgcct

SEQ ID NO: 4530595 - DNA, 21 bp, Homo sapiens
ctaaagagcccttgcctcccc

SEQ ID NO: 4530596 - DNA, 22 bp, Homo sapiens
ctaaagagcccttgcctcccca

SEQ ID NO: 4530597 - DNA, 17 bp, Homo sapiens
ctaaagatggaaaagaa

SEQ ID NO: 4530598 - DNA, 18 bp, Homo sapiens
ctaaagcactggtttcaa

SEQ ID NO: 4530599 - DNA, 22 bp, Homo sapiens
ctaaagcactggtttcaagaat

SEQ ID NO: 4530600 - DNA, 18 bp, Homo sapiens
ctaaagctaaaaatatta

SEQ ID NO: 4530601 - DNA, 14 bp, Homo sapiens
ctaaagctggagag

SEQ ID NO: 4530602 - DNA, 19 bp, Homo sapiens
ctaaaggaaatcaaatgaa

SEQ ID NO: 4530603 - DNA, 14 bp, Homo sapiens
ctaaaggatccaga

SEQ ID NO: 4530604 - DNA, 20 bp, Homo sapiens
ctaaaggatccagagagcag

SEQ ID NO: 4530605 - DNA, 19 bp, Homo sapiens
ctaaagggagaaatgccag

SEQ ID NO: 4530606 - DNA, 18 bp, Homo sapiens
ctaaagtctctgctgcta

SEQ ID NO: 4530607 - DNA, 15 bp, Homo sapiens
ctaaagttatatttc

SEQ ID NO: 4530608 - DNA, 22 bp, Homo sapiens
ctaaataaacacatagattcac

SEQ ID NO: 4530609 - DNA, 16 bp, Homo sapiens
ctaaatctcctatttt

SEQ ID NO: 4530610 - DNA, 11 bp, Homo sapiens
ctaaatgaagt

SEQ ID NO: 4530611 - DNA, 19 bp, Homo sapiens
ctaaatgagtcactgagca

SEQ ID NO: 4530612 - DNA, 23 bp, Homo sapiens
ctaaatgcaataagatttagttg

SEQ ID NO: 4530613 - DNA, 21 bp, Homo sapiens
ctaaatgcagacaacaccttc

SEQ ID NO: 4530614 - DNA, 18 bp, Homo sapiens
ctaaatgcccagttcact

SEQ ID NO: 4530615 - DNA, 15 bp, Homo sapiens
ctaaatgctcataca

SEQ ID NO: 4530616 - DNA, 14 bp, Homo sapiens
ctaaattatttact

SEQ ID NO: 4530617 - DNA, 20 bp, Homo sapiens
ctaaattgtctgccattaca

SEQ ID NO: 4530618 - DNA, 14 bp, Homo sapiens
ctaaattttaaagc

SEQ ID NO: 4530619 - DNA, 21 bp, Homo sapiens
ctaacaataatatttcaagtg

SEQ ID NO: 4530620 - DNA, 13 bp, Homo sapiens
ctaacaatgacat

SEQ ID NO: 4530621 - DNA, 13 bp, Homo sapiens
ctaacaattgtta

SEQ ID NO: 4530622 - DNA, 23 bp, Homo sapiens
ctaacactttagttatattcact

SEQ ID NO: 4530623 - DNA, 20 bp, Homo sapiens
ctaacagctacaaactttta

SEQ ID NO: 4530624 - DNA, 21 bp, Homo sapiens
ctaacagctacaaacttttaa

SEQ ID NO: 4530625 - DNA, 18 bp, Homo sapiens
ctaacaggagaaaggaca

SEQ ID NO: 4530626 - DNA, 15 bp, Homo sapiens
ctaacagttgccaca

SEQ ID NO: 4530627 - DNA, 22 bp, Homo sapiens
ctaacatggtgaaaccccgtct

SEQ ID NO: 4530628 - DNA, 16 bp, Homo sapiens
ctaacatggtttaaaa

SEQ ID NO: 4530629 - DNA, 17 bp, Homo sapiens
ctaacatgtcctgccta

SEQ ID NO: 4530630 - DNA, 16 bp, Homo sapiens
ctaacattatattgca

SEQ ID NO: 4530631 - DNA, 20 bp, Homo sapiens
ctaacattatattgcaatga

SEQ ID NO: 4530632 - DNA, 16 bp, Homo sapiens
ctaaccacggttattt

SEQ ID NO: 4530633 - DNA, 21 bp, Homo sapiens
ctaaccacggttatttaagca

SEQ ID NO: 4530634 - DNA, 12 bp, Homo sapiens
ctaaccatcccc

SEQ ID NO: 4530635 - DNA, 13 bp, Homo sapiens
ctaaccatcccca

SEQ ID NO: 4530636 - DNA, 21 bp, Homo sapiens
ctaaccatccccaactccatg

SEQ ID NO: 4530637 - DNA, 12 bp, Homo sapiens
ctaaccccaggg

SEQ ID NO: 4530638 - DNA, 14 bp, Homo sapiens
ctaaccccagggca

SEQ ID NO: 4530639 - DNA, 16 bp, Homo sapiens
ctaaccccagggcact

SEQ ID NO: 4530640 - DNA, 14 bp, Homo sapiens
ctaacccctttcct

SEQ ID NO: 4530641 - DNA, 23 bp, Homo sapiens
ctaacctcccttaagcagcaaca

SEQ ID NO: 4530642 - DNA, 21 bp, Homo sapiens
ctaactgactctgttattgat

SEQ ID NO: 4530643 - DNA, 22 bp, Homo sapiens
ctaactggaaacaaaacagaag

SEQ ID NO: 4530644 - DNA, 14 bp, Homo sapiens
ctaactggactggt

SEQ ID NO: 4530645 - DNA, 18 bp, Homo sapiens
ctaactgtaaatcatgtt

SEQ ID NO: 4530646 - DNA, 23 bp, Homo sapiens
ctaactgtgatttgtagatttac

SEQ ID NO: 4530647 - DNA, 17 bp, Homo sapiens
ctaacttatggactgtt

SEQ ID NO: 4530648 - DNA, 21 bp, Homo sapiens
ctaacttcctgtgcctttcct

SEQ ID NO: 4530649 - DNA, 23 bp, Homo sapiens
ctaacttcctgtgcctttcctat

SEQ ID NO: 4530650 - DNA, 11 bp, Homo sapiens
ctaagaaaaag

SEQ ID NO: 4530651 - DNA, 20 bp, Homo sapiens
ctaagaaatatctgtgaaat

SEQ ID NO: 4530652 - DNA, 18 bp, Homo sapiens
ctaagaatttttttttaa

SEQ ID NO: 4530653 - DNA, 14 bp, Homo sapiens
ctaagacatttttc

SEQ ID NO: 4530654 - DNA, 15 bp, Homo sapiens
ctaagacatttttca

SEQ ID NO: 4530655 - DNA, 18 bp, Homo sapiens
ctaagactctgtgtggct

SEQ ID NO: 4530656 - DNA, 15 bp, Homo sapiens
ctaagagaagtagaa

SEQ ID NO: 4530657 - DNA, 19 bp, Homo sapiens
ctaagagaagttattttct

SEQ ID NO: 4530658 - DNA, 20 bp, Homo sapiens
ctaagagccatttaggggcc

SEQ ID NO: 4530659 - DNA, 16 bp, Homo sapiens
ctaagagctagcgctg

SEQ ID NO: 4530660 - DNA, 19 bp, Homo sapiens
ctaagagctagcgctgccg

SEQ ID NO: 4530661 - DNA, 15 bp, Homo sapiens
ctaagatacactgca

SEQ ID NO: 4530662 - DNA, 18 bp, Homo sapiens
ctaagatgtgttcttatt

SEQ ID NO: 4530663 - DNA, 21 bp, Homo sapiens
ctaagattacaaatcagaagt

SEQ ID NO: 4530664 - DNA, 14 bp, Homo sapiens
ctaagattctttta

SEQ ID NO: 4530665 - DNA, 12 bp, Homo sapiens
ctaagcacttct

SEQ ID NO: 4530666 - DNA, 16 bp, Homo sapiens
ctaagcattgcctggc

SEQ ID NO: 4530667 - DNA, 23 bp, Homo sapiens
ctaagccaggcctggctggagga

SEQ ID NO: 4530668 - DNA, 14 bp, Homo sapiens
ctaaggaaccttcc

SEQ ID NO: 4530669 - DNA, 18 bp, Homo sapiens
ctaaggaagtatcagcac

SEQ ID NO: 4530670 - DNA, 21 bp, Homo sapiens
ctaaggaggggaaaaaaatgt

SEQ ID NO: 4530671 - DNA, 11 bp, Homo sapiens
ctaaggatttt

SEQ ID NO: 4530672 - DNA, 14 bp, Homo sapiens
ctaaggctcctcct

SEQ ID NO: 4530673 - DNA, 22 bp, Homo sapiens
ctaaggttgtctacgggggcac

SEQ ID NO: 4530674 - DNA, 18 bp, Homo sapiens
ctaagtaaaaccacagca

SEQ ID NO: 4530675 - DNA, 22 bp, Homo sapiens
ctaagtaaaaccacagcagttg

SEQ ID NO: 4530676 - DNA, 20 bp, Homo sapiens
ctaagtgaaataagccagac

SEQ ID NO: 4530677 - DNA, 23 bp, Homo sapiens
ctaagtgaaataagccagacatc

SEQ ID NO: 4530678 - DNA, 19 bp, Homo sapiens
ctaagtgaaatttctagcc

SEQ ID NO: 4530679 - DNA, 14 bp, Homo sapiens
ctaagtggctgcct

SEQ ID NO: 4530680 - DNA, 17 bp, Homo sapiens
ctaagtggctgccttct

SEQ ID NO: 4530681 - DNA, 12 bp, Homo sapiens
ctaagtgggaca

SEQ ID NO: 4530682 - DNA, 22 bp, Homo sapiens
ctaagtgggacattcaaaaaac

SEQ ID NO: 4530683 - DNA, 16 bp, Homo sapiens
ctaataaagagactga

SEQ ID NO: 4530684 - DNA, 15 bp, Homo sapiens
ctaataaagtgccgg

SEQ ID NO: 4530685 - DNA, 18 bp, Homo sapiens
ctaataagtgacaaataa

SEQ ID NO: 4530686 - DNA, 20 bp, Homo sapiens
ctaataatgagctattaaaa

SEQ ID NO: 4530687 - DNA, 19 bp, Homo sapiens
ctaatacagcaacaattta

SEQ ID NO: 4530688 - DNA, 23 bp, Homo sapiens
ctaatacagcaacaatttatgaa

SEQ ID NO: 4530689 - DNA, 19 bp, Homo sapiens
ctaatacgtgccagatata

SEQ ID NO: 4530690 - DNA, 13 bp, Homo sapiens
ctaatagaacttg

SEQ ID NO: 4530691 - DNA, 16 bp, Homo sapiens
ctaatagtttttcact

SEQ ID NO: 4530692 - DNA, 12 bp, Homo sapiens
ctaatatacttt

SEQ ID NO: 4530693 - DNA, 13 bp, Homo sapiens
ctaatatactttt

SEQ ID NO: 4530694 - DNA, 19 bp, Homo sapiens
ctaatatatgaaataagta

SEQ ID NO: 4530695 - DNA, 15 bp, Homo sapiens
ctaatatatttaaaa

SEQ ID NO: 4530696 - DNA, 23 bp, Homo sapiens
ctaatatgatagcgggaaaagga

SEQ ID NO: 4530697 - DNA, 23 bp, Homo sapiens
ctaatattagttcccttaacaaa

SEQ ID NO: 4530698 - DNA, 18 bp, Homo sapiens
ctaatattagttggcttt

SEQ ID NO: 4530699 - DNA, 15 bp, Homo sapiens
ctaatattgcttctt

SEQ ID NO: 4530700 - DNA, 21 bp, Homo sapiens
ctaatattgcttcttgtgttt

SEQ ID NO: 4530701 - DNA, 14 bp, Homo sapiens
ctaatatttttcat

SEQ ID NO: 4530702 - DNA, 18 bp, Homo sapiens
ctaatcacaaactgaatg

SEQ ID NO: 4530703 - DNA, 17 bp, Homo sapiens
ctaatcatacaccagaa

SEQ ID NO: 4530704 - DNA, 13 bp, Homo sapiens
ctaatccttttcc

SEQ ID NO: 4530705 - DNA, 23 bp, Homo sapiens
ctaatctgaccgttctattgtgt

SEQ ID NO: 4530706 - DNA, 12 bp, Homo sapiens
ctaatctgcctg

SEQ ID NO: 4530707 - DNA, 14 bp, Homo sapiens
ctaatcttccgtca

SEQ ID NO: 4530708 - DNA, 11 bp, Homo sapiens
ctaatgaagta

SEQ ID NO: 4530709 - DNA, 23 bp, Homo sapiens
ctaatgacatgcctatatgagaa

SEQ ID NO: 4530710 - DNA, 20 bp, Homo sapiens
ctaatgattcaaatgtttta

SEQ ID NO: 4530711 - DNA, 20 bp, Homo sapiens
ctaatggactgaccttaaaa

SEQ ID NO: 4530712 - DNA, 21 bp, Homo sapiens
ctaatggattataatcagaat

SEQ ID NO: 4530713 - DNA, 22 bp, Homo sapiens
ctaatggttgggttgattgtat

SEQ ID NO: 4530714 - DNA, 13 bp, Homo sapiens
ctaatgtgatcat

SEQ ID NO: 4530715 - DNA, 16 bp, Homo sapiens
ctaatgtgcagggata

SEQ ID NO: 4530716 - DNA, 12 bp, Homo sapiens
ctaatgtttact

SEQ ID NO: 4530717 - DNA, 18 bp, Homo sapiens
ctaattaaaattgtgcat

SEQ ID NO: 4530718 - DNA, 17 bp, Homo sapiens
ctaattaagaaaactat

SEQ ID NO: 4530719 - DNA, 13 bp, Homo sapiens
ctaattaatatat

SEQ ID NO: 4530720 - DNA, 21 bp, Homo sapiens
ctaattaatatattaaaattc

SEQ ID NO: 4530721 - DNA, 19 bp, Homo sapiens
ctaattatcaatgggatat

SEQ ID NO: 4530722 - DNA, 19 bp, Homo sapiens
ctaattattattttaaaat

SEQ ID NO: 4530723 - DNA, 18 bp, Homo sapiens
ctaattcaaggaatttct

SEQ ID NO: 4530724 - DNA, 22 bp, Homo sapiens
ctaattcacaaaaaaagtaatt

SEQ ID NO: 4530725 - DNA, 15 bp, Homo sapiens
ctaattctgggaagg

SEQ ID NO: 4530726 - DNA, 18 bp, Homo sapiens
ctaattctgtgattaaaa

SEQ ID NO: 4530727 - DNA, 12 bp, Homo sapiens
ctaattggaaag

SEQ ID NO: 4530728 - DNA, 19 bp, Homo sapiens
ctaattggaaagtgccagc

SEQ ID NO: 4530729 - DNA, 11 bp, Homo sapiens
ctaatttaaca

SEQ ID NO: 4530730 - DNA, 12 bp, Homo sapiens
ctaatttataaa

SEQ ID NO: 4530731 - DNA, 18 bp, Homo sapiens
ctaatttcaaaatgcttt

SEQ ID NO: 4530732 - DNA, 19 bp, Homo sapiens
ctaatttcaaaatgctttt

SEQ ID NO: 4530733 - DNA, 22 bp, Homo sapiens
ctaatttcaaaatgctttttat

SEQ ID NO: 4530734 - DNA, 15 bp, Homo sapiens
ctaatttcatttcaa

SEQ ID NO: 4530735 - DNA, 15 bp, Homo sapiens
ctaatttctcctccc

SEQ ID NO: 4530736 - DNA, 18 bp, Homo sapiens
ctaatttctcctcccttc

SEQ ID NO: 4530737 - DNA, 19 bp, Homo sapiens
ctaatttctcctcccttcc

SEQ ID NO: 4530738 - DNA, 21 bp, Homo sapiens
ctaatttgcattaaattcaca

SEQ ID NO: 4530739 - DNA, 15 bp, Homo sapiens
ctaattttacactct

SEQ ID NO: 4530740 - DNA, 12 bp, Homo sapiens
ctaattttctgt

SEQ ID NO: 4530741 - DNA, 17 bp, Homo sapiens
ctaatttttattaattt

SEQ ID NO: 4530742 - DNA, 12 bp, Homo sapiens
ctaatttttcca

SEQ ID NO: 4530743 - DNA, 15 bp, Homo sapiens
ctaatttttgtattt

SEQ ID NO: 4530744 - DNA, 14 bp, Homo sapiens
ctaattttttgttg

SEQ ID NO: 4530745 - DNA, 21 bp, Homo sapiens
ctaatttttttgtattttagc

SEQ ID NO: 4530746 - DNA, 18 bp, Homo sapiens
ctaatttttttttgtagt

SEQ ID NO: 4530747 - DNA, 16 bp, Homo sapiens
ctacaaaaacacagca

SEQ ID NO: 4530748 - DNA, 17 bp, Homo sapiens
ctacaaaaacacagcaa

SEQ ID NO: 4530749 - DNA, 13 bp, Homo sapiens
ctacaaacaaaat

SEQ ID NO: 4530750 - DNA, 17 bp, Homo sapiens
ctacaaacaaaatttct

SEQ ID NO: 4530751 - DNA, 23 bp, Homo sapiens
ctacaaacgtttgacaaacacaa

SEQ ID NO: 4530752 - DNA, 17 bp, Homo sapiens
ctacaaacttttaagat

SEQ ID NO: 4530753 - DNA, 20 bp, Homo sapiens
ctacaaagcactagagaatg

SEQ ID NO: 4530754 - DNA, 22 bp, Homo sapiens
ctacaagccaaaagtccctccc

SEQ ID NO: 4530755 - DNA, 21 bp, Homo sapiens
ctacaatcttggagctgcttg

SEQ ID NO: 4530756 - DNA, 21 bp, Homo sapiens
ctacaatttgtttttgcattt

SEQ ID NO: 4530757 - DNA, 22 bp, Homo sapiens
ctacaatttgtttttgcatttt

SEQ ID NO: 4530758 - DNA, 13 bp, Homo sapiens
ctacacaaagcag

SEQ ID NO: 4530759 - DNA, 15 bp, Homo sapiens
ctacacactcagcca

SEQ ID NO: 4530760 - DNA, 17 bp, Homo sapiens
ctacacactcagccaca

SEQ ID NO: 4530761 - DNA, 13 bp, Homo sapiens
ctacacatgttgc

SEQ ID NO: 4530762 - DNA, 18 bp, Homo sapiens
ctacacccttttccagct

SEQ ID NO: 4530763 - DNA, 21 bp, Homo sapiens
ctacacgcatgatggagctga

SEQ ID NO: 4530764 - DNA, 22 bp, Homo sapiens
ctacactagtccataagcttta

SEQ ID NO: 4530765 - DNA, 14 bp, Homo sapiens
ctacactctcctgg

SEQ ID NO: 4530766 - DNA, 21 bp, Homo sapiens
ctacactctcctgggcccctc

SEQ ID NO: 4530767 - DNA, 14 bp, Homo sapiens
ctacactgggtgct

SEQ ID NO: 4530768 - DNA, 14 bp, Homo sapiens
ctacacttctcctt

SEQ ID NO: 4530769 - DNA, 19 bp, Homo sapiens
ctacacttctccttatctt

SEQ ID NO: 4530770 - DNA, 20 bp, Homo sapiens
ctacagccgtcccgcgttca

SEQ ID NO: 4530771 - DNA, 16 bp, Homo sapiens
ctacagctccacacgc

SEQ ID NO: 4530772 - DNA, 17 bp, Homo sapiens
ctacagctccacacgcc

SEQ ID NO: 4530773 - DNA, 22 bp, Homo sapiens
ctacagctccacacgccccggt

SEQ ID NO: 4530774 - DNA, 20 bp, Homo sapiens
ctacaggaagcaccccatgc

SEQ ID NO: 4530775 - DNA, 18 bp, Homo sapiens
ctacaggcagtctctctc

SEQ ID NO: 4530776 - DNA, 18 bp, Homo sapiens
ctacagtaatgaaatgtt

SEQ ID NO: 4530777 - DNA, 12 bp, Homo sapiens
ctacagtatata

SEQ ID NO: 4530778 - DNA, 15 bp, Homo sapiens
ctacagtcaggaaag

SEQ ID NO: 4530779 - DNA, 14 bp, Homo sapiens
ctacagtggtttta

SEQ ID NO: 4530780 - DNA, 16 bp, Homo sapiens
ctacagtggttttata

SEQ ID NO: 4530781 - DNA, 21 bp, Homo sapiens
ctacagtggttttatactgaa

SEQ ID NO: 4530782 - DNA, 16 bp, Homo sapiens
ctacagtgtacagtct

SEQ ID NO: 4530783 - DNA, 19 bp, Homo sapiens
ctacagttttaactgtgga

SEQ ID NO: 4530784 - DNA, 14 bp, Homo sapiens
ctacatcagactct

SEQ ID NO: 4530785 - DNA, 21 bp, Homo sapiens
ctacatgacgacaaagctgct

SEQ ID NO: 4530786 - DNA, 15 bp, Homo sapiens
ctacatgaggtactg

SEQ ID NO: 4530787 - DNA, 18 bp, Homo sapiens
ctacatgaggtactgaga

SEQ ID NO: 4530788 - DNA, 19 bp, Homo sapiens
ctacatgatgctaaaggct

SEQ ID NO: 4530789 - DNA, 14 bp, Homo sapiens
ctacatgcagccca

SEQ ID NO: 4530790 - DNA, 17 bp, Homo sapiens
ctacatgcagcccatgc

SEQ ID NO: 4530791 - DNA, 16 bp, Homo sapiens
ctacatgcataaacta

SEQ ID NO: 4530792 - DNA, 13 bp, Homo sapiens
ctacatgccatgc

SEQ ID NO: 4530793 - DNA, 13 bp, Homo sapiens
ctacattaaacaa

SEQ ID NO: 4530794 - DNA, 20 bp, Homo sapiens
ctacattaaacaatgatcac

SEQ ID NO: 4530795 - DNA, 22 bp, Homo sapiens
ctacattataataaaatttctt

SEQ ID NO: 4530796 - DNA, 12 bp, Homo sapiens
ctacattcattt

SEQ ID NO: 4530797 - DNA, 21 bp, Homo sapiens
ctacattcttggttgttaatt

SEQ ID NO: 4530798 - DNA, 16 bp, Homo sapiens
ctaccaactttactgt

SEQ ID NO: 4530799 - DNA, 11 bp, Homo sapiens
ctaccagccag

SEQ ID NO: 4530800 - DNA, 17 bp, Homo sapiens
ctaccagccagcctcag

SEQ ID NO: 4530801 - DNA, 13 bp, Homo sapiens
ctaccagtattta

SEQ ID NO: 4530802 - DNA, 16 bp, Homo sapiens
ctaccatcagctctgc

SEQ ID NO: 4530803 - DNA, 17 bp, Homo sapiens
ctaccatcagctctgcc

SEQ ID NO: 4530804 - DNA, 20 bp, Homo sapiens
ctaccatcagctctgccttg

SEQ ID NO: 4530805 - DNA, 21 bp, Homo sapiens
ctaccatcagctctgccttgc

SEQ ID NO: 4530806 - DNA, 22 bp, Homo sapiens
ctaccatcagctctgccttgca

SEQ ID NO: 4530807 - DNA, 18 bp, Homo sapiens
ctacccacacctctgcca

SEQ ID NO: 4530808 - DNA, 19 bp, Homo sapiens
ctacccacacctctgccag

SEQ ID NO: 4530809 - DNA, 18 bp, Homo sapiens
ctacccagagaagcccct

SEQ ID NO: 4530810 - DNA, 18 bp, Homo sapiens
ctacccagcgtggcctcc

SEQ ID NO: 4530811 - DNA, 14 bp, Homo sapiens
ctacccagttgcct

SEQ ID NO: 4530812 - DNA, 14 bp, Homo sapiens
ctaccccaccacga

SEQ ID NO: 4530813 - DNA, 22 bp, Homo sapiens
ctaccccagttcctagcactgc

SEQ ID NO: 4530814 - DNA, 15 bp, Homo sapiens
ctacccctgctccca

SEQ ID NO: 4530815 - DNA, 12 bp, Homo sapiens
ctaccctcccac

SEQ ID NO: 4530816 - DNA, 19 bp, Homo sapiens
ctaccctcccacccccttc

SEQ ID NO: 4530817 - DNA, 19 bp, Homo sapiens
ctaccctgagatctgcaca

SEQ ID NO: 4530818 - DNA, 18 bp, Homo sapiens
ctaccctgagctgaggca

SEQ ID NO: 4530819 - DNA, 13 bp, Homo sapiens
ctacccttaatta

SEQ ID NO: 4530820 - DNA, 19 bp, Homo sapiens
ctacccttaattacttaaa

SEQ ID NO: 4530821 - DNA, 15 bp, Homo sapiens
ctacctacatatttg

SEQ ID NO: 4530822 - DNA, 15 bp, Homo sapiens
ctacctcaacctgta

SEQ ID NO: 4530823 - DNA, 13 bp, Homo sapiens
ctacctcaggcag

SEQ ID NO: 4530824 - DNA, 20 bp, Homo sapiens
ctacctcaggcaggaagggc

SEQ ID NO: 4530825 - DNA, 23 bp, Homo sapiens
ctacctcaggcaggaagggcagg

SEQ ID NO: 4530826 - DNA, 17 bp, Homo sapiens
ctacctcagtgctcctg

SEQ ID NO: 4530827 - DNA, 18 bp, Homo sapiens
ctacctcagtgctcctgg

SEQ ID NO: 4530828 - DNA, 19 bp, Homo sapiens
ctacctcagtgctcctgga

SEQ ID NO: 4530829 - DNA, 13 bp, Homo sapiens
ctacctctgagaa

SEQ ID NO: 4530830 - DNA, 15 bp, Homo sapiens
ctacctctgagaaga

SEQ ID NO: 4530831 - DNA, 16 bp, Homo sapiens
ctacctctgagaagac

SEQ ID NO: 4530832 - DNA, 17 bp, Homo sapiens
ctacctctgagaagaca

SEQ ID NO: 4530833 - DNA, 20 bp, Homo sapiens
ctacctgacactcccttggg

SEQ ID NO: 4530834 - DNA, 14 bp, Homo sapiens
ctacctgccactca

SEQ ID NO: 4530835 - DNA, 16 bp, Homo sapiens
ctacctgccactcaca

SEQ ID NO: 4530836 - DNA, 16 bp, Homo sapiens
ctacctgccctcaagg

SEQ ID NO: 4530837 - DNA, 14 bp, Homo sapiens
ctacctgccttgga

SEQ ID NO: 4530838 - DNA, 19 bp, Homo sapiens
cggatctcacaggctgaga

SEQ ID NO: 4530839 - DNA, 18 bp, Homo sapiens
cggatgacaccctggcct

SEQ ID NO: 4530840 - DNA, 20 bp, Homo sapiens
cggatgacaccctggcctga

SEQ ID NO: 4530841 - DNA, 20 bp, Homo sapiens
cggatgcccattcctgcctg

SEQ ID NO: 4530842 - DNA, 21 bp, Homo sapiens
cggatgcccattcctgcctgg

SEQ ID NO: 4530843 - DNA, 22 bp, Homo sapiens
cggatgcccattcctgcctggt

SEQ ID NO: 4530844 - DNA, 22 bp, Homo sapiens
cggatggaccaacctgctctgt

SEQ ID NO: 4530845 - DNA, 15 bp, Homo sapiens
cggatgtataaatgt

SEQ ID NO: 4530846 - DNA, 15 bp, Homo sapiens
cggatttgtccaaat

SEQ ID NO: 4530847 - DNA, 13 bp, Homo sapiens
cggattttttcca

SEQ ID NO: 4530848 - DNA, 16 bp, Homo sapiens
cggattttttccaaaa

SEQ ID NO: 4530849 - DNA, 18 bp, Homo sapiens
cggcaacctgcggaagga

SEQ ID NO: 4530850 - DNA, 19 bp, Homo sapiens
cggcaacgtagcctgggct

SEQ ID NO: 4530851 - DNA, 18 bp, Homo sapiens
cggcacagatgctccagg

SEQ ID NO: 4530852 - DNA, 14 bp, Homo sapiens
cggcagccccactt

SEQ ID NO: 4530853 - DNA, 15 bp, Homo sapiens
cggcagccccacttc

SEQ ID NO: 4530854 - DNA, 18 bp, Homo sapiens
cggcaggctcactgccag

SEQ ID NO: 4530855 - DNA, 22 bp, Homo sapiens
cggcaggctcactgccaggcca

SEQ ID NO: 4530856 - DNA, 20 bp, Homo sapiens
cggcagggcccccaataaac

SEQ ID NO: 4530857 - DNA, 15 bp, Homo sapiens
cggcaggttctcttt

SEQ ID NO: 4530858 - DNA, 17 bp, Homo sapiens
cggcatagcacccgtgg

SEQ ID NO: 4530859 - DNA, 15 bp, Homo sapiens
cggcatagtccccag

SEQ ID NO: 4530860 - DNA, 14 bp, Homo sapiens
cggccacacccagc

SEQ ID NO: 4530861 - DNA, 18 bp, Homo sapiens
cggccacacccagcggcc

SEQ ID NO: 4530862 - DNA, 14 bp, Homo sapiens
cggccacacccctc

SEQ ID NO: 4530863 - DNA, 16 bp, Homo sapiens
cggccacagctgctgg

SEQ ID NO: 4530864 - DNA, 22 bp, Homo sapiens
cggccagccccggccctgggct

SEQ ID NO: 4530865 - DNA, 12 bp, Homo sapiens
cggcccacagct

SEQ ID NO: 4530866 - DNA, 15 bp, Homo sapiens
cggcccacagctccc

SEQ ID NO: 4530867 - DNA, 19 bp, Homo sapiens
cggcccacagctcccaccc

SEQ ID NO: 4530868 - DNA, 22 bp, Homo sapiens
cggcccacagctcccaccccac

SEQ ID NO: 4530869 - DNA, 17 bp, Homo sapiens
cggcccagatgtgtccc

SEQ ID NO: 4530870 - DNA, 11 bp, Homo sapiens
cggcccaggcc

SEQ ID NO: 4530871 - DNA, 16 bp, Homo sapiens
cggcccaggccaggtg

SEQ ID NO: 4530872 - DNA, 21 bp, Homo sapiens
cggccccccgcacagccaccc

SEQ ID NO: 4530873 - DNA, 22 bp, Homo sapiens
cggccccccgcacagccacccg

SEQ ID NO: 4530874 - DNA, 22 bp, Homo sapiens
cggccccccgcgctcgcccagc

SEQ ID NO: 4530875 - DNA, 15 bp, Homo sapiens
cggcccccggccaag

SEQ ID NO: 4530876 - DNA, 17 bp, Homo sapiens
cggcccccggccaagga

SEQ ID NO: 4530877 - DNA, 18 bp, Homo sapiens
cggccccctggtctctgg

SEQ ID NO: 4530878 - DNA, 15 bp, Homo sapiens
cggcccctcccgccc

SEQ ID NO: 4530879 - DNA, 19 bp, Homo sapiens
cggcccctcggctgttcct

SEQ ID NO: 4530880 - DNA, 13 bp, Homo sapiens
cggcccctgtctg

SEQ ID NO: 4530881 - DNA, 14 bp, Homo sapiens
cggcccctgtctgt

SEQ ID NO: 4530882 - DNA, 15 bp, Homo sapiens
cggcccggctgagcc

SEQ ID NO: 4530883 - DNA, 12 bp, Homo sapiens
cggccctaaggg

SEQ ID NO: 4530884 - DNA, 13 bp, Homo sapiens
cggccctccagag

SEQ ID NO: 4530885 - DNA, 18 bp, Homo sapiens
cggccctgggctcggagg

SEQ ID NO: 4530886 - DNA, 13 bp, Homo sapiens
cggccgcattccc

SEQ ID NO: 4530887 - DNA, 18 bp, Homo sapiens
cggccgcattccctgagt

SEQ ID NO: 4530888 - DNA, 18 bp, Homo sapiens
cggccgccatagccccag

SEQ ID NO: 4530889 - DNA, 21 bp, Homo sapiens
cggcctcccaaagtgctggga

SEQ ID NO: 4530890 - DNA, 16 bp, Homo sapiens
cggcctcccaggtccc

SEQ ID NO: 4530891 - DNA, 15 bp, Homo sapiens
cggcctccgaggctc

SEQ ID NO: 4530892 - DNA, 13 bp, Homo sapiens
cggcctctaaccc

SEQ ID NO: 4530893 - DNA, 21 bp, Homo sapiens
cggcctctaaccccaggcccc

SEQ ID NO: 4530894 - DNA, 22 bp, Homo sapiens
cggcctctaaccccaggccccg

SEQ ID NO: 4530895 - DNA, 15 bp, Homo sapiens
cggcctgatgctccc

SEQ ID NO: 4530896 - DNA, 19 bp, Homo sapiens
cggcctgatgctccctccc

SEQ ID NO: 4530897 - DNA, 15 bp, Homo sapiens
cggcctgggtgacag

SEQ ID NO: 4530898 - DNA, 21 bp, Homo sapiens
cggcctgtgggtctctgaagg

SEQ ID NO: 4530899 - DNA, 18 bp, Homo sapiens
cggcgaagaagagaaaga

SEQ ID NO: 4530900 - DNA, 20 bp, Homo sapiens
cggcgcggtggctcacgcct

SEQ ID NO: 4530901 - DNA, 15 bp, Homo sapiens
cggcggaaagcctct

SEQ ID NO: 4530902 - DNA, 18 bp, Homo sapiens
cggcgggtgacagctccg

SEQ ID NO: 4530903 - DNA, 21 bp, Homo sapiens
cggcggtggactgcgctggac

SEQ ID NO: 4530904 - DNA, 17 bp, Homo sapiens
cggcgtcagcctccagc

SEQ ID NO: 4530905 - DNA, 19 bp, Homo sapiens
cggcgtcagcctccagcct

SEQ ID NO: 4530906 - DNA, 23 bp, Homo sapiens
cggcgtcagcctccagcctctgt

SEQ ID NO: 4530907 - DNA, 13 bp, Homo sapiens
cggctacatcagc

SEQ ID NO: 4530908 - DNA, 14 bp, Homo sapiens
cggctactcagcag

SEQ ID NO: 4530909 - DNA, 18 bp, Homo sapiens
cggctactcagcagccct

SEQ ID NO: 4530910 - DNA, 20 bp, Homo sapiens
cggctactcagcagccctcc

SEQ ID NO: 4530911 - DNA, 19 bp, Homo sapiens
cggctcccctctgcttctc

SEQ ID NO: 4530912 - DNA, 11 bp, Homo sapiens
cggctcctgca

SEQ ID NO: 4530913 - DNA, 14 bp, Homo sapiens
cggctcctggtgct

SEQ ID NO: 4530914 - DNA, 18 bp, Homo sapiens
cggctctgggggtgggaa

SEQ ID NO: 4530915 - DNA, 20 bp, Homo sapiens
cggctctgtgggtgatgggg

SEQ ID NO: 4530916 - DNA, 14 bp, Homo sapiens
cggctgagccctgc

SEQ ID NO: 4530917 - DNA, 23 bp, Homo sapiens
cggctgagtcatgatctccctgc

SEQ ID NO: 4530918 - DNA, 21 bp, Homo sapiens
cggctgcttggcagttgcagt

SEQ ID NO: 4530919 - DNA, 12 bp, Homo sapiens
cggctgggagga

SEQ ID NO: 4530920 - DNA, 16 bp, Homo sapiens
cggctggggactgcta

SEQ ID NO: 4530921 - DNA, 14 bp, Homo sapiens
cggctgtgctggga

SEQ ID NO: 4530922 - DNA, 22 bp, Homo sapiens
cggctgttcctcccctgtaggg

SEQ ID NO: 4530923 - DNA, 20 bp, Homo sapiens
cggcttcgttagaccgctct

SEQ ID NO: 4530924 - DNA, 20 bp, Homo sapiens
cggcttctcacgctttgttt

SEQ ID NO: 4530925 - DNA, 21 bp, Homo sapiens
cggcttctcacgctttgttta

SEQ ID NO: 4530926 - DNA, 16 bp, Homo sapiens
cgggaaggtcaccagc

SEQ ID NO: 4530927 - DNA, 16 bp, Homo sapiens
cgggaagtttatttcc

SEQ ID NO: 4530928 - DNA, 18 bp, Homo sapiens
cgggaagtttatttcctg

SEQ ID NO: 4530929 - DNA, 18 bp, Homo sapiens
cgggacacctaggctagg

SEQ ID NO: 4530930 - DNA, 19 bp, Homo sapiens
cgggacacctaggctaggg

SEQ ID NO: 4530931 - DNA, 18 bp, Homo sapiens
cgggacagtgctgcagct

SEQ ID NO: 4530932 - DNA, 16 bp, Homo sapiens
cgggaccaccctgagc

SEQ ID NO: 4530933 - DNA, 17 bp, Homo sapiens
cgggaccaccctgagcc

SEQ ID NO: 4530934 - DNA, 18 bp, Homo sapiens
cgggaccaccctgagccg

SEQ ID NO: 4530935 - DNA, 17 bp, Homo sapiens
cgggactgctgctctcc

SEQ ID NO: 4530936 - DNA, 23 bp, Homo sapiens
cgggactgctgctctcccaaggg

SEQ ID NO: 4530937 - DNA, 18 bp, Homo sapiens
cgggagacagcttctctg

SEQ ID NO: 4530938 - DNA, 13 bp, Homo sapiens
cgggagcacccag

SEQ ID NO: 4530939 - DNA, 16 bp, Homo sapiens
cgggagcacccagagc

SEQ ID NO: 4530940 - DNA, 13 bp, Homo sapiens
cgggagccagact

SEQ ID NO: 4530941 - DNA, 23 bp, Homo sapiens
cgggagccagactgtccagggaa

SEQ ID NO: 4530942 - DNA, 18 bp, Homo sapiens
cgggagctctgtatggtc

SEQ ID NO: 4530943 - DNA, 18 bp, Homo sapiens
cgggagctgggccctgcc

SEQ ID NO: 4530944 - DNA, 20 bp, Homo sapiens
cgggagctgggccctgcctg

SEQ ID NO: 4530945 - DNA, 20 bp, Homo sapiens
cgggaggcagaggttgcagt

SEQ ID NO: 4530946 - DNA, 18 bp, Homo sapiens
cgggaggcagcgccccac

SEQ ID NO: 4530947 - DNA, 22 bp, Homo sapiens
cgggaggcagcgccccaccacg

SEQ ID NO: 4530948 - DNA, 15 bp, Homo sapiens
cgggagtcagggacc

SEQ ID NO: 4530949 - DNA, 20 bp, Homo sapiens
cgggatgctctttaaataat

SEQ ID NO: 4530950 - DNA, 16 bp, Homo sapiens
cgggatggttctggct

SEQ ID NO: 4530951 - DNA, 18 bp, Homo sapiens
cgggcagagggctggagg

SEQ ID NO: 4530952 - DNA, 23 bp, Homo sapiens
cgggcagagggctggaggcccag

SEQ ID NO: 4530953 - DNA, 14 bp, Homo sapiens
cgggcagccaccca

SEQ ID NO: 4530954 - DNA, 15 bp, Homo sapiens
cgggcagccacccaa

SEQ ID NO: 4530955 - DNA, 13 bp, Homo sapiens
cgggcagccagca

SEQ ID NO: 4530956 - DNA, 12 bp, Homo sapiens
cgggcagccccg

SEQ ID NO: 4530957 - DNA, 14 bp, Homo sapiens
cgggcagtctgctc

SEQ ID NO: 4530958 - DNA, 18 bp, Homo sapiens
cgcctgcaggagagagca

SEQ ID NO: 4530959 - DNA, 11 bp, Homo sapiens
cgcctgccacc

SEQ ID NO: 4530960 - DNA, 12 bp, Homo sapiens
cgcctgcctgca

SEQ ID NO: 4530961 - DNA, 18 bp, Homo sapiens
cgcctgcctgcagcaggc

SEQ ID NO: 4530962 - DNA, 21 bp, Homo sapiens
cgcctggcagtccgtgggacg

SEQ ID NO: 4530963 - DNA, 16 bp, Homo sapiens
cgcctgggtcatgggc

SEQ ID NO: 4530964 - DNA, 17 bp, Homo sapiens
cgcctgggtcatgggcc

SEQ ID NO: 4530965 - DNA, 18 bp, Homo sapiens
cgcctgggtcatgggcct

SEQ ID NO: 4530966 - DNA, 16 bp, Homo sapiens
cgcctgtaatcccagc

SEQ ID NO: 4530967 - DNA, 17 bp, Homo sapiens
cgcctgtaatcccagca

SEQ ID NO: 4530968 - DNA, 18 bp, Homo sapiens
cgcctgtaatcccagcag

SEQ ID NO: 4530969 - DNA, 18 bp, Homo sapiens
cgccttcgtgcctgagac

SEQ ID NO: 4530970 - DNA, 13 bp, Homo sapiens
cgccttgtgagat

SEQ ID NO: 4530971 - DNA, 15 bp, Homo sapiens
cgcgactaatttcaa

SEQ ID NO: 4530972 - DNA, 22 bp, Homo sapiens
cgcgactaatttcaaaatgctt

SEQ ID NO: 4530973 - DNA, 21 bp, Homo sapiens
cgcgccaaataatgtctctgt

SEQ ID NO: 4530974 - DNA, 15 bp, Homo sapiens
cgcgccgatgccacc

SEQ ID NO: 4530975 - DNA, 16 bp, Homo sapiens
cgcgctcgcccagcag

SEQ ID NO: 4530976 - DNA, 17 bp, Homo sapiens
cgcgctcgcccagcagg

SEQ ID NO: 4530977 - DNA, 22 bp, Homo sapiens
cgcggccagccccggccctggg

SEQ ID NO: 4530978 - DNA, 11 bp, Homo sapiens
cgcggctggga

SEQ ID NO: 4530979 - DNA, 17 bp, Homo sapiens
cgcgggcagccacccaa

SEQ ID NO: 4530980 - DNA, 18 bp, Homo sapiens
cgcgggccaggaggctgc

SEQ ID NO: 4530981 - DNA, 17 bp, Homo sapiens
cgcggggaagctggctt

SEQ ID NO: 4530982 - DNA, 13 bp, Homo sapiens
cgcggtggctcac

SEQ ID NO: 4530983 - DNA, 15 bp, Homo sapiens
cgcgtcccagctccc

SEQ ID NO: 4530984 - DNA, 13 bp, Homo sapiens
cgctaaaagaaac

SEQ ID NO: 4530985 - DNA, 15 bp, Homo sapiens
cgctaaaagaaactt

SEQ ID NO: 4530986 - DNA, 18 bp, Homo sapiens
cgctaataagtgacaaat

SEQ ID NO: 4530987 - DNA, 17 bp, Homo sapiens
cgctagtgtttaaaagg

SEQ ID NO: 4530988 - DNA, 15 bp, Homo sapiens
cgctcaccgctggcc

SEQ ID NO: 4530989 - DNA, 21 bp, Homo sapiens
cgctcaccgctggcccttaga

SEQ ID NO: 4530990 - DNA, 14 bp, Homo sapiens
cgctcagcagccct

SEQ ID NO: 4530991 - DNA, 23 bp, Homo sapiens
cgctcagcagccctagcggctgc

SEQ ID NO: 4530992 - DNA, 13 bp, Homo sapiens
cgctcagccccag

SEQ ID NO: 4530993 - DNA, 18 bp, Homo sapiens
cgctcagccccaggccag

SEQ ID NO: 4530994 - DNA, 19 bp, Homo sapiens
cgctcagccccaggccagc

SEQ ID NO: 4530995 - DNA, 20 bp, Homo sapiens
cgctcagccccaggccagct

SEQ ID NO: 4530996 - DNA, 22 bp, Homo sapiens
cgctcagccccaggccagctgc

SEQ ID NO: 4530997 - DNA, 13 bp, Homo sapiens
cgctcatctggct

SEQ ID NO: 4530998 - DNA, 20 bp, Homo sapiens
cgctccctgtagctctgcct

SEQ ID NO: 4530999 - DNA, 22 bp, Homo sapiens
cgctccgggaacagtgcatgtg

SEQ ID NO: 4531000 - DNA, 19 bp, Homo sapiens
cgctcctgccgcagagctg

SEQ ID NO: 4531001 - DNA, 20 bp, Homo sapiens
cgctcgatggacctcagcaa

SEQ ID NO: 4531002 - DNA, 16 bp, Homo sapiens
cgctcgcccagcagga

SEQ ID NO: 4531003 - DNA, 18 bp, Homo sapiens
cgctcgcccagcaggaga

SEQ ID NO: 4531004 - DNA, 19 bp, Homo sapiens
cgctcggtctccaccccag

SEQ ID NO: 4531005 - DNA, 15 bp, Homo sapiens
cgctcgtgtgttcta

SEQ ID NO: 4531006 - DNA, 13 bp, Homo sapiens
cgctctcttttct

SEQ ID NO: 4531007 - DNA, 12 bp, Homo sapiens
cgctctgcatgc

SEQ ID NO: 4531008 - DNA, 23 bp, Homo sapiens
cgctctgcatgcggcccagcccg

SEQ ID NO: 4531009 - DNA, 17 bp, Homo sapiens
cgctgaagatggagggg

SEQ ID NO: 4531010 - DNA, 14 bp, Homo sapiens
cgctgagccacctg

SEQ ID NO: 4531011 - DNA, 17 bp, Homo sapiens
cgctgcacatggcctga

SEQ ID NO: 4531012 - DNA, 18 bp, Homo sapiens
cgctgcagaccccaggtt

SEQ ID NO: 4531013 - DNA, 14 bp, Homo sapiens
cgctgccagccttg

SEQ ID NO: 4531014 - DNA, 12 bp, Homo sapiens
cgctgccctgtg

SEQ ID NO: 4531015 - DNA, 20 bp, Homo sapiens
cgctgcccttgggtcccccc

SEQ ID NO: 4531016 - DNA, 22 bp, Homo sapiens
cgctgcccttgggtccccccga

SEQ ID NO: 4531017 - DNA, 13 bp, Homo sapiens
cgctgccgcaccc

SEQ ID NO: 4531018 - DNA, 20 bp, Homo sapiens
cgctgccgcaccccagagtg

SEQ ID NO: 4531019 - DNA, 18 bp, Homo sapiens
cgctgccgctgcaccacg

SEQ ID NO: 4531020 - DNA, 15 bp, Homo sapiens
cgctgccgctgccgc

SEQ ID NO: 4531021 - DNA, 18 bp, Homo sapiens
cgctgccgctgccgctgc

SEQ ID NO: 4531022 - DNA, 17 bp, Homo sapiens
cgctgcctaagtggctg

SEQ ID NO: 4531023 - DNA, 19 bp, Homo sapiens
cgctgcgcagcctccaggg

SEQ ID NO: 4531024 - DNA, 19 bp, Homo sapiens
cgctgctacatcagactct

SEQ ID NO: 4531025 - DNA, 19 bp, Homo sapiens
cgctgctgtgctctgggga

SEQ ID NO: 4531026 - DNA, 23 bp, Homo sapiens
cgctggactattgtgccaactgc

SEQ ID NO: 4531027 - DNA, 23 bp, Homo sapiens
cgctggcgacacactccgtccat

SEQ ID NO: 4531028 - DNA, 16 bp, Homo sapiens
cgctgtataaagcatg

SEQ ID NO: 4531029 - DNA, 23 bp, Homo sapiens
cgctgtcctctcgagcccagatg

SEQ ID NO: 4531030 - DNA, 20 bp, Homo sapiens
cgctgttctgggcatggcag

SEQ ID NO: 4531031 - DNA, 22 bp, Homo sapiens
cgcttaatccaatattttgcct

SEQ ID NO: 4531032 - DNA, 20 bp, Homo sapiens
cgcttatcaactaatgattt

SEQ ID NO: 4531033 - DNA, 21 bp, Homo sapiens
cgcttccttagccttgctcag

SEQ ID NO: 4531034 - DNA, 20 bp, Homo sapiens
cgcttgctggaacacagggg

SEQ ID NO: 4531035 - DNA, 17 bp, Homo sapiens
cgcttgcttctgcagca

SEQ ID NO: 4531036 - DNA, 21 bp, Homo sapiens
cgcttgcttctgcagcaactc

SEQ ID NO: 4531037 - DNA, 22 bp, Homo sapiens
cgcttgcttctgcagcaactcc

SEQ ID NO: 4531038 - DNA, 17 bp, Homo sapiens
cgcttgtccagcgccta

SEQ ID NO: 4531039 - DNA, 20 bp, Homo sapiens
cgcttgtccagcgcctagtg

SEQ ID NO: 4531040 - DNA, 14 bp, Homo sapiens
cgctttcctgaatc

SEQ ID NO: 4531041 - DNA, 13 bp, Homo sapiens
cgctttgtttact

SEQ ID NO: 4531042 - DNA, 17 bp, Homo sapiens
cgctttgtttactctct

SEQ ID NO: 4531043 - DNA, 20 bp, Homo sapiens
cggaaagtgaagagtcagaa

SEQ ID NO: 4531044 - DNA, 13 bp, Homo sapiens
cggaatatatttt

SEQ ID NO: 4531045 - DNA, 11 bp, Homo sapiens
cggaatgaact

SEQ ID NO: 4531046 - DNA, 14 bp, Homo sapiens
cggacactcctaga

SEQ ID NO: 4531047 - DNA, 15 bp, Homo sapiens
cggacactcctagag

SEQ ID NO: 4531048 - DNA, 23 bp, Homo sapiens
cggacagttccagaagtgtgact

SEQ ID NO: 4531049 - DNA, 17 bp, Homo sapiens
cggaccactcgaggcct

SEQ ID NO: 4531050 - DNA, 16 bp, Homo sapiens
cggacccaccccaact

SEQ ID NO: 4531051 - DNA, 17 bp, Homo sapiens
cggaccccactccggcc

SEQ ID NO: 4531052 - DNA, 15 bp, Homo sapiens
cggaccccagccatc

SEQ ID NO: 4531053 - DNA, 22 bp, Homo sapiens
cggacccttctgggtccaggga

SEQ ID NO: 4531054 - DNA, 21 bp, Homo sapiens
cggactaagcctacctgctct

SEQ ID NO: 4531055 - DNA, 16 bp, Homo sapiens
cggactgcccccagaa

SEQ ID NO: 4531056 - DNA, 18 bp, Homo sapiens
cggactgcccccagaaag

SEQ ID NO: 4531057 - DNA, 17 bp, Homo sapiens
cggagactatggcctcg

SEQ ID NO: 4531058 - DNA, 18 bp, Homo sapiens
cggagactatggcctcgc

SEQ ID NO: 4531059 - DNA, 16 bp, Homo sapiens
cggagagcagcagcac

SEQ ID NO: 4531060 - DNA, 17 bp, Homo sapiens
cggagagcagcagcacc

SEQ ID NO: 4531061 - DNA, 17 bp, Homo sapiens
cggagccactcctctga

SEQ ID NO: 4531062 - DNA, 18 bp, Homo sapiens
cggagccactcctctgac

SEQ ID NO: 4531063 - DNA, 19 bp, Homo sapiens
cggagcccacactgccacc

SEQ ID NO: 4531064 - DNA, 13 bp, Homo sapiens
cggagcccagcct

SEQ ID NO: 4531065 - DNA, 15 bp, Homo sapiens
cggagcccagcctgg

SEQ ID NO: 4531066 - DNA, 20 bp, Homo sapiens
cggaggctacccgctgtggc

SEQ ID NO: 4531067 - DNA, 13 bp, Homo sapiens
cggaggctgggcc

SEQ ID NO: 4531068 - DNA, 22 bp, Homo sapiens
cggaggctgggcccctgggatg

SEQ ID NO: 4531069 - DNA, 14 bp, Homo sapiens
cggaggctgtgctc

SEQ ID NO: 4531070 - DNA, 22 bp, Homo sapiens
cggagggcccctgcgtgggggc

SEQ ID NO: 4531071 - DNA, 17 bp, Homo sapiens
cggaggtcactccacca

SEQ ID NO: 4531072 - DNA, 17 bp, Homo sapiens
cggagtgaatgtggcag

SEQ ID NO: 4531073 - DNA, 18 bp, Homo sapiens
cggagtggggggacagag

SEQ ID NO: 4531074 - DNA, 18 bp, Homo sapiens
cggatcaccgagagtagc

SEQ ID NO: 4531075 - DNA, 23 bp, Homo sapiens
cggatcaccgagagtagccgaga

SEQ ID NO: 4531076 - DNA, 19 bp, Homo sapiens
cggatcatcaacaagattt

SEQ ID NO: 4531077 - DNA, 21 bp, Homo sapiens
cggatcatcaacaagatttcc

SEQ ID NO: 4531078 - DNA, 12 bp, Homo sapiens
cgaggggagggc

SEQ ID NO: 4531079 - DNA, 17 bp, Homo sapiens
cgaggggcccagggaag

SEQ ID NO: 4531080 - DNA, 14 bp, Homo sapiens
cgagggtcctggct

SEQ ID NO: 4531081 - DNA, 16 bp, Homo sapiens
cgaggtcaacagagaa

SEQ ID NO: 4531082 - DNA, 22 bp, Homo sapiens
cgaggtggatcacagaggcttc

SEQ ID NO: 4531083 - DNA, 17 bp, Homo sapiens
cgaggttcccagggctg

SEQ ID NO: 4531084 - DNA, 14 bp, Homo sapiens
cgagtactgtgggc

SEQ ID NO: 4531085 - DNA, 13 bp, Homo sapiens
cgagtccaaggcc

SEQ ID NO: 4531086 - DNA, 21 bp, Homo sapiens
cgagtctggggacctggcact

SEQ ID NO: 4531087 - DNA, 13 bp, Homo sapiens
cgagttcctctgg

SEQ ID NO: 4531088 - DNA, 21 bp, Homo sapiens
cgagtttctggtaagactgct

SEQ ID NO: 4531089 - DNA, 16 bp, Homo sapiens
cgagtttggtccctgg

SEQ ID NO: 4531090 - DNA, 18 bp, Homo sapiens
cgatatcagaatttgtgt

SEQ ID NO: 4531091 - DNA, 13 bp, Homo sapiens
cgatattctccct

SEQ ID NO: 4531092 - DNA, 22 bp, Homo sapiens
cgatcaagttgttgactgtgat

SEQ ID NO: 4531093 - DNA, 21 bp, Homo sapiens
cgatcctggattcactcactc

SEQ ID NO: 4531094 - DNA, 23 bp, Homo sapiens
cgatcgtaccactacactccagc

SEQ ID NO: 4531095 - DNA, 15 bp, Homo sapiens
cgatctctcctggcc

SEQ ID NO: 4531096 - DNA, 23 bp, Homo sapiens
cgatggacctcagcaagctgccc

SEQ ID NO: 4531097 - DNA, 12 bp, Homo sapiens
cgatgggtcagg

SEQ ID NO: 4531098 - DNA, 13 bp, Homo sapiens
cgatgtgctcagc

SEQ ID NO: 4531099 - DNA, 11 bp, Homo sapiens
cgatgtggccc

SEQ ID NO: 4531100 - DNA, 17 bp, Homo sapiens
cgatgtggccctggcct

SEQ ID NO: 4531101 - DNA, 17 bp, Homo sapiens
cgatttaaactccagca

SEQ ID NO: 4531102 - DNA, 17 bp, Homo sapiens
cgatttctgtaaactct

SEQ ID NO: 4531103 - DNA, 17 bp, Homo sapiens
cgcaaccaagtgtgcta

SEQ ID NO: 4531104 - DNA, 19 bp, Homo sapiens
cgcaaggtgtgctctgagc

SEQ ID NO: 4531105 - DNA, 16 bp, Homo sapiens
cgcaagttaacttgga

SEQ ID NO: 4531106 - DNA, 17 bp, Homo sapiens
cgcaatagttttttact

SEQ ID NO: 4531107 - DNA, 22 bp, Homo sapiens
cgcaatgaaaagtcgttttcca

SEQ ID NO: 4531108 - DNA, 16 bp, Homo sapiens
cgcacacagctgagca

SEQ ID NO: 4531109 - DNA, 12 bp, Homo sapiens
cgcacagccacc

SEQ ID NO: 4531110 - DNA, 16 bp, Homo sapiens
cgcacagccacccgtg

SEQ ID NO: 4531111 - DNA, 21 bp, Homo sapiens
cgcacatgtgccactgttcag

SEQ ID NO: 4531112 - DNA, 18 bp, Homo sapiens
cgcaccctgtcctgcaca

SEQ ID NO: 4531113 - DNA, 21 bp, Homo sapiens
cgcaccgcctgaaggcacagc

SEQ ID NO: 4531114 - DNA, 23 bp, Homo sapiens
cgcacgactgcgggagccagact

SEQ ID NO: 4531115 - DNA, 14 bp, Homo sapiens
cgcactctgccccc

SEQ ID NO: 4531116 - DNA, 14 bp, Homo sapiens
cgcagactcctcca

SEQ ID NO: 4531117 - DNA, 15 bp, Homo sapiens
cgcagactcctccac

SEQ ID NO: 4531118 - DNA, 22 bp, Homo sapiens
cgcagaggatccatcacagacg

SEQ ID NO: 4531119 - DNA, 22 bp, Homo sapiens
cgcagatttttatgttttgaaa

SEQ ID NO: 4531120 - DNA, 18 bp, Homo sapiens
cgcagccctagagcctgc

SEQ ID NO: 4531121 - DNA, 19 bp, Homo sapiens
cgcagccctagagcctgcc

SEQ ID NO: 4531122 - DNA, 14 bp, Homo sapiens
cgcagcggggtagg

SEQ ID NO: 4531123 - DNA, 20 bp, Homo sapiens
cgcaggaactgggctgggcc

SEQ ID NO: 4531124 - DNA, 18 bp, Homo sapiens
cgcaggtgggctggactt

SEQ ID NO: 4531125 - DNA, 22 bp, Homo sapiens
cgcagttgtgtggcccagcacg

SEQ ID NO: 4531126 - DNA, 22 bp, Homo sapiens
cgcatagtgtgctcggacacag

SEQ ID NO: 4531127 - DNA, 14 bp, Homo sapiens
cgcatcttctccat

SEQ ID NO: 4531128 - DNA, 19 bp, Homo sapiens
cgcatggtcacacactgat

SEQ ID NO: 4531129 - DNA, 19 bp, Homo sapiens
cgcattctaacctggaggt

SEQ ID NO: 4531130 - DNA, 17 bp, Homo sapiens
cgcattgctgtccttgg

SEQ ID NO: 4531131 - DNA, 21 bp, Homo sapiens
cgcattttggtttttcctcat

SEQ ID NO: 4531132 - DNA, 17 bp, Homo sapiens
cgccaaataatgtctct

SEQ ID NO: 4531133 - DNA, 19 bp, Homo sapiens
cgccaaggaggtgggccac

SEQ ID NO: 4531134 - DNA, 17 bp, Homo sapiens
cgccaagtctggcacca

SEQ ID NO: 4531135 - DNA, 19 bp, Homo sapiens
cgccaatgttatgccagct

SEQ ID NO: 4531136 - DNA, 16 bp, Homo sapiens
cgccaccgtgcctggc

SEQ ID NO: 4531137 - DNA, 16 bp, Homo sapiens
cgccactaggtgtccc

SEQ ID NO: 4531138 - DNA, 18 bp, Homo sapiens
cgccactaggtgtcccca

SEQ ID NO: 4531139 - DNA, 19 bp, Homo sapiens
cgccactaggtgtccccaa

SEQ ID NO: 4531140 - DNA, 23 bp, Homo sapiens
cgccactaggtgtccccaacgtc

SEQ ID NO: 4531141 - DNA, 17 bp, Homo sapiens
cgccactcatttcatct

SEQ ID NO: 4531142 - DNA, 15 bp, Homo sapiens
cgccactcgccttct

SEQ ID NO: 4531143 - DNA, 14 bp, Homo sapiens
cgccagcctcctct

SEQ ID NO: 4531144 - DNA, 15 bp, Homo sapiens
cgccagcctcctctg

SEQ ID NO: 4531145 - DNA, 16 bp, Homo sapiens
cgccagcctcctctgg

SEQ ID NO: 4531146 - DNA, 20 bp, Homo sapiens
cgccagctgggagcactggt

SEQ ID NO: 4531147 - DNA, 14 bp, Homo sapiens
cgccaggaagccag

SEQ ID NO: 4531148 - DNA, 20 bp, Homo sapiens
cgccaggccagcaggcgggc

SEQ ID NO: 4531149 - DNA, 11 bp, Homo sapiens
cgccagggctg

SEQ ID NO: 4531150 - DNA, 16 bp, Homo sapiens
cgccagggctggggac

SEQ ID NO: 4531151 - DNA, 21 bp, Homo sapiens
cgccagggctggggacagagg

SEQ ID NO: 4531152 - DNA, 18 bp, Homo sapiens
cgccattctcctgcctca

SEQ ID NO: 4531153 - DNA, 14 bp, Homo sapiens
cgccattgccacca

SEQ ID NO: 4531154 - DNA, 17 bp, Homo sapiens
cgccattgccaccagga

SEQ ID NO: 4531155 - DNA, 17 bp, Homo sapiens
cgcccaaggccttcccc

SEQ ID NO: 4531156 - DNA, 16 bp, Homo sapiens
cgcccaccagccttgc

SEQ ID NO: 4531157 - DNA, 13 bp, Homo sapiens
cgcccacccccac

SEQ ID NO: 4531158 - DNA, 19 bp, Homo sapiens
cgcccacccccacccccag

SEQ ID NO: 4531159 - DNA, 19 bp, Homo sapiens
cgcccaccccgctctgcat

SEQ ID NO: 4531160 - DNA, 12 bp, Homo sapiens
cgcccagacacc

SEQ ID NO: 4531161 - DNA, 11 bp, Homo sapiens
cgccccagcct

SEQ ID NO: 4531162 - DNA, 16 bp, Homo sapiens
cgccccatccctgctt

SEQ ID NO: 4531163 - DNA, 22 bp, Homo sapiens
cgccccatccctgcttgcccgc

SEQ ID NO: 4531164 - DNA, 18 bp, Homo sapiens
cgcccccagtccccaccc

SEQ ID NO: 4531165 - DNA, 22 bp, Homo sapiens
cgcccccagtccccacccctgc

SEQ ID NO: 4531166 - DNA, 14 bp, Homo sapiens
cgcccccgagccct

SEQ ID NO: 4531167 - DNA, 17 bp, Homo sapiens
cgccccggtcccccaga

SEQ ID NO: 4531168 - DNA, 18 bp, Homo sapiens
cgccccggtcccccagag

SEQ ID NO: 4531169 - DNA, 19 bp, Homo sapiens
cgccccggtcccccagagc

SEQ ID NO: 4531170 - DNA, 15 bp, Homo sapiens
cgccccgtgtttgcg

SEQ ID NO: 4531171 - DNA, 15 bp, Homo sapiens
cgcccctcccaagcg

SEQ ID NO: 4531172 - DNA, 16 bp, Homo sapiens
cgcccctcccacgcct

SEQ ID NO: 4531173 - DNA, 13 bp, Homo sapiens
cgccccttccctc

SEQ ID NO: 4531174 - DNA, 11 bp, Homo sapiens
cgccctccctg

SEQ ID NO: 4531175 - DNA, 22 bp, Homo sapiens
cgccctccctgctagcacagag

SEQ ID NO: 4531176 - DNA, 14 bp, Homo sapiens
cgccctgggctgtc

SEQ ID NO: 4531177 - DNA, 14 bp, Homo sapiens
cgcccttccatgtg

SEQ ID NO: 4531178 - DNA, 20 bp, Homo sapiens
cgcccttccatgtgcctttc

SEQ ID NO: 4531179 - DNA, 17 bp, Homo sapiens
cgccctttcctcctcag

SEQ ID NO: 4531180 - DNA, 20 bp, Homo sapiens
cgccctttcctcctcaggca

SEQ ID NO: 4531181 - DNA, 14 bp, Homo sapiens
cgccgccgccgctg

SEQ ID NO: 4531182 - DNA, 15 bp, Homo sapiens
cgccggcttcctcct

SEQ ID NO: 4531183 - DNA, 18 bp, Homo sapiens
cgccgggcaccaactcca

SEQ ID NO: 4531184 - DNA, 22 bp, Homo sapiens
cgccgtgccggcggcagcccca

SEQ ID NO: 4531185 - DNA, 22 bp, Homo sapiens
cgcctacccttcccgcctccct

SEQ ID NO: 4531186 - DNA, 17 bp, Homo sapiens
cgcctataatcccagct

SEQ ID NO: 4531187 - DNA, 19 bp, Homo sapiens
cgcctcaccagccccccgc

SEQ ID NO: 4531188 - DNA, 14 bp, Homo sapiens
cgcctcagccctca

SEQ ID NO: 4531189 - DNA, 16 bp, Homo sapiens
cgcctccactctagtt

SEQ ID NO: 4531190 - DNA, 15 bp, Homo sapiens
cgcctccctccaccc

SEQ ID NO: 4531191 - DNA, 15 bp, Homo sapiens
cgcctcctggccaga

SEQ ID NO: 4531192 - DNA, 16 bp, Homo sapiens
cgcctcctggccagac

SEQ ID NO: 4531193 - DNA, 18 bp, Homo sapiens
cgcctcgacctccccacc

SEQ ID NO: 4531194 - DNA, 22 bp, Homo sapiens
cgcctcgacctccccacccgct

SEQ ID NO: 4531195 - DNA, 16 bp, Homo sapiens
cgcctcggcctcccaa

SEQ ID NO: 4531196 - DNA, 13 bp, Homo sapiens
cgcctgaaagtgt

SEQ ID NO: 4531197 - DNA, 15 bp, Homo sapiens
cgcctgaaggcacag

SEQ ID NO: 4531198 - DNA, 17 bp, Homo sapiens
cgcctgaaggcacagct

SEQ ID NO: 4531199 - DNA, 14 bp, Homo sapiens
ccttttatctggtg

SEQ ID NO: 4531200 - DNA, 23 bp, Homo sapiens
ccttttcccaaaatgttgaaata

SEQ ID NO: 4531201 - DNA, 15 bp, Homo sapiens
ccttttccctgcttc

SEQ ID NO: 4531202 - DNA, 13 bp, Homo sapiens
ccttttcctatcc

SEQ ID NO: 4531203 - DNA, 10 bp, Homo sapiens
ccttttcctt

SEQ ID NO: 4531204 - DNA, 23 bp, Homo sapiens
ccttttcgtttagaatcagaata

SEQ ID NO: 4531205 - DNA, 19 bp, Homo sapiens
ccttttctcacaaaaaggc

SEQ ID NO: 4531206 - DNA, 14 bp, Homo sapiens
ccttttctcttttc

SEQ ID NO: 4531207 - DNA, 14 bp, Homo sapiens
ccttttctgtggct

SEQ ID NO: 4531208 - DNA, 13 bp, Homo sapiens
ccttttgacactg

SEQ ID NO: 4531209 - DNA, 19 bp, Homo sapiens
ccttttgctctctgtgacc

SEQ ID NO: 4531210 - DNA, 22 bp, Homo sapiens
ccttttggataagtttctattc

SEQ ID NO: 4531211 - DNA, 21 bp, Homo sapiens
ccttttgttaatgcattgttg

SEQ ID NO: 4531212 - DNA, 19 bp, Homo sapiens
cctttttatatttaaaaaa

SEQ ID NO: 4531213 - DNA, 19 bp, Homo sapiens
cctttttattccttttaaa

SEQ ID NO: 4531214 - DNA, 22 bp, Homo sapiens
cctttttcctgcgtcccagcct

SEQ ID NO: 4531215 - DNA, 14 bp, Homo sapiens
cctttttgacactg

SEQ ID NO: 4531216 - DNA, 18 bp, Homo sapiens
ccttttttaaaataaaat

SEQ ID NO: 4531217 - DNA, 19 bp, Homo sapiens
ccttttttaaaataaaata

SEQ ID NO: 4531218 - DNA, 17 bp, Homo sapiens
ccttttttcaatatgca

SEQ ID NO: 4531219 - DNA, 11 bp, Homo sapiens
ccttttttccc

SEQ ID NO: 4531220 - DNA, 11 bp, Homo sapiens
ccttttttcct

SEQ ID NO: 4531221 - DNA, 14 bp, Homo sapiens
ccttttttcttttt

SEQ ID NO: 4531222 - DNA, 12 bp, Homo sapiens
ccttttttgatc

SEQ ID NO: 4531223 - DNA, 16 bp, Homo sapiens
ccttttttttctgatt

SEQ ID NO: 4531224 - DNA, 16 bp, Homo sapiens
cgaaaatagtatttca

SEQ ID NO: 4531225 - DNA, 23 bp, Homo sapiens
cgaaacccccttttcccttcagc

SEQ ID NO: 4531226 - DNA, 15 bp, Homo sapiens
cgaaactaagccagg

SEQ ID NO: 4531227 - DNA, 18 bp, Homo sapiens
cgaaagtatttacttttt

SEQ ID NO: 4531228 - DNA, 18 bp, Homo sapiens
cgaaatagatatcctctc

SEQ ID NO: 4531229 - DNA, 13 bp, Homo sapiens
cgaacatgtgttt

SEQ ID NO: 4531230 - DNA, 16 bp, Homo sapiens
cgaacccacctgctga

SEQ ID NO: 4531231 - DNA, 19 bp, Homo sapiens
cgaagaagagaaagatgtg

SEQ ID NO: 4531232 - DNA, 20 bp, Homo sapiens
cgaagaccctcttgcccatc

SEQ ID NO: 4531233 - DNA, 23 bp, Homo sapiens
cgaagaccctcttgcccatcctg

SEQ ID NO: 4531234 - DNA, 19 bp, Homo sapiens
cgaagcaatactgtccagt

SEQ ID NO: 4531235 - DNA, 15 bp, Homo sapiens
cgaagggattgtgta

SEQ ID NO: 4531236 - DNA, 17 bp, Homo sapiens
cgaagtgtttatgtaat

SEQ ID NO: 4531237 - DNA, 14 bp, Homo sapiens
cgaataaatgttca

SEQ ID NO: 4531238 - DNA, 12 bp, Homo sapiens
cgaatctctgcc

SEQ ID NO: 4531239 - DNA, 15 bp, Homo sapiens
cgaatgaaaagacaa

SEQ ID NO: 4531240 - DNA, 16 bp, Homo sapiens
cgaatttggtacacat

SEQ ID NO: 4531241 - DNA, 18 bp, Homo sapiens
cgaatttggtacacatgt

SEQ ID NO: 4531242 - DNA, 13 bp, Homo sapiens
cgacaaagctgct

SEQ ID NO: 4531243 - DNA, 16 bp, Homo sapiens
cgacacatatacatat

SEQ ID NO: 4531244 - DNA, 15 bp, Homo sapiens
cgacactgagctgtg

SEQ ID NO: 4531245 - DNA, 14 bp, Homo sapiens
cgacagggcctgga

SEQ ID NO: 4531246 - DNA, 15 bp, Homo sapiens
cgacagtgagactct

SEQ ID NO: 4531247 - DNA, 21 bp, Homo sapiens
cgacagtggatgctgggtcca

SEQ ID NO: 4531248 - DNA, 15 bp, Homo sapiens
cgaccacccctgcct

SEQ ID NO: 4531249 - DNA, 16 bp, Homo sapiens
cgacccactctgcttc

SEQ ID NO: 4531250 - DNA, 12 bp, Homo sapiens
cgaccctggggc

SEQ ID NO: 4531251 - DNA, 21 bp, Homo sapiens
cgaccctgtgcaggagctagt

SEQ ID NO: 4531252 - DNA, 14 bp, Homo sapiens
cgacctcgtcctcc

SEQ ID NO: 4531253 - DNA, 19 bp, Homo sapiens
cgacctcgtcctccccctg

SEQ ID NO: 4531254 - DNA, 22 bp, Homo sapiens
cgacctcgtcctccccctgcca

SEQ ID NO: 4531255 - DNA, 14 bp, Homo sapiens
cgactaatttcaaa

SEQ ID NO: 4531256 - DNA, 10 bp, Homo sapiens
cgactccagc

SEQ ID NO: 4531257 - DNA, 13 bp, Homo sapiens
cgactccagccag

SEQ ID NO: 4531258 - DNA, 14 bp, Homo sapiens
cgactccagccagc

SEQ ID NO: 4531259 - DNA, 18 bp, Homo sapiens
cgactgaaaatattgttt

SEQ ID NO: 4531260 - DNA, 13 bp, Homo sapiens
cgactgcgggagc

SEQ ID NO: 4531261 - DNA, 18 bp, Homo sapiens
cgactgcgggagccagac

SEQ ID NO: 4531262 - DNA, 21 bp, Homo sapiens
cgactgcgggagccagactgt

SEQ ID NO: 4531263 - DNA, 21 bp, Homo sapiens
cgactgttgtacaagctcagg

SEQ ID NO: 4531264 - DNA, 14 bp, Homo sapiens
cgactgtttattgg

SEQ ID NO: 4531265 - DNA, 16 bp, Homo sapiens
cgacttggagactcct

SEQ ID NO: 4531266 - DNA, 22 bp, Homo sapiens
cgacttggagactcctggtctg

SEQ ID NO: 4531267 - DNA, 21 bp, Homo sapiens
cgagaaattcgtgtgtttttt

SEQ ID NO: 4531268 - DNA, 16 bp, Homo sapiens
cgagaactttcatttt

SEQ ID NO: 4531269 - DNA, 13 bp, Homo sapiens
cgagaagctctcg

SEQ ID NO: 4531270 - DNA, 13 bp, Homo sapiens
cgagaagtgcttt

SEQ ID NO: 4531271 - DNA, 20 bp, Homo sapiens
cgagacaacagcacacaggc

SEQ ID NO: 4531272 - DNA, 15 bp, Homo sapiens
cgagacacattgcct

SEQ ID NO: 4531273 - DNA, 16 bp, Homo sapiens
cgagacacattgcctt

SEQ ID NO: 4531274 - DNA, 17 bp, Homo sapiens
cgagaccaacctgacca

SEQ ID NO: 4531275 - DNA, 21 bp, Homo sapiens
cgagaccacccaacctcaccc

SEQ ID NO: 4531276 - DNA, 13 bp, Homo sapiens
cgagaccatcctg

SEQ ID NO: 4531277 - DNA, 17 bp, Homo sapiens
cgagaccatcctggcta

SEQ ID NO: 4531278 - DNA, 16 bp, Homo sapiens
cgagactcagcctctg

SEQ ID NO: 4531279 - DNA, 17 bp, Homo sapiens
cgagactcagcctctgc

SEQ ID NO: 4531280 - DNA, 18 bp, Homo sapiens
cgagactcagcctctgct

SEQ ID NO: 4531281 - DNA, 22 bp, Homo sapiens
cgagactcagcctctgctggag

SEQ ID NO: 4531282 - DNA, 11 bp, Homo sapiens
cgagactccat

SEQ ID NO: 4531283 - DNA, 17 bp, Homo sapiens
cgagagatcaaagatga

SEQ ID NO: 4531284 - DNA, 21 bp, Homo sapiens
cgagagcctgctcccccaccc

SEQ ID NO: 4531285 - DNA, 14 bp, Homo sapiens
cgagagggagagag

SEQ ID NO: 4531286 - DNA, 14 bp, Homo sapiens
cgagcaagccggca

SEQ ID NO: 4531287 - DNA, 13 bp, Homo sapiens
cgagcacctccac

SEQ ID NO: 4531288 - DNA, 15 bp, Homo sapiens
cgagcatgtcgtgga

SEQ ID NO: 4531289 - DNA, 17 bp, Homo sapiens
cgagccacaagctgcac

SEQ ID NO: 4531290 - DNA, 18 bp, Homo sapiens
cgagccacaagctgcact

SEQ ID NO: 4531291 - DNA, 22 bp, Homo sapiens
cgagccacaagctgcactgtga

SEQ ID NO: 4531292 - DNA, 19 bp, Homo sapiens
cgagccatttgtcccaagt

SEQ ID NO: 4531293 - DNA, 22 bp, Homo sapiens
cgagccatttgtcccaagtgcc

SEQ ID NO: 4531294 - DNA, 12 bp, Homo sapiens
cgagccctgact

SEQ ID NO: 4531295 - DNA, 18 bp, Homo sapiens
cgagccctgactcctgga

SEQ ID NO: 4531296 - DNA, 20 bp, Homo sapiens
cgagccctgactcctggact

SEQ ID NO: 4531297 - DNA, 15 bp, Homo sapiens
cgagcctgaactgag

SEQ ID NO: 4531298 - DNA, 13 bp, Homo sapiens
cgagcctgggcga

SEQ ID NO: 4531299 - DNA, 19 bp, Homo sapiens
cgagctcctggggagctcc

SEQ ID NO: 4531300 - DNA, 22 bp, Homo sapiens
cgagctcctggggagctcctgg

SEQ ID NO: 4531301 - DNA, 18 bp, Homo sapiens
cgaggaaaggattttacc

SEQ ID NO: 4531302 - DNA, 23 bp, Homo sapiens
cgaggaaaggattttaccaaagc

SEQ ID NO: 4531303 - DNA, 14 bp, Homo sapiens
cgaggacaggaaag

SEQ ID NO: 4531304 - DNA, 14 bp, Homo sapiens
cgaggacccagacc

SEQ ID NO: 4531305 - DNA, 15 bp, Homo sapiens
cgaggagctgggccc

SEQ ID NO: 4531306 - DNA, 20 bp, Homo sapiens
cgaggaggctccagagggca

SEQ ID NO: 4531307 - DNA, 11 bp, Homo sapiens
cgaggccagta

SEQ ID NO: 4531308 - DNA, 19 bp, Homo sapiens
cgaggccagtacctttcca

SEQ ID NO: 4531309 - DNA, 23 bp, Homo sapiens
cgaggccctcaatccaccttcag

SEQ ID NO: 4531310 - DNA, 16 bp, Homo sapiens
cgaggctacagctcca

SEQ ID NO: 4531311 - DNA, 17 bp, Homo sapiens
cgaggctacagctccac

SEQ ID NO: 4531312 - DNA, 21 bp, Homo sapiens
cgaggctacagctccacacgc

SEQ ID NO: 4531313 - DNA, 13 bp, Homo sapiens
cgaggctccccgc

SEQ ID NO: 4531314 - DNA, 19 bp, Homo sapiens
cgaggctccccgcctccac

SEQ ID NO: 4531315 - DNA, 20 bp, Homo sapiens
cgaggctccccgcctccact

SEQ ID NO: 4531316 - DNA, 14 bp, Homo sapiens
cgaggctgcagtca

SEQ ID NO: 4531317 - DNA, 20 bp, Homo sapiens
cgaggctgcagtcagccctg

SEQ ID NO: 4531318 - DNA, 12 bp, Homo sapiens
cgaggctgctag

SEQ ID NO: 4531319 - DNA, 18 bp, Homo sapiens
cgagggaggaacacctga

SEQ ID NO: 4531320 - DNA, 17 bp, Homo sapiens
cgagggctggctggcct

SEQ ID NO: 4531321 - DNA, 16 bp, Homo sapiens
ccttgcccagcctgga

SEQ ID NO: 4531322 - DNA, 13 bp, Homo sapiens
ccttgcccagctt

SEQ ID NO: 4531323 - DNA, 20 bp, Homo sapiens
ccttgccccccgccctcatg

SEQ ID NO: 4531324 - DNA, 14 bp, Homo sapiens
ccttgccctcctgg

SEQ ID NO: 4531325 - DNA, 16 bp, Homo sapiens
ccttgccctcctgggc

SEQ ID NO: 4531326 - DNA, 12 bp, Homo sapiens
ccttgcctcccc

SEQ ID NO: 4531327 - DNA, 17 bp, Homo sapiens
ccttgcctccccatttc

SEQ ID NO: 4531328 - DNA, 22 bp, Homo sapiens
ccttgcctccccatttcccatc

SEQ ID NO: 4531329 - DNA, 13 bp, Homo sapiens
ccttgcctctgcc

SEQ ID NO: 4531330 - DNA, 17 bp, Homo sapiens
ccttgcctgaactccag

SEQ ID NO: 4531331 - DNA, 20 bp, Homo sapiens
ccttgcctgaactccagagg

SEQ ID NO: 4531332 - DNA, 20 bp, Homo sapiens
ccttgcggtatccgccccca

SEQ ID NO: 4531333 - DNA, 13 bp, Homo sapiens
ccttgctctcctc

SEQ ID NO: 4531334 - DNA, 17 bp, Homo sapiens
ccttgctctcctcatct

SEQ ID NO: 4531335 - DNA, 12 bp, Homo sapiens
ccttgctctctt

SEQ ID NO: 4531336 - DNA, 14 bp, Homo sapiens
ccttgctctcttca

SEQ ID NO: 4531337 - DNA, 16 bp, Homo sapiens
ccttgctctcttcaat

SEQ ID NO: 4531338 - DNA, 12 bp, Homo sapiens
ccttgctgcccg

SEQ ID NO: 4531339 - DNA, 23 bp, Homo sapiens
ccttgctgcccgcgggagacagc

SEQ ID NO: 4531340 - DNA, 16 bp, Homo sapiens
ccttgctttcctgggc

SEQ ID NO: 4531341 - DNA, 19 bp, Homo sapiens
ccttgctttcctgggcctt

SEQ ID NO: 4531342 - DNA, 13 bp, Homo sapiens
ccttgcttttgct

SEQ ID NO: 4531343 - DNA, 20 bp, Homo sapiens
ccttggaaacagttggcact

SEQ ID NO: 4531344 - DNA, 21 bp, Homo sapiens
ccttggaaacagttggcactg

SEQ ID NO: 4531345 - DNA, 18 bp, Homo sapiens
ccttggaaatagaaagaa

SEQ ID NO: 4531346 - DNA, 22 bp, Homo sapiens
ccttggaaatagaaagaagcca

SEQ ID NO: 4531347 - DNA, 23 bp, Homo sapiens
ccttggaaatagaaagaagccat

SEQ ID NO: 4531348 - DNA, 22 bp, Homo sapiens
ccttggaaccagccccatcaga

SEQ ID NO: 4531349 - DNA, 16 bp, Homo sapiens
ccttggaatatggcca

SEQ ID NO: 4531350 - DNA, 21 bp, Homo sapiens
ccttggcacccccatgctgcc

SEQ ID NO: 4531351 - DNA, 22 bp, Homo sapiens
ccttggcacccccatgctgcct

SEQ ID NO: 4531352 - DNA, 14 bp, Homo sapiens
ccttggccacagac

SEQ ID NO: 4531353 - DNA, 15 bp, Homo sapiens
ccttggccacagact

SEQ ID NO: 4531354 - DNA, 13 bp, Homo sapiens
ccttggcccagag

SEQ ID NO: 4531355 - DNA, 15 bp, Homo sapiens
ccttggcctgtctca

SEQ ID NO: 4531356 - DNA, 20 bp, Homo sapiens
ccttggctttcagagccagc

SEQ ID NO: 4531357 - DNA, 22 bp, Homo sapiens
ccttgggagtcattaccacgcc

SEQ ID NO: 4531358 - DNA, 16 bp, Homo sapiens
ccttgggccataatta

SEQ ID NO: 4531359 - DNA, 12 bp, Homo sapiens
ccttgggccctt

SEQ ID NO: 4531360 - DNA, 14 bp, Homo sapiens
ccttgggctgctcc

SEQ ID NO: 4531361 - DNA, 17 bp, Homo sapiens
ccttgggctgctcctca

SEQ ID NO: 4531362 - DNA, 22 bp, Homo sapiens
ccttggggaatttcctctattg

SEQ ID NO: 4531363 - DNA, 23 bp, Homo sapiens
ccttggggtaagccagagcctgg

SEQ ID NO: 4531364 - DNA, 12 bp, Homo sapiens
ccttggtgcctc

SEQ ID NO: 4531365 - DNA, 14 bp, Homo sapiens
ccttggtgcctctg

SEQ ID NO: 4531366 - DNA, 18 bp, Homo sapiens
ccttggtgtccacctggc

SEQ ID NO: 4531367 - DNA, 21 bp, Homo sapiens
ccttggtgtccacctggcccc

SEQ ID NO: 4531368 - DNA, 16 bp, Homo sapiens
ccttggttcccccact

SEQ ID NO: 4531369 - DNA, 15 bp, Homo sapiens
ccttgtaatacctga

SEQ ID NO: 4531370 - DNA, 14 bp, Homo sapiens
ccttgtccacccac

SEQ ID NO: 4531371 - DNA, 23 bp, Homo sapiens
ccttgtcggccccaccagtgcct

SEQ ID NO: 4531372 - DNA, 15 bp, Homo sapiens
ccttgtgccttcttt

SEQ ID NO: 4531373 - DNA, 20 bp, Homo sapiens
ccttgtgtcaagacatttct

SEQ ID NO: 4531374 - DNA, 23 bp, Homo sapiens
ccttgtgttgcactgaacaggtt

SEQ ID NO: 4531375 - DNA, 20 bp, Homo sapiens
ccttgttccagctttgacgt

SEQ ID NO: 4531376 - DNA, 22 bp, Homo sapiens
ccttgtttgagtttttcctccc

SEQ ID NO: 4531377 - DNA, 16 bp, Homo sapiens
cctttaaaaatgtata

SEQ ID NO: 4531378 - DNA, 20 bp, Homo sapiens
cctttaaaaatgtataatga

SEQ ID NO: 4531379 - DNA, 12 bp, Homo sapiens
cctttaaaatat

SEQ ID NO: 4531380 - DNA, 20 bp, Homo sapiens
cctttaacttttttttctct

SEQ ID NO: 4531381 - DNA, 21 bp, Homo sapiens
cctttaacttttttttctctc

SEQ ID NO: 4531382 - DNA, 22 bp, Homo sapiens
cctttaacttttttttctctct

SEQ ID NO: 4531383 - DNA, 15 bp, Homo sapiens
cctttaagaacctta

SEQ ID NO: 4531384 - DNA, 11 bp, Homo sapiens
cctttaatatt

SEQ ID NO: 4531385 - DNA, 16 bp, Homo sapiens
cctttaatattttgta

SEQ ID NO: 4531386 - DNA, 12 bp, Homo sapiens
cctttagaaaat

SEQ ID NO: 4531387 - DNA, 14 bp, Homo sapiens
cctttagaaaatat

SEQ ID NO: 4531388 - DNA, 21 bp, Homo sapiens
cctttaggatgttttcctcct

SEQ ID NO: 4531389 - DNA, 18 bp, Homo sapiens
cctttagggttctgcctc

SEQ ID NO: 4531390 - DNA, 19 bp, Homo sapiens
cctttagggttctgcctct

SEQ ID NO: 4531391 - DNA, 16 bp, Homo sapiens
cctttaggtctggttg

SEQ ID NO: 4531392 - DNA, 23 bp, Homo sapiens
cctttatgtgaatttttaagctg

SEQ ID NO: 4531393 - DNA, 14 bp, Homo sapiens
cctttatttattaa

SEQ ID NO: 4531394 - DNA, 21 bp, Homo sapiens
cctttatttattaaacttcag

SEQ ID NO: 4531395 - DNA, 14 bp, Homo sapiens
cctttcaaatttag

SEQ ID NO: 4531396 - DNA, 17 bp, Homo sapiens
cctttcacaagcaacag

SEQ ID NO: 4531397 - DNA, 13 bp, Homo sapiens
cctttcagatgtc

SEQ ID NO: 4531398 - DNA, 13 bp, Homo sapiens
cctttcagccaca

SEQ ID NO: 4531399 - DNA, 18 bp, Homo sapiens
cctttccagagcaaccag

SEQ ID NO: 4531400 - DNA, 14 bp, Homo sapiens
cctttccgctgtcg

SEQ ID NO: 4531401 - DNA, 21 bp, Homo sapiens
cctttccgctgtcgccccagg

SEQ ID NO: 4531402 - DNA, 18 bp, Homo sapiens
cctttcctgttcagcatt

SEQ ID NO: 4531403 - DNA, 20 bp, Homo sapiens
cctttcctgttcagcattct

SEQ ID NO: 4531404 - DNA, 18 bp, Homo sapiens
cctttccttccatcccta

SEQ ID NO: 4531405 - DNA, 21 bp, Homo sapiens
cctttccttccttccctggct

SEQ ID NO: 4531406 - DNA, 19 bp, Homo sapiens
cctttccttttttgagatt

SEQ ID NO: 4531407 - DNA, 15 bp, Homo sapiens
cctttctcccctgcc

SEQ ID NO: 4531408 - DNA, 15 bp, Homo sapiens
cctttctcctgtgaa

SEQ ID NO: 4531409 - DNA, 17 bp, Homo sapiens
cctttctcctgtgaatg

SEQ ID NO: 4531410 - DNA, 17 bp, Homo sapiens
cctttctctctcctctc

SEQ ID NO: 4531411 - DNA, 18 bp, Homo sapiens
cctttctctctcctctct

SEQ ID NO: 4531412 - DNA, 22 bp, Homo sapiens
cctttctggaagtttctggtgc

SEQ ID NO: 4531413 - DNA, 19 bp, Homo sapiens
cctttctggcaggtcctcc

SEQ ID NO: 4531414 - DNA, 12 bp, Homo sapiens
cctttctttgcc

SEQ ID NO: 4531415 - DNA, 14 bp, Homo sapiens
cctttctttgcctc

SEQ ID NO: 4531416 - DNA, 21 bp, Homo sapiens
cctttcttttgaatcaatctg

SEQ ID NO: 4531417 - DNA, 21 bp, Homo sapiens
cctttgaatattttttgaagg

SEQ ID NO: 4531418 - DNA, 21 bp, Homo sapiens
cctttgagagacgccactccc

SEQ ID NO: 4531419 - DNA, 21 bp, Homo sapiens
cctttgattaaagactccagt

SEQ ID NO: 4531420 - DNA, 18 bp, Homo sapiens
cctttgcaagatgcttgg

SEQ ID NO: 4531421 - DNA, 22 bp, Homo sapiens
cctttgcaatagcagttataac

SEQ ID NO: 4531422 - DNA, 18 bp, Homo sapiens
cctttgccagcagagcca

SEQ ID NO: 4531423 - DNA, 22 bp, Homo sapiens
cctttgccagcagagccagggc

SEQ ID NO: 4531424 - DNA, 14 bp, Homo sapiens
cctttgctatgtaa

SEQ ID NO: 4531425 - DNA, 17 bp, Homo sapiens
cctttgctatgtaaggg

SEQ ID NO: 4531426 - DNA, 16 bp, Homo sapiens
cctttggctggtagca

SEQ ID NO: 4531427 - DNA, 21 bp, Homo sapiens
cctttggctggtagcagcagg

SEQ ID NO: 4531428 - DNA, 14 bp, Homo sapiens
cctttgggaagggg

SEQ ID NO: 4531429 - DNA, 14 bp, Homo sapiens
cctttgggcccagg

SEQ ID NO: 4531430 - DNA, 17 bp, Homo sapiens
cctttgggcccagggac

SEQ ID NO: 4531431 - DNA, 18 bp, Homo sapiens
cctttgtatctttctttc

SEQ ID NO: 4531432 - DNA, 15 bp, Homo sapiens
cctttgtcaacttca

SEQ ID NO: 4531433 - DNA, 14 bp, Homo sapiens
cctttgtcccagaa

SEQ ID NO: 4531434 - DNA, 13 bp, Homo sapiens
cctttgtgagtca

SEQ ID NO: 4531435 - DNA, 21 bp, Homo sapiens
cctttgtgcagcttcgaggac

SEQ ID NO: 4531436 - DNA, 22 bp, Homo sapiens
cctttgtggttttatggagacc

SEQ ID NO: 4531437 - DNA, 13 bp, Homo sapiens
cctttgtttcttg

SEQ ID NO: 4531438 - DNA, 23 bp, Homo sapiens
cctttgttttgatgtttgtggcc

SEQ ID NO: 4531439 - DNA, 15 bp, Homo sapiens
ccttttaaaattgaa

SEQ ID NO: 4531440 - DNA, 11 bp, Homo sapiens
ccttttatata

SEQ ID NO: 4531441 - DNA, 12 bp, Homo sapiens
ccttcagcctga

SEQ ID NO: 4531442 - DNA, 18 bp, Homo sapiens
ccttcaggactctgcggg

SEQ ID NO: 4531443 - DNA, 18 bp, Homo sapiens
ccttcagggagacaggca

SEQ ID NO: 4531444 - DNA, 16 bp, Homo sapiens
ccttcagtgagcccct

SEQ ID NO: 4531445 - DNA, 23 bp, Homo sapiens
ccttcagtgagcccctccccagc

SEQ ID NO: 4531446 - DNA, 16 bp, Homo sapiens
ccttcagtgcccacca

SEQ ID NO: 4531447 - DNA, 18 bp, Homo sapiens
ccttcatatcatccacac

SEQ ID NO: 4531448 - DNA, 19 bp, Homo sapiens
ccttcatatcatccacaca

SEQ ID NO: 4531449 - DNA, 18 bp, Homo sapiens
ccttccaacttcctgtgg

SEQ ID NO: 4531450 - DNA, 22 bp, Homo sapiens
ccttccaacttcctgtggcctg

SEQ ID NO: 4531451 - DNA, 21 bp, Homo sapiens
ccttccacggatccatgtagc

SEQ ID NO: 4531452 - DNA, 17 bp, Homo sapiens
ccttccagagcccaagg

SEQ ID NO: 4531453 - DNA, 19 bp, Homo sapiens
ccttccatacacagaggag

SEQ ID NO: 4531454 - DNA, 12 bp, Homo sapiens
ccttccatccct

SEQ ID NO: 4531455 - DNA, 13 bp, Homo sapiens
ccttccatctctt

SEQ ID NO: 4531456 - DNA, 23 bp, Homo sapiens
ccttccatggtgtgatcgtctga

SEQ ID NO: 4531457 - DNA, 19 bp, Homo sapiens
ccttccatgtcggcctcta

SEQ ID NO: 4531458 - DNA, 19 bp, Homo sapiens
ccttccatgtgcctttctt

SEQ ID NO: 4531459 - DNA, 22 bp, Homo sapiens
ccttccatgtgcctttctttgc

SEQ ID NO: 4531460 - DNA, 13 bp, Homo sapiens
ccttccattccat

SEQ ID NO: 4531461 - DNA, 23 bp, Homo sapiens
ccttcccaacgtactcctcagac

SEQ ID NO: 4531462 - DNA, 18 bp, Homo sapiens
ccttcccactcaccccgg

SEQ ID NO: 4531463 - DNA, 17 bp, Homo sapiens
ccttcccagctctccct

SEQ ID NO: 4531464 - DNA, 21 bp, Homo sapiens
ccttcccagctctccctctgg

SEQ ID NO: 4531465 - DNA, 19 bp, Homo sapiens
ccttcccaggagtggagga

SEQ ID NO: 4531466 - DNA, 13 bp, Homo sapiens
ccttcccagggca

SEQ ID NO: 4531467 - DNA, 13 bp, Homo sapiens
ccttccccatggg

SEQ ID NO: 4531468 - DNA, 22 bp, Homo sapiens
ccttcccccatccctaccactg

SEQ ID NO: 4531469 - DNA, 15 bp, Homo sapiens
ccttcccctccctgg

SEQ ID NO: 4531470 - DNA, 19 bp, Homo sapiens
ccttcccctccctggctcc

SEQ ID NO: 4531471 - DNA, 22 bp, Homo sapiens
ccttcccctccctggctcccat

SEQ ID NO: 4531472 - DNA, 17 bp, Homo sapiens
ccttccccttctgtgtc

SEQ ID NO: 4531473 - DNA, 18 bp, Homo sapiens
ccttccccttctgtgtca

SEQ ID NO: 4531474 - DNA, 19 bp, Homo sapiens
ccttcccggcccccggcca

SEQ ID NO: 4531475 - DNA, 15 bp, Homo sapiens
ccttccctcctttta

SEQ ID NO: 4531476 - DNA, 17 bp, Homo sapiens
ccttccctccttttaaa

SEQ ID NO: 4531477 - DNA, 14 bp, Homo sapiens
ccttccctctctcc

SEQ ID NO: 4531478 - DNA, 21 bp, Homo sapiens
ccttccctctctgatgtccca

SEQ ID NO: 4531479 - DNA, 11 bp, Homo sapiens
ccttccctctg

SEQ ID NO: 4531480 - DNA, 13 bp, Homo sapiens
ccttccctctggg

SEQ ID NO: 4531481 - DNA, 20 bp, Homo sapiens
ccttccctctgggcacgcct

SEQ ID NO: 4531482 - DNA, 17 bp, Homo sapiens
ccttccctgttctccct

SEQ ID NO: 4531483 - DNA, 21 bp, Homo sapiens
ccttcctattccaagcttcca

SEQ ID NO: 4531484 - DNA, 16 bp, Homo sapiens
ccttcctcagctgcct

SEQ ID NO: 4531485 - DNA, 18 bp, Homo sapiens
ccttcctcagctgcctcc

SEQ ID NO: 4531486 - DNA, 13 bp, Homo sapiens
ccttcctcctgca

SEQ ID NO: 4531487 - DNA, 19 bp, Homo sapiens
ccttcctgtccctgaggtt

SEQ ID NO: 4531488 - DNA, 23 bp, Homo sapiens
ccttcctgtgggtgttctttcct

SEQ ID NO: 4531489 - DNA, 16 bp, Homo sapiens
ccttccttcaggactc

SEQ ID NO: 4531490 - DNA, 14 bp, Homo sapiens
ccttccttccctgg

SEQ ID NO: 4531491 - DNA, 16 bp, Homo sapiens
ccttccttccctggct

SEQ ID NO: 4531492 - DNA, 13 bp, Homo sapiens
ccttccttttccc

SEQ ID NO: 4531493 - DNA, 15 bp, Homo sapiens
ccttccttttccctg

SEQ ID NO: 4531494 - DNA, 17 bp, Homo sapiens
ccttccttttccctgct

SEQ ID NO: 4531495 - DNA, 19 bp, Homo sapiens
ccttccttttccctgcttc

SEQ ID NO: 4531496 - DNA, 19 bp, Homo sapiens
ccttcgtccccagttgccg

SEQ ID NO: 4531497 - DNA, 14 bp, Homo sapiens
ccttcgtgcctgag

SEQ ID NO: 4531498 - DNA, 21 bp, Homo sapiens
ccttcgtggttatagccctgc

SEQ ID NO: 4531499 - DNA, 20 bp, Homo sapiens
ccttctaacatgttatcaaa

SEQ ID NO: 4531500 - DNA, 20 bp, Homo sapiens
ccttctaagacattctgttg

SEQ ID NO: 4531501 - DNA, 15 bp, Homo sapiens
ccttctacactctcc

SEQ ID NO: 4531502 - DNA, 19 bp, Homo sapiens
ccttctacactctcctggg

SEQ ID NO: 4531503 - DNA, 21 bp, Homo sapiens
ccttctacactctcctgggcc

SEQ ID NO: 4531504 - DNA, 21 bp, Homo sapiens
ccttctaccccaaggccagta

SEQ ID NO: 4531505 - DNA, 17 bp, Homo sapiens
ccttctacctgccactc

SEQ ID NO: 4531506 - DNA, 20 bp, Homo sapiens
ccttctacctgccactcaca

SEQ ID NO: 4531507 - DNA, 15 bp, Homo sapiens
ccttctactcccctt

SEQ ID NO: 4531508 - DNA, 20 bp, Homo sapiens
ccttctatacccacccagaa

SEQ ID NO: 4531509 - DNA, 15 bp, Homo sapiens
ccttctattctagcc

SEQ ID NO: 4531510 - DNA, 14 bp, Homo sapiens
ccttctcaccagct

SEQ ID NO: 4531511 - DNA, 19 bp, Homo sapiens
ccttctcaccagctgcaaa

SEQ ID NO: 4531512 - DNA, 15 bp, Homo sapiens
ccttctcagaagcac

SEQ ID NO: 4531513 - DNA, 14 bp, Homo sapiens
ccttctcatctccc

SEQ ID NO: 4531514 - DNA, 11 bp, Homo sapiens
ccttctccatc

SEQ ID NO: 4531515 - DNA, 13 bp, Homo sapiens
ccttctccatcca

SEQ ID NO: 4531516 - DNA, 22 bp, Homo sapiens
ccttctcgtgtttgcttaaaat

SEQ ID NO: 4531517 - DNA, 14 bp, Homo sapiens
ccttctctcatctc

SEQ ID NO: 4531518 - DNA, 21 bp, Homo sapiens
ccttctctcatctcttagctc

SEQ ID NO: 4531519 - DNA, 15 bp, Homo sapiens
ccttctctcctcccc

SEQ ID NO: 4531520 - DNA, 17 bp, Homo sapiens
ccttctctcctccccaa

SEQ ID NO: 4531521 - DNA, 13 bp, Homo sapiens
ccttctctgctcc

SEQ ID NO: 4531522 - DNA, 17 bp, Homo sapiens
ccttctctgctccacca

SEQ ID NO: 4531523 - DNA, 20 bp, Homo sapiens
ccttctctgctccaccacat

SEQ ID NO: 4531524 - DNA, 22 bp, Homo sapiens
ccttctctgctccaccacatcc

SEQ ID NO: 4531525 - DNA, 17 bp, Homo sapiens
ccttctcttcacagtca

SEQ ID NO: 4531526 - DNA, 13 bp, Homo sapiens
ccttctgaactcc

SEQ ID NO: 4531527 - DNA, 22 bp, Homo sapiens
ccttctgatcttggaaaaacag

SEQ ID NO: 4531528 - DNA, 15 bp, Homo sapiens
ccttctgatgaaatg

SEQ ID NO: 4531529 - DNA, 12 bp, Homo sapiens
ccttctgccacc

SEQ ID NO: 4531530 - DNA, 11 bp, Homo sapiens
ccttctgctgt

SEQ ID NO: 4531531 - DNA, 18 bp, Homo sapiens
ccttctggagctgggaga

SEQ ID NO: 4531532 - DNA, 10 bp, Homo sapiens
ccttctggcc

SEQ ID NO: 4531533 - DNA, 14 bp, Homo sapiens
ccttctgggtccag

SEQ ID NO: 4531534 - DNA, 20 bp, Homo sapiens
ccttctgtggggactccggc

SEQ ID NO: 4531535 - DNA, 20 bp, Homo sapiens
ccttcttattctcactccac

SEQ ID NO: 4531536 - DNA, 23 bp, Homo sapiens
ccttctttcactctgtcatcttt

SEQ ID NO: 4531537 - DNA, 13 bp, Homo sapiens
ccttctttctgga

SEQ ID NO: 4531538 - DNA, 16 bp, Homo sapiens
ccttctttctggactg

SEQ ID NO: 4531539 - DNA, 19 bp, Homo sapiens
ccttctttgggatagagaa

SEQ ID NO: 4531540 - DNA, 18 bp, Homo sapiens
ccttgaaatttacacagt

SEQ ID NO: 4531541 - DNA, 12 bp, Homo sapiens
ccttgaatgtgg

SEQ ID NO: 4531542 - DNA, 14 bp, Homo sapiens
ccttgaccattggc

SEQ ID NO: 4531543 - DNA, 19 bp, Homo sapiens
ccttgacctgcattgtaaa

SEQ ID NO: 4531544 - DNA, 13 bp, Homo sapiens
ccttgactttgct

SEQ ID NO: 4531545 - DNA, 20 bp, Homo sapiens
ccttgactttgctcctcaca

SEQ ID NO: 4531546 - DNA, 16 bp, Homo sapiens
ccttgagacctcagcc

SEQ ID NO: 4531547 - DNA, 15 bp, Homo sapiens
ccttgagccctggct

SEQ ID NO: 4531548 - DNA, 17 bp, Homo sapiens
ccttgagtttcatatat

SEQ ID NO: 4531549 - DNA, 20 bp, Homo sapiens
ccttgattttgccccctgag

SEQ ID NO: 4531550 - DNA, 21 bp, Homo sapiens
ccttgcaacctcaccttcctg

SEQ ID NO: 4531551 - DNA, 18 bp, Homo sapiens
ccttgcacactcagaagc

SEQ ID NO: 4531552 - DNA, 14 bp, Homo sapiens
ccttgcacatagta

SEQ ID NO: 4531553 - DNA, 13 bp, Homo sapiens
ccttgcacctgca

SEQ ID NO: 4531554 - DNA, 14 bp, Homo sapiens
ccttgcacctgcat

SEQ ID NO: 4531555 - DNA, 14 bp, Homo sapiens
ccttgcagggtggg

SEQ ID NO: 4531556 - DNA, 20 bp, Homo sapiens
ccttgcagttcagcaccacc

SEQ ID NO: 4531557 - DNA, 21 bp, Homo sapiens
ccttgcatccattgttgtgtc

SEQ ID NO: 4531558 - DNA, 19 bp, Homo sapiens
ccttgccaccccaccctcc

SEQ ID NO: 4531559 - DNA, 11 bp, Homo sapiens
ccttgcccaga

SEQ ID NO: 4531560 - DNA, 13 bp, Homo sapiens
ccttgcccagaga

SEQ ID NO: 4531561 - DNA, 21 bp, Homo sapiens
ccttgcccagagatgcctcca

SEQ ID NO: 4531562 - DNA, 16 bp, Homo sapiens
cctggcttctgtgggg

SEQ ID NO: 4531563 - DNA, 14 bp, Homo sapiens
cctggcttgaaaaa

SEQ ID NO: 4531564 - DNA, 17 bp, Homo sapiens
cctggcttgaaaaacag

SEQ ID NO: 4531565 - DNA, 22 bp, Homo sapiens
cctggcttgtaactccaccaac

SEQ ID NO: 4531566 - DNA, 13 bp, Homo sapiens
cctggctttgcct

SEQ ID NO: 4531567 - DNA, 14 bp, Homo sapiens
cctggctttgcctc

SEQ ID NO: 4531568 - DNA, 19 bp, Homo sapiens
cctggctttgcctcttctt

SEQ ID NO: 4531569 - DNA, 12 bp, Homo sapiens
cctgggacacag

SEQ ID NO: 4531570 - DNA, 15 bp, Homo sapiens
cctgggacacagacc

SEQ ID NO: 4531571 - DNA, 14 bp, Homo sapiens
cctgggagccagtc

SEQ ID NO: 4531572 - DNA, 23 bp, Homo sapiens
cctgggaggacaggcaggccaga

SEQ ID NO: 4531573 - DNA, 16 bp, Homo sapiens
cctgggatgggaccag

SEQ ID NO: 4531574 - DNA, 14 bp, Homo sapiens
cctgggccccacca

SEQ ID NO: 4531575 - DNA, 20 bp, Homo sapiens
cctgggcccctccctacctc

SEQ ID NO: 4531576 - DNA, 15 bp, Homo sapiens
cctgggccctctctg

SEQ ID NO: 4531577 - DNA, 15 bp, Homo sapiens
cctgggccctgggct

SEQ ID NO: 4531578 - DNA, 16 bp, Homo sapiens
cctgggccctgggctg

SEQ ID NO: 4531579 - DNA, 14 bp, Homo sapiens
cctgggcctgcccc

SEQ ID NO: 4531580 - DNA, 14 bp, Homo sapiens
cctgggctcaaatg

SEQ ID NO: 4531581 - DNA, 18 bp, Homo sapiens
cctgggctcactgtgctg

SEQ ID NO: 4531582 - DNA, 15 bp, Homo sapiens
cctgggctcggaggc

SEQ ID NO: 4531583 - DNA, 16 bp, Homo sapiens
cctgggctggcacagc

SEQ ID NO: 4531584 - DNA, 18 bp, Homo sapiens
cctgggctggcacagccc

SEQ ID NO: 4531585 - DNA, 22 bp, Homo sapiens
cctgggctggcacagcccctgg

SEQ ID NO: 4531586 - DNA, 17 bp, Homo sapiens
cctgggctgtctgtcac

SEQ ID NO: 4531587 - DNA, 17 bp, Homo sapiens
cctgggcttggcctgct

SEQ ID NO: 4531588 - DNA, 18 bp, Homo sapiens
cctgggcttggcctgctg

SEQ ID NO: 4531589 - DNA, 23 bp, Homo sapiens
cctggggacttcaactgcccagc

SEQ ID NO: 4531590 - DNA, 14 bp, Homo sapiens
cctggggagcccac

SEQ ID NO: 4531591 - DNA, 16 bp, Homo sapiens
cctggggagcccactg

SEQ ID NO: 4531592 - DNA, 18 bp, Homo sapiens
cctggggagcccactgag

SEQ ID NO: 4531593 - DNA, 14 bp, Homo sapiens
cctggggaggccct

SEQ ID NO: 4531594 - DNA, 16 bp, Homo sapiens
cctggggatcttccca

SEQ ID NO: 4531595 - DNA, 21 bp, Homo sapiens
cctggggatcttcccacagga

SEQ ID NO: 4531596 - DNA, 17 bp, Homo sapiens
cctggggcccagcccct

SEQ ID NO: 4531597 - DNA, 19 bp, Homo sapiens
cctgggggaagccctggat

SEQ ID NO: 4531598 - DNA, 14 bp, Homo sapiens
cctgggggtggcag

SEQ ID NO: 4531599 - DNA, 18 bp, Homo sapiens
cctgggggtggcaggcac

SEQ ID NO: 4531600 - DNA, 21 bp, Homo sapiens
cctggggtttgaagctgactt

SEQ ID NO: 4531601 - DNA, 16 bp, Homo sapiens
cctgggtcacagagtg

SEQ ID NO: 4531602 - DNA, 17 bp, Homo sapiens
cctgggtcacagagtga

SEQ ID NO: 4531603 - DNA, 18 bp, Homo sapiens
cctgggtcacagagtgag

SEQ ID NO: 4531604 - DNA, 20 bp, Homo sapiens
cctgggtcatgggcctgtgg

SEQ ID NO: 4531605 - DNA, 20 bp, Homo sapiens
cctgggtcctgttccctacc

SEQ ID NO: 4531606 - DNA, 18 bp, Homo sapiens
cctgggtctaaggggttg

SEQ ID NO: 4531607 - DNA, 16 bp, Homo sapiens
cctgggtgacttcagg

SEQ ID NO: 4531608 - DNA, 16 bp, Homo sapiens
cctgggtggaaatcct

SEQ ID NO: 4531609 - DNA, 17 bp, Homo sapiens
cctgggtgggctctgtg

SEQ ID NO: 4531610 - DNA, 16 bp, Homo sapiens
cctgggtggggctgct

SEQ ID NO: 4531611 - DNA, 20 bp, Homo sapiens
cctgggtggggctgctcctc

SEQ ID NO: 4531612 - DNA, 19 bp, Homo sapiens
cctgggtgtcaagtgcctg

SEQ ID NO: 4531613 - DNA, 13 bp, Homo sapiens
cctgggttccctt

SEQ ID NO: 4531614 - DNA, 19 bp, Homo sapiens
cctgggttttgtattctct

SEQ ID NO: 4531615 - DNA, 20 bp, Homo sapiens
cctgggttttgtattctctg

SEQ ID NO: 4531616 - DNA, 21 bp, Homo sapiens
cctgggttttgtattctctga

SEQ ID NO: 4531617 - DNA, 22 bp, Homo sapiens
cctgggttttgtattctctgag

SEQ ID NO: 4531618 - DNA, 23 bp, Homo sapiens
cctgggttttgtattctctgagc

SEQ ID NO: 4531619 - DNA, 17 bp, Homo sapiens
cctggtaagcagaggct

SEQ ID NO: 4531620 - DNA, 18 bp, Homo sapiens
cctggtaatagctgtaaa

SEQ ID NO: 4531621 - DNA, 18 bp, Homo sapiens
cctggtatatccaaaagc

SEQ ID NO: 4531622 - DNA, 19 bp, Homo sapiens
cctggtcaccgagactcag

SEQ ID NO: 4531623 - DNA, 18 bp, Homo sapiens
cctggtgcaggtctccac

SEQ ID NO: 4531624 - DNA, 22 bp, Homo sapiens
cctggtgcaggtctccacctgc

SEQ ID NO: 4531625 - DNA, 23 bp, Homo sapiens
cctggtgcaggtctccacctgca

SEQ ID NO: 4531626 - DNA, 20 bp, Homo sapiens
cctggtgctgccgagggctg

SEQ ID NO: 4531627 - DNA, 21 bp, Homo sapiens
cctggtgctgccgagggctgg

SEQ ID NO: 4531628 - DNA, 20 bp, Homo sapiens
cctggtgctgcctctacctg

SEQ ID NO: 4531629 - DNA, 20 bp, Homo sapiens
cctggtgctttccttcatct

SEQ ID NO: 4531630 - DNA, 13 bp, Homo sapiens
cctggtggcacca

SEQ ID NO: 4531631 - DNA, 23 bp, Homo sapiens
cctggtggcaccagatgcaacct

SEQ ID NO: 4531632 - DNA, 18 bp, Homo sapiens
cctggtgggtccaggggc

SEQ ID NO: 4531633 - DNA, 23 bp, Homo sapiens
cctggtgggtccaggggcccctc

SEQ ID NO: 4531634 - DNA, 17 bp, Homo sapiens
cctggttccctccccaa

SEQ ID NO: 4531635 - DNA, 13 bp, Homo sapiens
cctggttctcatc

SEQ ID NO: 4531636 - DNA, 15 bp, Homo sapiens
cctggttctcatctt

SEQ ID NO: 4531637 - DNA, 16 bp, Homo sapiens
cctggtttcctcgaga

SEQ ID NO: 4531638 - DNA, 16 bp, Homo sapiens
cctggttttatttata

SEQ ID NO: 4531639 - DNA, 20 bp, Homo sapiens
cctgtaaaactttattttat

SEQ ID NO: 4531640 - DNA, 13 bp, Homo sapiens
cctgtaaacctga

SEQ ID NO: 4531641 - DNA, 14 bp, Homo sapiens
cctgtaaattattt

SEQ ID NO: 4531642 - DNA, 18 bp, Homo sapiens
cctgtaaattattttaaa

SEQ ID NO: 4531643 - DNA, 15 bp, Homo sapiens
cctgtaagccaaaga

SEQ ID NO: 4531644 - DNA, 17 bp, Homo sapiens
cctgtaagccaaagaaa

SEQ ID NO: 4531645 - DNA, 14 bp, Homo sapiens
cctgtaatatattt

SEQ ID NO: 4531646 - DNA, 23 bp, Homo sapiens
cctgtaatatatttatatacttt

SEQ ID NO: 4531647 - DNA, 19 bp, Homo sapiens
cctgtaatcccagaacttt

SEQ ID NO: 4531648 - DNA, 14 bp, Homo sapiens
cctgtaatcccagc

SEQ ID NO: 4531649 - DNA, 16 bp, Homo sapiens
cctgtaatcccagcac

SEQ ID NO: 4531650 - DNA, 15 bp, Homo sapiens
cctgtaatcccagct

SEQ ID NO: 4531651 - DNA, 12 bp, Homo sapiens
cctgtacattct

SEQ ID NO: 4531652 - DNA, 14 bp, Homo sapiens
cctgtacctcagtg

SEQ ID NO: 4531653 - DNA, 14 bp, Homo sapiens
cctgtagagctaga

SEQ ID NO: 4531654 - DNA, 22 bp, Homo sapiens
cctgtagcaatggccagagcct

SEQ ID NO: 4531655 - DNA, 14 bp, Homo sapiens
cctgtagctctgcc

SEQ ID NO: 4531656 - DNA, 16 bp, Homo sapiens
cctgtagctttcctgg

SEQ ID NO: 4531657 - DNA, 13 bp, Homo sapiens
cctgtagtcccag

SEQ ID NO: 4531658 - DNA, 16 bp, Homo sapiens
cctgtagtctcagcta

SEQ ID NO: 4531659 - DNA, 16 bp, Homo sapiens
cctgtatacagtgcag

SEQ ID NO: 4531660 - DNA, 15 bp, Homo sapiens
cctgtatactcttga

SEQ ID NO: 4531661 - DNA, 14 bp, Homo sapiens
cctgtatttaagca

SEQ ID NO: 4531662 - DNA, 13 bp, Homo sapiens
cctgtcacaataa

SEQ ID NO: 4531663 - DNA, 20 bp, Homo sapiens
cctgtcacctagaacgtgca

SEQ ID NO: 4531664 - DNA, 14 bp, Homo sapiens
cctgtcacctcttc

SEQ ID NO: 4531665 - DNA, 16 bp, Homo sapiens
cctgtcacctcttccg

SEQ ID NO: 4531666 - DNA, 17 bp, Homo sapiens
cctgtcacctcttccga

SEQ ID NO: 4531667 - DNA, 14 bp, Homo sapiens
cctgtcagaataaa

SEQ ID NO: 4531668 - DNA, 13 bp, Homo sapiens
cctgtcagcctga

SEQ ID NO: 4531669 - DNA, 20 bp, Homo sapiens
cctgtcatttgaacctggat

SEQ ID NO: 4531670 - DNA, 18 bp, Homo sapiens
cctgtccacacccagctc

SEQ ID NO: 4531671 - DNA, 14 bp, Homo sapiens
cctgtccagcctgg

SEQ ID NO: 4531672 - DNA, 21 bp, Homo sapiens
cctgtcccaggccggcccaga

SEQ ID NO: 4531673 - DNA, 16 bp, Homo sapiens
cctgtcccattctaga

SEQ ID NO: 4531674 - DNA, 14 bp, Homo sapiens
cctgtccctctagt

SEQ ID NO: 4531675 - DNA, 14 bp, Homo sapiens
cctgtcccttgcct

SEQ ID NO: 4531676 - DNA, 15 bp, Homo sapiens
cctgtcccttgcctc

SEQ ID NO: 4531677 - DNA, 12 bp, Homo sapiens
cctgtccctttt

SEQ ID NO: 4531678 - DNA, 21 bp, Homo sapiens
cctgtccggcccagtgccact

SEQ ID NO: 4531679 - DNA, 17 bp, Homo sapiens
cctgtcctaaggaacct

SEQ ID NO: 4531680 - DNA, 12 bp, Homo sapiens
cctgtcctgcac

SEQ ID NO: 4531681 - DNA, 14 bp, Homo sapiens
cctgtcctgcacac

SEQ ID NO: 4531682 - DNA, 14 bp, Homo sapiens
cctgtccttccctg

SEQ ID NO: 4531683 - DNA, 17 bp, Homo sapiens
cctgctgctcctaggac

SEQ ID NO: 4531684 - DNA, 16 bp, Homo sapiens
cctgctgcttctccaa

SEQ ID NO: 4531685 - DNA, 18 bp, Homo sapiens
cctgctgctttgggctgg

SEQ ID NO: 4531686 - DNA, 19 bp, Homo sapiens
cctgctggcacccaccgtg

SEQ ID NO: 4531687 - DNA, 16 bp, Homo sapiens
cctgctggccgcctca

SEQ ID NO: 4531688 - DNA, 12 bp, Homo sapiens
cctgctggctct

SEQ ID NO: 4531689 - DNA, 13 bp, Homo sapiens
cctgctggctctt

SEQ ID NO: 4531690 - DNA, 11 bp, Homo sapiens
cctgctggctg

SEQ ID NO: 4531691 - DNA, 21 bp, Homo sapiens
cctgctggctgcggccccctc

SEQ ID NO: 4531692 - DNA, 22 bp, Homo sapiens
cctgctgggctctccacctcag

SEQ ID NO: 4531693 - DNA, 21 bp, Homo sapiens
cctgctggggaagaacagccc

SEQ ID NO: 4531694 - DNA, 20 bp, Homo sapiens
cctgctggtcacagcctcct

SEQ ID NO: 4531695 - DNA, 20 bp, Homo sapiens
cctgctgtgccatgctgggc

SEQ ID NO: 4531696 - DNA, 14 bp, Homo sapiens
cctgctgtgctgct

SEQ ID NO: 4531697 - DNA, 12 bp, Homo sapiens
cctgctgtggga

SEQ ID NO: 4531698 - DNA, 14 bp, Homo sapiens
cctgcttccaggaa

SEQ ID NO: 4531699 - DNA, 21 bp, Homo sapiens
cctgcttccaggaaactccac

SEQ ID NO: 4531700 - DNA, 22 bp, Homo sapiens
cctgcttccaggaaactccaca

SEQ ID NO: 4531701 - DNA, 17 bp, Homo sapiens
cctgcttggtctttcat

SEQ ID NO: 4531702 - DNA, 18 bp, Homo sapiens
cctgcttggtctttcatt

SEQ ID NO: 4531703 - DNA, 14 bp, Homo sapiens
cctgctttgcatct

SEQ ID NO: 4531704 - DNA, 18 bp, Homo sapiens
cctggaaaccttccaccc

SEQ ID NO: 4531705 - DNA, 22 bp, Homo sapiens
cctggaaatatcagttactcag

SEQ ID NO: 4531706 - DNA, 15 bp, Homo sapiens
cctggaactcctggc

SEQ ID NO: 4531707 - DNA, 17 bp, Homo sapiens
cctggaactcctggcct

SEQ ID NO: 4531708 - DNA, 20 bp, Homo sapiens
cctggaagatcatggacctg

SEQ ID NO: 4531709 - DNA, 15 bp, Homo sapiens
cctggaagccagctt

SEQ ID NO: 4531710 - DNA, 11 bp, Homo sapiens
cctggaagggc

SEQ ID NO: 4531711 - DNA, 12 bp, Homo sapiens
cctggaagggct

SEQ ID NO: 4531712 - DNA, 18 bp, Homo sapiens
cctggaatctacaagcca

SEQ ID NO: 4531713 - DNA, 11 bp, Homo sapiens
cctggacacat

SEQ ID NO: 4531714 - DNA, 16 bp, Homo sapiens
cctggacaggcgggct

SEQ ID NO: 4531715 - DNA, 20 bp, Homo sapiens
cctggacaggcgggctcgga

SEQ ID NO: 4531716 - DNA, 15 bp, Homo sapiens
cctggaccagcctct

SEQ ID NO: 4531717 - DNA, 16 bp, Homo sapiens
cctggaccagcctctc

SEQ ID NO: 4531718 - DNA, 14 bp, Homo sapiens
cctggaccaggccc

SEQ ID NO: 4531719 - DNA, 13 bp, Homo sapiens
cctggacctggga

SEQ ID NO: 4531720 - DNA, 19 bp, Homo sapiens
cctggaccttttgttttct

SEQ ID NO: 4531721 - DNA, 23 bp, Homo sapiens
cctggactgagccaaggaggcct

SEQ ID NO: 4531722 - DNA, 14 bp, Homo sapiens
cctggactgagggg

SEQ ID NO: 4531723 - DNA, 20 bp, Homo sapiens
cctggacttaagcatctggc

SEQ ID NO: 4531724 - DNA, 13 bp, Homo sapiens
cctggacttctgg

SEQ ID NO: 4531725 - DNA, 17 bp, Homo sapiens
cctggacttctgggaga

SEQ ID NO: 4531726 - DNA, 13 bp, Homo sapiens
cctggacttgcct

SEQ ID NO: 4531727 - DNA, 16 bp, Homo sapiens
cctggagacaaggtgc

SEQ ID NO: 4531728 - DNA, 18 bp, Homo sapiens
cctggagacaaggtgcta

SEQ ID NO: 4531729 - DNA, 21 bp, Homo sapiens
cctggagagccagaacctgga

SEQ ID NO: 4531730 - DNA, 14 bp, Homo sapiens
cctggagagctaga

SEQ ID NO: 4531731 - DNA, 16 bp, Homo sapiens
cctggagagtgcacat

SEQ ID NO: 4531732 - DNA, 22 bp, Homo sapiens
cctggagatgcagctactggaa

SEQ ID NO: 4531733 - DNA, 18 bp, Homo sapiens
cctggagcaggagccccg

SEQ ID NO: 4531734 - DNA, 13 bp, Homo sapiens
cctggagcccaga

SEQ ID NO: 4531735 - DNA, 22 bp, Homo sapiens
cctggagccccatcggccaaga

SEQ ID NO: 4531736 - DNA, 12 bp, Homo sapiens
cctggagcctca

SEQ ID NO: 4531737 - DNA, 18 bp, Homo sapiens
cctggaggattgcaggtg

SEQ ID NO: 4531738 - DNA, 19 bp, Homo sapiens
cctggaggctgcctcccaa

SEQ ID NO: 4531739 - DNA, 21 bp, Homo sapiens
cctggagggaatgaacctgga

SEQ ID NO: 4531740 - DNA, 19 bp, Homo sapiens
cctggagggcaagccctgc

SEQ ID NO: 4531741 - DNA, 21 bp, Homo sapiens
cctggagggcaagccctgccc

SEQ ID NO: 4531742 - DNA, 19 bp, Homo sapiens
cctggagggctagaaccta

SEQ ID NO: 4531743 - DNA, 21 bp, Homo sapiens
cctggagggctagaacctaga

SEQ ID NO: 4531744 - DNA, 22 bp, Homo sapiens
cctggagggctagaacctggag

SEQ ID NO: 4531745 - DNA, 21 bp, Homo sapiens
cctggaggggctagaacctag

SEQ ID NO: 4531746 - DNA, 22 bp, Homo sapiens
cctggaggggctagaacctaga

SEQ ID NO: 4531747 - DNA, 19 bp, Homo sapiens
cctggagtgtggctgagga

SEQ ID NO: 4531748 - DNA, 18 bp, Homo sapiens
cctggatccagcactggt

SEQ ID NO: 4531749 - DNA, 16 bp, Homo sapiens
cctggatctaccagca

SEQ ID NO: 4531750 - DNA, 14 bp, Homo sapiens
cctggatggtggcc

SEQ ID NO: 4531751 - DNA, 18 bp, Homo sapiens
cctggattaccagggact

SEQ ID NO: 4531752 - DNA, 18 bp, Homo sapiens
cctggattggttggcaaa

SEQ ID NO: 4531753 - DNA, 20 bp, Homo sapiens
cctggattttttatgtacaa

SEQ ID NO: 4531754 - DNA, 19 bp, Homo sapiens
cctggcacattgcccctct

SEQ ID NO: 4531755 - DNA, 22 bp, Homo sapiens
cctggcactggcaaacagggcc

SEQ ID NO: 4531756 - DNA, 18 bp, Homo sapiens
cctggcactgggaggcag

SEQ ID NO: 4531757 - DNA, 22 bp, Homo sapiens
cctggcactgggaggcagggct

SEQ ID NO: 4531758 - DNA, 14 bp, Homo sapiens
cctggcagacacaa

SEQ ID NO: 4531759 - DNA, 13 bp, Homo sapiens
cctggcagctgct

SEQ ID NO: 4531760 - DNA, 16 bp, Homo sapiens
cctggcagctgctgtg

SEQ ID NO: 4531761 - DNA, 21 bp, Homo sapiens
cctggcaggctgtctggccag

SEQ ID NO: 4531762 - DNA, 14 bp, Homo sapiens
cctggccaccagcc

SEQ ID NO: 4531763 - DNA, 16 bp, Homo sapiens
cctggccaccagccat

SEQ ID NO: 4531764 - DNA, 14 bp, Homo sapiens
cctggccaggagct

SEQ ID NO: 4531765 - DNA, 22 bp, Homo sapiens
cctggccaggcagatctgtgcc

SEQ ID NO: 4531766 - DNA, 11 bp, Homo sapiens
cctggcccagg

SEQ ID NO: 4531767 - DNA, 13 bp, Homo sapiens
cctggcccagggc

SEQ ID NO: 4531768 - DNA, 14 bp, Homo sapiens
cctggcccaggtgc

SEQ ID NO: 4531769 - DNA, 18 bp, Homo sapiens
cctggccccaggccccag

SEQ ID NO: 4531770 - DNA, 22 bp, Homo sapiens
cctggccccaggccccagacag

SEQ ID NO: 4531771 - DNA, 14 bp, Homo sapiens
cctggccccatgtc

SEQ ID NO: 4531772 - DNA, 18 bp, Homo sapiens
cctggccccatgtctctc

SEQ ID NO: 4531773 - DNA, 20 bp, Homo sapiens
cctggccccatgtctctcag

SEQ ID NO: 4531774 - DNA, 19 bp, Homo sapiens
cctggcccccaacctcagg

SEQ ID NO: 4531775 - DNA, 22 bp, Homo sapiens
cctggcccccaacctcagggct

SEQ ID NO: 4531776 - DNA, 22 bp, Homo sapiens
cctggcctcatctcagaccctg

SEQ ID NO: 4531777 - DNA, 13 bp, Homo sapiens
cctggcctcccgc

SEQ ID NO: 4531778 - DNA, 14 bp, Homo sapiens
cctggcctcccgcc

SEQ ID NO: 4531779 - DNA, 17 bp, Homo sapiens
cctggcctgaactgagg

SEQ ID NO: 4531780 - DNA, 21 bp, Homo sapiens
cctggcctgaactgaggagat

SEQ ID NO: 4531781 - DNA, 13 bp, Homo sapiens
cctggcctgccag

SEQ ID NO: 4531782 - DNA, 19 bp, Homo sapiens
cctggcctggccatctccc

SEQ ID NO: 4531783 - DNA, 19 bp, Homo sapiens
cctggctccactcttgatc

SEQ ID NO: 4531784 - DNA, 16 bp, Homo sapiens
cctggctccagtctca

SEQ ID NO: 4531785 - DNA, 14 bp, Homo sapiens
cctggctccagtga

SEQ ID NO: 4531786 - DNA, 22 bp, Homo sapiens
cctggctcccatgaccatactg

SEQ ID NO: 4531787 - DNA, 20 bp, Homo sapiens
cctggctccctcctccaggc

SEQ ID NO: 4531788 - DNA, 17 bp, Homo sapiens
cctggctccctgatggg

SEQ ID NO: 4531789 - DNA, 14 bp, Homo sapiens
cctggctctgcccc

SEQ ID NO: 4531790 - DNA, 20 bp, Homo sapiens
cctggctgaggttcctctgc

SEQ ID NO: 4531791 - DNA, 22 bp, Homo sapiens
cctggctgaggttcctctgcct

SEQ ID NO: 4531792 - DNA, 24 bp, Homo sapiens
cctggctgaggttcctctgcctgc

SEQ ID NO: 4531793 - DNA, 18 bp, Homo sapiens
cctggctgctgcccccac

SEQ ID NO: 4531794 - DNA, 21 bp, Homo sapiens
cctggctgctgcccccacccc

SEQ ID NO: 4531795 - DNA, 18 bp, Homo sapiens
cctggctggaggagcagc

SEQ ID NO: 4531796 - DNA, 21 bp, Homo sapiens
cctggctggaggagcagcagc

SEQ ID NO: 4531797 - DNA, 22 bp, Homo sapiens
cctggctggaggagcagcagct

SEQ ID NO: 4531798 - DNA, 16 bp, Homo sapiens
cctggctggctcctag

SEQ ID NO: 4531799 - DNA, 22 bp, Homo sapiens
cctggctgtcctaccatcagct

SEQ ID NO: 4531800 - DNA, 23 bp, Homo sapiens
cctggctgtcctaccatcagctc

SEQ ID NO: 4531801 - DNA, 23 bp, Homo sapiens
cctggctgtttggactttgtata

SEQ ID NO: 4531802 - DNA, 14 bp, Homo sapiens
cctggcttctgtgg

SEQ ID NO: 4531803 - DNA, 15 bp, Homo sapiens
cctgtcgcccctcct

SEQ ID NO: 4531804 - DNA, 17 bp, Homo sapiens
cctgtctaggtctcctc

SEQ ID NO: 4531805 - DNA, 22 bp, Homo sapiens
cctgtctaggtctcctcagggt

SEQ ID NO: 4531806 - DNA, 18 bp, Homo sapiens
cctgtctagtctctcctg

SEQ ID NO: 4531807 - DNA, 22 bp, Homo sapiens
cctgtctagtctctcctgtaag

SEQ ID NO: 4531808 - DNA, 23 bp, Homo sapiens
cctgtctagtctctcctgtaagc

SEQ ID NO: 4531809 - DNA, 19 bp, Homo sapiens
cctgtctatactacagtag

SEQ ID NO: 4531810 - DNA, 18 bp, Homo sapiens
cctgtctcaaagcataaa

SEQ ID NO: 4531811 - DNA, 15 bp, Homo sapiens
cctgtctcacctgga

SEQ ID NO: 4531812 - DNA, 13 bp, Homo sapiens
cctgtctcactct

SEQ ID NO: 4531813 - DNA, 23 bp, Homo sapiens
cctgtctctaaaaagaagccaca

SEQ ID NO: 4531814 - DNA, 13 bp, Homo sapiens
cctgtctctgccc

SEQ ID NO: 4531815 - DNA, 16 bp, Homo sapiens
cctgtctctgcctgcg

SEQ ID NO: 4531816 - DNA, 23 bp, Homo sapiens
cctgtctgcttgcatctgcacat

SEQ ID NO: 4531817 - DNA, 21 bp, Homo sapiens
cctgtctggctcggacccacc

SEQ ID NO: 4531818 - DNA, 23 bp, Homo sapiens
cctgtctgtagagggccctggtg

SEQ ID NO: 4531819 - DNA, 23 bp, Homo sapiens
cctgtctgttcccagcccctgca

SEQ ID NO: 4531820 - DNA, 19 bp, Homo sapiens
cctgtcttcagagaaccca

SEQ ID NO: 4531821 - DNA, 16 bp, Homo sapiens
cctgtcttcccagggt

SEQ ID NO: 4531822 - DNA, 19 bp, Homo sapiens
cctgtgaagagatccttcc

SEQ ID NO: 4531823 - DNA, 23 bp, Homo sapiens
cctgtgagatgtgtatcagtgtt

SEQ ID NO: 4531824 - DNA, 19 bp, Homo sapiens
cctgtgagcatggggccag

SEQ ID NO: 4531825 - DNA, 21 bp, Homo sapiens
cctgtgagcatggggccagga

SEQ ID NO: 4531826 - DNA, 16 bp, Homo sapiens
cctgtgatatgtctgc

SEQ ID NO: 4531827 - DNA, 20 bp, Homo sapiens
cctgtgcccgactgactgga

SEQ ID NO: 4531828 - DNA, 21 bp, Homo sapiens
cctgtgcccgcatgtgtgcct

SEQ ID NO: 4531829 - DNA, 17 bp, Homo sapiens
cctgtgcctggccccag

SEQ ID NO: 4531830 - DNA, 19 bp, Homo sapiens
cctgtggaacataaaaagg

SEQ ID NO: 4531831 - DNA, 14 bp, Homo sapiens
cctgtggacaggat

SEQ ID NO: 4531832 - DNA, 22 bp, Homo sapiens
cctgtggacaggatgaggacag

SEQ ID NO: 4531833 - DNA, 17 bp, Homo sapiens
cctgtggaggggcttgg

SEQ ID NO: 4531834 - DNA, 12 bp, Homo sapiens
cctgtggatatt

SEQ ID NO: 4531835 - DNA, 21 bp, Homo sapiens
cctgtggatgatcaatccttt

SEQ ID NO: 4531836 - DNA, 21 bp, Homo sapiens
cctgtggcagtaaagagaaac

SEQ ID NO: 4531837 - DNA, 22 bp, Homo sapiens
cctgtggcagtaaagagaaact

SEQ ID NO: 4531838 - DNA, 20 bp, Homo sapiens
cctgtggccaagttcttagt

SEQ ID NO: 4531839 - DNA, 19 bp, Homo sapiens
cctgtggcccctcccctgc

SEQ ID NO: 4531840 - DNA, 19 bp, Homo sapiens
cctgtggcggtgcctgggt

SEQ ID NO: 4531841 - DNA, 22 bp, Homo sapiens
cctgtggggcctggggagccca

SEQ ID NO: 4531842 - DNA, 17 bp, Homo sapiens
cctgtgggggtggccat

SEQ ID NO: 4531843 - DNA, 21 bp, Homo sapiens
cctgtgggggtggccatccct

SEQ ID NO: 4531844 - DNA, 16 bp, Homo sapiens
cctgtgggtctctgaa

SEQ ID NO: 4531845 - DNA, 19 bp, Homo sapiens
cctgtgggtctctgaaggg

SEQ ID NO: 4531846 - DNA, 22 bp, Homo sapiens
cctgtgggtgttctttcctgcc

SEQ ID NO: 4531847 - DNA, 23 bp, Homo sapiens
cctgtgggtgttctttcctgccc

SEQ ID NO: 4531848 - DNA, 18 bp, Homo sapiens
cctgtggtgaagtgtggc

SEQ ID NO: 4531849 - DNA, 19 bp, Homo sapiens
cctgtgtaacatctgccat

SEQ ID NO: 4531850 - DNA, 21 bp, Homo sapiens
cctgtgtataaaaaagaaaac

SEQ ID NO: 4531851 - DNA, 17 bp, Homo sapiens
cctgtgtatacagccct

SEQ ID NO: 4531852 - DNA, 21 bp, Homo sapiens
cctgtgtggaagaaggaaaca

SEQ ID NO: 4531853 - DNA, 13 bp, Homo sapiens
cctgtgttctggg

SEQ ID NO: 4531854 - DNA, 16 bp, Homo sapiens
cctgtgttctgggctg

SEQ ID NO: 4531855 - DNA, 23 bp, Homo sapiens
cctgtgtttttttctaaaaaggc

SEQ ID NO: 4531856 - DNA, 18 bp, Homo sapiens
cctgttacctactttgac

SEQ ID NO: 4531857 - DNA, 12 bp, Homo sapiens
cctgttatttct

SEQ ID NO: 4531858 - DNA, 13 bp, Homo sapiens
cctgttatttcta

SEQ ID NO: 4531859 - DNA, 13 bp, Homo sapiens
cctgttccctacc

SEQ ID NO: 4531860 - DNA, 14 bp, Homo sapiens
cctgttcctggagg

SEQ ID NO: 4531861 - DNA, 18 bp, Homo sapiens
cctgttcggttccagaca

SEQ ID NO: 4531862 - DNA, 14 bp, Homo sapiens
cctgttgcacccag

SEQ ID NO: 4531863 - DNA, 18 bp, Homo sapiens
cctgttgcacccagccct

SEQ ID NO: 4531864 - DNA, 19 bp, Homo sapiens
cctgttgcacccagccctg

SEQ ID NO: 4531865 - DNA, 20 bp, Homo sapiens
cctgttgcacccagccctgg

SEQ ID NO: 4531866 - DNA, 17 bp, Homo sapiens
cctgtttctggaagact

SEQ ID NO: 4531867 - DNA, 13 bp, Homo sapiens
cctgtttgaaata

SEQ ID NO: 4531868 - DNA, 15 bp, Homo sapiens
cctgtttgaaatatc

SEQ ID NO: 4531869 - DNA, 23 bp, Homo sapiens
cctgttttatatattatgtgaag

SEQ ID NO: 4531870 - DNA, 16 bp, Homo sapiens
cctgtttttcacattt

SEQ ID NO: 4531871 - DNA, 20 bp, Homo sapiens
cctgtttttcacattttcct

SEQ ID NO: 4531872 - DNA, 13 bp, Homo sapiens
cctgttttttgta

SEQ ID NO: 4531873 - DNA, 17 bp, Homo sapiens
ccttaaacacaggctgt

SEQ ID NO: 4531874 - DNA, 21 bp, Homo sapiens
ccttaaattaaacaatttatt

SEQ ID NO: 4531875 - DNA, 17 bp, Homo sapiens
ccttaacagttgtattt

SEQ ID NO: 4531876 - DNA, 20 bp, Homo sapiens
ccttaacccacctctcctgc

SEQ ID NO: 4531877 - DNA, 17 bp, Homo sapiens
ccttaaggcagtagttc

SEQ ID NO: 4531878 - DNA, 13 bp, Homo sapiens
ccttaaggctctt

SEQ ID NO: 4531879 - DNA, 12 bp, Homo sapiens
ccttaatatttc

SEQ ID NO: 4531880 - DNA, 14 bp, Homo sapiens
ccttaatctaatct

SEQ ID NO: 4531881 - DNA, 13 bp, Homo sapiens
ccttaattactta

SEQ ID NO: 4531882 - DNA, 12 bp, Homo sapiens
ccttaatttaat

SEQ ID NO: 4531883 - DNA, 16 bp, Homo sapiens
ccttaatttaattgct

SEQ ID NO: 4531884 - DNA, 22 bp, Homo sapiens
ccttaatttaattgctttgaag

SEQ ID NO: 4531885 - DNA, 20 bp, Homo sapiens
ccttacaacgccgagtgcac

SEQ ID NO: 4531886 - DNA, 21 bp, Homo sapiens
ccttacagtaggagcccagct

SEQ ID NO: 4531887 - DNA, 13 bp, Homo sapiens
ccttacctcctgc

SEQ ID NO: 4531888 - DNA, 18 bp, Homo sapiens
ccttacctcctgcccagg

SEQ ID NO: 4531889 - DNA, 12 bp, Homo sapiens
ccttactcacct

SEQ ID NO: 4531890 - DNA, 14 bp, Homo sapiens
ccttactcacctct

SEQ ID NO: 4531891 - DNA, 16 bp, Homo sapiens
ccttactcacctctct

SEQ ID NO: 4531892 - DNA, 16 bp, Homo sapiens
ccttagagccaggcac

SEQ ID NO: 4531893 - DNA, 15 bp, Homo sapiens
ccttagcaccttcag

SEQ ID NO: 4531894 - DNA, 22 bp, Homo sapiens
ccttagcaccttcagggctgag

SEQ ID NO: 4531895 - DNA, 20 bp, Homo sapiens
ccttagccctgtctgctagg

SEQ ID NO: 4531896 - DNA, 14 bp, Homo sapiens
ccttagcctccctg

SEQ ID NO: 4531897 - DNA, 16 bp, Homo sapiens
ccttagcctctcccac

SEQ ID NO: 4531898 - DNA, 17 bp, Homo sapiens
ccttagcctctcccacc

SEQ ID NO: 4531899 - DNA, 23 bp, Homo sapiens
ccttagcgttctggactctgccc

SEQ ID NO: 4531900 - DNA, 12 bp, Homo sapiens
ccttagcttcag

SEQ ID NO: 4531901 - DNA, 14 bp, Homo sapiens
ccttagcttcagga

SEQ ID NO: 4531902 - DNA, 17 bp, Homo sapiens
ccttagcttcaggaacc

SEQ ID NO: 4531903 - DNA, 22 bp, Homo sapiens
ccttaggctttgtatgacagtg

SEQ ID NO: 4531904 - DNA, 20 bp, Homo sapiens
ccttagggaagctggcctga

SEQ ID NO: 4531905 - DNA, 20 bp, Homo sapiens
ccttatatatgcacttaatt

SEQ ID NO: 4531906 - DNA, 14 bp, Homo sapiens
ccttatccctctct

SEQ ID NO: 4531907 - DNA, 16 bp, Homo sapiens
ccttatccctctcttc

SEQ ID NO: 4531908 - DNA, 22 bp, Homo sapiens
ccttattcccccaaactttttg

SEQ ID NO: 4531909 - DNA, 18 bp, Homo sapiens
ccttattgctgtcctgga

SEQ ID NO: 4531910 - DNA, 18 bp, Homo sapiens
ccttatttacctagtgca

SEQ ID NO: 4531911 - DNA, 10 bp, Homo sapiens
ccttatttat

SEQ ID NO: 4531912 - DNA, 19 bp, Homo sapiens
ccttatttatttttgtgta

SEQ ID NO: 4531913 - DNA, 21 bp, Homo sapiens
ccttatttcctcatagactta

SEQ ID NO: 4531914 - DNA, 12 bp, Homo sapiens
ccttatttctca

SEQ ID NO: 4531915 - DNA, 15 bp, Homo sapiens
ccttatttgccttct

SEQ ID NO: 4531916 - DNA, 20 bp, Homo sapiens
ccttatttgtctgtaaaaaa

SEQ ID NO: 4531917 - DNA, 13 bp, Homo sapiens
ccttcaaacctaa

SEQ ID NO: 4531918 - DNA, 23 bp, Homo sapiens
ccttcaaggactgtttcagtgtg

SEQ ID NO: 4531919 - DNA, 19 bp, Homo sapiens
ccttcagaatgctcctgag

SEQ ID NO: 4531920 - DNA, 21 bp, Homo sapiens
ccttcagactttgcttcccat

SEQ ID NO: 4531921 - DNA, 15 bp, Homo sapiens
ccttcagccctcacc

SEQ ID NO: 4531922 - DNA, 18 bp, Homo sapiens
ccttcagccctcacccct

SEQ ID NO: 4531923 - DNA, 16 bp, Homo sapiens
cctcagattcttcatt

SEQ ID NO: 4531924 - DNA, 14 bp, Homo sapiens
cctcagcaagctgc

SEQ ID NO: 4531925 - DNA, 19 bp, Homo sapiens
cctcagcaagctgcccagc

SEQ ID NO: 4531926 - DNA, 23 bp, Homo sapiens
cctcagcaagctgcccagccctg

SEQ ID NO: 4531927 - DNA, 18 bp, Homo sapiens
cctcagccacttgcctgt

SEQ ID NO: 4531928 - DNA, 14 bp, Homo sapiens
cctcagccagcctc

SEQ ID NO: 4531929 - DNA, 14 bp, Homo sapiens
cctcagccaggccc

SEQ ID NO: 4531930 - DNA, 17 bp, Homo sapiens
cctcagccccagcccag

SEQ ID NO: 4531931 - DNA, 18 bp, Homo sapiens
cctcagccccgcgtggaa

SEQ ID NO: 4531932 - DNA, 16 bp, Homo sapiens
cctcagccctcagaac

SEQ ID NO: 4531933 - DNA, 18 bp, Homo sapiens
cctcagccctgctccctg

SEQ ID NO: 4531934 - DNA, 19 bp, Homo sapiens
cctcagccctgctccctgc

SEQ ID NO: 4531935 - DNA, 20 bp, Homo sapiens
cctcagccctgctccctgcc

SEQ ID NO: 4531936 - DNA, 23 bp, Homo sapiens
cctcagcctgctttcctgcagca

SEQ ID NO: 4531937 - DNA, 12 bp, Homo sapiens
cctcagccttaa

SEQ ID NO: 4531938 - DNA, 13 bp, Homo sapiens
cctcagccttcca

SEQ ID NO: 4531939 - DNA, 23 bp, Homo sapiens
cctcagccttggataatgctgtt

SEQ ID NO: 4531940 - DNA, 17 bp, Homo sapiens
cctcagcgtcctgggct

SEQ ID NO: 4531941 - DNA, 16 bp, Homo sapiens
cctcagctctaggctg

SEQ ID NO: 4531942 - DNA, 16 bp, Homo sapiens
cctcagctctctggga

SEQ ID NO: 4531943 - DNA, 17 bp, Homo sapiens
cctcagctgcctcactt

SEQ ID NO: 4531944 - DNA, 19 bp, Homo sapiens
cctcagctgcctcacttcc

SEQ ID NO: 4531945 - DNA, 13 bp, Homo sapiens
cctcaggactgca

SEQ ID NO: 4531946 - DNA, 18 bp, Homo sapiens
cctcaggactgcaacagg

SEQ ID NO: 4531947 - DNA, 17 bp, Homo sapiens
cctcaggcacacagcta

SEQ ID NO: 4531948 - DNA, 18 bp, Homo sapiens
cctcaggcacccgtcccc

SEQ ID NO: 4531949 - DNA, 23 bp, Homo sapiens
cctcaggcagcgtgtgggtcccg

SEQ ID NO: 4531950 - DNA, 19 bp, Homo sapiens
cctcaggcaggaagggcag

SEQ ID NO: 4531951 - DNA, 18 bp, Homo sapiens
cctcaggccaagggacca

SEQ ID NO: 4531952 - DNA, 13 bp, Homo sapiens
cctcaggcccagc

SEQ ID NO: 4531953 - DNA, 21 bp, Homo sapiens
cctcaggctccgggcaccagg

SEQ ID NO: 4531954 - DNA, 13 bp, Homo sapiens
cctcaggctccta

SEQ ID NO: 4531955 - DNA, 18 bp, Homo sapiens
cctcaggctcctaaagag

SEQ ID NO: 4531956 - DNA, 21 bp, Homo sapiens
cctcaggctcctaaagagaca

SEQ ID NO: 4531957 - DNA, 11 bp, Homo sapiens
cctcagggaca

SEQ ID NO: 4531958 - DNA, 21 bp, Homo sapiens
cctcagggacagagacacctg

SEQ ID NO: 4531959 - DNA, 20 bp, Homo sapiens
cctcagggagcagggaaggc

SEQ ID NO: 4531960 - DNA, 22 bp, Homo sapiens
cctcagggagcagggaaggcct

SEQ ID NO: 4531961 - DNA, 17 bp, Homo sapiens
cctcagggctcccaggg

SEQ ID NO: 4531962 - DNA, 18 bp, Homo sapiens
cctcagggctcccagggg

SEQ ID NO: 4531963 - DNA, 17 bp, Homo sapiens
cctcagggctgtcccag

SEQ ID NO: 4531964 - DNA, 14 bp, Homo sapiens
cctcagggtggggg

SEQ ID NO: 4531965 - DNA, 15 bp, Homo sapiens
cctcaggtgccaacc

SEQ ID NO: 4531966 - DNA, 13 bp, Homo sapiens
cctcagtgctcct

SEQ ID NO: 4531967 - DNA, 20 bp, Homo sapiens
cctcagtggcttctccaggg

SEQ ID NO: 4531968 - DNA, 16 bp, Homo sapiens
cctcagttcaacctgg

SEQ ID NO: 4531969 - DNA, 15 bp, Homo sapiens
cctcagttcccttgg

SEQ ID NO: 4531970 - DNA, 14 bp, Homo sapiens
cctcagttccttca

SEQ ID NO: 4531971 - DNA, 17 bp, Homo sapiens
cctcatactcctgggct

SEQ ID NO: 4531972 - DNA, 20 bp, Homo sapiens
cctcatcccgagcacctcca

SEQ ID NO: 4531973 - DNA, 12 bp, Homo sapiens
cctcatctcaga

SEQ ID NO: 4531974 - DNA, 13 bp, Homo sapiens
cctcatctcagac

SEQ ID NO: 4531975 - DNA, 23 bp, Homo sapiens
cctcatctccaaggcagggacca

SEQ ID NO: 4531976 - DNA, 12 bp, Homo sapiens
cctcatctgcag

SEQ ID NO: 4531977 - DNA, 17 bp, Homo sapiens
cctcatctgtccctccg

SEQ ID NO: 4531978 - DNA, 19 bp, Homo sapiens
cctcatgccaaccctgggc

SEQ ID NO: 4531979 - DNA, 21 bp, Homo sapiens
cctcatgccaaccctgggcta

SEQ ID NO: 4531980 - DNA, 14 bp, Homo sapiens
cctcatgcccaccc

SEQ ID NO: 4531981 - DNA, 21 bp, Homo sapiens
cctcatgcccaccccctgccc

SEQ ID NO: 4531982 - DNA, 15 bp, Homo sapiens
cctcatgggtcctag

SEQ ID NO: 4531983 - DNA, 19 bp, Homo sapiens
cctcatggtgggttcaggg

SEQ ID NO: 4531984 - DNA, 20 bp, Homo sapiens
cctcatgtccactggttctt

SEQ ID NO: 4531985 - DNA, 18 bp, Homo sapiens
cctcattaatagctgcct

SEQ ID NO: 4531986 - DNA, 22 bp, Homo sapiens
cctcattcaggaaaactgacag

SEQ ID NO: 4531987 - DNA, 10 bp, Homo sapiens
cctccaaaga

SEQ ID NO: 4531988 - DNA, 16 bp, Homo sapiens
cctccaaaggccccct

SEQ ID NO: 4531989 - DNA, 14 bp, Homo sapiens
cctccaagcatttc

SEQ ID NO: 4531990 - DNA, 16 bp, Homo sapiens
cctccaagcctgcctc

SEQ ID NO: 4531991 - DNA, 21 bp, Homo sapiens
cctccaaggaggggctgtaaa

SEQ ID NO: 4531992 - DNA, 21 bp, Homo sapiens
cctccaataaagtgccttctg

SEQ ID NO: 4531993 - DNA, 22 bp, Homo sapiens
cctccaataaagtgccttctgg

SEQ ID NO: 4531994 - DNA, 20 bp, Homo sapiens
cctccacactgaccaagtgc

SEQ ID NO: 4531995 - DNA, 15 bp, Homo sapiens
cctccacatcctcca

SEQ ID NO: 4531996 - DNA, 22 bp, Homo sapiens
cctccaccctctgagctttgca

SEQ ID NO: 4531997 - DNA, 12 bp, Homo sapiens
cctccacctcaa

SEQ ID NO: 4531998 - DNA, 19 bp, Homo sapiens
cctccacctcaagaccccc

SEQ ID NO: 4531999 - DNA, 19 bp, Homo sapiens
cctccacgcctcctggcca

SEQ ID NO: 4532000 - DNA, 18 bp, Homo sapiens
cctccacgttctgctcat

SEQ ID NO: 4532001 - DNA, 15 bp, Homo sapiens
cctccactcgaccca

SEQ ID NO: 4532002 - DNA, 22 bp, Homo sapiens
cctccactggggaatgctccca

SEQ ID NO: 4532003 - DNA, 17 bp, Homo sapiens
cctccagaagcctctgg

SEQ ID NO: 4532004 - DNA, 20 bp, Homo sapiens
cctccagagacactgagcca

SEQ ID NO: 4532005 - DNA, 13 bp, Homo sapiens
cctccagagcccc

SEQ ID NO: 4532006 - DNA, 15 bp, Homo sapiens
cctccagagccccac

SEQ ID NO: 4532007 - DNA, 20 bp, Homo sapiens
cctccagagccccacagccc

SEQ ID NO: 4532008 - DNA, 16 bp, Homo sapiens
cctccagcctcccctc

SEQ ID NO: 4532009 - DNA, 14 bp, Homo sapiens
cctccagcctctgt

SEQ ID NO: 4532010 - DNA, 12 bp, Homo sapiens
cctccagctgcg

SEQ ID NO: 4532011 - DNA, 19 bp, Homo sapiens
cctccagctgcgactttta

SEQ ID NO: 4532012 - DNA, 19 bp, Homo sapiens
cctccagggaaggtggcca

SEQ ID NO: 4532013 - DNA, 14 bp, Homo sapiens
cctccagggccacg

SEQ ID NO: 4532014 - DNA, 16 bp, Homo sapiens
cctccagggccacgtg

SEQ ID NO: 4532015 - DNA, 22 bp, Homo sapiens
cctccagggccacgtgccaggc

SEQ ID NO: 4532016 - DNA, 20 bp, Homo sapiens
cctccagtacgtcccgctgc

SEQ ID NO: 4532017 - DNA, 21 bp, Homo sapiens
cctccagtacgtcccgctgct

SEQ ID NO: 4532018 - DNA, 23 bp, Homo sapiens
cctccagtacgtcccgctgctgt

SEQ ID NO: 4532019 - DNA, 22 bp, Homo sapiens
cctccagtattgccccctctca

SEQ ID NO: 4532020 - DNA, 16 bp, Homo sapiens
cctccagtcatggtac

SEQ ID NO: 4532021 - DNA, 19 bp, Homo sapiens
cctccagtgggctgatgct

SEQ ID NO: 4532022 - DNA, 20 bp, Homo sapiens
cctccagtgggctgatgctg

SEQ ID NO: 4532023 - DNA, 15 bp, Homo sapiens
cctccatagcgacac

SEQ ID NO: 4532024 - DNA, 23 bp, Homo sapiens
cctccatcctaccccctgtgcct

SEQ ID NO: 4532025 - DNA, 14 bp, Homo sapiens
cctccatgctcctc

SEQ ID NO: 4532026 - DNA, 20 bp, Homo sapiens
cctccatgctcctcacctgt

SEQ ID NO: 4532027 - DNA, 20 bp, Homo sapiens
cctccattgggcacagtcca

SEQ ID NO: 4532028 - DNA, 22 bp, Homo sapiens
cctccattgggcacagtccaga

SEQ ID NO: 4532029 - DNA, 15 bp, Homo sapiens
cctcccaacagagct

SEQ ID NO: 4532030 - DNA, 15 bp, Homo sapiens
cctcccaaggagaac

SEQ ID NO: 4532031 - DNA, 23 bp, Homo sapiens
cctcccaaggagaacaaatattc

SEQ ID NO: 4532032 - DNA, 17 bp, Homo sapiens
cctcccaagtggtgcct

SEQ ID NO: 4532033 - DNA, 23 bp, Homo sapiens
cctcccacaattaaaccgcatgt

SEQ ID NO: 4532034 - DNA, 11 bp, Homo sapiens
cctcccaccag

SEQ ID NO: 4532035 - DNA, 13 bp, Homo sapiens
cctcccaccccca

SEQ ID NO: 4532036 - DNA, 13 bp, Homo sapiens
cctcccaccccct

SEQ ID NO: 4532037 - DNA, 13 bp, Homo sapiens
cctcccagacagg

SEQ ID NO: 4532038 - DNA, 19 bp, Homo sapiens
cctcccagacaggccctcc

SEQ ID NO: 4532039 - DNA, 20 bp, Homo sapiens
cctcccagacaggccctccc

SEQ ID NO: 4532040 - DNA, 22 bp, Homo sapiens
cctcccagacaggccctccctg

SEQ ID NO: 4532041 - DNA, 17 bp, Homo sapiens
cctcccaggaagcccag

SEQ ID NO: 4532042 - DNA, 20 bp, Homo sapiens
cctcccaggaagcccaggag

SEQ ID NO: 4532043 - DNA, 18 bp, Homo sapiens
cagtgccattgtctttat

SEQ ID NO: 4532044 - DNA, 14 bp, Homo sapiens
cagtgccgaggaca

SEQ ID NO: 4532045 - DNA, 15 bp, Homo sapiens
cagtgccgaggacat

SEQ ID NO: 4532046 - DNA, 11 bp, Homo sapiens
cagtgcctgcc

SEQ ID NO: 4532047 - DNA, 13 bp, Homo sapiens
cagtgcctgccac

SEQ ID NO: 4532048 - DNA, 14 bp, Homo sapiens
cagtgcctgccact

SEQ ID NO: 4532049 - DNA, 18 bp, Homo sapiens
cagtgcctgccactctct

SEQ ID NO: 4532050 - DNA, 23 bp, Homo sapiens
cagtgcctgccactctctgggac

SEQ ID NO: 4532051 - DNA, 24 bp, Homo sapiens
cagtgcctgccactctctgggact

SEQ ID NO: 4532052 - DNA, 11 bp, Homo sapiens
cagtgcctgct

SEQ ID NO: 4532053 - DNA, 13 bp, Homo sapiens
cagtgcctgctga

SEQ ID NO: 4532054 - DNA, 18 bp, Homo sapiens
cagtgccttacctcctgc

SEQ ID NO: 4532055 - DNA, 22 bp, Homo sapiens
cagtgccttacctcctgcccag

SEQ ID NO: 4532056 - DNA, 21 bp, Homo sapiens
cagtgccttggggaatttcct

SEQ ID NO: 4532057 - DNA, 22 bp, Homo sapiens
cagtgccttggggaatttcctc

SEQ ID NO: 4532058 - DNA, 21 bp, Homo sapiens
cagtgctcaccagccctgcag

SEQ ID NO: 4532059 - DNA, 12 bp, Homo sapiens
cagtgctcaccc

SEQ ID NO: 4532060 - DNA, 13 bp, Homo sapiens
cagtgctcaccca

SEQ ID NO: 4532061 - DNA, 17 bp, Homo sapiens
cagtgctctgcctcaga

SEQ ID NO: 4532062 - DNA, 15 bp, Homo sapiens
cagtgctgcagctcc

SEQ ID NO: 4532063 - DNA, 13 bp, Homo sapiens
cagtgctggattt

SEQ ID NO: 4532064 - DNA, 24 bp, Homo sapiens
cagtgcttagcaaaaaataatgac

SEQ ID NO: 4532065 - DNA, 15 bp, Homo sapiens
cagtgcttgggctcc

SEQ ID NO: 4532066 - DNA, 20 bp, Homo sapiens
cagtgcttttaagtgaaaat

SEQ ID NO: 4532067 - DNA, 15 bp, Homo sapiens
cagtggaagaaacac

SEQ ID NO: 4532068 - DNA, 14 bp, Homo sapiens
cagtggatacgtgt

SEQ ID NO: 4532069 - DNA, 13 bp, Homo sapiens
cagtggatcttca

SEQ ID NO: 4532070 - DNA, 15 bp, Homo sapiens
cagtggatcttcaga

SEQ ID NO: 4532071 - DNA, 18 bp, Homo sapiens
cagtggatcttcagaact

SEQ ID NO: 4532072 - DNA, 23 bp, Homo sapiens
cagtggatcttcagaactgccct

SEQ ID NO: 4532073 - DNA, 13 bp, Homo sapiens
cagtggccactca

SEQ ID NO: 4532074 - DNA, 15 bp, Homo sapiens
cagtggccaggtgcc

SEQ ID NO: 4532075 - DNA, 23 bp, Homo sapiens
cagtggcctacaaatcagtaatt

SEQ ID NO: 4532076 - DNA, 16 bp, Homo sapiens
cagtggcgggcccact

SEQ ID NO: 4532077 - DNA, 21 bp, Homo sapiens
cagtggcgggtgatggccagc

SEQ ID NO: 4532078 - DNA, 17 bp, Homo sapiens
cagtggctcacgcctgt

SEQ ID NO: 4532079 - DNA, 20 bp, Homo sapiens
cagtggctcccctgcccagc

SEQ ID NO: 4532080 - DNA, 13 bp, Homo sapiens
cagtggctcgctc

SEQ ID NO: 4532081 - DNA, 18 bp, Homo sapiens
cagtggctcgctccctgt

SEQ ID NO: 4532082 - DNA, 16 bp, Homo sapiens
cagtggctgctctggg

SEQ ID NO: 4532083 - DNA, 22 bp, Homo sapiens
cagtggctggaagaaccactgt

SEQ ID NO: 4532084 - DNA, 18 bp, Homo sapiens
cagtggctggatctgtga

SEQ ID NO: 4532085 - DNA, 20 bp, Homo sapiens
cagtggctggatctgtgagg

SEQ ID NO: 4532086 - DNA, 14 bp, Homo sapiens
cagtggcttctcca

SEQ ID NO: 4532087 - DNA, 17 bp, Homo sapiens
cagtggcttctccaggg

SEQ ID NO: 4532088 - DNA, 19 bp, Homo sapiens
cagtggcttctccagggaa

SEQ ID NO: 4532089 - DNA, 22 bp, Homo sapiens
cagtgggaacgtgactgcccca

SEQ ID NO: 4532090 - DNA, 13 bp, Homo sapiens
cagtgggagaaaa

SEQ ID NO: 4532091 - DNA, 15 bp, Homo sapiens
cagtgggagatgtta

SEQ ID NO: 4532092 - DNA, 17 bp, Homo sapiens
cagtgggagatgttaga

SEQ ID NO: 4532093 - DNA, 23 bp, Homo sapiens
cagtgggcgttgggagcctagct

SEQ ID NO: 4532094 - DNA, 15 bp, Homo sapiens
cagtgggctgatgct

SEQ ID NO: 4532095 - DNA, 21 bp, Homo sapiens
cagtgggctgatgctgggacc

SEQ ID NO: 4532096 - DNA, 14 bp, Homo sapiens
cagtggggcagcct

SEQ ID NO: 4532097 - DNA, 14 bp, Homo sapiens
cagtggtcagcagg

SEQ ID NO: 4532098 - DNA, 15 bp, Homo sapiens
cagtgtaaagtgtgt

SEQ ID NO: 4532099 - DNA, 15 bp, Homo sapiens
cagtgtacagtcttg

SEQ ID NO: 4532100 - DNA, 19 bp, Homo sapiens
cagtgtcaaataaacactg

SEQ ID NO: 4532101 - DNA, 21 bp, Homo sapiens
cagtgtcaaataaacactgtg

SEQ ID NO: 4532102 - DNA, 18 bp, Homo sapiens
cagtgtcaagttgtgctt

SEQ ID NO: 4532103 - DNA, 19 bp, Homo sapiens
cagtgtcaagttgtgcttg

SEQ ID NO: 4532104 - DNA, 13 bp, Homo sapiens
cagtgtcctttcc

SEQ ID NO: 4532105 - DNA, 19 bp, Homo sapiens
cagtgtcgggaattttccc

SEQ ID NO: 4532106 - DNA, 23 bp, Homo sapiens
cagtgtctgtgttttgaaagaat

SEQ ID NO: 4532107 - DNA, 22 bp, Homo sapiens
cagtgtctttctttggtgcctt

SEQ ID NO: 4532108 - DNA, 19 bp, Homo sapiens
cagtgtgaatagcctggcc

SEQ ID NO: 4532109 - DNA, 19 bp, Homo sapiens
cagtgtgagtataaaataa

SEQ ID NO: 4532110 - DNA, 14 bp, Homo sapiens
cagtgtgagtcaga

SEQ ID NO: 4532111 - DNA, 13 bp, Homo sapiens
cagtgtgcatggg

SEQ ID NO: 4532112 - DNA, 22 bp, Homo sapiens
cagtgtggagaccctgccacag

SEQ ID NO: 4532113 - DNA, 21 bp, Homo sapiens
cagtgtggggggacagacagg

SEQ ID NO: 4532114 - DNA, 22 bp, Homo sapiens
cagtgtgtctttataaagctgt

SEQ ID NO: 4532115 - DNA, 16 bp, Homo sapiens
cagtgttagtgctggt

SEQ ID NO: 4532116 - DNA, 19 bp, Homo sapiens
cagtgttagtgctggtcag

SEQ ID NO: 4532117 - DNA, 17 bp, Homo sapiens
cagtgttcctgaagctg

SEQ ID NO: 4532118 - DNA, 22 bp, Homo sapiens
cagtgttcctgaagctgctgtg

SEQ ID NO: 4532119 - DNA, 17 bp, Homo sapiens
cagtgttctatttgctt

SEQ ID NO: 4532120 - DNA, 13 bp, Homo sapiens
cagtgttttcaga

SEQ ID NO: 4532121 - DNA, 23 bp, Homo sapiens
cagtgttttcagaagaaataaat

SEQ ID NO: 4532122 - DNA, 21 bp, Homo sapiens
cagtgtttttagacctgtgtt

SEQ ID NO: 4532123 - DNA, 16 bp, Homo sapiens
cagtgtttttattgct

SEQ ID NO: 4532124 - DNA, 17 bp, Homo sapiens
cagtgtttttattgctc

SEQ ID NO: 4532125 - DNA, 18 bp, Homo sapiens
cagtgtttttattgctcg

SEQ ID NO: 4532126 - DNA, 15 bp, Homo sapiens
cagttaaaaaaaatt

SEQ ID NO: 4532127 - DNA, 21 bp, Homo sapiens
cagttaactattgcatttata

SEQ ID NO: 4532128 - DNA, 18 bp, Homo sapiens
cagttaacttactcttta

SEQ ID NO: 4532129 - DNA, 16 bp, Homo sapiens
cagttaatttttccaa

SEQ ID NO: 4532130 - DNA, 18 bp, Homo sapiens
cagttactcagccctggg

SEQ ID NO: 4532131 - DNA, 19 bp, Homo sapiens
cagttactcagccctgggc

SEQ ID NO: 4532132 - DNA, 17 bp, Homo sapiens
cagttacttaatgacca

SEQ ID NO: 4532133 - DNA, 19 bp, Homo sapiens
cagttataaaattaaaagt

SEQ ID NO: 4532134 - DNA, 17 bp, Homo sapiens
cagttataagcgtattt

SEQ ID NO: 4532135 - DNA, 21 bp, Homo sapiens
cagttatctgtttgttactgc

SEQ ID NO: 4532136 - DNA, 22 bp, Homo sapiens
cagttatgatttttttttcata

SEQ ID NO: 4532137 - DNA, 14 bp, Homo sapiens
cagttattaaatga

SEQ ID NO: 4532138 - DNA, 23 bp, Homo sapiens
cagttatttctgtttcctattta

SEQ ID NO: 4532139 - DNA, 23 bp, Homo sapiens
cagttcaacctggtggcaccaga

SEQ ID NO: 4532140 - DNA, 21 bp, Homo sapiens
cagttcacttctttgcagagc

SEQ ID NO: 4532141 - DNA, 17 bp, Homo sapiens
cagttcagcaccaccct

SEQ ID NO: 4532142 - DNA, 19 bp, Homo sapiens
cagttcatcgattttctat

SEQ ID NO: 4532143 - DNA, 15 bp, Homo sapiens
cagttcattcccaga

SEQ ID NO: 4532144 - DNA, 13 bp, Homo sapiens
cagttcccttggc

SEQ ID NO: 4532145 - DNA, 15 bp, Homo sapiens
cagttcccttggcct

SEQ ID NO: 4532146 - DNA, 17 bp, Homo sapiens
cagttcccttggcctca

SEQ ID NO: 4532147 - DNA, 15 bp, Homo sapiens
cagttcctagcactg

SEQ ID NO: 4532148 - DNA, 19 bp, Homo sapiens
cagttctccgtaacagtgt

SEQ ID NO: 4532149 - DNA, 17 bp, Homo sapiens
cagttctctcccttcct

SEQ ID NO: 4532150 - DNA, 17 bp, Homo sapiens
cagttctgagctgtaat

SEQ ID NO: 4532151 - DNA, 11 bp, Homo sapiens
cagttctgcaa

SEQ ID NO: 4532152 - DNA, 13 bp, Homo sapiens
cagttctgcaaat

SEQ ID NO: 4532153 - DNA, 18 bp, Homo sapiens
cagttctgcaaatagaaa

SEQ ID NO: 4532154 - DNA, 20 bp, Homo sapiens
cagttctgcaaatagaaaac

SEQ ID NO: 4532155 - DNA, 16 bp, Homo sapiens
cagttgaaaacttgta

SEQ ID NO: 4532156 - DNA, 18 bp, Homo sapiens
cagttgaaaagactccaa

SEQ ID NO: 4532157 - DNA, 22 bp, Homo sapiens
cagttgaaaagactccaaagaa

SEQ ID NO: 4532158 - DNA, 19 bp, Homo sapiens
cagttgatttttcttattt

SEQ ID NO: 4532159 - DNA, 21 bp, Homo sapiens
cagttgcagagaattgtttct

SEQ ID NO: 4532160 - DNA, 15 bp, Homo sapiens
cagttgcagtgctgc

SEQ ID NO: 4532161 - DNA, 18 bp, Homo sapiens
cagttgcatgtagtaaca

SEQ ID NO: 4532162 - DNA, 20 bp, Homo sapiens
cagttgcatgtagtaacact

SEQ ID NO: 4532163 - DNA, 19 bp, Homo sapiens
cagttgctcaaaaagaaat

SEQ ID NO: 4532164 - DNA, 15 bp, Homo sapiens
cagttggactctcag

SEQ ID NO: 4532165 - DNA, 17 bp, Homo sapiens
cagttggactctcaggg

SEQ ID NO: 4532166 - DNA, 18 bp, Homo sapiens
cagttggactctcaggga

SEQ ID NO: 4532167 - DNA, 19 bp, Homo sapiens
cagttggactctcagggat

SEQ ID NO: 4532168 - DNA, 13 bp, Homo sapiens
cagttggactttt

SEQ ID NO: 4532169 - DNA, 16 bp, Homo sapiens
cagttggtaacttttg

SEQ ID NO: 4532170 - DNA, 15 bp, Homo sapiens
cagttggtgtgtttt

SEQ ID NO: 4532171 - DNA, 16 bp, Homo sapiens
cagttggtgtgttttt

SEQ ID NO: 4532172 - DNA, 16 bp, Homo sapiens
cagttgtataaactgt

SEQ ID NO: 4532173 - DNA, 21 bp, Homo sapiens
cagttgtatgtttgctgatta

SEQ ID NO: 4532174 - DNA, 14 bp, Homo sapiens
cagttgtatttaac

SEQ ID NO: 4532175 - DNA, 21 bp, Homo sapiens
cagttgtatttaacagaaatt

SEQ ID NO: 4532176 - DNA, 18 bp, Homo sapiens
cagttgtgtggcccagca

SEQ ID NO: 4532177 - DNA, 19 bp, Homo sapiens
cagttgtgtggcccagcac

SEQ ID NO: 4532178 - DNA, 22 bp, Homo sapiens
cagttgtgtggcccagcacgag

SEQ ID NO: 4532179 - DNA, 14 bp, Homo sapiens
cagttgttatttat

SEQ ID NO: 4532180 - DNA, 13 bp, Homo sapiens
cagttgttctttt

SEQ ID NO: 4532181 - DNA, 19 bp, Homo sapiens
cagttgttctttttagaaa

SEQ ID NO: 4532182 - DNA, 22 bp, Homo sapiens
cagtttaaaaaataacttcatt

SEQ ID NO: 4532183 - DNA, 15 bp, Homo sapiens
cagtttaaaagcacg

SEQ ID NO: 4532184 - DNA, 16 bp, Homo sapiens
cagtttatcatgaagc

SEQ ID NO: 4532185 - DNA, 18 bp, Homo sapiens
cagtttatcatgaagcct

SEQ ID NO: 4532186 - DNA, 20 bp, Homo sapiens
cagtttatcatgaagcctgt

SEQ ID NO: 4532187 - DNA, 22 bp, Homo sapiens
cagtttatcatgaagcctgtgg

SEQ ID NO: 4532188 - DNA, 13 bp, Homo sapiens
cagtttatcattc

SEQ ID NO: 4532189 - DNA, 21 bp, Homo sapiens
cagtttcacagaaaataaggc

SEQ ID NO: 4532190 - DNA, 14 bp, Homo sapiens
cagtttcactttgg

SEQ ID NO: 4532191 - DNA, 19 bp, Homo sapiens
cagtttcattcaacacatt

SEQ ID NO: 4532192 - DNA, 17 bp, Homo sapiens
cagtttccgaatctctt

SEQ ID NO: 4532193 - DNA, 21 bp, Homo sapiens
cagtttctgacaattaacata

SEQ ID NO: 4532194 - DNA, 16 bp, Homo sapiens
cagtttcttgtgtaga

SEQ ID NO: 4532195 - DNA, 18 bp, Homo sapiens
cagtttgaaattctgaat

SEQ ID NO: 4532196 - DNA, 14 bp, Homo sapiens
cagtttgacttttt

SEQ ID NO: 4532197 - DNA, 11 bp, Homo sapiens
cagtttgcaaa

SEQ ID NO: 4532198 - DNA, 15 bp, Homo sapiens
cagtttgcaaaaaat

SEQ ID NO: 4532199 - DNA, 18 bp, Homo sapiens
cagtttgtagtgccactg

SEQ ID NO: 4532200 - DNA, 19 bp, Homo sapiens
cagtttgttccttttgtac

SEQ ID NO: 4532201 - DNA, 12 bp, Homo sapiens
cagttttaaaga

SEQ ID NO: 4532202 - DNA, 15 bp, Homo sapiens
cagttttaactgtgg

SEQ ID NO: 4532203 - DNA, 20 bp, Homo sapiens
cagttttaactgtggatatt

SEQ ID NO: 4532204 - DNA, 11 bp, Homo sapiens
cagttttaata

SEQ ID NO: 4532205 - DNA, 12 bp, Homo sapiens
cagttttcataa

SEQ ID NO: 4532206 - DNA, 22 bp, Homo sapiens
cagtttttaactctactgtgta

SEQ ID NO: 4532207 - DNA, 22 bp, Homo sapiens
cagtttttattaatctactgta

SEQ ID NO: 4532208 - DNA, 14 bp, Homo sapiens
cagtttttcacttc

SEQ ID NO: 4532209 - DNA, 20 bp, Homo sapiens
cagtttttcattttaaaaag

SEQ ID NO: 4532210 - DNA, 23 bp, Homo sapiens
cagtttttgtttttgcatgaaat

SEQ ID NO: 4532211 - DNA, 18 bp, Homo sapiens
cataaaaactgatttgct

SEQ ID NO: 4532212 - DNA, 23 bp, Homo sapiens
cataaaaagaggatgatttcaga

SEQ ID NO: 4532213 - DNA, 20 bp, Homo sapiens
cataaaaaggacatcagcaa

SEQ ID NO: 4532214 - DNA, 15 bp, Homo sapiens
cataaaaatgatcta

SEQ ID NO: 4532215 - DNA, 15 bp, Homo sapiens
cataaaatggaataa

SEQ ID NO: 4532216 - DNA, 18 bp, Homo sapiens
cataaaatggaataacat

SEQ ID NO: 4532217 - DNA, 19 bp, Homo sapiens
cataaaatgggtgatatgc

SEQ ID NO: 4532218 - DNA, 21 bp, Homo sapiens
cataaaattgcagtttcatgt

SEQ ID NO: 4532219 - DNA, 13 bp, Homo sapiens
cataaactaaaaa

SEQ ID NO: 4532220 - DNA, 15 bp, Homo sapiens
cataaactaaaaact

SEQ ID NO: 4532221 - DNA, 17 bp, Homo sapiens
cataaagctcaaatgaa

SEQ ID NO: 4532222 - DNA, 16 bp, Homo sapiens
cataaatcatgttgtt

SEQ ID NO: 4532223 - DNA, 14 bp, Homo sapiens
cataaattttaatt

SEQ ID NO: 4532224 - DNA, 21 bp, Homo sapiens
cataaattttaattcaagaaa

SEQ ID NO: 4532225 - DNA, 22 bp, Homo sapiens
cataaattttaattcaagaaat

SEQ ID NO: 4532226 - DNA, 16 bp, Homo sapiens
cataacaattcctcta

SEQ ID NO: 4532227 - DNA, 15 bp, Homo sapiens
cataacagtgcaggg

SEQ ID NO: 4532228 - DNA, 20 bp, Homo sapiens
cataacatagtttttcatca

SEQ ID NO: 4532229 - DNA, 17 bp, Homo sapiens
cataaccaatttgtaat

SEQ ID NO: 4532230 - DNA, 14 bp, Homo sapiens
cataactgcttctt

SEQ ID NO: 4532231 - DNA, 16 bp, Homo sapiens
cataacttattgctga

SEQ ID NO: 4532232 - DNA, 19 bp, Homo sapiens
cataacttattgctgattt

SEQ ID NO: 4532233 - DNA, 16 bp, Homo sapiens
cataagagagatgaga

SEQ ID NO: 4532234 - DNA, 22 bp, Homo sapiens
cataagcttggtgacaaaattc

SEQ ID NO: 4532235 - DNA, 19 bp, Homo sapiens
cataagtattatgtctctt

SEQ ID NO: 4532236 - DNA, 22 bp, Homo sapiens
cataagtggggagagagccctt

SEQ ID NO: 4532237 - DNA, 19 bp, Homo sapiens
cataagttatgcctctgac

SEQ ID NO: 4532238 - DNA, 14 bp, Homo sapiens
cataataaattttc

SEQ ID NO: 4532239 - DNA, 18 bp, Homo sapiens
cataatcacaacccttca

SEQ ID NO: 4532240 - DNA, 15 bp, Homo sapiens
cataatcattacctt

SEQ ID NO: 4532241 - DNA, 13 bp, Homo sapiens
cataatcttctgc

SEQ ID NO: 4532242 - DNA, 21 bp, Homo sapiens
cataatcttctgccttctcat

SEQ ID NO: 4532243 - DNA, 15 bp, Homo sapiens
cataatgaacaattg

SEQ ID NO: 4532244 - DNA, 20 bp, Homo sapiens
cataatgctttggaaaaatg

SEQ ID NO: 4532245 - DNA, 13 bp, Homo sapiens
cataatgtaattt

SEQ ID NO: 4532246 - DNA, 22 bp, Homo sapiens
cataatgtttctggatttcata

SEQ ID NO: 4532247 - DNA, 16 bp, Homo sapiens
cataattagatccatt

SEQ ID NO: 4532248 - DNA, 22 bp, Homo sapiens
cataattagatccattaattta

SEQ ID NO: 4532249 - DNA, 13 bp, Homo sapiens
cataattatttct

SEQ ID NO: 4532250 - DNA, 18 bp, Homo sapiens
cataattcagcacttaac

SEQ ID NO: 4532251 - DNA, 12 bp, Homo sapiens
cataattctttt

SEQ ID NO: 4532252 - DNA, 19 bp, Homo sapiens
cataatttagttgtttcta

SEQ ID NO: 4532253 - DNA, 22 bp, Homo sapiens
cataatttagtttcatataaag

SEQ ID NO: 4532254 - DNA, 12 bp, Homo sapiens
cataattttgca

SEQ ID NO: 4532255 - DNA, 23 bp, Homo sapiens
catacaaaatatttaagtgaagg

SEQ ID NO: 4532256 - DNA, 16 bp, Homo sapiens
catacaaactctcacc

SEQ ID NO: 4532257 - DNA, 20 bp, Homo sapiens
catacaatgtatgtacaata

SEQ ID NO: 4532258 - DNA, 15 bp, Homo sapiens
catacacatttttaa

SEQ ID NO: 4532259 - DNA, 19 bp, Homo sapiens
catacacctcgtcaagagc

SEQ ID NO: 4532260 - DNA, 17 bp, Homo sapiens
catacagaggtaactat

SEQ ID NO: 4532261 - DNA, 10 bp, Homo sapiens
catacagttt

SEQ ID NO: 4532262 - DNA, 15 bp, Homo sapiens
catacagttttcatt

SEQ ID NO: 4532263 - DNA, 14 bp, Homo sapiens
catacataaactgt

SEQ ID NO: 4532264 - DNA, 12 bp, Homo sapiens
cataccaaatgg

SEQ ID NO: 4532265 - DNA, 15 bp, Homo sapiens
cataccaaatggcac

SEQ ID NO: 4532266 - DNA, 17 bp, Homo sapiens
cataccaacacgagcag

SEQ ID NO: 4532267 - DNA, 23 bp, Homo sapiens
cataccacaagacatttctttct

SEQ ID NO: 4532268 - DNA, 18 bp, Homo sapiens
cataccccttacaaatga

SEQ ID NO: 4532269 - DNA, 20 bp, Homo sapiens
cataccccttacaaatgaaa

SEQ ID NO: 4532270 - DNA, 14 bp, Homo sapiens
catacctaccagta

SEQ ID NO: 4532271 - DNA, 16 bp, Homo sapiens
catacctaccagtatt

SEQ ID NO: 4532272 - DNA, 14 bp, Homo sapiens
cataccttttctct

SEQ ID NO: 4532273 - DNA, 17 bp, Homo sapiens
catacgctcagctcatc

SEQ ID NO: 4532274 - DNA, 22 bp, Homo sapiens
catactcatttttcatgataat

SEQ ID NO: 4532275 - DNA, 20 bp, Homo sapiens
catactccttccatcaaata

SEQ ID NO: 4532276 - DNA, 15 bp, Homo sapiens
catactcttctaaaa

SEQ ID NO: 4532277 - DNA, 15 bp, Homo sapiens
catactgagggacca

SEQ ID NO: 4532278 - DNA, 22 bp, Homo sapiens
catactgcgtccaccctgagct

SEQ ID NO: 4532279 - DNA, 15 bp, Homo sapiens
catactgtacacatt

SEQ ID NO: 4532280 - DNA, 16 bp, Homo sapiens
catactgtacacattt

SEQ ID NO: 4532281 - DNA, 18 bp, Homo sapiens
catactgtacacatttct

SEQ ID NO: 4532282 - DNA, 19 bp, Homo sapiens
catactgtacacatttctt

SEQ ID NO: 4532283 - DNA, 24 bp, Homo sapiens
catactgtgcaggcctgtccctgg

SEQ ID NO: 4532284 - DNA, 23 bp, Homo sapiens
cagtcaacggggggctcctgccc

SEQ ID NO: 4532285 - DNA, 20 bp, Homo sapiens
cagtcaagctgttgaagtct

SEQ ID NO: 4532286 - DNA, 15 bp, Homo sapiens
cagtcaatattttta

SEQ ID NO: 4532287 - DNA, 15 bp, Homo sapiens
cagtcacatcacaat

SEQ ID NO: 4532288 - DNA, 15 bp, Homo sapiens
cagtcacattccaag

SEQ ID NO: 4532289 - DNA, 13 bp, Homo sapiens
cagtcacctcttc

SEQ ID NO: 4532290 - DNA, 17 bp, Homo sapiens
cagtcacctcttctacc

SEQ ID NO: 4532291 - DNA, 14 bp, Homo sapiens
cagtcactggaggt

SEQ ID NO: 4532292 - DNA, 23 bp, Homo sapiens
cagtcactggaggttgaagccaa

SEQ ID NO: 4532293 - DNA, 21 bp, Homo sapiens
cagtcactggcccaaccagaa

SEQ ID NO: 4532294 - DNA, 16 bp, Homo sapiens
cagtcagaaggacggc

SEQ ID NO: 4532295 - DNA, 18 bp, Homo sapiens
cagtcagaaggacggcag

SEQ ID NO: 4532296 - DNA, 22 bp, Homo sapiens
cagtcagccctgattgtgccag

SEQ ID NO: 4532297 - DNA, 21 bp, Homo sapiens
cagtcagcctctctcccagtc

SEQ ID NO: 4532298 - DNA, 21 bp, Homo sapiens
cagtcaggtagttgcaattga

SEQ ID NO: 4532299 - DNA, 22 bp, Homo sapiens
cagtcatcagtcatcaggtgtg

SEQ ID NO: 4532300 - DNA, 17 bp, Homo sapiens
cagtcatggcctgagat

SEQ ID NO: 4532301 - DNA, 18 bp, Homo sapiens
cagtcatggtactacccc

SEQ ID NO: 4532302 - DNA, 18 bp, Homo sapiens
cagtcattagactcctcc

SEQ ID NO: 4532303 - DNA, 22 bp, Homo sapiens
cagtcattcagcagcaaatttt

SEQ ID NO: 4532304 - DNA, 13 bp, Homo sapiens
cagtccacaaaat

SEQ ID NO: 4532305 - DNA, 12 bp, Homo sapiens
cagtccagaccc

SEQ ID NO: 4532306 - DNA, 17 bp, Homo sapiens
cagtccagacccaagtc

SEQ ID NO: 4532307 - DNA, 16 bp, Homo sapiens
cagtccagcaaataaa

SEQ ID NO: 4532308 - DNA, 21 bp, Homo sapiens
cagtccaggcctctctctgct

SEQ ID NO: 4532309 - DNA, 19 bp, Homo sapiens
cagtccatgcatgacagcc

SEQ ID NO: 4532310 - DNA, 13 bp, Homo sapiens
cagtccatgctcc

SEQ ID NO: 4532311 - DNA, 14 bp, Homo sapiens
cagtcccactgtgc

SEQ ID NO: 4532312 - DNA, 22 bp, Homo sapiens
cagtcccagacaattccattca

SEQ ID NO: 4532313 - DNA, 15 bp, Homo sapiens
cagtcccatgctggc

SEQ ID NO: 4532314 - DNA, 12 bp, Homo sapiens
cagtccccaccc

SEQ ID NO: 4532315 - DNA, 20 bp, Homo sapiens
cagtccccatttctgcctcg

SEQ ID NO: 4532316 - DNA, 12 bp, Homo sapiens
cagtccccgagg

SEQ ID NO: 4532317 - DNA, 20 bp, Homo sapiens
cagtccccgaggagctgggc

SEQ ID NO: 4532318 - DNA, 15 bp, Homo sapiens
cagtccctactgagt

SEQ ID NO: 4532319 - DNA, 11 bp, Homo sapiens
cagtccctgct

SEQ ID NO: 4532320 - DNA, 20 bp, Homo sapiens
cagtccctgggggaagccct

SEQ ID NO: 4532321 - DNA, 17 bp, Homo sapiens
cagtcctagaatgtttc

SEQ ID NO: 4532322 - DNA, 13 bp, Homo sapiens
cagtcctagctgc

SEQ ID NO: 4532323 - DNA, 17 bp, Homo sapiens
cagtcctagctgcacag

SEQ ID NO: 4532324 - DNA, 12 bp, Homo sapiens
cagtcctatttt

SEQ ID NO: 4532325 - DNA, 15 bp, Homo sapiens
cagtcctatttttca

SEQ ID NO: 4532326 - DNA, 20 bp, Homo sapiens
cagtcctccactcgacccag

SEQ ID NO: 4532327 - DNA, 15 bp, Homo sapiens
cagtcctgcccgcca

SEQ ID NO: 4532328 - DNA, 11 bp, Homo sapiens
cagtcctgcct

SEQ ID NO: 4532329 - DNA, 14 bp, Homo sapiens
cagtcctgcctgaa

SEQ ID NO: 4532330 - DNA, 22 bp, Homo sapiens
cagtcctgcctgaacagccctc

SEQ ID NO: 4532331 - DNA, 13 bp, Homo sapiens
cagtcctgcctgg

SEQ ID NO: 4532332 - DNA, 15 bp, Homo sapiens
cagtcctgcctggcc

SEQ ID NO: 4532333 - DNA, 18 bp, Homo sapiens
cagtcctgcctggccagg

SEQ ID NO: 4532334 - DNA, 18 bp, Homo sapiens
cagtcctgtagttttatt

SEQ ID NO: 4532335 - DNA, 17 bp, Homo sapiens
cagtcgcctgcctgcag

SEQ ID NO: 4532336 - DNA, 19 bp, Homo sapiens
cagtcgcctgcctgcagca

SEQ ID NO: 4532337 - DNA, 21 bp, Homo sapiens
cagtcgcctgcctgcagcagg

SEQ ID NO: 4532338 - DNA, 16 bp, Homo sapiens
cagtcgctcagtctgt

SEQ ID NO: 4532339 - DNA, 19 bp, Homo sapiens
cagtcgctcagtctgttca

SEQ ID NO: 4532340 - DNA, 15 bp, Homo sapiens
cagtcgtgatgtgga

SEQ ID NO: 4532341 - DNA, 19 bp, Homo sapiens
cagtctcactgtgggaagg

SEQ ID NO: 4532342 - DNA, 14 bp, Homo sapiens
cagtctcatcctcc

SEQ ID NO: 4532343 - DNA, 16 bp, Homo sapiens
cagtctcatcctccca

SEQ ID NO: 4532344 - DNA, 17 bp, Homo sapiens
cagtctcatcctcccat

SEQ ID NO: 4532345 - DNA, 20 bp, Homo sapiens
cagtctcatcctcccattgc

SEQ ID NO: 4532346 - DNA, 22 bp, Homo sapiens
cagtctcatcctcccattgccc

SEQ ID NO: 4532347 - DNA, 13 bp, Homo sapiens
cagtctcatttct

SEQ ID NO: 4532348 - DNA, 22 bp, Homo sapiens
cagtctccatgtgtgtgccaag

SEQ ID NO: 4532349 - DNA, 18 bp, Homo sapiens
cagtctccccttcctggc

SEQ ID NO: 4532350 - DNA, 12 bp, Homo sapiens
cagtctcctcac

SEQ ID NO: 4532351 - DNA, 15 bp, Homo sapiens
cagtctcctcactct

SEQ ID NO: 4532352 - DNA, 12 bp, Homo sapiens
cagtctcctctt

SEQ ID NO: 4532353 - DNA, 23 bp, Homo sapiens
cagtctcctctttaaaacaaaac

SEQ ID NO: 4532354 - DNA, 14 bp, Homo sapiens
cagtctctcttctc

SEQ ID NO: 4532355 - DNA, 12 bp, Homo sapiens
cagtctctgagc

SEQ ID NO: 4532356 - DNA, 18 bp, Homo sapiens
cagtctgagagaggccat

SEQ ID NO: 4532357 - DNA, 21 bp, Homo sapiens
cagtctgattataccatgtgt

SEQ ID NO: 4532358 - DNA, 12 bp, Homo sapiens
cagtctgtcatg

SEQ ID NO: 4532359 - DNA, 17 bp, Homo sapiens
cagtctgttcactgcat

SEQ ID NO: 4532360 - DNA, 17 bp, Homo sapiens
cagtcttccatttgcaa

SEQ ID NO: 4532361 - DNA, 16 bp, Homo sapiens
cagtcttcctgacact

SEQ ID NO: 4532362 - DNA, 21 bp, Homo sapiens
cagtcttcctgacactttaat

SEQ ID NO: 4532363 - DNA, 16 bp, Homo sapiens
cagtctttgaactgca

SEQ ID NO: 4532364 - DNA, 19 bp, Homo sapiens
cagtctttgaactgcagca

SEQ ID NO: 4532365 - DNA, 14 bp, Homo sapiens
cagtcttttgtcct

SEQ ID NO: 4532366 - DNA, 15 bp, Homo sapiens
cagtgaactcctgcc

SEQ ID NO: 4532367 - DNA, 20 bp, Homo sapiens
cagtgaactcctgccaggca

SEQ ID NO: 4532368 - DNA, 13 bp, Homo sapiens
cagtgaactcggc

SEQ ID NO: 4532369 - DNA, 18 bp, Homo sapiens
cagtgaacttgtctggct

SEQ ID NO: 4532370 - DNA, 14 bp, Homo sapiens
cagtgaagaaagcc

SEQ ID NO: 4532371 - DNA, 19 bp, Homo sapiens
cagtgaagcagcactgtga

SEQ ID NO: 4532372 - DNA, 12 bp, Homo sapiens
cagtgaagcctc

SEQ ID NO: 4532373 - DNA, 23 bp, Homo sapiens
cagtgaaggtggggagaagctga

SEQ ID NO: 4532374 - DNA, 19 bp, Homo sapiens
cagtgaatttttgcaataa

SEQ ID NO: 4532375 - DNA, 20 bp, Homo sapiens
cagtgaatttttgcaataat

SEQ ID NO: 4532376 - DNA, 21 bp, Homo sapiens
cagtgaatttttgcaataatg

SEQ ID NO: 4532377 - DNA, 13 bp, Homo sapiens
cagtgacaacatc

SEQ ID NO: 4532378 - DNA, 15 bp, Homo sapiens
cagtgagacagctct

SEQ ID NO: 4532379 - DNA, 18 bp, Homo sapiens
cagtgagactgtacataa

SEQ ID NO: 4532380 - DNA, 13 bp, Homo sapiens
cagtgagcccctc

SEQ ID NO: 4532381 - DNA, 17 bp, Homo sapiens
cagtgagcccctcccca

SEQ ID NO: 4532382 - DNA, 20 bp, Homo sapiens
cagtgagcccctccccagcc

SEQ ID NO: 4532383 - DNA, 22 bp, Homo sapiens
cagtgagcccctccccagccag

SEQ ID NO: 4532384 - DNA, 17 bp, Homo sapiens
cagtgagccctgctctt

SEQ ID NO: 4532385 - DNA, 19 bp, Homo sapiens
cagtgagccgcatcttctc

SEQ ID NO: 4532386 - DNA, 21 bp, Homo sapiens
cagtgagcctcctgtgcctgg

SEQ ID NO: 4532387 - DNA, 22 bp, Homo sapiens
cagtgagcctcctgtgcctggc

SEQ ID NO: 4532388 - DNA, 23 bp, Homo sapiens
cagtgagcctcctgtgcctggcc

SEQ ID NO: 4532389 - DNA, 15 bp, Homo sapiens
cagtgagctgagatc

SEQ ID NO: 4532390 - DNA, 17 bp, Homo sapiens
cagtgaggactctttcc

SEQ ID NO: 4532391 - DNA, 17 bp, Homo sapiens
cagtgatgaatgtacta

SEQ ID NO: 4532392 - DNA, 16 bp, Homo sapiens
cagtgattgtcttaat

SEQ ID NO: 4532393 - DNA, 21 bp, Homo sapiens
cagtgatttttagtaaccttt

SEQ ID NO: 4532394 - DNA, 22 bp, Homo sapiens
cagtgcactccggcctgggtga

SEQ ID NO: 4532395 - DNA, 20 bp, Homo sapiens
cagtgcagagccttctcaga

SEQ ID NO: 4532396 - DNA, 14 bp, Homo sapiens
cagtgcagcagagg

SEQ ID NO: 4532397 - DNA, 13 bp, Homo sapiens
cagtgcagccact

SEQ ID NO: 4532398 - DNA, 16 bp, Homo sapiens
cagtgcagccactggc

SEQ ID NO: 4532399 - DNA, 19 bp, Homo sapiens
cagtgcagtccatttccta

SEQ ID NO: 4532400 - DNA, 22 bp, Homo sapiens
cagtgcagtttcttttcacatt

SEQ ID NO: 4532401 - DNA, 15 bp, Homo sapiens
cagtgcatgtgcatg

SEQ ID NO: 4532402 - DNA, 21 bp, Homo sapiens
cagtgccacctatgcctgtgg

SEQ ID NO: 4532403 - DNA, 19 bp, Homo sapiens
cagtgccactgccccccga

SEQ ID NO: 4532404 - DNA, 17 bp, Homo sapiens
cagtgccattgtcttta

SEQ ID NO: 4532405 - DNA, 13 bp, Homo sapiens
caggtatcaaatc

SEQ ID NO: 4532406 - DNA, 19 bp, Homo sapiens
caggtatttttttaaatca

SEQ ID NO: 4532407 - DNA, 23 bp, Homo sapiens
caggtatttttttaaatcaagga

SEQ ID NO: 4532408 - DNA, 12 bp, Homo sapiens
caggtcacagaa

SEQ ID NO: 4532409 - DNA, 19 bp, Homo sapiens
caggtcagcgcggtcctga

SEQ ID NO: 4532410 - DNA, 14 bp, Homo sapiens
caggtcagtagtca

SEQ ID NO: 4532411 - DNA, 17 bp, Homo sapiens
caggtcagttgtaataa

SEQ ID NO: 4532412 - DNA, 12 bp, Homo sapiens
caggtccaagga

SEQ ID NO: 4532413 - DNA, 15 bp, Homo sapiens
caggtccagatgtgc

SEQ ID NO: 4532414 - DNA, 14 bp, Homo sapiens
caggtcccacgcca

SEQ ID NO: 4532415 - DNA, 16 bp, Homo sapiens
caggtcccacgccagg

SEQ ID NO: 4532416 - DNA, 18 bp, Homo sapiens
caggtcccacgccaggcc

SEQ ID NO: 4532417 - DNA, 21 bp, Homo sapiens
caggtcccacgccaggccagc

SEQ ID NO: 4532418 - DNA, 18 bp, Homo sapiens
caggtcccagcccctcct

SEQ ID NO: 4532419 - DNA, 19 bp, Homo sapiens
caggtcccagcccctcctc

SEQ ID NO: 4532420 - DNA, 20 bp, Homo sapiens
caggtcccagcccctcctcc

SEQ ID NO: 4532421 - DNA, 17 bp, Homo sapiens
caggtccgtagctcccc

SEQ ID NO: 4532422 - DNA, 20 bp, Homo sapiens
caggtccgtagctcccctgg

SEQ ID NO: 4532423 - DNA, 23 bp, Homo sapiens
caggtccgtagctcccctggctg

SEQ ID NO: 4532424 - DNA, 22 bp, Homo sapiens
caggtccgtttccttacacatt

SEQ ID NO: 4532425 - DNA, 21 bp, Homo sapiens
caggtcctgcccatgtgtccc

SEQ ID NO: 4532426 - DNA, 13 bp, Homo sapiens
caggtctacagtg

SEQ ID NO: 4532427 - DNA, 20 bp, Homo sapiens
caggtctccacctgcacatt

SEQ ID NO: 4532428 - DNA, 15 bp, Homo sapiens
caggtcttttcaaat

SEQ ID NO: 4532429 - DNA, 18 bp, Homo sapiens
caggtgacacgcttctga

SEQ ID NO: 4532430 - DNA, 21 bp, Homo sapiens
caggtgacacgcttctgagca

SEQ ID NO: 4532431 - DNA, 18 bp, Homo sapiens
caggtgacagtggctgct

SEQ ID NO: 4532432 - DNA, 22 bp, Homo sapiens
caggtgacagtggctgctctgg

SEQ ID NO: 4532433 - DNA, 21 bp, Homo sapiens
caggtgaggtctgttcctttt

SEQ ID NO: 4532434 - DNA, 14 bp, Homo sapiens
caggtgcccaggaa

SEQ ID NO: 4532435 - DNA, 21 bp, Homo sapiens
caggtgccccgactgtgggac

SEQ ID NO: 4532436 - DNA, 21 bp, Homo sapiens
caggtgcctttcaaatttaga

SEQ ID NO: 4532437 - DNA, 14 bp, Homo sapiens
caggtgctggtccc

SEQ ID NO: 4532438 - DNA, 16 bp, Homo sapiens
caggtggacgctgcag

SEQ ID NO: 4532439 - DNA, 14 bp, Homo sapiens
caggtggagagcac

SEQ ID NO: 4532440 - DNA, 23 bp, Homo sapiens
caggtggaggtgtcaggctgctg

SEQ ID NO: 4532441 - DNA, 15 bp, Homo sapiens
caggtggcacctgca

SEQ ID NO: 4532442 - DNA, 18 bp, Homo sapiens
caggtggcacctgcagcg

SEQ ID NO: 4532443 - DNA, 16 bp, Homo sapiens
caggtggcagagtgaa

SEQ ID NO: 4532444 - DNA, 22 bp, Homo sapiens
caggtggctagcaaattagaaa

SEQ ID NO: 4532445 - DNA, 19 bp, Homo sapiens
caggtggctgacccagtcc

SEQ ID NO: 4532446 - DNA, 13 bp, Homo sapiens
caggtgggaaagc

SEQ ID NO: 4532447 - DNA, 12 bp, Homo sapiens
caggtgggctgg

SEQ ID NO: 4532448 - DNA, 20 bp, Homo sapiens
caggtggggagactgggctg

SEQ ID NO: 4532449 - DNA, 13 bp, Homo sapiens
caggtgggtcccg

SEQ ID NO: 4532450 - DNA, 22 bp, Homo sapiens
caggtgggtcccggctctgtgg

SEQ ID NO: 4532451 - DNA, 11 bp, Homo sapiens
caggtgtagct

SEQ ID NO: 4532452 - DNA, 22 bp, Homo sapiens
caggtgtagctaacagttgcca

SEQ ID NO: 4532453 - DNA, 14 bp, Homo sapiens
caggtgtgctcagg

SEQ ID NO: 4532454 - DNA, 19 bp, Homo sapiens
caggttagaacctagaagg

SEQ ID NO: 4532455 - DNA, 22 bp, Homo sapiens
caggttattgcaataaagtata

SEQ ID NO: 4532456 - DNA, 22 bp, Homo sapiens
caggttcatggattacttctct

SEQ ID NO: 4532457 - DNA, 23 bp, Homo sapiens
caggttccagaacagccctcggc

SEQ ID NO: 4532458 - DNA, 16 bp, Homo sapiens
caggttccctcccaga

SEQ ID NO: 4532459 - DNA, 15 bp, Homo sapiens
caggttctctttgag

SEQ ID NO: 4532460 - DNA, 13 bp, Homo sapiens
caggttgcattgg

SEQ ID NO: 4532461 - DNA, 18 bp, Homo sapiens
caggttggcttttttccc

SEQ ID NO: 4532462 - DNA, 22 bp, Homo sapiens
caggtttctaagcataaaagat

SEQ ID NO: 4532463 - DNA, 15 bp, Homo sapiens
caggtttgcaggagc

SEQ ID NO: 4532464 - DNA, 20 bp, Homo sapiens
caggttttgttttttttcag

SEQ ID NO: 4532465 - DNA, 23 bp, Homo sapiens
caggttttgttttttttcagcca

SEQ ID NO: 4532466 - DNA, 18 bp, Homo sapiens
cagtaaaccactgaaaaa

SEQ ID NO: 4532467 - DNA, 14 bp, Homo sapiens
cagtaaagagaaac

SEQ ID NO: 4532468 - DNA, 17 bp, Homo sapiens
cagtaaagagaaacttt

SEQ ID NO: 4532469 - DNA, 19 bp, Homo sapiens
cagtaaagagaaactttgt

SEQ ID NO: 4532470 - DNA, 23 bp, Homo sapiens
cagtaaagagaaactttgtgcta

SEQ ID NO: 4532471 - DNA, 23 bp, Homo sapiens
cagtaaagagtacactcagccac

SEQ ID NO: 4532472 - DNA, 19 bp, Homo sapiens
cagtaaagtacctttatgt

SEQ ID NO: 4532473 - DNA, 23 bp, Homo sapiens
cagtaaagtggttctctgccttt

SEQ ID NO: 4532474 - DNA, 12 bp, Homo sapiens
cagtaaatcttt

SEQ ID NO: 4532475 - DNA, 20 bp, Homo sapiens
cagtaaatcttttacaactg

SEQ ID NO: 4532476 - DNA, 20 bp, Homo sapiens
cagtaagaagattctcgccc

SEQ ID NO: 4532477 - DNA, 16 bp, Homo sapiens
cagtaatctgtcagtg

SEQ ID NO: 4532478 - DNA, 14 bp, Homo sapiens
cagtaattgtgaca

SEQ ID NO: 4532479 - DNA, 15 bp, Homo sapiens
cagtaattttcggat

SEQ ID NO: 4532480 - DNA, 16 bp, Homo sapiens
cagtacaggggtgctg

SEQ ID NO: 4532481 - DNA, 17 bp, Homo sapiens
cagtacatttaaatttt

SEQ ID NO: 4532482 - DNA, 22 bp, Homo sapiens
cagtacatttaaattttttggc

SEQ ID NO: 4532483 - DNA, 23 bp, Homo sapiens
cagtaccttaggttctttctgaa

SEQ ID NO: 4532484 - DNA, 19 bp, Homo sapiens
cagtactggttactttcaa

SEQ ID NO: 4532485 - DNA, 22 bp, Homo sapiens
cagtactggttactttcaaaat

SEQ ID NO: 4532486 - DNA, 12 bp, Homo sapiens
cagtacttctaa

SEQ ID NO: 4532487 - DNA, 13 bp, Homo sapiens
cagtacttctaag

SEQ ID NO: 4532488 - DNA, 15 bp, Homo sapiens
cagtacttttctctg

SEQ ID NO: 4532489 - DNA, 15 bp, Homo sapiens
cagtacttttttaaa

SEQ ID NO: 4532490 - DNA, 23 bp, Homo sapiens
cagtacttttttaaatattttct

SEQ ID NO: 4532491 - DNA, 16 bp, Homo sapiens
cagtagaaagctaaag

SEQ ID NO: 4532492 - DNA, 18 bp, Homo sapiens
cagtagcccagagtgagc

SEQ ID NO: 4532493 - DNA, 14 bp, Homo sapiens
cagtagcttcccaa

SEQ ID NO: 4532494 - DNA, 21 bp, Homo sapiens
cagtaggagcccagctctgaa

SEQ ID NO: 4532495 - DNA, 23 bp, Homo sapiens
cagtagtcttgatgaccaaagtc

SEQ ID NO: 4532496 - DNA, 22 bp, Homo sapiens
cagtagttcacatacaaatcat

SEQ ID NO: 4532497 - DNA, 15 bp, Homo sapiens
cagtataacctgtct

SEQ ID NO: 4532498 - DNA, 17 bp, Homo sapiens
cagtatattttatttca

SEQ ID NO: 4532499 - DNA, 18 bp, Homo sapiens
cagtatattttatttcaa

SEQ ID NO: 4532500 - DNA, 22 bp, Homo sapiens
cagtatattttatttcaatgta

SEQ ID NO: 4532501 - DNA, 20 bp, Homo sapiens
cagtatattttctgtattta

SEQ ID NO: 4532502 - DNA, 13 bp, Homo sapiens
cagtatctcttac

SEQ ID NO: 4532503 - DNA, 17 bp, Homo sapiens
cagtatcttttttcctt

SEQ ID NO: 4532504 - DNA, 15 bp, Homo sapiens
cagtatggtacattt

SEQ ID NO: 4532505 - DNA, 23 bp, Homo sapiens
cagtatggtacatttttcaactt

SEQ ID NO: 4532506 - DNA, 15 bp, Homo sapiens
cagtatgttttaaca

SEQ ID NO: 4532507 - DNA, 19 bp, Homo sapiens
cagtattaacatcaaagac

SEQ ID NO: 4532508 - DNA, 20 bp, Homo sapiens
cagtattaacatcaaagact

SEQ ID NO: 4532509 - DNA, 14 bp, Homo sapiens
cagtattacagtgt

SEQ ID NO: 4532510 - DNA, 20 bp, Homo sapiens
cagtattatttctccatccc

SEQ ID NO: 4532511 - DNA, 15 bp, Homo sapiens
cagtattctatttgg

SEQ ID NO: 4532512 - DNA, 17 bp, Homo sapiens
cagtattgggcaggagg

SEQ ID NO: 4532513 - DNA, 16 bp, Homo sapiens
cagtatttagaagcca

SEQ ID NO: 4532514 - DNA, 17 bp, Homo sapiens
cagtatttagaagccaa

SEQ ID NO: 4532515 - DNA, 15 bp, Homo sapiens
cagtatttgtaatta

SEQ ID NO: 4532516 - DNA, 12 bp, Homo sapiens
cagtattttcca

SEQ ID NO: 4532517 - DNA, 18 bp, Homo sapiens
cagtattttccagcctta

SEQ ID NO: 4532518 - DNA, 23 bp, Homo sapiens
cagtattttcccaatagcacttt

SEQ ID NO: 4532519 - DNA, 19 bp, Homo sapiens
cagtatttttgctgcttct

SEQ ID NO: 4532520 - DNA, 15 bp, Homo sapiens
cagtcaacatttaca

SEQ ID NO: 4532521 - DNA, 16 bp, Homo sapiens
cagtcaacggggggct

SEQ ID NO: 4532522 - DNA, 19 bp, Homo sapiens
cagtcaacggggggctcct

SEQ ID NO: 4532523 - DNA, 20 bp, Homo sapiens
cagtcaacggggggctcctg

SEQ ID NO: 4532524 - DNA, 22 bp, Homo sapiens
cagtcaacggggggctcctgcc

SEQ ID NO: 4532525 - DNA, 15 bp, Homo sapiens
cagggcaaaatattc

SEQ ID NO: 4532526 - DNA, 21 bp, Homo sapiens
cagggcaaaatattcactggg

SEQ ID NO: 4532527 - DNA, 18 bp, Homo sapiens
cagggcaatgatgaatga

SEQ ID NO: 4532528 - DNA, 13 bp, Homo sapiens
cagggcacccagg

SEQ ID NO: 4532529 - DNA, 14 bp, Homo sapiens
cagggcagctgggc

SEQ ID NO: 4532530 - DNA, 16 bp, Homo sapiens
cagggcagctgggccc

SEQ ID NO: 4532531 - DNA, 17 bp, Homo sapiens
cagggcagctgggccca

SEQ ID NO: 4532532 - DNA, 22 bp, Homo sapiens
cagggcagctgggcccaaccct

SEQ ID NO: 4532533 - DNA, 15 bp, Homo sapiens
cagggcagggcgagc

SEQ ID NO: 4532534 - DNA, 16 bp, Homo sapiens
cagggcagggcgagct

SEQ ID NO: 4532535 - DNA, 18 bp, Homo sapiens
cagggcagggcgagctgc

SEQ ID NO: 4532536 - DNA, 20 bp, Homo sapiens
cagggccaaacgctgagcca

SEQ ID NO: 4532537 - DNA, 17 bp, Homo sapiens
cagggccactggaagga

SEQ ID NO: 4532538 - DNA, 13 bp, Homo sapiens
cagggccaggcct

SEQ ID NO: 4532539 - DNA, 17 bp, Homo sapiens
cagggcccccaataaac

SEQ ID NO: 4532540 - DNA, 19 bp, Homo sapiens
cagggcccccaataaacca

SEQ ID NO: 4532541 - DNA, 16 bp, Homo sapiens
cagggcccccctgacg

SEQ ID NO: 4532542 - DNA, 15 bp, Homo sapiens
cagggcccggccaca

SEQ ID NO: 4532543 - DNA, 17 bp, Homo sapiens
cagggcccggccacacc

SEQ ID NO: 4532544 - DNA, 20 bp, Homo sapiens
cagggcccggccacacccag

SEQ ID NO: 4532545 - DNA, 17 bp, Homo sapiens
cagggcctctgcggagc

SEQ ID NO: 4532546 - DNA, 20 bp, Homo sapiens
cagggcctgacttgagccac

SEQ ID NO: 4532547 - DNA, 22 bp, Homo sapiens
cagggcctgacttgagccactc

SEQ ID NO: 4532548 - DNA, 14 bp, Homo sapiens
cagggcctggagcc

SEQ ID NO: 4532549 - DNA, 15 bp, Homo sapiens
cagggcctggagccc

SEQ ID NO: 4532550 - DNA, 16 bp, Homo sapiens
cagggcctggctccag

SEQ ID NO: 4532551 - DNA, 18 bp, Homo sapiens
cagggcctggctccagtc

SEQ ID NO: 4532552 - DNA, 13 bp, Homo sapiens
cagggccttgccc

SEQ ID NO: 4532553 - DNA, 24 bp, Homo sapiens
cagggccttgcccagagatgcctc

SEQ ID NO: 4532554 - DNA, 14 bp, Homo sapiens
cagggcgagctgca

SEQ ID NO: 4532555 - DNA, 17 bp, Homo sapiens
cagggcggcctcccagg

SEQ ID NO: 4532556 - DNA, 19 bp, Homo sapiens
cagggcggcctcccaggtc

SEQ ID NO: 4532557 - DNA, 20 bp, Homo sapiens
cagggcggcctcccaggtcc

SEQ ID NO: 4532558 - DNA, 21 bp, Homo sapiens
cagggcggcctcccaggtccc

SEQ ID NO: 4532559 - DNA, 16 bp, Homo sapiens
cagggcgggcagaggg

SEQ ID NO: 4532560 - DNA, 20 bp, Homo sapiens
cagggcgggcagagggctgg

SEQ ID NO: 4532561 - DNA, 22 bp, Homo sapiens
cagggctaccctgagctgaggc

SEQ ID NO: 4532562 - DNA, 23 bp, Homo sapiens
cagggctaccctgagctgaggca

SEQ ID NO: 4532563 - DNA, 24 bp, Homo sapiens
cagggctaccctgagctgaggcag

SEQ ID NO: 4532564 - DNA, 13 bp, Homo sapiens
cagggctcctggg

SEQ ID NO: 4532565 - DNA, 14 bp, Homo sapiens
cagggctggactga

SEQ ID NO: 4532566 - DNA, 16 bp, Homo sapiens
cagggctggactgagg

SEQ ID NO: 4532567 - DNA, 20 bp, Homo sapiens
cagggctggactgaggcctg

SEQ ID NO: 4532568 - DNA, 12 bp, Homo sapiens
cagggctggccc

SEQ ID NO: 4532569 - DNA, 14 bp, Homo sapiens
cagggctggcccag

SEQ ID NO: 4532570 - DNA, 10 bp, Homo sapiens
cagggctggg

SEQ ID NO: 4532571 - DNA, 19 bp, Homo sapiens
cagggctggggttgccaga

SEQ ID NO: 4532572 - DNA, 21 bp, Homo sapiens
cagggctggggttgccagagg

SEQ ID NO: 4532573 - DNA, 15 bp, Homo sapiens
cagggctgtcccagc

SEQ ID NO: 4532574 - DNA, 14 bp, Homo sapiens
caggggaacctgcc

SEQ ID NO: 4532575 - DNA, 15 bp, Homo sapiens
caggggaagagaaga

SEQ ID NO: 4532576 - DNA, 18 bp, Homo sapiens
caggggaagagaagacaa

SEQ ID NO: 4532577 - DNA, 17 bp, Homo sapiens
caggggaattccctccc

SEQ ID NO: 4532578 - DNA, 15 bp, Homo sapiens
caggggactcagccc

SEQ ID NO: 4532579 - DNA, 20 bp, Homo sapiens
caggggactcagccctgagg

SEQ ID NO: 4532580 - DNA, 11 bp, Homo sapiens
caggggagaaa

SEQ ID NO: 4532581 - DNA, 16 bp, Homo sapiens
caggggagaaagagga

SEQ ID NO: 4532582 - DNA, 22 bp, Homo sapiens
caggggcacctatgagatggcc

SEQ ID NO: 4532583 - DNA, 15 bp, Homo sapiens
caggggcagccacac

SEQ ID NO: 4532584 - DNA, 17 bp, Homo sapiens
caggggcagccacacca

SEQ ID NO: 4532585 - DNA, 20 bp, Homo sapiens
caggggccaacctcaggctc

SEQ ID NO: 4532586 - DNA, 20 bp, Homo sapiens
caggggccaattttggatga

SEQ ID NO: 4532587 - DNA, 22 bp, Homo sapiens
caggggcccaaggcggcccctc

SEQ ID NO: 4532588 - DNA, 12 bp, Homo sapiens
caggggctccag

SEQ ID NO: 4532589 - DNA, 17 bp, Homo sapiens
caggggctccagcacct

SEQ ID NO: 4532590 - DNA, 22 bp, Homo sapiens
caggggctccatgctgggtctg

SEQ ID NO: 4532591 - DNA, 21 bp, Homo sapiens
cagggggatatgggtcctctg

SEQ ID NO: 4532592 - DNA, 11 bp, Homo sapiens
cagggggccct

SEQ ID NO: 4532593 - DNA, 15 bp, Homo sapiens
cagggggccctgccc

SEQ ID NO: 4532594 - DNA, 23 bp, Homo sapiens
cagggggccctgccccaccccat

SEQ ID NO: 4532595 - DNA, 21 bp, Homo sapiens
caggggtcagtgcagcagagg

SEQ ID NO: 4532596 - DNA, 14 bp, Homo sapiens
caggggtccaggcc

SEQ ID NO: 4532597 - DNA, 15 bp, Homo sapiens
caggggtccaggccc

SEQ ID NO: 4532598 - DNA, 15 bp, Homo sapiens
caggggtctccctgg

SEQ ID NO: 4532599 - DNA, 17 bp, Homo sapiens
caggggtctccctggct

SEQ ID NO: 4532600 - DNA, 18 bp, Homo sapiens
caggggtctccctggctc

SEQ ID NO: 4532601 - DNA, 14 bp, Homo sapiens
caggggtctgtctg

SEQ ID NO: 4532602 - DNA, 13 bp, Homo sapiens
caggggtgctcct

SEQ ID NO: 4532603 - DNA, 19 bp, Homo sapiens
cagggtacctcaagcccca

SEQ ID NO: 4532604 - DNA, 16 bp, Homo sapiens
cagggtagcccgcctg

SEQ ID NO: 4532605 - DNA, 12 bp, Homo sapiens
cagggtcctctc

SEQ ID NO: 4532606 - DNA, 15 bp, Homo sapiens
cagggtcctctcttc

SEQ ID NO: 4532607 - DNA, 16 bp, Homo sapiens
cagggtcctctcttcc

SEQ ID NO: 4532608 - DNA, 20 bp, Homo sapiens
cagggtcctctcttccacag

SEQ ID NO: 4532609 - DNA, 21 bp, Homo sapiens
cagggtcctctcttccacagt

SEQ ID NO: 4532610 - DNA, 19 bp, Homo sapiens
cagggtccttttgacactg

SEQ ID NO: 4532611 - DNA, 13 bp, Homo sapiens
cagggtcttccct

SEQ ID NO: 4532612 - DNA, 15 bp, Homo sapiens
cagggtcttgctctg

SEQ ID NO: 4532613 - DNA, 16 bp, Homo sapiens
cagggtcttgctctgt

SEQ ID NO: 4532614 - DNA, 16 bp, Homo sapiens
cagggtgacagagtga

SEQ ID NO: 4532615 - DNA, 13 bp, Homo sapiens
cagggtgctgtgg

SEQ ID NO: 4532616 - DNA, 14 bp, Homo sapiens
cagggtggccacac

SEQ ID NO: 4532617 - DNA, 21 bp, Homo sapiens
cagggtggccacacaggcagg

SEQ ID NO: 4532618 - DNA, 22 bp, Homo sapiens
cagggtggccacacaggcaggg

SEQ ID NO: 4532619 - DNA, 13 bp, Homo sapiens
cagggtgggaggg

SEQ ID NO: 4532620 - DNA, 14 bp, Homo sapiens
cagggtgggaggga

SEQ ID NO: 4532621 - DNA, 20 bp, Homo sapiens
cagggtgggcttcctgccct

SEQ ID NO: 4532622 - DNA, 11 bp, Homo sapiens
cagggtggggg

SEQ ID NO: 4532623 - DNA, 12 bp, Homo sapiens
cagggtgggggg

SEQ ID NO: 4532624 - DNA, 13 bp, Homo sapiens
cagggtggggggt

SEQ ID NO: 4532625 - DNA, 16 bp, Homo sapiens
cagggtggggggtgac

SEQ ID NO: 4532626 - DNA, 21 bp, Homo sapiens
cagggtgggtgagctctcagg

SEQ ID NO: 4532627 - DNA, 23 bp, Homo sapiens
cagggtgtctctatgaaaagcac

SEQ ID NO: 4532628 - DNA, 20 bp, Homo sapiens
cagggttgaccccagaggat

SEQ ID NO: 4532629 - DNA, 20 bp, Homo sapiens
cagggttgggcccagatctg

SEQ ID NO: 4532630 - DNA, 21 bp, Homo sapiens
cagggttgggcccagatctgg

SEQ ID NO: 4532631 - DNA, 19 bp, Homo sapiens
cagggtttcaccatgttgc

SEQ ID NO: 4532632 - DNA, 19 bp, Homo sapiens
cagggtttctctgcagatg

SEQ ID NO: 4532633 - DNA, 22 bp, Homo sapiens
cagggtttctctgcagatgtgc

SEQ ID NO: 4532634 - DNA, 15 bp, Homo sapiens
caggtaaaacagggc

SEQ ID NO: 4532635 - DNA, 23 bp, Homo sapiens
caggtaaaacagggccacataga

SEQ ID NO: 4532636 - DNA, 22 bp, Homo sapiens
caggtaaagggcaaataatgat

SEQ ID NO: 4532637 - DNA, 19 bp, Homo sapiens
caggtaatgtgaataaatt

SEQ ID NO: 4532638 - DNA, 18 bp, Homo sapiens
caggtacacctccccctg

SEQ ID NO: 4532639 - DNA, 15 bp, Homo sapiens
caggtaccagctgcg

SEQ ID NO: 4532640 - DNA, 19 bp, Homo sapiens
caggtaccagctgcgcttg

SEQ ID NO: 4532641 - DNA, 21 bp, Homo sapiens
caggtaccagctgcgcttgct

SEQ ID NO: 4532642 - DNA, 13 bp, Homo sapiens
caggtactgcatt

SEQ ID NO: 4532643 - DNA, 20 bp, Homo sapiens
caggtagaattatctaattt

SEQ ID NO: 4532644 - DNA, 23 bp, Homo sapiens
caggtagaattatctaatttata

SEQ ID NO: 4532645 - DNA, 18 bp, Homo sapiens
caggtagttgcaattgaa

SEQ ID NO: 4532646 - DNA, 15 bp, Homo sapiens
cattaacggtgctaa

SEQ ID NO: 4532647 - DNA, 16 bp, Homo sapiens
cattaacggtgctaaa

SEQ ID NO: 4532648 - DNA, 21 bp, Homo sapiens
cattaactatttttttcaaag

SEQ ID NO: 4532649 - DNA, 20 bp, Homo sapiens
cattaatcagttcattagaa

SEQ ID NO: 4532650 - DNA, 19 bp, Homo sapiens
cattaatgcctgctttttg

SEQ ID NO: 4532651 - DNA, 21 bp, Homo sapiens
cattaattattattgctgttg

SEQ ID NO: 4532652 - DNA, 22 bp, Homo sapiens
cattaattgctaacaattgtta

SEQ ID NO: 4532653 - DNA, 12 bp, Homo sapiens
cattaatttaaa

SEQ ID NO: 4532654 - DNA, 16 bp, Homo sapiens
cattacagattaaaga

SEQ ID NO: 4532655 - DNA, 23 bp, Homo sapiens
cattaccaaaataataaaaatca

SEQ ID NO: 4532656 - DNA, 16 bp, Homo sapiens
cattaccactcaggca

SEQ ID NO: 4532657 - DNA, 22 bp, Homo sapiens
cattacctcagtgagaagccag

SEQ ID NO: 4532658 - DNA, 12 bp, Homo sapiens
cattacctgtac

SEQ ID NO: 4532659 - DNA, 18 bp, Homo sapiens
cattactattaactctgc

SEQ ID NO: 4532660 - DNA, 14 bp, Homo sapiens
cattactccttcag

SEQ ID NO: 4532661 - DNA, 18 bp, Homo sapiens
cattagaaaaaaatgaaa

SEQ ID NO: 4532662 - DNA, 16 bp, Homo sapiens
cattagactcctcctc

SEQ ID NO: 4532663 - DNA, 17 bp, Homo sapiens
cattagactcctcctcc

SEQ ID NO: 4532664 - DNA, 12 bp, Homo sapiens
cattagccaagg

SEQ ID NO: 4532665 - DNA, 15 bp, Homo sapiens
cattaggatggctag

SEQ ID NO: 4532666 - DNA, 23 bp, Homo sapiens
cattagtattcctcattctgcat

SEQ ID NO: 4532667 - DNA, 18 bp, Homo sapiens
cattataactgaaggaga

SEQ ID NO: 4532668 - DNA, 13 bp, Homo sapiens
cattatactttat

SEQ ID NO: 4532669 - DNA, 18 bp, Homo sapiens
cattatactttatatctg

SEQ ID NO: 4532670 - DNA, 21 bp, Homo sapiens
cattatactttatatctgtaa

SEQ ID NO: 4532671 - DNA, 15 bp, Homo sapiens
cattatattctaatt

SEQ ID NO: 4532672 - DNA, 20 bp, Homo sapiens
cattatattctaattaaaat

SEQ ID NO: 4532673 - DNA, 15 bp, Homo sapiens
cattatattgcaatg

SEQ ID NO: 4532674 - DNA, 16 bp, Homo sapiens
cattatattgcaatga

SEQ ID NO: 4532675 - DNA, 14 bp, Homo sapiens
cattatccctgaat

SEQ ID NO: 4532676 - DNA, 21 bp, Homo sapiens
cattatcgagcagcattttat

SEQ ID NO: 4532677 - DNA, 24 bp, Homo sapiens
cattatctagttcattgaatcatt

SEQ ID NO: 4532678 - DNA, 16 bp, Homo sapiens
cattatctcacttagt

SEQ ID NO: 4532679 - DNA, 19 bp, Homo sapiens
cattatctcacttagtcct

SEQ ID NO: 4532680 - DNA, 15 bp, Homo sapiens
cattatcttcatatg

SEQ ID NO: 4532681 - DNA, 21 bp, Homo sapiens
cattatgcaaatggagataaa

SEQ ID NO: 4532682 - DNA, 12 bp, Homo sapiens
cattatgctttg

SEQ ID NO: 4532683 - DNA, 16 bp, Homo sapiens
cattatgttaatattt

SEQ ID NO: 4532684 - DNA, 18 bp, Homo sapiens
cattatttattaaatttt

SEQ ID NO: 4532685 - DNA, 22 bp, Homo sapiens
cattattttttatttctgattt

SEQ ID NO: 4532686 - DNA, 17 bp, Homo sapiens
cattattttttgttgaa

SEQ ID NO: 4532687 - DNA, 22 bp, Homo sapiens
cattcaaaaaactctctcccag

SEQ ID NO: 4532688 - DNA, 22 bp, Homo sapiens
cattcaaaaagacagcagacaa

SEQ ID NO: 4532689 - DNA, 23 bp, Homo sapiens
cattcaaaaagacagcagacaaa

SEQ ID NO: 4532690 - DNA, 13 bp, Homo sapiens
cattcaacacatt

SEQ ID NO: 4532691 - DNA, 17 bp, Homo sapiens
cattcaagtgtaaaata

SEQ ID NO: 4532692 - DNA, 21 bp, Homo sapiens
cattcaagtgtaaaatatttt

SEQ ID NO: 4532693 - DNA, 22 bp, Homo sapiens
cattcaagtgtaaaatattttg

SEQ ID NO: 4532694 - DNA, 19 bp, Homo sapiens
cattcacaactatgaaatc

SEQ ID NO: 4532695 - DNA, 16 bp, Homo sapiens
cattcacaagcctcct

SEQ ID NO: 4532696 - DNA, 20 bp, Homo sapiens
cattcacaagcctcctgtac

SEQ ID NO: 4532697 - DNA, 21 bp, Homo sapiens
cattcacaagcctcctgtacc

SEQ ID NO: 4532698 - DNA, 22 bp, Homo sapiens
cattcacgcatacttggatatc

SEQ ID NO: 4532699 - DNA, 15 bp, Homo sapiens
cattcacttcataat

SEQ ID NO: 4532700 - DNA, 20 bp, Homo sapiens
cattcagcagcaaattttca

SEQ ID NO: 4532701 - DNA, 19 bp, Homo sapiens
cattcaggaattcttggag

SEQ ID NO: 4532702 - DNA, 14 bp, Homo sapiens
cattcaggcagcac

SEQ ID NO: 4532703 - DNA, 17 bp, Homo sapiens
cattcaggcagcactga

SEQ ID NO: 4532704 - DNA, 15 bp, Homo sapiens
cattcaggtgacctc

SEQ ID NO: 4532705 - DNA, 21 bp, Homo sapiens
cattcagtatttattgagcat

SEQ ID NO: 4532706 - DNA, 13 bp, Homo sapiens
cattcagtggcaa

SEQ ID NO: 4532707 - DNA, 15 bp, Homo sapiens
cattcatacttaaaa

SEQ ID NO: 4532708 - DNA, 18 bp, Homo sapiens
cattcatacttaaaaatt

SEQ ID NO: 4532709 - DNA, 12 bp, Homo sapiens
cattcatgaata

SEQ ID NO: 4532710 - DNA, 15 bp, Homo sapiens
cattcatgaatattt

SEQ ID NO: 4532711 - DNA, 16 bp, Homo sapiens
cattcatttttatagc

SEQ ID NO: 4532712 - DNA, 17 bp, Homo sapiens
cattcatttttgttgtt

SEQ ID NO: 4532713 - DNA, 14 bp, Homo sapiens
cattccaaagaaac

SEQ ID NO: 4532714 - DNA, 17 bp, Homo sapiens
cattccagatcccaggc

SEQ ID NO: 4532715 - DNA, 14 bp, Homo sapiens
cattccagctctgc

SEQ ID NO: 4532716 - DNA, 17 bp, Homo sapiens
cattccagctctgcccc

SEQ ID NO: 4532717 - DNA, 18 bp, Homo sapiens
cattccagctctgccccc

SEQ ID NO: 4532718 - DNA, 19 bp, Homo sapiens
cattccaggtagctcggca

SEQ ID NO: 4532719 - DNA, 14 bp, Homo sapiens
cattccattgccta

SEQ ID NO: 4532720 - DNA, 16 bp, Homo sapiens
cattccattgcctagc

SEQ ID NO: 4532721 - DNA, 17 bp, Homo sapiens
cattccccaggtggctg

SEQ ID NO: 4532722 - DNA, 20 bp, Homo sapiens
cattccctgagtcaccagga

SEQ ID NO: 4532723 - DNA, 17 bp, Homo sapiens
cattcctaaaacaccct

SEQ ID NO: 4532724 - DNA, 13 bp, Homo sapiens
cattcctcaggga

SEQ ID NO: 4532725 - DNA, 23 bp, Homo sapiens
cattcctcagggacagagacacc

SEQ ID NO: 4532726 - DNA, 16 bp, Homo sapiens
cattcctccagcctcc

SEQ ID NO: 4532727 - DNA, 19 bp, Homo sapiens
cattcctccagcctcccct

SEQ ID NO: 4532728 - DNA, 21 bp, Homo sapiens
cattcctccagcctcccctcc

SEQ ID NO: 4532729 - DNA, 12 bp, Homo sapiens
cattcctccctc

SEQ ID NO: 4532730 - DNA, 13 bp, Homo sapiens
cattcctgcctgg

SEQ ID NO: 4532731 - DNA, 16 bp, Homo sapiens
cattccttgaggacag

SEQ ID NO: 4532732 - DNA, 17 bp, Homo sapiens
cattccttgaggacaga

SEQ ID NO: 4532733 - DNA, 15 bp, Homo sapiens
cattccttgcgcctc

SEQ ID NO: 4532734 - DNA, 17 bp, Homo sapiens
cattcgaatctctgccc

SEQ ID NO: 4532735 - DNA, 18 bp, Homo sapiens
cattcgaatctctgcccc

SEQ ID NO: 4532736 - DNA, 22 bp, Homo sapiens
cattcgaatctctgcccctcac

SEQ ID NO: 4532737 - DNA, 19 bp, Homo sapiens
cattcgtgagctggggact

SEQ ID NO: 4532738 - DNA, 21 bp, Homo sapiens
cattcgttgtgttttttaaga

SEQ ID NO: 4532739 - DNA, 13 bp, Homo sapiens
cattctaaaacac

SEQ ID NO: 4532740 - DNA, 16 bp, Homo sapiens
cattctaacctggagg

SEQ ID NO: 4532741 - DNA, 22 bp, Homo sapiens
cattctacacagagcaggactg

SEQ ID NO: 4532742 - DNA, 20 bp, Homo sapiens
cattctagataaccttgttt

SEQ ID NO: 4532743 - DNA, 17 bp, Homo sapiens
cattctaggctcactgc

SEQ ID NO: 4532744 - DNA, 11 bp, Homo sapiens
cattctcacat

SEQ ID NO: 4532745 - DNA, 17 bp, Homo sapiens
cattctcataattccta

SEQ ID NO: 4532746 - DNA, 18 bp, Homo sapiens
cattctcataattcctac

SEQ ID NO: 4532747 - DNA, 19 bp, Homo sapiens
cattctcataattcctaca

SEQ ID NO: 4532748 - DNA, 21 bp, Homo sapiens
cattctcataattcctacagc

SEQ ID NO: 4532749 - DNA, 20 bp, Homo sapiens
cattctcctcagtggcttct

SEQ ID NO: 4532750 - DNA, 15 bp, Homo sapiens
cattctcctgcctca

SEQ ID NO: 4532751 - DNA, 17 bp, Homo sapiens
cattctcctgcctcagc

SEQ ID NO: 4532752 - DNA, 18 bp, Homo sapiens
cattctcctgcctcagcc

SEQ ID NO: 4532753 - DNA, 13 bp, Homo sapiens
cattctcttttaa

SEQ ID NO: 4532754 - DNA, 20 bp, Homo sapiens
cattctgaattaattaattt

SEQ ID NO: 4532755 - DNA, 23 bp, Homo sapiens
cattctgaattaattaatttgga

SEQ ID NO: 4532756 - DNA, 22 bp, Homo sapiens
cattctgctacttcactgtcat

SEQ ID NO: 4532757 - DNA, 20 bp, Homo sapiens
cattctggggaaacaacatt

SEQ ID NO: 4532758 - DNA, 17 bp, Homo sapiens
cattctgtgcaggctgc

SEQ ID NO: 4532759 - DNA, 17 bp, Homo sapiens
cattcttcagtttttca

SEQ ID NO: 4532760 - DNA, 21 bp, Homo sapiens
cattcttcagtttttcacttc

SEQ ID NO: 4532761 - DNA, 22 bp, Homo sapiens
cattcttccatcatcactgtaa

SEQ ID NO: 4532762 - DNA, 21 bp, Homo sapiens
cattcttctctgttgtcgtaa

SEQ ID NO: 4532763 - DNA, 12 bp, Homo sapiens
cattcttgcttg

SEQ ID NO: 4532764 - DNA, 19 bp, Homo sapiens
cattcttggcttaatcatt

SEQ ID NO: 4532765 - DNA, 14 bp, Homo sapiens
cattctttcccaac

SEQ ID NO: 4532766 - DNA, 23 bp, Homo sapiens
catggcagctggttgctccattt

SEQ ID NO: 4532767 - DNA, 13 bp, Homo sapiens
catggcagggcca

SEQ ID NO: 4532768 - DNA, 20 bp, Homo sapiens
catggcagggccaggcctct

SEQ ID NO: 4532769 - DNA, 17 bp, Homo sapiens
catggcatagccccggc

SEQ ID NO: 4532770 - DNA, 17 bp, Homo sapiens
catggcatattttaatc

SEQ ID NO: 4532771 - DNA, 14 bp, Homo sapiens
catggcccccaata

SEQ ID NO: 4532772 - DNA, 17 bp, Homo sapiens
catggcccccaataaag

SEQ ID NO: 4532773 - DNA, 22 bp, Homo sapiens
catggcccccaataaaggcagc

SEQ ID NO: 4532774 - DNA, 23 bp, Homo sapiens
catggcccccaataaaggcagct

SEQ ID NO: 4532775 - DNA, 18 bp, Homo sapiens
catggccctgtcccaggc

SEQ ID NO: 4532776 - DNA, 20 bp, Homo sapiens
catggcctcagccctgctcc

SEQ ID NO: 4532777 - DNA, 13 bp, Homo sapiens
catggctacctca

SEQ ID NO: 4532778 - DNA, 14 bp, Homo sapiens
catggctattttat

SEQ ID NO: 4532779 - DNA, 17 bp, Homo sapiens
catggctcctgtctggc

SEQ ID NO: 4532780 - DNA, 21 bp, Homo sapiens
catggctgggaactgcagacc

SEQ ID NO: 4532781 - DNA, 19 bp, Homo sapiens
catgggaaatagcggccct

SEQ ID NO: 4532782 - DNA, 14 bp, Homo sapiens
catgggaggctcac

SEQ ID NO: 4532783 - DNA, 12 bp, Homo sapiens
catgggagggat

SEQ ID NO: 4532784 - DNA, 18 bp, Homo sapiens
catgggagggatcagccc

SEQ ID NO: 4532785 - DNA, 14 bp, Homo sapiens
catgggagggggct

SEQ ID NO: 4532786 - DNA, 17 bp, Homo sapiens
catgggcctgtggggac

SEQ ID NO: 4532787 - DNA, 13 bp, Homo sapiens
catggggccagga

SEQ ID NO: 4532788 - DNA, 15 bp, Homo sapiens
catggggccaggaaa

SEQ ID NO: 4532789 - DNA, 21 bp, Homo sapiens
catggggtccatccccttccc

SEQ ID NO: 4532790 - DNA, 16 bp, Homo sapiens
catgggtgagacctga

SEQ ID NO: 4532791 - DNA, 14 bp, Homo sapiens
catggtactacccc

SEQ ID NO: 4532792 - DNA, 15 bp, Homo sapiens
catggtactacccca

SEQ ID NO: 4532793 - DNA, 15 bp, Homo sapiens
catggtactgtagca

SEQ ID NO: 4532794 - DNA, 16 bp, Homo sapiens
catggtacttcctctg

SEQ ID NO: 4532795 - DNA, 18 bp, Homo sapiens
catggtacttcctctgtg

SEQ ID NO: 4532796 - DNA, 19 bp, Homo sapiens
catggtcagccctagggtg

SEQ ID NO: 4532797 - DNA, 18 bp, Homo sapiens
catggtcctttctggaag

SEQ ID NO: 4532798 - DNA, 15 bp, Homo sapiens
catggtgaaaagctc

SEQ ID NO: 4532799 - DNA, 18 bp, Homo sapiens
catggtgaaaagctccat

SEQ ID NO: 4532800 - DNA, 18 bp, Homo sapiens
catggtgaaacccccatc

SEQ ID NO: 4532801 - DNA, 15 bp, Homo sapiens
catggtgcagggaga

SEQ ID NO: 4532802 - DNA, 16 bp, Homo sapiens
catggtgcctgagagg

SEQ ID NO: 4532803 - DNA, 20 bp, Homo sapiens
catggtggcgcaagcctgta

SEQ ID NO: 4532804 - DNA, 21 bp, Homo sapiens
catggtgggtccatgggcaga

SEQ ID NO: 4532805 - DNA, 16 bp, Homo sapiens
catggtgtctcccaac

SEQ ID NO: 4532806 - DNA, 22 bp, Homo sapiens
catggtgtttaaaatttaaatc

SEQ ID NO: 4532807 - DNA, 18 bp, Homo sapiens
catggttgggggaatgca

SEQ ID NO: 4532808 - DNA, 15 bp, Homo sapiens
catggtttggagctg

SEQ ID NO: 4532809 - DNA, 19 bp, Homo sapiens
catgtaattttattttaaa

SEQ ID NO: 4532810 - DNA, 22 bp, Homo sapiens
catgtactacagctatatttga

SEQ ID NO: 4532811 - DNA, 17 bp, Homo sapiens
catgtagactgtgccag

SEQ ID NO: 4532812 - DNA, 15 bp, Homo sapiens
catgtagcatataaa

SEQ ID NO: 4532813 - DNA, 19 bp, Homo sapiens
catgtagcatataaatgtt

SEQ ID NO: 4532814 - DNA, 20 bp, Homo sapiens
catgtagcatataaatgttt

SEQ ID NO: 4532815 - DNA, 19 bp, Homo sapiens
catgtagtaacactaatat

SEQ ID NO: 4532816 - DNA, 21 bp, Homo sapiens
catgtcaattcataaaaacaa

SEQ ID NO: 4532817 - DNA, 15 bp, Homo sapiens
catgtcatttgcaca

SEQ ID NO: 4532818 - DNA, 17 bp, Homo sapiens
catgtcatttgcacaca

SEQ ID NO: 4532819 - DNA, 18 bp, Homo sapiens
catgtccaaagaggctgc

SEQ ID NO: 4532820 - DNA, 19 bp, Homo sapiens
catgtccatacactttgtt

SEQ ID NO: 4532821 - DNA, 23 bp, Homo sapiens
catgtccatacactttgttgcaa

SEQ ID NO: 4532822 - DNA, 14 bp, Homo sapiens
catgtcccacccac

SEQ ID NO: 4532823 - DNA, 22 bp, Homo sapiens
catgtcctgcctattatctgtc

SEQ ID NO: 4532824 - DNA, 16 bp, Homo sapiens
catgtcgctccggtca

SEQ ID NO: 4532825 - DNA, 17 bp, Homo sapiens
catgtctctcagaattc

SEQ ID NO: 4532826 - DNA, 13 bp, Homo sapiens
catgtctgtatac

SEQ ID NO: 4532827 - DNA, 19 bp, Homo sapiens
catgtctgtatactcctgt

SEQ ID NO: 4532828 - DNA, 14 bp, Homo sapiens
catgtcttgtcata

SEQ ID NO: 4532829 - DNA, 19 bp, Homo sapiens
catgtgaccgaacactgca

SEQ ID NO: 4532830 - DNA, 22 bp, Homo sapiens
catgtgagatagttttcatttt

SEQ ID NO: 4532831 - DNA, 23 bp, Homo sapiens
catgtgagatagttttcatttta

SEQ ID NO: 4532832 - DNA, 22 bp, Homo sapiens
catgtgccactgttcagcggag

SEQ ID NO: 4532833 - DNA, 22 bp, Homo sapiens
catgtgccagggcaatgatgaa

SEQ ID NO: 4532834 - DNA, 24 bp, Homo sapiens
catgtgccagggcaatgatgaatg

SEQ ID NO: 4532835 - DNA, 16 bp, Homo sapiens
catgtgcctctttgtc

SEQ ID NO: 4532836 - DNA, 22 bp, Homo sapiens
catgtgcctttctttgcctctg

SEQ ID NO: 4532837 - DNA, 23 bp, Homo sapiens
catgtgcctttctttgcctctgc

SEQ ID NO: 4532838 - DNA, 17 bp, Homo sapiens
catgtgctgccctgttg

SEQ ID NO: 4532839 - DNA, 23 bp, Homo sapiens
catgtggcagggagcagtacaca

SEQ ID NO: 4532840 - DNA, 21 bp, Homo sapiens
catgtgtgtgccaagccctgg

SEQ ID NO: 4532841 - DNA, 16 bp, Homo sapiens
catgtgttaagtattt

SEQ ID NO: 4532842 - DNA, 16 bp, Homo sapiens
catgtgttatctacct

SEQ ID NO: 4532843 - DNA, 19 bp, Homo sapiens
catgtgttatctacctcaa

SEQ ID NO: 4532844 - DNA, 22 bp, Homo sapiens
catgtgttttcatcatttcagc

SEQ ID NO: 4532845 - DNA, 16 bp, Homo sapiens
catgttaaattagaat

SEQ ID NO: 4532846 - DNA, 16 bp, Homo sapiens
catgttaatatttgaa

SEQ ID NO: 4532847 - DNA, 14 bp, Homo sapiens
catgttagttacct

SEQ ID NO: 4532848 - DNA, 15 bp, Homo sapiens
catgttatattgctt

SEQ ID NO: 4532849 - DNA, 21 bp, Homo sapiens
catgttgatcatgtacttttt

SEQ ID NO: 4532850 - DNA, 18 bp, Homo sapiens
catgttgcactgtttgca

SEQ ID NO: 4532851 - DNA, 18 bp, Homo sapiens
catgttgcgttcaaagag

SEQ ID NO: 4532852 - DNA, 15 bp, Homo sapiens
catgttgctgaattt

SEQ ID NO: 4532853 - DNA, 16 bp, Homo sapiens
catgttggaaatgtgt

SEQ ID NO: 4532854 - DNA, 17 bp, Homo sapiens
catgttggaaatgtgtt

SEQ ID NO: 4532855 - DNA, 12 bp, Homo sapiens
catgttggacat

SEQ ID NO: 4532856 - DNA, 21 bp, Homo sapiens
catgttggccaggctggtctt

SEQ ID NO: 4532857 - DNA, 14 bp, Homo sapiens
catgttggcctctt

SEQ ID NO: 4532858 - DNA, 20 bp, Homo sapiens
catgttggtcaggctggtct

SEQ ID NO: 4532859 - DNA, 23 bp, Homo sapiens
catgttgttgtgtgtatatgtat

SEQ ID NO: 4532860 - DNA, 12 bp, Homo sapiens
catgtttataaa

SEQ ID NO: 4532861 - DNA, 17 bp, Homo sapiens
catgtttattctgttcc

SEQ ID NO: 4532862 - DNA, 19 bp, Homo sapiens
catgtttgagctcagaccc

SEQ ID NO: 4532863 - DNA, 20 bp, Homo sapiens
catgtttgagctcagacccc

SEQ ID NO: 4532864 - DNA, 22 bp, Homo sapiens
catgtttggtgtttgtctgtgt

SEQ ID NO: 4532865 - DNA, 23 bp, Homo sapiens
catgtttggtgtttgtctgtgtt

SEQ ID NO: 4532866 - DNA, 17 bp, Homo sapiens
catgttttaatgtagaa

SEQ ID NO: 4532867 - DNA, 13 bp, Homo sapiens
catgtttttgaaa

SEQ ID NO: 4532868 - DNA, 13 bp, Homo sapiens
catgttttttcat

SEQ ID NO: 4532869 - DNA, 14 bp, Homo sapiens
catgttttttcatt

SEQ ID NO: 4532870 - DNA, 19 bp, Homo sapiens
catgttttttcatttgtaa

SEQ ID NO: 4532871 - DNA, 19 bp, Homo sapiens
cattaaaaatgagatttct

SEQ ID NO: 4532872 - DNA, 19 bp, Homo sapiens
cattaaaatatagagacag

SEQ ID NO: 4532873 - DNA, 20 bp, Homo sapiens
cattaaaatatagagacagg

SEQ ID NO: 4532874 - DNA, 21 bp, Homo sapiens
cattaaaatttcttatttacc

SEQ ID NO: 4532875 - DNA, 14 bp, Homo sapiens
cattaaacaaataa

SEQ ID NO: 4532876 - DNA, 14 bp, Homo sapiens
cattaaactttttt

SEQ ID NO: 4532877 - DNA, 11 bp, Homo sapiens
cattaaatgaa

SEQ ID NO: 4532878 - DNA, 22 bp, Homo sapiens
cattaaatgaatattttgataa

SEQ ID NO: 4532879 - DNA, 14 bp, Homo sapiens
cattaaattcacaa

SEQ ID NO: 4532880 - DNA, 18 bp, Homo sapiens
cattaaattcacaaactt

SEQ ID NO: 4532881 - DNA, 21 bp, Homo sapiens
cattaaattcacaaactttta

SEQ ID NO: 4532882 - DNA, 13 bp, Homo sapiens
cattaacaaataa

SEQ ID NO: 4532883 - DNA, 15 bp, Homo sapiens
cattaacaaataaaa

SEQ ID NO: 4532884 - DNA, 16 bp, Homo sapiens
cattaacaaataaaaa

SEQ ID NO: 4532885 - DNA, 13 bp, Homo sapiens
cattaacattttt

SEQ ID NO: 4532886 - DNA, 21 bp, Homo sapiens
catctatgtgaatatttgtaa

SEQ ID NO: 4532887 - DNA, 16 bp, Homo sapiens
catctattttatttta

SEQ ID NO: 4532888 - DNA, 19 bp, Homo sapiens
catctattttgatgcagca

SEQ ID NO: 4532889 - DNA, 23 bp, Homo sapiens
catctattttgatgcagcatttg

SEQ ID NO: 4532890 - DNA, 15 bp, Homo sapiens
catctcagaccctgc

SEQ ID NO: 4532891 - DNA, 22 bp, Homo sapiens
catctcaggagatggagggctt

SEQ ID NO: 4532892 - DNA, 21 bp, Homo sapiens
catctcatcatgtctattgtc

SEQ ID NO: 4532893 - DNA, 18 bp, Homo sapiens
catctcatgagtgtgccc

SEQ ID NO: 4532894 - DNA, 18 bp, Homo sapiens
catctcatttaagggaaa

SEQ ID NO: 4532895 - DNA, 21 bp, Homo sapiens
catctcatttaagggaaaaat

SEQ ID NO: 4532896 - DNA, 21 bp, Homo sapiens
catctccaatggaaagctttt

SEQ ID NO: 4532897 - DNA, 21 bp, Homo sapiens
catctcccacgaactcaaggg

SEQ ID NO: 4532898 - DNA, 22 bp, Homo sapiens
catctcccacgaactcaagggt

SEQ ID NO: 4532899 - DNA, 22 bp, Homo sapiens
catctcccagataatgtgaaaa

SEQ ID NO: 4532900 - DNA, 12 bp, Homo sapiens
catctcccaggc

SEQ ID NO: 4532901 - DNA, 13 bp, Homo sapiens
catctcccaggcc

SEQ ID NO: 4532902 - DNA, 20 bp, Homo sapiens
catctcccaggccccagggg

SEQ ID NO: 4532903 - DNA, 15 bp, Homo sapiens
catctccctccccag

SEQ ID NO: 4532904 - DNA, 21 bp, Homo sapiens
catctccctccccagaaacag

SEQ ID NO: 4532905 - DNA, 16 bp, Homo sapiens
catctcctgccttcct

SEQ ID NO: 4532906 - DNA, 15 bp, Homo sapiens
catctctactaaaaa

SEQ ID NO: 4532907 - DNA, 20 bp, Homo sapiens
catctctccccatatataaa

SEQ ID NO: 4532908 - DNA, 13 bp, Homo sapiens
catctctctgccc

SEQ ID NO: 4532909 - DNA, 15 bp, Homo sapiens
catctctctgccctc

SEQ ID NO: 4532910 - DNA, 14 bp, Homo sapiens
catctctctggggc

SEQ ID NO: 4532911 - DNA, 12 bp, Homo sapiens
catctctgaagg

SEQ ID NO: 4532912 - DNA, 15 bp, Homo sapiens
catctcttccccaga

SEQ ID NO: 4532913 - DNA, 14 bp, Homo sapiens
catctctttaaaaa

SEQ ID NO: 4532914 - DNA, 14 bp, Homo sapiens
catctgaaagccac

SEQ ID NO: 4532915 - DNA, 16 bp, Homo sapiens
catctgaacacaacca

SEQ ID NO: 4532916 - DNA, 16 bp, Homo sapiens
catctgagtccagctc

SEQ ID NO: 4532917 - DNA, 18 bp, Homo sapiens
catctgagtccagctccc

SEQ ID NO: 4532918 - DNA, 14 bp, Homo sapiens
catctgatatctat

SEQ ID NO: 4532919 - DNA, 14 bp, Homo sapiens
catctgcaggacag

SEQ ID NO: 4532920 - DNA, 16 bp, Homo sapiens
catctgccccaggtac

SEQ ID NO: 4532921 - DNA, 22 bp, Homo sapiens
catctgccccaggtacacctcc

SEQ ID NO: 4532922 - DNA, 15 bp, Homo sapiens
catctgcccctcccc

SEQ ID NO: 4532923 - DNA, 16 bp, Homo sapiens
catctgcccctccccc

SEQ ID NO: 4532924 - DNA, 18 bp, Homo sapiens
catctgcccctcccccaa

SEQ ID NO: 4532925 - DNA, 19 bp, Homo sapiens
catctgcccctcccccaac

SEQ ID NO: 4532926 - DNA, 20 bp, Homo sapiens
catctgccttaaaaccaaag

SEQ ID NO: 4532927 - DNA, 21 bp, Homo sapiens
catctgcgggggcagtgctca

SEQ ID NO: 4532928 - DNA, 16 bp, Homo sapiens
catctgctaagtaatt

SEQ ID NO: 4532929 - DNA, 16 bp, Homo sapiens
catctgctctccttcc

SEQ ID NO: 4532930 - DNA, 18 bp, Homo sapiens
catctgctctccttcctg

SEQ ID NO: 4532931 - DNA, 17 bp, Homo sapiens
catctggagagaacagg

SEQ ID NO: 4532932 - DNA, 21 bp, Homo sapiens
catctggataggagcctgctg

SEQ ID NO: 4532933 - DNA, 14 bp, Homo sapiens
catctggctcagca

SEQ ID NO: 4532934 - DNA, 13 bp, Homo sapiens
catctgggacaaa

SEQ ID NO: 4532935 - DNA, 17 bp, Homo sapiens
catctgggacaaaactg

SEQ ID NO: 4532936 - DNA, 22 bp, Homo sapiens
catctggttgaactctggtggc

SEQ ID NO: 4532937 - DNA, 17 bp, Homo sapiens
catctgtacctctgcct

SEQ ID NO: 4532938 - DNA, 17 bp, Homo sapiens
catctgtcattatattc

SEQ ID NO: 4532939 - DNA, 12 bp, Homo sapiens
catctgtccagc

SEQ ID NO: 4532940 - DNA, 17 bp, Homo sapiens
catctgtccctgcctca

SEQ ID NO: 4532941 - DNA, 13 bp, Homo sapiens
catctgtttgtaa

SEQ ID NO: 4532942 - DNA, 16 bp, Homo sapiens
catctgtttgtaatca

SEQ ID NO: 4532943 - DNA, 13 bp, Homo sapiens
catcttaaaagct

SEQ ID NO: 4532944 - DNA, 12 bp, Homo sapiens
catcttaaacta

SEQ ID NO: 4532945 - DNA, 17 bp, Homo sapiens
catcttagttctgtata

SEQ ID NO: 4532946 - DNA, 23 bp, Homo sapiens
catcttagttctgtatataaata

SEQ ID NO: 4532947 - DNA, 22 bp, Homo sapiens
catcttcaatttattactgaaa

SEQ ID NO: 4532948 - DNA, 12 bp, Homo sapiens
catcttctggct

SEQ ID NO: 4532949 - DNA, 14 bp, Homo sapiens
catcttctggcttg

SEQ ID NO: 4532950 - DNA, 14 bp, Homo sapiens
catcttcttcacca

SEQ ID NO: 4532951 - DNA, 16 bp, Homo sapiens
catcttgagccacagt

SEQ ID NO: 4532952 - DNA, 21 bp, Homo sapiens
catcttgagccacagtcactg

SEQ ID NO: 4532953 - DNA, 18 bp, Homo sapiens
catcttgatctttgagcc

SEQ ID NO: 4532954 - DNA, 21 bp, Homo sapiens
catcttgatctttgagcccat

SEQ ID NO: 4532955 - DNA, 17 bp, Homo sapiens
catcttgctaccagtat

SEQ ID NO: 4532956 - DNA, 23 bp, Homo sapiens
catcttgctaccagtatttagaa

SEQ ID NO: 4532957 - DNA, 19 bp, Homo sapiens
catcttggtagttctgtgc

SEQ ID NO: 4532958 - DNA, 17 bp, Homo sapiens
catcttgtacaaacttt

SEQ ID NO: 4532959 - DNA, 21 bp, Homo sapiens
catcttgtacaaactttgttt

SEQ ID NO: 4532960 - DNA, 12 bp, Homo sapiens
catcttgtgaaa

SEQ ID NO: 4532961 - DNA, 13 bp, Homo sapiens
catcttgtgaaat

SEQ ID NO: 4532962 - DNA, 17 bp, Homo sapiens
catctttgccaagtaag

SEQ ID NO: 4532963 - DNA, 15 bp, Homo sapiens
catctttgccttggg

SEQ ID NO: 4532964 - DNA, 15 bp, Homo sapiens
catcttttattcttt

SEQ ID NO: 4532965 - DNA, 20 bp, Homo sapiens
catcttttctagagacacat

SEQ ID NO: 4532966 - DNA, 18 bp, Homo sapiens
catcttttgtattaagaa

SEQ ID NO: 4532967 - DNA, 19 bp, Homo sapiens
catcttttgtattaagaaa

SEQ ID NO: 4532968 - DNA, 23 bp, Homo sapiens
catctttttaaagcttatccata

SEQ ID NO: 4532969 - DNA, 22 bp, Homo sapiens
catctttttctagagttatctt

SEQ ID NO: 4532970 - DNA, 14 bp, Homo sapiens
catgaaaaacaaac

SEQ ID NO: 4532971 - DNA, 14 bp, Homo sapiens
catgaaaaagctgc

SEQ ID NO: 4532972 - DNA, 15 bp, Homo sapiens
catgaaaaagctgct

SEQ ID NO: 4532973 - DNA, 18 bp, Homo sapiens
catgaaaacacacataca

SEQ ID NO: 4532974 - DNA, 23 bp, Homo sapiens
catgaaaatagctatttttttcc

SEQ ID NO: 4532975 - DNA, 16 bp, Homo sapiens
catgaacatgttcctg

SEQ ID NO: 4532976 - DNA, 19 bp, Homo sapiens
catgaagatgtagaggaga

SEQ ID NO: 4532977 - DNA, 16 bp, Homo sapiens
catgaagcctgtggat

SEQ ID NO: 4532978 - DNA, 16 bp, Homo sapiens
catgaagccttttgaa

SEQ ID NO: 4532979 - DNA, 19 bp, Homo sapiens
catgaagccttttgaaagg

SEQ ID NO: 4532980 - DNA, 13 bp, Homo sapiens
catgaaggctgga

SEQ ID NO: 4532981 - DNA, 16 bp, Homo sapiens
catgaaggtaaataaa

SEQ ID NO: 4532982 - DNA, 19 bp, Homo sapiens
catgaagtaaattgaaagc

SEQ ID NO: 4532983 - DNA, 19 bp, Homo sapiens
catgaagtcgttgtgaggg

SEQ ID NO: 4532984 - DNA, 13 bp, Homo sapiens
catgaataaaatt

SEQ ID NO: 4532985 - DNA, 19 bp, Homo sapiens
catgaataaagcctttgta

SEQ ID NO: 4532986 - DNA, 18 bp, Homo sapiens
catgaataacatttaaat

SEQ ID NO: 4532987 - DNA, 19 bp, Homo sapiens
catgaataacatttaaatt

SEQ ID NO: 4532988 - DNA, 13 bp, Homo sapiens
catgaatattttc

SEQ ID NO: 4532989 - DNA, 22 bp, Homo sapiens
catgaattacctggatgttctt

SEQ ID NO: 4532990 - DNA, 21 bp, Homo sapiens
catgaattttaaagtatgcat

SEQ ID NO: 4532991 - DNA, 23 bp, Homo sapiens
catgacaagatgggacagcaaca

SEQ ID NO: 4532992 - DNA, 16 bp, Homo sapiens
catgacacttccaaag

SEQ ID NO: 4532993 - DNA, 22 bp, Homo sapiens
catgacagaggctgcacccctg

SEQ ID NO: 4532994 - DNA, 19 bp, Homo sapiens
catgacgacaaagctgcta

SEQ ID NO: 4532995 - DNA, 15 bp, Homo sapiens
catgacttccttatt

SEQ ID NO: 4532996 - DNA, 18 bp, Homo sapiens
catgactttatagttatg

SEQ ID NO: 4532997 - DNA, 16 bp, Homo sapiens
catgagaacaaacaga

SEQ ID NO: 4532998 - DNA, 16 bp, Homo sapiens
catgagcaagcctagg

SEQ ID NO: 4532999 - DNA, 19 bp, Homo sapiens
catgagccgcccaaggcct

SEQ ID NO: 4533000 - DNA, 13 bp, Homo sapiens
catgaggagggtg

SEQ ID NO: 4533001 - DNA, 20 bp, Homo sapiens
catgaggagggtgggggagg

SEQ ID NO: 4533002 - DNA, 15 bp, Homo sapiens
catgaggagttgctg

SEQ ID NO: 4533003 - DNA, 18 bp, Homo sapiens
catgaggccactggagac

SEQ ID NO: 4533004 - DNA, 16 bp, Homo sapiens
catgaggccatctcag

SEQ ID NO: 4533005 - DNA, 17 bp, Homo sapiens
catgaggccatctcagg

SEQ ID NO: 4533006 - DNA, 18 bp, Homo sapiens
catgaggccatctcagga

SEQ ID NO: 4533007 - DNA, 14 bp, Homo sapiens
catcaccatttcct

SEQ ID NO: 4533008 - DNA, 14 bp, Homo sapiens
catcacccttccga

SEQ ID NO: 4533009 - DNA, 17 bp, Homo sapiens
catcacctatttaatgt

SEQ ID NO: 4533010 - DNA, 18 bp, Homo sapiens
catcacctatttaatgtt

SEQ ID NO: 4533011 - DNA, 15 bp, Homo sapiens
catcacgacacattt

SEQ ID NO: 4533012 - DNA, 22 bp, Homo sapiens
catcactgatgggaataaaagt

SEQ ID NO: 4533013 - DNA, 18 bp, Homo sapiens
catcactgtaaagacaaa

SEQ ID NO: 4533014 - DNA, 20 bp, Homo sapiens
catcactgtaaagacaaata

SEQ ID NO: 4533015 - DNA, 21 bp, Homo sapiens
catcactgtaaagacaaataa

SEQ ID NO: 4533016 - DNA, 17 bp, Homo sapiens
catcacttctccccgca

SEQ ID NO: 4533017 - DNA, 22 bp, Homo sapiens
catcagaaaacagggtccagga

SEQ ID NO: 4533018 - DNA, 20 bp, Homo sapiens
catcagaaaggaaaaacaaa

SEQ ID NO: 4533019 - DNA, 23 bp, Homo sapiens
catcagaaggagaaggaaggaga

SEQ ID NO: 4533020 - DNA, 13 bp, Homo sapiens
catcagccctgct

SEQ ID NO: 4533021 - DNA, 11 bp, Homo sapiens
catcagccttc

SEQ ID NO: 4533022 - DNA, 12 bp, Homo sapiens
catcagctctgc

SEQ ID NO: 4533023 - DNA, 13 bp, Homo sapiens
catcagctgctga

SEQ ID NO: 4533024 - DNA, 17 bp, Homo sapiens
catcagctgctgaaaca

SEQ ID NO: 4533025 - DNA, 16 bp, Homo sapiens
catcaggaaagagagc

SEQ ID NO: 4533026 - DNA, 20 bp, Homo sapiens
catcagggcggcctcccagg

SEQ ID NO: 4533027 - DNA, 16 bp, Homo sapiens
catcagtacttttctc

SEQ ID NO: 4533028 - DNA, 16 bp, Homo sapiens
catcagtagcattttt

SEQ ID NO: 4533029 - DNA, 21 bp, Homo sapiens
catcagtggatggcaggaggt

SEQ ID NO: 4533030 - DNA, 21 bp, Homo sapiens
catcagttacagagaatttct

SEQ ID NO: 4533031 - DNA, 14 bp, Homo sapiens
catcagtttgttcc

SEQ ID NO: 4533032 - DNA, 13 bp, Homo sapiens
catcatcactgta

SEQ ID NO: 4533033 - DNA, 12 bp, Homo sapiens
catcatcagagc

SEQ ID NO: 4533034 - DNA, 21 bp, Homo sapiens
catcatctcctgccttcctcc

SEQ ID NO: 4533035 - DNA, 18 bp, Homo sapiens
catcatgagttctgctga

SEQ ID NO: 4533036 - DNA, 13 bp, Homo sapiens
catcatgcctgac

SEQ ID NO: 4533037 - DNA, 20 bp, Homo sapiens
catcatgcggtgggtgctgc

SEQ ID NO: 4533038 - DNA, 22 bp, Homo sapiens
catcatgctggaacctgcaaaa

SEQ ID NO: 4533039 - DNA, 12 bp, Homo sapiens
catcatgtctgt

SEQ ID NO: 4533040 - DNA, 17 bp, Homo sapiens
catcattattgtagttt

SEQ ID NO: 4533041 - DNA, 21 bp, Homo sapiens
catcattattgtagtttgaaa

SEQ ID NO: 4533042 - DNA, 12 bp, Homo sapiens
catcattctctg

SEQ ID NO: 4533043 - DNA, 14 bp, Homo sapiens
catcattctctgtc

SEQ ID NO: 4533044 - DNA, 17 bp, Homo sapiens
catcattctctgtctca

SEQ ID NO: 4533045 - DNA, 22 bp, Homo sapiens
catcattctctgtctcatccat

SEQ ID NO: 4533046 - DNA, 18 bp, Homo sapiens
catcattgtcagccttgc

SEQ ID NO: 4533047 - DNA, 13 bp, Homo sapiens
catcatttaaaca

SEQ ID NO: 4533048 - DNA, 20 bp, Homo sapiens
catcatttaaacatgcagaa

SEQ ID NO: 4533049 - DNA, 12 bp, Homo sapiens
catcatttcagc

SEQ ID NO: 4533050 - DNA, 16 bp, Homo sapiens
catcatttcagccaaa

SEQ ID NO: 4533051 - DNA, 22 bp, Homo sapiens
catccaagtctttcttcttttt

SEQ ID NO: 4533052 - DNA, 22 bp, Homo sapiens
catccacccgggggagcccagt

SEQ ID NO: 4533053 - DNA, 17 bp, Homo sapiens
catccactctaccctcc

SEQ ID NO: 4533054 - DNA, 19 bp, Homo sapiens
catccactctaccctccca

SEQ ID NO: 4533055 - DNA, 15 bp, Homo sapiens
catccagacctgagc

SEQ ID NO: 4533056 - DNA, 15 bp, Homo sapiens
catccagaggagctg

SEQ ID NO: 4533057 - DNA, 18 bp, Homo sapiens
catccagagtccctgcct

SEQ ID NO: 4533058 - DNA, 23 bp, Homo sapiens
catccagcagatttccagccttc

SEQ ID NO: 4533059 - DNA, 12 bp, Homo sapiens
catccaggctgg

SEQ ID NO: 4533060 - DNA, 14 bp, Homo sapiens
catccagtctattc

SEQ ID NO: 4533061 - DNA, 21 bp, Homo sapiens
catccagtttgttctccgggt

SEQ ID NO: 4533062 - DNA, 14 bp, Homo sapiens
catccatgcctcag

SEQ ID NO: 4533063 - DNA, 23 bp, Homo sapiens
catccatgcctcagaagtgcatc

SEQ ID NO: 4533064 - DNA, 13 bp, Homo sapiens
catccattaatta

SEQ ID NO: 4533065 - DNA, 21 bp, Homo sapiens
catcccaaggcaagcatgaat

SEQ ID NO: 4533066 - DNA, 12 bp, Homo sapiens
catcccattgcc

SEQ ID NO: 4533067 - DNA, 12 bp, Homo sapiens
catccccagggg

SEQ ID NO: 4533068 - DNA, 18 bp, Homo sapiens
catccccaggggtcccag

SEQ ID NO: 4533069 - DNA, 21 bp, Homo sapiens
catcccccacctactctcagg

SEQ ID NO: 4533070 - DNA, 16 bp, Homo sapiens
catcccctccctgcct

SEQ ID NO: 4533071 - DNA, 22 bp, Homo sapiens
catcccctccctgcctgctcct

SEQ ID NO: 4533072 - DNA, 19 bp, Homo sapiens
catccccttcccccatccc

SEQ ID NO: 4533073 - DNA, 17 bp, Homo sapiens
catcccgtatcacagtg

SEQ ID NO: 4533074 - DNA, 16 bp, Homo sapiens
catccctaccactgtg

SEQ ID NO: 4533075 - DNA, 14 bp, Homo sapiens
catccctcacccat

SEQ ID NO: 4533076 - DNA, 14 bp, Homo sapiens
catccctccttaag

SEQ ID NO: 4533077 - DNA, 16 bp, Homo sapiens
catccctccttgccta

SEQ ID NO: 4533078 - DNA, 21 bp, Homo sapiens
catccctgactggccaaaccc

SEQ ID NO: 4533079 - DNA, 19 bp, Homo sapiens
catccctgcttgcccgctc

SEQ ID NO: 4533080 - DNA, 21 bp, Homo sapiens
catccctggacttctgggaga

SEQ ID NO: 4533081 - DNA, 17 bp, Homo sapiens
catcccttcccacatgc

SEQ ID NO: 4533082 - DNA, 15 bp, Homo sapiens
catccctttttcaat

SEQ ID NO: 4533083 - DNA, 21 bp, Homo sapiens
catccctttttttacatttca

SEQ ID NO: 4533084 - DNA, 13 bp, Homo sapiens
catccgcaggtgc

SEQ ID NO: 4533085 - DNA, 17 bp, Homo sapiens
catccgtagttccctga

SEQ ID NO: 4533086 - DNA, 15 bp, Homo sapiens
catccgtcccacatc

SEQ ID NO: 4533087 - DNA, 14 bp, Homo sapiens
catccgttgtgact

SEQ ID NO: 4533088 - DNA, 18 bp, Homo sapiens
catcctaaggttcttgct

SEQ ID NO: 4533089 - DNA, 22 bp, Homo sapiens
catcctaaggttcttgctttct

SEQ ID NO: 4533090 - DNA, 23 bp, Homo sapiens
catcctaaggttcttgctttctc

SEQ ID NO: 4533091 - DNA, 14 bp, Homo sapiens
catcctcaaagaaa

SEQ ID NO: 4533092 - DNA, 20 bp, Homo sapiens
catcctcaaagaaagtgtat

SEQ ID NO: 4533093 - DNA, 16 bp, Homo sapiens
catcctcatccctgac

SEQ ID NO: 4533094 - DNA, 19 bp, Homo sapiens
catcctccaaacctggcct

SEQ ID NO: 4533095 - DNA, 17 bp, Homo sapiens
catcctccagatagtgt

SEQ ID NO: 4533096 - DNA, 17 bp, Homo sapiens
catcctcccattgccca

SEQ ID NO: 4533097 - DNA, 18 bp, Homo sapiens
catcctcccattgcccag

SEQ ID NO: 4533098 - DNA, 21 bp, Homo sapiens
catcctccctccacctcaaga

SEQ ID NO: 4533099 - DNA, 19 bp, Homo sapiens
catcctccgtccagccgcc

SEQ ID NO: 4533100 - DNA, 11 bp, Homo sapiens
catcctctttc

SEQ ID NO: 4533101 - DNA, 21 bp, Homo sapiens
catcctctttctcttttctag

SEQ ID NO: 4533102 - DNA, 19 bp, Homo sapiens
catcctgatttttactatc

SEQ ID NO: 4533103 - DNA, 17 bp, Homo sapiens
catcctgccatcctcaa

SEQ ID NO: 4533104 - DNA, 22 bp, Homo sapiens
catcctgctgcccttaggccac

SEQ ID NO: 4533105 - DNA, 15 bp, Homo sapiens
catcctggcccaggg

SEQ ID NO: 4533106 - DNA, 23 bp, Homo sapiens
catccttagatgggacgcataat

SEQ ID NO: 4533107 - DNA, 21 bp, Homo sapiens
catcgaatctactaattccac

SEQ ID NO: 4533108 - DNA, 13 bp, Homo sapiens
catcgcagcttcc

SEQ ID NO: 4533109 - DNA, 15 bp, Homo sapiens
catcgcagcttcctg

SEQ ID NO: 4533110 - DNA, 18 bp, Homo sapiens
catcgcagcttcctgtct

SEQ ID NO: 4533111 - DNA, 18 bp, Homo sapiens
catcgctgttctgggcat

SEQ ID NO: 4533112 - DNA, 16 bp, Homo sapiens
catcggaaaaataatc

SEQ ID NO: 4533113 - DNA, 20 bp, Homo sapiens
catcggacaagacccccagc

SEQ ID NO: 4533114 - DNA, 23 bp, Homo sapiens
catcggaggctgggcccctggga

SEQ ID NO: 4533115 - DNA, 13 bp, Homo sapiens
catcgggaaagaa

SEQ ID NO: 4533116 - DNA, 13 bp, Homo sapiens
catcgtcctggga

SEQ ID NO: 4533117 - DNA, 23 bp, Homo sapiens
catcgtcctgggactcggagact

SEQ ID NO: 4533118 - DNA, 12 bp, Homo sapiens
catctaaagctt

SEQ ID NO: 4533119 - DNA, 15 bp, Homo sapiens
catctaaagctttat

SEQ ID NO: 4533120 - DNA, 18 bp, Homo sapiens
catctaaagctttatctt

SEQ ID NO: 4533121 - DNA, 22 bp, Homo sapiens
catctaactgatgagtaaactg

SEQ ID NO: 4533122 - DNA, 16 bp, Homo sapiens
catctaataaatcagt

SEQ ID NO: 4533123 - DNA, 16 bp, Homo sapiens
catctatctcaatcct

SEQ ID NO: 4533124 - DNA, 19 bp, Homo sapiens
catctatctggtgatttct

SEQ ID NO: 4533125 - DNA, 23 bp, Homo sapiens
catctatgagggtgtttcctcta

SEQ ID NO: 4533126 - DNA, 17 bp, Homo sapiens
catctatgtgaatattt

SEQ ID NO: 4533127 - DNA, 16 bp, Homo sapiens
catacttaacatttca

SEQ ID NO: 4533128 - DNA, 14 bp, Homo sapiens
catactttcatcct

SEQ ID NO: 4533129 - DNA, 22 bp, Homo sapiens
catactttcatcctgactctgc

SEQ ID NO: 4533130 - DNA, 22 bp, Homo sapiens
catactttgtaaataggatttt

SEQ ID NO: 4533131 - DNA, 22 bp, Homo sapiens
catagaaaattgaaacacagag

SEQ ID NO: 4533132 - DNA, 23 bp, Homo sapiens
catagaaatggaaattttgctat

SEQ ID NO: 4533133 - DNA, 16 bp, Homo sapiens
catagaaggaagtgtg

SEQ ID NO: 4533134 - DNA, 23 bp, Homo sapiens
catagaaggaagtgtgtttgcct

SEQ ID NO: 4533135 - DNA, 15 bp, Homo sapiens
catagacaaaggcct

SEQ ID NO: 4533136 - DNA, 19 bp, Homo sapiens
catagacaattcctccaga

SEQ ID NO: 4533137 - DNA, 11 bp, Homo sapiens
catagacacag

SEQ ID NO: 4533138 - DNA, 12 bp, Homo sapiens
catagacacagt

SEQ ID NO: 4533139 - DNA, 16 bp, Homo sapiens
catagactagagaaac

SEQ ID NO: 4533140 - DNA, 17 bp, Homo sapiens
catagactagagaaacc

SEQ ID NO: 4533141 - DNA, 20 bp, Homo sapiens
catagagatgagcccaccct

SEQ ID NO: 4533142 - DNA, 22 bp, Homo sapiens
catagagctttttaatagcact

SEQ ID NO: 4533143 - DNA, 23 bp, Homo sapiens
catagagctttttaatagcacta

SEQ ID NO: 4533144 - DNA, 21 bp, Homo sapiens
catagaggcttctccgccagc

SEQ ID NO: 4533145 - DNA, 15 bp, Homo sapiens
catagattcacctgt

SEQ ID NO: 4533146 - DNA, 21 bp, Homo sapiens
catagattcacctgtaaaact

SEQ ID NO: 4533147 - DNA, 17 bp, Homo sapiens
catagattccctgagca

SEQ ID NO: 4533148 - DNA, 18 bp, Homo sapiens
catagattccctgagcag

SEQ ID NO: 4533149 - DNA, 17 bp, Homo sapiens
catagcaagcttttgct

SEQ ID NO: 4533150 - DNA, 14 bp, Homo sapiens
catagcagatctgt

SEQ ID NO: 4533151 - DNA, 19 bp, Homo sapiens
catagcaggggcaccttcc

SEQ ID NO: 4533152 - DNA, 13 bp, Homo sapiens
catagccccagta

SEQ ID NO: 4533153 - DNA, 17 bp, Homo sapiens
catagctacaatttgtt

SEQ ID NO: 4533154 - DNA, 12 bp, Homo sapiens
catagctcactg

SEQ ID NO: 4533155 - DNA, 21 bp, Homo sapiens
catagctgtacttcttgaata

SEQ ID NO: 4533156 - DNA, 20 bp, Homo sapiens
catagtaagttcagcacttg

SEQ ID NO: 4533157 - DNA, 21 bp, Homo sapiens
catagtcagcagcagctctga

SEQ ID NO: 4533158 - DNA, 17 bp, Homo sapiens
catagtccccagagctc

SEQ ID NO: 4533159 - DNA, 20 bp, Homo sapiens
catagtctgaagtgaagtac

SEQ ID NO: 4533160 - DNA, 19 bp, Homo sapiens
catagtcttgaaatgaaag

SEQ ID NO: 4533161 - DNA, 20 bp, Homo sapiens
catagtcttgaaatgaaagg

SEQ ID NO: 4533162 - DNA, 18 bp, Homo sapiens
catagtctttgtttacat

SEQ ID NO: 4533163 - DNA, 20 bp, Homo sapiens
catagtgagacactgtctct

SEQ ID NO: 4533164 - DNA, 20 bp, Homo sapiens
catagttgtagacaaagtac

SEQ ID NO: 4533165 - DNA, 21 bp, Homo sapiens
catagttgtagacaaagtaca

SEQ ID NO: 4533166 - DNA, 22 bp, Homo sapiens
catagtttttcatcaagagttt

SEQ ID NO: 4533167 - DNA, 17 bp, Homo sapiens
catataaaactgtttca

SEQ ID NO: 4533168 - DNA, 15 bp, Homo sapiens
catataaatgtttat

SEQ ID NO: 4533169 - DNA, 16 bp, Homo sapiens
catataaatgtttata

SEQ ID NO: 4533170 - DNA, 15 bp, Homo sapiens
catatatgctgtatt

SEQ ID NO: 4533171 - DNA, 16 bp, Homo sapiens
catatatgctgtattt

SEQ ID NO: 4533172 - DNA, 17 bp, Homo sapiens
catatatgctgtatttc

SEQ ID NO: 4533173 - DNA, 13 bp, Homo sapiens
catatattgcttt

SEQ ID NO: 4533174 - DNA, 14 bp, Homo sapiens
catatcacacacat

SEQ ID NO: 4533175 - DNA, 13 bp, Homo sapiens
catatcagttgag

SEQ ID NO: 4533176 - DNA, 20 bp, Homo sapiens
catatcatccacacatgaat

SEQ ID NO: 4533177 - DNA, 18 bp, Homo sapiens
catatcattaaacaaata

SEQ ID NO: 4533178 - DNA, 14 bp, Homo sapiens
catatcatttctta

SEQ ID NO: 4533179 - DNA, 19 bp, Homo sapiens
catatcctttggtcctggt

SEQ ID NO: 4533180 - DNA, 18 bp, Homo sapiens
catatctccatggccctg

SEQ ID NO: 4533181 - DNA, 23 bp, Homo sapiens
catatctccatggccctgtccca

SEQ ID NO: 4533182 - DNA, 14 bp, Homo sapiens
catatctccttccc

SEQ ID NO: 4533183 - DNA, 15 bp, Homo sapiens
catatctccttcccc

SEQ ID NO: 4533184 - DNA, 18 bp, Homo sapiens
catatgaaaatacaactt

SEQ ID NO: 4533185 - DNA, 19 bp, Homo sapiens
catatgaaaggtgccatgg

SEQ ID NO: 4533186 - DNA, 22 bp, Homo sapiens
catatgagaatataccttattt

SEQ ID NO: 4533187 - DNA, 17 bp, Homo sapiens
catatgaggacctttat

SEQ ID NO: 4533188 - DNA, 22 bp, Homo sapiens
catatgagtaagggcactgacg

SEQ ID NO: 4533189 - DNA, 20 bp, Homo sapiens
catatgcagaaatagacaaa

SEQ ID NO: 4533190 - DNA, 21 bp, Homo sapiens
catatgctccaggatctttga

SEQ ID NO: 4533191 - DNA, 21 bp, Homo sapiens
catatgggatattcccaagcc

SEQ ID NO: 4533192 - DNA, 22 bp, Homo sapiens
catatgggatattcccaagccg

SEQ ID NO: 4533193 - DNA, 17 bp, Homo sapiens
catatgtagccttcaca

SEQ ID NO: 4533194 - DNA, 22 bp, Homo sapiens
catatgtctataacaaaagcaa

SEQ ID NO: 4533195 - DNA, 19 bp, Homo sapiens
catatgttgaatacttttt

SEQ ID NO: 4533196 - DNA, 14 bp, Homo sapiens
catatgtttggtaa

SEQ ID NO: 4533197 - DNA, 16 bp, Homo sapiens
catattattttagtgt

SEQ ID NO: 4533198 - DNA, 18 bp, Homo sapiens
catattattttagtgtgt

SEQ ID NO: 4533199 - DNA, 16 bp, Homo sapiens
catattcaactattct

SEQ ID NO: 4533200 - DNA, 18 bp, Homo sapiens
catattcaactattcttc

SEQ ID NO: 4533201 - DNA, 20 bp, Homo sapiens
catattcaactattcttcat

SEQ ID NO: 4533202 - DNA, 17 bp, Homo sapiens
catattcatgaaatgtg

SEQ ID NO: 4533203 - DNA, 19 bp, Homo sapiens
catattccctgcacacaca

SEQ ID NO: 4533204 - DNA, 15 bp, Homo sapiens
catattgaaaagcac

SEQ ID NO: 4533205 - DNA, 16 bp, Homo sapiens
catattgaaaagcaca

SEQ ID NO: 4533206 - DNA, 19 bp, Homo sapiens
catattgatctttttatca

SEQ ID NO: 4533207 - DNA, 21 bp, Homo sapiens
catattgatctttttatcatg

SEQ ID NO: 4533208 - DNA, 17 bp, Homo sapiens
catattgtaaaacaggt

SEQ ID NO: 4533209 - DNA, 20 bp, Homo sapiens
catattgtgattctgccttt

SEQ ID NO: 4533210 - DNA, 18 bp, Homo sapiens
catatttaatgttttaaa

SEQ ID NO: 4533211 - DNA, 21 bp, Homo sapiens
catatttaatgttttaaatgt

SEQ ID NO: 4533212 - DNA, 11 bp, Homo sapiens
catatttagct

SEQ ID NO: 4533213 - DNA, 13 bp, Homo sapiens
catatttatactt

SEQ ID NO: 4533214 - DNA, 14 bp, Homo sapiens
catatttatacttt

SEQ ID NO: 4533215 - DNA, 18 bp, Homo sapiens
catatttcagtgattttt

SEQ ID NO: 4533216 - DNA, 12 bp, Homo sapiens
catatttgctaa

SEQ ID NO: 4533217 - DNA, 16 bp, Homo sapiens
catatttgtatgtttt

SEQ ID NO: 4533218 - DNA, 23 bp, Homo sapiens
catatttgtttatggtaaaaaat

SEQ ID NO: 4533219 - DNA, 13 bp, Homo sapiens
catattttaaaat

SEQ ID NO: 4533220 - DNA, 22 bp, Homo sapiens
catattttaatcattatttgag

SEQ ID NO: 4533221 - DNA, 19 bp, Homo sapiens
catattttcttacttttat

SEQ ID NO: 4533222 - DNA, 17 bp, Homo sapiens
catatttttatacttta

SEQ ID NO: 4533223 - DNA, 19 bp, Homo sapiens
catattttttatatctgga

SEQ ID NO: 4533224 - DNA, 19 bp, Homo sapiens
catcaaagactccgagaag

SEQ ID NO: 4533225 - DNA, 18 bp, Homo sapiens
catcaaaggaatataaga

SEQ ID NO: 4533226 - DNA, 23 bp, Homo sapiens
catcaaagtggtaaatactgtga

SEQ ID NO: 4533227 - DNA, 12 bp, Homo sapiens
catcaactgaat

SEQ ID NO: 4533228 - DNA, 17 bp, Homo sapiens
catcaagactatctaca

SEQ ID NO: 4533229 - DNA, 18 bp, Homo sapiens
catcaagactatctacaa

SEQ ID NO: 4533230 - DNA, 19 bp, Homo sapiens
catcaagactatctacaaa

SEQ ID NO: 4533231 - DNA, 21 bp, Homo sapiens
catcaagactatctacaaaaa

SEQ ID NO: 4533232 - DNA, 20 bp, Homo sapiens
catcaagagtttattattgt

SEQ ID NO: 4533233 - DNA, 22 bp, Homo sapiens
catcaagctccaccctcctggc

SEQ ID NO: 4533234 - DNA, 21 bp, Homo sapiens
catcaagtccatctgacaaaa

SEQ ID NO: 4533235 - DNA, 14 bp, Homo sapiens
catcaatcttgtta

SEQ ID NO: 4533236 - DNA, 17 bp, Homo sapiens
catcaatcttgttactg

SEQ ID NO: 4533237 - DNA, 19 bp, Homo sapiens
catcaatcttgttactgct

SEQ ID NO: 4533238 - DNA, 13 bp, Homo sapiens
catcaatggcttt

SEQ ID NO: 4533239 - DNA, 17 bp, Homo sapiens
catcacacctgccctaa

SEQ ID NO: 4533240 - DNA, 14 bp, Homo sapiens
catcacacttatat

SEQ ID NO: 4533241 - DNA, 19 bp, Homo sapiens
catcacacttatattttat

SEQ ID NO: 4533242 - DNA, 18 bp, Homo sapiens
catcacagaccccagctg

SEQ ID NO: 4533243 - DNA, 22 bp, Homo sapiens
catcacagggttgggcccagat

SEQ ID NO: 4533244 - DNA, 15 bp, Homo sapiens
catcacatcttattt

SEQ ID NO: 4533245 - DNA, 14 bp, Homo sapiens
catcaccagagtct

SEQ ID NO: 4533246 - DNA, 17 bp, Homo sapiens
ccaggccctccctgact

SEQ ID NO: 4533247 - DNA, 14 bp, Homo sapiens
ccaggccctgagat

SEQ ID NO: 4533248 - DNA, 15 bp, Homo sapiens
ccaggccggcccaga

SEQ ID NO: 4533249 - DNA, 18 bp, Homo sapiens
ccaggcctctctctgctc

SEQ ID NO: 4533250 - DNA, 18 bp, Homo sapiens
ccaggcctctgctggctc

SEQ ID NO: 4533251 - DNA, 18 bp, Homo sapiens
ccaggcctcttggcagtc

SEQ ID NO: 4533252 - DNA, 16 bp, Homo sapiens
ccaggcctgcctccca

SEQ ID NO: 4533253 - DNA, 13 bp, Homo sapiens
ccaggcctggctg

SEQ ID NO: 4533254 - DNA, 19 bp, Homo sapiens
ccaggcctgtccaccctgc

SEQ ID NO: 4533255 - DNA, 13 bp, Homo sapiens
ccaggccttgtcc

SEQ ID NO: 4533256 - DNA, 17 bp, Homo sapiens
ccaggcgctgcatacag

SEQ ID NO: 4533257 - DNA, 24 bp, Homo sapiens
ccaggctaatttttttgtatttta

SEQ ID NO: 4533258 - DNA, 18 bp, Homo sapiens
ccaggctcgtggactgag

SEQ ID NO: 4533259 - DNA, 21 bp, Homo sapiens
ccaggctctcgctgccctgtg

SEQ ID NO: 4533260 - DNA, 14 bp, Homo sapiens
ccaggctctgtgct

SEQ ID NO: 4533261 - DNA, 19 bp, Homo sapiens
ccaggctctgtgctgaccc

SEQ ID NO: 4533262 - DNA, 23 bp, Homo sapiens
ccaggctctgtgctgaccctcct

SEQ ID NO: 4533263 - DNA, 14 bp, Homo sapiens
ccaggctgcctcct

SEQ ID NO: 4533264 - DNA, 11 bp, Homo sapiens
ccaggctggac

SEQ ID NO: 4533265 - DNA, 22 bp, Homo sapiens
ccaggctggactgcagtggcct

SEQ ID NO: 4533266 - DNA, 18 bp, Homo sapiens
ccaggctggagtgcagtg

SEQ ID NO: 4533267 - DNA, 17 bp, Homo sapiens
ccaggctggccagtgct

SEQ ID NO: 4533268 - DNA, 11 bp, Homo sapiens
ccaggctggga

SEQ ID NO: 4533269 - DNA, 13 bp, Homo sapiens
ccaggctgtttca

SEQ ID NO: 4533270 - DNA, 18 bp, Homo sapiens
ccaggctttgtacagagt

SEQ ID NO: 4533271 - DNA, 15 bp, Homo sapiens
ccaggcttttctcag

SEQ ID NO: 4533272 - DNA, 19 bp, Homo sapiens
ccagggaaacagcctctct

SEQ ID NO: 4533273 - DNA, 17 bp, Homo sapiens
ccagggaagctggccga

SEQ ID NO: 4533274 - DNA, 22 bp, Homo sapiens
ccagggaaggtggccacagcaa

SEQ ID NO: 4533275 - DNA, 17 bp, Homo sapiens
ccagggaattcttacag

SEQ ID NO: 4533276 - DNA, 22 bp, Homo sapiens
ccagggaattcttacagccaag

SEQ ID NO: 4533277 - DNA, 21 bp, Homo sapiens
ccagggacaccagccaggctc

SEQ ID NO: 4533278 - DNA, 14 bp, Homo sapiens
ccagggaccttgga

SEQ ID NO: 4533279 - DNA, 17 bp, Homo sapiens
ccagggaggaaggaggc

SEQ ID NO: 4533280 - DNA, 19 bp, Homo sapiens
ccagggaggaaggaggcca

SEQ ID NO: 4533281 - DNA, 17 bp, Homo sapiens
ccagggagtccagggtt

SEQ ID NO: 4533282 - DNA, 15 bp, Homo sapiens
ccagggatcacagac

SEQ ID NO: 4533283 - DNA, 16 bp, Homo sapiens
ccagggatcacagacc

SEQ ID NO: 4533284 - DNA, 21 bp, Homo sapiens
ccagggatcacagaccacagg

SEQ ID NO: 4533285 - DNA, 16 bp, Homo sapiens
ccagggatgagccaaa

SEQ ID NO: 4533286 - DNA, 18 bp, Homo sapiens
ccagggatgctgggctgg

SEQ ID NO: 4533287 - DNA, 21 bp, Homo sapiens
ccagggatgctgggctgggcc

SEQ ID NO: 4533288 - DNA, 23 bp, Homo sapiens
ccagggatgctgggctgggccct

SEQ ID NO: 4533289 - DNA, 15 bp, Homo sapiens
ccagggatgggcagc

SEQ ID NO: 4533290 - DNA, 17 bp, Homo sapiens
ccagggatgggggatgg

SEQ ID NO: 4533291 - DNA, 14 bp, Homo sapiens
ccagggcaagagag

SEQ ID NO: 4533292 - DNA, 16 bp, Homo sapiens
ccagggcactgccagc

SEQ ID NO: 4533293 - DNA, 17 bp, Homo sapiens
ccagggcactgccagcc

SEQ ID NO: 4533294 - DNA, 12 bp, Homo sapiens
ccagggcagggc

SEQ ID NO: 4533295 - DNA, 23 bp, Homo sapiens
ccagggcagggcgagctgcagga

SEQ ID NO: 4533296 - DNA, 19 bp, Homo sapiens
ccagggccacgtgccaggc

SEQ ID NO: 4533297 - DNA, 12 bp, Homo sapiens
ccagggccccca

SEQ ID NO: 4533298 - DNA, 14 bp, Homo sapiens
ccagggcccccacc

SEQ ID NO: 4533299 - DNA, 13 bp, Homo sapiens
ccagggcccccca

SEQ ID NO: 4533300 - DNA, 20 bp, Homo sapiens
ccagggcctgacttgagcca

SEQ ID NO: 4533301 - DNA, 19 bp, Homo sapiens
ccagggctccaggagcctc

SEQ ID NO: 4533302 - DNA, 21 bp, Homo sapiens
ccagggctccaggagcctcat

SEQ ID NO: 4533303 - DNA, 16 bp, Homo sapiens
ccagggctggactgag

SEQ ID NO: 4533304 - DNA, 18 bp, Homo sapiens
ccagggctggactgaggc

SEQ ID NO: 4533305 - DNA, 19 bp, Homo sapiens
ccagggctggactgaggcc

SEQ ID NO: 4533306 - DNA, 14 bp, Homo sapiens
ccagggctggggac

SEQ ID NO: 4533307 - DNA, 13 bp, Homo sapiens
ccagggctggggt

SEQ ID NO: 4533308 - DNA, 19 bp, Homo sapiens
ccagggctggggttgccag

SEQ ID NO: 4533309 - DNA, 22 bp, Homo sapiens
ccagggctggggttgccagagg

SEQ ID NO: 4533310 - DNA, 15 bp, Homo sapiens
ccagggcttcctcaa

SEQ ID NO: 4533311 - DNA, 15 bp, Homo sapiens
ccaggggaacctgcc

SEQ ID NO: 4533312 - DNA, 16 bp, Homo sapiens
ccaggggaacctgcca

SEQ ID NO: 4533313 - DNA, 17 bp, Homo sapiens
ccaggggaacctgccat

SEQ ID NO: 4533314 - DNA, 16 bp, Homo sapiens
ccaggggaaggccctg

SEQ ID NO: 4533315 - DNA, 18 bp, Homo sapiens
ccaggggaaggccctgag

SEQ ID NO: 4533316 - DNA, 14 bp, Homo sapiens
ccaggggcagccac

SEQ ID NO: 4533317 - DNA, 21 bp, Homo sapiens
ccaggggcagccacaccactg

SEQ ID NO: 4533318 - DNA, 19 bp, Homo sapiens
ccaggggcccaaggcggcc

SEQ ID NO: 4533319 - DNA, 22 bp, Homo sapiens
ccaggggcccaaggcggcccct

SEQ ID NO: 4533320 - DNA, 23 bp, Homo sapiens
ccaggggggacaatatgtgccaa

SEQ ID NO: 4533321 - DNA, 14 bp, Homo sapiens
ccaggggtcccagc

SEQ ID NO: 4533322 - DNA, 17 bp, Homo sapiens
ccaggggtcccagccac

SEQ ID NO: 4533323 - DNA, 15 bp, Homo sapiens
ccaggggtctccctg

SEQ ID NO: 4533324 - DNA, 18 bp, Homo sapiens
ccaggggtctccctggct

SEQ ID NO: 4533325 - DNA, 15 bp, Homo sapiens
ccaggggtgctcctg

SEQ ID NO: 4533326 - DNA, 16 bp, Homo sapiens
ccagggtagcccgcct

SEQ ID NO: 4533327 - DNA, 20 bp, Homo sapiens
ccagggtagcccgcctgcca

SEQ ID NO: 4533328 - DNA, 22 bp, Homo sapiens
ccagggtagcccgcctgccagt

SEQ ID NO: 4533329 - DNA, 16 bp, Homo sapiens
ccagggtcaggcggag

SEQ ID NO: 4533330 - DNA, 15 bp, Homo sapiens
ccagggtcctctctt

SEQ ID NO: 4533331 - DNA, 23 bp, Homo sapiens
ccagggtcttccctacctcaggc

SEQ ID NO: 4533332 - DNA, 15 bp, Homo sapiens
ccagggtggccacac

SEQ ID NO: 4533333 - DNA, 18 bp, Homo sapiens
ccagggtggccacacctc

SEQ ID NO: 4533334 - DNA, 14 bp, Homo sapiens
ccagggtgtctcta

SEQ ID NO: 4533335 - DNA, 21 bp, Homo sapiens
ccagggttgaccccagaggat

SEQ ID NO: 4533336 - DNA, 13 bp, Homo sapiens
ccaggtacacctc

SEQ ID NO: 4533337 - DNA, 16 bp, Homo sapiens
ccaggtacacctcccc

SEQ ID NO: 4533338 - DNA, 20 bp, Homo sapiens
ccaggtacacctccccctgc

SEQ ID NO: 4533339 - DNA, 15 bp, Homo sapiens
ccaggtaccagctgc

SEQ ID NO: 4533340 - DNA, 19 bp, Homo sapiens
ccaggtaccagctgcgctt

SEQ ID NO: 4533341 - DNA, 16 bp, Homo sapiens
ccaggtatcaaatcaa

SEQ ID NO: 4533342 - DNA, 19 bp, Homo sapiens
ccaggtatccaaaaatgtg

SEQ ID NO: 4533343 - DNA, 13 bp, Homo sapiens
ccaggtcccagcc

SEQ ID NO: 4533344 - DNA, 16 bp, Homo sapiens
ccaggtcccagcccct

SEQ ID NO: 4533345 - DNA, 18 bp, Homo sapiens
ccaggtccgtagctcccc

SEQ ID NO: 4533346 - DNA, 19 bp, Homo sapiens
ccaggtccgtagctcccct

SEQ ID NO: 4533347 - DNA, 21 bp, Homo sapiens
ccaggtccgtagctcccctgg

SEQ ID NO: 4533348 - DNA, 23 bp, Homo sapiens
ccaggtctgggaagctgagggca

SEQ ID NO: 4533349 - DNA, 20 bp, Homo sapiens
ccaggtgacacgcttctgag

SEQ ID NO: 4533350 - DNA, 12 bp, Homo sapiens
ccaggtgccagt

SEQ ID NO: 4533351 - DNA, 17 bp, Homo sapiens
ccaggtgccgacactga

SEQ ID NO: 4533352 - DNA, 19 bp, Homo sapiens
ccaggtgccgacactgagc

SEQ ID NO: 4533353 - DNA, 14 bp, Homo sapiens
ccaggtgccttgga

SEQ ID NO: 4533354 - DNA, 18 bp, Homo sapiens
ccaggtgcctttcaaatt

SEQ ID NO: 4533355 - DNA, 17 bp, Homo sapiens
ccaggtggcacctgcag

SEQ ID NO: 4533356 - DNA, 22 bp, Homo sapiens
ccaggtggcacctgcagcggct

SEQ ID NO: 4533357 - DNA, 16 bp, Homo sapiens
ccaggtggctgaccca

SEQ ID NO: 4533358 - DNA, 22 bp, Homo sapiens
ccaggtggctgacccagtccct

SEQ ID NO: 4533359 - DNA, 21 bp, Homo sapiens
ccaggtgttactgtaattcct

SEQ ID NO: 4533360 - DNA, 17 bp, Homo sapiens
ccaggttaggaaggcag

SEQ ID NO: 4533361 - DNA, 13 bp, Homo sapiens
ccaggttcagtgc

SEQ ID NO: 4533362 - DNA, 13 bp, Homo sapiens
ccagtacttctaa

SEQ ID NO: 4533363 - DNA, 20 bp, Homo sapiens
ccagtaggactcaaggtgga

SEQ ID NO: 4533364 - DNA, 15 bp, Homo sapiens
ccagtatgttttaac

SEQ ID NO: 4533365 - DNA, 17 bp, Homo sapiens
ccagtatgttttaacaa

SEQ ID NO: 4533366 - DNA, 14 bp, Homo sapiens
ccagtattgccccc

SEQ ID NO: 4533367 - DNA, 20 bp, Homo sapiens
ccagcactaaggccgtgtct

SEQ ID NO: 4533368 - DNA, 22 bp, Homo sapiens
ccagcactaaggccgtgtctct

SEQ ID NO: 4533369 - DNA, 21 bp, Homo sapiens
ccagcactatgctttccttct

SEQ ID NO: 4533370 - DNA, 12 bp, Homo sapiens
ccagcactgagg

SEQ ID NO: 4533371 - DNA, 17 bp, Homo sapiens
ccagcactgaggaagaa

SEQ ID NO: 4533372 - DNA, 14 bp, Homo sapiens
ccagcagagccagg

SEQ ID NO: 4533373 - DNA, 17 bp, Homo sapiens
ccagcagagccagggca

SEQ ID NO: 4533374 - DNA, 18 bp, Homo sapiens
ccagcagagccagggcag

SEQ ID NO: 4533375 - DNA, 18 bp, Homo sapiens
ccagcagaggcaggctgg

SEQ ID NO: 4533376 - DNA, 21 bp, Homo sapiens
ccagcagaggcaggctgggac

SEQ ID NO: 4533377 - DNA, 18 bp, Homo sapiens
ccagcagatttccagcct

SEQ ID NO: 4533378 - DNA, 23 bp, Homo sapiens
ccagcagcatggcatagccccgg

SEQ ID NO: 4533379 - DNA, 22 bp, Homo sapiens
ccagcaggagagactgagcagc

SEQ ID NO: 4533380 - DNA, 16 bp, Homo sapiens
ccagcaggcgggctcc

SEQ ID NO: 4533381 - DNA, 18 bp, Homo sapiens
ccagcaggcgggctcctt

SEQ ID NO: 4533382 - DNA, 20 bp, Homo sapiens
ccagcagggcatcttggaaa

SEQ ID NO: 4533383 - DNA, 18 bp, Homo sapiens
ccagcagtgtggagaccc

SEQ ID NO: 4533384 - DNA, 12 bp, Homo sapiens
ccagcatccctg

SEQ ID NO: 4533385 - DNA, 13 bp, Homo sapiens
ccagcatccctgg

SEQ ID NO: 4533386 - DNA, 14 bp, Homo sapiens
ccagcatccctgga

SEQ ID NO: 4533387 - DNA, 23 bp, Homo sapiens
ccagcatccctggagcaggagcc

SEQ ID NO: 4533388 - DNA, 14 bp, Homo sapiens
ccagcatctggaag

SEQ ID NO: 4533389 - DNA, 16 bp, Homo sapiens
ccagcattccagactt

SEQ ID NO: 4533390 - DNA, 20 bp, Homo sapiens
ccagcattccagacttcaaa

SEQ ID NO: 4533391 - DNA, 14 bp, Homo sapiens
ccagcattccagct

SEQ ID NO: 4533392 - DNA, 16 bp, Homo sapiens
ccagcattccagctct

SEQ ID NO: 4533393 - DNA, 17 bp, Homo sapiens
ccagcattccagctctg

SEQ ID NO: 4533394 - DNA, 18 bp, Homo sapiens
ccagcattccagctctgc

SEQ ID NO: 4533395 - DNA, 20 bp, Homo sapiens
ccagcattccagctctgccc

SEQ ID NO: 4533396 - DNA, 20 bp, Homo sapiens
ccagcattgctactgctcag

SEQ ID NO: 4533397 - DNA, 22 bp, Homo sapiens
ccagcattgctactgctcagct

SEQ ID NO: 4533398 - DNA, 18 bp, Homo sapiens
ccagcatttaagtgacct

SEQ ID NO: 4533399 - DNA, 16 bp, Homo sapiens
ccagcatttcccttcc

SEQ ID NO: 4533400 - DNA, 14 bp, Homo sapiens
ccagccaagggtcc

SEQ ID NO: 4533401 - DNA, 10 bp, Homo sapiens
ccagccacag

SEQ ID NO: 4533402 - DNA, 22 bp, Homo sapiens
ccagccaccccgggctctctgc

SEQ ID NO: 4533403 - DNA, 14 bp, Homo sapiens
ccagccagacccca

SEQ ID NO: 4533404 - DNA, 18 bp, Homo sapiens
ccagccagatcctcttgg

SEQ ID NO: 4533405 - DNA, 21 bp, Homo sapiens
ccagccagatggactccagcc

SEQ ID NO: 4533406 - DNA, 15 bp, Homo sapiens
ccagccagcccttcc

SEQ ID NO: 4533407 - DNA, 14 bp, Homo sapiens
ccagccagcctcag

SEQ ID NO: 4533408 - DNA, 13 bp, Homo sapiens
ccagccaggccct

SEQ ID NO: 4533409 - DNA, 20 bp, Homo sapiens
ccagccaggctctgtgctga

SEQ ID NO: 4533410 - DNA, 16 bp, Homo sapiens
ccagccatcaaaatgc

SEQ ID NO: 4533411 - DNA, 18 bp, Homo sapiens
ccagccatcaaaatgctt

SEQ ID NO: 4533412 - DNA, 15 bp, Homo sapiens
ccagccatgcctgag

SEQ ID NO: 4533413 - DNA, 13 bp, Homo sapiens
ccagcccaagcac

SEQ ID NO: 4533414 - DNA, 13 bp, Homo sapiens
ccagcccacagag

SEQ ID NO: 4533415 - DNA, 15 bp, Homo sapiens
ccagcccacagagcc

SEQ ID NO: 4533416 - DNA, 16 bp, Homo sapiens
ccagcccacagagcct

SEQ ID NO: 4533417 - DNA, 14 bp, Homo sapiens
ccagcccaccctcc

SEQ ID NO: 4533418 - DNA, 16 bp, Homo sapiens
ccagcccagagccacc

SEQ ID NO: 4533419 - DNA, 17 bp, Homo sapiens
ccagcccagagccacct

SEQ ID NO: 4533420 - DNA, 20 bp, Homo sapiens
ccagcccagagccacctgga

SEQ ID NO: 4533421 - DNA, 14 bp, Homo sapiens
ccagcccagcccag

SEQ ID NO: 4533422 - DNA, 22 bp, Homo sapiens
ccagcccatggcccccaataaa

SEQ ID NO: 4533423 - DNA, 17 bp, Homo sapiens
ccagcccattctctctc

SEQ ID NO: 4533424 - DNA, 22 bp, Homo sapiens
ccagcccattctctctcctgtc

SEQ ID NO: 4533425 - DNA, 13 bp, Homo sapiens
ccagccccaactc

SEQ ID NO: 4533426 - DNA, 15 bp, Homo sapiens
ccagccccacccagg

SEQ ID NO: 4533427 - DNA, 13 bp, Homo sapiens
ccagcccccacag

SEQ ID NO: 4533428 - DNA, 16 bp, Homo sapiens
ccagcccccacagtgc

SEQ ID NO: 4533429 - DNA, 18 bp, Homo sapiens
ccagcccccacagtgctg

SEQ ID NO: 4533430 - DNA, 17 bp, Homo sapiens
ccagcccccgccccaga

SEQ ID NO: 4533431 - DNA, 23 bp, Homo sapiens
ccagcccccgccccagagtggcc

SEQ ID NO: 4533432 - DNA, 17 bp, Homo sapiens
ccagccccctcccaccg

SEQ ID NO: 4533433 - DNA, 15 bp, Homo sapiens
ccagccccctttggg

SEQ ID NO: 4533434 - DNA, 22 bp, Homo sapiens
ccagccccctttgggcccaggg

SEQ ID NO: 4533435 - DNA, 23 bp, Homo sapiens
ccagccccctttgggcccaggga

SEQ ID NO: 4533436 - DNA, 15 bp, Homo sapiens
ccagccccgactcca

SEQ ID NO: 4533437 - DNA, 19 bp, Homo sapiens
ccagcccctcctccctcag

SEQ ID NO: 4533438 - DNA, 20 bp, Homo sapiens
ccagcccctcctccctcaga

SEQ ID NO: 4533439 - DNA, 20 bp, Homo sapiens
ccagccctccctgtcctcct

SEQ ID NO: 4533440 - DNA, 21 bp, Homo sapiens
ccagccctccctgtcctcctc

SEQ ID NO: 4533441 - DNA, 13 bp, Homo sapiens
ccagccctgcacg

SEQ ID NO: 4533442 - DNA, 15 bp, Homo sapiens
ccagccctgcacgac

SEQ ID NO: 4533443 - DNA, 13 bp, Homo sapiens
ccagccctgctgg

SEQ ID NO: 4533444 - DNA, 17 bp, Homo sapiens
ccagccctggcccaggt

SEQ ID NO: 4533445 - DNA, 19 bp, Homo sapiens
ccagccctggcccaggtgc

SEQ ID NO: 4533446 - DNA, 11 bp, Homo sapiens
ccagcccttca

SEQ ID NO: 4533447 - DNA, 18 bp, Homo sapiens
ccagccgcaggaaggcag

SEQ ID NO: 4533448 - DNA, 18 bp, Homo sapiens
ccagccgcccacccccac

SEQ ID NO: 4533449 - DNA, 14 bp, Homo sapiens
ccagccgccctggg

SEQ ID NO: 4533450 - DNA, 22 bp, Homo sapiens
ccagccggtacctgggaagggg

SEQ ID NO: 4533451 - DNA, 14 bp, Homo sapiens
ccagccgtggccag

SEQ ID NO: 4533452 - DNA, 20 bp, Homo sapiens
ccagcctagcctggctctgc

SEQ ID NO: 4533453 - DNA, 13 bp, Homo sapiens
ccagcctccaggc

SEQ ID NO: 4533454 - DNA, 19 bp, Homo sapiens
ccagcctccaggcccccaa

SEQ ID NO: 4533455 - DNA, 14 bp, Homo sapiens
ccagcctcccctcc

SEQ ID NO: 4533456 - DNA, 17 bp, Homo sapiens
ccagcctcccctcccct

SEQ ID NO: 4533457 - DNA, 21 bp, Homo sapiens
ccagcctcccctcccctgggg

SEQ ID NO: 4533458 - DNA, 19 bp, Homo sapiens
ccagcctccgagagggaga

SEQ ID NO: 4533459 - DNA, 12 bp, Homo sapiens
ccagcctcctct

SEQ ID NO: 4533460 - DNA, 23 bp, Homo sapiens
ccagcctcctctggacggcaggc

SEQ ID NO: 4533461 - DNA, 14 bp, Homo sapiens
ccagcctccttgtg

SEQ ID NO: 4533462 - DNA, 22 bp, Homo sapiens
ccagcctcgttggaagaggaac

SEQ ID NO: 4533463 - DNA, 14 bp, Homo sapiens
ccagcctctgccgc

SEQ ID NO: 4533464 - DNA, 17 bp, Homo sapiens
ccagcctctgccgctgc

SEQ ID NO: 4533465 - DNA, 21 bp, Homo sapiens
ccagcctgagtgacagagcga

SEQ ID NO: 4533466 - DNA, 22 bp, Homo sapiens
ccagcctgagtgacagagcgag

SEQ ID NO: 4533467 - DNA, 18 bp, Homo sapiens
ccagcctgcctggcaggc

SEQ ID NO: 4533468 - DNA, 20 bp, Homo sapiens
ccagcctgcctggcaggctg

SEQ ID NO: 4533469 - DNA, 23 bp, Homo sapiens
ccagcctggctctgccccctccc

SEQ ID NO: 4533470 - DNA, 15 bp, Homo sapiens
ccagcctgggagccc

SEQ ID NO: 4533471 - DNA, 18 bp, Homo sapiens
ccagcctgggagcccaga

SEQ ID NO: 4533472 - DNA, 18 bp, Homo sapiens
ccagcctgggcagccagg

SEQ ID NO: 4533473 - DNA, 17 bp, Homo sapiens
ccagccttctctcaagg

SEQ ID NO: 4533474 - DNA, 15 bp, Homo sapiens
ccagccttgcccagc

SEQ ID NO: 4533475 - DNA, 14 bp, Homo sapiens
ccagccttgctctc

SEQ ID NO: 4533476 - DNA, 15 bp, Homo sapiens
ccagccttgctctct

SEQ ID NO: 4533477 - DNA, 16 bp, Homo sapiens
ccagccttgctctctt

SEQ ID NO: 4533478 - DNA, 19 bp, Homo sapiens
ccagccttgctctcttcaa

SEQ ID NO: 4533479 - DNA, 13 bp, Homo sapiens
ccagcgatggtgc

SEQ ID NO: 4533480 - DNA, 14 bp, Homo sapiens
ccagcgatggtgct

SEQ ID NO: 4533481 - DNA, 20 bp, Homo sapiens
ccagcgatggtgctgcccag

SEQ ID NO: 4533482 - DNA, 23 bp, Homo sapiens
ccagcgatggtgctgcccaggcc

SEQ ID NO: 4533483 - DNA, 17 bp, Homo sapiens
ccagcgcctccctccac

SEQ ID NO: 4533484 - DNA, 18 bp, Homo sapiens
ccagcgcctccctccacc

SEQ ID NO: 4533485 - DNA, 21 bp, Homo sapiens
ccagcggccccccgcacagcc

SEQ ID NO: 4533486 - DNA, 12 bp, Homo sapiens
ccagcgggctgg

SEQ ID NO: 4533487 - DNA, 12 bp, Homo sapiens
ccagcggggctg

SEQ ID NO: 4533488 - DNA, 19 bp, Homo sapiens
ccagcgtcctcctctgtga

SEQ ID NO: 4533489 - DNA, 20 bp, Homo sapiens
ccagcgtgacggagcccaca

SEQ ID NO: 4533490 - DNA, 13 bp, Homo sapiens
ccagcgtttattg

SEQ ID NO: 4533491 - DNA, 15 bp, Homo sapiens
ccagctactcaggag

SEQ ID NO: 4533492 - DNA, 17 bp, Homo sapiens
ccagctactcaggaggc

SEQ ID NO: 4533493 - DNA, 21 bp, Homo sapiens
ccagctactggggaggctgag

SEQ ID NO: 4533494 - DNA, 17 bp, Homo sapiens
ccagctacttgggaggc

SEQ ID NO: 4533495 - DNA, 19 bp, Homo sapiens
ccagctacttgggaggctg

SEQ ID NO: 4533496 - DNA, 20 bp, Homo sapiens
ccagctacttgggaggctga

SEQ ID NO: 4533497 - DNA, 21 bp, Homo sapiens
ccagctatctgtcatctctct

SEQ ID NO: 4533498 - DNA, 22 bp, Homo sapiens
ccagctatgttatattgaaaaa

SEQ ID NO: 4533499 - DNA, 13 bp, Homo sapiens
ccagctcccacac

SEQ ID NO: 4533500 - DNA, 20 bp, Homo sapiens
ccagctcgtgtgtcctcatg

SEQ ID NO: 4533501 - DNA, 20 bp, Homo sapiens
ccagctctccctctggccct

SEQ ID NO: 4533502 - DNA, 21 bp, Homo sapiens
ccagctctccctctggccctg

SEQ ID NO: 4533503 - DNA, 21 bp, Homo sapiens
ccagctctgaaaccagtgtta

SEQ ID NO: 4533504 - DNA, 15 bp, Homo sapiens
ccagctctgcccccg

SEQ ID NO: 4533505 - DNA, 14 bp, Homo sapiens
ccagctgactaaac

SEQ ID NO: 4533506 - DNA, 23 bp, Homo sapiens
ccagctgactaaactttttttct

SEQ ID NO: 4533507 - DNA, 17 bp, Homo sapiens
ccagctgcaaagtgttt

SEQ ID NO: 4533508 - DNA, 12 bp, Homo sapiens
ccagctgcagaa

SEQ ID NO: 4533509 - DNA, 18 bp, Homo sapiens
ccagctgccccagccaga

SEQ ID NO: 4533510 - DNA, 18 bp, Homo sapiens
ccagctgccccggcccct

SEQ ID NO: 4533511 - DNA, 19 bp, Homo sapiens
ccagctgcccttgcagggt

SEQ ID NO: 4533512 - DNA, 21 bp, Homo sapiens
ccagctgcccttgcagggtgg

SEQ ID NO: 4533513 - DNA, 18 bp, Homo sapiens
ccagctgcgcttgctttt

SEQ ID NO: 4533514 - DNA, 15 bp, Homo sapiens
ccagctgcggccagg

SEQ ID NO: 4533515 - DNA, 19 bp, Homo sapiens
ccagctgcggccaggcctg

SEQ ID NO: 4533516 - DNA, 18 bp, Homo sapiens
ccagctgctcccctggag

SEQ ID NO: 4533517 - DNA, 22 bp, Homo sapiens
ccagctgctgagatcctggact

SEQ ID NO: 4533518 - DNA, 23 bp, Homo sapiens
ccagctgctgagatcctggactg

SEQ ID NO: 4533519 - DNA, 16 bp, Homo sapiens
ccagctgggaagccct

SEQ ID NO: 4533520 - DNA, 17 bp, Homo sapiens
ccagctgtctcccacgt

SEQ ID NO: 4533521 - DNA, 14 bp, Homo sapiens
ccagctgtgggcgg

SEQ ID NO: 4533522 - DNA, 18 bp, Homo sapiens
ccagcttaatagctgtag

SEQ ID NO: 4533523 - DNA, 18 bp, Homo sapiens
ccagcttgtggagcccca

SEQ ID NO: 4533524 - DNA, 18 bp, Homo sapiens
ccagctttccctgcctct

SEQ ID NO: 4533525 - DNA, 21 bp, Homo sapiens
ccagctttgacgtattatctg

SEQ ID NO: 4533526 - DNA, 18 bp, Homo sapiens
ccagcttttaaccatctg

SEQ ID NO: 4533527 - DNA, 21 bp, Homo sapiens
ccaggaaactccacatctgcc

SEQ ID NO: 4533528 - DNA, 21 bp, Homo sapiens
ccaggaaaggacggctgagca

SEQ ID NO: 4533529 - DNA, 19 bp, Homo sapiens
ccaggaacagcaaatgcaa

SEQ ID NO: 4533530 - DNA, 15 bp, Homo sapiens
ccaggaagccagagc

SEQ ID NO: 4533531 - DNA, 16 bp, Homo sapiens
ccaggaagccagagcc

SEQ ID NO: 4533532 - DNA, 15 bp, Homo sapiens
ccaggaagcccagga

SEQ ID NO: 4533533 - DNA, 18 bp, Homo sapiens
ccaggaagcccaggagcc

SEQ ID NO: 4533534 - DNA, 21 bp, Homo sapiens
ccaggaagggaaagcgggcag

SEQ ID NO: 4533535 - DNA, 13 bp, Homo sapiens
ccaggaatattaa

SEQ ID NO: 4533536 - DNA, 13 bp, Homo sapiens
ccaggacaggacc

SEQ ID NO: 4533537 - DNA, 21 bp, Homo sapiens
ccaggacgccactcatttcat

SEQ ID NO: 4533538 - DNA, 23 bp, Homo sapiens
ccaggacgccactcatttcatct

SEQ ID NO: 4533539 - DNA, 16 bp, Homo sapiens
ccaggactccctcctc

SEQ ID NO: 4533540 - DNA, 17 bp, Homo sapiens
ccaggactccctcctca

SEQ ID NO: 4533541 - DNA, 22 bp, Homo sapiens
ccaggactccctcctcacctct

SEQ ID NO: 4533542 - DNA, 23 bp, Homo sapiens
ccaggactccctcctcacctctg

SEQ ID NO: 4533543 - DNA, 13 bp, Homo sapiens
ccaggactgggcc

SEQ ID NO: 4533544 - DNA, 14 bp, Homo sapiens
ccaggactgggcca

SEQ ID NO: 4533545 - DNA, 19 bp, Homo sapiens
ccaggagaaatcaacagga

SEQ ID NO: 4533546 - DNA, 21 bp, Homo sapiens
ccaggagaaccactacatgca

SEQ ID NO: 4533547 - DNA, 23 bp, Homo sapiens
ccaggagaaccactacatgcagc

SEQ ID NO: 4533548 - DNA, 23 bp, Homo sapiens
ccaggagacagaccacttgccac

SEQ ID NO: 4533549 - DNA, 12 bp, Homo sapiens
ccaggagatggg

SEQ ID NO: 4533550 - DNA, 22 bp, Homo sapiens
ccaggagattggatttgctgtg

SEQ ID NO: 4533551 - DNA, 14 bp, Homo sapiens
ccaggagcagccct

SEQ ID NO: 4533552 - DNA, 13 bp, Homo sapiens
ccaggagcctcac

SEQ ID NO: 4533553 - DNA, 18 bp, Homo sapiens
ccaggagcctcatccagc

SEQ ID NO: 4533554 - DNA, 20 bp, Homo sapiens
ccaggagcctcatccagcct

SEQ ID NO: 4533555 - DNA, 13 bp, Homo sapiens
ccaggagctcttc

SEQ ID NO: 4533556 - DNA, 21 bp, Homo sapiens
ccaggagctcttcaggcctcc

SEQ ID NO: 4533557 - DNA, 16 bp, Homo sapiens
ccaggaggcagctcag

SEQ ID NO: 4533558 - DNA, 12 bp, Homo sapiens
ccaggagtccag

SEQ ID NO: 4533559 - DNA, 13 bp, Homo sapiens
ccaggagtccaga

SEQ ID NO: 4533560 - DNA, 16 bp, Homo sapiens
ccaggagtccagaccc

SEQ ID NO: 4533561 - DNA, 22 bp, Homo sapiens
ccaggagtccagaccccccagc

SEQ ID NO: 4533562 - DNA, 14 bp, Homo sapiens
ccaggagtccagcc

SEQ ID NO: 4533563 - DNA, 21 bp, Homo sapiens
ccaggagtccagcccctcctc

SEQ ID NO: 4533564 - DNA, 23 bp, Homo sapiens
ccaggagtccagcccctcctccc

SEQ ID NO: 4533565 - DNA, 22 bp, Homo sapiens
ccaggagtccaggcccccagcc

SEQ ID NO: 4533566 - DNA, 14 bp, Homo sapiens
ccaggagttctgaa

SEQ ID NO: 4533567 - DNA, 17 bp, Homo sapiens
ccaggagtttgaggctg

SEQ ID NO: 4533568 - DNA, 19 bp, Homo sapiens
ccaggagttttaagtccag

SEQ ID NO: 4533569 - DNA, 17 bp, Homo sapiens
ccaggatcccaggggcc

SEQ ID NO: 4533570 - DNA, 21 bp, Homo sapiens
ccaggatctgctccaacagaa

SEQ ID NO: 4533571 - DNA, 16 bp, Homo sapiens
ccaggatttattttga

SEQ ID NO: 4533572 - DNA, 23 bp, Homo sapiens
ccaggattttaatttcaggaaaa

SEQ ID NO: 4533573 - DNA, 16 bp, Homo sapiens
ccaggcacacactgtg

SEQ ID NO: 4533574 - DNA, 14 bp, Homo sapiens
ccaggcaccctcag

SEQ ID NO: 4533575 - DNA, 17 bp, Homo sapiens
ccaggcaccctcaggga

SEQ ID NO: 4533576 - DNA, 18 bp, Homo sapiens
ccaggcaccctcagggag

SEQ ID NO: 4533577 - DNA, 20 bp, Homo sapiens
ccaggcacgaacccacctgc

SEQ ID NO: 4533578 - DNA, 21 bp, Homo sapiens
ccaggcacgaacccacctgct

SEQ ID NO: 4533579 - DNA, 17 bp, Homo sapiens
ccaggcagatctgtgcc

SEQ ID NO: 4533580 - DNA, 18 bp, Homo sapiens
ccaggcagatctgtgccc

SEQ ID NO: 4533581 - DNA, 21 bp, Homo sapiens
ccaggcagatctgtgccccat

SEQ ID NO: 4533582 - DNA, 12 bp, Homo sapiens
ccaggcagcctc

SEQ ID NO: 4533583 - DNA, 21 bp, Homo sapiens
ccaggcaggggtgggggtgga

SEQ ID NO: 4533584 - DNA, 19 bp, Homo sapiens
ccaggcaggtgcagggaag

SEQ ID NO: 4533585 - DNA, 18 bp, Homo sapiens
ccaggcattggctcagcc

SEQ ID NO: 4533586 - DNA, 18 bp, Homo sapiens
ccaggccaacagcacctc

SEQ ID NO: 4533587 - DNA, 12 bp, Homo sapiens
ccaggccacagc

SEQ ID NO: 4533588 - DNA, 11 bp, Homo sapiens
ccaggccagcc

SEQ ID NO: 4533589 - DNA, 12 bp, Homo sapiens
ccaggccagcct

SEQ ID NO: 4533590 - DNA, 16 bp, Homo sapiens
ccaggccagcctccga

SEQ ID NO: 4533591 - DNA, 11 bp, Homo sapiens
ccaggccagct

SEQ ID NO: 4533592 - DNA, 13 bp, Homo sapiens
ccaggccagctca

SEQ ID NO: 4533593 - DNA, 14 bp, Homo sapiens
ccaggccagctcag

SEQ ID NO: 4533594 - DNA, 16 bp, Homo sapiens
ccaggccagctcagga

SEQ ID NO: 4533595 - DNA, 16 bp, Homo sapiens
ccaggccagctgcggc

SEQ ID NO: 4533596 - DNA, 21 bp, Homo sapiens
ccaggccagctgcggccaggc

SEQ ID NO: 4533597 - DNA, 14 bp, Homo sapiens
ccaggccaggtgcc

SEQ ID NO: 4533598 - DNA, 14 bp, Homo sapiens
ccaggcccaaggct

SEQ ID NO: 4533599 - DNA, 16 bp, Homo sapiens
ccaggccccagcctcc

SEQ ID NO: 4533600 - DNA, 18 bp, Homo sapiens
ccaggccccagcctccag

SEQ ID NO: 4533601 - DNA, 20 bp, Homo sapiens
ccaggccccagcctccaggc

SEQ ID NO: 4533602 - DNA, 20 bp, Homo sapiens
ccaggcccccaacccctcct

SEQ ID NO: 4533603 - DNA, 23 bp, Homo sapiens
ccaggcccccaacccctcctccc

SEQ ID NO: 4533604 - DNA, 17 bp, Homo sapiens
ccaggcccccagcccct

SEQ ID NO: 4533605 - DNA, 22 bp, Homo sapiens
ccaggccccgaggacccagacc

SEQ ID NO: 4533606 - DNA, 20 bp, Homo sapiens
ccaggcccggggctggcggc

SEQ ID NO: 4533607 - DNA, 21 bp, Homo sapiens
ccaggccctccagtgggctga

SEQ ID NO: 4533608 - DNA, 15 bp, Homo sapiens
ccacttaatgtatgt

SEQ ID NO: 4533609 - DNA, 24 bp, Homo sapiens
ccacttcacccccaacttcaccac

SEQ ID NO: 4533610 - DNA, 13 bp, Homo sapiens
ccacttcactgcg

SEQ ID NO: 4533611 - DNA, 12 bp, Homo sapiens
ccacttcatttt

SEQ ID NO: 4533612 - DNA, 21 bp, Homo sapiens
ccacttccaggggaacctgcc

SEQ ID NO: 4533613 - DNA, 20 bp, Homo sapiens
ccacttccaggtctgcctgg

SEQ ID NO: 4533614 - DNA, 16 bp, Homo sapiens
ccacttcgcacacacc

SEQ ID NO: 4533615 - DNA, 18 bp, Homo sapiens
ccacttcgcacacaccca

SEQ ID NO: 4533616 - DNA, 21 bp, Homo sapiens
ccactttcaagacagatgagc

SEQ ID NO: 4533617 - DNA, 18 bp, Homo sapiens
ccactttcatctaccttt

SEQ ID NO: 4533618 - DNA, 15 bp, Homo sapiens
ccactttgtaatttt

SEQ ID NO: 4533619 - DNA, 21 bp, Homo sapiens
ccagaaaacctctcctgaccc

SEQ ID NO: 4533620 - DNA, 15 bp, Homo sapiens
ccagaaacagggaca

SEQ ID NO: 4533621 - DNA, 16 bp, Homo sapiens
ccagaaaccaaactag

SEQ ID NO: 4533622 - DNA, 21 bp, Homo sapiens
ccagaaagcctcctgccccct

SEQ ID NO: 4533623 - DNA, 23 bp, Homo sapiens
ccagaaagcctcctgccccctgc

SEQ ID NO: 4533624 - DNA, 17 bp, Homo sapiens
ccagaaataaagggacc

SEQ ID NO: 4533625 - DNA, 17 bp, Homo sapiens
ccagaacagccctcggc

SEQ ID NO: 4533626 - DNA, 18 bp, Homo sapiens
ccagaacgcaccccactg

SEQ ID NO: 4533627 - DNA, 23 bp, Homo sapiens
ccagaacgcaccccactgggaga

SEQ ID NO: 4533628 - DNA, 16 bp, Homo sapiens
ccagaacgtggtttgc

SEQ ID NO: 4533629 - DNA, 19 bp, Homo sapiens
ccagaactttgggaggcca

SEQ ID NO: 4533630 - DNA, 18 bp, Homo sapiens
ccagaagatcccctcagg

SEQ ID NO: 4533631 - DNA, 15 bp, Homo sapiens
ccagaagcctctggc

SEQ ID NO: 4533632 - DNA, 19 bp, Homo sapiens
ccagaagcctgatctttgg

SEQ ID NO: 4533633 - DNA, 23 bp, Homo sapiens
ccagaagccttggaaccagcccc

SEQ ID NO: 4533634 - DNA, 16 bp, Homo sapiens
ccagaagtccacagga

SEQ ID NO: 4533635 - DNA, 23 bp, Homo sapiens
ccagaataagttattgcagttta

SEQ ID NO: 4533636 - DNA, 16 bp, Homo sapiens
ccagaatgctgtacat

SEQ ID NO: 4533637 - DNA, 17 bp, Homo sapiens
ccagacaattccattca

SEQ ID NO: 4533638 - DNA, 13 bp, Homo sapiens
ccagacagcctgt

SEQ ID NO: 4533639 - DNA, 12 bp, Homo sapiens
ccagacaggccc

SEQ ID NO: 4533640 - DNA, 18 bp, Homo sapiens
ccagacaggccctccctg

SEQ ID NO: 4533641 - DNA, 20 bp, Homo sapiens
ccagacaggccctccctgtc

SEQ ID NO: 4533642 - DNA, 13 bp, Homo sapiens
ccagacagggtgg

SEQ ID NO: 4533643 - DNA, 14 bp, Homo sapiens
ccagacatcaacag

SEQ ID NO: 4533644 - DNA, 12 bp, Homo sapiens
ccagaccatggg

SEQ ID NO: 4533645 - DNA, 10 bp, Homo sapiens
ccagacccag

SEQ ID NO: 4533646 - DNA, 15 bp, Homo sapiens
ccagacccagaggtc

SEQ ID NO: 4533647 - DNA, 19 bp, Homo sapiens
ccagacccagaggtccagg

SEQ ID NO: 4533648 - DNA, 18 bp, Homo sapiens
ccagaccgatccttccca

SEQ ID NO: 4533649 - DNA, 18 bp, Homo sapiens
ccagacctagcaggctgt

SEQ ID NO: 4533650 - DNA, 13 bp, Homo sapiens
ccagacctggctc

SEQ ID NO: 4533651 - DNA, 19 bp, Homo sapiens
ccagacctggctccactct

SEQ ID NO: 4533652 - DNA, 24 bp, Homo sapiens
ccagacgctgccgctgccgctgca

SEQ ID NO: 4533653 - DNA, 21 bp, Homo sapiens
ccagacgtcaggccctgactc

SEQ ID NO: 4533654 - DNA, 19 bp, Homo sapiens
ccagactaaaggatccaga

SEQ ID NO: 4533655 - DNA, 21 bp, Homo sapiens
ccagactaaaggatccagaga

SEQ ID NO: 4533656 - DNA, 17 bp, Homo sapiens
ccagactcaggttccag

SEQ ID NO: 4533657 - DNA, 12 bp, Homo sapiens
ccagactctcag

SEQ ID NO: 4533658 - DNA, 18 bp, Homo sapiens
ccagactgatgagcacat

SEQ ID NO: 4533659 - DNA, 13 bp, Homo sapiens
ccagactgtccag

SEQ ID NO: 4533660 - DNA, 19 bp, Homo sapiens
ccagacttcaaaaataaaa

SEQ ID NO: 4533661 - DNA, 14 bp, Homo sapiens
ccagagaagcccct

SEQ ID NO: 4533662 - DNA, 20 bp, Homo sapiens
ccagagaagccccttcccca

SEQ ID NO: 4533663 - DNA, 14 bp, Homo sapiens
ccagagacactgag

SEQ ID NO: 4533664 - DNA, 18 bp, Homo sapiens
ccagagacactgagccag

SEQ ID NO: 4533665 - DNA, 20 bp, Homo sapiens
ccagagacactgagccagtc

SEQ ID NO: 4533666 - DNA, 12 bp, Homo sapiens
ccagagacagga

SEQ ID NO: 4533667 - DNA, 15 bp, Homo sapiens
ccagagacaggaaaa

SEQ ID NO: 4533668 - DNA, 13 bp, Homo sapiens
ccagagacccctc

SEQ ID NO: 4533669 - DNA, 15 bp, Homo sapiens
ccagagagcagctcc

SEQ ID NO: 4533670 - DNA, 16 bp, Homo sapiens
ccagagaggaatcaga

SEQ ID NO: 4533671 - DNA, 19 bp, Homo sapiens
ccagagaggcactcagtga

SEQ ID NO: 4533672 - DNA, 16 bp, Homo sapiens
ccagagatgcctccac

SEQ ID NO: 4533673 - DNA, 23 bp, Homo sapiens
ccagagatgcctccaccgctgcc

SEQ ID NO: 4533674 - DNA, 17 bp, Homo sapiens
ccagagattcattttct

SEQ ID NO: 4533675 - DNA, 17 bp, Homo sapiens
ccagagcaaacagaaaa

SEQ ID NO: 4533676 - DNA, 14 bp, Homo sapiens
ccagagcagagcct

SEQ ID NO: 4533677 - DNA, 16 bp, Homo sapiens
ccagagcatctgcccc

SEQ ID NO: 4533678 - DNA, 20 bp, Homo sapiens
ccagagcatctgccccaggt

SEQ ID NO: 4533679 - DNA, 13 bp, Homo sapiens
ccagagccacctg

SEQ ID NO: 4533680 - DNA, 14 bp, Homo sapiens
ccagagccccaagc

SEQ ID NO: 4533681 - DNA, 16 bp, Homo sapiens
ccagagccccaagcag

SEQ ID NO: 4533682 - DNA, 13 bp, Homo sapiens
ccagagccccaca

SEQ ID NO: 4533683 - DNA, 14 bp, Homo sapiens
ccagagcctctggc

SEQ ID NO: 4533684 - DNA, 18 bp, Homo sapiens
ccagagcctctggcccct

SEQ ID NO: 4533685 - DNA, 16 bp, Homo sapiens
ccagagcgaggaaagg

SEQ ID NO: 4533686 - DNA, 23 bp, Homo sapiens
ccagagcgaggaaaggattttac

SEQ ID NO: 4533687 - DNA, 17 bp, Homo sapiens
ccagagcggtatctctg

SEQ ID NO: 4533688 - DNA, 22 bp, Homo sapiens
ccagagctcatttcggggtcag

SEQ ID NO: 4533689 - DNA, 19 bp, Homo sapiens
ccagagctgtttatggcct

SEQ ID NO: 4533690 - DNA, 24 bp, Homo sapiens
ccagagctgtttatggcctcagct

SEQ ID NO: 4533691 - DNA, 17 bp, Homo sapiens
ccagaggaaggggccag

SEQ ID NO: 4533692 - DNA, 15 bp, Homo sapiens
ccagaggagggcaga

SEQ ID NO: 4533693 - DNA, 16 bp, Homo sapiens
ccagaggagggcagag

SEQ ID NO: 4533694 - DNA, 19 bp, Homo sapiens
ccagaggagggcagaggga

SEQ ID NO: 4533695 - DNA, 13 bp, Homo sapiens
ccagaggcagagg

SEQ ID NO: 4533696 - DNA, 18 bp, Homo sapiens
ccagaggcagaggttgca

SEQ ID NO: 4533697 - DNA, 13 bp, Homo sapiens
ccagaggccctgg

SEQ ID NO: 4533698 - DNA, 16 bp, Homo sapiens
ccagaggccctggagg

SEQ ID NO: 4533699 - DNA, 18 bp, Homo sapiens
ccagaggctcccaatcag

SEQ ID NO: 4533700 - DNA, 22 bp, Homo sapiens
ccagaggctcccaatcagcttt

SEQ ID NO: 4533701 - DNA, 11 bp, Homo sapiens
ccagaggctcg

SEQ ID NO: 4533702 - DNA, 19 bp, Homo sapiens
ccagaggctgggagtccct

SEQ ID NO: 4533703 - DNA, 21 bp, Homo sapiens
ccagagggtgtggctttccag

SEQ ID NO: 4533704 - DNA, 13 bp, Homo sapiens
ccagaggtccagg

SEQ ID NO: 4533705 - DNA, 16 bp, Homo sapiens
ccagaggtccaggtcc

SEQ ID NO: 4533706 - DNA, 17 bp, Homo sapiens
ccagaggtccaggtccc

SEQ ID NO: 4533707 - DNA, 19 bp, Homo sapiens
ccagaggtccaggtcccag

SEQ ID NO: 4533708 - DNA, 21 bp, Homo sapiens
ccagaggtccaggtcccagcc

SEQ ID NO: 4533709 - DNA, 23 bp, Homo sapiens
ccagaggtggcaggagaatttct

SEQ ID NO: 4533710 - DNA, 20 bp, Homo sapiens
ccagagtggagtctgagtct

SEQ ID NO: 4533711 - DNA, 17 bp, Homo sapiens
ccagagtggcctggcca

SEQ ID NO: 4533712 - DNA, 23 bp, Homo sapiens
ccagagtggcctggccaggagct

SEQ ID NO: 4533713 - DNA, 13 bp, Homo sapiens
ccagatataactg

SEQ ID NO: 4533714 - DNA, 19 bp, Homo sapiens
ccagatataactgtcttgt

SEQ ID NO: 4533715 - DNA, 18 bp, Homo sapiens
ccagatcccaggcccctg

SEQ ID NO: 4533716 - DNA, 19 bp, Homo sapiens
ccagatcccaggcccctgg

SEQ ID NO: 4533717 - DNA, 23 bp, Homo sapiens
ccagatgaggatccgaaacggca

SEQ ID NO: 4533718 - DNA, 14 bp, Homo sapiens
ccagatgctttcct

SEQ ID NO: 4533719 - DNA, 17 bp, Homo sapiens
ccagatggactccagcc

SEQ ID NO: 4533720 - DNA, 12 bp, Homo sapiens
ccagatggcccc

SEQ ID NO: 4533721 - DNA, 22 bp, Homo sapiens
ccagattacaggaatgaagaac

SEQ ID NO: 4533722 - DNA, 18 bp, Homo sapiens
ccagattctgcctctctg

SEQ ID NO: 4533723 - DNA, 23 bp, Homo sapiens
ccagattctgcctctctggaaag

SEQ ID NO: 4533724 - DNA, 20 bp, Homo sapiens
ccagattggctcacactgag

SEQ ID NO: 4533725 - DNA, 21 bp, Homo sapiens
ccagattggctcacactgaga

SEQ ID NO: 4533726 - DNA, 21 bp, Homo sapiens
ccagcaccttctttctggact

SEQ ID NO: 4533727 - DNA, 17 bp, Homo sapiens
ccagcacgagcctgggc

SEQ ID NO: 4533728 - DNA, 17 bp, Homo sapiens
ccaaagaaatgtaaggg

SEQ ID NO: 4533729 - DNA, 15 bp, Homo sapiens
ccaaagagccttcag

SEQ ID NO: 4533730 - DNA, 16 bp, Homo sapiens
ccaaagaggctgcccc

SEQ ID NO: 4533731 - DNA, 17 bp, Homo sapiens
ccaaagaggctgcccct

SEQ ID NO: 4533732 - DNA, 20 bp, Homo sapiens
ccaaagaggctgcccctctc

SEQ ID NO: 4533733 - DNA, 16 bp, Homo sapiens
ccaaagagggcttcct

SEQ ID NO: 4533734 - DNA, 17 bp, Homo sapiens
ccaaagagggcttcctc

SEQ ID NO: 4533735 - DNA, 19 bp, Homo sapiens
ccaaagagggcttcctcta

SEQ ID NO: 4533736 - DNA, 19 bp, Homo sapiens
ccaaagcagcaggcctctg

SEQ ID NO: 4533737 - DNA, 19 bp, Homo sapiens
ccaaagctagggtggccct

SEQ ID NO: 4533738 - DNA, 13 bp, Homo sapiens
ccaaagctggtct

SEQ ID NO: 4533739 - DNA, 20 bp, Homo sapiens
ccaaagctttatctgtcttg

SEQ ID NO: 4533740 - DNA, 18 bp, Homo sapiens
ccaaaggaagtctaggag

SEQ ID NO: 4533741 - DNA, 21 bp, Homo sapiens
ccaaaggaatttgcatccagc

SEQ ID NO: 4533742 - DNA, 16 bp, Homo sapiens
ccaaaggaggctggca

SEQ ID NO: 4533743 - DNA, 18 bp, Homo sapiens
ccaaaggaggctggcagg

SEQ ID NO: 4533744 - DNA, 14 bp, Homo sapiens
ccaaagtgaactct

SEQ ID NO: 4533745 - DNA, 13 bp, Homo sapiens
ccaaagtgctgag

SEQ ID NO: 4533746 - DNA, 23 bp, Homo sapiens
ccaaagtgctgggattacaggtg

SEQ ID NO: 4533747 - DNA, 19 bp, Homo sapiens
ccaaagtggtatagaaatg

SEQ ID NO: 4533748 - DNA, 22 bp, Homo sapiens
ccaaagtggtatagaaatgctg

SEQ ID NO: 4533749 - DNA, 16 bp, Homo sapiens
ccaaataatgtctctg

SEQ ID NO: 4533750 - DNA, 16 bp, Homo sapiens
ccaaatacctcaattt

SEQ ID NO: 4533751 - DNA, 21 bp, Homo sapiens
ccaaatctcagttgtttgctt

SEQ ID NO: 4533752 - DNA, 22 bp, Homo sapiens
ccaaatctcagttgtttgcttc

SEQ ID NO: 4533753 - DNA, 12 bp, Homo sapiens
ccaaattaaaaa

SEQ ID NO: 4533754 - DNA, 19 bp, Homo sapiens
ccaaattatttcttaatta

SEQ ID NO: 4533755 - DNA, 15 bp, Homo sapiens
ccaaattcagtttca

SEQ ID NO: 4533756 - DNA, 20 bp, Homo sapiens
ccaaattgtgcttctcccca

SEQ ID NO: 4533757 - DNA, 15 bp, Homo sapiens
ccaaatttaattaaa

SEQ ID NO: 4533758 - DNA, 11 bp, Homo sapiens
ccaaatttaga

SEQ ID NO: 4533759 - DNA, 18 bp, Homo sapiens
ccaaatttcctgtttgaa

SEQ ID NO: 4533760 - DNA, 15 bp, Homo sapiens
ccaacacctgcctct

SEQ ID NO: 4533761 - DNA, 17 bp, Homo sapiens
ccaacagcaaaggaact

SEQ ID NO: 4533762 - DNA, 15 bp, Homo sapiens
ccaacagcacctccc

SEQ ID NO: 4533763 - DNA, 16 bp, Homo sapiens
ccaacagcacctcccc

SEQ ID NO: 4533764 - DNA, 16 bp, Homo sapiens
ccaacatccagtcctg

SEQ ID NO: 4533765 - DNA, 17 bp, Homo sapiens
ccaacatcccattgccc

SEQ ID NO: 4533766 - DNA, 21 bp, Homo sapiens
ccaacatgcactgatgttgtg

SEQ ID NO: 4533767 - DNA, 14 bp, Homo sapiens
ccaacatgggaggg

SEQ ID NO: 4533768 - DNA, 17 bp, Homo sapiens
ccaacatgggagggatc

SEQ ID NO: 4533769 - DNA, 23 bp, Homo sapiens
ccaacatgggagggatcagcccc

SEQ ID NO: 4533770 - DNA, 20 bp, Homo sapiens
ccaacatggtgaaaccccca

SEQ ID NO: 4533771 - DNA, 22 bp, Homo sapiens
ccaacatgtggctcctcccagc

SEQ ID NO: 4533772 - DNA, 15 bp, Homo sapiens
ccaacatttctcact

SEQ ID NO: 4533773 - DNA, 18 bp, Homo sapiens
ccaacccccaccccacac

SEQ ID NO: 4533774 - DNA, 13 bp, Homo sapiens
ccaacccccatct

SEQ ID NO: 4533775 - DNA, 15 bp, Homo sapiens
ccaacccccatctcc

SEQ ID NO: 4533776 - DNA, 16 bp, Homo sapiens
ccaacccccatctccc

SEQ ID NO: 4533777 - DNA, 21 bp, Homo sapiens
ccaaccccccagcactgagga

SEQ ID NO: 4533778 - DNA, 22 bp, Homo sapiens
ccaacccctcctccctcagact

SEQ ID NO: 4533779 - DNA, 14 bp, Homo sapiens
ccaacccctccttc

SEQ ID NO: 4533780 - DNA, 18 bp, Homo sapiens
ccaacccctccttcccca

SEQ ID NO: 4533781 - DNA, 15 bp, Homo sapiens
ccaacctcaccctcc

SEQ ID NO: 4533782 - DNA, 15 bp, Homo sapiens
ccaacctcaggctcc

SEQ ID NO: 4533783 - DNA, 16 bp, Homo sapiens
ccaacctcaggctcct

SEQ ID NO: 4533784 - DNA, 17 bp, Homo sapiens
ccaacctctttttcctc

SEQ ID NO: 4533785 - DNA, 18 bp, Homo sapiens
ccaacctctttttcctcc

SEQ ID NO: 4533786 - DNA, 13 bp, Homo sapiens
ccaacctgaccaa

SEQ ID NO: 4533787 - DNA, 12 bp, Homo sapiens
ccaacctgctct

SEQ ID NO: 4533788 - DNA, 18 bp, Homo sapiens
ccaacctttccctcaccc

SEQ ID NO: 4533789 - DNA, 20 bp, Homo sapiens
ccaacctttccctcaccccc

SEQ ID NO: 4533790 - DNA, 14 bp, Homo sapiens
ccaacgagacacat

SEQ ID NO: 4533791 - DNA, 20 bp, Homo sapiens
ccaactaatgccttactctt

SEQ ID NO: 4533792 - DNA, 14 bp, Homo sapiens
ccaactactaatag

SEQ ID NO: 4533793 - DNA, 11 bp, Homo sapiens
ccaactcagga

SEQ ID NO: 4533794 - DNA, 20 bp, Homo sapiens
ccaactccaggaaagagcag

SEQ ID NO: 4533795 - DNA, 21 bp, Homo sapiens
ccaactccatggggttcgaga

SEQ ID NO: 4533796 - DNA, 20 bp, Homo sapiens
ccaactccgcccagcctctc

SEQ ID NO: 4533797 - DNA, 19 bp, Homo sapiens
ccaactcctttcagccaca

SEQ ID NO: 4533798 - DNA, 14 bp, Homo sapiens
ccaactctccccag

SEQ ID NO: 4533799 - DNA, 15 bp, Homo sapiens
ccaactctccccagt

SEQ ID NO: 4533800 - DNA, 23 bp, Homo sapiens
ccaactctccccagtgcctgcca

SEQ ID NO: 4533801 - DNA, 20 bp, Homo sapiens
ccaactgacctgccagccgg

SEQ ID NO: 4533802 - DNA, 14 bp, Homo sapiens
ccaactgccccagg

SEQ ID NO: 4533803 - DNA, 16 bp, Homo sapiens
ccaactgctccagcct

SEQ ID NO: 4533804 - DNA, 17 bp, Homo sapiens
ccaactgctccagcctc

SEQ ID NO: 4533805 - DNA, 18 bp, Homo sapiens
ccaactgctccagcctct

SEQ ID NO: 4533806 - DNA, 19 bp, Homo sapiens
ccaactgctccagcctctg

SEQ ID NO: 4533807 - DNA, 20 bp, Homo sapiens
ccaactgctccagcctctgc

SEQ ID NO: 4533808 - DNA, 24 bp, Homo sapiens
ccaactgctccagcctctgccgct

SEQ ID NO: 4533809 - DNA, 16 bp, Homo sapiens
ccaactgggcccaaga

SEQ ID NO: 4533810 - DNA, 19 bp, Homo sapiens
ccaactggttcaggctcaa

SEQ ID NO: 4533811 - DNA, 20 bp, Homo sapiens
ccaactgtggtagctccagc

SEQ ID NO: 4533812 - DNA, 16 bp, Homo sapiens
ccaacttcaccacccc

SEQ ID NO: 4533813 - DNA, 18 bp, Homo sapiens
ccaacttcaccaccccct

SEQ ID NO: 4533814 - DNA, 19 bp, Homo sapiens
ccaacttctcttgctttct

SEQ ID NO: 4533815 - DNA, 14 bp, Homo sapiens
ccaagaaaatgaag

SEQ ID NO: 4533816 - DNA, 18 bp, Homo sapiens
ccaagaaaatgaagggat

SEQ ID NO: 4533817 - DNA, 14 bp, Homo sapiens
ccaagaaacgtctt

SEQ ID NO: 4533818 - DNA, 18 bp, Homo sapiens
ccaagaaaggaaaccttt

SEQ ID NO: 4533819 - DNA, 14 bp, Homo sapiens
ccaagaagcagtgg

SEQ ID NO: 4533820 - DNA, 21 bp, Homo sapiens
ccaagacagatgccccagagc

SEQ ID NO: 4533821 - DNA, 14 bp, Homo sapiens
ccaagacagcagca

SEQ ID NO: 4533822 - DNA, 15 bp, Homo sapiens
ccaagacagcagcag

SEQ ID NO: 4533823 - DNA, 16 bp, Homo sapiens
ccaagacagcagcagc

SEQ ID NO: 4533824 - DNA, 18 bp, Homo sapiens
ccaagacagcagcagcct

SEQ ID NO: 4533825 - DNA, 20 bp, Homo sapiens
ccaagacagcagcagcctgc

SEQ ID NO: 4533826 - DNA, 22 bp, Homo sapiens
ccaagacagcagcagcctgcac

SEQ ID NO: 4533827 - DNA, 19 bp, Homo sapiens
ccaagactcccatgaggga

SEQ ID NO: 4533828 - DNA, 17 bp, Homo sapiens
ccaagagaactaaagct

SEQ ID NO: 4533829 - DNA, 20 bp, Homo sapiens
ccaagagaactaaagctgga

SEQ ID NO: 4533830 - DNA, 17 bp, Homo sapiens
ccaagaggtctgagccc

SEQ ID NO: 4533831 - DNA, 19 bp, Homo sapiens
ccaagatgagctgcagccc

SEQ ID NO: 4533832 - DNA, 18 bp, Homo sapiens
ccaagatgggcatctttt

SEQ ID NO: 4533833 - DNA, 12 bp, Homo sapiens
ccaagatttaaa

SEQ ID NO: 4533834 - DNA, 18 bp, Homo sapiens
ccaagcaaaatctaaaat

SEQ ID NO: 4533835 - DNA, 18 bp, Homo sapiens
ccaagcaggacagtgctt

SEQ ID NO: 4533836 - DNA, 20 bp, Homo sapiens
ccaagcaggacgaaaaagag

SEQ ID NO: 4533837 - DNA, 18 bp, Homo sapiens
ccaagccacaagctgacc

SEQ ID NO: 4533838 - DNA, 14 bp, Homo sapiens
ccaagccctggccc

SEQ ID NO: 4533839 - DNA, 15 bp, Homo sapiens
ccaagcctgctggct

SEQ ID NO: 4533840 - DNA, 17 bp, Homo sapiens
ccaagctcacagttcct

SEQ ID NO: 4533841 - DNA, 16 bp, Homo sapiens
ccaagctgggccccag

SEQ ID NO: 4533842 - DNA, 18 bp, Homo sapiens
ccaagctgggccccagcc

SEQ ID NO: 4533843 - DNA, 19 bp, Homo sapiens
ccaagctgggccccagccc

SEQ ID NO: 4533844 - DNA, 22 bp, Homo sapiens
ccaagctgggccccagcccacc

SEQ ID NO: 4533845 - DNA, 21 bp, Homo sapiens
ccaagcttccatagctgctgc

SEQ ID NO: 4533846 - DNA, 22 bp, Homo sapiens
ccaagcttccatagctgctgcc

SEQ ID NO: 4533847 - DNA, 16 bp, Homo sapiens
ccaaggacccaggcgc

SEQ ID NO: 4533848 - DNA, 16 bp, Homo sapiens
ccaccgccttgcccag

SEQ ID NO: 4533849 - DNA, 19 bp, Homo sapiens
ccaccgccttgcccagcct

SEQ ID NO: 4533850 - DNA, 15 bp, Homo sapiens
ccaccgctgcctcgt

SEQ ID NO: 4533851 - DNA, 17 bp, Homo sapiens
ccaccggaactgggctg

SEQ ID NO: 4533852 - DNA, 20 bp, Homo sapiens
ccaccggaggtcactccacc

SEQ ID NO: 4533853 - DNA, 21 bp, Homo sapiens
ccaccggaggtcactccacca

SEQ ID NO: 4533854 - DNA, 15 bp, Homo sapiens
ccaccgtgaaccaga

SEQ ID NO: 4533855 - DNA, 14 bp, Homo sapiens
ccaccgttcagtca

SEQ ID NO: 4533856 - DNA, 15 bp, Homo sapiens
ccaccgttcagtcat

SEQ ID NO: 4533857 - DNA, 16 bp, Homo sapiens
ccacctagactctccc

SEQ ID NO: 4533858 - DNA, 18 bp, Homo sapiens
ccacctaggccactcctc

SEQ ID NO: 4533859 - DNA, 19 bp, Homo sapiens
ccacctatgcctgtggtga

SEQ ID NO: 4533860 - DNA, 16 bp, Homo sapiens
ccacctcaagaccccc

SEQ ID NO: 4533861 - DNA, 15 bp, Homo sapiens
ccacctcagccttgg

SEQ ID NO: 4533862 - DNA, 16 bp, Homo sapiens
ccacctcagccttgga

SEQ ID NO: 4533863 - DNA, 22 bp, Homo sapiens
ccacctcccctatccacccagc

SEQ ID NO: 4533864 - DNA, 18 bp, Homo sapiens
ccacctcggcctcccaaa

SEQ ID NO: 4533865 - DNA, 22 bp, Homo sapiens
ccacctcttgtgcaaggtggcc

SEQ ID NO: 4533866 - DNA, 17 bp, Homo sapiens
ccacctgacacaccagg

SEQ ID NO: 4533867 - DNA, 17 bp, Homo sapiens
ccacctgagaccctggg

SEQ ID NO: 4533868 - DNA, 15 bp, Homo sapiens
ccacctgcccatcac

SEQ ID NO: 4533869 - DNA, 15 bp, Homo sapiens
ccacctgccttggcc

SEQ ID NO: 4533870 - DNA, 23 bp, Homo sapiens
ccacctgccttggcctcccaaag

SEQ ID NO: 4533871 - DNA, 19 bp, Homo sapiens
ccacctgctagtgtgaatt

SEQ ID NO: 4533872 - DNA, 22 bp, Homo sapiens
ccacctgctgagagacccaagg

SEQ ID NO: 4533873 - DNA, 19 bp, Homo sapiens
ccacctggaaactgctcag

SEQ ID NO: 4533874 - DNA, 21 bp, Homo sapiens
ccacctggatctatccctgcg

SEQ ID NO: 4533875 - DNA, 22 bp, Homo sapiens
ccacctggcaaaggacccttga

SEQ ID NO: 4533876 - DNA, 22 bp, Homo sapiens
ccacctggccccatgtctctca

SEQ ID NO: 4533877 - DNA, 20 bp, Homo sapiens
ccacctggcttcatacagaa

SEQ ID NO: 4533878 - DNA, 15 bp, Homo sapiens
ccacctgtggggcct

SEQ ID NO: 4533879 - DNA, 20 bp, Homo sapiens
ccaccttaaattaaacaatt

SEQ ID NO: 4533880 - DNA, 15 bp, Homo sapiens
ccaccttcccagctc

SEQ ID NO: 4533881 - DNA, 21 bp, Homo sapiens
ccaccttcccagctctccctc

SEQ ID NO: 4533882 - DNA, 13 bp, Homo sapiens
ccaccttgttaca

SEQ ID NO: 4533883 - DNA, 16 bp, Homo sapiens
ccacctttcaccctca

SEQ ID NO: 4533884 - DNA, 16 bp, Homo sapiens
ccacctttgtgcagct

SEQ ID NO: 4533885 - DNA, 14 bp, Homo sapiens
ccacgactgtctcc

SEQ ID NO: 4533886 - DNA, 16 bp, Homo sapiens
ccacgactgtctccat

SEQ ID NO: 4533887 - DNA, 14 bp, Homo sapiens
ccacgagggctggc

SEQ ID NO: 4533888 - DNA, 17 bp, Homo sapiens
ccacgagggctggctgg

SEQ ID NO: 4533889 - DNA, 12 bp, Homo sapiens
ccacgccacagg

SEQ ID NO: 4533890 - DNA, 18 bp, Homo sapiens
ccacgcccaccagccttg

SEQ ID NO: 4533891 - DNA, 16 bp, Homo sapiens
ccacgccctccctgct

SEQ ID NO: 4533892 - DNA, 17 bp, Homo sapiens
ccacgccctccctgcta

SEQ ID NO: 4533893 - DNA, 18 bp, Homo sapiens
ccacgcctcttgaccagg

SEQ ID NO: 4533894 - DNA, 19 bp, Homo sapiens
ccacgcctcttgaccaggc

SEQ ID NO: 4533895 - DNA, 18 bp, Homo sapiens
ccacgctagggctggctc

SEQ ID NO: 4533896 - DNA, 13 bp, Homo sapiens
ccacgctccagct

SEQ ID NO: 4533897 - DNA, 13 bp, Homo sapiens
ccacgctgggcct

SEQ ID NO: 4533898 - DNA, 17 bp, Homo sapiens
ccacggaaggcgggctg

SEQ ID NO: 4533899 - DNA, 18 bp, Homo sapiens
ccacgtcccagcatccct

SEQ ID NO: 4533900 - DNA, 22 bp, Homo sapiens
ccacgtcccagcatccctggag

SEQ ID NO: 4533901 - DNA, 20 bp, Homo sapiens
ccacgtcgggcttccctggc

SEQ ID NO: 4533902 - DNA, 16 bp, Homo sapiens
ccacgtgccaggcccg

SEQ ID NO: 4533903 - DNA, 22 bp, Homo sapiens
ccacgtggcgggaatgagctgt

SEQ ID NO: 4533904 - DNA, 15 bp, Homo sapiens
ccacgttccttactg

SEQ ID NO: 4533905 - DNA, 13 bp, Homo sapiens
ccacgttctgtta

SEQ ID NO: 4533906 - DNA, 20 bp, Homo sapiens
ccactaagaacccctctgct

SEQ ID NO: 4533907 - DNA, 14 bp, Homo sapiens
ccactaataaagtg

SEQ ID NO: 4533908 - DNA, 13 bp, Homo sapiens
ccactacacctgg

SEQ ID NO: 4533909 - DNA, 15 bp, Homo sapiens
ccactacacctggct

SEQ ID NO: 4533910 - DNA, 17 bp, Homo sapiens
ccactacacctggctga

SEQ ID NO: 4533911 - DNA, 12 bp, Homo sapiens
ccactaccagcc

SEQ ID NO: 4533912 - DNA, 19 bp, Homo sapiens
ccactaggaatcccagagg

SEQ ID NO: 4533913 - DNA, 14 bp, Homo sapiens
ccactaggtgtccc

SEQ ID NO: 4533914 - DNA, 15 bp, Homo sapiens
ccactaggtgtcccc

SEQ ID NO: 4533915 - DNA, 17 bp, Homo sapiens
ccactaggtgtccccaa

SEQ ID NO: 4533916 - DNA, 21 bp, Homo sapiens
ccactaggtgtccccaacgtc

SEQ ID NO: 4533917 - DNA, 13 bp, Homo sapiens
ccactcaacagag

SEQ ID NO: 4533918 - DNA, 17 bp, Homo sapiens
ccactcaacagagagga

SEQ ID NO: 4533919 - DNA, 13 bp, Homo sapiens
ccactcacacagc

SEQ ID NO: 4533920 - DNA, 18 bp, Homo sapiens
ccactcacacagccaggt

SEQ ID NO: 4533921 - DNA, 19 bp, Homo sapiens
ccactcatgtgactctttc

SEQ ID NO: 4533922 - DNA, 22 bp, Homo sapiens
ccactcatgtgactctttccaa

SEQ ID NO: 4533923 - DNA, 13 bp, Homo sapiens
ccactcattttga

SEQ ID NO: 4533924 - DNA, 14 bp, Homo sapiens
ccactccctgggac

SEQ ID NO: 4533925 - DNA, 15 bp, Homo sapiens
ccactccctgggaca

SEQ ID NO: 4533926 - DNA, 20 bp, Homo sapiens
ccactccggccctccagagc

SEQ ID NO: 4533927 - DNA, 12 bp, Homo sapiens
ccactcctccaa

SEQ ID NO: 4533928 - DNA, 14 bp, Homo sapiens
ccactcctctgact

SEQ ID NO: 4533929 - DNA, 15 bp, Homo sapiens
ccactccttccagaa

SEQ ID NO: 4533930 - DNA, 19 bp, Homo sapiens
ccactccttccttcaggac

SEQ ID NO: 4533931 - DNA, 15 bp, Homo sapiens
ccactcgccttctta

SEQ ID NO: 4533932 - DNA, 16 bp, Homo sapiens
ccactctaccctccca

SEQ ID NO: 4533933 - DNA, 16 bp, Homo sapiens
ccactctagttctaga

SEQ ID NO: 4533934 - DNA, 16 bp, Homo sapiens
ccactctcattcccca

SEQ ID NO: 4533935 - DNA, 17 bp, Homo sapiens
ccactctcattccccag

SEQ ID NO: 4533936 - DNA, 18 bp, Homo sapiens
ccactctcattccccagg

SEQ ID NO: 4533937 - DNA, 14 bp, Homo sapiens
ccactctccccaca

SEQ ID NO: 4533938 - DNA, 15 bp, Homo sapiens
ccactctccccacac

SEQ ID NO: 4533939 - DNA, 21 bp, Homo sapiens
ccactctgccccttgccctcc

SEQ ID NO: 4533940 - DNA, 23 bp, Homo sapiens
ccactctggagcatttctcatca

SEQ ID NO: 4533941 - DNA, 20 bp, Homo sapiens
ccactcttctttaagccata

SEQ ID NO: 4533942 - DNA, 15 bp, Homo sapiens
ccactgaaaaaatat

SEQ ID NO: 4533943 - DNA, 13 bp, Homo sapiens
ccactgagggcag

SEQ ID NO: 4533944 - DNA, 14 bp, Homo sapiens
ccactgcactccag

SEQ ID NO: 4533945 - DNA, 19 bp, Homo sapiens
ccactgcactttccaatgc

SEQ ID NO: 4533946 - DNA, 16 bp, Homo sapiens
ccactgccattaccca

SEQ ID NO: 4533947 - DNA, 19 bp, Homo sapiens
ccactgccattacccagtg

SEQ ID NO: 4533948 - DNA, 21 bp, Homo sapiens
ccactgccattacccagtgcc

SEQ ID NO: 4533949 - DNA, 23 bp, Homo sapiens
ccactgcgggagctctgtatggt

SEQ ID NO: 4533950 - DNA, 23 bp, Homo sapiens
ccactgctgggggtgagctgtac

SEQ ID NO: 4533951 - DNA, 14 bp, Homo sapiens
ccactgcttttccc

SEQ ID NO: 4533952 - DNA, 20 bp, Homo sapiens
ccactggaaggaacatggag

SEQ ID NO: 4533953 - DNA, 17 bp, Homo sapiens
ccactggatcctgctgc

SEQ ID NO: 4533954 - DNA, 21 bp, Homo sapiens
ccactggatcctgctgctttg

SEQ ID NO: 4533955 - DNA, 16 bp, Homo sapiens
ccactggcatcgcagc

SEQ ID NO: 4533956 - DNA, 16 bp, Homo sapiens
ccactggcttttgcct

SEQ ID NO: 4533957 - DNA, 17 bp, Homo sapiens
ccactggggactttatt

SEQ ID NO: 4533958 - DNA, 18 bp, Homo sapiens
ccactggggactttattt

SEQ ID NO: 4533959 - DNA, 21 bp, Homo sapiens
ccactggggaggaatcctgga

SEQ ID NO: 4533960 - DNA, 23 bp, Homo sapiens
ccactggggaggaatcctggacc

SEQ ID NO: 4533961 - DNA, 20 bp, Homo sapiens
ccactggggtgccttcactg

SEQ ID NO: 4533962 - DNA, 23 bp, Homo sapiens
ccactggggtgccttcactgggc

SEQ ID NO: 4533963 - DNA, 14 bp, Homo sapiens
ccactgtcacaggc

SEQ ID NO: 4533964 - DNA, 20 bp, Homo sapiens
ccactgtgcaggtgctattg

SEQ ID NO: 4533965 - DNA, 22 bp, Homo sapiens
ccactgtgtactggagcctgca

SEQ ID NO: 4533966 - DNA, 21 bp, Homo sapiens
ccactgttctgaaaggagaca

SEQ ID NO: 4533967 - DNA, 16 bp, Homo sapiens
ccacttaaaaattaaa

SEQ ID NO: 4533968 - DNA, 23 bp, Homo sapiens
ccacactaacctgggttcccttt

SEQ ID NO: 4533969 - DNA, 18 bp, Homo sapiens
ccacactgaccaagtgct

SEQ ID NO: 4533970 - DNA, 13 bp, Homo sapiens
ccacactgccacc

SEQ ID NO: 4533971 - DNA, 18 bp, Homo sapiens
ccacagaaagccaggagc

SEQ ID NO: 4533972 - DNA, 17 bp, Homo sapiens
ccacagaacctttgtca

SEQ ID NO: 4533973 - DNA, 17 bp, Homo sapiens
ccacagagaggagggga

SEQ ID NO: 4533974 - DNA, 13 bp, Homo sapiens
ccacagaggcccc

SEQ ID NO: 4533975 - DNA, 21 bp, Homo sapiens
ccacagaggccccacctgaag

SEQ ID NO: 4533976 - DNA, 17 bp, Homo sapiens
ccacagagtgctggact

SEQ ID NO: 4533977 - DNA, 18 bp, Homo sapiens
ccacagagtgctggactg

SEQ ID NO: 4533978 - DNA, 15 bp, Homo sapiens
ccacagatttttttg

SEQ ID NO: 4533979 - DNA, 19 bp, Homo sapiens
ccacagatttttttgtaag

SEQ ID NO: 4533980 - DNA, 11 bp, Homo sapiens
ccacagcagac

SEQ ID NO: 4533981 - DNA, 14 bp, Homo sapiens
ccacagcagcattt

SEQ ID NO: 4533982 - DNA, 20 bp, Homo sapiens
ccacagcagccccaggagaa

SEQ ID NO: 4533983 - DNA, 15 bp, Homo sapiens
ccacagcagtgtcac

SEQ ID NO: 4533984 - DNA, 12 bp, Homo sapiens
ccacagccagag

SEQ ID NO: 4533985 - DNA, 14 bp, Homo sapiens
ccacagccagagga

SEQ ID NO: 4533986 - DNA, 17 bp, Homo sapiens
ccacagccagaggaggg

SEQ ID NO: 4533987 - DNA, 16 bp, Homo sapiens
ccacagcctcccctgc

SEQ ID NO: 4533988 - DNA, 20 bp, Homo sapiens
ccacagcctcccctgccagg

SEQ ID NO: 4533989 - DNA, 16 bp, Homo sapiens
ccacagctcccacccc

SEQ ID NO: 4533990 - DNA, 13 bp, Homo sapiens
ccacagctgctgg

SEQ ID NO: 4533991 - DNA, 14 bp, Homo sapiens
ccacagctgctgga

SEQ ID NO: 4533992 - DNA, 14 bp, Homo sapiens
ccacagctggcctg

SEQ ID NO: 4533993 - DNA, 15 bp, Homo sapiens
ccacagctggcctgg

SEQ ID NO: 4533994 - DNA, 18 bp, Homo sapiens
ccacaggaagatgggagg

SEQ ID NO: 4533995 - DNA, 21 bp, Homo sapiens
ccacaggaagatgggaggtgg

SEQ ID NO: 4533996 - DNA, 21 bp, Homo sapiens
ccacaggacatttctctaaga

SEQ ID NO: 4533997 - DNA, 15 bp, Homo sapiens
ccacaggcagtccag

SEQ ID NO: 4533998 - DNA, 19 bp, Homo sapiens
ccacaggcagtccaggcct

SEQ ID NO: 4533999 - DNA, 12 bp, Homo sapiens
ccacaggcctga

SEQ ID NO: 4534000 - DNA, 19 bp, Homo sapiens
ccacaggcctgagatttca

SEQ ID NO: 4534001 - DNA, 17 bp, Homo sapiens
ccacagggagctccgtc

SEQ ID NO: 4534002 - DNA, 20 bp, Homo sapiens
ccacagggctaagagctagc

SEQ ID NO: 4534003 - DNA, 20 bp, Homo sapiens
ccacagtagaactgtctgtg

SEQ ID NO: 4534004 - DNA, 14 bp, Homo sapiens
ccacagtcactgga

SEQ ID NO: 4534005 - DNA, 21 bp, Homo sapiens
ccacagtggcgggcccactca

SEQ ID NO: 4534006 - DNA, 14 bp, Homo sapiens
ccacataaatttta

SEQ ID NO: 4534007 - DNA, 20 bp, Homo sapiens
ccacataagaaggcaatttt

SEQ ID NO: 4534008 - DNA, 10 bp, Homo sapiens
ccacatccct

SEQ ID NO: 4534009 - DNA, 14 bp, Homo sapiens
ccacatctgcctta

SEQ ID NO: 4534010 - DNA, 21 bp, Homo sapiens
ccacatgaggccatctcagga

SEQ ID NO: 4534011 - DNA, 14 bp, Homo sapiens
ccacatgccccagg

SEQ ID NO: 4534012 - DNA, 16 bp, Homo sapiens
ccacatgccccaggct

SEQ ID NO: 4534013 - DNA, 19 bp, Homo sapiens
ccacatgcctgcgcctgct

SEQ ID NO: 4534014 - DNA, 23 bp, Homo sapiens
ccacatggcttagagaggcttga

SEQ ID NO: 4534015 - DNA, 24 bp, Homo sapiens
ccacatgggagcagtccatgcatg

SEQ ID NO: 4534016 - DNA, 17 bp, Homo sapiens
ccacatggtgtctccca

SEQ ID NO: 4534017 - DNA, 18 bp, Homo sapiens
ccacatggtgtctcccaa

SEQ ID NO: 4534018 - DNA, 22 bp, Homo sapiens
ccacatgttactggataaattg

SEQ ID NO: 4534019 - DNA, 16 bp, Homo sapiens
ccacattactttttat

SEQ ID NO: 4534020 - DNA, 13 bp, Homo sapiens
ccacatttggaat

SEQ ID NO: 4534021 - DNA, 12 bp, Homo sapiens
ccaccaacccat

SEQ ID NO: 4534022 - DNA, 17 bp, Homo sapiens
ccaccaagagggacgcc

SEQ ID NO: 4534023 - DNA, 15 bp, Homo sapiens
ccaccaagggatctg

SEQ ID NO: 4534024 - DNA, 13 bp, Homo sapiens
ccaccaccctgag

SEQ ID NO: 4534025 - DNA, 20 bp, Homo sapiens
ccaccagaacgcaccccact

SEQ ID NO: 4534026 - DNA, 14 bp, Homo sapiens
ccaccagagccggg

SEQ ID NO: 4534027 - DNA, 15 bp, Homo sapiens
ccaccagagccggga

SEQ ID NO: 4534028 - DNA, 20 bp, Homo sapiens
ccaccagcccccgccccaga

SEQ ID NO: 4534029 - DNA, 13 bp, Homo sapiens
ccaccagcccctc

SEQ ID NO: 4534030 - DNA, 15 bp, Homo sapiens
ccaccagccttgctc

SEQ ID NO: 4534031 - DNA, 16 bp, Homo sapiens
ccaccagccttgctct

SEQ ID NO: 4534032 - DNA, 15 bp, Homo sapiens
ccaccaggactgaaa

SEQ ID NO: 4534033 - DNA, 17 bp, Homo sapiens
ccaccaggactgaaaga

SEQ ID NO: 4534034 - DNA, 14 bp, Homo sapiens
ccaccaggccagct

SEQ ID NO: 4534035 - DNA, 11 bp, Homo sapiens
ccaccagggat

SEQ ID NO: 4534036 - DNA, 23 bp, Homo sapiens
ccaccagggatcacagaccacag

SEQ ID NO: 4534037 - DNA, 16 bp, Homo sapiens
ccaccagggctccagg

SEQ ID NO: 4534038 - DNA, 17 bp, Homo sapiens
ccaccagggctccagga

SEQ ID NO: 4534039 - DNA, 16 bp, Homo sapiens
ccaccaggtgcctttc

SEQ ID NO: 4534040 - DNA, 12 bp, Homo sapiens
ccaccagtgcct

SEQ ID NO: 4534041 - DNA, 14 bp, Homo sapiens
ccaccagtgcctct

SEQ ID NO: 4534042 - DNA, 15 bp, Homo sapiens
ccaccagtgcctctc

SEQ ID NO: 4534043 - DNA, 21 bp, Homo sapiens
ccaccatgctctctcacctgc

SEQ ID NO: 4534044 - DNA, 17 bp, Homo sapiens
ccaccatgcttgcctga

SEQ ID NO: 4534045 - DNA, 21 bp, Homo sapiens
ccaccatgcttgcctgaagct

SEQ ID NO: 4534046 - DNA, 22 bp, Homo sapiens
ccaccatgcttgcctgaagctt

SEQ ID NO: 4534047 - DNA, 19 bp, Homo sapiens
ccaccatggaccagcccat

SEQ ID NO: 4534048 - DNA, 21 bp, Homo sapiens
ccaccatggaccagcccattg

SEQ ID NO: 4534049 - DNA, 15 bp, Homo sapiens
ccaccatttaatttc

SEQ ID NO: 4534050 - DNA, 18 bp, Homo sapiens
ccacccaagcctgctggc

SEQ ID NO: 4534051 - DNA, 20 bp, Homo sapiens
ccacccaagcctgctggctg

SEQ ID NO: 4534052 - DNA, 13 bp, Homo sapiens
ccacccacctggc

SEQ ID NO: 4534053 - DNA, 11 bp, Homo sapiens
ccacccagccc

SEQ ID NO: 4534054 - DNA, 13 bp, Homo sapiens
ccacccagcccat

SEQ ID NO: 4534055 - DNA, 12 bp, Homo sapiens
ccacccaggagg

SEQ ID NO: 4534056 - DNA, 14 bp, Homo sapiens
ccacccaggaggga

SEQ ID NO: 4534057 - DNA, 22 bp, Homo sapiens
ccacccagtccatgctccaggg

SEQ ID NO: 4534058 - DNA, 14 bp, Homo sapiens
ccacccatgtcacc

SEQ ID NO: 4534059 - DNA, 18 bp, Homo sapiens
ccaccccaaaccccagcc

SEQ ID NO: 4534060 - DNA, 18 bp, Homo sapiens
ccaccccatccagccaga

SEQ ID NO: 4534061 - DNA, 13 bp, Homo sapiens
ccacccccagccc

SEQ ID NO: 4534062 - DNA, 14 bp, Homo sapiens
ccacccccagcccc

SEQ ID NO: 4534063 - DNA, 22 bp, Homo sapiens
ccacccccctctctttctctgg

SEQ ID NO: 4534064 - DNA, 12 bp, Homo sapiens
ccaccccctagg

SEQ ID NO: 4534065 - DNA, 18 bp, Homo sapiens
ccaccccctccccagggg

SEQ ID NO: 4534066 - DNA, 13 bp, Homo sapiens
ccaccccctgccc

SEQ ID NO: 4534067 - DNA, 14 bp, Homo sapiens
ccaccccctgccct

SEQ ID NO: 4534068 - DNA, 14 bp, Homo sapiens
ccaccccctgtccc

SEQ ID NO: 4534069 - DNA, 12 bp, Homo sapiens
ccacccccttca

SEQ ID NO: 4534070 - DNA, 18 bp, Homo sapiens
ccacccccttctctgctc

SEQ ID NO: 4534071 - DNA, 14 bp, Homo sapiens
ccaccccgggctct

SEQ ID NO: 4534072 - DNA, 20 bp, Homo sapiens
ccaccccgggctctctgctg

SEQ ID NO: 4534073 - DNA, 14 bp, Homo sapiens
ccacccggccacag

SEQ ID NO: 4534074 - DNA, 16 bp, Homo sapiens
ccacccgggggagccc

SEQ ID NO: 4534075 - DNA, 20 bp, Homo sapiens
ccacccgtggggtgctgccc

SEQ ID NO: 4534076 - DNA, 21 bp, Homo sapiens
ccacccgtggggtgctgccct

SEQ ID NO: 4534077 - DNA, 15 bp, Homo sapiens
ccaccctccatgctc

SEQ ID NO: 4534078 - DNA, 16 bp, Homo sapiens
ccaccctccctggagt

SEQ ID NO: 4534079 - DNA, 12 bp, Homo sapiens
ccaccctcctgt

SEQ ID NO: 4534080 - DNA, 21 bp, Homo sapiens
ccaccctcctgtcttcccagg

SEQ ID NO: 4534081 - DNA, 22 bp, Homo sapiens
ccaccctcctgtcttcccaggg

SEQ ID NO: 4534082 - DNA, 23 bp, Homo sapiens
ccaccctcctgtcttcccagggt

SEQ ID NO: 4534083 - DNA, 13 bp, Homo sapiens
ccaccctgagccg

SEQ ID NO: 4534084 - DNA, 21 bp, Homo sapiens
ccaccctgagccggccccagg

SEQ ID NO: 4534085 - DNA, 19 bp, Homo sapiens
ccaccctgagctcggggac

SEQ ID NO: 4534086 - DNA, 20 bp, Homo sapiens
ccaccctgagctcggggaca

SEQ ID NO: 4534087 - DNA, 19 bp, Homo sapiens
ccaccctgccaagactcct

SEQ ID NO: 4534088 - DNA, 15 bp, Homo sapiens
ccacccttggcctgt

SEQ ID NO: 4534089 - DNA, 14 bp, Homo sapiens
ccaccctttcacaa

SEQ ID NO: 4534090 - DNA, 22 bp, Homo sapiens
ccaaggaccttggaagagcaag

SEQ ID NO: 4534091 - DNA, 13 bp, Homo sapiens
ccaaggaggcctg

SEQ ID NO: 4534092 - DNA, 18 bp, Homo sapiens
ccaaggaggcctggggag

SEQ ID NO: 4534093 - DNA, 15 bp, Homo sapiens
ccaaggagggaagag

SEQ ID NO: 4534094 - DNA, 18 bp, Homo sapiens
ccaaggatcggactctgc

SEQ ID NO: 4534095 - DNA, 23 bp, Homo sapiens
ccaaggatcggactctgcccctg

SEQ ID NO: 4534096 - DNA, 18 bp, Homo sapiens
ccaaggccagagtggcct

SEQ ID NO: 4534097 - DNA, 19 bp, Homo sapiens
ccaaggccttcccctggca

SEQ ID NO: 4534098 - DNA, 18 bp, Homo sapiens
ccaaggctagaaccacct

SEQ ID NO: 4534099 - DNA, 16 bp, Homo sapiens
ccaaggctctcccctc

SEQ ID NO: 4534100 - DNA, 19 bp, Homo sapiens
ccaaggctctcccctctcg

SEQ ID NO: 4534101 - DNA, 19 bp, Homo sapiens
ccaaggctgattaaaccaa

SEQ ID NO: 4534102 - DNA, 13 bp, Homo sapiens
ccaagggcccaaa

SEQ ID NO: 4534103 - DNA, 21 bp, Homo sapiens
ccaagggctttgttttgcaca

SEQ ID NO: 4534104 - DNA, 15 bp, Homo sapiens
ccaaggtcctgctca

SEQ ID NO: 4534105 - DNA, 12 bp, Homo sapiens
ccaaggtgctgg

SEQ ID NO: 4534106 - DNA, 21 bp, Homo sapiens
ccaaggttactcagcagcaga

SEQ ID NO: 4534107 - DNA, 16 bp, Homo sapiens
ccaaggttcccttgtg

SEQ ID NO: 4534108 - DNA, 16 bp, Homo sapiens
ccaaggttgcacagca

SEQ ID NO: 4534109 - DNA, 13 bp, Homo sapiens
ccaagtaaaatgt

SEQ ID NO: 4534110 - DNA, 18 bp, Homo sapiens
ccaagtaaacagggtacc

SEQ ID NO: 4534111 - DNA, 21 bp, Homo sapiens
ccaagtatgaagtataaatct

SEQ ID NO: 4534112 - DNA, 13 bp, Homo sapiens
ccaagtcccaccc

SEQ ID NO: 4534113 - DNA, 21 bp, Homo sapiens
ccaagtccgcagaagccctga

SEQ ID NO: 4534114 - DNA, 16 bp, Homo sapiens
ccaagtctcagaagag

SEQ ID NO: 4534115 - DNA, 15 bp, Homo sapiens
ccaagtctggcacca

SEQ ID NO: 4534116 - DNA, 12 bp, Homo sapiens
ccaagtgcaata

SEQ ID NO: 4534117 - DNA, 21 bp, Homo sapiens
ccaagtgcagagttcagactt

SEQ ID NO: 4534118 - DNA, 23 bp, Homo sapiens
ccaagtgccaaagaagcagacca

SEQ ID NO: 4534119 - DNA, 13 bp, Homo sapiens
ccaagtgctggcc

SEQ ID NO: 4534120 - DNA, 22 bp, Homo sapiens
ccaagtggggtgctgggaggag

SEQ ID NO: 4534121 - DNA, 11 bp, Homo sapiens
ccaagtgtctt

SEQ ID NO: 4534122 - DNA, 23 bp, Homo sapiens
ccaataaaagcaattccaacctt

SEQ ID NO: 4534123 - DNA, 16 bp, Homo sapiens
ccaataaaatgtatct

SEQ ID NO: 4534124 - DNA, 14 bp, Homo sapiens
ccaataaaccagtg

SEQ ID NO: 4534125 - DNA, 17 bp, Homo sapiens
ccaataaaccagtgtga

SEQ ID NO: 4534126 - DNA, 20 bp, Homo sapiens
ccaataaaccagtgtgaacc

SEQ ID NO: 4534127 - DNA, 14 bp, Homo sapiens
ccaataaagccttt

SEQ ID NO: 4534128 - DNA, 13 bp, Homo sapiens
ccaataaaggcag

SEQ ID NO: 4534129 - DNA, 14 bp, Homo sapiens
ccaataaaggcagc

SEQ ID NO: 4534130 - DNA, 16 bp, Homo sapiens
ccaataaagtgccttc

SEQ ID NO: 4534131 - DNA, 19 bp, Homo sapiens
ccaataaagtgccttctgg

SEQ ID NO: 4534132 - DNA, 16 bp, Homo sapiens
ccaatagaaagaaact

SEQ ID NO: 4534133 - DNA, 22 bp, Homo sapiens
ccaatagggctgagctctctgt

SEQ ID NO: 4534134 - DNA, 18 bp, Homo sapiens
ccaatattaaatctgctg

SEQ ID NO: 4534135 - DNA, 15 bp, Homo sapiens
ccaatattgtacagt

SEQ ID NO: 4534136 - DNA, 18 bp, Homo sapiens
ccaatatttctgctttct

SEQ ID NO: 4534137 - DNA, 12 bp, Homo sapiens
ccaatattttaa

SEQ ID NO: 4534138 - DNA, 14 bp, Homo sapiens
ccaatcagcactct

SEQ ID NO: 4534139 - DNA, 21 bp, Homo sapiens
ccaatcagcttttgttctaga

SEQ ID NO: 4534140 - DNA, 13 bp, Homo sapiens
ccaatcctatgtt

SEQ ID NO: 4534141 - DNA, 15 bp, Homo sapiens
ccaatcggactgcca

SEQ ID NO: 4534142 - DNA, 17 bp, Homo sapiens
ccaatcggactgccaaa

SEQ ID NO: 4534143 - DNA, 19 bp, Homo sapiens
ccaatcggactgccaaatt

SEQ ID NO: 4534144 - DNA, 15 bp, Homo sapiens
ccaatgaaaaaatgt

SEQ ID NO: 4534145 - DNA, 23 bp, Homo sapiens
ccaatgaaaaaatgtatatgcac

SEQ ID NO: 4534146 - DNA, 14 bp, Homo sapiens
ccaatgaacatctc

SEQ ID NO: 4534147 - DNA, 18 bp, Homo sapiens
ccaatgaattattatata

SEQ ID NO: 4534148 - DNA, 23 bp, Homo sapiens
ccaatgagactctagggtccagt

SEQ ID NO: 4534149 - DNA, 14 bp, Homo sapiens
ccaatgccacagac

SEQ ID NO: 4534150 - DNA, 21 bp, Homo sapiens
ccaatgccacatacttgcagc

SEQ ID NO: 4534151 - DNA, 16 bp, Homo sapiens
ccaatgcctttttaga

SEQ ID NO: 4534152 - DNA, 19 bp, Homo sapiens
ccaatggaaagcttttcag

SEQ ID NO: 4534153 - DNA, 22 bp, Homo sapiens
ccaatggaaagcttttcagtgt

SEQ ID NO: 4534154 - DNA, 12 bp, Homo sapiens
ccaatgtcttga

SEQ ID NO: 4534155 - DNA, 16 bp, Homo sapiens
ccaatgttatgccagc

SEQ ID NO: 4534156 - DNA, 20 bp, Homo sapiens
ccaatgttttattggggaat

SEQ ID NO: 4534157 - DNA, 22 bp, Homo sapiens
ccaattaaaatactatgcagta

SEQ ID NO: 4534158 - DNA, 19 bp, Homo sapiens
ccaattacagggtgactca

SEQ ID NO: 4534159 - DNA, 17 bp, Homo sapiens
ccaattatcatcttttg

SEQ ID NO: 4534160 - DNA, 20 bp, Homo sapiens
ccaattccttgcacatagta

SEQ ID NO: 4534161 - DNA, 17 bp, Homo sapiens
ccaattctggacagaca

SEQ ID NO: 4534162 - DNA, 13 bp, Homo sapiens
ccaattgcctctt

SEQ ID NO: 4534163 - DNA, 13 bp, Homo sapiens
ccaattgctaccg

SEQ ID NO: 4534164 - DNA, 20 bp, Homo sapiens
ccaatttcaccccattttct

SEQ ID NO: 4534165 - DNA, 22 bp, Homo sapiens
ccaatttcaccccattttctgt

SEQ ID NO: 4534166 - DNA, 21 bp, Homo sapiens
ccaatttcggattttttccaa

SEQ ID NO: 4534167 - DNA, 22 bp, Homo sapiens
ccaatttcggattttttccaaa

SEQ ID NO: 4534168 - DNA, 23 bp, Homo sapiens
ccaatttcggattttttccaaaa

SEQ ID NO: 4534169 - DNA, 20 bp, Homo sapiens
ccaatttggtaaaaatgctg

SEQ ID NO: 4534170 - DNA, 22 bp, Homo sapiens
ccaatttggtaaaaatgctgct

SEQ ID NO: 4534171 - DNA, 22 bp, Homo sapiens
ccaattttaatttagtaaatgt

SEQ ID NO: 4534172 - DNA, 23 bp, Homo sapiens
ccaattttaatttagtaaatgtt

SEQ ID NO: 4534173 - DNA, 20 bp, Homo sapiens
ccaattttcagacacatttt

SEQ ID NO: 4534174 - DNA, 15 bp, Homo sapiens
ccacaaaaaatactt

SEQ ID NO: 4534175 - DNA, 16 bp, Homo sapiens
ccacaaacacattata

SEQ ID NO: 4534176 - DNA, 16 bp, Homo sapiens
ccacaaactgatttct

SEQ ID NO: 4534177 - DNA, 18 bp, Homo sapiens
ccacaaagccccccagct

SEQ ID NO: 4534178 - DNA, 19 bp, Homo sapiens
ccacaaagccccccagctc

SEQ ID NO: 4534179 - DNA, 22 bp, Homo sapiens
ccacaaagccccccagctccca

SEQ ID NO: 4534180 - DNA, 22 bp, Homo sapiens
ccacaaagctaggatggttctg

SEQ ID NO: 4534181 - DNA, 16 bp, Homo sapiens
ccacaacatgaggcca

SEQ ID NO: 4534182 - DNA, 13 bp, Homo sapiens
ccacaactaacaa

SEQ ID NO: 4534183 - DNA, 15 bp, Homo sapiens
ccacaagattcccag

SEQ ID NO: 4534184 - DNA, 16 bp, Homo sapiens
ccacaagattcccaga

SEQ ID NO: 4534185 - DNA, 18 bp, Homo sapiens
ccacaagattcccagaga

SEQ ID NO: 4534186 - DNA, 24 bp, Homo sapiens
ccacaagattcccagagacaggaa

SEQ ID NO: 4534187 - DNA, 16 bp, Homo sapiens
ccacaagccttactca

SEQ ID NO: 4534188 - DNA, 21 bp, Homo sapiens
ccacaagccttactcacctct

SEQ ID NO: 4534189 - DNA, 11 bp, Homo sapiens
ccacaagctgc

SEQ ID NO: 4534190 - DNA, 13 bp, Homo sapiens
ccacaagctgcac

SEQ ID NO: 4534191 - DNA, 15 bp, Homo sapiens
ccacaagctgcactg

SEQ ID NO: 4534192 - DNA, 17 bp, Homo sapiens
ccacaagctgcactgtg

SEQ ID NO: 4534193 - DNA, 20 bp, Homo sapiens
ccacaagctgcactgtgaac

SEQ ID NO: 4534194 - DNA, 13 bp, Homo sapiens
ccacacacagcct

SEQ ID NO: 4534195 - DNA, 12 bp, Homo sapiens
ccacacaggcag

SEQ ID NO: 4534196 - DNA, 20 bp, Homo sapiens
ccacacaggtgttccgtggg

SEQ ID NO: 4534197 - DNA, 14 bp, Homo sapiens
ccacaccaagcagc

SEQ ID NO: 4534198 - DNA, 14 bp, Homo sapiens
ccacacccagcggc

SEQ ID NO: 4534199 - DNA, 14 bp, Homo sapiens
ccacacccaggaag

SEQ ID NO: 4534200 - DNA, 17 bp, Homo sapiens
ccacacccctctgctgc

SEQ ID NO: 4534201 - DNA, 19 bp, Homo sapiens
ccacacccctctgctgcaa

SEQ ID NO: 4534202 - DNA, 16 bp, Homo sapiens
ccacaccgcgtcccag

SEQ ID NO: 4534203 - DNA, 17 bp, Homo sapiens
ccacaccgcgtcccagc

SEQ ID NO: 4534204 - DNA, 22 bp, Homo sapiens
ccacaccgcgtcccagctcccc

SEQ ID NO: 4534205 - DNA, 14 bp, Homo sapiens
ccacacctccctac

SEQ ID NO: 4534206 - DNA, 15 bp, Homo sapiens
ccacacctctgccag

SEQ ID NO: 4534207 - DNA, 18 bp, Homo sapiens
ccacacctggcatggtgc

SEQ ID NO: 4534208 - DNA, 13 bp, Homo sapiens
ccacacgagggcc

SEQ ID NO: 4534209 - DNA, 19 bp, Homo sapiens
ccacacggaagcaagcaga

SEQ ID NO: 4534210 - DNA, 15 bp, Homo sapiens
cattctttgcttgaa

SEQ ID NO: 4534211 - DNA, 19 bp, Homo sapiens
cattctttgcttgaacaca

SEQ ID NO: 4534212 - DNA, 20 bp, Homo sapiens
cattctttgcttgaacacag

SEQ ID NO: 4534213 - DNA, 20 bp, Homo sapiens
cattcttttgccacatccct

SEQ ID NO: 4534214 - DNA, 16 bp, Homo sapiens
cattctttttgaaatg

SEQ ID NO: 4534215 - DNA, 18 bp, Homo sapiens
cattgaaagaagagatga

SEQ ID NO: 4534216 - DNA, 19 bp, Homo sapiens
cattgaaatgtaatttcag

SEQ ID NO: 4534217 - DNA, 15 bp, Homo sapiens
cattgaacacaaact

SEQ ID NO: 4534218 - DNA, 22 bp, Homo sapiens
cattgaacacaaactgtaaata

SEQ ID NO: 4534219 - DNA, 19 bp, Homo sapiens
cattgaagcagatttctgc

SEQ ID NO: 4534220 - DNA, 14 bp, Homo sapiens
cattgaaggcttaa

SEQ ID NO: 4534221 - DNA, 18 bp, Homo sapiens
cattgaagtaatgaattt

SEQ ID NO: 4534222 - DNA, 22 bp, Homo sapiens
cattgaatagtggaacattttc

SEQ ID NO: 4534223 - DNA, 21 bp, Homo sapiens
cattgaccgcgactaatttca

SEQ ID NO: 4534224 - DNA, 22 bp, Homo sapiens
cattgaccgcgactaatttcaa

SEQ ID NO: 4534225 - DNA, 23 bp, Homo sapiens
cattgactcctttccaatagaaa

SEQ ID NO: 4534226 - DNA, 13 bp, Homo sapiens
cattgagtagaca

SEQ ID NO: 4534227 - DNA, 19 bp, Homo sapiens
cattgagtttacttataaa

SEQ ID NO: 4534228 - DNA, 22 bp, Homo sapiens
cattgatctgttttacaggaaa

SEQ ID NO: 4534229 - DNA, 18 bp, Homo sapiens
cattgcagcagataactt

SEQ ID NO: 4534230 - DNA, 17 bp, Homo sapiens
cattgccaccaggagaa

SEQ ID NO: 4534231 - DNA, 15 bp, Homo sapiens
cattgccagtgtctt

SEQ ID NO: 4534232 - DNA, 21 bp, Homo sapiens
cattgccagtgtctttctttg

SEQ ID NO: 4534233 - DNA, 11 bp, Homo sapiens
cattgcccagt

SEQ ID NO: 4534234 - DNA, 15 bp, Homo sapiens
cattgcccagtgagc

SEQ ID NO: 4534235 - DNA, 16 bp, Homo sapiens
cattgcccagtgagcc

SEQ ID NO: 4534236 - DNA, 19 bp, Homo sapiens
cattgcctcttctacttgt

SEQ ID NO: 4534237 - DNA, 11 bp, Homo sapiens
cattgcctggc

SEQ ID NO: 4534238 - DNA, 22 bp, Homo sapiens
cattgcctttgaatgttaattt

SEQ ID NO: 4534239 - DNA, 23 bp, Homo sapiens
cattgcgtttgaccttttatgta

SEQ ID NO: 4534240 - DNA, 22 bp, Homo sapiens
cattgctggtagagacccccag

SEQ ID NO: 4534241 - DNA, 23 bp, Homo sapiens
cattgctggtagagacccccagg

SEQ ID NO: 4534242 - DNA, 15 bp, Homo sapiens
cattgcttaaaatat

SEQ ID NO: 4534243 - DNA, 20 bp, Homo sapiens
cattggaattctactggaaa

SEQ ID NO: 4534244 - DNA, 11 bp, Homo sapiens
cattggacaga

SEQ ID NO: 4534245 - DNA, 17 bp, Homo sapiens
cattggacagaaaatgc

SEQ ID NO: 4534246 - DNA, 16 bp, Homo sapiens
cattggacccttccat

SEQ ID NO: 4534247 - DNA, 23 bp, Homo sapiens
cattggagtctcatttgggctag

SEQ ID NO: 4534248 - DNA, 23 bp, Homo sapiens
cattgggaccctccagtgctgga

SEQ ID NO: 4534249 - DNA, 17 bp, Homo sapiens
cattgggcacagtccag

SEQ ID NO: 4534250 - DNA, 19 bp, Homo sapiens
cattgggcacagtccagac

SEQ ID NO: 4534251 - DNA, 21 bp, Homo sapiens
cattggggctcccagccaggc

SEQ ID NO: 4534252 - DNA, 15 bp, Homo sapiens
cattgggtggggctc

SEQ ID NO: 4534253 - DNA, 23 bp, Homo sapiens
cattgggtggggctcctgggagg

SEQ ID NO: 4534254 - DNA, 22 bp, Homo sapiens
cattggtggcatcacagacccc

SEQ ID NO: 4534255 - DNA, 14 bp, Homo sapiens
cattggttttgaaa

SEQ ID NO: 4534256 - DNA, 13 bp, Homo sapiens
cattgtaaaataa

SEQ ID NO: 4534257 - DNA, 14 bp, Homo sapiens
cattgtaaaataat

SEQ ID NO: 4534258 - DNA, 15 bp, Homo sapiens
cattgtaaaataatt

SEQ ID NO: 4534259 - DNA, 15 bp, Homo sapiens
cattgtaatctgcaa

SEQ ID NO: 4534260 - DNA, 15 bp, Homo sapiens
cattgtactccagcc

SEQ ID NO: 4534261 - DNA, 16 bp, Homo sapiens
cattgtagattttgtt

SEQ ID NO: 4534262 - DNA, 19 bp, Homo sapiens
cattgtatagatataatga

SEQ ID NO: 4534263 - DNA, 15 bp, Homo sapiens
cattgtatgtggtca

SEQ ID NO: 4534264 - DNA, 14 bp, Homo sapiens
cattgtcagccttg

SEQ ID NO: 4534265 - DNA, 22 bp, Homo sapiens
cattgtcgtataggcatgtaaa

SEQ ID NO: 4534266 - DNA, 21 bp, Homo sapiens
cattgtctcctatatatttct

SEQ ID NO: 4534267 - DNA, 13 bp, Homo sapiens
cattgtcttgatg

SEQ ID NO: 4534268 - DNA, 17 bp, Homo sapiens
cattgtctttatatgaa

SEQ ID NO: 4534269 - DNA, 15 bp, Homo sapiens
cattgtgagctctgg

SEQ ID NO: 4534270 - DNA, 19 bp, Homo sapiens
cattgtgcttggcccctgg

SEQ ID NO: 4534271 - DNA, 16 bp, Homo sapiens
cattgtggctcctatc

SEQ ID NO: 4534272 - DNA, 14 bp, Homo sapiens
cattgtgttacctg

SEQ ID NO: 4534273 - DNA, 12 bp, Homo sapiens
cattgttgtaaa

SEQ ID NO: 4534274 - DNA, 16 bp, Homo sapiens
cattgttgtaaagtat

SEQ ID NO: 4534275 - DNA, 18 bp, Homo sapiens
cattgtttagaaagaata

SEQ ID NO: 4534276 - DNA, 17 bp, Homo sapiens
cattgtttcgtaacaca

SEQ ID NO: 4534277 - DNA, 13 bp, Homo sapiens
cattgttttgaat

SEQ ID NO: 4534278 - DNA, 16 bp, Homo sapiens
cattgttttgaatatt

SEQ ID NO: 4534279 - DNA, 18 bp, Homo sapiens
cattgttttgaatattac

SEQ ID NO: 4534280 - DNA, 14 bp, Homo sapiens
cattgtttttgtat

SEQ ID NO: 4534281 - DNA, 22 bp, Homo sapiens
catttaaaaaggtttaaaacta

SEQ ID NO: 4534282 - DNA, 16 bp, Homo sapiens
catttaaacatgttta

SEQ ID NO: 4534283 - DNA, 12 bp, Homo sapiens
catttaaacttt

SEQ ID NO: 4534284 - DNA, 15 bp, Homo sapiens
catttaaacttttta

SEQ ID NO: 4534285 - DNA, 19 bp, Homo sapiens
catttaaagcttattaaaa

SEQ ID NO: 4534286 - DNA, 16 bp, Homo sapiens
catttaaatgtgtaca

SEQ ID NO: 4534287 - DNA, 12 bp, Homo sapiens
catttaaattcc

SEQ ID NO: 4534288 - DNA, 13 bp, Homo sapiens
catttaaattcca

SEQ ID NO: 4534289 - DNA, 17 bp, Homo sapiens
catttaaattccacaga

SEQ ID NO: 4534290 - DNA, 12 bp, Homo sapiens
catttaaatttt

SEQ ID NO: 4534291 - DNA, 22 bp, Homo sapiens
catttaaggatggggttatgaa

SEQ ID NO: 4534292 - DNA, 17 bp, Homo sapiens
catttaagggaaaaata

SEQ ID NO: 4534293 - DNA, 19 bp, Homo sapiens
catttaagggaaaaatata

SEQ ID NO: 4534294 - DNA, 21 bp, Homo sapiens
catttaatggcagctagtgcc

SEQ ID NO: 4534295 - DNA, 22 bp, Homo sapiens
catttaatggcagctagtgcct

SEQ ID NO: 4534296 - DNA, 23 bp, Homo sapiens
catttaatttcaacctaaatact

SEQ ID NO: 4534297 - DNA, 15 bp, Homo sapiens
catttaatttcatgt

SEQ ID NO: 4534298 - DNA, 20 bp, Homo sapiens
catttacattaggtattaca

SEQ ID NO: 4534299 - DNA, 13 bp, Homo sapiens
catttaccactgt

SEQ ID NO: 4534300 - DNA, 15 bp, Homo sapiens
catttagaaaagtga

SEQ ID NO: 4534301 - DNA, 11 bp, Homo sapiens
catttagatgc

SEQ ID NO: 4534302 - DNA, 16 bp, Homo sapiens
catttagcatgttgtt

SEQ ID NO: 4534303 - DNA, 17 bp, Homo sapiens
catttaggatccatgca

SEQ ID NO: 4534304 - DNA, 22 bp, Homo sapiens
catttataatactgttttaaaa

SEQ ID NO: 4534305 - DNA, 16 bp, Homo sapiens
catttatataaaactt

SEQ ID NO: 4534306 - DNA, 13 bp, Homo sapiens
catttatatgtac

SEQ ID NO: 4534307 - DNA, 22 bp, Homo sapiens
catttatctttgtattcttcat

SEQ ID NO: 4534308 - DNA, 12 bp, Homo sapiens
catttatttctc

SEQ ID NO: 4534309 - DNA, 15 bp, Homo sapiens
catttcaaaatgctt

SEQ ID NO: 4534310 - DNA, 16 bp, Homo sapiens
catttcacattattct

SEQ ID NO: 4534311 - DNA, 19 bp, Homo sapiens
catttcacatttttgtaat

SEQ ID NO: 4534312 - DNA, 13 bp, Homo sapiens
catttcacccctc

SEQ ID NO: 4534313 - DNA, 15 bp, Homo sapiens
catttcacccctccc

SEQ ID NO: 4534314 - DNA, 17 bp, Homo sapiens
catttcacccctccctt

SEQ ID NO: 4534315 - DNA, 22 bp, Homo sapiens
catttcacccctccctttctcc

SEQ ID NO: 4534316 - DNA, 13 bp, Homo sapiens
catttcagaagtt

SEQ ID NO: 4534317 - DNA, 23 bp, Homo sapiens
catttcagaagttagtttgtata

SEQ ID NO: 4534318 - DNA, 12 bp, Homo sapiens
catttcatatta

SEQ ID NO: 4534319 - DNA, 23 bp, Homo sapiens
catttcatgaaaaagctgcttct

SEQ ID NO: 4534320 - DNA, 16 bp, Homo sapiens
catttcattatgcttt

SEQ ID NO: 4534321 - DNA, 13 bp, Homo sapiens
catttcattccat

SEQ ID NO: 4534322 - DNA, 18 bp, Homo sapiens
catttcattccattgcct

SEQ ID NO: 4534323 - DNA, 20 bp, Homo sapiens
catttcattgtacaagtatt

SEQ ID NO: 4534324 - DNA, 16 bp, Homo sapiens
catttccaccaggccg

SEQ ID NO: 4534325 - DNA, 15 bp, Homo sapiens
catttcccatctgca

SEQ ID NO: 4534326 - DNA, 13 bp, Homo sapiens
catttcctatgca

SEQ ID NO: 4534327 - DNA, 13 bp, Homo sapiens
catttctaattaa

SEQ ID NO: 4534328 - DNA, 23 bp, Homo sapiens
catttctaattaaccttactaat

SEQ ID NO: 4534329 - DNA, 12 bp, Homo sapiens
catttctagact

SEQ ID NO: 4534330 - DNA, 15 bp, Homo sapiens
catttctagactcaa

SEQ ID NO: 4534331 - DNA, 20 bp, Homo sapiens
catttctctaactcctgcca

SEQ ID NO: 4534332 - DNA, 21 bp, Homo sapiens
catttctcttccccttagaaa

SEQ ID NO: 4534333 - DNA, 23 bp, Homo sapiens
catttctgcatcagctgctgaaa

SEQ ID NO: 4534334 - DNA, 13 bp, Homo sapiens
catttctgcctcg

SEQ ID NO: 4534335 - DNA, 20 bp, Homo sapiens
catttcttaaaacacatgat

SEQ ID NO: 4534336 - DNA, 14 bp, Homo sapiens
catttcttaaatta

SEQ ID NO: 4534337 - DNA, 15 bp, Homo sapiens
catttcttgctagct

SEQ ID NO: 4534338 - DNA, 19 bp, Homo sapiens
catttcttggcattggaat

SEQ ID NO: 4534339 - DNA, 16 bp, Homo sapiens
catttgacaaaactaa

SEQ ID NO: 4534340 - DNA, 23 bp, Homo sapiens
catttgagagaagccacgctgtc

SEQ ID NO: 4534341 - DNA, 16 bp, Homo sapiens
catttgagccatgtca

SEQ ID NO: 4534342 - DNA, 20 bp, Homo sapiens
catttgatgcatgtctttta

SEQ ID NO: 4534343 - DNA, 22 bp, Homo sapiens
catttgatgcatgtcttttaaa

SEQ ID NO: 4534344 - DNA, 20 bp, Homo sapiens
catttgattaataaaatatc

SEQ ID NO: 4534345 - DNA, 22 bp, Homo sapiens
catttgcacaaacttgtgagca

SEQ ID NO: 4534346 - DNA, 17 bp, Homo sapiens
catttgctgaactcagc

SEQ ID NO: 4534347 - DNA, 14 bp, Homo sapiens
catttgctgttcat

SEQ ID NO: 4534348 - DNA, 16 bp, Homo sapiens
catttgcttaaacctg

SEQ ID NO: 4534349 - DNA, 17 bp, Homo sapiens
catttggaatacttttt

SEQ ID NO: 4534350 - DNA, 15 bp, Homo sapiens
catttggagctcttg

SEQ ID NO: 4534351 - DNA, 20 bp, Homo sapiens
catttggagctcttgggtca

SEQ ID NO: 4534352 - DNA, 22 bp, Homo sapiens
catttggagctcttgggtcaga

SEQ ID NO: 4534353 - DNA, 15 bp, Homo sapiens
catttggcactatgg

SEQ ID NO: 4534354 - DNA, 18 bp, Homo sapiens
catttggcactatggttt

SEQ ID NO: 4534355 - DNA, 14 bp, Homo sapiens
catttggcttgctg

SEQ ID NO: 4534356 - DNA, 16 bp, Homo sapiens
catttggcttgctgtt

SEQ ID NO: 4534357 - DNA, 20 bp, Homo sapiens
catttggcttgctgtttact

SEQ ID NO: 4534358 - DNA, 23 bp, Homo sapiens
catttgggagtttttatgagaaa

SEQ ID NO: 4534359 - DNA, 22 bp, Homo sapiens
catttggtgagagtcaaagctg

SEQ ID NO: 4534360 - DNA, 16 bp, Homo sapiens
catttggttaaatcat

SEQ ID NO: 4534361 - DNA, 17 bp, Homo sapiens
catttggttaaatcatt

SEQ ID NO: 4534362 - DNA, 23 bp, Homo sapiens
catttggttatgttgataaacca

SEQ ID NO: 4534363 - DNA, 20 bp, Homo sapiens
catttggttcattaattcta

SEQ ID NO: 4534364 - DNA, 20 bp, Homo sapiens
catttgtatgtcaaagcttt

SEQ ID NO: 4534365 - DNA, 19 bp, Homo sapiens
catttgtcccaagtgccaa

SEQ ID NO: 4534366 - DNA, 12 bp, Homo sapiens
catttgtcccag

SEQ ID NO: 4534367 - DNA, 19 bp, Homo sapiens
catttgtggtaatctacac

SEQ ID NO: 4534368 - DNA, 14 bp, Homo sapiens
catttgtgtctctt

SEQ ID NO: 4534369 - DNA, 22 bp, Homo sapiens
catttgttaatatcactcatta

SEQ ID NO: 4534370 - DNA, 18 bp, Homo sapiens
catttgtttaaacaatct

SEQ ID NO: 4534371 - DNA, 17 bp, Homo sapiens
cattttaacgctgccta

SEQ ID NO: 4534372 - DNA, 18 bp, Homo sapiens
cattttaagtaaaagtct

SEQ ID NO: 4534373 - DNA, 22 bp, Homo sapiens
cattttaagtaacgtgctcact

SEQ ID NO: 4534374 - DNA, 13 bp, Homo sapiens
cattttaatatat

SEQ ID NO: 4534375 - DNA, 13 bp, Homo sapiens
cattttaatgtaa

SEQ ID NO: 4534376 - DNA, 14 bp, Homo sapiens
cattttaggaaagg

SEQ ID NO: 4534377 - DNA, 13 bp, Homo sapiens
cattttataatga

SEQ ID NO: 4534378 - DNA, 12 bp, Homo sapiens
cattttatattt

SEQ ID NO: 4534379 - DNA, 15 bp, Homo sapiens
cattttatatttaaa

SEQ ID NO: 4534380 - DNA, 11 bp, Homo sapiens
cattttattct

SEQ ID NO: 4534381 - DNA, 17 bp, Homo sapiens
cattttccccccactct

SEQ ID NO: 4534382 - DNA, 11 bp, Homo sapiens
cattttcctcc

SEQ ID NO: 4534383 - DNA, 17 bp, Homo sapiens
cattttcctcctctgcc

SEQ ID NO: 4534384 - DNA, 19 bp, Homo sapiens
cattttcctcctctgccta

SEQ ID NO: 4534385 - DNA, 20 bp, Homo sapiens
cattttcctgacatttgttt

SEQ ID NO: 4534386 - DNA, 12 bp, Homo sapiens
cattttctagat

SEQ ID NO: 4534387 - DNA, 23 bp, Homo sapiens
cattttctagatacaataaattg

SEQ ID NO: 4534388 - DNA, 11 bp, Homo sapiens
cattttgaaaa

SEQ ID NO: 4534389 - DNA, 14 bp, Homo sapiens
cattttgaaaatat

SEQ ID NO: 4534390 - DNA, 16 bp, Homo sapiens
cattttgaaaatatgt

SEQ ID NO: 4534391 - DNA, 19 bp, Homo sapiens
cattttgaaaatatgtact

SEQ ID NO: 4534392 - DNA, 22 bp, Homo sapiens
cattttgaaaatatgtactgta

SEQ ID NO: 4534393 - DNA, 16 bp, Homo sapiens
cattttggtttttcct

SEQ ID NO: 4534394 - DNA, 23 bp, Homo sapiens
cattttggtttttcctcattgag

SEQ ID NO: 4534395 - DNA, 15 bp, Homo sapiens
cattttgtaaaatat

SEQ ID NO: 4534396 - DNA, 19 bp, Homo sapiens
cattttgtaaaatattatg

SEQ ID NO: 4534397 - DNA, 19 bp, Homo sapiens
cattttgtggaattttgag

SEQ ID NO: 4534398 - DNA, 14 bp, Homo sapiens
catttttaaaacta

SEQ ID NO: 4534399 - DNA, 15 bp, Homo sapiens
catttttaaacttga

SEQ ID NO: 4534400 - DNA, 18 bp, Homo sapiens
catttttaaacttgaaat

SEQ ID NO: 4534401 - DNA, 15 bp, Homo sapiens
catttttaagatgca

SEQ ID NO: 4534402 - DNA, 18 bp, Homo sapiens
catttttaagatgcatgt

SEQ ID NO: 4534403 - DNA, 15 bp, Homo sapiens
catttttaatgtatc

SEQ ID NO: 4534404 - DNA, 20 bp, Homo sapiens
catttttaatgtatctattt

SEQ ID NO: 4534405 - DNA, 22 bp, Homo sapiens
catttttaatgtatctatttgt

SEQ ID NO: 4534406 - DNA, 14 bp, Homo sapiens
catttttcaatata

SEQ ID NO: 4534407 - DNA, 21 bp, Homo sapiens
catttttcaatatattgaact

SEQ ID NO: 4534408 - DNA, 16 bp, Homo sapiens
catttttcattcatga

SEQ ID NO: 4534409 - DNA, 20 bp, Homo sapiens
catttttctcccaagaaacc

SEQ ID NO: 4534410 - DNA, 19 bp, Homo sapiens
catttttgaaactgcattt

SEQ ID NO: 4534411 - DNA, 19 bp, Homo sapiens
catttttgctaattatcaa

SEQ ID NO: 4534412 - DNA, 14 bp, Homo sapiens
catttttgtaatgc

SEQ ID NO: 4534413 - DNA, 19 bp, Homo sapiens
catttttgttttgaaagtt

SEQ ID NO: 4534414 - DNA, 22 bp, Homo sapiens
catttttgtttttggtttctta

SEQ ID NO: 4534415 - DNA, 23 bp, Homo sapiens
catttttgtttttggtttcttat

SEQ ID NO: 4534416 - DNA, 14 bp, Homo sapiens
cattttttacttga

SEQ ID NO: 4534417 - DNA, 16 bp, Homo sapiens
catttttttagtttgt

SEQ ID NO: 4534418 - DNA, 17 bp, Homo sapiens
catttttttccaggctg

SEQ ID NO: 4534419 - DNA, 18 bp, Homo sapiens
catttttttccaggctgg

SEQ ID NO: 4534420 - DNA, 16 bp, Homo sapiens
catttttttctttact

SEQ ID NO: 4534421 - DNA, 16 bp, Homo sapiens
ccaaaaagaccagact

SEQ ID NO: 4534422 - DNA, 17 bp, Homo sapiens
ccaaaaagaccagacta

SEQ ID NO: 4534423 - DNA, 13 bp, Homo sapiens
ccaaaaagcacat

SEQ ID NO: 4534424 - DNA, 19 bp, Homo sapiens
ccaaaacaatctatttaaa

SEQ ID NO: 4534425 - DNA, 21 bp, Homo sapiens
ccaaaacaatctatttaaaaa

SEQ ID NO: 4534426 - DNA, 18 bp, Homo sapiens
ccaaaacatttctaagac

SEQ ID NO: 4534427 - DNA, 22 bp, Homo sapiens
ccaaaagattgctgaaatttta

SEQ ID NO: 4534428 - DNA, 22 bp, Homo sapiens
ccaaaagcgccctcactattct

SEQ ID NO: 4534429 - DNA, 13 bp, Homo sapiens
ccaaaaggaaaaa

SEQ ID NO: 4534430 - DNA, 15 bp, Homo sapiens
ccaaaaggaaaaagc

SEQ ID NO: 4534431 - DNA, 16 bp, Homo sapiens
ccaaaaggaaaaagct

SEQ ID NO: 4534432 - DNA, 17 bp, Homo sapiens
ccaaaagtccctccctg

SEQ ID NO: 4534433 - DNA, 17 bp, Homo sapiens
ccaaaagtggctagtcc

SEQ ID NO: 4534434 - DNA, 23 bp, Homo sapiens
ccaaaataaataaggaaaagctt

SEQ ID NO: 4534435 - DNA, 15 bp, Homo sapiens
ccaaaatgacatctt

SEQ ID NO: 4534436 - DNA, 13 bp, Homo sapiens
ccaaaatgtgaag

SEQ ID NO: 4534437 - DNA, 21 bp, Homo sapiens
ccaaaatgttggtcattttat

SEQ ID NO: 4534438 - DNA, 13 bp, Homo sapiens
ccaaaatttgatg

SEQ ID NO: 4534439 - DNA, 13 bp, Homo sapiens
ccaaacacccaga

SEQ ID NO: 4534440 - DNA, 14 bp, Homo sapiens
ccaaacaggaacta

SEQ ID NO: 4534441 - DNA, 14 bp, Homo sapiens
ccaaacatgtattt

SEQ ID NO: 4534442 - DNA, 18 bp, Homo sapiens
ccaaacatgtatttatgt

SEQ ID NO: 4534443 - DNA, 15 bp, Homo sapiens
ccaaacccttaactg

SEQ ID NO: 4534444 - DNA, 18 bp, Homo sapiens
ccaaacccttaactgaca

SEQ ID NO: 4534445 - DNA, 13 bp, Homo sapiens
ccaaactgggtct

SEQ ID NO: 4534446 - DNA, 17 bp, Homo sapiens
ccaaactgggtcttcag

SEQ ID NO: 4534447 - DNA, 18 bp, Homo sapiens
ccaaactgggtcttcagc

SEQ ID NO: 4534448 - DNA, 21 bp, Homo sapiens
ccaaactgggtcttcagcttt

SEQ ID NO: 4534449 - DNA, 22 bp, Homo sapiens
ccaaactgggtcttcagcttta

SEQ ID NO: 4534450 - DNA, 16 bp, Homo sapiens
ccaaagaaatgaacat

SEQ ID NO: 4534451 - DNA, 18 bp, Homo sapiens
catgagggagatgccatg

SEQ ID NO: 4534452 - DNA, 14 bp, Homo sapiens
catgaggtatctaa

SEQ ID NO: 4534453 - DNA, 22 bp, Homo sapiens
catgagtctacctgagcattca

SEQ ID NO: 4534454 - DNA, 18 bp, Homo sapiens
catgagttatcatgaatt

SEQ ID NO: 4534455 - DNA, 23 bp, Homo sapiens
catgagttatcatgaattttaaa

SEQ ID NO: 4534456 - DNA, 19 bp, Homo sapiens
catgagttccagaaagtaa

SEQ ID NO: 4534457 - DNA, 20 bp, Homo sapiens
catgagttccagaaagtaaa

SEQ ID NO: 4534458 - DNA, 16 bp, Homo sapiens
catgagttctgctgaa

SEQ ID NO: 4534459 - DNA, 13 bp, Homo sapiens
catgataaatgat

SEQ ID NO: 4534460 - DNA, 13 bp, Homo sapiens
catgataagacat

SEQ ID NO: 4534461 - DNA, 22 bp, Homo sapiens
catgataccagcagcaactgaa

SEQ ID NO: 4534462 - DNA, 15 bp, Homo sapiens
catgatagaaagaat

SEQ ID NO: 4534463 - DNA, 18 bp, Homo sapiens
catgatagaaagaataaa

SEQ ID NO: 4534464 - DNA, 20 bp, Homo sapiens
catgatagaaagaataaaat

SEQ ID NO: 4534465 - DNA, 20 bp, Homo sapiens
catgatcaagatatatgtgt

SEQ ID NO: 4534466 - DNA, 14 bp, Homo sapiens
catgatgatagttg

SEQ ID NO: 4534467 - DNA, 19 bp, Homo sapiens
catgatgatagttgaatgt

SEQ ID NO: 4534468 - DNA, 15 bp, Homo sapiens
catgatgcagtctcc

SEQ ID NO: 4534469 - DNA, 14 bp, Homo sapiens
catgatgctagcca

SEQ ID NO: 4534470 - DNA, 15 bp, Homo sapiens
catgatgtgaagagt

SEQ ID NO: 4534471 - DNA, 21 bp, Homo sapiens
catgatgtgaagagtttcaca

SEQ ID NO: 4534472 - DNA, 21 bp, Homo sapiens
catgattgaaaccaagttgaa

SEQ ID NO: 4534473 - DNA, 13 bp, Homo sapiens
catgatttaaaga

SEQ ID NO: 4534474 - DNA, 20 bp, Homo sapiens
catgattttacaagtataac

SEQ ID NO: 4534475 - DNA, 22 bp, Homo sapiens
catgcaaactgctttattttcc

SEQ ID NO: 4534476 - DNA, 12 bp, Homo sapiens
catgcaaattgt

SEQ ID NO: 4534477 - DNA, 13 bp, Homo sapiens
catgcaaattgtg

SEQ ID NO: 4534478 - DNA, 15 bp, Homo sapiens
catgcaactggagtt

SEQ ID NO: 4534479 - DNA, 21 bp, Homo sapiens
catgcacatgctgtctggccc

SEQ ID NO: 4534480 - DNA, 18 bp, Homo sapiens
catgcacccctgagccag

SEQ ID NO: 4534481 - DNA, 15 bp, Homo sapiens
catgcactgatgttg

SEQ ID NO: 4534482 - DNA, 20 bp, Homo sapiens
catgcactgatgttgtgttt

SEQ ID NO: 4534483 - DNA, 23 bp, Homo sapiens
catgcactgttccccctgtgcag

SEQ ID NO: 4534484 - DNA, 14 bp, Homo sapiens
catgcagaaagcat

SEQ ID NO: 4534485 - DNA, 20 bp, Homo sapiens
catgcagcccatgcccacct

SEQ ID NO: 4534486 - DNA, 23 bp, Homo sapiens
catgcagcctaaagtacagcctg

SEQ ID NO: 4534487 - DNA, 20 bp, Homo sapiens
catgcagctcttcaacatga

SEQ ID NO: 4534488 - DNA, 16 bp, Homo sapiens
catgcagtttgaaatt

SEQ ID NO: 4534489 - DNA, 20 bp, Homo sapiens
catgcagtttgaaattctga

SEQ ID NO: 4534490 - DNA, 21 bp, Homo sapiens
catgcagtttgaaattctgaa

SEQ ID NO: 4534491 - DNA, 22 bp, Homo sapiens
catgcagtttgaaattctgaat

SEQ ID NO: 4534492 - DNA, 18 bp, Homo sapiens
catgcataacaaaccctg

SEQ ID NO: 4534493 - DNA, 17 bp, Homo sapiens
catgcatacttacagac

SEQ ID NO: 4534494 - DNA, 23 bp, Homo sapiens
catgcatatcattaaacaaataa

SEQ ID NO: 4534495 - DNA, 14 bp, Homo sapiens
catgcatgacactt

SEQ ID NO: 4534496 - DNA, 19 bp, Homo sapiens
catgcatgacagcctctat

SEQ ID NO: 4534497 - DNA, 17 bp, Homo sapiens
catgcatgtcctgtaaa

SEQ ID NO: 4534498 - DNA, 14 bp, Homo sapiens
catgcatgtctgcc

SEQ ID NO: 4534499 - DNA, 19 bp, Homo sapiens
catgccagattctgcctct

SEQ ID NO: 4534500 - DNA, 16 bp, Homo sapiens
catgccaggctaattt

SEQ ID NO: 4534501 - DNA, 18 bp, Homo sapiens
catgccaggctaattttt

SEQ ID NO: 4534502 - DNA, 14 bp, Homo sapiens
catgccagtatttt

SEQ ID NO: 4534503 - DNA, 16 bp, Homo sapiens
catgcccaccccctgc

SEQ ID NO: 4534504 - DNA, 20 bp, Homo sapiens
catgcccaccccctgccctg

SEQ ID NO: 4534505 - DNA, 22 bp, Homo sapiens
catgcccaccccctgccctgca

SEQ ID NO: 4534506 - DNA, 17 bp, Homo sapiens
catgcccacctgcccat

SEQ ID NO: 4534507 - DNA, 13 bp, Homo sapiens
catgccccaggct

SEQ ID NO: 4534508 - DNA, 12 bp, Homo sapiens
catgccccagtc

SEQ ID NO: 4534509 - DNA, 22 bp, Homo sapiens
catgccccagtcggccccatct

SEQ ID NO: 4534510 - DNA, 21 bp, Homo sapiens
catgcccggctaatttttgta

SEQ ID NO: 4534511 - DNA, 17 bp, Homo sapiens
catgccctgtgtggctg

SEQ ID NO: 4534512 - DNA, 18 bp, Homo sapiens
catgcctcagaagtgcat

SEQ ID NO: 4534513 - DNA, 20 bp, Homo sapiens
catgcctgtagctttcctgg

SEQ ID NO: 4534514 - DNA, 21 bp, Homo sapiens
catgcctgtagctttcctggt

SEQ ID NO: 4534515 - DNA, 20 bp, Homo sapiens
catgcctgtagtctcagcta

SEQ ID NO: 4534516 - DNA, 22 bp, Homo sapiens
catgcctgtagtctcagctagt

SEQ ID NO: 4534517 - DNA, 16 bp, Homo sapiens
catgcctgtccagcct

SEQ ID NO: 4534518 - DNA, 18 bp, Homo sapiens
catgcctgtccagcctgg

SEQ ID NO: 4534519 - DNA, 20 bp, Homo sapiens
catgcctgtccagcctgggc

SEQ ID NO: 4534520 - DNA, 14 bp, Homo sapiens
catgcggcccagcc

SEQ ID NO: 4534521 - DNA, 16 bp, Homo sapiens
catgcggcccagcccg

SEQ ID NO: 4534522 - DNA, 19 bp, Homo sapiens
catgcggcccagcccggct

SEQ ID NO: 4534523 - DNA, 18 bp, Homo sapiens
catgcggtgggtgctgcc

SEQ ID NO: 4534524 - DNA, 17 bp, Homo sapiens
catgcgtgtttctgact

SEQ ID NO: 4534525 - DNA, 16 bp, Homo sapiens
catgctaagagaagta

SEQ ID NO: 4534526 - DNA, 15 bp, Homo sapiens
catgctaagcaagct

SEQ ID NO: 4534527 - DNA, 16 bp, Homo sapiens
catgctaagcaagcta

SEQ ID NO: 4534528 - DNA, 13 bp, Homo sapiens
catgctcaacccc

SEQ ID NO: 4534529 - DNA, 19 bp, Homo sapiens
catgctcaacccccctccc

SEQ ID NO: 4534530 - DNA, 20 bp, Homo sapiens
catgctcatgtatatttagt

SEQ ID NO: 4534531 - DNA, 12 bp, Homo sapiens
catgctccaggg

SEQ ID NO: 4534532 - DNA, 13 bp, Homo sapiens
catgctccttaat

SEQ ID NO: 4534533 - DNA, 22 bp, Homo sapiens
catgctccttaatggcgccatg

SEQ ID NO: 4534534 - DNA, 14 bp, Homo sapiens
catgctctctcacc

SEQ ID NO: 4534535 - DNA, 17 bp, Homo sapiens
catgctctctcacctgc

SEQ ID NO: 4534536 - DNA, 20 bp, Homo sapiens
catgctctctcacctgctcc

SEQ ID NO: 4534537 - DNA, 13 bp, Homo sapiens
catgctctctgca

SEQ ID NO: 4534538 - DNA, 14 bp, Homo sapiens
catgctctctgcag

SEQ ID NO: 4534539 - DNA, 20 bp, Homo sapiens
catgctctctgcagccagcc

SEQ ID NO: 4534540 - DNA, 23 bp, Homo sapiens
catgctctctgcagccagcccag

SEQ ID NO: 4534541 - DNA, 17 bp, Homo sapiens
catgctgaaaaatatag

SEQ ID NO: 4534542 - DNA, 15 bp, Homo sapiens
catgctgccttcagg

SEQ ID NO: 4534543 - DNA, 14 bp, Homo sapiens
catgctgggatttc

SEQ ID NO: 4534544 - DNA, 20 bp, Homo sapiens
catgctgggccactggggac

SEQ ID NO: 4534545 - DNA, 15 bp, Homo sapiens
catgctgggtctgag

SEQ ID NO: 4534546 - DNA, 22 bp, Homo sapiens
catgctgggtctgaggcccctg

SEQ ID NO: 4534547 - DNA, 23 bp, Homo sapiens
catgctgggtctgaggcccctgc

SEQ ID NO: 4534548 - DNA, 13 bp, Homo sapiens
catgcttaataaa

SEQ ID NO: 4534549 - DNA, 21 bp, Homo sapiens
catgcttctcatcttgtgaaa

SEQ ID NO: 4534550 - DNA, 18 bp, Homo sapiens
catgcttgaatggagctg

SEQ ID NO: 4534551 - DNA, 13 bp, Homo sapiens
catgcttgacata

SEQ ID NO: 4534552 - DNA, 17 bp, Homo sapiens
catgcttgcctgaagct

SEQ ID NO: 4534553 - DNA, 18 bp, Homo sapiens
catgcttgcctgaagctt

SEQ ID NO: 4534554 - DNA, 13 bp, Homo sapiens
catgctttatgtg

SEQ ID NO: 4534555 - DNA, 14 bp, Homo sapiens
catgctttccattt

SEQ ID NO: 4534556 - DNA, 23 bp, Homo sapiens
catgctttcctaaagtctctgct

SEQ ID NO: 4534557 - DNA, 21 bp, Homo sapiens
catggaaaaatgccatcaaat

SEQ ID NO: 4534558 - DNA, 22 bp, Homo sapiens
catggaaaaatgccatcaaatg

SEQ ID NO: 4534559 - DNA, 18 bp, Homo sapiens
catggaaatgaagcaggg

SEQ ID NO: 4534560 - DNA, 16 bp, Homo sapiens
catggacctggtgccc

SEQ ID NO: 4534561 - DNA, 16 bp, Homo sapiens
catggagaaaccctgt

SEQ ID NO: 4534562 - DNA, 16 bp, Homo sapiens
catggagccccagccc

SEQ ID NO: 4534563 - DNA, 18 bp, Homo sapiens
catggagccccctctgcc

SEQ ID NO: 4534564 - DNA, 20 bp, Homo sapiens
catggagctgtcacctctca

SEQ ID NO: 4534565 - DNA, 21 bp, Homo sapiens
catggagctgtcacctctcag

SEQ ID NO: 4534566 - DNA, 13 bp, Homo sapiens
catggaggatggt

SEQ ID NO: 4534567 - DNA, 18 bp, Homo sapiens
catggatatagttttact

SEQ ID NO: 4534568 - DNA, 20 bp, Homo sapiens
catggatgattcttttccca

SEQ ID NO: 4534569 - DNA, 19 bp, Homo sapiens
catggattacttctctata

SEQ ID NO: 4534570 - DNA, 23 bp, Homo sapiens
catggcaccttcagactttgctt

SEQ ID NO: 4534571 - DNA, 14 bp, Homo sapiens
ccagtcaacctggg

SEQ ID NO: 4534572 - DNA, 21 bp, Homo sapiens
ccagtcaacggggggctcctg

SEQ ID NO: 4534573 - DNA, 23 bp, Homo sapiens
ccagtcaacggggggctcctgcc

SEQ ID NO: 4534574 - DNA, 12 bp, Homo sapiens
ccagtcacattg

SEQ ID NO: 4534575 - DNA, 15 bp, Homo sapiens
ccagtcagcctctct

SEQ ID NO: 4534576 - DNA, 19 bp, Homo sapiens
ccagtcagcctctctccca

SEQ ID NO: 4534577 - DNA, 20 bp, Homo sapiens
ccagtcagcctctctcccag

SEQ ID NO: 4534578 - DNA, 17 bp, Homo sapiens
ccagtcattttattttg

SEQ ID NO: 4534579 - DNA, 15 bp, Homo sapiens
ccagtccatgctcca

SEQ ID NO: 4534580 - DNA, 16 bp, Homo sapiens
ccagtccatgctccag

SEQ ID NO: 4534581 - DNA, 22 bp, Homo sapiens
ccagtcccaatggtcctgactt

SEQ ID NO: 4534582 - DNA, 14 bp, Homo sapiens
ccagtcccattcct

SEQ ID NO: 4534583 - DNA, 19 bp, Homo sapiens
ccagtccccacccctgccc

SEQ ID NO: 4534584 - DNA, 21 bp, Homo sapiens
ccagtccccatttctgcctcg

SEQ ID NO: 4534585 - DNA, 17 bp, Homo sapiens
ccagtccccgaggagct

SEQ ID NO: 4534586 - DNA, 19 bp, Homo sapiens
ccagtccctgggggaagcc

SEQ ID NO: 4534587 - DNA, 22 bp, Homo sapiens
ccagtccctgggggaagccctg

SEQ ID NO: 4534588 - DNA, 21 bp, Homo sapiens
ccagtcctccactcgacccag

SEQ ID NO: 4534589 - DNA, 14 bp, Homo sapiens
ccagtcctgcctgg

SEQ ID NO: 4534590 - DNA, 15 bp, Homo sapiens
ccagtcctgcctggc

SEQ ID NO: 4534591 - DNA, 12 bp, Homo sapiens
ccagtctcacct

SEQ ID NO: 4534592 - DNA, 18 bp, Homo sapiens
ccagtctcatcctcccat

SEQ ID NO: 4534593 - DNA, 13 bp, Homo sapiens
ccagtctcctcac

SEQ ID NO: 4534594 - DNA, 15 bp, Homo sapiens
ccagtctcctcactc

SEQ ID NO: 4534595 - DNA, 20 bp, Homo sapiens
ccagtctggaaaacagaaac

SEQ ID NO: 4534596 - DNA, 14 bp, Homo sapiens
ccagtctttttaaa

SEQ ID NO: 4534597 - DNA, 22 bp, Homo sapiens
ccagtgaactcctgccaggcac

SEQ ID NO: 4534598 - DNA, 16 bp, Homo sapiens
ccagtgaactcggccc

SEQ ID NO: 4534599 - DNA, 12 bp, Homo sapiens
ccagtgaagcct

SEQ ID NO: 4534600 - DNA, 17 bp, Homo sapiens
ccagtgaatttttgcaa

SEQ ID NO: 4534601 - DNA, 21 bp, Homo sapiens
ccagtgaatttttgcaataat

SEQ ID NO: 4534602 - DNA, 13 bp, Homo sapiens
ccagtgagccctg

SEQ ID NO: 4534603 - DNA, 19 bp, Homo sapiens
ccagtgagtctctggggca

SEQ ID NO: 4534604 - DNA, 13 bp, Homo sapiens
ccagtgcagccac

SEQ ID NO: 4534605 - DNA, 15 bp, Homo sapiens
ccagtgcagccactg

SEQ ID NO: 4534606 - DNA, 16 bp, Homo sapiens
ccagtgcagccactgg

SEQ ID NO: 4534607 - DNA, 14 bp, Homo sapiens
ccagtgcctgccac

SEQ ID NO: 4534608 - DNA, 16 bp, Homo sapiens
ccagtgcctgccactc

SEQ ID NO: 4534609 - DNA, 17 bp, Homo sapiens
ccagtgcctgccactct

SEQ ID NO: 4534610 - DNA, 18 bp, Homo sapiens
ccagtgcctgccactctc

SEQ ID NO: 4534611 - DNA, 21 bp, Homo sapiens
ccagtgcctgccactctctgg

SEQ ID NO: 4534612 - DNA, 13 bp, Homo sapiens
ccagtgcctgggt

SEQ ID NO: 4534613 - DNA, 17 bp, Homo sapiens
ccagtgccttacctcct

SEQ ID NO: 4534614 - DNA, 18 bp, Homo sapiens
ccagtgccttacctcctg

SEQ ID NO: 4534615 - DNA, 20 bp, Homo sapiens
ccagtgccttacctcctgcc

SEQ ID NO: 4534616 - DNA, 22 bp, Homo sapiens
ccagtgccttacctcctgccca

SEQ ID NO: 4534617 - DNA, 23 bp, Homo sapiens
ccagtgccttacctcctgcccag

SEQ ID NO: 4534618 - DNA, 22 bp, Homo sapiens
ccagtgctcaccagccctgcag

SEQ ID NO: 4534619 - DNA, 18 bp, Homo sapiens
ccagtgctctgcctcaga

SEQ ID NO: 4534620 - DNA, 12 bp, Homo sapiens
ccagtgctgaat

SEQ ID NO: 4534621 - DNA, 19 bp, Homo sapiens
ccagtgctgcccatgagca

SEQ ID NO: 4534622 - DNA, 21 bp, Homo sapiens
ccagtggccactcagcttcct

SEQ ID NO: 4534623 - DNA, 20 bp, Homo sapiens
ccagtggctggaagaaccac

SEQ ID NO: 4534624 - DNA, 16 bp, Homo sapiens
ccagtgtctttctttg

SEQ ID NO: 4534625 - DNA, 12 bp, Homo sapiens
ccagtgtgaacc

SEQ ID NO: 4534626 - DNA, 17 bp, Homo sapiens
ccagtgttagggaaggg

SEQ ID NO: 4534627 - DNA, 20 bp, Homo sapiens
ccagtgttagggaagggcct

SEQ ID NO: 4534628 - DNA, 18 bp, Homo sapiens
ccagtgttcctgaagctg

SEQ ID NO: 4534629 - DNA, 20 bp, Homo sapiens
ccagtgttctatttgcttta

SEQ ID NO: 4534630 - DNA, 16 bp, Homo sapiens
ccagttaatttttcca

SEQ ID NO: 4534631 - DNA, 21 bp, Homo sapiens
ccagttatggctataggtgct

SEQ ID NO: 4534632 - DNA, 13 bp, Homo sapiens
ccagttccacagc

SEQ ID NO: 4534633 - DNA, 13 bp, Homo sapiens
ccagttcctagca

SEQ ID NO: 4534634 - DNA, 21 bp, Homo sapiens
ccagttcctagcactgcccca

SEQ ID NO: 4534635 - DNA, 18 bp, Homo sapiens
ccagttgcactcaggtga

SEQ ID NO: 4534636 - DNA, 10 bp, Homo sapiens
ccagtttctt

SEQ ID NO: 4534637 - DNA, 14 bp, Homo sapiens
ccagtttgcagaaa

SEQ ID NO: 4534638 - DNA, 18 bp, Homo sapiens
ccagttttactgtgattc

SEQ ID NO: 4534639 - DNA, 15 bp, Homo sapiens
ccagttttccctgga

SEQ ID NO: 4534640 - DNA, 23 bp, Homo sapiens
ccagtttttgtttttgcatgaaa

SEQ ID NO: 4534641 - DNA, 18 bp, Homo sapiens
ccataaatttggactgtc

SEQ ID NO: 4534642 - DNA, 17 bp, Homo sapiens
ccataagctactgccat

SEQ ID NO: 4534643 - DNA, 13 bp, Homo sapiens
ccatacaatgtat

SEQ ID NO: 4534644 - DNA, 17 bp, Homo sapiens
ccatacaatgtatgtac

SEQ ID NO: 4534645 - DNA, 20 bp, Homo sapiens
ccatacaatgtatgtacaat

SEQ ID NO: 4534646 - DNA, 19 bp, Homo sapiens
ccatacaatttcatcctcc

SEQ ID NO: 4534647 - DNA, 12 bp, Homo sapiens
ccatacacagag

SEQ ID NO: 4534648 - DNA, 17 bp, Homo sapiens
ccatacactttgttgca

SEQ ID NO: 4534649 - DNA, 20 bp, Homo sapiens
ccatacactttgttgcaaga

SEQ ID NO: 4534650 - DNA, 13 bp, Homo sapiens
ccatacagcctct

SEQ ID NO: 4534651 - DNA, 23 bp, Homo sapiens
ccatacccagtctaggagctcct

SEQ ID NO: 4534652 - DNA, 14 bp, Homo sapiens
ccatagaaaaatgt

SEQ ID NO: 4534653 - DNA, 18 bp, Homo sapiens
ccatagatactctcttct

SEQ ID NO: 4534654 - DNA, 14 bp, Homo sapiens
ccatagctgctgcc

SEQ ID NO: 4534655 - DNA, 14 bp, Homo sapiens
ccatagctgggact

SEQ ID NO: 4534656 - DNA, 20 bp, Homo sapiens
ccataggaaggctgtgataa

SEQ ID NO: 4534657 - DNA, 20 bp, Homo sapiens
ccatagggtcggaggtgctg

SEQ ID NO: 4534658 - DNA, 16 bp, Homo sapiens
ccatatataaattatt

SEQ ID NO: 4534659 - DNA, 20 bp, Homo sapiens
ccatatatgaccagaagcct

SEQ ID NO: 4534660 - DNA, 18 bp, Homo sapiens
ccatatatgctgtatttc

SEQ ID NO: 4534661 - DNA, 23 bp, Homo sapiens
ccatatatgctgtatttctttgt

SEQ ID NO: 4534662 - DNA, 18 bp, Homo sapiens
ccatatctccatggccct

SEQ ID NO: 4534663 - DNA, 19 bp, Homo sapiens
ccatatctccatggccctg

SEQ ID NO: 4534664 - DNA, 14 bp, Homo sapiens
ccatatctccttcc

SEQ ID NO: 4534665 - DNA, 15 bp, Homo sapiens
ccatatgctccagga

SEQ ID NO: 4534666 - DNA, 22 bp, Homo sapiens
ccatatgtcagtgtaaatcctt

SEQ ID NO: 4534667 - DNA, 11 bp, Homo sapiens
ccatattttaa

SEQ ID NO: 4534668 - DNA, 16 bp, Homo sapiens
ccatcaaaatgctttt

SEQ ID NO: 4534669 - DNA, 17 bp, Homo sapiens
ccatcaacaaaaattgt

SEQ ID NO: 4534670 - DNA, 19 bp, Homo sapiens
ccatcaactaaaacattat

SEQ ID NO: 4534671 - DNA, 15 bp, Homo sapiens
ccatcaagcacttcc

SEQ ID NO: 4534672 - DNA, 18 bp, Homo sapiens
ccatcaagcacttcccag

SEQ ID NO: 4534673 - DNA, 20 bp, Homo sapiens
ccatcacagggttgggccca

SEQ ID NO: 4534674 - DNA, 13 bp, Homo sapiens
ccatcaccagaaa

SEQ ID NO: 4534675 - DNA, 15 bp, Homo sapiens
ccatcacccaagcca

SEQ ID NO: 4534676 - DNA, 16 bp, Homo sapiens
ccatcacttctccccg

SEQ ID NO: 4534677 - DNA, 20 bp, Homo sapiens
ccatcacttctccccgcagc

SEQ ID NO: 4534678 - DNA, 18 bp, Homo sapiens
ccatcagaacctgagcta

SEQ ID NO: 4534679 - DNA, 16 bp, Homo sapiens
ccatcagccctgctag

SEQ ID NO: 4534680 - DNA, 17 bp, Homo sapiens
ccatcagccctgctaga

SEQ ID NO: 4534681 - DNA, 12 bp, Homo sapiens
ccatcagctctg

SEQ ID NO: 4534682 - DNA, 17 bp, Homo sapiens
ccatcagctctgccttg

SEQ ID NO: 4534683 - DNA, 19 bp, Homo sapiens
ccatcagggttctcttagc

SEQ ID NO: 4534684 - DNA, 15 bp, Homo sapiens
ccatcagtgctctgt

SEQ ID NO: 4534685 - DNA, 16 bp, Homo sapiens
ccatcagtgctctgta

SEQ ID NO: 4534686 - DNA, 14 bp, Homo sapiens
ccatcataattcta

SEQ ID NO: 4534687 - DNA, 14 bp, Homo sapiens
ccatcatcactgta

SEQ ID NO: 4534688 - DNA, 13 bp, Homo sapiens
ccatcatctcctg

SEQ ID NO: 4534689 - DNA, 13 bp, Homo sapiens
ccatcatctctga

SEQ ID NO: 4534690 - DNA, 15 bp, Homo sapiens
ccatcatctctgaag

SEQ ID NO: 4534691 - DNA, 23 bp, Homo sapiens
ccatcatgcggtgggtgctgcca

SEQ ID NO: 4534692 - DNA, 20 bp, Homo sapiens
ccatcatgtttacagaggac

SEQ ID NO: 4534693 - DNA, 22 bp, Homo sapiens
ccatcatgtttacagaggacag

SEQ ID NO: 4534694 - DNA, 16 bp, Homo sapiens
ccatccactctaccct

SEQ ID NO: 4534695 - DNA, 13 bp, Homo sapiens
ccatccagatgtg

SEQ ID NO: 4534696 - DNA, 13 bp, Homo sapiens
ccatccagccaga

SEQ ID NO: 4534697 - DNA, 20 bp, Homo sapiens
ccatccattctcctcagtgg

SEQ ID NO: 4534698 - DNA, 11 bp, Homo sapiens
ccatcccctcc

SEQ ID NO: 4534699 - DNA, 12 bp, Homo sapiens
ccatcccctccc

SEQ ID NO: 4534700 - DNA, 15 bp, Homo sapiens
ccatcccctccctgc

SEQ ID NO: 4534701 - DNA, 22 bp, Homo sapiens
ccatccccttcccccatcccta

SEQ ID NO: 4534702 - DNA, 13 bp, Homo sapiens
ccatcccgaagcc

SEQ ID NO: 4534703 - DNA, 22 bp, Homo sapiens
ccatcccgaagccatcacttct

SEQ ID NO: 4534704 - DNA, 12 bp, Homo sapiens
ccatccctacca

SEQ ID NO: 4534705 - DNA, 16 bp, Homo sapiens
ccatccctaccactgt

SEQ ID NO: 4534706 - DNA, 17 bp, Homo sapiens
ccatccctgggcccctc

SEQ ID NO: 4534707 - DNA, 19 bp, Homo sapiens
ccatccctgggcccctcca

SEQ ID NO: 4534708 - DNA, 12 bp, Homo sapiens
ccatccctgtga

SEQ ID NO: 4534709 - DNA, 17 bp, Homo sapiens
ccatccctttttttaca

SEQ ID NO: 4534710 - DNA, 22 bp, Homo sapiens
ccatccgactgcccctgctgtg

SEQ ID NO: 4534711 - DNA, 17 bp, Homo sapiens
ccatcctggcccagggc

SEQ ID NO: 4534712 - DNA, 15 bp, Homo sapiens
ccatcgtcctgggac

SEQ ID NO: 4534713 - DNA, 21 bp, Homo sapiens
ccatctcaaaaaaaaaaaaga

SEQ ID NO: 4534714 - DNA, 12 bp, Homo sapiens
ccatctcaggag

SEQ ID NO: 4534715 - DNA, 13 bp, Homo sapiens
ccatctcaggaga

SEQ ID NO: 4534716 - DNA, 22 bp, Homo sapiens
ccatctccctccccagaaacag

SEQ ID NO: 4534717 - DNA, 14 bp, Homo sapiens
ccatctccctgcct

SEQ ID NO: 4534718 - DNA, 12 bp, Homo sapiens
ccatctctacaa

SEQ ID NO: 4534719 - DNA, 14 bp, Homo sapiens
ccatctcttccttc

SEQ ID NO: 4534720 - DNA, 12 bp, Homo sapiens
ccatctgcaccc

SEQ ID NO: 4534721 - DNA, 17 bp, Homo sapiens
ccatctgcaccccttct

SEQ ID NO: 4534722 - DNA, 20 bp, Homo sapiens
ccatctgcgggggcagtgct

SEQ ID NO: 4534723 - DNA, 14 bp, Homo sapiens
ccatgaagatgtag

SEQ ID NO: 4534724 - DNA, 16 bp, Homo sapiens
ccatgaagccttttga

SEQ ID NO: 4534725 - DNA, 21 bp, Homo sapiens
ccatgaaggctggaaggcagc

SEQ ID NO: 4534726 - DNA, 23 bp, Homo sapiens
ccatgaaggctggaaggcagcag

SEQ ID NO: 4534727 - DNA, 15 bp, Homo sapiens
ccatgacagaggctg

SEQ ID NO: 4534728 - DNA, 16 bp, Homo sapiens
ccatgacagaggctgc

SEQ ID NO: 4534729 - DNA, 17 bp, Homo sapiens
ccatgacagaggctgca

SEQ ID NO: 4534730 - DNA, 19 bp, Homo sapiens
ccatgacagaggctgcacc

SEQ ID NO: 4534731 - DNA, 16 bp, Homo sapiens
ccatgaccagaaacag

SEQ ID NO: 4534732 - DNA, 20 bp, Homo sapiens
ccatgagcactactctacca

SEQ ID NO: 4534733 - DNA, 20 bp, Homo sapiens
ccatgaggagttgctgtttg

SEQ ID NO: 4534734 - DNA, 12 bp, Homo sapiens
ccatgatctgta

SEQ ID NO: 4534735 - DNA, 17 bp, Homo sapiens
ccatgcaaattgtgaaa

SEQ ID NO: 4534736 - DNA, 12 bp, Homo sapiens
ccatgcaactgg

SEQ ID NO: 4534737 - DNA, 19 bp, Homo sapiens
ccatgccagattctgcctc

SEQ ID NO: 4534738 - DNA, 23 bp, Homo sapiens
ccatgccagattctgcctctctg

SEQ ID NO: 4534739 - DNA, 16 bp, Homo sapiens
ccatgcccacctgccc

SEQ ID NO: 4534740 - DNA, 13 bp, Homo sapiens
ccatgccccagtc

SEQ ID NO: 4534741 - DNA, 13 bp, Homo sapiens
ccatgcctgtcca

SEQ ID NO: 4534742 - DNA, 21 bp, Homo sapiens
ccatgctctctcacctgctcc

SEQ ID NO: 4534743 - DNA, 22 bp, Homo sapiens
ccatgctctctcacctgctccc

SEQ ID NO: 4534744 - DNA, 17 bp, Homo sapiens
ccatgctgccttcaggg

SEQ ID NO: 4534745 - DNA, 16 bp, Homo sapiens
ccatgctggctgaaga

SEQ ID NO: 4534746 - DNA, 20 bp, Homo sapiens
ccatgctgggccactgggga

SEQ ID NO: 4534747 - DNA, 21 bp, Homo sapiens
ccatgctgggtctgaggcccc

SEQ ID NO: 4534748 - DNA, 20 bp, Homo sapiens
ccatgctttgagtccacgcc

SEQ ID NO: 4534749 - DNA, 22 bp, Homo sapiens
ccatgctttgagtccacgccca

SEQ ID NO: 4534750 - DNA, 23 bp, Homo sapiens
ccatggaagaggctacagggcca

SEQ ID NO: 4534751 - DNA, 14 bp, Homo sapiens
ccatggagccccag

SEQ ID NO: 4534752 - DNA, 19 bp, Homo sapiens
ccatggagccccagccccc

SEQ ID NO: 4534753 - DNA, 14 bp, Homo sapiens
ccatggccccaggc

SEQ ID NO: 4534754 - DNA, 13 bp, Homo sapiens
ccatggccctgtc

SEQ ID NO: 4534755 - DNA, 18 bp, Homo sapiens
ccatggccctgtcccagg

SEQ ID NO: 4534756 - DNA, 16 bp, Homo sapiens
ccatggcctcagccct

SEQ ID NO: 4534757 - DNA, 17 bp, Homo sapiens
ccatggcctcagccctg

SEQ ID NO: 4534758 - DNA, 21 bp, Homo sapiens
ccatggcctcagccctgctcc

SEQ ID NO: 4534759 - DNA, 17 bp, Homo sapiens
ccatgggcagagcccaa

SEQ ID NO: 4534760 - DNA, 15 bp, Homo sapiens
ccatggggtccatcc

SEQ ID NO: 4534761 - DNA, 17 bp, Homo sapiens
ccatggggttcgagact

SEQ ID NO: 4534762 - DNA, 17 bp, Homo sapiens
ccatggtgaaagggttt

SEQ ID NO: 4534763 - DNA, 23 bp, Homo sapiens
ccatggtgaaagggtttgatatg

SEQ ID NO: 4534764 - DNA, 23 bp, Homo sapiens
ccatggtggcggcgaagaagaga

SEQ ID NO: 4534765 - DNA, 19 bp, Homo sapiens
ccatggtgtgatcgtctga

SEQ ID NO: 4534766 - DNA, 15 bp, Homo sapiens
ccatggttctgcctc

SEQ ID NO: 4534767 - DNA, 17 bp, Homo sapiens
ccatggttctgcctcct

SEQ ID NO: 4534768 - DNA, 16 bp, Homo sapiens
ccatgtaaccactgca

SEQ ID NO: 4534769 - DNA, 18 bp, Homo sapiens
ccatgtactcaagtacca

SEQ ID NO: 4534770 - DNA, 15 bp, Homo sapiens
ccatgtagaaaattt

SEQ ID NO: 4534771 - DNA, 14 bp, Homo sapiens
ccatgtatttgtta

SEQ ID NO: 4534772 - DNA, 13 bp, Homo sapiens
ccatgtccaaaga

SEQ ID NO: 4534773 - DNA, 20 bp, Homo sapiens
ccatgtccaaagaggctgcc

SEQ ID NO: 4534774 - DNA, 15 bp, Homo sapiens
ccatgtgcctctttg

SEQ ID NO: 4534775 - DNA, 18 bp, Homo sapiens
ccatgtgcctttctttgc

SEQ ID NO: 4534776 - DNA, 20 bp, Homo sapiens
ccatgtgcctttctttgcct

SEQ ID NO: 4534777 - DNA, 13 bp, Homo sapiens
ccatgtgctgccc

SEQ ID NO: 4534778 - DNA, 12 bp, Homo sapiens
ccatgtgtcccc

SEQ ID NO: 4534779 - DNA, 14 bp, Homo sapiens
ccatgtgtcccctc

SEQ ID NO: 4534780 - DNA, 18 bp, Homo sapiens
ccatgtgtcccctcactc

SEQ ID NO: 4534781 - DNA, 20 bp, Homo sapiens
ccatgtgtcccctcactctg

SEQ ID NO: 4534782 - DNA, 22 bp, Homo sapiens
ccatgtgtcccctcactctgtc

SEQ ID NO: 4534783 - DNA, 21 bp, Homo sapiens
ccatgtgtgtgccaagccctg

SEQ ID NO: 4534784 - DNA, 22 bp, Homo sapiens
ccatgtgtgtgccaagccctgg

SEQ ID NO: 4534785 - DNA, 20 bp, Homo sapiens
ccatgttagccaggatggtc

SEQ ID NO: 4534786 - DNA, 19 bp, Homo sapiens
ccatgttatattgcttcct

SEQ ID NO: 4534787 - DNA, 18 bp, Homo sapiens
ccatgttccccagttcag

SEQ ID NO: 4534788 - DNA, 12 bp, Homo sapiens
ccatgttgaagt

SEQ ID NO: 4534789 - DNA, 13 bp, Homo sapiens
ccatgttgcgttc

SEQ ID NO: 4534790 - DNA, 20 bp, Homo sapiens
ccatgttggtcaggatggtc

SEQ ID NO: 4534791 - DNA, 17 bp, Homo sapiens
ccatgtttgagctcaga

SEQ ID NO: 4534792 - DNA, 21 bp, Homo sapiens
ccatgtttgagctcagacccc

SEQ ID NO: 4534793 - DNA, 17 bp, Homo sapiens
ccattagccagatttgt

SEQ ID NO: 4534794 - DNA, 15 bp, Homo sapiens
ccattatactttata

SEQ ID NO: 4534795 - DNA, 18 bp, Homo sapiens
ccattcacaagcctcctg

SEQ ID NO: 4534796 - DNA, 22 bp, Homo sapiens
ccattccaaagctttattacca

SEQ ID NO: 4534797 - DNA, 22 bp, Homo sapiens
ccattccatctagtttttggaa

SEQ ID NO: 4534798 - DNA, 13 bp, Homo sapiens
ccattcctcaggg

SEQ ID NO: 4534799 - DNA, 15 bp, Homo sapiens
ccattcctgcctggt

SEQ ID NO: 4534800 - DNA, 19 bp, Homo sapiens
ccattccttgcgcctcagc

SEQ ID NO: 4534801 - DNA, 15 bp, Homo sapiens
ccattctagatcctg

SEQ ID NO: 4534802 - DNA, 19 bp, Homo sapiens
ccattctagatcctgcacc

SEQ ID NO: 4534803 - DNA, 22 bp, Homo sapiens
ccattctagatcctgcacccca

SEQ ID NO: 4534804 - DNA, 23 bp, Homo sapiens
ccattctagatcctgcaccccag

SEQ ID NO: 4534805 - DNA, 11 bp, Homo sapiens
ccattctccca

SEQ ID NO: 4534806 - DNA, 12 bp, Homo sapiens
ccattctcccag

SEQ ID NO: 4534807 - DNA, 23 bp, Homo sapiens
ccattctcccaggtaccagctgc

SEQ ID NO: 4534808 - DNA, 15 bp, Homo sapiens
ccattctccccctct

SEQ ID NO: 4534809 - DNA, 14 bp, Homo sapiens
ccattctcctgcct

SEQ ID NO: 4534810 - DNA, 20 bp, Homo sapiens
ccattctctctcctgtccaa

SEQ ID NO: 4534811 - DNA, 16 bp, Homo sapiens
ccattctgtgcaggct

SEQ ID NO: 4534812 - DNA, 17 bp, Homo sapiens
ccattctgtgtcccatg

SEQ ID NO: 4534813 - DNA, 13 bp, Homo sapiens
ccattcttctggg

SEQ ID NO: 4534814 - DNA, 14 bp, Homo sapiens
ccattcttctgggt

SEQ ID NO: 4534815 - DNA, 14 bp, Homo sapiens
ccattctttcccaa

SEQ ID NO: 4534816 - DNA, 21 bp, Homo sapiens
ccattgaaactaagagctctc

SEQ ID NO: 4534817 - DNA, 19 bp, Homo sapiens
ccattgagatcttcctgct

SEQ ID NO: 4534818 - DNA, 21 bp, Homo sapiens
ccattgagatcttcctgctga

SEQ ID NO: 4534819 - DNA, 15 bp, Homo sapiens
ccattgccaccagga

SEQ ID NO: 4534820 - DNA, 16 bp, Homo sapiens
ccattgccaccaggag

SEQ ID NO: 4534821 - DNA, 22 bp, Homo sapiens
ccattgcccagtgagccctgct

SEQ ID NO: 4534822 - DNA, 14 bp, Homo sapiens
ccattgccctggtt

SEQ ID NO: 4534823 - DNA, 18 bp, Homo sapiens
ccattggccgagctcctg

SEQ ID NO: 4534824 - DNA, 20 bp, Homo sapiens
ccattggccgagctcctggg

SEQ ID NO: 4534825 - DNA, 17 bp, Homo sapiens
ccattgggaccctccag

SEQ ID NO: 4534826 - DNA, 20 bp, Homo sapiens
ccattgggaccctccagtgc

SEQ ID NO: 4534827 - DNA, 19 bp, Homo sapiens
ccattgggcacagtccaga

SEQ ID NO: 4534828 - DNA, 15 bp, Homo sapiens
ccattggggctccca

SEQ ID NO: 4534829 - DNA, 16 bp, Homo sapiens
ccattggggctcccag

SEQ ID NO: 4534830 - DNA, 20 bp, Homo sapiens
ccattggggctcccagccag

SEQ ID NO: 4534831 - DNA, 18 bp, Homo sapiens
ccattgtctttatatgaa

SEQ ID NO: 4534832 - DNA, 15 bp, Homo sapiens
ccatttaaagaaaga

SEQ ID NO: 4534833 - DNA, 13 bp, Homo sapiens
ccatttaaagctt

SEQ ID NO: 4534834 - DNA, 20 bp, Homo sapiens
ccatttaagaactgaggaac

SEQ ID NO: 4534835 - DNA, 19 bp, Homo sapiens
ccatttaagtatcttgtgc

SEQ ID NO: 4534836 - DNA, 20 bp, Homo sapiens
ccatttaagtatcttgtgct

SEQ ID NO: 4534837 - DNA, 18 bp, Homo sapiens
ccatttacacttttgaga

SEQ ID NO: 4534838 - DNA, 17 bp, Homo sapiens
ccatttacatgttttaa

SEQ ID NO: 4534839 - DNA, 22 bp, Homo sapiens
ccatttacatgttttaaagaaa

SEQ ID NO: 4534840 - DNA, 15 bp, Homo sapiens
ccatttatttcctca

SEQ ID NO: 4534841 - DNA, 14 bp, Homo sapiens
ccatttcccatctg

SEQ ID NO: 4534842 - DNA, 12 bp, Homo sapiens
ccatttctgcct

SEQ ID NO: 4534843 - DNA, 20 bp, Homo sapiens
ccatttgctactgtacataa

SEQ ID NO: 4534844 - DNA, 16 bp, Homo sapiens
ccatttgtattaccat

SEQ ID NO: 4534845 - DNA, 13 bp, Homo sapiens
ccatttgtcccaa

SEQ ID NO: 4534846 - DNA, 15 bp, Homo sapiens
ccatttgtcccaagt

SEQ ID NO: 4534847 - DNA, 21 bp, Homo sapiens
ccatttgtgtacacagtcagc

SEQ ID NO: 4534848 - DNA, 17 bp, Homo sapiens
ccattttaacgctgcct

SEQ ID NO: 4534849 - DNA, 17 bp, Homo sapiens
ccattttacagatttct

SEQ ID NO: 4534850 - DNA, 11 bp, Homo sapiens
ccattttccag

SEQ ID NO: 4534851 - DNA, 12 bp, Homo sapiens
ccattttccagt

SEQ ID NO: 4534852 - DNA, 23 bp, Homo sapiens
ccattttcctacaggcagtctct

SEQ ID NO: 4534853 - DNA, 16 bp, Homo sapiens
ccatttttaaccactt

SEQ ID NO: 4534854 - DNA, 14 bp, Homo sapiens
ccatttttacaagt

SEQ ID NO: 4534855 - DNA, 15 bp, Homo sapiens
ccatttttcaaagca

SEQ ID NO: 4534856 - DNA, 14 bp, Homo sapiens
ccatttttctcttg

SEQ ID NO: 4534857 - DNA, 23 bp, Homo sapiens
cccaaaaacagcccccctgctgc

SEQ ID NO: 4534858 - DNA, 18 bp, Homo sapiens
cccaaaaggcagaagcaa

SEQ ID NO: 4534859 - DNA, 22 bp, Homo sapiens
cccaaaagtcaaaaggtgcctg

SEQ ID NO: 4534860 - DNA, 20 bp, Homo sapiens
cccaaacagctgtatttata

SEQ ID NO: 4534861 - DNA, 23 bp, Homo sapiens
cccaaactgttgattattagcca

SEQ ID NO: 4534862 - DNA, 23 bp, Homo sapiens
cccaaagcagcaggcctctggtt

SEQ ID NO: 4534863 - DNA, 14 bp, Homo sapiens
cccaaagggcacac

SEQ ID NO: 4534864 - DNA, 21 bp, Homo sapiens
cccaaagtccccctcctcagc

SEQ ID NO: 4534865 - DNA, 14 bp, Homo sapiens
cccaaatcaataca

SEQ ID NO: 4534866 - DNA, 17 bp, Homo sapiens
cccaaatgatggatcac

SEQ ID NO: 4534867 - DNA, 16 bp, Homo sapiens
cccaaatttgattgat

SEQ ID NO: 4534868 - DNA, 13 bp, Homo sapiens
cccaacacctctt

SEQ ID NO: 4534869 - DNA, 16 bp, Homo sapiens
cccaacactgccagca

SEQ ID NO: 4534870 - DNA, 17 bp, Homo sapiens
cccaacagtttattttt

SEQ ID NO: 4534871 - DNA, 12 bp, Homo sapiens
cccaacatggga

SEQ ID NO: 4534872 - DNA, 22 bp, Homo sapiens
cccaacatgggagggatcagcc

SEQ ID NO: 4534873 - DNA, 23 bp, Homo sapiens
cccaacatgggagggatcagccc

SEQ ID NO: 4534874 - DNA, 12 bp, Homo sapiens
cccaacccccac

SEQ ID NO: 4534875 - DNA, 17 bp, Homo sapiens
cccaaccccgtgtcctg

SEQ ID NO: 4534876 - DNA, 15 bp, Homo sapiens
cccaacccctcctcc

SEQ ID NO: 4534877 - DNA, 19 bp, Homo sapiens
cccaacccctcctccctca

SEQ ID NO: 4534878 - DNA, 14 bp, Homo sapiens
cccaaccctgtctg

SEQ ID NO: 4534879 - DNA, 19 bp, Homo sapiens
cccaacgtcccctccgccg

SEQ ID NO: 4534880 - DNA, 23 bp, Homo sapiens
cccaacgtcccctccgccgtgcc

SEQ ID NO: 4534881 - DNA, 14 bp, Homo sapiens
cccaactccacagg

SEQ ID NO: 4534882 - DNA, 16 bp, Homo sapiens
cccaactccaggggca

SEQ ID NO: 4534883 - DNA, 19 bp, Homo sapiens
cccaactccaggggcacct

SEQ ID NO: 4534884 - DNA, 12 bp, Homo sapiens
cccaactgctcc

SEQ ID NO: 4534885 - DNA, 15 bp, Homo sapiens
cccaactgctccagc

SEQ ID NO: 4534886 - DNA, 17 bp, Homo sapiens
cccaactggttcaggct

SEQ ID NO: 4534887 - DNA, 19 bp, Homo sapiens
cccaactggttcaggctca

SEQ ID NO: 4534888 - DNA, 19 bp, Homo sapiens
cccaacttcaccaccccct

SEQ ID NO: 4534889 - DNA, 13 bp, Homo sapiens
cccaacttcttcc

SEQ ID NO: 4534890 - DNA, 20 bp, Homo sapiens
cccaagacagatgccccaga

SEQ ID NO: 4534891 - DNA, 16 bp, Homo sapiens
cccaagactcccatga

SEQ ID NO: 4534892 - DNA, 18 bp, Homo sapiens
cccaagaggactgagact

SEQ ID NO: 4534893 - DNA, 16 bp, Homo sapiens
cccaagaggtctgagc

SEQ ID NO: 4534894 - DNA, 18 bp, Homo sapiens
cccaagaggtctgagccc

SEQ ID NO: 4534895 - DNA, 20 bp, Homo sapiens
cccaagatgggcatcttttg

SEQ ID NO: 4534896 - DNA, 18 bp, Homo sapiens
cccaagcgttcctggcct

SEQ ID NO: 4534897 - DNA, 13 bp, Homo sapiens
cccaagctgggcc

SEQ ID NO: 4534898 - DNA, 14 bp, Homo sapiens
cccaagctgggccc

SEQ ID NO: 4534899 - DNA, 18 bp, Homo sapiens
cccaagctgggccccagc

SEQ ID NO: 4534900 - DNA, 16 bp, Homo sapiens
cccaaggactgaggga

SEQ ID NO: 4534901 - DNA, 21 bp, Homo sapiens
cccaaggactgagggactctg

SEQ ID NO: 4534902 - DNA, 15 bp, Homo sapiens
cccaaggaggaaaaa

SEQ ID NO: 4534903 - DNA, 18 bp, Homo sapiens
cccaaggcctaccccagt

SEQ ID NO: 4534904 - DNA, 19 bp, Homo sapiens
cccaagggtgccctttggg

SEQ ID NO: 4534905 - DNA, 17 bp, Homo sapiens
cccaaggtcctctcagt

SEQ ID NO: 4534906 - DNA, 14 bp, Homo sapiens
cccaagtgggggca

SEQ ID NO: 4534907 - DNA, 19 bp, Homo sapiens
cccaagttcatgcagctgt

SEQ ID NO: 4534908 - DNA, 12 bp, Homo sapiens
cccaataaacca

SEQ ID NO: 4534909 - DNA, 14 bp, Homo sapiens
cccaataaagcctt

SEQ ID NO: 4534910 - DNA, 17 bp, Homo sapiens
cccaataaaggcagctg

SEQ ID NO: 4534911 - DNA, 20 bp, Homo sapiens
cccaataaaggcagctgcct

SEQ ID NO: 4534912 - DNA, 21 bp, Homo sapiens
cccaataaaggcagctgcctc

SEQ ID NO: 4534913 - DNA, 22 bp, Homo sapiens
cccaataaaggcagctgcctct

SEQ ID NO: 4534914 - DNA, 12 bp, Homo sapiens
cccaatatattc

SEQ ID NO: 4534915 - DNA, 21 bp, Homo sapiens
cccaatcagcttttgttctag

SEQ ID NO: 4534916 - DNA, 23 bp, Homo sapiens
cccaatcagcttttgttctagac

SEQ ID NO: 4534917 - DNA, 16 bp, Homo sapiens
cccaatccatgcttca

SEQ ID NO: 4534918 - DNA, 18 bp, Homo sapiens
cccaatcggactgccaaa

SEQ ID NO: 4534919 - DNA, 19 bp, Homo sapiens
cccaatcggactgccaaat

SEQ ID NO: 4534920 - DNA, 12 bp, Homo sapiens
cccaatgaatta

SEQ ID NO: 4534921 - DNA, 22 bp, Homo sapiens
cccaatttcggattttttccaa

SEQ ID NO: 4534922 - DNA, 19 bp, Homo sapiens
cccacaacccaaaaggttt

SEQ ID NO: 4534923 - DNA, 13 bp, Homo sapiens
cccacaagaaatg

SEQ ID NO: 4534924 - DNA, 20 bp, Homo sapiens
cccacaagccttactcacct

SEQ ID NO: 4534925 - DNA, 22 bp, Homo sapiens
cccacaagccttactcacctct

SEQ ID NO: 4534926 - DNA, 22 bp, Homo sapiens
cccacaatctggcttagtgcca

SEQ ID NO: 4534927 - DNA, 23 bp, Homo sapiens
cccacaatctggcttagtgccac

SEQ ID NO: 4534928 - DNA, 14 bp, Homo sapiens
cccacaatgccaga

SEQ ID NO: 4534929 - DNA, 14 bp, Homo sapiens
cccacactcactcc

SEQ ID NO: 4534930 - DNA, 16 bp, Homo sapiens
cccacactcactcctg

SEQ ID NO: 4534931 - DNA, 16 bp, Homo sapiens
cccacagagcctgaat

SEQ ID NO: 4534932 - DNA, 20 bp, Homo sapiens
cccacagctcccaccccacc

SEQ ID NO: 4534933 - DNA, 12 bp, Homo sapiens
cccacagctggg

SEQ ID NO: 4534934 - DNA, 14 bp, Homo sapiens
cccagtggtcagca

SEQ ID NO: 4534935 - DNA, 16 bp, Homo sapiens
cccagtggtcagcagg

SEQ ID NO: 4534936 - DNA, 19 bp, Homo sapiens
cccagtgtcccctttcttc

SEQ ID NO: 4534937 - DNA, 14 bp, Homo sapiens
cccagttaaagatt

SEQ ID NO: 4534938 - DNA, 16 bp, Homo sapiens
cccagttccacagcag

SEQ ID NO: 4534939 - DNA, 22 bp, Homo sapiens
cccagttcccgtgacgaggctc

SEQ ID NO: 4534940 - DNA, 20 bp, Homo sapiens
cccagttgcactcaggtgac

SEQ ID NO: 4534941 - DNA, 15 bp, Homo sapiens
cccatacaatgtatg

SEQ ID NO: 4534942 - DNA, 16 bp, Homo sapiens
cccatacaatgtatgt

SEQ ID NO: 4534943 - DNA, 21 bp, Homo sapiens
cccatacaatgtatgtacaat

SEQ ID NO: 4534944 - DNA, 17 bp, Homo sapiens
cccatacccagtctagg

SEQ ID NO: 4534945 - DNA, 17 bp, Homo sapiens
cccataggccaccccct

SEQ ID NO: 4534946 - DNA, 20 bp, Homo sapiens
cccatagggtcggaggtgct

SEQ ID NO: 4534947 - DNA, 15 bp, Homo sapiens
cccatattgtaaaac

SEQ ID NO: 4534948 - DNA, 18 bp, Homo sapiens
cccatattgtaaaacagg

SEQ ID NO: 4534949 - DNA, 19 bp, Homo sapiens
cccatattgtaaaacaggt

SEQ ID NO: 4534950 - DNA, 22 bp, Homo sapiens
cccatcacagggttgggcccag

SEQ ID NO: 4534951 - DNA, 15 bp, Homo sapiens
cccatcaccagagtc

SEQ ID NO: 4534952 - DNA, 15 bp, Homo sapiens
cccatcacccaagcc

SEQ ID NO: 4534953 - DNA, 14 bp, Homo sapiens
cccatcagaaggag

SEQ ID NO: 4534954 - DNA, 14 bp, Homo sapiens
cccatccaaccact

SEQ ID NO: 4534955 - DNA, 17 bp, Homo sapiens
cccatccagacctggct

SEQ ID NO: 4534956 - DNA, 22 bp, Homo sapiens
cccatccagacctggctccact

SEQ ID NO: 4534957 - DNA, 15 bp, Homo sapiens
cccatctccctgcct

SEQ ID NO: 4534958 - DNA, 18 bp, Homo sapiens
cccatctccctgcctggc

SEQ ID NO: 4534959 - DNA, 13 bp, Homo sapiens
cccatctgcaccc

SEQ ID NO: 4534960 - DNA, 19 bp, Homo sapiens
cccatctgtagtaatttat

SEQ ID NO: 4534961 - DNA, 12 bp, Homo sapiens
cccatctgtcca

SEQ ID NO: 4534962 - DNA, 17 bp, Homo sapiens
cccatctgtctgccaac

SEQ ID NO: 4534963 - DNA, 16 bp, Homo sapiens
cccatgaaattgaccc

SEQ ID NO: 4534964 - DNA, 11 bp, Homo sapiens
cccatgaagcc

SEQ ID NO: 4534965 - DNA, 18 bp, Homo sapiens
cccatgaccccaaagcca

SEQ ID NO: 4534966 - DNA, 20 bp, Homo sapiens
cccatgagggagatgccatg

SEQ ID NO: 4534967 - DNA, 13 bp, Homo sapiens
cccatgccagaga

SEQ ID NO: 4534968 - DNA, 15 bp, Homo sapiens
cccatgccagagagg

SEQ ID NO: 4534969 - DNA, 19 bp, Homo sapiens
cccatgccggtacacagcc

SEQ ID NO: 4534970 - DNA, 12 bp, Homo sapiens
cccatgctgcct

SEQ ID NO: 4534971 - DNA, 20 bp, Homo sapiens
cccatgcttacgtgatcctc

SEQ ID NO: 4534972 - DNA, 16 bp, Homo sapiens
cccatggagccccagc

SEQ ID NO: 4534973 - DNA, 18 bp, Homo sapiens
cccatggcccccaataaa

SEQ ID NO: 4534974 - DNA, 14 bp, Homo sapiens
cccatggcctcagc

SEQ ID NO: 4534975 - DNA, 21 bp, Homo sapiens
cccatggcctcagccctgctc

SEQ ID NO: 4534976 - DNA, 22 bp, Homo sapiens
cccatggcctcagccctgctcc

SEQ ID NO: 4534977 - DNA, 13 bp, Homo sapiens
cccatgggcccct

SEQ ID NO: 4534978 - DNA, 16 bp, Homo sapiens
cccatgggctctgaca

SEQ ID NO: 4534979 - DNA, 11 bp, Homo sapiens
cccatgggctg

SEQ ID NO: 4534980 - DNA, 15 bp, Homo sapiens
cccatgggctgtgtc

SEQ ID NO: 4534981 - DNA, 18 bp, Homo sapiens
cccatggtcatctctgtt

SEQ ID NO: 4534982 - DNA, 20 bp, Homo sapiens
cccatgtgtcccctcactct

SEQ ID NO: 4534983 - DNA, 22 bp, Homo sapiens
cccatgtgtcccctcactctgt

SEQ ID NO: 4534984 - DNA, 23 bp, Homo sapiens
cccatgtgtcccctcactctgtc

SEQ ID NO: 4534985 - DNA, 13 bp, Homo sapiens
cccatgtttcaaa

SEQ ID NO: 4534986 - DNA, 13 bp, Homo sapiens
cccattcccacca

SEQ ID NO: 4534987 - DNA, 13 bp, Homo sapiens
cccattcctgcct

SEQ ID NO: 4534988 - DNA, 14 bp, Homo sapiens
cccattcctgggaa

SEQ ID NO: 4534989 - DNA, 21 bp, Homo sapiens
cccattccttgcgcctcagcc

SEQ ID NO: 4534990 - DNA, 18 bp, Homo sapiens
cccattctacacagagca

SEQ ID NO: 4534991 - DNA, 15 bp, Homo sapiens
cccattctagatcct

SEQ ID NO: 4534992 - DNA, 19 bp, Homo sapiens
cccattctagatcctgcac

SEQ ID NO: 4534993 - DNA, 18 bp, Homo sapiens
cccattctctctcctgtc

SEQ ID NO: 4534994 - DNA, 15 bp, Homo sapiens
cccattctgcaccac

SEQ ID NO: 4534995 - DNA, 21 bp, Homo sapiens
cccattctgtgtcccatgtcc

SEQ ID NO: 4534996 - DNA, 21 bp, Homo sapiens
cccattcttctgggtgtgctt

SEQ ID NO: 4534997 - DNA, 11 bp, Homo sapiens
cccattctttg

SEQ ID NO: 4534998 - DNA, 17 bp, Homo sapiens
cccattgcccagtgagc

SEQ ID NO: 4534999 - DNA, 21 bp, Homo sapiens
cccattgcccagtgagccctg

SEQ ID NO: 4535000 - DNA, 14 bp, Homo sapiens
cccattgccctggt

SEQ ID NO: 4535001 - DNA, 14 bp, Homo sapiens
cccattggccgagc

SEQ ID NO: 4535002 - DNA, 21 bp, Homo sapiens
cccattggccgagctcctggg

SEQ ID NO: 4535003 - DNA, 14 bp, Homo sapiens
cccatttcaatgtg

SEQ ID NO: 4535004 - DNA, 16 bp, Homo sapiens
cccatttcccatctgc

SEQ ID NO: 4535005 - DNA, 23 bp, Homo sapiens
cccatttctgcctcgctcaccgc

SEQ ID NO: 4535006 - DNA, 14 bp, Homo sapiens
cccatttcttgcta

SEQ ID NO: 4535007 - DNA, 13 bp, Homo sapiens
cccatttttctct

SEQ ID NO: 4535008 - DNA, 17 bp, Homo sapiens
cccatttttgctaatta

SEQ ID NO: 4535009 - DNA, 15 bp, Homo sapiens
ccccaaacaggacag

SEQ ID NO: 4535010 - DNA, 17 bp, Homo sapiens
ccccaaacaggacagca

SEQ ID NO: 4535011 - DNA, 14 bp, Homo sapiens
ccccaaaccccagc

SEQ ID NO: 4535012 - DNA, 15 bp, Homo sapiens
ccccaaaggacgcct

SEQ ID NO: 4535013 - DNA, 20 bp, Homo sapiens
ccccaaaggacgcctgcagg

SEQ ID NO: 4535014 - DNA, 23 bp, Homo sapiens
ccccaaaggacgcctgcaggaga

SEQ ID NO: 4535015 - DNA, 13 bp, Homo sapiens
ccccaacacctgc

SEQ ID NO: 4535016 - DNA, 16 bp, Homo sapiens
ccccaacatgttcaga

SEQ ID NO: 4535017 - DNA, 13 bp, Homo sapiens
ccccaacccccac

SEQ ID NO: 4535018 - DNA, 16 bp, Homo sapiens
ccccaacgtcccctcc

SEQ ID NO: 4535019 - DNA, 17 bp, Homo sapiens
ccccaacgtcccctccg

SEQ ID NO: 4535020 - DNA, 13 bp, Homo sapiens
ccccaactcctgg

SEQ ID NO: 4535021 - DNA, 14 bp, Homo sapiens
ccccaactcctgga

SEQ ID NO: 4535022 - DNA, 14 bp, Homo sapiens
ccccaactctcccc

SEQ ID NO: 4535023 - DNA, 16 bp, Homo sapiens
ccccaactctccccag

SEQ ID NO: 4535024 - DNA, 17 bp, Homo sapiens
ccccaactctccccagt

SEQ ID NO: 4535025 - DNA, 12 bp, Homo sapiens
ccccaactgctc

SEQ ID NO: 4535026 - DNA, 18 bp, Homo sapiens
ccccaagaggggcgggct

SEQ ID NO: 4535027 - DNA, 21 bp, Homo sapiens
ccccaagaggggcgggctcag

SEQ ID NO: 4535028 - DNA, 12 bp, Homo sapiens
ccccaaggccag

SEQ ID NO: 4535029 - DNA, 11 bp, Homo sapiens
ccccaataaac

SEQ ID NO: 4535030 - DNA, 13 bp, Homo sapiens
ccccaataaacca

SEQ ID NO: 4535031 - DNA, 17 bp, Homo sapiens
ccccaataaaccagtgt

SEQ ID NO: 4535032 - DNA, 18 bp, Homo sapiens
ccccaataaaccagtgtg

SEQ ID NO: 4535033 - DNA, 14 bp, Homo sapiens
ccccaataaagcct

SEQ ID NO: 4535034 - DNA, 15 bp, Homo sapiens
ccccaataaagcctt

SEQ ID NO: 4535035 - DNA, 14 bp, Homo sapiens
ccccaataaaggca

SEQ ID NO: 4535036 - DNA, 15 bp, Homo sapiens
ccccaataaaggcag

SEQ ID NO: 4535037 - DNA, 17 bp, Homo sapiens
ccccaataaaggcagct

SEQ ID NO: 4535038 - DNA, 22 bp, Homo sapiens
ccccaataaaggcagctgcctc

SEQ ID NO: 4535039 - DNA, 15 bp, Homo sapiens
ccccaatccatgctt

SEQ ID NO: 4535040 - DNA, 17 bp, Homo sapiens
ccccaatcggactgcca

SEQ ID NO: 4535041 - DNA, 23 bp, Homo sapiens
ccccaatgacacccatgccagag

SEQ ID NO: 4535042 - DNA, 17 bp, Homo sapiens
ccccacacctccctact

SEQ ID NO: 4535043 - DNA, 13 bp, Homo sapiens
ccccacactgggg

SEQ ID NO: 4535044 - DNA, 22 bp, Homo sapiens
ccccacacttgttccagctctt

SEQ ID NO: 4535045 - DNA, 13 bp, Homo sapiens
ccccacagaacct

SEQ ID NO: 4535046 - DNA, 12 bp, Homo sapiens
ccccacagcccc

SEQ ID NO: 4535047 - DNA, 13 bp, Homo sapiens
ccccacagcgctc

SEQ ID NO: 4535048 - DNA, 13 bp, Homo sapiens
ccccacagctggg

SEQ ID NO: 4535049 - DNA, 14 bp, Homo sapiens
ccccacagctgggg

SEQ ID NO: 4535050 - DNA, 18 bp, Homo sapiens
ccccacatgcatgtctgc

SEQ ID NO: 4535051 - DNA, 15 bp, Homo sapiens
ccccaccagtgcctc

SEQ ID NO: 4535052 - DNA, 16 bp, Homo sapiens
ccccaccagtgcctct

SEQ ID NO: 4535053 - DNA, 17 bp, Homo sapiens
ccccaccagtgcctctc

SEQ ID NO: 4535054 - DNA, 12 bp, Homo sapiens
ccccacccagga

SEQ ID NO: 4535055 - DNA, 13 bp, Homo sapiens
ccccacccaggag

SEQ ID NO: 4535056 - DNA, 12 bp, Homo sapiens
ccccaccccatc

SEQ ID NO: 4535057 - DNA, 19 bp, Homo sapiens
cccagcccacagagcctga

SEQ ID NO: 4535058 - DNA, 18 bp, Homo sapiens
cccagcccaccctcctgt

SEQ ID NO: 4535059 - DNA, 19 bp, Homo sapiens
cccagcccagagccacctg

SEQ ID NO: 4535060 - DNA, 16 bp, Homo sapiens
cccagcccagctggtg

SEQ ID NO: 4535061 - DNA, 14 bp, Homo sapiens
cccagccccagccc

SEQ ID NO: 4535062 - DNA, 12 bp, Homo sapiens
cccagcccccac

SEQ ID NO: 4535063 - DNA, 12 bp, Homo sapiens
cccagccccctc

SEQ ID NO: 4535064 - DNA, 20 bp, Homo sapiens
cccagccccctcccaccgct

SEQ ID NO: 4535065 - DNA, 15 bp, Homo sapiens
cccagccccctttgg

SEQ ID NO: 4535066 - DNA, 17 bp, Homo sapiens
cccagccccgactccag

SEQ ID NO: 4535067 - DNA, 18 bp, Homo sapiens
cccagccccgactccagc

SEQ ID NO: 4535068 - DNA, 19 bp, Homo sapiens
cccagcccctcctccctca

SEQ ID NO: 4535069 - DNA, 14 bp, Homo sapiens
cccagccctcatcc

SEQ ID NO: 4535070 - DNA, 15 bp, Homo sapiens
cccagccctcatccc

SEQ ID NO: 4535071 - DNA, 19 bp, Homo sapiens
cccagccctcatcccgagc

SEQ ID NO: 4535072 - DNA, 11 bp, Homo sapiens
cccagccctgc

SEQ ID NO: 4535073 - DNA, 14 bp, Homo sapiens
cccagccctgctgg

SEQ ID NO: 4535074 - DNA, 20 bp, Homo sapiens
cccagccctgctggccgcct

SEQ ID NO: 4535075 - DNA, 12 bp, Homo sapiens
cccagccctggc

SEQ ID NO: 4535076 - DNA, 17 bp, Homo sapiens
cccagccctggcccagg

SEQ ID NO: 4535077 - DNA, 14 bp, Homo sapiens
cccagccctggtct

SEQ ID NO: 4535078 - DNA, 18 bp, Homo sapiens
cccagccctggtctcagc

SEQ ID NO: 4535079 - DNA, 13 bp, Homo sapiens
cccagccgcagga

SEQ ID NO: 4535080 - DNA, 18 bp, Homo sapiens
cccagccgcaggaaggca

SEQ ID NO: 4535081 - DNA, 14 bp, Homo sapiens
cccagcctacctct

SEQ ID NO: 4535082 - DNA, 14 bp, Homo sapiens
cccagcctccaggc

SEQ ID NO: 4535083 - DNA, 22 bp, Homo sapiens
cccagcctctccccgctctgga

SEQ ID NO: 4535084 - DNA, 12 bp, Homo sapiens
cccagcctgggc

SEQ ID NO: 4535085 - DNA, 15 bp, Homo sapiens
cccagcctgggccat

SEQ ID NO: 4535086 - DNA, 17 bp, Homo sapiens
cccagcggccccccgca

SEQ ID NO: 4535087 - DNA, 23 bp, Homo sapiens
cccagcggccccccgcacagcca

SEQ ID NO: 4535088 - DNA, 22 bp, Homo sapiens
cccagctaatttttgtattttt

SEQ ID NO: 4535089 - DNA, 17 bp, Homo sapiens
cccagctactggggagg

SEQ ID NO: 4535090 - DNA, 22 bp, Homo sapiens
cccagctactggggaggctgag

SEQ ID NO: 4535091 - DNA, 17 bp, Homo sapiens
cccagctacttgggagg

SEQ ID NO: 4535092 - DNA, 16 bp, Homo sapiens
cccagctcccacaccg

SEQ ID NO: 4535093 - DNA, 17 bp, Homo sapiens
cccagctcccacaccgc

SEQ ID NO: 4535094 - DNA, 18 bp, Homo sapiens
cccagctcctttctcctg

SEQ ID NO: 4535095 - DNA, 21 bp, Homo sapiens
cccagctcctttctcctgtga

SEQ ID NO: 4535096 - DNA, 14 bp, Homo sapiens
cccagctctccctc

SEQ ID NO: 4535097 - DNA, 15 bp, Homo sapiens
cccagctctccctct

SEQ ID NO: 4535098 - DNA, 18 bp, Homo sapiens
cccagctctccctctggc

SEQ ID NO: 4535099 - DNA, 23 bp, Homo sapiens
cccagctgtgggcggctcctggt

SEQ ID NO: 4535100 - DNA, 14 bp, Homo sapiens
cccaggaagcccag

SEQ ID NO: 4535101 - DNA, 15 bp, Homo sapiens
cccaggaagcccagg

SEQ ID NO: 4535102 - DNA, 21 bp, Homo sapiens
cccaggacctcggatgaccat

SEQ ID NO: 4535103 - DNA, 19 bp, Homo sapiens
cccaggacgccactcattt

SEQ ID NO: 4535104 - DNA, 13 bp, Homo sapiens
cccaggactgggc

SEQ ID NO: 4535105 - DNA, 14 bp, Homo sapiens
cccaggactgggcc

SEQ ID NO: 4535106 - DNA, 21 bp, Homo sapiens
cccaggagagccagccctccc

SEQ ID NO: 4535107 - DNA, 22 bp, Homo sapiens
cccaggagagccagccctccct

SEQ ID NO: 4535108 - DNA, 14 bp, Homo sapiens
cccaggagggaggg

SEQ ID NO: 4535109 - DNA, 15 bp, Homo sapiens
cccaggagtccagac

SEQ ID NO: 4535110 - DNA, 16 bp, Homo sapiens
cccaggagtccagacc

SEQ ID NO: 4535111 - DNA, 18 bp, Homo sapiens
cccaggagtccagcccct

SEQ ID NO: 4535112 - DNA, 20 bp, Homo sapiens
cccaggagtttgaggctgca

SEQ ID NO: 4535113 - DNA, 17 bp, Homo sapiens
cccaggatactggcaca

SEQ ID NO: 4535114 - DNA, 19 bp, Homo sapiens
cccaggatactggcacaga

SEQ ID NO: 4535115 - DNA, 16 bp, Homo sapiens
cccaggatctgctcca

SEQ ID NO: 4535116 - DNA, 17 bp, Homo sapiens
cccaggatctgctccaa

SEQ ID NO: 4535117 - DNA, 21 bp, Homo sapiens
cccaggcaggtgcagggaagt

SEQ ID NO: 4535118 - DNA, 23 bp, Homo sapiens
cccaggcaggtgcagggaagtgc

SEQ ID NO: 4535119 - DNA, 13 bp, Homo sapiens
cccaggccacaga

SEQ ID NO: 4535120 - DNA, 13 bp, Homo sapiens
cccaggccagctg

SEQ ID NO: 4535121 - DNA, 16 bp, Homo sapiens
cccaggccagctgcgg

SEQ ID NO: 4535122 - DNA, 14 bp, Homo sapiens
cccaggccccaggg

SEQ ID NO: 4535123 - DNA, 12 bp, Homo sapiens
cccaggcccctg

SEQ ID NO: 4535124 - DNA, 18 bp, Homo sapiens
cccaggcccctggaggct

SEQ ID NO: 4535125 - DNA, 13 bp, Homo sapiens
cccaggccctccc

SEQ ID NO: 4535126 - DNA, 17 bp, Homo sapiens
cccaggccctccctgac

SEQ ID NO: 4535127 - DNA, 15 bp, Homo sapiens
cccaggccggcccag

SEQ ID NO: 4535128 - DNA, 17 bp, Homo sapiens
cccaggccggcccagat

SEQ ID NO: 4535129 - DNA, 12 bp, Homo sapiens
cccaggcgctgc

SEQ ID NO: 4535130 - DNA, 14 bp, Homo sapiens
cccaggcgctgcat

SEQ ID NO: 4535131 - DNA, 17 bp, Homo sapiens
cccaggctggagacccc

SEQ ID NO: 4535132 - DNA, 21 bp, Homo sapiens
cccagggaagcctgggtgtca

SEQ ID NO: 4535133 - DNA, 14 bp, Homo sapiens
cccagggacaccag

SEQ ID NO: 4535134 - DNA, 15 bp, Homo sapiens
cccagggacaccagc

SEQ ID NO: 4535135 - DNA, 17 bp, Homo sapiens
cccagggacaccagcca

SEQ ID NO: 4535136 - DNA, 15 bp, Homo sapiens
cccagggagtccagg

SEQ ID NO: 4535137 - DNA, 16 bp, Homo sapiens
cccagggcacccaggc

SEQ ID NO: 4535138 - DNA, 15 bp, Homo sapiens
cccagggcactgcca

SEQ ID NO: 4535139 - DNA, 17 bp, Homo sapiens
cccagggcatctgggag

SEQ ID NO: 4535140 - DNA, 13 bp, Homo sapiens
cccagggcctgac

SEQ ID NO: 4535141 - DNA, 15 bp, Homo sapiens
cccaggggcagccac

SEQ ID NO: 4535142 - DNA, 18 bp, Homo sapiens
cccaggggtcccagccac

SEQ ID NO: 4535143 - DNA, 13 bp, Homo sapiens
cccagggtagccc

SEQ ID NO: 4535144 - DNA, 19 bp, Homo sapiens
cccagggtagcccgcctgc

SEQ ID NO: 4535145 - DNA, 23 bp, Homo sapiens
cccagggtcataagtggggagag

SEQ ID NO: 4535146 - DNA, 13 bp, Homo sapiens
cccagggtggcca

SEQ ID NO: 4535147 - DNA, 14 bp, Homo sapiens
cccaggtacacctc

SEQ ID NO: 4535148 - DNA, 14 bp, Homo sapiens
cccaggtaccagct

SEQ ID NO: 4535149 - DNA, 21 bp, Homo sapiens
cccaggtgacacgcttctgag

SEQ ID NO: 4535150 - DNA, 16 bp, Homo sapiens
cccaggtgatattttt

SEQ ID NO: 4535151 - DNA, 13 bp, Homo sapiens
cccaggtgccagt

SEQ ID NO: 4535152 - DNA, 18 bp, Homo sapiens
cccaggtggctgacccag

SEQ ID NO: 4535153 - DNA, 15 bp, Homo sapiens
cccaggtgggtcccg

SEQ ID NO: 4535154 - DNA, 20 bp, Homo sapiens
cccaggttcatgaatatggt

SEQ ID NO: 4535155 - DNA, 20 bp, Homo sapiens
cccaggttcccccagcaagc

SEQ ID NO: 4535156 - DNA, 22 bp, Homo sapiens
cccagtacacaggggcttgact

SEQ ID NO: 4535157 - DNA, 18 bp, Homo sapiens
cccagtatgttttaacaa

SEQ ID NO: 4535158 - DNA, 17 bp, Homo sapiens
cccagtcagcctctctc

SEQ ID NO: 4535159 - DNA, 21 bp, Homo sapiens
cccagtcagcctctctcccag

SEQ ID NO: 4535160 - DNA, 19 bp, Homo sapiens
cccagtccaaatgtcctcc

SEQ ID NO: 4535161 - DNA, 18 bp, Homo sapiens
cccagtccatgctccagg

SEQ ID NO: 4535162 - DNA, 22 bp, Homo sapiens
cccagtccatgctccagggtca

SEQ ID NO: 4535163 - DNA, 19 bp, Homo sapiens
cccagtccccacccctgcc

SEQ ID NO: 4535164 - DNA, 15 bp, Homo sapiens
cccagtcctgcctga

SEQ ID NO: 4535165 - DNA, 18 bp, Homo sapiens
cccagtcggccccatctc

SEQ ID NO: 4535166 - DNA, 22 bp, Homo sapiens
cccagtcggccccatctctcat

SEQ ID NO: 4535167 - DNA, 17 bp, Homo sapiens
cccagtgaactcctgcc

SEQ ID NO: 4535168 - DNA, 18 bp, Homo sapiens
cccagtgaactcctgcca

SEQ ID NO: 4535169 - DNA, 14 bp, Homo sapiens
cccagtgaagcctc

SEQ ID NO: 4535170 - DNA, 18 bp, Homo sapiens
cccagtgaagcctctgag

SEQ ID NO: 4535171 - DNA, 18 bp, Homo sapiens
cccagtgagactgcccca

SEQ ID NO: 4535172 - DNA, 14 bp, Homo sapiens
cccagtgagccctg

SEQ ID NO: 4535173 - DNA, 15 bp, Homo sapiens
cccagtgagccctgc

SEQ ID NO: 4535174 - DNA, 16 bp, Homo sapiens
cccagtgagccctgct

SEQ ID NO: 4535175 - DNA, 16 bp, Homo sapiens
cccagtgcctgccact

SEQ ID NO: 4535176 - DNA, 13 bp, Homo sapiens
cccagtgcttctc

SEQ ID NO: 4535177 - DNA, 16 bp, Homo sapiens
cccagtggccactcag

SEQ ID NO: 4535178 - DNA, 13 bp, Homo sapiens
cccagtggtcagc

SEQ ID NO: 4535179 - DNA, 15 bp, Homo sapiens
cccacagctggggcc

SEQ ID NO: 4535180 - DNA, 16 bp, Homo sapiens
cccacagctggggccg

SEQ ID NO: 4535181 - DNA, 18 bp, Homo sapiens
cccacagcttcctgaggg

SEQ ID NO: 4535182 - DNA, 13 bp, Homo sapiens
cccacaggagggc

SEQ ID NO: 4535183 - DNA, 15 bp, Homo sapiens
cccacagtgctgtct

SEQ ID NO: 4535184 - DNA, 23 bp, Homo sapiens
cccacatcagggcggcctcccag

SEQ ID NO: 4535185 - DNA, 14 bp, Homo sapiens
cccacatgaggcca

SEQ ID NO: 4535186 - DNA, 12 bp, Homo sapiens
cccacatgcatg

SEQ ID NO: 4535187 - DNA, 18 bp, Homo sapiens
cccacatgcatgtctgcc

SEQ ID NO: 4535188 - DNA, 21 bp, Homo sapiens
cccaccaacatcccattgccc

SEQ ID NO: 4535189 - DNA, 19 bp, Homo sapiens
cccaccacctaggccactc

SEQ ID NO: 4535190 - DNA, 16 bp, Homo sapiens
cccaccactgatatca

SEQ ID NO: 4535191 - DNA, 12 bp, Homo sapiens
cccaccagcctt

SEQ ID NO: 4535192 - DNA, 14 bp, Homo sapiens
cccaccagccttgc

SEQ ID NO: 4535193 - DNA, 20 bp, Homo sapiens
cccaccagccttgctctctt

SEQ ID NO: 4535194 - DNA, 13 bp, Homo sapiens
cccaccaggccag

SEQ ID NO: 4535195 - DNA, 15 bp, Homo sapiens
cccaccaggccagct

SEQ ID NO: 4535196 - DNA, 23 bp, Homo sapiens
cccaccagtgcctctccctgctg

SEQ ID NO: 4535197 - DNA, 13 bp, Homo sapiens
cccacccagtcca

SEQ ID NO: 4535198 - DNA, 13 bp, Homo sapiens
cccacccatgcgc

SEQ ID NO: 4535199 - DNA, 17 bp, Homo sapiens
cccaccccaactctccc

SEQ ID NO: 4535200 - DNA, 16 bp, Homo sapiens
cccacccccagccccg

SEQ ID NO: 4535201 - DNA, 17 bp, Homo sapiens
cccacccccgccatgca

SEQ ID NO: 4535202 - DNA, 13 bp, Homo sapiens
cccaccccctcct

SEQ ID NO: 4535203 - DNA, 15 bp, Homo sapiens
cccaccccctgccct

SEQ ID NO: 4535204 - DNA, 19 bp, Homo sapiens
cccacccccttcagtgccc

SEQ ID NO: 4535205 - DNA, 17 bp, Homo sapiens
cccaccccggggaccct

SEQ ID NO: 4535206 - DNA, 18 bp, Homo sapiens
cccaccccggggaccctg

SEQ ID NO: 4535207 - DNA, 15 bp, Homo sapiens
cccacccctgcacag

SEQ ID NO: 4535208 - DNA, 22 bp, Homo sapiens
cccacccgccgcctcccacggc

SEQ ID NO: 4535209 - DNA, 14 bp, Homo sapiens
cccacccgccttgt

SEQ ID NO: 4535210 - DNA, 17 bp, Homo sapiens
cccacccggccacagct

SEQ ID NO: 4535211 - DNA, 13 bp, Homo sapiens
cccaccctcccta

SEQ ID NO: 4535212 - DNA, 16 bp, Homo sapiens
cccaccctccctggag

SEQ ID NO: 4535213 - DNA, 21 bp, Homo sapiens
cccaccctccggcgggtgaca

SEQ ID NO: 4535214 - DNA, 18 bp, Homo sapiens
cccaccgaggttcccagg

SEQ ID NO: 4535215 - DNA, 15 bp, Homo sapiens
cccaccgctgcctcg

SEQ ID NO: 4535216 - DNA, 16 bp, Homo sapiens
cccaccgggagcctcc

SEQ ID NO: 4535217 - DNA, 23 bp, Homo sapiens
cccaccgggagcctccccctcag

SEQ ID NO: 4535218 - DNA, 19 bp, Homo sapiens
cccaccgtggaggaggaag

SEQ ID NO: 4535219 - DNA, 16 bp, Homo sapiens
cccacctactctcagg

SEQ ID NO: 4535220 - DNA, 13 bp, Homo sapiens
cccacctgcccat

SEQ ID NO: 4535221 - DNA, 19 bp, Homo sapiens
cccacctgctgagagaccc

SEQ ID NO: 4535222 - DNA, 18 bp, Homo sapiens
cccacctgtggggcctgg

SEQ ID NO: 4535223 - DNA, 19 bp, Homo sapiens
cccacctgtttctggaaga

SEQ ID NO: 4535224 - DNA, 18 bp, Homo sapiens
cccacgaaactgccctgg

SEQ ID NO: 4535225 - DNA, 15 bp, Homo sapiens
cccacgagggctggc

SEQ ID NO: 4535226 - DNA, 15 bp, Homo sapiens
cccacggctcctcga

SEQ ID NO: 4535227 - DNA, 15 bp, Homo sapiens
cccacgtcagctggg

SEQ ID NO: 4535228 - DNA, 15 bp, Homo sapiens
cccacgtcaggcctg

SEQ ID NO: 4535229 - DNA, 21 bp, Homo sapiens
cccacgtcaggcctggcctca

SEQ ID NO: 4535230 - DNA, 14 bp, Homo sapiens
cccactctcattcc

SEQ ID NO: 4535231 - DNA, 21 bp, Homo sapiens
cccactctcattccccaggtg

SEQ ID NO: 4535232 - DNA, 14 bp, Homo sapiens
cccactgaggggcc

SEQ ID NO: 4535233 - DNA, 20 bp, Homo sapiens
cccactgaggggccagggag

SEQ ID NO: 4535234 - DNA, 16 bp, Homo sapiens
cccactgcactccagc

SEQ ID NO: 4535235 - DNA, 17 bp, Homo sapiens
cccactgcactccagcc

SEQ ID NO: 4535236 - DNA, 19 bp, Homo sapiens
cccactgcactccagcctg

SEQ ID NO: 4535237 - DNA, 20 bp, Homo sapiens
cccactgttctgaaaggaga

SEQ ID NO: 4535238 - DNA, 18 bp, Homo sapiens
cccactttcatctacctt

SEQ ID NO: 4535239 - DNA, 21 bp, Homo sapiens
cccactttcatctaccttttc

SEQ ID NO: 4535240 - DNA, 14 bp, Homo sapiens
cccagaaaggagac

SEQ ID NO: 4535241 - DNA, 15 bp, Homo sapiens
cccagaaaggagact

SEQ ID NO: 4535242 - DNA, 17 bp, Homo sapiens
cccagaaaggagactag

SEQ ID NO: 4535243 - DNA, 15 bp, Homo sapiens
cccagaaagtggggg

SEQ ID NO: 4535244 - DNA, 23 bp, Homo sapiens
cccagaaagtgggggtggaggac

SEQ ID NO: 4535245 - DNA, 21 bp, Homo sapiens
cccagaactttgggaggccaa

SEQ ID NO: 4535246 - DNA, 16 bp, Homo sapiens
cccagaagaaaattct

SEQ ID NO: 4535247 - DNA, 20 bp, Homo sapiens
cccagaagtccacaggacgc

SEQ ID NO: 4535248 - DNA, 15 bp, Homo sapiens
cccagaatggagcct

SEQ ID NO: 4535249 - DNA, 18 bp, Homo sapiens
cccagaatggagcctgct

SEQ ID NO: 4535250 - DNA, 21 bp, Homo sapiens
cccagaatggagcctgctctc

SEQ ID NO: 4535251 - DNA, 22 bp, Homo sapiens
cccagaatttaccatcatctct

SEQ ID NO: 4535252 - DNA, 14 bp, Homo sapiens
cccagacaggccct

SEQ ID NO: 4535253 - DNA, 20 bp, Homo sapiens
cccagacaggccctccctgt

SEQ ID NO: 4535254 - DNA, 20 bp, Homo sapiens
cccagacagggtgggcttcc

SEQ ID NO: 4535255 - DNA, 22 bp, Homo sapiens
cccagacagggtgggcttcctg

SEQ ID NO: 4535256 - DNA, 12 bp, Homo sapiens
cccagacccaga

SEQ ID NO: 4535257 - DNA, 19 bp, Homo sapiens
cccagacccagaggtccag

SEQ ID NO: 4535258 - DNA, 15 bp, Homo sapiens
cccagactgatgagc

SEQ ID NO: 4535259 - DNA, 16 bp, Homo sapiens
cccagactgatgagca

SEQ ID NO: 4535260 - DNA, 12 bp, Homo sapiens
cccagagaagcc

SEQ ID NO: 4535261 - DNA, 15 bp, Homo sapiens
cccagagacaggaaa

SEQ ID NO: 4535262 - DNA, 18 bp, Homo sapiens
cccagagagagctctgca

SEQ ID NO: 4535263 - DNA, 19 bp, Homo sapiens
cccagagaggaatcagact

SEQ ID NO: 4535264 - DNA, 17 bp, Homo sapiens
cccagagaggcactcag

SEQ ID NO: 4535265 - DNA, 14 bp, Homo sapiens
cccagagcaccccc

SEQ ID NO: 4535266 - DNA, 20 bp, Homo sapiens
cccagagcaccccctgctcc

SEQ ID NO: 4535267 - DNA, 18 bp, Homo sapiens
cccagagcatctgcccca

SEQ ID NO: 4535268 - DNA, 20 bp, Homo sapiens
cccagagcatctgccccagg

SEQ ID NO: 4535269 - DNA, 24 bp, Homo sapiens
cccagagcatctgccccaggtaca

SEQ ID NO: 4535270 - DNA, 12 bp, Homo sapiens
cccagagctggc

SEQ ID NO: 4535271 - DNA, 20 bp, Homo sapiens
cccagaggagccaccagttc

SEQ ID NO: 4535272 - DNA, 12 bp, Homo sapiens
cccagaggcaga

SEQ ID NO: 4535273 - DNA, 18 bp, Homo sapiens
cccagaggggacgctgag

SEQ ID NO: 4535274 - DNA, 20 bp, Homo sapiens
cccagaggggacgctgagga

SEQ ID NO: 4535275 - DNA, 17 bp, Homo sapiens
cccagagtcagaggaga

SEQ ID NO: 4535276 - DNA, 21 bp, Homo sapiens
cccagagtggagtctgagtct

SEQ ID NO: 4535277 - DNA, 23 bp, Homo sapiens
cccagagtgtgggaagggagagc

SEQ ID NO: 4535278 - DNA, 23 bp, Homo sapiens
cccagatggctggaaggggtcca

SEQ ID NO: 4535279 - DNA, 21 bp, Homo sapiens
cccagatgtgtcccccccagg

SEQ ID NO: 4535280 - DNA, 20 bp, Homo sapiens
cccagattggctcacactga

SEQ ID NO: 4535281 - DNA, 21 bp, Homo sapiens
cccagattggctcacactgag

SEQ ID NO: 4535282 - DNA, 21 bp, Homo sapiens
cccagcactaaggccgtgtct

SEQ ID NO: 4535283 - DNA, 15 bp, Homo sapiens
cccagcactgaggaa

SEQ ID NO: 4535284 - DNA, 24 bp, Homo sapiens
cccagcactgaggaagaacggggc

SEQ ID NO: 4535285 - DNA, 23 bp, Homo sapiens
cccagcactttgagaggctgagg

SEQ ID NO: 4535286 - DNA, 21 bp, Homo sapiens
cccagcactttgggaggcagg

SEQ ID NO: 4535287 - DNA, 14 bp, Homo sapiens
cccagcagaggcag

SEQ ID NO: 4535288 - DNA, 14 bp, Homo sapiens
cccagcagtgtgga

SEQ ID NO: 4535289 - DNA, 19 bp, Homo sapiens
cccagcattccagctctgc

SEQ ID NO: 4535290 - DNA, 20 bp, Homo sapiens
cccagcattccagctctgcc

SEQ ID NO: 4535291 - DNA, 16 bp, Homo sapiens
cccagccacaggccaa

SEQ ID NO: 4535292 - DNA, 22 bp, Homo sapiens
cccagccaccccgggctctctg

SEQ ID NO: 4535293 - DNA, 15 bp, Homo sapiens
cccagccagcccttc

SEQ ID NO: 4535294 - DNA, 18 bp, Homo sapiens
cccagccaggccaacagc

SEQ ID NO: 4535295 - DNA, 14 bp, Homo sapiens
cccagccaggccct

SEQ ID NO: 4535296 - DNA, 13 bp, Homo sapiens
cccagccatccag

SEQ ID NO: 4535297 - DNA, 9 bp, Homo sapiens
cccagccca

SEQ ID NO: 4535298 - DNA, 18 bp, Homo sapiens
cccagcccacagagcctg

SEQ ID NO: 4535299 - DNA, 17 bp, Homo sapiens
cccccatcaccagagtc

SEQ ID NO: 4535300 - DNA, 16 bp, Homo sapiens
cccccatcacccaagc

SEQ ID NO: 4535301 - DNA, 15 bp, Homo sapiens
cccccatcagccctg

SEQ ID NO: 4535302 - DNA, 15 bp, Homo sapiens
cccccatcatgtggc

SEQ ID NO: 4535303 - DNA, 11 bp, Homo sapiens
cccccatctcc

SEQ ID NO: 4535304 - DNA, 15 bp, Homo sapiens
cccccatgctgcctt

SEQ ID NO: 4535305 - DNA, 18 bp, Homo sapiens
cccccatgggctgtgtcc

SEQ ID NO: 4535306 - DNA, 13 bp, Homo sapiens
ccccccagctccc

SEQ ID NO: 4535307 - DNA, 12 bp, Homo sapiens
cccccctcctcc

SEQ ID NO: 4535308 - DNA, 13 bp, Homo sapiens
cccccctcctcca

SEQ ID NO: 4535309 - DNA, 20 bp, Homo sapiens
cccccgagccctgactcctg

SEQ ID NO: 4535310 - DNA, 16 bp, Homo sapiens
cccccgcacagccacc

SEQ ID NO: 4535311 - DNA, 14 bp, Homo sapiens
cccccgccctcatg

SEQ ID NO: 4535312 - DNA, 14 bp, Homo sapiens
cccccgcctgccac

SEQ ID NO: 4535313 - DNA, 15 bp, Homo sapiens
cccccgcctgccacc

SEQ ID NO: 4535314 - DNA, 18 bp, Homo sapiens
cccccgcgctcgcccagc

SEQ ID NO: 4535315 - DNA, 21 bp, Homo sapiens
cccccgcgctcgcccagcagg

SEQ ID NO: 4535316 - DNA, 15 bp, Homo sapiens
cccccggccccctgg

SEQ ID NO: 4535317 - DNA, 16 bp, Homo sapiens
ccccctcccaccccca

SEQ ID NO: 4535318 - DNA, 20 bp, Homo sapiens
ccccctcccaccgctgcctc

SEQ ID NO: 4535319 - DNA, 17 bp, Homo sapiens
ccccctccgcctccagg

SEQ ID NO: 4535320 - DNA, 15 bp, Homo sapiens
ccccctcctcagcca

SEQ ID NO: 4535321 - DNA, 12 bp, Homo sapiens
ccccctcctcca

SEQ ID NO: 4535322 - DNA, 15 bp, Homo sapiens
ccccctcctccagta

SEQ ID NO: 4535323 - DNA, 22 bp, Homo sapiens
ccccctcgggtctcctcactcc

SEQ ID NO: 4535324 - DNA, 22 bp, Homo sapiens
ccccctctgccggtcgggcagc

SEQ ID NO: 4535325 - DNA, 23 bp, Homo sapiens
ccccctctgccggtcgggcagcc

SEQ ID NO: 4535326 - DNA, 13 bp, Homo sapiens
ccccctgccctgc

SEQ ID NO: 4535327 - DNA, 20 bp, Homo sapiens
ccccctgctccaccagcagc

SEQ ID NO: 4535328 - DNA, 12 bp, Homo sapiens
ccccctgtccca

SEQ ID NO: 4535329 - DNA, 12 bp, Homo sapiens
ccccctgtgcag

SEQ ID NO: 4535330 - DNA, 22 bp, Homo sapiens
ccccctgtgccttgtcacgcca

SEQ ID NO: 4535331 - DNA, 14 bp, Homo sapiens
cccccttcagtgcc

SEQ ID NO: 4535332 - DNA, 15 bp, Homo sapiens
cccccttcagtgccc

SEQ ID NO: 4535333 - DNA, 23 bp, Homo sapiens
cccccttcagtgcccaccaacat

SEQ ID NO: 4535334 - DNA, 16 bp, Homo sapiens
cccccttccccttctg

SEQ ID NO: 4535335 - DNA, 15 bp, Homo sapiens
cccccttctctgctc

SEQ ID NO: 4535336 - DNA, 16 bp, Homo sapiens
cccccttctctgctcc

SEQ ID NO: 4535337 - DNA, 17 bp, Homo sapiens
cccccttctctgctcca

SEQ ID NO: 4535338 - DNA, 22 bp, Homo sapiens
cccccttctctgctccaccaca

SEQ ID NO: 4535339 - DNA, 17 bp, Homo sapiens
ccccctttcagatgtct

SEQ ID NO: 4535340 - DNA, 16 bp, Homo sapiens
ccccctttgggcccag

SEQ ID NO: 4535341 - DNA, 17 bp, Homo sapiens
ccccctttgggcccagg

SEQ ID NO: 4535342 - DNA, 19 bp, Homo sapiens
ccccctttgggcccaggga

SEQ ID NO: 4535343 - DNA, 20 bp, Homo sapiens
ccccctttgggcccagggac

SEQ ID NO: 4535344 - DNA, 15 bp, Homo sapiens
ccccgactccagcca

SEQ ID NO: 4535345 - DNA, 21 bp, Homo sapiens
ccccgagccctgactcctgga

SEQ ID NO: 4535346 - DNA, 17 bp, Homo sapiens
ccccgaggacccagacc

SEQ ID NO: 4535347 - DNA, 13 bp, Homo sapiens
ccccgatgtcccc

SEQ ID NO: 4535348 - DNA, 14 bp, Homo sapiens
ccccgatgtcccct

SEQ ID NO: 4535349 - DNA, 17 bp, Homo sapiens
ccccgatgtcccctgcg

SEQ ID NO: 4535350 - DNA, 15 bp, Homo sapiens
ccccgcacgactgcg

SEQ ID NO: 4535351 - DNA, 13 bp, Homo sapiens
ccccgccagggct

SEQ ID NO: 4535352 - DNA, 16 bp, Homo sapiens
ccccgcccccagtccc

SEQ ID NO: 4535353 - DNA, 14 bp, Homo sapiens
ccccgcctccactc

SEQ ID NO: 4535354 - DNA, 15 bp, Homo sapiens
ccccgcctccactct

SEQ ID NO: 4535355 - DNA, 15 bp, Homo sapiens
ccccgcctgccaccg

SEQ ID NO: 4535356 - DNA, 12 bp, Homo sapiens
ccccgcctgtca

SEQ ID NO: 4535357 - DNA, 17 bp, Homo sapiens
ccccgctcccgctccca

SEQ ID NO: 4535358 - DNA, 19 bp, Homo sapiens
ccccgcttgtccagcgcct

SEQ ID NO: 4535359 - DNA, 20 bp, Homo sapiens
ccccggccaaggacccaggc

SEQ ID NO: 4535360 - DNA, 21 bp, Homo sapiens
ccccggccaaggacccaggcg

SEQ ID NO: 4535361 - DNA, 12 bp, Homo sapiens
ccccggccctgg

SEQ ID NO: 4535362 - DNA, 21 bp, Homo sapiens
ccccggccctgggctcggagg

SEQ ID NO: 4535363 - DNA, 15 bp, Homo sapiens
ccccgggctctctgc

SEQ ID NO: 4535364 - DNA, 17 bp, Homo sapiens
ccccgggctctctgctg

SEQ ID NO: 4535365 - DNA, 22 bp, Homo sapiens
ccccggggtgagtccattctcc

SEQ ID NO: 4535366 - DNA, 13 bp, Homo sapiens
ccccggtccccca

SEQ ID NO: 4535367 - DNA, 20 bp, Homo sapiens
ccccggtcccccagagcatc

SEQ ID NO: 4535368 - DNA, 16 bp, Homo sapiens
ccccggtcccttgaga

SEQ ID NO: 4535369 - DNA, 17 bp, Homo sapiens
ccccgtctctcttggac

SEQ ID NO: 4535370 - DNA, 22 bp, Homo sapiens
ccccgtctggggttcagcccct

SEQ ID NO: 4535371 - DNA, 22 bp, Homo sapiens
ccccgtgtcctctccctgccaa

SEQ ID NO: 4535372 - DNA, 14 bp, Homo sapiens
ccccgtttcttgca

SEQ ID NO: 4535373 - DNA, 14 bp, Homo sapiens
cccctagatccaga

SEQ ID NO: 4535374 - DNA, 18 bp, Homo sapiens
cccctagcaatacaggga

SEQ ID NO: 4535375 - DNA, 18 bp, Homo sapiens
cccctatcagttgatttt

SEQ ID NO: 4535376 - DNA, 16 bp, Homo sapiens
cccctatccacccagc

SEQ ID NO: 4535377 - DNA, 17 bp, Homo sapiens
cccctatccacccagcc

SEQ ID NO: 4535378 - DNA, 19 bp, Homo sapiens
cccctatccacccagccca

SEQ ID NO: 4535379 - DNA, 20 bp, Homo sapiens
cccctatccacccagcccat

SEQ ID NO: 4535380 - DNA, 15 bp, Homo sapiens
cccctatcctctgag

SEQ ID NO: 4535381 - DNA, 13 bp, Homo sapiens
cccctcacctact

SEQ ID NO: 4535382 - DNA, 21 bp, Homo sapiens
cccctcactctgtcagccagc

SEQ ID NO: 4535383 - DNA, 13 bp, Homo sapiens
cccctcagcccca

SEQ ID NO: 4535384 - DNA, 11 bp, Homo sapiens
cccctccactg

SEQ ID NO: 4535385 - DNA, 12 bp, Homo sapiens
cccctccactgg

SEQ ID NO: 4535386 - DNA, 14 bp, Homo sapiens
cccctccagccaga

SEQ ID NO: 4535387 - DNA, 22 bp, Homo sapiens
cccctccagcttgtggagcccc

SEQ ID NO: 4535388 - DNA, 15 bp, Homo sapiens
cccctccatccaccc

SEQ ID NO: 4535389 - DNA, 21 bp, Homo sapiens
cccctcccaagcgttcctggc

SEQ ID NO: 4535390 - DNA, 12 bp, Homo sapiens
cccctcccagac

SEQ ID NO: 4535391 - DNA, 14 bp, Homo sapiens
cccctcccagacag

SEQ ID NO: 4535392 - DNA, 16 bp, Homo sapiens
cccctcccagacaggc

SEQ ID NO: 4535393 - DNA, 12 bp, Homo sapiens
cccctccccact

SEQ ID NO: 4535394 - DNA, 12 bp, Homo sapiens
cccctccccagc

SEQ ID NO: 4535395 - DNA, 14 bp, Homo sapiens
cccctcccccactt

SEQ ID NO: 4535396 - DNA, 20 bp, Homo sapiens
cccctccccctgagattcag

SEQ ID NO: 4535397 - DNA, 14 bp, Homo sapiens
cccctccctacctc

SEQ ID NO: 4535398 - DNA, 14 bp, Homo sapiens
cccctccctgcctg

SEQ ID NO: 4535399 - DNA, 15 bp, Homo sapiens
cccctccctggctcc

SEQ ID NO: 4535400 - DNA, 22 bp, Homo sapiens
cccctccctggctcccatgacc

SEQ ID NO: 4535401 - DNA, 18 bp, Homo sapiens
cccctcctccactctccc

SEQ ID NO: 4535402 - DNA, 17 bp, Homo sapiens
cccctcctccctcagac

SEQ ID NO: 4535403 - DNA, 11 bp, Homo sapiens
cccctcctctg

SEQ ID NO: 4535404 - DNA, 22 bp, Homo sapiens
cccctcctctgaaacagctgcc

SEQ ID NO: 4535405 - DNA, 23 bp, Homo sapiens
cccctcctctgaaacagctgcct

SEQ ID NO: 4535406 - DNA, 15 bp, Homo sapiens
cccctcctcttccct

SEQ ID NO: 4535407 - DNA, 22 bp, Homo sapiens
cccctccttccccagacccaga

SEQ ID NO: 4535408 - DNA, 13 bp, Homo sapiens
cccctcgccccag

SEQ ID NO: 4535409 - DNA, 16 bp, Homo sapiens
cccctcgccccagcct

SEQ ID NO: 4535410 - DNA, 17 bp, Homo sapiens
cccctcgccccagcctc

SEQ ID NO: 4535411 - DNA, 19 bp, Homo sapiens
cccctcgccttcaggagaa

SEQ ID NO: 4535412 - DNA, 15 bp, Homo sapiens
cccctcggagaagag

SEQ ID NO: 4535413 - DNA, 12 bp, Homo sapiens
cccctctcacca

SEQ ID NO: 4535414 - DNA, 20 bp, Homo sapiens
cccctctcctccccttcctg

SEQ ID NO: 4535415 - DNA, 13 bp, Homo sapiens
cccctctcgcccc

SEQ ID NO: 4535416 - DNA, 14 bp, Homo sapiens
cccctctctttctc

SEQ ID NO: 4535417 - DNA, 18 bp, Homo sapiens
cccctctgcacccagaac

SEQ ID NO: 4535418 - DNA, 15 bp, Homo sapiens
cccctctgcccctgc

SEQ ID NO: 4535419 - DNA, 21 bp, Homo sapiens
cccctctgctgcaacaagctc

SEQ ID NO: 4535420 - DNA, 11 bp, Homo sapiens
cccctctgtag

SEQ ID NO: 4535421 - DNA, 14 bp, Homo sapiens
ccccaccccatcca

SEQ ID NO: 4535422 - DNA, 14 bp, Homo sapiens
ccccacccccagtg

SEQ ID NO: 4535423 - DNA, 18 bp, Homo sapiens
ccccacccccgccatgca

SEQ ID NO: 4535424 - DNA, 23 bp, Homo sapiens
ccccaccccctccccaggggaga

SEQ ID NO: 4535425 - DNA, 21 bp, Homo sapiens
ccccacccccttcagtgccca

SEQ ID NO: 4535426 - DNA, 14 bp, Homo sapiens
ccccacccctgccc

SEQ ID NO: 4535427 - DNA, 17 bp, Homo sapiens
ccccacccctgccccca

SEQ ID NO: 4535428 - DNA, 14 bp, Homo sapiens
ccccaccccttcct

SEQ ID NO: 4535429 - DNA, 19 bp, Homo sapiens
ccccaccccttcctgtctc

SEQ ID NO: 4535430 - DNA, 24 bp, Homo sapiens
ccccaccggaactgggctggcgct

SEQ ID NO: 4535431 - DNA, 19 bp, Homo sapiens
ccccacggaaggcgggctg

SEQ ID NO: 4535432 - DNA, 17 bp, Homo sapiens
ccccacgttgtccctga

SEQ ID NO: 4535433 - DNA, 22 bp, Homo sapiens
ccccactcccccgtttctcctt

SEQ ID NO: 4535434 - DNA, 12 bp, Homo sapiens
ccccactctccc

SEQ ID NO: 4535435 - DNA, 18 bp, Homo sapiens
ccccactgcaggccccgc

SEQ ID NO: 4535436 - DNA, 15 bp, Homo sapiens
ccccactgggagagc

SEQ ID NO: 4535437 - DNA, 14 bp, Homo sapiens
ccccacttcacccc

SEQ ID NO: 4535438 - DNA, 12 bp, Homo sapiens
ccccagacccag

SEQ ID NO: 4535439 - DNA, 16 bp, Homo sapiens
ccccagagagaccctg

SEQ ID NO: 4535440 - DNA, 23 bp, Homo sapiens
ccccagagagaccctgcaagacc

SEQ ID NO: 4535441 - DNA, 18 bp, Homo sapiens
ccccagagaggcactcag

SEQ ID NO: 4535442 - DNA, 21 bp, Homo sapiens
ccccagagcatctgccccagg

SEQ ID NO: 4535443 - DNA, 13 bp, Homo sapiens
ccccagagctggc

SEQ ID NO: 4535444 - DNA, 21 bp, Homo sapiens
ccccagagctgtttatggcct

SEQ ID NO: 4535445 - DNA, 23 bp, Homo sapiens
ccccagagctgtttatggcctca

SEQ ID NO: 4535446 - DNA, 13 bp, Homo sapiens
ccccagaggcaga

SEQ ID NO: 4535447 - DNA, 14 bp, Homo sapiens
ccccagaggctccc

SEQ ID NO: 4535448 - DNA, 22 bp, Homo sapiens
ccccagcactaaggccgtgtct

SEQ ID NO: 4535449 - DNA, 14 bp, Homo sapiens
ccccagcagaggca

SEQ ID NO: 4535450 - DNA, 20 bp, Homo sapiens
ccccagcagaggcaggctgg

SEQ ID NO: 4535451 - DNA, 22 bp, Homo sapiens
ccccagcagaggcaggctggga

SEQ ID NO: 4535452 - DNA, 19 bp, Homo sapiens
ccccagcattccagctctg

SEQ ID NO: 4535453 - DNA, 11 bp, Homo sapiens
ccccagccaca

SEQ ID NO: 4535454 - DNA, 23 bp, Homo sapiens
ccccagccagcccttccctggcc

SEQ ID NO: 4535455 - DNA, 20 bp, Homo sapiens
ccccagcccaccctcctgtc

SEQ ID NO: 4535456 - DNA, 22 bp, Homo sapiens
ccccagcccaccctcctgtctt

SEQ ID NO: 4535457 - DNA, 14 bp, Homo sapiens
ccccagcccagaca

SEQ ID NO: 4535458 - DNA, 14 bp, Homo sapiens
ccccagccccaact

SEQ ID NO: 4535459 - DNA, 17 bp, Homo sapiens
ccccagccccagcccct

SEQ ID NO: 4535460 - DNA, 23 bp, Homo sapiens
ccccagccccgactccagccagc

SEQ ID NO: 4535461 - DNA, 22 bp, Homo sapiens
ccccagcccctcctccctcaga

SEQ ID NO: 4535462 - DNA, 15 bp, Homo sapiens
ccccagccccttcca

SEQ ID NO: 4535463 - DNA, 14 bp, Homo sapiens
ccccagcctacctc

SEQ ID NO: 4535464 - DNA, 11 bp, Homo sapiens
ccccagcctcc

SEQ ID NO: 4535465 - DNA, 14 bp, Homo sapiens
ccccagccttgccc

SEQ ID NO: 4535466 - DNA, 17 bp, Homo sapiens
ccccagccttgcccagc

SEQ ID NO: 4535467 - DNA, 21 bp, Homo sapiens
ccccagcgggctggcgggcct

SEQ ID NO: 4535468 - DNA, 13 bp, Homo sapiens
ccccagctcccac

SEQ ID NO: 4535469 - DNA, 23 bp, Homo sapiens
ccccaggacgccactcatttcat

SEQ ID NO: 4535470 - DNA, 14 bp, Homo sapiens
ccccaggactgggc

SEQ ID NO: 4535471 - DNA, 16 bp, Homo sapiens
ccccaggactgggcca

SEQ ID NO: 4535472 - DNA, 22 bp, Homo sapiens
ccccaggactgggccacttctg

SEQ ID NO: 4535473 - DNA, 18 bp, Homo sapiens
ccccaggccagctgcggc

SEQ ID NO: 4535474 - DNA, 20 bp, Homo sapiens
ccccaggccccgaggaccca

SEQ ID NO: 4535475 - DNA, 15 bp, Homo sapiens
ccccaggcctgtcca

SEQ ID NO: 4535476 - DNA, 23 bp, Homo sapiens
ccccaggcctgtccaccctgcca

SEQ ID NO: 4535477 - DNA, 13 bp, Homo sapiens
ccccaggccttgt

SEQ ID NO: 4535478 - DNA, 11 bp, Homo sapiens
ccccagggagt

SEQ ID NO: 4535479 - DNA, 18 bp, Homo sapiens
ccccagggcactgccagc

SEQ ID NO: 4535480 - DNA, 19 bp, Homo sapiens
ccccagggcactgccagcc

SEQ ID NO: 4535481 - DNA, 21 bp, Homo sapiens
ccccagggcactgccagccca

SEQ ID NO: 4535482 - DNA, 15 bp, Homo sapiens
ccccaggggagaaag

SEQ ID NO: 4535483 - DNA, 17 bp, Homo sapiens
ccccaggggtcccagcc

SEQ ID NO: 4535484 - DNA, 23 bp, Homo sapiens
ccccaggtacacctccccctgcg

SEQ ID NO: 4535485 - DNA, 14 bp, Homo sapiens
ccccaggtgccagt

SEQ ID NO: 4535486 - DNA, 13 bp, Homo sapiens
ccccaggtggctg

SEQ ID NO: 4535487 - DNA, 14 bp, Homo sapiens
ccccagtacacagg

SEQ ID NO: 4535488 - DNA, 19 bp, Homo sapiens
ccccagtccccacccctgc

SEQ ID NO: 4535489 - DNA, 22 bp, Homo sapiens
ccccagtcgtgatgtggaggaa

SEQ ID NO: 4535490 - DNA, 16 bp, Homo sapiens
ccccagttccacagca

SEQ ID NO: 4535491 - DNA, 12 bp, Homo sapiens
ccccagttccta

SEQ ID NO: 4535492 - DNA, 21 bp, Homo sapiens
ccccagttcctcccaggaagc

SEQ ID NO: 4535493 - DNA, 21 bp, Homo sapiens
ccccatagggtcggaggtgct

SEQ ID NO: 4535494 - DNA, 16 bp, Homo sapiens
ccccatatataaatta

SEQ ID NO: 4535495 - DNA, 19 bp, Homo sapiens
ccccatcagaacctgagct

SEQ ID NO: 4535496 - DNA, 15 bp, Homo sapiens
ccccatcagccctgc

SEQ ID NO: 4535497 - DNA, 17 bp, Homo sapiens
ccccatcagccctgcta

SEQ ID NO: 4535498 - DNA, 20 bp, Homo sapiens
ccccatcagtgctccctcac

SEQ ID NO: 4535499 - DNA, 13 bp, Homo sapiens
ccccatccctggg

SEQ ID NO: 4535500 - DNA, 13 bp, Homo sapiens
ccccatctccctg

SEQ ID NO: 4535501 - DNA, 14 bp, Homo sapiens
ccccatctccctgc

SEQ ID NO: 4535502 - DNA, 13 bp, Homo sapiens
ccccatctctcat

SEQ ID NO: 4535503 - DNA, 14 bp, Homo sapiens
ccccatctgcgggg

SEQ ID NO: 4535504 - DNA, 21 bp, Homo sapiens
ccccatcttgatctttgagcc

SEQ ID NO: 4535505 - DNA, 18 bp, Homo sapiens
ccccatgaggaaggaaca

SEQ ID NO: 4535506 - DNA, 19 bp, Homo sapiens
ccccatgcctgtccagcct

SEQ ID NO: 4535507 - DNA, 18 bp, Homo sapiens
ccccatgctgccttcagg

SEQ ID NO: 4535508 - DNA, 15 bp, Homo sapiens
ccccatgtctctcag

SEQ ID NO: 4535509 - DNA, 13 bp, Homo sapiens
ccccattccttgc

SEQ ID NO: 4535510 - DNA, 22 bp, Homo sapiens
ccccattccttgcgcctcagcc

SEQ ID NO: 4535511 - DNA, 23 bp, Homo sapiens
ccccattgagatcttcctgctga

SEQ ID NO: 4535512 - DNA, 15 bp, Homo sapiens
ccccattgtggtcac

SEQ ID NO: 4535513 - DNA, 18 bp, Homo sapiens
ccccatttcccatctgca

SEQ ID NO: 4535514 - DNA, 22 bp, Homo sapiens
ccccatttcccatctgcacccc

SEQ ID NO: 4535515 - DNA, 15 bp, Homo sapiens
ccccatttgtcccag

SEQ ID NO: 4535516 - DNA, 22 bp, Homo sapiens
cccccaacccctcctccctcag

SEQ ID NO: 4535517 - DNA, 16 bp, Homo sapiens
cccccaacccctcctt

SEQ ID NO: 4535518 - DNA, 23 bp, Homo sapiens
cccccaacccctccttccccaga

SEQ ID NO: 4535519 - DNA, 23 bp, Homo sapiens
cccccaataaaccagtgtgaacc

SEQ ID NO: 4535520 - DNA, 12 bp, Homo sapiens
cccccaataaag

SEQ ID NO: 4535521 - DNA, 18 bp, Homo sapiens
cccccaataaaggcagct

SEQ ID NO: 4535522 - DNA, 19 bp, Homo sapiens
cccccaataaaggcagctg

SEQ ID NO: 4535523 - DNA, 20 bp, Homo sapiens
cccccaataaaggcagctgc

SEQ ID NO: 4535524 - DNA, 19 bp, Homo sapiens
cccccaatcggactgccaa

SEQ ID NO: 4535525 - DNA, 14 bp, Homo sapiens
cccccacagcgctc

SEQ ID NO: 4535526 - DNA, 20 bp, Homo sapiens
cccccaccccggggaccctg

SEQ ID NO: 4535527 - DNA, 19 bp, Homo sapiens
cccccaccggaactgggct

SEQ ID NO: 4535528 - DNA, 14 bp, Homo sapiens
cccccactgcaggc

SEQ ID NO: 4535529 - DNA, 12 bp, Homo sapiens
cccccagaaagc

SEQ ID NO: 4535530 - DNA, 15 bp, Homo sapiens
cccccagaccccgcc

SEQ ID NO: 4535531 - DNA, 23 bp, Homo sapiens
cccccagaccccgcccctgggga

SEQ ID NO: 4535532 - DNA, 16 bp, Homo sapiens
cccccagagcatctgc

SEQ ID NO: 4535533 - DNA, 20 bp, Homo sapiens
cccccagagcatctgcccca

SEQ ID NO: 4535534 - DNA, 13 bp, Homo sapiens
cccccagcactga

SEQ ID NO: 4535535 - DNA, 18 bp, Homo sapiens
cccccagcactgaggaag

SEQ ID NO: 4535536 - DNA, 12 bp, Homo sapiens
cccccagctccc

SEQ ID NO: 4535537 - DNA, 14 bp, Homo sapiens
cccccagctcccac

SEQ ID NO: 4535538 - DNA, 13 bp, Homo sapiens
cccccaggactgg

SEQ ID NO: 4535539 - DNA, 12 bp, Homo sapiens
cccccaggaggc

SEQ ID NO: 4535540 - DNA, 20 bp, Homo sapiens
cccccaggctggagtgcagt

SEQ ID NO: 4535541 - DNA, 22 bp, Homo sapiens
cccccagtccccacccctgccc

SEQ ID NO: 4535542 - DNA, 20 bp, Homo sapiens
ccctggagagtgcacatgcc

SEQ ID NO: 4535543 - DNA, 13 bp, Homo sapiens
ccctggagcagga

SEQ ID NO: 4535544 - DNA, 15 bp, Homo sapiens
ccctggagcaggagc

SEQ ID NO: 4535545 - DNA, 16 bp, Homo sapiens
ccctggagcctcagaa

SEQ ID NO: 4535546 - DNA, 16 bp, Homo sapiens
ccctggaggctgcctc

SEQ ID NO: 4535547 - DNA, 19 bp, Homo sapiens
ccctggaggctgcctccca

SEQ ID NO: 4535548 - DNA, 18 bp, Homo sapiens
ccctggagggcaagccct

SEQ ID NO: 4535549 - DNA, 20 bp, Homo sapiens
ccctggcatgtcaacagcgt

SEQ ID NO: 4535550 - DNA, 15 bp, Homo sapiens
ccctggcccccacag

SEQ ID NO: 4535551 - DNA, 19 bp, Homo sapiens
ccctggcccccacagcgct

SEQ ID NO: 4535552 - DNA, 23 bp, Homo sapiens
ccctggcccccatcagccctgct

SEQ ID NO: 4535553 - DNA, 19 bp, Homo sapiens
ccctggcctgaactgagga

SEQ ID NO: 4535554 - DNA, 20 bp, Homo sapiens
ccctggcctgaactgaggag

SEQ ID NO: 4535555 - DNA, 15 bp, Homo sapiens
ccctggctaacagtc

SEQ ID NO: 4535556 - DNA, 15 bp, Homo sapiens
ccctggctcccatga

SEQ ID NO: 4535557 - DNA, 20 bp, Homo sapiens
ccctggctccctcctccagg

SEQ ID NO: 4535558 - DNA, 23 bp, Homo sapiens
ccctggctccctcctccaggcct

SEQ ID NO: 4535559 - DNA, 14 bp, Homo sapiens
ccctggctgctgcc

SEQ ID NO: 4535560 - DNA, 15 bp, Homo sapiens
ccctggctgctgccc

SEQ ID NO: 4535561 - DNA, 22 bp, Homo sapiens
ccctggctgctgcccccacccc

SEQ ID NO: 4535562 - DNA, 13 bp, Homo sapiens
ccctggcttctgt

SEQ ID NO: 4535563 - DNA, 14 bp, Homo sapiens
ccctggcttctgtg

SEQ ID NO: 4535564 - DNA, 19 bp, Homo sapiens
ccctggcttgtaactccac

SEQ ID NO: 4535565 - DNA, 17 bp, Homo sapiens
ccctggctttgcctctt

SEQ ID NO: 4535566 - DNA, 21 bp, Homo sapiens
ccctgggacacagacccagga

SEQ ID NO: 4535567 - DNA, 17 bp, Homo sapiens
ccctgggagccagtcct

SEQ ID NO: 4535568 - DNA, 19 bp, Homo sapiens
ccctgggagccagtcctcc

SEQ ID NO: 4535569 - DNA, 19 bp, Homo sapiens
ccctgggatgggaccaggg

SEQ ID NO: 4535570 - DNA, 13 bp, Homo sapiens
ccctgggccacgc

SEQ ID NO: 4535571 - DNA, 21 bp, Homo sapiens
ccctgggccagcggggctgct

SEQ ID NO: 4535572 - DNA, 22 bp, Homo sapiens
ccctgggccccaccacctaggc

SEQ ID NO: 4535573 - DNA, 22 bp, Homo sapiens
ccctgggcccctccacgcctcc

SEQ ID NO: 4535574 - DNA, 23 bp, Homo sapiens
ccctgggcctcagttcaacctgg

SEQ ID NO: 4535575 - DNA, 21 bp, Homo sapiens
ccctgggctattgctgctgcc

SEQ ID NO: 4535576 - DNA, 18 bp, Homo sapiens
ccctgggctgtctgtcac

SEQ ID NO: 4535577 - DNA, 19 bp, Homo sapiens
ccctgggctgtctgtcacc

SEQ ID NO: 4535578 - DNA, 18 bp, Homo sapiens
ccctgggcttggcctgct

SEQ ID NO: 4535579 - DNA, 13 bp, Homo sapiens
ccctggggaaata

SEQ ID NO: 4535580 - DNA, 22 bp, Homo sapiens
ccctggggacttcaactgccca

SEQ ID NO: 4535581 - DNA, 20 bp, Homo sapiens
ccctggggatcttcccacag

SEQ ID NO: 4535582 - DNA, 23 bp, Homo sapiens
ccctggggatcttcccacaggag

SEQ ID NO: 4535583 - DNA, 17 bp, Homo sapiens
ccctggggcccagcccc

SEQ ID NO: 4535584 - DNA, 14 bp, Homo sapiens
ccctggggctgagt

SEQ ID NO: 4535585 - DNA, 21 bp, Homo sapiens
ccctggggctgagtctccagg

SEQ ID NO: 4535586 - DNA, 22 bp, Homo sapiens
ccctggggctgagtctccaggg

SEQ ID NO: 4535587 - DNA, 17 bp, Homo sapiens
ccctgggggaagccctg

SEQ ID NO: 4535588 - DNA, 17 bp, Homo sapiens
ccctggggtggccacca

SEQ ID NO: 4535589 - DNA, 19 bp, Homo sapiens
ccctgggtaagaagggtgg

SEQ ID NO: 4535590 - DNA, 20 bp, Homo sapiens
ccctgggtaagaagggtggg

SEQ ID NO: 4535591 - DNA, 17 bp, Homo sapiens
ccctgggtgggctctgt

SEQ ID NO: 4535592 - DNA, 18 bp, Homo sapiens
ccctgggtgggctctgtg

SEQ ID NO: 4535593 - DNA, 20 bp, Homo sapiens
ccctgggtgggctctgtgca

SEQ ID NO: 4535594 - DNA, 18 bp, Homo sapiens
ccctggtaagcagaggct

SEQ ID NO: 4535595 - DNA, 22 bp, Homo sapiens
ccctggtcaccgagactcagcc

SEQ ID NO: 4535596 - DNA, 23 bp, Homo sapiens
ccctggtcaccgagactcagcct

SEQ ID NO: 4535597 - DNA, 13 bp, Homo sapiens
ccctggtctctgg

SEQ ID NO: 4535598 - DNA, 18 bp, Homo sapiens
ccctggtgctttccttca

SEQ ID NO: 4535599 - DNA, 18 bp, Homo sapiens
ccctggttatattctcac

SEQ ID NO: 4535600 - DNA, 14 bp, Homo sapiens
ccctggttctcatc

SEQ ID NO: 4535601 - DNA, 17 bp, Homo sapiens
ccctggttctcatcttt

SEQ ID NO: 4535602 - DNA, 16 bp, Homo sapiens
ccctgtagctctgcct

SEQ ID NO: 4535603 - DNA, 17 bp, Homo sapiens
ccctgtagctctgcctc

SEQ ID NO: 4535604 - DNA, 21 bp, Homo sapiens
ccctgtagctctgcctccctc

SEQ ID NO: 4535605 - DNA, 13 bp, Homo sapiens
ccctgtcccaggc

SEQ ID NO: 4535606 - DNA, 22 bp, Homo sapiens
ccctgtccggcccagtgccact

SEQ ID NO: 4535607 - DNA, 19 bp, Homo sapiens
ccctgtctgctaggcgctg

SEQ ID NO: 4535608 - DNA, 20 bp, Homo sapiens
ccctgtctgtagagggccct

SEQ ID NO: 4535609 - DNA, 15 bp, Homo sapiens
ccctgtctgttccca

SEQ ID NO: 4535610 - DNA, 19 bp, Homo sapiens
ccctgtctgttcccagccc

SEQ ID NO: 4535611 - DNA, 21 bp, Homo sapiens
ccctgtctgttcccagcccct

SEQ ID NO: 4535612 - DNA, 23 bp, Homo sapiens
ccctgtctgttcccagcccctgc

SEQ ID NO: 4535613 - DNA, 19 bp, Homo sapiens
ccctgtgacatggtgcctg

SEQ ID NO: 4535614 - DNA, 24 bp, Homo sapiens
ccctgtgacatggtgcctgagagg

SEQ ID NO: 4535615 - DNA, 18 bp, Homo sapiens
ccctgtgcaggagctagt

SEQ ID NO: 4535616 - DNA, 15 bp, Homo sapiens
ccctgtgccttgtca

SEQ ID NO: 4535617 - DNA, 19 bp, Homo sapiens
ccctgtggaatgggctcaa

SEQ ID NO: 4535618 - DNA, 21 bp, Homo sapiens
ccctgtgggagccgcagagcc

SEQ ID NO: 4535619 - DNA, 18 bp, Homo sapiens
ccctgtgggggtggccat

SEQ ID NO: 4535620 - DNA, 22 bp, Homo sapiens
ccctgtgggggtggccatccct

SEQ ID NO: 4535621 - DNA, 24 bp, Homo sapiens
ccctgtgggggtggccatccctgg

SEQ ID NO: 4535622 - DNA, 17 bp, Homo sapiens
ccctgtggtctattgtc

SEQ ID NO: 4535623 - DNA, 23 bp, Homo sapiens
ccctgtgttctgggctggggcca

SEQ ID NO: 4535624 - DNA, 20 bp, Homo sapiens
ccctgttctccctttctctc

SEQ ID NO: 4535625 - DNA, 15 bp, Homo sapiens
ccctgttgccgagcc

SEQ ID NO: 4535626 - DNA, 19 bp, Homo sapiens
ccctgtttactggttcttg

SEQ ID NO: 4535627 - DNA, 22 bp, Homo sapiens
ccctgttttcccacgaggaatc

SEQ ID NO: 4535628 - DNA, 15 bp, Homo sapiens
ccctgttttttgtag

SEQ ID NO: 4535629 - DNA, 21 bp, Homo sapiens
cccttaaacacaggctgtcct

SEQ ID NO: 4535630 - DNA, 19 bp, Homo sapiens
cccttagcaccttcagggc

SEQ ID NO: 4535631 - DNA, 19 bp, Homo sapiens
cccttagcctctcccaccc

SEQ ID NO: 4535632 - DNA, 20 bp, Homo sapiens
cccttaggatggggctccca

SEQ ID NO: 4535633 - DNA, 15 bp, Homo sapiens
cccttcagcttgctt

SEQ ID NO: 4535634 - DNA, 16 bp, Homo sapiens
cccttcccacatgcct

SEQ ID NO: 4535635 - DNA, 12 bp, Homo sapiens
cccttcccaggg

SEQ ID NO: 4535636 - DNA, 13 bp, Homo sapiens
cccttcccagggc

SEQ ID NO: 4535637 - DNA, 23 bp, Homo sapiens
cccttcccagggcacccaggcag

SEQ ID NO: 4535638 - DNA, 17 bp, Homo sapiens
cccttcccatttcttcc

SEQ ID NO: 4535639 - DNA, 11 bp, Homo sapiens
cccttccccat

SEQ ID NO: 4535640 - DNA, 12 bp, Homo sapiens
cccttcccctcc

SEQ ID NO: 4535641 - DNA, 15 bp, Homo sapiens
cccttcccctccctg

SEQ ID NO: 4535642 - DNA, 17 bp, Homo sapiens
cccttccctctctccct

SEQ ID NO: 4535643 - DNA, 20 bp, Homo sapiens
cccttccctctctccctgcc

SEQ ID NO: 4535644 - DNA, 21 bp, Homo sapiens
cccttccctctgggcacgcct

SEQ ID NO: 4535645 - DNA, 14 bp, Homo sapiens
cccttccctgagtg

SEQ ID NO: 4535646 - DNA, 18 bp, Homo sapiens
cccttccgacaggagcac

SEQ ID NO: 4535647 - DNA, 16 bp, Homo sapiens
cccttcctctctcctt

SEQ ID NO: 4535648 - DNA, 17 bp, Homo sapiens
cccttccttttccctgc

SEQ ID NO: 4535649 - DNA, 18 bp, Homo sapiens
cccttccttttccctgct

SEQ ID NO: 4535650 - DNA, 22 bp, Homo sapiens
cccttcgtggttatagccctgc

SEQ ID NO: 4535651 - DNA, 17 bp, Homo sapiens
cccttctacctgccact

SEQ ID NO: 4535652 - DNA, 19 bp, Homo sapiens
cccttctatacccacccag

SEQ ID NO: 4535653 - DNA, 21 bp, Homo sapiens
cccttctatacccacccagaa

SEQ ID NO: 4535654 - DNA, 14 bp, Homo sapiens
cccttctctgctcc

SEQ ID NO: 4535655 - DNA, 17 bp, Homo sapiens
cccttctctgctccacc

SEQ ID NO: 4535656 - DNA, 15 bp, Homo sapiens
cccttgagacctcag

SEQ ID NO: 4535657 - DNA, 19 bp, Homo sapiens
cccttgagacctcagccat

SEQ ID NO: 4535658 - DNA, 14 bp, Homo sapiens
cccttgcaggggtc

SEQ ID NO: 4535659 - DNA, 19 bp, Homo sapiens
cccttgcagttcagcacca

SEQ ID NO: 4535660 - DNA, 21 bp, Homo sapiens
cccttgcagttcagcaccacc

SEQ ID NO: 4535661 - DNA, 23 bp, Homo sapiens
cccgtcggactgcccccagaaag

SEQ ID NO: 4535662 - DNA, 17 bp, Homo sapiens
cccgtctccagctgctg

SEQ ID NO: 4535663 - DNA, 22 bp, Homo sapiens
cccgtgagggtgggggggaccg

SEQ ID NO: 4535664 - DNA, 12 bp, Homo sapiens
cccgtgcctggg

SEQ ID NO: 4535665 - DNA, 14 bp, Homo sapiens
cccgtgcctgggag

SEQ ID NO: 4535666 - DNA, 15 bp, Homo sapiens
cccgtgcctgggaga

SEQ ID NO: 4535667 - DNA, 18 bp, Homo sapiens
cccgtggccatccctgtg

SEQ ID NO: 4535668 - DNA, 19 bp, Homo sapiens
cccgtggccatccctgtga

SEQ ID NO: 4535669 - DNA, 20 bp, Homo sapiens
cccgtgggtgggcctggccc

SEQ ID NO: 4535670 - DNA, 22 bp, Homo sapiens
cccgtgggtgggcctggccctg

SEQ ID NO: 4535671 - DNA, 22 bp, Homo sapiens
cccgtggtggcggtggctgccc

SEQ ID NO: 4535672 - DNA, 22 bp, Homo sapiens
cccgtgtttgcgcttgaccatg

SEQ ID NO: 4535673 - DNA, 19 bp, Homo sapiens
cccgtttctccttttccta

SEQ ID NO: 4535674 - DNA, 13 bp, Homo sapiens
cccgtttcttgca

SEQ ID NO: 4535675 - DNA, 21 bp, Homo sapiens
cccgtttgtcaaagaggatgg

SEQ ID NO: 4535676 - DNA, 22 bp, Homo sapiens
ccctaaaatggcgaacatgtgt

SEQ ID NO: 4535677 - DNA, 12 bp, Homo sapiens
ccctaagagact

SEQ ID NO: 4535678 - DNA, 17 bp, Homo sapiens
ccctaagtggctgcctt

SEQ ID NO: 4535679 - DNA, 19 bp, Homo sapiens
ccctaatttatgtgctata

SEQ ID NO: 4535680 - DNA, 13 bp, Homo sapiens
ccctacagtatat

SEQ ID NO: 4535681 - DNA, 15 bp, Homo sapiens
ccctacagtatataa

SEQ ID NO: 4535682 - DNA, 13 bp, Homo sapiens
ccctaccactgtg

SEQ ID NO: 4535683 - DNA, 20 bp, Homo sapiens
ccctacctcaacctgtaaat

SEQ ID NO: 4535684 - DNA, 22 bp, Homo sapiens
ccctacctcaacctgtaaatta

SEQ ID NO: 4535685 - DNA, 23 bp, Homo sapiens
ccctacttaggaaatactcagca

SEQ ID NO: 4535686 - DNA, 21 bp, Homo sapiens
ccctagaaatatatcctgtgt

SEQ ID NO: 4535687 - DNA, 20 bp, Homo sapiens
ccctagagcctgcctggagc

SEQ ID NO: 4535688 - DNA, 18 bp, Homo sapiens
ccctagctttagaccctg

SEQ ID NO: 4535689 - DNA, 22 bp, Homo sapiens
ccctagtcccttcccctccctg

SEQ ID NO: 4535690 - DNA, 17 bp, Homo sapiens
ccctatagaccactggg

SEQ ID NO: 4535691 - DNA, 22 bp, Homo sapiens
ccctattttgctgatgaggaaa

SEQ ID NO: 4535692 - DNA, 20 bp, Homo sapiens
ccctatttttctctcctgtc

SEQ ID NO: 4535693 - DNA, 20 bp, Homo sapiens
ccctcaaagaagtcggaatg

SEQ ID NO: 4535694 - DNA, 21 bp, Homo sapiens
ccctcacaacagtcacctcac

SEQ ID NO: 4535695 - DNA, 17 bp, Homo sapiens
ccctcacccccatggcc

SEQ ID NO: 4535696 - DNA, 20 bp, Homo sapiens
ccctcacccctggttctcat

SEQ ID NO: 4535697 - DNA, 22 bp, Homo sapiens
ccctcacccctggttctcatct

SEQ ID NO: 4535698 - DNA, 18 bp, Homo sapiens
ccctcactctgtcagcca

SEQ ID NO: 4535699 - DNA, 13 bp, Homo sapiens
ccctcagacccag

SEQ ID NO: 4535700 - DNA, 15 bp, Homo sapiens
ccctcagacccagga

SEQ ID NO: 4535701 - DNA, 16 bp, Homo sapiens
ccctcagactcagagg

SEQ ID NO: 4535702 - DNA, 14 bp, Homo sapiens
ccctcagcagctct

SEQ ID NO: 4535703 - DNA, 16 bp, Homo sapiens
ccctcagcagctctgg

SEQ ID NO: 4535704 - DNA, 10 bp, Homo sapiens
ccctcagcct

SEQ ID NO: 4535705 - DNA, 13 bp, Homo sapiens
ccctcaggcccag

SEQ ID NO: 4535706 - DNA, 16 bp, Homo sapiens
ccctcaggcccaggag

SEQ ID NO: 4535707 - DNA, 17 bp, Homo sapiens
ccctcagggagcctccc

SEQ ID NO: 4535708 - DNA, 13 bp, Homo sapiens
ccctcaggggcct

SEQ ID NO: 4535709 - DNA, 18 bp, Homo sapiens
ccctcagtactattcctt

SEQ ID NO: 4535710 - DNA, 17 bp, Homo sapiens
ccctcataagtttgttt

SEQ ID NO: 4535711 - DNA, 13 bp, Homo sapiens
ccctcatctgtcc

SEQ ID NO: 4535712 - DNA, 14 bp, Homo sapiens
ccctcatctttctt

SEQ ID NO: 4535713 - DNA, 23 bp, Homo sapiens
ccctccaaatgtcctttctcaga

SEQ ID NO: 4535714 - DNA, 13 bp, Homo sapiens
ccctccacctcaa

SEQ ID NO: 4535715 - DNA, 12 bp, Homo sapiens
ccctccactgct

SEQ ID NO: 4535716 - DNA, 13 bp, Homo sapiens
ccctccagagaca

SEQ ID NO: 4535717 - DNA, 18 bp, Homo sapiens
ccctccagagccccacag

SEQ ID NO: 4535718 - DNA, 19 bp, Homo sapiens
ccctccagagccccacagc

SEQ ID NO: 4535719 - DNA, 21 bp, Homo sapiens
ccctccagagccccacagccc

SEQ ID NO: 4535720 - DNA, 15 bp, Homo sapiens
ccctccagcttgtgg

SEQ ID NO: 4535721 - DNA, 14 bp, Homo sapiens
ccctccatccaccc

SEQ ID NO: 4535722 - DNA, 24 bp, Homo sapiens
ccctccattgggcacagtccagac

SEQ ID NO: 4535723 - DNA, 12 bp, Homo sapiens
ccctcccacccc

SEQ ID NO: 4535724 - DNA, 13 bp, Homo sapiens
ccctcccaccccc

SEQ ID NO: 4535725 - DNA, 15 bp, Homo sapiens
ccctcccacccccag

SEQ ID NO: 4535726 - DNA, 18 bp, Homo sapiens
ccctcccaccgctgcctc

SEQ ID NO: 4535727 - DNA, 12 bp, Homo sapiens
ccctcccagaca

SEQ ID NO: 4535728 - DNA, 13 bp, Homo sapiens
ccctcccagacag

SEQ ID NO: 4535729 - DNA, 14 bp, Homo sapiens
ccctcccagacagg

SEQ ID NO: 4535730 - DNA, 16 bp, Homo sapiens
ccctcccagacaggcc

SEQ ID NO: 4535731 - DNA, 19 bp, Homo sapiens
ccctcccagacaggccctc

SEQ ID NO: 4535732 - DNA, 20 bp, Homo sapiens
ccctccccagccagcccttc

SEQ ID NO: 4535733 - DNA, 14 bp, Homo sapiens
ccctccccagggga

SEQ ID NO: 4535734 - DNA, 16 bp, Homo sapiens
ccctcccccaaccccc

SEQ ID NO: 4535735 - DNA, 14 bp, Homo sapiens
ccctccccctgcca

SEQ ID NO: 4535736 - DNA, 14 bp, Homo sapiens
ccctcccctgccct

SEQ ID NO: 4535737 - DNA, 18 bp, Homo sapiens
ccctcccctggggacgcc

SEQ ID NO: 4535738 - DNA, 22 bp, Homo sapiens
ccctccccttcgtgtttccccc

SEQ ID NO: 4535739 - DNA, 15 bp, Homo sapiens
ccctccctaccctaa

SEQ ID NO: 4535740 - DNA, 12 bp, Homo sapiens
ccctccctacct

SEQ ID NO: 4535741 - DNA, 13 bp, Homo sapiens
ccctccctacctc

SEQ ID NO: 4535742 - DNA, 14 bp, Homo sapiens
ccctccctacctca

SEQ ID NO: 4535743 - DNA, 15 bp, Homo sapiens
ccctccctccagggt

SEQ ID NO: 4535744 - DNA, 16 bp, Homo sapiens
ccctccctccagggtc

SEQ ID NO: 4535745 - DNA, 13 bp, Homo sapiens
ccctccctgcctg

SEQ ID NO: 4535746 - DNA, 14 bp, Homo sapiens
ccctccctgcctgc

SEQ ID NO: 4535747 - DNA, 18 bp, Homo sapiens
ccctccctgcctgctcct

SEQ ID NO: 4535748 - DNA, 12 bp, Homo sapiens
ccctccctggag

SEQ ID NO: 4535749 - DNA, 13 bp, Homo sapiens
ccctccctggagt

SEQ ID NO: 4535750 - DNA, 13 bp, Homo sapiens
ccctccctttctc

SEQ ID NO: 4535751 - DNA, 13 bp, Homo sapiens
ccctccgcctcca

SEQ ID NO: 4535752 - DNA, 16 bp, Homo sapiens
ccctccgtgtggagca

SEQ ID NO: 4535753 - DNA, 19 bp, Homo sapiens
ccctcctagctctcccagt

SEQ ID NO: 4535754 - DNA, 21 bp, Homo sapiens
ccctcctagctctcccagtga

SEQ ID NO: 4535755 - DNA, 14 bp, Homo sapiens
ccctcctcaccccg

SEQ ID NO: 4535756 - DNA, 12 bp, Homo sapiens
ccctcctccact

SEQ ID NO: 4535757 - DNA, 23 bp, Homo sapiens
ccctcctccaggcctgcctccca

SEQ ID NO: 4535758 - DNA, 12 bp, Homo sapiens
ccctcctccagt

SEQ ID NO: 4535759 - DNA, 11 bp, Homo sapiens
ccctcctccct

SEQ ID NO: 4535760 - DNA, 14 bp, Homo sapiens
ccctcctccctcag

SEQ ID NO: 4535761 - DNA, 15 bp, Homo sapiens
ccctcctccctcaga

SEQ ID NO: 4535762 - DNA, 18 bp, Homo sapiens
ccctcctccctcagaccc

SEQ ID NO: 4535763 - DNA, 23 bp, Homo sapiens
ccctcctccctcagactcagagg

SEQ ID NO: 4535764 - DNA, 13 bp, Homo sapiens
ccctcctcttccc

SEQ ID NO: 4535765 - DNA, 22 bp, Homo sapiens
ccctcctcttcccttagcctct

SEQ ID NO: 4535766 - DNA, 23 bp, Homo sapiens
ccctcctcttcccttagcctctc

SEQ ID NO: 4535767 - DNA, 18 bp, Homo sapiens
ccctcctgacccccatgt

SEQ ID NO: 4535768 - DNA, 13 bp, Homo sapiens
ccctcctgagggc

SEQ ID NO: 4535769 - DNA, 16 bp, Homo sapiens
ccctcctgtcttccca

SEQ ID NO: 4535770 - DNA, 22 bp, Homo sapiens
ccctcctgttgcacccagccct

SEQ ID NO: 4535771 - DNA, 11 bp, Homo sapiens
ccctccttcca

SEQ ID NO: 4535772 - DNA, 20 bp, Homo sapiens
ccctccttccccagacccag

SEQ ID NO: 4535773 - DNA, 22 bp, Homo sapiens
ccctccttccccagacccagag

SEQ ID NO: 4535774 - DNA, 15 bp, Homo sapiens
ccctccttggtgcct

SEQ ID NO: 4535775 - DNA, 14 bp, Homo sapiens
ccctcgccccagcc

SEQ ID NO: 4535776 - DNA, 13 bp, Homo sapiens
ccctcgggcccag

SEQ ID NO: 4535777 - DNA, 14 bp, Homo sapiens
ccctcgttagcctt

SEQ ID NO: 4535778 - DNA, 21 bp, Homo sapiens
ccctctaagcacattccaaac

SEQ ID NO: 4535779 - DNA, 17 bp, Homo sapiens
ccctctcctgcctactc

SEQ ID NO: 4535780 - DNA, 22 bp, Homo sapiens
ccctctcgccccatccctgctt

SEQ ID NO: 4535781 - DNA, 21 bp, Homo sapiens
ccctctcggccaggcattggc

SEQ ID NO: 4535782 - DNA, 15 bp, Homo sapiens
ccctctctccctgcc

SEQ ID NO: 4535783 - DNA, 22 bp, Homo sapiens
cccctgaatctgctgagaggca

SEQ ID NO: 4535784 - DNA, 18 bp, Homo sapiens
cccctgaggacctttctg

SEQ ID NO: 4535785 - DNA, 21 bp, Homo sapiens
cccctgagttgggcagccagg

SEQ ID NO: 4535786 - DNA, 23 bp, Homo sapiens
cccctgcacagcaggctgccagt

SEQ ID NO: 4535787 - DNA, 22 bp, Homo sapiens
cccctgcagacggatgcccatt

SEQ ID NO: 4535788 - DNA, 11 bp, Homo sapiens
cccctgcagct

SEQ ID NO: 4535789 - DNA, 19 bp, Homo sapiens
cccctgccagggcagggcc

SEQ ID NO: 4535790 - DNA, 14 bp, Homo sapiens
cccctgccagtgcc

SEQ ID NO: 4535791 - DNA, 16 bp, Homo sapiens
cccctgccagtgcctt

SEQ ID NO: 4535792 - DNA, 17 bp, Homo sapiens
cccctgcccagcctgct

SEQ ID NO: 4535793 - DNA, 23 bp, Homo sapiens
cccctgcccccaggactgggcca

SEQ ID NO: 4535794 - DNA, 12 bp, Homo sapiens
cccctgccctgc

SEQ ID NO: 4535795 - DNA, 17 bp, Homo sapiens
cccctgccctggtccag

SEQ ID NO: 4535796 - DNA, 10 bp, Homo sapiens
cccctgcctc

SEQ ID NO: 4535797 - DNA, 11 bp, Homo sapiens
cccctgcctcc

SEQ ID NO: 4535798 - DNA, 12 bp, Homo sapiens
cccctgcctcca

SEQ ID NO: 4535799 - DNA, 22 bp, Homo sapiens
cccctgcctgttggcaggccca

SEQ ID NO: 4535800 - DNA, 14 bp, Homo sapiens
cccctgcgccccgc

SEQ ID NO: 4535801 - DNA, 22 bp, Homo sapiens
cccctgcgggcgcgggcagcca

SEQ ID NO: 4535802 - DNA, 14 bp, Homo sapiens
cccctgctcagcaa

SEQ ID NO: 4535803 - DNA, 20 bp, Homo sapiens
cccctgctccaccagcagca

SEQ ID NO: 4535804 - DNA, 15 bp, Homo sapiens
cccctgctgaccttg

SEQ ID NO: 4535805 - DNA, 19 bp, Homo sapiens
cccctgctgtgctgctcaa

SEQ ID NO: 4535806 - DNA, 15 bp, Homo sapiens
cccctggacctggga

SEQ ID NO: 4535807 - DNA, 13 bp, Homo sapiens
cccctggcctccg

SEQ ID NO: 4535808 - DNA, 16 bp, Homo sapiens
cccctggctggctcct

SEQ ID NO: 4535809 - DNA, 11 bp, Homo sapiens
cccctggcttt

SEQ ID NO: 4535810 - DNA, 18 bp, Homo sapiens
cccctggctttgcctctt

SEQ ID NO: 4535811 - DNA, 22 bp, Homo sapiens
cccctggctttgcctcttcttt

SEQ ID NO: 4535812 - DNA, 20 bp, Homo sapiens
cccctggggacgccaaggag

SEQ ID NO: 4535813 - DNA, 14 bp, Homo sapiens
cccctggggcccag

SEQ ID NO: 4535814 - DNA, 22 bp, Homo sapiens
cccctggggctgagtctccagg

SEQ ID NO: 4535815 - DNA, 19 bp, Homo sapiens
cccctggggtggccaccag

SEQ ID NO: 4535816 - DNA, 15 bp, Homo sapiens
cccctggtctctggt

SEQ ID NO: 4535817 - DNA, 15 bp, Homo sapiens
cccctgtcccattct

SEQ ID NO: 4535818 - DNA, 14 bp, Homo sapiens
cccctgtgccttgt

SEQ ID NO: 4535819 - DNA, 20 bp, Homo sapiens
cccctgtgtattcaccacca

SEQ ID NO: 4535820 - DNA, 13 bp, Homo sapiens
ccccttcagtgcc

SEQ ID NO: 4535821 - DNA, 23 bp, Homo sapiens
ccccttccatggtactgtagcag

SEQ ID NO: 4535822 - DNA, 10 bp, Homo sapiens
ccccttccca

SEQ ID NO: 4535823 - DNA, 14 bp, Homo sapiens
ccccttcccctgct

SEQ ID NO: 4535824 - DNA, 21 bp, Homo sapiens
ccccttccctctctccctgcc

SEQ ID NO: 4535825 - DNA, 11 bp, Homo sapiens
ccccttcctgt

SEQ ID NO: 4535826 - DNA, 14 bp, Homo sapiens
ccccttcctgtctc

SEQ ID NO: 4535827 - DNA, 15 bp, Homo sapiens
ccccttcctgtctca

SEQ ID NO: 4535828 - DNA, 20 bp, Homo sapiens
ccccttctacactctcctgg

SEQ ID NO: 4535829 - DNA, 22 bp, Homo sapiens
ccccttctacactctcctgggc

SEQ ID NO: 4535830 - DNA, 16 bp, Homo sapiens
ccccttctctcatctc

SEQ ID NO: 4535831 - DNA, 14 bp, Homo sapiens
ccccttctctcctc

SEQ ID NO: 4535832 - DNA, 15 bp, Homo sapiens
ccccttctctcctcc

SEQ ID NO: 4535833 - DNA, 19 bp, Homo sapiens
ccccttctctcctccccaa

SEQ ID NO: 4535834 - DNA, 14 bp, Homo sapiens
ccccttctgtgtca

SEQ ID NO: 4535835 - DNA, 17 bp, Homo sapiens
ccccttctgtgtcacag

SEQ ID NO: 4535836 - DNA, 14 bp, Homo sapiens
ccccttgccacccc

SEQ ID NO: 4535837 - DNA, 12 bp, Homo sapiens
ccccttggtcct

SEQ ID NO: 4535838 - DNA, 17 bp, Homo sapiens
ccccttggtcctggcag

SEQ ID NO: 4535839 - DNA, 21 bp, Homo sapiens
ccccttggtcctggcagggcg

SEQ ID NO: 4535840 - DNA, 22 bp, Homo sapiens
cccctttatcgcattgctgtcc

SEQ ID NO: 4535841 - DNA, 14 bp, Homo sapiens
cccctttcacactg

SEQ ID NO: 4535842 - DNA, 17 bp, Homo sapiens
cccctttgggcccaggg

SEQ ID NO: 4535843 - DNA, 16 bp, Homo sapiens
cccgactccagccagc

SEQ ID NO: 4535844 - DNA, 14 bp, Homo sapiens
cccgagccctgact

SEQ ID NO: 4535845 - DNA, 20 bp, Homo sapiens
cccgagccctgactcctgga

SEQ ID NO: 4535846 - DNA, 16 bp, Homo sapiens
cccgaggagctgggcc

SEQ ID NO: 4535847 - DNA, 22 bp, Homo sapiens
cccgaggagctgggcccctgca

SEQ ID NO: 4535848 - DNA, 19 bp, Homo sapiens
cccgatattctccctgacc

SEQ ID NO: 4535849 - DNA, 15 bp, Homo sapiens
cccgatgtcccctgc

SEQ ID NO: 4535850 - DNA, 19 bp, Homo sapiens
cccgatgtcccctgcgggc

SEQ ID NO: 4535851 - DNA, 12 bp, Homo sapiens
cccgcactctgc

SEQ ID NO: 4535852 - DNA, 16 bp, Homo sapiens
cccgcagcccgcctgc

SEQ ID NO: 4535853 - DNA, 21 bp, Homo sapiens
cccgcaggaactgggctgggc

SEQ ID NO: 4535854 - DNA, 17 bp, Homo sapiens
cccgccactcgccttct

SEQ ID NO: 4535855 - DNA, 17 bp, Homo sapiens
cccgccagggctgggga

SEQ ID NO: 4535856 - DNA, 15 bp, Homo sapiens
cccgcccacccgcct

SEQ ID NO: 4535857 - DNA, 14 bp, Homo sapiens
cccgcccctgggga

SEQ ID NO: 4535858 - DNA, 13 bp, Homo sapiens
cccgcccttccga

SEQ ID NO: 4535859 - DNA, 13 bp, Homo sapiens
cccgcctccactc

SEQ ID NO: 4535860 - DNA, 11 bp, Homo sapiens
cccgcctgcca

SEQ ID NO: 4535861 - DNA, 16 bp, Homo sapiens
cccgcctgccagtcct

SEQ ID NO: 4535862 - DNA, 13 bp, Homo sapiens
cccgcctgtcaca

SEQ ID NO: 4535863 - DNA, 20 bp, Homo sapiens
cccgcctttagttctccact

SEQ ID NO: 4535864 - DNA, 21 bp, Homo sapiens
cccgcctttagttctccactg

SEQ ID NO: 4535865 - DNA, 16 bp, Homo sapiens
cccgcgctcgcccagc

SEQ ID NO: 4535866 - DNA, 21 bp, Homo sapiens
cccgcgggagacagcttctct

SEQ ID NO: 4535867 - DNA, 14 bp, Homo sapiens
cccgcgggttctag

SEQ ID NO: 4535868 - DNA, 16 bp, Homo sapiens
cccgcgggttctagac

SEQ ID NO: 4535869 - DNA, 12 bp, Homo sapiens
cccgcgttcaag

SEQ ID NO: 4535870 - DNA, 19 bp, Homo sapiens
cccgctcccacagcttcct

SEQ ID NO: 4535871 - DNA, 13 bp, Homo sapiens
cccgctctgcatg

SEQ ID NO: 4535872 - DNA, 23 bp, Homo sapiens
cccgctgctgtgctctggggatt

SEQ ID NO: 4535873 - DNA, 14 bp, Homo sapiens
cccgctgtggccgg

SEQ ID NO: 4535874 - DNA, 21 bp, Homo sapiens
cccgcttgctcgcttgctgga

SEQ ID NO: 4535875 - DNA, 22 bp, Homo sapiens
cccgcttgctcgcttgctggaa

SEQ ID NO: 4535876 - DNA, 14 bp, Homo sapiens
cccggcagggcggg

SEQ ID NO: 4535877 - DNA, 20 bp, Homo sapiens
cccggccaaggacccaggcg

SEQ ID NO: 4535878 - DNA, 15 bp, Homo sapiens
cccggccacacccag

SEQ ID NO: 4535879 - DNA, 16 bp, Homo sapiens
cccggccacacccagc

SEQ ID NO: 4535880 - DNA, 21 bp, Homo sapiens
cccggccccctggtctctggt

SEQ ID NO: 4535881 - DNA, 22 bp, Homo sapiens
cccggccctgggctcggaggct

SEQ ID NO: 4535882 - DNA, 14 bp, Homo sapiens
cccggcgcggtggc

SEQ ID NO: 4535883 - DNA, 22 bp, Homo sapiens
cccggcgcggtggctcacgcct

SEQ ID NO: 4535884 - DNA, 16 bp, Homo sapiens
cccggctgagccctgc

SEQ ID NO: 4535885 - DNA, 17 bp, Homo sapiens
cccggctgagccctgcc

SEQ ID NO: 4535886 - DNA, 14 bp, Homo sapiens
cccgggagctcagg

SEQ ID NO: 4535887 - DNA, 14 bp, Homo sapiens
cccgggagctgggc

SEQ ID NO: 4535888 - DNA, 15 bp, Homo sapiens
cccgggagctgggcc

SEQ ID NO: 4535889 - DNA, 16 bp, Homo sapiens
cccgggagctgggccc

SEQ ID NO: 4535890 - DNA, 23 bp, Homo sapiens
cccgggaggcagaggttgcagtg

SEQ ID NO: 4535891 - DNA, 17 bp, Homo sapiens
cccgggctctctgctgt

SEQ ID NO: 4535892 - DNA, 15 bp, Homo sapiens
cccggggaccctgtg

SEQ ID NO: 4535893 - DNA, 16 bp, Homo sapiens
cccggggaccctgtga

SEQ ID NO: 4535894 - DNA, 11 bp, Homo sapiens
cccggggcctg

SEQ ID NO: 4535895 - DNA, 20 bp, Homo sapiens
cccggggcctggacaggcgg

SEQ ID NO: 4535896 - DNA, 18 bp, Homo sapiens
cccgggggagcccagtga

SEQ ID NO: 4535897 - DNA, 13 bp, Homo sapiens
cccgggggtgggg

SEQ ID NO: 4535898 - DNA, 16 bp, Homo sapiens
cccggtccacaggtcc

SEQ ID NO: 4535899 - DNA, 13 bp, Homo sapiens
cccggtcccccag

SEQ ID NO: 4535900 - DNA, 14 bp, Homo sapiens
cccggtcccccaga

SEQ ID NO: 4535901 - DNA, 22 bp, Homo sapiens
cccggtggtgggatccacgctg

SEQ ID NO: 4535902 - DNA, 15 bp, Homo sapiens
cccgtatcacagtgt

SEQ ID NO: 4535903 - DNA, 19 bp, Homo sapiens
cccgtcagcatcactgatg

SEQ ID NO: 4535904 - DNA, 22 bp, Homo sapiens
cccgtcggactgcccccagaaa

SEQ ID NO: 4535905 - DNA, 22 bp, Homo sapiens
cctgccagcaggccagggactc

SEQ ID NO: 4535906 - DNA, 13 bp, Homo sapiens
cctgccagccact

SEQ ID NO: 4535907 - DNA, 14 bp, Homo sapiens
cctgccagccactg

SEQ ID NO: 4535908 - DNA, 16 bp, Homo sapiens
cctgccagccactgtc

SEQ ID NO: 4535909 - DNA, 21 bp, Homo sapiens
cctgccagctggatcgctgca

SEQ ID NO: 4535910 - DNA, 21 bp, Homo sapiens
cctgccaggagctttggacct

SEQ ID NO: 4535911 - DNA, 12 bp, Homo sapiens
cctgccaggcac

SEQ ID NO: 4535912 - DNA, 15 bp, Homo sapiens
cctgccaggcagggg

SEQ ID NO: 4535913 - DNA, 12 bp, Homo sapiens
cctgccaggccg

SEQ ID NO: 4535914 - DNA, 13 bp, Homo sapiens
cctgccagggcag

SEQ ID NO: 4535915 - DNA, 17 bp, Homo sapiens
cctgccagggcagggcc

SEQ ID NO: 4535916 - DNA, 19 bp, Homo sapiens
cctgccagggcagggcccc

SEQ ID NO: 4535917 - DNA, 12 bp, Homo sapiens
cctgccagtcct

SEQ ID NO: 4535918 - DNA, 14 bp, Homo sapiens
cctgccagtcctag

SEQ ID NO: 4535919 - DNA, 15 bp, Homo sapiens
cctgccagtcctagc

SEQ ID NO: 4535920 - DNA, 21 bp, Homo sapiens
cctgccagtcctagctgcaca

SEQ ID NO: 4535921 - DNA, 22 bp, Homo sapiens
cctgccagtcctagctgcacag

SEQ ID NO: 4535922 - DNA, 14 bp, Homo sapiens
cctgccagtgcctt

SEQ ID NO: 4535923 - DNA, 20 bp, Homo sapiens
cctgccagtgccttacctcc

SEQ ID NO: 4535924 - DNA, 23 bp, Homo sapiens
cctgccagtgccttacctcctgc

SEQ ID NO: 4535925 - DNA, 16 bp, Homo sapiens
cctgccatcatgcctg

SEQ ID NO: 4535926 - DNA, 22 bp, Homo sapiens
cctgccatggaactgtttcctt

SEQ ID NO: 4535927 - DNA, 23 bp, Homo sapiens
cctgccattcttctggtgctact

SEQ ID NO: 4535928 - DNA, 22 bp, Homo sapiens
cctgcccaaggcctaccccagt

SEQ ID NO: 4535929 - DNA, 14 bp, Homo sapiens
cctgcccagactga

SEQ ID NO: 4535930 - DNA, 18 bp, Homo sapiens
cctgcccagactgatgag

SEQ ID NO: 4535931 - DNA, 19 bp, Homo sapiens
cctgcccagactgatgagc

SEQ ID NO: 4535932 - DNA, 22 bp, Homo sapiens
cctgcccaggagagccagccct

SEQ ID NO: 4535933 - DNA, 17 bp, Homo sapiens
cctgcccaggccacaga

SEQ ID NO: 4535934 - DNA, 21 bp, Homo sapiens
cctgcccaggccacagagaac

SEQ ID NO: 4535935 - DNA, 12 bp, Homo sapiens
cctgcccatgtg

SEQ ID NO: 4535936 - DNA, 13 bp, Homo sapiens
cctgccccacccc

SEQ ID NO: 4535937 - DNA, 19 bp, Homo sapiens
cctgccccaccccatccag

SEQ ID NO: 4535938 - DNA, 24 bp, Homo sapiens
cctgccccaccccatccagccaga

SEQ ID NO: 4535939 - DNA, 16 bp, Homo sapiens
cctgcccccaatccat

SEQ ID NO: 4535940 - DNA, 16 bp, Homo sapiens
cctgcccccacccctt

SEQ ID NO: 4535941 - DNA, 22 bp, Homo sapiens
cctgcccccagagcgtccttgg

SEQ ID NO: 4535942 - DNA, 15 bp, Homo sapiens
cctgcccccagcccc

SEQ ID NO: 4535943 - DNA, 12 bp, Homo sapiens
cctgcccccagg

SEQ ID NO: 4535944 - DNA, 14 bp, Homo sapiens
cctgcccccaggac

SEQ ID NO: 4535945 - DNA, 17 bp, Homo sapiens
cctgcccccaggactgg

SEQ ID NO: 4535946 - DNA, 19 bp, Homo sapiens
cctgcccccaggactgggc

SEQ ID NO: 4535947 - DNA, 13 bp, Homo sapiens
cctgccccctgcc

SEQ ID NO: 4535948 - DNA, 13 bp, Homo sapiens
cctgccccgcccc

SEQ ID NO: 4535949 - DNA, 20 bp, Homo sapiens
cctgccccgcccccagtccc

SEQ ID NO: 4535950 - DNA, 21 bp, Homo sapiens
cctgccccgtgtgtgtggccg

SEQ ID NO: 4535951 - DNA, 22 bp, Homo sapiens
cctgccccgtgtgtgtggccgg

SEQ ID NO: 4535952 - DNA, 16 bp, Homo sapiens
cctgcccctctctctc

SEQ ID NO: 4535953 - DNA, 20 bp, Homo sapiens
cctgccccttctacactctc

SEQ ID NO: 4535954 - DNA, 17 bp, Homo sapiens
cctgcccgtctctctcc

SEQ ID NO: 4535955 - DNA, 19 bp, Homo sapiens
cctgcccgtctctctccca

SEQ ID NO: 4535956 - DNA, 23 bp, Homo sapiens
cctgcccgtctctctcccatgga

SEQ ID NO: 4535957 - DNA, 14 bp, Homo sapiens
cctgccctcaaggg

SEQ ID NO: 4535958 - DNA, 24 bp, Homo sapiens
cctgccctccacccacacctgccc

SEQ ID NO: 4535959 - DNA, 16 bp, Homo sapiens
cctgccctcccaagtc

SEQ ID NO: 4535960 - DNA, 13 bp, Homo sapiens
cctgccctgcacg

SEQ ID NO: 4535961 - DNA, 14 bp, Homo sapiens
cctgccctgtccaa

SEQ ID NO: 4535962 - DNA, 21 bp, Homo sapiens
cctgccctgtgatatgtctgc

SEQ ID NO: 4535963 - DNA, 18 bp, Homo sapiens
cctgcccttccctctggg

SEQ ID NO: 4535964 - DNA, 14 bp, Homo sapiens
cctgccgtgcatgg

SEQ ID NO: 4535965 - DNA, 16 bp, Homo sapiens
cctgccgtgcatggct

SEQ ID NO: 4535966 - DNA, 18 bp, Homo sapiens
cctgccgtgcatggctcc

SEQ ID NO: 4535967 - DNA, 16 bp, Homo sapiens
cctgcctcactcctcc

SEQ ID NO: 4535968 - DNA, 16 bp, Homo sapiens
cctgcctcagccaggc

SEQ ID NO: 4535969 - DNA, 13 bp, Homo sapiens
cctgcctcagcct

SEQ ID NO: 4535970 - DNA, 14 bp, Homo sapiens
cctgcctcagcctc

SEQ ID NO: 4535971 - DNA, 14 bp, Homo sapiens
cctgcctcagcctt

SEQ ID NO: 4535972 - DNA, 16 bp, Homo sapiens
cctgcctccaccctct

SEQ ID NO: 4535973 - DNA, 15 bp, Homo sapiens
cctgcctccagggct

SEQ ID NO: 4535974 - DNA, 16 bp, Homo sapiens
cctgcctccagggctg

SEQ ID NO: 4535975 - DNA, 20 bp, Homo sapiens
cctgcctccagggctggact

SEQ ID NO: 4535976 - DNA, 13 bp, Homo sapiens
cctgcctcccaag

SEQ ID NO: 4535977 - DNA, 17 bp, Homo sapiens
cctgcctcctgcctatg

SEQ ID NO: 4535978 - DNA, 20 bp, Homo sapiens
cctgcctctcatcaactgaa

SEQ ID NO: 4535979 - DNA, 23 bp, Homo sapiens
cctgcctctcatcaactgaatga

SEQ ID NO: 4535980 - DNA, 19 bp, Homo sapiens
cctgcctgaacagccctct

SEQ ID NO: 4535981 - DNA, 12 bp, Homo sapiens
cctgcctgcagc

SEQ ID NO: 4535982 - DNA, 13 bp, Homo sapiens
cctgcctgcagca

SEQ ID NO: 4535983 - DNA, 15 bp, Homo sapiens
cctgcctgcagcagg

SEQ ID NO: 4535984 - DNA, 16 bp, Homo sapiens
cctgcctgcagcaggc

SEQ ID NO: 4535985 - DNA, 15 bp, Homo sapiens
cctgcctgcagccag

SEQ ID NO: 4535986 - DNA, 16 bp, Homo sapiens
cctgcctgcagccagg

SEQ ID NO: 4535987 - DNA, 17 bp, Homo sapiens
cctgcctgcagccaggg

SEQ ID NO: 4535988 - DNA, 20 bp, Homo sapiens
cctgcctgcagccagggctg

SEQ ID NO: 4535989 - DNA, 14 bp, Homo sapiens
cctgcctggcaggc

SEQ ID NO: 4535990 - DNA, 18 bp, Homo sapiens
cctgcctggccaggcaga

SEQ ID NO: 4535991 - DNA, 23 bp, Homo sapiens
cctgcctggccaggcagatctgt

SEQ ID NO: 4535992 - DNA, 12 bp, Homo sapiens
cctgcctggccc

SEQ ID NO: 4535993 - DNA, 13 bp, Homo sapiens
cctgcctggcccc

SEQ ID NO: 4535994 - DNA, 14 bp, Homo sapiens
cctgccttcctcct

SEQ ID NO: 4535995 - DNA, 14 bp, Homo sapiens
cctgcgccccgcac

SEQ ID NO: 4535996 - DNA, 15 bp, Homo sapiens
cctgcgcctgctgcc

SEQ ID NO: 4535997 - DNA, 18 bp, Homo sapiens
cctgcgcctgctgcctgc

SEQ ID NO: 4535998 - DNA, 22 bp, Homo sapiens
cctgcggaaggaggttctccca

SEQ ID NO: 4535999 - DNA, 13 bp, Homo sapiens
cctgcgggcccct

SEQ ID NO: 4536000 - DNA, 20 bp, Homo sapiens
cctgcgggcgcgggcagcca

SEQ ID NO: 4536001 - DNA, 19 bp, Homo sapiens
cctgcgtcccagcctgcac

SEQ ID NO: 4536002 - DNA, 14 bp, Homo sapiens
cctgcgttcccaga

SEQ ID NO: 4536003 - DNA, 17 bp, Homo sapiens
cctgcgttcccagacca

SEQ ID NO: 4536004 - DNA, 17 bp, Homo sapiens
cctgctagacgcaccgc

SEQ ID NO: 4536005 - DNA, 20 bp, Homo sapiens
cctgctagacgcaccgcctg

SEQ ID NO: 4536006 - DNA, 20 bp, Homo sapiens
cctgctagcacagaggcctg

SEQ ID NO: 4536007 - DNA, 16 bp, Homo sapiens
cctgctcactgggccc

SEQ ID NO: 4536008 - DNA, 23 bp, Homo sapiens
cctgctcagcaattcagacccct

SEQ ID NO: 4536009 - DNA, 11 bp, Homo sapiens
cctgctcaggc

SEQ ID NO: 4536010 - DNA, 22 bp, Homo sapiens
cctgctcagtgcttgggctcca

SEQ ID NO: 4536011 - DNA, 22 bp, Homo sapiens
cctgctccaccagcagcatggc

SEQ ID NO: 4536012 - DNA, 20 bp, Homo sapiens
cctgctcccagtcctgcctg

SEQ ID NO: 4536013 - DNA, 19 bp, Homo sapiens
cctgctcccattcctccct

SEQ ID NO: 4536014 - DNA, 20 bp, Homo sapiens
cctgctcccattcctccctc

SEQ ID NO: 4536015 - DNA, 14 bp, Homo sapiens
cctgctcccccacc

SEQ ID NO: 4536016 - DNA, 18 bp, Homo sapiens
cctgctcccccaccccct

SEQ ID NO: 4536017 - DNA, 15 bp, Homo sapiens
cctgctccctgcctc

SEQ ID NO: 4536018 - DNA, 17 bp, Homo sapiens
cctgctccctgcctcct

SEQ ID NO: 4536019 - DNA, 20 bp, Homo sapiens
cctgctccttggcaccccca

SEQ ID NO: 4536020 - DNA, 13 bp, Homo sapiens
cctgctctgtccc

SEQ ID NO: 4536021 - DNA, 19 bp, Homo sapiens
cctgctgaaactgcccact

SEQ ID NO: 4536022 - DNA, 22 bp, Homo sapiens
cctgctgaccttggaggaatga

SEQ ID NO: 4536023 - DNA, 15 bp, Homo sapiens
cctgctgccagtgca

SEQ ID NO: 4536024 - DNA, 15 bp, Homo sapiens
cctgctgctcagtaa

SEQ ID NO: 4536025 - DNA, 13 bp, Homo sapiens
cctgctgctccta

SEQ ID NO: 4536026 - DNA, 22 bp, Homo sapiens
cctgacctcgtgatgggcccgc

SEQ ID NO: 4536027 - DNA, 17 bp, Homo sapiens
cctgaccttagcgttct

SEQ ID NO: 4536028 - DNA, 19 bp, Homo sapiens
cctgaccttagcgttctgg

SEQ ID NO: 4536029 - DNA, 12 bp, Homo sapiens
cctgacgctcag

SEQ ID NO: 4536030 - DNA, 13 bp, Homo sapiens
cctgacgctcagc

SEQ ID NO: 4536031 - DNA, 15 bp, Homo sapiens
cctgacgctcagccc

SEQ ID NO: 4536032 - DNA, 18 bp, Homo sapiens
cctgactcagtgaccagt

SEQ ID NO: 4536033 - DNA, 16 bp, Homo sapiens
cctgactccctgtggg

SEQ ID NO: 4536034 - DNA, 17 bp, Homo sapiens
cctgactcctctggctt

SEQ ID NO: 4536035 - DNA, 19 bp, Homo sapiens
cctgactcctctggctttc

SEQ ID NO: 4536036 - DNA, 14 bp, Homo sapiens
cctgactcctggac

SEQ ID NO: 4536037 - DNA, 16 bp, Homo sapiens
cctgactcctggactc

SEQ ID NO: 4536038 - DNA, 12 bp, Homo sapiens
cctgactctgcc

SEQ ID NO: 4536039 - DNA, 13 bp, Homo sapiens
cctgactctgccc

SEQ ID NO: 4536040 - DNA, 15 bp, Homo sapiens
cctgactctgccccc

SEQ ID NO: 4536041 - DNA, 22 bp, Homo sapiens
cctgactctgccccctgctggc

SEQ ID NO: 4536042 - DNA, 22 bp, Homo sapiens
cctgactgacttttttgcttaa

SEQ ID NO: 4536043 - DNA, 17 bp, Homo sapiens
cctgacttcctctgcca

SEQ ID NO: 4536044 - DNA, 13 bp, Homo sapiens
cctgagaactgaa

SEQ ID NO: 4536045 - DNA, 23 bp, Homo sapiens
cctgagaagaagtggctgccaca

SEQ ID NO: 4536046 - DNA, 21 bp, Homo sapiens
cctgagaccagggtggccaca

SEQ ID NO: 4536047 - DNA, 16 bp, Homo sapiens
cctgagacccctggcc

SEQ ID NO: 4536048 - DNA, 19 bp, Homo sapiens
cctgagaccctgggagaga

SEQ ID NO: 4536049 - DNA, 19 bp, Homo sapiens
cctgagacctctagagaaa

SEQ ID NO: 4536050 - DNA, 15 bp, Homo sapiens
cctgagagcctgtgg

SEQ ID NO: 4536051 - DNA, 14 bp, Homo sapiens
cctgagaggcaggc

SEQ ID NO: 4536052 - DNA, 15 bp, Homo sapiens
cctgagaggggaagc

SEQ ID NO: 4536053 - DNA, 21 bp, Homo sapiens
cctgagatacaaggcccagaa

SEQ ID NO: 4536054 - DNA, 17 bp, Homo sapiens
cctgagatgcaggtgat

SEQ ID NO: 4536055 - DNA, 20 bp, Homo sapiens
cctgagatttaacccctcca

SEQ ID NO: 4536056 - DNA, 15 bp, Homo sapiens
cctgagatttcatct

SEQ ID NO: 4536057 - DNA, 13 bp, Homo sapiens
cctgagcaactct

SEQ ID NO: 4536058 - DNA, 14 bp, Homo sapiens
cctgagcaactctt

SEQ ID NO: 4536059 - DNA, 18 bp, Homo sapiens
cctgagcaactcttgatt

SEQ ID NO: 4536060 - DNA, 12 bp, Homo sapiens
cctgagcattca

SEQ ID NO: 4536061 - DNA, 23 bp, Homo sapiens
cctgagcgggagtcagggacctg

SEQ ID NO: 4536062 - DNA, 21 bp, Homo sapiens
cctgagctagaagctggagga

SEQ ID NO: 4536063 - DNA, 14 bp, Homo sapiens
cctgagctcgggga

SEQ ID NO: 4536064 - DNA, 14 bp, Homo sapiens
cctgagctctgata

SEQ ID NO: 4536065 - DNA, 16 bp, Homo sapiens
cctgagctgaggcagc

SEQ ID NO: 4536066 - DNA, 18 bp, Homo sapiens
cctgagctgaggcagcag

SEQ ID NO: 4536067 - DNA, 20 bp, Homo sapiens
cctgaggccctgggctgggt

SEQ ID NO: 4536068 - DNA, 13 bp, Homo sapiens
cctgaggcctaga

SEQ ID NO: 4536069 - DNA, 17 bp, Homo sapiens
cctgaggcggaggctgt

SEQ ID NO: 4536070 - DNA, 21 bp, Homo sapiens
cctgaggcggaggctgtgctc

SEQ ID NO: 4536071 - DNA, 13 bp, Homo sapiens
cctgaggctgttt

SEQ ID NO: 4536072 - DNA, 21 bp, Homo sapiens
cctgagggccggttctaaggc

SEQ ID NO: 4536073 - DNA, 20 bp, Homo sapiens
cctgaggggcatctgcccct

SEQ ID NO: 4536074 - DNA, 14 bp, Homo sapiens
cctgagtcaccagg

SEQ ID NO: 4536075 - DNA, 22 bp, Homo sapiens
cctgagtcgtacagaaagctgc

SEQ ID NO: 4536076 - DNA, 21 bp, Homo sapiens
cctgagtggccagggaatcta

SEQ ID NO: 4536077 - DNA, 17 bp, Homo sapiens
cctgagttcccgggagc

SEQ ID NO: 4536078 - DNA, 18 bp, Homo sapiens
cctgagttcccgggagct

SEQ ID NO: 4536079 - DNA, 20 bp, Homo sapiens
cctgagttcccgggagctgg

SEQ ID NO: 4536080 - DNA, 22 bp, Homo sapiens
cctgagttcccgggagctgggc

SEQ ID NO: 4536081 - DNA, 23 bp, Homo sapiens
cctgagttcccgggagctgggcc

SEQ ID NO: 4536082 - DNA, 20 bp, Homo sapiens
cctgagttgggcagccagga

SEQ ID NO: 4536083 - DNA, 20 bp, Homo sapiens
cctgataaaacaacagctcg

SEQ ID NO: 4536084 - DNA, 19 bp, Homo sapiens
cctgataacaacctggaga

SEQ ID NO: 4536085 - DNA, 14 bp, Homo sapiens
cctgatcccacccc

SEQ ID NO: 4536086 - DNA, 14 bp, Homo sapiens
cctgatctctgctc

SEQ ID NO: 4536087 - DNA, 14 bp, Homo sapiens
cctgatgctccctc

SEQ ID NO: 4536088 - DNA, 16 bp, Homo sapiens
cctgatgctccctccc

SEQ ID NO: 4536089 - DNA, 19 bp, Homo sapiens
cctgatgctccctcccctg

SEQ ID NO: 4536090 - DNA, 20 bp, Homo sapiens
cctgatgctccctcccctgc

SEQ ID NO: 4536091 - DNA, 19 bp, Homo sapiens
cctgatggcctttggaccc

SEQ ID NO: 4536092 - DNA, 21 bp, Homo sapiens
cctgatggcctttggacccag

SEQ ID NO: 4536093 - DNA, 21 bp, Homo sapiens
cctgatgtgtcctcagggagc

SEQ ID NO: 4536094 - DNA, 14 bp, Homo sapiens
cctgattgatcaca

SEQ ID NO: 4536095 - DNA, 21 bp, Homo sapiens
cctgattgatcacacagtgtt

SEQ ID NO: 4536096 - DNA, 18 bp, Homo sapiens
cctgattgtgccagtgca

SEQ ID NO: 4536097 - DNA, 22 bp, Homo sapiens
cctgcaaaaattcagagtcctt

SEQ ID NO: 4536098 - DNA, 19 bp, Homo sapiens
cctgcaaaactccaggcag

SEQ ID NO: 4536099 - DNA, 19 bp, Homo sapiens
cctgcaaaaggactctcag

SEQ ID NO: 4536100 - DNA, 16 bp, Homo sapiens
cctgcaaaccttcctg

SEQ ID NO: 4536101 - DNA, 19 bp, Homo sapiens
cctgcaaaccttcctggga

SEQ ID NO: 4536102 - DNA, 22 bp, Homo sapiens
cctgcaagatggacacgagcca

SEQ ID NO: 4536103 - DNA, 15 bp, Homo sapiens
cctgcaagctccgcc

SEQ ID NO: 4536104 - DNA, 16 bp, Homo sapiens
cctgcaagttgctctg

SEQ ID NO: 4536105 - DNA, 23 bp, Homo sapiens
cctgcaatgtggtgacacctccc

SEQ ID NO: 4536106 - DNA, 15 bp, Homo sapiens
cctgcacacacatgc

SEQ ID NO: 4536107 - DNA, 17 bp, Homo sapiens
cctgcacacacatgcat

SEQ ID NO: 4536108 - DNA, 23 bp, Homo sapiens
cctgcacacagagtgagggagga

SEQ ID NO: 4536109 - DNA, 21 bp, Homo sapiens
cctgcacaccctgggccacgc

SEQ ID NO: 4536110 - DNA, 20 bp, Homo sapiens
cctgcacagcaggctgccag

SEQ ID NO: 4536111 - DNA, 17 bp, Homo sapiens
cctgcacaggcacacag

SEQ ID NO: 4536112 - DNA, 23 bp, Homo sapiens
cctgcacattgggtggggctcct

SEQ ID NO: 4536113 - DNA, 20 bp, Homo sapiens
cctgcaccaggggtgcacaa

SEQ ID NO: 4536114 - DNA, 12 bp, Homo sapiens
cctgcacccctc

SEQ ID NO: 4536115 - DNA, 16 bp, Homo sapiens
cctgcacccctccggc

SEQ ID NO: 4536116 - DNA, 14 bp, Homo sapiens
cctgcacccttcca

SEQ ID NO: 4536117 - DNA, 21 bp, Homo sapiens
cctgcacctccccccactgca

SEQ ID NO: 4536118 - DNA, 15 bp, Homo sapiens
cctgcacctgccccg

SEQ ID NO: 4536119 - DNA, 17 bp, Homo sapiens
cctgcacctgccccgtg

SEQ ID NO: 4536120 - DNA, 16 bp, Homo sapiens
cctgcacggtgggcct

SEQ ID NO: 4536121 - DNA, 19 bp, Homo sapiens
cctgcacggtgggccttgc

SEQ ID NO: 4536122 - DNA, 23 bp, Homo sapiens
cctgcacggtgggccttgctggg

SEQ ID NO: 4536123 - DNA, 17 bp, Homo sapiens
cctgcactaacagagtg

SEQ ID NO: 4536124 - DNA, 22 bp, Homo sapiens
cctgcagctggaatgtgccaca

SEQ ID NO: 4536125 - DNA, 12 bp, Homo sapiens
cctgcaggcaga

SEQ ID NO: 4536126 - DNA, 17 bp, Homo sapiens
cctgcaggcagagctgg

SEQ ID NO: 4536127 - DNA, 21 bp, Homo sapiens
cctgcaggcagagctggagcc

SEQ ID NO: 4536128 - DNA, 17 bp, Homo sapiens
cctgcaggtcagttgta

SEQ ID NO: 4536129 - DNA, 19 bp, Homo sapiens
cctgcaggtttgacacgca

SEQ ID NO: 4536130 - DNA, 20 bp, Homo sapiens
cctgcaggtttgacacgcag

SEQ ID NO: 4536131 - DNA, 13 bp, Homo sapiens
cctgcagtttctt

SEQ ID NO: 4536132 - DNA, 21 bp, Homo sapiens
cctgcagtttcttgtgtagat

SEQ ID NO: 4536133 - DNA, 14 bp, Homo sapiens
cctgcagtttttaa

SEQ ID NO: 4536134 - DNA, 12 bp, Homo sapiens
cctgcatattta

SEQ ID NO: 4536135 - DNA, 22 bp, Homo sapiens
cctgcatccgtagttccctgaa

SEQ ID NO: 4536136 - DNA, 18 bp, Homo sapiens
cctgcatctctgtgaagc

SEQ ID NO: 4536137 - DNA, 19 bp, Homo sapiens
cctgcattactccttcagc

SEQ ID NO: 4536138 - DNA, 20 bp, Homo sapiens
cctgcattactccttcagct

SEQ ID NO: 4536139 - DNA, 22 bp, Homo sapiens
cctgccacaaaccaccaggact

SEQ ID NO: 4536140 - DNA, 13 bp, Homo sapiens
cctgccacagcca

SEQ ID NO: 4536141 - DNA, 17 bp, Homo sapiens
cctgccacagccagagg

SEQ ID NO: 4536142 - DNA, 17 bp, Homo sapiens
cctgccacatggagccc

SEQ ID NO: 4536143 - DNA, 13 bp, Homo sapiens
cctgccactcaca

SEQ ID NO: 4536144 - DNA, 23 bp, Homo sapiens
cctgccactcacacagccaggtg

SEQ ID NO: 4536145 - DNA, 18 bp, Homo sapiens
cctgccactctctgggac

SEQ ID NO: 4536146 - DNA, 15 bp, Homo sapiens
cctctcttccccttc

SEQ ID NO: 4536147 - DNA, 17 bp, Homo sapiens
cctctcttccccttccc

SEQ ID NO: 4536148 - DNA, 21 bp, Homo sapiens
cctctctttcacacaatgccc

SEQ ID NO: 4536149 - DNA, 16 bp, Homo sapiens
cctctgaaacagctgc

SEQ ID NO: 4536150 - DNA, 22 bp, Homo sapiens
cctctgaaacagctgccttagc

SEQ ID NO: 4536151 - DNA, 15 bp, Homo sapiens
cctctgacagtccac

SEQ ID NO: 4536152 - DNA, 17 bp, Homo sapiens
cctctgacagtccacag

SEQ ID NO: 4536153 - DNA, 16 bp, Homo sapiens
cctctgactcagggct

SEQ ID NO: 4536154 - DNA, 21 bp, Homo sapiens
cctctgactcagggctcctgg

SEQ ID NO: 4536155 - DNA, 16 bp, Homo sapiens
cctctgacttggggac

SEQ ID NO: 4536156 - DNA, 11 bp, Homo sapiens
cctctgagaag

SEQ ID NO: 4536157 - DNA, 21 bp, Homo sapiens
cctctgatcaaattggctaca

SEQ ID NO: 4536158 - DNA, 13 bp, Homo sapiens
cctctgcagtctc

SEQ ID NO: 4536159 - DNA, 16 bp, Homo sapiens
cctctgcagtgccttg

SEQ ID NO: 4536160 - DNA, 23 bp, Homo sapiens
cctctgcattgagcatattttct

SEQ ID NO: 4536161 - DNA, 14 bp, Homo sapiens
cctctgccacctcc

SEQ ID NO: 4536162 - DNA, 15 bp, Homo sapiens
cctctgccacctccc

SEQ ID NO: 4536163 - DNA, 23 bp, Homo sapiens
cctctgccagaagatcccctcag

SEQ ID NO: 4536164 - DNA, 14 bp, Homo sapiens
cctctgccagcgcc

SEQ ID NO: 4536165 - DNA, 12 bp, Homo sapiens
cctctgcccctg

SEQ ID NO: 4536166 - DNA, 14 bp, Homo sapiens
cctctgcccctgca

SEQ ID NO: 4536167 - DNA, 20 bp, Homo sapiens
cctctgcccctgcagctgga

SEQ ID NO: 4536168 - DNA, 12 bp, Homo sapiens
cctctgccctgg

SEQ ID NO: 4536169 - DNA, 19 bp, Homo sapiens
cctctgccgctgccatgct

SEQ ID NO: 4536170 - DNA, 10 bp, Homo sapiens
cctctgccta

SEQ ID NO: 4536171 - DNA, 12 bp, Homo sapiens
cctctgcctgcc

SEQ ID NO: 4536172 - DNA, 22 bp, Homo sapiens
cctctgccttgccctcctgggc

SEQ ID NO: 4536173 - DNA, 21 bp, Homo sapiens
cctctgctcaccgcccatcag

SEQ ID NO: 4536174 - DNA, 13 bp, Homo sapiens
cctctgctccctc

SEQ ID NO: 4536175 - DNA, 18 bp, Homo sapiens
cctctgctgcaacaagct

SEQ ID NO: 4536176 - DNA, 23 bp, Homo sapiens
cctctgctgcaacaagctcatcc

SEQ ID NO: 4536177 - DNA, 17 bp, Homo sapiens
cctctgctggagaaagc

SEQ ID NO: 4536178 - DNA, 12 bp, Homo sapiens
cctctgctggct

SEQ ID NO: 4536179 - DNA, 14 bp, Homo sapiens
cctctgctggctca

SEQ ID NO: 4536180 - DNA, 16 bp, Homo sapiens
cctctgctggctcagg

SEQ ID NO: 4536181 - DNA, 17 bp, Homo sapiens
cctctgctggctcagga

SEQ ID NO: 4536182 - DNA, 15 bp, Homo sapiens
cctctgcttctcatc

SEQ ID NO: 4536183 - DNA, 15 bp, Homo sapiens
cctctggacagccag

SEQ ID NO: 4536184 - DNA, 15 bp, Homo sapiens
cctctggactggcta

SEQ ID NO: 4536185 - DNA, 14 bp, Homo sapiens
cctctggcccctca

SEQ ID NO: 4536186 - DNA, 13 bp, Homo sapiens
cctctggccctgc

SEQ ID NO: 4536187 - DNA, 17 bp, Homo sapiens
cctctggccgcagaggt

SEQ ID NO: 4536188 - DNA, 22 bp, Homo sapiens
cctctggctagaggccagcccc

SEQ ID NO: 4536189 - DNA, 22 bp, Homo sapiens
cctctggctggctaactggaag

SEQ ID NO: 4536190 - DNA, 23 bp, Homo sapiens
cctctgggaaatgagaaggcagc

SEQ ID NO: 4536191 - DNA, 19 bp, Homo sapiens
cctctgggcacgcctgctg

SEQ ID NO: 4536192 - DNA, 21 bp, Homo sapiens
cctctggtaaacattcctcca

SEQ ID NO: 4536193 - DNA, 16 bp, Homo sapiens
cctctggttgcctccc

SEQ ID NO: 4536194 - DNA, 21 bp, Homo sapiens
cctctgtccaggcactgagat

SEQ ID NO: 4536195 - DNA, 22 bp, Homo sapiens
cctctgtccccttctctcatct

SEQ ID NO: 4536196 - DNA, 13 bp, Homo sapiens
cctctgtctgccc

SEQ ID NO: 4536197 - DNA, 17 bp, Homo sapiens
cctctgtgaactgtgtg

SEQ ID NO: 4536198 - DNA, 22 bp, Homo sapiens
cctctgtgaactgtgtgtgaat

SEQ ID NO: 4536199 - DNA, 19 bp, Homo sapiens
cctctgtgaccaatgtctt

SEQ ID NO: 4536200 - DNA, 21 bp, Homo sapiens
cctctgtgaccaatgtcttga

SEQ ID NO: 4536201 - DNA, 23 bp, Homo sapiens
cctctgttcagttcattcccaga

SEQ ID NO: 4536202 - DNA, 21 bp, Homo sapiens
cctcttagaagaatattgtat

SEQ ID NO: 4536203 - DNA, 13 bp, Homo sapiens
cctcttcaggcct

SEQ ID NO: 4536204 - DNA, 22 bp, Homo sapiens
cctcttcaggcctgctagtcac

SEQ ID NO: 4536205 - DNA, 13 bp, Homo sapiens
cctcttccccaga

SEQ ID NO: 4536206 - DNA, 22 bp, Homo sapiens
cctcttccccagaaaggagact

SEQ ID NO: 4536207 - DNA, 23 bp, Homo sapiens
cctcttcccttagcctctcccac

SEQ ID NO: 4536208 - DNA, 17 bp, Homo sapiens
cctcttccgactctttc

SEQ ID NO: 4536209 - DNA, 19 bp, Homo sapiens
cctcttccgactctttctg

SEQ ID NO: 4536210 - DNA, 14 bp, Homo sapiens
cctcttcctaccct

SEQ ID NO: 4536211 - DNA, 20 bp, Homo sapiens
cctcttctaaaatagcaata

SEQ ID NO: 4536212 - DNA, 23 bp, Homo sapiens
cctcttctaccctcatcatcata

SEQ ID NO: 4536213 - DNA, 18 bp, Homo sapiens
cctcttctcaactttttt

SEQ ID NO: 4536214 - DNA, 21 bp, Homo sapiens
cctcttctgctcttttcctgg

SEQ ID NO: 4536215 - DNA, 13 bp, Homo sapiens
cctcttctgggag

SEQ ID NO: 4536216 - DNA, 17 bp, Homo sapiens
cctcttctgggagggca

SEQ ID NO: 4536217 - DNA, 18 bp, Homo sapiens
cctcttctgggagggcag

SEQ ID NO: 4536218 - DNA, 20 bp, Homo sapiens
cctcttctttgtgcctttgg

SEQ ID NO: 4536219 - DNA, 22 bp, Homo sapiens
cctcttctttgtgcctttggcc

SEQ ID NO: 4536220 - DNA, 15 bp, Homo sapiens
cctcttgaccaggct

SEQ ID NO: 4536221 - DNA, 20 bp, Homo sapiens
cctcttgaccaggctgcctc

SEQ ID NO: 4536222 - DNA, 22 bp, Homo sapiens
cctcttggggagtttagggtgg

SEQ ID NO: 4536223 - DNA, 21 bp, Homo sapiens
cctcttgtgcaaggtggcctt

SEQ ID NO: 4536224 - DNA, 22 bp, Homo sapiens
cctcttgtgcaaggtggccttt

SEQ ID NO: 4536225 - DNA, 13 bp, Homo sapiens
cctctttaaaaca

SEQ ID NO: 4536226 - DNA, 15 bp, Homo sapiens
cctctttaaaacaaa

SEQ ID NO: 4536227 - DNA, 14 bp, Homo sapiens
cctctttccctgcg

SEQ ID NO: 4536228 - DNA, 16 bp, Homo sapiens
cctcttttacctgctg

SEQ ID NO: 4536229 - DNA, 21 bp, Homo sapiens
cctcttttacctgctgcttct

SEQ ID NO: 4536230 - DNA, 22 bp, Homo sapiens
cctcttttacctgctgcttctc

SEQ ID NO: 4536231 - DNA, 21 bp, Homo sapiens
cctcttttcctggcagctgct

SEQ ID NO: 4536232 - DNA, 23 bp, Homo sapiens
cctcttttcctggcagctgctgt

SEQ ID NO: 4536233 - DNA, 24 bp, Homo sapiens
cctcttttgcttgccaaagtacag

SEQ ID NO: 4536234 - DNA, 20 bp, Homo sapiens
cctctttttccatcataatt

SEQ ID NO: 4536235 - DNA, 13 bp, Homo sapiens
cctctttttcctc

SEQ ID NO: 4536236 - DNA, 13 bp, Homo sapiens
cctcttttttcgt

SEQ ID NO: 4536237 - DNA, 16 bp, Homo sapiens
cctgaaaacccagaga

SEQ ID NO: 4536238 - DNA, 21 bp, Homo sapiens
cctgaaaatgtttttctgcca

SEQ ID NO: 4536239 - DNA, 22 bp, Homo sapiens
cctgaaacccgccctcaggggc

SEQ ID NO: 4536240 - DNA, 23 bp, Homo sapiens
cctgaaacccgccctcaggggcc

SEQ ID NO: 4536241 - DNA, 20 bp, Homo sapiens
cctgaaacctagtactgccc

SEQ ID NO: 4536242 - DNA, 23 bp, Homo sapiens
cctgaaacctcttcctaggccac

SEQ ID NO: 4536243 - DNA, 18 bp, Homo sapiens
cctgaaatgacatttcac

SEQ ID NO: 4536244 - DNA, 19 bp, Homo sapiens
cctgaaatgacatttcact

SEQ ID NO: 4536245 - DNA, 14 bp, Homo sapiens
cctgaaatttcacc

SEQ ID NO: 4536246 - DNA, 19 bp, Homo sapiens
cctgaaccccagaggcaga

SEQ ID NO: 4536247 - DNA, 17 bp, Homo sapiens
cctgaactgaacaccat

SEQ ID NO: 4536248 - DNA, 18 bp, Homo sapiens
cctgaactgagccccagc

SEQ ID NO: 4536249 - DNA, 19 bp, Homo sapiens
cctgaactgagccccagcg

SEQ ID NO: 4536250 - DNA, 14 bp, Homo sapiens
cctgaactgaggag

SEQ ID NO: 4536251 - DNA, 13 bp, Homo sapiens
cctgaagctgctg

SEQ ID NO: 4536252 - DNA, 18 bp, Homo sapiens
cctgaagctgctgtgtcc

SEQ ID NO: 4536253 - DNA, 22 bp, Homo sapiens
cctgaaggcacagctaaccact

SEQ ID NO: 4536254 - DNA, 19 bp, Homo sapiens
cctgaagttgctgctgtga

SEQ ID NO: 4536255 - DNA, 18 bp, Homo sapiens
cctgaattctatttgctg

SEQ ID NO: 4536256 - DNA, 17 bp, Homo sapiens
cctgacacaccaggcgc

SEQ ID NO: 4536257 - DNA, 15 bp, Homo sapiens
cctgacagctctgtt

SEQ ID NO: 4536258 - DNA, 13 bp, Homo sapiens
cctgacagcttga

SEQ ID NO: 4536259 - DNA, 22 bp, Homo sapiens
cctgacaggtgaggtctgttcc

SEQ ID NO: 4536260 - DNA, 13 bp, Homo sapiens
cctgacattgtct

SEQ ID NO: 4536261 - DNA, 15 bp, Homo sapiens
cctgaccagctgctc

SEQ ID NO: 4536262 - DNA, 14 bp, Homo sapiens
cctgacccctgctc

SEQ ID NO: 4536263 - DNA, 16 bp, Homo sapiens
cctgacccctgctcag

SEQ ID NO: 4536264 - DNA, 22 bp, Homo sapiens
cctgaccctcatctttcttcca

SEQ ID NO: 4536265 - DNA, 15 bp, Homo sapiens
cctgaccctgctcct

SEQ ID NO: 4536266 - DNA, 13 bp, Homo sapiens
cctcctgcctcag

SEQ ID NO: 4536267 - DNA, 14 bp, Homo sapiens
cctcctgcctcagc

SEQ ID NO: 4536268 - DNA, 16 bp, Homo sapiens
cctcctgcctcagcct

SEQ ID NO: 4536269 - DNA, 12 bp, Homo sapiens
cctcctggacac

SEQ ID NO: 4536270 - DNA, 14 bp, Homo sapiens
cctcctgggccctg

SEQ ID NO: 4536271 - DNA, 15 bp, Homo sapiens
cctcctgggccctgg

SEQ ID NO: 4536272 - DNA, 19 bp, Homo sapiens
cctcctgggccctgggctg

SEQ ID NO: 4536273 - DNA, 14 bp, Homo sapiens
cctcctgggctcca

SEQ ID NO: 4536274 - DNA, 19 bp, Homo sapiens
cctcctggtgggtccaggg

SEQ ID NO: 4536275 - DNA, 20 bp, Homo sapiens
cctcctggtgggtccagggg

SEQ ID NO: 4536276 - DNA, 17 bp, Homo sapiens
cctcctgtacctcagtg

SEQ ID NO: 4536277 - DNA, 23 bp, Homo sapiens
cctcctgtcagtgaggactcttt

SEQ ID NO: 4536278 - DNA, 16 bp, Homo sapiens
cctcctgtcttcccag

SEQ ID NO: 4536279 - DNA, 14 bp, Homo sapiens
cctcctgtgcctgg

SEQ ID NO: 4536280 - DNA, 19 bp, Homo sapiens
cctcctgtgcctggcccca

SEQ ID NO: 4536281 - DNA, 20 bp, Homo sapiens
cctcctgtgcctggccccag

SEQ ID NO: 4536282 - DNA, 23 bp, Homo sapiens
cctcctgtgcctggccccagcct

SEQ ID NO: 4536283 - DNA, 17 bp, Homo sapiens
cctcctgtgtactgtgt

SEQ ID NO: 4536284 - DNA, 19 bp, Homo sapiens
cctcctgttgcacccagcc

SEQ ID NO: 4536285 - DNA, 14 bp, Homo sapiens
cctccttaatttaa

SEQ ID NO: 4536286 - DNA, 18 bp, Homo sapiens
cctccttagccctgtctg

SEQ ID NO: 4536287 - DNA, 13 bp, Homo sapiens
cctccttccccag

SEQ ID NO: 4536288 - DNA, 16 bp, Homo sapiens
cctccttccccagacc

SEQ ID NO: 4536289 - DNA, 17 bp, Homo sapiens
cctccttgcccagacta

SEQ ID NO: 4536290 - DNA, 16 bp, Homo sapiens
cctccttggtgcctct

SEQ ID NO: 4536291 - DNA, 18 bp, Homo sapiens
cctccttggtgcctctgg

SEQ ID NO: 4536292 - DNA, 15 bp, Homo sapiens
cctccttgtccaccc

SEQ ID NO: 4536293 - DNA, 19 bp, Homo sapiens
cctcctttagtaaaactcc

SEQ ID NO: 4536294 - DNA, 18 bp, Homo sapiens
cctcctttcctcctctga

SEQ ID NO: 4536295 - DNA, 15 bp, Homo sapiens
cctccttttaaaatt

SEQ ID NO: 4536296 - DNA, 17 bp, Homo sapiens
cctccttttcttcaccc

SEQ ID NO: 4536297 - DNA, 15 bp, Homo sapiens
cctccttttggcctg

SEQ ID NO: 4536298 - DNA, 19 bp, Homo sapiens
cctcgacagggcctggagc

SEQ ID NO: 4536299 - DNA, 22 bp, Homo sapiens
cctcgacagggcctggagcccc

SEQ ID NO: 4536300 - DNA, 14 bp, Homo sapiens
cctcgaccctgtgc

SEQ ID NO: 4536301 - DNA, 15 bp, Homo sapiens
cctcgaccctgtgca

SEQ ID NO: 4536302 - DNA, 13 bp, Homo sapiens
cctcgagtactgt

SEQ ID NO: 4536303 - DNA, 17 bp, Homo sapiens
cctcgagtactgtgggc

SEQ ID NO: 4536304 - DNA, 18 bp, Homo sapiens
cctcgagtttctggtaag

SEQ ID NO: 4536305 - DNA, 15 bp, Homo sapiens
cctcgccccagcctc

SEQ ID NO: 4536306 - DNA, 14 bp, Homo sapiens
cctcgctgccagct

SEQ ID NO: 4536307 - DNA, 17 bp, Homo sapiens
cctcgctggactctcag

SEQ ID NO: 4536308 - DNA, 18 bp, Homo sapiens
cctcgctggactctcagt

SEQ ID NO: 4536309 - DNA, 16 bp, Homo sapiens
cctcggacagagcccc

SEQ ID NO: 4536310 - DNA, 23 bp, Homo sapiens
cctcggacagagcccccctagca

SEQ ID NO: 4536311 - DNA, 18 bp, Homo sapiens
cctcggactgtgtgcagg

SEQ ID NO: 4536312 - DNA, 14 bp, Homo sapiens
cctcggagaagagc

SEQ ID NO: 4536313 - DNA, 19 bp, Homo sapiens
cctcggagagcagcagcac

SEQ ID NO: 4536314 - DNA, 16 bp, Homo sapiens
cctcgggcccagcccc

SEQ ID NO: 4536315 - DNA, 18 bp, Homo sapiens
cctcgggccccatcctca

SEQ ID NO: 4536316 - DNA, 15 bp, Homo sapiens
cctcgggtctcctca

SEQ ID NO: 4536317 - DNA, 17 bp, Homo sapiens
cctcgggtctcctcact

SEQ ID NO: 4536318 - DNA, 22 bp, Homo sapiens
cctcgtcaagagcatgcacatg

SEQ ID NO: 4536319 - DNA, 20 bp, Homo sapiens
cctcgtcctccccctgccag

SEQ ID NO: 4536320 - DNA, 16 bp, Homo sapiens
cctcgtgatgggcccg

SEQ ID NO: 4536321 - DNA, 13 bp, Homo sapiens
cctctaaccccag

SEQ ID NO: 4536322 - DNA, 15 bp, Homo sapiens
cctctaaccccaggc

SEQ ID NO: 4536323 - DNA, 16 bp, Homo sapiens
cctctaaccccaggcc

SEQ ID NO: 4536324 - DNA, 18 bp, Homo sapiens
cctctaaccccaggcccc

SEQ ID NO: 4536325 - DNA, 21 bp, Homo sapiens
cctctaaccccaggccccgag

SEQ ID NO: 4536326 - DNA, 16 bp, Homo sapiens
cctctaagctgctcta

SEQ ID NO: 4536327 - DNA, 21 bp, Homo sapiens
cctctacagagcttccctgac

SEQ ID NO: 4536328 - DNA, 21 bp, Homo sapiens
cctctacagccgtcccgcgtt

SEQ ID NO: 4536329 - DNA, 15 bp, Homo sapiens
cctctagaagccaag

SEQ ID NO: 4536330 - DNA, 22 bp, Homo sapiens
cctctagagccttcagccttaa

SEQ ID NO: 4536331 - DNA, 18 bp, Homo sapiens
cctctagttgagtttctg

SEQ ID NO: 4536332 - DNA, 22 bp, Homo sapiens
cctctatcatggtgaaaagctc

SEQ ID NO: 4536333 - DNA, 22 bp, Homo sapiens
cctctatggaaggaggcctcca

SEQ ID NO: 4536334 - DNA, 20 bp, Homo sapiens
cctctattgatgtacagtct

SEQ ID NO: 4536335 - DNA, 23 bp, Homo sapiens
cctctattgatgtacagtctgtc

SEQ ID NO: 4536336 - DNA, 18 bp, Homo sapiens
cctctcaaattcagctct

SEQ ID NO: 4536337 - DNA, 20 bp, Homo sapiens
cctctcacctgccgtgcgta

SEQ ID NO: 4536338 - DNA, 17 bp, Homo sapiens
cctctcagaggcctgct

SEQ ID NO: 4536339 - DNA, 22 bp, Homo sapiens
cctctcagaggcctgctgccag

SEQ ID NO: 4536340 - DNA, 13 bp, Homo sapiens
cctctcagagtga

SEQ ID NO: 4536341 - DNA, 17 bp, Homo sapiens
cctctcagagtgacagt

SEQ ID NO: 4536342 - DNA, 18 bp, Homo sapiens
cctctcattccagaggaa

SEQ ID NO: 4536343 - DNA, 22 bp, Homo sapiens
cctctccaagacagcagcagcc

SEQ ID NO: 4536344 - DNA, 20 bp, Homo sapiens
cctctccatatctccttccc

SEQ ID NO: 4536345 - DNA, 19 bp, Homo sapiens
cctctcccacagagtgctg

SEQ ID NO: 4536346 - DNA, 22 bp, Homo sapiens
cctctcccacccggccacagct

SEQ ID NO: 4536347 - DNA, 23 bp, Homo sapiens
cctctcccacccggccacagctg

SEQ ID NO: 4536348 - DNA, 24 bp, Homo sapiens
cctctcccacccggccacagctgc

SEQ ID NO: 4536349 - DNA, 21 bp, Homo sapiens
cctctccccaatccatgcttc

SEQ ID NO: 4536350 - DNA, 23 bp, Homo sapiens
cctctccccaatccatgcttcac

SEQ ID NO: 4536351 - DNA, 13 bp, Homo sapiens
cctctccccagga

SEQ ID NO: 4536352 - DNA, 22 bp, Homo sapiens
cctctccccctcctccagggaa

SEQ ID NO: 4536353 - DNA, 12 bp, Homo sapiens
cctctccctgcc

SEQ ID NO: 4536354 - DNA, 13 bp, Homo sapiens
cctctccctgcct

SEQ ID NO: 4536355 - DNA, 15 bp, Homo sapiens
cctctccctgctgct

SEQ ID NO: 4536356 - DNA, 21 bp, Homo sapiens
cctctccctgtgttctgggct

SEQ ID NO: 4536357 - DNA, 22 bp, Homo sapiens
cctctccctgtgttctgggctg

SEQ ID NO: 4536358 - DNA, 16 bp, Homo sapiens
cctctccgactctgca

SEQ ID NO: 4536359 - DNA, 13 bp, Homo sapiens
cctctcctgaccc

SEQ ID NO: 4536360 - DNA, 16 bp, Homo sapiens
cctctcctgacccctg

SEQ ID NO: 4536361 - DNA, 14 bp, Homo sapiens
cctctcctgccctg

SEQ ID NO: 4536362 - DNA, 14 bp, Homo sapiens
cctctcctgcctac

SEQ ID NO: 4536363 - DNA, 17 bp, Homo sapiens
cctctcctgcctactca

SEQ ID NO: 4536364 - DNA, 11 bp, Homo sapiens
cctctcctgga

SEQ ID NO: 4536365 - DNA, 15 bp, Homo sapiens
cctctcctggaggat

SEQ ID NO: 4536366 - DNA, 12 bp, Homo sapiens
cctctcctgggg

SEQ ID NO: 4536367 - DNA, 23 bp, Homo sapiens
cctctccttcatgacagcctcca

SEQ ID NO: 4536368 - DNA, 13 bp, Homo sapiens
cctctccttccta

SEQ ID NO: 4536369 - DNA, 15 bp, Homo sapiens
cctctcgccccatcc

SEQ ID NO: 4536370 - DNA, 16 bp, Homo sapiens
cctctcgccccatccc

SEQ ID NO: 4536371 - DNA, 15 bp, Homo sapiens
cctctcggccaggca

SEQ ID NO: 4536372 - DNA, 13 bp, Homo sapiens
cctctctagggac

SEQ ID NO: 4536373 - DNA, 14 bp, Homo sapiens
cctctctagggacc

SEQ ID NO: 4536374 - DNA, 17 bp, Homo sapiens
cctctctagggacccct

SEQ ID NO: 4536375 - DNA, 14 bp, Homo sapiens
cctctctcccagtc

SEQ ID NO: 4536376 - DNA, 16 bp, Homo sapiens
cctctctccctgcctc

SEQ ID NO: 4536377 - DNA, 19 bp, Homo sapiens
cctctctcctgcctgccct

SEQ ID NO: 4536378 - DNA, 21 bp, Homo sapiens
cctctctctcactcccctctc

SEQ ID NO: 4536379 - DNA, 16 bp, Homo sapiens
cctctctcttctgctc

SEQ ID NO: 4536380 - DNA, 19 bp, Homo sapiens
cctctctcttctgctccac

SEQ ID NO: 4536381 - DNA, 13 bp, Homo sapiens
cctctctcttttc

SEQ ID NO: 4536382 - DNA, 22 bp, Homo sapiens
cctctctcttttctacacactc

SEQ ID NO: 4536383 - DNA, 16 bp, Homo sapiens
cctctctgatgtccca

SEQ ID NO: 4536384 - DNA, 20 bp, Homo sapiens
cctctctgatgtcccagtgc

SEQ ID NO: 4536385 - DNA, 21 bp, Homo sapiens
cctctctgcagacttcccagc

SEQ ID NO: 4536386 - DNA, 18 bp, Homo sapiens
cccttgccaccccaccct

SEQ ID NO: 4536387 - DNA, 15 bp, Homo sapiens
cccttgcctccccat

SEQ ID NO: 4536388 - DNA, 16 bp, Homo sapiens
cccttgcctctgccct

SEQ ID NO: 4536389 - DNA, 22 bp, Homo sapiens
cccttgcctctgccctggattg

SEQ ID NO: 4536390 - DNA, 15 bp, Homo sapiens
cccttgctgtgaatt

SEQ ID NO: 4536391 - DNA, 13 bp, Homo sapiens
cccttggcctcag

SEQ ID NO: 4536392 - DNA, 19 bp, Homo sapiens
cccttggcctgtctcatcc

SEQ ID NO: 4536393 - DNA, 20 bp, Homo sapiens
cccttggtcctggcagggcg

SEQ ID NO: 4536394 - DNA, 17 bp, Homo sapiens
cccttgtgagagcccat

SEQ ID NO: 4536395 - DNA, 13 bp, Homo sapiens
cccttgtttataa

SEQ ID NO: 4536396 - DNA, 12 bp, Homo sapiens
ccctttactcgt

SEQ ID NO: 4536397 - DNA, 16 bp, Homo sapiens
ccctttcacactggat

SEQ ID NO: 4536398 - DNA, 19 bp, Homo sapiens
ccctttcagatgtcttctg

SEQ ID NO: 4536399 - DNA, 14 bp, Homo sapiens
ccctttcctcctca

SEQ ID NO: 4536400 - DNA, 17 bp, Homo sapiens
ccctttcctcctcaggc

SEQ ID NO: 4536401 - DNA, 13 bp, Homo sapiens
ccctttcctgcgg

SEQ ID NO: 4536402 - DNA, 18 bp, Homo sapiens
ccctttccttccttccct

SEQ ID NO: 4536403 - DNA, 21 bp, Homo sapiens
ccctttccttccttccctggc

SEQ ID NO: 4536404 - DNA, 14 bp, Homo sapiens
ccctttctcccctg

SEQ ID NO: 4536405 - DNA, 13 bp, Homo sapiens
ccctttctctctc

SEQ ID NO: 4536406 - DNA, 14 bp, Homo sapiens
ccctttctctctcc

SEQ ID NO: 4536407 - DNA, 18 bp, Homo sapiens
ccctttctctctcctctc

SEQ ID NO: 4536408 - DNA, 15 bp, Homo sapiens
ccctttctgtcccac

SEQ ID NO: 4536409 - DNA, 14 bp, Homo sapiens
ccctttgagtgcag

SEQ ID NO: 4536410 - DNA, 17 bp, Homo sapiens
ccctttgggcccaggga

SEQ ID NO: 4536411 - DNA, 17 bp, Homo sapiens
ccctttgtctttcaaac

SEQ ID NO: 4536412 - DNA, 19 bp, Homo sapiens
cccttttccatcctccaaa

SEQ ID NO: 4536413 - DNA, 13 bp, Homo sapiens
cccttttctgttc

SEQ ID NO: 4536414 - DNA, 14 bp, Homo sapiens
ccctttttcaatga

SEQ ID NO: 4536415 - DNA, 14 bp, Homo sapiens
cccttttttctgcc

SEQ ID NO: 4536416 - DNA, 17 bp, Homo sapiens
ccgaagccatcacttct

SEQ ID NO: 4536417 - DNA, 23 bp, Homo sapiens
ccgaatctctttttgctttcgaa

SEQ ID NO: 4536418 - DNA, 20 bp, Homo sapiens
ccgaatttggtacacatgtg

SEQ ID NO: 4536419 - DNA, 17 bp, Homo sapiens
ccgaccacttccagggg

SEQ ID NO: 4536420 - DNA, 22 bp, Homo sapiens
ccgacctcgtcctccccctgcc

SEQ ID NO: 4536421 - DNA, 23 bp, Homo sapiens
ccgacctcgtcctccccctgcca

SEQ ID NO: 4536422 - DNA, 23 bp, Homo sapiens
ccgaccttccctccgccttctcc

SEQ ID NO: 4536423 - DNA, 22 bp, Homo sapiens
ccgacgacacatatacatatga

SEQ ID NO: 4536424 - DNA, 10 bp, Homo sapiens
ccgactccag

SEQ ID NO: 4536425 - DNA, 14 bp, Homo sapiens
ccgactccagccag

SEQ ID NO: 4536426 - DNA, 19 bp, Homo sapiens
ccgactctttctgagtgcc

SEQ ID NO: 4536427 - DNA, 21 bp, Homo sapiens
ccgactctttctgagtgcctt

SEQ ID NO: 4536428 - DNA, 18 bp, Homo sapiens
ccgactgactggaggagg

SEQ ID NO: 4536429 - DNA, 12 bp, Homo sapiens
ccgactgcccag

SEQ ID NO: 4536430 - DNA, 14 bp, Homo sapiens
ccgactgggctcaa

SEQ ID NO: 4536431 - DNA, 24 bp, Homo sapiens
ccgacttggagactcctggtctgt

SEQ ID NO: 4536432 - DNA, 15 bp, Homo sapiens
ccgagacactttata

SEQ ID NO: 4536433 - DNA, 13 bp, Homo sapiens
ccgagactcagcc

SEQ ID NO: 4536434 - DNA, 16 bp, Homo sapiens
ccgagactcagcctct

SEQ ID NO: 4536435 - DNA, 18 bp, Homo sapiens
ccgagactcagcctctgc

SEQ ID NO: 4536436 - DNA, 20 bp, Homo sapiens
ccgagactcagcctctgctg

SEQ ID NO: 4536437 - DNA, 22 bp, Homo sapiens
ccgagactcagcctctgctgga

SEQ ID NO: 4536438 - DNA, 23 bp, Homo sapiens
ccgagactcagcctctgctggag

SEQ ID NO: 4536439 - DNA, 15 bp, Homo sapiens
ccgagagcctgctcc

SEQ ID NO: 4536440 - DNA, 13 bp, Homo sapiens
ccgagagggagag

SEQ ID NO: 4536441 - DNA, 21 bp, Homo sapiens
ccgagcaccgtgtcgggcagg

SEQ ID NO: 4536442 - DNA, 18 bp, Homo sapiens
ccgagcggtgtggggacc

SEQ ID NO: 4536443 - DNA, 14 bp, Homo sapiens
ccgagctgtttatg

SEQ ID NO: 4536444 - DNA, 17 bp, Homo sapiens
ccgaggacccagaccca

SEQ ID NO: 4536445 - DNA, 18 bp, Homo sapiens
ccgaggagctgggcccct

SEQ ID NO: 4536446 - DNA, 23 bp, Homo sapiens
ccgaggagctgggcccctgcaca

SEQ ID NO: 4536447 - DNA, 15 bp, Homo sapiens
ccgaggctacagctc

SEQ ID NO: 4536448 - DNA, 16 bp, Homo sapiens
ccgaggctacagctcc

SEQ ID NO: 4536449 - DNA, 13 bp, Homo sapiens
ccgaggctccccg

SEQ ID NO: 4536450 - DNA, 14 bp, Homo sapiens
ccgaggctgctaga

SEQ ID NO: 4536451 - DNA, 11 bp, Homo sapiens
ccgagggctgg

SEQ ID NO: 4536452 - DNA, 12 bp, Homo sapiens
ccgagggctggc

SEQ ID NO: 4536453 - DNA, 13 bp, Homo sapiens
ccgagggctggcc

SEQ ID NO: 4536454 - DNA, 16 bp, Homo sapiens
ccgagggggctgctcc

SEQ ID NO: 4536455 - DNA, 18 bp, Homo sapiens
ccgagggggctgctccca

SEQ ID NO: 4536456 - DNA, 19 bp, Homo sapiens
ccgagggggctgctcccac

SEQ ID NO: 4536457 - DNA, 16 bp, Homo sapiens
ccgagggtcctggctc

SEQ ID NO: 4536458 - DNA, 17 bp, Homo sapiens
ccgagggtcctggctcc

SEQ ID NO: 4536459 - DNA, 14 bp, Homo sapiens
ccgaggttcccagg

SEQ ID NO: 4536460 - DNA, 14 bp, Homo sapiens
ccgagtctccggga

SEQ ID NO: 4536461 - DNA, 17 bp, Homo sapiens
ccgatatcagaatttgt

SEQ ID NO: 4536462 - DNA, 14 bp, Homo sapiens
ccgatattctccct

SEQ ID NO: 4536463 - DNA, 13 bp, Homo sapiens
ccgatgccaccgg

SEQ ID NO: 4536464 - DNA, 19 bp, Homo sapiens
ccgatgccaccggcctgtg

SEQ ID NO: 4536465 - DNA, 16 bp, Homo sapiens
ccgcacgactgcggga

SEQ ID NO: 4536466 - DNA, 20 bp, Homo sapiens
ccgcagacggtctgtgtgct

SEQ ID NO: 4536467 - DNA, 12 bp, Homo sapiens
ccgcagagactg

SEQ ID NO: 4536468 - DNA, 22 bp, Homo sapiens
ccgcagaggatccatcacagac

SEQ ID NO: 4536469 - DNA, 16 bp, Homo sapiens
ccgcagcccgcctgcc

SEQ ID NO: 4536470 - DNA, 17 bp, Homo sapiens
ccgcagcccgcctgccg

SEQ ID NO: 4536471 - DNA, 18 bp, Homo sapiens
ccgcaggaactgggctgg

SEQ ID NO: 4536472 - DNA, 20 bp, Homo sapiens
ccgcaggaactgggctgggc

SEQ ID NO: 4536473 - DNA, 14 bp, Homo sapiens
ccgcatcacctcac

SEQ ID NO: 4536474 - DNA, 12 bp, Homo sapiens
ccgcatcttctc

SEQ ID NO: 4536475 - DNA, 15 bp, Homo sapiens
ccgcatcttctccat

SEQ ID NO: 4536476 - DNA, 22 bp, Homo sapiens
ccgcatgtgtgcctggccgcag

SEQ ID NO: 4536477 - DNA, 14 bp, Homo sapiens
ccgcattccctgag

SEQ ID NO: 4536478 - DNA, 15 bp, Homo sapiens
ccgcattccctgagt

SEQ ID NO: 4536479 - DNA, 16 bp, Homo sapiens
ccgcattggtgactca

SEQ ID NO: 4536480 - DNA, 11 bp, Homo sapiens
ccgccacagcc

SEQ ID NO: 4536481 - DNA, 14 bp, Homo sapiens
ccgccacagccttc

SEQ ID NO: 4536482 - DNA, 15 bp, Homo sapiens
ccgccagcctcctct

SEQ ID NO: 4536483 - DNA, 18 bp, Homo sapiens
ccgccagcctcctctgga

SEQ ID NO: 4536484 - DNA, 14 bp, Homo sapiens
ccgccagctgggag

SEQ ID NO: 4536485 - DNA, 11 bp, Homo sapiens
ccgccagggct

SEQ ID NO: 4536486 - DNA, 15 bp, Homo sapiens
ccgccatagccccag

SEQ ID NO: 4536487 - DNA, 16 bp, Homo sapiens
ccgccatagccccagt

SEQ ID NO: 4536488 - DNA, 12 bp, Homo sapiens
ccgccccagagt

SEQ ID NO: 4536489 - DNA, 13 bp, Homo sapiens
ccgcccctgggga

SEQ ID NO: 4536490 - DNA, 18 bp, Homo sapiens
ccgccctgggctgtctgt

SEQ ID NO: 4536491 - DNA, 20 bp, Homo sapiens
ccgccctgggctgtctgtca

SEQ ID NO: 4536492 - DNA, 14 bp, Homo sapiens
ccgccgccgccgcc

SEQ ID NO: 4536493 - DNA, 15 bp, Homo sapiens
ccgccgcctcccacg

SEQ ID NO: 4536494 - DNA, 14 bp, Homo sapiens
ccgccgtgccggcg

SEQ ID NO: 4536495 - DNA, 17 bp, Homo sapiens
ccgccgtgccggcggca

SEQ ID NO: 4536496 - DNA, 12 bp, Homo sapiens
ccgcctccactc

SEQ ID NO: 4536497 - DNA, 14 bp, Homo sapiens
ccgcctccactcta

SEQ ID NO: 4536498 - DNA, 14 bp, Homo sapiens
ccgcctccctctca

SEQ ID NO: 4536499 - DNA, 23 bp, Homo sapiens
ccgcctcgacctccccacccgct

SEQ ID NO: 4536500 - DNA, 15 bp, Homo sapiens
ccgcctgcccagact

SEQ ID NO: 4536501 - DNA, 24 bp, Homo sapiens
ccgcctgggtcatgggcctgtggg

SEQ ID NO: 4536502 - DNA, 15 bp, Homo sapiens
ccgccttgcccagcc

SEQ ID NO: 4536503 - DNA, 16 bp, Homo sapiens
ccgccttgcccagcct

SEQ ID NO: 4536504 - DNA, 22 bp, Homo sapiens
ccgcgccaaataatgtctctgt

SEQ ID NO: 4536505 - DNA, 16 bp, Homo sapiens
ccgcgctcgcccagca

SEQ ID NO: 4536506 - DNA, 19 bp, Homo sapiens
ccgcgctcgcccagcagga

SEQ ID NO: 4536507 - DNA, 14 bp, Homo sapiens
ccgcgggccaggag

SEQ ID NO: 4536508 - DNA, 16 bp, Homo sapiens
ccgcgggccaggaggc

SEQ ID NO: 4536509 - DNA, 18 bp, Homo sapiens
ccgcggggaagctggctt

SEQ ID NO: 4536510 - DNA, 14 bp, Homo sapiens
ccgcgtcccagctc

SEQ ID NO: 4536511 - DNA, 17 bp, Homo sapiens
ccgcgtcccagctcccc

SEQ ID NO: 4536512 - DNA, 15 bp, Homo sapiens
ccgcgtcccggcaag

SEQ ID NO: 4536513 - DNA, 22 bp, Homo sapiens
ccgcgttcaagacttgagcgga

SEQ ID NO: 4536514 - DNA, 15 bp, Homo sapiens
ccgctcccacagctt

SEQ ID NO: 4536515 - DNA, 19 bp, Homo sapiens
ccgctcccacagcttcctg

SEQ ID NO: 4536516 - DNA, 23 bp, Homo sapiens
ccgctcccacagcttcctgaggg

SEQ ID NO: 4536517 - DNA, 15 bp, Homo sapiens
ccgctcccgctccca

SEQ ID NO: 4536518 - DNA, 17 bp, Homo sapiens
ccgctcccgctcccagg

SEQ ID NO: 4536519 - DNA, 20 bp, Homo sapiens
ccgctctgcatgcggcccag

SEQ ID NO: 4536520 - DNA, 23 bp, Homo sapiens
ccgctgagcgaggagatgctcct

SEQ ID NO: 4536521 - DNA, 21 bp, Homo sapiens
ccgctgagcgcccccgagccc

SEQ ID NO: 4536522 - DNA, 23 bp, Homo sapiens
ccgctgagcgcccccgagccctg

SEQ ID NO: 4536523 - DNA, 18 bp, Homo sapiens
ccgctgaggggtctcgga

SEQ ID NO: 4536524 - DNA, 16 bp, Homo sapiens
ccgctgccacccgccc

SEQ ID NO: 4536525 - DNA, 13 bp, Homo sapiens
ccgctgccagcct

SEQ ID NO: 4536526 - DNA, 18 bp, Homo sapiens
ccgctgccgctgcaccac

SEQ ID NO: 4536527 - DNA, 22 bp, Homo sapiens
ccgctgcctcgtagagtgacct

SEQ ID NO: 4536528 - DNA, 14 bp, Homo sapiens
ccgctgctgtgctc

SEQ ID NO: 4536529 - DNA, 15 bp, Homo sapiens
ccgctgctgtgctct

SEQ ID NO: 4536530 - DNA, 14 bp, Homo sapiens
ccgctggcccttag

SEQ ID NO: 4536531 - DNA, 15 bp, Homo sapiens
ccgctggcccttaga

SEQ ID NO: 4536532 - DNA, 16 bp, Homo sapiens
ccgctgtcgccccagg

SEQ ID NO: 4536533 - DNA, 19 bp, Homo sapiens
ccgctgtcgccccaggccc

SEQ ID NO: 4536534 - DNA, 18 bp, Homo sapiens
ccgctgtggccggtgcca

SEQ ID NO: 4536535 - DNA, 21 bp, Homo sapiens
ccgctgtggccggtgccagct

SEQ ID NO: 4536536 - DNA, 14 bp, Homo sapiens
ccgctgttcaccca

SEQ ID NO: 4536537 - DNA, 14 bp, Homo sapiens
ccgcttgctcgctt

SEQ ID NO: 4536538 - DNA, 18 bp, Homo sapiens
ccgcttgctcgcttgctg

SEQ ID NO: 4536539 - DNA, 15 bp, Homo sapiens
ccgcttggagcagag

SEQ ID NO: 4536540 - DNA, 19 bp, Homo sapiens
ccgcttgtccagcgcctag

SEQ ID NO: 4536541 - DNA, 13 bp, Homo sapiens
ccggaactgggct

SEQ ID NO: 4536542 - DNA, 20 bp, Homo sapiens
ccggagcaggggtctgagcc

SEQ ID NO: 4536543 - DNA, 22 bp, Homo sapiens
ccggaggactgagcccccaccg

SEQ ID NO: 4536544 - DNA, 14 bp, Homo sapiens
ccggcaagccacag

SEQ ID NO: 4536545 - DNA, 18 bp, Homo sapiens
ccggcaagcgagcacagt

SEQ ID NO: 4536546 - DNA, 17 bp, Homo sapiens
ccggcagggcccccaat

SEQ ID NO: 4536547 - DNA, 21 bp, Homo sapiens
ccggcagggcccccaataaac

SEQ ID NO: 4536548 - DNA, 16 bp, Homo sapiens
ccggcagggcgggcag

SEQ ID NO: 4536549 - DNA, 14 bp, Homo sapiens
ccggcatggctggg

SEQ ID NO: 4536550 - DNA, 21 bp, Homo sapiens
ccggccacacccctctgctgc

SEQ ID NO: 4536551 - DNA, 14 bp, Homo sapiens
ccggccacagctgc

SEQ ID NO: 4536552 - DNA, 15 bp, Homo sapiens
ccggccacagctgct

SEQ ID NO: 4536553 - DNA, 14 bp, Homo sapiens
ccggcccagatgtg

SEQ ID NO: 4536554 - DNA, 13 bp, Homo sapiens
ccggcccagtgcc

SEQ ID NO: 4536555 - DNA, 16 bp, Homo sapiens
ccggcccagtgccact

SEQ ID NO: 4536556 - DNA, 18 bp, Homo sapiens
ccggccccagtacacagg

SEQ ID NO: 4536557 - DNA, 21 bp, Homo sapiens
ccggccccccgcgctcgccca

SEQ ID NO: 4536558 - DNA, 22 bp, Homo sapiens
ccggccccgtctctcttggacc

SEQ ID NO: 4536559 - DNA, 14 bp, Homo sapiens
ccggcccggctgag

SEQ ID NO: 4536560 - DNA, 20 bp, Homo sapiens
ccggcccggctgagccctgc

SEQ ID NO: 4536561 - DNA, 13 bp, Homo sapiens
ccggccctccaga

SEQ ID NO: 4536562 - DNA, 16 bp, Homo sapiens
ccggccctccagagcc

SEQ ID NO: 4536563 - DNA, 24 bp, Homo sapiens
ccggccctgggctcggaggctgcc

SEQ ID NO: 4536564 - DNA, 15 bp, Homo sapiens
ccggccgtggaagga

SEQ ID NO: 4536565 - DNA, 21 bp, Homo sapiens
ccggccgtggaaggagggatg

SEQ ID NO: 4536566 - DNA, 21 bp, Homo sapiens
ccggcctcctcctcacccttc

SEQ ID NO: 4536567 - DNA, 17 bp, Homo sapiens
ccggcctctccctgcct

SEQ ID NO: 4536568 - DNA, 13 bp, Homo sapiens
ccggcgccgggca

SEQ ID NO: 4536569 - DNA, 23 bp, Homo sapiens
ccggcggaattcaccagtgttcc

SEQ ID NO: 4536570 - DNA, 13 bp, Homo sapiens
ccggcgtcagcct

SEQ ID NO: 4536571 - DNA, 15 bp, Homo sapiens
ccggcgtcagcctcc

SEQ ID NO: 4536572 - DNA, 16 bp, Homo sapiens
ccggcgtcagcctcca

SEQ ID NO: 4536573 - DNA, 14 bp, Homo sapiens
ccggctacatcagc

SEQ ID NO: 4536574 - DNA, 21 bp, Homo sapiens
ccggctccccctccagccaga

SEQ ID NO: 4536575 - DNA, 15 bp, Homo sapiens
ccggctctgtgggtg

SEQ ID NO: 4536576 - DNA, 19 bp, Homo sapiens
ccggctggttgtgggcact

SEQ ID NO: 4536577 - DNA, 16 bp, Homo sapiens
ccggctgtgctgggag

SEQ ID NO: 4536578 - DNA, 17 bp, Homo sapiens
ccggctgtttcctgaca

SEQ ID NO: 4536579 - DNA, 24 bp, Homo sapiens
ccggctgtttcctgacagatgcct

SEQ ID NO: 4536580 - DNA, 21 bp, Homo sapiens
ccgggaccaccctgagccggc

SEQ ID NO: 4536581 - DNA, 14 bp, Homo sapiens
ccgggactgctgct

SEQ ID NO: 4536582 - DNA, 20 bp, Homo sapiens
ccgggagcctccccctcaga

SEQ ID NO: 4536583 - DNA, 22 bp, Homo sapiens
ccgggagcctccccctcagatg

SEQ ID NO: 4536584 - DNA, 21 bp, Homo sapiens
ccgggagctgggccctgcctg

SEQ ID NO: 4536585 - DNA, 22 bp, Homo sapiens
ccgggagctgggccctgcctgc

SEQ ID NO: 4536586 - DNA, 17 bp, Homo sapiens
ccgggatattatagaaa

SEQ ID NO: 4536587 - DNA, 13 bp, Homo sapiens
ccgggcacagtgg

SEQ ID NO: 4536588 - DNA, 20 bp, Homo sapiens
ccgggcaggcaagggctctg

SEQ ID NO: 4536589 - DNA, 15 bp, Homo sapiens
ccgggcaggtcctgc

SEQ ID NO: 4536590 - DNA, 19 bp, Homo sapiens
ccgggcaggtcctgcccat

SEQ ID NO: 4536591 - DNA, 21 bp, Homo sapiens
ccgggcatggtggcaggcgcc

SEQ ID NO: 4536592 - DNA, 21 bp, Homo sapiens
ccgggcgcggtggcgggcacc

SEQ ID NO: 4536593 - DNA, 16 bp, Homo sapiens
ccgggctgggcccctc

SEQ ID NO: 4536594 - DNA, 15 bp, Homo sapiens
ccggggccccctggt

SEQ ID NO: 4536595 - DNA, 17 bp, Homo sapiens
ccggggcctggacaggc

SEQ ID NO: 4536596 - DNA, 19 bp, Homo sapiens
ccggggctggcggctactc

SEQ ID NO: 4536597 - DNA, 13 bp, Homo sapiens
ccgggggacagag

SEQ ID NO: 4536598 - DNA, 14 bp, Homo sapiens
ccgggggacagagg

SEQ ID NO: 4536599 - DNA, 14 bp, Homo sapiens
ccgggggagcccag

SEQ ID NO: 4536600 - DNA, 16 bp, Homo sapiens
ccggggggtctcttct

SEQ ID NO: 4536601 - DNA, 22 bp, Homo sapiens
ccgggtcatctgtacctctgcc

SEQ ID NO: 4536602 - DNA, 16 bp, Homo sapiens
ccgggtgtggcctcag

SEQ ID NO: 4536603 - DNA, 18 bp, Homo sapiens
ccgggtgtggcctcagcc

SEQ ID NO: 4536604 - DNA, 21 bp, Homo sapiens
ccggtcagccaagtgcagagt

SEQ ID NO: 4536605 - DNA, 13 bp, Homo sapiens
ccggtcagtgcct

SEQ ID NO: 4536606 - DNA, 20 bp, Homo sapiens
ccggtcagtgccttttggaa

SEQ ID NO: 4536607 - DNA, 12 bp, Homo sapiens
ccggtccacagg

SEQ ID NO: 4536608 - DNA, 12 bp, Homo sapiens
ccggtcccccag

SEQ ID NO: 4536609 - DNA, 17 bp, Homo sapiens
ccggtcccccagagcat

SEQ ID NO: 4536610 - DNA, 22 bp, Homo sapiens
ccggtcccttgagacctcagcc

SEQ ID NO: 4536611 - DNA, 18 bp, Homo sapiens
ccggtgccagctgccctt

SEQ ID NO: 4536612 - DNA, 20 bp, Homo sapiens
ccggtgccagctgcccttgc

SEQ ID NO: 4536613 - DNA, 20 bp, Homo sapiens
ccggttcagacccctgcctg

SEQ ID NO: 4536614 - DNA, 19 bp, Homo sapiens
ccgtagctcccctggctgg

SEQ ID NO: 4536615 - DNA, 15 bp, Homo sapiens
ccgtatcacagtgtt

SEQ ID NO: 4536616 - DNA, 18 bp, Homo sapiens
ccgtatcacagtgttttt

SEQ ID NO: 4536617 - DNA, 22 bp, Homo sapiens
ccgtatctcaggaagtccagcc

SEQ ID NO: 4536618 - DNA, 20 bp, Homo sapiens
ccgtcaccacgactggccag

SEQ ID NO: 4536619 - DNA, 17 bp, Homo sapiens
ccgtcacccctgtttct

SEQ ID NO: 4536620 - DNA, 16 bp, Homo sapiens
ccgtcagcatcactga

SEQ ID NO: 4536621 - DNA, 17 bp, Homo sapiens
ccgtcccgcgttcaaga

SEQ ID NO: 4536622 - DNA, 17 bp, Homo sapiens
ccgtcggactgccccca

SEQ ID NO: 4536623 - DNA, 14 bp, Homo sapiens
ccgtctacatttca

SEQ ID NO: 4536624 - DNA, 15 bp, Homo sapiens
ccgtctccagctgct

SEQ ID NO: 4536625 - DNA, 12 bp, Homo sapiens
ccgtctcctccc

SEQ ID NO: 4536626 - DNA, 13 bp, Homo sapiens
ccgtctcctccct

SEQ ID NO: 4536627 - DNA, 14 bp, Homo sapiens
ccgtctctctccca

SEQ ID NO: 4536628 - DNA, 16 bp, Homo sapiens
ccgtctctcttggacc

SEQ ID NO: 4536629 - DNA, 17 bp, Homo sapiens
ccgtctctcttggaccc

SEQ ID NO: 4536630 - DNA, 18 bp, Homo sapiens
ccgtctctcttggaccca

SEQ ID NO: 4536631 - DNA, 16 bp, Homo sapiens
ccgtctggcccaccag

SEQ ID NO: 4536632 - DNA, 18 bp, Homo sapiens
ccgtctggcccaccaggg

SEQ ID NO: 4536633 - DNA, 19 bp, Homo sapiens
ccgtctggggttcagcccc

SEQ ID NO: 4536634 - DNA, 22 bp, Homo sapiens
ccgtctggggttcagcccctcc

SEQ ID NO: 4536635 - DNA, 23 bp, Homo sapiens
ccgtctggggttcagcccctcct

SEQ ID NO: 4536636 - DNA, 15 bp, Homo sapiens
ccgtgaaccagaggg

SEQ ID NO: 4536637 - DNA, 15 bp, Homo sapiens
ccgtgacgaggctca

SEQ ID NO: 4536638 - DNA, 21 bp, Homo sapiens
ccgtgagcaccaccagggctc

SEQ ID NO: 4536639 - DNA, 14 bp, Homo sapiens
ccgtgagcatgcac

SEQ ID NO: 4536640 - DNA, 20 bp, Homo sapiens
ccgtgatggagaggacagag

SEQ ID NO: 4536641 - DNA, 22 bp, Homo sapiens
ccgtgcatcccccctgctcagc

SEQ ID NO: 4536642 - DNA, 14 bp, Homo sapiens
ccgtgcatggctcc

SEQ ID NO: 4536643 - DNA, 21 bp, Homo sapiens
ccgtgcccccgcctgccaccg

SEQ ID NO: 4536644 - DNA, 23 bp, Homo sapiens
ccgtgcccgcaggaactgggctg

SEQ ID NO: 4536645 - DNA, 16 bp, Homo sapiens
ccgtgcctggccagat

SEQ ID NO: 4536646 - DNA, 12 bp, Homo sapiens
ccgtgcctggga

SEQ ID NO: 4536647 - DNA, 20 bp, Homo sapiens
ccgtggaggaggaaggcaag

SEQ ID NO: 4536648 - DNA, 23 bp, Homo sapiens
ccgtggaggaggaaggcaagagg

SEQ ID NO: 4536649 - DNA, 17 bp, Homo sapiens
ccgtggccatccctgtg

SEQ ID NO: 4536650 - DNA, 23 bp, Homo sapiens
ccgtggctgtggcatccagagtc

SEQ ID NO: 4536651 - DNA, 18 bp, Homo sapiens
ccgtgggcggggccttgc

SEQ ID NO: 4536652 - DNA, 15 bp, Homo sapiens
ccgtggggtgctgcc

SEQ ID NO: 4536653 - DNA, 17 bp, Homo sapiens
ccgtgggtcattacaaa

SEQ ID NO: 4536654 - DNA, 21 bp, Homo sapiens
ccgtgggtgggcctggccctg

SEQ ID NO: 4536655 - DNA, 17 bp, Homo sapiens
ccgtggtcagagtgcca

SEQ ID NO: 4536656 - DNA, 14 bp, Homo sapiens
ccgtggtcctttgg

SEQ ID NO: 4536657 - DNA, 13 bp, Homo sapiens
ccgtggtgcctgc

SEQ ID NO: 4536658 - DNA, 19 bp, Homo sapiens
ccgtgtcctctccctgcca

SEQ ID NO: 4536659 - DNA, 22 bp, Homo sapiens
ccgtgtcgggcaggtcagcgcg

SEQ ID NO: 4536660 - DNA, 21 bp, Homo sapiens
ccgtgtgttctccgtccctgc

SEQ ID NO: 4536661 - DNA, 19 bp, Homo sapiens
ccgtgtttgcgcttgacca

SEQ ID NO: 4536662 - DNA, 14 bp, Homo sapiens
ccgttactctccaa

SEQ ID NO: 4536663 - DNA, 21 bp, Homo sapiens
ccgttctattgtgtggatgac

SEQ ID NO: 4536664 - DNA, 19 bp, Homo sapiens
ccgttttgtcactttttct

SEQ ID NO: 4536665 - DNA, 21 bp, Homo sapiens
cctaaaaacatttactgacca

SEQ ID NO: 4536666 - DNA, 18 bp, Homo sapiens
cctaaaacacccttcagc

SEQ ID NO: 4536667 - DNA, 13 bp, Homo sapiens
cctaaaagcaaaa

SEQ ID NO: 4536668 - DNA, 22 bp, Homo sapiens
cctaaaagcaaaataaaaacta

SEQ ID NO: 4536669 - DNA, 16 bp, Homo sapiens
cctaaactttggcctt

SEQ ID NO: 4536670 - DNA, 20 bp, Homo sapiens
cctaaagaaaaatatcttgg

SEQ ID NO: 4536671 - DNA, 15 bp, Homo sapiens
cctaaagaggaaaag

SEQ ID NO: 4536672 - DNA, 18 bp, Homo sapiens
cctaaagagttattcaaa

SEQ ID NO: 4536673 - DNA, 22 bp, Homo sapiens
cctaaaggttatagtagaacaa

SEQ ID NO: 4536674 - DNA, 19 bp, Homo sapiens
cctaaataaacacatagat

SEQ ID NO: 4536675 - DNA, 14 bp, Homo sapiens
cctaaatctccagt

SEQ ID NO: 4536676 - DNA, 11 bp, Homo sapiens
cctaaccaagt

SEQ ID NO: 4536677 - DNA, 13 bp, Homo sapiens
cctaaccccaggg

SEQ ID NO: 4536678 - DNA, 13 bp, Homo sapiens
cctaacctgccga

SEQ ID NO: 4536679 - DNA, 12 bp, Homo sapiens
cctaagaatttt

SEQ ID NO: 4536680 - DNA, 17 bp, Homo sapiens
cctaagcacttctagaa

SEQ ID NO: 4536681 - DNA, 16 bp, Homo sapiens
cctaaggttcttgctt

SEQ ID NO: 4536682 - DNA, 14 bp, Homo sapiens
cctaagtgcctctt

SEQ ID NO: 4536683 - DNA, 14 bp, Homo sapiens
cctaagtggctgct

SEQ ID NO: 4536684 - DNA, 16 bp, Homo sapiens
cctaagtggctgctga

SEQ ID NO: 4536685 - DNA, 16 bp, Homo sapiens
cctaataaagttctgt

SEQ ID NO: 4536686 - DNA, 21 bp, Homo sapiens
cctaataaagttctgtactca

SEQ ID NO: 4536687 - DNA, 17 bp, Homo sapiens
cctaatatcaaatgcag

SEQ ID NO: 4536688 - DNA, 18 bp, Homo sapiens
cctaatcatataccagag

SEQ ID NO: 4536689 - DNA, 12 bp, Homo sapiens
cctaatgaaagt

SEQ ID NO: 4536690 - DNA, 21 bp, Homo sapiens
cctaatgaaagtgatgacata

SEQ ID NO: 4536691 - DNA, 15 bp, Homo sapiens
cctaatgagagtgca

SEQ ID NO: 4536692 - DNA, 20 bp, Homo sapiens
cctaatggctatttttgaag

SEQ ID NO: 4536693 - DNA, 12 bp, Homo sapiens
cctaatgtgttt

SEQ ID NO: 4536694 - DNA, 21 bp, Homo sapiens
cctaattaatatattaaaatt

SEQ ID NO: 4536695 - DNA, 19 bp, Homo sapiens
cctaattggaaagtgccag

SEQ ID NO: 4536696 - DNA, 14 bp, Homo sapiens
cctaatttcatttt

SEQ ID NO: 4536697 - DNA, 14 bp, Homo sapiens
cctacaaatcagta

SEQ ID NO: 4536698 - DNA, 15 bp, Homo sapiens
cctacaaatcagtaa

SEQ ID NO: 4536699 - DNA, 19 bp, Homo sapiens
cctacaagagcagcctgtg

SEQ ID NO: 4536700 - DNA, 16 bp, Homo sapiens
cctacagaagggcagt

SEQ ID NO: 4536701 - DNA, 12 bp, Homo sapiens
cctacagcacta

SEQ ID NO: 4536702 - DNA, 15 bp, Homo sapiens
cctacagcactactg

SEQ ID NO: 4536703 - DNA, 20 bp, Homo sapiens
cctacagcactactgggtgt

SEQ ID NO: 4536704 - DNA, 21 bp, Homo sapiens
cctacagcactactgggtgtc

SEQ ID NO: 4536705 - DNA, 21 bp, Homo sapiens
cctacaggcagtctctctctt

SEQ ID NO: 4536706 - DNA, 13 bp, Homo sapiens
cctacagtatata

SEQ ID NO: 4536707 - DNA, 15 bp, Homo sapiens
cctacagtatataag

SEQ ID NO: 4536708 - DNA, 17 bp, Homo sapiens
cctacagtatataagct

SEQ ID NO: 4536709 - DNA, 23 bp, Homo sapiens
cctacatatttgtatgtttttct

SEQ ID NO: 4536710 - DNA, 17 bp, Homo sapiens
cctaccactgtggcccc

SEQ ID NO: 4536711 - DNA, 23 bp, Homo sapiens
cctaccactgtggccccaagagg

SEQ ID NO: 4536712 - DNA, 16 bp, Homo sapiens
cctaccatcagctctg

SEQ ID NO: 4536713 - DNA, 16 bp, Homo sapiens
cctacccacacctctg

SEQ ID NO: 4536714 - DNA, 11 bp, Homo sapiens
cctaccccacc

SEQ ID NO: 4536715 - DNA, 15 bp, Homo sapiens
cctaccccagttcct

SEQ ID NO: 4536716 - DNA, 17 bp, Homo sapiens
cctacctcaacctgtaa

SEQ ID NO: 4536717 - DNA, 20 bp, Homo sapiens
cctacctcaacctgtaaatt

SEQ ID NO: 4536718 - DNA, 15 bp, Homo sapiens
cctacctcaggcagg

SEQ ID NO: 4536719 - DNA, 13 bp, Homo sapiens
cctacctgctctc

SEQ ID NO: 4536720 - DNA, 16 bp, Homo sapiens
cctacctgctctccaa

SEQ ID NO: 4536721 - DNA, 16 bp, Homo sapiens
cctacgtccaaggtgg

SEQ ID NO: 4536722 - DNA, 19 bp, Homo sapiens
cctactaggagaggggggc

SEQ ID NO: 4536723 - DNA, 22 bp, Homo sapiens
cctactaggccattagcccttc

SEQ ID NO: 4536724 - DNA, 15 bp, Homo sapiens
cctactcccctgggc

SEQ ID NO: 4536725 - DNA, 15 bp, Homo sapiens
cctacttccaggatg

SEQ ID NO: 4536726 - DNA, 13 bp, Homo sapiens
cctactttctctc

SEQ ID NO: 4536727 - DNA, 15 bp, Homo sapiens
cctactttgactttt

SEQ ID NO: 4536728 - DNA, 21 bp, Homo sapiens
cctactttgactttttgcatt

SEQ ID NO: 4536729 - DNA, 13 bp, Homo sapiens
cctagaagggcta

SEQ ID NO: 4536730 - DNA, 23 bp, Homo sapiens
cctagaagtcttaattgtgttta

SEQ ID NO: 4536731 - DNA, 18 bp, Homo sapiens
cctagaatgtttcatttg

SEQ ID NO: 4536732 - DNA, 14 bp, Homo sapiens
cctagactctccct

SEQ ID NO: 4536733 - DNA, 18 bp, Homo sapiens
cctagactgttactttgg

SEQ ID NO: 4536734 - DNA, 18 bp, Homo sapiens
cctagagaacgcagccct

SEQ ID NO: 4536735 - DNA, 19 bp, Homo sapiens
cctagagaagacaggctgg

SEQ ID NO: 4536736 - DNA, 22 bp, Homo sapiens
cctagagaagacaggctggaag

SEQ ID NO: 4536737 - DNA, 18 bp, Homo sapiens
cctagagcctgcctggag

SEQ ID NO: 4536738 - DNA, 14 bp, Homo sapiens
cctagatatgaata

SEQ ID NO: 4536739 - DNA, 11 bp, Homo sapiens
cctagatccag

SEQ ID NO: 4536740 - DNA, 12 bp, Homo sapiens
cctagattacat

SEQ ID NO: 4536741 - DNA, 19 bp, Homo sapiens
cctagattacatctgcctt

SEQ ID NO: 4536742 - DNA, 18 bp, Homo sapiens
cctagcaatacagggagg

SEQ ID NO: 4536743 - DNA, 14 bp, Homo sapiens
cctagcaccctgga

SEQ ID NO: 4536744 - DNA, 15 bp, Homo sapiens
cctagcaccctggag

SEQ ID NO: 4536745 - DNA, 17 bp, Homo sapiens
cctagcactgccccaca

SEQ ID NO: 4536746 - DNA, 22 bp, Homo sapiens
cctagcactgccccacatgcat

SEQ ID NO: 4536747 - DNA, 16 bp, Homo sapiens
cctagcaggctgttcc

SEQ ID NO: 4536748 - DNA, 12 bp, Homo sapiens
cctagcccagtg

SEQ ID NO: 4536749 - DNA, 19 bp, Homo sapiens
cctcccagtgagactgccc

SEQ ID NO: 4536750 - DNA, 22 bp, Homo sapiens
cctcccataattgctttgccaa

SEQ ID NO: 4536751 - DNA, 15 bp, Homo sapiens
cctcccatggcacct

SEQ ID NO: 4536752 - DNA, 14 bp, Homo sapiens
cctcccattctgca

SEQ ID NO: 4536753 - DNA, 18 bp, Homo sapiens
cctcccattgcccagtga

SEQ ID NO: 4536754 - DNA, 19 bp, Homo sapiens
cctcccattgcccagtgag

SEQ ID NO: 4536755 - DNA, 20 bp, Homo sapiens
cctccccaaatcaatacact

SEQ ID NO: 4536756 - DNA, 14 bp, Homo sapiens
cctccccacccgct

SEQ ID NO: 4536757 - DNA, 14 bp, Homo sapiens
cctccccagagctg

SEQ ID NO: 4536758 - DNA, 13 bp, Homo sapiens
cctccccagccag

SEQ ID NO: 4536759 - DNA, 16 bp, Homo sapiens
cctccccatctgtcca

SEQ ID NO: 4536760 - DNA, 17 bp, Homo sapiens
cctccccatctgtccag

SEQ ID NO: 4536761 - DNA, 18 bp, Homo sapiens
cctccccatctgtccagc

SEQ ID NO: 4536762 - DNA, 20 bp, Homo sapiens
cctccccatttcccatctgc

SEQ ID NO: 4536763 - DNA, 12 bp, Homo sapiens
cctcccccagtg

SEQ ID NO: 4536764 - DNA, 14 bp, Homo sapiens
cctcccccattccc

SEQ ID NO: 4536765 - DNA, 15 bp, Homo sapiens
cctccccccactgca

SEQ ID NO: 4536766 - DNA, 18 bp, Homo sapiens
cctccccccactgcaggc

SEQ ID NO: 4536767 - DNA, 13 bp, Homo sapiens
cctcccccgcctc

SEQ ID NO: 4536768 - DNA, 14 bp, Homo sapiens
cctccccctgcaac

SEQ ID NO: 4536769 - DNA, 19 bp, Homo sapiens
cctccccctgccagtgcct

SEQ ID NO: 4536770 - DNA, 20 bp, Homo sapiens
cctccccctgccagtgcctt

SEQ ID NO: 4536771 - DNA, 12 bp, Homo sapiens
cctccccctgcg

SEQ ID NO: 4536772 - DNA, 14 bp, Homo sapiens
cctccccctgcgcc

SEQ ID NO: 4536773 - DNA, 17 bp, Homo sapiens
cctcccctatccaccca

SEQ ID NO: 4536774 - DNA, 17 bp, Homo sapiens
cctcccctcctcttccc

SEQ ID NO: 4536775 - DNA, 13 bp, Homo sapiens
cctcccctctctt

SEQ ID NO: 4536776 - DNA, 13 bp, Homo sapiens
cctcccctgccct

SEQ ID NO: 4536777 - DNA, 22 bp, Homo sapiens
cctccctacctcaacctgtaaa

SEQ ID NO: 4536778 - DNA, 22 bp, Homo sapiens
cctccctagttagcatccaggc

SEQ ID NO: 4536779 - DNA, 13 bp, Homo sapiens
cctccctcagacc

SEQ ID NO: 4536780 - DNA, 14 bp, Homo sapiens
cctccctcagaccc

SEQ ID NO: 4536781 - DNA, 15 bp, Homo sapiens
cctccctcagaccca

SEQ ID NO: 4536782 - DNA, 23 bp, Homo sapiens
cctccctcagacccaggggtcca

SEQ ID NO: 4536783 - DNA, 14 bp, Homo sapiens
cctccctcagactc

SEQ ID NO: 4536784 - DNA, 16 bp, Homo sapiens
cctccctcaggcccag

SEQ ID NO: 4536785 - DNA, 20 bp, Homo sapiens
cctccctcaggcccaggagt

SEQ ID NO: 4536786 - DNA, 13 bp, Homo sapiens
cctccctccaccc

SEQ ID NO: 4536787 - DNA, 17 bp, Homo sapiens
cctccctccaccccagg

SEQ ID NO: 4536788 - DNA, 19 bp, Homo sapiens
cctccctccaccccaggac

SEQ ID NO: 4536789 - DNA, 20 bp, Homo sapiens
cctccctccaccccaggacg

SEQ ID NO: 4536790 - DNA, 15 bp, Homo sapiens
cctccctccacctca

SEQ ID NO: 4536791 - DNA, 19 bp, Homo sapiens
cctccctccagctgcgact

SEQ ID NO: 4536792 - DNA, 13 bp, Homo sapiens
cctccctctctct

SEQ ID NO: 4536793 - DNA, 18 bp, Homo sapiens
cctccctctctcttctgc

SEQ ID NO: 4536794 - DNA, 19 bp, Homo sapiens
cctccctgaccctgctcct

SEQ ID NO: 4536795 - DNA, 13 bp, Homo sapiens
cctccctgcctga

SEQ ID NO: 4536796 - DNA, 13 bp, Homo sapiens
cctccctgcctgc

SEQ ID NO: 4536797 - DNA, 15 bp, Homo sapiens
cctccctgcctgctc

SEQ ID NO: 4536798 - DNA, 17 bp, Homo sapiens
cctccctgcctgctcct

SEQ ID NO: 4536799 - DNA, 11 bp, Homo sapiens
cctccctgcta

SEQ ID NO: 4536800 - DNA, 17 bp, Homo sapiens
cctccctgctagcacag

SEQ ID NO: 4536801 - DNA, 20 bp, Homo sapiens
cctccctgctagcacagagg

SEQ ID NO: 4536802 - DNA, 23 bp, Homo sapiens
cctccctgctagcacagaggcct

SEQ ID NO: 4536803 - DNA, 19 bp, Homo sapiens
cctccctgctcagtgcttg

SEQ ID NO: 4536804 - DNA, 12 bp, Homo sapiens
cctccctgctgt

SEQ ID NO: 4536805 - DNA, 17 bp, Homo sapiens
cctccctggcagacaca

SEQ ID NO: 4536806 - DNA, 16 bp, Homo sapiens
cctccctggctcccat

SEQ ID NO: 4536807 - DNA, 15 bp, Homo sapiens
cctccctgtcctcct

SEQ ID NO: 4536808 - DNA, 17 bp, Homo sapiens
cctcccttccttttccc

SEQ ID NO: 4536809 - DNA, 16 bp, Homo sapiens
cctcccttctcttcac

SEQ ID NO: 4536810 - DNA, 12 bp, Homo sapiens
cctccctttctc

SEQ ID NO: 4536811 - DNA, 13 bp, Homo sapiens
cctccctttctcc

SEQ ID NO: 4536812 - DNA, 22 bp, Homo sapiens
cctccgaccacttccaggggaa

SEQ ID NO: 4536813 - DNA, 16 bp, Homo sapiens
cctccgagagggagag

SEQ ID NO: 4536814 - DNA, 19 bp, Homo sapiens
cctccgaggctccccgcct

SEQ ID NO: 4536815 - DNA, 13 bp, Homo sapiens
cctccgcccctgc

SEQ ID NO: 4536816 - DNA, 16 bp, Homo sapiens
cctccgcctgggtcat

SEQ ID NO: 4536817 - DNA, 22 bp, Homo sapiens
cctccgcctgggtcatgggcct

SEQ ID NO: 4536818 - DNA, 17 bp, Homo sapiens
cctccgccttctcccac

SEQ ID NO: 4536819 - DNA, 19 bp, Homo sapiens
cctccggcgtcagcctcca

SEQ ID NO: 4536820 - DNA, 20 bp, Homo sapiens
cctccggcgtcagcctccag

SEQ ID NO: 4536821 - DNA, 22 bp, Homo sapiens
cctccgtgagcaccaccagggc

SEQ ID NO: 4536822 - DNA, 17 bp, Homo sapiens
cctcctaccctcccacc

SEQ ID NO: 4536823 - DNA, 16 bp, Homo sapiens
cctcctagctctccca

SEQ ID NO: 4536824 - DNA, 19 bp, Homo sapiens
cctcctagctctcccagtg

SEQ ID NO: 4536825 - DNA, 13 bp, Homo sapiens
cctcctcaccccg

SEQ ID NO: 4536826 - DNA, 13 bp, Homo sapiens
cctcctcacctca

SEQ ID NO: 4536827 - DNA, 14 bp, Homo sapiens
cctcctcacctcat

SEQ ID NO: 4536828 - DNA, 22 bp, Homo sapiens
cctcctcacctcatgcccaccc

SEQ ID NO: 4536829 - DNA, 14 bp, Homo sapiens
cctcctcacctctg

SEQ ID NO: 4536830 - DNA, 21 bp, Homo sapiens
cctcctcacctctggactggc

SEQ ID NO: 4536831 - DNA, 16 bp, Homo sapiens
cctcctcagccagcct

SEQ ID NO: 4536832 - DNA, 17 bp, Homo sapiens
cctcctcaggcacacag

SEQ ID NO: 4536833 - DNA, 19 bp, Homo sapiens
cctcctcaggcacacagct

SEQ ID NO: 4536834 - DNA, 19 bp, Homo sapiens
cctcctccaaaggccccct

SEQ ID NO: 4536835 - DNA, 15 bp, Homo sapiens
cctcctccaggcctg

SEQ ID NO: 4536836 - DNA, 12 bp, Homo sapiens
cctcctccaggg

SEQ ID NO: 4536837 - DNA, 15 bp, Homo sapiens
cctcctccccagagc

SEQ ID NO: 4536838 - DNA, 13 bp, Homo sapiens
cctcctcccccag

SEQ ID NO: 4536839 - DNA, 13 bp, Homo sapiens
cctcctccctcaa

SEQ ID NO: 4536840 - DNA, 16 bp, Homo sapiens
cctcctccctcagacc

SEQ ID NO: 4536841 - DNA, 17 bp, Homo sapiens
cctcctccctcagaccc

SEQ ID NO: 4536842 - DNA, 23 bp, Homo sapiens
cctcctccctcagacccaggagt

SEQ ID NO: 4536843 - DNA, 17 bp, Homo sapiens
cctcctccctcagactc

SEQ ID NO: 4536844 - DNA, 12 bp, Homo sapiens
cctcctcctggg

SEQ ID NO: 4536845 - DNA, 19 bp, Homo sapiens
cctcctcggagagcagcag

SEQ ID NO: 4536846 - DNA, 17 bp, Homo sapiens
cctcctctgaaacagct

SEQ ID NO: 4536847 - DNA, 19 bp, Homo sapiens
cctcctctgaaacagctgc

SEQ ID NO: 4536848 - DNA, 21 bp, Homo sapiens
cctcctctgaaacagctgcct

SEQ ID NO: 4536849 - DNA, 12 bp, Homo sapiens
cctcctctgcca

SEQ ID NO: 4536850 - DNA, 15 bp, Homo sapiens
cctcctctgccacct

SEQ ID NO: 4536851 - DNA, 15 bp, Homo sapiens
cctcctctgcccggg

SEQ ID NO: 4536852 - DNA, 14 bp, Homo sapiens
cctcctctgcctac

SEQ ID NO: 4536853 - DNA, 17 bp, Homo sapiens
cctcctctgcctacagc

SEQ ID NO: 4536854 - DNA, 18 bp, Homo sapiens
cctcctctgcctacagcc

SEQ ID NO: 4536855 - DNA, 19 bp, Homo sapiens
cctcctctgcctacagcca

SEQ ID NO: 4536856 - DNA, 21 bp, Homo sapiens
cctcctctggacggcaggctc

SEQ ID NO: 4536857 - DNA, 13 bp, Homo sapiens
cctcctctgggcc

SEQ ID NO: 4536858 - DNA, 17 bp, Homo sapiens
cctcctctgggccctgt

SEQ ID NO: 4536859 - DNA, 19 bp, Homo sapiens
cctcctctgggccctgtcg

SEQ ID NO: 4536860 - DNA, 13 bp, Homo sapiens
cctcctctgtctg

SEQ ID NO: 4536861 - DNA, 16 bp, Homo sapiens
cctcctctgtctgccc

SEQ ID NO: 4536862 - DNA, 12 bp, Homo sapiens
cctcctctgtga

SEQ ID NO: 4536863 - DNA, 22 bp, Homo sapiens
cctcctcttcccttagcctctc

SEQ ID NO: 4536864 - DNA, 15 bp, Homo sapiens
cctcctcttggaatt

SEQ ID NO: 4536865 - DNA, 12 bp, Homo sapiens
cctcctgagaaa

SEQ ID NO: 4536866 - DNA, 23 bp, Homo sapiens
cctcctgcagacacctggactga

SEQ ID NO: 4536867 - DNA, 13 bp, Homo sapiens
cctcctgcccagg

SEQ ID NO: 4536868 - DNA, 14 bp, Homo sapiens
cctcctgcccagga

SEQ ID NO: 4536869 - DNA, 15 bp, Homo sapiens
cctcctgcccaggag

SEQ ID NO: 4536870 - DNA, 12 bp, Homo sapiens
cctcctgccctt

SEQ ID NO: 4536871 - DNA, 13 bp, Homo sapiens
cctagcccagtgc

SEQ ID NO: 4536872 - DNA, 20 bp, Homo sapiens
cctagcccagtgcttctcca

SEQ ID NO: 4536873 - DNA, 14 bp, Homo sapiens
cctagcccttccct

SEQ ID NO: 4536874 - DNA, 16 bp, Homo sapiens
cctagcccttccctga

SEQ ID NO: 4536875 - DNA, 17 bp, Homo sapiens
cctagcccttccctgag

SEQ ID NO: 4536876 - DNA, 18 bp, Homo sapiens
cctagcccttccctgagt

SEQ ID NO: 4536877 - DNA, 21 bp, Homo sapiens
cctagcgatctctcctggcct

SEQ ID NO: 4536878 - DNA, 22 bp, Homo sapiens
cctagcgatctctcctggccta

SEQ ID NO: 4536879 - DNA, 20 bp, Homo sapiens
cctagcggagcccagcctgg

SEQ ID NO: 4536880 - DNA, 20 bp, Homo sapiens
cctagcggctgctccttcag

SEQ ID NO: 4536881 - DNA, 21 bp, Homo sapiens
cctagcggctgctccttcagg

SEQ ID NO: 4536882 - DNA, 15 bp, Homo sapiens
cctagctacactgag

SEQ ID NO: 4536883 - DNA, 15 bp, Homo sapiens
cctagctcctgccac

SEQ ID NO: 4536884 - DNA, 16 bp, Homo sapiens
cctagctctcccagtg

SEQ ID NO: 4536885 - DNA, 17 bp, Homo sapiens
cctagctctcccagtga

SEQ ID NO: 4536886 - DNA, 18 bp, Homo sapiens
cctagctctcccagtgaa

SEQ ID NO: 4536887 - DNA, 19 bp, Homo sapiens
cctagctgcacagggcagc

SEQ ID NO: 4536888 - DNA, 13 bp, Homo sapiens
cctagctggctct

SEQ ID NO: 4536889 - DNA, 22 bp, Homo sapiens
cctagctgtgtgaatacctgct

SEQ ID NO: 4536890 - DNA, 17 bp, Homo sapiens
cctagctttagaccctg

SEQ ID NO: 4536891 - DNA, 22 bp, Homo sapiens
cctagctttagaccctgggtgg

SEQ ID NO: 4536892 - DNA, 21 bp, Homo sapiens
cctaggacccgtctccagctg

SEQ ID NO: 4536893 - DNA, 22 bp, Homo sapiens
cctaggacccgtctccagctgc

SEQ ID NO: 4536894 - DNA, 16 bp, Homo sapiens
cctaggccactcctcc

SEQ ID NO: 4536895 - DNA, 18 bp, Homo sapiens
cctaggccactcctccaa

SEQ ID NO: 4536896 - DNA, 20 bp, Homo sapiens
cctaggccactcctccaaag

SEQ ID NO: 4536897 - DNA, 23 bp, Homo sapiens
cctaggcctcaactcctcccata

SEQ ID NO: 4536898 - DNA, 23 bp, Homo sapiens
cctaggcgattttgtctaccatt

SEQ ID NO: 4536899 - DNA, 17 bp, Homo sapiens
cctaggggtttctgttg

SEQ ID NO: 4536900 - DNA, 16 bp, Homo sapiens
cctagtaaatgttaac

SEQ ID NO: 4536901 - DNA, 20 bp, Homo sapiens
cctagtagctgggattacag

SEQ ID NO: 4536902 - DNA, 16 bp, Homo sapiens
cctagtcccttcccct

SEQ ID NO: 4536903 - DNA, 17 bp, Homo sapiens
cctagtgcaaaaactgt

SEQ ID NO: 4536904 - DNA, 14 bp, Homo sapiens
cctagtgggagtta

SEQ ID NO: 4536905 - DNA, 20 bp, Homo sapiens
cctagtggggtctccctctc

SEQ ID NO: 4536906 - DNA, 23 bp, Homo sapiens
cctagtggggtctccctctcctg

SEQ ID NO: 4536907 - DNA, 20 bp, Homo sapiens
cctagttaaagaaaggaaaa

SEQ ID NO: 4536908 - DNA, 16 bp, Homo sapiens
cctataaaatgcccat

SEQ ID NO: 4536909 - DNA, 12 bp, Homo sapiens
cctataaggaag

SEQ ID NO: 4536910 - DNA, 22 bp, Homo sapiens
cctataaggagagttcaagcct

SEQ ID NO: 4536911 - DNA, 23 bp, Homo sapiens
cctataaggagagttcaagcctg

SEQ ID NO: 4536912 - DNA, 17 bp, Homo sapiens
cctatagtcccactact

SEQ ID NO: 4536913 - DNA, 18 bp, Homo sapiens
cctatctaaccctcccat

SEQ ID NO: 4536914 - DNA, 16 bp, Homo sapiens
cctatctagcatttat

SEQ ID NO: 4536915 - DNA, 23 bp, Homo sapiens
cctatctagcatttatttctctg

SEQ ID NO: 4536916 - DNA, 14 bp, Homo sapiens
cctatctcagccat

SEQ ID NO: 4536917 - DNA, 19 bp, Homo sapiens
cctatctgtgattccccca

SEQ ID NO: 4536918 - DNA, 16 bp, Homo sapiens
cctatgcactgaagag

SEQ ID NO: 4536919 - DNA, 20 bp, Homo sapiens
cctatgcactgaagagctct

SEQ ID NO: 4536920 - DNA, 23 bp, Homo sapiens
cctatgctattgacaataaaata

SEQ ID NO: 4536921 - DNA, 15 bp, Homo sapiens
cctatgtctcctcta

SEQ ID NO: 4536922 - DNA, 22 bp, Homo sapiens
cctatgtttttgttcaaagcca

SEQ ID NO: 4536923 - DNA, 15 bp, Homo sapiens
cctattaggtggaaa

SEQ ID NO: 4536924 - DNA, 21 bp, Homo sapiens
cctattaggtggaaattttat

SEQ ID NO: 4536925 - DNA, 19 bp, Homo sapiens
cctattgtgcaatgtaaat

SEQ ID NO: 4536926 - DNA, 15 bp, Homo sapiens
cctatttcagctgct

SEQ ID NO: 4536927 - DNA, 18 bp, Homo sapiens
cctatttccattcaacaa

SEQ ID NO: 4536928 - DNA, 14 bp, Homo sapiens
cctatttctatgtc

SEQ ID NO: 4536929 - DNA, 19 bp, Homo sapiens
cctatttctatgtcatttt

SEQ ID NO: 4536930 - DNA, 20 bp, Homo sapiens
cctattttagggttctaaat

SEQ ID NO: 4536931 - DNA, 19 bp, Homo sapiens
cctcaaaaagcagaaggag

SEQ ID NO: 4536932 - DNA, 21 bp, Homo sapiens
cctcaaaacctgattggccac

SEQ ID NO: 4536933 - DNA, 17 bp, Homo sapiens
cctcaaaactggagtcc

SEQ ID NO: 4536934 - DNA, 19 bp, Homo sapiens
cctcaaactcattgcagca

SEQ ID NO: 4536935 - DNA, 20 bp, Homo sapiens
cctcaaactcattgcagcag

SEQ ID NO: 4536936 - DNA, 20 bp, Homo sapiens
cctcaaagaagtcggaatgt

SEQ ID NO: 4536937 - DNA, 15 bp, Homo sapiens
cctcaaagaggcctt

SEQ ID NO: 4536938 - DNA, 23 bp, Homo sapiens
cctcaaatcaaaaacaggcaggt

SEQ ID NO: 4536939 - DNA, 17 bp, Homo sapiens
cctcaaattactttgtg

SEQ ID NO: 4536940 - DNA, 23 bp, Homo sapiens
cctcaaccgcacatgtgccactg

SEQ ID NO: 4536941 - DNA, 18 bp, Homo sapiens
cctcaacgtattgtttcg

SEQ ID NO: 4536942 - DNA, 16 bp, Homo sapiens
cctcaactcctcccat

SEQ ID NO: 4536943 - DNA, 17 bp, Homo sapiens
cctcaactcctcccata

SEQ ID NO: 4536944 - DNA, 14 bp, Homo sapiens
cctcaactgcctac

SEQ ID NO: 4536945 - DNA, 15 bp, Homo sapiens
cctcaactgcctact

SEQ ID NO: 4536946 - DNA, 18 bp, Homo sapiens
cctcaagccccatttcct

SEQ ID NO: 4536947 - DNA, 20 bp, Homo sapiens
cctcaagccccatttcctca

SEQ ID NO: 4536948 - DNA, 23 bp, Homo sapiens
cctcaaggtaacaagagtatgtg

SEQ ID NO: 4536949 - DNA, 16 bp, Homo sapiens
cctcaatccaccttca

SEQ ID NO: 4536950 - DNA, 21 bp, Homo sapiens
cctcaatccaccttcaggccc

SEQ ID NO: 4536951 - DNA, 21 bp, Homo sapiens
cctcaatgtgaatcagaccct

SEQ ID NO: 4536952 - DNA, 17 bp, Homo sapiens
cctcaattgacattcct

SEQ ID NO: 4536953 - DNA, 18 bp, Homo sapiens
cctcaattgacattcctt

SEQ ID NO: 4536954 - DNA, 13 bp, Homo sapiens
cctcacagtgaac

SEQ ID NO: 4536955 - DNA, 15 bp, Homo sapiens
cctcacccaccatgg

SEQ ID NO: 4536956 - DNA, 21 bp, Homo sapiens
cctcacccacccctgcacagt

SEQ ID NO: 4536957 - DNA, 17 bp, Homo sapiens
cctcaccccgtctgggg

SEQ ID NO: 4536958 - DNA, 15 bp, Homo sapiens
cctcacccctggttc

SEQ ID NO: 4536959 - DNA, 13 bp, Homo sapiens
cctcacccttccc

SEQ ID NO: 4536960 - DNA, 21 bp, Homo sapiens
cctcacccttcccggcccccg

SEQ ID NO: 4536961 - DNA, 14 bp, Homo sapiens
cctcacctcatgcc

SEQ ID NO: 4536962 - DNA, 13 bp, Homo sapiens
cctcacctctgga

SEQ ID NO: 4536963 - DNA, 18 bp, Homo sapiens
cctcacctctggactggc

SEQ ID NO: 4536964 - DNA, 20 bp, Homo sapiens
cctcacctctggactggcta

SEQ ID NO: 4536965 - DNA, 15 bp, Homo sapiens
cctcaccttcctgtg

SEQ ID NO: 4536966 - DNA, 22 bp, Homo sapiens
cctcacggggttggctgttcca

SEQ ID NO: 4536967 - DNA, 19 bp, Homo sapiens
cctcactagccatgcttta

SEQ ID NO: 4536968 - DNA, 22 bp, Homo sapiens
cctcactatggtatgctggcca

SEQ ID NO: 4536969 - DNA, 24 bp, Homo sapiens
cctcactatggtatgctggccagc

SEQ ID NO: 4536970 - DNA, 15 bp, Homo sapiens
cctcactctgtccct

SEQ ID NO: 4536971 - DNA, 18 bp, Homo sapiens
cctcactctgtccctgtc

SEQ ID NO: 4536972 - DNA, 15 bp, Homo sapiens
cctcacttgaggagg

SEQ ID NO: 4536973 - DNA, 19 bp, Homo sapiens
cctcagaaggccccagaga

SEQ ID NO: 4536974 - DNA, 21 bp, Homo sapiens
cctcagaaggccccagagaga

SEQ ID NO: 4536975 - DNA, 13 bp, Homo sapiens
cctcagacccagg

SEQ ID NO: 4536976 - DNA, 15 bp, Homo sapiens
cctcagacccaggag

SEQ ID NO: 4536977 - DNA, 21 bp, Homo sapiens
cctcagacccaggagtccagc

SEQ ID NO: 4536978 - DNA, 23 bp, Homo sapiens
cctcagacccaggggtccaggcc

SEQ ID NO: 4536979 - DNA, 16 bp, Homo sapiens
cctcagacgttgcctg

SEQ ID NO: 4536980 - DNA, 19 bp, Homo sapiens
cctcagacgttgcctgaga

SEQ ID NO: 4536981 - DNA, 13 bp, Homo sapiens
cctcagactcaga

SEQ ID NO: 4536982 - DNA, 14 bp, Homo sapiens
cctcagactcagag

SEQ ID NO: 4536983 - DNA, 20 bp, Homo sapiens
cctcagactcagaggtccag

SEQ ID NO: 4536984 - DNA, 23 bp, Homo sapiens
cctcagactcagaggtccaggcc

SEQ ID NO: 4536985 - DNA, 16 bp, Homo sapiens
cctcagagatctccct

SEQ ID NO: 4536986 - DNA, 18 bp, Homo sapiens
cctcagagatctcccttc

SEQ ID NO: 4536987 - DNA, 15 bp, Homo sapiens
cctcagagcgccagg

SEQ ID NO: 4536988 - DNA, 22 bp, Homo sapiens
cctcagagcgccaggaagccag

SEQ ID NO: 4536989 - DNA, 19 bp, Homo sapiens
cctcagatgatctctccac

SEQ ID NO: 4536990 - DNA, 16 bp, Homo sapiens
ccctctctccctgcct

SEQ ID NO: 4536991 - DNA, 17 bp, Homo sapiens
ccctctctctcactccc

SEQ ID NO: 4536992 - DNA, 13 bp, Homo sapiens
ccctctctctggg

SEQ ID NO: 4536993 - DNA, 19 bp, Homo sapiens
ccctctctcttctgctcca

SEQ ID NO: 4536994 - DNA, 14 bp, Homo sapiens
ccctctctgctctg

SEQ ID NO: 4536995 - DNA, 15 bp, Homo sapiens
ccctctctgctctgc

SEQ ID NO: 4536996 - DNA, 13 bp, Homo sapiens
ccctctctgtgca

SEQ ID NO: 4536997 - DNA, 14 bp, Homo sapiens
ccctctcttgtcag

SEQ ID NO: 4536998 - DNA, 12 bp, Homo sapiens
ccctctctttct

SEQ ID NO: 4536999 - DNA, 13 bp, Homo sapiens
ccctctgcccctg

SEQ ID NO: 4537000 - DNA, 15 bp, Homo sapiens
ccctctgcccctgca

SEQ ID NO: 4537001 - DNA, 19 bp, Homo sapiens
ccctctgcccctgcagctg

SEQ ID NO: 4537002 - DNA, 23 bp, Homo sapiens
ccctctgccggtcgggcagccag

SEQ ID NO: 4537003 - DNA, 20 bp, Homo sapiens
ccctctgctgcaacaagctc

SEQ ID NO: 4537004 - DNA, 16 bp, Homo sapiens
ccctctggccctgcct

SEQ ID NO: 4537005 - DNA, 24 bp, Homo sapiens
ccctctgtccaggcactgagatac

SEQ ID NO: 4537006 - DNA, 13 bp, Homo sapiens
ccctcttgcccat

SEQ ID NO: 4537007 - DNA, 16 bp, Homo sapiens
ccctcttgcccatcct

SEQ ID NO: 4537008 - DNA, 12 bp, Homo sapiens
ccctctttccct

SEQ ID NO: 4537009 - DNA, 23 bp, Homo sapiens
ccctgaaaatgtttttctgccag

SEQ ID NO: 4537010 - DNA, 24 bp, Homo sapiens
ccctgaaaatgtttttctgccagg

SEQ ID NO: 4537011 - DNA, 21 bp, Homo sapiens
ccctgaaacctagtactgccc

SEQ ID NO: 4537012 - DNA, 15 bp, Homo sapiens
ccctgaatccccctt

SEQ ID NO: 4537013 - DNA, 20 bp, Homo sapiens
ccctgaatcccccttgccac

SEQ ID NO: 4537014 - DNA, 21 bp, Homo sapiens
ccctgaatcccccttgccacc

SEQ ID NO: 4537015 - DNA, 23 bp, Homo sapiens
ccctgaatcccccttgccacccc

SEQ ID NO: 4537016 - DNA, 15 bp, Homo sapiens
ccctgaccctgctcc

SEQ ID NO: 4537017 - DNA, 15 bp, Homo sapiens
ccctgacctccgccc

SEQ ID NO: 4537018 - DNA, 22 bp, Homo sapiens
ccctgacgttaggaccaggaga

SEQ ID NO: 4537019 - DNA, 19 bp, Homo sapiens
ccctgactcattctgaagg

SEQ ID NO: 4537020 - DNA, 21 bp, Homo sapiens
ccctgactcattctgaaggag

SEQ ID NO: 4537021 - DNA, 16 bp, Homo sapiens
ccctgactccctgtgg

SEQ ID NO: 4537022 - DNA, 15 bp, Homo sapiens
ccctgactcctctgg

SEQ ID NO: 4537023 - DNA, 18 bp, Homo sapiens
ccctgactcctctggctt

SEQ ID NO: 4537024 - DNA, 13 bp, Homo sapiens
ccctgactcctgg

SEQ ID NO: 4537025 - DNA, 22 bp, Homo sapiens
ccctgagatttaacccctccac

SEQ ID NO: 4537026 - DNA, 16 bp, Homo sapiens
ccctgagcactcctgg

SEQ ID NO: 4537027 - DNA, 18 bp, Homo sapiens
ccctgagcactcctggtg

SEQ ID NO: 4537028 - DNA, 19 bp, Homo sapiens
ccctgagcactcctggtgc

SEQ ID NO: 4537029 - DNA, 15 bp, Homo sapiens
ccctgagccagcagg

SEQ ID NO: 4537030 - DNA, 16 bp, Homo sapiens
ccctgagccagcaggg

SEQ ID NO: 4537031 - DNA, 13 bp, Homo sapiens
ccctgagctgagg

SEQ ID NO: 4537032 - DNA, 21 bp, Homo sapiens
ccctgagctgaggcagcagtg

SEQ ID NO: 4537033 - DNA, 13 bp, Homo sapiens
ccctgaggccctg

SEQ ID NO: 4537034 - DNA, 16 bp, Homo sapiens
ccctgaggccctgggc

SEQ ID NO: 4537035 - DNA, 22 bp, Homo sapiens
ccctgaggcggaggctgtgctc

SEQ ID NO: 4537036 - DNA, 17 bp, Homo sapiens
ccctgaggggtccctga

SEQ ID NO: 4537037 - DNA, 18 bp, Homo sapiens
ccctgaggtgaaagggag

SEQ ID NO: 4537038 - DNA, 16 bp, Homo sapiens
ccctgagtcaccagga

SEQ ID NO: 4537039 - DNA, 19 bp, Homo sapiens
ccctgagttgggcagccag

SEQ ID NO: 4537040 - DNA, 18 bp, Homo sapiens
ccctgatcccaccccctc

SEQ ID NO: 4537041 - DNA, 13 bp, Homo sapiens
ccctgatggcctt

SEQ ID NO: 4537042 - DNA, 22 bp, Homo sapiens
ccctgcaaaactccaggcagga

SEQ ID NO: 4537043 - DNA, 18 bp, Homo sapiens
ccctgcaaaaggactctc

SEQ ID NO: 4537044 - DNA, 21 bp, Homo sapiens
ccctgcacagcaggctgccag

SEQ ID NO: 4537045 - DNA, 13 bp, Homo sapiens
ccctgcagacctc

SEQ ID NO: 4537046 - DNA, 17 bp, Homo sapiens
ccctgcagattctgagc

SEQ ID NO: 4537047 - DNA, 21 bp, Homo sapiens
ccctgcagattctgagcaaag

SEQ ID NO: 4537048 - DNA, 21 bp, Homo sapiens
ccctgcagctggaatgtgcca

SEQ ID NO: 4537049 - DNA, 18 bp, Homo sapiens
ccctgcaggttgttcata

SEQ ID NO: 4537050 - DNA, 14 bp, Homo sapiens
ccctgccacagcca

SEQ ID NO: 4537051 - DNA, 17 bp, Homo sapiens
ccctgccacagccagag

SEQ ID NO: 4537052 - DNA, 19 bp, Homo sapiens
ccctgccacagccagagga

SEQ ID NO: 4537053 - DNA, 12 bp, Homo sapiens
ccctgccagggc

SEQ ID NO: 4537054 - DNA, 13 bp, Homo sapiens
ccctgcccacaga

SEQ ID NO: 4537055 - DNA, 21 bp, Homo sapiens
ccctgcccagcctgctctccc

SEQ ID NO: 4537056 - DNA, 17 bp, Homo sapiens
ccctgccccaccccatc

SEQ ID NO: 4537057 - DNA, 16 bp, Homo sapiens
ccctgccccagcaaga

SEQ ID NO: 4537058 - DNA, 18 bp, Homo sapiens
ccctgcccccagccccgg

SEQ ID NO: 4537059 - DNA, 13 bp, Homo sapiens
ccctgcccccagg

SEQ ID NO: 4537060 - DNA, 16 bp, Homo sapiens
ccctgcccccaggact

SEQ ID NO: 4537061 - DNA, 15 bp, Homo sapiens
ccctgcccccaggtg

SEQ ID NO: 4537062 - DNA, 18 bp, Homo sapiens
ccctgccctggtccaggg

SEQ ID NO: 4537063 - DNA, 16 bp, Homo sapiens
ccctgcctcagccagg

SEQ ID NO: 4537064 - DNA, 12 bp, Homo sapiens
ccctgcctccac

SEQ ID NO: 4537065 - DNA, 16 bp, Homo sapiens
ccctgcctccaccctc

SEQ ID NO: 4537066 - DNA, 22 bp, Homo sapiens
ccctgcctctcatcaactgaat

SEQ ID NO: 4537067 - DNA, 9 bp, Homo sapiens
ccctgcctg

SEQ ID NO: 4537068 - DNA, 12 bp, Homo sapiens
ccctgcctgagg

SEQ ID NO: 4537069 - DNA, 13 bp, Homo sapiens
ccctgcctgaggg

SEQ ID NO: 4537070 - DNA, 12 bp, Homo sapiens
ccctgcctgcag

SEQ ID NO: 4537071 - DNA, 14 bp, Homo sapiens
ccctgcctgcagcc

SEQ ID NO: 4537072 - DNA, 15 bp, Homo sapiens
ccctgcctgcagcca

SEQ ID NO: 4537073 - DNA, 22 bp, Homo sapiens
ccctgcctgcagccagggctgg

SEQ ID NO: 4537074 - DNA, 23 bp, Homo sapiens
ccctgcctgcagccagggctggg

SEQ ID NO: 4537075 - DNA, 21 bp, Homo sapiens
ccctgcctggcccccaacctc

SEQ ID NO: 4537076 - DNA, 17 bp, Homo sapiens
ccctgcctgtgcccgca

SEQ ID NO: 4537077 - DNA, 12 bp, Homo sapiens
ccctgcctgtgg

SEQ ID NO: 4537078 - DNA, 23 bp, Homo sapiens
ccctgcctgttggcaggcccact

SEQ ID NO: 4537079 - DNA, 18 bp, Homo sapiens
ccctgcgggcgcgggcag

SEQ ID NO: 4537080 - DNA, 24 bp, Homo sapiens
ccctgcgggcgcgggcagccaccc

SEQ ID NO: 4537081 - DNA, 17 bp, Homo sapiens
ccctgcgtgggggccag

SEQ ID NO: 4537082 - DNA, 17 bp, Homo sapiens
ccctgctactcctgtgc

SEQ ID NO: 4537083 - DNA, 18 bp, Homo sapiens
ccctgctactcctgtgct

SEQ ID NO: 4537084 - DNA, 21 bp, Homo sapiens
ccctgctactcctgtgctctg

SEQ ID NO: 4537085 - DNA, 15 bp, Homo sapiens
ccctgctcactgggc

SEQ ID NO: 4537086 - DNA, 12 bp, Homo sapiens
ccctgctcagtg

SEQ ID NO: 4537087 - DNA, 13 bp, Homo sapiens
ccctgctcagtgc

SEQ ID NO: 4537088 - DNA, 16 bp, Homo sapiens
ccctgctcagtgcttg

SEQ ID NO: 4537089 - DNA, 14 bp, Homo sapiens
ccctgctccaccag

SEQ ID NO: 4537090 - DNA, 15 bp, Homo sapiens
ccctgctccaccagc

SEQ ID NO: 4537091 - DNA, 16 bp, Homo sapiens
ccctgctccaccagca

SEQ ID NO: 4537092 - DNA, 20 bp, Homo sapiens
ccctgctccaccagcagcat

SEQ ID NO: 4537093 - DNA, 17 bp, Homo sapiens
ccctgctccctgcctcc

SEQ ID NO: 4537094 - DNA, 19 bp, Homo sapiens
ccctgctccctgcctcctg

SEQ ID NO: 4537095 - DNA, 19 bp, Homo sapiens
ccctgctcttctctcccca

SEQ ID NO: 4537096 - DNA, 20 bp, Homo sapiens
ccctgctcttctctccccag

SEQ ID NO: 4537097 - DNA, 22 bp, Homo sapiens
ccctgctcttctctccccagcc

SEQ ID NO: 4537098 - DNA, 19 bp, Homo sapiens
ccctgctgaccttggagga

SEQ ID NO: 4537099 - DNA, 13 bp, Homo sapiens
ccctgctggctct

SEQ ID NO: 4537100 - DNA, 21 bp, Homo sapiens
ccctgctggctcttctgccca

SEQ ID NO: 4537101 - DNA, 22 bp, Homo sapiens
ccctgctggggaagaacagccc

SEQ ID NO: 4537102 - DNA, 13 bp, Homo sapiens
ccctgctgtgcca

SEQ ID NO: 4537103 - DNA, 20 bp, Homo sapiens
ccctgctgtgccatgctggg

SEQ ID NO: 4537104 - DNA, 21 bp, Homo sapiens
ccctgctgtgccatgctgggc

SEQ ID NO: 4537105 - DNA, 14 bp, Homo sapiens
ccctgctgtgggag

SEQ ID NO: 4537106 - DNA, 14 bp, Homo sapiens
ccctgcttccagga

SEQ ID NO: 4537107 - DNA, 10 bp, Homo sapiens
ccctgctttt

SEQ ID NO: 4537108 - DNA, 14 bp, Homo sapiens
ccctggactgtttc

SEQ ID NO: 4537109 - DNA, 15 bp, Homo sapiens
ccctggactgtttca

SEQ ID NO: 4537110 - DNA, 17 bp, Homo sapiens
ccctggacttgcctctg

SEQ ID NO: 4537111 - DNA, 11 bp, Homo sapiens
aaacagaaaac

SEQ ID NO: 4537112 - DNA, 14 bp, Homo sapiens
aaacagaatttttc

SEQ ID NO: 4537113 - DNA, 22 bp, Homo sapiens
aaacagacaaaaacagcctcac

SEQ ID NO: 4537114 - DNA, 20 bp, Homo sapiens
aaacagacaggaatttagaa

SEQ ID NO: 4537115 - DNA, 22 bp, Homo sapiens
aaacagagtggcctccctgctg

SEQ ID NO: 4537116 - DNA, 17 bp, Homo sapiens
aaacagcaccaccattt

SEQ ID NO: 4537117 - DNA, 16 bp, Homo sapiens
aaacagcccccctgct

SEQ ID NO: 4537118 - DNA, 16 bp, Homo sapiens
aaacagcgtcttcctt

SEQ ID NO: 4537119 - DNA, 11 bp, Homo sapiens
aaacagctgcc

SEQ ID NO: 4537120 - DNA, 18 bp, Homo sapiens
aaacaggaaaaaaacttt

SEQ ID NO: 4537121 - DNA, 20 bp, Homo sapiens
aaacaggaaaaaaactttta

SEQ ID NO: 4537122 - DNA, 17 bp, Homo sapiens
aaacagggccacataga

SEQ ID NO: 4537123 - DNA, 18 bp, Homo sapiens
aaacagtgcctgctgaat

SEQ ID NO: 4537124 - DNA, 16 bp, Homo sapiens
aaacagttggtaactt

SEQ ID NO: 4537125 - DNA, 20 bp, Homo sapiens
aaacataatatagcttaaaa

SEQ ID NO: 4537126 - DNA, 14 bp, Homo sapiens
aaacatagaaatgg

SEQ ID NO: 4537127 - DNA, 14 bp, Homo sapiens
aaacatatggcttt

SEQ ID NO: 4537128 - DNA, 17 bp, Homo sapiens
aaacatatttttatact

SEQ ID NO: 4537129 - DNA, 16 bp, Homo sapiens
aaacatcactatcaat

SEQ ID NO: 4537130 - DNA, 19 bp, Homo sapiens
aaacatcattcatttttgt

SEQ ID NO: 4537131 - DNA, 21 bp, Homo sapiens
aaacatgaccctaaatcttga

SEQ ID NO: 4537132 - DNA, 12 bp, Homo sapiens
aaacatgcagaa

SEQ ID NO: 4537133 - DNA, 14 bp, Homo sapiens
aaacatggagaaat

SEQ ID NO: 4537134 - DNA, 17 bp, Homo sapiens
aaacatggagaaatcta

SEQ ID NO: 4537135 - DNA, 15 bp, Homo sapiens
aaacatgtactacag

SEQ ID NO: 4537136 - DNA, 15 bp, Homo sapiens
aaacatgtatttatg

SEQ ID NO: 4537137 - DNA, 20 bp, Homo sapiens
aaacatgtcacaatacagta

SEQ ID NO: 4537138 - DNA, 19 bp, Homo sapiens
aaacattatatgtatacat

SEQ ID NO: 4537139 - DNA, 19 bp, Homo sapiens
aaacattcctccagcctcc

SEQ ID NO: 4537140 - DNA, 16 bp, Homo sapiens
aaacattgaagtaatg

SEQ ID NO: 4537141 - DNA, 18 bp, Homo sapiens
aaacattgcctttgaatg

SEQ ID NO: 4537142 - DNA, 21 bp, Homo sapiens
aaacatttattttgacataaa

SEQ ID NO: 4537143 - DNA, 18 bp, Homo sapiens
aaacatttcataatttgt

SEQ ID NO: 4537144 - DNA, 21 bp, Homo sapiens
aaacatttcataatttgtttc

SEQ ID NO: 4537145 - DNA, 21 bp, Homo sapiens
aaacatttctggacagtacct

SEQ ID NO: 4537146 - DNA, 19 bp, Homo sapiens
aaacatttgattaataaaa

SEQ ID NO: 4537147 - DNA, 23 bp, Homo sapiens
aaacatttgattaataaaatatc

SEQ ID NO: 4537148 - DNA, 17 bp, Homo sapiens
aaacatttgtttccccc

SEQ ID NO: 4537149 - DNA, 19 bp, Homo sapiens
aaacattttaaatgaaagt

SEQ ID NO: 4537150 - DNA, 16 bp, Homo sapiens
aaacatttttgttctt

SEQ ID NO: 4537151 - DNA, 16 bp, Homo sapiens
aaacattttttataca

SEQ ID NO: 4537152 - DNA, 21 bp, Homo sapiens
aaacattttttatacatttgg

SEQ ID NO: 4537153 - DNA, 15 bp, Homo sapiens
aaacattttttcttc

SEQ ID NO: 4537154 - DNA, 17 bp, Homo sapiens
aaaccaaaaacatttga

SEQ ID NO: 4537155 - DNA, 18 bp, Homo sapiens
aaaccaaaatgacatctt

SEQ ID NO: 4537156 - DNA, 19 bp, Homo sapiens
aaaccaaaatgacatcttt

SEQ ID NO: 4537157 - DNA, 16 bp, Homo sapiens
aaaccaaacacccaga

SEQ ID NO: 4537158 - DNA, 17 bp, Homo sapiens
aaaccaaacacccagag

SEQ ID NO: 4537159 - DNA, 21 bp, Homo sapiens
aaaccaaagagggcttcctct

SEQ ID NO: 4537160 - DNA, 19 bp, Homo sapiens
aaaccaagggtacagatcc

SEQ ID NO: 4537161 - DNA, 12 bp, Homo sapiens
aaaccacagcag

SEQ ID NO: 4537162 - DNA, 15 bp, Homo sapiens
aaaccactaaagtag

SEQ ID NO: 4537163 - DNA, 18 bp, Homo sapiens
aaaccactgaaaaaatat

SEQ ID NO: 4537164 - DNA, 11 bp, Homo sapiens
aaaccagaacc

SEQ ID NO: 4537165 - DNA, 19 bp, Homo sapiens
aaaccagatctgtctccaa

SEQ ID NO: 4537166 - DNA, 22 bp, Homo sapiens
aaaccagctctgaacttccaag

SEQ ID NO: 4537167 - DNA, 16 bp, Homo sapiens
aaaccaggaccctgtc

SEQ ID NO: 4537168 - DNA, 13 bp, Homo sapiens
aaaccagtattta

SEQ ID NO: 4537169 - DNA, 18 bp, Homo sapiens
aaaccagtatttaagctt

SEQ ID NO: 4537170 - DNA, 15 bp, Homo sapiens
aaaccattgctctta

SEQ ID NO: 4537171 - DNA, 18 bp, Homo sapiens
aaaccatttttgttactc

SEQ ID NO: 4537172 - DNA, 23 bp, Homo sapiens
aaaccatttttgttactctcttc

SEQ ID NO: 4537173 - DNA, 16 bp, Homo sapiens
aaacccaaaatatata

SEQ ID NO: 4537174 - DNA, 15 bp, Homo sapiens
aaacccaatccaaat

SEQ ID NO: 4537175 - DNA, 12 bp, Homo sapiens
aaacccagagag

SEQ ID NO: 4537176 - DNA, 17 bp, Homo sapiens
aaacccccttttccctt

SEQ ID NO: 4537177 - DNA, 22 bp, Homo sapiens
aaacccccttttcccttcagct

SEQ ID NO: 4537178 - DNA, 14 bp, Homo sapiens
aaaccctcagagcc

SEQ ID NO: 4537179 - DNA, 18 bp, Homo sapiens
aaaccctcattgtgtttc

SEQ ID NO: 4537180 - DNA, 20 bp, Homo sapiens
aaaccctggtgctttccttc

SEQ ID NO: 4537181 - DNA, 16 bp, Homo sapiens
aaaccctttagtgctt

SEQ ID NO: 4537182 - DNA, 16 bp, Homo sapiens
aaacctaaagaggaaa

SEQ ID NO: 4537183 - DNA, 16 bp, Homo sapiens
aaacctagtactgccc

SEQ ID NO: 4537184 - DNA, 11 bp, Homo sapiens
aaacctcaggg

SEQ ID NO: 4537185 - DNA, 15 bp, Homo sapiens
aaacctcagggctgt

SEQ ID NO: 4537186 - DNA, 17 bp, Homo sapiens
aaacctctcctgacccc

SEQ ID NO: 4537187 - DNA, 18 bp, Homo sapiens
aaacctctcctgacccct

SEQ ID NO: 4537188 - DNA, 20 bp, Homo sapiens
aaacctgcagtttttaattt

SEQ ID NO: 4537189 - DNA, 23 bp, Homo sapiens
aaacctggattttttatgtacaa

SEQ ID NO: 4537190 - DNA, 21 bp, Homo sapiens
aaacctggttcatatttatac

SEQ ID NO: 4537191 - DNA, 17 bp, Homo sapiens
aaaccttaagtgctgca

SEQ ID NO: 4537192 - DNA, 13 bp, Homo sapiens
aaaccttaatatt

SEQ ID NO: 4537193 - DNA, 19 bp, Homo sapiens
aaaccttaatatttcttca

SEQ ID NO: 4537194 - DNA, 23 bp, Homo sapiens
aaaccttaatatttcttcaaata

SEQ ID NO: 4537195 - DNA, 19 bp, Homo sapiens
aaaccttaccttggaattg

SEQ ID NO: 4537196 - DNA, 23 bp, Homo sapiens
aaaccttagtcatcagatatgct

SEQ ID NO: 4537197 - DNA, 13 bp, Homo sapiens
aaaccttcctggg

SEQ ID NO: 4537198 - DNA, 21 bp, Homo sapiens
aaaccttcctgggaggacagg

SEQ ID NO: 4537199 - DNA, 20 bp, Homo sapiens
aaaccttgctctcctcatct

SEQ ID NO: 4537200 - DNA, 15 bp, Homo sapiens
aaacctttaaaaaaa

SEQ ID NO: 4537201 - DNA, 14 bp, Homo sapiens
aaacctttccattt

SEQ ID NO: 4537202 - DNA, 15 bp, Homo sapiens
aaacctttgtttcaa

SEQ ID NO: 4537203 - DNA, 16 bp, Homo sapiens
aaaccttttcttgtat

SEQ ID NO: 4537204 - DNA, 23 bp, Homo sapiens
aaacctttttataaagatcattt

SEQ ID NO: 4537205 - DNA, 23 bp, Homo sapiens
aaacgcagttgtgtggcccagca

SEQ ID NO: 4537206 - DNA, 22 bp, Homo sapiens
aaacgctaaagagcccttgcct

SEQ ID NO: 4537207 - DNA, 21 bp, Homo sapiens
aaacggcaacgtagcctgggc

SEQ ID NO: 4537208 - DNA, 16 bp, Homo sapiens
aaacggtgcccatcct

SEQ ID NO: 4537209 - DNA, 22 bp, Homo sapiens
aaactaagagacagttctctgt

SEQ ID NO: 4537210 - DNA, 13 bp, Homo sapiens
aaactaagccagg

SEQ ID NO: 4537211 - DNA, 12 bp, Homo sapiens
aaactaatacgt

SEQ ID NO: 4537212 - DNA, 21 bp, Homo sapiens
aaactacagaatattaaatat

SEQ ID NO: 4537213 - DNA, 12 bp, Homo sapiens
aaactacatttc

SEQ ID NO: 4537214 - DNA, 15 bp, Homo sapiens
aaactaccaaattag

SEQ ID NO: 4537215 - DNA, 22 bp, Homo sapiens
aaactactatttttctttccaa

SEQ ID NO: 4537216 - DNA, 13 bp, Homo sapiens
aaactactctttg

SEQ ID NO: 4537217 - DNA, 14 bp, Homo sapiens
aaactactctttga

SEQ ID NO: 4537218 - DNA, 17 bp, Homo sapiens
aaactacttttctaaaa

SEQ ID NO: 4537219 - DNA, 18 bp, Homo sapiens
aaactacttttctaaaat

SEQ ID NO: 4537220 - DNA, 15 bp, Homo sapiens
aaactagcaactctt

SEQ ID NO: 4537221 - DNA, 19 bp, Homo sapiens
aaactagcaactcttattt

SEQ ID NO: 4537222 - DNA, 19 bp, Homo sapiens
aaactagctttgctcttta

SEQ ID NO: 4537223 - DNA, 21 bp, Homo sapiens
aaactaggagatgaaactggt

SEQ ID NO: 4537224 - DNA, 21 bp, Homo sapiens
aaactagtttaagggtggaaa

SEQ ID NO: 4537225 - DNA, 15 bp, Homo sapiens
aaactagtttttcct

SEQ ID NO: 4537226 - DNA, 16 bp, Homo sapiens
aaactagtttttccta

SEQ ID NO: 4537227 - DNA, 13 bp, Homo sapiens
aaactataaactt

SEQ ID NO: 4537228 - DNA, 22 bp, Homo sapiens
aaactataagcaagaaggcaaa

SEQ ID NO: 4537229 - DNA, 13 bp, Homo sapiens
aaactatacttga

SEQ ID NO: 4537230 - DNA, 18 bp, Homo sapiens
aaactatacttgaacaaa

SEQ ID NO: 4537231 - DNA, 21 bp, Homo sapiens
aaactatgtgtttttctcata

SEQ ID NO: 4537232 - DNA, 13 bp, Homo sapiens
aaactatttgtat

SEQ ID NO: 4537233 - DNA, 15 bp, Homo sapiens
aaactatttgtataa

SEQ ID NO: 4537234 - DNA, 14 bp, Homo sapiens
aaactcaaggaaaa

SEQ ID NO: 4537235 - DNA, 21 bp, Homo sapiens
aaactcatgatcaagatatat

SEQ ID NO: 4537236 - DNA, 15 bp, Homo sapiens
aaactcattgcagca

SEQ ID NO: 4537237 - DNA, 17 bp, Homo sapiens
aaactcattgcagcaga

SEQ ID NO: 4537238 - DNA, 14 bp, Homo sapiens
aaactccgaagaaa

SEQ ID NO: 4537239 - DNA, 14 bp, Homo sapiens
aaactcctatttca

SEQ ID NO: 4537240 - DNA, 16 bp, Homo sapiens
aaactcctatttcaat

SEQ ID NO: 4537241 - DNA, 14 bp, Homo sapiens
aaactcctgtgacc

SEQ ID NO: 4537242 - DNA, 21 bp, Homo sapiens
aaactcgcgagtgtaactttc

SEQ ID NO: 4537243 - DNA, 19 bp, Homo sapiens
aaactctggtgataaaaat

SEQ ID NO: 4537244 - DNA, 13 bp, Homo sapiens
aaactcttttccc

SEQ ID NO: 4537245 - DNA, 17 bp, Homo sapiens
aaactgaacttgaagct

SEQ ID NO: 4537246 - DNA, 20 bp, Homo sapiens
aaactgaacttgaagctaac

SEQ ID NO: 4537247 - DNA, 23 bp, Homo sapiens
aaactgagatgtgaacacatcag

SEQ ID NO: 4537248 - DNA, 13 bp, Homo sapiens
aaactgagtcact

SEQ ID NO: 4537249 - DNA, 22 bp, Homo sapiens
aaactgagtcactcacattgag

SEQ ID NO: 4537250 - DNA, 22 bp, Homo sapiens
aaactgatccagtataagacta

SEQ ID NO: 4537251 - DNA, 13 bp, Homo sapiens
aaactgatttctc

SEQ ID NO: 4537252 - DNA, 23 bp, Homo sapiens
aaactgcatcccacgttctgtta

SEQ ID NO: 4537253 - DNA, 14 bp, Homo sapiens
aaactgcatctgga

SEQ ID NO: 4537254 - DNA, 11 bp, Homo sapiens
aaactgcattt

SEQ ID NO: 4537255 - DNA, 12 bp, Homo sapiens
aaactgctttat

SEQ ID NO: 4537256 - DNA, 13 bp, Homo sapiens
aaactgctttatt

SEQ ID NO: 4537257 - DNA, 15 bp, Homo sapiens
aaactggaattcttt

SEQ ID NO: 4537258 - DNA, 19 bp, Homo sapiens
aaactggcttccccactcc

SEQ ID NO: 4537259 - DNA, 19 bp, Homo sapiens
aaactgggattaagaaacc

SEQ ID NO: 4537260 - DNA, 16 bp, Homo sapiens
aaactgggtttctcat

SEQ ID NO: 4537261 - DNA, 16 bp, Homo sapiens
aaactggtattttatc

SEQ ID NO: 4537262 - DNA, 22 bp, Homo sapiens
aaactggtattttatctttgat

SEQ ID NO: 4537263 - DNA, 14 bp, Homo sapiens
aaactgtcactgtt

SEQ ID NO: 4537264 - DNA, 14 bp, Homo sapiens
aaactgtgcaatcc

SEQ ID NO: 4537265 - DNA, 19 bp, Homo sapiens
aaactgtgtattccaagac

SEQ ID NO: 4537266 - DNA, 14 bp, Homo sapiens
aaactgtgttgcca

SEQ ID NO: 4537267 - DNA, 16 bp, Homo sapiens
aaactgtgttgccaca

SEQ ID NO: 4537268 - DNA, 19 bp, Homo sapiens
aaactgtttgacttctcaa

SEQ ID NO: 4537269 - DNA, 15 bp, Homo sapiens
aaacttaaaaacaag

SEQ ID NO: 4537270 - DNA, 21 bp, Homo sapiens
aaacttaaatgttattatctg

SEQ ID NO: 4537271 - DNA, 23 bp, Homo sapiens
aaacttagcttttgatgtctcca

SEQ ID NO: 4537272 - DNA, 18 bp, Homo sapiens
aaacttaggatataagag

SEQ ID NO: 4537273 - DNA, 19 bp, Homo sapiens
aaacttattggaatgttga

SEQ ID NO: 4537274 - DNA, 19 bp, Homo sapiens
aaacttcagacatagaatt

SEQ ID NO: 4537275 - DNA, 20 bp, Homo sapiens
aaacttcagtttcacagaaa

SEQ ID NO: 4537276 - DNA, 16 bp, Homo sapiens
aaacttcatgtaattt

SEQ ID NO: 4537277 - DNA, 17 bp, Homo sapiens
aaacttccccatcttct

SEQ ID NO: 4537278 - DNA, 11 bp, Homo sapiens
aaacttgaaat

SEQ ID NO: 4537279 - DNA, 15 bp, Homo sapiens
aaacttgaaatatat

SEQ ID NO: 4537280 - DNA, 18 bp, Homo sapiens
aaacttgaaatatataat

SEQ ID NO: 4537281 - DNA, 13 bp, Homo sapiens
aaacttggatact

SEQ ID NO: 4537282 - DNA, 17 bp, Homo sapiens
aaacttggatacttgga

SEQ ID NO: 4537283 - DNA, 20 bp, Homo sapiens
aaacttggtgcttattgata

SEQ ID NO: 4537284 - DNA, 13 bp, Homo sapiens
aaacttgtgaatg

SEQ ID NO: 4537285 - DNA, 15 bp, Homo sapiens
aaacttgtgaatgct

SEQ ID NO: 4537286 - DNA, 12 bp, Homo sapiens
aaactttaaaga

SEQ ID NO: 4537287 - DNA, 22 bp, Homo sapiens
aaactttaaagcgtttgcacag

SEQ ID NO: 4537288 - DNA, 15 bp, Homo sapiens
aaactttagacttcc

SEQ ID NO: 4537289 - DNA, 16 bp, Homo sapiens
aaactttaggtttttt

SEQ ID NO: 4537290 - DNA, 15 bp, Homo sapiens
aaactttattttata

SEQ ID NO: 4537291 - DNA, 18 bp, Homo sapiens
aaactttctccatttaag

SEQ ID NO: 4537292 - DNA, 14 bp, Homo sapiens
aaactttctctgca

SEQ ID NO: 4537293 - DNA, 16 bp, Homo sapiens
aaactttgaagttagc

SEQ ID NO: 4537294 - DNA, 16 bp, Homo sapiens
aaactttggcctttgt

SEQ ID NO: 4537295 - DNA, 12 bp, Homo sapiens
aaactttgtcac

SEQ ID NO: 4537296 - DNA, 20 bp, Homo sapiens
aaacttttaagatttctcta

SEQ ID NO: 4537297 - DNA, 19 bp, Homo sapiens
aaacttttaggttgttacc

SEQ ID NO: 4537298 - DNA, 13 bp, Homo sapiens
aaacttttataaa

SEQ ID NO: 4537299 - DNA, 12 bp, Homo sapiens
aaactttttaat

SEQ ID NO: 4537300 - DNA, 18 bp, Homo sapiens
aaactttttgttcatgtg

SEQ ID NO: 4537301 - DNA, 19 bp, Homo sapiens
aaacttttttatttaaaaa

SEQ ID NO: 4537302 - DNA, 23 bp, Homo sapiens
aaagaaaaatctcattatttcaa

SEQ ID NO: 4537303 - DNA, 14 bp, Homo sapiens
aaagaaaacaaaaa

SEQ ID NO: 4537304 - DNA, 13 bp, Homo sapiens
aaagaaaaccttt

SEQ ID NO: 4537305 - DNA, 16 bp, Homo sapiens
aaagaaaagaaaattt

SEQ ID NO: 4537306 - DNA, 23 bp, Homo sapiens
aaagaaaataaagacaaccatat

SEQ ID NO: 4537307 - DNA, 13 bp, Homo sapiens
aaagaaaatgtct

SEQ ID NO: 4537308 - DNA, 13 bp, Homo sapiens
aaagaaaattcct

SEQ ID NO: 4537309 - DNA, 15 bp, Homo sapiens
aaagaaagtacccag

SEQ ID NO: 4537310 - DNA, 15 bp, Homo sapiens
aaagaaatatacagt

SEQ ID NO: 4537311 - DNA, 16 bp, Homo sapiens
aaagaaatatacagtt

SEQ ID NO: 4537312 - DNA, 13 bp, Homo sapiens
aaagaaatgaaca

SEQ ID NO: 4537313 - DNA, 14 bp, Homo sapiens
aaagaaatgaacat

SEQ ID NO: 4537314 - DNA, 20 bp, Homo sapiens
aaagaacatgcagtttgaaa

SEQ ID NO: 4537315 - DNA, 19 bp, Homo sapiens
aaagaagcttccacaaaat

SEQ ID NO: 4537316 - DNA, 16 bp, Homo sapiens
aaagaataaaatgttt

SEQ ID NO: 4537317 - DNA, 13 bp, Homo sapiens
aaagaatacttga

SEQ ID NO: 4537318 - DNA, 14 bp, Homo sapiens
aaagaatacttgaa

SEQ ID NO: 4537319 - DNA, 16 bp, Homo sapiens
aaagaatacttgaact

SEQ ID NO: 4537320 - DNA, 15 bp, Homo sapiens
aaagaatatgacttt

SEQ ID NO: 4537321 - DNA, 20 bp, Homo sapiens
aaagaatatgactttttata

SEQ ID NO: 4537322 - DNA, 12 bp, Homo sapiens
aaagaatttgtt

SEQ ID NO: 4537323 - DNA, 13 bp, Homo sapiens
aaagaatttgtta

SEQ ID NO: 4537324 - DNA, 13 bp, Homo sapiens
aaagaattttcat

SEQ ID NO: 4537325 - DNA, 13 bp, Homo sapiens
aaagacaaatttt

SEQ ID NO: 4537326 - DNA, 15 bp, Homo sapiens
aaagacaaattttgc

SEQ ID NO: 4537327 - DNA, 21 bp, Homo sapiens
aaagacatcagtctccaacat

SEQ ID NO: 4537328 - DNA, 16 bp, Homo sapiens
aaagacatctgcctgt

SEQ ID NO: 4537329 - DNA, 17 bp, Homo sapiens
aaagacattttttaaaa

SEQ ID NO: 4537330 - DNA, 15 bp, Homo sapiens
aaagactattcaaac

SEQ ID NO: 4537331 - DNA, 19 bp, Homo sapiens
aaagactattcaaacagtc

SEQ ID NO: 4537332 - DNA, 14 bp, Homo sapiens
aaagactattttct

SEQ ID NO: 4537333 - DNA, 14 bp, Homo sapiens
aaagactccaaaga

SEQ ID NO: 4537334 - DNA, 13 bp, Homo sapiens
aaagactggcttt

SEQ ID NO: 4537335 - DNA, 21 bp, Homo sapiens
aaagactggcttttattaatg

SEQ ID NO: 4537336 - DNA, 23 bp, Homo sapiens
aaagactggcttttattaatgca

SEQ ID NO: 4537337 - DNA, 15 bp, Homo sapiens
aaagactggttttct

SEQ ID NO: 4537338 - DNA, 16 bp, Homo sapiens
aaagactggttttctg

SEQ ID NO: 4537339 - DNA, 13 bp, Homo sapiens
aaagagaaacttt

SEQ ID NO: 4537340 - DNA, 14 bp, Homo sapiens
aaagagaaggagcc

SEQ ID NO: 4537341 - DNA, 12 bp, Homo sapiens
aaagagacattt

SEQ ID NO: 4537342 - DNA, 15 bp, Homo sapiens
aaagagacatttcaa

SEQ ID NO: 4537343 - DNA, 23 bp, Homo sapiens
aaagagcaagtctggatctggga

SEQ ID NO: 4537344 - DNA, 14 bp, Homo sapiens
aaagaggatgattt

SEQ ID NO: 4537345 - DNA, 20 bp, Homo sapiens
aaagaggctgcccctctcac

SEQ ID NO: 4537346 - DNA, 13 bp, Homo sapiens
aaagagggacaag

SEQ ID NO: 4537347 - DNA, 16 bp, Homo sapiens
aaagagtaatttcatt

SEQ ID NO: 4537348 - DNA, 18 bp, Homo sapiens
aaagagtaatttcattta

SEQ ID NO: 4537349 - DNA, 21 bp, Homo sapiens
aaagagtacactcagccactg

SEQ ID NO: 4537350 - DNA, 14 bp, Homo sapiens
aaagagtcttccaa

SEQ ID NO: 4537351 - DNA, 19 bp, Homo sapiens
aaagagtgtgttataaaat

SEQ ID NO: 4537352 - DNA, 20 bp, Homo sapiens
aaagagttattcaaatgaag

SEQ ID NO: 4537353 - DNA, 16 bp, Homo sapiens
aaagagttcaagaaat

SEQ ID NO: 4537354 - DNA, 20 bp, Homo sapiens
aaagagttcaagaaataagt

SEQ ID NO: 4537355 - DNA, 24 bp, Homo sapiens
aaagataatcgaagcaaaagtaat

SEQ ID NO: 4537356 - DNA, 20 bp, Homo sapiens
aaagataatttatttcaata

SEQ ID NO: 4537357 - DNA, 14 bp, Homo sapiens
aaagatacatgatt

SEQ ID NO: 4537358 - DNA, 16 bp, Homo sapiens
aaagatacatgattga

SEQ ID NO: 4537359 - DNA, 17 bp, Homo sapiens
aaagatacatgattgaa

SEQ ID NO: 4537360 - DNA, 23 bp, Homo sapiens
aaagatatggagaattgctgaag

SEQ ID NO: 4537361 - DNA, 13 bp, Homo sapiens
aaagatcacacat

SEQ ID NO: 4537362 - DNA, 21 bp, Homo sapiens
aaagatctgttttgaaggcaa

SEQ ID NO: 4537363 - DNA, 19 bp, Homo sapiens
aaagattctggggctgtgt

SEQ ID NO: 4537364 - DNA, 16 bp, Homo sapiens
aaagatttcatatcta

SEQ ID NO: 4537365 - DNA, 18 bp, Homo sapiens
aaagatttcatatctaac

SEQ ID NO: 4537366 - DNA, 20 bp, Homo sapiens
aaagatttgtgaactggaag

SEQ ID NO: 4537367 - DNA, 14 bp, Homo sapiens
aaagcaaaaaagaa

SEQ ID NO: 4537368 - DNA, 17 bp, Homo sapiens
aaagcaaaataaaaact

SEQ ID NO: 4537369 - DNA, 18 bp, Homo sapiens
aaagcaagaatcagagaa

SEQ ID NO: 4537370 - DNA, 14 bp, Homo sapiens
aaagcaatattgta

SEQ ID NO: 4537371 - DNA, 17 bp, Homo sapiens
aaagcaattctgactgt

SEQ ID NO: 4537372 - DNA, 12 bp, Homo sapiens
aaagcacctgcc

SEQ ID NO: 4537373 - DNA, 18 bp, Homo sapiens
aaagcactagagaatgca

SEQ ID NO: 4537374 - DNA, 22 bp, Homo sapiens
aaagcactagagaatgcacaga

SEQ ID NO: 4537375 - DNA, 17 bp, Homo sapiens
aaagcactgacttctaa

SEQ ID NO: 4537376 - DNA, 23 bp, Homo sapiens
aaagcactggtttcaagaatatg

SEQ ID NO: 4537377 - DNA, 20 bp, Homo sapiens
aaagcagcaggcctctggtt

SEQ ID NO: 4537378 - DNA, 24 bp, Homo sapiens
aaagcaggcttgcccagtacattt

SEQ ID NO: 4537379 - DNA, 16 bp, Homo sapiens
aaagcagttaaactga

SEQ ID NO: 4537380 - DNA, 15 bp, Homo sapiens
aaagcataaaatgga

SEQ ID NO: 4537381 - DNA, 22 bp, Homo sapiens
aaagcataaagctcaaatgaaa

SEQ ID NO: 4537382 - DNA, 20 bp, Homo sapiens
aaagcatcaccactcatttt

SEQ ID NO: 4537383 - DNA, 18 bp, Homo sapiens
aaagcatggacatttaga

SEQ ID NO: 4537384 - DNA, 11 bp, Homo sapiens
aaagcatgtat

SEQ ID NO: 4537385 - DNA, 13 bp, Homo sapiens
aaagcatgtatag

SEQ ID NO: 4537386 - DNA, 15 bp, Homo sapiens
aaagcattatttttt

SEQ ID NO: 4537387 - DNA, 17 bp, Homo sapiens
aaagcatttcttttctc

SEQ ID NO: 4537388 - DNA, 11 bp, Homo sapiens
aaagcattttt

SEQ ID NO: 4537389 - DNA, 22 bp, Homo sapiens
aaagccacgccctccctgctag

SEQ ID NO: 4537390 - DNA, 17 bp, Homo sapiens
aaagccattctgattat

SEQ ID NO: 4537391 - DNA, 15 bp, Homo sapiens
aaagcccaaagtggt

SEQ ID NO: 4537392 - DNA, 18 bp, Homo sapiens
aaagcccgcttgctcgct

SEQ ID NO: 4537393 - DNA, 17 bp, Homo sapiens
aaagccctcccccttcc

SEQ ID NO: 4537394 - DNA, 20 bp, Homo sapiens
aaagcctcctgccccctgcc

SEQ ID NO: 4537395 - DNA, 12 bp, Homo sapiens
aaagcctgctca

SEQ ID NO: 4537396 - DNA, 13 bp, Homo sapiens
aaagcctgctcaa

SEQ ID NO: 4537397 - DNA, 17 bp, Homo sapiens
aaagccttccagttttg

SEQ ID NO: 4537398 - DNA, 21 bp, Homo sapiens
aaagccttccagttttgtgga

SEQ ID NO: 4537399 - DNA, 10 bp, Homo sapiens
aaagcctttt

SEQ ID NO: 4537400 - DNA, 12 bp, Homo sapiens
aaagcgaaaaaa

SEQ ID NO: 4537401 - DNA, 16 bp, Homo sapiens
aaagcgggcagccccg

SEQ ID NO: 4537402 - DNA, 22 bp, Homo sapiens
aaagcgtgtgagtgagggagac

SEQ ID NO: 4537403 - DNA, 14 bp, Homo sapiens
aaagcgtttgcaca

SEQ ID NO: 4537404 - DNA, 16 bp, Homo sapiens
aaagctaaaatatata

SEQ ID NO: 4537405 - DNA, 14 bp, Homo sapiens
aaagctagaattga

SEQ ID NO: 4537406 - DNA, 20 bp, Homo sapiens
aaagctagaattgagtgttt

SEQ ID NO: 4537407 - DNA, 15 bp, Homo sapiens
aaagctattggagat

SEQ ID NO: 4537408 - DNA, 19 bp, Homo sapiens
aaagctcaaatgaaatgta

SEQ ID NO: 4537409 - DNA, 19 bp, Homo sapiens
aaagctcatttcatgctct

SEQ ID NO: 4537410 - DNA, 22 bp, Homo sapiens
aaagctccatgtgcctctttgt

SEQ ID NO: 4537411 - DNA, 13 bp, Homo sapiens
aaagctctgaaaa

SEQ ID NO: 4537412 - DNA, 17 bp, Homo sapiens
aaagctctgtagagcat

SEQ ID NO: 4537413 - DNA, 12 bp, Homo sapiens
aaagctcttcct

SEQ ID NO: 4537414 - DNA, 19 bp, Homo sapiens
aaagctgacattgccaaaa

SEQ ID NO: 4537415 - DNA, 15 bp, Homo sapiens
aaagctgctaaatct

SEQ ID NO: 4537416 - DNA, 17 bp, Homo sapiens
aaagctgctaaatctcc

SEQ ID NO: 4537417 - DNA, 18 bp, Homo sapiens
aaagctggtttaatgttt

SEQ ID NO: 4537418 - DNA, 15 bp, Homo sapiens
aaagcttaggtcaaa

SEQ ID NO: 4537419 - DNA, 13 bp, Homo sapiens
aaagctttatctt

SEQ ID NO: 4537420 - DNA, 14 bp, Homo sapiens
aaagctttatcttt

SEQ ID NO: 4537421 - DNA, 17 bp, Homo sapiens
aaagctttatctttgtg

SEQ ID NO: 4537422 - DNA, 21 bp, Homo sapiens
aaagctttatgattttcataa

SEQ ID NO: 4537423 - DNA, 23 bp, Homo sapiens
aaagctttcatgtcccagaactt

SEQ ID NO: 4537424 - DNA, 17 bp, Homo sapiens
aaagctttcttttctaa

SEQ ID NO: 4537425 - DNA, 16 bp, Homo sapiens
aaagcttttattcctt

SEQ ID NO: 4537426 - DNA, 14 bp, Homo sapiens
aaaggaaacctttt

SEQ ID NO: 4537427 - DNA, 22 bp, Homo sapiens
aaaggaaagtttgccaggagga

SEQ ID NO: 4537428 - DNA, 12 bp, Homo sapiens
aaaggaactaga

SEQ ID NO: 4537429 - DNA, 17 bp, Homo sapiens
aaaggaatcatttctat

SEQ ID NO: 4537430 - DNA, 18 bp, Homo sapiens
aaaggacaacagttctga

SEQ ID NO: 4537431 - DNA, 22 bp, Homo sapiens
aaaggacaacagttctgagctg

SEQ ID NO: 4537432 - DNA, 23 bp, Homo sapiens
aaaggacagagccagcggctcca

SEQ ID NO: 4537433 - DNA, 16 bp, Homo sapiens
aaaggaccgttttgta

SEQ ID NO: 4537434 - DNA, 15 bp, Homo sapiens
aaaggacgcctgcag

SEQ ID NO: 4537435 - DNA, 21 bp, Homo sapiens
aaaggacgcctgcaggagaga

SEQ ID NO: 4537436 - DNA, 16 bp, Homo sapiens
aaaggacggctgagca

SEQ ID NO: 4537437 - DNA, 13 bp, Homo sapiens
aaaggactcagtg

SEQ ID NO: 4537438 - DNA, 13 bp, Homo sapiens
aaaggagaaatct

SEQ ID NO: 4537439 - DNA, 14 bp, Homo sapiens
aaaggagacatatc

SEQ ID NO: 4537440 - DNA, 16 bp, Homo sapiens
aaaggagtcaaaacta

SEQ ID NO: 4537441 - DNA, 18 bp, Homo sapiens
aaaggatagtatttttat

SEQ ID NO: 4537442 - DNA, 21 bp, Homo sapiens
aaaggatagtatttttatcca

SEQ ID NO: 4537443 - DNA, 20 bp, Homo sapiens
aaaggatgtaaacagtgcct

SEQ ID NO: 4537444 - DNA, 12 bp, Homo sapiens
aaaggattttgg

SEQ ID NO: 4537445 - DNA, 20 bp, Homo sapiens
aaaggattttggaaactcaa

SEQ ID NO: 4537446 - DNA, 13 bp, Homo sapiens
aaaggcaaatatt

SEQ ID NO: 4537447 - DNA, 14 bp, Homo sapiens
aaaggcaaatattg

SEQ ID NO: 4537448 - DNA, 15 bp, Homo sapiens
aaaggcaaatattga

SEQ ID NO: 4537449 - DNA, 16 bp, Homo sapiens
aaaggcaaatattgaa

SEQ ID NO: 4537450 - DNA, 20 bp, Homo sapiens
aaaggcaaatattgaagttg

SEQ ID NO: 4537451 - DNA, 22 bp, Homo sapiens
aaaggcaacataattcttcctt

SEQ ID NO: 4537452 - DNA, 13 bp, Homo sapiens
aaaggcacaaata

SEQ ID NO: 4537453 - DNA, 19 bp, Homo sapiens
aaaggcagaagcaacccaa

SEQ ID NO: 4537454 - DNA, 14 bp, Homo sapiens
aaaggcagcatttg

SEQ ID NO: 4537455 - DNA, 12 bp, Homo sapiens
aaaggcagctgc

SEQ ID NO: 4537456 - DNA, 14 bp, Homo sapiens
aaaggcagctgcct

SEQ ID NO: 4537457 - DNA, 15 bp, Homo sapiens
aaaggcagctgcctc

SEQ ID NO: 4537458 - DNA, 17 bp, Homo sapiens
aaaggcagctgcctctg

SEQ ID NO: 4537459 - DNA, 17 bp, Homo sapiens
aaaggcaggtttcattt

SEQ ID NO: 4537460 - DNA, 23 bp, Homo sapiens
aaaggcagtttgcaaaaaatgtt

SEQ ID NO: 4537461 - DNA, 19 bp, Homo sapiens
aaaggcatgttttaaaatc

SEQ ID NO: 4537462 - DNA, 21 bp, Homo sapiens
aaaggcatgttttaaaatcta

SEQ ID NO: 4537463 - DNA, 15 bp, Homo sapiens
aaaggcattagagtc

SEQ ID NO: 4537464 - DNA, 19 bp, Homo sapiens
aaaggccagtggaagaaac

SEQ ID NO: 4537465 - DNA, 17 bp, Homo sapiens
aaaggccgtcatttcat

SEQ ID NO: 4537466 - DNA, 17 bp, Homo sapiens
aaaggccttaacaaacg

SEQ ID NO: 4537467 - DNA, 14 bp, Homo sapiens
aaaggctaaacata

SEQ ID NO: 4537468 - DNA, 12 bp, Homo sapiens
aaaggctcattt

SEQ ID NO: 4537469 - DNA, 18 bp, Homo sapiens
aaaggctgttaaatacag

SEQ ID NO: 4537470 - DNA, 22 bp, Homo sapiens
aaaggctgttaaatacaggaaa

SEQ ID NO: 4537471 - DNA, 24 bp, Homo sapiens
aaagggaagtaacagacacacgat

SEQ ID NO: 4537472 - DNA, 14 bp, Homo sapiens
aaagggacactttt

SEQ ID NO: 4537473 - DNA, 20 bp, Homo sapiens
aaagggagaatggtgctgtt

SEQ ID NO: 4537474 - DNA, 15 bp, Homo sapiens
aaagggagtttaaaa

SEQ ID NO: 4537475 - DNA, 14 bp, Homo sapiens
aaagggagtttttg

SEQ ID NO: 4537476 - DNA, 20 bp, Homo sapiens
aaaggggacacctgtacatt

SEQ ID NO: 4537477 - DNA, 19 bp, Homo sapiens
aaaggggagagcctgctgg

SEQ ID NO: 4537478 - DNA, 11 bp, Homo sapiens
aaagggtcagg

SEQ ID NO: 4537479 - DNA, 13 bp, Homo sapiens
aaagggtcaggcc

SEQ ID NO: 4537480 - DNA, 20 bp, Homo sapiens
aaagggtttgatatggagaa

SEQ ID NO: 4537481 - DNA, 19 bp, Homo sapiens
aaagggtttgtaatacttt

SEQ ID NO: 4537482 - DNA, 20 bp, Homo sapiens
aaaggtattttaatcaccaa

SEQ ID NO: 4537483 - DNA, 13 bp, Homo sapiens
aaaggtcctgtaa

SEQ ID NO: 4537484 - DNA, 21 bp, Homo sapiens
aaaggtgcctgtgaggcaggg

SEQ ID NO: 4537485 - DNA, 18 bp, Homo sapiens
aaaggtggtgaggcaata

SEQ ID NO: 4537486 - DNA, 12 bp, Homo sapiens
aaaggtgtcttc

SEQ ID NO: 4537487 - DNA, 16 bp, Homo sapiens
aaaggtgtcttcctcc

SEQ ID NO: 4537488 - DNA, 18 bp, Homo sapiens
aaaggttcagaaaattaa

SEQ ID NO: 4537489 - DNA, 20 bp, Homo sapiens
aaaggtttaagaaatagaat

SEQ ID NO: 4537490 - DNA, 16 bp, Homo sapiens
aaaggtttatgaaaaa

SEQ ID NO: 4537491 - DNA, 19 bp, Homo sapiens
aaaggtttatgaaaaagaa

SEQ ID NO: 4537492 - DNA, 22 bp, Homo sapiens
aaaggtttatgaaaaagaagaa

SEQ ID NO: 4537493 - DNA, 14 bp, Homo sapiens
aaaggtttttgaaa

SEQ ID NO: 4537494 - DNA, 12 bp, Homo sapiens
aaagtaaacttg

SEQ ID NO: 4537495 - DNA, 13 bp, Homo sapiens
aaagtaaattatt

SEQ ID NO: 4537496 - DNA, 15 bp, Homo sapiens
aaagtaatcacttaa

SEQ ID NO: 4537497 - DNA, 13 bp, Homo sapiens
aaagtacagaatt

SEQ ID NO: 4537498 - DNA, 15 bp, Homo sapiens
aaagtacagaatttg

SEQ ID NO: 4537499 - DNA, 14 bp, Homo sapiens
aaagtacagcctgg

SEQ ID NO: 4537500 - DNA, 14 bp, Homo sapiens
aaagtacattgctt

SEQ ID NO: 4537501 - DNA, 15 bp, Homo sapiens
aaagtacctttatgt

SEQ ID NO: 4537502 - DNA, 23 bp, Homo sapiens
aaagtagcaaatgtttactgtat

SEQ ID NO: 4537503 - DNA, 12 bp, Homo sapiens
aaagtagggggc

SEQ ID NO: 4537504 - DNA, 17 bp, Homo sapiens
aaagtagttattttata

SEQ ID NO: 4537505 - DNA, 14 bp, Homo sapiens
aaagtataatgttt

SEQ ID NO: 4537506 - DNA, 16 bp, Homo sapiens
aaagtataatgtttat

SEQ ID NO: 4537507 - DNA, 23 bp, Homo sapiens
aaagtataatgtttattaaatgc

SEQ ID NO: 4537508 - DNA, 13 bp, Homo sapiens
aaagtatagagag

SEQ ID NO: 4537509 - DNA, 16 bp, Homo sapiens
aaagtatgtattattt

SEQ ID NO: 4537510 - DNA, 16 bp, Homo sapiens
aaagtatgtccttcag

SEQ ID NO: 4537511 - DNA, 20 bp, Homo sapiens
aaagtattccaccttaaatt

SEQ ID NO: 4537512 - DNA, 21 bp, Homo sapiens
aaagtattccaccttaaatta

SEQ ID NO: 4537513 - DNA, 22 bp, Homo sapiens
aaagtattcttctcttcctttt

SEQ ID NO: 4537514 - DNA, 16 bp, Homo sapiens
aaagtattgtaaatta

SEQ ID NO: 4537515 - DNA, 22 bp, Homo sapiens
aaagtatttataaaaatataaa

SEQ ID NO: 4537516 - DNA, 18 bp, Homo sapiens
aaagtattttaattttaa

SEQ ID NO: 4537517 - DNA, 18 bp, Homo sapiens
aaagtcaaaaggtgcctg

SEQ ID NO: 4537518 - DNA, 20 bp, Homo sapiens
aaagtcaaaaggtgcctgtg

SEQ ID NO: 4537519 - DNA, 19 bp, Homo sapiens
aaagtcaatgtacttgttt

SEQ ID NO: 4537520 - DNA, 13 bp, Homo sapiens
aaagtcagaagtt

SEQ ID NO: 4537521 - DNA, 15 bp, Homo sapiens
aaagtcagaagtttt

SEQ ID NO: 4537522 - DNA, 14 bp, Homo sapiens
aaagtcagaatcag

SEQ ID NO: 4537523 - DNA, 17 bp, Homo sapiens
aaagtcattattcctgg

SEQ ID NO: 4537524 - DNA, 19 bp, Homo sapiens
aaagtccaattttaattta

SEQ ID NO: 4537525 - DNA, 22 bp, Homo sapiens
aaagtccccctcctcagccagc

SEQ ID NO: 4537526 - DNA, 14 bp, Homo sapiens
aaagtccctccctg

SEQ ID NO: 4537527 - DNA, 17 bp, Homo sapiens
aaagtcctggccctggc

SEQ ID NO: 4537528 - DNA, 18 bp, Homo sapiens
aaagtcctttttttccat

SEQ ID NO: 4537529 - DNA, 22 bp, Homo sapiens
aaagtcctttttttccatcttt

SEQ ID NO: 4537530 - DNA, 16 bp, Homo sapiens
aaagtctatctaatga

SEQ ID NO: 4537531 - DNA, 18 bp, Homo sapiens
aaagtctcaatgaaatag

SEQ ID NO: 4537532 - DNA, 12 bp, Homo sapiens
aaagtctctatt

SEQ ID NO: 4537533 - DNA, 14 bp, Homo sapiens
aaagtctctattta

SEQ ID NO: 4537534 - DNA, 23 bp, Homo sapiens
aaagtctctatttaaattctttt

SEQ ID NO: 4537535 - DNA, 18 bp, Homo sapiens
aaagtctgtctttcctga

SEQ ID NO: 4537536 - DNA, 19 bp, Homo sapiens
aaagtctgtgacttgaagt

SEQ ID NO: 4537537 - DNA, 17 bp, Homo sapiens
aaagtgatgtattttca

SEQ ID NO: 4537538 - DNA, 16 bp, Homo sapiens
aaagtgattatctctt

SEQ ID NO: 4537539 - DNA, 21 bp, Homo sapiens
aaagtgattatctctttgatc

SEQ ID NO: 4537540 - DNA, 19 bp, Homo sapiens
aaagtgctgggattacagg

SEQ ID NO: 4537541 - DNA, 19 bp, Homo sapiens
aaagtggaaaacaaggaag

SEQ ID NO: 4537542 - DNA, 20 bp, Homo sapiens
aaagtggaacgaaaatgaaa

SEQ ID NO: 4537543 - DNA, 16 bp, Homo sapiens
aaagtggaattaaagg

SEQ ID NO: 4537544 - DNA, 20 bp, Homo sapiens
aaagtggggctaaatgaagt

SEQ ID NO: 4537545 - DNA, 21 bp, Homo sapiens
aaagtgggttattctggagtt

SEQ ID NO: 4537546 - DNA, 17 bp, Homo sapiens
aaagtggtaaatactgt

SEQ ID NO: 4537547 - DNA, 13 bp, Homo sapiens
aaagtggttgtcc

SEQ ID NO: 4537548 - DNA, 12 bp, Homo sapiens
aaagtgtacaga

SEQ ID NO: 4537549 - DNA, 15 bp, Homo sapiens
aaagtgtatttggaa

SEQ ID NO: 4537550 - DNA, 22 bp, Homo sapiens
aaagtgtatttggaaataaagt

SEQ ID NO: 4537551 - DNA, 20 bp, Homo sapiens
aaagtgtgagctcttccctt

SEQ ID NO: 4537552 - DNA, 23 bp, Homo sapiens
aaagtgttttgccctatatacct

SEQ ID NO: 4537553 - DNA, 15 bp, Homo sapiens
aaagttaacattaat

SEQ ID NO: 4537554 - DNA, 21 bp, Homo sapiens
aaagttacctggaatcaaata

SEQ ID NO: 4537555 - DNA, 21 bp, Homo sapiens
aaagttagtatcttttgatat

SEQ ID NO: 4537556 - DNA, 13 bp, Homo sapiens
aaagttatatttc

SEQ ID NO: 4537557 - DNA, 22 bp, Homo sapiens
aaagttatgtatttaaagttgt

SEQ ID NO: 4537558 - DNA, 12 bp, Homo sapiens
aaagttattctt

SEQ ID NO: 4537559 - DNA, 12 bp, Homo sapiens
aaagttctgtgt

SEQ ID NO: 4537560 - DNA, 13 bp, Homo sapiens
aaagttctgtgta

SEQ ID NO: 4537561 - DNA, 13 bp, Homo sapiens
aaagttcttattt

SEQ ID NO: 4537562 - DNA, 18 bp, Homo sapiens
aaagttcttattttagta

SEQ ID NO: 4537563 - DNA, 19 bp, Homo sapiens
aaagttgaaccattatact

SEQ ID NO: 4537564 - DNA, 13 bp, Homo sapiens
aaagttgaatatt

SEQ ID NO: 4537565 - DNA, 17 bp, Homo sapiens
aaagttgaatattatat

SEQ ID NO: 4537566 - DNA, 16 bp, Homo sapiens
aaagttgacatttaac

SEQ ID NO: 4537567 - DNA, 12 bp, Homo sapiens
aaagttgctttt

SEQ ID NO: 4537568 - DNA, 15 bp, Homo sapiens
aaagttgtacatgat

SEQ ID NO: 4537569 - DNA, 18 bp, Homo sapiens
aaagttgtatttcaaata

SEQ ID NO: 4537570 - DNA, 17 bp, Homo sapiens
aaagtttaaatgtattt

SEQ ID NO: 4537571 - DNA, 15 bp, Homo sapiens
aaagtttaataaatt

SEQ ID NO: 4537572 - DNA, 15 bp, Homo sapiens
aaagtttgccagaag

SEQ ID NO: 4537573 - DNA, 13 bp, Homo sapiens
aaagtttgccagg

SEQ ID NO: 4537574 - DNA, 13 bp, Homo sapiens
aaagttttacaga

SEQ ID NO: 4537575 - DNA, 17 bp, Homo sapiens
aaagttttgaaggaaac

SEQ ID NO: 4537576 - DNA, 13 bp, Homo sapiens
aaagttttgtaaa

SEQ ID NO: 4537577 - DNA, 17 bp, Homo sapiens
aaataaaaaaagatttt

SEQ ID NO: 4537578 - DNA, 13 bp, Homo sapiens
aaataaaaaagtc

SEQ ID NO: 4537579 - DNA, 19 bp, Homo sapiens
aaataaaaaatctgaagag

SEQ ID NO: 4537580 - DNA, 13 bp, Homo sapiens
aaataaaaactat

SEQ ID NO: 4537581 - DNA, 19 bp, Homo sapiens
aaataaaaagaaaggctgt

SEQ ID NO: 4537582 - DNA, 19 bp, Homo sapiens
aaataaaaagtaatgactt

SEQ ID NO: 4537583 - DNA, 17 bp, Homo sapiens
aaataaaacacacctcg

SEQ ID NO: 4537584 - DNA, 18 bp, Homo sapiens
aaataaaacacacctcgt

SEQ ID NO: 4537585 - DNA, 13 bp, Homo sapiens
aaataaaagcaca

SEQ ID NO: 4537586 - DNA, 13 bp, Homo sapiens
aaataaaatactt

SEQ ID NO: 4537587 - DNA, 15 bp, Homo sapiens
aaataaaatgaaaat

SEQ ID NO: 4537588 - DNA, 19 bp, Homo sapiens
aaataaaatgaaaattgta

SEQ ID NO: 4537589 - DNA, 15 bp, Homo sapiens
aaataaaatttgttg

SEQ ID NO: 4537590 - DNA, 16 bp, Homo sapiens
aaataaaatttgttgc

SEQ ID NO: 4537591 - DNA, 18 bp, Homo sapiens
aaataaaatttgttgcat

SEQ ID NO: 4537592 - DNA, 14 bp, Homo sapiens
aaataaactattta

SEQ ID NO: 4537593 - DNA, 13 bp, Homo sapiens
aaataaagactag

SEQ ID NO: 4537594 - DNA, 17 bp, Homo sapiens
aaataaagataaccctt

SEQ ID NO: 4537595 - DNA, 13 bp, Homo sapiens
aaataaagcaaat

SEQ ID NO: 4537596 - DNA, 23 bp, Homo sapiens
aaataaaggatgtgattgtggaa

SEQ ID NO: 4537597 - DNA, 15 bp, Homo sapiens
aaataaatagaaaag

SEQ ID NO: 4537598 - DNA, 15 bp, Homo sapiens
aaataaatagaaaga

SEQ ID NO: 4537599 - DNA, 16 bp, Homo sapiens
aaataaatatgaaagt

SEQ ID NO: 4537600 - DNA, 19 bp, Homo sapiens
aaataaatcttagtgttca

SEQ ID NO: 4537601 - DNA, 21 bp, Homo sapiens
aaataaatggtttggtgcttt

SEQ ID NO: 4537602 - DNA, 12 bp, Homo sapiens
aaataaatgttt

SEQ ID NO: 4537603 - DNA, 13 bp, Homo sapiens
aaataaattaaga

SEQ ID NO: 4537604 - DNA, 14 bp, Homo sapiens
aaataaatttatat

SEQ ID NO: 4537605 - DNA, 17 bp, Homo sapiens
aaataaatttatatgaa

SEQ ID NO: 4537606 - DNA, 13 bp, Homo sapiens
aaataaatttccc

SEQ ID NO: 4537607 - DNA, 19 bp, Homo sapiens
aaataaccaatcctggaca

SEQ ID NO: 4537608 - DNA, 20 bp, Homo sapiens
aaataacctaattaatatat

SEQ ID NO: 4537609 - DNA, 14 bp, Homo sapiens
aaataactaaaatg

SEQ ID NO: 4537610 - DNA, 15 bp, Homo sapiens
aaataactgaatttg

SEQ ID NO: 4537611 - DNA, 23 bp, Homo sapiens
aaataacttcattgtttggacct

SEQ ID NO: 4537612 - DNA, 14 bp, Homo sapiens
aaataagaaacttt

SEQ ID NO: 4537613 - DNA, 15 bp, Homo sapiens
aaataagaagaatgc

SEQ ID NO: 4537614 - DNA, 14 bp, Homo sapiens
aaataagaatagaa

SEQ ID NO: 4537615 - DNA, 22 bp, Homo sapiens
aaataagacaatagtatttctc

SEQ ID NO: 4537616 - DNA, 16 bp, Homo sapiens
aaataaggaaaagctt

SEQ ID NO: 4537617 - DNA, 22 bp, Homo sapiens
aaataaggcacccatctgtctg

SEQ ID NO: 4537618 - DNA, 18 bp, Homo sapiens
aaataagtcaacagtaaa

SEQ ID NO: 4537619 - DNA, 16 bp, Homo sapiens
aaataagtttttgttt

SEQ ID NO: 4537620 - DNA, 19 bp, Homo sapiens
aaataataaagatggtttt

SEQ ID NO: 4537621 - DNA, 16 bp, Homo sapiens
aaataatatatttctt

SEQ ID NO: 4537622 - DNA, 15 bp, Homo sapiens
aaataatcggcccac

SEQ ID NO: 4537623 - DNA, 22 bp, Homo sapiens
aaataattatataactgtattt

SEQ ID NO: 4537624 - DNA, 15 bp, Homo sapiens
aaataattcatatct

SEQ ID NO: 4537625 - DNA, 16 bp, Homo sapiens
aaataattcatatcta

SEQ ID NO: 4537626 - DNA, 14 bp, Homo sapiens
aaataattgccaca

SEQ ID NO: 4537627 - DNA, 13 bp, Homo sapiens
aaataatttaact

SEQ ID NO: 4537628 - DNA, 14 bp, Homo sapiens
aaataatttaacta

SEQ ID NO: 4537629 - DNA, 12 bp, Homo sapiens
aaatacaaaaac

SEQ ID NO: 4537630 - DNA, 20 bp, Homo sapiens
aaatacaatttttatttctt

SEQ ID NO: 4537631 - DNA, 21 bp, Homo sapiens
aaatacaatttttatttcttt

SEQ ID NO: 4537632 - DNA, 16 bp, Homo sapiens
aaatacaggaaacagt

SEQ ID NO: 4537633 - DNA, 18 bp, Homo sapiens
aaatacagttatttcatc

SEQ ID NO: 4537634 - DNA, 12 bp, Homo sapiens
aaatacatgcac

SEQ ID NO: 4537635 - DNA, 13 bp, Homo sapiens
aaatacatgctaa

SEQ ID NO: 4537636 - DNA, 19 bp, Homo sapiens
aaatacattataacaacta

SEQ ID NO: 4537637 - DNA, 21 bp, Homo sapiens
aaataccatgccatttaaagc

SEQ ID NO: 4537638 - DNA, 17 bp, Homo sapiens
aaatacctcaggaaaga

SEQ ID NO: 4537639 - DNA, 19 bp, Homo sapiens
aaataccttctatgtatta

SEQ ID NO: 4537640 - DNA, 16 bp, Homo sapiens
aaatactcagcaactg

SEQ ID NO: 4537641 - DNA, 23 bp, Homo sapiens
aaatactcttgatttcacatttc

SEQ ID NO: 4537642 - DNA, 19 bp, Homo sapiens
aaatacttctttttcatta

SEQ ID NO: 4537643 - DNA, 21 bp, Homo sapiens
aaatacttttgctttcaggga

SEQ ID NO: 4537644 - DNA, 16 bp, Homo sapiens
aaatactttttatcac

SEQ ID NO: 4537645 - DNA, 16 bp, Homo sapiens
aaatagaaagaagcca

SEQ ID NO: 4537646 - DNA, 15 bp, Homo sapiens
aaatagaaagagttc

SEQ ID NO: 4537647 - DNA, 12 bp, Homo sapiens
aaatagaacaag

SEQ ID NO: 4537648 - DNA, 15 bp, Homo sapiens
aaatagagcaaaatc

SEQ ID NO: 4537649 - DNA, 16 bp, Homo sapiens
aaatagagcaaaatca

SEQ ID NO: 4537650 - DNA, 18 bp, Homo sapiens
aaatagatgtcttttata

SEQ ID NO: 4537651 - DNA, 13 bp, Homo sapiens
aaatagcagaaag

SEQ ID NO: 4537652 - DNA, 21 bp, Homo sapiens
aaatagccctgcaaaaattca

SEQ ID NO: 4537653 - DNA, 15 bp, Homo sapiens
aaatagctatttttt

SEQ ID NO: 4537654 - DNA, 19 bp, Homo sapiens
aaatagctccgtggagcag

SEQ ID NO: 4537655 - DNA, 19 bp, Homo sapiens
aaataggctattaaaaaag

SEQ ID NO: 4537656 - DNA, 16 bp, Homo sapiens
aaatagggtctaactc

SEQ ID NO: 4537657 - DNA, 13 bp, Homo sapiens
aaatagtatacat

SEQ ID NO: 4537658 - DNA, 22 bp, Homo sapiens
aaatagtatacattgtcttgat

SEQ ID NO: 4537659 - DNA, 13 bp, Homo sapiens
aaatagtgtaaga

SEQ ID NO: 4537660 - DNA, 18 bp, Homo sapiens
aaatagtgtaagaactgt

SEQ ID NO: 4537661 - DNA, 13 bp, Homo sapiens
aaatagtgtgaaa

SEQ ID NO: 4537662 - DNA, 14 bp, Homo sapiens
aaatagtttggata

SEQ ID NO: 4537663 - DNA, 20 bp, Homo sapiens
aaatataaattgtacatttt

SEQ ID NO: 4537664 - DNA, 17 bp, Homo sapiens
aaatataaggacttttt

SEQ ID NO: 4537665 - DNA, 18 bp, Homo sapiens
aaatatacagtttgactt

SEQ ID NO: 4537666 - DNA, 12 bp, Homo sapiens
aaatatacttga

SEQ ID NO: 4537667 - DNA, 16 bp, Homo sapiens
aaatatacttgactct

SEQ ID NO: 4537668 - DNA, 19 bp, Homo sapiens
aaatatacttgactctaat

SEQ ID NO: 4537669 - DNA, 16 bp, Homo sapiens
aaatatagagacagga

SEQ ID NO: 4537670 - DNA, 12 bp, Homo sapiens
aaatatatacta

SEQ ID NO: 4537671 - DNA, 13 bp, Homo sapiens
aaatatatataaa

SEQ ID NO: 4537672 - DNA, 22 bp, Homo sapiens
aaatatatcctgtgtacctcac

SEQ ID NO: 4537673 - DNA, 14 bp, Homo sapiens
aaatatatgtatgt

SEQ ID NO: 4537674 - DNA, 20 bp, Homo sapiens
aaatatatgtatgtaaaaat

SEQ ID NO: 4537675 - DNA, 12 bp, Homo sapiens
aaatatcagctt

SEQ ID NO: 4537676 - DNA, 12 bp, Homo sapiens
aaatatcagtat

SEQ ID NO: 4537677 - DNA, 19 bp, Homo sapiens
aaatatcagtattctgaca

SEQ ID NO: 4537678 - DNA, 21 bp, Homo sapiens
aaatatcagtattctgacatg

SEQ ID NO: 4537679 - DNA, 19 bp, Homo sapiens
aaatatccatttatctttt

SEQ ID NO: 4537680 - DNA, 21 bp, Homo sapiens
aaatatctatttgaataaatt

SEQ ID NO: 4537681 - DNA, 16 bp, Homo sapiens
aaatatctctatttaa

SEQ ID NO: 4537682 - DNA, 17 bp, Homo sapiens
aaatatctctatttaat

SEQ ID NO: 4537683 - DNA, 16 bp, Homo sapiens
aaatatctgaacattt

SEQ ID NO: 4537684 - DNA, 17 bp, Homo sapiens
aaatatctgaacattta

SEQ ID NO: 4537685 - DNA, 14 bp, Homo sapiens
aaatatctgctcaa

SEQ ID NO: 4537686 - DNA, 21 bp, Homo sapiens
aaatatgatgttaaaaaaata

SEQ ID NO: 4537687 - DNA, 15 bp, Homo sapiens
aaatatgtaagaaca

SEQ ID NO: 4537688 - DNA, 16 bp, Homo sapiens
aaatatgtactgtata

SEQ ID NO: 4537689 - DNA, 18 bp, Homo sapiens
aaatatgtactgtataac

SEQ ID NO: 4537690 - DNA, 17 bp, Homo sapiens
aaatatgtgaagttttc

SEQ ID NO: 4537691 - DNA, 22 bp, Homo sapiens
aaatatgtgaagttttccttgc

SEQ ID NO: 4537692 - DNA, 17 bp, Homo sapiens
aaatattaagaacattt

SEQ ID NO: 4537693 - DNA, 23 bp, Homo sapiens
aaatattaagaacattttataaa

SEQ ID NO: 4537694 - DNA, 20 bp, Homo sapiens
aaatattaagagctatttta

SEQ ID NO: 4537695 - DNA, 15 bp, Homo sapiens
aaatattataactca

SEQ ID NO: 4537696 - DNA, 13 bp, Homo sapiens
aaatattatttgt

SEQ ID NO: 4537697 - DNA, 21 bp, Homo sapiens
aaatattatttgtgtttccta

SEQ ID NO: 4537698 - DNA, 15 bp, Homo sapiens
aaatattgaagttgt

SEQ ID NO: 4537699 - DNA, 17 bp, Homo sapiens
aaatattgaagttgttt

SEQ ID NO: 4537700 - DNA, 22 bp, Homo sapiens
aaatattgaagttgtttatcaa

SEQ ID NO: 4537701 - DNA, 21 bp, Homo sapiens
aaatattgagcagaattcatt

SEQ ID NO: 4537702 - DNA, 13 bp, Homo sapiens
aaatattgcttca

SEQ ID NO: 4537703 - DNA, 12 bp, Homo sapiens
aaatattggtta

SEQ ID NO: 4537704 - DNA, 14 bp, Homo sapiens
aaatatttaagtga

SEQ ID NO: 4537705 - DNA, 15 bp, Homo sapiens
aaatatttattcatt

SEQ ID NO: 4537706 - DNA, 12 bp, Homo sapiens
aaatatttctta

SEQ ID NO: 4537707 - DNA, 18 bp, Homo sapiens
aaatattttaaagaattg

SEQ ID NO: 4537708 - DNA, 23 bp, Homo sapiens
aaatattttaaagaattgtgtca

SEQ ID NO: 4537709 - DNA, 11 bp, Homo sapiens
aaatattttct

SEQ ID NO: 4537710 - DNA, 13 bp, Homo sapiens
aaatattttctat

SEQ ID NO: 4537711 - DNA, 14 bp, Homo sapiens
aaatattttctatt

SEQ ID NO: 4537712 - DNA, 15 bp, Homo sapiens
aaatattttctattt

SEQ ID NO: 4537713 - DNA, 19 bp, Homo sapiens
aaatattttctattttaag

SEQ ID NO: 4537714 - DNA, 12 bp, Homo sapiens
aaatattttctc

SEQ ID NO: 4537715 - DNA, 12 bp, Homo sapiens
aaatcaaatatg

SEQ ID NO: 4537716 - DNA, 23 bp, Homo sapiens
aaatcaacaggagggcagcccgt

SEQ ID NO: 4537717 - DNA, 13 bp, Homo sapiens
aaatcaacatgac

SEQ ID NO: 4537718 - DNA, 16 bp, Homo sapiens
aaatcaaggaaaggct

SEQ ID NO: 4537719 - DNA, 17 bp, Homo sapiens
aaatcaaggatgctcag

SEQ ID NO: 4537720 - DNA, 17 bp, Homo sapiens
aaatcaatagttgaatt

SEQ ID NO: 4537721 - DNA, 13 bp, Homo sapiens
aaatcacaacatt

SEQ ID NO: 4537722 - DNA, 16 bp, Homo sapiens
aaatcacaacattctg

SEQ ID NO: 4537723 - DNA, 18 bp, Homo sapiens
aaatcacagaaaatttaa

SEQ ID NO: 4537724 - DNA, 19 bp, Homo sapiens
aaatcacatattttaaaat

SEQ ID NO: 4537725 - DNA, 15 bp, Homo sapiens
aaatcaggtattaat

SEQ ID NO: 4537726 - DNA, 17 bp, Homo sapiens
aaatcaggtattaatct

SEQ ID NO: 4537727 - DNA, 20 bp, Homo sapiens
aaatcagtagaaagctaaag

SEQ ID NO: 4537728 - DNA, 17 bp, Homo sapiens
aaatcagtatattttct

SEQ ID NO: 4537729 - DNA, 24 bp, Homo sapiens
aaatcagtatattttctgtattta

SEQ ID NO: 4537730 - DNA, 13 bp, Homo sapiens
aaatcataaagtc

SEQ ID NO: 4537731 - DNA, 14 bp, Homo sapiens
aaatcataaagtca

SEQ ID NO: 4537732 - DNA, 16 bp, Homo sapiens
aaatcataaagtcagt

SEQ ID NO: 4537733 - DNA, 15 bp, Homo sapiens
aaatcatcagaaagg

SEQ ID NO: 4537734 - DNA, 20 bp, Homo sapiens
aaatcatcagaaaggaaaaa

SEQ ID NO: 4537735 - DNA, 22 bp, Homo sapiens
aaatcatcagaaaggaaaaaca

SEQ ID NO: 4537736 - DNA, 12 bp, Homo sapiens
aaatcatctatt

SEQ ID NO: 4537737 - DNA, 16 bp, Homo sapiens
aaatcatctattttga

SEQ ID NO: 4537738 - DNA, 11 bp, Homo sapiens
aaatcatctca

SEQ ID NO: 4537739 - DNA, 19 bp, Homo sapiens
aaatcatgatttcccttgt

SEQ ID NO: 4537740 - DNA, 15 bp, Homo sapiens
aaatcattatgtttc

SEQ ID NO: 4537741 - DNA, 18 bp, Homo sapiens
aaatcattttaggaaagg

SEQ ID NO: 4537742 - DNA, 19 bp, Homo sapiens
aaatcattttaggaaagga

SEQ ID NO: 4537743 - DNA, 14 bp, Homo sapiens
aaatccaagatgct

SEQ ID NO: 4537744 - DNA, 15 bp, Homo sapiens
aaatccattccaggt

SEQ ID NO: 4537745 - DNA, 15 bp, Homo sapiens
aaatccatttaatca

SEQ ID NO: 4537746 - DNA, 15 bp, Homo sapiens
aaatcccaccagaat

SEQ ID NO: 4537747 - DNA, 17 bp, Homo sapiens
aaatccccccttcagaa

SEQ ID NO: 4537748 - DNA, 17 bp, Homo sapiens
aaatccggtcagccaag

SEQ ID NO: 4537749 - DNA, 18 bp, Homo sapiens
aaatcctaggaagttatc

SEQ ID NO: 4537750 - DNA, 22 bp, Homo sapiens
aaatcctattctgatgaatctc

SEQ ID NO: 4537751 - DNA, 11 bp, Homo sapiens
aaatcctcagc

SEQ ID NO: 4537752 - DNA, 17 bp, Homo sapiens
aaatcctggaaggacac

SEQ ID NO: 4537753 - DNA, 12 bp, Homo sapiens
aaatcctgtgtt

SEQ ID NO: 4537754 - DNA, 21 bp, Homo sapiens
aaatccttgtgacttacaatt

SEQ ID NO: 4537755 - DNA, 20 bp, Homo sapiens
aaatcgaatgaaattaactg

SEQ ID NO: 4537756 - DNA, 18 bp, Homo sapiens
aaatctaaaatttcataa

SEQ ID NO: 4537757 - DNA, 19 bp, Homo sapiens
aaatctaaaatttcataat

SEQ ID NO: 4537758 - DNA, 13 bp, Homo sapiens
aaatctaccactg

SEQ ID NO: 4537759 - DNA, 18 bp, Homo sapiens
aaatctagaatttagtga

SEQ ID NO: 4537760 - DNA, 21 bp, Homo sapiens
aaatctagacattcttttaat

SEQ ID NO: 4537761 - DNA, 15 bp, Homo sapiens
aaatctcagttgttt

SEQ ID NO: 4537762 - DNA, 22 bp, Homo sapiens
aaatctcagttgtttgcttctt

SEQ ID NO: 4537763 - DNA, 15 bp, Homo sapiens
aaatctcattatttc

SEQ ID NO: 4537764 - DNA, 18 bp, Homo sapiens
aaatctcccattttggaa

SEQ ID NO: 4537765 - DNA, 20 bp, Homo sapiens
aaatctcccattttggaatt

SEQ ID NO: 4537766 - DNA, 14 bp, Homo sapiens
aaatctcctatttt

SEQ ID NO: 4537767 - DNA, 15 bp, Homo sapiens
aaatctcctattttt

SEQ ID NO: 4537768 - DNA, 23 bp, Homo sapiens
aaatctgaagaggcttctcctgt

SEQ ID NO: 4537769 - DNA, 19 bp, Homo sapiens
aaatctggggaagaggttt

SEQ ID NO: 4537770 - DNA, 21 bp, Homo sapiens
aaatctgtgacctgtcagaat

SEQ ID NO: 4537771 - DNA, 14 bp, Homo sapiens
aaatcttagtgttc

SEQ ID NO: 4537772 - DNA, 15 bp, Homo sapiens
aaatcttagtgttca

SEQ ID NO: 4537773 - DNA, 20 bp, Homo sapiens
aaatcttagtgttcaaaaca

SEQ ID NO: 4537774 - DNA, 20 bp, Homo sapiens
aaatcttggttgatgccaaa

SEQ ID NO: 4537775 - DNA, 21 bp, Homo sapiens
aaatctttttgcttctacttt

SEQ ID NO: 4537776 - DNA, 14 bp, Homo sapiens
aaatgaaagggaaa

SEQ ID NO: 4537777 - DNA, 18 bp, Homo sapiens
aaatgaaatgccaaagga

SEQ ID NO: 4537778 - DNA, 22 bp, Homo sapiens
aaatgaacaaggcaggaaacaa

SEQ ID NO: 4537779 - DNA, 23 bp, Homo sapiens
aaatgaagtacagtagtttccct

SEQ ID NO: 4537780 - DNA, 19 bp, Homo sapiens
aaatgaagtttatattatc

SEQ ID NO: 4537781 - DNA, 18 bp, Homo sapiens
aaatgaatattttgataa

SEQ ID NO: 4537782 - DNA, 19 bp, Homo sapiens
aaatgaatattttgataat

SEQ ID NO: 4537783 - DNA, 21 bp, Homo sapiens
aaatgaatgattaaattatga

SEQ ID NO: 4537784 - DNA, 17 bp, Homo sapiens
aaatgaattgaaaaaca

SEQ ID NO: 4537785 - DNA, 13 bp, Homo sapiens
aaatgaattttta

SEQ ID NO: 4537786 - DNA, 17 bp, Homo sapiens
aaatgacagatcttttt

SEQ ID NO: 4537787 - DNA, 13 bp, Homo sapiens
aaatgacagattt

SEQ ID NO: 4537788 - DNA, 17 bp, Homo sapiens
aaatgacagatttctgt

SEQ ID NO: 4537789 - DNA, 14 bp, Homo sapiens
aaatgacagtaata

SEQ ID NO: 4537790 - DNA, 17 bp, Homo sapiens
aaatgacagtcaaaaga

SEQ ID NO: 4537791 - DNA, 19 bp, Homo sapiens
aaatgacatttcactaaaa

SEQ ID NO: 4537792 - DNA, 15 bp, Homo sapiens
aaatgactgtggtgt

SEQ ID NO: 4537793 - DNA, 17 bp, Homo sapiens
aaatgacttatttctgc

SEQ ID NO: 4537794 - DNA, 20 bp, Homo sapiens
aaatgacttatttctgctct

SEQ ID NO: 4537795 - DNA, 19 bp, Homo sapiens
aaatgagaatgacagcctt

SEQ ID NO: 4537796 - DNA, 13 bp, Homo sapiens
aaatgagatttct

SEQ ID NO: 4537797 - DNA, 14 bp, Homo sapiens
aaatgagatttctt

SEQ ID NO: 4537798 - DNA, 11 bp, Homo sapiens
aaatgagccct

SEQ ID NO: 4537799 - DNA, 19 bp, Homo sapiens
aaatgagcttgattaaatc

SEQ ID NO: 4537800 - DNA, 15 bp, Homo sapiens
aaatgaggtctgttt

SEQ ID NO: 4537801 - DNA, 16 bp, Homo sapiens
aaatgagtcactgagc

SEQ ID NO: 4537802 - DNA, 13 bp, Homo sapiens
aaatgagtcattt

SEQ ID NO: 4537803 - DNA, 19 bp, Homo sapiens
aaatgagtcatttgtttaa

SEQ ID NO: 4537804 - DNA, 13 bp, Homo sapiens
aaatgagttactt

SEQ ID NO: 4537805 - DNA, 21 bp, Homo sapiens
aaatgagtttgtattattaca

SEQ ID NO: 4537806 - DNA, 21 bp, Homo sapiens
aaatgattcaaattgctgctt

SEQ ID NO: 4537807 - DNA, 23 bp, Homo sapiens
aaatgattgtttcttcttcatgc

SEQ ID NO: 4537808 - DNA, 13 bp, Homo sapiens
aaatgatttcata

SEQ ID NO: 4537809 - DNA, 16 bp, Homo sapiens
aaatgatttcatattg

SEQ ID NO: 4537810 - DNA, 17 bp, Homo sapiens
aaatgatttcatattga

SEQ ID NO: 4537811 - DNA, 19 bp, Homo sapiens
aaatgattttattaccttg

SEQ ID NO: 4537812 - DNA, 19 bp, Homo sapiens
aaatgcaaaaactctttga

SEQ ID NO: 4537813 - DNA, 14 bp, Homo sapiens
aaatgcaataagat

SEQ ID NO: 4537814 - DNA, 17 bp, Homo sapiens
aaatgcacttctattta

SEQ ID NO: 4537815 - DNA, 15 bp, Homo sapiens
aaatgcagggagggg

SEQ ID NO: 4537816 - DNA, 21 bp, Homo sapiens
aaatgcagggaggggaggcag

SEQ ID NO: 4537817 - DNA, 19 bp, Homo sapiens
aaatgcaggtgtcctgagc

SEQ ID NO: 4537818 - DNA, 18 bp, Homo sapiens
aaatgcagtatatttctt

SEQ ID NO: 4537819 - DNA, 20 bp, Homo sapiens
aaatgcatccattcctcagg

SEQ ID NO: 4537820 - DNA, 22 bp, Homo sapiens
aaatgcatccattcctcaggga

SEQ ID NO: 4537821 - DNA, 12 bp, Homo sapiens
aaatgcattgaa

SEQ ID NO: 4537822 - DNA, 11 bp, Homo sapiens
aaatgcccagt

SEQ ID NO: 4537823 - DNA, 20 bp, Homo sapiens
aaatgcccatttttgctaat

SEQ ID NO: 4537824 - DNA, 14 bp, Homo sapiens
aaatgcctcagcta

SEQ ID NO: 4537825 - DNA, 21 bp, Homo sapiens
aaatgccttttcccaaaatgt

SEQ ID NO: 4537826 - DNA, 18 bp, Homo sapiens
aaatgctcctagaagtct

SEQ ID NO: 4537827 - DNA, 18 bp, Homo sapiens
aaatgctgctctcagcct

SEQ ID NO: 4537828 - DNA, 19 bp, Homo sapiens
aaatgctgctgtcagacga

SEQ ID NO: 4537829 - DNA, 16 bp, Homo sapiens
aaatgctgtattttta

SEQ ID NO: 4537830 - DNA, 19 bp, Homo sapiens
aaatgctgtatttttacag

SEQ ID NO: 4537831 - DNA, 18 bp, Homo sapiens
aaatgctgttagtaaatt

SEQ ID NO: 4537832 - DNA, 15 bp, Homo sapiens
aaatgcttaaaaaat

SEQ ID NO: 4537833 - DNA, 16 bp, Homo sapiens
aaatgcttaaatttca

SEQ ID NO: 4537834 - DNA, 18 bp, Homo sapiens
aaatgcttcactgtacgt

SEQ ID NO: 4537835 - DNA, 19 bp, Homo sapiens
aaatgctttaaaaattaat

SEQ ID NO: 4537836 - DNA, 17 bp, Homo sapiens
aaatgcttttatattct

SEQ ID NO: 4537837 - DNA, 19 bp, Homo sapiens
aaatgcttttatattctaa

SEQ ID NO: 4537838 - DNA, 13 bp, Homo sapiens
aaatgcttttcac

SEQ ID NO: 4537839 - DNA, 14 bp, Homo sapiens
aaatggaaattttg

SEQ ID NO: 4537840 - DNA, 16 bp, Homo sapiens
aaatggaataacatat

SEQ ID NO: 4537841 - DNA, 17 bp, Homo sapiens
aaatggactgttacaga

SEQ ID NO: 4537842 - DNA, 17 bp, Homo sapiens
aaatggatgcaaagtac

SEQ ID NO: 4537843 - DNA, 17 bp, Homo sapiens
aaatggctatgaacaga

SEQ ID NO: 4537844 - DNA, 15 bp, Homo sapiens
aaatgggaaaaaact

SEQ ID NO: 4537845 - DNA, 20 bp, Homo sapiens
aaatgggagctgagcagcct

SEQ ID NO: 4537846 - DNA, 18 bp, Homo sapiens
aaatgggtcatgacaaga

SEQ ID NO: 4537847 - DNA, 14 bp, Homo sapiens
aaatgggtctttta

SEQ ID NO: 4537848 - DNA, 15 bp, Homo sapiens
aaatgggtcttttat

SEQ ID NO: 4537849 - DNA, 20 bp, Homo sapiens
aaatgggtcttttataggaa

SEQ ID NO: 4537850 - DNA, 19 bp, Homo sapiens
aaatggtaggcatttccta

SEQ ID NO: 4537851 - DNA, 19 bp, Homo sapiens
aaatggtgctcaccatgct

SEQ ID NO: 4537852 - DNA, 23 bp, Homo sapiens
aaatggttatccaattgctcttt

SEQ ID NO: 4537853 - DNA, 15 bp, Homo sapiens
aaatgtaaaaatgaa

SEQ ID NO: 4537854 - DNA, 13 bp, Homo sapiens
aaatgtaactgtc

SEQ ID NO: 4537855 - DNA, 21 bp, Homo sapiens
aaatgtaatataatgtatttt

SEQ ID NO: 4537856 - DNA, 22 bp, Homo sapiens
aaatgtaattaactgtaaactt

SEQ ID NO: 4537857 - DNA, 21 bp, Homo sapiens
aaatgtaattaataactttct

SEQ ID NO: 4537858 - DNA, 14 bp, Homo sapiens
aaatgtacactttt

SEQ ID NO: 4537859 - DNA, 16 bp, Homo sapiens
aaatgtacagacatat

SEQ ID NO: 4537860 - DNA, 19 bp, Homo sapiens
aaatgtacagacatattta

SEQ ID NO: 4537861 - DNA, 20 bp, Homo sapiens
aaatgtacagacatatttaa

SEQ ID NO: 4537862 - DNA, 20 bp, Homo sapiens
aaatgtacccgagcacatag

SEQ ID NO: 4537863 - DNA, 20 bp, Homo sapiens
aaatgtacgtcatttgtgca

SEQ ID NO: 4537864 - DNA, 19 bp, Homo sapiens
aaatgtagaaacttaaaca

SEQ ID NO: 4537865 - DNA, 18 bp, Homo sapiens
aaatgtagaatattcaga

SEQ ID NO: 4537866 - DNA, 15 bp, Homo sapiens
aaatgtagttttgta

SEQ ID NO: 4537867 - DNA, 19 bp, Homo sapiens
aaatgtataaaaattatca

SEQ ID NO: 4537868 - DNA, 11 bp, Homo sapiens
aaatgtatact

SEQ ID NO: 4537869 - DNA, 13 bp, Homo sapiens
aaatgtattatgt

SEQ ID NO: 4537870 - DNA, 14 bp, Homo sapiens
aaatgtattatgtc

SEQ ID NO: 4537871 - DNA, 21 bp, Homo sapiens
aaatgtattcctttaaaatat

SEQ ID NO: 4537872 - DNA, 15 bp, Homo sapiens
aaatgtattttacat

SEQ ID NO: 4537873 - DNA, 21 bp, Homo sapiens
aaatgtcccctcaaactcatt

SEQ ID NO: 4537874 - DNA, 22 bp, Homo sapiens
aaatgtcctccagaagcctctg

SEQ ID NO: 4537875 - DNA, 18 bp, Homo sapiens
aaatgtcctttctcagag

SEQ ID NO: 4537876 - DNA, 22 bp, Homo sapiens
aaatgtcttgctgttgacatat

SEQ ID NO: 4537877 - DNA, 12 bp, Homo sapiens
aaatgtcttgtg

SEQ ID NO: 4537878 - DNA, 15 bp, Homo sapiens
aaatgtgaaaaacta

SEQ ID NO: 4537879 - DNA, 21 bp, Homo sapiens
aaatgtgaaaagagcaatcag

SEQ ID NO: 4537880 - DNA, 16 bp, Homo sapiens
aaatgtgaaatgcttt

SEQ ID NO: 4537881 - DNA, 24 bp, Homo sapiens
aaatgtgactcagcatcacccacc

SEQ ID NO: 4537882 - DNA, 17 bp, Homo sapiens
aaatgtgactggttcag

SEQ ID NO: 4537883 - DNA, 11 bp, Homo sapiens
aaatgtgctca

SEQ ID NO: 4537884 - DNA, 16 bp, Homo sapiens
aaatgtgctttgagaa

SEQ ID NO: 4537885 - DNA, 16 bp, Homo sapiens
aaatgtggattttgta

SEQ ID NO: 4537886 - DNA, 19 bp, Homo sapiens
aaatgtggattttgtagat

SEQ ID NO: 4537887 - DNA, 18 bp, Homo sapiens
aaatgtggccaagcctat

SEQ ID NO: 4537888 - DNA, 19 bp, Homo sapiens
aaatgtggccaagcctatc

SEQ ID NO: 4537889 - DNA, 23 bp, Homo sapiens
aaatgtgtacaatgtacacactg

SEQ ID NO: 4537890 - DNA, 17 bp, Homo sapiens
aaatgtgtatttcttaa

SEQ ID NO: 4537891 - DNA, 14 bp, Homo sapiens
aaatgtgtgtatgt

SEQ ID NO: 4537892 - DNA, 16 bp, Homo sapiens
aaatgttaaaccctta

SEQ ID NO: 4537893 - DNA, 17 bp, Homo sapiens
aaatgttacttctgata

SEQ ID NO: 4537894 - DNA, 15 bp, Homo sapiens
aaatgttagacttgt

SEQ ID NO: 4537895 - DNA, 20 bp, Homo sapiens
aaatgttatcttatactgta

SEQ ID NO: 4537896 - DNA, 17 bp, Homo sapiens
aaatgttcccttgacca

SEQ ID NO: 4537897 - DNA, 14 bp, Homo sapiens
aaatgttcttggtg

SEQ ID NO: 4537898 - DNA, 19 bp, Homo sapiens
aaatgttgagaatcccaaa

SEQ ID NO: 4537899 - DNA, 14 bp, Homo sapiens
aaatgtttaaagaa

SEQ ID NO: 4537900 - DNA, 21 bp, Homo sapiens
aaatgtttatattgtttttat

SEQ ID NO: 4537901 - DNA, 13 bp, Homo sapiens
aaatgtttatgga

SEQ ID NO: 4537902 - DNA, 16 bp, Homo sapiens
aaatgtttatggaaat

SEQ ID NO: 4537903 - DNA, 15 bp, Homo sapiens
aaatgtttttatttt

SEQ ID NO: 4537904 - DNA, 23 bp, Homo sapiens
aaatgtttttctgccagggagct

SEQ ID NO: 4537905 - DNA, 12 bp, Homo sapiens
aaatgtttttgg

SEQ ID NO: 4537906 - DNA, 21 bp, Homo sapiens
aaatgtttttggtcttttata

SEQ ID NO: 4537907 - DNA, 23 bp, Homo sapiens
aaatgtttttggtcttttataat

SEQ ID NO: 4537908 - DNA, 14 bp, Homo sapiens
aaatgttttttgat

SEQ ID NO: 4537909 - DNA, 14 bp, Homo sapiens
aaattaaaatggat

SEQ ID NO: 4537910 - DNA, 13 bp, Homo sapiens
aaattaaacaatt

SEQ ID NO: 4537911 - DNA, 12 bp, Homo sapiens
aaattaaatata

SEQ ID NO: 4537912 - DNA, 23 bp, Homo sapiens
aaattaaatatatgtatgtaaaa

SEQ ID NO: 4537913 - DNA, 21 bp, Homo sapiens
aaattaactgggtaatgaaac

SEQ ID NO: 4537914 - DNA, 14 bp, Homo sapiens
aaattaagaaggca

SEQ ID NO: 4537915 - DNA, 16 bp, Homo sapiens
aaattaagtgtgtata

SEQ ID NO: 4537916 - DNA, 18 bp, Homo sapiens
aaattaatgtaataaagt

SEQ ID NO: 4537917 - DNA, 16 bp, Homo sapiens
aaattaattaggaatt

SEQ ID NO: 4537918 - DNA, 17 bp, Homo sapiens
aaattaatttgttaatt

SEQ ID NO: 4537919 - DNA, 20 bp, Homo sapiens
aaattacactataatataaa

SEQ ID NO: 4537920 - DNA, 13 bp, Homo sapiens
aaattacagcttt

SEQ ID NO: 4537921 - DNA, 14 bp, Homo sapiens
aaattacagctttt

SEQ ID NO: 4537922 - DNA, 14 bp, Homo sapiens
aaattacatatact

SEQ ID NO: 4537923 - DNA, 22 bp, Homo sapiens
aaattacatgttttttcatttg

SEQ ID NO: 4537924 - DNA, 18 bp, Homo sapiens
aaattacctgtggatatt

SEQ ID NO: 4537925 - DNA, 20 bp, Homo sapiens
aaattacctttacatatata

SEQ ID NO: 4537926 - DNA, 22 bp, Homo sapiens
aaattactttgattccatttta

SEQ ID NO: 4537927 - DNA, 19 bp, Homo sapiens
aaattagaaaatattctct

SEQ ID NO: 4537928 - DNA, 19 bp, Homo sapiens
aaattagatcctaagatgt

SEQ ID NO: 4537929 - DNA, 13 bp, Homo sapiens
aaattagatttgt

SEQ ID NO: 4537930 - DNA, 18 bp, Homo sapiens
aaattaggaataaataaa

SEQ ID NO: 4537931 - DNA, 14 bp, Homo sapiens
aaattagggcaatt

SEQ ID NO: 4537932 - DNA, 15 bp, Homo sapiens
aaattagtcttttgt

SEQ ID NO: 4537933 - DNA, 20 bp, Homo sapiens
aaattagtgaccattattca

SEQ ID NO: 4537934 - DNA, 22 bp, Homo sapiens
aaattagtgtacctattaaaag

SEQ ID NO: 4537935 - DNA, 12 bp, Homo sapiens
aaattataagga

SEQ ID NO: 4537936 - DNA, 13 bp, Homo sapiens
aaattatatattt

SEQ ID NO: 4537937 - DNA, 17 bp, Homo sapiens
aaattatatgatatgca

SEQ ID NO: 4537938 - DNA, 21 bp, Homo sapiens
aaattatatgatatgcatgta

SEQ ID NO: 4537939 - DNA, 14 bp, Homo sapiens
aaattatcttcacc

SEQ ID NO: 4537940 - DNA, 16 bp, Homo sapiens
aaattatggcatttct

SEQ ID NO: 4537941 - DNA, 12 bp, Homo sapiens
aaattatgtgtt

SEQ ID NO: 4537942 - DNA, 22 bp, Homo sapiens
aaattattttatatcatacagt

SEQ ID NO: 4537943 - DNA, 14 bp, Homo sapiens
aaattcaaaatgct

SEQ ID NO: 4537944 - DNA, 17 bp, Homo sapiens
aaattcaaaatgctcta

SEQ ID NO: 4537945 - DNA, 13 bp, Homo sapiens
aaattcaagaagt

SEQ ID NO: 4537946 - DNA, 15 bp, Homo sapiens
aaattcacaaacttt

SEQ ID NO: 4537947 - DNA, 21 bp, Homo sapiens
aaattcacatgatgcacttca

SEQ ID NO: 4537948 - DNA, 14 bp, Homo sapiens
aaattcactttcat

SEQ ID NO: 4537949 - DNA, 15 bp, Homo sapiens
aaattcagcatttga

SEQ ID NO: 4537950 - DNA, 14 bp, Homo sapiens
aaattcagtttcat

SEQ ID NO: 4537951 - DNA, 18 bp, Homo sapiens
aaattcatggcatgctta

SEQ ID NO: 4537952 - DNA, 12 bp, Homo sapiens
aaattcatttct

SEQ ID NO: 4537953 - DNA, 14 bp, Homo sapiens
aaattccactgaaa

SEQ ID NO: 4537954 - DNA, 13 bp, Homo sapiens
aaattctgaattt

SEQ ID NO: 4537955 - DNA, 14 bp, Homo sapiens
aaattctgaatttg

SEQ ID NO: 4537956 - DNA, 17 bp, Homo sapiens
aaattctgaatttgcaa

SEQ ID NO: 4537957 - DNA, 21 bp, Homo sapiens
aaattctgaatttgcaaagta

SEQ ID NO: 4537958 - DNA, 22 bp, Homo sapiens
aaattctgaatttgcaaagtac

SEQ ID NO: 4537959 - DNA, 15 bp, Homo sapiens
aaattctgaattttg

SEQ ID NO: 4537960 - DNA, 22 bp, Homo sapiens
aaattctgtgccttgttttttg

SEQ ID NO: 4537961 - DNA, 15 bp, Homo sapiens
aaattgaaataaata

SEQ ID NO: 4537962 - DNA, 16 bp, Homo sapiens
aaattgaacaaaaatg

SEQ ID NO: 4537963 - DNA, 19 bp, Homo sapiens
aaattgaatagtttatttc

SEQ ID NO: 4537964 - DNA, 14 bp, Homo sapiens
aaattgatattata

SEQ ID NO: 4537965 - DNA, 16 bp, Homo sapiens
aaattgcagtaacaaa

SEQ ID NO: 4537966 - DNA, 15 bp, Homo sapiens
aaattgcagtttcat

SEQ ID NO: 4537967 - DNA, 18 bp, Homo sapiens
aaattgcagtttcatgta

SEQ ID NO: 4537968 - DNA, 21 bp, Homo sapiens
aaattgcagtttcatgtatgt

SEQ ID NO: 4537969 - DNA, 13 bp, Homo sapiens
aaattgctctgtg

SEQ ID NO: 4537970 - DNA, 22 bp, Homo sapiens
aaattgctctgtgtatatctct

SEQ ID NO: 4537971 - DNA, 16 bp, Homo sapiens
aaattgggttcatgat

SEQ ID NO: 4537972 - DNA, 15 bp, Homo sapiens
aaattggtacatagg

SEQ ID NO: 4537973 - DNA, 13 bp, Homo sapiens
aaattgtacattt

SEQ ID NO: 4537974 - DNA, 15 bp, Homo sapiens
aaattgtacattttg

SEQ ID NO: 4537975 - DNA, 15 bp, Homo sapiens
aaattgtaccttttt

SEQ ID NO: 4537976 - DNA, 21 bp, Homo sapiens
aaattgtataccaatgtgttt

SEQ ID NO: 4537977 - DNA, 22 bp, Homo sapiens
aaattgtataccaatgtgtttt

SEQ ID NO: 4537978 - DNA, 13 bp, Homo sapiens
aaattgtatattg

SEQ ID NO: 4537979 - DNA, 15 bp, Homo sapiens
aaattgtatctcagt

SEQ ID NO: 4537980 - DNA, 13 bp, Homo sapiens
aaattgtgaaata

SEQ ID NO: 4537981 - DNA, 17 bp, Homo sapiens
aaattgtgcttctcccc

SEQ ID NO: 4537982 - DNA, 17 bp, Homo sapiens
aaatttaaaagtaaaat

SEQ ID NO: 4537983 - DNA, 19 bp, Homo sapiens
aaatttaaaagtaaaatgt

SEQ ID NO: 4537984 - DNA, 22 bp, Homo sapiens
aaatttaaaagtaaaatgtctt

SEQ ID NO: 4537985 - DNA, 14 bp, Homo sapiens
aaatttaaactata

SEQ ID NO: 4537986 - DNA, 17 bp, Homo sapiens
aaatttactgtgagact

SEQ ID NO: 4537987 - DNA, 19 bp, Homo sapiens
aaatttactgtgagactgt

SEQ ID NO: 4537988 - DNA, 17 bp, Homo sapiens
aaatttagaaactaatt

SEQ ID NO: 4537989 - DNA, 15 bp, Homo sapiens
aaatttagtttgtta

SEQ ID NO: 4537990 - DNA, 16 bp, Homo sapiens
aaatttagtttgttaa

SEQ ID NO: 4537991 - DNA, 21 bp, Homo sapiens
aaatttagtttgttaaagcct

SEQ ID NO: 4537992 - DNA, 20 bp, Homo sapiens
aaatttattctacttttaaa

SEQ ID NO: 4537993 - DNA, 15 bp, Homo sapiens
aaatttatttccaat

SEQ ID NO: 4537994 - DNA, 14 bp, Homo sapiens
aaatttatttgcaa

SEQ ID NO: 4537995 - DNA, 15 bp, Homo sapiens
aaatttatttggatt

SEQ ID NO: 4537996 - DNA, 18 bp, Homo sapiens
aaatttcataattctgaa

SEQ ID NO: 4537997 - DNA, 19 bp, Homo sapiens
aaatttcataattctgaaa

SEQ ID NO: 4537998 - DNA, 23 bp, Homo sapiens
aaatttcccagttaaagattatt

SEQ ID NO: 4537999 - DNA, 18 bp, Homo sapiens
aaatttctgtctttctgc

SEQ ID NO: 4538000 - DNA, 15 bp, Homo sapiens
aaatttcttatgtga

SEQ ID NO: 4538001 - DNA, 18 bp, Homo sapiens
aaatttgactaattttac

SEQ ID NO: 4538002 - DNA, 17 bp, Homo sapiens
aaatttggccttaagaa

SEQ ID NO: 4538003 - DNA, 18 bp, Homo sapiens
aaatttggccttaagaac

SEQ ID NO: 4538004 - DNA, 22 bp, Homo sapiens
aaatttggccttaagaactgtg

SEQ ID NO: 4538005 - DNA, 12 bp, Homo sapiens
aaatttgtagaa

SEQ ID NO: 4538006 - DNA, 19 bp, Homo sapiens
aaatttgtctgaaacattt

SEQ ID NO: 4538007 - DNA, 14 bp, Homo sapiens
aaatttgtgtaaat

SEQ ID NO: 4538008 - DNA, 13 bp, Homo sapiens
aaatttgttgcat

SEQ ID NO: 4538009 - DNA, 14 bp, Homo sapiens
aaatttgttgcata

SEQ ID NO: 4538010 - DNA, 16 bp, Homo sapiens
aaatttgttttcaaca

SEQ ID NO: 4538011 - DNA, 13 bp, Homo sapiens
aaattttaaaaaa

SEQ ID NO: 4538012 - DNA, 14 bp, Homo sapiens
aaattttaaaaaag

SEQ ID NO: 4538013 - DNA, 13 bp, Homo sapiens
aaattttaaaatt

SEQ ID NO: 4538014 - DNA, 12 bp, Homo sapiens
aaattttaaagc

SEQ ID NO: 4538015 - DNA, 12 bp, Homo sapiens
aaattttaagaa

SEQ ID NO: 4538016 - DNA, 10 bp, Homo sapiens
aaattttaat

SEQ ID NO: 4538017 - DNA, 14 bp, Homo sapiens
aaattttaattcaa

SEQ ID NO: 4538018 - DNA, 15 bp, Homo sapiens
aaattttagaaatat

SEQ ID NO: 4538019 - DNA, 15 bp, Homo sapiens
aaattttagtacatt

SEQ ID NO: 4538020 - DNA, 20 bp, Homo sapiens
aaattttatgtcatagaaat

SEQ ID NO: 4538021 - DNA, 12 bp, Homo sapiens
aaattttctaaa

SEQ ID NO: 4538022 - DNA, 18 bp, Homo sapiens
aaattttcttcagttggt

SEQ ID NO: 4538023 - DNA, 21 bp, Homo sapiens
aaattttgctatcaacaataa

SEQ ID NO: 4538024 - DNA, 12 bp, Homo sapiens
aaattttgtaag

SEQ ID NO: 4538025 - DNA, 15 bp, Homo sapiens
aaattttgtaatgaa

SEQ ID NO: 4538026 - DNA, 17 bp, Homo sapiens
aaattttgtgttccttt

SEQ ID NO: 4538027 - DNA, 12 bp, Homo sapiens
aaatttttcata

SEQ ID NO: 4538028 - DNA, 13 bp, Homo sapiens
aaatttttcatag

SEQ ID NO: 4538029 - DNA, 23 bp, Homo sapiens
aaattttttgactttttttgtat

SEQ ID NO: 4538030 - DNA, 13 bp, Homo sapiens
aaattttttggca

SEQ ID NO: 4538031 - DNA, 15 bp, Homo sapiens
aaattttttttacat

SEQ ID NO: 4538032 - DNA, 17 bp, Homo sapiens
aaattttttttacattt

SEQ ID NO: 4538033 - DNA, 18 bp, Homo sapiens
aaattttttttacatttt

SEQ ID NO: 4538034 - DNA, 16 bp, Homo sapiens
aacaaaacaaaactat

SEQ ID NO: 4538035 - DNA, 14 bp, Homo sapiens
aacaaaacagaagg

SEQ ID NO: 4538036 - DNA, 14 bp, Homo sapiens
aacaaaactatact

SEQ ID NO: 4538037 - DNA, 20 bp, Homo sapiens
aacaaaagggtgtatagtgt

SEQ ID NO: 4538038 - DNA, 22 bp, Homo sapiens
aacaaaagggttcatagaaact

SEQ ID NO: 4538039 - DNA, 13 bp, Homo sapiens
aacaaaatttcac

SEQ ID NO: 4538040 - DNA, 15 bp, Homo sapiens
aacaaaatttctatt

SEQ ID NO: 4538041 - DNA, 11 bp, Homo sapiens
aacaaaatttg

SEQ ID NO: 4538042 - DNA, 16 bp, Homo sapiens
aacaaataaatatgaa

SEQ ID NO: 4538043 - DNA, 17 bp, Homo sapiens
aacaaataaatatgaaa

SEQ ID NO: 4538044 - DNA, 17 bp, Homo sapiens
aacaaataatatattaa

SEQ ID NO: 4538045 - DNA, 22 bp, Homo sapiens
aacaaatgtggccaagcctatc

SEQ ID NO: 4538046 - DNA, 19 bp, Homo sapiens
aacaacaattggtaaaact

SEQ ID NO: 4538047 - DNA, 17 bp, Homo sapiens
aacaacatttatatgta

SEQ ID NO: 4538048 - DNA, 13 bp, Homo sapiens
aacaacctggaga

SEQ ID NO: 4538049 - DNA, 17 bp, Homo sapiens
aacaagaagaatttgaa

SEQ ID NO: 4538050 - DNA, 18 bp, Homo sapiens
aacaagatgtttcatttt

SEQ ID NO: 4538051 - DNA, 17 bp, Homo sapiens
aacaagcatgcataaat

SEQ ID NO: 4538052 - DNA, 19 bp, Homo sapiens
aacaagcatgcataaatca

SEQ ID NO: 4538053 - DNA, 17 bp, Homo sapiens
aacaagtcatttttgta

SEQ ID NO: 4538054 - DNA, 20 bp, Homo sapiens
aacaagttccattatgaaaa

SEQ ID NO: 4538055 - DNA, 16 bp, Homo sapiens
aacaataacttttata

SEQ ID NO: 4538056 - DNA, 16 bp, Homo sapiens
aacaatattactttgt

SEQ ID NO: 4538057 - DNA, 23 bp, Homo sapiens
aacaatattactttgtcttttca

SEQ ID NO: 4538058 - DNA, 17 bp, Homo sapiens
aacaatctatttaaaaa

SEQ ID NO: 4538059 - DNA, 20 bp, Homo sapiens
aacaatctatttaaaaaact

SEQ ID NO: 4538060 - DNA, 19 bp, Homo sapiens
aacaatgccttgttgtatt

SEQ ID NO: 4538061 - DNA, 20 bp, Homo sapiens
aacaatggtaacatttttca

SEQ ID NO: 4538062 - DNA, 12 bp, Homo sapiens
aacaatgtatac

SEQ ID NO: 4538063 - DNA, 14 bp, Homo sapiens
aacaattctaaaat

SEQ ID NO: 4538064 - DNA, 22 bp, Homo sapiens
aacaattgtcgaaaagagtctt

SEQ ID NO: 4538065 - DNA, 15 bp, Homo sapiens
aacacaaactgtaaa

SEQ ID NO: 4538066 - DNA, 21 bp, Homo sapiens
aacacaaccagaggtggcagg

SEQ ID NO: 4538067 - DNA, 12 bp, Homo sapiens
aacacaagcaaa

SEQ ID NO: 4538068 - DNA, 10 bp, Homo sapiens
aacacacctc

SEQ ID NO: 4538069 - DNA, 15 bp, Homo sapiens
aacacagcaagggtg

SEQ ID NO: 4538070 - DNA, 18 bp, Homo sapiens
aacacagcaagggtgatg

SEQ ID NO: 4538071 - DNA, 20 bp, Homo sapiens
aacacagcaagggtgatggg

SEQ ID NO: 4538072 - DNA, 12 bp, Homo sapiens
aacacagtattt

SEQ ID NO: 4538073 - DNA, 12 bp, Homo sapiens
aacacagtgcat

SEQ ID NO: 4538074 - DNA, 12 bp, Homo sapiens
aacacatcagct

SEQ ID NO: 4538075 - DNA, 21 bp, Homo sapiens
aacacatcaggaaagagagca

SEQ ID NO: 4538076 - DNA, 11 bp, Homo sapiens
aacacatgata

SEQ ID NO: 4538077 - DNA, 13 bp, Homo sapiens
aacacattttaaa

SEQ ID NO: 4538078 - DNA, 20 bp, Homo sapiens
aacacatttttaagatgcat

SEQ ID NO: 4538079 - DNA, 15 bp, Homo sapiens
aacaccattgaaggc

SEQ ID NO: 4538080 - DNA, 21 bp, Homo sapiens
aacacctgccttctaccctct

SEQ ID NO: 4538081 - DNA, 16 bp, Homo sapiens
aacaccttcctcctgc

SEQ ID NO: 4538082 - DNA, 17 bp, Homo sapiens
aacaccttcctcctgca

SEQ ID NO: 4538083 - DNA, 15 bp, Homo sapiens
aacacgagcaggcta

SEQ ID NO: 4538084 - DNA, 16 bp, Homo sapiens
aacacgcgtatttaca

SEQ ID NO: 4538085 - DNA, 14 bp, Homo sapiens
aacactaatatatt

SEQ ID NO: 4538086 - DNA, 20 bp, Homo sapiens
aacactacagagtacgtgaa

SEQ ID NO: 4538087 - DNA, 18 bp, Homo sapiens
aacactattttcagaatc

SEQ ID NO: 4538088 - DNA, 16 bp, Homo sapiens
aacactcttttgcttt

SEQ ID NO: 4538089 - DNA, 20 bp, Homo sapiens
aacactgaagtgcttgcaga

SEQ ID NO: 4538090 - DNA, 20 bp, Homo sapiens
aacactgataatcacactgc

SEQ ID NO: 4538091 - DNA, 20 bp, Homo sapiens
aacactggtgtgacctgagg

SEQ ID NO: 4538092 - DNA, 22 bp, Homo sapiens
aacactggtgtgacctgagggc

SEQ ID NO: 4538093 - DNA, 22 bp, Homo sapiens
aacactgtattttaatgtactt

SEQ ID NO: 4538094 - DNA, 18 bp, Homo sapiens
aacactgtgatttatctt

SEQ ID NO: 4538095 - DNA, 22 bp, Homo sapiens
aacactgtgcacatctgtgtct

SEQ ID NO: 4538096 - DNA, 14 bp, Homo sapiens
aacacttaatagca

SEQ ID NO: 4538097 - DNA, 20 bp, Homo sapiens
aacacttaatcattttatgg

SEQ ID NO: 4538098 - DNA, 19 bp, Homo sapiens
aacacttggcatacaaaat

SEQ ID NO: 4538099 - DNA, 20 bp, Homo sapiens
aacacttggcatacaaaata

SEQ ID NO: 4538100 - DNA, 17 bp, Homo sapiens
aacagaaattgtatatt

SEQ ID NO: 4538101 - DNA, 19 bp, Homo sapiens
aacagaaattgtatattgt

SEQ ID NO: 4538102 - DNA, 13 bp, Homo sapiens
aacagaagcaaat

SEQ ID NO: 4538103 - DNA, 11 bp, Homo sapiens
aacagacagga

SEQ ID NO: 4538104 - DNA, 14 bp, Homo sapiens
aacagacaggagaa

SEQ ID NO: 4538105 - DNA, 14 bp, Homo sapiens
aacagagaaataga

SEQ ID NO: 4538106 - DNA, 15 bp, Homo sapiens
aacagagaaggcagg

SEQ ID NO: 4538107 - DNA, 15 bp, Homo sapiens
aacagaggcatttaa

SEQ ID NO: 4538108 - DNA, 19 bp, Homo sapiens
aacagagggaccaaattgc

SEQ ID NO: 4538109 - DNA, 20 bp, Homo sapiens
aacagagggaccaaattgct

SEQ ID NO: 4538110 - DNA, 23 bp, Homo sapiens
aacagagggagtttaatacagga

SEQ ID NO: 4538111 - DNA, 18 bp, Homo sapiens
aacagagtggcctccctg

SEQ ID NO: 4538112 - DNA, 13 bp, Homo sapiens
aacagatgtgaaa

SEQ ID NO: 4538113 - DNA, 19 bp, Homo sapiens
aacagattattaccttaca

SEQ ID NO: 4538114 - DNA, 20 bp, Homo sapiens
aacagattcaggccagccca

SEQ ID NO: 4538115 - DNA, 21 bp, Homo sapiens
aacagattcaggccagcccag

SEQ ID NO: 4538116 - DNA, 23 bp, Homo sapiens
aacagattcaggccagcccagcc

SEQ ID NO: 4538117 - DNA, 19 bp, Homo sapiens
aacagcacacaggcagcca

SEQ ID NO: 4538118 - DNA, 17 bp, Homo sapiens
aacagcacttttcctct

SEQ ID NO: 4538119 - DNA, 19 bp, Homo sapiens
aacagccaactagcccctg

SEQ ID NO: 4538120 - DNA, 18 bp, Homo sapiens
aacagccaagattttcct

SEQ ID NO: 4538121 - DNA, 19 bp, Homo sapiens
aacagcccccctgctgctg

SEQ ID NO: 4538122 - DNA, 20 bp, Homo sapiens
aacagccccggggccccctg

SEQ ID NO: 4538123 - DNA, 19 bp, Homo sapiens
aacagccctcctctgcact

SEQ ID NO: 4538124 - DNA, 19 bp, Homo sapiens
aacagccctctctctcact

SEQ ID NO: 4538125 - DNA, 22 bp, Homo sapiens
aacagctatgggagccccaggg

SEQ ID NO: 4538126 - DNA, 21 bp, Homo sapiens
aacagctattatatcagcttt

SEQ ID NO: 4538127 - DNA, 16 bp, Homo sapiens
aacagctcgatccaaa

SEQ ID NO: 4538128 - DNA, 20 bp, Homo sapiens
aacagctgccttagcttcag

SEQ ID NO: 4538129 - DNA, 15 bp, Homo sapiens
aacagctgtatttat

SEQ ID NO: 4538130 - DNA, 22 bp, Homo sapiens
aacaggaaaaaaacttttataa

SEQ ID NO: 4538131 - DNA, 16 bp, Homo sapiens
aacaggagaaaggaca

SEQ ID NO: 4538132 - DNA, 14 bp, Homo sapiens
aacaggagggcagc

SEQ ID NO: 4538133 - DNA, 17 bp, Homo sapiens
aacaggagggcagcccg

SEQ ID NO: 4538134 - DNA, 20 bp, Homo sapiens
aacaggatcagttaactatt

SEQ ID NO: 4538135 - DNA, 20 bp, Homo sapiens
aacaggattacagtgtagct

SEQ ID NO: 4538136 - DNA, 16 bp, Homo sapiens
aacaggcaaagtttta

SEQ ID NO: 4538137 - DNA, 14 bp, Homo sapiens
aacagggaaaatga

SEQ ID NO: 4538138 - DNA, 19 bp, Homo sapiens
aacagggagaagtagctag

SEQ ID NO: 4538139 - DNA, 21 bp, Homo sapiens
aacagggagaagtagctagta

SEQ ID NO: 4538140 - DNA, 14 bp, Homo sapiens
aacagggctgcctt

SEQ ID NO: 4538141 - DNA, 23 bp, Homo sapiens
aacagggtccaggaatggtgctt

SEQ ID NO: 4538142 - DNA, 23 bp, Homo sapiens
aacaggtttttagtttgttcttc

SEQ ID NO: 4538143 - DNA, 15 bp, Homo sapiens
aacagtaaaccactg

SEQ ID NO: 4538144 - DNA, 16 bp, Homo sapiens
aacagtaaaccactga

SEQ ID NO: 4538145 - DNA, 17 bp, Homo sapiens
aacagtaaaccactgaa

SEQ ID NO: 4538146 - DNA, 13 bp, Homo sapiens
aacagtctcagga

SEQ ID NO: 4538147 - DNA, 14 bp, Homo sapiens
aacagtctcaggaa

SEQ ID NO: 4538148 - DNA, 14 bp, Homo sapiens
aacagtgaacttgt

SEQ ID NO: 4538149 - DNA, 20 bp, Homo sapiens
aacagtgccattgtctttat

SEQ ID NO: 4538150 - DNA, 13 bp, Homo sapiens
aacagtgcctgct

SEQ ID NO: 4538151 - DNA, 12 bp, Homo sapiens
aacagtggggaa

SEQ ID NO: 4538152 - DNA, 16 bp, Homo sapiens
aacagtggggaagagt

SEQ ID NO: 4538153 - DNA, 18 bp, Homo sapiens
aacagttctgagctgtaa

SEQ ID NO: 4538154 - DNA, 20 bp, Homo sapiens
aacagttgcatgtagtaaca

SEQ ID NO: 4538155 - DNA, 21 bp, Homo sapiens
aacagttgcatgtagtaacac

SEQ ID NO: 4538156 - DNA, 21 bp, Homo sapiens
aacagttggtaacttttgtga

SEQ ID NO: 4538157 - DNA, 23 bp, Homo sapiens
aacagttgtatttaacagaaatt

SEQ ID NO: 4538158 - DNA, 20 bp, Homo sapiens
aacagtttatttttattatt

SEQ ID NO: 4538159 - DNA, 19 bp, Homo sapiens
aacataaaaaggacatcag

SEQ ID NO: 4538160 - DNA, 20 bp, Homo sapiens
aacataatcttctgccttct

SEQ ID NO: 4538161 - DNA, 20 bp, Homo sapiens
aacatacattggttttgaaa

SEQ ID NO: 4538162 - DNA, 20 bp, Homo sapiens
aacataccccttacaaatga

SEQ ID NO: 4538163 - DNA, 23 bp, Homo sapiens
aacatacgggaagtttatttcct

SEQ ID NO: 4538164 - DNA, 15 bp, Homo sapiens
aacatagacagaaga

SEQ ID NO: 4538165 - DNA, 19 bp, Homo sapiens
aacatagacagaagaaaca

SEQ ID NO: 4538166 - DNA, 19 bp, Homo sapiens
aacatagtaagttcagcac

SEQ ID NO: 4538167 - DNA, 18 bp, Homo sapiens
aacatagtgagacactgt

SEQ ID NO: 4538168 - DNA, 13 bp, Homo sapiens
aacatattcatga

SEQ ID NO: 4538169 - DNA, 15 bp, Homo sapiens
aacatattcatgaaa

SEQ ID NO: 4538170 - DNA, 22 bp, Homo sapiens
aacatattcatgaaatgtggaa

SEQ ID NO: 4538171 - DNA, 18 bp, Homo sapiens
aacatatttttatacttt

SEQ ID NO: 4538172 - DNA, 13 bp, Homo sapiens
aacatcatttcaa

SEQ ID NO: 4538173 - DNA, 17 bp, Homo sapiens
aacatctcatgtgtgct

SEQ ID NO: 4538174 - DNA, 14 bp, Homo sapiens
aacatctgaagagc

SEQ ID NO: 4538175 - DNA, 18 bp, Homo sapiens
aacatctgccatttattt

SEQ ID NO: 4538176 - DNA, 18 bp, Homo sapiens
aacatctttattgaaatt

SEQ ID NO: 4538177 - DNA, 21 bp, Homo sapiens
aacatgaaaaacaaacaaaaa

SEQ ID NO: 4538178 - DNA, 21 bp, Homo sapiens
aacatgaagtcgttgtgaggg

SEQ ID NO: 4538179 - DNA, 24 bp, Homo sapiens
aacatgattttacaagtataacag

SEQ ID NO: 4538180 - DNA, 16 bp, Homo sapiens
aacatgcactgatgtt

SEQ ID NO: 4538181 - DNA, 11 bp, Homo sapiens
aacatgcagtt

SEQ ID NO: 4538182 - DNA, 13 bp, Homo sapiens
aacatgcagtttg

SEQ ID NO: 4538183 - DNA, 18 bp, Homo sapiens
aacatgcagtttgaaatt

SEQ ID NO: 4538184 - DNA, 19 bp, Homo sapiens
aacatgcttataacattaa

SEQ ID NO: 4538185 - DNA, 14 bp, Homo sapiens
aacatggagaaatc

SEQ ID NO: 4538186 - DNA, 18 bp, Homo sapiens
aacatggagaaatctact

SEQ ID NO: 4538187 - DNA, 12 bp, Homo sapiens
aacatgggaggg

SEQ ID NO: 4538188 - DNA, 20 bp, Homo sapiens
aacatggtttaaaagaaaaa

SEQ ID NO: 4538189 - DNA, 15 bp, Homo sapiens
aacatgtaggaagta

SEQ ID NO: 4538190 - DNA, 12 bp, Homo sapiens
aacatgtattta

SEQ ID NO: 4538191 - DNA, 15 bp, Homo sapiens
aacatgtatttatgt

SEQ ID NO: 4538192 - DNA, 21 bp, Homo sapiens
aacatgtatttatgtaatgaa

SEQ ID NO: 4538193 - DNA, 16 bp, Homo sapiens
aacatgtggctcctcc

SEQ ID NO: 4538194 - DNA, 19 bp, Homo sapiens
aacatgtgttttcatcatt

SEQ ID NO: 4538195 - DNA, 20 bp, Homo sapiens
aacatgtgttttcatcattt

SEQ ID NO: 4538196 - DNA, 22 bp, Homo sapiens
aacattaagaaaaacaataaag

SEQ ID NO: 4538197 - DNA, 19 bp, Homo sapiens
aacattaatccacatgttt

SEQ ID NO: 4538198 - DNA, 15 bp, Homo sapiens
aacattacttattta

SEQ ID NO: 4538199 - DNA, 18 bp, Homo sapiens
aacattatataacaaaaa

SEQ ID NO: 4538200 - DNA, 20 bp, Homo sapiens
aacattattacttttcctct

SEQ ID NO: 4538201 - DNA, 21 bp, Homo sapiens
aacattattttttatttctga

SEQ ID NO: 4538202 - DNA, 18 bp, Homo sapiens
aacattcacttttgttaa

SEQ ID NO: 4538203 - DNA, 16 bp, Homo sapiens
aacattcatagtcttt

SEQ ID NO: 4538204 - DNA, 15 bp, Homo sapiens
aacattccagggatg

SEQ ID NO: 4538205 - DNA, 16 bp, Homo sapiens
aacattccagggatga

SEQ ID NO: 4538206 - DNA, 21 bp, Homo sapiens
aacattcccctccccactcct

SEQ ID NO: 4538207 - DNA, 18 bp, Homo sapiens
aacattcctaaaatgctt

SEQ ID NO: 4538208 - DNA, 16 bp, Homo sapiens
aacattcctccagcct

SEQ ID NO: 4538209 - DNA, 18 bp, Homo sapiens
aacattcgaatctctgcc

SEQ ID NO: 4538210 - DNA, 20 bp, Homo sapiens
aacattcgaatctctgcccc

SEQ ID NO: 4538211 - DNA, 23 bp, Homo sapiens
aacattctttttctgttgaaact

SEQ ID NO: 4538212 - DNA, 18 bp, Homo sapiens
aacattgaagtaatgaat

SEQ ID NO: 4538213 - DNA, 19 bp, Homo sapiens
aacattgaagtaatgaatt

SEQ ID NO: 4538214 - DNA, 16 bp, Homo sapiens
aacattgatctgtttt

SEQ ID NO: 4538215 - DNA, 17 bp, Homo sapiens
aacattgatctgtttta

SEQ ID NO: 4538216 - DNA, 22 bp, Homo sapiens
aacattgcctttgaatgttaat

SEQ ID NO: 4538217 - DNA, 15 bp, Homo sapiens
aacattgctgatttt

SEQ ID NO: 4538218 - DNA, 21 bp, Homo sapiens
aacattggacagaaaatgcaa

SEQ ID NO: 4538219 - DNA, 22 bp, Homo sapiens
aacattggacagaaaatgcaat

SEQ ID NO: 4538220 - DNA, 21 bp, Homo sapiens
aacattggcacatgccacctg

SEQ ID NO: 4538221 - DNA, 13 bp, Homo sapiens
aacattgttatcc

SEQ ID NO: 4538222 - DNA, 18 bp, Homo sapiens
aacatttaaactttttaa

SEQ ID NO: 4538223 - DNA, 13 bp, Homo sapiens
aacatttaaattc

SEQ ID NO: 4538224 - DNA, 14 bp, Homo sapiens
aacatttaaattcc

SEQ ID NO: 4538225 - DNA, 13 bp, Homo sapiens
aacatttatgtga

SEQ ID NO: 4538226 - DNA, 20 bp, Homo sapiens
aacatttccaaaagtggcta

SEQ ID NO: 4538227 - DNA, 16 bp, Homo sapiens
aacatttctcaataat

SEQ ID NO: 4538228 - DNA, 18 bp, Homo sapiens
aacatttgattaataaaa

SEQ ID NO: 4538229 - DNA, 19 bp, Homo sapiens
aacatttgattaataaaat

SEQ ID NO: 4538230 - DNA, 21 bp, Homo sapiens
aacatttgattaataaaatat

SEQ ID NO: 4538231 - DNA, 16 bp, Homo sapiens
aacatttgtttccccc

SEQ ID NO: 4538232 - DNA, 21 bp, Homo sapiens
aacattttacagtaaatgtta

SEQ ID NO: 4538233 - DNA, 16 bp, Homo sapiens
aacattttctggccag

SEQ ID NO: 4538234 - DNA, 19 bp, Homo sapiens
aacattttttatacatttg

SEQ ID NO: 4538235 - DNA, 14 bp, Homo sapiens
aaccaaaaacattt

SEQ ID NO: 4538236 - DNA, 19 bp, Homo sapiens
aaccaaaaagaccagacta

SEQ ID NO: 4538237 - DNA, 15 bp, Homo sapiens
aaccaaaaatagaaa

SEQ ID NO: 4538238 - DNA, 11 bp, Homo sapiens
aaccaaaatga

SEQ ID NO: 4538239 - DNA, 16 bp, Homo sapiens
aaccaaaatgacatct

SEQ ID NO: 4538240 - DNA, 16 bp, Homo sapiens
aaccaaacacccagag

SEQ ID NO: 4538241 - DNA, 19 bp, Homo sapiens
aaccaaactcctatttcaa

SEQ ID NO: 4538242 - DNA, 19 bp, Homo sapiens
aaccaaagagggcttcctc

SEQ ID NO: 4538243 - DNA, 14 bp, Homo sapiens
aaccaaagggtgct

SEQ ID NO: 4538244 - DNA, 15 bp, Homo sapiens
aaccaaatacctcaa

SEQ ID NO: 4538245 - DNA, 23 bp, Homo sapiens
aaccaaatacctcaatttttgtt

SEQ ID NO: 4538246 - DNA, 14 bp, Homo sapiens
aaccaactctaata

SEQ ID NO: 4538247 - DNA, 23 bp, Homo sapiens
aaccaactgcattggttttccat

SEQ ID NO: 4538248 - DNA, 13 bp, Homo sapiens
aaccaactgcccc

SEQ ID NO: 4538249 - DNA, 17 bp, Homo sapiens
aaccaactgccccaggg

SEQ ID NO: 4538250 - DNA, 23 bp, Homo sapiens
aaccaagggtacagatccccagc

SEQ ID NO: 4538251 - DNA, 23 bp, Homo sapiens
aaccaatgcctttttagatgtat

SEQ ID NO: 4538252 - DNA, 14 bp, Homo sapiens
aaccaatttgtaat

SEQ ID NO: 4538253 - DNA, 20 bp, Homo sapiens
aaccacaatgtttcttcatt

SEQ ID NO: 4538254 - DNA, 21 bp, Homo sapiens
aaccacagaaatcacagtcaa

SEQ ID NO: 4538255 - DNA, 12 bp, Homo sapiens
aaccacagcagt

SEQ ID NO: 4538256 - DNA, 14 bp, Homo sapiens
aaccacgccatgag

SEQ ID NO: 4538257 - DNA, 16 bp, Homo sapiens
aaccactgaaaaaata

SEQ ID NO: 4538258 - DNA, 15 bp, Homo sapiens
aaccacttttcaatg

SEQ ID NO: 4538259 - DNA, 15 bp, Homo sapiens
aaccagcagggagtt

SEQ ID NO: 4538260 - DNA, 15 bp, Homo sapiens
aaccagccccatcag

SEQ ID NO: 4538261 - DNA, 21 bp, Homo sapiens
aaccaggccagagcaaacaga

SEQ ID NO: 4538262 - DNA, 14 bp, Homo sapiens
aaccagtatttaag

SEQ ID NO: 4538263 - DNA, 16 bp, Homo sapiens
aaccagtatttttgct

SEQ ID NO: 4538264 - DNA, 11 bp, Homo sapiens
aaccagtgtga

SEQ ID NO: 4538265 - DNA, 19 bp, Homo sapiens
aaccataaaaccctataca

SEQ ID NO: 4538266 - DNA, 14 bp, Homo sapiens
aaccatatttagca

SEQ ID NO: 4538267 - DNA, 15 bp, Homo sapiens
aaccatcggtccaca

SEQ ID NO: 4538268 - DNA, 19 bp, Homo sapiens
aaccatctgaagaaacttc

SEQ ID NO: 4538269 - DNA, 17 bp, Homo sapiens
aaccatgtcatttcaga

SEQ ID NO: 4538270 - DNA, 14 bp, Homo sapiens
aaccattaaagtca

SEQ ID NO: 4538271 - DNA, 13 bp, Homo sapiens
aaccattatactt

SEQ ID NO: 4538272 - DNA, 17 bp, Homo sapiens
aaccattatactttata

SEQ ID NO: 4538273 - DNA, 18 bp, Homo sapiens
aaccattatactttatat

SEQ ID NO: 4538274 - DNA, 22 bp, Homo sapiens
aaccattatgatcaaaaactgc

SEQ ID NO: 4538275 - DNA, 17 bp, Homo sapiens
aaccattcaaaaatttc

SEQ ID NO: 4538276 - DNA, 15 bp, Homo sapiens
aaccattccaacttc

SEQ ID NO: 4538277 - DNA, 14 bp, Homo sapiens
aaccattttcatta

SEQ ID NO: 4538278 - DNA, 19 bp, Homo sapiens
aacccaagtgctgcacaaa

SEQ ID NO: 4538279 - DNA, 20 bp, Homo sapiens
aacccacctctcctgccctg

SEQ ID NO: 4538280 - DNA, 18 bp, Homo sapiens
aacccagaatgtaaaaaa

SEQ ID NO: 4538281 - DNA, 11 bp, Homo sapiens
aacccagagag

SEQ ID NO: 4538282 - DNA, 22 bp, Homo sapiens
aacccaggttcatgaatatggt

SEQ ID NO: 4538283 - DNA, 13 bp, Homo sapiens
aacccagtggctg

SEQ ID NO: 4538284 - DNA, 17 bp, Homo sapiens
aacccatattgtaaaac

SEQ ID NO: 4538285 - DNA, 15 bp, Homo sapiens
aacccatctctgaac

SEQ ID NO: 4538286 - DNA, 16 bp, Homo sapiens
aaccccaagttagttc

SEQ ID NO: 4538287 - DNA, 13 bp, Homo sapiens
aaccccagcccca

SEQ ID NO: 4538288 - DNA, 12 bp, Homo sapiens
aacccccacccc

SEQ ID NO: 4538289 - DNA, 17 bp, Homo sapiens
aacccccaccccacact

SEQ ID NO: 4538290 - DNA, 19 bp, Homo sapiens
aaccccccagcactgagga

SEQ ID NO: 4538291 - DNA, 12 bp, Homo sapiens
aacccccctccc

SEQ ID NO: 4538292 - DNA, 13 bp, Homo sapiens
aacccccctccca

SEQ ID NO: 4538293 - DNA, 17 bp, Homo sapiens
aacccccttttcccttc

SEQ ID NO: 4538294 - DNA, 15 bp, Homo sapiens
aacccctcctccctc

SEQ ID NO: 4538295 - DNA, 20 bp, Homo sapiens
aacccctcctccctcagact

SEQ ID NO: 4538296 - DNA, 22 bp, Homo sapiens
aacccctcctccctcagactca

SEQ ID NO: 4538297 - DNA, 23 bp, Homo sapiens
aacccgggagcggaggttgcagt

SEQ ID NO: 4538298 - DNA, 15 bp, Homo sapiens
aacccgggggacaga

SEQ ID NO: 4538299 - DNA, 21 bp, Homo sapiens
aaccctaaggaagttgctaac

SEQ ID NO: 4538300 - DNA, 16 bp, Homo sapiens
aaccctagaaatatat

SEQ ID NO: 4538301 - DNA, 23 bp, Homo sapiens
aaccctagaaatatatcctgtgt

SEQ ID NO: 4538302 - DNA, 13 bp, Homo sapiens
aaccctgccatgg

SEQ ID NO: 4538303 - DNA, 21 bp, Homo sapiens
aaccctgccatggaactgttt

SEQ ID NO: 4538304 - DNA, 19 bp, Homo sapiens
aaccctgcctcttgtgtcc

SEQ ID NO: 4538305 - DNA, 17 bp, Homo sapiens
aaccctggtgctttcct

SEQ ID NO: 4538306 - DNA, 20 bp, Homo sapiens
aacccttcctgagctttatg

SEQ ID NO: 4538307 - DNA, 16 bp, Homo sapiens
aaccctttagtgcttt

SEQ ID NO: 4538308 - DNA, 20 bp, Homo sapiens
aaccgagggggctgctccca

SEQ ID NO: 4538309 - DNA, 22 bp, Homo sapiens
aaccgtaaaggtttatttttct

SEQ ID NO: 4538310 - DNA, 15 bp, Homo sapiens
aaccgtcctcttttt

SEQ ID NO: 4538311 - DNA, 17 bp, Homo sapiens
aacctaaaactctttcg

SEQ ID NO: 4538312 - DNA, 13 bp, Homo sapiens
aacctaaatactg

SEQ ID NO: 4538313 - DNA, 20 bp, Homo sapiens
aacctaatcaccatgtaagc

SEQ ID NO: 4538314 - DNA, 21 bp, Homo sapiens
aacctaatcaccatgtaagca

SEQ ID NO: 4538315 - DNA, 18 bp, Homo sapiens
aacctaattaatatatta

SEQ ID NO: 4538316 - DNA, 20 bp, Homo sapiens
aacctacagttttaactgtg

SEQ ID NO: 4538317 - DNA, 14 bp, Homo sapiens
aacctagaagggct

SEQ ID NO: 4538318 - DNA, 19 bp, Homo sapiens
aacctagacttcagagaga

SEQ ID NO: 4538319 - DNA, 16 bp, Homo sapiens
aacctatgataattat

SEQ ID NO: 4538320 - DNA, 22 bp, Homo sapiens
aacctatgataattatttacaa

SEQ ID NO: 4538321 - DNA, 18 bp, Homo sapiens
aacctcaactgcctactc

SEQ ID NO: 4538322 - DNA, 20 bp, Homo sapiens
aacctcaattgacattcctt

SEQ ID NO: 4538323 - DNA, 18 bp, Homo sapiens
aacctcacctcccgggtt

SEQ ID NO: 4538324 - DNA, 20 bp, Homo sapiens
aacctcaccttcctgtgggt

SEQ ID NO: 4538325 - DNA, 23 bp, Homo sapiens
aacctcactatggtatgctggcc

SEQ ID NO: 4538326 - DNA, 15 bp, Homo sapiens
aacctcaggctccta

SEQ ID NO: 4538327 - DNA, 11 bp, Homo sapiens
aacctcaggga

SEQ ID NO: 4538328 - DNA, 18 bp, Homo sapiens
aacctcagggctcccagg

SEQ ID NO: 4538329 - DNA, 18 bp, Homo sapiens
aacctcagggctgtccca

SEQ ID NO: 4538330 - DNA, 14 bp, Homo sapiens
aacctcagtaattt

SEQ ID NO: 4538331 - DNA, 18 bp, Homo sapiens
aacctcagtaatttagaa

SEQ ID NO: 4538332 - DNA, 16 bp, Homo sapiens
aacctcatcttcttca

SEQ ID NO: 4538333 - DNA, 20 bp, Homo sapiens
aacctccagcagactcctgc

SEQ ID NO: 4538334 - DNA, 14 bp, Homo sapiens
aacctcgagtactg

SEQ ID NO: 4538335 - DNA, 22 bp, Homo sapiens
aacctcggagacgggaccctgc

SEQ ID NO: 4538336 - DNA, 16 bp, Homo sapiens
aacctcgggcctgctg

SEQ ID NO: 4538337 - DNA, 11 bp, Homo sapiens
aacctcttccc

SEQ ID NO: 4538338 - DNA, 12 bp, Homo sapiens
aacctcttcccc

SEQ ID NO: 4538339 - DNA, 16 bp, Homo sapiens
aacctctttttcctcc

SEQ ID NO: 4538340 - DNA, 19 bp, Homo sapiens
aacctctttttcctcctgg

SEQ ID NO: 4538341 - DNA, 20 bp, Homo sapiens
aacctgagtcgtacagaaag

SEQ ID NO: 4538342 - DNA, 19 bp, Homo sapiens
aacctgagttcccgggagc

SEQ ID NO: 4538343 - DNA, 21 bp, Homo sapiens
aacctgatgctggggacacag

SEQ ID NO: 4538344 - DNA, 23 bp, Homo sapiens
aacctgatgctggggacacagca

SEQ ID NO: 4538345 - DNA, 24 bp, Homo sapiens
aacctgcaagttgctctgacctcc

SEQ ID NO: 4538346 - DNA, 15 bp, Homo sapiens
aacctgcagttttta

SEQ ID NO: 4538347 - DNA, 20 bp, Homo sapiens
aacctgcagtttttaatttg

SEQ ID NO: 4538348 - DNA, 22 bp, Homo sapiens
aacctggaatctacaagccaaa

SEQ ID NO: 4538349 - DNA, 20 bp, Homo sapiens
aacctggagatgcagctact

SEQ ID NO: 4538350 - DNA, 22 bp, Homo sapiens
aacctggagggctagaatctgg

SEQ ID NO: 4538351 - DNA, 11 bp, Homo sapiens
aacctggaggt

SEQ ID NO: 4538352 - DNA, 23 bp, Homo sapiens
aacctgggatcctgactaagcct

SEQ ID NO: 4538353 - DNA, 22 bp, Homo sapiens
aacctggttcatatttatactt

SEQ ID NO: 4538354 - DNA, 16 bp, Homo sapiens
aacctgtaaattattt

SEQ ID NO: 4538355 - DNA, 19 bp, Homo sapiens
aacctgtatactcttgaat

SEQ ID NO: 4538356 - DNA, 15 bp, Homo sapiens
aacctgttatttcta

SEQ ID NO: 4538357 - DNA, 12 bp, Homo sapiens
aaccttaatatt

SEQ ID NO: 4538358 - DNA, 13 bp, Homo sapiens
aaccttaatgaca

SEQ ID NO: 4538359 - DNA, 17 bp, Homo sapiens
aaccttaatgacaacac

SEQ ID NO: 4538360 - DNA, 19 bp, Homo sapiens
aaccttagagcttggacag

SEQ ID NO: 4538361 - DNA, 23 bp, Homo sapiens
aaccttagatgttctaagtcttt

SEQ ID NO: 4538362 - DNA, 16 bp, Homo sapiens
aaccttatcctgcatt

SEQ ID NO: 4538363 - DNA, 18 bp, Homo sapiens
aaccttatcctgcattgt

SEQ ID NO: 4538364 - DNA, 22 bp, Homo sapiens
aaccttatcctgcattgttagc

SEQ ID NO: 4538365 - DNA, 12 bp, Homo sapiens
aaccttcctggg

SEQ ID NO: 4538366 - DNA, 14 bp, Homo sapiens
aaccttcctgggag

SEQ ID NO: 4538367 - DNA, 21 bp, Homo sapiens
aaccttcctgggaggacaggc

SEQ ID NO: 4538368 - DNA, 17 bp, Homo sapiens
aaccttgaaaaaaaaca

SEQ ID NO: 4538369 - DNA, 20 bp, Homo sapiens
aaccttgaaaaaaaacagtg

SEQ ID NO: 4538370 - DNA, 15 bp, Homo sapiens
aaccttgccttgaaa

SEQ ID NO: 4538371 - DNA, 21 bp, Homo sapiens
aaccttgctctcctcatctcc

SEQ ID NO: 4538372 - DNA, 18 bp, Homo sapiens
aaccttgtttattaaatt

SEQ ID NO: 4538373 - DNA, 20 bp, Homo sapiens
aaccttgtttattaaattgc

SEQ ID NO: 4538374 - DNA, 22 bp, Homo sapiens
aaccttttcttgtatctggatt

SEQ ID NO: 4538375 - DNA, 16 bp, Homo sapiens
aacgagtcaatcccct

SEQ ID NO: 4538376 - DNA, 12 bp, Homo sapiens
aacgcaccccac

SEQ ID NO: 4538377 - DNA, 20 bp, Homo sapiens
aacgcaggcccccaggtgcc

SEQ ID NO: 4538378 - DNA, 12 bp, Homo sapiens
aacgcagttgat

SEQ ID NO: 4538379 - DNA, 20 bp, Homo sapiens
aacgcagttgtgtggcccag

SEQ ID NO: 4538380 - DNA, 19 bp, Homo sapiens
aacgcgacttccacaaacc

SEQ ID NO: 4538381 - DNA, 20 bp, Homo sapiens
aacgctctaggtacgatgac

SEQ ID NO: 4538382 - DNA, 18 bp, Homo sapiens
aacgctgaactgacaatg

SEQ ID NO: 4538383 - DNA, 21 bp, Homo sapiens
aacgcttaaaggtgtcttcct

SEQ ID NO: 4538384 - DNA, 19 bp, Homo sapiens
aacggcaacgtagcctggg

SEQ ID NO: 4538385 - DNA, 11 bp, Homo sapiens
aacggcccagg

SEQ ID NO: 4538386 - DNA, 16 bp, Homo sapiens
aacggcccaggccagg

SEQ ID NO: 4538387 - DNA, 17 bp, Homo sapiens
aacggcccaggccaggt

SEQ ID NO: 4538388 - DNA, 17 bp, Homo sapiens
aacgggcagtctgctct

SEQ ID NO: 4538389 - DNA, 12 bp, Homo sapiens
aacggggagaaa

SEQ ID NO: 4538390 - DNA, 20 bp, Homo sapiens
aacggggggctcctgcccag

SEQ ID NO: 4538391 - DNA, 22 bp, Homo sapiens
aacggggggctcctgcccaggc

SEQ ID NO: 4538392 - DNA, 20 bp, Homo sapiens
aacggtgctaaaaatgaaaa

SEQ ID NO: 4538393 - DNA, 20 bp, Homo sapiens
aacggtgctgtgagggaggg

SEQ ID NO: 4538394 - DNA, 20 bp, Homo sapiens
aacgtgggcttaaagcagaa

SEQ ID NO: 4538395 - DNA, 16 bp, Homo sapiens
aacgtgttcaatattt

SEQ ID NO: 4538396 - DNA, 22 bp, Homo sapiens
aactaaaaattaaaacctcttt

SEQ ID NO: 4538397 - DNA, 14 bp, Homo sapiens
aactaaaacattat

SEQ ID NO: 4538398 - DNA, 16 bp, Homo sapiens
aactaaacaaggcatt

SEQ ID NO: 4538399 - DNA, 21 bp, Homo sapiens
aactaaacagaaaactcccaa

SEQ ID NO: 4538400 - DNA, 21 bp, Homo sapiens
aactaaatgtgcaatagaagg

SEQ ID NO: 4538401 - DNA, 16 bp, Homo sapiens
aactaaattttaaagc

SEQ ID NO: 4538402 - DNA, 15 bp, Homo sapiens
aactaacatgtcctg

SEQ ID NO: 4538403 - DNA, 16 bp, Homo sapiens
aactaagattctttta

SEQ ID NO: 4538404 - DNA, 15 bp, Homo sapiens
aactaagcaagtata

SEQ ID NO: 4538405 - DNA, 15 bp, Homo sapiens
aactaaggatttttc

SEQ ID NO: 4538406 - DNA, 12 bp, Homo sapiens
aactaatgcctt

SEQ ID NO: 4538407 - DNA, 14 bp, Homo sapiens
aactacagtctaaa

SEQ ID NO: 4538408 - DNA, 22 bp, Homo sapiens
aactacatgagaacaaacagat

SEQ ID NO: 4538409 - DNA, 21 bp, Homo sapiens
aactacccttaattacttaaa

SEQ ID NO: 4538410 - DNA, 15 bp, Homo sapiens
aactacctgagctaa

SEQ ID NO: 4538411 - DNA, 17 bp, Homo sapiens
aactactaatagaataa

SEQ ID NO: 4538412 - DNA, 13 bp, Homo sapiens
aactactctttga

SEQ ID NO: 4538413 - DNA, 15 bp, Homo sapiens
aactactctttgatt

SEQ ID NO: 4538414 - DNA, 16 bp, Homo sapiens
aactactctttgattt

SEQ ID NO: 4538415 - DNA, 23 bp, Homo sapiens
aactactgaatgaagcagtattt

SEQ ID NO: 4538416 - DNA, 17 bp, Homo sapiens
aactactgacagggagc

SEQ ID NO: 4538417 - DNA, 14 bp, Homo sapiens
aactactgattgaa

SEQ ID NO: 4538418 - DNA, 16 bp, Homo sapiens
aactagaacctggagg

SEQ ID NO: 4538419 - DNA, 16 bp, Homo sapiens
aactagaatttgatta

SEQ ID NO: 4538420 - DNA, 21 bp, Homo sapiens
aactagaggtgagaaatttaa

SEQ ID NO: 4538421 - DNA, 22 bp, Homo sapiens
aactagaggtgagaaatttaaa

SEQ ID NO: 4538422 - DNA, 15 bp, Homo sapiens
aactagctttgctct

SEQ ID NO: 4538423 - DNA, 13 bp, Homo sapiens
aactaggctctta

SEQ ID NO: 4538424 - DNA, 23 bp, Homo sapiens
aactagtactcaaggtttaacct

SEQ ID NO: 4538425 - DNA, 13 bp, Homo sapiens
aactataaactta

SEQ ID NO: 4538426 - DNA, 18 bp, Homo sapiens
aactataacattatataa

SEQ ID NO: 4538427 - DNA, 20 bp, Homo sapiens
aactataacattatataaca

SEQ ID NO: 4538428 - DNA, 16 bp, Homo sapiens
aactatacccgggacc

SEQ ID NO: 4538429 - DNA, 18 bp, Homo sapiens
aactatacttgaacaaaa

SEQ ID NO: 4538430 - DNA, 24 bp, Homo sapiens
aactatatataatcatcaagtaat

SEQ ID NO: 4538431 - DNA, 16 bp, Homo sapiens
aactatcaatatttaa

SEQ ID NO: 4538432 - DNA, 15 bp, Homo sapiens
aactatcatttttac

SEQ ID NO: 4538433 - DNA, 20 bp, Homo sapiens
aactatgtgtttttctcata

SEQ ID NO: 4538434 - DNA, 12 bp, Homo sapiens
aactatttactt

SEQ ID NO: 4538435 - DNA, 14 bp, Homo sapiens
aactatttactttt

SEQ ID NO: 4538436 - DNA, 16 bp, Homo sapiens
aactatttttttcaaa

SEQ ID NO: 4538437 - DNA, 17 bp, Homo sapiens
aactatttttttcaaag

SEQ ID NO: 4538438 - DNA, 22 bp, Homo sapiens
aactcaaactgaggaatttcac

SEQ ID NO: 4538439 - DNA, 21 bp, Homo sapiens
aactcaaatgtgagtgttttt

SEQ ID NO: 4538440 - DNA, 21 bp, Homo sapiens
aactcaactgggctctgtccc

SEQ ID NO: 4538441 - DNA, 16 bp, Homo sapiens
aactcaaggaaaagtt

SEQ ID NO: 4538442 - DNA, 22 bp, Homo sapiens
aactcaaggataccttcttatt

SEQ ID NO: 4538443 - DNA, 17 bp, Homo sapiens
aactcactaacagggag

SEQ ID NO: 4538444 - DNA, 14 bp, Homo sapiens
aactcactcactgt

SEQ ID NO: 4538445 - DNA, 15 bp, Homo sapiens
aactcactgtgatca

SEQ ID NO: 4538446 - DNA, 16 bp, Homo sapiens
aactcagcctgggaca

SEQ ID NO: 4538447 - DNA, 17 bp, Homo sapiens
aactcagcctgggacag

SEQ ID NO: 4538448 - DNA, 19 bp, Homo sapiens
aactcatcacataaagaaa

SEQ ID NO: 4538449 - DNA, 16 bp, Homo sapiens
aactcatccttcttcc

SEQ ID NO: 4538450 - DNA, 15 bp, Homo sapiens
aactcatgatcaaga

SEQ ID NO: 4538451 - DNA, 15 bp, Homo sapiens
aactcattcatagga

SEQ ID NO: 4538452 - DNA, 14 bp, Homo sapiens
aactcattccagat

SEQ ID NO: 4538453 - DNA, 21 bp, Homo sapiens
aactcattccagatcccaggc

SEQ ID NO: 4538454 - DNA, 16 bp, Homo sapiens
aactcattgcagcaga

SEQ ID NO: 4538455 - DNA, 17 bp, Homo sapiens
aactcattgcagcagat

SEQ ID NO: 4538456 - DNA, 15 bp, Homo sapiens
aactccacatctgcc

SEQ ID NO: 4538457 - DNA, 17 bp, Homo sapiens
aactccacatctgcctt

SEQ ID NO: 4538458 - DNA, 18 bp, Homo sapiens
aactccacatctgcctta

SEQ ID NO: 4538459 - DNA, 16 bp, Homo sapiens
aactccatacagcctc

SEQ ID NO: 4538460 - DNA, 17 bp, Homo sapiens
aactccatggggttcga

SEQ ID NO: 4538461 - DNA, 17 bp, Homo sapiens
aactccgagtgaactgg

SEQ ID NO: 4538462 - DNA, 19 bp, Homo sapiens
aactccgcccagcctctcc

SEQ ID NO: 4538463 - DNA, 15 bp, Homo sapiens
aactcctgccattct

SEQ ID NO: 4538464 - DNA, 13 bp, Homo sapiens
aactcctggcctt

SEQ ID NO: 4538465 - DNA, 12 bp, Homo sapiens
aactcctgtccc

SEQ ID NO: 4538466 - DNA, 14 bp, Homo sapiens
aactcctgtccctt

SEQ ID NO: 4538467 - DNA, 22 bp, Homo sapiens
aactcctgtcccttttccctta

SEQ ID NO: 4538468 - DNA, 16 bp, Homo sapiens
aactctacccctgctc

SEQ ID NO: 4538469 - DNA, 17 bp, Homo sapiens
aactctacccctgctcc

SEQ ID NO: 4538470 - DNA, 23 bp, Homo sapiens
aactctatattgttcagcatgca

SEQ ID NO: 4538471 - DNA, 22 bp, Homo sapiens
aactctcaccatgatgtgaaga

SEQ ID NO: 4538472 - DNA, 21 bp, Homo sapiens
aactctcccaaagggcacacc

SEQ ID NO: 4538473 - DNA, 13 bp, Homo sapiens
aactctccccagt

SEQ ID NO: 4538474 - DNA, 23 bp, Homo sapiens
aactctccccagtgcctgccact

SEQ ID NO: 4538475 - DNA, 14 bp, Homo sapiens
aactctctcccagg

SEQ ID NO: 4538476 - DNA, 20 bp, Homo sapiens
aactctctggaagcccctgg

SEQ ID NO: 4538477 - DNA, 15 bp, Homo sapiens
aactctgcactactc

SEQ ID NO: 4538478 - DNA, 18 bp, Homo sapiens
aactctgcatagacaaag

SEQ ID NO: 4538479 - DNA, 16 bp, Homo sapiens
aactctgcttgatttt

SEQ ID NO: 4538480 - DNA, 22 bp, Homo sapiens
aactctggtgataaaaataaag

SEQ ID NO: 4538481 - DNA, 16 bp, Homo sapiens
aactctgtataataga

SEQ ID NO: 4538482 - DNA, 14 bp, Homo sapiens
aactctgttccccc

SEQ ID NO: 4538483 - DNA, 15 bp, Homo sapiens
aactctgttccccca

SEQ ID NO: 4538484 - DNA, 12 bp, Homo sapiens
aactctttcaaa

SEQ ID NO: 4538485 - DNA, 19 bp, Homo sapiens
aactctttgttatttgaaa

SEQ ID NO: 4538486 - DNA, 22 bp, Homo sapiens
aactgaacaccattgaaggctt

SEQ ID NO: 4538487 - DNA, 14 bp, Homo sapiens
aactgaactgtaac

SEQ ID NO: 4538488 - DNA, 18 bp, Homo sapiens
aactgaacttgaagctaa

SEQ ID NO: 4538489 - DNA, 17 bp, Homo sapiens
aactgaatctatggctt

SEQ ID NO: 4538490 - DNA, 18 bp, Homo sapiens
aactgaatctatggcttt

SEQ ID NO: 4538491 - DNA, 14 bp, Homo sapiens
aactgaatttggag

SEQ ID NO: 4538492 - DNA, 10 bp, Homo sapiens
aactgacaag

SEQ ID NO: 4538493 - DNA, 16 bp, Homo sapiens
aactgacaatgaaggg

SEQ ID NO: 4538494 - DNA, 22 bp, Homo sapiens
aactgacgattcttaatcaaga

SEQ ID NO: 4538495 - DNA, 16 bp, Homo sapiens
aactgactctgttatt

SEQ ID NO: 4538496 - DNA, 14 bp, Homo sapiens
aactgacttaatgc

SEQ ID NO: 4538497 - DNA, 15 bp, Homo sapiens
aactgagagaaagat

SEQ ID NO: 4538498 - DNA, 19 bp, Homo sapiens
aactgagatattattttaa

SEQ ID NO: 4538499 - DNA, 20 bp, Homo sapiens
aactgagatattattttaaa

SEQ ID NO: 4538500 - DNA, 23 bp, Homo sapiens
aactgagatattattttaaattt

SEQ ID NO: 4538501 - DNA, 23 bp, Homo sapiens
aactgagatgtgaacacatcagc

SEQ ID NO: 4538502 - DNA, 14 bp, Homo sapiens
aactgagccccagc

SEQ ID NO: 4538503 - DNA, 20 bp, Homo sapiens
aactgagggctctgtttgtg

SEQ ID NO: 4538504 - DNA, 17 bp, Homo sapiens
aactgagtcactcacat

SEQ ID NO: 4538505 - DNA, 15 bp, Homo sapiens
aactgattaaaaata

SEQ ID NO: 4538506 - DNA, 13 bp, Homo sapiens
aactgatttctat

SEQ ID NO: 4538507 - DNA, 14 bp, Homo sapiens
aactgatttctatg

SEQ ID NO: 4538508 - DNA, 18 bp, Homo sapiens
aactgatttctatggctt

SEQ ID NO: 4538509 - DNA, 17 bp, Homo sapiens
aactgcaaccttgttta

SEQ ID NO: 4538510 - DNA, 19 bp, Homo sapiens
aactgcacactatttccct

SEQ ID NO: 4538511 - DNA, 15 bp, Homo sapiens
aactgcagctctcca

SEQ ID NO: 4538512 - DNA, 16 bp, Homo sapiens
aactgcatacactttt

SEQ ID NO: 4538513 - DNA, 21 bp, Homo sapiens
aactgcatcccacgttctgtt

SEQ ID NO: 4538514 - DNA, 12 bp, Homo sapiens
aactgcccagca

SEQ ID NO: 4538515 - DNA, 17 bp, Homo sapiens
aactgcccttgctgccc

SEQ ID NO: 4538516 - DNA, 18 bp, Homo sapiens
aactgccgtaatttaact

SEQ ID NO: 4538517 - DNA, 14 bp, Homo sapiens
aactgcgaggacat

SEQ ID NO: 4538518 - DNA, 24 bp, Homo sapiens
aactgctccagcctctgccgctgc

SEQ ID NO: 4538519 - DNA, 19 bp, Homo sapiens
aactgctgttaaaattaat

SEQ ID NO: 4538520 - DNA, 14 bp, Homo sapiens
aactgctttctgtt

SEQ ID NO: 4538521 - DNA, 15 bp, Homo sapiens
aactgctttctgttc

SEQ ID NO: 4538522 - DNA, 18 bp, Homo sapiens
aactgctttctgttccaa

SEQ ID NO: 4538523 - DNA, 19 bp, Homo sapiens
aactggaaacaaaacagaa

SEQ ID NO: 4538524 - DNA, 15 bp, Homo sapiens
aactggaagaaagca

SEQ ID NO: 4538525 - DNA, 23 bp, Homo sapiens
aactggagttccttatccctctc

SEQ ID NO: 4538526 - DNA, 22 bp, Homo sapiens
aactggcaggggagacaggagc

SEQ ID NO: 4538527 - DNA, 17 bp, Homo sapiens
aactggcatgtcatttg

SEQ ID NO: 4538528 - DNA, 18 bp, Homo sapiens
aactggccctatttagat

SEQ ID NO: 4538529 - DNA, 11 bp, Homo sapiens
aactggctggc

SEQ ID NO: 4538530 - DNA, 13 bp, Homo sapiens
aactgggataact

SEQ ID NO: 4538531 - DNA, 16 bp, Homo sapiens
aactgggataactgat

SEQ ID NO: 4538532 - DNA, 19 bp, Homo sapiens
aactgggataactgatttc

SEQ ID NO: 4538533 - DNA, 12 bp, Homo sapiens
aactgggctggc

SEQ ID NO: 4538534 - DNA, 14 bp, Homo sapiens
aactggtagaaaaa

SEQ ID NO: 4538535 - DNA, 15 bp, Homo sapiens
aactggtagaaaaac

SEQ ID NO: 4538536 - DNA, 22 bp, Homo sapiens
aactggtattttatctttgatt

SEQ ID NO: 4538537 - DNA, 19 bp, Homo sapiens
aactggtcttcctttttgg

SEQ ID NO: 4538538 - DNA, 20 bp, Homo sapiens
aactggtgcactttgtaaat

SEQ ID NO: 4538539 - DNA, 22 bp, Homo sapiens
aactgtaaacttggaatcaagg

SEQ ID NO: 4538540 - DNA, 18 bp, Homo sapiens
aactgtaaagttcaattg

SEQ ID NO: 4538541 - DNA, 13 bp, Homo sapiens
aactgtaaataaa

SEQ ID NO: 4538542 - DNA, 16 bp, Homo sapiens
aactgtatatttgtat

SEQ ID NO: 4538543 - DNA, 15 bp, Homo sapiens
aactgtatttcagta

SEQ ID NO: 4538544 - DNA, 16 bp, Homo sapiens
aactgtatttcagtat

SEQ ID NO: 4538545 - DNA, 22 bp, Homo sapiens
aactgtatttcagtattttcca

SEQ ID NO: 4538546 - DNA, 13 bp, Homo sapiens
aactgtatttgaa

SEQ ID NO: 4538547 - DNA, 21 bp, Homo sapiens
aactgtccgtaagcagtatat

SEQ ID NO: 4538548 - DNA, 23 bp, Homo sapiens
aactgtctcgatgcaatgaacac

SEQ ID NO: 4538549 - DNA, 11 bp, Homo sapiens
aactgtcttgt

SEQ ID NO: 4538550 - DNA, 16 bp, Homo sapiens
aactgtgaaaatagtg

SEQ ID NO: 4538551 - DNA, 17 bp, Homo sapiens
aactgtgaaaatagtgt

SEQ ID NO: 4538552 - DNA, 22 bp, Homo sapiens
aactgtgaaataccacaagcct

SEQ ID NO: 4538553 - DNA, 14 bp, Homo sapiens
aactgtggatattg

SEQ ID NO: 4538554 - DNA, 18 bp, Homo sapiens
aactgtggatattgttac

SEQ ID NO: 4538555 - DNA, 16 bp, Homo sapiens
aactgtggtagctcca

SEQ ID NO: 4538556 - DNA, 18 bp, Homo sapiens
aactgtggtagctccagc

SEQ ID NO: 4538557 - DNA, 23 bp, Homo sapiens
aactgtgtatttatttaaaactc

SEQ ID NO: 4538558 - DNA, 13 bp, Homo sapiens
aactgtgtgtgaa

SEQ ID NO: 4538559 - DNA, 16 bp, Homo sapiens
aactgtgtttcaaatg

SEQ ID NO: 4538560 - DNA, 22 bp, Homo sapiens
aactgtgtttcaaatggactgt

SEQ ID NO: 4538561 - DNA, 14 bp, Homo sapiens
aactgttacaactt

SEQ ID NO: 4538562 - DNA, 20 bp, Homo sapiens
aactgttgcctaattggaaa

SEQ ID NO: 4538563 - DNA, 18 bp, Homo sapiens
aactgtttatatgtgttg

SEQ ID NO: 4538564 - DNA, 22 bp, Homo sapiens
aactgtttatatgtgttgaaaa

SEQ ID NO: 4538565 - DNA, 22 bp, Homo sapiens
aactgtttcaagccctcctccc

SEQ ID NO: 4538566 - DNA, 18 bp, Homo sapiens
aacttaaaaattaatatg

SEQ ID NO: 4538567 - DNA, 13 bp, Homo sapiens
aacttaaataata

SEQ ID NO: 4538568 - DNA, 20 bp, Homo sapiens
aacttaagggcaaggagttt

SEQ ID NO: 4538569 - DNA, 13 bp, Homo sapiens
aacttaagtattt

SEQ ID NO: 4538570 - DNA, 12 bp, Homo sapiens
aacttacaaaaa

SEQ ID NO: 4538571 - DNA, 23 bp, Homo sapiens
aacttacattgtgaaacttctgt

SEQ ID NO: 4538572 - DNA, 21 bp, Homo sapiens
aacttacttgcataccaagtt

SEQ ID NO: 4538573 - DNA, 20 bp, Homo sapiens
aacttagactctagtattta

SEQ ID NO: 4538574 - DNA, 21 bp, Homo sapiens
aacttagccatttttcaaagc

SEQ ID NO: 4538575 - DNA, 12 bp, Homo sapiens
aacttagttttt

SEQ ID NO: 4538576 - DNA, 22 bp, Homo sapiens
aacttagtttttaaaatttatt

SEQ ID NO: 4538577 - DNA, 13 bp, Homo sapiens
aacttataatgat

SEQ ID NO: 4538578 - DNA, 15 bp, Homo sapiens
aacttattacctcag

SEQ ID NO: 4538579 - DNA, 16 bp, Homo sapiens
aacttattacctcagg

SEQ ID NO: 4538580 - DNA, 14 bp, Homo sapiens
aacttattcaaaga

SEQ ID NO: 4538581 - DNA, 16 bp, Homo sapiens
aacttattgctgattt

SEQ ID NO: 4538582 - DNA, 21 bp, Homo sapiens
aacttattgctgattttaatg

SEQ ID NO: 4538583 - DNA, 22 bp, Homo sapiens
aacttattgctgattttaatgg

SEQ ID NO: 4538584 - DNA, 17 bp, Homo sapiens
aacttcaaatatagaga

SEQ ID NO: 4538585 - DNA, 14 bp, Homo sapiens
aacttcaccacccc

SEQ ID NO: 4538586 - DNA, 15 bp, Homo sapiens
aacttcaccaccccc

SEQ ID NO: 4538587 - DNA, 22 bp, Homo sapiens
aacttcaccaccccctgtccca

SEQ ID NO: 4538588 - DNA, 12 bp, Homo sapiens
aacttcagcaac

SEQ ID NO: 4538589 - DNA, 19 bp, Homo sapiens
aacttcagtttcacagaaa

SEQ ID NO: 4538590 - DNA, 21 bp, Homo sapiens
aacttcatattaatataagtt

SEQ ID NO: 4538591 - DNA, 16 bp, Homo sapiens
aacttcatgtaatttt

SEQ ID NO: 4538592 - DNA, 14 bp, Homo sapiens
aacttccactgtta

SEQ ID NO: 4538593 - DNA, 22 bp, Homo sapiens
aacttccaggtgttactgtaat

SEQ ID NO: 4538594 - DNA, 18 bp, Homo sapiens
aacttcccatctggctca

SEQ ID NO: 4538595 - DNA, 15 bp, Homo sapiens
aacttcccattaaaa

SEQ ID NO: 4538596 - DNA, 17 bp, Homo sapiens
aacttccccatcttcta

SEQ ID NO: 4538597 - DNA, 18 bp, Homo sapiens
aacttcctgtgcctttcc

SEQ ID NO: 4538598 - DNA, 23 bp, Homo sapiens
aacttccttggactcattttaaa

SEQ ID NO: 4538599 - DNA, 16 bp, Homo sapiens
aacttcgctagaaaaa

SEQ ID NO: 4538600 - DNA, 17 bp, Homo sapiens
aacttcttatggaattg

SEQ ID NO: 4538601 - DNA, 24 bp, Homo sapiens
aacttcttatggaattgatttgca

SEQ ID NO: 4538602 - DNA, 12 bp, Homo sapiens
aacttcttcctg

SEQ ID NO: 4538603 - DNA, 22 bp, Homo sapiens
aacttcttgcttctttctagaa

SEQ ID NO: 4538604 - DNA, 12 bp, Homo sapiens
aacttgaaatat

SEQ ID NO: 4538605 - DNA, 18 bp, Homo sapiens
aacttgaaatatataata

SEQ ID NO: 4538606 - DNA, 14 bp, Homo sapiens
aacttgactgggtg

SEQ ID NO: 4538607 - DNA, 16 bp, Homo sapiens
aacttgagtataagat

SEQ ID NO: 4538608 - DNA, 19 bp, Homo sapiens
aacttgagtggctgtctta

SEQ ID NO: 4538609 - DNA, 22 bp, Homo sapiens
aacttgcctcttttacctgctg

SEQ ID NO: 4538610 - DNA, 15 bp, Homo sapiens
aacttgcttaaattt

SEQ ID NO: 4538611 - DNA, 21 bp, Homo sapiens
aacttgcttaaatttcttatg

SEQ ID NO: 4538612 - DNA, 17 bp, Homo sapiens
aacttggacccttggaa

SEQ ID NO: 4538613 - DNA, 18 bp, Homo sapiens
aacttggacccttggaaa

SEQ ID NO: 4538614 - DNA, 16 bp, Homo sapiens
aacttgggcacatgct

SEQ ID NO: 4538615 - DNA, 16 bp, Homo sapiens
aacttggtcagagcca

SEQ ID NO: 4538616 - DNA, 17 bp, Homo sapiens
aacttggtgcttattga

SEQ ID NO: 4538617 - DNA, 12 bp, Homo sapiens
aacttgtaaata

SEQ ID NO: 4538618 - DNA, 14 bp, Homo sapiens
aacttgtatttcca

SEQ ID NO: 4538619 - DNA, 15 bp, Homo sapiens
aacttgtctcttcat

SEQ ID NO: 4538620 - DNA, 17 bp, Homo sapiens
aacttgtgagcatcaga

SEQ ID NO: 4538621 - DNA, 18 bp, Homo sapiens
aacttgtgttcaatctgt

SEQ ID NO: 4538622 - DNA, 21 bp, Homo sapiens
aactttaagaactaaaatgtt

SEQ ID NO: 4538623 - DNA, 20 bp, Homo sapiens
aactttagaaataaacctta

SEQ ID NO: 4538624 - DNA, 14 bp, Homo sapiens
aactttagacttcc

SEQ ID NO: 4538625 - DNA, 22 bp, Homo sapiens
aactttatcagggaaactaaga

SEQ ID NO: 4538626 - DNA, 14 bp, Homo sapiens
aactttatttttct

SEQ ID NO: 4538627 - DNA, 15 bp, Homo sapiens
aactttcaattgtca

SEQ ID NO: 4538628 - DNA, 13 bp, Homo sapiens
aactttcatttaa

SEQ ID NO: 4538629 - DNA, 12 bp, Homo sapiens
aactttcctcaa

SEQ ID NO: 4538630 - DNA, 23 bp, Homo sapiens
aactttctaagagggttcttgct

SEQ ID NO: 4538631 - DNA, 12 bp, Homo sapiens
aactttctccct

SEQ ID NO: 4538632 - DNA, 16 bp, Homo sapiens
aactttctccctcatc

SEQ ID NO: 4538633 - DNA, 15 bp, Homo sapiens
aactttgaagttagc

SEQ ID NO: 4538634 - DNA, 15 bp, Homo sapiens
aactttgaataaaga

SEQ ID NO: 4538635 - DNA, 17 bp, Homo sapiens
aactttgaataaagaat

SEQ ID NO: 4538636 - DNA, 23 bp, Homo sapiens
aactttgaataaagaatacttga

SEQ ID NO: 4538637 - DNA, 10 bp, Homo sapiens
aactttgtca

SEQ ID NO: 4538638 - DNA, 15 bp, Homo sapiens
aacttttaagatttc

SEQ ID NO: 4538639 - DNA, 20 bp, Homo sapiens
aacttttataaattaaatat

SEQ ID NO: 4538640 - DNA, 22 bp, Homo sapiens
aacttttataaattaaatatat

SEQ ID NO: 4538641 - DNA, 21 bp, Homo sapiens
aacttttccaagcaaaatcta

SEQ ID NO: 4538642 - DNA, 13 bp, Homo sapiens
aacttttgaaaga

SEQ ID NO: 4538643 - DNA, 15 bp, Homo sapiens
aacttttgaaagatg

SEQ ID NO: 4538644 - DNA, 18 bp, Homo sapiens
aacttttgtactgaattt

SEQ ID NO: 4538645 - DNA, 15 bp, Homo sapiens
aactttttaattgtg

SEQ ID NO: 4538646 - DNA, 21 bp, Homo sapiens
aactttttgtttttatttctt

SEQ ID NO: 4538647 - DNA, 14 bp, Homo sapiens
aacttttttttaag

SEQ ID NO: 4538648 - DNA, 18 bp, Homo sapiens
aagaaaaaaaaaaaagcc

SEQ ID NO: 4538649 - DNA, 15 bp, Homo sapiens
aagaaaaaaaatgta

SEQ ID NO: 4538650 - DNA, 16 bp, Homo sapiens
aagaaaaaaaatgtac

SEQ ID NO: 4538651 - DNA, 19 bp, Homo sapiens
aagaaaaaaagcacaaagt

SEQ ID NO: 4538652 - DNA, 18 bp, Homo sapiens
aagaaaaaagaaaaatct

SEQ ID NO: 4538653 - DNA, 20 bp, Homo sapiens
aagaaaaacaaactcgtttt

SEQ ID NO: 4538654 - DNA, 18 bp, Homo sapiens
aagaaaaaggacaaataa

SEQ ID NO: 4538655 - DNA, 21 bp, Homo sapiens
aagaaaaaggacaaataaaac

SEQ ID NO: 4538656 - DNA, 12 bp, Homo sapiens
aagaaaacagta

SEQ ID NO: 4538657 - DNA, 16 bp, Homo sapiens
aagaaaagtttaccat

SEQ ID NO: 4538658 - DNA, 15 bp, Homo sapiens
aagaaaatctttata

SEQ ID NO: 4538659 - DNA, 16 bp, Homo sapiens
aagaaaatgaagggat

SEQ ID NO: 4538660 - DNA, 13 bp, Homo sapiens
aagaaaatgtctt

SEQ ID NO: 4538661 - DNA, 12 bp, Homo sapiens
aagaaaatttac

SEQ ID NO: 4538662 - DNA, 14 bp, Homo sapiens
aagaaacaaagatg

SEQ ID NO: 4538663 - DNA, 17 bp, Homo sapiens
aagaaaccttgctctcc

SEQ ID NO: 4538664 - DNA, 13 bp, Homo sapiens
aagaaagaaaatc

SEQ ID NO: 4538665 - DNA, 16 bp, Homo sapiens
aagaaagaaaatcagg

SEQ ID NO: 4538666 - DNA, 21 bp, Homo sapiens
aagaaagaatgcaagagtgga

SEQ ID NO: 4538667 - DNA, 22 bp, Homo sapiens
aagaaagaatgttactgcctta

SEQ ID NO: 4538668 - DNA, 20 bp, Homo sapiens
aagaaagggaaactggctga

SEQ ID NO: 4538669 - DNA, 19 bp, Homo sapiens
aagaaagtctatctaatga

SEQ ID NO: 4538670 - DNA, 23 bp, Homo sapiens
aagaaagtctatctaatgacatg

SEQ ID NO: 4538671 - DNA, 12 bp, Homo sapiens
aagaaatatctg

SEQ ID NO: 4538672 - DNA, 16 bp, Homo sapiens
aagaaatcatgtccat

SEQ ID NO: 4538673 - DNA, 14 bp, Homo sapiens
aagaaatgaacatt

SEQ ID NO: 4538674 - DNA, 17 bp, Homo sapiens
aagaaatggctatgaac

SEQ ID NO: 4538675 - DNA, 14 bp, Homo sapiens
aagaaatgtaaggg

SEQ ID NO: 4538676 - DNA, 17 bp, Homo sapiens
aagaaatgtcagatgcg

SEQ ID NO: 4538677 - DNA, 18 bp, Homo sapiens
aagaacacattttaaata

SEQ ID NO: 4538678 - DNA, 12 bp, Homo sapiens
aagaacagcccc

SEQ ID NO: 4538679 - DNA, 23 bp, Homo sapiens
aagaacagccccggggccccctg

SEQ ID NO: 4538680 - DNA, 14 bp, Homo sapiens
aagaacatgatttt

SEQ ID NO: 4538681 - DNA, 20 bp, Homo sapiens
aagaacatgcagtttgaaat

SEQ ID NO: 4538682 - DNA, 12 bp, Homo sapiens
aagaaccaaata

SEQ ID NO: 4538683 - DNA, 13 bp, Homo sapiens
aagaaccacttgt

SEQ ID NO: 4538684 - DNA, 14 bp, Homo sapiens
aagaacccctctgc

SEQ ID NO: 4538685 - DNA, 23 bp, Homo sapiens
aagaacctacagactccatctct

SEQ ID NO: 4538686 - DNA, 19 bp, Homo sapiens
aagaaccttaatgacaaca

SEQ ID NO: 4538687 - DNA, 21 bp, Homo sapiens
aagaacgttttttcctcagtg

SEQ ID NO: 4538688 - DNA, 21 bp, Homo sapiens
aagaactacaaacaaaatttc

SEQ ID NO: 4538689 - DNA, 23 bp, Homo sapiens
aagaagaaactccgaagaaaaga

SEQ ID NO: 4538690 - DNA, 18 bp, Homo sapiens
aagaagaaacttgtaaat

SEQ ID NO: 4538691 - DNA, 14 bp, Homo sapiens
aagaagacattttg

SEQ ID NO: 4538692 - DNA, 13 bp, Homo sapiens
aagaagagaaaga

SEQ ID NO: 4538693 - DNA, 12 bp, Homo sapiens
aagaagccacag

SEQ ID NO: 4538694 - DNA, 11 bp, Homo sapiens
aagaagccata

SEQ ID NO: 4538695 - DNA, 21 bp, Homo sapiens
aagaagctactattttggaaa

SEQ ID NO: 4538696 - DNA, 16 bp, Homo sapiens
aagaagctttatttct

SEQ ID NO: 4538697 - DNA, 18 bp, Homo sapiens
aagaaggaaggcctgagc

SEQ ID NO: 4538698 - DNA, 21 bp, Homo sapiens
aagaaggagagcaagaaggaa

SEQ ID NO: 4538699 - DNA, 19 bp, Homo sapiens
aagaaggcaaaaatagttt

SEQ ID NO: 4538700 - DNA, 14 bp, Homo sapiens
aagaaggcaatatt

SEQ ID NO: 4538701 - DNA, 22 bp, Homo sapiens
aagaagggctagaacctggagg

SEQ ID NO: 4538702 - DNA, 23 bp, Homo sapiens
aagaagggtgggagtggggcctt

SEQ ID NO: 4538703 - DNA, 14 bp, Homo sapiens
aagaagtaaaagca

SEQ ID NO: 4538704 - DNA, 22 bp, Homo sapiens
aagaagtaaaagcaaaaaagaa

SEQ ID NO: 4538705 - DNA, 17 bp, Homo sapiens
aagaagtatttttttaa

SEQ ID NO: 4538706 - DNA, 19 bp, Homo sapiens
aagaagtatttttttaatt

SEQ ID NO: 4538707 - DNA, 23 bp, Homo sapiens
aagaagtatttttttaatttctg

SEQ ID NO: 4538708 - DNA, 22 bp, Homo sapiens
aagaagttaattcttaaaacta

SEQ ID NO: 4538709 - DNA, 13 bp, Homo sapiens
aagaataaaatgt

SEQ ID NO: 4538710 - DNA, 13 bp, Homo sapiens
aagaataataaaa

SEQ ID NO: 4538711 - DNA, 15 bp, Homo sapiens
aagaataataaaatc

SEQ ID NO: 4538712 - DNA, 13 bp, Homo sapiens
aagaataatttat

SEQ ID NO: 4538713 - DNA, 13 bp, Homo sapiens
aagaatacttgaa

SEQ ID NO: 4538714 - DNA, 11 bp, Homo sapiens
aagaatagaac

SEQ ID NO: 4538715 - DNA, 13 bp, Homo sapiens
aagaatattgtat

SEQ ID NO: 4538716 - DNA, 18 bp, Homo sapiens
aagaatattgtattgtta

SEQ ID NO: 4538717 - DNA, 13 bp, Homo sapiens
aagaatattttaa

SEQ ID NO: 4538718 - DNA, 15 bp, Homo sapiens
aagaatattttgatg

SEQ ID NO: 4538719 - DNA, 23 bp, Homo sapiens
aagaatattttgatgcagataaa

SEQ ID NO: 4538720 - DNA, 23 bp, Homo sapiens
aagaatcagagaaggaacatacc

SEQ ID NO: 4538721 - DNA, 22 bp, Homo sapiens
aagaatcattatttattaaatt

SEQ ID NO: 4538722 - DNA, 14 bp, Homo sapiens
aagaatctagaaga

SEQ ID NO: 4538723 - DNA, 18 bp, Homo sapiens
aagaatctagaagatgtg

SEQ ID NO: 4538724 - DNA, 16 bp, Homo sapiens
aagaatgcagtacaga

SEQ ID NO: 4538725 - DNA, 17 bp, Homo sapiens
aagaatgccatttctca

SEQ ID NO: 4538726 - DNA, 13 bp, Homo sapiens
aagaatggccaac

SEQ ID NO: 4538727 - DNA, 20 bp, Homo sapiens
aagaatgttactgccttaat

SEQ ID NO: 4538728 - DNA, 19 bp, Homo sapiens
aagaattcaaatttgtaat

SEQ ID NO: 4538729 - DNA, 21 bp, Homo sapiens
aagaattcaaatttgtaataa

SEQ ID NO: 4538730 - DNA, 14 bp, Homo sapiens
aagaattgaaacca

SEQ ID NO: 4538731 - DNA, 16 bp, Homo sapiens
aagaattgaacccagg

SEQ ID NO: 4538732 - DNA, 20 bp, Homo sapiens
aagaattgaacccaggaggt

SEQ ID NO: 4538733 - DNA, 17 bp, Homo sapiens
aagaatttagatcttat

SEQ ID NO: 4538734 - DNA, 20 bp, Homo sapiens
aagaatttgaagacttcaaa

SEQ ID NO: 4538735 - DNA, 15 bp, Homo sapiens
aagaatttgtttaaa

SEQ ID NO: 4538736 - DNA, 20 bp, Homo sapiens
aagaatttttcattctcaga

SEQ ID NO: 4538737 - DNA, 16 bp, Homo sapiens
aagacaaaaataatag

SEQ ID NO: 4538738 - DNA, 15 bp, Homo sapiens
aagacaaaacgagtc

SEQ ID NO: 4538739 - DNA, 21 bp, Homo sapiens
aagacaagagatctacacatg

SEQ ID NO: 4538740 - DNA, 15 bp, Homo sapiens
aagacaatgacatac

SEQ ID NO: 4538741 - DNA, 20 bp, Homo sapiens
aagacaattttttttcaaat

SEQ ID NO: 4538742 - DNA, 21 bp, Homo sapiens
aagacaattttttttcaaatg

SEQ ID NO: 4538743 - DNA, 23 bp, Homo sapiens
aagacacactccccacttcactt

SEQ ID NO: 4538744 - DNA, 22 bp, Homo sapiens
aagacacatcttattgaataaa

SEQ ID NO: 4538745 - DNA, 18 bp, Homo sapiens
aagacagcagcagcctgc

SEQ ID NO: 4538746 - DNA, 19 bp, Homo sapiens
aagacaggagagattattt

SEQ ID NO: 4538747 - DNA, 19 bp, Homo sapiens
aagacagggtgggagggag

SEQ ID NO: 4538748 - DNA, 21 bp, Homo sapiens
aagacagggtgggagggagga

SEQ ID NO: 4538749 - DNA, 16 bp, Homo sapiens
aagacatgatttcctt

SEQ ID NO: 4538750 - DNA, 21 bp, Homo sapiens
aagacatgatttccttgaatg

SEQ ID NO: 4538751 - DNA, 17 bp, Homo sapiens
aagacatgtctgttcta

SEQ ID NO: 4538752 - DNA, 15 bp, Homo sapiens
aagacatttgctgaa

SEQ ID NO: 4538753 - DNA, 13 bp, Homo sapiens
aagacattttgtt

SEQ ID NO: 4538754 - DNA, 20 bp, Homo sapiens
aagacattttgttacataag

SEQ ID NO: 4538755 - DNA, 23 bp, Homo sapiens
aagacattttgtttttactgtat

SEQ ID NO: 4538756 - DNA, 23 bp, Homo sapiens
aagacatttttcattcatgaata

SEQ ID NO: 4538757 - DNA, 13 bp, Homo sapiens
aagacccaaaagg

SEQ ID NO: 4538758 - DNA, 20 bp, Homo sapiens
aagacccccatttgtcccag

SEQ ID NO: 4538759 - DNA, 21 bp, Homo sapiens
aagaccctcttgcccatcctg

SEQ ID NO: 4538760 - DNA, 22 bp, Homo sapiens
aagaccctcttgcccatcctga

SEQ ID NO: 4538761 - DNA, 18 bp, Homo sapiens
aagacgcaaggtgtgctc

SEQ ID NO: 4538762 - DNA, 22 bp, Homo sapiens
aagacgccttcatctgggacaa

SEQ ID NO: 4538763 - DNA, 23 bp, Homo sapiens
aagacgccttcatctgggacaaa

SEQ ID NO: 4538764 - DNA, 16 bp, Homo sapiens
aagacgtgattttgct

SEQ ID NO: 4538765 - DNA, 21 bp, Homo sapiens
aagacgtttttgtgctgtggg

SEQ ID NO: 4538766 - DNA, 17 bp, Homo sapiens
aagactactaaggcctt

SEQ ID NO: 4538767 - DNA, 23 bp, Homo sapiens
aagactaggatattgaatgtgaa

SEQ ID NO: 4538768 - DNA, 16 bp, Homo sapiens
aagactatctacaaaa

SEQ ID NO: 4538769 - DNA, 22 bp, Homo sapiens
aagactatcttactatttcaca

SEQ ID NO: 4538770 - DNA, 21 bp, Homo sapiens
aagactcaagtgggaacgact

SEQ ID NO: 4538771 - DNA, 19 bp, Homo sapiens
aagactgaagatggctttt

SEQ ID NO: 4538772 - DNA, 16 bp, Homo sapiens
aagactgcaagagatg

SEQ ID NO: 4538773 - DNA, 20 bp, Homo sapiens
aagactggaagctaatttgc

SEQ ID NO: 4538774 - DNA, 13 bp, Homo sapiens
aagactgggcccc

SEQ ID NO: 4538775 - DNA, 19 bp, Homo sapiens
aagactgtggaaatgccaa

SEQ ID NO: 4538776 - DNA, 21 bp, Homo sapiens
aagacttcaaaatattgagca

SEQ ID NO: 4538777 - DNA, 22 bp, Homo sapiens
aagacttttatgtgagatttcc

SEQ ID NO: 4538778 - DNA, 22 bp, Homo sapiens
aagagaaaaaaagtttgccaga

SEQ ID NO: 4538779 - DNA, 11 bp, Homo sapiens
aagagaaaaag

SEQ ID NO: 4538780 - DNA, 15 bp, Homo sapiens
aagagaaaagagaga

SEQ ID NO: 4538781 - DNA, 14 bp, Homo sapiens
aagagaaaggactc

SEQ ID NO: 4538782 - DNA, 20 bp, Homo sapiens
aagagaactactaaggaaaa

SEQ ID NO: 4538783 - DNA, 17 bp, Homo sapiens
aagagaagatgcctgtt

SEQ ID NO: 4538784 - DNA, 18 bp, Homo sapiens
aagagaagggcagggctg

SEQ ID NO: 4538785 - DNA, 17 bp, Homo sapiens
aagagaagtgagtggtg

SEQ ID NO: 4538786 - DNA, 23 bp, Homo sapiens
aagagaatatttacaatatatga

SEQ ID NO: 4538787 - DNA, 14 bp, Homo sapiens
aagagacagtgata

SEQ ID NO: 4538788 - DNA, 17 bp, Homo sapiens
aagagacagttctctgt

SEQ ID NO: 4538789 - DNA, 18 bp, Homo sapiens
aagagactgcgttctgca

SEQ ID NO: 4538790 - DNA, 14 bp, Homo sapiens
aagagagatgagaa

SEQ ID NO: 4538791 - DNA, 16 bp, Homo sapiens
aagagataactgtaaa

SEQ ID NO: 4538792 - DNA, 14 bp, Homo sapiens
aagagatagcttct

SEQ ID NO: 4538793 - DNA, 19 bp, Homo sapiens
aagagatctacacatgttg

SEQ ID NO: 4538794 - DNA, 20 bp, Homo sapiens
aagagatctacacatgttgc

SEQ ID NO: 4538795 - DNA, 14 bp, Homo sapiens
aagagatctttctt

SEQ ID NO: 4538796 - DNA, 20 bp, Homo sapiens
aagagatctttctttccaaa

SEQ ID NO: 4538797 - DNA, 15 bp, Homo sapiens
aagagcaagtctgga

SEQ ID NO: 4538798 - DNA, 21 bp, Homo sapiens
aagagcacggtcccccaggag

SEQ ID NO: 4538799 - DNA, 23 bp, Homo sapiens
aagagcatggatgcatttcaaat

SEQ ID NO: 4538800 - DNA, 11 bp, Homo sapiens
aagagccacct

SEQ ID NO: 4538801 - DNA, 14 bp, Homo sapiens
aagagcccttgcct

SEQ ID NO: 4538802 - DNA, 21 bp, Homo sapiens
aagagccttggtgtccacctg

SEQ ID NO: 4538803 - DNA, 18 bp, Homo sapiens
aagagcgagagatcaaag

SEQ ID NO: 4538804 - DNA, 23 bp, Homo sapiens
aagagcgagagatcaaagatgaa

SEQ ID NO: 4538805 - DNA, 18 bp, Homo sapiens
aagagctacgtatttaat

SEQ ID NO: 4538806 - DNA, 20 bp, Homo sapiens
aagagctagcgctgccgcac

SEQ ID NO: 4538807 - DNA, 11 bp, Homo sapiens
aagagctcttg

SEQ ID NO: 4538808 - DNA, 13 bp, Homo sapiens
aagagctcttggc

SEQ ID NO: 4538809 - DNA, 14 bp, Homo sapiens
aagagcttaagaac

SEQ ID NO: 4538810 - DNA, 16 bp, Homo sapiens
aagaggaagttcagat

SEQ ID NO: 4538811 - DNA, 24 bp, Homo sapiens
aagaggaatctgtttctctgctgt

SEQ ID NO: 4538812 - DNA, 23 bp, Homo sapiens
aagaggaatgaagtactcataca

SEQ ID NO: 4538813 - DNA, 19 bp, Homo sapiens
aagaggaattacgtgctct

SEQ ID NO: 4538814 - DNA, 15 bp, Homo sapiens
aagaggaccagagga

SEQ ID NO: 4538815 - DNA, 17 bp, Homo sapiens
aagaggactgagactgg

SEQ ID NO: 4538816 - DNA, 17 bp, Homo sapiens
aagaggattgtaaaatg

SEQ ID NO: 4538817 - DNA, 19 bp, Homo sapiens
aagaggcaagctgaaattt

SEQ ID NO: 4538818 - DNA, 16 bp, Homo sapiens
aagaggcatcttttct

SEQ ID NO: 4538819 - DNA, 21 bp, Homo sapiens
aagaggctctggacagcagaa

SEQ ID NO: 4538820 - DNA, 11 bp, Homo sapiens
aagaggcttct

SEQ ID NO: 4538821 - DNA, 14 bp, Homo sapiens
aagagggaaaacag

SEQ ID NO: 4538822 - DNA, 18 bp, Homo sapiens
aagagggaaaacagaaaa

SEQ ID NO: 4538823 - DNA, 19 bp, Homo sapiens
aagagggaaaacagaaaac

SEQ ID NO: 4538824 - DNA, 23 bp, Homo sapiens
aagagggaagaaagagaaggagc

SEQ ID NO: 4538825 - DNA, 19 bp, Homo sapiens
aagagggcccaaagaattg

SEQ ID NO: 4538826 - DNA, 15 bp, Homo sapiens
aagagggcccagccc

SEQ ID NO: 4538827 - DNA, 16 bp, Homo sapiens
aagagggcccagccca

SEQ ID NO: 4538828 - DNA, 17 bp, Homo sapiens
aagaggggcgggctcag

SEQ ID NO: 4538829 - DNA, 20 bp, Homo sapiens
aagaggggcgggctcagagc

SEQ ID NO: 4538830 - DNA, 21 bp, Homo sapiens
aagaggggcgggctcagagct

SEQ ID NO: 4538831 - DNA, 23 bp, Homo sapiens
aagaggggcgggctcagagcttt

SEQ ID NO: 4538832 - DNA, 16 bp, Homo sapiens
aagaggtattggattt

SEQ ID NO: 4538833 - DNA, 13 bp, Homo sapiens
aagaggtctgagc

SEQ ID NO: 4538834 - DNA, 15 bp, Homo sapiens
aagaggtctgagccc

SEQ ID NO: 4538835 - DNA, 22 bp, Homo sapiens
aagaggtctgagccctggtgtg

SEQ ID NO: 4538836 - DNA, 17 bp, Homo sapiens
aagaggtgaacattaaa

SEQ ID NO: 4538837 - DNA, 16 bp, Homo sapiens
aagaggtgggagggcc

SEQ ID NO: 4538838 - DNA, 12 bp, Homo sapiens
aagaggttttat

SEQ ID NO: 4538839 - DNA, 14 bp, Homo sapiens
aagagtaatttcat

SEQ ID NO: 4538840 - DNA, 13 bp, Homo sapiens
aagagtacactca

SEQ ID NO: 4538841 - DNA, 21 bp, Homo sapiens
aagagtacactcagccactgt

SEQ ID NO: 4538842 - DNA, 20 bp, Homo sapiens
aagagtagaaactgcaggga

SEQ ID NO: 4538843 - DNA, 21 bp, Homo sapiens
aagagtatgtggcaaaacata

SEQ ID NO: 4538844 - DNA, 13 bp, Homo sapiens
aagagtctccagt

SEQ ID NO: 4538845 - DNA, 15 bp, Homo sapiens
aagagtctgtctcaa

SEQ ID NO: 4538846 - DNA, 22 bp, Homo sapiens
aagagtgactctccaggggtcc

SEQ ID NO: 4538847 - DNA, 19 bp, Homo sapiens
aagagtgtgttataaaata

SEQ ID NO: 4538848 - DNA, 20 bp, Homo sapiens
aagagtgtgttataaaataa

SEQ ID NO: 4538849 - DNA, 21 bp, Homo sapiens
aagagtgtgttataaaataat

SEQ ID NO: 4538850 - DNA, 17 bp, Homo sapiens
aagagttattcaaatga

SEQ ID NO: 4538851 - DNA, 20 bp, Homo sapiens
aagagttattcaaatgaagg

SEQ ID NO: 4538852 - DNA, 19 bp, Homo sapiens
aagagtttattattgtact

SEQ ID NO: 4538853 - DNA, 19 bp, Homo sapiens
aagataacccttattccat

SEQ ID NO: 4538854 - DNA, 15 bp, Homo sapiens
aagataatctcagtg

SEQ ID NO: 4538855 - DNA, 23 bp, Homo sapiens
aagataatctcagtgctttcctc

SEQ ID NO: 4538856 - DNA, 15 bp, Homo sapiens
aagatacaataaaac

SEQ ID NO: 4538857 - DNA, 23 bp, Homo sapiens
aagatacactgcactttgtttag

SEQ ID NO: 4538858 - DNA, 20 bp, Homo sapiens
aagatacagaactctttcaa

SEQ ID NO: 4538859 - DNA, 16 bp, Homo sapiens
aagatagtcttggaag

SEQ ID NO: 4538860 - DNA, 12 bp, Homo sapiens
aagatatatgtg

SEQ ID NO: 4538861 - DNA, 15 bp, Homo sapiens
aagatcaatttctcc

SEQ ID NO: 4538862 - DNA, 15 bp, Homo sapiens
aagatcacagagcag

SEQ ID NO: 4538863 - DNA, 15 bp, Homo sapiens
aagatcactttctca

SEQ ID NO: 4538864 - DNA, 23 bp, Homo sapiens
aagatcactttctcagttttcat

SEQ ID NO: 4538865 - DNA, 13 bp, Homo sapiens
aagatcatttata

SEQ ID NO: 4538866 - DNA, 14 bp, Homo sapiens
aagatccagaaata

SEQ ID NO: 4538867 - DNA, 23 bp, Homo sapiens
aagatccccaactgctccagcct

SEQ ID NO: 4538868 - DNA, 13 bp, Homo sapiens
aagatcctaaact

SEQ ID NO: 4538869 - DNA, 16 bp, Homo sapiens
aagatcctaaactctc

SEQ ID NO: 4538870 - DNA, 19 bp, Homo sapiens
aagatcctaaactctctag

SEQ ID NO: 4538871 - DNA, 19 bp, Homo sapiens
aagatcgcaccactgcact

SEQ ID NO: 4538872 - DNA, 12 bp, Homo sapiens
aagatctaaatc

SEQ ID NO: 4538873 - DNA, 22 bp, Homo sapiens
aagatctgttttgaaggcaaaa

SEQ ID NO: 4538874 - DNA, 19 bp, Homo sapiens
aagatcttgcagaagttct

SEQ ID NO: 4538875 - DNA, 14 bp, Homo sapiens
aagatgagctgtgc

SEQ ID NO: 4538876 - DNA, 15 bp, Homo sapiens
aagatgcaaggacca

SEQ ID NO: 4538877 - DNA, 18 bp, Homo sapiens
aagatgcctgttaattta

SEQ ID NO: 4538878 - DNA, 23 bp, Homo sapiens
aagatgcctgttaatttataatg

SEQ ID NO: 4538879 - DNA, 16 bp, Homo sapiens
aagatggaaatacagt

SEQ ID NO: 4538880 - DNA, 19 bp, Homo sapiens
aagatggacacgagccaca

SEQ ID NO: 4538881 - DNA, 21 bp, Homo sapiens
aagatggacacgagccacaag

SEQ ID NO: 4538882 - DNA, 20 bp, Homo sapiens
aagatgggcatcttttgtat

SEQ ID NO: 4538883 - DNA, 22 bp, Homo sapiens
aagatgggcatcttttgtatta

SEQ ID NO: 4538884 - DNA, 20 bp, Homo sapiens
aagatgtaataatcatttta

SEQ ID NO: 4538885 - DNA, 22 bp, Homo sapiens
aagatgtaataatcattttaga

SEQ ID NO: 4538886 - DNA, 20 bp, Homo sapiens
aagatgtacatttaataata

SEQ ID NO: 4538887 - DNA, 17 bp, Homo sapiens
aagatgtctatgtagct

SEQ ID NO: 4538888 - DNA, 21 bp, Homo sapiens
aagatgtcttaacctcaggga

SEQ ID NO: 4538889 - DNA, 13 bp, Homo sapiens
aagatgtgaatta

SEQ ID NO: 4538890 - DNA, 20 bp, Homo sapiens
aagatgtgaattattgacac

SEQ ID NO: 4538891 - DNA, 16 bp, Homo sapiens
aagatgtgtaaacagg

SEQ ID NO: 4538892 - DNA, 18 bp, Homo sapiens
aagatgtgttcttatttt

SEQ ID NO: 4538893 - DNA, 16 bp, Homo sapiens
aagatgttatggtgtt

SEQ ID NO: 4538894 - DNA, 20 bp, Homo sapiens
aagatgttatggtgtttaga

SEQ ID NO: 4538895 - DNA, 20 bp, Homo sapiens
aagatgtttcttgccttttg

SEQ ID NO: 4538896 - DNA, 23 bp, Homo sapiens
aagattaactttcaaaagcaaac

SEQ ID NO: 4538897 - DNA, 21 bp, Homo sapiens
aagattacaaatcagaagtca

SEQ ID NO: 4538898 - DNA, 21 bp, Homo sapiens
aagattaggtcgttttccaaa

SEQ ID NO: 4538899 - DNA, 20 bp, Homo sapiens
aagattatgtgacttgcaat

SEQ ID NO: 4538900 - DNA, 20 bp, Homo sapiens
aagattattgtgacttcact

SEQ ID NO: 4538901 - DNA, 21 bp, Homo sapiens
aagattattgtgacttcactg

SEQ ID NO: 4538902 - DNA, 12 bp, Homo sapiens
aagattccaaaa

SEQ ID NO: 4538903 - DNA, 13 bp, Homo sapiens
aagattcccagag

SEQ ID NO: 4538904 - DNA, 15 bp, Homo sapiens
aagattcccagagac

SEQ ID NO: 4538905 - DNA, 20 bp, Homo sapiens
aagattcccagagacaggaa

SEQ ID NO: 4538906 - DNA, 19 bp, Homo sapiens
aagattcccttgaaattta

SEQ ID NO: 4538907 - DNA, 19 bp, Homo sapiens
aagattctatgttaatatt

SEQ ID NO: 4538908 - DNA, 21 bp, Homo sapiens
aagattctatgttaatatttt

SEQ ID NO: 4538909 - DNA, 18 bp, Homo sapiens
aagattctcgccccttcc

SEQ ID NO: 4538910 - DNA, 16 bp, Homo sapiens
aagattcttttaaatt

SEQ ID NO: 4538911 - DNA, 20 bp, Homo sapiens
aagattcttttaaattagaa

SEQ ID NO: 4538912 - DNA, 18 bp, Homo sapiens
aagattgccccatctaga

SEQ ID NO: 4538913 - DNA, 16 bp, Homo sapiens
aagattgctgaaattt

SEQ ID NO: 4538914 - DNA, 16 bp, Homo sapiens
aagattgtattgctgt

SEQ ID NO: 4538915 - DNA, 19 bp, Homo sapiens
aagattgttattaaatgta

SEQ ID NO: 4538916 - DNA, 20 bp, Homo sapiens
aagattgttattaaatgtag

SEQ ID NO: 4538917 - DNA, 22 bp, Homo sapiens
aagatttagttgagttattcca

SEQ ID NO: 4538918 - DNA, 23 bp, Homo sapiens
aagatttcatatctaactttgta

SEQ ID NO: 4538919 - DNA, 16 bp, Homo sapiens
aagatttccttgtgca

SEQ ID NO: 4538920 - DNA, 17 bp, Homo sapiens
aagatttccttgtgcaa

SEQ ID NO: 4538921 - DNA, 23 bp, Homo sapiens
aagatttgatgtatgtaatacat

SEQ ID NO: 4538922 - DNA, 21 bp, Homo sapiens
aagatttgcccatttacactt

SEQ ID NO: 4538923 - DNA, 18 bp, Homo sapiens
aagatttgtgaactggaa

SEQ ID NO: 4538924 - DNA, 19 bp, Homo sapiens
aagatttgtgaactggaag

SEQ ID NO: 4538925 - DNA, 22 bp, Homo sapiens
aagatttgtgaactggaagaaa

SEQ ID NO: 4538926 - DNA, 16 bp, Homo sapiens
aagattttcctcttgt

SEQ ID NO: 4538927 - DNA, 19 bp, Homo sapiens
aagattttcctcttgtgat

SEQ ID NO: 4538928 - DNA, 20 bp, Homo sapiens
aagattttcctcttgtgatt

SEQ ID NO: 4538929 - DNA, 17 bp, Homo sapiens
aagatttttaaaatgaa

SEQ ID NO: 4538930 - DNA, 14 bp, Homo sapiens
aagattttttaata

SEQ ID NO: 4538931 - DNA, 17 bp, Homo sapiens
aagattttttcatttca

SEQ ID NO: 4538932 - DNA, 18 bp, Homo sapiens
aagcaaaaggctgagaag

SEQ ID NO: 4538933 - DNA, 21 bp, Homo sapiens
aagcaaaaggctgagaaggaa

SEQ ID NO: 4538934 - DNA, 21 bp, Homo sapiens
aagcaaaagtaatcacttaaa

SEQ ID NO: 4538935 - DNA, 22 bp, Homo sapiens
aagcaaaagtaatcacttaaag

SEQ ID NO: 4538936 - DNA, 15 bp, Homo sapiens
aagcaaaatctaaaa

SEQ ID NO: 4538937 - DNA, 21 bp, Homo sapiens
aagcaaactctaaaattataa

SEQ ID NO: 4538938 - DNA, 13 bp, Homo sapiens
aagcaaacttaca

SEQ ID NO: 4538939 - DNA, 23 bp, Homo sapiens
aagcaaacttacaggtcctgctg

SEQ ID NO: 4538940 - DNA, 17 bp, Homo sapiens
aagcaaatcagaaactt

SEQ ID NO: 4538941 - DNA, 19 bp, Homo sapiens
aagcaaatcatttgtttaa

SEQ ID NO: 4538942 - DNA, 15 bp, Homo sapiens
aagcaaattaagaca

SEQ ID NO: 4538943 - DNA, 20 bp, Homo sapiens
aagcaacaaagattgagaag

SEQ ID NO: 4538944 - DNA, 21 bp, Homo sapiens
aagcaacaaagattgagaagc

SEQ ID NO: 4538945 - DNA, 17 bp, Homo sapiens
aagcaacccaaatgttc

SEQ ID NO: 4538946 - DNA, 18 bp, Homo sapiens
aagcaacctcagtaattt

SEQ ID NO: 4538947 - DNA, 20 bp, Homo sapiens
aagcaacctcagtaatttag

SEQ ID NO: 4538948 - DNA, 15 bp, Homo sapiens
aagcaagcattcaga

SEQ ID NO: 4538949 - DNA, 19 bp, Homo sapiens
aagcaagcattcagaagaa

SEQ ID NO: 4538950 - DNA, 21 bp, Homo sapiens
aagcaagcattcagaagaaaa

SEQ ID NO: 4538951 - DNA, 13 bp, Homo sapiens
aagcaagccagac

SEQ ID NO: 4538952 - DNA, 15 bp, Homo sapiens
aagcaaggcaaaaat

SEQ ID NO: 4538953 - DNA, 14 bp, Homo sapiens
aagcaataaatgaa

SEQ ID NO: 4538954 - DNA, 17 bp, Homo sapiens
aagcaatattgtatatt

SEQ ID NO: 4538955 - DNA, 15 bp, Homo sapiens
aagcaatcattttat

SEQ ID NO: 4538956 - DNA, 15 bp, Homo sapiens
aagcaatccacctgc

SEQ ID NO: 4538957 - DNA, 20 bp, Homo sapiens
aagcaatccacctgccttgg

SEQ ID NO: 4538958 - DNA, 14 bp, Homo sapiens
aagcaatcctcctg

SEQ ID NO: 4538959 - DNA, 21 bp, Homo sapiens
aagcaatcctcctgcctcagc

SEQ ID NO: 4538960 - DNA, 21 bp, Homo sapiens
aagcacaaagttctcagagct

SEQ ID NO: 4538961 - DNA, 15 bp, Homo sapiens
aagcacaactccctt

SEQ ID NO: 4538962 - DNA, 15 bp, Homo sapiens
aagcacaagtacttt

SEQ ID NO: 4538963 - DNA, 23 bp, Homo sapiens
aagcacaccatatgtccactgtt

SEQ ID NO: 4538964 - DNA, 16 bp, Homo sapiens
aagcacactggaatat

SEQ ID NO: 4538965 - DNA, 13 bp, Homo sapiens
aagcacagagcct

SEQ ID NO: 4538966 - DNA, 21 bp, Homo sapiens
aagcacagagcctggccccag

SEQ ID NO: 4538967 - DNA, 13 bp, Homo sapiens
aagcacagccctt

SEQ ID NO: 4538968 - DNA, 12 bp, Homo sapiens
aagcacctgccg

SEQ ID NO: 4538969 - DNA, 15 bp, Homo sapiens
aagcacgggggagtg

SEQ ID NO: 4538970 - DNA, 16 bp, Homo sapiens
aagcactgacttctaa

SEQ ID NO: 4538971 - DNA, 19 bp, Homo sapiens
aagcactggtttcaagaat

SEQ ID NO: 4538972 - DNA, 18 bp, Homo sapiens
aagcacttaaacagaagc

SEQ ID NO: 4538973 - DNA, 11 bp, Homo sapiens
aagcagaggcc

SEQ ID NO: 4538974 - DNA, 19 bp, Homo sapiens
aagcagaggccctgccccc

SEQ ID NO: 4538975 - DNA, 21 bp, Homo sapiens
aagcagaggctttggggtcct

SEQ ID NO: 4538976 - DNA, 19 bp, Homo sapiens
aagcagagtaacaggatca

SEQ ID NO: 4538977 - DNA, 14 bp, Homo sapiens
aagcagcaacagcc

SEQ ID NO: 4538978 - DNA, 22 bp, Homo sapiens
aagcagctttttattccctgcc

SEQ ID NO: 4538979 - DNA, 17 bp, Homo sapiens
aagcaggtttcaaggaa

SEQ ID NO: 4538980 - DNA, 14 bp, Homo sapiens
aagcaggtttgttt

SEQ ID NO: 4538981 - DNA, 16 bp, Homo sapiens
aagcaggtttgttttc

SEQ ID NO: 4538982 - DNA, 13 bp, Homo sapiens
aagcagtattttg

SEQ ID NO: 4538983 - DNA, 15 bp, Homo sapiens
aagcagtattttggt

SEQ ID NO: 4538984 - DNA, 17 bp, Homo sapiens
aagcagtatttttcttg

SEQ ID NO: 4538985 - DNA, 18 bp, Homo sapiens
aagcagtatttttcttga

SEQ ID NO: 4538986 - DNA, 14 bp, Homo sapiens
aagcagtgtttgct

SEQ ID NO: 4538987 - DNA, 22 bp, Homo sapiens
aagcagttatggtgatgactta

SEQ ID NO: 4538988 - DNA, 22 bp, Homo sapiens
aagcataaaagatgaaagagca

SEQ ID NO: 4538989 - DNA, 21 bp, Homo sapiens
aagcataaaatggaataacat

SEQ ID NO: 4538990 - DNA, 17 bp, Homo sapiens
aagcataatctgaaaac

SEQ ID NO: 4538991 - DNA, 18 bp, Homo sapiens
aagcatactttgtaaata

SEQ ID NO: 4538992 - DNA, 20 bp, Homo sapiens
aagcatagctacaatttgtt

SEQ ID NO: 4538993 - DNA, 23 bp, Homo sapiens
aagcatccctcacccatcctaga

SEQ ID NO: 4538994 - DNA, 17 bp, Homo sapiens
aagcatctggctctaat

SEQ ID NO: 4538995 - DNA, 19 bp, Homo sapiens
aagcatctggctctaattc

SEQ ID NO: 4538996 - DNA, 12 bp, Homo sapiens
aagcatgaataa

SEQ ID NO: 4538997 - DNA, 13 bp, Homo sapiens
aagcatgtcaatt

SEQ ID NO: 4538998 - DNA, 19 bp, Homo sapiens
aagcattaccactcaggca

SEQ ID NO: 4538999 - DNA, 16 bp, Homo sapiens
aagcattgaatggcta

SEQ ID NO: 4539000 - DNA, 13 bp, Homo sapiens
aagcattgcctgg

SEQ ID NO: 4539001 - DNA, 14 bp, Homo sapiens
aagcattgtaaaat

SEQ ID NO: 4539002 - DNA, 12 bp, Homo sapiens
aagcatttccag

SEQ ID NO: 4539003 - DNA, 13 bp, Homo sapiens
aagcattttgtaa

SEQ ID NO: 4539004 - DNA, 20 bp, Homo sapiens
aagcatttttccatctgtgt

SEQ ID NO: 4539005 - DNA, 21 bp, Homo sapiens
aagccaaagaaaaataaccct

SEQ ID NO: 4539006 - DNA, 19 bp, Homo sapiens
aagccaaagaaatgaacat

SEQ ID NO: 4539007 - DNA, 20 bp, Homo sapiens
aagccaaagaaatgaacatt

SEQ ID NO: 4539008 - DNA, 23 bp, Homo sapiens
aagccaaagaaatgaacattcca

SEQ ID NO: 4539009 - DNA, 23 bp, Homo sapiens
aagccaaaggttcagaaaattaa

SEQ ID NO: 4539010 - DNA, 14 bp, Homo sapiens
aagccaagaaagat

SEQ ID NO: 4539011 - DNA, 13 bp, Homo sapiens
aagccaagggaaa

SEQ ID NO: 4539012 - DNA, 16 bp, Homo sapiens
aagccaagggaaaggg

SEQ ID NO: 4539013 - DNA, 13 bp, Homo sapiens
aagccaagtgggg

SEQ ID NO: 4539014 - DNA, 13 bp, Homo sapiens
aagccacaggaag

SEQ ID NO: 4539015 - DNA, 19 bp, Homo sapiens
aagccaccttgttacaaat

SEQ ID NO: 4539016 - DNA, 21 bp, Homo sapiens
aagccacgccctccctgctag

SEQ ID NO: 4539017 - DNA, 21 bp, Homo sapiens
aagccagacctagcaggctgt

SEQ ID NO: 4539018 - DNA, 12 bp, Homo sapiens
aagccagagccc

SEQ ID NO: 4539019 - DNA, 22 bp, Homo sapiens
aagccagccaagctttaaatta

SEQ ID NO: 4539020 - DNA, 17 bp, Homo sapiens
aagccagcgtcctcctc

SEQ ID NO: 4539021 - DNA, 14 bp, Homo sapiens
aagccagctttccc

SEQ ID NO: 4539022 - DNA, 15 bp, Homo sapiens
aagccagctttccct

SEQ ID NO: 4539023 - DNA, 23 bp, Homo sapiens
aagccagctttccctgcctctca

SEQ ID NO: 4539024 - DNA, 12 bp, Homo sapiens
aagccaggagca

SEQ ID NO: 4539025 - DNA, 17 bp, Homo sapiens
aagccagtcagggcccc

SEQ ID NO: 4539026 - DNA, 17 bp, Homo sapiens
aagccatagaccctgag

SEQ ID NO: 4539027 - DNA, 14 bp, Homo sapiens
aagccatcacttct

SEQ ID NO: 4539028 - DNA, 18 bp, Homo sapiens
aagccatgtactcaagta

SEQ ID NO: 4539029 - DNA, 17 bp, Homo sapiens
aagcccaaggtgctgat

SEQ ID NO: 4539030 - DNA, 20 bp, Homo sapiens
aagcccagcactgcttgagg

SEQ ID NO: 4539031 - DNA, 23 bp, Homo sapiens
aagcccagcactgcttgaggaaa

SEQ ID NO: 4539032 - DNA, 16 bp, Homo sapiens
aagcccatcctgacca

SEQ ID NO: 4539033 - DNA, 18 bp, Homo sapiens
aagcccatcctgaccagc

SEQ ID NO: 4539034 - DNA, 13 bp, Homo sapiens
aagccccccagct

SEQ ID NO: 4539035 - DNA, 21 bp, Homo sapiens
aagccccccagctcccacacc

SEQ ID NO: 4539036 - DNA, 23 bp, Homo sapiens
aagcccgcttgctcgcttgctgg

SEQ ID NO: 4539037 - DNA, 21 bp, Homo sapiens
aagccctcaaagaagtcggaa

SEQ ID NO: 4539038 - DNA, 12 bp, Homo sapiens
aagccctccttc

SEQ ID NO: 4539039 - DNA, 11 bp, Homo sapiens
aagccctgccc

SEQ ID NO: 4539040 - DNA, 17 bp, Homo sapiens
aagccctgcccacagaa

SEQ ID NO: 4539041 - DNA, 22 bp, Homo sapiens
aagcctaagggatcctgcctgc

SEQ ID NO: 4539042 - DNA, 16 bp, Homo sapiens
aagcctacctgctctc

SEQ ID NO: 4539043 - DNA, 21 bp, Homo sapiens
aagcctatcaaaggaaatgag

SEQ ID NO: 4539044 - DNA, 19 bp, Homo sapiens
aagcctccgcctgctgtgt

SEQ ID NO: 4539045 - DNA, 14 bp, Homo sapiens
aagcctcctgcccc

SEQ ID NO: 4539046 - DNA, 23 bp, Homo sapiens
aagcctctctccttggccacaga

SEQ ID NO: 4539047 - DNA, 14 bp, Homo sapiens
aagcctctggctag

SEQ ID NO: 4539048 - DNA, 23 bp, Homo sapiens
aagcctctggctagaggccagcc

SEQ ID NO: 4539049 - DNA, 12 bp, Homo sapiens
aagcctctggga

SEQ ID NO: 4539050 - DNA, 19 bp, Homo sapiens
aagcctgatactttagcca

SEQ ID NO: 4539051 - DNA, 21 bp, Homo sapiens
aagcctgctggctgcggcccc

SEQ ID NO: 4539052 - DNA, 20 bp, Homo sapiens
aagcctgggtgtcaagtgcc

SEQ ID NO: 4539053 - DNA, 23 bp, Homo sapiens
aagcctgggtgtcaagtgcctgc

SEQ ID NO: 4539054 - DNA, 17 bp, Homo sapiens
aagcctgtgcaaaaaaa

SEQ ID NO: 4539055 - DNA, 14 bp, Homo sapiens
aagcctgtggatga

SEQ ID NO: 4539056 - DNA, 17 bp, Homo sapiens
aagcctgtggatgatca

SEQ ID NO: 4539057 - DNA, 18 bp, Homo sapiens
aagcctgttgtttaagtg

SEQ ID NO: 4539058 - DNA, 18 bp, Homo sapiens
aagccttactcacctctc

SEQ ID NO: 4539059 - DNA, 19 bp, Homo sapiens
aagccttactcacctctct

SEQ ID NO: 4539060 - DNA, 15 bp, Homo sapiens
aagcgagcacagtat

SEQ ID NO: 4539061 - DNA, 14 bp, Homo sapiens
aagcgattctcctg

SEQ ID NO: 4539062 - DNA, 20 bp, Homo sapiens
aagcgcgttgtgtatattac

SEQ ID NO: 4539063 - DNA, 22 bp, Homo sapiens
aagcgctcatctggcttttcgc

SEQ ID NO: 4539064 - DNA, 15 bp, Homo sapiens
aagcgggcagccccg

SEQ ID NO: 4539065 - DNA, 21 bp, Homo sapiens
aagcgtgcacaaggattgaaa

SEQ ID NO: 4539066 - DNA, 23 bp, Homo sapiens
aagcgtgcacaaggattgaaaat

SEQ ID NO: 4539067 - DNA, 13 bp, Homo sapiens
aagcgtgttctca

SEQ ID NO: 4539068 - DNA, 14 bp, Homo sapiens
aagcgtgttctcag

SEQ ID NO: 4539069 - DNA, 16 bp, Homo sapiens
aagcgttcctggcctt

SEQ ID NO: 4539070 - DNA, 19 bp, Homo sapiens
aagcgttcctggccttctg

SEQ ID NO: 4539071 - DNA, 11 bp, Homo sapiens
aagctaaactg

SEQ ID NO: 4539072 - DNA, 14 bp, Homo sapiens
aagctaatgtgcag

SEQ ID NO: 4539073 - DNA, 14 bp, Homo sapiens
aagctaatttgcat

SEQ ID NO: 4539074 - DNA, 15 bp, Homo sapiens
aagctaatttgcatt

SEQ ID NO: 4539075 - DNA, 19 bp, Homo sapiens
aagctacctcaaacttcca

SEQ ID NO: 4539076 - DNA, 18 bp, Homo sapiens
aagctactattttggaaa

SEQ ID NO: 4539077 - DNA, 17 bp, Homo sapiens
aagctactgccatcctg

SEQ ID NO: 4539078 - DNA, 17 bp, Homo sapiens
aagctagaacctggagg

SEQ ID NO: 4539079 - DNA, 19 bp, Homo sapiens
aagctagaattgagtgttt

SEQ ID NO: 4539080 - DNA, 15 bp, Homo sapiens
aagctagacacatga

SEQ ID NO: 4539081 - DNA, 22 bp, Homo sapiens
aagctagggtggcccttgcagt

SEQ ID NO: 4539082 - DNA, 20 bp, Homo sapiens
aagctataaagcagtatttt

SEQ ID NO: 4539083 - DNA, 22 bp, Homo sapiens
aagctatcttcatgtaaattga

SEQ ID NO: 4539084 - DNA, 18 bp, Homo sapiens
aagctatttaaagcatct

SEQ ID NO: 4539085 - DNA, 15 bp, Homo sapiens
aagctcacagttcct

SEQ ID NO: 4539086 - DNA, 18 bp, Homo sapiens
aagctcatttcatgctct

SEQ ID NO: 4539087 - DNA, 15 bp, Homo sapiens
aagctccatcaatga

SEQ ID NO: 4539088 - DNA, 15 bp, Homo sapiens
aagctctgaagaact

SEQ ID NO: 4539089 - DNA, 15 bp, Homo sapiens
aagctctgaatagtt

SEQ ID NO: 4539090 - DNA, 18 bp, Homo sapiens
aagctgaaattttagaaa

SEQ ID NO: 4539091 - DNA, 14 bp, Homo sapiens
aagctgaagatccc

SEQ ID NO: 4539092 - DNA, 19 bp, Homo sapiens
aagctgaagatccccaact

SEQ ID NO: 4539093 - DNA, 22 bp, Homo sapiens
aagctgaagatccccaactgct

SEQ ID NO: 4539094 - DNA, 21 bp, Homo sapiens
aagctgaatcagacagtggat

SEQ ID NO: 4539095 - DNA, 16 bp, Homo sapiens
aagctgacaatttatg

SEQ ID NO: 4539096 - DNA, 22 bp, Homo sapiens
aagctgacattgccaaaaagga

SEQ ID NO: 4539097 - DNA, 15 bp, Homo sapiens
aagctgcaaatctga

SEQ ID NO: 4539098 - DNA, 19 bp, Homo sapiens
aagctgcaaatctgatggc

SEQ ID NO: 4539099 - DNA, 16 bp, Homo sapiens
aagctgcactgtgaac

SEQ ID NO: 4539100 - DNA, 17 bp, Homo sapiens
aagctgcccagccctgg

SEQ ID NO: 4539101 - DNA, 22 bp, Homo sapiens
aagctggccgagggtcctggct

SEQ ID NO: 4539102 - DNA, 21 bp, Homo sapiens
aagctggctttgaaacctcag

SEQ ID NO: 4539103 - DNA, 17 bp, Homo sapiens
aagctgggccccagccc

SEQ ID NO: 4539104 - DNA, 16 bp, Homo sapiens
aagctggtttaatgtt

SEQ ID NO: 4539105 - DNA, 13 bp, Homo sapiens
aagctgtctactg

SEQ ID NO: 4539106 - DNA, 12 bp, Homo sapiens
aagctgtgtcct

SEQ ID NO: 4539107 - DNA, 22 bp, Homo sapiens
aagctgtgtccttgcacctgca

SEQ ID NO: 4539108 - DNA, 16 bp, Homo sapiens
aagctgttatttcttc

SEQ ID NO: 4539109 - DNA, 17 bp, Homo sapiens
aagctgttatttcttcc

SEQ ID NO: 4539110 - DNA, 14 bp, Homo sapiens
aagctgttggtgtt

SEQ ID NO: 4539111 - DNA, 14 bp, Homo sapiens
aagcttaaaacttt

SEQ ID NO: 4539112 - DNA, 22 bp, Homo sapiens
aagcttaaataggaaagtttct

SEQ ID NO: 4539113 - DNA, 17 bp, Homo sapiens
aagcttaacatttcatg

SEQ ID NO: 4539114 - DNA, 18 bp, Homo sapiens
aagcttaacatttcatgt

SEQ ID NO: 4539115 - DNA, 21 bp, Homo sapiens
aagcttaatggctgataattt

SEQ ID NO: 4539116 - DNA, 18 bp, Homo sapiens
aagcttattaaaactcat

SEQ ID NO: 4539117 - DNA, 19 bp, Homo sapiens
aagcttcaaagtttatatg

SEQ ID NO: 4539118 - DNA, 15 bp, Homo sapiens
aagcttcagcaggag

SEQ ID NO: 4539119 - DNA, 15 bp, Homo sapiens
aagcttccacaaaat

SEQ ID NO: 4539120 - DNA, 16 bp, Homo sapiens
aagcttccacaaaatt

SEQ ID NO: 4539121 - DNA, 20 bp, Homo sapiens
aagcttccatagctgctgcc

SEQ ID NO: 4539122 - DNA, 15 bp, Homo sapiens
aagcttccatgattc

SEQ ID NO: 4539123 - DNA, 17 bp, Homo sapiens
aagcttctctgttctgg

SEQ ID NO: 4539124 - DNA, 20 bp, Homo sapiens
aagcttctgtctccagcttc

SEQ ID NO: 4539125 - DNA, 20 bp, Homo sapiens
aagcttggtgacaaaattca

SEQ ID NO: 4539126 - DNA, 20 bp, Homo sapiens
aagctttaaatgacagtaat

SEQ ID NO: 4539127 - DNA, 13 bp, Homo sapiens
aagctttaaatta

SEQ ID NO: 4539128 - DNA, 14 bp, Homo sapiens
aagctttaggcaga

SEQ ID NO: 4539129 - DNA, 15 bp, Homo sapiens
aagctttatctttgt

SEQ ID NO: 4539130 - DNA, 21 bp, Homo sapiens
aagctttatgattttcataac

SEQ ID NO: 4539131 - DNA, 16 bp, Homo sapiens
aagctttgatttagat

SEQ ID NO: 4539132 - DNA, 19 bp, Homo sapiens
aagctttggaaaaatcttt

SEQ ID NO: 4539133 - DNA, 20 bp, Homo sapiens
aagctttgtccttttgctct

SEQ ID NO: 4539134 - DNA, 14 bp, Homo sapiens
aagcttttattcct

SEQ ID NO: 4539135 - DNA, 18 bp, Homo sapiens
aagcttttcattttaata

SEQ ID NO: 4539136 - DNA, 21 bp, Homo sapiens
aagcttttcattttaatatat

SEQ ID NO: 4539137 - DNA, 12 bp, Homo sapiens
aagctttttgga

SEQ ID NO: 4539138 - DNA, 13 bp, Homo sapiens
aagctttttggaa

SEQ ID NO: 4539139 - DNA, 16 bp, Homo sapiens
aaggaaaaaagatttt

SEQ ID NO: 4539140 - DNA, 17 bp, Homo sapiens
aaggaaaaaatgcaaac

SEQ ID NO: 4539141 - DNA, 15 bp, Homo sapiens
aaggaaaaacaaact

SEQ ID NO: 4539142 - DNA, 10 bp, Homo sapiens
aaggaaaaag

SEQ ID NO: 4539143 - DNA, 13 bp, Homo sapiens
aaggaaaaagctc

SEQ ID NO: 4539144 - DNA, 14 bp, Homo sapiens
aaggaaaacaaaaa

SEQ ID NO: 4539145 - DNA, 20 bp, Homo sapiens
aaggaaaagaaaacaaaaaa

SEQ ID NO: 4539146 - DNA, 20 bp, Homo sapiens
aaggaaacaaccatgtcatt

SEQ ID NO: 4539147 - DNA, 20 bp, Homo sapiens
aaggaaactttttaattgtg

SEQ ID NO: 4539148 - DNA, 15 bp, Homo sapiens
aaggaaagatttgtg

SEQ ID NO: 4539149 - DNA, 16 bp, Homo sapiens
aaggaaagcaataaat

SEQ ID NO: 4539150 - DNA, 20 bp, Homo sapiens
aaggaaaggctcatttaaaa

SEQ ID NO: 4539151 - DNA, 20 bp, Homo sapiens
aaggaaataaaaaagtctct

SEQ ID NO: 4539152 - DNA, 13 bp, Homo sapiens
aaggaagagaaga

SEQ ID NO: 4539153 - DNA, 18 bp, Homo sapiens
aaggaagcattgtaaaat

SEQ ID NO: 4539154 - DNA, 23 bp, Homo sapiens
aaggaagcattgtaaaataattc

SEQ ID NO: 4539155 - DNA, 14 bp, Homo sapiens
aaggaagtctagga

SEQ ID NO: 4539156 - DNA, 17 bp, Homo sapiens
aaggaagtgtgtttgcc

SEQ ID NO: 4539157 - DNA, 21 bp, Homo sapiens
aaggaagttttaactttaata

SEQ ID NO: 4539158 - DNA, 19 bp, Homo sapiens
aaggaatcacgttagagga

SEQ ID NO: 4539159 - DNA, 13 bp, Homo sapiens
aaggacacagtga

SEQ ID NO: 4539160 - DNA, 15 bp, Homo sapiens
aaggacacagtgatg

SEQ ID NO: 4539161 - DNA, 13 bp, Homo sapiens
aaggacagtccct

SEQ ID NO: 4539162 - DNA, 16 bp, Homo sapiens
aaggacagtccctgct

SEQ ID NO: 4539163 - DNA, 19 bp, Homo sapiens
aaggacagtccctgctggg

SEQ ID NO: 4539164 - DNA, 14 bp, Homo sapiens
aaggacatcagcaa

SEQ ID NO: 4539165 - DNA, 17 bp, Homo sapiens
aaggacatcagcaaaca

SEQ ID NO: 4539166 - DNA, 19 bp, Homo sapiens
aaggacatggtgagtctat

SEQ ID NO: 4539167 - DNA, 11 bp, Homo sapiens
aaggacccagg

SEQ ID NO: 4539168 - DNA, 17 bp, Homo sapiens
aaggacccaggcgctgc

SEQ ID NO: 4539169 - DNA, 15 bp, Homo sapiens
aaggacgcctgcagg

SEQ ID NO: 4539170 - DNA, 16 bp, Homo sapiens
aaggacggcaggagtg

SEQ ID NO: 4539171 - DNA, 12 bp, Homo sapiens
aaggacggctga

SEQ ID NO: 4539172 - DNA, 13 bp, Homo sapiens
aaggactgaggga

SEQ ID NO: 4539173 - DNA, 15 bp, Homo sapiens
aaggactgcatggta

SEQ ID NO: 4539174 - DNA, 14 bp, Homo sapiens
aaggagaaatctgg

SEQ ID NO: 4539175 - DNA, 13 bp, Homo sapiens
aaggagaacaaat

SEQ ID NO: 4539176 - DNA, 15 bp, Homo sapiens
aaggagaaccagcac

SEQ ID NO: 4539177 - DNA, 16 bp, Homo sapiens
aaggagaatatgataa

SEQ ID NO: 4539178 - DNA, 14 bp, Homo sapiens
aaggagacatatca

SEQ ID NO: 4539179 - DNA, 20 bp, Homo sapiens
aaggagacattgctctatgt

SEQ ID NO: 4539180 - DNA, 22 bp, Homo sapiens
aaggagactcacctctgcctca

SEQ ID NO: 4539181 - DNA, 17 bp, Homo sapiens
aaggagagcaagaagga

SEQ ID NO: 4539182 - DNA, 19 bp, Homo sapiens
aaggagccccattcctggg

SEQ ID NO: 4539183 - DNA, 11 bp, Homo sapiens
aaggaggaaaa

SEQ ID NO: 4539184 - DNA, 19 bp, Homo sapiens
aaggaggccataagctaca

SEQ ID NO: 4539185 - DNA, 18 bp, Homo sapiens
aaggaggccgccagactc

SEQ ID NO: 4539186 - DNA, 17 bp, Homo sapiens
aaggaggggaaaaaaat

SEQ ID NO: 4539187 - DNA, 20 bp, Homo sapiens
aaggaggggaaaaaaatgtt

SEQ ID NO: 4539188 - DNA, 18 bp, Homo sapiens
aaggaggggaaacaatga

SEQ ID NO: 4539189 - DNA, 20 bp, Homo sapiens
aaggaggggaaacaatgaaa

SEQ ID NO: 4539190 - DNA, 21 bp, Homo sapiens
aaggaggggaaacaatgaaaa

SEQ ID NO: 4539191 - DNA, 20 bp, Homo sapiens
aaggaggtgggccacaccca

SEQ ID NO: 4539192 - DNA, 16 bp, Homo sapiens
aaggagttggaagtga

SEQ ID NO: 4539193 - DNA, 19 bp, Homo sapiens
aaggagtttattacaatgt

SEQ ID NO: 4539194 - DNA, 22 bp, Homo sapiens
aaggataaatcataaagtcagt

SEQ ID NO: 4539195 - DNA, 17 bp, Homo sapiens
aaggatagtatttttat

SEQ ID NO: 4539196 - DNA, 17 bp, Homo sapiens
aaggatccggaaagaag

SEQ ID NO: 4539197 - DNA, 14 bp, Homo sapiens
aaggatgattttaa

SEQ ID NO: 4539198 - DNA, 17 bp, Homo sapiens
aaggatgtaaacagtgc

SEQ ID NO: 4539199 - DNA, 15 bp, Homo sapiens
aaggatgtgattgtg

SEQ ID NO: 4539200 - DNA, 14 bp, Homo sapiens
aaggattgaaaatt

SEQ ID NO: 4539201 - DNA, 19 bp, Homo sapiens
aaggattttaccaaagcat

SEQ ID NO: 4539202 - DNA, 12 bp, Homo sapiens
aaggattttctt

SEQ ID NO: 4539203 - DNA, 15 bp, Homo sapiens
aaggattttcttttt

SEQ ID NO: 4539204 - DNA, 21 bp, Homo sapiens
aaggattttctttttaacttt

SEQ ID NO: 4539205 - DNA, 18 bp, Homo sapiens
aaggatttttcaagagat

SEQ ID NO: 4539206 - DNA, 14 bp, Homo sapiens
aaggcaaaaatgta

SEQ ID NO: 4539207 - DNA, 15 bp, Homo sapiens
aaggcaaaaatgtat

SEQ ID NO: 4539208 - DNA, 16 bp, Homo sapiens
aaggcaaatattgaag

SEQ ID NO: 4539209 - DNA, 19 bp, Homo sapiens
aaggcaagagggggtggag

SEQ ID NO: 4539210 - DNA, 17 bp, Homo sapiens
aaggcaatattaaccta

SEQ ID NO: 4539211 - DNA, 20 bp, Homo sapiens
aaggcaattttagtgtatta

SEQ ID NO: 4539212 - DNA, 21 bp, Homo sapiens
aaggcaccttcttaaaagaaa

SEQ ID NO: 4539213 - DNA, 13 bp, Homo sapiens
aaggcagagaaat

SEQ ID NO: 4539214 - DNA, 13 bp, Homo sapiens
aaggcagctgcct

SEQ ID NO: 4539215 - DNA, 14 bp, Homo sapiens
aaggcagctgcctc

SEQ ID NO: 4539216 - DNA, 15 bp, Homo sapiens
aaggcagctgcctct

SEQ ID NO: 4539217 - DNA, 20 bp, Homo sapiens
aaggcagctgcctctgctcc

SEQ ID NO: 4539218 - DNA, 21 bp, Homo sapiens
aaggcagctgcctctgctccc

SEQ ID NO: 4539219 - DNA, 22 bp, Homo sapiens
aaggcagctgcctctgctccct

SEQ ID NO: 4539220 - DNA, 16 bp, Homo sapiens
aaggcaggaggatcac

SEQ ID NO: 4539221 - DNA, 15 bp, Homo sapiens
aaggcagttttctaa

SEQ ID NO: 4539222 - DNA, 20 bp, Homo sapiens
aaggcatgttttaaaatcta

SEQ ID NO: 4539223 - DNA, 21 bp, Homo sapiens
aaggcatgttttaaaatctat

SEQ ID NO: 4539224 - DNA, 17 bp, Homo sapiens
aaggcattcagcagttt

SEQ ID NO: 4539225 - DNA, 16 bp, Homo sapiens
aaggccaaaatcaaga

SEQ ID NO: 4539226 - DNA, 17 bp, Homo sapiens
aaggccaaaatcaagag

SEQ ID NO: 4539227 - DNA, 17 bp, Homo sapiens
aaggccataaaacaggt

SEQ ID NO: 4539228 - DNA, 15 bp, Homo sapiens
aaggcccactgtaat

SEQ ID NO: 4539229 - DNA, 18 bp, Homo sapiens
aaggcccagaagcctgat

SEQ ID NO: 4539230 - DNA, 15 bp, Homo sapiens
aaggccccagagaga

SEQ ID NO: 4539231 - DNA, 16 bp, Homo sapiens
aaggccccagagagac

SEQ ID NO: 4539232 - DNA, 14 bp, Homo sapiens
aaggcccctgcaat

SEQ ID NO: 4539233 - DNA, 16 bp, Homo sapiens
aaggcccctgcaatgt

SEQ ID NO: 4539234 - DNA, 12 bp, Homo sapiens
aaggcctcttgg

SEQ ID NO: 4539235 - DNA, 20 bp, Homo sapiens
aaggcctcttggagacctta

SEQ ID NO: 4539236 - DNA, 17 bp, Homo sapiens
aaggccttttatgtaat

SEQ ID NO: 4539237 - DNA, 20 bp, Homo sapiens
aaggcgtgagccactgcgcc

SEQ ID NO: 4539238 - DNA, 15 bp, Homo sapiens
aaggctaagaaaaag

SEQ ID NO: 4539239 - DNA, 18 bp, Homo sapiens
aaggctcagactgggcac

SEQ ID NO: 4539240 - DNA, 17 bp, Homo sapiens
aaggctctcccctctcg

SEQ ID NO: 4539241 - DNA, 12 bp, Homo sapiens
aaggctgagaag

SEQ ID NO: 4539242 - DNA, 14 bp, Homo sapiens
aaggctgagaagga

SEQ ID NO: 4539243 - DNA, 23 bp, Homo sapiens
aaggctgagacagtgaatttggg

SEQ ID NO: 4539244 - DNA, 17 bp, Homo sapiens
aaggctggaaggcagca

SEQ ID NO: 4539245 - DNA, 20 bp, Homo sapiens
aaggctgttaaatacaggaa

SEQ ID NO: 4539246 - DNA, 16 bp, Homo sapiens
aaggcttccaggctga

SEQ ID NO: 4539247 - DNA, 18 bp, Homo sapiens
aaggcttctctctgtggg

SEQ ID NO: 4539248 - DNA, 12 bp, Homo sapiens
aagggaaaaata

SEQ ID NO: 4539249 - DNA, 16 bp, Homo sapiens
aagggaaaagtctctt

SEQ ID NO: 4539250 - DNA, 14 bp, Homo sapiens
aagggaaactggct

SEQ ID NO: 4539251 - DNA, 17 bp, Homo sapiens
aagggaaactgggaaac

SEQ ID NO: 4539252 - DNA, 14 bp, Homo sapiens
aagggaattgctca

SEQ ID NO: 4539253 - DNA, 15 bp, Homo sapiens
aagggagaagaaagg

SEQ ID NO: 4539254 - DNA, 13 bp, Homo sapiens
aagggagggaagg

SEQ ID NO: 4539255 - DNA, 15 bp, Homo sapiens
aagggagtttaaaaa

SEQ ID NO: 4539256 - DNA, 15 bp, Homo sapiens
aagggcaaataatga

SEQ ID NO: 4539257 - DNA, 15 bp, Homo sapiens
aagggcacaagctca

SEQ ID NO: 4539258 - DNA, 15 bp, Homo sapiens
aagggcacacccctg

SEQ ID NO: 4539259 - DNA, 22 bp, Homo sapiens
aagggccagtcctgcctggcca

SEQ ID NO: 4539260 - DNA, 23 bp, Homo sapiens
aagggcctgcccagttgcactca

SEQ ID NO: 4539261 - DNA, 17 bp, Homo sapiens
aagggctagaacctgga

SEQ ID NO: 4539262 - DNA, 19 bp, Homo sapiens
aagggctagaacctggaga

SEQ ID NO: 4539263 - DNA, 22 bp, Homo sapiens
aagggctggctccccctcccca

SEQ ID NO: 4539264 - DNA, 13 bp, Homo sapiens
aagggctgggcca

SEQ ID NO: 4539265 - DNA, 20 bp, Homo sapiens
aagggcttgtttttcttcag

SEQ ID NO: 4539266 - DNA, 15 bp, Homo sapiens
aaggggagagcctgc

SEQ ID NO: 4539267 - DNA, 17 bp, Homo sapiens
aaggggccagaggctcg

SEQ ID NO: 4539268 - DNA, 20 bp, Homo sapiens
aaggggtcggctaagtggga

SEQ ID NO: 4539269 - DNA, 17 bp, Homo sapiens
aaggggtgcttttatag

SEQ ID NO: 4539270 - DNA, 14 bp, Homo sapiens
aaggggttcctcaa

SEQ ID NO: 4539271 - DNA, 21 bp, Homo sapiens
aagggtacagatccccagccc

SEQ ID NO: 4539272 - DNA, 23 bp, Homo sapiens
aagggtacagatccccagcccct

SEQ ID NO: 4539273 - DNA, 12 bp, Homo sapiens
aagggtcctctt

SEQ ID NO: 4539274 - DNA, 19 bp, Homo sapiens
aagggtgatgggaaagcat

SEQ ID NO: 4539275 - DNA, 18 bp, Homo sapiens
aagggtggatgtgctgga

SEQ ID NO: 4539276 - DNA, 21 bp, Homo sapiens
aagggtgggagtggggccttt

SEQ ID NO: 4539277 - DNA, 22 bp, Homo sapiens
aagggtggggatatcagggcac

SEQ ID NO: 4539278 - DNA, 22 bp, Homo sapiens
aagggttgagagccagtggcgg

SEQ ID NO: 4539279 - DNA, 19 bp, Homo sapiens
aagggttgcttgcttgccc

SEQ ID NO: 4539280 - DNA, 13 bp, Homo sapiens
aagggtttctcta

SEQ ID NO: 4539281 - DNA, 17 bp, Homo sapiens
aagggtttgtggctggg

SEQ ID NO: 4539282 - DNA, 20 bp, Homo sapiens
aaggtaacaagagtatgtgg

SEQ ID NO: 4539283 - DNA, 18 bp, Homo sapiens
aaggtacaactgtattta

SEQ ID NO: 4539284 - DNA, 18 bp, Homo sapiens
aaggtacaagaagcattt

SEQ ID NO: 4539285 - DNA, 15 bp, Homo sapiens
aaggtacatcattat

SEQ ID NO: 4539286 - DNA, 14 bp, Homo sapiens
aaggtagaatgttt

SEQ ID NO: 4539287 - DNA, 19 bp, Homo sapiens
aaggtagattttacagaga

SEQ ID NO: 4539288 - DNA, 13 bp, Homo sapiens
aaggtcatcatcg

SEQ ID NO: 4539289 - DNA, 19 bp, Homo sapiens
aaggtccgcaccctgtcct

SEQ ID NO: 4539290 - DNA, 23 bp, Homo sapiens
aaggtcctctcagttctctccct

SEQ ID NO: 4539291 - DNA, 23 bp, Homo sapiens
aaggtccttgcctgaactccaga

SEQ ID NO: 4539292 - DNA, 19 bp, Homo sapiens
aaggtctcctaaaactggg

SEQ ID NO: 4539293 - DNA, 12 bp, Homo sapiens
aaggtctttcag

SEQ ID NO: 4539294 - DNA, 20 bp, Homo sapiens
aaggtgaaaattgtataaat

SEQ ID NO: 4539295 - DNA, 19 bp, Homo sapiens
aaggtgacatcggaaaaat

SEQ ID NO: 4539296 - DNA, 14 bp, Homo sapiens
aaggtgatttcaga

SEQ ID NO: 4539297 - DNA, 14 bp, Homo sapiens
aaggtgccatggaa

SEQ ID NO: 4539298 - DNA, 13 bp, Homo sapiens
aaggtgctaacat

SEQ ID NO: 4539299 - DNA, 16 bp, Homo sapiens
aaggtggtgtgatctt

SEQ ID NO: 4539300 - DNA, 15 bp, Homo sapiens
aaggtgtgagactgg

SEQ ID NO: 4539301 - DNA, 21 bp, Homo sapiens
aaggtgtgctctgagccacag

SEQ ID NO: 4539302 - DNA, 18 bp, Homo sapiens
aaggtgtgtactcagggc

SEQ ID NO: 4539303 - DNA, 16 bp, Homo sapiens
aaggttaagccctgag

SEQ ID NO: 4539304 - DNA, 19 bp, Homo sapiens
aaggttactcagcagcaga

SEQ ID NO: 4539305 - DNA, 18 bp, Homo sapiens
aaggttagagaataaatt

SEQ ID NO: 4539306 - DNA, 15 bp, Homo sapiens
aaggttataattttt

SEQ ID NO: 4539307 - DNA, 16 bp, Homo sapiens
aaggtttctggagcag

SEQ ID NO: 4539308 - DNA, 20 bp, Homo sapiens
aaggtttctggagcagtgga

SEQ ID NO: 4539309 - DNA, 23 bp, Homo sapiens
aaggttttggttatggagtcttg

SEQ ID NO: 4539310 - DNA, 14 bp, Homo sapiens
aagtaaaaccacag

SEQ ID NO: 4539311 - DNA, 21 bp, Homo sapiens
aagtaaaagcaaaaaagaaaa

SEQ ID NO: 4539312 - DNA, 21 bp, Homo sapiens
aagtaaagccattaaatgaat

SEQ ID NO: 4539313 - DNA, 22 bp, Homo sapiens
aagtaaccaggccccagcctcc

SEQ ID NO: 4539314 - DNA, 20 bp, Homo sapiens
aagtaagagtggtggcctat

SEQ ID NO: 4539315 - DNA, 16 bp, Homo sapiens
aagtaatacaaactaa

SEQ ID NO: 4539316 - DNA, 23 bp, Homo sapiens
aagtaatcatgttttaatgtaga

SEQ ID NO: 4539317 - DNA, 17 bp, Homo sapiens
aagtaatgaagaatcac

SEQ ID NO: 4539318 - DNA, 19 bp, Homo sapiens
aagtaatgacttagaaact

SEQ ID NO: 4539319 - DNA, 13 bp, Homo sapiens
aagtacaaacatg

SEQ ID NO: 4539320 - DNA, 16 bp, Homo sapiens
aagtacaaacatgaaa

SEQ ID NO: 4539321 - DNA, 17 bp, Homo sapiens
aagtacaaacatgaaaa

SEQ ID NO: 4539322 - DNA, 19 bp, Homo sapiens
aagtacaatgtgtttttct

SEQ ID NO: 4539323 - DNA, 15 bp, Homo sapiens
aagtacactctgctg

SEQ ID NO: 4539324 - DNA, 14 bp, Homo sapiens
aagtacagaatttg

SEQ ID NO: 4539325 - DNA, 16 bp, Homo sapiens
aagtacagaatttgaa

SEQ ID NO: 4539326 - DNA, 13 bp, Homo sapiens
aagtacattgctt

SEQ ID NO: 4539327 - DNA, 21 bp, Homo sapiens
aagtacgaatcttatttttcc

SEQ ID NO: 4539328 - DNA, 17 bp, Homo sapiens
aagtactgctgtaaata

SEQ ID NO: 4539329 - DNA, 17 bp, Homo sapiens
aagtactgtaagaataa

SEQ ID NO: 4539330 - DNA, 19 bp, Homo sapiens
aagtactgtaagaataatt

SEQ ID NO: 4539331 - DNA, 14 bp, Homo sapiens
aagtactgtttacc

SEQ ID NO: 4539332 - DNA, 17 bp, Homo sapiens
aagtacttacattccag

SEQ ID NO: 4539333 - DNA, 18 bp, Homo sapiens
aagtagaaacaaaataca

SEQ ID NO: 4539334 - DNA, 17 bp, Homo sapiens
aagtagacaatcattgt

SEQ ID NO: 4539335 - DNA, 12 bp, Homo sapiens
aagtagaggagg

SEQ ID NO: 4539336 - DNA, 19 bp, Homo sapiens
aagtagcaaatgtttactg

SEQ ID NO: 4539337 - DNA, 16 bp, Homo sapiens
aagtagctagtagcaa

SEQ ID NO: 4539338 - DNA, 19 bp, Homo sapiens
aagtagctgggattacagg

SEQ ID NO: 4539339 - DNA, 13 bp, Homo sapiens
aagtaggaagtaa

SEQ ID NO: 4539340 - DNA, 18 bp, Homo sapiens
aagtagtcatcaatgcaa

SEQ ID NO: 4539341 - DNA, 19 bp, Homo sapiens
aagtagtgggcatttcata

SEQ ID NO: 4539342 - DNA, 22 bp, Homo sapiens
aagtagtgtctggatcagtaaa

SEQ ID NO: 4539343 - DNA, 13 bp, Homo sapiens
aagtagttatttt

SEQ ID NO: 4539344 - DNA, 15 bp, Homo sapiens
aagtataaactttta

SEQ ID NO: 4539345 - DNA, 13 bp, Homo sapiens
aagtataatgttt

SEQ ID NO: 4539346 - DNA, 20 bp, Homo sapiens
aagtataatgtttattaaat

SEQ ID NO: 4539347 - DNA, 22 bp, Homo sapiens
aagtataatgtttattaaatgc

SEQ ID NO: 4539348 - DNA, 22 bp, Homo sapiens
aagtatccacagaaaatgtaaa

SEQ ID NO: 4539349 - DNA, 16 bp, Homo sapiens
aagtatcctgcgacct

SEQ ID NO: 4539350 - DNA, 18 bp, Homo sapiens
aagtatgcattattaaat

SEQ ID NO: 4539351 - DNA, 21 bp, Homo sapiens
aagtatgcattattaaattgt

SEQ ID NO: 4539352 - DNA, 13 bp, Homo sapiens
aagtatgtgaaaa

SEQ ID NO: 4539353 - DNA, 23 bp, Homo sapiens
aagtattacaaccatatattgag

SEQ ID NO: 4539354 - DNA, 18 bp, Homo sapiens
aagtattccaccttaaat

SEQ ID NO: 4539355 - DNA, 14 bp, Homo sapiens
aagtattgtaaatt

SEQ ID NO: 4539356 - DNA, 17 bp, Homo sapiens
aagtattgtaaattata

SEQ ID NO: 4539357 - DNA, 22 bp, Homo sapiens
aagtattgtaaattatatttgt

SEQ ID NO: 4539358 - DNA, 20 bp, Homo sapiens
aagtatttacagggtggccc

SEQ ID NO: 4539359 - DNA, 23 bp, Homo sapiens
aagtatttactttttaaaaataa

SEQ ID NO: 4539360 - DNA, 15 bp, Homo sapiens
aagtatttataaaaa

SEQ ID NO: 4539361 - DNA, 13 bp, Homo sapiens
aagtatttcaaat

SEQ ID NO: 4539362 - DNA, 17 bp, Homo sapiens
aagtatttgatgtacat

SEQ ID NO: 4539363 - DNA, 20 bp, Homo sapiens
aagtatttgatgtacattac

SEQ ID NO: 4539364 - DNA, 20 bp, Homo sapiens
aagtatttgttaatttagaa

SEQ ID NO: 4539365 - DNA, 20 bp, Homo sapiens
aagtattttaattttaaaga

SEQ ID NO: 4539366 - DNA, 17 bp, Homo sapiens
aagtattttcataagta

SEQ ID NO: 4539367 - DNA, 16 bp, Homo sapiens
aagtcaaccaatgtag

SEQ ID NO: 4539368 - DNA, 17 bp, Homo sapiens
aagtcacccctttctgt

SEQ ID NO: 4539369 - DNA, 21 bp, Homo sapiens
aagtcactggccagtggctgg

SEQ ID NO: 4539370 - DNA, 18 bp, Homo sapiens
aagtcagaatcagaagat

SEQ ID NO: 4539371 - DNA, 13 bp, Homo sapiens
aagtcagatgttt

SEQ ID NO: 4539372 - DNA, 20 bp, Homo sapiens
aagtcagatttttatttatg

SEQ ID NO: 4539373 - DNA, 17 bp, Homo sapiens
aagtcagtacgatcaag

SEQ ID NO: 4539374 - DNA, 22 bp, Homo sapiens
aagtcagttgctcaaaaagaaa

SEQ ID NO: 4539375 - DNA, 20 bp, Homo sapiens
aagtcatttttgtatttttc

SEQ ID NO: 4539376 - DNA, 15 bp, Homo sapiens
aagtcattttttact

SEQ ID NO: 4539377 - DNA, 19 bp, Homo sapiens
aagtccaattttaatttag

SEQ ID NO: 4539378 - DNA, 20 bp, Homo sapiens
aagtccagaagcctcctgtt

SEQ ID NO: 4539379 - DNA, 21 bp, Homo sapiens
aagtccagctgggaagccctt

SEQ ID NO: 4539380 - DNA, 23 bp, Homo sapiens
aagtcccaccctcttcccatgtc

SEQ ID NO: 4539381 - DNA, 15 bp, Homo sapiens
aagtcccatcataga

SEQ ID NO: 4539382 - DNA, 19 bp, Homo sapiens
aagtccccctcctcagcca

SEQ ID NO: 4539383 - DNA, 11 bp, Homo sapiens
aagtccctccc

SEQ ID NO: 4539384 - DNA, 18 bp, Homo sapiens
aagtccctccctgcctga

SEQ ID NO: 4539385 - DNA, 18 bp, Homo sapiens
aagtccgcagaagccctg

SEQ ID NO: 4539386 - DNA, 19 bp, Homo sapiens
aagtccgcagaagccctga

SEQ ID NO: 4539387 - DNA, 18 bp, Homo sapiens
aagtccggccccagtaca

SEQ ID NO: 4539388 - DNA, 16 bp, Homo sapiens
aagtcctaacttcctg

SEQ ID NO: 4539389 - DNA, 23 bp, Homo sapiens
aagtcctccctgacttttctgtg

SEQ ID NO: 4539390 - DNA, 13 bp, Homo sapiens
aagtcctgctttc

SEQ ID NO: 4539391 - DNA, 22 bp, Homo sapiens
aagtccttcagtgagcccctcc

SEQ ID NO: 4539392 - DNA, 15 bp, Homo sapiens
aagtcgttttccaaa

SEQ ID NO: 4539393 - DNA, 19 bp, Homo sapiens
aagtcgttttccaaactga

SEQ ID NO: 4539394 - DNA, 13 bp, Homo sapiens
aagtctagaatca

SEQ ID NO: 4539395 - DNA, 21 bp, Homo sapiens
aagtctcactggctgtcagta

SEQ ID NO: 4539396 - DNA, 13 bp, Homo sapiens
aagtctcagaaga

SEQ ID NO: 4539397 - DNA, 21 bp, Homo sapiens
aagtctcataggttaaaaaaa

SEQ ID NO: 4539398 - DNA, 14 bp, Homo sapiens
aagtctctatttaa

SEQ ID NO: 4539399 - DNA, 14 bp, Homo sapiens
aagtctctgctgct

SEQ ID NO: 4539400 - DNA, 17 bp, Homo sapiens
aagtgaacccatatttt

SEQ ID NO: 4539401 - DNA, 20 bp, Homo sapiens
aagtgaacccatattttaaa

SEQ ID NO: 4539402 - DNA, 13 bp, Homo sapiens
aagtgaagactgg

SEQ ID NO: 4539403 - DNA, 13 bp, Homo sapiens
aagtgaagagtca

SEQ ID NO: 4539404 - DNA, 14 bp, Homo sapiens
aagtgaattgaagt

SEQ ID NO: 4539405 - DNA, 14 bp, Homo sapiens
aagtgagaactcca

SEQ ID NO: 4539406 - DNA, 15 bp, Homo sapiens
aagtgagagaaatga

SEQ ID NO: 4539407 - DNA, 18 bp, Homo sapiens
aagtgatgtattttcata

SEQ ID NO: 4539408 - DNA, 20 bp, Homo sapiens
aagtgatgtattttcatagt

SEQ ID NO: 4539409 - DNA, 13 bp, Homo sapiens
aagtgatgtcatt

SEQ ID NO: 4539410 - DNA, 16 bp, Homo sapiens
aagtgatgtcatttga

SEQ ID NO: 4539411 - DNA, 13 bp, Homo sapiens
aagtgattgtgaa

SEQ ID NO: 4539412 - DNA, 17 bp, Homo sapiens
aagtgccttctgggctt

SEQ ID NO: 4539413 - DNA, 16 bp, Homo sapiens
aagtgctgaatttaca

SEQ ID NO: 4539414 - DNA, 14 bp, Homo sapiens
aagtgctgcacaaa

SEQ ID NO: 4539415 - DNA, 19 bp, Homo sapiens
aagtgctgggattacaggt

SEQ ID NO: 4539416 - DNA, 22 bp, Homo sapiens
aagtgctgtttattaatcttag

SEQ ID NO: 4539417 - DNA, 16 bp, Homo sapiens
aagtgcttaaaaatac

SEQ ID NO: 4539418 - DNA, 14 bp, Homo sapiens
aagtgcttcctaca

SEQ ID NO: 4539419 - DNA, 13 bp, Homo sapiens
aagtggaaatgtt

SEQ ID NO: 4539420 - DNA, 20 bp, Homo sapiens
aagtggaccaggacaggacc

SEQ ID NO: 4539421 - DNA, 18 bp, Homo sapiens
aagtggactggcccctgg

SEQ ID NO: 4539422 - DNA, 19 bp, Homo sapiens
aagtggccaagaagcagtg

SEQ ID NO: 4539423 - DNA, 16 bp, Homo sapiens
aagtggccactggcat

SEQ ID NO: 4539424 - DNA, 13 bp, Homo sapiens
aagtggctgcctt

SEQ ID NO: 4539425 - DNA, 13 bp, Homo sapiens
aagtggctgtccc

SEQ ID NO: 4539426 - DNA, 17 bp, Homo sapiens
aagtggggagagagccc

SEQ ID NO: 4539427 - DNA, 13 bp, Homo sapiens
aagtggggcagag

SEQ ID NO: 4539428 - DNA, 15 bp, Homo sapiens
aagtggtaaatactg

SEQ ID NO: 4539429 - DNA, 19 bp, Homo sapiens
aagtggtaaatactgtgaa

SEQ ID NO: 4539430 - DNA, 18 bp, Homo sapiens
aagtggttctctgccttt

SEQ ID NO: 4539431 - DNA, 22 bp, Homo sapiens
aagtgtaaaatattttgaatca

SEQ ID NO: 4539432 - DNA, 13 bp, Homo sapiens
aagtgtaaatgaa

SEQ ID NO: 4539433 - DNA, 14 bp, Homo sapiens
aagtgtaaatgaag

SEQ ID NO: 4539434 - DNA, 15 bp, Homo sapiens
aagtgtatttggaaa

SEQ ID NO: 4539435 - DNA, 16 bp, Homo sapiens
aagtgtgctgggcaga

SEQ ID NO: 4539436 - DNA, 17 bp, Homo sapiens
aagtgtgctgggcagag

SEQ ID NO: 4539437 - DNA, 17 bp, Homo sapiens
aagtgtggctggtgtcc

SEQ ID NO: 4539438 - DNA, 19 bp, Homo sapiens
aagtgtggctggtgtcccc

SEQ ID NO: 4539439 - DNA, 20 bp, Homo sapiens
aagtgtggctggtgtcccct

SEQ ID NO: 4539440 - DNA, 23 bp, Homo sapiens
aagtgtggctggtgtccccttcc

SEQ ID NO: 4539441 - DNA, 17 bp, Homo sapiens
aagtgtgggtctgtgtg

SEQ ID NO: 4539442 - DNA, 18 bp, Homo sapiens
aagtgttaatacatcaca

SEQ ID NO: 4539443 - DNA, 11 bp, Homo sapiens
aagtgttcatt

SEQ ID NO: 4539444 - DNA, 20 bp, Homo sapiens
aagtgttggaaaaaatttgt

SEQ ID NO: 4539445 - DNA, 17 bp, Homo sapiens
aagtgtttatgtaatag

SEQ ID NO: 4539446 - DNA, 14 bp, Homo sapiens
aagtgttttcagag

SEQ ID NO: 4539447 - DNA, 18 bp, Homo sapiens
aagtgttttgtaccagtg

SEQ ID NO: 4539448 - DNA, 13 bp, Homo sapiens
aagtgttttgtat

SEQ ID NO: 4539449 - DNA, 17 bp, Homo sapiens
aagttaaaaaacagctg

SEQ ID NO: 4539450 - DNA, 19 bp, Homo sapiens
aagttaaaaaacagctgca

SEQ ID NO: 4539451 - DNA, 19 bp, Homo sapiens
aagttaatccactgtgact

SEQ ID NO: 4539452 - DNA, 16 bp, Homo sapiens
aagttagtatcttttg

SEQ ID NO: 4539453 - DNA, 20 bp, Homo sapiens
aagttagtatcttttgatat

SEQ ID NO: 4539454 - DNA, 22 bp, Homo sapiens
aagttagtggaaatctgaacat

SEQ ID NO: 4539455 - DNA, 17 bp, Homo sapiens
aagttagtttgtatata

SEQ ID NO: 4539456 - DNA, 22 bp, Homo sapiens
aagttagtttgtatatattatt

SEQ ID NO: 4539457 - DNA, 23 bp, Homo sapiens
aagttagtttgtatatattatta

SEQ ID NO: 4539458 - DNA, 23 bp, Homo sapiens
aagttatatttcagatgtaatgt

SEQ ID NO: 4539459 - DNA, 18 bp, Homo sapiens
aagttatggcagtgatgc

SEQ ID NO: 4539460 - DNA, 15 bp, Homo sapiens
aagttatgtatttaa

SEQ ID NO: 4539461 - DNA, 17 bp, Homo sapiens
aagttattagtggttta

SEQ ID NO: 4539462 - DNA, 21 bp, Homo sapiens
aagttattcttgtcattttga

SEQ ID NO: 4539463 - DNA, 18 bp, Homo sapiens
aagttattttctacagtg

SEQ ID NO: 4539464 - DNA, 21 bp, Homo sapiens
aagttattttctacagtggtt

SEQ ID NO: 4539465 - DNA, 23 bp, Homo sapiens
aagttcaaattcttctgaactca

SEQ ID NO: 4539466 - DNA, 23 bp, Homo sapiens
aagttcatgttggccatggtgaa

SEQ ID NO: 4539467 - DNA, 21 bp, Homo sapiens
aagttccacttccaggtctgc

SEQ ID NO: 4539468 - DNA, 12 bp, Homo sapiens
aagttctgtgta

SEQ ID NO: 4539469 - DNA, 16 bp, Homo sapiens
aagttctgtgtattta

SEQ ID NO: 4539470 - DNA, 9 bp, Homo sapiens
aagttctta

SEQ ID NO: 4539471 - DNA, 17 bp, Homo sapiens
aagttcttaaaaaattt

SEQ ID NO: 4539472 - DNA, 15 bp, Homo sapiens
aagttcttagttgct

SEQ ID NO: 4539473 - DNA, 19 bp, Homo sapiens
aagttcttatgaggagggg

SEQ ID NO: 4539474 - DNA, 19 bp, Homo sapiens
aagttcttggattacttta

SEQ ID NO: 4539475 - DNA, 20 bp, Homo sapiens
aagttgaaccattatacttt

SEQ ID NO: 4539476 - DNA, 15 bp, Homo sapiens
aagttgacatttaac

SEQ ID NO: 4539477 - DNA, 19 bp, Homo sapiens
aagttgagaaaaatttata

SEQ ID NO: 4539478 - DNA, 23 bp, Homo sapiens
aagttgagcgtgcgcactgcatg

SEQ ID NO: 4539479 - DNA, 18 bp, Homo sapiens
aagttgattaagaaagga

SEQ ID NO: 4539480 - DNA, 20 bp, Homo sapiens
aagttgattaagaaaggaag

SEQ ID NO: 4539481 - DNA, 19 bp, Homo sapiens
aagttgcaaagtggaatta

SEQ ID NO: 4539482 - DNA, 19 bp, Homo sapiens
aagttgctgtaaaatttgt

SEQ ID NO: 4539483 - DNA, 23 bp, Homo sapiens
aagttgctgtaaaatttgtgtaa

SEQ ID NO: 4539484 - DNA, 17 bp, Homo sapiens
aagttggcttctgtttc

SEQ ID NO: 4539485 - DNA, 19 bp, Homo sapiens
aagttggtattaataaaaa

SEQ ID NO: 4539486 - DNA, 17 bp, Homo sapiens
aagttgtacatgataag

SEQ ID NO: 4539487 - DNA, 14 bp, Homo sapiens
aagttgttgactgt

SEQ ID NO: 4539488 - DNA, 15 bp, Homo sapiens
aagtttaaatgtatt

SEQ ID NO: 4539489 - DNA, 17 bp, Homo sapiens
aagtttaaatgtatttt

SEQ ID NO: 4539490 - DNA, 14 bp, Homo sapiens
aagtttaattgact

SEQ ID NO: 4539491 - DNA, 19 bp, Homo sapiens
aagtttacaatcaaaggaa

SEQ ID NO: 4539492 - DNA, 13 bp, Homo sapiens
aagtttatatgcc

SEQ ID NO: 4539493 - DNA, 21 bp, Homo sapiens
aagtttattgtttgatgtttt

SEQ ID NO: 4539494 - DNA, 13 bp, Homo sapiens
aagtttatttcct

SEQ ID NO: 4539495 - DNA, 18 bp, Homo sapiens
aagtttcagagtatattg

SEQ ID NO: 4539496 - DNA, 12 bp, Homo sapiens
aagtttctattc

SEQ ID NO: 4539497 - DNA, 18 bp, Homo sapiens
aagtttgaaaagcaatat

SEQ ID NO: 4539498 - DNA, 23 bp, Homo sapiens
aagtttgattaaaattcaggaag

SEQ ID NO: 4539499 - DNA, 16 bp, Homo sapiens
aagtttgtttttgcgt

SEQ ID NO: 4539500 - DNA, 13 bp, Homo sapiens
aagttttaaagtt

SEQ ID NO: 4539501 - DNA, 21 bp, Homo sapiens
aagttttaactttaatacagc

SEQ ID NO: 4539502 - DNA, 11 bp, Homo sapiens
aagttttgcac

SEQ ID NO: 4539503 - DNA, 14 bp, Homo sapiens
aagtttttaaaaat

SEQ ID NO: 4539504 - DNA, 18 bp, Homo sapiens
aagtttttaaaaataaag

SEQ ID NO: 4539505 - DNA, 11 bp, Homo sapiens
aagtttttaat

SEQ ID NO: 4539506 - DNA, 15 bp, Homo sapiens
aagtttttagaatgt

SEQ ID NO: 4539507 - DNA, 20 bp, Homo sapiens
aagtttttatagttattaaa

SEQ ID NO: 4539508 - DNA, 16 bp, Homo sapiens
aagtttttcatactgt

SEQ ID NO: 4539509 - DNA, 19 bp, Homo sapiens
aagtttttcatactgtaca

SEQ ID NO: 4539510 - DNA, 21 bp, Homo sapiens
aagtttttcatactgtacaca

SEQ ID NO: 4539511 - DNA, 21 bp, Homo sapiens
aataaaaaatctgaagaggct

SEQ ID NO: 4539512 - DNA, 15 bp, Homo sapiens
aataaaaagaaaggc

SEQ ID NO: 4539513 - DNA, 14 bp, Homo sapiens
aataaaaagacaac

SEQ ID NO: 4539514 - DNA, 15 bp, Homo sapiens
aataaaaatgtttaa

SEQ ID NO: 4539515 - DNA, 16 bp, Homo sapiens
aataaaaattctagat

SEQ ID NO: 4539516 - DNA, 11 bp, Homo sapiens
aataaaacatc

SEQ ID NO: 4539517 - DNA, 13 bp, Homo sapiens
aataaaacatcac

SEQ ID NO: 4539518 - DNA, 11 bp, Homo sapiens
aataaaagcac

SEQ ID NO: 4539519 - DNA, 16 bp, Homo sapiens
aataaaataagttctt

SEQ ID NO: 4539520 - DNA, 19 bp, Homo sapiens
aataaaattatttgcaggt

SEQ ID NO: 4539521 - DNA, 16 bp, Homo sapiens
aataaaattcatttct

SEQ ID NO: 4539522 - DNA, 13 bp, Homo sapiens
aataaaatttgtt

SEQ ID NO: 4539523 - DNA, 10 bp, Homo sapiens
aataaacact

SEQ ID NO: 4539524 - DNA, 19 bp, Homo sapiens
aataaacagacaaaaacaa

SEQ ID NO: 4539525 - DNA, 23 bp, Homo sapiens
aataaacatgtcacaatacagta

SEQ ID NO: 4539526 - DNA, 12 bp, Homo sapiens
aataaaccagtg

SEQ ID NO: 4539527 - DNA, 13 bp, Homo sapiens
aataaaccagtgt

SEQ ID NO: 4539528 - DNA, 15 bp, Homo sapiens
aataaaccagtgtga

SEQ ID NO: 4539529 - DNA, 17 bp, Homo sapiens
aataaaccagtgtgaac

SEQ ID NO: 4539530 - DNA, 18 bp, Homo sapiens
aataaaccagtgtgaacc

SEQ ID NO: 4539531 - DNA, 16 bp, Homo sapiens
aataaacctgttcttc

SEQ ID NO: 4539532 - DNA, 17 bp, Homo sapiens
aataaagaatgccattt

SEQ ID NO: 4539533 - DNA, 12 bp, Homo sapiens
aataaagaattc

SEQ ID NO: 4539534 - DNA, 15 bp, Homo sapiens
aataaagactagagc

SEQ ID NO: 4539535 - DNA, 11 bp, Homo sapiens
aataaagatgg

SEQ ID NO: 4539536 - DNA, 11 bp, Homo sapiens
aataaagcaat

SEQ ID NO: 4539537 - DNA, 11 bp, Homo sapiens
aataaaggaaa

SEQ ID NO: 4539538 - DNA, 13 bp, Homo sapiens
aataaaggcagct

SEQ ID NO: 4539539 - DNA, 16 bp, Homo sapiens
aataaaggcagctgcc

SEQ ID NO: 4539540 - DNA, 17 bp, Homo sapiens
aataaaggcagctgcct

SEQ ID NO: 4539541 - DNA, 18 bp, Homo sapiens
aataaaggcagctgcctc

SEQ ID NO: 4539542 - DNA, 16 bp, Homo sapiens
aataaaggcagttttc

SEQ ID NO: 4539543 - DNA, 18 bp, Homo sapiens
aataaaggcagttttcta

SEQ ID NO: 4539544 - DNA, 20 bp, Homo sapiens
aataaagtattccaccttaa

SEQ ID NO: 4539545 - DNA, 13 bp, Homo sapiens
aataaagtgtttt

SEQ ID NO: 4539546 - DNA, 19 bp, Homo sapiens
aataaagtgttttcagagc

SEQ ID NO: 4539547 - DNA, 15 bp, Homo sapiens
aataaagttgaatat

SEQ ID NO: 4539548 - DNA, 17 bp, Homo sapiens
aataaagttgaatatta

SEQ ID NO: 4539549 - DNA, 21 bp, Homo sapiens
aataaagttgaatattatata

SEQ ID NO: 4539550 - DNA, 23 bp, Homo sapiens
aataaatatatctaccccagact

SEQ ID NO: 4539551 - DNA, 16 bp, Homo sapiens
aataaatatgaaagta

SEQ ID NO: 4539552 - DNA, 19 bp, Homo sapiens
aataaatctcttctttgct

SEQ ID NO: 4539553 - DNA, 20 bp, Homo sapiens
aataaatcttagtgttcaaa

SEQ ID NO: 4539554 - DNA, 14 bp, Homo sapiens
aataaatcttccta

SEQ ID NO: 4539555 - DNA, 16 bp, Homo sapiens
aataaatgattatatt

SEQ ID NO: 4539556 - DNA, 21 bp, Homo sapiens
aataaatgattatattcacag

SEQ ID NO: 4539557 - DNA, 12 bp, Homo sapiens
aataaatgtgcc

SEQ ID NO: 4539558 - DNA, 20 bp, Homo sapiens
aataaattctacctccttgt

SEQ ID NO: 4539559 - DNA, 20 bp, Homo sapiens
aataaattgctaatgttgct

SEQ ID NO: 4539560 - DNA, 20 bp, Homo sapiens
aataaatttattttcttgga

SEQ ID NO: 4539561 - DNA, 15 bp, Homo sapiens
aataaatttcccagt

SEQ ID NO: 4539562 - DNA, 21 bp, Homo sapiens
aataaatttcccagttaaaga

SEQ ID NO: 4539563 - DNA, 20 bp, Homo sapiens
aataaatttgacttttctgt

SEQ ID NO: 4539564 - DNA, 14 bp, Homo sapiens
aataaattttctaa

SEQ ID NO: 4539565 - DNA, 16 bp, Homo sapiens
aataaattttctaaaa

SEQ ID NO: 4539566 - DNA, 17 bp, Homo sapiens
aataacactgtatttta

SEQ ID NO: 4539567 - DNA, 22 bp, Homo sapiens
aataacagatggtgctgctaat

SEQ ID NO: 4539568 - DNA, 11 bp, Homo sapiens
aataacattta

SEQ ID NO: 4539569 - DNA, 20 bp, Homo sapiens
aataacatttaaattccaca

SEQ ID NO: 4539570 - DNA, 22 bp, Homo sapiens
aataaccccattctttgcttga

SEQ ID NO: 4539571 - DNA, 18 bp, Homo sapiens
aataaccctttggttttt

SEQ ID NO: 4539572 - DNA, 22 bp, Homo sapiens
aataacgtttaagccaaaacaa

SEQ ID NO: 4539573 - DNA, 15 bp, Homo sapiens
aataactaaaatgta

SEQ ID NO: 4539574 - DNA, 16 bp, Homo sapiens
aataactgaaaatgaa

SEQ ID NO: 4539575 - DNA, 13 bp, Homo sapiens
aataactgaattt

SEQ ID NO: 4539576 - DNA, 20 bp, Homo sapiens
aataactggaacaaattatt

SEQ ID NO: 4539577 - DNA, 13 bp, Homo sapiens
aataagaatagaa

SEQ ID NO: 4539578 - DNA, 13 bp, Homo sapiens
aataagacaagag

SEQ ID NO: 4539579 - DNA, 21 bp, Homo sapiens
aataagacaagagatctacac

SEQ ID NO: 4539580 - DNA, 15 bp, Homo sapiens
aataagattaataag

SEQ ID NO: 4539581 - DNA, 14 bp, Homo sapiens
aataagcagaacat

SEQ ID NO: 4539582 - DNA, 15 bp, Homo sapiens
aataaggaaaagctt

SEQ ID NO: 4539583 - DNA, 23 bp, Homo sapiens
aataaggattctgaagttttatt

SEQ ID NO: 4539584 - DNA, 16 bp, Homo sapiens
aataaggcacccatct

SEQ ID NO: 4539585 - DNA, 16 bp, Homo sapiens
aataaggcccagagcg

SEQ ID NO: 4539586 - DNA, 15 bp, Homo sapiens
aataagggaataaaa

SEQ ID NO: 4539587 - DNA, 15 bp, Homo sapiens
aataaggtacaagaa

SEQ ID NO: 4539588 - DNA, 15 bp, Homo sapiens
aataagtcattgaaa

SEQ ID NO: 4539589 - DNA, 20 bp, Homo sapiens
aataagtgacaaataagatt

SEQ ID NO: 4539590 - DNA, 11 bp, Homo sapiens
aataagttatt

SEQ ID NO: 4539591 - DNA, 22 bp, Homo sapiens
aataagttcaaattcttctgaa

SEQ ID NO: 4539592 - DNA, 22 bp, Homo sapiens
aataagtttcttttaatccaat

SEQ ID NO: 4539593 - DNA, 19 bp, Homo sapiens
aataataagtgatgtgctg

SEQ ID NO: 4539594 - DNA, 16 bp, Homo sapiens
aataatagcaatgtaa

SEQ ID NO: 4539595 - DNA, 21 bp, Homo sapiens
aataatagcaatgtaaaaatg

SEQ ID NO: 4539596 - DNA, 13 bp, Homo sapiens
aataatagtacta

SEQ ID NO: 4539597 - DNA, 17 bp, Homo sapiens
aataatatattttctgt

SEQ ID NO: 4539598 - DNA, 19 bp, Homo sapiens
aataatatattttctgttt

SEQ ID NO: 4539599 - DNA, 17 bp, Homo sapiens
aataatattgtttttct

SEQ ID NO: 4539600 - DNA, 14 bp, Homo sapiens
aataatatttatgt

SEQ ID NO: 4539601 - DNA, 15 bp, Homo sapiens
aataatatttcaagt

SEQ ID NO: 4539602 - DNA, 16 bp, Homo sapiens
aataatcggcccacag

SEQ ID NO: 4539603 - DNA, 16 bp, Homo sapiens
aataatgagctattaa

SEQ ID NO: 4539604 - DNA, 21 bp, Homo sapiens
aataatgagctattaaaactc

SEQ ID NO: 4539605 - DNA, 22 bp, Homo sapiens
aataatgagctattaaaactca

SEQ ID NO: 4539606 - DNA, 19 bp, Homo sapiens
aataatgcaacgcaggagg

SEQ ID NO: 4539607 - DNA, 22 bp, Homo sapiens
aataatgcagtatggtacattt

SEQ ID NO: 4539608 - DNA, 15 bp, Homo sapiens
aataatgcttttcta

SEQ ID NO: 4539609 - DNA, 13 bp, Homo sapiens
aataatgtacaga

SEQ ID NO: 4539610 - DNA, 15 bp, Homo sapiens
aataattcatatcta

SEQ ID NO: 4539611 - DNA, 17 bp, Homo sapiens
aataattctgagttttg

SEQ ID NO: 4539612 - DNA, 21 bp, Homo sapiens
aataattctgagttttgtgtt

SEQ ID NO: 4539613 - DNA, 17 bp, Homo sapiens
aataattgaagtgttcc

SEQ ID NO: 4539614 - DNA, 18 bp, Homo sapiens
aataatttaactaccctt

SEQ ID NO: 4539615 - DNA, 12 bp, Homo sapiens
aataatttagac

SEQ ID NO: 4539616 - DNA, 16 bp, Homo sapiens
aataatttatagtaat

SEQ ID NO: 4539617 - DNA, 19 bp, Homo sapiens
aataatttttgctgaattc

SEQ ID NO: 4539618 - DNA, 21 bp, Homo sapiens
aataatttttgctgaattcct

SEQ ID NO: 4539619 - DNA, 19 bp, Homo sapiens
aatacaaaaagcaaaacaa

SEQ ID NO: 4539620 - DNA, 20 bp, Homo sapiens
aatacaaaaattagccgggc

SEQ ID NO: 4539621 - DNA, 17 bp, Homo sapiens
aatacaacaacaacaaa

SEQ ID NO: 4539622 - DNA, 13 bp, Homo sapiens
aatacaatgtaca

SEQ ID NO: 4539623 - DNA, 16 bp, Homo sapiens
aatacaatgtacaatt

SEQ ID NO: 4539624 - DNA, 14 bp, Homo sapiens
aatacacactcaaa

SEQ ID NO: 4539625 - DNA, 23 bp, Homo sapiens
aatacacatagcatgtaatggta

SEQ ID NO: 4539626 - DNA, 13 bp, Homo sapiens
aatacagacaaag

SEQ ID NO: 4539627 - DNA, 18 bp, Homo sapiens
aatacagcaacaatttat

SEQ ID NO: 4539628 - DNA, 20 bp, Homo sapiens
aatacagctgaagtcaaaat

SEQ ID NO: 4539629 - DNA, 12 bp, Homo sapiens
aatacagggagg

SEQ ID NO: 4539630 - DNA, 15 bp, Homo sapiens
aatacagtaagtaaa

SEQ ID NO: 4539631 - DNA, 21 bp, Homo sapiens
aatacagtcttccacaaagaa

SEQ ID NO: 4539632 - DNA, 16 bp, Homo sapiens
aatacagttacttaat

SEQ ID NO: 4539633 - DNA, 15 bp, Homo sapiens
aatacatactaatga

SEQ ID NO: 4539634 - DNA, 14 bp, Homo sapiens
aatacatcacatct

SEQ ID NO: 4539635 - DNA, 15 bp, Homo sapiens
aatacatcacatctt

SEQ ID NO: 4539636 - DNA, 20 bp, Homo sapiens
aatacatcacatcttattta

SEQ ID NO: 4539637 - DNA, 23 bp, Homo sapiens
aatacatgacatttatttttcat

SEQ ID NO: 4539638 - DNA, 17 bp, Homo sapiens
aatacatgagaaagatg

SEQ ID NO: 4539639 - DNA, 12 bp, Homo sapiens
aatacatgcaca

SEQ ID NO: 4539640 - DNA, 17 bp, Homo sapiens
aatacattaacggtgct

SEQ ID NO: 4539641 - DNA, 15 bp, Homo sapiens
aatacattttattct

SEQ ID NO: 4539642 - DNA, 17 bp, Homo sapiens
aataccacaaacactgt

SEQ ID NO: 4539643 - DNA, 14 bp, Homo sapiens
aataccacaagcct

SEQ ID NO: 4539644 - DNA, 20 bp, Homo sapiens
aataccacctcgagatgggt

SEQ ID NO: 4539645 - DNA, 13 bp, Homo sapiens
aataccagagcct

SEQ ID NO: 4539646 - DNA, 18 bp, Homo sapiens
aataccatgccatttaaa

SEQ ID NO: 4539647 - DNA, 18 bp, Homo sapiens
aatacctgattgatcaca

SEQ ID NO: 4539648 - DNA, 17 bp, Homo sapiens
aatacgtgccagatata

SEQ ID NO: 4539649 - DNA, 21 bp, Homo sapiens
aatacgtgccagatataactg

SEQ ID NO: 4539650 - DNA, 21 bp, Homo sapiens
aatacgttaggaggacaaaag

SEQ ID NO: 4539651 - DNA, 14 bp, Homo sapiens
aatactaccttgaa

SEQ ID NO: 4539652 - DNA, 15 bp, Homo sapiens
aatactaccttgaaa

SEQ ID NO: 4539653 - DNA, 16 bp, Homo sapiens
aatactaccttgaaaa

SEQ ID NO: 4539654 - DNA, 21 bp, Homo sapiens
aatactatgcagtatctctta

SEQ ID NO: 4539655 - DNA, 17 bp, Homo sapiens
aatactctgccctctag

SEQ ID NO: 4539656 - DNA, 19 bp, Homo sapiens
aatactgtccagttttctt

SEQ ID NO: 4539657 - DNA, 14 bp, Homo sapiens
aatactttatttct

SEQ ID NO: 4539658 - DNA, 23 bp, Homo sapiens
aatactttctatgtgacatttct

SEQ ID NO: 4539659 - DNA, 22 bp, Homo sapiens
aatactttcttttattaatata

SEQ ID NO: 4539660 - DNA, 17 bp, Homo sapiens
aatactttgtatacaag

SEQ ID NO: 4539661 - DNA, 23 bp, Homo sapiens
aatactttgtatacaagtactgg

SEQ ID NO: 4539662 - DNA, 14 bp, Homo sapiens
aatacttttccaca

SEQ ID NO: 4539663 - DNA, 10 bp, Homo sapiens
aatacttttt

SEQ ID NO: 4539664 - DNA, 16 bp, Homo sapiens
aatactttttctaatg

SEQ ID NO: 4539665 - DNA, 17 bp, Homo sapiens
aatagaaaacaggaaaa

SEQ ID NO: 4539666 - DNA, 19 bp, Homo sapiens
aatagaaaagttattagtg

SEQ ID NO: 4539667 - DNA, 11 bp, Homo sapiens
aatagaaagaa

SEQ ID NO: 4539668 - DNA, 14 bp, Homo sapiens
aatagaaagaaact

SEQ ID NO: 4539669 - DNA, 22 bp, Homo sapiens
aatagaaataaaggatgtgatt

SEQ ID NO: 4539670 - DNA, 13 bp, Homo sapiens
aatagaaattttc

SEQ ID NO: 4539671 - DNA, 16 bp, Homo sapiens
aatagaaattttgtaa

SEQ ID NO: 4539672 - DNA, 16 bp, Homo sapiens
aatagaataaaggcag

SEQ ID NO: 4539673 - DNA, 16 bp, Homo sapiens
aatagaattataactg

SEQ ID NO: 4539674 - DNA, 17 bp, Homo sapiens
aatagacaaaaagtata

SEQ ID NO: 4539675 - DNA, 18 bp, Homo sapiens
aatagacaaaaagtatat

SEQ ID NO: 4539676 - DNA, 12 bp, Homo sapiens
aatagacaagtt

SEQ ID NO: 4539677 - DNA, 14 bp, Homo sapiens
aatagagagtctcc

SEQ ID NO: 4539678 - DNA, 18 bp, Homo sapiens
aatagagctccatttccc

SEQ ID NO: 4539679 - DNA, 14 bp, Homo sapiens
aatagaggaagaaa

SEQ ID NO: 4539680 - DNA, 19 bp, Homo sapiens
aatagatatgaaagctgat

SEQ ID NO: 4539681 - DNA, 21 bp, Homo sapiens
aatagattactgatgtgatat

SEQ ID NO: 4539682 - DNA, 20 bp, Homo sapiens
aatagatttaggagcagaaa

SEQ ID NO: 4539683 - DNA, 23 bp, Homo sapiens
aatagatttcagctatgcagaaa

SEQ ID NO: 4539684 - DNA, 13 bp, Homo sapiens
aatagcaaaagaa

SEQ ID NO: 4539685 - DNA, 16 bp, Homo sapiens
aatagcaaaagaagaa

SEQ ID NO: 4539686 - DNA, 17 bp, Homo sapiens
aatagcagttataacag

SEQ ID NO: 4539687 - DNA, 20 bp, Homo sapiens
aatagccaaagatttcatat

SEQ ID NO: 4539688 - DNA, 20 bp, Homo sapiens
aatagccacaattatataaa

SEQ ID NO: 4539689 - DNA, 20 bp, Homo sapiens
aatagccacatttggaatac

SEQ ID NO: 4539690 - DNA, 17 bp, Homo sapiens
aatagcggccctggagg

SEQ ID NO: 4539691 - DNA, 18 bp, Homo sapiens
aatagcggccctggagga

SEQ ID NO: 4539692 - DNA, 16 bp, Homo sapiens
aatagctacagtgcat

SEQ ID NO: 4539693 - DNA, 19 bp, Homo sapiens
aatagctatttttttccta

SEQ ID NO: 4539694 - DNA, 19 bp, Homo sapiens
aatagctttgtatttttgt

SEQ ID NO: 4539695 - DNA, 21 bp, Homo sapiens
aataggaatcttcactagaag

SEQ ID NO: 4539696 - DNA, 16 bp, Homo sapiens
aataggaattggtttc

SEQ ID NO: 4539697 - DNA, 23 bp, Homo sapiens
aataggagaaagcttaatatatt

SEQ ID NO: 4539698 - DNA, 16 bp, Homo sapiens
aataggagtatttttg

SEQ ID NO: 4539699 - DNA, 15 bp, Homo sapiens
aataggatttttaga

SEQ ID NO: 4539700 - DNA, 22 bp, Homo sapiens
aataggctgatgggcaaaaaac

SEQ ID NO: 4539701 - DNA, 13 bp, Homo sapiens
aatagtaatgttt

SEQ ID NO: 4539702 - DNA, 20 bp, Homo sapiens
aatagtatacattgtcttga

SEQ ID NO: 4539703 - DNA, 23 bp, Homo sapiens
aatagtgataagttgaggaaaga

SEQ ID NO: 4539704 - DNA, 16 bp, Homo sapiens
aatagtggcataccaa

SEQ ID NO: 4539705 - DNA, 18 bp, Homo sapiens
aatagtgtaagaactgta

SEQ ID NO: 4539706 - DNA, 16 bp, Homo sapiens
aatagtgtgaaatata

SEQ ID NO: 4539707 - DNA, 15 bp, Homo sapiens
aatagttaaaaatta

SEQ ID NO: 4539708 - DNA, 18 bp, Homo sapiens
aatagttaaaaattaaat

SEQ ID NO: 4539709 - DNA, 22 bp, Homo sapiens
aatagttaaaaattaaatattt

SEQ ID NO: 4539710 - DNA, 23 bp, Homo sapiens
aatagttaaaaattaaatattta

SEQ ID NO: 4539711 - DNA, 23 bp, Homo sapiens
aatagttaagacatgatttcctt

SEQ ID NO: 4539712 - DNA, 23 bp, Homo sapiens
aatagttagatctttgtaaatgc

SEQ ID NO: 4539713 - DNA, 18 bp, Homo sapiens
aatagttcaggagacttt

SEQ ID NO: 4539714 - DNA, 14 bp, Homo sapiens
aatagtttggatat

SEQ ID NO: 4539715 - DNA, 20 bp, Homo sapiens
aatagtttttcactttgtgt

SEQ ID NO: 4539716 - DNA, 12 bp, Homo sapiens
aatataaaaaat

SEQ ID NO: 4539717 - DNA, 16 bp, Homo sapiens
aatataaaaaatcatg

SEQ ID NO: 4539718 - DNA, 14 bp, Homo sapiens
aatataaaacagtc

SEQ ID NO: 4539719 - DNA, 12 bp, Homo sapiens
aatataaatata

SEQ ID NO: 4539720 - DNA, 20 bp, Homo sapiens
aatataaatgtgtgtatgtg

SEQ ID NO: 4539721 - DNA, 12 bp, Homo sapiens
aatataaatgtt

SEQ ID NO: 4539722 - DNA, 13 bp, Homo sapiens
aatataaatgttg

SEQ ID NO: 4539723 - DNA, 19 bp, Homo sapiens
aatataaattgtacatttt

SEQ ID NO: 4539724 - DNA, 18 bp, Homo sapiens
aatataagaagcaatctt

SEQ ID NO: 4539725 - DNA, 22 bp, Homo sapiens
aatataagtctatactaatgct

SEQ ID NO: 4539726 - DNA, 15 bp, Homo sapiens
aatataagtttcttt

SEQ ID NO: 4539727 - DNA, 14 bp, Homo sapiens
aatataataatgat

SEQ ID NO: 4539728 - DNA, 12 bp, Homo sapiens
aatatacagttt

SEQ ID NO: 4539729 - DNA, 14 bp, Homo sapiens
aatatacagtttga

SEQ ID NO: 4539730 - DNA, 17 bp, Homo sapiens
aatataccccaaattgt

SEQ ID NO: 4539731 - DNA, 20 bp, Homo sapiens
aatataccccaaattgtgta

SEQ ID NO: 4539732 - DNA, 14 bp, Homo sapiens
aatataccttattt

SEQ ID NO: 4539733 - DNA, 22 bp, Homo sapiens
aatatactaaaccaactctaat

SEQ ID NO: 4539734 - DNA, 20 bp, Homo sapiens
aatatactcattagaattac

SEQ ID NO: 4539735 - DNA, 14 bp, Homo sapiens
aatatactttactt

SEQ ID NO: 4539736 - DNA, 19 bp, Homo sapiens
aatatactttactttttcc

SEQ ID NO: 4539737 - DNA, 11 bp, Homo sapiens
aatatactttt

SEQ ID NO: 4539738 - DNA, 16 bp, Homo sapiens
aatatagacagtgccc

SEQ ID NO: 4539739 - DNA, 18 bp, Homo sapiens
aatatagacattctcaca

SEQ ID NO: 4539740 - DNA, 20 bp, Homo sapiens
aatatagacattctcacata

SEQ ID NO: 4539741 - DNA, 20 bp, Homo sapiens
aatatagagacaggacagaa

SEQ ID NO: 4539742 - DNA, 23 bp, Homo sapiens
aatatagagacaggacagaatgt

SEQ ID NO: 4539743 - DNA, 18 bp, Homo sapiens
aatatagatgctggccag

SEQ ID NO: 4539744 - DNA, 23 bp, Homo sapiens
aatatagtttggaaataaaaatg

SEQ ID NO: 4539745 - DNA, 14 bp, Homo sapiens
aatatataatattc

SEQ ID NO: 4539746 - DNA, 23 bp, Homo sapiens
aatatatacacatagttctgtaa

SEQ ID NO: 4539747 - DNA, 21 bp, Homo sapiens
aatatatagtgaaaaatgtca

SEQ ID NO: 4539748 - DNA, 19 bp, Homo sapiens
aatatatataaagaatata

SEQ ID NO: 4539749 - DNA, 15 bp, Homo sapiens
aatatatatggtcat

SEQ ID NO: 4539750 - DNA, 14 bp, Homo sapiens
aatatatattttgt

SEQ ID NO: 4539751 - DNA, 19 bp, Homo sapiens
aatatatcctgaaagcatt

SEQ ID NO: 4539752 - DNA, 14 bp, Homo sapiens
aatatatcctgtgt

SEQ ID NO: 4539753 - DNA, 19 bp, Homo sapiens
aatatatctagaactatca

SEQ ID NO: 4539754 - DNA, 14 bp, Homo sapiens
aatatatgaaataa

SEQ ID NO: 4539755 - DNA, 13 bp, Homo sapiens
aatatatgattct

SEQ ID NO: 4539756 - DNA, 14 bp, Homo sapiens
aatatatggcattt

SEQ ID NO: 4539757 - DNA, 13 bp, Homo sapiens
aatatatgtatgt

SEQ ID NO: 4539758 - DNA, 22 bp, Homo sapiens
aatatatgtatttttatataat

SEQ ID NO: 4539759 - DNA, 14 bp, Homo sapiens
aatatatgtgaaag

SEQ ID NO: 4539760 - DNA, 13 bp, Homo sapiens
aatatattgaaca

SEQ ID NO: 4539761 - DNA, 18 bp, Homo sapiens
aatatattgaacttttgt

SEQ ID NO: 4539762 - DNA, 19 bp, Homo sapiens
aatatattgaacttttgta

SEQ ID NO: 4539763 - DNA, 14 bp, Homo sapiens
aatatatttaaaaa

SEQ ID NO: 4539764 - DNA, 14 bp, Homo sapiens
aatatatttatata

SEQ ID NO: 4539765 - DNA, 12 bp, Homo sapiens
aatatatttctt

SEQ ID NO: 4539766 - DNA, 13 bp, Homo sapiens
aatatatttcttc

SEQ ID NO: 4539767 - DNA, 16 bp, Homo sapiens
aatatatttcttcttc

SEQ ID NO: 4539768 - DNA, 17 bp, Homo sapiens
aatatcaaagcatttta

SEQ ID NO: 4539769 - DNA, 14 bp, Homo sapiens
aatatcaaatgcag

SEQ ID NO: 4539770 - DNA, 14 bp, Homo sapiens
aatatcaactctga

SEQ ID NO: 4539771 - DNA, 13 bp, Homo sapiens
aatatcactcatt

SEQ ID NO: 4539772 - DNA, 16 bp, Homo sapiens
aatatcactcattaat

SEQ ID NO: 4539773 - DNA, 17 bp, Homo sapiens
aatatcagctttgataa

SEQ ID NO: 4539774 - DNA, 18 bp, Homo sapiens
aatatcagctttgataat

SEQ ID NO: 4539775 - DNA, 23 bp, Homo sapiens
aatatcagctttgataattgtgt

SEQ ID NO: 4539776 - DNA, 19 bp, Homo sapiens
aatatcatctgtcattata

SEQ ID NO: 4539777 - DNA, 15 bp, Homo sapiens
aatatccatttatct

SEQ ID NO: 4539778 - DNA, 18 bp, Homo sapiens
aatatccatttatctttt

SEQ ID NO: 4539779 - DNA, 15 bp, Homo sapiens
aatatcctaaacatc

SEQ ID NO: 4539780 - DNA, 18 bp, Homo sapiens
aatatcctaaacatcatt

SEQ ID NO: 4539781 - DNA, 16 bp, Homo sapiens
aatatctaaagttata

SEQ ID NO: 4539782 - DNA, 17 bp, Homo sapiens
aatatctatttgaataa

SEQ ID NO: 4539783 - DNA, 21 bp, Homo sapiens
aatatctatttgaataaatta

SEQ ID NO: 4539784 - DNA, 22 bp, Homo sapiens
aatatctatttgaataaattat

SEQ ID NO: 4539785 - DNA, 15 bp, Homo sapiens
aatatctgttattca

SEQ ID NO: 4539786 - DNA, 22 bp, Homo sapiens
aatatctgttattcaaatttga

SEQ ID NO: 4539787 - DNA, 13 bp, Homo sapiens
aatatcttaccag

SEQ ID NO: 4539788 - DNA, 14 bp, Homo sapiens
aatatctttcagtt

SEQ ID NO: 4539789 - DNA, 12 bp, Homo sapiens
aatatctttctg

SEQ ID NO: 4539790 - DNA, 21 bp, Homo sapiens
aatatgaaccctttgtttctt

SEQ ID NO: 4539791 - DNA, 20 bp, Homo sapiens
aatatgactttttataaaat

SEQ ID NO: 4539792 - DNA, 14 bp, Homo sapiens
aatatgagcttcaa

SEQ ID NO: 4539793 - DNA, 21 bp, Homo sapiens
aatatgagcttcaatataaga

SEQ ID NO: 4539794 - DNA, 16 bp, Homo sapiens
aatatgatgttaaaaa

SEQ ID NO: 4539795 - DNA, 11 bp, Homo sapiens
aatatgattat

SEQ ID NO: 4539796 - DNA, 13 bp, Homo sapiens
aatatgcaagcag

SEQ ID NO: 4539797 - DNA, 17 bp, Homo sapiens
aatatgcaagcagcttt

SEQ ID NO: 4539798 - DNA, 20 bp, Homo sapiens
aatatgcaaggcggtacact

SEQ ID NO: 4539799 - DNA, 17 bp, Homo sapiens
aatatgctgcaacaaaa

SEQ ID NO: 4539800 - DNA, 18 bp, Homo sapiens
aatatgctgcaacaaaat

SEQ ID NO: 4539801 - DNA, 21 bp, Homo sapiens
aatatgctgcaacaaaatgta

SEQ ID NO: 4539802 - DNA, 23 bp, Homo sapiens
aatatggaaatcttttacatttt

SEQ ID NO: 4539803 - DNA, 21 bp, Homo sapiens
aatatggaaccttccctccaa

SEQ ID NO: 4539804 - DNA, 17 bp, Homo sapiens
aatatggacacttaata

SEQ ID NO: 4539805 - DNA, 21 bp, Homo sapiens
aatatggacacttaatactac

SEQ ID NO: 4539806 - DNA, 16 bp, Homo sapiens
aatatgggaggaacaa

SEQ ID NO: 4539807 - DNA, 21 bp, Homo sapiens
aatatgggggccttttgggaa

SEQ ID NO: 4539808 - DNA, 14 bp, Homo sapiens
aatatgtactgtat

SEQ ID NO: 4539809 - DNA, 19 bp, Homo sapiens
aatatgtactgtataacat

SEQ ID NO: 4539810 - DNA, 16 bp, Homo sapiens
aatatgtgaagttttc

SEQ ID NO: 4539811 - DNA, 18 bp, Homo sapiens
aatatgttgctttgaaaa

SEQ ID NO: 4539812 - DNA, 13 bp, Homo sapiens
aatattaaaaaac

SEQ ID NO: 4539813 - DNA, 21 bp, Homo sapiens
aatattaaatctgctggagtt

SEQ ID NO: 4539814 - DNA, 17 bp, Homo sapiens
aatattaagaacatttt

SEQ ID NO: 4539815 - DNA, 14 bp, Homo sapiens
aatattaagacaat

SEQ ID NO: 4539816 - DNA, 16 bp, Homo sapiens
aatattaagagctatt

SEQ ID NO: 4539817 - DNA, 19 bp, Homo sapiens
aatattaagagctatttta

SEQ ID NO: 4539818 - DNA, 14 bp, Homo sapiens
aatattactttgtc

SEQ ID NO: 4539819 - DNA, 20 bp, Homo sapiens
aatattagttggctttcata

SEQ ID NO: 4539820 - DNA, 22 bp, Homo sapiens
aatattataactcatttgttgt

SEQ ID NO: 4539821 - DNA, 20 bp, Homo sapiens
aatattatttgtgtttccta

SEQ ID NO: 4539822 - DNA, 17 bp, Homo sapiens
aatattcactgggccaa

SEQ ID NO: 4539823 - DNA, 20 bp, Homo sapiens
aatattcagacaaaatggat

SEQ ID NO: 4539824 - DNA, 21 bp, Homo sapiens
aatattcagacaaaatggata

SEQ ID NO: 4539825 - DNA, 23 bp, Homo sapiens
aatattcagacaaaatggataca

SEQ ID NO: 4539826 - DNA, 22 bp, Homo sapiens
aatattcagccagcttaaaccc

SEQ ID NO: 4539827 - DNA, 18 bp, Homo sapiens
aatattcatattggaaaa

SEQ ID NO: 4539828 - DNA, 11 bp, Homo sapiens
aatattcatgg

SEQ ID NO: 4539829 - DNA, 19 bp, Homo sapiens
aatattcatggatggctca

SEQ ID NO: 4539830 - DNA, 13 bp, Homo sapiens
aatattcctttat

SEQ ID NO: 4539831 - DNA, 14 bp, Homo sapiens
aatattctctattt

SEQ ID NO: 4539832 - DNA, 19 bp, Homo sapiens
aatattctgaatcaccaat

SEQ ID NO: 4539833 - DNA, 15 bp, Homo sapiens
aatattgaaaattga

SEQ ID NO: 4539834 - DNA, 21 bp, Homo sapiens
aatattgactcaaaccatatt

SEQ ID NO: 4539835 - DNA, 16 bp, Homo sapiens
aatattgagaaagaaa

SEQ ID NO: 4539836 - DNA, 20 bp, Homo sapiens
aatattgagaaagaaactaa

SEQ ID NO: 4539837 - DNA, 18 bp, Homo sapiens
aatattgcccaaataata

SEQ ID NO: 4539838 - DNA, 19 bp, Homo sapiens
aatattgctaaaagcatgt

SEQ ID NO: 4539839 - DNA, 20 bp, Homo sapiens
aatattgctaaaagcatgta

SEQ ID NO: 4539840 - DNA, 22 bp, Homo sapiens
aatattgctaaaagcatgtata

SEQ ID NO: 4539841 - DNA, 23 bp, Homo sapiens
aatattgctaaaagcatgtatag

SEQ ID NO: 4539842 - DNA, 18 bp, Homo sapiens
aatattgcttcaatttca

SEQ ID NO: 4539843 - DNA, 15 bp, Homo sapiens
aatattggtatgtaa

SEQ ID NO: 4539844 - DNA, 17 bp, Homo sapiens
aatattggtatgtaaca

SEQ ID NO: 4539845 - DNA, 21 bp, Homo sapiens
aatattggtgctatttaacat

SEQ ID NO: 4539846 - DNA, 13 bp, Homo sapiens
aatattgtacagt

SEQ ID NO: 4539847 - DNA, 23 bp, Homo sapiens
aatattgtacagtttttattgct

SEQ ID NO: 4539848 - DNA, 15 bp, Homo sapiens
aatattgtattgtta

SEQ ID NO: 4539849 - DNA, 13 bp, Homo sapiens
aatattgtcatct

SEQ ID NO: 4539850 - DNA, 12 bp, Homo sapiens
aatattgtttct

SEQ ID NO: 4539851 - DNA, 15 bp, Homo sapiens
aatattgtttctgca

SEQ ID NO: 4539852 - DNA, 14 bp, Homo sapiens
aatattgtttttct

SEQ ID NO: 4539853 - DNA, 14 bp, Homo sapiens
aatatttaaaaatg

SEQ ID NO: 4539854 - DNA, 18 bp, Homo sapiens
aatatttaagtttgttgc

SEQ ID NO: 4539855 - DNA, 17 bp, Homo sapiens
aatatttacaatgtatt

SEQ ID NO: 4539856 - DNA, 19 bp, Homo sapiens
aatatttacaatgtattaa

SEQ ID NO: 4539857 - DNA, 12 bp, Homo sapiens
aatatttatgtt

SEQ ID NO: 4539858 - DNA, 12 bp, Homo sapiens
aatatttctgaa

SEQ ID NO: 4539859 - DNA, 17 bp, Homo sapiens
aatatttctgctttctt

SEQ ID NO: 4539860 - DNA, 16 bp, Homo sapiens
aatatttcttcaaata

SEQ ID NO: 4539861 - DNA, 23 bp, Homo sapiens
aatatttcttttgttgtacttta

SEQ ID NO: 4539862 - DNA, 11 bp, Homo sapiens
aatatttgctt

SEQ ID NO: 4539863 - DNA, 16 bp, Homo sapiens
aatattttaaagaatt

SEQ ID NO: 4539864 - DNA, 15 bp, Homo sapiens
aatattttacataca

SEQ ID NO: 4539865 - DNA, 19 bp, Homo sapiens
aatattttcaagtttttca

SEQ ID NO: 4539866 - DNA, 14 bp, Homo sapiens
aatattttcagtaa

SEQ ID NO: 4539867 - DNA, 23 bp, Homo sapiens
aatattttctctgtacttttcat

SEQ ID NO: 4539868 - DNA, 18 bp, Homo sapiens
aatattttctgcaatcca

SEQ ID NO: 4539869 - DNA, 22 bp, Homo sapiens
aatattttgaatcaataatata

SEQ ID NO: 4539870 - DNA, 16 bp, Homo sapiens
aatattttgataataa

SEQ ID NO: 4539871 - DNA, 18 bp, Homo sapiens
aatattttgatgcagata

SEQ ID NO: 4539872 - DNA, 21 bp, Homo sapiens
aatattttgctaaaaaagcat

SEQ ID NO: 4539873 - DNA, 13 bp, Homo sapiens
aatattttgtaat

SEQ ID NO: 4539874 - DNA, 17 bp, Homo sapiens
aatattttgtaatattc

SEQ ID NO: 4539875 - DNA, 18 bp, Homo sapiens
aatattttgtaatattct

SEQ ID NO: 4539876 - DNA, 18 bp, Homo sapiens
aatatttttagactattt

SEQ ID NO: 4539877 - DNA, 18 bp, Homo sapiens
aatatttttatatttcct

SEQ ID NO: 4539878 - DNA, 15 bp, Homo sapiens
aatattttttgaagg

SEQ ID NO: 4539879 - DNA, 13 bp, Homo sapiens
aatattttttgct

SEQ ID NO: 4539880 - DNA, 20 bp, Homo sapiens
aatattttttgctctaatct

SEQ ID NO: 4539881 - DNA, 18 bp, Homo sapiens
aatcaaaataaaaattaa

SEQ ID NO: 4539882 - DNA, 13 bp, Homo sapiens
aatcaaactgctt

SEQ ID NO: 4539883 - DNA, 22 bp, Homo sapiens
aatcaaatatgcaaagcactga

SEQ ID NO: 4539884 - DNA, 12 bp, Homo sapiens
aatcaaatgaat

SEQ ID NO: 4539885 - DNA, 14 bp, Homo sapiens
aatcaaatgaatga

SEQ ID NO: 4539886 - DNA, 12 bp, Homo sapiens
aatcaaatgatt

SEQ ID NO: 4539887 - DNA, 14 bp, Homo sapiens
aatcaaatgatttc

SEQ ID NO: 4539888 - DNA, 15 bp, Homo sapiens
aatcaaatgatttca

SEQ ID NO: 4539889 - DNA, 16 bp, Homo sapiens
aatcaaatgatttcat

SEQ ID NO: 4539890 - DNA, 13 bp, Homo sapiens
aatcaacttttat

SEQ ID NO: 4539891 - DNA, 16 bp, Homo sapiens
aatcaacttttatgca

SEQ ID NO: 4539892 - DNA, 18 bp, Homo sapiens
aatcaactttttattgcc

SEQ ID NO: 4539893 - DNA, 21 bp, Homo sapiens
aatcaactttttattgccttc

SEQ ID NO: 4539894 - DNA, 24 bp, Homo sapiens
aatcaagaaaagaattacagactc

SEQ ID NO: 4539895 - DNA, 13 bp, Homo sapiens
aatcaagagaaac

SEQ ID NO: 4539896 - DNA, 10 bp, Homo sapiens
aatcaagagt

SEQ ID NO: 4539897 - DNA, 20 bp, Homo sapiens
aatcaagatttttttcctga

SEQ ID NO: 4539898 - DNA, 23 bp, Homo sapiens
aatcaaggaaaggctcatttaaa

SEQ ID NO: 4539899 - DNA, 14 bp, Homo sapiens
aatcaagtaatgaa

SEQ ID NO: 4539900 - DNA, 15 bp, Homo sapiens
aatcaagtaatgaat

SEQ ID NO: 4539901 - DNA, 15 bp, Homo sapiens
aatcaatatttaaga

SEQ ID NO: 4539902 - DNA, 21 bp, Homo sapiens
aatcaatctgcagtttaacaa

SEQ ID NO: 4539903 - DNA, 12 bp, Homo sapiens
aatcaatttaag

SEQ ID NO: 4539904 - DNA, 17 bp, Homo sapiens
aatcacaattttcctgt

SEQ ID NO: 4539905 - DNA, 15 bp, Homo sapiens
aatcacaatttttaa

SEQ ID NO: 4539906 - DNA, 14 bp, Homo sapiens
aatcacactgcggt

SEQ ID NO: 4539907 - DNA, 17 bp, Homo sapiens
aatcacagttgtgttcc

SEQ ID NO: 4539908 - DNA, 15 bp, Homo sapiens
aatcaccaattaaaa

SEQ ID NO: 4539909 - DNA, 16 bp, Homo sapiens
aatcaccaattaaaaa

SEQ ID NO: 4539910 - DNA, 14 bp, Homo sapiens
aatcaccatgtaag

SEQ ID NO: 4539911 - DNA, 16 bp, Homo sapiens
aatcaccatgtaagca

SEQ ID NO: 4539912 - DNA, 19 bp, Homo sapiens
aatcaccatgtaagcactc

SEQ ID NO: 4539913 - DNA, 19 bp, Homo sapiens
aatcacccctctgcccctg

SEQ ID NO: 4539914 - DNA, 16 bp, Homo sapiens
aatcacgctttttgaa

SEQ ID NO: 4539915 - DNA, 17 bp, Homo sapiens
aatcacgctttttgaaa

SEQ ID NO: 4539916 - DNA, 18 bp, Homo sapiens
aatcacgctttttgaaaa

SEQ ID NO: 4539917 - DNA, 20 bp, Homo sapiens
aatcacgtaaagctagaaat

SEQ ID NO: 4539918 - DNA, 22 bp, Homo sapiens
aatcactaacattatattgcaa

SEQ ID NO: 4539919 - DNA, 15 bp, Homo sapiens
aatcactgctccagg

SEQ ID NO: 4539920 - DNA, 13 bp, Homo sapiens
aatcactgttgct

SEQ ID NO: 4539921 - DNA, 18 bp, Homo sapiens
aatcacttaacattccta

SEQ ID NO: 4539922 - DNA, 16 bp, Homo sapiens
aatcacttaggaaatg

SEQ ID NO: 4539923 - DNA, 23 bp, Homo sapiens
aatcacttgaacccgggggacag

SEQ ID NO: 4539924 - DNA, 21 bp, Homo sapiens
aatcagaagatagtcttggaa

SEQ ID NO: 4539925 - DNA, 14 bp, Homo sapiens
aatcagaatggaag

SEQ ID NO: 4539926 - DNA, 13 bp, Homo sapiens
aatcagaattaga

SEQ ID NO: 4539927 - DNA, 20 bp, Homo sapiens
aatcagaattgtgctttttc

SEQ ID NO: 4539928 - DNA, 16 bp, Homo sapiens
aatcagatagatattc

SEQ ID NO: 4539929 - DNA, 12 bp, Homo sapiens
aatcagatgctg

SEQ ID NO: 4539930 - DNA, 20 bp, Homo sapiens
aatcagattgcttaaaagca

SEQ ID NO: 4539931 - DNA, 17 bp, Homo sapiens
aatcagcactctgtaaa

SEQ ID NO: 4539932 - DNA, 21 bp, Homo sapiens
aatcagcctcatgactttata

SEQ ID NO: 4539933 - DNA, 23 bp, Homo sapiens
aatcagcctcatgactttatagt

SEQ ID NO: 4539934 - DNA, 15 bp, Homo sapiens
aatcagctattttgt

SEQ ID NO: 4539935 - DNA, 15 bp, Homo sapiens
aatcagtatattttc

SEQ ID NO: 4539936 - DNA, 17 bp, Homo sapiens
aatcagtctcagaatgt

SEQ ID NO: 4539937 - DNA, 13 bp, Homo sapiens
aatcatacaaact

SEQ ID NO: 4539938 - DNA, 17 bp, Homo sapiens
aatcatacaccagaaga

SEQ ID NO: 4539939 - DNA, 19 bp, Homo sapiens
aatcatagtactctttgta

SEQ ID NO: 4539940 - DNA, 22 bp, Homo sapiens
aatcatcagaaaggaaaaacaa

SEQ ID NO: 4539941 - DNA, 15 bp, Homo sapiens
aatcatcccttaata

SEQ ID NO: 4539942 - DNA, 19 bp, Homo sapiens
aatcatctattttgatgca

SEQ ID NO: 4539943 - DNA, 13 bp, Homo sapiens
aatcatgtagttt

SEQ ID NO: 4539944 - DNA, 17 bp, Homo sapiens
aatcatgtccatacact

SEQ ID NO: 4539945 - DNA, 22 bp, Homo sapiens
aatcatgtccatacactttgtt

SEQ ID NO: 4539946 - DNA, 22 bp, Homo sapiens
aatcatgttgatcatgtacttt

SEQ ID NO: 4539947 - DNA, 12 bp, Homo sapiens
aatcatgttgtt

SEQ ID NO: 4539948 - DNA, 20 bp, Homo sapiens
aatcattatctcactttgta

SEQ ID NO: 4539949 - DNA, 13 bp, Homo sapiens
aatcattatgttt

SEQ ID NO: 4539950 - DNA, 14 bp, Homo sapiens
aatcattgtatgtg

SEQ ID NO: 4539951 - DNA, 14 bp, Homo sapiens
aatcattgttttga

SEQ ID NO: 4539952 - DNA, 20 bp, Homo sapiens
aatcattgttttgaatatta

SEQ ID NO: 4539953 - DNA, 22 bp, Homo sapiens
aatcattgttttgaatattact

SEQ ID NO: 4539954 - DNA, 14 bp, Homo sapiens
aatcatttattcat

SEQ ID NO: 4539955 - DNA, 20 bp, Homo sapiens
aatcatttctatttctcctc

SEQ ID NO: 4539956 - DNA, 17 bp, Homo sapiens
aatcatttggttaaatc

SEQ ID NO: 4539957 - DNA, 16 bp, Homo sapiens
aatcatttgtttacat

SEQ ID NO: 4539958 - DNA, 21 bp, Homo sapiens
aatcattttatgctgtttatg

SEQ ID NO: 4539959 - DNA, 20 bp, Homo sapiens
aatccaaaaagctctgaaaa

SEQ ID NO: 4539960 - DNA, 14 bp, Homo sapiens
aatccaatgcactg

SEQ ID NO: 4539961 - DNA, 14 bp, Homo sapiens
aatccacacatatt

SEQ ID NO: 4539962 - DNA, 13 bp, Homo sapiens
aatccacctgcct

SEQ ID NO: 4539963 - DNA, 16 bp, Homo sapiens
aatccacctgccttgg

SEQ ID NO: 4539964 - DNA, 16 bp, Homo sapiens
aatccaccttcaggcc

SEQ ID NO: 4539965 - DNA, 18 bp, Homo sapiens
aatccagactttcttttt

SEQ ID NO: 4539966 - DNA, 19 bp, Homo sapiens
aatccagactttctttttc

SEQ ID NO: 4539967 - DNA, 19 bp, Homo sapiens
aatccaggctgttctcagc

SEQ ID NO: 4539968 - DNA, 14 bp, Homo sapiens
aatccagtattatc

SEQ ID NO: 4539969 - DNA, 14 bp, Homo sapiens
aatccatgcttcac

SEQ ID NO: 4539970 - DNA, 15 bp, Homo sapiens
aatccatgcttcact

SEQ ID NO: 4539971 - DNA, 11 bp, Homo sapiens
aatcccaaatt

SEQ ID NO: 4539972 - DNA, 16 bp, Homo sapiens
aatcccaaatttgatt

SEQ ID NO: 4539973 - DNA, 13 bp, Homo sapiens
aatcccagcactt

SEQ ID NO: 4539974 - DNA, 14 bp, Homo sapiens
aatcccagctactg

SEQ ID NO: 4539975 - DNA, 14 bp, Homo sapiens
aatccctgcttttt

SEQ ID NO: 4539976 - DNA, 23 bp, Homo sapiens
aatcccttttatctattagataa

SEQ ID NO: 4539977 - DNA, 15 bp, Homo sapiens
aatcctacctcaaaa

SEQ ID NO: 4539978 - DNA, 17 bp, Homo sapiens
aatcctaccttgctttt

SEQ ID NO: 4539979 - DNA, 14 bp, Homo sapiens
aatcctagagtctt

SEQ ID NO: 4539980 - DNA, 13 bp, Homo sapiens
aatcctatttaaa

SEQ ID NO: 4539981 - DNA, 15 bp, Homo sapiens
aatcctatttaaaga

SEQ ID NO: 4539982 - DNA, 22 bp, Homo sapiens
aatcctcagccgagaaattggg

SEQ ID NO: 4539983 - DNA, 16 bp, Homo sapiens
aatcctcaggaaatta

SEQ ID NO: 4539984 - DNA, 11 bp, Homo sapiens
aatcctctggc

SEQ ID NO: 4539985 - DNA, 20 bp, Homo sapiens
aatcctctgttaatgtggac

SEQ ID NO: 4539986 - DNA, 19 bp, Homo sapiens
aatcctcttctaaaatagc

SEQ ID NO: 4539987 - DNA, 23 bp, Homo sapiens
aatcctcttctaaaatagcaata

SEQ ID NO: 4539988 - DNA, 23 bp, Homo sapiens
aatcctcttttgtattgtttcta

SEQ ID NO: 4539989 - DNA, 18 bp, Homo sapiens
aatcctgtatataaaata

SEQ ID NO: 4539990 - DNA, 22 bp, Homo sapiens
aatccttctattctagcctgca

SEQ ID NO: 4539991 - DNA, 18 bp, Homo sapiens
aatccttggagtcccagg

SEQ ID NO: 4539992 - DNA, 14 bp, Homo sapiens
aatccttttcctta

SEQ ID NO: 4539993 - DNA, 22 bp, Homo sapiens
aatcgaagcaaaagtaatcact

SEQ ID NO: 4539994 - DNA, 17 bp, Homo sapiens
aatcgaagtgtttatgt

SEQ ID NO: 4539995 - DNA, 18 bp, Homo sapiens
aatcgaagtgtttatgta

SEQ ID NO: 4539996 - DNA, 14 bp, Homo sapiens
aatcgcaagttaac

SEQ ID NO: 4539997 - DNA, 19 bp, Homo sapiens
aatcgctaatcagtcattt

SEQ ID NO: 4539998 - DNA, 12 bp, Homo sapiens
aatcggactgcc

SEQ ID NO: 4539999 - DNA, 13 bp, Homo sapiens
aatcggactgcca

SEQ ID NO: 4540000 - DNA, 15 bp, Homo sapiens
aatcggactgccaaa

SEQ ID NO: 4540001 - DNA, 18 bp, Homo sapiens
aatcggcccacagctccc

SEQ ID NO: 4540002 - DNA, 18 bp, Homo sapiens
aatcggctggggactgct

SEQ ID NO: 4540003 - DNA, 23 bp, Homo sapiens
aatcgggtccagagaccacacca

SEQ ID NO: 4540004 - DNA, 21 bp, Homo sapiens
aatcgtggcacgtattgctgt

SEQ ID NO: 4540005 - DNA, 16 bp, Homo sapiens
aatcgttctgctggcc

SEQ ID NO: 4540006 - DNA, 20 bp, Homo sapiens
aatcgttctgctggccaaga

SEQ ID NO: 4540007 - DNA, 19 bp, Homo sapiens
aatctaaaagctctgttcc

SEQ ID NO: 4540008 - DNA, 14 bp, Homo sapiens
aatctaaaatgttt

SEQ ID NO: 4540009 - DNA, 19 bp, Homo sapiens
aatctaaaatttcataatt

SEQ ID NO: 4540010 - DNA, 19 bp, Homo sapiens
aatctaacaataatatttc

SEQ ID NO: 4540011 - DNA, 16 bp, Homo sapiens
aatctaacaatggaag

SEQ ID NO: 4540012 - DNA, 20 bp, Homo sapiens
aatctaagtatatgtgagaa

SEQ ID NO: 4540013 - DNA, 18 bp, Homo sapiens
aatctaatatccccaaat

SEQ ID NO: 4540014 - DNA, 16 bp, Homo sapiens
aatctaatctgaactg

SEQ ID NO: 4540015 - DNA, 10 bp, Homo sapiens
aatctacacc

SEQ ID NO: 4540016 - DNA, 17 bp, Homo sapiens
aatctacaccaatgaaa

SEQ ID NO: 4540017 - DNA, 23 bp, Homo sapiens
aatctacaccaatgaaaacatgt

SEQ ID NO: 4540018 - DNA, 20 bp, Homo sapiens
aatctacattataataaaat

SEQ ID NO: 4540019 - DNA, 21 bp, Homo sapiens
aatctacattataataaaatt

SEQ ID NO: 4540020 - DNA, 15 bp, Homo sapiens
aatctactaattcca

SEQ ID NO: 4540021 - DNA, 18 bp, Homo sapiens
aatctactggaaatgtag

SEQ ID NO: 4540022 - DNA, 23 bp, Homo sapiens
aatctactggaaatgtagcactt

SEQ ID NO: 4540023 - DNA, 12 bp, Homo sapiens
aatctactgtat

SEQ ID NO: 4540024 - DNA, 14 bp, Homo sapiens
aatctagaagatgt

SEQ ID NO: 4540025 - DNA, 15 bp, Homo sapiens
aatctagaagatgtg

SEQ ID NO: 4540026 - DNA, 21 bp, Homo sapiens
aatctagaagatgtgtaaaca

SEQ ID NO: 4540027 - DNA, 13 bp, Homo sapiens
aatctagaattta

SEQ ID NO: 4540028 - DNA, 15 bp, Homo sapiens
aatctagaatttagt

SEQ ID NO: 4540029 - DNA, 17 bp, Homo sapiens
aatctagaatttagtga

SEQ ID NO: 4540030 - DNA, 20 bp, Homo sapiens
aatctagacattcttttaat

SEQ ID NO: 4540031 - DNA, 12 bp, Homo sapiens
aatctataacat

SEQ ID NO: 4540032 - DNA, 17 bp, Homo sapiens
aatctatattaaatgag

SEQ ID NO: 4540033 - DNA, 13 bp, Homo sapiens
aatctatggcttt

SEQ ID NO: 4540034 - DNA, 16 bp, Homo sapiens
aatctattagatttta

SEQ ID NO: 4540035 - DNA, 20 bp, Homo sapiens
aatctattgacttttcaata

SEQ ID NO: 4540036 - DNA, 13 bp, Homo sapiens
aatctatttaaaa

SEQ ID NO: 4540037 - DNA, 14 bp, Homo sapiens
aatctatttaaaaa

SEQ ID NO: 4540038 - DNA, 15 bp, Homo sapiens
aatctatttaaaaaa

SEQ ID NO: 4540039 - DNA, 21 bp, Homo sapiens
aatctatttaaaaaactgtat

SEQ ID NO: 4540040 - DNA, 23 bp, Homo sapiens
aatctatttacataaaatgggtg

SEQ ID NO: 4540041 - DNA, 22 bp, Homo sapiens
aatctcaattgaaagcttttaa

SEQ ID NO: 4540042 - DNA, 18 bp, Homo sapiens
aatctcagattcttcact

SEQ ID NO: 4540043 - DNA, 20 bp, Homo sapiens
aatctcagttgtttgcttct

SEQ ID NO: 4540044 - DNA, 21 bp, Homo sapiens
aatctcagttgtttgcttctt

SEQ ID NO: 4540045 - DNA, 17 bp, Homo sapiens
aatctcatctcagtgaa

SEQ ID NO: 4540046 - DNA, 11 bp, Homo sapiens
aatctcattat

SEQ ID NO: 4540047 - DNA, 20 bp, Homo sapiens
aatctcattatttcaaaatg

SEQ ID NO: 4540048 - DNA, 19 bp, Homo sapiens
aatctctcatattcgctag

SEQ ID NO: 4540049 - DNA, 19 bp, Homo sapiens
aatctcttcatgcttgaca

SEQ ID NO: 4540050 - DNA, 24 bp, Homo sapiens
aatctcttcatgcttgacatacct

SEQ ID NO: 4540051 - DNA, 21 bp, Homo sapiens
aatctcttcattattctctgc

SEQ ID NO: 4540052 - DNA, 20 bp, Homo sapiens
aatctctttttgctttcgaa

SEQ ID NO: 4540053 - DNA, 17 bp, Homo sapiens
aatctgaaagacttgaa

SEQ ID NO: 4540054 - DNA, 22 bp, Homo sapiens
aatctgaaattcaaaatgctct

SEQ ID NO: 4540055 - DNA, 23 bp, Homo sapiens
aatctgaactgaccttgaatctt

SEQ ID NO: 4540056 - DNA, 14 bp, Homo sapiens
aatctgaatgtaat

SEQ ID NO: 4540057 - DNA, 18 bp, Homo sapiens
aatctgatggccttaatt

SEQ ID NO: 4540058 - DNA, 19 bp, Homo sapiens
aatctgatggccttaattt

SEQ ID NO: 4540059 - DNA, 21 bp, Homo sapiens
aatctgatggccttaatttcc

SEQ ID NO: 4540060 - DNA, 18 bp, Homo sapiens
aatctgattaatccattt

SEQ ID NO: 4540061 - DNA, 14 bp, Homo sapiens
aatctgcacagtca

SEQ ID NO: 4540062 - DNA, 18 bp, Homo sapiens
aatctgcttttcctctgc

SEQ ID NO: 4540063 - DNA, 17 bp, Homo sapiens
aatctggcttagtgcca

SEQ ID NO: 4540064 - DNA, 17 bp, Homo sapiens
aatctggcttctgcatt

SEQ ID NO: 4540065 - DNA, 19 bp, Homo sapiens
aatctgggactgtgcctgg

SEQ ID NO: 4540066 - DNA, 22 bp, Homo sapiens
aatctgggactgtgcctggctc

SEQ ID NO: 4540067 - DNA, 18 bp, Homo sapiens
aatctggggaagaggttt

SEQ ID NO: 4540068 - DNA, 16 bp, Homo sapiens
aatctgtaaactgtgt

SEQ ID NO: 4540069 - DNA, 21 bp, Homo sapiens
aatctgtaaactgtgtattcc

SEQ ID NO: 4540070 - DNA, 15 bp, Homo sapiens
aatctgtaattacca

SEQ ID NO: 4540071 - DNA, 18 bp, Homo sapiens
aatctgtattctgtttgc

SEQ ID NO: 4540072 - DNA, 22 bp, Homo sapiens
aatctgtcacgtagaacttgga

SEQ ID NO: 4540073 - DNA, 19 bp, Homo sapiens
aatctgtgacctgtcagaa

SEQ ID NO: 4540074 - DNA, 21 bp, Homo sapiens
aatctgtgacctgtcagaata

SEQ ID NO: 4540075 - DNA, 16 bp, Homo sapiens
aatctgtgcaaacagt

SEQ ID NO: 4540076 - DNA, 20 bp, Homo sapiens
aatctgtgtgaaactttcat

SEQ ID NO: 4540077 - DNA, 21 bp, Homo sapiens
aatctgtgtgcatatttgtta

SEQ ID NO: 4540078 - DNA, 20 bp, Homo sapiens
aatctgtttctctgctgtca

SEQ ID NO: 4540079 - DNA, 14 bp, Homo sapiens
aatcttaaagacaa

SEQ ID NO: 4540080 - DNA, 14 bp, Homo sapiens
aatcttagataact

SEQ ID NO: 4540081 - DNA, 23 bp, Homo sapiens
aatcttagtatagtagaaagaca

SEQ ID NO: 4540082 - DNA, 17 bp, Homo sapiens
aatcttatttttcctgt

SEQ ID NO: 4540083 - DNA, 21 bp, Homo sapiens
aatcttatttttcctgtcctg

SEQ ID NO: 4540084 - DNA, 14 bp, Homo sapiens
aatcttgaaattaa

SEQ ID NO: 4540085 - DNA, 12 bp, Homo sapiens
aatcttgctgtt

SEQ ID NO: 4540086 - DNA, 17 bp, Homo sapiens
aatcttggagctgcttg

SEQ ID NO: 4540087 - DNA, 12 bp, Homo sapiens
aatcttgttact

SEQ ID NO: 4540088 - DNA, 22 bp, Homo sapiens
aatcttgttactgctgattctt

SEQ ID NO: 4540089 - DNA, 13 bp, Homo sapiens
aatcttgttttga

SEQ ID NO: 4540090 - DNA, 14 bp, Homo sapiens
aatcttgttttgaa

SEQ ID NO: 4540091 - DNA, 16 bp, Homo sapiens
aatctttataaatgta

SEQ ID NO: 4540092 - DNA, 12 bp, Homo sapiens
aatctttcaaaa

SEQ ID NO: 4540093 - DNA, 21 bp, Homo sapiens
aatctttcaaaccagcttcat

SEQ ID NO: 4540094 - DNA, 13 bp, Homo sapiens
aatctttcatgtc

SEQ ID NO: 4540095 - DNA, 13 bp, Homo sapiens
aatctttccaaat

SEQ ID NO: 4540096 - DNA, 16 bp, Homo sapiens
aatctttgtgacagga

SEQ ID NO: 4540097 - DNA, 15 bp, Homo sapiens
aatcttttacatttt

SEQ ID NO: 4540098 - DNA, 16 bp, Homo sapiens
aatcttttataggatt

SEQ ID NO: 4540099 - DNA, 13 bp, Homo sapiens
aatcttttcttat

SEQ ID NO: 4540100 - DNA, 17 bp, Homo sapiens
aatctttttatcccatt

SEQ ID NO: 4540101 - DNA, 20 bp, Homo sapiens
aatctttttgcttctacttt

SEQ ID NO: 4540102 - DNA, 14 bp, Homo sapiens
aatgaaaaattcca

SEQ ID NO: 4540103 - DNA, 15 bp, Homo sapiens
aatgaaaacaaataa

SEQ ID NO: 4540104 - DNA, 14 bp, Homo sapiens
aatgaaaacatgta

SEQ ID NO: 4540105 - DNA, 15 bp, Homo sapiens
aatgaaaacatgtac

SEQ ID NO: 4540106 - DNA, 18 bp, Homo sapiens
aatgaaaactctttgctg

SEQ ID NO: 4540107 - DNA, 21 bp, Homo sapiens
aatgaaaagtcgttttccaaa

SEQ ID NO: 4540108 - DNA, 16 bp, Homo sapiens
aatgaaaatgtcttgt

SEQ ID NO: 4540109 - DNA, 13 bp, Homo sapiens
aatgaaaatttta

SEQ ID NO: 4540110 - DNA, 16 bp, Homo sapiens
aatgaaacaaagagtt

SEQ ID NO: 4540111 - DNA, 23 bp, Homo sapiens
aatgaaacaaagagttcaagaaa

SEQ ID NO: 4540112 - DNA, 21 bp, Homo sapiens
aatgaaacagggaaaatgaag

SEQ ID NO: 4540113 - DNA, 23 bp, Homo sapiens
aatgaaagcataagcttaagcat

SEQ ID NO: 4540114 - DNA, 15 bp, Homo sapiens
aatgaaagtattggc

SEQ ID NO: 4540115 - DNA, 15 bp, Homo sapiens
aatgaaagtggtaat

SEQ ID NO: 4540116 - DNA, 19 bp, Homo sapiens
aatgaaataggagggaaac

SEQ ID NO: 4540117 - DNA, 23 bp, Homo sapiens
aatgaaataggagggaaaccttt

SEQ ID NO: 4540118 - DNA, 17 bp, Homo sapiens
aatgaaatgccaaagga

SEQ ID NO: 4540119 - DNA, 14 bp, Homo sapiens
aatgaaatgtatgc

SEQ ID NO: 4540120 - DNA, 17 bp, Homo sapiens
aatgaacaaaattattt

SEQ ID NO: 4540121 - DNA, 15 bp, Homo sapiens
aatgaacactctttt

SEQ ID NO: 4540122 - DNA, 18 bp, Homo sapiens
aatgaacactcttttgct

SEQ ID NO: 4540123 - DNA, 21 bp, Homo sapiens
aatgaacactcttttgcttta

SEQ ID NO: 4540124 - DNA, 22 bp, Homo sapiens
aatgaacagaacatagacagaa

SEQ ID NO: 4540125 - DNA, 18 bp, Homo sapiens
aatgaactgtccgtgaat

SEQ ID NO: 4540126 - DNA, 14 bp, Homo sapiens
aatgaactttaaaa

SEQ ID NO: 4540127 - DNA, 11 bp, Homo sapiens
aatgaagaaag

SEQ ID NO: 4540128 - DNA, 21 bp, Homo sapiens
aatgaagaaagggaggcccag

SEQ ID NO: 4540129 - DNA, 20 bp, Homo sapiens
aatgaagaactgttgcctaa

SEQ ID NO: 4540130 - DNA, 15 bp, Homo sapiens
aatgaagctttggtt

SEQ ID NO: 4540131 - DNA, 13 bp, Homo sapiens
aatgaaggaatta

SEQ ID NO: 4540132 - DNA, 23 bp, Homo sapiens
aatgaagtattacatgatttaaa

SEQ ID NO: 4540133 - DNA, 18 bp, Homo sapiens
aatgaatcgcaagttaac

SEQ ID NO: 4540134 - DNA, 15 bp, Homo sapiens
aatgaatgaatgaat

SEQ ID NO: 4540135 - DNA, 20 bp, Homo sapiens
aatgaatgattaaattatga

SEQ ID NO: 4540136 - DNA, 13 bp, Homo sapiens
aatgaatgattct

SEQ ID NO: 4540137 - DNA, 17 bp, Homo sapiens
aatgaattcctagaatt

SEQ ID NO: 4540138 - DNA, 18 bp, Homo sapiens
aatgaattgaaaaacaat

SEQ ID NO: 4540139 - DNA, 15 bp, Homo sapiens
aatgaatttatcttt

SEQ ID NO: 4540140 - DNA, 12 bp, Homo sapiens
aatgacaacact

SEQ ID NO: 4540141 - DNA, 18 bp, Homo sapiens
aatgacagatttctgtaa

SEQ ID NO: 4540142 - DNA, 15 bp, Homo sapiens
aatgacagtcaaaag

SEQ ID NO: 4540143 - DNA, 21 bp, Homo sapiens
aatgacatacgcttttaatga

SEQ ID NO: 4540144 - DNA, 16 bp, Homo sapiens
aatgaccatgttatat

SEQ ID NO: 4540145 - DNA, 22 bp, Homo sapiens
aatgaccttcattctgagacca

SEQ ID NO: 4540146 - DNA, 15 bp, Homo sapiens
aatgactatataatt

SEQ ID NO: 4540147 - DNA, 14 bp, Homo sapiens
aatgactggctcct

SEQ ID NO: 4540148 - DNA, 15 bp, Homo sapiens
aatgactggctcctg

SEQ ID NO: 4540149 - DNA, 13 bp, Homo sapiens
aatgactgtggtg

SEQ ID NO: 4540150 - DNA, 22 bp, Homo sapiens
aatgacttatttctgctctgga

SEQ ID NO: 4540151 - DNA, 21 bp, Homo sapiens
aatgacttgtacaaacagtat

SEQ ID NO: 4540152 - DNA, 16 bp, Homo sapiens
aatgagaaaggacaga

SEQ ID NO: 4540153 - DNA, 14 bp, Homo sapiens
aatgagaaccaaca

SEQ ID NO: 4540154 - DNA, 15 bp, Homo sapiens
aatgagaaggcagcc

SEQ ID NO: 4540155 - DNA, 14 bp, Homo sapiens
aatgagaatagaaa

SEQ ID NO: 4540156 - DNA, 14 bp, Homo sapiens
aatgagacatccag

SEQ ID NO: 4540157 - DNA, 16 bp, Homo sapiens
aatgagccctggctcc

SEQ ID NO: 4540158 - DNA, 19 bp, Homo sapiens
aatgagccctggctcccac

SEQ ID NO: 4540159 - DNA, 18 bp, Homo sapiens
aatgagctattaaaactc

SEQ ID NO: 4540160 - DNA, 17 bp, Homo sapiens
aatgaggccggacagag

SEQ ID NO: 4540161 - DNA, 23 bp, Homo sapiens
aatgaggtgggaggtggaagaag

SEQ ID NO: 4540162 - DNA, 22 bp, Homo sapiens
aatgaggtttttccaaacttag

SEQ ID NO: 4540163 - DNA, 16 bp, Homo sapiens
aatgagtcatttgttt

SEQ ID NO: 4540164 - DNA, 19 bp, Homo sapiens
aatgagtcatttgtttaaa

SEQ ID NO: 4540165 - DNA, 19 bp, Homo sapiens
aatgagtctgtaattttac

SEQ ID NO: 4540166 - DNA, 16 bp, Homo sapiens
aatgagtgaattgaat

SEQ ID NO: 4540167 - DNA, 17 bp, Homo sapiens
aatgagtttaaaaatca

SEQ ID NO: 4540168 - DNA, 21 bp, Homo sapiens
aatgagtttttatggggctga

SEQ ID NO: 4540169 - DNA, 14 bp, Homo sapiens
aatgataaaacacc

SEQ ID NO: 4540170 - DNA, 14 bp, Homo sapiens
aatgatagacatat

SEQ ID NO: 4540171 - DNA, 16 bp, Homo sapiens
aatgatattgctgaag

SEQ ID NO: 4540172 - DNA, 20 bp, Homo sapiens
aatgatcacatctaaagctt

SEQ ID NO: 4540173 - DNA, 17 bp, Homo sapiens
aatgatcctcccacctc

SEQ ID NO: 4540174 - DNA, 12 bp, Homo sapiens
aatgatctattc

SEQ ID NO: 4540175 - DNA, 21 bp, Homo sapiens
aatgatgatgatgatgatgaa

SEQ ID NO: 4540176 - DNA, 15 bp, Homo sapiens
aatgatgattatgga

SEQ ID NO: 4540177 - DNA, 22 bp, Homo sapiens
aatgatgattgaactggaataa

SEQ ID NO: 4540178 - DNA, 22 bp, Homo sapiens
aatgatggatcaccattatatt

SEQ ID NO: 4540179 - DNA, 13 bp, Homo sapiens
aatgattaaatta

SEQ ID NO: 4540180 - DNA, 19 bp, Homo sapiens
aatgattaagggacatttc

SEQ ID NO: 4540181 - DNA, 21 bp, Homo sapiens
aatgattaagggacatttcta

SEQ ID NO: 4540182 - DNA, 23 bp, Homo sapiens
aatgattaagggacatttctata

SEQ ID NO: 4540183 - DNA, 18 bp, Homo sapiens
aatgattatattcacaga

SEQ ID NO: 4540184 - DNA, 20 bp, Homo sapiens
aatgattcaaattgctgctt

SEQ ID NO: 4540185 - DNA, 21 bp, Homo sapiens
aatgattcaaattgctgcttg

SEQ ID NO: 4540186 - DNA, 14 bp, Homo sapiens
aatgattcagtgtt

SEQ ID NO: 4540187 - DNA, 20 bp, Homo sapiens
aatgattggttaaaatgtga

SEQ ID NO: 4540188 - DNA, 15 bp, Homo sapiens
aatgattgtagtaat

SEQ ID NO: 4540189 - DNA, 18 bp, Homo sapiens
aatgatttccaaagagaa

SEQ ID NO: 4540190 - DNA, 19 bp, Homo sapiens
aatgcaaatttctataaat

SEQ ID NO: 4540191 - DNA, 21 bp, Homo sapiens
aatgcaagattttccacaaga

SEQ ID NO: 4540192 - DNA, 16 bp, Homo sapiens
aatgcaaggggctgca

SEQ ID NO: 4540193 - DNA, 13 bp, Homo sapiens
aatgcaataactc

SEQ ID NO: 4540194 - DNA, 14 bp, Homo sapiens
aatgcaataactct

SEQ ID NO: 4540195 - DNA, 12 bp, Homo sapiens
aatgcacaaaca

SEQ ID NO: 4540196 - DNA, 23 bp, Homo sapiens
aatgcaccaatcttgtttatagc

SEQ ID NO: 4540197 - DNA, 16 bp, Homo sapiens
aatgcaccatggagac

SEQ ID NO: 4540198 - DNA, 18 bp, Homo sapiens
aatgcacccatcagcact

SEQ ID NO: 4540199 - DNA, 15 bp, Homo sapiens
aatgcacctaaagaa

SEQ ID NO: 4540200 - DNA, 22 bp, Homo sapiens
aatgcactgatgtgtgaagtga

SEQ ID NO: 4540201 - DNA, 16 bp, Homo sapiens
aatgcacttctattta

SEQ ID NO: 4540202 - DNA, 11 bp, Homo sapiens
aatgcactttc

SEQ ID NO: 4540203 - DNA, 15 bp, Homo sapiens
aatgcactttctatc

SEQ ID NO: 4540204 - DNA, 22 bp, Homo sapiens
aatgcactttctatcctctgta

SEQ ID NO: 4540205 - DNA, 20 bp, Homo sapiens
aatgcacttttatgaagttt

SEQ ID NO: 4540206 - DNA, 20 bp, Homo sapiens
aatgcagacaacaccttcct

SEQ ID NO: 4540207 - DNA, 19 bp, Homo sapiens
aatgcagcaggaaggaaca

SEQ ID NO: 4540208 - DNA, 17 bp, Homo sapiens
aatgcagtatggtacat

SEQ ID NO: 4540209 - DNA, 19 bp, Homo sapiens
aatgcagtatggtacattt

SEQ ID NO: 4540210 - DNA, 15 bp, Homo sapiens
aatgcagtttttaaa

SEQ ID NO: 4540211 - DNA, 14 bp, Homo sapiens
aatgcataaatgca

SEQ ID NO: 4540212 - DNA, 21 bp, Homo sapiens
aatgcataattggcaaaaaaa

SEQ ID NO: 4540213 - DNA, 17 bp, Homo sapiens
aatgcataatttatggt

SEQ ID NO: 4540214 - DNA, 18 bp, Homo sapiens
aatgcattccagaacaaa

SEQ ID NO: 4540215 - DNA, 10 bp, Homo sapiens
aatgcattgt

SEQ ID NO: 4540216 - DNA, 16 bp, Homo sapiens
aatgcattgttgtaaa

SEQ ID NO: 4540217 - DNA, 22 bp, Homo sapiens
aatgcattgttgtaaagtattt

SEQ ID NO: 4540218 - DNA, 17 bp, Homo sapiens
aatgccaaaatgtactt

SEQ ID NO: 4540219 - DNA, 14 bp, Homo sapiens
aatgccaaaggaag

SEQ ID NO: 4540220 - DNA, 15 bp, Homo sapiens
aatgccaccaaagga

SEQ ID NO: 4540221 - DNA, 20 bp, Homo sapiens
aatgccaggcggacaaagtt

SEQ ID NO: 4540222 - DNA, 17 bp, Homo sapiens
aatgcccatttttgcta

SEQ ID NO: 4540223 - DNA, 15 bp, Homo sapiens
aatgccgaatttggt

SEQ ID NO: 4540224 - DNA, 18 bp, Homo sapiens
aatgccggttaaattcca

SEQ ID NO: 4540225 - DNA, 14 bp, Homo sapiens
aatgcctcagctat

SEQ ID NO: 4540226 - DNA, 21 bp, Homo sapiens
aatgcctgctttttggaaagt

SEQ ID NO: 4540227 - DNA, 17 bp, Homo sapiens
aatgccttgttgtattc

SEQ ID NO: 4540228 - DNA, 23 bp, Homo sapiens
aatgcctttgtaaccacaacttt

SEQ ID NO: 4540229 - DNA, 15 bp, Homo sapiens
aatgccttttcccaa

SEQ ID NO: 4540230 - DNA, 21 bp, Homo sapiens
aatgcctttttagatgtattt

SEQ ID NO: 4540231 - DNA, 16 bp, Homo sapiens
aatgctatttgaacaa

SEQ ID NO: 4540232 - DNA, 23 bp, Homo sapiens
aatgctatttttgtttttagaat

SEQ ID NO: 4540233 - DNA, 18 bp, Homo sapiens
aatgctcaatttcagcac

SEQ ID NO: 4540234 - DNA, 12 bp, Homo sapiens
aatgctcccagc

SEQ ID NO: 4540235 - DNA, 15 bp, Homo sapiens
aatgctcccagctgt

SEQ ID NO: 4540236 - DNA, 19 bp, Homo sapiens
aatgctcccagctgtgctg

SEQ ID NO: 4540237 - DNA, 20 bp, Homo sapiens
aatgctccccacagcgtccc

SEQ ID NO: 4540238 - DNA, 18 bp, Homo sapiens
aatgctgctgtcagacga

SEQ ID NO: 4540239 - DNA, 18 bp, Homo sapiens
aatgctggtttttcagtt

SEQ ID NO: 4540240 - DNA, 12 bp, Homo sapiens
aatgctgtacat

SEQ ID NO: 4540241 - DNA, 15 bp, Homo sapiens
aatgctgtacatcta

SEQ ID NO: 4540242 - DNA, 18 bp, Homo sapiens
aatgctgtgggtttccaa

SEQ ID NO: 4540243 - DNA, 16 bp, Homo sapiens
aatgctgttgcctcat

SEQ ID NO: 4540244 - DNA, 16 bp, Homo sapiens
aatgcttaaaaaataa

SEQ ID NO: 4540245 - DNA, 17 bp, Homo sapiens
aatgcttaaatttcaga

SEQ ID NO: 4540246 - DNA, 15 bp, Homo sapiens
aatgcttattgatga

SEQ ID NO: 4540247 - DNA, 17 bp, Homo sapiens
aatgcttcattgaaagc

SEQ ID NO: 4540248 - DNA, 14 bp, Homo sapiens
aatgctttggaaaa

SEQ ID NO: 4540249 - DNA, 20 bp, Homo sapiens
aatgctttttatttctgcat

SEQ ID NO: 4540250 - DNA, 20 bp, Homo sapiens
aatggaaaatgccatgaatt

SEQ ID NO: 4540251 - DNA, 14 bp, Homo sapiens
aatggaaagctttt

SEQ ID NO: 4540252 - DNA, 14 bp, Homo sapiens
aatggaaatttata

SEQ ID NO: 4540253 - DNA, 16 bp, Homo sapiens
aatggaaattttgcta

SEQ ID NO: 4540254 - DNA, 17 bp, Homo sapiens
aatggaaattttgctat

SEQ ID NO: 4540255 - DNA, 19 bp, Homo sapiens
aatggaacagatttcaaaa

SEQ ID NO: 4540256 - DNA, 21 bp, Homo sapiens
aatggaacagatttcaaaaaa

SEQ ID NO: 4540257 - DNA, 21 bp, Homo sapiens
aatggaagatttgcccattta

SEQ ID NO: 4540258 - DNA, 22 bp, Homo sapiens
aatggaccctttttgttatgat

SEQ ID NO: 4540259 - DNA, 20 bp, Homo sapiens
aatggactaaaacattttga

SEQ ID NO: 4540260 - DNA, 16 bp, Homo sapiens
aatggactgaccttaa

SEQ ID NO: 4540261 - DNA, 18 bp, Homo sapiens
aatggactttgcacactt

SEQ ID NO: 4540262 - DNA, 17 bp, Homo sapiens
aatggagcatcaagcca

SEQ ID NO: 4540263 - DNA, 17 bp, Homo sapiens
aatggaggaagaacaac

SEQ ID NO: 4540264 - DNA, 16 bp, Homo sapiens
aatggatacataaaga

SEQ ID NO: 4540265 - DNA, 17 bp, Homo sapiens
aatggatgccttgaata

SEQ ID NO: 4540266 - DNA, 18 bp, Homo sapiens
aatggatttttctttaac

SEQ ID NO: 4540267 - DNA, 20 bp, Homo sapiens
aatggatttttctttaactg

SEQ ID NO: 4540268 - DNA, 20 bp, Homo sapiens
aatggcaaaagatccaggag

SEQ ID NO: 4540269 - DNA, 15 bp, Homo sapiens
aatggcacttttgat

SEQ ID NO: 4540270 - DNA, 16 bp, Homo sapiens
aatggcagctagtgcc

SEQ ID NO: 4540271 - DNA, 21 bp, Homo sapiens
aatggccagagcctctggccc

SEQ ID NO: 4540272 - DNA, 14 bp, Homo sapiens
aatggctatgtttt

SEQ ID NO: 4540273 - DNA, 20 bp, Homo sapiens
aatggctatgtttttaatgt

SEQ ID NO: 4540274 - DNA, 20 bp, Homo sapiens
aatggctatttttgaagcaa

SEQ ID NO: 4540275 - DNA, 17 bp, Homo sapiens
aatggctgataatttta

SEQ ID NO: 4540276 - DNA, 19 bp, Homo sapiens
aatggctgataattttaaa

SEQ ID NO: 4540277 - DNA, 17 bp, Homo sapiens
aatggctgtaatcattt

SEQ ID NO: 4540278 - DNA, 15 bp, Homo sapiens
aatggctttgtactt

SEQ ID NO: 4540279 - DNA, 17 bp, Homo sapiens
aatgggaattgcgctca

SEQ ID NO: 4540280 - DNA, 19 bp, Homo sapiens
aatgggagaggcaataaat

SEQ ID NO: 4540281 - DNA, 16 bp, Homo sapiens
aatgggagctgagcag

SEQ ID NO: 4540282 - DNA, 22 bp, Homo sapiens
aatgggatggtcggatctcaca

SEQ ID NO: 4540283 - DNA, 20 bp, Homo sapiens
aatgggcattttacaagaag

SEQ ID NO: 4540284 - DNA, 22 bp, Homo sapiens
aatgggggcagtctccccttcc

SEQ ID NO: 4540285 - DNA, 23 bp, Homo sapiens
aatgggggcagtctccccttcct

SEQ ID NO: 4540286 - DNA, 19 bp, Homo sapiens
aatgggtaagggagggaag

SEQ ID NO: 4540287 - DNA, 13 bp, Homo sapiens
aatgggtctttta

SEQ ID NO: 4540288 - DNA, 16 bp, Homo sapiens
aatggtatcaaaatta

SEQ ID NO: 4540289 - DNA, 18 bp, Homo sapiens
aatggtatcaaaattaca

SEQ ID NO: 4540290 - DNA, 15 bp, Homo sapiens
aatggtcctgacttt

SEQ ID NO: 4540291 - DNA, 14 bp, Homo sapiens
aatggtctctgtca

SEQ ID NO: 4540292 - DNA, 13 bp, Homo sapiens
aatggtgctgttt

SEQ ID NO: 4540293 - DNA, 22 bp, Homo sapiens
aatggtggcttcttttctttgt

SEQ ID NO: 4540294 - DNA, 22 bp, Homo sapiens
aatggtgtgaacccgggagcgg

SEQ ID NO: 4540295 - DNA, 18 bp, Homo sapiens
aatggttatgtgcattat

SEQ ID NO: 4540296 - DNA, 23 bp, Homo sapiens
aatggtttggtgctttttataaa

SEQ ID NO: 4540297 - DNA, 13 bp, Homo sapiens
aatggtttttaaa

SEQ ID NO: 4540298 - DNA, 17 bp, Homo sapiens
aatggtttttaaatttt

SEQ ID NO: 4540299 - DNA, 19 bp, Homo sapiens
aatgtaaaaaagaaaaaac

SEQ ID NO: 4540300 - DNA, 19 bp, Homo sapiens
aatgtaaactctcttctct

SEQ ID NO: 4540301 - DNA, 21 bp, Homo sapiens
aatgtaaaggagtcaaaacta

SEQ ID NO: 4540302 - DNA, 12 bp, Homo sapiens
aatgtaaataaa

SEQ ID NO: 4540303 - DNA, 16 bp, Homo sapiens
aatgtaaataaaacat

SEQ ID NO: 4540304 - DNA, 19 bp, Homo sapiens
aatgtaaataaaacatcac

SEQ ID NO: 4540305 - DNA, 21 bp, Homo sapiens
aatgtaaataaaacatcacta

SEQ ID NO: 4540306 - DNA, 15 bp, Homo sapiens
aatgtaaataaacta

SEQ ID NO: 4540307 - DNA, 20 bp, Homo sapiens
aatgtaaatattttaaagaa

SEQ ID NO: 4540308 - DNA, 21 bp, Homo sapiens
aatgtaagttgagaaaaattt

SEQ ID NO: 4540309 - DNA, 13 bp, Homo sapiens
aatgtaataaagt

SEQ ID NO: 4540310 - DNA, 17 bp, Homo sapiens
aatgtaataaagtgaac

SEQ ID NO: 4540311 - DNA, 17 bp, Homo sapiens
aatgtaatataatgtat

SEQ ID NO: 4540312 - DNA, 22 bp, Homo sapiens
aatgtaatataatgtattttct

SEQ ID NO: 4540313 - DNA, 23 bp, Homo sapiens
aatgtaatttgtgtaataaagtg

SEQ ID NO: 4540314 - DNA, 12 bp, Homo sapiens
aatgtacaatta

SEQ ID NO: 4540315 - DNA, 22 bp, Homo sapiens
aatgtacaattatgtctcttga

SEQ ID NO: 4540316 - DNA, 22 bp, Homo sapiens
aatgtacaccacatgctattgt

SEQ ID NO: 4540317 - DNA, 14 bp, Homo sapiens
aatgtacacttttt

SEQ ID NO: 4540318 - DNA, 21 bp, Homo sapiens
aatgtacactttttacagcag

SEQ ID NO: 4540319 - DNA, 15 bp, Homo sapiens
aatgtacagacatat

SEQ ID NO: 4540320 - DNA, 17 bp, Homo sapiens
aatgtacagttgaaata

SEQ ID NO: 4540321 - DNA, 18 bp, Homo sapiens
aatgtacagttgagctca

SEQ ID NO: 4540322 - DNA, 16 bp, Homo sapiens
aatgtacatgaagcaa

SEQ ID NO: 4540323 - DNA, 16 bp, Homo sapiens
aatgtactatgtctga

SEQ ID NO: 4540324 - DNA, 18 bp, Homo sapiens
aatgtactatgtctgaac

SEQ ID NO: 4540325 - DNA, 19 bp, Homo sapiens
aatgtactgatttcagtaa

SEQ ID NO: 4540326 - DNA, 16 bp, Homo sapiens
aatgtacttaaatgag

SEQ ID NO: 4540327 - DNA, 17 bp, Homo sapiens
aatgtacttaaatgagt

SEQ ID NO: 4540328 - DNA, 22 bp, Homo sapiens
aatgtacttaaatgagttactt

SEQ ID NO: 4540329 - DNA, 17 bp, Homo sapiens
aatgtagaataggcagg

SEQ ID NO: 4540330 - DNA, 18 bp, Homo sapiens
aatgtaggcacttttatt

SEQ ID NO: 4540331 - DNA, 20 bp, Homo sapiens
aatgtaggcacttttatttt

SEQ ID NO: 4540332 - DNA, 19 bp, Homo sapiens
aatgtagttatctattgaa

SEQ ID NO: 4540333 - DNA, 20 bp, Homo sapiens
aatgtataaaaattatcaaa

SEQ ID NO: 4540334 - DNA, 18 bp, Homo sapiens
aatgtatacaatgcactt

SEQ ID NO: 4540335 - DNA, 21 bp, Homo sapiens
aatgtatacaatgcactttta

SEQ ID NO: 4540336 - DNA, 13 bp, Homo sapiens
aatgtatagtaaa

SEQ ID NO: 4540337 - DNA, 15 bp, Homo sapiens
aatgtatataaaaat

SEQ ID NO: 4540338 - DNA, 14 bp, Homo sapiens
aatgtatatgcact

SEQ ID NO: 4540339 - DNA, 20 bp, Homo sapiens
aatgtatcattcagtgtaaa

SEQ ID NO: 4540340 - DNA, 20 bp, Homo sapiens
aatgtatctatttgtacaat

SEQ ID NO: 4540341 - DNA, 13 bp, Homo sapiens
aatgtatctgcat

SEQ ID NO: 4540342 - DNA, 14 bp, Homo sapiens
aatgtatgtaaata

SEQ ID NO: 4540343 - DNA, 23 bp, Homo sapiens
aatgtattaagcccacagtatat

SEQ ID NO: 4540344 - DNA, 17 bp, Homo sapiens
aatgtattcctttaaaa

SEQ ID NO: 4540345 - DNA, 20 bp, Homo sapiens
aatgtattcctttaaaatat

SEQ ID NO: 4540346 - DNA, 21 bp, Homo sapiens
aatgtattcctttaaaatatt

SEQ ID NO: 4540347 - DNA, 18 bp, Homo sapiens
aatgtcaccaccttccca

SEQ ID NO: 4540348 - DNA, 17 bp, Homo sapiens
aatgtcactatatcttc

SEQ ID NO: 4540349 - DNA, 16 bp, Homo sapiens
aatgtcagtatgtgga

SEQ ID NO: 4540350 - DNA, 22 bp, Homo sapiens
aatgtcagtatgtggaagtgtg

SEQ ID NO: 4540351 - DNA, 18 bp, Homo sapiens
aatgtcagtgtttgggaa

SEQ ID NO: 4540352 - DNA, 20 bp, Homo sapiens
aatgtcagttgttatttatt

SEQ ID NO: 4540353 - DNA, 14 bp, Homo sapiens
aatgtcattgaaaa

SEQ ID NO: 4540354 - DNA, 19 bp, Homo sapiens
aatgtcattgaaaaactaa

SEQ ID NO: 4540355 - DNA, 13 bp, Homo sapiens
aatgtcattgtct

SEQ ID NO: 4540356 - DNA, 14 bp, Homo sapiens
aatgtcattgtcta

SEQ ID NO: 4540357 - DNA, 18 bp, Homo sapiens
aatgtcccctcaaactca

SEQ ID NO: 4540358 - DNA, 20 bp, Homo sapiens
aatgtcccctcaaactcatt

SEQ ID NO: 4540359 - DNA, 22 bp, Homo sapiens
aatgtcctaacagagaaataga

SEQ ID NO: 4540360 - DNA, 18 bp, Homo sapiens
aatgtctctgtgagactc

SEQ ID NO: 4540361 - DNA, 17 bp, Homo sapiens
aatgtctgaagtacaaa

SEQ ID NO: 4540362 - DNA, 17 bp, Homo sapiens
aatgtcttgctgttgac

SEQ ID NO: 4540363 - DNA, 22 bp, Homo sapiens
aatgtcttgctgttgacatatt

SEQ ID NO: 4540364 - DNA, 13 bp, Homo sapiens
aatgtgaaaaact

SEQ ID NO: 4540365 - DNA, 17 bp, Homo sapiens
aatgtgaaaaaggaata

SEQ ID NO: 4540366 - DNA, 18 bp, Homo sapiens
aatgtgaaaaatctgctg

SEQ ID NO: 4540367 - DNA, 22 bp, Homo sapiens
aatgtgaaaatggtccaggaga

SEQ ID NO: 4540368 - DNA, 13 bp, Homo sapiens
aatgtgaaagcac

SEQ ID NO: 4540369 - DNA, 13 bp, Homo sapiens
aatgtgaaatgct

SEQ ID NO: 4540370 - DNA, 15 bp, Homo sapiens
aatgtgaaatgcttt

SEQ ID NO: 4540371 - DNA, 15 bp, Homo sapiens
aatgtgaggcaataa

SEQ ID NO: 4540372 - DNA, 17 bp, Homo sapiens
aatgtgagtagttacta

SEQ ID NO: 4540373 - DNA, 11 bp, Homo sapiens
aatgtgatatg

SEQ ID NO: 4540374 - DNA, 16 bp, Homo sapiens
aatgtgatcatatgag

SEQ ID NO: 4540375 - DNA, 21 bp, Homo sapiens
aatgtgatcatatgaggacct

SEQ ID NO: 4540376 - DNA, 14 bp, Homo sapiens
aatgtgatctatgt

SEQ ID NO: 4540377 - DNA, 19 bp, Homo sapiens
aatgtgatctatgtttcat

SEQ ID NO: 4540378 - DNA, 16 bp, Homo sapiens
aatgtgatgaatactg

SEQ ID NO: 4540379 - DNA, 17 bp, Homo sapiens
aatgtgcaatagaaggt

SEQ ID NO: 4540380 - DNA, 19 bp, Homo sapiens
aatgtgcagaaaatattta

SEQ ID NO: 4540381 - DNA, 16 bp, Homo sapiens
aatgtgcagggatatt

SEQ ID NO: 4540382 - DNA, 21 bp, Homo sapiens
aatgtgcagggatattgcctt

SEQ ID NO: 4540383 - DNA, 22 bp, Homo sapiens
aatgtgctcaaattactaatga

SEQ ID NO: 4540384 - DNA, 14 bp, Homo sapiens
aatgtggcagttta

SEQ ID NO: 4540385 - DNA, 18 bp, Homo sapiens
aatgtggctgtaaaactt

SEQ ID NO: 4540386 - DNA, 16 bp, Homo sapiens
aatgtggcttgagaaa

SEQ ID NO: 4540387 - DNA, 21 bp, Homo sapiens
aatgtggcttgagaaatatgg

SEQ ID NO: 4540388 - DNA, 21 bp, Homo sapiens
aatgtggtgacacctccccct

SEQ ID NO: 4540389 - DNA, 22 bp, Homo sapiens
aatgtgtacatgtagttgaatt

SEQ ID NO: 4540390 - DNA, 16 bp, Homo sapiens
aatgtgtataaattgt

SEQ ID NO: 4540391 - DNA, 18 bp, Homo sapiens
aatgtgtataaattgtct

SEQ ID NO: 4540392 - DNA, 13 bp, Homo sapiens
aatgtgtatttct

SEQ ID NO: 4540393 - DNA, 18 bp, Homo sapiens
aatgtgtctgtgttgctt

SEQ ID NO: 4540394 - DNA, 18 bp, Homo sapiens
aatgtgtctttctaagaa

SEQ ID NO: 4540395 - DNA, 23 bp, Homo sapiens
aatgtgtgtattcttaaaatgca

SEQ ID NO: 4540396 - DNA, 23 bp, Homo sapiens
aatgtgttagcactgatagtcct

SEQ ID NO: 4540397 - DNA, 20 bp, Homo sapiens
aatgtgttcttttctccttt

SEQ ID NO: 4540398 - DNA, 17 bp, Homo sapiens
aatgtgttttgtctttt

SEQ ID NO: 4540399 - DNA, 16 bp, Homo sapiens
aatgtgtttttctcca

SEQ ID NO: 4540400 - DNA, 22 bp, Homo sapiens
aatgtgtttttctccagtgctg

SEQ ID NO: 4540401 - DNA, 21 bp, Homo sapiens
aatgttaaggacttctgcagc

SEQ ID NO: 4540402 - DNA, 13 bp, Homo sapiens
aatgttaattttt

SEQ ID NO: 4540403 - DNA, 13 bp, Homo sapiens
aatgttactgcct

SEQ ID NO: 4540404 - DNA, 17 bp, Homo sapiens
aatgttactgccttaat

SEQ ID NO: 4540405 - DNA, 13 bp, Homo sapiens
aatgttagatatt

SEQ ID NO: 4540406 - DNA, 22 bp, Homo sapiens
aatgttagatgcttagtgtgaa

SEQ ID NO: 4540407 - DNA, 23 bp, Homo sapiens
aatgttatcttatactgtacaat

SEQ ID NO: 4540408 - DNA, 16 bp, Homo sapiens
aatgttatgccagctc

SEQ ID NO: 4540409 - DNA, 16 bp, Homo sapiens
aatgttattgtgtata

SEQ ID NO: 4540410 - DNA, 21 bp, Homo sapiens
aatgttattttcttctaagtg

SEQ ID NO: 4540411 - DNA, 20 bp, Homo sapiens
aatgttcatcaatgaatgaa

SEQ ID NO: 4540412 - DNA, 22 bp, Homo sapiens
aatgttcattgtagattttgtt

SEQ ID NO: 4540413 - DNA, 20 bp, Homo sapiens
aatgttccttttttgtatat

SEQ ID NO: 4540414 - DNA, 21 bp, Homo sapiens
aatgttccttttttgtatatt

SEQ ID NO: 4540415 - DNA, 13 bp, Homo sapiens
aatgttcttggtg

SEQ ID NO: 4540416 - DNA, 15 bp, Homo sapiens
aatgttcttggtgtt

SEQ ID NO: 4540417 - DNA, 11 bp, Homo sapiens
aatgttctttg

SEQ ID NO: 4540418 - DNA, 20 bp, Homo sapiens
aatgttctttggaaagtaca

SEQ ID NO: 4540419 - DNA, 22 bp, Homo sapiens
aatgttctttggaaagtacact

SEQ ID NO: 4540420 - DNA, 17 bp, Homo sapiens
aatgttgaaaagtaatt

SEQ ID NO: 4540421 - DNA, 22 bp, Homo sapiens
aatgttgaaatatgatgttaaa

SEQ ID NO: 4540422 - DNA, 13 bp, Homo sapiens
aatgttgctggat

SEQ ID NO: 4540423 - DNA, 19 bp, Homo sapiens
aatgttgtatcatactctt

SEQ ID NO: 4540424 - DNA, 21 bp, Homo sapiens
aatgttgttgtctatttgtct

SEQ ID NO: 4540425 - DNA, 12 bp, Homo sapiens
aatgttgtttcc

SEQ ID NO: 4540426 - DNA, 22 bp, Homo sapiens
aatgttgtttcctaatatcaaa

SEQ ID NO: 4540427 - DNA, 23 bp, Homo sapiens
aatgttgtttcctaatatcaaat

SEQ ID NO: 4540428 - DNA, 20 bp, Homo sapiens
aatgtttactaagtggactg

SEQ ID NO: 4540429 - DNA, 14 bp, Homo sapiens
aatgtttactgtat

SEQ ID NO: 4540430 - DNA, 19 bp, Homo sapiens
aatgtttatggaaatatta

SEQ ID NO: 4540431 - DNA, 15 bp, Homo sapiens
aatgtttcatttgca

SEQ ID NO: 4540432 - DNA, 23 bp, Homo sapiens
aatgttttaaagtttaatgccta

SEQ ID NO: 4540433 - DNA, 16 bp, Homo sapiens
aatgttttaaatgtac

SEQ ID NO: 4540434 - DNA, 19 bp, Homo sapiens
aatgttttatgacattttt

SEQ ID NO: 4540435 - DNA, 21 bp, Homo sapiens
aatgttttatgacatttttct

SEQ ID NO: 4540436 - DNA, 13 bp, Homo sapiens
aatgttttcattt

SEQ ID NO: 4540437 - DNA, 16 bp, Homo sapiens
aatgttttccaatatt

SEQ ID NO: 4540438 - DNA, 22 bp, Homo sapiens
aatgttttccaatattttaata

SEQ ID NO: 4540439 - DNA, 22 bp, Homo sapiens
aatgttttctttgcaaagtatt

SEQ ID NO: 4540440 - DNA, 11 bp, Homo sapiens
aatgtttttaa

SEQ ID NO: 4540441 - DNA, 16 bp, Homo sapiens
aattaaaaaaaaattg

SEQ ID NO: 4540442 - DNA, 17 bp, Homo sapiens
aattaaaaaaaaattgt

SEQ ID NO: 4540443 - DNA, 18 bp, Homo sapiens
aattaaaaaaaaattgta

SEQ ID NO: 4540444 - DNA, 17 bp, Homo sapiens
aattaaaaatgaaaatt

SEQ ID NO: 4540445 - DNA, 20 bp, Homo sapiens
aattaaaagcaaatcatttg

SEQ ID NO: 4540446 - DNA, 20 bp, Homo sapiens
aattaaaatgcccatttgtg

SEQ ID NO: 4540447 - DNA, 13 bp, Homo sapiens
aattaaaatggat

SEQ ID NO: 4540448 - DNA, 12 bp, Homo sapiens
aattaaaattgt

SEQ ID NO: 4540449 - DNA, 18 bp, Homo sapiens
aattaaaattgtgcataa

SEQ ID NO: 4540450 - DNA, 19 bp, Homo sapiens
aattaaacaatttatttta

SEQ ID NO: 4540451 - DNA, 16 bp, Homo sapiens
aattaaaccgcatgtg

SEQ ID NO: 4540452 - DNA, 19 bp, Homo sapiens
aattaaactacagaatatt

SEQ ID NO: 4540453 - DNA, 14 bp, Homo sapiens
aattaaagtacttt

SEQ ID NO: 4540454 - DNA, 11 bp, Homo sapiens
aattaaatagt

SEQ ID NO: 4540455 - DNA, 16 bp, Homo sapiens
aattaaatagtgtgat

SEQ ID NO: 4540456 - DNA, 17 bp, Homo sapiens
aattaaattttgtgtct

SEQ ID NO: 4540457 - DNA, 18 bp, Homo sapiens
aattaaattttgtgtctc

SEQ ID NO: 4540458 - DNA, 15 bp, Homo sapiens
aattaacatatgtca

SEQ ID NO: 4540459 - DNA, 20 bp, Homo sapiens
aattaaccccataattagat

SEQ ID NO: 4540460 - DNA, 16 bp, Homo sapiens
aattaaccgagacact

SEQ ID NO: 4540461 - DNA, 14 bp, Homo sapiens
aattaacttagttt

SEQ ID NO: 4540462 - DNA, 15 bp, Homo sapiens
aattaacttagtttt

SEQ ID NO: 4540463 - DNA, 18 bp, Homo sapiens
aattaagatcctaaactc

SEQ ID NO: 4540464 - DNA, 16 bp, Homo sapiens
aattaagcagaaacag

SEQ ID NO: 4540465 - DNA, 23 bp, Homo sapiens
aattaatagccaaagatttcata

SEQ ID NO: 4540466 - DNA, 13 bp, Homo sapiens
aattaatatcttt

SEQ ID NO: 4540467 - DNA, 16 bp, Homo sapiens
aattaatgaaatgata

SEQ ID NO: 4540468 - DNA, 14 bp, Homo sapiens
aattaatgtaataa

SEQ ID NO: 4540469 - DNA, 19 bp, Homo sapiens
aattaatgtaataaagtga

SEQ ID NO: 4540470 - DNA, 16 bp, Homo sapiens
aattacacttgtcttt

SEQ ID NO: 4540471 - DNA, 19 bp, Homo sapiens
aattacagcttttatggat

SEQ ID NO: 4540472 - DNA, 21 bp, Homo sapiens
aattacagcttttatggatga

SEQ ID NO: 4540473 - DNA, 16 bp, Homo sapiens
aattacagggtgactc

SEQ ID NO: 4540474 - DNA, 17 bp, Homo sapiens
aattacattttatatgt

SEQ ID NO: 4540475 - DNA, 15 bp, Homo sapiens
aattaccaacctgtt

SEQ ID NO: 4540476 - DNA, 13 bp, Homo sapiens
aattaccagtttt

SEQ ID NO: 4540477 - DNA, 19 bp, Homo sapiens
aattaccatagagtaatga

SEQ ID NO: 4540478 - DNA, 22 bp, Homo sapiens
aattaccatagagtaatgatgt

SEQ ID NO: 4540479 - DNA, 18 bp, Homo sapiens
aattaccatttgttaata

SEQ ID NO: 4540480 - DNA, 14 bp, Homo sapiens
aattaccttctatt

SEQ ID NO: 4540481 - DNA, 17 bp, Homo sapiens
aattacctttacatata

SEQ ID NO: 4540482 - DNA, 17 bp, Homo sapiens
aattactatagcaaagt

SEQ ID NO: 4540483 - DNA, 14 bp, Homo sapiens
aattactgcactct

SEQ ID NO: 4540484 - DNA, 15 bp, Homo sapiens
aattacttaaaaaaa

SEQ ID NO: 4540485 - DNA, 18 bp, Homo sapiens
aattactttattataaaa

SEQ ID NO: 4540486 - DNA, 23 bp, Homo sapiens
aattactttggggctaatttaac

SEQ ID NO: 4540487 - DNA, 14 bp, Homo sapiens
aattagaaaatatt

SEQ ID NO: 4540488 - DNA, 13 bp, Homo sapiens
aattagaaaatta

SEQ ID NO: 4540489 - DNA, 19 bp, Homo sapiens
aattagaaacaccattcat

SEQ ID NO: 4540490 - DNA, 19 bp, Homo sapiens
aattagaatgaatttatct

SEQ ID NO: 4540491 - DNA, 19 bp, Homo sapiens
aattagactgtgattcaga

SEQ ID NO: 4540492 - DNA, 20 bp, Homo sapiens
aattagactgtgattcagaa

SEQ ID NO: 4540493 - DNA, 13 bp, Homo sapiens
aattagatttgtg

SEQ ID NO: 4540494 - DNA, 21 bp, Homo sapiens
aattaggcagtgctaaagcct

SEQ ID NO: 4540495 - DNA, 17 bp, Homo sapiens
aattaggctgtaactac

SEQ ID NO: 4540496 - DNA, 18 bp, Homo sapiens
aattaggctgtaactact

SEQ ID NO: 4540497 - DNA, 21 bp, Homo sapiens
aattaggctgtaactacttta

SEQ ID NO: 4540498 - DNA, 17 bp, Homo sapiens
aattagtaacatgtgtt

SEQ ID NO: 4540499 - DNA, 13 bp, Homo sapiens
aattagtgaacca

SEQ ID NO: 4540500 - DNA, 20 bp, Homo sapiens
aattagtttgggttctctac

SEQ ID NO: 4540501 - DNA, 10 bp, Homo sapiens
aattataaaa

SEQ ID NO: 4540502 - DNA, 16 bp, Homo sapiens
aattataaaaaattaa

SEQ ID NO: 4540503 - DNA, 13 bp, Homo sapiens
aattataaatgac

SEQ ID NO: 4540504 - DNA, 13 bp, Homo sapiens
aattataaatgtg

SEQ ID NO: 4540505 - DNA, 20 bp, Homo sapiens
aattataactgtaaagatgt

SEQ ID NO: 4540506 - DNA, 17 bp, Homo sapiens
aattataaggactgcat

SEQ ID NO: 4540507 - DNA, 22 bp, Homo sapiens
aattatagtgatgtaatcttga

SEQ ID NO: 4540508 - DNA, 18 bp, Homo sapiens
aattatatgatatgcatg

SEQ ID NO: 4540509 - DNA, 20 bp, Homo sapiens
aattatcagcaaagaaaaaa

SEQ ID NO: 4540510 - DNA, 13 bp, Homo sapiens
aattatccaggaa

SEQ ID NO: 4540511 - DNA, 19 bp, Homo sapiens
aattatctaatttataaaa

SEQ ID NO: 4540512 - DNA, 22 bp, Homo sapiens
aattatctatagctaagtacac

SEQ ID NO: 4540513 - DNA, 21 bp, Homo sapiens
aattatgaagctcatatcctt

SEQ ID NO: 4540514 - DNA, 22 bp, Homo sapiens
aattatgggaataattgctttt

SEQ ID NO: 4540515 - DNA, 18 bp, Homo sapiens
aattatgttactgtattt

SEQ ID NO: 4540516 - DNA, 22 bp, Homo sapiens
aattatgttactgtatttttca

SEQ ID NO: 4540517 - DNA, 17 bp, Homo sapiens
aattattaatgaaaata

SEQ ID NO: 4540518 - DNA, 13 bp, Homo sapiens
aattattagaaca

SEQ ID NO: 4540519 - DNA, 13 bp, Homo sapiens
aattattataaaa

SEQ ID NO: 4540520 - DNA, 15 bp, Homo sapiens
aattattataaaaat

SEQ ID NO: 4540521 - DNA, 20 bp, Homo sapiens
aattattattttaaaatata

SEQ ID NO: 4540522 - DNA, 22 bp, Homo sapiens
aattattattttaaaatatatg

SEQ ID NO: 4540523 - DNA, 16 bp, Homo sapiens
aattattgacactgaa

SEQ ID NO: 4540524 - DNA, 17 bp, Homo sapiens
aattattgacactgaac

SEQ ID NO: 4540525 - DNA, 13 bp, Homo sapiens
aattattgatata

SEQ ID NO: 4540526 - DNA, 16 bp, Homo sapiens
aattattgatatatat

SEQ ID NO: 4540527 - DNA, 14 bp, Homo sapiens
aattattgtagaca

SEQ ID NO: 4540528 - DNA, 19 bp, Homo sapiens
aattatttaagatttcttt

SEQ ID NO: 4540529 - DNA, 12 bp, Homo sapiens
aattatttgcat

SEQ ID NO: 4540530 - DNA, 21 bp, Homo sapiens
aattatttgcatattttgaga

SEQ ID NO: 4540531 - DNA, 15 bp, Homo sapiens
aattattttaaatta

SEQ ID NO: 4540532 - DNA, 20 bp, Homo sapiens
aattattttaaattataagg

SEQ ID NO: 4540533 - DNA, 22 bp, Homo sapiens
aattattttatatcatacagtt

SEQ ID NO: 4540534 - DNA, 14 bp, Homo sapiens
aattattttgacat

SEQ ID NO: 4540535 - DNA, 17 bp, Homo sapiens
aattatttttaaagatc

SEQ ID NO: 4540536 - DNA, 23 bp, Homo sapiens
aattattttttgcatcatttaaa

SEQ ID NO: 4540537 - DNA, 19 bp, Homo sapiens
aattcaaaagtgattatct

SEQ ID NO: 4540538 - DNA, 22 bp, Homo sapiens
aattcaaatttgtaataaaact

SEQ ID NO: 4540539 - DNA, 23 bp, Homo sapiens
aattcaaggaatttcttaacttc

SEQ ID NO: 4540540 - DNA, 15 bp, Homo sapiens
aattcaattcaaagc

SEQ ID NO: 4540541 - DNA, 13 bp, Homo sapiens
aattcacaaactt

SEQ ID NO: 4540542 - DNA, 18 bp, Homo sapiens
aattcagaactaaatttt

SEQ ID NO: 4540543 - DNA, 21 bp, Homo sapiens
aattcagaactaaatttttca

SEQ ID NO: 4540544 - DNA, 22 bp, Homo sapiens
aattcagacatctgaggtttta

SEQ ID NO: 4540545 - DNA, 13 bp, Homo sapiens
aattcagcagttt

SEQ ID NO: 4540546 - DNA, 13 bp, Homo sapiens
aattcagtttcat

SEQ ID NO: 4540547 - DNA, 16 bp, Homo sapiens
aattcagtttcataaa

SEQ ID NO: 4540548 - DNA, 18 bp, Homo sapiens
aattcataataaattttc

SEQ ID NO: 4540549 - DNA, 16 bp, Homo sapiens
aattcatatctaaata

SEQ ID NO: 4540550 - DNA, 18 bp, Homo sapiens
aattcatgggctgtgtgt

SEQ ID NO: 4540551 - DNA, 16 bp, Homo sapiens
aattcattcatactta

SEQ ID NO: 4540552 - DNA, 15 bp, Homo sapiens
aattccaaaatccaa

SEQ ID NO: 4540553 - DNA, 15 bp, Homo sapiens
aattccaaagcaaaa

SEQ ID NO: 4540554 - DNA, 13 bp, Homo sapiens
aattccactcaaa

SEQ ID NO: 4540555 - DNA, 14 bp, Homo sapiens
aattccactgaaaa

SEQ ID NO: 4540556 - DNA, 17 bp, Homo sapiens
aattccactgaaaattt

SEQ ID NO: 4540557 - DNA, 19 bp, Homo sapiens
aattcccaacatttcttaa

SEQ ID NO: 4540558 - DNA, 20 bp, Homo sapiens
aattcccgttttgtcacttt

SEQ ID NO: 4540559 - DNA, 14 bp, Homo sapiens
aattccctggggaa

SEQ ID NO: 4540560 - DNA, 13 bp, Homo sapiens
aattccgtcacca

SEQ ID NO: 4540561 - DNA, 13 bp, Homo sapiens
aattcctacagca

SEQ ID NO: 4540562 - DNA, 17 bp, Homo sapiens
aattcctagaattaaac

SEQ ID NO: 4540563 - DNA, 17 bp, Homo sapiens
aattcctccagagacac

SEQ ID NO: 4540564 - DNA, 19 bp, Homo sapiens
aattcctccagagacactg

SEQ ID NO: 4540565 - DNA, 16 bp, Homo sapiens
aattcctcctctattt

SEQ ID NO: 4540566 - DNA, 17 bp, Homo sapiens
aattcctcctctattta

SEQ ID NO: 4540567 - DNA, 18 bp, Homo sapiens
aattcggtgtgctgccaa

SEQ ID NO: 4540568 - DNA, 21 bp, Homo sapiens
aattctaacccaagacatgac

SEQ ID NO: 4540569 - DNA, 22 bp, Homo sapiens
aattctaatctaacaatggaag

SEQ ID NO: 4540570 - DNA, 18 bp, Homo sapiens
aattctaccctgaaagtg

SEQ ID NO: 4540571 - DNA, 21 bp, Homo sapiens
aattctacctccttgtgttgc

SEQ ID NO: 4540572 - DNA, 16 bp, Homo sapiens
aattctactggaaaaa

SEQ ID NO: 4540573 - DNA, 18 bp, Homo sapiens
aattctaggatgaacaat

SEQ ID NO: 4540574 - DNA, 21 bp, Homo sapiens
aattctaggatgaacaatgta

SEQ ID NO: 4540575 - DNA, 16 bp, Homo sapiens
aattctataaggccat

SEQ ID NO: 4540576 - DNA, 22 bp, Homo sapiens
aattctatcttttgtttccttt

SEQ ID NO: 4540577 - DNA, 23 bp, Homo sapiens
aattctccaggattttaatttca

SEQ ID NO: 4540578 - DNA, 19 bp, Homo sapiens
aattctcctgcctcagcct

SEQ ID NO: 4540579 - DNA, 14 bp, Homo sapiens
aattctgaatttgc

SEQ ID NO: 4540580 - DNA, 15 bp, Homo sapiens
aattctgaatttgca

SEQ ID NO: 4540581 - DNA, 17 bp, Homo sapiens
aattctgaatttgcaaa

SEQ ID NO: 4540582 - DNA, 15 bp, Homo sapiens
aattctgactgtcca

SEQ ID NO: 4540583 - DNA, 23 bp, Homo sapiens
aattctgagttttgtgtttgttg

SEQ ID NO: 4540584 - DNA, 17 bp, Homo sapiens
aattctgtaatttgaat

SEQ ID NO: 4540585 - DNA, 14 bp, Homo sapiens
aattcttaaaacta

SEQ ID NO: 4540586 - DNA, 16 bp, Homo sapiens
aattcttaagtatgtt

SEQ ID NO: 4540587 - DNA, 16 bp, Homo sapiens
aattcttacagccaag

SEQ ID NO: 4540588 - DNA, 15 bp, Homo sapiens
aattcttccttccct

SEQ ID NO: 4540589 - DNA, 15 bp, Homo sapiens
aattcttctgaactc

SEQ ID NO: 4540590 - DNA, 23 bp, Homo sapiens
aattcttctgaactcaaactgag

SEQ ID NO: 4540591 - DNA, 12 bp, Homo sapiens
aattctttcaac

SEQ ID NO: 4540592 - DNA, 17 bp, Homo sapiens
aattctttgtttatgca

SEQ ID NO: 4540593 - DNA, 22 bp, Homo sapiens
aattgaaagtgggcaaaagctt

SEQ ID NO: 4540594 - DNA, 18 bp, Homo sapiens
aattgaacgactgtatat

SEQ ID NO: 4540595 - DNA, 16 bp, Homo sapiens
aattgacccacaagaa

SEQ ID NO: 4540596 - DNA, 21 bp, Homo sapiens
aattgacccacaagaaatgaa

SEQ ID NO: 4540597 - DNA, 21 bp, Homo sapiens
aattgacttatttatataaat

SEQ ID NO: 4540598 - DNA, 17 bp, Homo sapiens
aattgagttttcagtgg

SEQ ID NO: 4540599 - DNA, 15 bp, Homo sapiens
aattgatattatatt

SEQ ID NO: 4540600 - DNA, 14 bp, Homo sapiens
aattgatattttta

SEQ ID NO: 4540601 - DNA, 20 bp, Homo sapiens
aattgatttttataaatact

SEQ ID NO: 4540602 - DNA, 18 bp, Homo sapiens
aattgcaaatcttgaaat

SEQ ID NO: 4540603 - DNA, 15 bp, Homo sapiens
aattgcaccaaaaga

SEQ ID NO: 4540604 - DNA, 15 bp, Homo sapiens
aattgcatgaaaata

SEQ ID NO: 4540605 - DNA, 14 bp, Homo sapiens
aattgcgctcaggg

SEQ ID NO: 4540606 - DNA, 23 bp, Homo sapiens
aattgcgctcaggggctccatgc

SEQ ID NO: 4540607 - DNA, 14 bp, Homo sapiens
aattgctaacaatt

SEQ ID NO: 4540608 - DNA, 17 bp, Homo sapiens
aattgctaacaattgtt

SEQ ID NO: 4540609 - DNA, 16 bp, Homo sapiens
aattgctaatgttgct

SEQ ID NO: 4540610 - DNA, 16 bp, Homo sapiens
aattgctacatctaaa

SEQ ID NO: 4540611 - DNA, 20 bp, Homo sapiens
aattgctctgtgtatatctc

SEQ ID NO: 4540612 - DNA, 18 bp, Homo sapiens
aattgctttgccaaaata

SEQ ID NO: 4540613 - DNA, 17 bp, Homo sapiens
aattggaacaaagtgaa

SEQ ID NO: 4540614 - DNA, 18 bp, Homo sapiens
aattggaagtctaagaac

SEQ ID NO: 4540615 - DNA, 11 bp, Homo sapiens
aattggatttc

SEQ ID NO: 4540616 - DNA, 15 bp, Homo sapiens
aattggatttcctaa

SEQ ID NO: 4540617 - DNA, 14 bp, Homo sapiens
aattggcataattt

SEQ ID NO: 4540618 - DNA, 16 bp, Homo sapiens
aattgggttcatgatg

SEQ ID NO: 4540619 - DNA, 20 bp, Homo sapiens
aattggtaaaactcactgtg

SEQ ID NO: 4540620 - DNA, 12 bp, Homo sapiens
aattggtaatat

SEQ ID NO: 4540621 - DNA, 17 bp, Homo sapiens
aattggtctgaaaggct

SEQ ID NO: 4540622 - DNA, 14 bp, Homo sapiens
aattggtgtcattt

SEQ ID NO: 4540623 - DNA, 16 bp, Homo sapiens
aattggtgtcattttc

SEQ ID NO: 4540624 - DNA, 17 bp, Homo sapiens
aattgtaaactgtacta

SEQ ID NO: 4540625 - DNA, 18 bp, Homo sapiens
aattgtaaatcctgtgtt

SEQ ID NO: 4540626 - DNA, 22 bp, Homo sapiens
aattgtaccttttttgtttttt

SEQ ID NO: 4540627 - DNA, 13 bp, Homo sapiens
aattgtactgtgt

SEQ ID NO: 4540628 - DNA, 18 bp, Homo sapiens
aattgtataccaatgtgt

SEQ ID NO: 4540629 - DNA, 14 bp, Homo sapiens
aattgtatattgta

SEQ ID NO: 4540630 - DNA, 19 bp, Homo sapiens
aattgtcattatttttgtt

SEQ ID NO: 4540631 - DNA, 20 bp, Homo sapiens
aattgtcattatttttgtta

SEQ ID NO: 4540632 - DNA, 11 bp, Homo sapiens
aattgtccctt

SEQ ID NO: 4540633 - DNA, 16 bp, Homo sapiens
aattgtcccttaaaca

SEQ ID NO: 4540634 - DNA, 23 bp, Homo sapiens
aattgtcgaaaagagtcttccaa

SEQ ID NO: 4540635 - DNA, 15 bp, Homo sapiens
aattgtctttaaaaa

SEQ ID NO: 4540636 - DNA, 19 bp, Homo sapiens
aattgtgcaaaggataaat

SEQ ID NO: 4540637 - DNA, 22 bp, Homo sapiens
aattgtgcaaaggataaatttt

SEQ ID NO: 4540638 - DNA, 17 bp, Homo sapiens
aattgtgcataatgctt

SEQ ID NO: 4540639 - DNA, 13 bp, Homo sapiens
aattgtgtacctt

SEQ ID NO: 4540640 - DNA, 16 bp, Homo sapiens
aattgtgtatatatct

SEQ ID NO: 4540641 - DNA, 18 bp, Homo sapiens
aattgtgtatatatctta

SEQ ID NO: 4540642 - DNA, 19 bp, Homo sapiens
aattgtgtggattctttaa

SEQ ID NO: 4540643 - DNA, 20 bp, Homo sapiens
aattgtgtttattttttaaa

SEQ ID NO: 4540644 - DNA, 20 bp, Homo sapiens
aattgtgttttaattgtaaa

SEQ ID NO: 4540645 - DNA, 21 bp, Homo sapiens
aattgttgaacaggtgttttt

SEQ ID NO: 4540646 - DNA, 22 bp, Homo sapiens
aattgttgaacaggtgtttttc

SEQ ID NO: 4540647 - DNA, 21 bp, Homo sapiens
aattgtttatgtgttatgaac

SEQ ID NO: 4540648 - DNA, 19 bp, Homo sapiens
aatttaaaataattatata

SEQ ID NO: 4540649 - DNA, 21 bp, Homo sapiens
aatttaactacccttaattac

SEQ ID NO: 4540650 - DNA, 15 bp, Homo sapiens
aatttaaggcttaaa

SEQ ID NO: 4540651 - DNA, 13 bp, Homo sapiens
aatttaatgtaaa

SEQ ID NO: 4540652 - DNA, 15 bp, Homo sapiens
aatttaatgtaaata

SEQ ID NO: 4540653 - DNA, 17 bp, Homo sapiens
aatttaatgtaaataaa

SEQ ID NO: 4540654 - DNA, 19 bp, Homo sapiens
aatttaatgtaaataaaac

SEQ ID NO: 4540655 - DNA, 20 bp, Homo sapiens
aatttaatgtaaataaaaca

SEQ ID NO: 4540656 - DNA, 20 bp, Homo sapiens
aatttaattcctctttttag

SEQ ID NO: 4540657 - DNA, 17 bp, Homo sapiens
aatttacagagacagaa

SEQ ID NO: 4540658 - DNA, 16 bp, Homo sapiens
aatttaccatcatctc

SEQ ID NO: 4540659 - DNA, 16 bp, Homo sapiens
aatttacctaagatta

SEQ ID NO: 4540660 - DNA, 18 bp, Homo sapiens
aatttacctaagattaca

SEQ ID NO: 4540661 - DNA, 21 bp, Homo sapiens
aatttacctaagattacaaat

SEQ ID NO: 4540662 - DNA, 18 bp, Homo sapiens
aatttacttaagtgttca

SEQ ID NO: 4540663 - DNA, 17 bp, Homo sapiens
aatttagaaaaagaaca

SEQ ID NO: 4540664 - DNA, 21 bp, Homo sapiens
aatttagaaaaagaacatgca

SEQ ID NO: 4540665 - DNA, 15 bp, Homo sapiens
aatttagaaaaagtc

SEQ ID NO: 4540666 - DNA, 16 bp, Homo sapiens
aatttagaaaaagtca

SEQ ID NO: 4540667 - DNA, 13 bp, Homo sapiens
aatttagaaacta

SEQ ID NO: 4540668 - DNA, 16 bp, Homo sapiens
aatttagaaagcttaa

SEQ ID NO: 4540669 - DNA, 14 bp, Homo sapiens
aatttagaaatcat

SEQ ID NO: 4540670 - DNA, 17 bp, Homo sapiens
aatttagacttcaagca

SEQ ID NO: 4540671 - DNA, 13 bp, Homo sapiens
aatttagttgttt

SEQ ID NO: 4540672 - DNA, 12 bp, Homo sapiens
aatttagtttca

SEQ ID NO: 4540673 - DNA, 14 bp, Homo sapiens
aatttagtttgtta

SEQ ID NO: 4540674 - DNA, 23 bp, Homo sapiens
aatttataacgtgttcaatattt

SEQ ID NO: 4540675 - DNA, 20 bp, Homo sapiens
aatttataatgtatttgaaa

SEQ ID NO: 4540676 - DNA, 15 bp, Homo sapiens
aatttatagtttata

SEQ ID NO: 4540677 - DNA, 16 bp, Homo sapiens
aatttatagtttatac

SEQ ID NO: 4540678 - DNA, 14 bp, Homo sapiens
aatttatatgaaaa

SEQ ID NO: 4540679 - DNA, 16 bp, Homo sapiens
aatttatcacattgaa

SEQ ID NO: 4540680 - DNA, 18 bp, Homo sapiens
aatttatcacattgaata

SEQ ID NO: 4540681 - DNA, 23 bp, Homo sapiens
aatttatgaattgaattatcttg

SEQ ID NO: 4540682 - DNA, 22 bp, Homo sapiens
aatttatgtgaaatgctttctg

SEQ ID NO: 4540683 - DNA, 14 bp, Homo sapiens
aatttatgtgatgg

SEQ ID NO: 4540684 - DNA, 15 bp, Homo sapiens
aatttattgtctgtc

SEQ ID NO: 4540685 - DNA, 17 bp, Homo sapiens
aatttattgtctgtcta

SEQ ID NO: 4540686 - DNA, 12 bp, Homo sapiens
aatttatttcaa

SEQ ID NO: 4540687 - DNA, 14 bp, Homo sapiens
aatttatttcaata

SEQ ID NO: 4540688 - DNA, 23 bp, Homo sapiens
aatttatttccaatgtttcaagc

SEQ ID NO: 4540689 - DNA, 20 bp, Homo sapiens
aatttatttccactaaaaat

SEQ ID NO: 4540690 - DNA, 13 bp, Homo sapiens
aatttatttgcaa

SEQ ID NO: 4540691 - DNA, 20 bp, Homo sapiens
aatttattttattttagcag

SEQ ID NO: 4540692 - DNA, 12 bp, Homo sapiens
aatttcacagtt

SEQ ID NO: 4540693 - DNA, 21 bp, Homo sapiens
aatttcaccccattttctgtg

SEQ ID NO: 4540694 - DNA, 16 bp, Homo sapiens
aatttcacctgtaaac

SEQ ID NO: 4540695 - DNA, 18 bp, Homo sapiens
aatttcacgattcatttt

SEQ ID NO: 4540696 - DNA, 23 bp, Homo sapiens
aatttcactgtctttaattctgt

SEQ ID NO: 4540697 - DNA, 23 bp, Homo sapiens
aatttcagtcctgtagttttatt

SEQ ID NO: 4540698 - DNA, 19 bp, Homo sapiens
aatttcataattctgaaac

SEQ ID NO: 4540699 - DNA, 20 bp, Homo sapiens
aatttcataattctgaaaca

SEQ ID NO: 4540700 - DNA, 14 bp, Homo sapiens
aatttcatgtatat

SEQ ID NO: 4540701 - DNA, 11 bp, Homo sapiens
aatttcatttc

SEQ ID NO: 4540702 - DNA, 11 bp, Homo sapiens
aatttccaaaa

SEQ ID NO: 4540703 - DNA, 18 bp, Homo sapiens
aatttcccagttaaagat

SEQ ID NO: 4540704 - DNA, 13 bp, Homo sapiens
aatttcctctatt

SEQ ID NO: 4540705 - DNA, 22 bp, Homo sapiens
aatttcctgtttgaaatatcat

SEQ ID NO: 4540706 - DNA, 14 bp, Homo sapiens
aatttcctttttga

SEQ ID NO: 4540707 - DNA, 17 bp, Homo sapiens
aatttcggattttttcc

SEQ ID NO: 4540708 - DNA, 15 bp, Homo sapiens
aatttctactttgaa

SEQ ID NO: 4540709 - DNA, 21 bp, Homo sapiens
aatttctataaatttaagaaa

SEQ ID NO: 4540710 - DNA, 13 bp, Homo sapiens
aatttctattaaa

SEQ ID NO: 4540711 - DNA, 19 bp, Homo sapiens
aatttctgaagaagttaat

SEQ ID NO: 4540712 - DNA, 17 bp, Homo sapiens
aatttctgccatttcat

SEQ ID NO: 4540713 - DNA, 13 bp, Homo sapiens
aatttctgtcttt

SEQ ID NO: 4540714 - DNA, 20 bp, Homo sapiens
aatttcttaacttcttgctt

SEQ ID NO: 4540715 - DNA, 15 bp, Homo sapiens
aatttcttatgtgac

SEQ ID NO: 4540716 - DNA, 16 bp, Homo sapiens
aatttcttatgtgaca

SEQ ID NO: 4540717 - DNA, 18 bp, Homo sapiens
aatttcttatgtgacatt

SEQ ID NO: 4540718 - DNA, 20 bp, Homo sapiens
aatttcttatgtgacattaa

SEQ ID NO: 4540719 - DNA, 13 bp, Homo sapiens
aatttcttgctgc

SEQ ID NO: 4540720 - DNA, 21 bp, Homo sapiens
aatttctttaaatgtgtattt

SEQ ID NO: 4540721 - DNA, 21 bp, Homo sapiens
aatttgaagtaacttatttga

SEQ ID NO: 4540722 - DNA, 23 bp, Homo sapiens
aatttgaagtaacttatttgact

SEQ ID NO: 4540723 - DNA, 16 bp, Homo sapiens
aatttgacttttctgt

SEQ ID NO: 4540724 - DNA, 17 bp, Homo sapiens
aatttgacttttctgta

SEQ ID NO: 4540725 - DNA, 21 bp, Homo sapiens
aatttgatgatgttaaatgta

SEQ ID NO: 4540726 - DNA, 20 bp, Homo sapiens
aatttgatgcccaatatatt

SEQ ID NO: 4540727 - DNA, 12 bp, Homo sapiens
aatttgattgat

SEQ ID NO: 4540728 - DNA, 14 bp, Homo sapiens
aatttgattgattt

SEQ ID NO: 4540729 - DNA, 13 bp, Homo sapiens
aatttgcaaagta

SEQ ID NO: 4540730 - DNA, 16 bp, Homo sapiens
aatttgcaaagtactg

SEQ ID NO: 4540731 - DNA, 18 bp, Homo sapiens
aatttgcaaagtactgta

SEQ ID NO: 4540732 - DNA, 15 bp, Homo sapiens
aatttgcattaaatt

SEQ ID NO: 4540733 - DNA, 17 bp, Homo sapiens
aatttgcattaaattca

SEQ ID NO: 4540734 - DNA, 18 bp, Homo sapiens
aatttgcattaaattcac

SEQ ID NO: 4540735 - DNA, 18 bp, Homo sapiens
aatttggagcacaaaatt

SEQ ID NO: 4540736 - DNA, 21 bp, Homo sapiens
aatttggagcacaaaattcaa

SEQ ID NO: 4540737 - DNA, 18 bp, Homo sapiens
aatttggccttaagaact

SEQ ID NO: 4540738 - DNA, 21 bp, Homo sapiens
aatttgggagaagcaaatata

SEQ ID NO: 4540739 - DNA, 18 bp, Homo sapiens
aatttggtaaaaatgctg

SEQ ID NO: 4540740 - DNA, 14 bp, Homo sapiens
aatttggtacacat

SEQ ID NO: 4540741 - DNA, 14 bp, Homo sapiens
aatttgtaatgatt

SEQ ID NO: 4540742 - DNA, 14 bp, Homo sapiens
aatttgtgtaaatt

SEQ ID NO: 4540743 - DNA, 17 bp, Homo sapiens
aatttgtgtaaatttgt

SEQ ID NO: 4540744 - DNA, 19 bp, Homo sapiens
aatttgtgtaaatttgtat

SEQ ID NO: 4540745 - DNA, 20 bp, Homo sapiens
aatttgtgtaataaagtgtt

SEQ ID NO: 4540746 - DNA, 19 bp, Homo sapiens
aatttgtgttgaaggaact

SEQ ID NO: 4540747 - DNA, 12 bp, Homo sapiens
aatttgttaatt

SEQ ID NO: 4540748 - DNA, 16 bp, Homo sapiens
aatttgttcttgtatt

SEQ ID NO: 4540749 - DNA, 16 bp, Homo sapiens
aatttgttttagccat

SEQ ID NO: 4540750 - DNA, 17 bp, Homo sapiens
aatttgttttggatata

SEQ ID NO: 4540751 - DNA, 14 bp, Homo sapiens
aatttgtttttgca

SEQ ID NO: 4540752 - DNA, 17 bp, Homo sapiens
aatttgtttttgcattt

SEQ ID NO: 4540753 - DNA, 21 bp, Homo sapiens
aattttaaaattggtatattt

SEQ ID NO: 4540754 - DNA, 12 bp, Homo sapiens
aattttaaagcc

SEQ ID NO: 4540755 - DNA, 13 bp, Homo sapiens
aattttaaagcca

SEQ ID NO: 4540756 - DNA, 16 bp, Homo sapiens
aattttaaagtatgca

SEQ ID NO: 4540757 - DNA, 13 bp, Homo sapiens
aattttaaagttc

SEQ ID NO: 4540758 - DNA, 14 bp, Homo sapiens
aattttaaagttct

SEQ ID NO: 4540759 - DNA, 16 bp, Homo sapiens
aattttaaagttctta

SEQ ID NO: 4540760 - DNA, 14 bp, Homo sapiens
aattttaactgatt

SEQ ID NO: 4540761 - DNA, 16 bp, Homo sapiens
aattttaatgaagaaa

SEQ ID NO: 4540762 - DNA, 12 bp, Homo sapiens
aattttaattta

SEQ ID NO: 4540763 - DNA, 14 bp, Homo sapiens
aattttaatttagt

SEQ ID NO: 4540764 - DNA, 15 bp, Homo sapiens
aattttaccttgttt

SEQ ID NO: 4540765 - DNA, 16 bp, Homo sapiens
aattttactgtgaaaa

SEQ ID NO: 4540766 - DNA, 17 bp, Homo sapiens
aattttatatgtaaatg

SEQ ID NO: 4540767 - DNA, 20 bp, Homo sapiens
aattttatatgtaaatgtgt

SEQ ID NO: 4540768 - DNA, 18 bp, Homo sapiens
aattttatgtcatagaaa

SEQ ID NO: 4540769 - DNA, 11 bp, Homo sapiens
aattttattat

SEQ ID NO: 4540770 - DNA, 11 bp, Homo sapiens
aattttattga

SEQ ID NO: 4540771 - DNA, 17 bp, Homo sapiens
aattttcagaccccagc

SEQ ID NO: 4540772 - DNA, 12 bp, Homo sapiens
aattttcagcat

SEQ ID NO: 4540773 - DNA, 13 bp, Homo sapiens
aattttcctgtgg

SEQ ID NO: 4540774 - DNA, 14 bp, Homo sapiens
aattttctgtattt

SEQ ID NO: 4540775 - DNA, 14 bp, Homo sapiens
aattttcttcagtt

SEQ ID NO: 4540776 - DNA, 17 bp, Homo sapiens
aattttcttcagttggt

SEQ ID NO: 4540777 - DNA, 14 bp, Homo sapiens
aattttgaatgtac

SEQ ID NO: 4540778 - DNA, 17 bp, Homo sapiens
aattttgagttgccaca

SEQ ID NO: 4540779 - DNA, 20 bp, Homo sapiens
aattttgatataatctttca

SEQ ID NO: 4540780 - DNA, 12 bp, Homo sapiens
aattttgcaatg

SEQ ID NO: 4540781 - DNA, 21 bp, Homo sapiens
aattttgccaaaatcctgaac

SEQ ID NO: 4540782 - DNA, 12 bp, Homo sapiens
aattttggattt

SEQ ID NO: 4540783 - DNA, 22 bp, Homo sapiens
aattttggggattttcaaaaga

SEQ ID NO: 4540784 - DNA, 12 bp, Homo sapiens
aattttgtaaga

SEQ ID NO: 4540785 - DNA, 13 bp, Homo sapiens
aattttgtaatga

SEQ ID NO: 4540786 - DNA, 14 bp, Homo sapiens
aattttgtacaaat

SEQ ID NO: 4540787 - DNA, 18 bp, Homo sapiens
aattttgtgttccttttt

SEQ ID NO: 4540788 - DNA, 19 bp, Homo sapiens
aatttttaaacaagtattt

SEQ ID NO: 4540789 - DNA, 14 bp, Homo sapiens
aatttttaatgatg

SEQ ID NO: 4540790 - DNA, 15 bp, Homo sapiens
aatttttatttattt

SEQ ID NO: 4540791 - DNA, 19 bp, Homo sapiens
aatttttatttatttttct

SEQ ID NO: 4540792 - DNA, 18 bp, Homo sapiens
aatttttcttttctttct

SEQ ID NO: 4540793 - DNA, 13 bp, Homo sapiens
aatttttgatact

SEQ ID NO: 4540794 - DNA, 11 bp, Homo sapiens
aatttttgcaa

SEQ ID NO: 4540795 - DNA, 14 bp, Homo sapiens
aatttttgcaataa

SEQ ID NO: 4540796 - DNA, 21 bp, Homo sapiens
aatttttgcaataatgcagta

SEQ ID NO: 4540797 - DNA, 20 bp, Homo sapiens
aatttttgcttttagaaaag

SEQ ID NO: 4540798 - DNA, 14 bp, Homo sapiens
aatttttgtaattt

SEQ ID NO: 4540799 - DNA, 13 bp, Homo sapiens
aatttttgtagta

SEQ ID NO: 4540800 - DNA, 11 bp, Homo sapiens
aattttttcct

SEQ ID NO: 4540801 - DNA, 13 bp, Homo sapiens
aattttttgactt

SEQ ID NO: 4540802 - DNA, 20 bp, Homo sapiens
aattttttggtacaaaaata

SEQ ID NO: 4540803 - DNA, 23 bp, Homo sapiens
acaaaaaaatacctcaggaaaga

SEQ ID NO: 4540804 - DNA, 14 bp, Homo sapiens
acaaaaaaccgagg

SEQ ID NO: 4540805 - DNA, 17 bp, Homo sapiens
acaaaaaacgaatgaaa

SEQ ID NO: 4540806 - DNA, 12 bp, Homo sapiens
acaaaaaatact

SEQ ID NO: 4540807 - DNA, 14 bp, Homo sapiens
acaaaaaatgtttt

SEQ ID NO: 4540808 - DNA, 13 bp, Homo sapiens
acaaaaacacagc

SEQ ID NO: 4540809 - DNA, 16 bp, Homo sapiens
acaaaaacacagcaag

SEQ ID NO: 4540810 - DNA, 15 bp, Homo sapiens
acaaaaacagcctca

SEQ ID NO: 4540811 - DNA, 21 bp, Homo sapiens
acaaaaacagcctcacagaag

SEQ ID NO: 4540812 - DNA, 16 bp, Homo sapiens
acaaaaagatgtctca

SEQ ID NO: 4540813 - DNA, 14 bp, Homo sapiens
acaaaaaggcaaat

SEQ ID NO: 4540814 - DNA, 19 bp, Homo sapiens
acaaaaaggcaaatattga

SEQ ID NO: 4540815 - DNA, 12 bp, Homo sapiens
acaaaaataata

SEQ ID NO: 4540816 - DNA, 15 bp, Homo sapiens
acaaaacaaaacaaa

SEQ ID NO: 4540817 - DNA, 15 bp, Homo sapiens
acaaaacaaaactat

SEQ ID NO: 4540818 - DNA, 18 bp, Homo sapiens
acaaaaccctcagcactg

SEQ ID NO: 4540819 - DNA, 15 bp, Homo sapiens
acaaaactacatgag

SEQ ID NO: 4540820 - DNA, 10 bp, Homo sapiens
acaaaactat

SEQ ID NO: 4540821 - DNA, 17 bp, Homo sapiens
acaaaactatacttgaa

SEQ ID NO: 4540822 - DNA, 21 bp, Homo sapiens
acaaaactatacttgaacaaa

SEQ ID NO: 4540823 - DNA, 13 bp, Homo sapiens
acaaaagcagata

SEQ ID NO: 4540824 - DNA, 15 bp, Homo sapiens
acaaaagggtgtata

SEQ ID NO: 4540825 - DNA, 16 bp, Homo sapiens
acaaaagggtgtatag

SEQ ID NO: 4540826 - DNA, 16 bp, Homo sapiens
acaaaagtacattgct

SEQ ID NO: 4540827 - DNA, 21 bp, Homo sapiens
acaaaagtctgtctttcctga

SEQ ID NO: 4540828 - DNA, 18 bp, Homo sapiens
acaaaagttttaattaaa

SEQ ID NO: 4540829 - DNA, 13 bp, Homo sapiens
acaaaatacacat

SEQ ID NO: 4540830 - DNA, 15 bp, Homo sapiens
acaaaatatttaagt

SEQ ID NO: 4540831 - DNA, 12 bp, Homo sapiens
acaaaatgactg

SEQ ID NO: 4540832 - DNA, 18 bp, Homo sapiens
acaaaatgactggctcct

SEQ ID NO: 4540833 - DNA, 22 bp, Homo sapiens
acaaaatggatacataaagact

SEQ ID NO: 4540834 - DNA, 21 bp, Homo sapiens
acaaaatgggactgctgaaga

SEQ ID NO: 4540835 - DNA, 17 bp, Homo sapiens
acaaaatgtagaatatt

SEQ ID NO: 4540836 - DNA, 23 bp, Homo sapiens
acaaaatgtagaatattcagaca

SEQ ID NO: 4540837 - DNA, 17 bp, Homo sapiens
acaaaatgttttttgat

SEQ ID NO: 4540838 - DNA, 14 bp, Homo sapiens
acaaaattatttgt

SEQ ID NO: 4540839 - DNA, 13 bp, Homo sapiens
acaaaatttgact

SEQ ID NO: 4540840 - DNA, 12 bp, Homo sapiens
acaaaattttaa

SEQ ID NO: 4540841 - DNA, 18 bp, Homo sapiens
acaaacaaaatttctatt

SEQ ID NO: 4540842 - DNA, 14 bp, Homo sapiens
acaaacaatctctt

SEQ ID NO: 4540843 - DNA, 20 bp, Homo sapiens
acaaacagggctgccttctg

SEQ ID NO: 4540844 - DNA, 18 bp, Homo sapiens
acaaaccttgccttgaaa

SEQ ID NO: 4540845 - DNA, 18 bp, Homo sapiens
acaaactgtgaaaatagt

SEQ ID NO: 4540846 - DNA, 14 bp, Homo sapiens
acaaacttttaaga

SEQ ID NO: 4540847 - DNA, 14 bp, Homo sapiens
acaaagaaaaatta

SEQ ID NO: 4540848 - DNA, 18 bp, Homo sapiens
acaaagaaacaaagatgt

SEQ ID NO: 4540849 - DNA, 17 bp, Homo sapiens
acaaagacaaaagtctg

SEQ ID NO: 4540850 - DNA, 14 bp, Homo sapiens
acaaagacaggcaa

SEQ ID NO: 4540851 - DNA, 13 bp, Homo sapiens
acaaagacattta

SEQ ID NO: 4540852 - DNA, 18 bp, Homo sapiens
acaaagagttcaagaaat

SEQ ID NO: 4540853 - DNA, 22 bp, Homo sapiens
acaaagagttcaagaaataagt

SEQ ID NO: 4540854 - DNA, 18 bp, Homo sapiens
acaaagattgagaagcca

SEQ ID NO: 4540855 - DNA, 19 bp, Homo sapiens
acaaagccccccagctccc

SEQ ID NO: 4540856 - DNA, 21 bp, Homo sapiens
acaaagccccccagctcccac

SEQ ID NO: 4540857 - DNA, 16 bp, Homo sapiens
acaaagcccttttata

SEQ ID NO: 4540858 - DNA, 22 bp, Homo sapiens
acaaagctaggatggttctgtg

SEQ ID NO: 4540859 - DNA, 17 bp, Homo sapiens
acaaagctgctaaatct

SEQ ID NO: 4540860 - DNA, 23 bp, Homo sapiens
acaaagctgctaaatctcctatt

SEQ ID NO: 4540861 - DNA, 15 bp, Homo sapiens
acaaaggaggaattt

SEQ ID NO: 4540862 - DNA, 18 bp, Homo sapiens
acaaaggctgacattcac

SEQ ID NO: 4540863 - DNA, 14 bp, Homo sapiens
acaaagttcagtgt

SEQ ID NO: 4540864 - DNA, 16 bp, Homo sapiens
acaaagttctcagagc

SEQ ID NO: 4540865 - DNA, 19 bp, Homo sapiens
acaaagttgattaagaaag

SEQ ID NO: 4540866 - DNA, 18 bp, Homo sapiens
acaaagtttcagagtata

SEQ ID NO: 4540867 - DNA, 12 bp, Homo sapiens
acaaataaaagt

SEQ ID NO: 4540868 - DNA, 18 bp, Homo sapiens
acaaataaatagttgctc

SEQ ID NO: 4540869 - DNA, 18 bp, Homo sapiens
acaaataaatgattatat

SEQ ID NO: 4540870 - DNA, 19 bp, Homo sapiens
acaaataaatgattatatt

SEQ ID NO: 4540871 - DNA, 22 bp, Homo sapiens
acaaataaatgattatattcac

SEQ ID NO: 4540872 - DNA, 13 bp, Homo sapiens
acaaataatttag

SEQ ID NO: 4540873 - DNA, 20 bp, Homo sapiens
acaaatatccaccactttaa

SEQ ID NO: 4540874 - DNA, 16 bp, Homo sapiens
acaaatattgtcatct

SEQ ID NO: 4540875 - DNA, 20 bp, Homo sapiens
acaaatcagaagtcatcttg

SEQ ID NO: 4540876 - DNA, 20 bp, Homo sapiens
acaaatcctctgttttctct

SEQ ID NO: 4540877 - DNA, 19 bp, Homo sapiens
acaaatctaaaatgcaaag

SEQ ID NO: 4540878 - DNA, 11 bp, Homo sapiens
acaaatgaaaa

SEQ ID NO: 4540879 - DNA, 16 bp, Homo sapiens
acaaatgactgtatct

SEQ ID NO: 4540880 - DNA, 18 bp, Homo sapiens
acaaatgcaaatttctat

SEQ ID NO: 4540881 - DNA, 21 bp, Homo sapiens
acaaatgcaggtgtcctgagc

SEQ ID NO: 4540882 - DNA, 17 bp, Homo sapiens
acaaatgcataaatgca

SEQ ID NO: 4540883 - DNA, 12 bp, Homo sapiens
acaaatgtcatt

SEQ ID NO: 4540884 - DNA, 16 bp, Homo sapiens
acaaatgtggccaagc

SEQ ID NO: 4540885 - DNA, 21 bp, Homo sapiens
acaaatgtggccaagcctatc

SEQ ID NO: 4540886 - DNA, 21 bp, Homo sapiens
acaaatgttcatatttattga

SEQ ID NO: 4540887 - DNA, 23 bp, Homo sapiens
acaaatgttcatatttattgatt

SEQ ID NO: 4540888 - DNA, 17 bp, Homo sapiens
acaaattattaatgaaa

SEQ ID NO: 4540889 - DNA, 18 bp, Homo sapiens
acaaattctactttaata

SEQ ID NO: 4540890 - DNA, 19 bp, Homo sapiens
acaaatttacagagacaga

SEQ ID NO: 4540891 - DNA, 13 bp, Homo sapiens
acaaatttataaa

SEQ ID NO: 4540892 - DNA, 14 bp, Homo sapiens
acaaatttataaag

SEQ ID NO: 4540893 - DNA, 17 bp, Homo sapiens
acaaatttggccttaag

SEQ ID NO: 4540894 - DNA, 17 bp, Homo sapiens
acaaattttcagaaggt

SEQ ID NO: 4540895 - DNA, 16 bp, Homo sapiens
acaaattttgcatatt

SEQ ID NO: 4540896 - DNA, 17 bp, Homo sapiens
acaaattttttaatttc

SEQ ID NO: 4540897 - DNA, 14 bp, Homo sapiens
acaacaaaaaatac

SEQ ID NO: 4540898 - DNA, 13 bp, Homo sapiens
acaacaaagacat

SEQ ID NO: 4540899 - DNA, 15 bp, Homo sapiens
acaacaagaaactgt

SEQ ID NO: 4540900 - DNA, 19 bp, Homo sapiens
acaacaattggtaaaactc

SEQ ID NO: 4540901 - DNA, 15 bp, Homo sapiens
acaacaccttcctcc

SEQ ID NO: 4540902 - DNA, 22 bp, Homo sapiens
acaacaccttcctcctgcagac

SEQ ID NO: 4540903 - DNA, 22 bp, Homo sapiens
acaacagctcgatccaaattgt

SEQ ID NO: 4540904 - DNA, 15 bp, Homo sapiens
acaacagtcacctca

SEQ ID NO: 4540905 - DNA, 21 bp, Homo sapiens
acaacatgaggccactggaga

SEQ ID NO: 4540906 - DNA, 12 bp, Homo sapiens
acaacatttatg

SEQ ID NO: 4540907 - DNA, 21 bp, Homo sapiens
acaaccactgggatcagctgg

SEQ ID NO: 4540908 - DNA, 21 bp, Homo sapiens
acaaccatgcaaattgtgaaa

SEQ ID NO: 4540909 - DNA, 22 bp, Homo sapiens
acaaccatgcaaattgtgaaat

SEQ ID NO: 4540910 - DNA, 13 bp, Homo sapiens
acaaccattaaag

SEQ ID NO: 4540911 - DNA, 18 bp, Homo sapiens
acaaccattaaagtcaga

SEQ ID NO: 4540912 - DNA, 19 bp, Homo sapiens
acaaccctgaccgtgaccg

SEQ ID NO: 4540913 - DNA, 15 bp, Homo sapiens
acaacctcaactgcc

SEQ ID NO: 4540914 - DNA, 17 bp, Homo sapiens
acaactaacaatgcctt

SEQ ID NO: 4540915 - DNA, 18 bp, Homo sapiens
acaactaacaatgccttg

SEQ ID NO: 4540916 - DNA, 17 bp, Homo sapiens
acaactatggatcagaa

SEQ ID NO: 4540917 - DNA, 14 bp, Homo sapiens
acaactatttttgt

SEQ ID NO: 4540918 - DNA, 22 bp, Homo sapiens
acaactgcctcgaaacacagaa

SEQ ID NO: 4540919 - DNA, 15 bp, Homo sapiens
acaacttaaataata

SEQ ID NO: 4540920 - DNA, 15 bp, Homo sapiens
acaacttgtatttcc

SEQ ID NO: 4540921 - DNA, 16 bp, Homo sapiens
acaacttgtatttcca

SEQ ID NO: 4540922 - DNA, 17 bp, Homo sapiens
acaacttgtatttccaa

SEQ ID NO: 4540923 - DNA, 22 bp, Homo sapiens
acaactttcactataatgtgaa

SEQ ID NO: 4540924 - DNA, 12 bp, Homo sapiens
acaagaaactgt

SEQ ID NO: 4540925 - DNA, 13 bp, Homo sapiens
acaagaacattct

SEQ ID NO: 4540926 - DNA, 19 bp, Homo sapiens
acaagacatttctttctgt

SEQ ID NO: 4540927 - DNA, 20 bp, Homo sapiens
acaagagcaaaactccgtct

SEQ ID NO: 4540928 - DNA, 15 bp, Homo sapiens
acaagagcagcctgt

SEQ ID NO: 4540929 - DNA, 18 bp, Homo sapiens
acaagagcagcctgtggc

SEQ ID NO: 4540930 - DNA, 18 bp, Homo sapiens
acaagaggattgtaaaat

SEQ ID NO: 4540931 - DNA, 19 bp, Homo sapiens
acaagaggattgtaaaatg

SEQ ID NO: 4540932 - DNA, 21 bp, Homo sapiens
acaagaggattgtaaaatgca

SEQ ID NO: 4540933 - DNA, 21 bp, Homo sapiens
acaagagtatgtggcaaaaca

SEQ ID NO: 4540934 - DNA, 13 bp, Homo sapiens
acaagatattatt

SEQ ID NO: 4540935 - DNA, 15 bp, Homo sapiens
acaagatgtgggcct

SEQ ID NO: 4540936 - DNA, 17 bp, Homo sapiens
acaagatgtttcatttt

SEQ ID NO: 4540937 - DNA, 14 bp, Homo sapiens
acaagattcccaga

SEQ ID NO: 4540938 - DNA, 15 bp, Homo sapiens
acaagattcccagag

SEQ ID NO: 4540939 - DNA, 17 bp, Homo sapiens
acaagattcccagagac

SEQ ID NO: 4540940 - DNA, 11 bp, Homo sapiens
acaagcatctc

SEQ ID NO: 4540941 - DNA, 15 bp, Homo sapiens
acaagcatgcataaa

SEQ ID NO: 4540942 - DNA, 14 bp, Homo sapiens
acaagccaaagagc

SEQ ID NO: 4540943 - DNA, 23 bp, Homo sapiens
acaagctcaggaggcgaataaat

SEQ ID NO: 4540944 - DNA, 18 bp, Homo sapiens
acaagctcatccctggac

SEQ ID NO: 4540945 - DNA, 19 bp, Homo sapiens
acaagctgtataaacagaa

SEQ ID NO: 4540946 - DNA, 20 bp, Homo sapiens
acaagctgtataaacagaac

SEQ ID NO: 4540947 - DNA, 14 bp, Homo sapiens
acaaggaataaatg

SEQ ID NO: 4540948 - DNA, 13 bp, Homo sapiens
acaaggattgaaa

SEQ ID NO: 4540949 - DNA, 14 bp, Homo sapiens
acaagggagaagac

SEQ ID NO: 4540950 - DNA, 18 bp, Homo sapiens
acaaggggcaaatgaatt

SEQ ID NO: 4540951 - DNA, 17 bp, Homo sapiens
acaagggtctagggaga

SEQ ID NO: 4540952 - DNA, 10 bp, Homo sapiens
acaaggtaaa

SEQ ID NO: 4540953 - DNA, 14 bp, Homo sapiens
acaagtaatgtaaa

SEQ ID NO: 4540954 - DNA, 18 bp, Homo sapiens
acaagtactggtaagatt

SEQ ID NO: 4540955 - DNA, 17 bp, Homo sapiens
acaagtatataatttac

SEQ ID NO: 4540956 - DNA, 14 bp, Homo sapiens
acaagtatttgtta

SEQ ID NO: 4540957 - DNA, 16 bp, Homo sapiens
acaagtcatggtcaca

SEQ ID NO: 4540958 - DNA, 20 bp, Homo sapiens
acaagtctgcatttcatatt

SEQ ID NO: 4540959 - DNA, 22 bp, Homo sapiens
acaagtctgcatttcatattat

SEQ ID NO: 4540960 - DNA, 22 bp, Homo sapiens
acaagtgagttgttgccctggg

SEQ ID NO: 4540961 - DNA, 23 bp, Homo sapiens
acaagtgccgcaaattgtacctt

SEQ ID NO: 4540962 - DNA, 22 bp, Homo sapiens
acaagttccattatgaaaatct

SEQ ID NO: 4540963 - DNA, 17 bp, Homo sapiens
acaagttccctggagaa

SEQ ID NO: 4540964 - DNA, 18 bp, Homo sapiens
acaagttccctggagaaa

SEQ ID NO: 4540965 - DNA, 13 bp, Homo sapiens
acaagttttagtt

SEQ ID NO: 4540966 - DNA, 22 bp, Homo sapiens
acaagttttagttaaaactcat

SEQ ID NO: 4540967 - DNA, 16 bp, Homo sapiens
acaataaaacaaataa

SEQ ID NO: 4540968 - DNA, 18 bp, Homo sapiens
acaataaaacaaataaat

SEQ ID NO: 4540969 - DNA, 15 bp, Homo sapiens
acaataaaccctcag

SEQ ID NO: 4540970 - DNA, 20 bp, Homo sapiens
acaataaaccctcagagcct

SEQ ID NO: 4540971 - DNA, 19 bp, Homo sapiens
acaataaagggagaatggt

SEQ ID NO: 4540972 - DNA, 23 bp, Homo sapiens
acaataaagggagaatggtgctg

SEQ ID NO: 4540973 - DNA, 23 bp, Homo sapiens
acaataaattgctaatgttgctg

SEQ ID NO: 4540974 - DNA, 15 bp, Homo sapiens
acaataagcaaaaac

SEQ ID NO: 4540975 - DNA, 12 bp, Homo sapiens
acaataataaaa

SEQ ID NO: 4540976 - DNA, 18 bp, Homo sapiens
acaataatatttcaagtg

SEQ ID NO: 4540977 - DNA, 21 bp, Homo sapiens
acaataatatttcaagtgcct

SEQ ID NO: 4540978 - DNA, 22 bp, Homo sapiens
acaataatatttcaagtgccta

SEQ ID NO: 4540979 - DNA, 18 bp, Homo sapiens
acaataattctacatgtt

SEQ ID NO: 4540980 - DNA, 13 bp, Homo sapiens
acaatacaatgta

SEQ ID NO: 4540981 - DNA, 16 bp, Homo sapiens
acaatacaatgtacaa

SEQ ID NO: 4540982 - DNA, 18 bp, Homo sapiens
acaatacagtattataga

SEQ ID NO: 4540983 - DNA, 18 bp, Homo sapiens
acaatacatgagaaagat

SEQ ID NO: 4540984 - DNA, 22 bp, Homo sapiens
acaatagccgatatcagaattt

SEQ ID NO: 4540985 - DNA, 15 bp, Homo sapiens
acaatagtatacatt

SEQ ID NO: 4540986 - DNA, 18 bp, Homo sapiens
acaatagtatacatttta

SEQ ID NO: 4540987 - DNA, 20 bp, Homo sapiens
acaatagtatacattttata

SEQ ID NO: 4540988 - DNA, 16 bp, Homo sapiens
acaatatagttttttc

SEQ ID NO: 4540989 - DNA, 15 bp, Homo sapiens
acaatattactttgt

SEQ ID NO: 4540990 - DNA, 19 bp, Homo sapiens
acaatattcagtggtgaaa

SEQ ID NO: 4540991 - DNA, 17 bp, Homo sapiens
acaatatttcttttgtt

SEQ ID NO: 4540992 - DNA, 14 bp, Homo sapiens
acaatcaaaggaaa

SEQ ID NO: 4540993 - DNA, 17 bp, Homo sapiens
acaatcagttatacagt

SEQ ID NO: 4540994 - DNA, 15 bp, Homo sapiens
acaatccattcacaa

SEQ ID NO: 4540995 - DNA, 22 bp, Homo sapiens
acaatcctttaaggtcaacatt

SEQ ID NO: 4540996 - DNA, 13 bp, Homo sapiens
acaatctatttaa

SEQ ID NO: 4540997 - DNA, 16 bp, Homo sapiens
acaatctatttaaaaa

SEQ ID NO: 4540998 - DNA, 20 bp, Homo sapiens
acaatctatttaaaaaactg

SEQ ID NO: 4540999 - DNA, 19 bp, Homo sapiens
acaatctggcttagtgcca

SEQ ID NO: 4541000 - DNA, 21 bp, Homo sapiens
acaatgaagggaaattgttta

SEQ ID NO: 4541001 - DNA, 20 bp, Homo sapiens
acaatgcctattgtaatata

SEQ ID NO: 4541002 - DNA, 12 bp, Homo sapiens
acaatgtacaat

SEQ ID NO: 4541003 - DNA, 18 bp, Homo sapiens
acaatgtacaattatgtc

SEQ ID NO: 4541004 - DNA, 14 bp, Homo sapiens
acaatgtacacact

SEQ ID NO: 4541005 - DNA, 16 bp, Homo sapiens
acaatgtatgtacaat

SEQ ID NO: 4541006 - DNA, 15 bp, Homo sapiens
acaatgtgtttttct

SEQ ID NO: 4541007 - DNA, 19 bp, Homo sapiens
acaatgtgtttttctccag

SEQ ID NO: 4541008 - DNA, 17 bp, Homo sapiens
acaatgtttaaaccttt

SEQ ID NO: 4541009 - DNA, 23 bp, Homo sapiens
acaatgtttcttcatttctctgc

SEQ ID NO: 4541010 - DNA, 21 bp, Homo sapiens
acaattaaaaacctgatggaa

SEQ ID NO: 4541011 - DNA, 14 bp, Homo sapiens
acaattagatttct

SEQ ID NO: 4541012 - DNA, 15 bp, Homo sapiens
acaattatgtctctt

SEQ ID NO: 4541013 - DNA, 20 bp, Homo sapiens
acaattattccaaaccaaat

SEQ ID NO: 4541014 - DNA, 21 bp, Homo sapiens
acaattattccaaaccaaatt

SEQ ID NO: 4541015 - DNA, 13 bp, Homo sapiens
acaattattggca

SEQ ID NO: 4541016 - DNA, 21 bp, Homo sapiens
acaattcccttctttttcatc

SEQ ID NO: 4541017 - DNA, 22 bp, Homo sapiens
acaattcctccagagacactga

SEQ ID NO: 4541018 - DNA, 12 bp, Homo sapiens
acaattctaaaa

SEQ ID NO: 4541019 - DNA, 19 bp, Homo sapiens
acaattctaggatgaacaa

SEQ ID NO: 4541020 - DNA, 24 bp, Homo sapiens
acaattctaggatgaacaatgtat

SEQ ID NO: 4541021 - DNA, 15 bp, Homo sapiens
acaattctgttttta

SEQ ID NO: 4541022 - DNA, 21 bp, Homo sapiens
acaattctgtttttaatgcta

SEQ ID NO: 4541023 - DNA, 22 bp, Homo sapiens
acaattgaggtaagttttttga

SEQ ID NO: 4541024 - DNA, 13 bp, Homo sapiens
acaattgggagct

SEQ ID NO: 4541025 - DNA, 15 bp, Homo sapiens
acaattggtaaaact

SEQ ID NO: 4541026 - DNA, 22 bp, Homo sapiens
acaattggtgtcattttcttga

SEQ ID NO: 4541027 - DNA, 12 bp, Homo sapiens
acaatttatttt

SEQ ID NO: 4541028 - DNA, 15 bp, Homo sapiens
acaatttattttatt

SEQ ID NO: 4541029 - DNA, 15 bp, Homo sapiens
acaatttgcacaata

SEQ ID NO: 4541030 - DNA, 14 bp, Homo sapiens
acaattttaaagtt

SEQ ID NO: 4541031 - DNA, 16 bp, Homo sapiens
acaattttaaagttct

SEQ ID NO: 4541032 - DNA, 19 bp, Homo sapiens
acaattttaaagttcttat

SEQ ID NO: 4541033 - DNA, 13 bp, Homo sapiens
acaatttttaatg

SEQ ID NO: 4541034 - DNA, 15 bp, Homo sapiens
acaatttttaatggc

SEQ ID NO: 4541035 - DNA, 16 bp, Homo sapiens
acaattttttatcatg

SEQ ID NO: 4541036 - DNA, 19 bp, Homo sapiens
acacaaaatccattccagg

SEQ ID NO: 4541037 - DNA, 24 bp, Homo sapiens
acacaaaatccattccaggtagct

SEQ ID NO: 4541038 - DNA, 13 bp, Homo sapiens
acacaaaggaagt

SEQ ID NO: 4541039 - DNA, 15 bp, Homo sapiens
acacaacaagaaact

SEQ ID NO: 4541040 - DNA, 19 bp, Homo sapiens
acacaagaccagtgcttag

SEQ ID NO: 4541041 - DNA, 20 bp, Homo sapiens
acacaaggggcaaatgaatt

SEQ ID NO: 4541042 - DNA, 15 bp, Homo sapiens
acacaataaagaacc

SEQ ID NO: 4541043 - DNA, 16 bp, Homo sapiens
acacaatacagtatta

SEQ ID NO: 4541044 - DNA, 21 bp, Homo sapiens
acacaataggtctttctctca

SEQ ID NO: 4541045 - DNA, 23 bp, Homo sapiens
acacaatggtttttaaattttgt

SEQ ID NO: 4541046 - DNA, 17 bp, Homo sapiens
acacaattggaagtcta

SEQ ID NO: 4541047 - DNA, 22 bp, Homo sapiens
acacacccatgtaaccactgca

SEQ ID NO: 4541048 - DNA, 17 bp, Homo sapiens
acacaccctgcttcatt

SEQ ID NO: 4541049 - DNA, 16 bp, Homo sapiens
acacacctgctccaat

SEQ ID NO: 4541050 - DNA, 20 bp, Homo sapiens
acacactcaaatcaagaaac

SEQ ID NO: 4541051 - DNA, 18 bp, Homo sapiens
acacactgagttgcacat

SEQ ID NO: 4541052 - DNA, 15 bp, Homo sapiens
acacactgatgctta

SEQ ID NO: 4541053 - DNA, 23 bp, Homo sapiens
acacactgtgctttctattgtac

SEQ ID NO: 4541054 - DNA, 20 bp, Homo sapiens
acacactgttacacgtgcct

SEQ ID NO: 4541055 - DNA, 13 bp, Homo sapiens
acacagaaacctt

SEQ ID NO: 4541056 - DNA, 18 bp, Homo sapiens
acacagaaacctttttaa

SEQ ID NO: 4541057 - DNA, 17 bp, Homo sapiens
acacagaggagtgcagc

SEQ ID NO: 4541058 - DNA, 13 bp, Homo sapiens
acacagatattgt

SEQ ID NO: 4541059 - DNA, 13 bp, Homo sapiens
acacagcagcccc

SEQ ID NO: 4541060 - DNA, 14 bp, Homo sapiens
acacagctgagcac

SEQ ID NO: 4541061 - DNA, 12 bp, Homo sapiens
acacaggcagcc

SEQ ID NO: 4541062 - DNA, 16 bp, Homo sapiens
acacaggcagggcctg

SEQ ID NO: 4541063 - DNA, 20 bp, Homo sapiens
acacaggcagggcctggctc

SEQ ID NO: 4541064 - DNA, 22 bp, Homo sapiens
acacaggcagggcctggctcca

SEQ ID NO: 4541065 - DNA, 12 bp, Homo sapiens
acacaggctgtc

SEQ ID NO: 4541066 - DNA, 14 bp, Homo sapiens
acacaggggccttt

SEQ ID NO: 4541067 - DNA, 16 bp, Homo sapiens
acacagtacttcctcc

SEQ ID NO: 4541068 - DNA, 19 bp, Homo sapiens
acacagtgagactgtacat

SEQ ID NO: 4541069 - DNA, 21 bp, Homo sapiens
acacagtgagactgtacataa

SEQ ID NO: 4541070 - DNA, 14 bp, Homo sapiens
acacagttaaataa

SEQ ID NO: 4541071 - DNA, 19 bp, Homo sapiens
acacagttcaacataaaga

SEQ ID NO: 4541072 - DNA, 16 bp, Homo sapiens
acacagttcctgggaa

SEQ ID NO: 4541073 - DNA, 16 bp, Homo sapiens
acacataatttctgtt

SEQ ID NO: 4541074 - DNA, 13 bp, Homo sapiens
acacatagattca

SEQ ID NO: 4541075 - DNA, 19 bp, Homo sapiens
acacatagattcacctgta

SEQ ID NO: 4541076 - DNA, 22 bp, Homo sapiens
acacatagattcacctgtaaaa

SEQ ID NO: 4541077 - DNA, 17 bp, Homo sapiens
acacatagcatgtaatg

SEQ ID NO: 4541078 - DNA, 19 bp, Homo sapiens
acacatcaagactatctac

SEQ ID NO: 4541079 - DNA, 21 bp, Homo sapiens
acacatcaagactatctacaa

SEQ ID NO: 4541080 - DNA, 15 bp, Homo sapiens
acacatcctgtcagt

SEQ ID NO: 4541081 - DNA, 13 bp, Homo sapiens
acacatcttaaaa

SEQ ID NO: 4541082 - DNA, 15 bp, Homo sapiens
acacatcttaaaagt

SEQ ID NO: 4541083 - DNA, 16 bp, Homo sapiens
acacatcttaaaagtg

SEQ ID NO: 4541084 - DNA, 18 bp, Homo sapiens
acacatgatcctgcaatt

SEQ ID NO: 4541085 - DNA, 17 bp, Homo sapiens
acacatgcatacttaca

SEQ ID NO: 4541086 - DNA, 17 bp, Homo sapiens
acacatgtgttatctac

SEQ ID NO: 4541087 - DNA, 16 bp, Homo sapiens
acacattataaagttc

SEQ ID NO: 4541088 - DNA, 15 bp, Homo sapiens
acacattatcttctg

SEQ ID NO: 4541089 - DNA, 21 bp, Homo sapiens
acacattgctgtgaacaggaa

SEQ ID NO: 4541090 - DNA, 14 bp, Homo sapiens
acacattgtgcttg

SEQ ID NO: 4541091 - DNA, 17 bp, Homo sapiens
acacattgtgcttggcc

SEQ ID NO: 4541092 - DNA, 19 bp, Homo sapiens
acacatttctattttgcaa

SEQ ID NO: 4541093 - DNA, 13 bp, Homo sapiens
acacatttcttaa

SEQ ID NO: 4541094 - DNA, 14 bp, Homo sapiens
acacatttgaaaca

SEQ ID NO: 4541095 - DNA, 14 bp, Homo sapiens
acacattttatgag

SEQ ID NO: 4541096 - DNA, 13 bp, Homo sapiens
acacatttttaaa

SEQ ID NO: 4541097 - DNA, 18 bp, Homo sapiens
acacatttttaaaacaac

SEQ ID NO: 4541098 - DNA, 14 bp, Homo sapiens
acacatttttcaga

SEQ ID NO: 4541099 - DNA, 13 bp, Homo sapiens
acaccaagcagca

SEQ ID NO: 4541100 - DNA, 16 bp, Homo sapiens
acaccaagcagcaaca

SEQ ID NO: 4541101 - DNA, 22 bp, Homo sapiens
acaccaaggtttatgccaccag

SEQ ID NO: 4541102 - DNA, 15 bp, Homo sapiens
acaccaatattcata

SEQ ID NO: 4541103 - DNA, 20 bp, Homo sapiens
acaccaatgaaaacatgtac

SEQ ID NO: 4541104 - DNA, 14 bp, Homo sapiens
acaccacatgctat

SEQ ID NO: 4541105 - DNA, 18 bp, Homo sapiens
acaccactaaccatcccc

SEQ ID NO: 4541106 - DNA, 19 bp, Homo sapiens
acaccactaaccatcccca

SEQ ID NO: 4541107 - DNA, 11 bp, Homo sapiens
acaccagaaga

SEQ ID NO: 4541108 - DNA, 19 bp, Homo sapiens
acaccagagacaagcagag

SEQ ID NO: 4541109 - DNA, 19 bp, Homo sapiens
acaccataagctactgcca

SEQ ID NO: 4541110 - DNA, 21 bp, Homo sapiens
acaccataagctactgccatc

SEQ ID NO: 4541111 - DNA, 16 bp, Homo sapiens
acaccatgtgcaataa

SEQ ID NO: 4541112 - DNA, 21 bp, Homo sapiens
acaccattaccaaaataataa

SEQ ID NO: 4541113 - DNA, 18 bp, Homo sapiens
acacccagcggccccccg

SEQ ID NO: 4541114 - DNA, 14 bp, Homo sapiens
acacccaggaaggg

SEQ ID NO: 4541115 - DNA, 23 bp, Homo sapiens
acacccaggctggagtgcagtgg

SEQ ID NO: 4541116 - DNA, 23 bp, Homo sapiens
acacccaggggaaggccctgagg

SEQ ID NO: 4541117 - DNA, 16 bp, Homo sapiens
acacccatgccagaga

SEQ ID NO: 4541118 - DNA, 18 bp, Homo sapiens
acacccatgccagagagg

SEQ ID NO: 4541119 - DNA, 15 bp, Homo sapiens
acacccatggcctca

SEQ ID NO: 4541120 - DNA, 12 bp, Homo sapiens
acaccctgccct

SEQ ID NO: 4541121 - DNA, 13 bp, Homo sapiens
acaccctggcctg

SEQ ID NO: 4541122 - DNA, 13 bp, Homo sapiens
acaccctgggcca

SEQ ID NO: 4541123 - DNA, 22 bp, Homo sapiens
acaccctttcatctcagagtcc

SEQ ID NO: 4541124 - DNA, 21 bp, Homo sapiens
acaccgcgtcccagctcccct

SEQ ID NO: 4541125 - DNA, 21 bp, Homo sapiens
acacctactagtcaccagaga

SEQ ID NO: 4541126 - DNA, 23 bp, Homo sapiens
acacctaggctagggtggggaga

SEQ ID NO: 4541127 - DNA, 16 bp, Homo sapiens
acacctcactctttat

SEQ ID NO: 4541128 - DNA, 18 bp, Homo sapiens
acacctcactctttatag

SEQ ID NO: 4541129 - DNA, 23 bp, Homo sapiens
acacctcagttcccttggcctca

SEQ ID NO: 4541130 - DNA, 17 bp, Homo sapiens
acacctccccctgcgcc

SEQ ID NO: 4541131 - DNA, 18 bp, Homo sapiens
acacctccccctgcgccc

SEQ ID NO: 4541132 - DNA, 22 bp, Homo sapiens
acacctccccctttcacactgg

SEQ ID NO: 4541133 - DNA, 14 bp, Homo sapiens
acacctccctactc

SEQ ID NO: 4541134 - DNA, 21 bp, Homo sapiens
acacctcctcccgaaaaatgt

SEQ ID NO: 4541135 - DNA, 13 bp, Homo sapiens
acacctctgccag

SEQ ID NO: 4541136 - DNA, 17 bp, Homo sapiens
acacctgagccagcctg

SEQ ID NO: 4541137 - DNA, 11 bp, Homo sapiens
acacctgcacc

SEQ ID NO: 4541138 - DNA, 14 bp, Homo sapiens
acacctgcacctcc

SEQ ID NO: 4541139 - DNA, 15 bp, Homo sapiens
acacctgcacctccc

SEQ ID NO: 4541140 - DNA, 18 bp, Homo sapiens
acacctgcacctcccccc

SEQ ID NO: 4541141 - DNA, 19 bp, Homo sapiens
acacctgcacctcccccca

SEQ ID NO: 4541142 - DNA, 24 bp, Homo sapiens
acacctgcacctccccccactgca

SEQ ID NO: 4541143 - DNA, 14 bp, Homo sapiens
acacctgccctaaa

SEQ ID NO: 4541144 - DNA, 20 bp, Homo sapiens
acacctgccttctaccctct

SEQ ID NO: 4541145 - DNA, 13 bp, Homo sapiens
acacctggactga

SEQ ID NO: 4541146 - DNA, 14 bp, Homo sapiens
acaccttcctcctg

SEQ ID NO: 4541147 - DNA, 15 bp, Homo sapiens
acaccttcctcctgc

SEQ ID NO: 4541148 - DNA, 21 bp, Homo sapiens
acaccttttattgacacagaa

SEQ ID NO: 4541149 - DNA, 21 bp, Homo sapiens
acacgccccggtcccccagag

SEQ ID NO: 4541150 - DNA, 12 bp, Homo sapiens
acacgcttctga

SEQ ID NO: 4541151 - DNA, 15 bp, Homo sapiens
acacgtgaggggggg

SEQ ID NO: 4541152 - DNA, 19 bp, Homo sapiens
acacgtttaatcccagcac

SEQ ID NO: 4541153 - DNA, 15 bp, Homo sapiens
acactaacctgggtt

SEQ ID NO: 4541154 - DNA, 14 bp, Homo sapiens
acactaatatattt

SEQ ID NO: 4541155 - DNA, 20 bp, Homo sapiens
acactagcccaatgaaatga

SEQ ID NO: 4541156 - DNA, 23 bp, Homo sapiens
acactagccttggcctctttcct

SEQ ID NO: 4541157 - DNA, 22 bp, Homo sapiens
acactagggactatcaggtaat

SEQ ID NO: 4541158 - DNA, 21 bp, Homo sapiens
acactaggggtttcacctgca

SEQ ID NO: 4541159 - DNA, 19 bp, Homo sapiens
acactcaaatcaagaaact

SEQ ID NO: 4541160 - DNA, 15 bp, Homo sapiens
acactcaaggacagg

SEQ ID NO: 4541161 - DNA, 16 bp, Homo sapiens
acactcaaggacagga

SEQ ID NO: 4541162 - DNA, 17 bp, Homo sapiens
acactcaataaacagtc

SEQ ID NO: 4541163 - DNA, 18 bp, Homo sapiens
acactcaataaacagtca

SEQ ID NO: 4541164 - DNA, 20 bp, Homo sapiens
acactcaataaacagtcact

SEQ ID NO: 4541165 - DNA, 19 bp, Homo sapiens
acactcagccactgtcaca

SEQ ID NO: 4541166 - DNA, 18 bp, Homo sapiens
acactcattgaaatgtaa

SEQ ID NO: 4541167 - DNA, 14 bp, Homo sapiens
acactccagtgaga

SEQ ID NO: 4541168 - DNA, 15 bp, Homo sapiens
acactccttgtcaac

SEQ ID NO: 4541169 - DNA, 22 bp, Homo sapiens
acactctatatgtagtgcattt

SEQ ID NO: 4541170 - DNA, 17 bp, Homo sapiens
acactctcctgggcccc

SEQ ID NO: 4541171 - DNA, 19 bp, Homo sapiens
acactctcctgggcccctc

SEQ ID NO: 4541172 - DNA, 20 bp, Homo sapiens
acactctcctgggcccctcc

SEQ ID NO: 4541173 - DNA, 21 bp, Homo sapiens
acactcttttgctttattcca

SEQ ID NO: 4541174 - DNA, 18 bp, Homo sapiens
acactgaaagttttgtaa

SEQ ID NO: 4541175 - DNA, 23 bp, Homo sapiens
acactgaaagttttgtaaaagaa

SEQ ID NO: 4541176 - DNA, 12 bp, Homo sapiens
acactgaactta

SEQ ID NO: 4541177 - DNA, 20 bp, Homo sapiens
acactgaccaagtgctggcc

SEQ ID NO: 4541178 - DNA, 21 bp, Homo sapiens
acactgagctgtgacccagag

SEQ ID NO: 4541179 - DNA, 22 bp, Homo sapiens
acactgagctgtgacccagagg

SEQ ID NO: 4541180 - DNA, 18 bp, Homo sapiens
acactgatcccccagatg

SEQ ID NO: 4541181 - DNA, 17 bp, Homo sapiens
acactgcactttgttta

SEQ ID NO: 4541182 - DNA, 20 bp, Homo sapiens
acactgcactttgtttagaa

SEQ ID NO: 4541183 - DNA, 11 bp, Homo sapiens
acactgccagc

SEQ ID NO: 4541184 - DNA, 15 bp, Homo sapiens
acactgccctcttgt

SEQ ID NO: 4541185 - DNA, 21 bp, Homo sapiens
acactgcggtaggtcattctt

SEQ ID NO: 4541186 - DNA, 17 bp, Homo sapiens
acactgctctaacagcc

SEQ ID NO: 4541187 - DNA, 20 bp, Homo sapiens
acactgctctaacagccctc

SEQ ID NO: 4541188 - DNA, 17 bp, Homo sapiens
acactggaatataaaac

SEQ ID NO: 4541189 - DNA, 20 bp, Homo sapiens
acactggggtgccgcctgcc

SEQ ID NO: 4541190 - DNA, 21 bp, Homo sapiens
acactggggtgccgcctgccc

SEQ ID NO: 4541191 - DNA, 20 bp, Homo sapiens
acactgggtggtggcctggt

SEQ ID NO: 4541192 - DNA, 23 bp, Homo sapiens
acactgggtggtggcctggtccc

SEQ ID NO: 4541193 - DNA, 20 bp, Homo sapiens
acactggtctgctgttccag

SEQ ID NO: 4541194 - DNA, 16 bp, Homo sapiens
acactggtgtgacctg

SEQ ID NO: 4541195 - DNA, 20 bp, Homo sapiens
acactggtgtgacctgaggg

SEQ ID NO: 4541196 - DNA, 21 bp, Homo sapiens
acactggtgtgacctgagggc

SEQ ID NO: 4541197 - DNA, 12 bp, Homo sapiens
acactgtatttt

SEQ ID NO: 4541198 - DNA, 14 bp, Homo sapiens
acactgtattttaa

SEQ ID NO: 4541199 - DNA, 15 bp, Homo sapiens
acactgtattttaat

SEQ ID NO: 4541200 - DNA, 18 bp, Homo sapiens
acactgtgtactgcagtt

SEQ ID NO: 4541201 - DNA, 16 bp, Homo sapiens
acactgttagaacact

SEQ ID NO: 4541202 - DNA, 20 bp, Homo sapiens
acactgttagaacactattt

SEQ ID NO: 4541203 - DNA, 13 bp, Homo sapiens
acacttaaaaatg

SEQ ID NO: 4541204 - DNA, 14 bp, Homo sapiens
acacttaatactac

SEQ ID NO: 4541205 - DNA, 13 bp, Homo sapiens
acacttaatagca

SEQ ID NO: 4541206 - DNA, 21 bp, Homo sapiens
acacttatattttatgaacat

SEQ ID NO: 4541207 - DNA, 24 bp, Homo sapiens
acacttatattttatgaacattgt

SEQ ID NO: 4541208 - DNA, 15 bp, Homo sapiens
acacttatcttctgg

SEQ ID NO: 4541209 - DNA, 18 bp, Homo sapiens
acacttctccttatcttt

SEQ ID NO: 4541210 - DNA, 23 bp, Homo sapiens
acacttctgtgagacccccacac

SEQ ID NO: 4541211 - DNA, 24 bp, Homo sapiens
acacttgaagcctaaatttgtgct

SEQ ID NO: 4541212 - DNA, 23 bp, Homo sapiens
acacttgatggagtgtgagccac

SEQ ID NO: 4541213 - DNA, 16 bp, Homo sapiens
acacttggcatacaaa

SEQ ID NO: 4541214 - DNA, 17 bp, Homo sapiens
acactttgccaaggctc

SEQ ID NO: 4541215 - DNA, 19 bp, Homo sapiens
acactttgccaaggctctc

SEQ ID NO: 4541216 - DNA, 19 bp, Homo sapiens
acactttgcctcctgtgta

SEQ ID NO: 4541217 - DNA, 18 bp, Homo sapiens
acacttttgagacttttt

SEQ ID NO: 4541218 - DNA, 21 bp, Homo sapiens
acactttttctctttccatga

SEQ ID NO: 4541219 - DNA, 15 bp, Homo sapiens
acactttttgtgaat

SEQ ID NO: 4541220 - DNA, 13 bp, Homo sapiens
acagaaaaagaag

SEQ ID NO: 4541221 - DNA, 21 bp, Homo sapiens
acagaaaaattgaactacagc

SEQ ID NO: 4541222 - DNA, 17 bp, Homo sapiens
acagaaaccagaaaagc

SEQ ID NO: 4541223 - DNA, 15 bp, Homo sapiens
acagaaaccttttta

SEQ ID NO: 4541224 - DNA, 23 bp, Homo sapiens
acagaaagccaggagcagccctg

SEQ ID NO: 4541225 - DNA, 20 bp, Homo sapiens
acagaaaggcaggtttcatt

SEQ ID NO: 4541226 - DNA, 15 bp, Homo sapiens
acagaaatggactgg

SEQ ID NO: 4541227 - DNA, 16 bp, Homo sapiens
acagaaattgtatatt

SEQ ID NO: 4541228 - DNA, 16 bp, Homo sapiens
acagaacatagacaga

SEQ ID NO: 4541229 - DNA, 16 bp, Homo sapiens
acagaaccaaatcgtg

SEQ ID NO: 4541230 - DNA, 15 bp, Homo sapiens
acagaacctttgtca

SEQ ID NO: 4541231 - DNA, 14 bp, Homo sapiens
acagaagaaaagca

SEQ ID NO: 4541232 - DNA, 13 bp, Homo sapiens
acagaatagttta

SEQ ID NO: 4541233 - DNA, 17 bp, Homo sapiens
acagaatattaaatatt

SEQ ID NO: 4541234 - DNA, 18 bp, Homo sapiens
acagaatattaaatatta

SEQ ID NO: 4541235 - DNA, 20 bp, Homo sapiens
acagaatattaaatattata

SEQ ID NO: 4541236 - DNA, 16 bp, Homo sapiens
acagaatatttttata

SEQ ID NO: 4541237 - DNA, 13 bp, Homo sapiens
acagaatgtgttc

SEQ ID NO: 4541238 - DNA, 14 bp, Homo sapiens
acagaatgtgttct

SEQ ID NO: 4541239 - DNA, 18 bp, Homo sapiens
acagaatgtgttcttttc

SEQ ID NO: 4541240 - DNA, 20 bp, Homo sapiens
acagaattatagatgtctga

SEQ ID NO: 4541241 - DNA, 14 bp, Homo sapiens
acagaattggatac

SEQ ID NO: 4541242 - DNA, 15 bp, Homo sapiens
acagacaaaaacaag

SEQ ID NO: 4541243 - DNA, 17 bp, Homo sapiens
acagacccacccccagc

SEQ ID NO: 4541244 - DNA, 12 bp, Homo sapiens
acagacccagga

SEQ ID NO: 4541245 - DNA, 17 bp, Homo sapiens
acagacctcgagtttct

SEQ ID NO: 4541246 - DNA, 18 bp, Homo sapiens
acagacgagacaacagca

SEQ ID NO: 4541247 - DNA, 16 bp, Homo sapiens
acagactatttgctaa

SEQ ID NO: 4541248 - DNA, 14 bp, Homo sapiens
acagactattttta

SEQ ID NO: 4541249 - DNA, 17 bp, Homo sapiens
acagactatttttagat

SEQ ID NO: 4541250 - DNA, 18 bp, Homo sapiens
acagactccatctcttct

SEQ ID NO: 4541251 - DNA, 16 bp, Homo sapiens
acagagaaatacaaaa

SEQ ID NO: 4541252 - DNA, 16 bp, Homo sapiens
acagagaaggcaggaa

SEQ ID NO: 4541253 - DNA, 14 bp, Homo sapiens
acagagaatttcta

SEQ ID NO: 4541254 - DNA, 14 bp, Homo sapiens
acagagacacctgc

SEQ ID NO: 4541255 - DNA, 17 bp, Homo sapiens
acagagacacctgcacc

SEQ ID NO: 4541256 - DNA, 14 bp, Homo sapiens
acagagacagtgaa

SEQ ID NO: 4541257 - DNA, 23 bp, Homo sapiens
acagagactcagatgaggacaga

SEQ ID NO: 4541258 - DNA, 13 bp, Homo sapiens
acagagcccccct

SEQ ID NO: 4541259 - DNA, 22 bp, Homo sapiens
acagagcctgaatttgtaagca

SEQ ID NO: 4541260 - DNA, 19 bp, Homo sapiens
acagagcgagactccatct

SEQ ID NO: 4541261 - DNA, 20 bp, Homo sapiens
acagagcgagactccatctc

SEQ ID NO: 4541262 - DNA, 15 bp, Homo sapiens
acagagcttccctga

SEQ ID NO: 4541263 - DNA, 13 bp, Homo sapiens
acagaggcagccc

SEQ ID NO: 4541264 - DNA, 12 bp, Homo sapiens
acagaggcctga

SEQ ID NO: 4541265 - DNA, 21 bp, Homo sapiens
acagaggctgcacccctgggc

SEQ ID NO: 4541266 - DNA, 22 bp, Homo sapiens
acagaggctgcacccctgggcc

SEQ ID NO: 4541267 - DNA, 21 bp, Homo sapiens
acagagggaagccagtcaggg

SEQ ID NO: 4541268 - DNA, 23 bp, Homo sapiens
acagagggaccaaattgcttcta

SEQ ID NO: 4541269 - DNA, 18 bp, Homo sapiens
acagagggagacagggct

SEQ ID NO: 4541270 - DNA, 20 bp, Homo sapiens
acagagggagacagggctgc

SEQ ID NO: 4541271 - DNA, 16 bp, Homo sapiens
acagaggttgtagtga

SEQ ID NO: 4541272 - DNA, 17 bp, Homo sapiens
acagagtgctggactgt

SEQ ID NO: 4541273 - DNA, 16 bp, Homo sapiens
acagagtgcttttctg

SEQ ID NO: 4541274 - DNA, 21 bp, Homo sapiens
acagagtggcctccctgctgt

SEQ ID NO: 4541275 - DNA, 16 bp, Homo sapiens
acagagtggtttccaa

SEQ ID NO: 4541276 - DNA, 13 bp, Homo sapiens
acagagttgattt

SEQ ID NO: 4541277 - DNA, 19 bp, Homo sapiens
acagatatactttgtggac

SEQ ID NO: 4541278 - DNA, 22 bp, Homo sapiens
acagatcaggaattctaaataa

SEQ ID NO: 4541279 - DNA, 18 bp, Homo sapiens
acagatcaggctagccct

SEQ ID NO: 4541280 - DNA, 12 bp, Homo sapiens
acagatcagtaa

SEQ ID NO: 4541281 - DNA, 14 bp, Homo sapiens
acagatgaataaac

SEQ ID NO: 4541282 - DNA, 16 bp, Homo sapiens
acagatgccccagagc

SEQ ID NO: 4541283 - DNA, 18 bp, Homo sapiens
acagatgccccagagctg

SEQ ID NO: 4541284 - DNA, 19 bp, Homo sapiens
acagatttctcactatata

SEQ ID NO: 4541285 - DNA, 16 bp, Homo sapiens
acagatttttttgtaa

SEQ ID NO: 4541286 - DNA, 22 bp, Homo sapiens
acagcaaacaggtgctaatttg

SEQ ID NO: 4541287 - DNA, 20 bp, Homo sapiens
acagcaacaatttatgaatt

SEQ ID NO: 4541288 - DNA, 17 bp, Homo sapiens
acagcaagatgtttctt

SEQ ID NO: 4541289 - DNA, 13 bp, Homo sapiens
acagcacacaggc

SEQ ID NO: 4541290 - DNA, 19 bp, Homo sapiens
acagcacagggaagcaaat

SEQ ID NO: 4541291 - DNA, 14 bp, Homo sapiens
acagcactactctg

SEQ ID NO: 4541292 - DNA, 17 bp, Homo sapiens
acagcactactctgtgc

SEQ ID NO: 4541293 - DNA, 16 bp, Homo sapiens
acagcactactgggtg

SEQ ID NO: 4541294 - DNA, 22 bp, Homo sapiens
acagcactactgggtgtcattt

SEQ ID NO: 4541295 - DNA, 12 bp, Homo sapiens
acagcagaagcc

SEQ ID NO: 4541296 - DNA, 12 bp, Homo sapiens
acagcagcattt

SEQ ID NO: 4541297 - DNA, 20 bp, Homo sapiens
acagcagccccccagcacta

SEQ ID NO: 4541298 - DNA, 20 bp, Homo sapiens
acagcaggctgccagtgcct

SEQ ID NO: 4541299 - DNA, 22 bp, Homo sapiens
acagcagtgtgaatagcctggc

SEQ ID NO: 4541300 - DNA, 22 bp, Homo sapiens
acagcagttgaaaagactccaa

SEQ ID NO: 4541301 - DNA, 15 bp, Homo sapiens
acagcatcccttccc

SEQ ID NO: 4541302 - DNA, 16 bp, Homo sapiens
acagcatcccttccca

SEQ ID NO: 4541303 - DNA, 16 bp, Homo sapiens
acagcatgtgttaatc

SEQ ID NO: 4541304 - DNA, 14 bp, Homo sapiens
acagccaaatttaa

SEQ ID NO: 4541305 - DNA, 16 bp, Homo sapiens
acagccaactagcccc

SEQ ID NO: 4541306 - DNA, 19 bp, Homo sapiens
acagccaagttgtgacagt

SEQ ID NO: 4541307 - DNA, 21 bp, Homo sapiens
acagccacccgtggggtgctg

SEQ ID NO: 4541308 - DNA, 23 bp, Homo sapiens
acagccacccgtggggtgctgcc

SEQ ID NO: 4541309 - DNA, 15 bp, Homo sapiens
acagccagactggca

SEQ ID NO: 4541310 - DNA, 13 bp, Homo sapiens
acagccagaggag

SEQ ID NO: 4541311 - DNA, 18 bp, Homo sapiens
acagccagaggagggcag

SEQ ID NO: 4541312 - DNA, 16 bp, Homo sapiens
acagccaggtgccttg

SEQ ID NO: 4541313 - DNA, 17 bp, Homo sapiens
acagccaggtggcacct

SEQ ID NO: 4541314 - DNA, 20 bp, Homo sapiens
acagccaggtggcacctgca

SEQ ID NO: 4541315 - DNA, 21 bp, Homo sapiens
acagccaggtggcacctgcag

SEQ ID NO: 4541316 - DNA, 17 bp, Homo sapiens
acagcccccctgctgct

SEQ ID NO: 4541317 - DNA, 23 bp, Homo sapiens
acagcccctatagcactgagctc

SEQ ID NO: 4541318 - DNA, 12 bp, Homo sapiens
acagcccctgga

SEQ ID NO: 4541319 - DNA, 20 bp, Homo sapiens
acagcccctggagcctcaga

SEQ ID NO: 4541320 - DNA, 15 bp, Homo sapiens
acagccctcggcctc

SEQ ID NO: 4541321 - DNA, 18 bp, Homo sapiens
acagccctctctctcact

SEQ ID NO: 4541322 - DNA, 19 bp, Homo sapiens
acagccgcgggccaggagg

SEQ ID NO: 4541323 - DNA, 23 bp, Homo sapiens
acagccgtcccgcgttcaagact

SEQ ID NO: 4541324 - DNA, 17 bp, Homo sapiens
acagcctcccctgccag

SEQ ID NO: 4541325 - DNA, 22 bp, Homo sapiens
acagcctcccctgccagggcag

SEQ ID NO: 4541326 - DNA, 13 bp, Homo sapiens
acagcctcctctg

SEQ ID NO: 4541327 - DNA, 20 bp, Homo sapiens
acagcctcctctgtctgccc

SEQ ID NO: 4541328 - DNA, 15 bp, Homo sapiens
acagcctctacagcc

SEQ ID NO: 4541329 - DNA, 13 bp, Homo sapiens
acagcctctctct

SEQ ID NO: 4541330 - DNA, 16 bp, Homo sapiens
acagcctctctctttt

SEQ ID NO: 4541331 - DNA, 14 bp, Homo sapiens
acagcctcttactt

SEQ ID NO: 4541332 - DNA, 21 bp, Homo sapiens
acagcctgtggcggtgcctgg

SEQ ID NO: 4541333 - DNA, 19 bp, Homo sapiens
acagccttgcagcggctcc

SEQ ID NO: 4541334 - DNA, 23 bp, Homo sapiens
acagccttgcagcggctcctgca

SEQ ID NO: 4541335 - DNA, 17 bp, Homo sapiens
acagcgataagctttca

SEQ ID NO: 4541336 - DNA, 23 bp, Homo sapiens
acagcgctcgatggacctcagca

SEQ ID NO: 4541337 - DNA, 19 bp, Homo sapiens
acagcggctcccctctgct

SEQ ID NO: 4541338 - DNA, 14 bp, Homo sapiens
acagcgtccctggc

SEQ ID NO: 4541339 - DNA, 17 bp, Homo sapiens
acagctacaaactttta

SEQ ID NO: 4541340 - DNA, 22 bp, Homo sapiens
acagctactctccccacgaggg

SEQ ID NO: 4541341 - DNA, 13 bp, Homo sapiens
acagctactttaa

SEQ ID NO: 4541342 - DNA, 22 bp, Homo sapiens
acagctatatttgattatgtat

SEQ ID NO: 4541343 - DNA, 20 bp, Homo sapiens
acagctattggcaagtttta

SEQ ID NO: 4541344 - DNA, 22 bp, Homo sapiens
acagctattggcaagttttaaa

SEQ ID NO: 4541345 - DNA, 16 bp, Homo sapiens
acagctcattaaactt

SEQ ID NO: 4541346 - DNA, 16 bp, Homo sapiens
acagctcccaccccac

SEQ ID NO: 4541347 - DNA, 18 bp, Homo sapiens
acagctcccaccccaccc

SEQ ID NO: 4541348 - DNA, 22 bp, Homo sapiens
acagctcccaccccaccccctt

SEQ ID NO: 4541349 - DNA, 16 bp, Homo sapiens
acagctcctggaccag

SEQ ID NO: 4541350 - DNA, 19 bp, Homo sapiens
acagctgaagtcaaaatat

SEQ ID NO: 4541351 - DNA, 23 bp, Homo sapiens
acagctgagcacccagctctgtc

SEQ ID NO: 4541352 - DNA, 14 bp, Homo sapiens
acagctgagcactt

SEQ ID NO: 4541353 - DNA, 11 bp, Homo sapiens
acagctgcctt

SEQ ID NO: 4541354 - DNA, 14 bp, Homo sapiens
acagctgccttagc

SEQ ID NO: 4541355 - DNA, 18 bp, Homo sapiens
acagctgctgttctcagg

SEQ ID NO: 4541356 - DNA, 22 bp, Homo sapiens
acagctgctgttctcaggacag

SEQ ID NO: 4541357 - DNA, 13 bp, Homo sapiens
acagctgctttct

SEQ ID NO: 4541358 - DNA, 18 bp, Homo sapiens
acagctggaggaatacat

SEQ ID NO: 4541359 - DNA, 22 bp, Homo sapiens
acagctggaggaatacatttta

SEQ ID NO: 4541360 - DNA, 11 bp, Homo sapiens
acagctggggc

SEQ ID NO: 4541361 - DNA, 22 bp, Homo sapiens
acagctgtatagctgcttccag

SEQ ID NO: 4541362 - DNA, 13 bp, Homo sapiens
acagctgtattta

SEQ ID NO: 4541363 - DNA, 17 bp, Homo sapiens
acagctgtatttatata

SEQ ID NO: 4541364 - DNA, 15 bp, Homo sapiens
acagctgtccctgtc

SEQ ID NO: 4541365 - DNA, 12 bp, Homo sapiens
acagctgtgccg

SEQ ID NO: 4541366 - DNA, 15 bp, Homo sapiens
acagctgtgccggga

SEQ ID NO: 4541367 - DNA, 14 bp, Homo sapiens
acagcttagatttc

SEQ ID NO: 4541368 - DNA, 16 bp, Homo sapiens
acagcttagatttcat

SEQ ID NO: 4541369 - DNA, 21 bp, Homo sapiens
acagcttgagccgggcccctg

SEQ ID NO: 4541370 - DNA, 18 bp, Homo sapiens
acagctttgtatgtttat

SEQ ID NO: 4541371 - DNA, 18 bp, Homo sapiens
acagcttttcccaggaga

SEQ ID NO: 4541372 - DNA, 17 bp, Homo sapiens
acaggaaaatcctctgg

SEQ ID NO: 4541373 - DNA, 13 bp, Homo sapiens
acaggaaacaaac

SEQ ID NO: 4541374 - DNA, 16 bp, Homo sapiens
acaggaaagccctccc

SEQ ID NO: 4541375 - DNA, 18 bp, Homo sapiens
acaggaaagccctccccc

SEQ ID NO: 4541376 - DNA, 16 bp, Homo sapiens
acaggaagatgggagg

SEQ ID NO: 4541377 - DNA, 22 bp, Homo sapiens
acaggaagatgggaggtggaag

SEQ ID NO: 4541378 - DNA, 20 bp, Homo sapiens
acaggaagcaccccatgcca

SEQ ID NO: 4541379 - DNA, 14 bp, Homo sapiens
acaggagcctagcg

SEQ ID NO: 4541380 - DNA, 12 bp, Homo sapiens
acaggagggcca

SEQ ID NO: 4541381 - DNA, 13 bp, Homo sapiens
acaggagggccag

SEQ ID NO: 4541382 - DNA, 23 bp, Homo sapiens
acaggaggtggatttggagaccg

SEQ ID NO: 4541383 - DNA, 17 bp, Homo sapiens
acaggcacacagggccc

SEQ ID NO: 4541384 - DNA, 9 bp, Homo sapiens
acaggcagc

SEQ ID NO: 4541385 - DNA, 22 bp, Homo sapiens
acaggcaggccagatggcccct

SEQ ID NO: 4541386 - DNA, 16 bp, Homo sapiens
acaggcagggcctggc

SEQ ID NO: 4541387 - DNA, 19 bp, Homo sapiens
acaggcagggcctggctcc

SEQ ID NO: 4541388 - DNA, 16 bp, Homo sapiens
acaggcaggtcacaga

SEQ ID NO: 4541389 - DNA, 18 bp, Homo sapiens
acaggcagtctctctctt

SEQ ID NO: 4541390 - DNA, 18 bp, Homo sapiens
acaggcatattccctgca

SEQ ID NO: 4541391 - DNA, 20 bp, Homo sapiens
acaggcatattccctgcaca

SEQ ID NO: 4541392 - DNA, 19 bp, Homo sapiens
acaggccattgtgaaccaa

SEQ ID NO: 4541393 - DNA, 17 bp, Homo sapiens
acaggcctgagatttca

SEQ ID NO: 4541394 - DNA, 15 bp, Homo sapiens
acaggcgggctcgga

SEQ ID NO: 4541395 - DNA, 18 bp, Homo sapiens
acaggctggaagatagct

SEQ ID NO: 4541396 - DNA, 14 bp, Homo sapiens
acaggctgggtcct

SEQ ID NO: 4541397 - DNA, 19 bp, Homo sapiens
acaggctgggtcctgccag

SEQ ID NO: 4541398 - DNA, 20 bp, Homo sapiens
acaggctgggtcctgccagc

SEQ ID NO: 4541399 - DNA, 21 bp, Homo sapiens
acaggctgggtcctgccagct

SEQ ID NO: 4541400 - DNA, 20 bp, Homo sapiens
acagggacatgccctgtgtg

SEQ ID NO: 4541401 - DNA, 13 bp, Homo sapiens
acagggaggctcc

SEQ ID NO: 4541402 - DNA, 16 bp, Homo sapiens
acagggaggctcccgg

SEQ ID NO: 4541403 - DNA, 23 bp, Homo sapiens
acagggaggctcccggggcctgg

SEQ ID NO: 4541404 - DNA, 22 bp, Homo sapiens
acagggataaggcctgtggggg

SEQ ID NO: 4541405 - DNA, 17 bp, Homo sapiens
acagggcagctgggccc

SEQ ID NO: 4541406 - DNA, 16 bp, Homo sapiens
acagggctgccttctg

SEQ ID NO: 4541407 - DNA, 24 bp, Homo sapiens
acagggctgctccccaacacctgc

SEQ ID NO: 4541408 - DNA, 16 bp, Homo sapiens
acagggctggcccagc

SEQ ID NO: 4541409 - DNA, 21 bp, Homo sapiens
acagggctggcccagccctgc

SEQ ID NO: 4541410 - DNA, 23 bp, Homo sapiens
acagggctggcccagccctgctg

SEQ ID NO: 4541411 - DNA, 19 bp, Homo sapiens
acagggctgttttgcctcc

SEQ ID NO: 4541412 - DNA, 14 bp, Homo sapiens
acaggggcttgact

SEQ ID NO: 4541413 - DNA, 17 bp, Homo sapiens
acaggggtagtttgttt

SEQ ID NO: 4541414 - DNA, 15 bp, Homo sapiens
acagggtacctcaag

SEQ ID NO: 4541415 - DNA, 17 bp, Homo sapiens
acagggtccaggaatgg

SEQ ID NO: 4541416 - DNA, 15 bp, Homo sapiens
acagggtcttgctct

SEQ ID NO: 4541417 - DNA, 17 bp, Homo sapiens
acagggtcttgctctgt

SEQ ID NO: 4541418 - DNA, 20 bp, Homo sapiens
acagggtcttgctctgtccc

SEQ ID NO: 4541419 - DNA, 21 bp, Homo sapiens
acagggtgggagggaggaggg

SEQ ID NO: 4541420 - DNA, 21 bp, Homo sapiens
acagggtgggcttcctgccct

SEQ ID NO: 4541421 - DNA, 14 bp, Homo sapiens
acagggttgggccc

SEQ ID NO: 4541422 - DNA, 15 bp, Homo sapiens
acagggtttcaccat

SEQ ID NO: 4541423 - DNA, 17 bp, Homo sapiens
acaggtatttttttaaa

SEQ ID NO: 4541424 - DNA, 21 bp, Homo sapiens
acaggtcagtagtcacaaact

SEQ ID NO: 4541425 - DNA, 19 bp, Homo sapiens
acaggtcccacgccaggcc

SEQ ID NO: 4541426 - DNA, 21 bp, Homo sapiens
acaggtcccacgccaggccag

SEQ ID NO: 4541427 - DNA, 23 bp, Homo sapiens
acaggtgcgcgccaccgtgcctg

SEQ ID NO: 4541428 - DNA, 24 bp, Homo sapiens
acaggtgttccgtgggaccctcag

SEQ ID NO: 4541429 - DNA, 18 bp, Homo sapiens
acaggttataacagtgtt

SEQ ID NO: 4541430 - DNA, 19 bp, Homo sapiens
acaggttcttaaaaaggaa

SEQ ID NO: 4541431 - DNA, 20 bp, Homo sapiens
acaggttcttaaaaaggaac

SEQ ID NO: 4541432 - DNA, 21 bp, Homo sapiens
acaggttcttaaaaaggaaca

SEQ ID NO: 4541433 - DNA, 15 bp, Homo sapiens
acaggttgggatggg

SEQ ID NO: 4541434 - DNA, 13 bp, Homo sapiens
acagtaaaaataa

SEQ ID NO: 4541435 - DNA, 16 bp, Homo sapiens
acagtaaaaataaaat

SEQ ID NO: 4541436 - DNA, 23 bp, Homo sapiens
acagtaaacactccacattcttc

SEQ ID NO: 4541437 - DNA, 15 bp, Homo sapiens
acagtaaaccactga

SEQ ID NO: 4541438 - DNA, 18 bp, Homo sapiens
acagtaaaccactgaaaa

SEQ ID NO: 4541439 - DNA, 22 bp, Homo sapiens
acagtaaaccactgaaaaaata

SEQ ID NO: 4541440 - DNA, 13 bp, Homo sapiens
acagtaatgaaat

SEQ ID NO: 4541441 - DNA, 18 bp, Homo sapiens
acagtaatgaaatgttta

SEQ ID NO: 4541442 - DNA, 15 bp, Homo sapiens
acagtaattgtgaca

SEQ ID NO: 4541443 - DNA, 15 bp, Homo sapiens
acagtacagaaggca

SEQ ID NO: 4541444 - DNA, 15 bp, Homo sapiens
acagtacccaaactg

SEQ ID NO: 4541445 - DNA, 18 bp, Homo sapiens
acagtaccttaggttctt

SEQ ID NO: 4541446 - DNA, 20 bp, Homo sapiens
acagtactggttactttcaa

SEQ ID NO: 4541447 - DNA, 21 bp, Homo sapiens
acagtactggttactttcaaa

SEQ ID NO: 4541448 - DNA, 18 bp, Homo sapiens
acagtagaactgtctgtg

SEQ ID NO: 4541449 - DNA, 19 bp, Homo sapiens
acagtagaactgtctgtga

SEQ ID NO: 4541450 - DNA, 22 bp, Homo sapiens
acagtaggagcccagctctgaa

SEQ ID NO: 4541451 - DNA, 23 bp, Homo sapiens
acagtagtcttgatgaccaaagt

SEQ ID NO: 4541452 - DNA, 15 bp, Homo sapiens
acagtatataagctt

SEQ ID NO: 4541453 - DNA, 21 bp, Homo sapiens
acagtatcagtattttcacac

SEQ ID NO: 4541454 - DNA, 21 bp, Homo sapiens
acagtattaacatcaaagact

SEQ ID NO: 4541455 - DNA, 20 bp, Homo sapiens
acagtattatagacaaaaga

SEQ ID NO: 4541456 - DNA, 14 bp, Homo sapiens
acagtattgggcag

SEQ ID NO: 4541457 - DNA, 14 bp, Homo sapiens
acagtattgtggca

SEQ ID NO: 4541458 - DNA, 14 bp, Homo sapiens
acagtatttgtaat

SEQ ID NO: 4541459 - DNA, 15 bp, Homo sapiens
acagtcacctcacaa

SEQ ID NO: 4541460 - DNA, 12 bp, Homo sapiens
acagtcactgga

SEQ ID NO: 4541461 - DNA, 14 bp, Homo sapiens
acagtcatggcctg

SEQ ID NO: 4541462 - DNA, 12 bp, Homo sapiens
acagtccacagg

SEQ ID NO: 4541463 - DNA, 17 bp, Homo sapiens
acagtccacaggggcca

SEQ ID NO: 4541464 - DNA, 22 bp, Homo sapiens
acagtccacaggggccaccacc

SEQ ID NO: 4541465 - DNA, 14 bp, Homo sapiens
acagtccagaccca

SEQ ID NO: 4541466 - DNA, 12 bp, Homo sapiens
acagtccctgct

SEQ ID NO: 4541467 - DNA, 14 bp, Homo sapiens
acagtccctgctgg

SEQ ID NO: 4541468 - DNA, 14 bp, Homo sapiens
acagtctagtgcaa

SEQ ID NO: 4541469 - DNA, 14 bp, Homo sapiens
acagtctcaggaaa

SEQ ID NO: 4541470 - DNA, 15 bp, Homo sapiens
acagtctcaggaaat

SEQ ID NO: 4541471 - DNA, 17 bp, Homo sapiens
acagtctgaagctcgca

SEQ ID NO: 4541472 - DNA, 14 bp, Homo sapiens
acagtcttccattt

SEQ ID NO: 4541473 - DNA, 15 bp, Homo sapiens
acagtcttgtattaa

SEQ ID NO: 4541474 - DNA, 18 bp, Homo sapiens
acagtcttgtattaagtt

SEQ ID NO: 4541475 - DNA, 22 bp, Homo sapiens
acagtcttgtgaactttgaatg

SEQ ID NO: 4541476 - DNA, 20 bp, Homo sapiens
acagtgaagcagcactgtga

SEQ ID NO: 4541477 - DNA, 14 bp, Homo sapiens
acagtgagactctg

SEQ ID NO: 4541478 - DNA, 16 bp, Homo sapiens
acagtgagactgtaca

SEQ ID NO: 4541479 - DNA, 16 bp, Homo sapiens
acagtgagccaagagt

SEQ ID NO: 4541480 - DNA, 17 bp, Homo sapiens
acagtgatagagcaaag

SEQ ID NO: 4541481 - DNA, 18 bp, Homo sapiens
acagtgatattggaactt

SEQ ID NO: 4541482 - DNA, 12 bp, Homo sapiens
acagtgatgaat

SEQ ID NO: 4541483 - DNA, 15 bp, Homo sapiens
acagtgatgaatgta

SEQ ID NO: 4541484 - DNA, 19 bp, Homo sapiens
acagtgcagagccttctca

SEQ ID NO: 4541485 - DNA, 21 bp, Homo sapiens
acagtgcagagccttctcaga

SEQ ID NO: 4541486 - DNA, 22 bp, Homo sapiens
acagtgcagagccttctcagaa

SEQ ID NO: 4541487 - DNA, 19 bp, Homo sapiens
acagtgcagggcaaaatat

SEQ ID NO: 4541488 - DNA, 17 bp, Homo sapiens
acagtgccattgtcttt

SEQ ID NO: 4541489 - DNA, 18 bp, Homo sapiens
acagtgccattgtcttta

SEQ ID NO: 4541490 - DNA, 15 bp, Homo sapiens
acagtgcccttggtg

SEQ ID NO: 4541491 - DNA, 13 bp, Homo sapiens
acagtgcctgctg

SEQ ID NO: 4541492 - DNA, 12 bp, Homo sapiens
acagtgccttct

SEQ ID NO: 4541493 - DNA, 15 bp, Homo sapiens
acagtgctcttttct

SEQ ID NO: 4541494 - DNA, 17 bp, Homo sapiens
acagtgctcttttctcc

SEQ ID NO: 4541495 - DNA, 18 bp, Homo sapiens
acagtggaatataaggaa

SEQ ID NO: 4541496 - DNA, 18 bp, Homo sapiens
acagtggatcacaaagtg

SEQ ID NO: 4541497 - DNA, 15 bp, Homo sapiens
acagtggcgggccca

SEQ ID NO: 4541498 - DNA, 16 bp, Homo sapiens
acagtggctgctctgg

SEQ ID NO: 4541499 - DNA, 17 bp, Homo sapiens
acagtggctgctctggg

SEQ ID NO: 4541500 - DNA, 23 bp, Homo sapiens
acagtggtggcaacattcattgc

SEQ ID NO: 4541501 - DNA, 18 bp, Homo sapiens
acagtggttttatactga

SEQ ID NO: 4541502 - DNA, 22 bp, Homo sapiens
acagtggttttatactgaagga

SEQ ID NO: 4541503 - DNA, 21 bp, Homo sapiens
acagtgtaatccaggggtgta

SEQ ID NO: 4541504 - DNA, 12 bp, Homo sapiens
acagtgtacagt

SEQ ID NO: 4541505 - DNA, 18 bp, Homo sapiens
acagtgtacagtcttgta

SEQ ID NO: 4541506 - DNA, 17 bp, Homo sapiens
acagtgtctttctagcc

SEQ ID NO: 4541507 - DNA, 19 bp, Homo sapiens
acagtgtctttctagccat

SEQ ID NO: 4541508 - DNA, 16 bp, Homo sapiens
acagtgttttcagaag

SEQ ID NO: 4541509 - DNA, 14 bp, Homo sapiens
acagttacagttga

SEQ ID NO: 4541510 - DNA, 19 bp, Homo sapiens
acagttacttaatgaccat

SEQ ID NO: 4541511 - DNA, 14 bp, Homo sapiens
acagttataaaatt

SEQ ID NO: 4541512 - DNA, 17 bp, Homo sapiens
acagttataaaattaaa

SEQ ID NO: 4541513 - DNA, 21 bp, Homo sapiens
acagttatttcatcttttatt

SEQ ID NO: 4541514 - DNA, 15 bp, Homo sapiens
acagttcctcgccct

SEQ ID NO: 4541515 - DNA, 16 bp, Homo sapiens
acagttcctcgccctg

SEQ ID NO: 4541516 - DNA, 12 bp, Homo sapiens
acagttctctgt

SEQ ID NO: 4541517 - DNA, 18 bp, Homo sapiens
acagttctgagctgtaat

SEQ ID NO: 4541518 - DNA, 19 bp, Homo sapiens
acagttctgagctgtaatt

SEQ ID NO: 4541519 - DNA, 21 bp, Homo sapiens
acagttctgctctggttgttt

SEQ ID NO: 4541520 - DNA, 22 bp, Homo sapiens
acagttcttggtgactgtccca

SEQ ID NO: 4541521 - DNA, 17 bp, Homo sapiens
acagttgagctcaggtt

SEQ ID NO: 4541522 - DNA, 13 bp, Homo sapiens
acagttgatgttt

SEQ ID NO: 4541523 - DNA, 13 bp, Homo sapiens
acagttggcactg

SEQ ID NO: 4541524 - DNA, 16 bp, Homo sapiens
acagttggtaactttt

SEQ ID NO: 4541525 - DNA, 18 bp, Homo sapiens
acagttgtatttaacaga

SEQ ID NO: 4541526 - DNA, 22 bp, Homo sapiens
acagttgtatttaacagaaatt

SEQ ID NO: 4541527 - DNA, 15 bp, Homo sapiens
acagtttatcatgaa

SEQ ID NO: 4541528 - DNA, 17 bp, Homo sapiens
acagtttatcatgaagc

SEQ ID NO: 4541529 - DNA, 18 bp, Homo sapiens
acagtttatcatgaagcc

SEQ ID NO: 4541530 - DNA, 13 bp, Homo sapiens
acagttttaaaga

SEQ ID NO: 4541531 - DNA, 17 bp, Homo sapiens
acagttttaactgtgga

SEQ ID NO: 4541532 - DNA, 12 bp, Homo sapiens
acagttttaata

SEQ ID NO: 4541533 - DNA, 15 bp, Homo sapiens
acagttttataattt

SEQ ID NO: 4541534 - DNA, 22 bp, Homo sapiens
acagttttcattgattatatgg

SEQ ID NO: 4541535 - DNA, 20 bp, Homo sapiens
acagttttctgagaaagact

SEQ ID NO: 4541536 - DNA, 19 bp, Homo sapiens
acataaaaactgatttgct

SEQ ID NO: 4541537 - DNA, 21 bp, Homo sapiens
acataaaaaggacatcagcaa

SEQ ID NO: 4541538 - DNA, 22 bp, Homo sapiens
acataaaaaggacatcagcaaa

SEQ ID NO: 4541539 - DNA, 17 bp, Homo sapiens
acataaaaaggatccag

SEQ ID NO: 4541540 - DNA, 14 bp, Homo sapiens
acataaagaaattc

SEQ ID NO: 4541541 - DNA, 20 bp, Homo sapiens
acataaagactaagtagccc

SEQ ID NO: 4541542 - DNA, 11 bp, Homo sapiens
acataaatttt

SEQ ID NO: 4541543 - DNA, 12 bp, Homo sapiens
acataaatttta

SEQ ID NO: 4541544 - DNA, 20 bp, Homo sapiens
acataaccaatttgtaatga

SEQ ID NO: 4541545 - DNA, 15 bp, Homo sapiens
acataactgcttctt

SEQ ID NO: 4541546 - DNA, 21 bp, Homo sapiens
acataagaaggcaattttagt

SEQ ID NO: 4541547 - DNA, 21 bp, Homo sapiens
acataagagaaagaggccaga

SEQ ID NO: 4541548 - DNA, 16 bp, Homo sapiens
acataagcaatcattt

SEQ ID NO: 4541549 - DNA, 22 bp, Homo sapiens
acataatgggccactgaaatct

SEQ ID NO: 4541550 - DNA, 14 bp, Homo sapiens
acataattatttct

SEQ ID NO: 4541551 - DNA, 14 bp, Homo sapiens
acataattgcatga

SEQ ID NO: 4541552 - DNA, 17 bp, Homo sapiens
acataattgcatgaaaa

SEQ ID NO: 4541553 - DNA, 13 bp, Homo sapiens
acataatttctgt

SEQ ID NO: 4541554 - DNA, 14 bp, Homo sapiens
acatacaacttttt

SEQ ID NO: 4541555 - DNA, 22 bp, Homo sapiens
acatacacccaaacacttacac

SEQ ID NO: 4541556 - DNA, 22 bp, Homo sapiens
acatacactgtatgttatagaa

SEQ ID NO: 4541557 - DNA, 17 bp, Homo sapiens
acatacataatacaatg

SEQ ID NO: 4541558 - DNA, 17 bp, Homo sapiens
acatacatgatacattt

SEQ ID NO: 4541559 - DNA, 18 bp, Homo sapiens
acatacattggttttgaa

SEQ ID NO: 4541560 - DNA, 14 bp, Homo sapiens
acatactgtaatca

SEQ ID NO: 4541561 - DNA, 17 bp, Homo sapiens
acatacttcaaaaatgt

SEQ ID NO: 4541562 - DNA, 23 bp, Homo sapiens
acatactttcatcctgactctgc

SEQ ID NO: 4541563 - DNA, 12 bp, Homo sapiens
acatagaaatgg

SEQ ID NO: 4541564 - DNA, 22 bp, Homo sapiens
acatagaaatggaaattttgct

SEQ ID NO: 4541565 - DNA, 14 bp, Homo sapiens
acatagaattaaca

SEQ ID NO: 4541566 - DNA, 18 bp, Homo sapiens
acatagacagaagaaaca

SEQ ID NO: 4541567 - DNA, 16 bp, Homo sapiens
acatagaggtatattg

SEQ ID NO: 4541568 - DNA, 20 bp, Homo sapiens
acatagcaggggcaccttcc

SEQ ID NO: 4541569 - DNA, 21 bp, Homo sapiens
acataggtttttaaagactag

SEQ ID NO: 4541570 - DNA, 20 bp, Homo sapiens
acatagtaagttcagcactt

SEQ ID NO: 4541571 - DNA, 22 bp, Homo sapiens
acatagtaagttcagcacttgt

SEQ ID NO: 4541572 - DNA, 17 bp, Homo sapiens
acatagtctttgtttac

SEQ ID NO: 4541573 - DNA, 15 bp, Homo sapiens
acatagtttttcagt

SEQ ID NO: 4541574 - DNA, 14 bp, Homo sapiens
acatatacatatga

SEQ ID NO: 4541575 - DNA, 14 bp, Homo sapiens
acatataccaccca

SEQ ID NO: 4541576 - DNA, 20 bp, Homo sapiens
acatataggttactacttaa

SEQ ID NO: 4541577 - DNA, 15 bp, Homo sapiens
acatatataaaacta

SEQ ID NO: 4541578 - DNA, 13 bp, Homo sapiens
acatatcaaatag

SEQ ID NO: 4541579 - DNA, 19 bp, Homo sapiens
acatatgagaatatacctt

SEQ ID NO: 4541580 - DNA, 14 bp, Homo sapiens
acatatgagtgttt

SEQ ID NO: 4541581 - DNA, 19 bp, Homo sapiens
acatatgatctgtctgtgg

SEQ ID NO: 4541582 - DNA, 17 bp, Homo sapiens
acatatggaattttgca

SEQ ID NO: 4541583 - DNA, 18 bp, Homo sapiens
acatattgtatatatatt

SEQ ID NO: 4541584 - DNA, 18 bp, Homo sapiens
acatatttaactggtgca

SEQ ID NO: 4541585 - DNA, 21 bp, Homo sapiens
acatatttaatgttttaaatg

SEQ ID NO: 4541586 - DNA, 22 bp, Homo sapiens
acatatttatttttacctgctt

SEQ ID NO: 4541587 - DNA, 17 bp, Homo sapiens
acatatttgtatgtttt

SEQ ID NO: 4541588 - DNA, 20 bp, Homo sapiens
acatatttgtatgtttttct

SEQ ID NO: 4541589 - DNA, 15 bp, Homo sapiens
acatattttttatat

SEQ ID NO: 4541590 - DNA, 20 bp, Homo sapiens
acatcaaagtggtaaatact

SEQ ID NO: 4541591 - DNA, 21 bp, Homo sapiens
acatcaaagtggtaaatactg

SEQ ID NO: 4541592 - DNA, 21 bp, Homo sapiens
acatcaagactatctacaaaa

SEQ ID NO: 4541593 - DNA, 21 bp, Homo sapiens
acatcaagtccatctgacaaa

SEQ ID NO: 4541594 - DNA, 22 bp, Homo sapiens
acatcaagtccatctgacaaaa

SEQ ID NO: 4541595 - DNA, 16 bp, Homo sapiens
acatcacatcttattt

SEQ ID NO: 4541596 - DNA, 22 bp, Homo sapiens
acatcacatcttatttatttta

SEQ ID NO: 4541597 - DNA, 13 bp, Homo sapiens
acatcaccagtcc

SEQ ID NO: 4541598 - DNA, 18 bp, Homo sapiens
acatcacctatttaatgt

SEQ ID NO: 4541599 - DNA, 21 bp, Homo sapiens
acatcacctatttaatgtttt

SEQ ID NO: 4541600 - DNA, 17 bp, Homo sapiens
acatcactatcaatttt

SEQ ID NO: 4541601 - DNA, 20 bp, Homo sapiens
acatcagactctagaaaaaa

SEQ ID NO: 4541602 - DNA, 12 bp, Homo sapiens
acatcagcaaac

SEQ ID NO: 4541603 - DNA, 13 bp, Homo sapiens
acatcagcaaaca

SEQ ID NO: 4541604 - DNA, 15 bp, Homo sapiens
acatcaggaaagaga

SEQ ID NO: 4541605 - DNA, 20 bp, Homo sapiens
acatcattattgtagtttga

SEQ ID NO: 4541606 - DNA, 15 bp, Homo sapiens
acatcattcattttt

SEQ ID NO: 4541607 - DNA, 15 bp, Homo sapiens
acatcattcttgaga

SEQ ID NO: 4541608 - DNA, 16 bp, Homo sapiens
acatcattgtcagcct

SEQ ID NO: 4541609 - DNA, 16 bp, Homo sapiens
acatcccagaccagcc

SEQ ID NO: 4541610 - DNA, 17 bp, Homo sapiens
acatcccattgccctgg

SEQ ID NO: 4541611 - DNA, 13 bp, Homo sapiens
acatcccattggg

SEQ ID NO: 4541612 - DNA, 21 bp, Homo sapiens
acatccgtaggacaagtttta

SEQ ID NO: 4541613 - DNA, 16 bp, Homo sapiens
acatcctaaggttctt

SEQ ID NO: 4541614 - DNA, 19 bp, Homo sapiens
acatcgatatacatttatt

SEQ ID NO: 4541615 - DNA, 21 bp, Homo sapiens
acatcgcaatagttttttact

SEQ ID NO: 4541616 - DNA, 14 bp, Homo sapiens
acatctaaagcttt

SEQ ID NO: 4541617 - DNA, 20 bp, Homo sapiens
acatctaaagctttatcttt

SEQ ID NO: 4541618 - DNA, 16 bp, Homo sapiens
acatctacatgccatg

SEQ ID NO: 4541619 - DNA, 18 bp, Homo sapiens
acatctcatgtgtgctca

SEQ ID NO: 4541620 - DNA, 18 bp, Homo sapiens
acatctccttgatcatgt

SEQ ID NO: 4541621 - DNA, 17 bp, Homo sapiens
acatctctctgccctct

SEQ ID NO: 4541622 - DNA, 23 bp, Homo sapiens
acatctcttcctccgaggccagt

SEQ ID NO: 4541623 - DNA, 21 bp, Homo sapiens
acatctgaggttttatttcat

SEQ ID NO: 4541624 - DNA, 15 bp, Homo sapiens
acatctgccatttat

SEQ ID NO: 4541625 - DNA, 17 bp, Homo sapiens
acatctgcctgtaatta

SEQ ID NO: 4541626 - DNA, 14 bp, Homo sapiens
acatctggcatggc

SEQ ID NO: 4541627 - DNA, 13 bp, Homo sapiens
acatctgttttgt

SEQ ID NO: 4541628 - DNA, 15 bp, Homo sapiens
acatcttaaattcat

SEQ ID NO: 4541629 - DNA, 17 bp, Homo sapiens
acatcttattgaataaa

SEQ ID NO: 4541630 - DNA, 19 bp, Homo sapiens
acatcttattgaataaaga

SEQ ID NO: 4541631 - DNA, 20 bp, Homo sapiens
acatcttatttattttagca

SEQ ID NO: 4541632 - DNA, 22 bp, Homo sapiens
acatcttatttattttagcaaa

SEQ ID NO: 4541633 - DNA, 23 bp, Homo sapiens
acatcttgcattcaaaatcttca

SEQ ID NO: 4541634 - DNA, 13 bp, Homo sapiens
acatctttatccg

SEQ ID NO: 4541635 - DNA, 22 bp, Homo sapiens
acatctttattgaaattctatt

SEQ ID NO: 4541636 - DNA, 11 bp, Homo sapiens
acatctttccc

SEQ ID NO: 4541637 - DNA, 24 bp, Homo sapiens
acatcttttcttgcctctgtcccc

SEQ ID NO: 4541638 - DNA, 16 bp, Homo sapiens
acatctttttaaagct

SEQ ID NO: 4541639 - DNA, 17 bp, Homo sapiens
acatgaaaaacaaacaa

SEQ ID NO: 4541640 - DNA, 17 bp, Homo sapiens
acatgaagattctttcc

SEQ ID NO: 4541641 - DNA, 21 bp, Homo sapiens
acatgaaggtaaataaaaaga

SEQ ID NO: 4541642 - DNA, 19 bp, Homo sapiens
acatgacgtggtaaaatgt

SEQ ID NO: 4541643 - DNA, 22 bp, Homo sapiens
acatgactctttattgtctgta

SEQ ID NO: 4541644 - DNA, 21 bp, Homo sapiens
acatgacttccttatttctga

SEQ ID NO: 4541645 - DNA, 23 bp, Homo sapiens
acatgacttccttatttctgaac

SEQ ID NO: 4541646 - DNA, 15 bp, Homo sapiens
acatgagaaagatgt

SEQ ID NO: 4541647 - DNA, 21 bp, Homo sapiens
acatgaggccatctcaggaga

SEQ ID NO: 4541648 - DNA, 22 bp, Homo sapiens
acatgaggccatctcaggagat

SEQ ID NO: 4541649 - DNA, 20 bp, Homo sapiens
acatgaggtactgagagtga

SEQ ID NO: 4541650 - DNA, 15 bp, Homo sapiens
acatgagttcaaata

SEQ ID NO: 4541651 - DNA, 19 bp, Homo sapiens
acatgagttcaaatacttt

SEQ ID NO: 4541652 - DNA, 15 bp, Homo sapiens
acatgatacattttt

SEQ ID NO: 4541653 - DNA, 17 bp, Homo sapiens
acatgatttaaagacta

SEQ ID NO: 4541654 - DNA, 13 bp, Homo sapiens
acatgatttcctt

SEQ ID NO: 4541655 - DNA, 15 bp, Homo sapiens
acatgcaataacaag

SEQ ID NO: 4541656 - DNA, 16 bp, Homo sapiens
acatgcaataacaagc

SEQ ID NO: 4541657 - DNA, 21 bp, Homo sapiens
acatgcaataacaagcatgca

SEQ ID NO: 4541658 - DNA, 22 bp, Homo sapiens
acatgcaataacaagcatgcat

SEQ ID NO: 4541659 - DNA, 14 bp, Homo sapiens
acatgcacagtcat

SEQ ID NO: 4541660 - DNA, 21 bp, Homo sapiens
acatgcagctcttcaacatga

SEQ ID NO: 4541661 - DNA, 10 bp, Homo sapiens
acatgcagtt

SEQ ID NO: 4541662 - DNA, 11 bp, Homo sapiens
acatgcagttt

SEQ ID NO: 4541663 - DNA, 16 bp, Homo sapiens
acatgcagtttgaaat

SEQ ID NO: 4541664 - DNA, 17 bp, Homo sapiens
acatgcagtttgaaatt

SEQ ID NO: 4541665 - DNA, 23 bp, Homo sapiens
acatgcagtttgaaattctgaat

SEQ ID NO: 4541666 - DNA, 16 bp, Homo sapiens
acatgcatgtctgcct

SEQ ID NO: 4541667 - DNA, 16 bp, Homo sapiens
acatgcccaaaactta

SEQ ID NO: 4541668 - DNA, 20 bp, Homo sapiens
acatgccccttggtcctggc

SEQ ID NO: 4541669 - DNA, 15 bp, Homo sapiens
acatgcctctgtaga

SEQ ID NO: 4541670 - DNA, 17 bp, Homo sapiens
acatgcctgcgcctgct

SEQ ID NO: 4541671 - DNA, 20 bp, Homo sapiens
acatgcctgcgcctgctgcc

SEQ ID NO: 4541672 - DNA, 19 bp, Homo sapiens
acatgctaagagaagtaga

SEQ ID NO: 4541673 - DNA, 14 bp, Homo sapiens
acatgctattgtct

SEQ ID NO: 4541674 - DNA, 23 bp, Homo sapiens
acatggaaagggagacagccagg

SEQ ID NO: 4541675 - DNA, 14 bp, Homo sapiens
acatggagaaatct

SEQ ID NO: 4541676 - DNA, 15 bp, Homo sapiens
acatggagaaatcta

SEQ ID NO: 4541677 - DNA, 13 bp, Homo sapiens
acatggagatgta

SEQ ID NO: 4541678 - DNA, 21 bp, Homo sapiens
acatggagatgtaaaatgagt

SEQ ID NO: 4541679 - DNA, 19 bp, Homo sapiens
acatggattcagtttctaa

SEQ ID NO: 4541680 - DNA, 20 bp, Homo sapiens
acatgggagccgggtctgcc

SEQ ID NO: 4541681 - DNA, 18 bp, Homo sapiens
acatgggagggatcagcc

SEQ ID NO: 4541682 - DNA, 13 bp, Homo sapiens
acatggtgcctta

SEQ ID NO: 4541683 - DNA, 16 bp, Homo sapiens
acatggtgtctcacac

SEQ ID NO: 4541684 - DNA, 14 bp, Homo sapiens
acatggtgtctccc

SEQ ID NO: 4541685 - DNA, 20 bp, Homo sapiens
acatggtgtctcccaacatg

SEQ ID NO: 4541686 - DNA, 22 bp, Homo sapiens
acatggtgtctcccaacatggg

SEQ ID NO: 4541687 - DNA, 14 bp, Homo sapiens
acatggttggggga

SEQ ID NO: 4541688 - DNA, 19 bp, Homo sapiens
acatggttgggggaatgca

SEQ ID NO: 4541689 - DNA, 21 bp, Homo sapiens
acatggtttaaaagaaaaaat

SEQ ID NO: 4541690 - DNA, 14 bp, Homo sapiens
acatgtaagaaaat

SEQ ID NO: 4541691 - DNA, 15 bp, Homo sapiens
acatgtaagaaaatg

SEQ ID NO: 4541692 - DNA, 19 bp, Homo sapiens
acatgtaagaaaatgttac

SEQ ID NO: 4541693 - DNA, 17 bp, Homo sapiens
acatgtcacaatacagt

SEQ ID NO: 4541694 - DNA, 18 bp, Homo sapiens
acatgtcacaatacagta

SEQ ID NO: 4541695 - DNA, 19 bp, Homo sapiens
acatgtcagtaccttcaaa

SEQ ID NO: 4541696 - DNA, 20 bp, Homo sapiens
acatgtgagatagttttcat

SEQ ID NO: 4541697 - DNA, 22 bp, Homo sapiens
acatgtgagatagttttcattt

SEQ ID NO: 4541698 - DNA, 22 bp, Homo sapiens
acatgtgccactgttcagcgga

SEQ ID NO: 4541699 - DNA, 22 bp, Homo sapiens
acatgtgccagggcaatgatga

SEQ ID NO: 4541700 - DNA, 19 bp, Homo sapiens
acatgtgttatctacctca

SEQ ID NO: 4541701 - DNA, 23 bp, Homo sapiens
acatgtgttttcatcatttcagc

SEQ ID NO: 4541702 - DNA, 17 bp, Homo sapiens
acatgttaaacttactt

SEQ ID NO: 4541703 - DNA, 11 bp, Homo sapiens
acatgttactg

SEQ ID NO: 4541704 - DNA, 19 bp, Homo sapiens
acatgttactggataaatt

SEQ ID NO: 4541705 - DNA, 21 bp, Homo sapiens
acatgttactggataaattgt

SEQ ID NO: 4541706 - DNA, 13 bp, Homo sapiens
acatgttgccttg

SEQ ID NO: 4541707 - DNA, 13 bp, Homo sapiens
acatgtttataaa

SEQ ID NO: 4541708 - DNA, 18 bp, Homo sapiens
acattaaacaatgatcac

SEQ ID NO: 4541709 - DNA, 14 bp, Homo sapiens
acattaacaaataa

SEQ ID NO: 4541710 - DNA, 16 bp, Homo sapiens
acattaagaaaatatt

SEQ ID NO: 4541711 - DNA, 19 bp, Homo sapiens
acattaattgctaacaatt

SEQ ID NO: 4541712 - DNA, 18 bp, Homo sapiens
acattacagattaaagaa

SEQ ID NO: 4541713 - DNA, 15 bp, Homo sapiens
acattacatctgagt

SEQ ID NO: 4541714 - DNA, 16 bp, Homo sapiens
acattacttatttaac

SEQ ID NO: 4541715 - DNA, 13 bp, Homo sapiens
acattagaaaaaa

SEQ ID NO: 4541716 - DNA, 19 bp, Homo sapiens
acattagaaaaaaatgaaa

SEQ ID NO: 4541717 - DNA, 14 bp, Homo sapiens
acattataacaact

SEQ ID NO: 4541718 - DNA, 19 bp, Homo sapiens
acattataacaactattta

SEQ ID NO: 4541719 - DNA, 21 bp, Homo sapiens
acattataacaactatttact

SEQ ID NO: 4541720 - DNA, 19 bp, Homo sapiens
acattatattgcaatgaag

SEQ ID NO: 4541721 - DNA, 15 bp, Homo sapiens
acattattgcttatt

SEQ ID NO: 4541722 - DNA, 14 bp, Homo sapiens
acattcacttttgt

SEQ ID NO: 4541723 - DNA, 21 bp, Homo sapiens
acattcagctgaggttcatta

SEQ ID NO: 4541724 - DNA, 19 bp, Homo sapiens
acattcaggaattcttgga

SEQ ID NO: 4541725 - DNA, 22 bp, Homo sapiens
acattcatagtctttggagaaa

SEQ ID NO: 4541726 - DNA, 13 bp, Homo sapiens
acattcccctccc

SEQ ID NO: 4541727 - DNA, 13 bp, Homo sapiens
acattcctccagc

SEQ ID NO: 4541728 - DNA, 23 bp, Homo sapiens
acattcctccagcctcccctccc

SEQ ID NO: 4541729 - DNA, 11 bp, Homo sapiens
acattccttct

SEQ ID NO: 4541730 - DNA, 13 bp, Homo sapiens
acattcctttgaa

SEQ ID NO: 4541731 - DNA, 20 bp, Homo sapiens
acattcgggaccaatatata

SEQ ID NO: 4541732 - DNA, 18 bp, Homo sapiens
acattcgtgagctgggga

SEQ ID NO: 4541733 - DNA, 19 bp, Homo sapiens
acattctctcatagaacat

SEQ ID NO: 4541734 - DNA, 12 bp, Homo sapiens
acattctgcctt

SEQ ID NO: 4541735 - DNA, 13 bp, Homo sapiens
acattctgccttg

SEQ ID NO: 4541736 - DNA, 14 bp, Homo sapiens
acattctgccttgg

SEQ ID NO: 4541737 - DNA, 20 bp, Homo sapiens
acattctgctaagattcctt

SEQ ID NO: 4541738 - DNA, 20 bp, Homo sapiens
acattcttcagtttttcact

SEQ ID NO: 4541739 - DNA, 14 bp, Homo sapiens
acattcttccatca

SEQ ID NO: 4541740 - DNA, 15 bp, Homo sapiens
acattcttccatcat

SEQ ID NO: 4541741 - DNA, 19 bp, Homo sapiens
acattcttccatcatcact

SEQ ID NO: 4541742 - DNA, 21 bp, Homo sapiens
acattcttccatcatcactgt

SEQ ID NO: 4541743 - DNA, 23 bp, Homo sapiens
acattcttccatcatcactgtaa

SEQ ID NO: 4541744 - DNA, 12 bp, Homo sapiens
acattcttttaa

SEQ ID NO: 4541745 - DNA, 15 bp, Homo sapiens
acattgaagtaatga

SEQ ID NO: 4541746 - DNA, 20 bp, Homo sapiens
acattgaagtaatgaatttt

SEQ ID NO: 4541747 - DNA, 22 bp, Homo sapiens
acattgaatagtggaacatttt

SEQ ID NO: 4541748 - DNA, 17 bp, Homo sapiens
acattgagactttcttc

SEQ ID NO: 4541749 - DNA, 18 bp, Homo sapiens
acattgatctgttttaca

SEQ ID NO: 4541750 - DNA, 22 bp, Homo sapiens
acattgatctgttttacaggaa

SEQ ID NO: 4541751 - DNA, 14 bp, Homo sapiens
acattgccaaaaag

SEQ ID NO: 4541752 - DNA, 17 bp, Homo sapiens
acattgccaaaaaggat

SEQ ID NO: 4541753 - DNA, 12 bp, Homo sapiens
acattgcccctc

SEQ ID NO: 4541754 - DNA, 12 bp, Homo sapiens
acattgccttct

SEQ ID NO: 4541755 - DNA, 18 bp, Homo sapiens
acattgccttctggagct

SEQ ID NO: 4541756 - DNA, 12 bp, Homo sapiens
acattgcctttg

SEQ ID NO: 4541757 - DNA, 23 bp, Homo sapiens
acattgcctttgaatgttaattt

SEQ ID NO: 4541758 - DNA, 15 bp, Homo sapiens
acattgcgtttgacc

SEQ ID NO: 4541759 - DNA, 21 bp, Homo sapiens
acattgctctatgtctgcctt

SEQ ID NO: 4541760 - DNA, 13 bp, Homo sapiens
acattgcttaaaa

SEQ ID NO: 4541761 - DNA, 17 bp, Homo sapiens
acattgcttaaaatata

SEQ ID NO: 4541762 - DNA, 16 bp, Homo sapiens
acattggaatgccttg

SEQ ID NO: 4541763 - DNA, 16 bp, Homo sapiens
acattggacagaaaat

SEQ ID NO: 4541764 - DNA, 17 bp, Homo sapiens
acattggacagaaaatg

SEQ ID NO: 4541765 - DNA, 21 bp, Homo sapiens
acattggacagaaaatgcaat

SEQ ID NO: 4541766 - DNA, 22 bp, Homo sapiens
acattggagatgccatcctctt

SEQ ID NO: 4541767 - DNA, 12 bp, Homo sapiens
acattgtactgt

SEQ ID NO: 4541768 - DNA, 13 bp, Homo sapiens
acattgtactgtt

SEQ ID NO: 4541769 - DNA, 24 bp, Homo sapiens
acattgtccccaatgaatatactc

SEQ ID NO: 4541770 - DNA, 16 bp, Homo sapiens
acattgtcttgatgtt

SEQ ID NO: 4541771 - DNA, 20 bp, Homo sapiens
acattgttcaactcccttct

SEQ ID NO: 4541772 - DNA, 15 bp, Homo sapiens
acattgtttttgtat

SEQ ID NO: 4541773 - DNA, 19 bp, Homo sapiens
acattgtttttgtatattg

SEQ ID NO: 4541774 - DNA, 21 bp, Homo sapiens
acatttaaggatggggttatg

SEQ ID NO: 4541775 - DNA, 13 bp, Homo sapiens
acatttaataaaa

SEQ ID NO: 4541776 - DNA, 14 bp, Homo sapiens
acatttaataaaac

SEQ ID NO: 4541777 - DNA, 16 bp, Homo sapiens
acatttagaaaagtga

SEQ ID NO: 4541778 - DNA, 18 bp, Homo sapiens
acatttagaagaaagatg

SEQ ID NO: 4541779 - DNA, 15 bp, Homo sapiens
acatttatctttgta

SEQ ID NO: 4541780 - DNA, 15 bp, Homo sapiens
acatttatttcctcc

SEQ ID NO: 4541781 - DNA, 16 bp, Homo sapiens
acatttattttgacat

SEQ ID NO: 4541782 - DNA, 16 bp, Homo sapiens
acatttcattgtacaa

SEQ ID NO: 4541783 - DNA, 20 bp, Homo sapiens
acatttctactctagatggc

SEQ ID NO: 4541784 - DNA, 16 bp, Homo sapiens
acatttctataaaaat

SEQ ID NO: 4541785 - DNA, 12 bp, Homo sapiens
acatttctcaat

SEQ ID NO: 4541786 - DNA, 14 bp, Homo sapiens
acatttctctaact

SEQ ID NO: 4541787 - DNA, 21 bp, Homo sapiens
acatttctcttccccttagaa

SEQ ID NO: 4541788 - DNA, 14 bp, Homo sapiens
acatttctggacag

SEQ ID NO: 4541789 - DNA, 15 bp, Homo sapiens
acatttctggacagt

SEQ ID NO: 4541790 - DNA, 18 bp, Homo sapiens
acatttcttaaaacacat

SEQ ID NO: 4541791 - DNA, 19 bp, Homo sapiens
acatttcttaaaacacatg

SEQ ID NO: 4541792 - DNA, 15 bp, Homo sapiens
acatttcttaaatta

SEQ ID NO: 4541793 - DNA, 14 bp, Homo sapiens
acatttcttttaaa

SEQ ID NO: 4541794 - DNA, 17 bp, Homo sapiens
acatttcttttaaaata

SEQ ID NO: 4541795 - DNA, 20 bp, Homo sapiens
acatttgatgcatgtctttt

SEQ ID NO: 4541796 - DNA, 20 bp, Homo sapiens
acatttgattaataaaatat

SEQ ID NO: 4541797 - DNA, 24 bp, Homo sapiens
acatttgattaataaaatatctat

SEQ ID NO: 4541798 - DNA, 16 bp, Homo sapiens
acatttggaatacttt

SEQ ID NO: 4541799 - DNA, 21 bp, Homo sapiens
acatttgggttggttccaagt

SEQ ID NO: 4541800 - DNA, 13 bp, Homo sapiens
acattttacagta

SEQ ID NO: 4541801 - DNA, 19 bp, Homo sapiens
acattttacagtaaatgtt

SEQ ID NO: 4541802 - DNA, 16 bp, Homo sapiens
acattttatgagagtt

SEQ ID NO: 4541803 - DNA, 12 bp, Homo sapiens
acattttcagtg

SEQ ID NO: 4541804 - DNA, 12 bp, Homo sapiens
acattttcttaa

SEQ ID NO: 4541805 - DNA, 13 bp, Homo sapiens
acattttcttaat

SEQ ID NO: 4541806 - DNA, 12 bp, Homo sapiens
acattttgtatg

SEQ ID NO: 4541807 - DNA, 21 bp, Homo sapiens
acattttgtttttactgtatg

SEQ ID NO: 4541808 - DNA, 14 bp, Homo sapiens
acatttttaaatgt

SEQ ID NO: 4541809 - DNA, 22 bp, Homo sapiens
acatttttcaactttgaataaa

SEQ ID NO: 4541810 - DNA, 15 bp, Homo sapiens
acatttttcattcat

SEQ ID NO: 4541811 - DNA, 18 bp, Homo sapiens
acatttttcattcatgaa

SEQ ID NO: 4541812 - DNA, 21 bp, Homo sapiens
acatttttcattcatgaatat

SEQ ID NO: 4541813 - DNA, 20 bp, Homo sapiens
acatttttggatttctgtga

SEQ ID NO: 4541814 - DNA, 15 bp, Homo sapiens
acatttttgtaatgc

SEQ ID NO: 4541815 - DNA, 14 bp, Homo sapiens
acattttttataca

SEQ ID NO: 4541816 - DNA, 19 bp, Homo sapiens
acattttttcttctgaaga

SEQ ID NO: 4541817 - DNA, 21 bp, Homo sapiens
acattttttcttctgaagatt

SEQ ID NO: 4541818 - DNA, 20 bp, Homo sapiens
acatttttttctacctataa

SEQ ID NO: 4541819 - DNA, 19 bp, Homo sapiens
acatttttttttctccata

SEQ ID NO: 4541820 - DNA, 22 bp, Homo sapiens
accaaaaaccatgttgcgttca

SEQ ID NO: 4541821 - DNA, 17 bp, Homo sapiens
accaaaaagaccagact

SEQ ID NO: 4541822 - DNA, 16 bp, Homo sapiens
accaaaacagttaatc

SEQ ID NO: 4541823 - DNA, 14 bp, Homo sapiens
accaaaagaagtaa

SEQ ID NO: 4541824 - DNA, 21 bp, Homo sapiens
accaaaagaagtaaaagcaaa

SEQ ID NO: 4541825 - DNA, 15 bp, Homo sapiens
accaaaataataaaa

SEQ ID NO: 4541826 - DNA, 14 bp, Homo sapiens
accaaaattttaaa

SEQ ID NO: 4541827 - DNA, 18 bp, Homo sapiens
accaaaattttaaaaaag

SEQ ID NO: 4541828 - DNA, 15 bp, Homo sapiens
accaaacacccagag

SEQ ID NO: 4541829 - DNA, 15 bp, Homo sapiens
accaaacatgcttat

SEQ ID NO: 4541830 - DNA, 21 bp, Homo sapiens
accaaacatgcttataacatt

SEQ ID NO: 4541831 - DNA, 22 bp, Homo sapiens
accaaacatgcttataacatta

SEQ ID NO: 4541832 - DNA, 18 bp, Homo sapiens
accaaaccctataaacct

SEQ ID NO: 4541833 - DNA, 18 bp, Homo sapiens
accaaactttatttttct

SEQ ID NO: 4541834 - DNA, 18 bp, Homo sapiens
accaaagagggcttcctc

SEQ ID NO: 4541835 - DNA, 22 bp, Homo sapiens
accaaatacctcaatttttgtt

SEQ ID NO: 4541836 - DNA, 16 bp, Homo sapiens
accaaatagtgtgaaa

SEQ ID NO: 4541837 - DNA, 18 bp, Homo sapiens
accaaatagtgtgaaata

SEQ ID NO: 4541838 - DNA, 18 bp, Homo sapiens
accaaatgaaatgccaaa

SEQ ID NO: 4541839 - DNA, 17 bp, Homo sapiens
accaaatgtagttttgt

SEQ ID NO: 4541840 - DNA, 23 bp, Homo sapiens
accaaattgcttctaggagtcaa

SEQ ID NO: 4541841 - DNA, 13 bp, Homo sapiens
accaaattttaat

SEQ ID NO: 4541842 - DNA, 14 bp, Homo sapiens
accaaattttaatt

SEQ ID NO: 4541843 - DNA, 20 bp, Homo sapiens
accaacaatcttcctgttta

SEQ ID NO: 4541844 - DNA, 18 bp, Homo sapiens
accaacagaacccacagt

SEQ ID NO: 4541845 - DNA, 15 bp, Homo sapiens
accaacagcttttcc

SEQ ID NO: 4541846 - DNA, 23 bp, Homo sapiens
accaacataaaaatgatctaaac

SEQ ID NO: 4541847 - DNA, 22 bp, Homo sapiens
accaacccatcagaaggagaag

SEQ ID NO: 4541848 - DNA, 21 bp, Homo sapiens
accaacccccatctccctagc

SEQ ID NO: 4541849 - DNA, 13 bp, Homo sapiens
accaacctgacca

SEQ ID NO: 4541850 - DNA, 14 bp, Homo sapiens
accaacctgctctg

SEQ ID NO: 4541851 - DNA, 13 bp, Homo sapiens
accaactctaata

SEQ ID NO: 4541852 - DNA, 15 bp, Homo sapiens
accaactctaatatt

SEQ ID NO: 4541853 - DNA, 15 bp, Homo sapiens
accaagatacttaag

SEQ ID NO: 4541854 - DNA, 20 bp, Homo sapiens
accaagatacttaagtgctg

SEQ ID NO: 4541855 - DNA, 21 bp, Homo sapiens
accaagatacttaagtgctgc

SEQ ID NO: 4541856 - DNA, 22 bp, Homo sapiens
accaaggacggaaaatgcttaa

SEQ ID NO: 4541857 - DNA, 21 bp, Homo sapiens
accaaggctgagacagtgaat

SEQ ID NO: 4541858 - DNA, 22 bp, Homo sapiens
accaaggtttatgccaccaggt

SEQ ID NO: 4541859 - DNA, 14 bp, Homo sapiens
accaagtgcttcct

SEQ ID NO: 4541860 - DNA, 17 bp, Homo sapiens
accaagtgcttcctaca

SEQ ID NO: 4541861 - DNA, 22 bp, Homo sapiens
accaagttgaaaaatagcatat

SEQ ID NO: 4541862 - DNA, 15 bp, Homo sapiens
accaatacaaattga

SEQ ID NO: 4541863 - DNA, 23 bp, Homo sapiens
accaatagggctgagctctctgt

SEQ ID NO: 4541864 - DNA, 16 bp, Homo sapiens
accaatcttgtttata

SEQ ID NO: 4541865 - DNA, 19 bp, Homo sapiens
accaatcttgtttatagca

SEQ ID NO: 4541866 - DNA, 20 bp, Homo sapiens
accaatcttgtttatagcaa

SEQ ID NO: 4541867 - DNA, 17 bp, Homo sapiens
accaatgaaaaaatgta

SEQ ID NO: 4541868 - DNA, 21 bp, Homo sapiens
accaatgccgccgtgtttcct

SEQ ID NO: 4541869 - DNA, 15 bp, Homo sapiens
accaatgccttttta

SEQ ID NO: 4541870 - DNA, 23 bp, Homo sapiens
accaatgcctttttagatgtatt

SEQ ID NO: 4541871 - DNA, 17 bp, Homo sapiens
accaatgtgttttctgt

SEQ ID NO: 4541872 - DNA, 21 bp, Homo sapiens
accaatttggtaaaaatgctg

SEQ ID NO: 4541873 - DNA, 17 bp, Homo sapiens
accacaacatgaggcca

SEQ ID NO: 4541874 - DNA, 21 bp, Homo sapiens
accacaacatgaggccactgg

SEQ ID NO: 4541875 - DNA, 16 bp, Homo sapiens
accacaagcctgagaa

SEQ ID NO: 4541876 - DNA, 17 bp, Homo sapiens
accacagcagacaccat

SEQ ID NO: 4541877 - DNA, 11 bp, Homo sapiens
accacagcagt

SEQ ID NO: 4541878 - DNA, 12 bp, Homo sapiens
accacagcatcg

SEQ ID NO: 4541879 - DNA, 23 bp, Homo sapiens
accacagcatcgggagcacccag

SEQ ID NO: 4541880 - DNA, 21 bp, Homo sapiens
accacatttagaaatgtttat

SEQ ID NO: 4541881 - DNA, 23 bp, Homo sapiens
accacccactctcctctgcctca

SEQ ID NO: 4541882 - DNA, 20 bp, Homo sapiens
accacccatagtgcttcaca

SEQ ID NO: 4541883 - DNA, 17 bp, Homo sapiens
accacccatatcatgca

SEQ ID NO: 4541884 - DNA, 10 bp, Homo sapiens
accaccccct

SEQ ID NO: 4541885 - DNA, 14 bp, Homo sapiens
accacccctgcctc

SEQ ID NO: 4541886 - DNA, 22 bp, Homo sapiens
accacccctgcctccaccctct

SEQ ID NO: 4541887 - DNA, 13 bp, Homo sapiens
accaccctgaggc

SEQ ID NO: 4541888 - DNA, 18 bp, Homo sapiens
accacctaggccactcct

SEQ ID NO: 4541889 - DNA, 13 bp, Homo sapiens
accaccttcccag

SEQ ID NO: 4541890 - DNA, 13 bp, Homo sapiens
accacgactggcc

SEQ ID NO: 4541891 - DNA, 24 bp, Homo sapiens
accacgactggccagggccacgct

SEQ ID NO: 4541892 - DNA, 17 bp, Homo sapiens
accacgatgtggccctg

SEQ ID NO: 4541893 - DNA, 18 bp, Homo sapiens
accacgccttgaccttcc

SEQ ID NO: 4541894 - DNA, 18 bp, Homo sapiens
accacggagggagcgaca

SEQ ID NO: 4541895 - DNA, 18 bp, Homo sapiens
accacggttatttaagca

SEQ ID NO: 4541896 - DNA, 23 bp, Homo sapiens
accactaaagtagggaagtttta

SEQ ID NO: 4541897 - DNA, 17 bp, Homo sapiens
accactaaccatcccca

SEQ ID NO: 4541898 - DNA, 19 bp, Homo sapiens
accactaggaatcccagag

SEQ ID NO: 4541899 - DNA, 15 bp, Homo sapiens
accactgaaaaaata

SEQ ID NO: 4541900 - DNA, 19 bp, Homo sapiens
accactgaaaaaatatatg

SEQ ID NO: 4541901 - DNA, 17 bp, Homo sapiens
accactgcactttccaa

SEQ ID NO: 4541902 - DNA, 19 bp, Homo sapiens
accactgcagaagacagta

SEQ ID NO: 4541903 - DNA, 18 bp, Homo sapiens
accactgccattacccag

SEQ ID NO: 4541904 - DNA, 17 bp, Homo sapiens
accactgggatcagctg

SEQ ID NO: 4541905 - DNA, 23 bp, Homo sapiens
accactgttctgttcatttccta

SEQ ID NO: 4541906 - DNA, 14 bp, Homo sapiens
accacttccagggg

SEQ ID NO: 4541907 - DNA, 16 bp, Homo sapiens
accacttgaatttatt

SEQ ID NO: 4541908 - DNA, 21 bp, Homo sapiens
accacttgaatttattgatat

SEQ ID NO: 4541909 - DNA, 17 bp, Homo sapiens
accagaaaagcccaagt

SEQ ID NO: 4541910 - DNA, 18 bp, Homo sapiens
accagaacagtatgaatt

SEQ ID NO: 4541911 - DNA, 15 bp, Homo sapiens
accagaagccttgga

SEQ ID NO: 4541912 - DNA, 18 bp, Homo sapiens
accagaagtgtttcagat

SEQ ID NO: 4541913 - DNA, 20 bp, Homo sapiens
accagagaaaaagggagggg

SEQ ID NO: 4541914 - DNA, 18 bp, Homo sapiens
accagagaatgctttgaa

SEQ ID NO: 4541915 - DNA, 13 bp, Homo sapiens
accagagccttca

SEQ ID NO: 4541916 - DNA, 16 bp, Homo sapiens
accagagccttcaagt

SEQ ID NO: 4541917 - DNA, 18 bp, Homo sapiens
accagagccttcaagtgc

SEQ ID NO: 4541918 - DNA, 21 bp, Homo sapiens
accagagcggtatctctggca

SEQ ID NO: 4541919 - DNA, 21 bp, Homo sapiens
accagatctgtctccaagacc

SEQ ID NO: 4541920 - DNA, 16 bp, Homo sapiens
accagatgagaattag

SEQ ID NO: 4541921 - DNA, 12 bp, Homo sapiens
accagcagggag

SEQ ID NO: 4541922 - DNA, 14 bp, Homo sapiens
accagcatctggaa

SEQ ID NO: 4541923 - DNA, 14 bp, Homo sapiens
accagccagcctca

SEQ ID NO: 4541924 - DNA, 17 bp, Homo sapiens
accagccaggctctgtg

SEQ ID NO: 4541925 - DNA, 23 bp, Homo sapiens
accagccaggctctgtgctgacc

SEQ ID NO: 4541926 - DNA, 21 bp, Homo sapiens
accagcccctccccagactct

SEQ ID NO: 4541927 - DNA, 22 bp, Homo sapiens
accagcccctccccagactctc

SEQ ID NO: 4541928 - DNA, 23 bp, Homo sapiens
accagcccctccccagactctca

SEQ ID NO: 4541929 - DNA, 15 bp, Homo sapiens
accagccctgcacga

SEQ ID NO: 4541930 - DNA, 13 bp, Homo sapiens
accagccctgcag

SEQ ID NO: 4541931 - DNA, 15 bp, Homo sapiens
accagccgtatttta

SEQ ID NO: 4541932 - DNA, 13 bp, Homo sapiens
accagcctgtcca

SEQ ID NO: 4541933 - DNA, 12 bp, Homo sapiens
accagccttgct

SEQ ID NO: 4541934 - DNA, 19 bp, Homo sapiens
accagccttgctctcttca

SEQ ID NO: 4541935 - DNA, 21 bp, Homo sapiens
accagctatctgtcatctctc

SEQ ID NO: 4541936 - DNA, 11 bp, Homo sapiens
accagctgcaa

SEQ ID NO: 4541937 - DNA, 16 bp, Homo sapiens
accagctgcaaagtgt

SEQ ID NO: 4541938 - DNA, 18 bp, Homo sapiens
accagctgcaaagtgttt

SEQ ID NO: 4541939 - DNA, 19 bp, Homo sapiens
accagctgcaaagtgtttt

SEQ ID NO: 4541940 - DNA, 15 bp, Homo sapiens
accagcttttaacca

SEQ ID NO: 4541941 - DNA, 14 bp, Homo sapiens
accaggacaggacc

SEQ ID NO: 4541942 - DNA, 21 bp, Homo sapiens
accaggactccctcctcacct

SEQ ID NO: 4541943 - DNA, 19 bp, Homo sapiens
accaggaggattgccttta

SEQ ID NO: 4541944 - DNA, 14 bp, Homo sapiens
accaggatttattt

SEQ ID NO: 4541945 - DNA, 21 bp, Homo sapiens
accaggcacgaacccacctgc

SEQ ID NO: 4541946 - DNA, 16 bp, Homo sapiens
accaggccccagcctc

SEQ ID NO: 4541947 - DNA, 14 bp, Homo sapiens
accaggctgggcat

SEQ ID NO: 4541948 - DNA, 17 bp, Homo sapiens
accagggatcacagacc

SEQ ID NO: 4541949 - DNA, 13 bp, Homo sapiens
accagggatgctg

SEQ ID NO: 4541950 - DNA, 15 bp, Homo sapiens
accagggatgctggg

SEQ ID NO: 4541951 - DNA, 13 bp, Homo sapiens
accaggggccaac

SEQ ID NO: 4541952 - DNA, 22 bp, Homo sapiens
accaggggccaacctcaggctc

SEQ ID NO: 4541953 - DNA, 23 bp, Homo sapiens
accaggggccaacctcaggctcc

SEQ ID NO: 4541954 - DNA, 19 bp, Homo sapiens
accagggtggccacacagg

SEQ ID NO: 4541955 - DNA, 23 bp, Homo sapiens
accagggtggccacacaggcagg

SEQ ID NO: 4541956 - DNA, 14 bp, Homo sapiens
accagggtttagtt

SEQ ID NO: 4541957 - DNA, 16 bp, Homo sapiens
accaggtatcaaatca

SEQ ID NO: 4541958 - DNA, 17 bp, Homo sapiens
accaggtccagatgtgc

SEQ ID NO: 4541959 - DNA, 22 bp, Homo sapiens
accaggtgcctttcaaatttag

SEQ ID NO: 4541960 - DNA, 16 bp, Homo sapiens
accagtacttctaaga

SEQ ID NO: 4541961 - DNA, 15 bp, Homo sapiens
accagtagcttccca

SEQ ID NO: 4541962 - DNA, 11 bp, Homo sapiens
accagtattta

SEQ ID NO: 4541963 - DNA, 22 bp, Homo sapiens
accagtatttaagctttaaatg

SEQ ID NO: 4541964 - DNA, 19 bp, Homo sapiens
accagtatttagaagccaa

SEQ ID NO: 4541965 - DNA, 16 bp, Homo sapiens
accagtatttttgctg

SEQ ID NO: 4541966 - DNA, 14 bp, Homo sapiens
accagtcccatgct

SEQ ID NO: 4541967 - DNA, 18 bp, Homo sapiens
accagtcctatttttcaa

SEQ ID NO: 4541968 - DNA, 13 bp, Homo sapiens
accagtctcctca

SEQ ID NO: 4541969 - DNA, 14 bp, Homo sapiens
accagtctcctcac

SEQ ID NO: 4541970 - DNA, 23 bp, Homo sapiens
accagtctcctcactctgtccct

SEQ ID NO: 4541971 - DNA, 18 bp, Homo sapiens
accagtgaatttttgcaa

SEQ ID NO: 4541972 - DNA, 19 bp, Homo sapiens
accagtgaatttttgcaat

SEQ ID NO: 4541973 - DNA, 18 bp, Homo sapiens
accagtgcctctccctgc

SEQ ID NO: 4541974 - DNA, 21 bp, Homo sapiens
accagtgcctctccctgctgc

SEQ ID NO: 4541975 - DNA, 23 bp, Homo sapiens
accagtgcctctccctgctgctc

SEQ ID NO: 4541976 - DNA, 20 bp, Homo sapiens
accagtgttcctgaagctgc

SEQ ID NO: 4541977 - DNA, 13 bp, Homo sapiens
accagttaatttt

SEQ ID NO: 4541978 - DNA, 14 bp, Homo sapiens
accagttaattttt

SEQ ID NO: 4541979 - DNA, 21 bp, Homo sapiens
accagttctcatgggtggcac

SEQ ID NO: 4541980 - DNA, 13 bp, Homo sapiens
accagtttcttaa

SEQ ID NO: 4541981 - DNA, 12 bp, Homo sapiens
accagtttcttt

SEQ ID NO: 4541982 - DNA, 17 bp, Homo sapiens
accagtttcttttcttt

SEQ ID NO: 4541983 - DNA, 21 bp, Homo sapiens
accagtttcttttcttttgtt

SEQ ID NO: 4541984 - DNA, 16 bp, Homo sapiens
accataaaaagaggat

SEQ ID NO: 4541985 - DNA, 20 bp, Homo sapiens
accataaaaccctatacaag

SEQ ID NO: 4541986 - DNA, 17 bp, Homo sapiens
accataagctactgcca

SEQ ID NO: 4541987 - DNA, 22 bp, Homo sapiens
accataagctactgccatcctg

SEQ ID NO: 4541988 - DNA, 14 bp, Homo sapiens
accatagaaaaatg

SEQ ID NO: 4541989 - DNA, 14 bp, Homo sapiens
accatattacctgg

SEQ ID NO: 4541990 - DNA, 14 bp, Homo sapiens
accatcagctctgc

SEQ ID NO: 4541991 - DNA, 16 bp, Homo sapiens
accatcagctctgcct

SEQ ID NO: 4541992 - DNA, 17 bp, Homo sapiens
accatcagctctgcctt

SEQ ID NO: 4541993 - DNA, 22 bp, Homo sapiens
accatcctggctaacatggtga

SEQ ID NO: 4541994 - DNA, 15 bp, Homo sapiens
accatcgctttattg

SEQ ID NO: 4541995 - DNA, 22 bp, Homo sapiens
accatctagtgactcaggatat

SEQ ID NO: 4541996 - DNA, 20 bp, Homo sapiens
accatctggggcacctgctt

SEQ ID NO: 4541997 - DNA, 19 bp, Homo sapiens
accatcttttattcttttt

SEQ ID NO: 4541998 - DNA, 17 bp, Homo sapiens
accatgaagaacataaa

SEQ ID NO: 4541999 - DNA, 19 bp, Homo sapiens
accatgcaaattgtgaaat

SEQ ID NO: 4542000 - DNA, 18 bp, Homo sapiens
accatgcattttaccatc

SEQ ID NO: 4542001 - DNA, 19 bp, Homo sapiens
accatgcctcactaatttt

SEQ ID NO: 4542002 - DNA, 22 bp, Homo sapiens
accatgcgtcaggggcctagag

SEQ ID NO: 4542003 - DNA, 13 bp, Homo sapiens
accatgctctctc

SEQ ID NO: 4542004 - DNA, 19 bp, Homo sapiens
accatgctctctcacctgc

SEQ ID NO: 4542005 - DNA, 18 bp, Homo sapiens
accatggccaattcagtt

SEQ ID NO: 4542006 - DNA, 18 bp, Homo sapiens
accatggttctgcctcct

SEQ ID NO: 4542007 - DNA, 15 bp, Homo sapiens
accatggtttgatat

SEQ ID NO: 4542008 - DNA, 21 bp, Homo sapiens
accatgtaagcactctggatg

SEQ ID NO: 4542009 - DNA, 18 bp, Homo sapiens
accatgtggtttgctgtt

SEQ ID NO: 4542010 - DNA, 16 bp, Homo sapiens
accatgttagccagga

SEQ ID NO: 4542011 - DNA, 14 bp, Homo sapiens
accatgttggcctc

SEQ ID NO: 4542012 - DNA, 23 bp, Homo sapiens
accatgttggttgcactttgtag

SEQ ID NO: 4542013 - DNA, 15 bp, Homo sapiens
accattaacattttt

SEQ ID NO: 4542014 - DNA, 12 bp, Homo sapiens
accattattcac

SEQ ID NO: 4542015 - DNA, 16 bp, Homo sapiens
accattattcacaggt

SEQ ID NO: 4542016 - DNA, 12 bp, Homo sapiens
accattattttt

SEQ ID NO: 4542017 - DNA, 17 bp, Homo sapiens
accattcacaataaaag

SEQ ID NO: 4542018 - DNA, 21 bp, Homo sapiens
accatttaatttcatgtatat

SEQ ID NO: 4542019 - DNA, 16 bp, Homo sapiens
accatttcttggcatt

SEQ ID NO: 4542020 - DNA, 16 bp, Homo sapiens
accatttgctactgta

SEQ ID NO: 4542021 - DNA, 20 bp, Homo sapiens
accatttgtgtctctttatt

SEQ ID NO: 4542022 - DNA, 18 bp, Homo sapiens
accattttaacgctgcct

SEQ ID NO: 4542023 - DNA, 19 bp, Homo sapiens
accattttggatgtcattg

SEQ ID NO: 4542024 - DNA, 15 bp, Homo sapiens
accatttttgttact

SEQ ID NO: 4542025 - DNA, 16 bp, Homo sapiens
accatttttgttactc

SEQ ID NO: 4542026 - DNA, 17 bp, Homo sapiens
acccaaagcggtccctg

SEQ ID NO: 4542027 - DNA, 21 bp, Homo sapiens
acccaaatgttcatcaatgaa

SEQ ID NO: 4542028 - DNA, 18 bp, Homo sapiens
acccaactgacctgccag

SEQ ID NO: 4542029 - DNA, 18 bp, Homo sapiens
acccaagagaactttctt

SEQ ID NO: 4542030 - DNA, 17 bp, Homo sapiens
acccaagcctgctggct

SEQ ID NO: 4542031 - DNA, 16 bp, Homo sapiens
acccaagtgggggcag

SEQ ID NO: 4542032 - DNA, 13 bp, Homo sapiens
acccaatccaaat

SEQ ID NO: 4542033 - DNA, 15 bp, Homo sapiens
acccacacctctgcc

SEQ ID NO: 4542034 - DNA, 12 bp, Homo sapiens
acccacccagaa

SEQ ID NO: 4542035 - DNA, 15 bp, Homo sapiens
acccacccagaatga

SEQ ID NO: 4542036 - DNA, 21 bp, Homo sapiens
acccaccccaactctccccag

SEQ ID NO: 4542037 - DNA, 14 bp, Homo sapiens
acccacccccagcc

SEQ ID NO: 4542038 - DNA, 15 bp, Homo sapiens
acccacccccagcct

SEQ ID NO: 4542039 - DNA, 16 bp, Homo sapiens
acccacccccagcctt

SEQ ID NO: 4542040 - DNA, 15 bp, Homo sapiens
acccacccctgcaca

SEQ ID NO: 4542041 - DNA, 22 bp, Homo sapiens
acccaccgtggaggaggaaggc

SEQ ID NO: 4542042 - DNA, 20 bp, Homo sapiens
acccactctcctctgcctca

SEQ ID NO: 4542043 - DNA, 14 bp, Homo sapiens
acccactctgcttc

SEQ ID NO: 4542044 - DNA, 13 bp, Homo sapiens
acccactttgtaa

SEQ ID NO: 4542045 - DNA, 19 bp, Homo sapiens
acccagaatgagacatcca

SEQ ID NO: 4542046 - DNA, 20 bp, Homo sapiens
acccagaatgagacatccag

SEQ ID NO: 4542047 - DNA, 14 bp, Homo sapiens
acccagacccagtg

SEQ ID NO: 4542048 - DNA, 17 bp, Homo sapiens
acccagagaggaatcag

SEQ ID NO: 4542049 - DNA, 18 bp, Homo sapiens
acccagaggggacgctga

SEQ ID NO: 4542050 - DNA, 19 bp, Homo sapiens
acccagaggggacgctgag

SEQ ID NO: 4542051 - DNA, 15 bp, Homo sapiens
acccagaggtccagg

SEQ ID NO: 4542052 - DNA, 22 bp, Homo sapiens
acccagaggtctcatctcccag

SEQ ID NO: 4542053 - DNA, 20 bp, Homo sapiens
acccagagtggagtctgagt

SEQ ID NO: 4542054 - DNA, 21 bp, Homo sapiens
acccagatggaaaaataacaa

SEQ ID NO: 4542055 - DNA, 18 bp, Homo sapiens
acccagcaaatgggcatt

SEQ ID NO: 4542056 - DNA, 19 bp, Homo sapiens
acccagcccattctctctc

SEQ ID NO: 4542057 - DNA, 22 bp, Homo sapiens
acccagcccattctctctcctg

SEQ ID NO: 4542058 - DNA, 16 bp, Homo sapiens
acccagccctcatccc

SEQ ID NO: 4542059 - DNA, 12 bp, Homo sapiens
acccagccctgg

SEQ ID NO: 4542060 - DNA, 14 bp, Homo sapiens
acccagccctggtc

SEQ ID NO: 4542061 - DNA, 16 bp, Homo sapiens
acccagccctggtctc

SEQ ID NO: 4542062 - DNA, 19 bp, Homo sapiens
acccagccctggtctcagc

SEQ ID NO: 4542063 - DNA, 14 bp, Homo sapiens
acccagcggtccaa

SEQ ID NO: 4542064 - DNA, 22 bp, Homo sapiens
acccagctatggttctctcgca

SEQ ID NO: 4542065 - DNA, 13 bp, Homo sapiens
acccaggaaggga

SEQ ID NO: 4542066 - DNA, 23 bp, Homo sapiens
acccaggaagggaaagcgggcag

SEQ ID NO: 4542067 - DNA, 19 bp, Homo sapiens
acccaggagggagggggct

SEQ ID NO: 4542068 - DNA, 21 bp, Homo sapiens
acccaggaggtggaggttgca

SEQ ID NO: 4542069 - DNA, 23 bp, Homo sapiens
acccaggagtccagaccccccag

SEQ ID NO: 4542070 - DNA, 15 bp, Homo sapiens
acccaggagtccagc

SEQ ID NO: 4542071 - DNA, 22 bp, Homo sapiens
acccaggagtccagcccctcct

SEQ ID NO: 4542072 - DNA, 21 bp, Homo sapiens
acccaggcaggtgcagggaag

SEQ ID NO: 4542073 - DNA, 14 bp, Homo sapiens
acccaggcgctgca

SEQ ID NO: 4542074 - DNA, 21 bp, Homo sapiens
acccagggcctgacttgagcc

SEQ ID NO: 4542075 - DNA, 22 bp, Homo sapiens
acccagggcctgacttgagcca

SEQ ID NO: 4542076 - DNA, 22 bp, Homo sapiens
acccaggggaaggccctgaggc

SEQ ID NO: 4542077 - DNA, 18 bp, Homo sapiens
acccaggggtccaggccc

SEQ ID NO: 4542078 - DNA, 18 bp, Homo sapiens
acccaggtgggtcccggc

SEQ ID NO: 4542079 - DNA, 16 bp, Homo sapiens
acccagtccacaaaat

SEQ ID NO: 4542080 - DNA, 15 bp, Homo sapiens
acccagtccatgctc

SEQ ID NO: 4542081 - DNA, 16 bp, Homo sapiens
acccagtccatgctcc

SEQ ID NO: 4542082 - DNA, 17 bp, Homo sapiens
acccagtccatgctcca

SEQ ID NO: 4542083 - DNA, 14 bp, Homo sapiens
acccagtccctggg

SEQ ID NO: 4542084 - DNA, 15 bp, Homo sapiens
acccagtgggacaga

SEQ ID NO: 4542085 - DNA, 17 bp, Homo sapiens
acccatacaatgtatgt

SEQ ID NO: 4542086 - DNA, 18 bp, Homo sapiens
acccatacaatgtatgta

SEQ ID NO: 4542087 - DNA, 17 bp, Homo sapiens
acccatagtgcttcaca

SEQ ID NO: 4542088 - DNA, 20 bp, Homo sapiens
acccatattgtaaaacaggt

SEQ ID NO: 4542089 - DNA, 15 bp, Homo sapiens
acccatcaacaaaaa

SEQ ID NO: 4542090 - DNA, 18 bp, Homo sapiens
acccatcagaaggagaag

SEQ ID NO: 4542091 - DNA, 10 bp, Homo sapiens
acccatctgt

SEQ ID NO: 4542092 - DNA, 16 bp, Homo sapiens
acccatggcctcagcc

SEQ ID NO: 4542093 - DNA, 23 bp, Homo sapiens
acccatggcctcagccctgctcc

SEQ ID NO: 4542094 - DNA, 20 bp, Homo sapiens
acccatgtcaccggtcagtg

SEQ ID NO: 4542095 - DNA, 20 bp, Homo sapiens
accccaactctccccagtgc

SEQ ID NO: 4542096 - DNA, 16 bp, Homo sapiens
accccaagactcccat

SEQ ID NO: 4542097 - DNA, 17 bp, Homo sapiens
accccaagactcccatg

SEQ ID NO: 4542098 - DNA, 14 bp, Homo sapiens
accccacagctggg

SEQ ID NO: 4542099 - DNA, 22 bp, Homo sapiens
accccaccacgatgtggccctg

SEQ ID NO: 4542100 - DNA, 14 bp, Homo sapiens
accccaccccaccc

SEQ ID NO: 4542101 - DNA, 16 bp, Homo sapiens
accccaccccaccccc

SEQ ID NO: 4542102 - DNA, 22 bp, Homo sapiens
accccacccccttcagtgccca

SEQ ID NO: 4542103 - DNA, 13 bp, Homo sapiens
accccaccctccc

SEQ ID NO: 4542104 - DNA, 19 bp, Homo sapiens
accccaccctccctggagt

SEQ ID NO: 4542105 - DNA, 20 bp, Homo sapiens
accccaccctccctggagtg

SEQ ID NO: 4542106 - DNA, 14 bp, Homo sapiens
accccactgggaga

SEQ ID NO: 4542107 - DNA, 14 bp, Homo sapiens
accccagaggcaga

SEQ ID NO: 4542108 - DNA, 20 bp, Homo sapiens
accccagcattccagctctg

SEQ ID NO: 4542109 - DNA, 13 bp, Homo sapiens
accccagccccaa

SEQ ID NO: 4542110 - DNA, 23 bp, Homo sapiens
accccaggacgccactcatttca

SEQ ID NO: 4542111 - DNA, 13 bp, Homo sapiens
accccaggccccg

SEQ ID NO: 4542112 - DNA, 13 bp, Homo sapiens
accccagggcact

SEQ ID NO: 4542113 - DNA, 17 bp, Homo sapiens
accccagggcactgcca

SEQ ID NO: 4542114 - DNA, 22 bp, Homo sapiens
accccagggcactgccagccca

SEQ ID NO: 4542115 - DNA, 24 bp, Homo sapiens
accccagggcactgccagcccacc

SEQ ID NO: 4542116 - DNA, 11 bp, Homo sapiens
accccagggtc

SEQ ID NO: 4542117 - DNA, 17 bp, Homo sapiens
accccagtggccactca

SEQ ID NO: 4542118 - DNA, 23 bp, Homo sapiens
accccagtggccactcagcttcc

SEQ ID NO: 4542119 - DNA, 19 bp, Homo sapiens
accccatggagctgggcta

SEQ ID NO: 4542120 - DNA, 23 bp, Homo sapiens
accccattctttgcttgaacaca

SEQ ID NO: 4542121 - DNA, 12 bp, Homo sapiens
acccccacccca

SEQ ID NO: 4542122 - DNA, 13 bp, Homo sapiens
acccccactctca

SEQ ID NO: 4542123 - DNA, 17 bp, Homo sapiens
acccccagcccacagag

SEQ ID NO: 4542124 - DNA, 22 bp, Homo sapiens
acccccagccccgactccagcc

SEQ ID NO: 4542125 - DNA, 13 bp, Homo sapiens
acccccagccttg

SEQ ID NO: 4542126 - DNA, 17 bp, Homo sapiens
acccccagccttgccca

SEQ ID NO: 4542127 - DNA, 20 bp, Homo sapiens
acccccagccttgcccagct

SEQ ID NO: 4542128 - DNA, 21 bp, Homo sapiens
acccccagccttgcccagctt

SEQ ID NO: 4542129 - DNA, 17 bp, Homo sapiens
acccccaggcctgtcca

SEQ ID NO: 4542130 - DNA, 16 bp, Homo sapiens
acccccatctccctag

SEQ ID NO: 4542131 - DNA, 15 bp, Homo sapiens
acccccatgctgcct

SEQ ID NO: 4542132 - DNA, 19 bp, Homo sapiens
acccccatgctgccttcag

SEQ ID NO: 4542133 - DNA, 21 bp, Homo sapiens
acccccatgctgccttcaggg

SEQ ID NO: 4542134 - DNA, 20 bp, Homo sapiens
acccccatggccccaggccc

SEQ ID NO: 4542135 - DNA, 17 bp, Homo sapiens
acccccatgtaaatatt

SEQ ID NO: 4542136 - DNA, 22 bp, Homo sapiens
acccccatgtaaatattgttct

SEQ ID NO: 4542137 - DNA, 17 bp, Homo sapiens
accccccagcactgagg

SEQ ID NO: 4542138 - DNA, 20 bp, Homo sapiens
accccccagcccctcctccc

SEQ ID NO: 4542139 - DNA, 18 bp, Homo sapiens
acccccccccaatcggac

SEQ ID NO: 4542140 - DNA, 20 bp, Homo sapiens
accccccctcctgctgccta

SEQ ID NO: 4542141 - DNA, 14 bp, Homo sapiens
acccccctccccaa

SEQ ID NO: 4542142 - DNA, 17 bp, Homo sapiens
acccccctctctttctc

SEQ ID NO: 4542143 - DNA, 20 bp, Homo sapiens
acccccctctctttctctgg

SEQ ID NO: 4542144 - DNA, 15 bp, Homo sapiens
acccccgaggggagg

SEQ ID NO: 4542145 - DNA, 20 bp, Homo sapiens
acccccgaggggagggcagg

SEQ ID NO: 4542146 - DNA, 13 bp, Homo sapiens
acccccgccatgc

SEQ ID NO: 4542147 - DNA, 19 bp, Homo sapiens
acccccgtcctcttcgaga

SEQ ID NO: 4542148 - DNA, 14 bp, Homo sapiens
accccctcccaccc

SEQ ID NO: 4542149 - DNA, 17 bp, Homo sapiens
accccctcccaccccca

SEQ ID NO: 4542150 - DNA, 14 bp, Homo sapiens
accccctccccagg

SEQ ID NO: 4542151 - DNA, 15 bp, Homo sapiens
accccctccccgccc

SEQ ID NO: 4542152 - DNA, 13 bp, Homo sapiens
accccctcctccc

SEQ ID NO: 4542153 - DNA, 16 bp, Homo sapiens
accccctcctccccca

SEQ ID NO: 4542154 - DNA, 14 bp, Homo sapiens
accccctgccctgc

SEQ ID NO: 4542155 - DNA, 18 bp, Homo sapiens
accccctgctccaccagc

SEQ ID NO: 4542156 - DNA, 13 bp, Homo sapiens
accccctgtccca

SEQ ID NO: 4542157 - DNA, 20 bp, Homo sapiens
accccctgtcccattctaga

SEQ ID NO: 4542158 - DNA, 13 bp, Homo sapiens
acccccttctctg

SEQ ID NO: 4542159 - DNA, 17 bp, Homo sapiens
acccccttctctgctcc

SEQ ID NO: 4542160 - DNA, 18 bp, Homo sapiens
accccctttgactctggg

SEQ ID NO: 4542161 - DNA, 12 bp, Homo sapiens
accccgactttt

SEQ ID NO: 4542162 - DNA, 14 bp, Homo sapiens
accccgaggtaggg

SEQ ID NO: 4542163 - DNA, 21 bp, Homo sapiens
accccgctctgcatgcggccc

SEQ ID NO: 4542164 - DNA, 22 bp, Homo sapiens
accccgctctgcatgcggccca

SEQ ID NO: 4542165 - DNA, 15 bp, Homo sapiens
accccgggctctctg

SEQ ID NO: 4542166 - DNA, 16 bp, Homo sapiens
accccgggctctctgc

SEQ ID NO: 4542167 - DNA, 16 bp, Homo sapiens
accccggggaccctgt

SEQ ID NO: 4542168 - DNA, 17 bp, Homo sapiens
accccggggaccctgtg

SEQ ID NO: 4542169 - DNA, 23 bp, Homo sapiens
accccgtctggggttcagcccct

SEQ ID NO: 4542170 - DNA, 14 bp, Homo sapiens
acccctccctttct

SEQ ID NO: 4542171 - DNA, 14 bp, Homo sapiens
acccctcctccctc

SEQ ID NO: 4542172 - DNA, 15 bp, Homo sapiens
acccctcctccctca

SEQ ID NO: 4542173 - DNA, 17 bp, Homo sapiens
acccctcctccctcaga

SEQ ID NO: 4542174 - DNA, 15 bp, Homo sapiens
acccctccttcccca

SEQ ID NO: 4542175 - DNA, 20 bp, Homo sapiens
acccctctgcccctgcagct

SEQ ID NO: 4542176 - DNA, 17 bp, Homo sapiens
acccctgagccagcagg

SEQ ID NO: 4542177 - DNA, 20 bp, Homo sapiens
acccctgcccccagccccgg

SEQ ID NO: 4542178 - DNA, 14 bp, Homo sapiens
acccctgcctccac

SEQ ID NO: 4542179 - DNA, 18 bp, Homo sapiens
acccctgcctccaccctc

SEQ ID NO: 4542180 - DNA, 20 bp, Homo sapiens
acccctgcctccaccctctg

SEQ ID NO: 4542181 - DNA, 22 bp, Homo sapiens
acccctgcctccaccctctgag

SEQ ID NO: 4542182 - DNA, 12 bp, Homo sapiens
acccctggcctc

SEQ ID NO: 4542183 - DNA, 15 bp, Homo sapiens
acccctggttctcat

SEQ ID NO: 4542184 - DNA, 13 bp, Homo sapiens
acccctgtttctg

SEQ ID NO: 4542185 - DNA, 15 bp, Homo sapiens
accccttagcctccc

SEQ ID NO: 4542186 - DNA, 12 bp, Homo sapiens
accccttcgtgg

SEQ ID NO: 4542187 - DNA, 17 bp, Homo sapiens
accccttctctcctccc

SEQ ID NO: 4542188 - DNA, 23 bp, Homo sapiens
accccttctctcctccccaaatc

SEQ ID NO: 4542189 - DNA, 13 bp, Homo sapiens
acccgagcacata

SEQ ID NO: 4542190 - DNA, 16 bp, Homo sapiens
acccgccgcctcccac

SEQ ID NO: 4542191 - DNA, 13 bp, Homo sapiens
acccgctgtggcc

SEQ ID NO: 4542192 - DNA, 14 bp, Homo sapiens
acccggccacagct

SEQ ID NO: 4542193 - DNA, 17 bp, Homo sapiens
acccggccacagctgct

SEQ ID NO: 4542194 - DNA, 24 bp, Homo sapiens
acccgggaccaaactcacggacca

SEQ ID NO: 4542195 - DNA, 17 bp, Homo sapiens
acccgggaggcagaggt

SEQ ID NO: 4542196 - DNA, 21 bp, Homo sapiens
acccgggcaagggtcctcttt

SEQ ID NO: 4542197 - DNA, 17 bp, Homo sapiens
acccgggggagcccagt

SEQ ID NO: 4542198 - DNA, 18 bp, Homo sapiens
acccgggggagcccagtg

SEQ ID NO: 4542199 - DNA, 19 bp, Homo sapiens
acccgggggagcccagtga

SEQ ID NO: 4542200 - DNA, 16 bp, Homo sapiens
acccgtctccagctgc

SEQ ID NO: 4542201 - DNA, 14 bp, Homo sapiens
accctaaccaagtt

SEQ ID NO: 4542202 - DNA, 15 bp, Homo sapiens
accctaaccaagttc

SEQ ID NO: 4542203 - DNA, 22 bp, Homo sapiens
accctacagtatataagctttt

SEQ ID NO: 4542204 - DNA, 15 bp, Homo sapiens
accctaccccaccac

SEQ ID NO: 4542205 - DNA, 22 bp, Homo sapiens
accctatctgtgattcccccaa

SEQ ID NO: 4542206 - DNA, 16 bp, Homo sapiens
accctatgggtctagg

SEQ ID NO: 4542207 - DNA, 23 bp, Homo sapiens
accctatgggtctaggacacagt

SEQ ID NO: 4542208 - DNA, 17 bp, Homo sapiens
accctcagcagctctgg

SEQ ID NO: 4542209 - DNA, 22 bp, Homo sapiens
accctcagcagctctggctctg

SEQ ID NO: 4542210 - DNA, 17 bp, Homo sapiens
accctcagggagcctcc

SEQ ID NO: 4542211 - DNA, 14 bp, Homo sapiens
accctcatctttct

SEQ ID NO: 4542212 - DNA, 17 bp, Homo sapiens
accctcattgtgtttct

SEQ ID NO: 4542213 - DNA, 20 bp, Homo sapiens
accctccagtgctggatttg

SEQ ID NO: 4542214 - DNA, 20 bp, Homo sapiens
accctccatgctcctcacct

SEQ ID NO: 4542215 - DNA, 12 bp, Homo sapiens
accctcccaccc

SEQ ID NO: 4542216 - DNA, 16 bp, Homo sapiens
accctcccatggcacc

SEQ ID NO: 4542217 - DNA, 15 bp, Homo sapiens
accctccctggagtg

SEQ ID NO: 4542218 - DNA, 14 bp, Homo sapiens
accctccggcgggt

SEQ ID NO: 4542219 - DNA, 16 bp, Homo sapiens
accctcctgtcttccc

SEQ ID NO: 4542220 - DNA, 18 bp, Homo sapiens
accctcctgtcttcccag

SEQ ID NO: 4542221 - DNA, 11 bp, Homo sapiens
accctcctgtt

SEQ ID NO: 4542222 - DNA, 21 bp, Homo sapiens
accctcctgttgcacccagcc

SEQ ID NO: 4542223 - DNA, 24 bp, Homo sapiens
accctcctgttgcacccagccctg

SEQ ID NO: 4542224 - DNA, 18 bp, Homo sapiens
accctccttggtgcctct

SEQ ID NO: 4542225 - DNA, 14 bp, Homo sapiens
accctctcctgggg

SEQ ID NO: 4542226 - DNA, 21 bp, Homo sapiens
accctctcctgggggtggcag

SEQ ID NO: 4542227 - DNA, 22 bp, Homo sapiens
accctcttgcccatcctgactg

SEQ ID NO: 4542228 - DNA, 17 bp, Homo sapiens
accctgacctccgcccc

SEQ ID NO: 4542229 - DNA, 20 bp, Homo sapiens
accctgacctccgcccctgc

SEQ ID NO: 4542230 - DNA, 17 bp, Homo sapiens
accctgagctgaggcag

SEQ ID NO: 4542231 - DNA, 18 bp, Homo sapiens
accctgaggccctgggct

SEQ ID NO: 4542232 - DNA, 20 bp, Homo sapiens
accctgaggccctgggctgg

SEQ ID NO: 4542233 - DNA, 13 bp, Homo sapiens
accctgcaagacc

SEQ ID NO: 4542234 - DNA, 20 bp, Homo sapiens
accctgcaagaccacggagg

SEQ ID NO: 4542235 - DNA, 13 bp, Homo sapiens
accctgcaggttg

SEQ ID NO: 4542236 - DNA, 20 bp, Homo sapiens
accctgccaagactcctcag

SEQ ID NO: 4542237 - DNA, 23 bp, Homo sapiens
accctgccatggaactgtttcct

SEQ ID NO: 4542238 - DNA, 15 bp, Homo sapiens
accctgcccagagct

SEQ ID NO: 4542239 - DNA, 16 bp, Homo sapiens
accctgcccagagctg

SEQ ID NO: 4542240 - DNA, 23 bp, Homo sapiens
accctgcctcccttgactttgct

SEQ ID NO: 4542241 - DNA, 15 bp, Homo sapiens
accctgcctcctccc

SEQ ID NO: 4542242 - DNA, 23 bp, Homo sapiens
accctggaaatggactggtttga

SEQ ID NO: 4542243 - DNA, 19 bp, Homo sapiens
accctggagagtgcacatg

SEQ ID NO: 4542244 - DNA, 21 bp, Homo sapiens
accctgggctattgctgctgc

SEQ ID NO: 4542245 - DNA, 17 bp, Homo sapiens
accctggggcaggggtg

SEQ ID NO: 4542246 - DNA, 18 bp, Homo sapiens
accctggggcaggggtgc

SEQ ID NO: 4542247 - DNA, 20 bp, Homo sapiens
accctgggtgggctctgtgc

SEQ ID NO: 4542248 - DNA, 19 bp, Homo sapiens
accctggtgctttccttca

SEQ ID NO: 4542249 - DNA, 22 bp, Homo sapiens
accctggtgctttccttcatct

SEQ ID NO: 4542250 - DNA, 20 bp, Homo sapiens
accctgtcctgcacaccctg

SEQ ID NO: 4542251 - DNA, 21 bp, Homo sapiens
accctgtctctactaaaaata

SEQ ID NO: 4542252 - DNA, 21 bp, Homo sapiens
accctgtgacatggtgcctga

SEQ ID NO: 4542253 - DNA, 17 bp, Homo sapiens
accctgtgcaggagcta

SEQ ID NO: 4542254 - DNA, 15 bp, Homo sapiens
accctgttcctggag

SEQ ID NO: 4542255 - DNA, 14 bp, Homo sapiens
acccttaactgaca

SEQ ID NO: 4542256 - DNA, 19 bp, Homo sapiens
acccttacagtaggagccc

SEQ ID NO: 4542257 - DNA, 18 bp, Homo sapiens
acccttaccccttagcct

SEQ ID NO: 4542258 - DNA, 22 bp, Homo sapiens
acccttaccccttagcctccct

SEQ ID NO: 4542259 - DNA, 17 bp, Homo sapiens
acccttattgctgtcct

SEQ ID NO: 4542260 - DNA, 15 bp, Homo sapiens
acccttccacagctg

SEQ ID NO: 4542261 - DNA, 12 bp, Homo sapiens
acccttcccggc

SEQ ID NO: 4542262 - DNA, 17 bp, Homo sapiens
acccttcctgagcttta

SEQ ID NO: 4542263 - DNA, 20 bp, Homo sapiens
acccttctctcacttctaaa

SEQ ID NO: 4542264 - DNA, 14 bp, Homo sapiens
acccttctgggtcc

SEQ ID NO: 4542265 - DNA, 16 bp, Homo sapiens
acccttgctgtgaatt

SEQ ID NO: 4542266 - DNA, 20 bp, Homo sapiens
acccttgctttcctgggcct

SEQ ID NO: 4542267 - DNA, 23 bp, Homo sapiens
acccttggaaaacaaaagtttta

SEQ ID NO: 4542268 - DNA, 23 bp, Homo sapiens
acccttggctatgaaaatgagcc

SEQ ID NO: 4542269 - DNA, 15 bp, Homo sapiens
accctttagtgcttt

SEQ ID NO: 4542270 - DNA, 15 bp, Homo sapiens
accctttccttcctt

SEQ ID NO: 4542271 - DNA, 18 bp, Homo sapiens
accctttccttccttccc

SEQ ID NO: 4542272 - DNA, 12 bp, Homo sapiens
accctttggttt

SEQ ID NO: 4542273 - DNA, 21 bp, Homo sapiens
acccttttcccccttcccatt

SEQ ID NO: 4542274 - DNA, 22 bp, Homo sapiens
acccttttcccccttcccattt

SEQ ID NO: 4542275 - DNA, 17 bp, Homo sapiens
acccttttcctttgtgg

SEQ ID NO: 4542276 - DNA, 23 bp, Homo sapiens
accgaagtggactggcccctggg

SEQ ID NO: 4542277 - DNA, 23 bp, Homo sapiens
accgaatattcatggatggctca

SEQ ID NO: 4542278 - DNA, 12 bp, Homo sapiens
accgaatattga

SEQ ID NO: 4542279 - DNA, 14 bp, Homo sapiens
accgagactcagcc

SEQ ID NO: 4542280 - DNA, 15 bp, Homo sapiens
accgagactcagcct

SEQ ID NO: 4542281 - DNA, 16 bp, Homo sapiens
accgagactcagcctc

SEQ ID NO: 4542282 - DNA, 12 bp, Homo sapiens
accgaggccctc

SEQ ID NO: 4542283 - DNA, 16 bp, Homo sapiens
accgaggcgcgggggc

SEQ ID NO: 4542284 - DNA, 20 bp, Homo sapiens
accgcctgaaggcacagcta

SEQ ID NO: 4542285 - DNA, 15 bp, Homo sapiens
accgccttgcccagc

SEQ ID NO: 4542286 - DNA, 22 bp, Homo sapiens
accgccttgcccagcctggatg

SEQ ID NO: 4542287 - DNA, 16 bp, Homo sapiens
accgcgactaatttca

SEQ ID NO: 4542288 - DNA, 16 bp, Homo sapiens
accgctctcttttctg

SEQ ID NO: 4542289 - DNA, 15 bp, Homo sapiens
accggaactgggctg

SEQ ID NO: 4542290 - DNA, 19 bp, Homo sapiens
accggcctgtgggtctctg

SEQ ID NO: 4542291 - DNA, 20 bp, Homo sapiens
accggcctgtgggtctctga

SEQ ID NO: 4542292 - DNA, 21 bp, Homo sapiens
accggcctgtgggtctctgaa

SEQ ID NO: 4542293 - DNA, 23 bp, Homo sapiens
accggcggaccccagccatccag

SEQ ID NO: 4542294 - DNA, 12 bp, Homo sapiens
accgggcccctc

SEQ ID NO: 4542295 - DNA, 15 bp, Homo sapiens
accggtcagtgcctt

SEQ ID NO: 4542296 - DNA, 15 bp, Homo sapiens
accggtgctgcagga

SEQ ID NO: 4542297 - DNA, 23 bp, Homo sapiens
accgtaaaggtttatttttctgt

SEQ ID NO: 4542298 - DNA, 15 bp, Homo sapiens
accgtctacatttca

SEQ ID NO: 4542299 - DNA, 18 bp, Homo sapiens
accgtggaggaggaaggc

SEQ ID NO: 4542300 - DNA, 14 bp, Homo sapiens
accgtgggctccct

SEQ ID NO: 4542301 - DNA, 16 bp, Homo sapiens
accgtgggctccctga

SEQ ID NO: 4542302 - DNA, 15 bp, Homo sapiens
accgttcagtcattt

SEQ ID NO: 4542303 - DNA, 20 bp, Homo sapiens
acctaaataaacacatagat

SEQ ID NO: 4542304 - DNA, 18 bp, Homo sapiens
acctaaatttctgccaag

SEQ ID NO: 4542305 - DNA, 17 bp, Homo sapiens
acctaacccctttcctg

SEQ ID NO: 4542306 - DNA, 21 bp, Homo sapiens
acctaagattacaaatcagaa

SEQ ID NO: 4542307 - DNA, 19 bp, Homo sapiens
acctaagcacttctagaat

SEQ ID NO: 4542308 - DNA, 13 bp, Homo sapiens
acctaatgaaagt

SEQ ID NO: 4542309 - DNA, 21 bp, Homo sapiens
acctaatgaaagtgatgacat

SEQ ID NO: 4542310 - DNA, 16 bp, Homo sapiens
acctacagactccatc

SEQ ID NO: 4542311 - DNA, 16 bp, Homo sapiens
acctacagtgtacagt

SEQ ID NO: 4542312 - DNA, 17 bp, Homo sapiens
acctacagtgtacagtc

SEQ ID NO: 4542313 - DNA, 19 bp, Homo sapiens
acctacagttttaactgtg

SEQ ID NO: 4542314 - DNA, 18 bp, Homo sapiens
acctacatgctgaaaaat

SEQ ID NO: 4542315 - DNA, 23 bp, Homo sapiens
acctacgagggaggaacacctga

SEQ ID NO: 4542316 - DNA, 15 bp, Homo sapiens
acctagaacgtgcat

SEQ ID NO: 4542317 - DNA, 20 bp, Homo sapiens
acctagagacttcacccggg

SEQ ID NO: 4542318 - DNA, 21 bp, Homo sapiens
acctagtgcaaaaactgtaaa

SEQ ID NO: 4542319 - DNA, 18 bp, Homo sapiens
acctagttaaagaaagga

SEQ ID NO: 4542320 - DNA, 21 bp, Homo sapiens
acctatgagatggccatgctc

SEQ ID NO: 4542321 - DNA, 22 bp, Homo sapiens
acctatgcctgtggtgaagtgt

SEQ ID NO: 4542322 - DNA, 11 bp, Homo sapiens
acctattttag

SEQ ID NO: 4542323 - DNA, 15 bp, Homo sapiens
acctcaaaatttaac

SEQ ID NO: 4542324 - DNA, 17 bp, Homo sapiens
acctcaacctgtaaatt

SEQ ID NO: 4542325 - DNA, 21 bp, Homo sapiens
acctcaatttttgtttttgag

SEQ ID NO: 4542326 - DNA, 12 bp, Homo sapiens
acctcaccctgc

SEQ ID NO: 4542327 - DNA, 22 bp, Homo sapiens
acctcactagccatgctttatg

SEQ ID NO: 4542328 - DNA, 15 bp, Homo sapiens
acctcactgtccaat

SEQ ID NO: 4542329 - DNA, 14 bp, Homo sapiens
acctcagcaagctg

SEQ ID NO: 4542330 - DNA, 21 bp, Homo sapiens
acctcagccctgaaaataaca

SEQ ID NO: 4542331 - DNA, 16 bp, Homo sapiens
acctcaggaaagaata

SEQ ID NO: 4542332 - DNA, 12 bp, Homo sapiens
acctcaggcagg

SEQ ID NO: 4542333 - DNA, 12 bp, Homo sapiens
acctcagggctc

SEQ ID NO: 4542334 - DNA, 20 bp, Homo sapiens
acctcagggctcccaggggt

SEQ ID NO: 4542335 - DNA, 21 bp, Homo sapiens
acctcagtaatttagaaatca

SEQ ID NO: 4542336 - DNA, 23 bp, Homo sapiens
acctcagtgctcctggaaactta

SEQ ID NO: 4542337 - DNA, 18 bp, Homo sapiens
acctcagttattacatgt

SEQ ID NO: 4542338 - DNA, 22 bp, Homo sapiens
acctcagttattacatgtaatt

SEQ ID NO: 4542339 - DNA, 18 bp, Homo sapiens
acctcagttcccttggcc

SEQ ID NO: 4542340 - DNA, 21 bp, Homo sapiens
acctcagttcccttggcctca

SEQ ID NO: 4542341 - DNA, 19 bp, Homo sapiens
acctcataaaaatctagca

SEQ ID NO: 4542342 - DNA, 11 bp, Homo sapiens
acctcatcctg

SEQ ID NO: 4542343 - DNA, 19 bp, Homo sapiens
acctcatctttctccttca

SEQ ID NO: 4542344 - DNA, 20 bp, Homo sapiens
acctcatgcccaccccctgc

SEQ ID NO: 4542345 - DNA, 21 bp, Homo sapiens
acctcatgcccaccccctgcc

SEQ ID NO: 4542346 - DNA, 22 bp, Homo sapiens
acctccaataaagtgccttctg

SEQ ID NO: 4542347 - DNA, 16 bp, Homo sapiens
acctccacatcctcca

SEQ ID NO: 4542348 - DNA, 21 bp, Homo sapiens
acctccattctattttagaat

SEQ ID NO: 4542349 - DNA, 14 bp, Homo sapiens
acctccccccactg

SEQ ID NO: 4542350 - DNA, 15 bp, Homo sapiens
acctccccccactgc

SEQ ID NO: 4542351 - DNA, 16 bp, Homo sapiens
acctccccccactgca

SEQ ID NO: 4542352 - DNA, 14 bp, Homo sapiens
acctcccctatcca

SEQ ID NO: 4542353 - DNA, 15 bp, Homo sapiens
acctccgcccctgcc

SEQ ID NO: 4542354 - DNA, 22 bp, Homo sapiens
acctccgcccctgcccccgctc

SEQ ID NO: 4542355 - DNA, 17 bp, Homo sapiens
acctcctaaatgcccca

SEQ ID NO: 4542356 - DNA, 18 bp, Homo sapiens
acctcctaccctcccacc

SEQ ID NO: 4542357 - DNA, 20 bp, Homo sapiens
acctcctctgtgatttcttt

SEQ ID NO: 4542358 - DNA, 13 bp, Homo sapiens
acctcctgagaaa

SEQ ID NO: 4542359 - DNA, 15 bp, Homo sapiens
acctcctgcccagga

SEQ ID NO: 4542360 - DNA, 19 bp, Homo sapiens
acctcctgcccaggagagc

SEQ ID NO: 4542361 - DNA, 17 bp, Homo sapiens
acctccttagccctgtc

SEQ ID NO: 4542362 - DNA, 19 bp, Homo sapiens
acctcctttcatcacactg

SEQ ID NO: 4542363 - DNA, 22 bp, Homo sapiens
acctcctttcatcacactgggt

SEQ ID NO: 4542364 - DNA, 22 bp, Homo sapiens
acctcgagaagtaattatcagt

SEQ ID NO: 4542365 - DNA, 19 bp, Homo sapiens
acctcgagtactgtgggca

SEQ ID NO: 4542366 - DNA, 16 bp, Homo sapiens
acctcgctggactctc

SEQ ID NO: 4542367 - DNA, 15 bp, Homo sapiens
acctcggacagagcc

SEQ ID NO: 4542368 - DNA, 16 bp, Homo sapiens
acctcggacagagccc

SEQ ID NO: 4542369 - DNA, 17 bp, Homo sapiens
acctcggacagagcccc

SEQ ID NO: 4542370 - DNA, 18 bp, Homo sapiens
acctcggacagagccccc

SEQ ID NO: 4542371 - DNA, 20 bp, Homo sapiens
acctcggacagagcccccct

SEQ ID NO: 4542372 - DNA, 20 bp, Homo sapiens
acctcgtcctccccctgcca

SEQ ID NO: 4542373 - DNA, 16 bp, Homo sapiens
acctctagagaaaaga

SEQ ID NO: 4542374 - DNA, 15 bp, Homo sapiens
acctctcctgacccc

SEQ ID NO: 4542375 - DNA, 17 bp, Homo sapiens
acctctcctgacccctg

SEQ ID NO: 4542376 - DNA, 21 bp, Homo sapiens
acctctcctgacccctgcctg

SEQ ID NO: 4542377 - DNA, 14 bp, Homo sapiens
acctctctgtcatg

SEQ ID NO: 4542378 - DNA, 12 bp, Homo sapiens
acctctgagaag

SEQ ID NO: 4542379 - DNA, 14 bp, Homo sapiens
acctctgagaagac

SEQ ID NO: 4542380 - DNA, 12 bp, Homo sapiens
acctctgccaga

SEQ ID NO: 4542381 - DNA, 13 bp, Homo sapiens
acctctgcctcaa

SEQ ID NO: 4542382 - DNA, 18 bp, Homo sapiens
acctctgcctcccaggtt

SEQ ID NO: 4542383 - DNA, 14 bp, Homo sapiens
acctcttcctaggc

SEQ ID NO: 4542384 - DNA, 10 bp, Homo sapiens
acctcttgcc

SEQ ID NO: 4542385 - DNA, 15 bp, Homo sapiens
acctcttgtgcaagg

SEQ ID NO: 4542386 - DNA, 21 bp, Homo sapiens
acctctttttcctcctggaca

SEQ ID NO: 4542387 - DNA, 22 bp, Homo sapiens
acctctttttcctcctggacac

SEQ ID NO: 4542388 - DNA, 11 bp, Homo sapiens
acctgaaaaca

SEQ ID NO: 4542389 - DNA, 21 bp, Homo sapiens
acctgaaaacactgtgcacat

SEQ ID NO: 4542390 - DNA, 17 bp, Homo sapiens
acctgaaataatatatt

SEQ ID NO: 4542391 - DNA, 22 bp, Homo sapiens
acctgaaataatatatttcttc

SEQ ID NO: 4542392 - DNA, 15 bp, Homo sapiens
acctgaaccccagag

SEQ ID NO: 4542393 - DNA, 19 bp, Homo sapiens
acctgaaccccagaggcag

SEQ ID NO: 4542394 - DNA, 21 bp, Homo sapiens
acctgaaccccagaggcagag

SEQ ID NO: 4542395 - DNA, 17 bp, Homo sapiens
acctgacccctgctcag

SEQ ID NO: 4542396 - DNA, 20 bp, Homo sapiens
acctgaccgtgggcggggcc

SEQ ID NO: 4542397 - DNA, 22 bp, Homo sapiens
acctgactcaattatttgcata

SEQ ID NO: 4542398 - DNA, 16 bp, Homo sapiens
acctgagaccctggga

SEQ ID NO: 4542399 - DNA, 19 bp, Homo sapiens
acctgagaccctgggagag

SEQ ID NO: 4542400 - DNA, 21 bp, Homo sapiens
acctgagaccctgggagagaa

SEQ ID NO: 4542401 - DNA, 23 bp, Homo sapiens
acctgagaccctgggagagaagt

SEQ ID NO: 4542402 - DNA, 16 bp, Homo sapiens
acctgagccagcctgc

SEQ ID NO: 4542403 - DNA, 19 bp, Homo sapiens
acctgagctattttcctct

SEQ ID NO: 4542404 - DNA, 21 bp, Homo sapiens
acctgaggccaggacgtctgg

SEQ ID NO: 4542405 - DNA, 15 bp, Homo sapiens
acctgaggtcaggag

SEQ ID NO: 4542406 - DNA, 16 bp, Homo sapiens
acctgagttcccggga

SEQ ID NO: 4542407 - DNA, 17 bp, Homo sapiens
acctgagttcccgggag

SEQ ID NO: 4542408 - DNA, 15 bp, Homo sapiens
acctgattgatcaca

SEQ ID NO: 4542409 - DNA, 16 bp, Homo sapiens
acctgattgatcacac

SEQ ID NO: 4542410 - DNA, 17 bp, Homo sapiens
acctgattgatcacaca

SEQ ID NO: 4542411 - DNA, 21 bp, Homo sapiens
acctgattgatcacacagtgt

SEQ ID NO: 4542412 - DNA, 21 bp, Homo sapiens
acctgattggccactggatcc

SEQ ID NO: 4542413 - DNA, 15 bp, Homo sapiens
acctgattgtatttt

SEQ ID NO: 4542414 - DNA, 23 bp, Homo sapiens
acctgattgtattttttttttaa

SEQ ID NO: 4542415 - DNA, 13 bp, Homo sapiens
acctgcaaaaaat

SEQ ID NO: 4542416 - DNA, 10 bp, Homo sapiens
acctgcaaga

SEQ ID NO: 4542417 - DNA, 16 bp, Homo sapiens
acctgcaagatttcac

SEQ ID NO: 4542418 - DNA, 12 bp, Homo sapiens
acctgcaagttg

SEQ ID NO: 4542419 - DNA, 18 bp, Homo sapiens
acctgcacctccccccac

SEQ ID NO: 4542420 - DNA, 20 bp, Homo sapiens
acctgcacctccccccactg

SEQ ID NO: 4542421 - DNA, 22 bp, Homo sapiens
acctgcacctccccccactgca

SEQ ID NO: 4542422 - DNA, 21 bp, Homo sapiens
acctgcaggtttgacacgcag

SEQ ID NO: 4542423 - DNA, 15 bp, Homo sapiens
acctgcatatttagc

SEQ ID NO: 4542424 - DNA, 18 bp, Homo sapiens
acctgcatatttagctgt

SEQ ID NO: 4542425 - DNA, 19 bp, Homo sapiens
acctgcatccgtagttccc

SEQ ID NO: 4542426 - DNA, 15 bp, Homo sapiens
acctgcattgtaaat

SEQ ID NO: 4542427 - DNA, 23 bp, Homo sapiens
acctgccacaaaccaccaggact

SEQ ID NO: 4542428 - DNA, 17 bp, Homo sapiens
acctgccactcacacag

SEQ ID NO: 4542429 - DNA, 18 bp, Homo sapiens
acctgccagccactgtca

SEQ ID NO: 4542430 - DNA, 20 bp, Homo sapiens
acctgccagccactgtcacc

SEQ ID NO: 4542431 - DNA, 16 bp, Homo sapiens
acctgccatgccagga

SEQ ID NO: 4542432 - DNA, 14 bp, Homo sapiens
acctgccctcaagg

SEQ ID NO: 4542433 - DNA, 20 bp, Homo sapiens
acctgcccttttttctgcct

SEQ ID NO: 4542434 - DNA, 13 bp, Homo sapiens
acctgccgacctc

SEQ ID NO: 4542435 - DNA, 20 bp, Homo sapiens
acctgccgacctcgtcctcc

SEQ ID NO: 4542436 - DNA, 13 bp, Homo sapiens
acctgccttggcc

SEQ ID NO: 4542437 - DNA, 16 bp, Homo sapiens
acctgccttttaagtt

SEQ ID NO: 4542438 - DNA, 16 bp, Homo sapiens
acctgcggaaggaggt

SEQ ID NO: 4542439 - DNA, 12 bp, Homo sapiens
acctgctcaggc

SEQ ID NO: 4542440 - DNA, 19 bp, Homo sapiens
acctgctcccagtcctgcc

SEQ ID NO: 4542441 - DNA, 20 bp, Homo sapiens
acctgctcccagtcctgcct

SEQ ID NO: 4542442 - DNA, 17 bp, Homo sapiens
acctgctctgtccccaa

SEQ ID NO: 4542443 - DNA, 18 bp, Homo sapiens
acctgcttcacgttggcc

SEQ ID NO: 4542444 - DNA, 20 bp, Homo sapiens
acctggaaactgctcagacg

SEQ ID NO: 4542445 - DNA, 21 bp, Homo sapiens
acctggaagggctagaacctg

SEQ ID NO: 4542446 - DNA, 19 bp, Homo sapiens
acctggactgaccctgcag

SEQ ID NO: 4542447 - DNA, 22 bp, Homo sapiens
acctggactgagccaaggaggc

SEQ ID NO: 4542448 - DNA, 21 bp, Homo sapiens
acctggagagctagaacctag

SEQ ID NO: 4542449 - DNA, 20 bp, Homo sapiens
acctggagagctagaacctg

SEQ ID NO: 4542450 - DNA, 23 bp, Homo sapiens
acctggagagctagaacctggag

SEQ ID NO: 4542451 - DNA, 22 bp, Homo sapiens
acctggaggggctagaacctag

SEQ ID NO: 4542452 - DNA, 18 bp, Homo sapiens
acctggatccagcactgg

SEQ ID NO: 4542453 - DNA, 22 bp, Homo sapiens
acctggattttttatgtacaac

SEQ ID NO: 4542454 - DNA, 15 bp, Homo sapiens
acctggcaaaggacc

SEQ ID NO: 4542455 - DNA, 19 bp, Homo sapiens
acctggcactgggaggcag

SEQ ID NO: 4542456 - DNA, 23 bp, Homo sapiens
acctggccccatgtctctcagaa

SEQ ID NO: 4542457 - DNA, 23 bp, Homo sapiens
acctggcctggcctccaaaatat

SEQ ID NO: 4542458 - DNA, 13 bp, Homo sapiens
acctggctgaggt

SEQ ID NO: 4542459 - DNA, 14 bp, Homo sapiens
acctggcttattta

SEQ ID NO: 4542460 - DNA, 13 bp, Homo sapiens
acctgggaagggg

SEQ ID NO: 4542461 - DNA, 19 bp, Homo sapiens
acctgggcatttggtgaga

SEQ ID NO: 4542462 - DNA, 22 bp, Homo sapiens
acctggggagtggttaggcagc

SEQ ID NO: 4542463 - DNA, 22 bp, Homo sapiens
acctgggttccctttccttcca

SEQ ID NO: 4542464 - DNA, 15 bp, Homo sapiens
acctggtgcccctgc

SEQ ID NO: 4542465 - DNA, 16 bp, Homo sapiens
acctggtgcccctgct

SEQ ID NO: 4542466 - DNA, 16 bp, Homo sapiens
acctggtgtgtttctt

SEQ ID NO: 4542467 - DNA, 17 bp, Homo sapiens
acctgtaaaactttatt

SEQ ID NO: 4542468 - DNA, 19 bp, Homo sapiens
acctgtaaattattttaaa

SEQ ID NO: 4542469 - DNA, 20 bp, Homo sapiens
acctgtaacttttgtaaata

SEQ ID NO: 4542470 - DNA, 14 bp, Homo sapiens
acctgtacattctt

SEQ ID NO: 4542471 - DNA, 16 bp, Homo sapiens
acctgtatacagtgca

SEQ ID NO: 4542472 - DNA, 17 bp, Homo sapiens
acctgtatactcttgaa

SEQ ID NO: 4542473 - DNA, 17 bp, Homo sapiens
acctgtatatttctttt

SEQ ID NO: 4542474 - DNA, 18 bp, Homo sapiens
acctgtatatttctttta

SEQ ID NO: 4542475 - DNA, 14 bp, Homo sapiens
acctgtatttaagc

SEQ ID NO: 4542476 - DNA, 15 bp, Homo sapiens
acctgtatttaagca

SEQ ID NO: 4542477 - DNA, 13 bp, Homo sapiens
acctgtcagaata

SEQ ID NO: 4542478 - DNA, 14 bp, Homo sapiens
acctgtcagaataa

SEQ ID NO: 4542479 - DNA, 18 bp, Homo sapiens
acctgtctcacctggact

SEQ ID NO: 4542480 - DNA, 22 bp, Homo sapiens
acctgtgcttcgggcccttccc

SEQ ID NO: 4542481 - DNA, 23 bp, Homo sapiens
acctgtggaacataaaaaggaca

SEQ ID NO: 4542482 - DNA, 18 bp, Homo sapiens
acctgtggccaagttctt

SEQ ID NO: 4542483 - DNA, 16 bp, Homo sapiens
acctgtggggcctggg

SEQ ID NO: 4542484 - DNA, 18 bp, Homo sapiens
acctgttacctactttga

SEQ ID NO: 4542485 - DNA, 21 bp, Homo sapiens
acctgttcttccttttttaaa

SEQ ID NO: 4542486 - DNA, 20 bp, Homo sapiens
accttaaaattaagatttcc

SEQ ID NO: 4542487 - DNA, 16 bp, Homo sapiens
accttaaaattgatat

SEQ ID NO: 4542488 - DNA, 21 bp, Homo sapiens
accttaaattaaacaatttat

SEQ ID NO: 4542489 - DNA, 13 bp, Homo sapiens
accttaatgacaa

SEQ ID NO: 4542490 - DNA, 14 bp, Homo sapiens
accttacccctggc

SEQ ID NO: 4542491 - DNA, 22 bp, Homo sapiens
accttacccctggctgtttgga

SEQ ID NO: 4542492 - DNA, 13 bp, Homo sapiens
accttactaatta

SEQ ID NO: 4542493 - DNA, 14 bp, Homo sapiens
accttagaaaaaaa

SEQ ID NO: 4542494 - DNA, 18 bp, Homo sapiens
accttagataatatttct

SEQ ID NO: 4542495 - DNA, 20 bp, Homo sapiens
accttagataatatttctga

SEQ ID NO: 4542496 - DNA, 22 bp, Homo sapiens
accttagatgttctaagtcttt

SEQ ID NO: 4542497 - DNA, 13 bp, Homo sapiens
accttagcgttct

SEQ ID NO: 4542498 - DNA, 15 bp, Homo sapiens
accttaggctttgta

SEQ ID NO: 4542499 - DNA, 23 bp, Homo sapiens
accttaggctttgtatgacagtg

SEQ ID NO: 4542500 - DNA, 20 bp, Homo sapiens
accttagttgaaatgatagc

SEQ ID NO: 4542501 - DNA, 18 bp, Homo sapiens
accttatagttactgtgt

SEQ ID NO: 4542502 - DNA, 19 bp, Homo sapiens
accttatagttactgtgta

SEQ ID NO: 4542503 - DNA, 16 bp, Homo sapiens
accttatcctgcattg

SEQ ID NO: 4542504 - DNA, 18 bp, Homo sapiens
accttatgagaaactgca

SEQ ID NO: 4542505 - DNA, 17 bp, Homo sapiens
accttcagactttgctt

SEQ ID NO: 4542506 - DNA, 14 bp, Homo sapiens
accttcatattggc

SEQ ID NO: 4542507 - DNA, 18 bp, Homo sapiens
accttcatgcccttctga

SEQ ID NO: 4542508 - DNA, 19 bp, Homo sapiens
accttcatgcttactattt

SEQ ID NO: 4542509 - DNA, 11 bp, Homo sapiens
accttcccagc

SEQ ID NO: 4542510 - DNA, 13 bp, Homo sapiens
accttcccagctc

SEQ ID NO: 4542511 - DNA, 17 bp, Homo sapiens
accttcccagctctccc

SEQ ID NO: 4542512 - DNA, 18 bp, Homo sapiens
accttcccagctctccct

SEQ ID NO: 4542513 - DNA, 16 bp, Homo sapiens
accttccttcctgctt

SEQ ID NO: 4542514 - DNA, 14 bp, Homo sapiens
accttctatgtatt

SEQ ID NO: 4542515 - DNA, 15 bp, Homo sapiens
accttctatgtatta

SEQ ID NO: 4542516 - DNA, 17 bp, Homo sapiens
accttctttcactctgt

SEQ ID NO: 4542517 - DNA, 14 bp, Homo sapiens
accttctttctgga

SEQ ID NO: 4542518 - DNA, 20 bp, Homo sapiens
accttgaccatcgtccttcc

SEQ ID NO: 4542519 - DNA, 17 bp, Homo sapiens
accttgcaacctcacct

SEQ ID NO: 4542520 - DNA, 22 bp, Homo sapiens
accttgctgcaagcacagccct

SEQ ID NO: 4542521 - DNA, 23 bp, Homo sapiens
accttgctgcaagcacagccctt

SEQ ID NO: 4542522 - DNA, 13 bp, Homo sapiens
accttgcttttgc

SEQ ID NO: 4542523 - DNA, 21 bp, Homo sapiens
accttggaggaatgacaataa

SEQ ID NO: 4542524 - DNA, 19 bp, Homo sapiens
accttggcctctccttgga

SEQ ID NO: 4542525 - DNA, 19 bp, Homo sapiens
acctttaacttttttttct

SEQ ID NO: 4542526 - DNA, 21 bp, Homo sapiens
acctttaggtcaaactcccta

SEQ ID NO: 4542527 - DNA, 21 bp, Homo sapiens
acctttatatctgtcttttat

SEQ ID NO: 4542528 - DNA, 11 bp, Homo sapiens
acctttcatac

SEQ ID NO: 4542529 - DNA, 23 bp, Homo sapiens
acctttccattttacgttttaga

SEQ ID NO: 4542530 - DNA, 18 bp, Homo sapiens
acctttcccacctctctc

SEQ ID NO: 4542531 - DNA, 14 bp, Homo sapiens
acctttccctcacc

SEQ ID NO: 4542532 - DNA, 18 bp, Homo sapiens
acctttccctcaccccct

SEQ ID NO: 4542533 - DNA, 21 bp, Homo sapiens
acctttccgctgtcgccccag

SEQ ID NO: 4542534 - DNA, 17 bp, Homo sapiens
acctttctaaccttcac

SEQ ID NO: 4542535 - DNA, 22 bp, Homo sapiens
acctttctgaggagtaaaaaga

SEQ ID NO: 4542536 - DNA, 16 bp, Homo sapiens
acctttgctatgtaag

SEQ ID NO: 4542537 - DNA, 13 bp, Homo sapiens
acctttgtcaact

SEQ ID NO: 4542538 - DNA, 15 bp, Homo sapiens
accttttaccagctt

SEQ ID NO: 4542539 - DNA, 18 bp, Homo sapiens
accttttatgaatcaaat

SEQ ID NO: 4542540 - DNA, 16 bp, Homo sapiens
accttttattgacaca

SEQ ID NO: 4542541 - DNA, 12 bp, Homo sapiens
accttttcctca

SEQ ID NO: 4542542 - DNA, 17 bp, Homo sapiens
accttttctcacaaaaa

SEQ ID NO: 4542543 - DNA, 14 bp, Homo sapiens
accttttctctttt

SEQ ID NO: 4542544 - DNA, 16 bp, Homo sapiens
accttttctgtggctg

SEQ ID NO: 4542545 - DNA, 15 bp, Homo sapiens
acctttttatattta

SEQ ID NO: 4542546 - DNA, 19 bp, Homo sapiens
acctttttatttgcatgtg

SEQ ID NO: 4542547 - DNA, 17 bp, Homo sapiens
acgaaagtatttacttt

SEQ ID NO: 4542548 - DNA, 23 bp, Homo sapiens
acgaaagtatttactttttaaaa

SEQ ID NO: 4542549 - DNA, 14 bp, Homo sapiens
acgaacccacctgc

SEQ ID NO: 4542550 - DNA, 14 bp, Homo sapiens
acgaacttgaaagt

SEQ ID NO: 4542551 - DNA, 14 bp, Homo sapiens
acgaatattttcag

SEQ ID NO: 4542552 - DNA, 21 bp, Homo sapiens
acgaatgaaaataactgaatt

SEQ ID NO: 4542553 - DNA, 12 bp, Homo sapiens
acgacaaagctg

SEQ ID NO: 4542554 - DNA, 23 bp, Homo sapiens
acgacaaagctgctaaatctcct

SEQ ID NO: 4542555 - DNA, 12 bp, Homo sapiens
acgactgtctcc

SEQ ID NO: 4542556 - DNA, 12 bp, Homo sapiens
acgagacaacag

SEQ ID NO: 4542557 - DNA, 17 bp, Homo sapiens
acgagagcagaggtctc

SEQ ID NO: 4542558 - DNA, 18 bp, Homo sapiens
acgagccacaagctgcac

SEQ ID NO: 4542559 - DNA, 21 bp, Homo sapiens
acgagccacaagctgcactgt

SEQ ID NO: 4542560 - DNA, 19 bp, Homo sapiens
acgagctgtttactaggga

SEQ ID NO: 4542561 - DNA, 20 bp, Homo sapiens
acgaggaatctgtgggtctg

SEQ ID NO: 4542562 - DNA, 20 bp, Homo sapiens
acgaggccctcgggcccagc

SEQ ID NO: 4542563 - DNA, 21 bp, Homo sapiens
acgaggccctcgggcccagcc

SEQ ID NO: 4542564 - DNA, 22 bp, Homo sapiens
acgaggccctcgggcccagccc

SEQ ID NO: 4542565 - DNA, 18 bp, Homo sapiens
acgagggaggaacacctg

SEQ ID NO: 4542566 - DNA, 16 bp, Homo sapiens
acgagggctggctggc

SEQ ID NO: 4542567 - DNA, 16 bp, Homo sapiens
acgatccttcaaagtc

SEQ ID NO: 4542568 - DNA, 14 bp, Homo sapiens
acgatgacagtgtt

SEQ ID NO: 4542569 - DNA, 17 bp, Homo sapiens
acgatgtggccctggcc

SEQ ID NO: 4542570 - DNA, 17 bp, Homo sapiens
acgcaaatacactccag

SEQ ID NO: 4542571 - DNA, 15 bp, Homo sapiens
acgcacagccaagga

SEQ ID NO: 4542572 - DNA, 23 bp, Homo sapiens
acgcaccgcctgaaggcacagct

SEQ ID NO: 4542573 - DNA, 13 bp, Homo sapiens
acgcactggacag

SEQ ID NO: 4542574 - DNA, 17 bp, Homo sapiens
acgcactggacagcatc

SEQ ID NO: 4542575 - DNA, 19 bp, Homo sapiens
acgcagccctagagcctgc

SEQ ID NO: 4542576 - DNA, 21 bp, Homo sapiens
acgcagttgctcgcttttcct

SEQ ID NO: 4542577 - DNA, 21 bp, Homo sapiens
acgcagttgtgtggcccagca

SEQ ID NO: 4542578 - DNA, 16 bp, Homo sapiens
acgcatgatggagctg

SEQ ID NO: 4542579 - DNA, 19 bp, Homo sapiens
acgccaatgttatgccagc

SEQ ID NO: 4542580 - DNA, 12 bp, Homo sapiens
acgccactcatt

SEQ ID NO: 4542581 - DNA, 21 bp, Homo sapiens
acgccactcatttcatctcat

SEQ ID NO: 4542582 - DNA, 16 bp, Homo sapiens
acgccactccctggga

SEQ ID NO: 4542583 - DNA, 18 bp, Homo sapiens
acgccactccctgggaca

SEQ ID NO: 4542584 - DNA, 16 bp, Homo sapiens
acgccagacttcccac

SEQ ID NO: 4542585 - DNA, 22 bp, Homo sapiens
acgccagacttcccacggctcc

SEQ ID NO: 4542586 - DNA, 15 bp, Homo sapiens
acgccattctcctgc

SEQ ID NO: 4542587 - DNA, 21 bp, Homo sapiens
acgccattctcctgcctcagc

SEQ ID NO: 4542588 - DNA, 22 bp, Homo sapiens
acgccattctcctgcctcagcc

SEQ ID NO: 4542589 - DNA, 23 bp, Homo sapiens
acgccattctcctgcctcagcct

SEQ ID NO: 4542590 - DNA, 19 bp, Homo sapiens
acgccattgtactccagcc

SEQ ID NO: 4542591 - DNA, 21 bp, Homo sapiens
acgcccaccagccttgctctc

SEQ ID NO: 4542592 - DNA, 17 bp, Homo sapiens
acgccccggtcccccag

SEQ ID NO: 4542593 - DNA, 23 bp, Homo sapiens
acgcccctcccaagcgttcctgg

SEQ ID NO: 4542594 - DNA, 15 bp, Homo sapiens
acgccctccctgcta

SEQ ID NO: 4542595 - DNA, 24 bp, Homo sapiens
acgccctccctgctagcacagagg

SEQ ID NO: 4542596 - DNA, 17 bp, Homo sapiens
acgccctttcctcctca

SEQ ID NO: 4542597 - DNA, 12 bp, Homo sapiens
acgccgagtgca

SEQ ID NO: 4542598 - DNA, 19 bp, Homo sapiens
acgccggccacacccctct

SEQ ID NO: 4542599 - DNA, 17 bp, Homo sapiens
acgccggcttcctcctt

SEQ ID NO: 4542600 - DNA, 21 bp, Homo sapiens
acgccggcttcctccttccag

SEQ ID NO: 4542601 - DNA, 23 bp, Homo sapiens
acgccggggacagaggcctgccc

SEQ ID NO: 4542602 - DNA, 23 bp, Homo sapiens
acgcctctccctaggagaagagt

SEQ ID NO: 4542603 - DNA, 15 bp, Homo sapiens
acgcctcttgaccag

SEQ ID NO: 4542604 - DNA, 19 bp, Homo sapiens
acgcctgaggcaattagac

SEQ ID NO: 4542605 - DNA, 13 bp, Homo sapiens
acgcctgctggcc

SEQ ID NO: 4542606 - DNA, 18 bp, Homo sapiens
acgcctgtaatcccagca

SEQ ID NO: 4542607 - DNA, 19 bp, Homo sapiens
acgcctgtaatcccagcac

SEQ ID NO: 4542608 - DNA, 22 bp, Homo sapiens
acgcgacttccacaaacctgga

SEQ ID NO: 4542609 - DNA, 23 bp, Homo sapiens
acgcgcctcgccggatctgaggg

SEQ ID NO: 4542610 - DNA, 16 bp, Homo sapiens
acgctaaagagccctt

SEQ ID NO: 4542611 - DNA, 18 bp, Homo sapiens
acgctaaagagcccttgc

SEQ ID NO: 4542612 - DNA, 21 bp, Homo sapiens
acgctcagccccaggccagct

SEQ ID NO: 4542613 - DNA, 16 bp, Homo sapiens
acgctccctccccctg

SEQ ID NO: 4542614 - DNA, 14 bp, Homo sapiens
acgctgagccacct

SEQ ID NO: 4542615 - DNA, 17 bp, Homo sapiens
acgctgagccacctgcc

SEQ ID NO: 4542616 - DNA, 16 bp, Homo sapiens
acgctgggcctaggat

SEQ ID NO: 4542617 - DNA, 20 bp, Homo sapiens
acgctgtcctctcgagccca

SEQ ID NO: 4542618 - DNA, 18 bp, Homo sapiens
acgcttactagatgtgag

SEQ ID NO: 4542619 - DNA, 22 bp, Homo sapiens
acgcttgctctgtttgtggggt

SEQ ID NO: 4542620 - DNA, 18 bp, Homo sapiens
acgctttcctgaatccaa

SEQ ID NO: 4542621 - DNA, 12 bp, Homo sapiens
acgctttgattc

SEQ ID NO: 4542622 - DNA, 14 bp, Homo sapiens
acgctttgattcat

SEQ ID NO: 4542623 - DNA, 15 bp, Homo sapiens
acgctttgtttactc

SEQ ID NO: 4542624 - DNA, 16 bp, Homo sapiens
acgctttgtttactct

SEQ ID NO: 4542625 - DNA, 22 bp, Homo sapiens
acgcttttaatgaaaaggaatc

SEQ ID NO: 4542626 - DNA, 12 bp, Homo sapiens
acggagtggggg

SEQ ID NO: 4542627 - DNA, 19 bp, Homo sapiens
acggagtggggggacagag

SEQ ID NO: 4542628 - DNA, 22 bp, Homo sapiens
acggagtggggggacagagact

SEQ ID NO: 4542629 - DNA, 21 bp, Homo sapiens
acggatccatgtagcaggact

SEQ ID NO: 4542630 - DNA, 20 bp, Homo sapiens
acggcaacgtagcctgggct

SEQ ID NO: 4542631 - DNA, 23 bp, Homo sapiens
acggcacctcggggacaccagag

SEQ ID NO: 4542632 - DNA, 17 bp, Homo sapiens
acggcaggctcactgcc

SEQ ID NO: 4542633 - DNA, 13 bp, Homo sapiens
acggcccaggcca

SEQ ID NO: 4542634 - DNA, 15 bp, Homo sapiens
acggcccaggccagg

SEQ ID NO: 4542635 - DNA, 16 bp, Homo sapiens
acggcccaggccaggt

SEQ ID NO: 4542636 - DNA, 15 bp, Homo sapiens
acggcctgatgctcc

SEQ ID NO: 4542637 - DNA, 18 bp, Homo sapiens
acggcctgatgctccctc

SEQ ID NO: 4542638 - DNA, 22 bp, Homo sapiens
acggcctgatgctccctcccct

SEQ ID NO: 4542639 - DNA, 15 bp, Homo sapiens
acggctcactgcagc

SEQ ID NO: 4542640 - DNA, 12 bp, Homo sapiens
acggctcctcag

SEQ ID NO: 4542641 - DNA, 22 bp, Homo sapiens
acggcttgtgggcactgtgcca

SEQ ID NO: 4542642 - DNA, 20 bp, Homo sapiens
acgggaccctgcccagagct

SEQ ID NO: 4542643 - DNA, 24 bp, Homo sapiens
acgggatgattgcttgagctcagg

SEQ ID NO: 4542644 - DNA, 12 bp, Homo sapiens
acgggcaggggt

SEQ ID NO: 4542645 - DNA, 16 bp, Homo sapiens
acgggcagtagctgtg

SEQ ID NO: 4542646 - DNA, 20 bp, Homo sapiens
acgggcagtctgctctgctg

SEQ ID NO: 4542647 - DNA, 22 bp, Homo sapiens
acgggctcatgcacccctgagc

SEQ ID NO: 4542648 - DNA, 15 bp, Homo sapiens
acggggctcttctca

SEQ ID NO: 4542649 - DNA, 18 bp, Homo sapiens
acggggctcttctcattt

SEQ ID NO: 4542650 - DNA, 14 bp, Homo sapiens
acggggggctcctg

SEQ ID NO: 4542651 - DNA, 21 bp, Homo sapiens
acggggggctcctgcccaggc

SEQ ID NO: 4542652 - DNA, 15 bp, Homo sapiens
acggggttccctcct

SEQ ID NO: 4542653 - DNA, 20 bp, Homo sapiens
acggggttggctgttccaga

SEQ ID NO: 4542654 - DNA, 15 bp, Homo sapiens
acggggtttcaccat

SEQ ID NO: 4542655 - DNA, 23 bp, Homo sapiens
acgggtgcccgtaatcccagcta

SEQ ID NO: 4542656 - DNA, 21 bp, Homo sapiens
acggtcccccaggaggcagct

SEQ ID NO: 4542657 - DNA, 18 bp, Homo sapiens
acggtgctgtgagggagg

SEQ ID NO: 4542658 - DNA, 19 bp, Homo sapiens
acggtgctgtgagggaggg

SEQ ID NO: 4542659 - DNA, 17 bp, Homo sapiens
acggtgttttgccatgt

SEQ ID NO: 4542660 - DNA, 17 bp, Homo sapiens
acgtaaagctagaaatg

SEQ ID NO: 4542661 - DNA, 19 bp, Homo sapiens
acgtaatttgttatatcag

SEQ ID NO: 4542662 - DNA, 16 bp, Homo sapiens
acgtactcctcagacg

SEQ ID NO: 4542663 - DNA, 17 bp, Homo sapiens
acgtacttaatttactt

SEQ ID NO: 4542664 - DNA, 14 bp, Homo sapiens
acgtagctctctta

SEQ ID NO: 4542665 - DNA, 23 bp, Homo sapiens
acgtataaatatcagtattctga

SEQ ID NO: 4542666 - DNA, 14 bp, Homo sapiens
acgtattgctgtgt

SEQ ID NO: 4542667 - DNA, 15 bp, Homo sapiens
acgtatttaatagca

SEQ ID NO: 4542668 - DNA, 20 bp, Homo sapiens
acgtccatcacgttagctgt

SEQ ID NO: 4542669 - DNA, 18 bp, Homo sapiens
acgtcccagcatccctgg

SEQ ID NO: 4542670 - DNA, 21 bp, Homo sapiens
acgtcccagcatccctggagc

SEQ ID NO: 4542671 - DNA, 16 bp, Homo sapiens
acgtcgggcttccctg

SEQ ID NO: 4542672 - DNA, 19 bp, Homo sapiens
acgtctggcctacagaatg

SEQ ID NO: 4542673 - DNA, 18 bp, Homo sapiens
acgtctgtcaggggcttg

SEQ ID NO: 4542674 - DNA, 16 bp, Homo sapiens
acgtcttccttcttta

SEQ ID NO: 4542675 - DNA, 15 bp, Homo sapiens
acgtgaatattttgc

SEQ ID NO: 4542676 - DNA, 15 bp, Homo sapiens
acgtgaatgtctcag

SEQ ID NO: 4542677 - DNA, 20 bp, Homo sapiens
acgtgatcctctcacctcag

SEQ ID NO: 4542678 - DNA, 17 bp, Homo sapiens
acgtgccagatataact

SEQ ID NO: 4542679 - DNA, 14 bp, Homo sapiens
acgtgccaggcccg

SEQ ID NO: 4542680 - DNA, 19 bp, Homo sapiens
acgtgccaggcccggggct

SEQ ID NO: 4542681 - DNA, 23 bp, Homo sapiens
acgtgcctgtagtcccagctact

SEQ ID NO: 4542682 - DNA, 14 bp, Homo sapiens
acgtggagagctgg

SEQ ID NO: 4542683 - DNA, 19 bp, Homo sapiens
acgtggagagctggtgccc

SEQ ID NO: 4542684 - DNA, 16 bp, Homo sapiens
acgtggagatagtgcc

SEQ ID NO: 4542685 - DNA, 14 bp, Homo sapiens
acgtggtagtcact

SEQ ID NO: 4542686 - DNA, 15 bp, Homo sapiens
acgtgtgtattatgg

SEQ ID NO: 4542687 - DNA, 16 bp, Homo sapiens
acgtgtttgtgctgtg

SEQ ID NO: 4542688 - DNA, 20 bp, Homo sapiens
acgttagaggaaaaatattt

SEQ ID NO: 4542689 - DNA, 22 bp, Homo sapiens
acgttaggaggacaaaaggaat

SEQ ID NO: 4542690 - DNA, 16 bp, Homo sapiens
acgttcatcacctgct

SEQ ID NO: 4542691 - DNA, 11 bp, Homo sapiens
acgttccagcc

SEQ ID NO: 4542692 - DNA, 12 bp, Homo sapiens
acgttccagccg

SEQ ID NO: 4542693 - DNA, 20 bp, Homo sapiens
acgttccttactgcagaata

SEQ ID NO: 4542694 - DNA, 23 bp, Homo sapiens
acgttgcccaaggttgcacagca

SEQ ID NO: 4542695 - DNA, 20 bp, Homo sapiens
acgttgctgagccagctgca

SEQ ID NO: 4542696 - DNA, 23 bp, Homo sapiens
acgttggagtttgggctggagct

SEQ ID NO: 4542697 - DNA, 18 bp, Homo sapiens
acgtttaatcccagcact

SEQ ID NO: 4542698 - DNA, 21 bp, Homo sapiens
acgtttccccaataaagcctt

SEQ ID NO: 4542699 - DNA, 14 bp, Homo sapiens
acgttttaataatt

SEQ ID NO: 4542700 - DNA, 12 bp, Homo sapiens
acgttttagaaa

SEQ ID NO: 4542701 - DNA, 13 bp, Homo sapiens
acgtttttctggt

SEQ ID NO: 4542702 - DNA, 19 bp, Homo sapiens
acgtttttgtgctgtgggc

SEQ ID NO: 4542703 - DNA, 21 bp, Homo sapiens
actaaaaatattgtttctgca

SEQ ID NO: 4542704 - DNA, 16 bp, Homo sapiens
actaaaagtctccaaa

SEQ ID NO: 4542705 - DNA, 12 bp, Homo sapiens
actaaaattatg

SEQ ID NO: 4542706 - DNA, 14 bp, Homo sapiens
actaaaattatgtt

SEQ ID NO: 4542707 - DNA, 14 bp, Homo sapiens
actaaaatttacac

SEQ ID NO: 4542708 - DNA, 12 bp, Homo sapiens
actaaacagaaa

SEQ ID NO: 4542709 - DNA, 18 bp, Homo sapiens
actaaaccaactctaata

SEQ ID NO: 4542710 - DNA, 18 bp, Homo sapiens
actaaacttggtgcttat

SEQ ID NO: 4542711 - DNA, 22 bp, Homo sapiens
actaaacttggtgcttattgat

SEQ ID NO: 4542712 - DNA, 17 bp, Homo sapiens
actaaactttttttctg

SEQ ID NO: 4542713 - DNA, 20 bp, Homo sapiens
actaaagtatggtacatcta

SEQ ID NO: 4542714 - DNA, 21 bp, Homo sapiens
actaaagtatggtacatctac

SEQ ID NO: 4542715 - DNA, 20 bp, Homo sapiens
actaaattcgtgattttcaa

SEQ ID NO: 4542716 - DNA, 15 bp, Homo sapiens
actaaatttttcata

SEQ ID NO: 4542717 - DNA, 15 bp, Homo sapiens
actaacaatgccttg

SEQ ID NO: 4542718 - DNA, 21 bp, Homo sapiens
actaacaatgccttgttgtat

SEQ ID NO: 4542719 - DNA, 22 bp, Homo sapiens
actaacaatttccccctgttct

SEQ ID NO: 4542720 - DNA, 12 bp, Homo sapiens
actaacattata

SEQ ID NO: 4542721 - DNA, 20 bp, Homo sapiens
actaaccatccccaactcca

SEQ ID NO: 4542722 - DNA, 13 bp, Homo sapiens
actaacctgaccg

SEQ ID NO: 4542723 - DNA, 19 bp, Homo sapiens
actaagaacccctctgctt

SEQ ID NO: 4542724 - DNA, 20 bp, Homo sapiens
actaagacaagaacattctc

SEQ ID NO: 4542725 - DNA, 19 bp, Homo sapiens
actaagagacagttctctg

SEQ ID NO: 4542726 - DNA, 20 bp, Homo sapiens
actaagagacagttctctgt

SEQ ID NO: 4542727 - DNA, 13 bp, Homo sapiens
actaagattcttt

SEQ ID NO: 4542728 - DNA, 16 bp, Homo sapiens
actaaggatttttcaa

SEQ ID NO: 4542729 - DNA, 12 bp, Homo sapiens
actaataaagtg

SEQ ID NO: 4542730 - DNA, 23 bp, Homo sapiens
actaatacgtgccagatataact

SEQ ID NO: 4542731 - DNA, 15 bp, Homo sapiens
actaatagaacttgt

SEQ ID NO: 4542732 - DNA, 16 bp, Homo sapiens
actaatagaataaagg

SEQ ID NO: 4542733 - DNA, 20 bp, Homo sapiens
actaatagaataaaggcagt

SEQ ID NO: 4542734 - DNA, 14 bp, Homo sapiens
actaatatatgaaa

SEQ ID NO: 4542735 - DNA, 17 bp, Homo sapiens
actaatatatttaaaaa

SEQ ID NO: 4542736 - DNA, 19 bp, Homo sapiens
actaatgccttactcttct

SEQ ID NO: 4542737 - DNA, 23 bp, Homo sapiens
actaatgccttactcttcttgaa

SEQ ID NO: 4542738 - DNA, 22 bp, Homo sapiens
actaatgcttacaactttctaa

SEQ ID NO: 4542739 - DNA, 21 bp, Homo sapiens
actaattatactactttgtta

SEQ ID NO: 4542740 - DNA, 20 bp, Homo sapiens
actaattattattttaaaat

SEQ ID NO: 4542741 - DNA, 15 bp, Homo sapiens
actaattccacacct

SEQ ID NO: 4542742 - DNA, 21 bp, Homo sapiens
actaattttacatgtttataa

SEQ ID NO: 4542743 - DNA, 13 bp, Homo sapiens
actaatttttgta

SEQ ID NO: 4542744 - DNA, 19 bp, Homo sapiens
actaatttttgtattattt

SEQ ID NO: 4542745 - DNA, 22 bp, Homo sapiens
actacaaacaaaatttctatta

SEQ ID NO: 4542746 - DNA, 14 bp, Homo sapiens
actacacctggctg

SEQ ID NO: 4542747 - DNA, 20 bp, Homo sapiens
actacactccagcctgggca

SEQ ID NO: 4542748 - DNA, 22 bp, Homo sapiens
actacagaatattaaatattat

SEQ ID NO: 4542749 - DNA, 19 bp, Homo sapiens
actacagctatatttgatt

SEQ ID NO: 4542750 - DNA, 21 bp, Homo sapiens
actacaggctcatgccatcat

SEQ ID NO: 4542751 - DNA, 20 bp, Homo sapiens
actacatgcagcccatgccc

SEQ ID NO: 4542752 - DNA, 19 bp, Homo sapiens
actacattccaaagaaaca

SEQ ID NO: 4542753 - DNA, 16 bp, Homo sapiens
actacattttaaaaac

SEQ ID NO: 4542754 - DNA, 16 bp, Homo sapiens
actacccttaattact

SEQ ID NO: 4542755 - DNA, 17 bp, Homo sapiens
actaccttgaaaataag

SEQ ID NO: 4542756 - DNA, 18 bp, Homo sapiens
actaccttggttccccca

SEQ ID NO: 4542757 - DNA, 14 bp, Homo sapiens
actactaaggaaaa

SEQ ID NO: 4542758 - DNA, 19 bp, Homo sapiens
actactatttttctttcca

SEQ ID NO: 4542759 - DNA, 20 bp, Homo sapiens
actactatttttctttccaa

SEQ ID NO: 4542760 - DNA, 21 bp, Homo sapiens
actactcctctgcagtgcctt

SEQ ID NO: 4542761 - DNA, 17 bp, Homo sapiens
actactgggtgtcattt

SEQ ID NO: 4542762 - DNA, 19 bp, Homo sapiens
actactgggtgtcatttca

SEQ ID NO: 4542763 - DNA, 21 bp, Homo sapiens
actacttatctctaaaccatc

SEQ ID NO: 4542764 - DNA, 12 bp, Homo sapiens
actactttataa

SEQ ID NO: 4542765 - DNA, 15 bp, Homo sapiens
actacttttctaaaa

SEQ ID NO: 4542766 - DNA, 17 bp, Homo sapiens
actacttttctaaaatc

SEQ ID NO: 4542767 - DNA, 14 bp, Homo sapiens
actagaacctggag

SEQ ID NO: 4542768 - DNA, 19 bp, Homo sapiens
actagaagattagaaacta

SEQ ID NO: 4542769 - DNA, 14 bp, Homo sapiens
actagaagggccag

SEQ ID NO: 4542770 - DNA, 22 bp, Homo sapiens
actagactggtggcaggggctt

SEQ ID NO: 4542771 - DNA, 23 bp, Homo sapiens
actagagaatgcacagatatact

SEQ ID NO: 4542772 - DNA, 18 bp, Homo sapiens
actagaggtgagaaattt

SEQ ID NO: 4542773 - DNA, 21 bp, Homo sapiens
actagaggtgagaaatttaaa

SEQ ID NO: 4542774 - DNA, 17 bp, Homo sapiens
actagatgtagtatttt

SEQ ID NO: 4542775 - DNA, 10 bp, Homo sapiens
actagcatta

SEQ ID NO: 4542776 - DNA, 20 bp, Homo sapiens
actagccagcacaaaaggca

SEQ ID NO: 4542777 - DNA, 19 bp, Homo sapiens
actagccatgctttatgtg

SEQ ID NO: 4542778 - DNA, 15 bp, Homo sapiens
actagcccaatgaaa

SEQ ID NO: 4542779 - DNA, 23 bp, Homo sapiens
actagctagaagtgggccaggac

SEQ ID NO: 4542780 - DNA, 13 bp, Homo sapiens
actaggaaacgtg

SEQ ID NO: 4542781 - DNA, 16 bp, Homo sapiens
actagggatccctcat

SEQ ID NO: 4542782 - DNA, 19 bp, Homo sapiens
actagggattcaggctgct

SEQ ID NO: 4542783 - DNA, 16 bp, Homo sapiens
actagggccaagccca

SEQ ID NO: 4542784 - DNA, 14 bp, Homo sapiens
actaggtgtcccca

SEQ ID NO: 4542785 - DNA, 16 bp, Homo sapiens
actagtgtttaagtca

SEQ ID NO: 4542786 - DNA, 20 bp, Homo sapiens
actagttgtgtctggcagtt

SEQ ID NO: 4542787 - DNA, 18 bp, Homo sapiens
actataagatacaataaa

SEQ ID NO: 4542788 - DNA, 15 bp, Homo sapiens
actataatcaaatga

SEQ ID NO: 4542789 - DNA, 17 bp, Homo sapiens
actataatcaaatgatt

SEQ ID NO: 4542790 - DNA, 15 bp, Homo sapiens
actatacccgggacc

SEQ ID NO: 4542791 - DNA, 16 bp, Homo sapiens
actatacttgaacaaa

SEQ ID NO: 4542792 - DNA, 18 bp, Homo sapiens
actatacttgaacaaaag

SEQ ID NO: 4542793 - DNA, 15 bp, Homo sapiens
actataggtccagaa

SEQ ID NO: 4542794 - DNA, 18 bp, Homo sapiens
actatatagaatttcctg

SEQ ID NO: 4542795 - DNA, 22 bp, Homo sapiens
actatatagaatttcctgtaat

SEQ ID NO: 4542796 - DNA, 21 bp, Homo sapiens
actatatgtgaaacatttttt

SEQ ID NO: 4542797 - DNA, 16 bp, Homo sapiens
actatcaatatttaag

SEQ ID NO: 4542798 - DNA, 18 bp, Homo sapiens
actatcaatatttaagtt

SEQ ID NO: 4542799 - DNA, 14 bp, Homo sapiens
actatcacacatga

SEQ ID NO: 4542800 - DNA, 19 bp, Homo sapiens
actatcaggtaataaaagc

SEQ ID NO: 4542801 - DNA, 22 bp, Homo sapiens
actatcatttttacactattgt

SEQ ID NO: 4542802 - DNA, 14 bp, Homo sapiens
actatctacaaaaa

SEQ ID NO: 4542803 - DNA, 22 bp, Homo sapiens
actatctcatgccagtgcctta

SEQ ID NO: 4542804 - DNA, 16 bp, Homo sapiens
actatgaaaagctaga

SEQ ID NO: 4542805 - DNA, 22 bp, Homo sapiens
actatgaactgaaggcagcatg

SEQ ID NO: 4542806 - DNA, 16 bp, Homo sapiens
actatgcagtatctct

SEQ ID NO: 4542807 - DNA, 15 bp, Homo sapiens
actatgcccttttat

SEQ ID NO: 4542808 - DNA, 15 bp, Homo sapiens
actatgctttccttc

SEQ ID NO: 4542809 - DNA, 20 bp, Homo sapiens
actatggagtcttgtgaaag

SEQ ID NO: 4542810 - DNA, 21 bp, Homo sapiens
actatggtatgctggccagca

SEQ ID NO: 4542811 - DNA, 11 bp, Homo sapiens
actatgtaaac

SEQ ID NO: 4542812 - DNA, 16 bp, Homo sapiens
actatgtaaactactt

SEQ ID NO: 4542813 - DNA, 17 bp, Homo sapiens
actatgtctgaacatag

SEQ ID NO: 4542814 - DNA, 19 bp, Homo sapiens
actattactattactattt

SEQ ID NO: 4542815 - DNA, 13 bp, Homo sapiens
actattacttgaa

SEQ ID NO: 4542816 - DNA, 16 bp, Homo sapiens
actattacttgaactt

SEQ ID NO: 4542817 - DNA, 13 bp, Homo sapiens
actattacttttc

SEQ ID NO: 4542818 - DNA, 19 bp, Homo sapiens
actattagtattattaaca

SEQ ID NO: 4542819 - DNA, 16 bp, Homo sapiens
actattataagtgctt

SEQ ID NO: 4542820 - DNA, 14 bp, Homo sapiens
actattcaaacagt

SEQ ID NO: 4542821 - DNA, 21 bp, Homo sapiens
actattcaaacagtctcagga

SEQ ID NO: 4542822 - DNA, 15 bp, Homo sapiens
actattgcatttata

SEQ ID NO: 4542823 - DNA, 15 bp, Homo sapiens
actattgtgccaact

SEQ ID NO: 4542824 - DNA, 15 bp, Homo sapiens
actatttatatcaca

SEQ ID NO: 4542825 - DNA, 13 bp, Homo sapiens
actatttcagtga

SEQ ID NO: 4542826 - DNA, 16 bp, Homo sapiens
actatttcagtgataa

SEQ ID NO: 4542827 - DNA, 17 bp, Homo sapiens
actatttccaaaagcac

SEQ ID NO: 4542828 - DNA, 16 bp, Homo sapiens
actatttctgttccag

SEQ ID NO: 4542829 - DNA, 16 bp, Homo sapiens
actatttgtataaaaa

SEQ ID NO: 4542830 - DNA, 16 bp, Homo sapiens
actattttaaataaaa

SEQ ID NO: 4542831 - DNA, 19 bp, Homo sapiens
actattttcagaatctgaa

SEQ ID NO: 4542832 - DNA, 17 bp, Homo sapiens
actatttttttcttaaa

SEQ ID NO: 4542833 - DNA, 14 bp, Homo sapiens
actcaaattttggc

SEQ ID NO: 4542834 - DNA, 23 bp, Homo sapiens
actcaacagagaggaccaacatc

SEQ ID NO: 4542835 - DNA, 15 bp, Homo sapiens
actcaagaagcacac

SEQ ID NO: 4542836 - DNA, 17 bp, Homo sapiens
actcaagaggaatctgt

SEQ ID NO: 4542837 - DNA, 19 bp, Homo sapiens
actcaagaggaatctgttt

SEQ ID NO: 4542838 - DNA, 17 bp, Homo sapiens
actcaaggacaggagcc

SEQ ID NO: 4542839 - DNA, 15 bp, Homo sapiens
actcaagggttttcc

SEQ ID NO: 4542840 - DNA, 18 bp, Homo sapiens
actcaaggtttaacctta

SEQ ID NO: 4542841 - DNA, 21 bp, Homo sapiens
actcaataaacagtcactgga

SEQ ID NO: 4542842 - DNA, 14 bp, Homo sapiens
actcacacagccag

SEQ ID NO: 4542843 - DNA, 22 bp, Homo sapiens
actcacacagccaggtgccttg

SEQ ID NO: 4542844 - DNA, 18 bp, Homo sapiens
actcacatagccaactct

SEQ ID NO: 4542845 - DNA, 21 bp, Homo sapiens
actcacattgttcaactccct

SEQ ID NO: 4542846 - DNA, 19 bp, Homo sapiens
actcaccactaccagccag

SEQ ID NO: 4542847 - DNA, 12 bp, Homo sapiens
actcacccaagc

SEQ ID NO: 4542848 - DNA, 15 bp, Homo sapiens
actcaccctgggagc

SEQ ID NO: 4542849 - DNA, 22 bp, Homo sapiens
actcaccctgggagccagtcct

SEQ ID NO: 4542850 - DNA, 12 bp, Homo sapiens
actcacctctct

SEQ ID NO: 4542851 - DNA, 13 bp, Homo sapiens
actcacctctgcc

SEQ ID NO: 4542852 - DNA, 14 bp, Homo sapiens
actcacctctgcct

SEQ ID NO: 4542853 - DNA, 16 bp, Homo sapiens
actcacctctgcctca

SEQ ID NO: 4542854 - DNA, 16 bp, Homo sapiens
actcactcctgagacc

SEQ ID NO: 4542855 - DNA, 14 bp, Homo sapiens
actcactgtttata

SEQ ID NO: 4542856 - DNA, 14 bp, Homo sapiens
actcagaagttgtg

SEQ ID NO: 4542857 - DNA, 20 bp, Homo sapiens
actcagacgtgtgacctcca

SEQ ID NO: 4542858 - DNA, 21 bp, Homo sapiens
actcagacgtgtgacctccat

SEQ ID NO: 4542859 - DNA, 24 bp, Homo sapiens
actcagacgtgtgacctccatact

SEQ ID NO: 4542860 - DNA, 16 bp, Homo sapiens
actcagatctgtctga

SEQ ID NO: 4542861 - DNA, 19 bp, Homo sapiens
actcagatgatgccagctg

SEQ ID NO: 4542862 - DNA, 24 bp, Homo sapiens
actcagatgatgccagctgtctcc

SEQ ID NO: 4542863 - DNA, 19 bp, Homo sapiens
actcagcaactgttagctg

SEQ ID NO: 4542864 - DNA, 16 bp, Homo sapiens
actcagcagcagagag

SEQ ID NO: 4542865 - DNA, 19 bp, Homo sapiens
actcagccactgtcacagg

SEQ ID NO: 4542866 - DNA, 20 bp, Homo sapiens
actcagccactgtcacaggc

SEQ ID NO: 4542867 - DNA, 21 bp, Homo sapiens
actcagccactgtcacaggca

SEQ ID NO: 4542868 - DNA, 23 bp, Homo sapiens
actcagccactgtcacaggcata

SEQ ID NO: 4542869 - DNA, 14 bp, Homo sapiens
actcagccctgagg

SEQ ID NO: 4542870 - DNA, 15 bp, Homo sapiens
actcagccctgaggt

SEQ ID NO: 4542871 - DNA, 17 bp, Homo sapiens
actcagctctcctgctg

SEQ ID NO: 4542872 - DNA, 12 bp, Homo sapiens
actcaggaggct

SEQ ID NO: 4542873 - DNA, 20 bp, Homo sapiens
actcaggaggctgagacagg

SEQ ID NO: 4542874 - DNA, 11 bp, Homo sapiens
actcaggcaga

SEQ ID NO: 4542875 - DNA, 17 bp, Homo sapiens
actcagggaccggtgct

SEQ ID NO: 4542876 - DNA, 15 bp, Homo sapiens
actcaggttccagaa

SEQ ID NO: 4542877 - DNA, 22 bp, Homo sapiens
actcagtagccatatcttccaa

SEQ ID NO: 4542878 - DNA, 13 bp, Homo sapiens
actcagtctttaa

SEQ ID NO: 4542879 - DNA, 21 bp, Homo sapiens
actcagtgtctgcctttaaat

SEQ ID NO: 4542880 - DNA, 23 bp, Homo sapiens
actcagtgtgtgatccggtttct

SEQ ID NO: 4542881 - DNA, 21 bp, Homo sapiens
actcatagattgcaaatattg

SEQ ID NO: 4542882 - DNA, 14 bp, Homo sapiens
actcatcacataaa

SEQ ID NO: 4542883 - DNA, 15 bp, Homo sapiens
actcatcacataaag

SEQ ID NO: 4542884 - DNA, 22 bp, Homo sapiens
actcatgcaaactgctttattt

SEQ ID NO: 4542885 - DNA, 15 bp, Homo sapiens
actcatgtgactctt

SEQ ID NO: 4542886 - DNA, 20 bp, Homo sapiens
actcatgtgcagtcagcttt

SEQ ID NO: 4542887 - DNA, 23 bp, Homo sapiens
actcattagaattaccatttgtt

SEQ ID NO: 4542888 - DNA, 13 bp, Homo sapiens
actcattgcagca

SEQ ID NO: 4542889 - DNA, 17 bp, Homo sapiens
actcattgcagcagata

SEQ ID NO: 4542890 - DNA, 20 bp, Homo sapiens
actcatttttcatgataatg

SEQ ID NO: 4542891 - DNA, 21 bp, Homo sapiens
actccaaagaaatgtaaggga

SEQ ID NO: 4542892 - DNA, 15 bp, Homo sapiens
actccaaggttccct

SEQ ID NO: 4542893 - DNA, 22 bp, Homo sapiens
actccacaccttttatgaatca

SEQ ID NO: 4542894 - DNA, 16 bp, Homo sapiens
actccacatctgcctt

SEQ ID NO: 4542895 - DNA, 14 bp, Homo sapiens
actccaccacccaa

SEQ ID NO: 4542896 - DNA, 22 bp, Homo sapiens
actccactactttactgttggt

SEQ ID NO: 4542897 - DNA, 19 bp, Homo sapiens
actccagccagcgcctccc

SEQ ID NO: 4542898 - DNA, 20 bp, Homo sapiens
actccagccagcgcctccct

SEQ ID NO: 4542899 - DNA, 15 bp, Homo sapiens
actccagcctgggca

SEQ ID NO: 4542900 - DNA, 18 bp, Homo sapiens
actccagcctgggtcaca

SEQ ID NO: 4542901 - DNA, 23 bp, Homo sapiens
actccagcctgggtcacagagtg

SEQ ID NO: 4542902 - DNA, 19 bp, Homo sapiens
actccaggcccaaggctcc

SEQ ID NO: 4542903 - DNA, 20 bp, Homo sapiens
actccagttaaaaaaaattt

SEQ ID NO: 4542904 - DNA, 22 bp, Homo sapiens
actccagtttgcccaccacaac

SEQ ID NO: 4542905 - DNA, 22 bp, Homo sapiens
actccatacagcctctacagcc

SEQ ID NO: 4542906 - DNA, 19 bp, Homo sapiens
actccatcagaaaaccaaa

SEQ ID NO: 4542907 - DNA, 14 bp, Homo sapiens
actccatctcttct

SEQ ID NO: 4542908 - DNA, 15 bp, Homo sapiens
actccatctcttctg

SEQ ID NO: 4542909 - DNA, 11 bp, Homo sapiens
actccatcttg

SEQ ID NO: 4542910 - DNA, 17 bp, Homo sapiens
actccatcttggtagtt

SEQ ID NO: 4542911 - DNA, 13 bp, Homo sapiens
actccatgctcct

SEQ ID NO: 4542912 - DNA, 19 bp, Homo sapiens
actcccaaagctcagactt

SEQ ID NO: 4542913 - DNA, 14 bp, Homo sapiens
actcccatgaagcc

SEQ ID NO: 4542914 - DNA, 16 bp, Homo sapiens
actcccatgaagcctt

SEQ ID NO: 4542915 - DNA, 18 bp, Homo sapiens
actcccatgaagcctttt

SEQ ID NO: 4542916 - DNA, 17 bp, Homo sapiens
actcccatgagggagat

SEQ ID NO: 4542917 - DNA, 21 bp, Homo sapiens
actccccacttcactttcttc

SEQ ID NO: 4542918 - DNA, 17 bp, Homo sapiens
actccccagccccagcc

SEQ ID NO: 4542919 - DNA, 17 bp, Homo sapiens
actcccccgtttctcct

SEQ ID NO: 4542920 - DNA, 19 bp, Homo sapiens
actcccccgtttctccttt

SEQ ID NO: 4542921 - DNA, 16 bp, Homo sapiens
actccccgaagtcttt

SEQ ID NO: 4542922 - DNA, 20 bp, Homo sapiens
actccctcctcacctctgga

SEQ ID NO: 4542923 - DNA, 22 bp, Homo sapiens
actcccttctcggggtgggaca

SEQ ID NO: 4542924 - DNA, 16 bp, Homo sapiens
actcccttctgtagtt

SEQ ID NO: 4542925 - DNA, 16 bp, Homo sapiens
actccgaagaaaagaa

SEQ ID NO: 4542926 - DNA, 16 bp, Homo sapiens
actccgagtgaactgg

SEQ ID NO: 4542927 - DNA, 17 bp, Homo sapiens
actccgcatcacctcac

SEQ ID NO: 4542928 - DNA, 16 bp, Homo sapiens
actccgcccagcctct

SEQ ID NO: 4542929 - DNA, 17 bp, Homo sapiens
actccgcccagcctctc

SEQ ID NO: 4542930 - DNA, 22 bp, Homo sapiens
actccgcccagcctctccccgc

SEQ ID NO: 4542931 - DNA, 17 bp, Homo sapiens
actccgcgccgatgcca

SEQ ID NO: 4542932 - DNA, 18 bp, Homo sapiens
actccgcgccgatgccac

SEQ ID NO: 4542933 - DNA, 22 bp, Homo sapiens
actccgcgccgatgccaccggc

SEQ ID NO: 4542934 - DNA, 23 bp, Homo sapiens
actccgcgccgatgccaccggcc

SEQ ID NO: 4542935 - DNA, 12 bp, Homo sapiens
actccggaggac

SEQ ID NO: 4542936 - DNA, 14 bp, Homo sapiens
actccggaggactg

SEQ ID NO: 4542937 - DNA, 16 bp, Homo sapiens
actccggccctccaga

SEQ ID NO: 4542938 - DNA, 13 bp, Homo sapiens
actccggctgtgc

SEQ ID NO: 4542939 - DNA, 15 bp, Homo sapiens
actccggctgtgctg

SEQ ID NO: 4542940 - DNA, 18 bp, Homo sapiens
actccggctgtgctggga

SEQ ID NO: 4542941 - DNA, 15 bp, Homo sapiens
actccgtcaagctgg

SEQ ID NO: 4542942 - DNA, 21 bp, Homo sapiens
actcctagagaacgcagccct

SEQ ID NO: 4542943 - DNA, 16 bp, Homo sapiens
actcctatttttgtaa

SEQ ID NO: 4542944 - DNA, 12 bp, Homo sapiens
actcctcagacg

SEQ ID NO: 4542945 - DNA, 21 bp, Homo sapiens
actcctcagacgggctgagag

SEQ ID NO: 4542946 - DNA, 20 bp, Homo sapiens
actcctcatccccacaatct

SEQ ID NO: 4542947 - DNA, 18 bp, Homo sapiens
actcctccgtgagcacca

SEQ ID NO: 4542948 - DNA, 23 bp, Homo sapiens
actcctcctccaaaggcccccta

SEQ ID NO: 4542949 - DNA, 22 bp, Homo sapiens
actcctctggctttcccaggag

SEQ ID NO: 4542950 - DNA, 20 bp, Homo sapiens
actcctgaagttgtacttgt

SEQ ID NO: 4542951 - DNA, 17 bp, Homo sapiens
actcctgagacccctgg

SEQ ID NO: 4542952 - DNA, 20 bp, Homo sapiens
actcctgagacccctggcct

SEQ ID NO: 4542953 - DNA, 23 bp, Homo sapiens
actcctgccaggcacacacagcc

SEQ ID NO: 4542954 - DNA, 19 bp, Homo sapiens
actcctgccattcttctgg

SEQ ID NO: 4542955 - DNA, 22 bp, Homo sapiens
actcctggactccggaggactg

SEQ ID NO: 4542956 - DNA, 22 bp, Homo sapiens
actcctgggcacccttaatctt

SEQ ID NO: 4542957 - DNA, 14 bp, Homo sapiens
actcctgtgctctg

SEQ ID NO: 4542958 - DNA, 18 bp, Homo sapiens
actccttccatctcttcc

SEQ ID NO: 4542959 - DNA, 19 bp, Homo sapiens
actccttccttcaggactc

SEQ ID NO: 4542960 - DNA, 17 bp, Homo sapiens
actcctttatctgtaat

SEQ ID NO: 4542961 - DNA, 15 bp, Homo sapiens
actcctttcagccac

SEQ ID NO: 4542962 - DNA, 17 bp, Homo sapiens
actcctttcagccacat

SEQ ID NO: 4542963 - DNA, 20 bp, Homo sapiens
actcctttccaatagaaaga

SEQ ID NO: 4542964 - DNA, 20 bp, Homo sapiens
actcgacaaaggccacaggc

SEQ ID NO: 4542965 - DNA, 22 bp, Homo sapiens
actcgacaaaggccacaggcag

SEQ ID NO: 4542966 - DNA, 13 bp, Homo sapiens
actcgagaacttt

SEQ ID NO: 4542967 - DNA, 21 bp, Homo sapiens
actcgatttaaactccagcat

SEQ ID NO: 4542968 - DNA, 13 bp, Homo sapiens
actcgccttctta

SEQ ID NO: 4542969 - DNA, 20 bp, Homo sapiens
actcggagactatggcctcg

SEQ ID NO: 4542970 - DNA, 14 bp, Homo sapiens
actcggggtccctg

SEQ ID NO: 4542971 - DNA, 17 bp, Homo sapiens
actcgggtctgcagacc

SEQ ID NO: 4542972 - DNA, 22 bp, Homo sapiens
actcgtgcattaaaatttctta

SEQ ID NO: 4542973 - DNA, 15 bp, Homo sapiens
actcgtgtgtttcta

SEQ ID NO: 4542974 - DNA, 23 bp, Homo sapiens
actcgtgtgtttctattttttga

SEQ ID NO: 4542975 - DNA, 12 bp, Homo sapiens
actctaaagatt

SEQ ID NO: 4542976 - DNA, 14 bp, Homo sapiens
actctaactgtata

SEQ ID NO: 4542977 - DNA, 17 bp, Homo sapiens
actctaatatgattata

SEQ ID NO: 4542978 - DNA, 19 bp, Homo sapiens
actctacccctgctcccat

SEQ ID NO: 4542979 - DNA, 13 bp, Homo sapiens
actctaccctccc

SEQ ID NO: 4542980 - DNA, 15 bp, Homo sapiens
actctaccctcccac

SEQ ID NO: 4542981 - DNA, 18 bp, Homo sapiens
actctaccctcccacccc

SEQ ID NO: 4542982 - DNA, 21 bp, Homo sapiens
actctacctgcaagatttcac

SEQ ID NO: 4542983 - DNA, 15 bp, Homo sapiens
actctactgtgtaat

SEQ ID NO: 4542984 - DNA, 14 bp, Homo sapiens
actctagttctaga

SEQ ID NO: 4542985 - DNA, 15 bp, Homo sapiens
actctagttctagat

SEQ ID NO: 4542986 - DNA, 18 bp, Homo sapiens
actctataagattccaaa

SEQ ID NO: 4542987 - DNA, 16 bp, Homo sapiens
actctatattgttcag

SEQ ID NO: 4542988 - DNA, 14 bp, Homo sapiens
actctatttttaca

SEQ ID NO: 4542989 - DNA, 22 bp, Homo sapiens
actctcaccatgatgtgaagag

SEQ ID NO: 4542990 - DNA, 16 bp, Homo sapiens
actctcagcccagaag

SEQ ID NO: 4542991 - DNA, 11 bp, Homo sapiens
actctcaggga

SEQ ID NO: 4542992 - DNA, 19 bp, Homo sapiens
actctccaacctggacaac

SEQ ID NO: 4542993 - DNA, 16 bp, Homo sapiens
actctccaatgttcta

SEQ ID NO: 4542994 - DNA, 15 bp, Homo sapiens
actctccaggggtcc

SEQ ID NO: 4542995 - DNA, 21 bp, Homo sapiens
actctcccaaagggcacaccc

SEQ ID NO: 4542996 - DNA, 19 bp, Homo sapiens
actctccccacgagggctg

SEQ ID NO: 4542997 - DNA, 11 bp, Homo sapiens
actctccccag

SEQ ID NO: 4542998 - DNA, 14 bp, Homo sapiens
actctccccagtgc

SEQ ID NO: 4542999 - DNA, 15 bp, Homo sapiens
actctccccagtgcc

SEQ ID NO: 4543000 - DNA, 16 bp, Homo sapiens
actctccccagtgcct

SEQ ID NO: 4543001 - DNA, 20 bp, Homo sapiens
actctccccagtgcctgcca

SEQ ID NO: 4543002 - DNA, 21 bp, Homo sapiens
actctccccagtgcctgccac

SEQ ID NO: 4543003 - DNA, 14 bp, Homo sapiens
actctcccccaccc

SEQ ID NO: 4543004 - DNA, 20 bp, Homo sapiens
actctcccccaccccctccc

SEQ ID NO: 4543005 - DNA, 14 bp, Homo sapiens
actctcctcctccc

SEQ ID NO: 4543006 - DNA, 18 bp, Homo sapiens
actctcctcctcccctcc

SEQ ID NO: 4543007 - DNA, 16 bp, Homo sapiens
actctcctctgcctca

SEQ ID NO: 4543008 - DNA, 14 bp, Homo sapiens
actctctcccagga

SEQ ID NO: 4543009 - DNA, 21 bp, Homo sapiens
actctctgccattctgtgcag

SEQ ID NO: 4543010 - DNA, 12 bp, Homo sapiens
actctctgggac

SEQ ID NO: 4543011 - DNA, 17 bp, Homo sapiens
actctctgtggtccctt

SEQ ID NO: 4543012 - DNA, 18 bp, Homo sapiens
actctcttctctttctct

SEQ ID NO: 4543013 - DNA, 13 bp, Homo sapiens
actctgaaagagc

SEQ ID NO: 4543014 - DNA, 18 bp, Homo sapiens
actctgaaatatcccggg

SEQ ID NO: 4543015 - DNA, 15 bp, Homo sapiens
actctgaagcctctg

SEQ ID NO: 4543016 - DNA, 15 bp, Homo sapiens
actctgcactactcc

SEQ ID NO: 4543017 - DNA, 19 bp, Homo sapiens
actctgcactactcctctg

SEQ ID NO: 4543018 - DNA, 17 bp, Homo sapiens
actctgcatagacaaag

SEQ ID NO: 4543019 - DNA, 18 bp, Homo sapiens
actctgcatagacaaagg

SEQ ID NO: 4543020 - DNA, 14 bp, Homo sapiens
actctgccccaatc

SEQ ID NO: 4543021 - DNA, 19 bp, Homo sapiens
actctgccccctgctggct

SEQ ID NO: 4543022 - DNA, 19 bp, Homo sapiens
actctgcccctggacctgg

SEQ ID NO: 4543023 - DNA, 13 bp, Homo sapiens
actctgccctcta

SEQ ID NO: 4543024 - DNA, 19 bp, Homo sapiens
actctgcgggaggctgggg

SEQ ID NO: 4543025 - DNA, 12 bp, Homo sapiens
actctgctgctc

SEQ ID NO: 4543026 - DNA, 14 bp, Homo sapiens
actctgctgtttga

SEQ ID NO: 4543027 - DNA, 13 bp, Homo sapiens
actctgcttgtta

SEQ ID NO: 4543028 - DNA, 21 bp, Homo sapiens
actctggaggtttgtttagaa

SEQ ID NO: 4543029 - DNA, 22 bp, Homo sapiens
actctgggagtaatacttttta

SEQ ID NO: 4543030 - DNA, 18 bp, Homo sapiens
actctggggtgcagcttc

SEQ ID NO: 4543031 - DNA, 20 bp, Homo sapiens
actctggtgagtcaccactt

SEQ ID NO: 4543032 - DNA, 16 bp, Homo sapiens
actctgtaaaacgcac

SEQ ID NO: 4543033 - DNA, 12 bp, Homo sapiens
actctgtaaaat

SEQ ID NO: 4543034 - DNA, 13 bp, Homo sapiens
actctgtaaaatg

SEQ ID NO: 4543035 - DNA, 17 bp, Homo sapiens
actctgtcagccagccg

SEQ ID NO: 4543036 - DNA, 22 bp, Homo sapiens
actctgtccctgtccttccctg

SEQ ID NO: 4543037 - DNA, 15 bp, Homo sapiens
actctgtctcagtcc

SEQ ID NO: 4543038 - DNA, 18 bp, Homo sapiens
actctgtctcagtccatg

SEQ ID NO: 4543039 - DNA, 20 bp, Homo sapiens
actctgtctcagtccatgaa

SEQ ID NO: 4543040 - DNA, 22 bp, Homo sapiens
actctgtgtggctgtgcaattt

SEQ ID NO: 4543041 - DNA, 21 bp, Homo sapiens
actctgttattgatcccttct

SEQ ID NO: 4543042 - DNA, 18 bp, Homo sapiens
actctgttcccccaccct

SEQ ID NO: 4543043 - DNA, 19 bp, Homo sapiens
actctgttcccccaccctc

SEQ ID NO: 4543044 - DNA, 22 bp, Homo sapiens
actctgttcccccaccctccat

SEQ ID NO: 4543045 - DNA, 18 bp, Homo sapiens
actcttagagatgattca

SEQ ID NO: 4543046 - DNA, 16 bp, Homo sapiens
actcttctaaaacttg

SEQ ID NO: 4543047 - DNA, 22 bp, Homo sapiens
actcttctgactgccccctcct

SEQ ID NO: 4543048 - DNA, 20 bp, Homo sapiens
actcttctgtcttgtcccca

SEQ ID NO: 4543049 - DNA, 19 bp, Homo sapiens
actcttcttgaaattttaa

SEQ ID NO: 4543050 - DNA, 21 bp, Homo sapiens
actcttctttaagccatagac

SEQ ID NO: 4543051 - DNA, 21 bp, Homo sapiens
actcttgatctctcttgtcct

SEQ ID NO: 4543052 - DNA, 20 bp, Homo sapiens
actcttggtcagcttttgtt

SEQ ID NO: 4543053 - DNA, 23 bp, Homo sapiens
actcttggttcgatacctggagc

SEQ ID NO: 4543054 - DNA, 16 bp, Homo sapiens
actcttgtactgcctg

SEQ ID NO: 4543055 - DNA, 20 bp, Homo sapiens
actctttattgtctgtaaat

SEQ ID NO: 4543056 - DNA, 13 bp, Homo sapiens
actctttcaaaac

SEQ ID NO: 4543057 - DNA, 17 bp, Homo sapiens
actctttccgactgccc

SEQ ID NO: 4543058 - DNA, 19 bp, Homo sapiens
actctttccgactgcccag

SEQ ID NO: 4543059 - DNA, 12 bp, Homo sapiens
actctttctctc

SEQ ID NO: 4543060 - DNA, 19 bp, Homo sapiens
actctttctctcccctcct

SEQ ID NO: 4543061 - DNA, 16 bp, Homo sapiens
actctttgaaagcttt

SEQ ID NO: 4543062 - DNA, 13 bp, Homo sapiens
actctttgagaaa

SEQ ID NO: 4543063 - DNA, 18 bp, Homo sapiens
actctttgagaaacaaca

SEQ ID NO: 4543064 - DNA, 21 bp, Homo sapiens
actctttgctttgtagtttgc

SEQ ID NO: 4543065 - DNA, 18 bp, Homo sapiens
actcttttccttcccttt

SEQ ID NO: 4543066 - DNA, 21 bp, Homo sapiens
actcttttgctttattccaga

SEQ ID NO: 4543067 - DNA, 21 bp, Homo sapiens
actgaaaaaaaaaaagaagaa

SEQ ID NO: 4543068 - DNA, 23 bp, Homo sapiens
actgaaaaaaaaaaagaagaaga

SEQ ID NO: 4543069 - DNA, 24 bp, Homo sapiens
actgaaaaaaaaaaagaagaagaa

SEQ ID NO: 4543070 - DNA, 16 bp, Homo sapiens
actgaaaatgaatgcc

SEQ ID NO: 4543071 - DNA, 21 bp, Homo sapiens
actgaaaggtgattgcagctt

SEQ ID NO: 4543072 - DNA, 15 bp, Homo sapiens
actgaaagttttgta

SEQ ID NO: 4543073 - DNA, 17 bp, Homo sapiens
actgaaagttttgtaaa

SEQ ID NO: 4543074 - DNA, 14 bp, Homo sapiens
actgaaatctgtca

SEQ ID NO: 4543075 - DNA, 21 bp, Homo sapiens
actgaaatgtgaaaagagcaa

SEQ ID NO: 4543076 - DNA, 19 bp, Homo sapiens
actgaacaccattgaaggc

SEQ ID NO: 4543077 - DNA, 20 bp, Homo sapiens
actgaacaccattgaaggct

SEQ ID NO: 4543078 - DNA, 18 bp, Homo sapiens
actgaacaggttctcttc

SEQ ID NO: 4543079 - DNA, 14 bp, Homo sapiens
actgaaccaggcca

SEQ ID NO: 4543080 - DNA, 20 bp, Homo sapiens
actgaactacatgcataaac

SEQ ID NO: 4543081 - DNA, 12 bp, Homo sapiens
actgaactgtaa

SEQ ID NO: 4543082 - DNA, 15 bp, Homo sapiens
actgaactgtaactt

SEQ ID NO: 4543083 - DNA, 12 bp, Homo sapiens
actgaacttgaa

SEQ ID NO: 4543084 - DNA, 17 bp, Homo sapiens
actgaacttgaagctaa

SEQ ID NO: 4543085 - DNA, 18 bp, Homo sapiens
actgaacttgaagctaac

SEQ ID NO: 4543086 - DNA, 14 bp, Homo sapiens
actgaagagctctt

SEQ ID NO: 4543087 - DNA, 19 bp, Homo sapiens
actgaagagctcttggccc

SEQ ID NO: 4543088 - DNA, 20 bp, Homo sapiens
actgaagcttcaaaaagcca

SEQ ID NO: 4543089 - DNA, 18 bp, Homo sapiens
actgaaggaaaaacacaa

SEQ ID NO: 4543090 - DNA, 14 bp, Homo sapiens
actgaaggagaagg

SEQ ID NO: 4543091 - DNA, 20 bp, Homo sapiens
actgaaggctaaaaagcaac

SEQ ID NO: 4543092 - DNA, 16 bp, Homo sapiens
actgaagtgcttgcag

SEQ ID NO: 4543093 - DNA, 23 bp, Homo sapiens
actgaatatcaactctgaaagag

SEQ ID NO: 4543094 - DNA, 18 bp, Homo sapiens
actgaatctatggcttta

SEQ ID NO: 4543095 - DNA, 12 bp, Homo sapiens
actgaatgaggt

SEQ ID NO: 4543096 - DNA, 14 bp, Homo sapiens
actgaatgatctat

SEQ ID NO: 4543097 - DNA, 17 bp, Homo sapiens
actgaatggactttgca

SEQ ID NO: 4543098 - DNA, 21 bp, Homo sapiens
actgaattgtatcaatttgtt

SEQ ID NO: 4543099 - DNA, 13 bp, Homo sapiens
actgaatttggag

SEQ ID NO: 4543100 - DNA, 15 bp, Homo sapiens
actgaattttgggac

SEQ ID NO: 4543101 - DNA, 20 bp, Homo sapiens
actgacagggagcagccccc

SEQ ID NO: 4543102 - DNA, 20 bp, Homo sapiens
actgaccaatattgtacagt

SEQ ID NO: 4543103 - DNA, 12 bp, Homo sapiens
actgaccactgg

SEQ ID NO: 4543104 - DNA, 16 bp, Homo sapiens
actgaccatccactct

SEQ ID NO: 4543105 - DNA, 22 bp, Homo sapiens
actgaccatccactctaccctc

SEQ ID NO: 4543106 - DNA, 23 bp, Homo sapiens
actgaccatccactctaccctcc

SEQ ID NO: 4543107 - DNA, 15 bp, Homo sapiens
actgacttctaagta

SEQ ID NO: 4543108 - DNA, 22 bp, Homo sapiens
actgacttctaagtaaaaccac

SEQ ID NO: 4543109 - DNA, 14 bp, Homo sapiens
actgagaacctgat

SEQ ID NO: 4543110 - DNA, 14 bp, Homo sapiens
actgagagaaagat

SEQ ID NO: 4543111 - DNA, 18 bp, Homo sapiens
actgagagtgaacaaatt

SEQ ID NO: 4543112 - DNA, 18 bp, Homo sapiens
actgagatattattttaa

SEQ ID NO: 4543113 - DNA, 16 bp, Homo sapiens
actgagcagccgccag

SEQ ID NO: 4543114 - DNA, 21 bp, Homo sapiens
actgagcatcactagtgacaa

SEQ ID NO: 4543115 - DNA, 19 bp, Homo sapiens
actgagccaaggaggcctg

SEQ ID NO: 4543116 - DNA, 12 bp, Homo sapiens
actgagccccag

SEQ ID NO: 4543117 - DNA, 20 bp, Homo sapiens
actgagccccagcgggctgg

SEQ ID NO: 4543118 - DNA, 11 bp, Homo sapiens
actgagccccc

SEQ ID NO: 4543119 - DNA, 18 bp, Homo sapiens
actgaggaacctgagact

SEQ ID NO: 4543120 - DNA, 20 bp, Homo sapiens
actgagggaccaactgggcc

SEQ ID NO: 4543121 - DNA, 22 bp, Homo sapiens
actgagggaccaactgggccca

SEQ ID NO: 4543122 - DNA, 14 bp, Homo sapiens
actgagggactctg

SEQ ID NO: 4543123 - DNA, 18 bp, Homo sapiens
actgagggactctgaagc

SEQ ID NO: 4543124 - DNA, 17 bp, Homo sapiens
actgagggctctgtttg

SEQ ID NO: 4543125 - DNA, 18 bp, Homo sapiens
actgagtgcctactcttt

SEQ ID NO: 4543126 - DNA, 13 bp, Homo sapiens
actgagtgggaag

SEQ ID NO: 4543127 - DNA, 18 bp, Homo sapiens
actgagttatcaggtgca

SEQ ID NO: 4543128 - DNA, 20 bp, Homo sapiens
actgagttttgtttcacttt

SEQ ID NO: 4543129 - DNA, 15 bp, Homo sapiens
actgatcacaaaaac

SEQ ID NO: 4543130 - DNA, 18 bp, Homo sapiens
actgatcccccagatgca

SEQ ID NO: 4543131 - DNA, 16 bp, Homo sapiens
actgatgattttcctt

SEQ ID NO: 4543132 - DNA, 16 bp, Homo sapiens
actgatggaaaatacc

SEQ ID NO: 4543133 - DNA, 17 bp, Homo sapiens
actgatggaaaatacca

SEQ ID NO: 4543134 - DNA, 15 bp, Homo sapiens
actgatgggaataaa

SEQ ID NO: 4543135 - DNA, 19 bp, Homo sapiens
actgatgggaataaaagta

SEQ ID NO: 4543136 - DNA, 21 bp, Homo sapiens
actgatgggaataaaagtatt

SEQ ID NO: 4543137 - DNA, 20 bp, Homo sapiens
actgatgtgtgaagtgagaa

SEQ ID NO: 4543138 - DNA, 13 bp, Homo sapiens
actgatgttgtgt

SEQ ID NO: 4543139 - DNA, 17 bp, Homo sapiens
actgatgttgtgttttt

SEQ ID NO: 4543140 - DNA, 15 bp, Homo sapiens
actgatttcagagtg

SEQ ID NO: 4543141 - DNA, 14 bp, Homo sapiens
actgatttcagtaa

SEQ ID NO: 4543142 - DNA, 23 bp, Homo sapiens
actgatttctatggctttcaaag

SEQ ID NO: 4543143 - DNA, 18 bp, Homo sapiens
actgatttgctggagttc

SEQ ID NO: 4543144 - DNA, 18 bp, Homo sapiens
actgcaaatcaggctttt

SEQ ID NO: 4543145 - DNA, 20 bp, Homo sapiens
actgcaaatcaggcttttgt

SEQ ID NO: 4543146 - DNA, 22 bp, Homo sapiens
actgcaaatcaggcttttgttt

SEQ ID NO: 4543147 - DNA, 16 bp, Homo sapiens
actgcaaattttaact

SEQ ID NO: 4543148 - DNA, 18 bp, Homo sapiens
actgcaacaggcttgtgc

SEQ ID NO: 4543149 - DNA, 16 bp, Homo sapiens
actgcaacctctgcct

SEQ ID NO: 4543150 - DNA, 18 bp, Homo sapiens
actgcaacctctgcctcc

SEQ ID NO: 4543151 - DNA, 17 bp, Homo sapiens
actgcaaccttgtttat

SEQ ID NO: 4543152 - DNA, 14 bp, Homo sapiens
actgcaactttaaa

SEQ ID NO: 4543153 - DNA, 16 bp, Homo sapiens
actgcaagagccttgg

SEQ ID NO: 4543154 - DNA, 17 bp, Homo sapiens
actgcaagagccttggt

SEQ ID NO: 4543155 - DNA, 18 bp, Homo sapiens
actgcaagcatttttcca

SEQ ID NO: 4543156 - DNA, 12 bp, Homo sapiens
actgcacccctg

SEQ ID NO: 4543157 - DNA, 16 bp, Homo sapiens
actgcactccagcctg

SEQ ID NO: 4543158 - DNA, 17 bp, Homo sapiens
actgcactccagcctgg

SEQ ID NO: 4543159 - DNA, 20 bp, Homo sapiens
actgcactccagcctggggg

SEQ ID NO: 4543160 - DNA, 19 bp, Homo sapiens
actgcactccagcctgggt

SEQ ID NO: 4543161 - DNA, 22 bp, Homo sapiens
actgcactttccaatgccacag

SEQ ID NO: 4543162 - DNA, 23 bp, Homo sapiens
actgcactttccaatgccacaga

SEQ ID NO: 4543163 - DNA, 16 bp, Homo sapiens
actgcactttgtttag

SEQ ID NO: 4543164 - DNA, 20 bp, Homo sapiens
actgcagacctgtcctcctg

SEQ ID NO: 4543165 - DNA, 23 bp, Homo sapiens
actgcagacctgtcctcctggtg

SEQ ID NO: 4543166 - DNA, 21 bp, Homo sapiens
actgcagcaatcacaaaggct

SEQ ID NO: 4543167 - DNA, 21 bp, Homo sapiens
actgcaggccccgcttgtcca

SEQ ID NO: 4543168 - DNA, 23 bp, Homo sapiens
actgcagggaaaattatttgcat

SEQ ID NO: 4543169 - DNA, 19 bp, Homo sapiens
actgcagtcacctcttcta

SEQ ID NO: 4543170 - DNA, 13 bp, Homo sapiens
actgcagtcagat

SEQ ID NO: 4543171 - DNA, 17 bp, Homo sapiens
actgcatactttttaaa

SEQ ID NO: 4543172 - DNA, 16 bp, Homo sapiens
actgcatcatctgttt

SEQ ID NO: 4543173 - DNA, 15 bp, Homo sapiens
actgcatccagcctg

SEQ ID NO: 4543174 - DNA, 21 bp, Homo sapiens
actgcatcttggttatttctg

SEQ ID NO: 4543175 - DNA, 16 bp, Homo sapiens
actgcatgtcagagca

SEQ ID NO: 4543176 - DNA, 17 bp, Homo sapiens
actgcatttgcctgctt

SEQ ID NO: 4543177 - DNA, 21 bp, Homo sapiens
actgcatttgcctgcttcttt

SEQ ID NO: 4543178 - DNA, 19 bp, Homo sapiens
actgccaggccagcctccg

SEQ ID NO: 4543179 - DNA, 16 bp, Homo sapiens
actgcccactctgcaa

SEQ ID NO: 4543180 - DNA, 19 bp, Homo sapiens
actgcccagaaagtggggg

SEQ ID NO: 4543181 - DNA, 11 bp, Homo sapiens
actgcccagca

SEQ ID NO: 4543182 - DNA, 19 bp, Homo sapiens
actgccccacggagacaga

SEQ ID NO: 4543183 - DNA, 21 bp, Homo sapiens
actgccccacgttgtccctga

SEQ ID NO: 4543184 - DNA, 12 bp, Homo sapiens
actgcccccaga

SEQ ID NO: 4543185 - DNA, 22 bp, Homo sapiens
actgcccccagaaagcctcctg

SEQ ID NO: 4543186 - DNA, 23 bp, Homo sapiens
actgcccccagaaagcctcctgc

SEQ ID NO: 4543187 - DNA, 13 bp, Homo sapiens
actgccccccgag

SEQ ID NO: 4543188 - DNA, 16 bp, Homo sapiens
actgccccctcctgtg

SEQ ID NO: 4543189 - DNA, 18 bp, Homo sapiens
actgcccttgctgcccgc

SEQ ID NO: 4543190 - DNA, 17 bp, Homo sapiens
actgccgtaatttaact

SEQ ID NO: 4543191 - DNA, 16 bp, Homo sapiens
actgcctgtctgcttg

SEQ ID NO: 4543192 - DNA, 11 bp, Homo sapiens
actgccttaat

SEQ ID NO: 4543193 - DNA, 23 bp, Homo sapiens
actgccttaataaaaaatgaaaa

SEQ ID NO: 4543194 - DNA, 19 bp, Homo sapiens
actgcgaggacatcaaagt

SEQ ID NO: 4543195 - DNA, 23 bp, Homo sapiens
actgcgggagctctgtatggtca

SEQ ID NO: 4543196 - DNA, 16 bp, Homo sapiens
actgcgtccaccctga

SEQ ID NO: 4543197 - DNA, 14 bp, Homo sapiens
actgcgttctgcaa

SEQ ID NO: 4543198 - DNA, 17 bp, Homo sapiens
actgctaaataaaattt

SEQ ID NO: 4543199 - DNA, 19 bp, Homo sapiens
actgctccagcctctgccg

SEQ ID NO: 4543200 - DNA, 20 bp, Homo sapiens
actgctcccggcccgcctgc

SEQ ID NO: 4543201 - DNA, 17 bp, Homo sapiens
actgctgaagccagttg

SEQ ID NO: 4543202 - DNA, 23 bp, Homo sapiens
actgctgattcttgtaaatcttt

SEQ ID NO: 4543203 - DNA, 15 bp, Homo sapiens
actgctgccttaccc

SEQ ID NO: 4543204 - DNA, 16 bp, Homo sapiens
actgctgctctcccaa

SEQ ID NO: 4543205 - DNA, 14 bp, Homo sapiens
actgctgctgctgc

SEQ ID NO: 4543206 - DNA, 23 bp, Homo sapiens
actgctgtcgttgttgtggaagc

SEQ ID NO: 4543207 - DNA, 20 bp, Homo sapiens
actgcttacctactttcttc

SEQ ID NO: 4543208 - DNA, 16 bp, Homo sapiens
actgcttctctttgtg

SEQ ID NO: 4543209 - DNA, 21 bp, Homo sapiens
actgcttcttggagctttgga

SEQ ID NO: 4543210 - DNA, 15 bp, Homo sapiens
actgctttattttcc

SEQ ID NO: 4543211 - DNA, 20 bp, Homo sapiens
actgctttattttccctact

SEQ ID NO: 4543212 - DNA, 16 bp, Homo sapiens
actgctttctgttcca

SEQ ID NO: 4543213 - DNA, 20 bp, Homo sapiens
actgcttttaaaagtgcaca

SEQ ID NO: 4543214 - DNA, 21 bp, Homo sapiens
actggaaaggggagagcctgc

SEQ ID NO: 4543215 - DNA, 22 bp, Homo sapiens
actggaaaggggagagcctgct

SEQ ID NO: 4543216 - DNA, 18 bp, Homo sapiens
actggaaatgtagcactt

SEQ ID NO: 4543217 - DNA, 19 bp, Homo sapiens
actggaaattgaggtccat

SEQ ID NO: 4543218 - DNA, 14 bp, Homo sapiens
actggaagaaagca

SEQ ID NO: 4543219 - DNA, 20 bp, Homo sapiens
actggaagcatgtaggagaa

SEQ ID NO: 4543220 - DNA, 19 bp, Homo sapiens
actggaagctaatttgcat

SEQ ID NO: 4543221 - DNA, 13 bp, Homo sapiens
actggaattaaaa

SEQ ID NO: 4543222 - DNA, 18 bp, Homo sapiens
actggaattcttctgcaa

SEQ ID NO: 4543223 - DNA, 23 bp, Homo sapiens
actggagatgcatcgggaaagaa

SEQ ID NO: 4543224 - DNA, 13 bp, Homo sapiens
actggagcaccag

SEQ ID NO: 4543225 - DNA, 18 bp, Homo sapiens
actggaggttgaagccaa

SEQ ID NO: 4543226 - DNA, 19 bp, Homo sapiens
actggataaattgtttagt

SEQ ID NO: 4543227 - DNA, 17 bp, Homo sapiens
actggcaaacagggcct

SEQ ID NO: 4543228 - DNA, 20 bp, Homo sapiens
actggcaaacagggcctctg

SEQ ID NO: 4543229 - DNA, 14 bp, Homo sapiens
actggcacagaggt

SEQ ID NO: 4543230 - DNA, 21 bp, Homo sapiens
actggcacagttttctgagaa

SEQ ID NO: 4543231 - DNA, 22 bp, Homo sapiens
actggcacagttttctgagaaa

SEQ ID NO: 4543232 - DNA, 21 bp, Homo sapiens
actggcaggggagacaggagc

SEQ ID NO: 4543233 - DNA, 22 bp, Homo sapiens
actggcatgtcatttgcacaca

SEQ ID NO: 4543234 - DNA, 14 bp, Homo sapiens
actggccacccctc

SEQ ID NO: 4543235 - DNA, 18 bp, Homo sapiens
actggcccaaccagaact

SEQ ID NO: 4543236 - DNA, 13 bp, Homo sapiens
actggcccctggg

SEQ ID NO: 4543237 - DNA, 15 bp, Homo sapiens
actggcccctgggtc

SEQ ID NO: 4543238 - DNA, 18 bp, Homo sapiens
actggcctctccccagga

SEQ ID NO: 4543239 - DNA, 20 bp, Homo sapiens
actggcctctccccaggaag

SEQ ID NO: 4543240 - DNA, 20 bp, Homo sapiens
actggcgttcacctccctgc

SEQ ID NO: 4543241 - DNA, 18 bp, Homo sapiens
actggctagagtcctcac

SEQ ID NO: 4543242 - DNA, 15 bp, Homo sapiens
actggctcacccagt

SEQ ID NO: 4543243 - DNA, 21 bp, Homo sapiens
actggctggccagtctgggtc

SEQ ID NO: 4543244 - DNA, 19 bp, Homo sapiens
actggcttttattaatgca

SEQ ID NO: 4543245 - DNA, 23 bp, Homo sapiens
actggcttttattaatgcacttt

SEQ ID NO: 4543246 - DNA, 10 bp, Homo sapiens
actgggaaac

SEQ ID NO: 4543247 - DNA, 20 bp, Homo sapiens
actgggaaggcttgggattt

SEQ ID NO: 4543248 - DNA, 22 bp, Homo sapiens
actgggagccacttctccccag

SEQ ID NO: 4543249 - DNA, 14 bp, Homo sapiens
actgggaggcaggg

SEQ ID NO: 4543250 - DNA, 15 bp, Homo sapiens
actgggccccacatg

SEQ ID NO: 4543251 - DNA, 19 bp, Homo sapiens
actgggccccacatggctt

SEQ ID NO: 4543252 - DNA, 21 bp, Homo sapiens
actgggctggcgcttggatct

SEQ ID NO: 4543253 - DNA, 22 bp, Homo sapiens
actgggctggcgcttggatctg

SEQ ID NO: 4543254 - DNA, 13 bp, Homo sapiens
actgggctgggcc

SEQ ID NO: 4543255 - DNA, 21 bp, Homo sapiens
actggggaggctgaggcagga

SEQ ID NO: 4543256 - DNA, 22 bp, Homo sapiens
actggggagtaaacggcccagg

SEQ ID NO: 4543257 - DNA, 23 bp, Homo sapiens
actggggagtaaacggcccaggc

SEQ ID NO: 4543258 - DNA, 13 bp, Homo sapiens
actggggtgcctt

SEQ ID NO: 4543259 - DNA, 22 bp, Homo sapiens
actggggtgccttcactgggcc

SEQ ID NO: 4543260 - DNA, 15 bp, Homo sapiens
actgggtcttcagct

SEQ ID NO: 4543261 - DNA, 18 bp, Homo sapiens
actgggtcttcagcttta

SEQ ID NO: 4543262 - DNA, 13 bp, Homo sapiens
actgggtgagaga

SEQ ID NO: 4543263 - DNA, 14 bp, Homo sapiens
actgggtgtcattt

SEQ ID NO: 4543264 - DNA, 17 bp, Homo sapiens
actgggtgtcatttcat

SEQ ID NO: 4543265 - DNA, 21 bp, Homo sapiens
actgggtgtcatttcattcca

SEQ ID NO: 4543266 - DNA, 16 bp, Homo sapiens
actggtaagattgtta

SEQ ID NO: 4543267 - DNA, 16 bp, Homo sapiens
actggtacttagagtt

SEQ ID NO: 4543268 - DNA, 23 bp, Homo sapiens
actggtacttagagtttctgttt

SEQ ID NO: 4543269 - DNA, 14 bp, Homo sapiens
actggtagaaaaac

SEQ ID NO: 4543270 - DNA, 20 bp, Homo sapiens
actggtatattattgcttca

SEQ ID NO: 4543271 - DNA, 18 bp, Homo sapiens
actggtatgtaaaagaaa

SEQ ID NO: 4543272 - DNA, 22 bp, Homo sapiens
actggtccaaaagattgctgaa

SEQ ID NO: 4543273 - DNA, 19 bp, Homo sapiens
actggtgaatataaatgat

SEQ ID NO: 4543274 - DNA, 18 bp, Homo sapiens
actggtgcactttgtaaa

SEQ ID NO: 4543275 - DNA, 20 bp, Homo sapiens
actggtgcactttgtaaatt

SEQ ID NO: 4543276 - DNA, 21 bp, Homo sapiens
actggtgcactttgtaaattc

SEQ ID NO: 4543277 - DNA, 22 bp, Homo sapiens
actggtgcactttgtaaattcc

SEQ ID NO: 4543278 - DNA, 20 bp, Homo sapiens
actggtgtcaccctttgcct

SEQ ID NO: 4543279 - DNA, 14 bp, Homo sapiens
actggtgtgacctg

SEQ ID NO: 4543280 - DNA, 15 bp, Homo sapiens
actggttactttcaa

SEQ ID NO: 4543281 - DNA, 12 bp, Homo sapiens
actggttcaggc

SEQ ID NO: 4543282 - DNA, 13 bp, Homo sapiens
actggttcaggct

SEQ ID NO: 4543283 - DNA, 14 bp, Homo sapiens
actggtttgagatt

SEQ ID NO: 4543284 - DNA, 13 bp, Homo sapiens
actggttttctgc

SEQ ID NO: 4543285 - DNA, 18 bp, Homo sapiens
actgtaaaagtgtacaga

SEQ ID NO: 4543286 - DNA, 18 bp, Homo sapiens
actgtaaagacaaataaa

SEQ ID NO: 4543287 - DNA, 13 bp, Homo sapiens
actgtaaagatgt

SEQ ID NO: 4543288 - DNA, 11 bp, Homo sapiens
actgtaaatca

SEQ ID NO: 4543289 - DNA, 15 bp, Homo sapiens
actgtaacattcagg

SEQ ID NO: 4543290 - DNA, 15 bp, Homo sapiens
actgtaagaataatt

SEQ ID NO: 4543291 - DNA, 23 bp, Homo sapiens
actgtaagaataatttatagtaa

SEQ ID NO: 4543292 - DNA, 21 bp, Homo sapiens
actgtaaggtgcttgctcccc

SEQ ID NO: 4543293 - DNA, 16 bp, Homo sapiens
actgtaatacttcttt

SEQ ID NO: 4543294 - DNA, 18 bp, Homo sapiens
actgtaatacttctttgt

SEQ ID NO: 4543295 - DNA, 17 bp, Homo sapiens
actgtaatcaaaaggag

SEQ ID NO: 4543296 - DNA, 19 bp, Homo sapiens
actgtaatcttatttagga

SEQ ID NO: 4543297 - DNA, 14 bp, Homo sapiens
actgtacacacttt

SEQ ID NO: 4543298 - DNA, 13 bp, Homo sapiens
actgtacacattt

SEQ ID NO: 4543299 - DNA, 16 bp, Homo sapiens
actgtacacatttctt

SEQ ID NO: 4543300 - DNA, 20 bp, Homo sapiens
actgtacataattgcatgaa

SEQ ID NO: 4543301 - DNA, 21 bp, Homo sapiens
actgtacataattgcatgaaa

SEQ ID NO: 4543302 - DNA, 22 bp, Homo sapiens
actgtacataattgcatgaaaa

SEQ ID NO: 4543303 - DNA, 14 bp, Homo sapiens
actgtagccacagc

SEQ ID NO: 4543304 - DNA, 18 bp, Homo sapiens
actgtatataaacatatt

SEQ ID NO: 4543305 - DNA, 16 bp, Homo sapiens
actgtatattacagat

SEQ ID NO: 4543306 - DNA, 14 bp, Homo sapiens
actgtatattcagg

SEQ ID NO: 4543307 - DNA, 23 bp, Homo sapiens
actgtatattttgtagttaatat

SEQ ID NO: 4543308 - DNA, 19 bp, Homo sapiens
actgtatcaataaaattct

SEQ ID NO: 4543309 - DNA, 19 bp, Homo sapiens
actgtatcctgaaaggcaa

SEQ ID NO: 4543310 - DNA, 21 bp, Homo sapiens
actgtatgttatagaacttca

SEQ ID NO: 4543311 - DNA, 20 bp, Homo sapiens
actgtattcgtgcatttttg

SEQ ID NO: 4543312 - DNA, 21 bp, Homo sapiens
actgtatttcagtattttcca

SEQ ID NO: 4543313 - DNA, 12 bp, Homo sapiens
actgtatttgaa

SEQ ID NO: 4543314 - DNA, 18 bp, Homo sapiens
actgtatttttcagaaat

SEQ ID NO: 4543315 - DNA, 20 bp, Homo sapiens
actgtatttttgaagactat

SEQ ID NO: 4543316 - DNA, 20 bp, Homo sapiens
actgtcacggggttccctcc

SEQ ID NO: 4543317 - DNA, 15 bp, Homo sapiens
actgtcagattaaat

SEQ ID NO: 4543318 - DNA, 16 bp, Homo sapiens
actgtcagattaaatt

SEQ ID NO: 4543319 - DNA, 23 bp, Homo sapiens
actgtcagttctctgggaagtgg

SEQ ID NO: 4543320 - DNA, 22 bp, Homo sapiens
actgtcatcctcaaagaaagtg

SEQ ID NO: 4543321 - DNA, 12 bp, Homo sapiens
actgtcattccc

SEQ ID NO: 4543322 - DNA, 17 bp, Homo sapiens
actgtccaatatgaaaa

SEQ ID NO: 4543323 - DNA, 23 bp, Homo sapiens
actgtccaggagctaatctgacc

SEQ ID NO: 4543324 - DNA, 13 bp, Homo sapiens
actgtccagggaa

SEQ ID NO: 4543325 - DNA, 15 bp, Homo sapiens
actgtcctaacatgg

SEQ ID NO: 4543326 - DNA, 21 bp, Homo sapiens
actgtctatatcataactata

SEQ ID NO: 4543327 - DNA, 22 bp, Homo sapiens
actgtctatttaagtgcaatta

SEQ ID NO: 4543328 - DNA, 21 bp, Homo sapiens
actgtctcgatgcaatgaaca

SEQ ID NO: 4543329 - DNA, 15 bp, Homo sapiens
actgtctgtgaacag

SEQ ID NO: 4543330 - DNA, 16 bp, Homo sapiens
actgtgaaaaaaaatt

SEQ ID NO: 4543331 - DNA, 18 bp, Homo sapiens
actgtgaaaaaaaatttg

SEQ ID NO: 4543332 - DNA, 17 bp, Homo sapiens
actgtgaaaatagtgta

SEQ ID NO: 4543333 - DNA, 20 bp, Homo sapiens
actgtgaaataccacaagcc

SEQ ID NO: 4543334 - DNA, 22 bp, Homo sapiens
actgtgaccaagtataaacttt

SEQ ID NO: 4543335 - DNA, 12 bp, Homo sapiens
actgtgagactg

SEQ ID NO: 4543336 - DNA, 16 bp, Homo sapiens
actgtgagactgtatg

SEQ ID NO: 4543337 - DNA, 20 bp, Homo sapiens
actgtgattactctttgctt

SEQ ID NO: 4543338 - DNA, 17 bp, Homo sapiens
actgtgattagatcaca

SEQ ID NO: 4543339 - DNA, 22 bp, Homo sapiens
actgtgattcagaaaatgttct

SEQ ID NO: 4543340 - DNA, 18 bp, Homo sapiens
actgtgcaccaagcagga

SEQ ID NO: 4543341 - DNA, 14 bp, Homo sapiens
actgtgcaggcctg

SEQ ID NO: 4543342 - DNA, 21 bp, Homo sapiens
actgtgcaggcctgtccctgg

SEQ ID NO: 4543343 - DNA, 23 bp, Homo sapiens
actgtgcaggtgctattgttact

SEQ ID NO: 4543344 - DNA, 18 bp, Homo sapiens
actgtgccaagatttaaa

SEQ ID NO: 4543345 - DNA, 19 bp, Homo sapiens
actgtgccaagatttaaaa

SEQ ID NO: 4543346 - DNA, 17 bp, Homo sapiens
actgtgccagaggccag

SEQ ID NO: 4543347 - DNA, 13 bp, Homo sapiens
actgtgcctggct

SEQ ID NO: 4543348 - DNA, 15 bp, Homo sapiens
actgtgcctggctcc

SEQ ID NO: 4543349 - DNA, 20 bp, Homo sapiens
actgtgcctggctccctgat

SEQ ID NO: 4543350 - DNA, 21 bp, Homo sapiens
actgtgcctggctccctgatg

SEQ ID NO: 4543351 - DNA, 22 bp, Homo sapiens
actgtggccatatatgctgtat

SEQ ID NO: 4543352 - DNA, 23 bp, Homo sapiens
actgtggccatatatgctgtatt

SEQ ID NO: 4543353 - DNA, 14 bp, Homo sapiens
actgtggccccaag

SEQ ID NO: 4543354 - DNA, 18 bp, Homo sapiens
actgtgggcaatttagaa

SEQ ID NO: 4543355 - DNA, 17 bp, Homo sapiens
actgtggtagctccagc

SEQ ID NO: 4543356 - DNA, 18 bp, Homo sapiens
actgtggtagctccagcg

SEQ ID NO: 4543357 - DNA, 22 bp, Homo sapiens
actgtggtcgtcaactttcctc

SEQ ID NO: 4543358 - DNA, 21 bp, Homo sapiens
actgtgtaatataaaagatct

SEQ ID NO: 4543359 - DNA, 13 bp, Homo sapiens
actgtgtaattag

SEQ ID NO: 4543360 - DNA, 17 bp, Homo sapiens
actgtgtacataactga

SEQ ID NO: 4543361 - DNA, 14 bp, Homo sapiens
actgtgtataggaa

SEQ ID NO: 4543362 - DNA, 12 bp, Homo sapiens
actgtgtattta

SEQ ID NO: 4543363 - DNA, 21 bp, Homo sapiens
actgtgtatttatttaaaact

SEQ ID NO: 4543364 - DNA, 16 bp, Homo sapiens
actgtgtgtgtgaatg

SEQ ID NO: 4543365 - DNA, 14 bp, Homo sapiens
actgtgttgccaca

SEQ ID NO: 4543366 - DNA, 18 bp, Homo sapiens
actgtgtttcaaatggac

SEQ ID NO: 4543367 - DNA, 19 bp, Homo sapiens
actgtgtttttaaattttg

SEQ ID NO: 4543368 - DNA, 21 bp, Homo sapiens
actgtgtttttaaattttgta

SEQ ID NO: 4543369 - DNA, 16 bp, Homo sapiens
actgttaaaataaagc

SEQ ID NO: 4543370 - DNA, 22 bp, Homo sapiens
actgttaatagtactattaaca

SEQ ID NO: 4543371 - DNA, 19 bp, Homo sapiens
actgttacacgtgcctgta

SEQ ID NO: 4543372 - DNA, 14 bp, Homo sapiens
actgttacagactg

SEQ ID NO: 4543373 - DNA, 16 bp, Homo sapiens
actgttacagtaatgt

SEQ ID NO: 4543374 - DNA, 15 bp, Homo sapiens
actgttactttggca

SEQ ID NO: 4543375 - DNA, 17 bp, Homo sapiens
actgttagaacactatt

SEQ ID NO: 4543376 - DNA, 18 bp, Homo sapiens
actgttagaacactattt

SEQ ID NO: 4543377 - DNA, 23 bp, Homo sapiens
actgttagaacactattttcaga

SEQ ID NO: 4543378 - DNA, 16 bp, Homo sapiens
actgttcagcggagct

SEQ ID NO: 4543379 - DNA, 19 bp, Homo sapiens
actgttccaggccctccag

SEQ ID NO: 4543380 - DNA, 18 bp, Homo sapiens
actgttccccctgtgcag

SEQ ID NO: 4543381 - DNA, 19 bp, Homo sapiens
actgttctcctgaatattt

SEQ ID NO: 4543382 - DNA, 12 bp, Homo sapiens
actgttctgatt

SEQ ID NO: 4543383 - DNA, 14 bp, Homo sapiens
actgttgaaaaaga

SEQ ID NO: 4543384 - DNA, 21 bp, Homo sapiens
actgttgaaaaagataaagag

SEQ ID NO: 4543385 - DNA, 17 bp, Homo sapiens
actgttgcctaattgga

SEQ ID NO: 4543386 - DNA, 15 bp, Homo sapiens
actgttgctttaata

SEQ ID NO: 4543387 - DNA, 19 bp, Homo sapiens
actgttgctttaatatgag

SEQ ID NO: 4543388 - DNA, 20 bp, Homo sapiens
actgttgctttgaaaaatct

SEQ ID NO: 4543389 - DNA, 21 bp, Homo sapiens
actgttggaatggatttttct

SEQ ID NO: 4543390 - DNA, 20 bp, Homo sapiens
actgttgtaactaggctcag

SEQ ID NO: 4543391 - DNA, 15 bp, Homo sapiens
actgttgtacaagct

SEQ ID NO: 4543392 - DNA, 11 bp, Homo sapiens
actgtttacag

SEQ ID NO: 4543393 - DNA, 13 bp, Homo sapiens
actgtttacagtt

SEQ ID NO: 4543394 - DNA, 13 bp, Homo sapiens
actgtttataaat

SEQ ID NO: 4543395 - DNA, 16 bp, Homo sapiens
actgtttataaatgtt

SEQ ID NO: 4543396 - DNA, 17 bp, Homo sapiens
actgtttcagaaaacat

SEQ ID NO: 4543397 - DNA, 16 bp, Homo sapiens
actgtttcatctaagt

SEQ ID NO: 4543398 - DNA, 19 bp, Homo sapiens
actgtttgtttacaaaatc

SEQ ID NO: 4543399 - DNA, 17 bp, Homo sapiens
actgttttaaaatgtga

SEQ ID NO: 4543400 - DNA, 15 bp, Homo sapiens
actgttttagaaatt

SEQ ID NO: 4543401 - DNA, 17 bp, Homo sapiens
actgttttccagttcat

SEQ ID NO: 4543402 - DNA, 17 bp, Homo sapiens
acttaaaaacaagagaa

SEQ ID NO: 4543403 - DNA, 15 bp, Homo sapiens
acttaaacagaagca

SEQ ID NO: 4543404 - DNA, 20 bp, Homo sapiens
acttaaacagaagcagaggc

SEQ ID NO: 4543405 - DNA, 15 bp, Homo sapiens
acttaaactttgtca

SEQ ID NO: 4543406 - DNA, 18 bp, Homo sapiens
acttaaactttgtcactt

SEQ ID NO: 4543407 - DNA, 15 bp, Homo sapiens
acttaaatgttatta

SEQ ID NO: 4543408 - DNA, 20 bp, Homo sapiens
acttaacacgtgaatatttt

SEQ ID NO: 4543409 - DNA, 20 bp, Homo sapiens
acttaacatttcattgtaca

SEQ ID NO: 4543410 - DNA, 13 bp, Homo sapiens
acttaaccttgaa

SEQ ID NO: 4543411 - DNA, 21 bp, Homo sapiens
acttaacgttctataaatgaa

SEQ ID NO: 4543412 - DNA, 21 bp, Homo sapiens
acttaactgtccgtaagcagt

SEQ ID NO: 4543413 - DNA, 17 bp, Homo sapiens
acttaagcatctggctc

SEQ ID NO: 4543414 - DNA, 21 bp, Homo sapiens
acttaagcatctggctctaat

SEQ ID NO: 4543415 - DNA, 14 bp, Homo sapiens
acttaaggaccttt

SEQ ID NO: 4543416 - DNA, 21 bp, Homo sapiens
acttaaggacctttttaaaga

SEQ ID NO: 4543417 - DNA, 18 bp, Homo sapiens
acttaagtgttcatttta

SEQ ID NO: 4543418 - DNA, 18 bp, Homo sapiens
acttaatactaccttgaa

SEQ ID NO: 4543419 - DNA, 21 bp, Homo sapiens
acttaatactaccttgaaaat

SEQ ID NO: 4543420 - DNA, 15 bp, Homo sapiens
acttaatcattttat

SEQ ID NO: 4543421 - DNA, 15 bp, Homo sapiens
acttaatgtatgtta

SEQ ID NO: 4543422 - DNA, 15 bp, Homo sapiens
acttaatgtttctta

SEQ ID NO: 4543423 - DNA, 15 bp, Homo sapiens
acttacaatttgcac

SEQ ID NO: 4543424 - DNA, 16 bp, Homo sapiens
acttacaatttgcaca

SEQ ID NO: 4543425 - DNA, 22 bp, Homo sapiens
acttacaatttgcacaatattt

SEQ ID NO: 4543426 - DNA, 15 bp, Homo sapiens
acttacgtaaaacat

SEQ ID NO: 4543427 - DNA, 15 bp, Homo sapiens
acttagaatgccata

SEQ ID NO: 4543428 - DNA, 21 bp, Homo sapiens
acttagaatgccataaaattg

SEQ ID NO: 4543429 - DNA, 18 bp, Homo sapiens
acttagagtttctgtttg

SEQ ID NO: 4543430 - DNA, 20 bp, Homo sapiens
acttagcctcctcccaaagt

SEQ ID NO: 4543431 - DNA, 17 bp, Homo sapiens
acttagcctttacctgt

SEQ ID NO: 4543432 - DNA, 17 bp, Homo sapiens
acttagcgtcaagacat

SEQ ID NO: 4543433 - DNA, 21 bp, Homo sapiens
acttagcgtcaagacatttgc

SEQ ID NO: 4543434 - DNA, 22 bp, Homo sapiens
acttaggtaaaataaaagacta

SEQ ID NO: 4543435 - DNA, 23 bp, Homo sapiens
acttagtttttaaaatttatttg

SEQ ID NO: 4543436 - DNA, 14 bp, Homo sapiens
acttatagtacatg

SEQ ID NO: 4543437 - DNA, 15 bp, Homo sapiens
acttatagtacatga

SEQ ID NO: 4543438 - DNA, 18 bp, Homo sapiens
acttatatgctgaattga

SEQ ID NO: 4543439 - DNA, 22 bp, Homo sapiens
acttatattaatagtaatttgt

SEQ ID NO: 4543440 - DNA, 18 bp, Homo sapiens
acttatattttatgaaca

SEQ ID NO: 4543441 - DNA, 21 bp, Homo sapiens
acttatcagtttgctaatgtt

SEQ ID NO: 4543442 - DNA, 21 bp, Homo sapiens
acttatctctcaaaacaatat

SEQ ID NO: 4543443 - DNA, 16 bp, Homo sapiens
acttatctctctgtgc

SEQ ID NO: 4543444 - DNA, 17 bp, Homo sapiens
acttatctctctgtgct

SEQ ID NO: 4543445 - DNA, 14 bp, Homo sapiens
acttatcttctgga

SEQ ID NO: 4543446 - DNA, 14 bp, Homo sapiens
acttatgctgattt

SEQ ID NO: 4543447 - DNA, 16 bp, Homo sapiens
acttatggactgtttt

SEQ ID NO: 4543448 - DNA, 15 bp, Homo sapiens
acttatgtacagaaa

SEQ ID NO: 4543449 - DNA, 18 bp, Homo sapiens
acttattaaaaaatttgt

SEQ ID NO: 4543450 - DNA, 13 bp, Homo sapiens
acttattcattcc

SEQ ID NO: 4543451 - DNA, 14 bp, Homo sapiens
acttattcattcct

SEQ ID NO: 4543452 - DNA, 19 bp, Homo sapiens
acttattgctgattttaat

SEQ ID NO: 4543453 - DNA, 20 bp, Homo sapiens
acttattgctgattttaatg

SEQ ID NO: 4543454 - DNA, 21 bp, Homo sapiens
acttattgctgattttaatgg

SEQ ID NO: 4543455 - DNA, 20 bp, Homo sapiens
acttattggaactctgcttg

SEQ ID NO: 4543456 - DNA, 21 bp, Homo sapiens
acttattggaactctgcttga

SEQ ID NO: 4543457 - DNA, 13 bp, Homo sapiens
acttattgtaaat

SEQ ID NO: 4543458 - DNA, 16 bp, Homo sapiens
acttcaaaatattgag

SEQ ID NO: 4543459 - DNA, 19 bp, Homo sapiens
acttcaatgtgtcatttcc

SEQ ID NO: 4543460 - DNA, 16 bp, Homo sapiens
acttcacactgcaaga

SEQ ID NO: 4543461 - DNA, 17 bp, Homo sapiens
acttcaccaccccctgt

SEQ ID NO: 4543462 - DNA, 23 bp, Homo sapiens
acttcaccaccccctgtcccatt

SEQ ID NO: 4543463 - DNA, 15 bp, Homo sapiens
acttcacccccaact

SEQ ID NO: 4543464 - DNA, 12 bp, Homo sapiens
acttcactgtat

SEQ ID NO: 4543465 - DNA, 17 bp, Homo sapiens
acttcactgtatataaa

SEQ ID NO: 4543466 - DNA, 15 bp, Homo sapiens
acttcactttcttca

SEQ ID NO: 4543467 - DNA, 21 bp, Homo sapiens
acttcactttcttcaaagcca

SEQ ID NO: 4543468 - DNA, 12 bp, Homo sapiens
acttcagacata

SEQ ID NO: 4543469 - DNA, 21 bp, Homo sapiens
acttcagacatagaattaaca

SEQ ID NO: 4543470 - DNA, 13 bp, Homo sapiens
acttcagagagaa

SEQ ID NO: 4543471 - DNA, 21 bp, Homo sapiens
acttcagagagaatgagcaga

SEQ ID NO: 4543472 - DNA, 22 bp, Homo sapiens
acttcagtttcacagaaaataa

SEQ ID NO: 4543473 - DNA, 17 bp, Homo sapiens
acttcatattaatataa

SEQ ID NO: 4543474 - DNA, 18 bp, Homo sapiens
acttcatcgacttagcct

SEQ ID NO: 4543475 - DNA, 21 bp, Homo sapiens
acttcattgtttggacctgca

SEQ ID NO: 4543476 - DNA, 13 bp, Homo sapiens
acttcattttata

SEQ ID NO: 4543477 - DNA, 14 bp, Homo sapiens
acttcattttgtat

SEQ ID NO: 4543478 - DNA, 17 bp, Homo sapiens
acttccaaagaaagttc

SEQ ID NO: 4543479 - DNA, 24 bp, Homo sapiens
acttccaaagactccctccatagc

SEQ ID NO: 4543480 - DNA, 21 bp, Homo sapiens
acttccaggggaacctgccat

SEQ ID NO: 4543481 - DNA, 17 bp, Homo sapiens
acttccaggtctgcctg

SEQ ID NO: 4543482 - DNA, 22 bp, Homo sapiens
acttccaggtctgcctggttcc

SEQ ID NO: 4543483 - DNA, 20 bp, Homo sapiens
acttccaggtgttactgtaa

SEQ ID NO: 4543484 - DNA, 21 bp, Homo sapiens
acttccaggtgttactgtaat

SEQ ID NO: 4543485 - DNA, 16 bp, Homo sapiens
acttcccatctggctc

SEQ ID NO: 4543486 - DNA, 17 bp, Homo sapiens
acttcccatctggctca

SEQ ID NO: 4543487 - DNA, 13 bp, Homo sapiens
acttccccatccc

SEQ ID NO: 4543488 - DNA, 21 bp, Homo sapiens
acttccccatcccgaagccat

SEQ ID NO: 4543489 - DNA, 14 bp, Homo sapiens
acttccgctgaggg

SEQ ID NO: 4543490 - DNA, 13 bp, Homo sapiens
acttcctctgtga

SEQ ID NO: 4543491 - DNA, 15 bp, Homo sapiens
acttcctctgtgaac

SEQ ID NO: 4543492 - DNA, 16 bp, Homo sapiens
acttcctctgtgaact

SEQ ID NO: 4543493 - DNA, 18 bp, Homo sapiens
acttcctgcctcagtctg

SEQ ID NO: 4543494 - DNA, 15 bp, Homo sapiens
acttccttatttctg

SEQ ID NO: 4543495 - DNA, 16 bp, Homo sapiens
acttccttatttctga

SEQ ID NO: 4543496 - DNA, 16 bp, Homo sapiens
acttcgcacacaccca

SEQ ID NO: 4543497 - DNA, 23 bp, Homo sapiens
acttcgttggtgaccagtttctt

SEQ ID NO: 4543498 - DNA, 20 bp, Homo sapiens
acttcgttttggttaagttg

SEQ ID NO: 4543499 - DNA, 23 bp, Homo sapiens
acttcgttttggttaagttggct

SEQ ID NO: 4543500 - DNA, 23 bp, Homo sapiens
acttctaagtaaaaccacagcag

SEQ ID NO: 4543501 - DNA, 22 bp, Homo sapiens
acttctacccagatggaaaaat

SEQ ID NO: 4543502 - DNA, 17 bp, Homo sapiens
acttctacctgccctca

SEQ ID NO: 4543503 - DNA, 21 bp, Homo sapiens
acttctattttaaagacaatg

SEQ ID NO: 4543504 - DNA, 15 bp, Homo sapiens
acttctcaagtaaca

SEQ ID NO: 4543505 - DNA, 19 bp, Homo sapiens
acttctcattttttaaaaa

SEQ ID NO: 4543506 - DNA, 22 bp, Homo sapiens
acttctcggaattcataataaa

SEQ ID NO: 4543507 - DNA, 21 bp, Homo sapiens
acttctctataaaaaatatgt

SEQ ID NO: 4543508 - DNA, 19 bp, Homo sapiens
acttctcttaaacttgtga

SEQ ID NO: 4543509 - DNA, 16 bp, Homo sapiens
acttctcttgctttct

SEQ ID NO: 4543510 - DNA, 18 bp, Homo sapiens
acttctgatactttagta

SEQ ID NO: 4543511 - DNA, 15 bp, Homo sapiens
acttctgctgctggc

SEQ ID NO: 4543512 - DNA, 16 bp, Homo sapiens
acttctgctgctggcc

SEQ ID NO: 4543513 - DNA, 17 bp, Homo sapiens
acttctgggtggggcag

SEQ ID NO: 4543514 - DNA, 23 bp, Homo sapiens
acttctgtgagacccccacacct

SEQ ID NO: 4543515 - DNA, 17 bp, Homo sapiens
acttcttatggaattga

SEQ ID NO: 4543516 - DNA, 21 bp, Homo sapiens
acttcttatggaattgatttg

SEQ ID NO: 4543517 - DNA, 23 bp, Homo sapiens
acttcttatggaattgatttgca

SEQ ID NO: 4543518 - DNA, 18 bp, Homo sapiens
acttcttcatccatagac

SEQ ID NO: 4543519 - DNA, 22 bp, Homo sapiens
acttcttcatccatagacacag

SEQ ID NO: 4543520 - DNA, 23 bp, Homo sapiens
acttcttcatccatagacacagt

SEQ ID NO: 4543521 - DNA, 13 bp, Homo sapiens
acttcttctgtaa

SEQ ID NO: 4543522 - DNA, 13 bp, Homo sapiens
acttcttgaaaaa

SEQ ID NO: 4543523 - DNA, 15 bp, Homo sapiens
acttcttgaaaaaga

SEQ ID NO: 4543524 - DNA, 19 bp, Homo sapiens
acttctttttggcattatc

SEQ ID NO: 4543525 - DNA, 16 bp, Homo sapiens
acttgaaagttttcta

SEQ ID NO: 4543526 - DNA, 14 bp, Homo sapiens
acttgaaatatata

SEQ ID NO: 4543527 - DNA, 17 bp, Homo sapiens
acttgaaatatataata

SEQ ID NO: 4543528 - DNA, 15 bp, Homo sapiens
acttgaacaaaaggg

SEQ ID NO: 4543529 - DNA, 23 bp, Homo sapiens
acttgaacccgggaggcagaggt

SEQ ID NO: 4543530 - DNA, 23 bp, Homo sapiens
acttgaagaaacagagtggcctc

SEQ ID NO: 4543531 - DNA, 14 bp, Homo sapiens
acttgaagattaat

SEQ ID NO: 4543532 - DNA, 22 bp, Homo sapiens
acttgaagcctaaatttgtgct

SEQ ID NO: 4543533 - DNA, 19 bp, Homo sapiens
acttgaataaccatctgaa

SEQ ID NO: 4543534 - DNA, 13 bp, Homo sapiens
acttgaatgaaaa

SEQ ID NO: 4543535 - DNA, 24 bp, Homo sapiens
acttgaatgctagttatacttatt

SEQ ID NO: 4543536 - DNA, 21 bp, Homo sapiens
acttgagaaccagtctcctca

SEQ ID NO: 4543537 - DNA, 21 bp, Homo sapiens
acttgagaccaacttttcaat

SEQ ID NO: 4543538 - DNA, 21 bp, Homo sapiens
acttgaggaggagctggcctg

SEQ ID NO: 4543539 - DNA, 15 bp, Homo sapiens
acttgaggttctctt

SEQ ID NO: 4543540 - DNA, 16 bp, Homo sapiens
acttgaggttctcttt

SEQ ID NO: 4543541 - DNA, 15 bp, Homo sapiens
acttgagtataagat

SEQ ID NO: 4543542 - DNA, 19 bp, Homo sapiens
acttgagtataagataaaa

SEQ ID NO: 4543543 - DNA, 13 bp, Homo sapiens
acttgatatttat

SEQ ID NO: 4543544 - DNA, 22 bp, Homo sapiens
acttgatgtacataactcctgt

SEQ ID NO: 4543545 - DNA, 23 bp, Homo sapiens
acttgatgtacataactcctgtc

SEQ ID NO: 4543546 - DNA, 21 bp, Homo sapiens
acttgcaatccaggctgttct

SEQ ID NO: 4543547 - DNA, 20 bp, Homo sapiens
acttgcagcgccaagtggcc

SEQ ID NO: 4543548 - DNA, 16 bp, Homo sapiens
acttgccctgaccatg

SEQ ID NO: 4543549 - DNA, 20 bp, Homo sapiens
acttgccctgaccatgcatt

SEQ ID NO: 4543550 - DNA, 21 bp, Homo sapiens
acttgccctgagcactcctgg

SEQ ID NO: 4543551 - DNA, 14 bp, Homo sapiens
acttgctcccaacc

SEQ ID NO: 4543552 - DNA, 11 bp, Homo sapiens
acttgctccct

SEQ ID NO: 4543553 - DNA, 18 bp, Homo sapiens
acttgcttaaatttctta

SEQ ID NO: 4543554 - DNA, 23 bp, Homo sapiens
acttggaaatcagtagaaagcta

SEQ ID NO: 4543555 - DNA, 22 bp, Homo sapiens
acttggaatcaaggtaagctca

SEQ ID NO: 4543556 - DNA, 17 bp, Homo sapiens
acttggacttttgatag

SEQ ID NO: 4543557 - DNA, 21 bp, Homo sapiens
acttggagactcctggtctgt

SEQ ID NO: 4543558 - DNA, 22 bp, Homo sapiens
acttggagactcctggtctgtg

SEQ ID NO: 4543559 - DNA, 18 bp, Homo sapiens
acttggatacttggattt

SEQ ID NO: 4543560 - DNA, 17 bp, Homo sapiens
acttggatcccaaagca

SEQ ID NO: 4543561 - DNA, 13 bp, Homo sapiens
acttgggaatata

SEQ ID NO: 4543562 - DNA, 22 bp, Homo sapiens
acttgggaggctgagatgggag

SEQ ID NO: 4543563 - DNA, 19 bp, Homo sapiens
acttgggggttcaggcccg

SEQ ID NO: 4543564 - DNA, 14 bp, Homo sapiens
acttggttttgcta

SEQ ID NO: 4543565 - DNA, 12 bp, Homo sapiens
acttgtaaaatg

SEQ ID NO: 4543566 - DNA, 16 bp, Homo sapiens
acttgtaaaatgcttt

SEQ ID NO: 4543567 - DNA, 20 bp, Homo sapiens
acttgtaaattgttgtttca

SEQ ID NO: 4543568 - DNA, 17 bp, Homo sapiens
acttgtacaaacagtat

SEQ ID NO: 4543569 - DNA, 22 bp, Homo sapiens
acttgtatatatggatcagagg

SEQ ID NO: 4543570 - DNA, 23 bp, Homo sapiens
acttgtatatatggatcagagga

SEQ ID NO: 4543571 - DNA, 14 bp, Homo sapiens
acttgtatttccaa

SEQ ID NO: 4543572 - DNA, 21 bp, Homo sapiens
acttgtattttgtcacttttt

SEQ ID NO: 4543573 - DNA, 17 bp, Homo sapiens
acttgtcatatcactaa

SEQ ID NO: 4543574 - DNA, 12 bp, Homo sapiens
acttgtctggct

SEQ ID NO: 4543575 - DNA, 14 bp, Homo sapiens
acttgtcttgaaaa

SEQ ID NO: 4543576 - DNA, 10 bp, Homo sapiens
acttgtgaat

SEQ ID NO: 4543577 - DNA, 12 bp, Homo sapiens
acttgtgaatgc

SEQ ID NO: 4543578 - DNA, 13 bp, Homo sapiens
acttgtgaatgct

SEQ ID NO: 4543579 - DNA, 18 bp, Homo sapiens
acttgtgaatgcttctca

SEQ ID NO: 4543580 - DNA, 22 bp, Homo sapiens
acttgtgtgtgtacctgtggct

SEQ ID NO: 4543581 - DNA, 14 bp, Homo sapiens
acttgtttaacatt

SEQ ID NO: 4543582 - DNA, 18 bp, Homo sapiens
acttgtttgaatatttgt

SEQ ID NO: 4543583 - DNA, 20 bp, Homo sapiens
acttgtttgaatatttgttt

SEQ ID NO: 4543584 - DNA, 13 bp, Homo sapiens
actttaaattata

SEQ ID NO: 4543585 - DNA, 20 bp, Homo sapiens
actttaattaccaacctgtt

SEQ ID NO: 4543586 - DNA, 22 bp, Homo sapiens
actttaattaccaacctgttac

SEQ ID NO: 4543587 - DNA, 23 bp, Homo sapiens
actttaattatatattttcatcc

SEQ ID NO: 4543588 - DNA, 15 bp, Homo sapiens
actttacaaaccatt

SEQ ID NO: 4543589 - DNA, 21 bp, Homo sapiens
actttacaaaccattacctgt

SEQ ID NO: 4543590 - DNA, 17 bp, Homo sapiens
actttacaaacctttgt

SEQ ID NO: 4543591 - DNA, 22 bp, Homo sapiens
actttacaaacctttgtttcaa

SEQ ID NO: 4543592 - DNA, 18 bp, Homo sapiens
actttacagaaatggact

SEQ ID NO: 4543593 - DNA, 19 bp, Homo sapiens
actttacagaaatggactg

SEQ ID NO: 4543594 - DNA, 18 bp, Homo sapiens
actttaccaaatgaaatg

SEQ ID NO: 4543595 - DNA, 21 bp, Homo sapiens
actttaccaaatgaaatgcca

SEQ ID NO: 4543596 - DNA, 22 bp, Homo sapiens
actttacctctctgtcatgtgc

SEQ ID NO: 4543597 - DNA, 17 bp, Homo sapiens
actttacttttgctgtt

SEQ ID NO: 4543598 - DNA, 16 bp, Homo sapiens
actttactttttccat

SEQ ID NO: 4543599 - DNA, 20 bp, Homo sapiens
actttaggtttttttaatga

SEQ ID NO: 4543600 - DNA, 19 bp, Homo sapiens
actttagttatattcactg

SEQ ID NO: 4543601 - DNA, 20 bp, Homo sapiens
actttagtttgcctgcagtt

SEQ ID NO: 4543602 - DNA, 14 bp, Homo sapiens
actttataaatttc

SEQ ID NO: 4543603 - DNA, 15 bp, Homo sapiens
actttatagctgcaa

SEQ ID NO: 4543604 - DNA, 17 bp, Homo sapiens
actttatatctgtaatg

SEQ ID NO: 4543605 - DNA, 20 bp, Homo sapiens
actttatatctgtaatgata

SEQ ID NO: 4543606 - DNA, 22 bp, Homo sapiens
actttatatctgtaatgatact

SEQ ID NO: 4543607 - DNA, 13 bp, Homo sapiens
actttatcatgaa

SEQ ID NO: 4543608 - DNA, 15 bp, Homo sapiens
actttatctgaaaat

SEQ ID NO: 4543609 - DNA, 12 bp, Homo sapiens
actttatgctaa

SEQ ID NO: 4543610 - DNA, 13 bp, Homo sapiens
actttatgtagtt

SEQ ID NO: 4543611 - DNA, 22 bp, Homo sapiens
actttattgcaactcttttaag

SEQ ID NO: 4543612 - DNA, 12 bp, Homo sapiens
actttatttact

SEQ ID NO: 4543613 - DNA, 20 bp, Homo sapiens
actttattttatataataaa

SEQ ID NO: 4543614 - DNA, 16 bp, Homo sapiens
actttcaaaagcaaac

SEQ ID NO: 4543615 - DNA, 11 bp, Homo sapiens
actttcaaaat

SEQ ID NO: 4543616 - DNA, 15 bp, Homo sapiens
actttcaatatttta

SEQ ID NO: 4543617 - DNA, 21 bp, Homo sapiens
actttcactataatgtgaaat

SEQ ID NO: 4543618 - DNA, 19 bp, Homo sapiens
actttcaggctactgttct

SEQ ID NO: 4543619 - DNA, 19 bp, Homo sapiens
actttcatcctgactctgc

SEQ ID NO: 4543620 - DNA, 16 bp, Homo sapiens
actttcatcttaaact

SEQ ID NO: 4543621 - DNA, 13 bp, Homo sapiens
actttcattgcca

SEQ ID NO: 4543622 - DNA, 16 bp, Homo sapiens
actttcattgccagtg

SEQ ID NO: 4543623 - DNA, 17 bp, Homo sapiens
actttcatttttttcca

SEQ ID NO: 4543624 - DNA, 23 bp, Homo sapiens
actttcatttttttccaggctgg

SEQ ID NO: 4543625 - DNA, 14 bp, Homo sapiens
actttccaaaacct

SEQ ID NO: 4543626 - DNA, 21 bp, Homo sapiens
actttcgaccgactttcccca

SEQ ID NO: 4543627 - DNA, 19 bp, Homo sapiens
actttcgtaatagctcaga

SEQ ID NO: 4543628 - DNA, 17 bp, Homo sapiens
actttctatcctctgta

SEQ ID NO: 4543629 - DNA, 13 bp, Homo sapiens
actttctcagttt

SEQ ID NO: 4543630 - DNA, 14 bp, Homo sapiens
actttctcagtttt

SEQ ID NO: 4543631 - DNA, 16 bp, Homo sapiens
actttctctgtgaaag

SEQ ID NO: 4543632 - DNA, 19 bp, Homo sapiens
actttctctgtgaaagctt

SEQ ID NO: 4543633 - DNA, 13 bp, Homo sapiens
actttctcttaag

SEQ ID NO: 4543634 - DNA, 22 bp, Homo sapiens
actttctcttaagattaatttt

SEQ ID NO: 4543635 - DNA, 23 bp, Homo sapiens
actttctgtctaggttaaagcta

SEQ ID NO: 4543636 - DNA, 17 bp, Homo sapiens
actttctgtctcaaacc

SEQ ID NO: 4543637 - DNA, 23 bp, Homo sapiens
actttctgtctcaaaccctggct

SEQ ID NO: 4543638 - DNA, 14 bp, Homo sapiens
actttcttttatta

SEQ ID NO: 4543639 - DNA, 12 bp, Homo sapiens
actttgaataaa

SEQ ID NO: 4543640 - DNA, 15 bp, Homo sapiens
actttgaataaagaa

SEQ ID NO: 4543641 - DNA, 18 bp, Homo sapiens
actttgaataaagaatac

SEQ ID NO: 4543642 - DNA, 22 bp, Homo sapiens
actttgaataaagaatacttga

SEQ ID NO: 4543643 - DNA, 17 bp, Homo sapiens
actttgacacttttcat

SEQ ID NO: 4543644 - DNA, 18 bp, Homo sapiens
actttgacacttttcata

SEQ ID NO: 4543645 - DNA, 22 bp, Homo sapiens
actttgacacttttcatatcat

SEQ ID NO: 4543646 - DNA, 23 bp, Homo sapiens
actttgacacttttcatatcatt

SEQ ID NO: 4543647 - DNA, 14 bp, Homo sapiens
actttgacagtgtt

SEQ ID NO: 4543648 - DNA, 15 bp, Homo sapiens
actttgactttttgc

SEQ ID NO: 4543649 - DNA, 19 bp, Homo sapiens
actttgatgtcatgtgttc

SEQ ID NO: 4543650 - DNA, 20 bp, Homo sapiens
actttgattccattttaagt

SEQ ID NO: 4543651 - DNA, 22 bp, Homo sapiens
actttgccaaggctctcccctc

SEQ ID NO: 4543652 - DNA, 16 bp, Homo sapiens
actttgcctcctgtgt

SEQ ID NO: 4543653 - DNA, 17 bp, Homo sapiens
actttgcgggatattta

SEQ ID NO: 4543654 - DNA, 18 bp, Homo sapiens
actttgcgggatatttag

SEQ ID NO: 4543655 - DNA, 20 bp, Homo sapiens
actttgctgttactgcttct

SEQ ID NO: 4543656 - DNA, 22 bp, Homo sapiens
actttgctgttactgcttctct

SEQ ID NO: 4543657 - DNA, 16 bp, Homo sapiens
actttggcaatttcct

SEQ ID NO: 4543658 - DNA, 14 bp, Homo sapiens
actttggtttctga

SEQ ID NO: 4543659 - DNA, 14 bp, Homo sapiens
actttgtaaataaa

SEQ ID NO: 4543660 - DNA, 12 bp, Homo sapiens
actttgtagtgt

SEQ ID NO: 4543661 - DNA, 20 bp, Homo sapiens
actttgtagtgtttggtgct

SEQ ID NO: 4543662 - DNA, 14 bp, Homo sapiens
actttgtatacttt

SEQ ID NO: 4543663 - DNA, 14 bp, Homo sapiens
actttgtcacttct

SEQ ID NO: 4543664 - DNA, 20 bp, Homo sapiens
actttgtcacttctgctgta

SEQ ID NO: 4543665 - DNA, 14 bp, Homo sapiens
actttgtcttttca

SEQ ID NO: 4543666 - DNA, 14 bp, Homo sapiens
actttgtgaataga

SEQ ID NO: 4543667 - DNA, 21 bp, Homo sapiens
actttgtggaccaattattga

SEQ ID NO: 4543668 - DNA, 22 bp, Homo sapiens
actttgtggaccaattattgat

SEQ ID NO: 4543669 - DNA, 13 bp, Homo sapiens
actttgtgtatta

SEQ ID NO: 4543670 - DNA, 16 bp, Homo sapiens
actttgtgtattaaat

SEQ ID NO: 4543671 - DNA, 15 bp, Homo sapiens
actttgtgttcattt

SEQ ID NO: 4543672 - DNA, 19 bp, Homo sapiens
actttgtgttcatttcatt

SEQ ID NO: 4543673 - DNA, 21 bp, Homo sapiens
actttgttgcaagatgtgaat

SEQ ID NO: 4543674 - DNA, 14 bp, Homo sapiens
actttgtttagaaa

SEQ ID NO: 4543675 - DNA, 18 bp, Homo sapiens
acttttaaaatttgtaga

SEQ ID NO: 4543676 - DNA, 22 bp, Homo sapiens
acttttaagatttctctaatat

SEQ ID NO: 4543677 - DNA, 18 bp, Homo sapiens
acttttataaattaaata

SEQ ID NO: 4543678 - DNA, 23 bp, Homo sapiens
acttttatactctttctgtatat

SEQ ID NO: 4543679 - DNA, 21 bp, Homo sapiens
acttttatgcagcaaatatat

SEQ ID NO: 4543680 - DNA, 16 bp, Homo sapiens
acttttatgtgagatt

SEQ ID NO: 4543681 - DNA, 18 bp, Homo sapiens
acttttatgtgagatttc

SEQ ID NO: 4543682 - DNA, 22 bp, Homo sapiens
acttttattttcattgtgattt

SEQ ID NO: 4543683 - DNA, 15 bp, Homo sapiens
acttttattttcttt

SEQ ID NO: 4543684 - DNA, 14 bp, Homo sapiens
acttttcattctct

SEQ ID NO: 4543685 - DNA, 20 bp, Homo sapiens
acttttcattctcttttaat

SEQ ID NO: 4543686 - DNA, 11 bp, Homo sapiens
acttttctgta

SEQ ID NO: 4543687 - DNA, 18 bp, Homo sapiens
acttttctgtcttacaag

SEQ ID NO: 4543688 - DNA, 14 bp, Homo sapiens
acttttctgtttag

SEQ ID NO: 4543689 - DNA, 15 bp, Homo sapiens
acttttgaaagatgt

SEQ ID NO: 4543690 - DNA, 17 bp, Homo sapiens
acttttgaaagatgtat

SEQ ID NO: 4543691 - DNA, 21 bp, Homo sapiens
acttttgagtatggctatcta

SEQ ID NO: 4543692 - DNA, 13 bp, Homo sapiens
acttttgctgttt

SEQ ID NO: 4543693 - DNA, 22 bp, Homo sapiens
acttttgtgaattaggctgtaa

SEQ ID NO: 4543694 - DNA, 16 bp, Homo sapiens
acttttgttaaattca

SEQ ID NO: 4543695 - DNA, 17 bp, Homo sapiens
actttttaaaaataact

SEQ ID NO: 4543696 - DNA, 14 bp, Homo sapiens
actttttaaattac

SEQ ID NO: 4543697 - DNA, 11 bp, Homo sapiens
actttttacaa

SEQ ID NO: 4543698 - DNA, 12 bp, Homo sapiens
actttttattgc

SEQ ID NO: 4543699 - DNA, 15 bp, Homo sapiens
actttttattgcctt

SEQ ID NO: 4543700 - DNA, 22 bp, Homo sapiens
actttttgatggaattaaatgt

SEQ ID NO: 4543701 - DNA, 17 bp, Homo sapiens
actttttggaattcagc

SEQ ID NO: 4543702 - DNA, 20 bp, Homo sapiens
actttttgtttttatttctt

SEQ ID NO: 4543703 - DNA, 18 bp, Homo sapiens
acttttttaaatattttc

SEQ ID NO: 4543704 - DNA, 14 bp, Homo sapiens
acttttttctgcct

SEQ ID NO: 4543705 - DNA, 22 bp, Homo sapiens
acttttttggtactataaaagc

SEQ ID NO: 4543706 - DNA, 13 bp, Homo sapiens
actttttttagta

SEQ ID NO: 4543707 - DNA, 19 bp, Homo sapiens
actttttttctatattatt

SEQ ID NO: 4543708 - DNA, 21 bp, Homo sapiens
actttttttctgtaccagtta

SEQ ID NO: 4543709 - DNA, 13 bp, Homo sapiens
actttttttgtat

SEQ ID NO: 4543710 - DNA, 16 bp, Homo sapiens
actttttttgtatgtg

SEQ ID NO: 4543711 - DNA, 15 bp, Homo sapiens
actttttttgttata

SEQ ID NO: 4543712 - DNA, 18 bp, Homo sapiens
acttttttttctctcttt

SEQ ID NO: 4543713 - DNA, 22 bp, Homo sapiens
agaaaaaaaaaagaaatgcaaa

SEQ ID NO: 4543714 - DNA, 20 bp, Homo sapiens
agaaaaaaaaagaaaaatca

SEQ ID NO: 4543715 - DNA, 18 bp, Homo sapiens
agaaaaaaaatagacttt

SEQ ID NO: 4543716 - DNA, 21 bp, Homo sapiens
agaaaaaaagtttgccagaag

SEQ ID NO: 4543717 - DNA, 20 bp, Homo sapiens
agaaaaaaattgctctgtgt

SEQ ID NO: 4543718 - DNA, 17 bp, Homo sapiens
agaaaaaagtagcaaat

SEQ ID NO: 4543719 - DNA, 20 bp, Homo sapiens
agaaaaaagtagcaaatgtt

SEQ ID NO: 4543720 - DNA, 19 bp, Homo sapiens
agaaaaacaatggtaacat

SEQ ID NO: 4543721 - DNA, 13 bp, Homo sapiens
agaaaaacattta

SEQ ID NO: 4543722 - DNA, 21 bp, Homo sapiens
agaaaaagcttaatgattctg

SEQ ID NO: 4543723 - DNA, 15 bp, Homo sapiens
agaaaaataaccctt

SEQ ID NO: 4543724 - DNA, 21 bp, Homo sapiens
agaaaaatagagcaaaatcaa

SEQ ID NO: 4543725 - DNA, 14 bp, Homo sapiens
agaaaaatctcatt

SEQ ID NO: 4543726 - DNA, 16 bp, Homo sapiens
agaaaaatttcacgat

SEQ ID NO: 4543727 - DNA, 15 bp, Homo sapiens
agaaaacaagtatat

SEQ ID NO: 4543728 - DNA, 20 bp, Homo sapiens
agaaaacaggaaaaaaactt

SEQ ID NO: 4543729 - DNA, 20 bp, Homo sapiens
agaaaacatgtataaatata

SEQ ID NO: 4543730 - DNA, 19 bp, Homo sapiens
agaaaacctaagcaaactt

SEQ ID NO: 4543731 - DNA, 23 bp, Homo sapiens
agaaaacctgatgctggggacac

SEQ ID NO: 4543732 - DNA, 16 bp, Homo sapiens
agaaaacctttcttca

SEQ ID NO: 4543733 - DNA, 21 bp, Homo sapiens
agaaaactcccaatacaaaga

SEQ ID NO: 4543734 - DNA, 16 bp, Homo sapiens
agaaaagaagtgaagt

SEQ ID NO: 4543735 - DNA, 13 bp, Homo sapiens
agaaaagagagaa

SEQ ID NO: 4543736 - DNA, 16 bp, Homo sapiens
agaaaagcacctgccg

SEQ ID NO: 4543737 - DNA, 22 bp, Homo sapiens
agaaaagcgcgttgtgtatatt

SEQ ID NO: 4543738 - DNA, 16 bp, Homo sapiens
agaaaagtaatgaaga

SEQ ID NO: 4543739 - DNA, 20 bp, Homo sapiens
agaaaagtaatgaagaatca

SEQ ID NO: 4543740 - DNA, 14 bp, Homo sapiens
agaaaagtgaattg

SEQ ID NO: 4543741 - DNA, 12 bp, Homo sapiens
agaaaagttatt

SEQ ID NO: 4543742 - DNA, 21 bp, Homo sapiens
agaaaataaagacaaccatat

SEQ ID NO: 4543743 - DNA, 16 bp, Homo sapiens
agaaaatagataattt

SEQ ID NO: 4543744 - DNA, 11 bp, Homo sapiens
agaaaatataa

SEQ ID NO: 4543745 - DNA, 12 bp, Homo sapiens
agaaaatataag

SEQ ID NO: 4543746 - DNA, 20 bp, Homo sapiens
agaaaatatcactgtaatga

SEQ ID NO: 4543747 - DNA, 10 bp, Homo sapiens
agaaaatatt

SEQ ID NO: 4543748 - DNA, 23 bp, Homo sapiens
agaaaatatttaatatcaaaaga

SEQ ID NO: 4543749 - DNA, 19 bp, Homo sapiens
agaaaatgacttatttctg

SEQ ID NO: 4543750 - DNA, 20 bp, Homo sapiens
agaaaatgacttatttctgc

SEQ ID NO: 4543751 - DNA, 19 bp, Homo sapiens
agaaaatgagaaaggacag

SEQ ID NO: 4543752 - DNA, 20 bp, Homo sapiens
agaaaatgtaaggcaatgct

SEQ ID NO: 4543753 - DNA, 12 bp, Homo sapiens
agaaaatgtctt

SEQ ID NO: 4543754 - DNA, 18 bp, Homo sapiens
agaaaatgttctgtttgc

SEQ ID NO: 4543755 - DNA, 17 bp, Homo sapiens
agaaaatgttgagaatc

SEQ ID NO: 4543756 - DNA, 14 bp, Homo sapiens
agaaaattcctata

SEQ ID NO: 4543757 - DNA, 22 bp, Homo sapiens
agaaaattcctataaggaagat

SEQ ID NO: 4543758 - DNA, 16 bp, Homo sapiens
agaaaattctgtgcct

SEQ ID NO: 4543759 - DNA, 14 bp, Homo sapiens
agaaaattgaaaca

SEQ ID NO: 4543760 - DNA, 23 bp, Homo sapiens
agaaaattgatatttttatacaa

SEQ ID NO: 4543761 - DNA, 12 bp, Homo sapiens
agaaaatttaca

SEQ ID NO: 4543762 - DNA, 23 bp, Homo sapiens
agaaaatttacaaaatttattct

SEQ ID NO: 4543763 - DNA, 17 bp, Homo sapiens
agaaacaaagatgttat

SEQ ID NO: 4543764 - DNA, 18 bp, Homo sapiens
agaaacaacaatttctac

SEQ ID NO: 4543765 - DNA, 18 bp, Homo sapiens
agaaacaaggttttcagt

SEQ ID NO: 4543766 - DNA, 13 bp, Homo sapiens
agaaacactcaag

SEQ ID NO: 4543767 - DNA, 16 bp, Homo sapiens
agaaacactgaaaaga

SEQ ID NO: 4543768 - DNA, 22 bp, Homo sapiens
agaaacactgcaaattttaact

SEQ ID NO: 4543769 - DNA, 18 bp, Homo sapiens
agaaacagagtggcctcc

SEQ ID NO: 4543770 - DNA, 18 bp, Homo sapiens
agaaacagggacaaagaa

SEQ ID NO: 4543771 - DNA, 19 bp, Homo sapiens
agaaacagggacaaagaaa

SEQ ID NO: 4543772 - DNA, 12 bp, Homo sapiens
agaaacagtgtg

SEQ ID NO: 4543773 - DNA, 22 bp, Homo sapiens
agaaacagttggtaacttttgt

SEQ ID NO: 4543774 - DNA, 19 bp, Homo sapiens
agaaacataaccgtgaagc

SEQ ID NO: 4543775 - DNA, 16 bp, Homo sapiens
agaaaccgtcctcttt

SEQ ID NO: 4543776 - DNA, 22 bp, Homo sapiens
agaaacctgactcaattatttg

SEQ ID NO: 4543777 - DNA, 18 bp, Homo sapiens
agaaacctttttaaaaat

SEQ ID NO: 4543778 - DNA, 18 bp, Homo sapiens
agaaacgtcttctaaact

SEQ ID NO: 4543779 - DNA, 21 bp, Homo sapiens
agaaacgtcttctaaacttcc

SEQ ID NO: 4543780 - DNA, 17 bp, Homo sapiens
agaaactaattgacttt

SEQ ID NO: 4543781 - DNA, 18 bp, Homo sapiens
agaaactcgggcttgagt

SEQ ID NO: 4543782 - DNA, 21 bp, Homo sapiens
agaaactgtccaaatgctttg

SEQ ID NO: 4543783 - DNA, 13 bp, Homo sapiens
agaaacttaaaca

SEQ ID NO: 4543784 - DNA, 18 bp, Homo sapiens
agaaacttaaatgttatt

SEQ ID NO: 4543785 - DNA, 23 bp, Homo sapiens
agaaacttaaatgttattatctg

SEQ ID NO: 4543786 - DNA, 23 bp, Homo sapiens
agaaacttaaggttacctttgtt

SEQ ID NO: 4543787 - DNA, 13 bp, Homo sapiens
agaaacttgtaaa

SEQ ID NO: 4543788 - DNA, 13 bp, Homo sapiens
agaaacttgtgaa

SEQ ID NO: 4543789 - DNA, 19 bp, Homo sapiens
agaaacttttttatttaaa

SEQ ID NO: 4543790 - DNA, 16 bp, Homo sapiens
agaaagaaaaaatttt

SEQ ID NO: 4543791 - DNA, 14 bp, Homo sapiens
agaaagaagccata

SEQ ID NO: 4543792 - DNA, 16 bp, Homo sapiens
agaaagaataaaatgt

SEQ ID NO: 4543793 - DNA, 19 bp, Homo sapiens
agaaagaataaaatgtttc

SEQ ID NO: 4543794 - DNA, 16 bp, Homo sapiens
agaaagactattcaaa

SEQ ID NO: 4543795 - DNA, 19 bp, Homo sapiens
agaaagactattcaaacag

SEQ ID NO: 4543796 - DNA, 20 bp, Homo sapiens
agaaagactattcaaacagt

SEQ ID NO: 4543797 - DNA, 15 bp, Homo sapiens
agaaagagctacctg

SEQ ID NO: 4543798 - DNA, 14 bp, Homo sapiens
agaaagatgacaaa

SEQ ID NO: 4543799 - DNA, 14 bp, Homo sapiens
agaaagatgtatat

SEQ ID NO: 4543800 - DNA, 16 bp, Homo sapiens
agaaagatttaaagta

SEQ ID NO: 4543801 - DNA, 20 bp, Homo sapiens
agaaagcagaacagtgatta

SEQ ID NO: 4543802 - DNA, 15 bp, Homo sapiens
agaaagcatattgac

SEQ ID NO: 4543803 - DNA, 17 bp, Homo sapiens
agaaagcatattgactt

SEQ ID NO: 4543804 - DNA, 17 bp, Homo sapiens
agaaagccacgccctcc

SEQ ID NO: 4543805 - DNA, 22 bp, Homo sapiens
agaaagccacgccctccctgct

SEQ ID NO: 4543806 - DNA, 23 bp, Homo sapiens
agaaagccacgccctccctgcta

SEQ ID NO: 4543807 - DNA, 14 bp, Homo sapiens
agaaagctaaagtg

SEQ ID NO: 4543808 - DNA, 17 bp, Homo sapiens
agaaagctaaagtgatc

SEQ ID NO: 4543809 - DNA, 16 bp, Homo sapiens
agaaagctaaatgaat

SEQ ID NO: 4543810 - DNA, 17 bp, Homo sapiens
agaaagctaaatgaatc

SEQ ID NO: 4543811 - DNA, 13 bp, Homo sapiens
agaaagctgcctg

SEQ ID NO: 4543812 - DNA, 21 bp, Homo sapiens
agaaagcttaatatattccca

SEQ ID NO: 4543813 - DNA, 15 bp, Homo sapiens
agaaaggaaaccttt

SEQ ID NO: 4543814 - DNA, 19 bp, Homo sapiens
agaaaggaagcattgtaaa

SEQ ID NO: 4543815 - DNA, 21 bp, Homo sapiens
agaaaggatttcctttctttt

SEQ ID NO: 4543816 - DNA, 12 bp, Homo sapiens
agaaaggcaggt

SEQ ID NO: 4543817 - DNA, 15 bp, Homo sapiens
agaaaggctgttaaa

SEQ ID NO: 4543818 - DNA, 22 bp, Homo sapiens
agaaaggctgttaaatacagga

SEQ ID NO: 4543819 - DNA, 16 bp, Homo sapiens
agaaagggaggcccag

SEQ ID NO: 4543820 - DNA, 23 bp, Homo sapiens
agaaagggaggcccagccgcagg

SEQ ID NO: 4543821 - DNA, 23 bp, Homo sapiens
agaaaggtgagtttgagctgcct

SEQ ID NO: 4543822 - DNA, 22 bp, Homo sapiens
agaaagtaagcatttccagcct

SEQ ID NO: 4543823 - DNA, 22 bp, Homo sapiens
agaaagtctatctaatgacatg

SEQ ID NO: 4543824 - DNA, 15 bp, Homo sapiens
agaaagtgaagcaaa

SEQ ID NO: 4543825 - DNA, 23 bp, Homo sapiens
agaaagtggaaaacaaggaagtc

SEQ ID NO: 4543826 - DNA, 13 bp, Homo sapiens
agaaagtgtattt

SEQ ID NO: 4543827 - DNA, 16 bp, Homo sapiens
agaaagtgtatttgga

SEQ ID NO: 4543828 - DNA, 16 bp, Homo sapiens
agaaataaaccttaat

SEQ ID NO: 4543829 - DNA, 16 bp, Homo sapiens
agaaataaagggacca

SEQ ID NO: 4543830 - DNA, 16 bp, Homo sapiens
agaaataagtttttgt

SEQ ID NO: 4543831 - DNA, 23 bp, Homo sapiens
agaaataagtttttgtttcacag

SEQ ID NO: 4543832 - DNA, 14 bp, Homo sapiens
agaaatacaaaata

SEQ ID NO: 4543833 - DNA, 21 bp, Homo sapiens
agaaatagacaaaaagtatat

SEQ ID NO: 4543834 - DNA, 19 bp, Homo sapiens
agaaatagctccgtggagc

SEQ ID NO: 4543835 - DNA, 14 bp, Homo sapiens
agaaatatacagtt

SEQ ID NO: 4543836 - DNA, 16 bp, Homo sapiens
agaaatatacagtttg

SEQ ID NO: 4543837 - DNA, 19 bp, Homo sapiens
agaaatatacagtttgact

SEQ ID NO: 4543838 - DNA, 17 bp, Homo sapiens
agaaatatggacactta

SEQ ID NO: 4543839 - DNA, 15 bp, Homo sapiens
agaaatattttaaaa

SEQ ID NO: 4543840 - DNA, 17 bp, Homo sapiens
agaaatattttaaaatc

SEQ ID NO: 4543841 - DNA, 21 bp, Homo sapiens
agaaatattttaaaatcagct

SEQ ID NO: 4543842 - DNA, 19 bp, Homo sapiens
agaaatcaagtaatgaatc

SEQ ID NO: 4543843 - DNA, 15 bp, Homo sapiens
agaaatcaatagttg

SEQ ID NO: 4543844 - DNA, 22 bp, Homo sapiens
agaaatcacaattttcctgtgg

SEQ ID NO: 4543845 - DNA, 17 bp, Homo sapiens
agaaatcattttgcaat

SEQ ID NO: 4543846 - DNA, 19 bp, Homo sapiens
agaaatgaagtttatatta

SEQ ID NO: 4543847 - DNA, 15 bp, Homo sapiens
agaaatgcttagaaa

SEQ ID NO: 4543848 - DNA, 21 bp, Homo sapiens
agaaatgtgtagctgcaaaaa

SEQ ID NO: 4543849 - DNA, 18 bp, Homo sapiens
agaaatgtttatggaaat

SEQ ID NO: 4543850 - DNA, 18 bp, Homo sapiens
agaaattacctgtggata

SEQ ID NO: 4543851 - DNA, 22 bp, Homo sapiens
agaaattcaagaagtatttttt

SEQ ID NO: 4543852 - DNA, 18 bp, Homo sapiens
agaaattcttgttatggt

SEQ ID NO: 4543853 - DNA, 16 bp, Homo sapiens
agaaattgtatattgt

SEQ ID NO: 4543854 - DNA, 16 bp, Homo sapiens
agaaatttaaactata

SEQ ID NO: 4543855 - DNA, 24 bp, Homo sapiens
agaaatttaaactataagcaagaa

SEQ ID NO: 4543856 - DNA, 14 bp, Homo sapiens
agaaattttgtaag

SEQ ID NO: 4543857 - DNA, 14 bp, Homo sapiens
agaacaaatattca

SEQ ID NO: 4543858 - DNA, 11 bp, Homo sapiens
agaacacagtt

SEQ ID NO: 4543859 - DNA, 21 bp, Homo sapiens
agaacacctgccttctaccct

SEQ ID NO: 4543860 - DNA, 12 bp, Homo sapiens
agaacactaacc

SEQ ID NO: 4543861 - DNA, 20 bp, Homo sapiens
agaacactattttcagaatc

SEQ ID NO: 4543862 - DNA, 14 bp, Homo sapiens
agaacagaggcatt

SEQ ID NO: 4543863 - DNA, 12 bp, Homo sapiens
agaacagccccg

SEQ ID NO: 4543864 - DNA, 18 bp, Homo sapiens
agaacagccccggggccc

SEQ ID NO: 4543865 - DNA, 20 bp, Homo sapiens
agaacagtatgaatttgagc

SEQ ID NO: 4543866 - DNA, 21 bp, Homo sapiens
agaacagtattgggcaggagg

SEQ ID NO: 4543867 - DNA, 18 bp, Homo sapiens
agaacatacatgatacat

SEQ ID NO: 4543868 - DNA, 14 bp, Homo sapiens
agaacatgcagttt

SEQ ID NO: 4543869 - DNA, 17 bp, Homo sapiens
agaacatgcagtttgaa

SEQ ID NO: 4543870 - DNA, 22 bp, Homo sapiens
agaacatgcagtttgaaattct

SEQ ID NO: 4543871 - DNA, 17 bp, Homo sapiens
agaacattcacttttgt

SEQ ID NO: 4543872 - DNA, 18 bp, Homo sapiens
agaacattcacttttgtt

SEQ ID NO: 4543873 - DNA, 14 bp, Homo sapiens
agaacattgatctg

SEQ ID NO: 4543874 - DNA, 19 bp, Homo sapiens
agaacattgatctgtttta

SEQ ID NO: 4543875 - DNA, 17 bp, Homo sapiens
agaacattttataaaac

SEQ ID NO: 4543876 - DNA, 23 bp, Homo sapiens
agaaccaaactcctatttcaatg

SEQ ID NO: 4543877 - DNA, 15 bp, Homo sapiens
agaaccaaatacctc

SEQ ID NO: 4543878 - DNA, 16 bp, Homo sapiens
agaaccaagaagggct

SEQ ID NO: 4543879 - DNA, 14 bp, Homo sapiens
agaaccacagcaga

SEQ ID NO: 4543880 - DNA, 13 bp, Homo sapiens
agaaccactatga

SEQ ID NO: 4543881 - DNA, 14 bp, Homo sapiens
agaaccagtctcct

SEQ ID NO: 4543882 - DNA, 22 bp, Homo sapiens
agaacccagtgtttccacactt

SEQ ID NO: 4543883 - DNA, 16 bp, Homo sapiens
agaacccctctgcttt

SEQ ID NO: 4543884 - DNA, 16 bp, Homo sapiens
agaacctaatgcactc

SEQ ID NO: 4543885 - DNA, 15 bp, Homo sapiens
agaacctaattcaat

SEQ ID NO: 4543886 - DNA, 19 bp, Homo sapiens
agaacctaattcaattcaa

SEQ ID NO: 4543887 - DNA, 20 bp, Homo sapiens
agaacctacagactccatct

SEQ ID NO: 4543888 - DNA, 20 bp, Homo sapiens
agaacctgagctattttcct

SEQ ID NO: 4543889 - DNA, 22 bp, Homo sapiens
agaacctgagctattttcctct

SEQ ID NO: 4543890 - DNA, 17 bp, Homo sapiens
agaacctggagagctag

SEQ ID NO: 4543891 - DNA, 23 bp, Homo sapiens
agaacctggagggctagaactgg

SEQ ID NO: 4543892 - DNA, 13 bp, Homo sapiens
agaacctttgtca

SEQ ID NO: 4543893 - DNA, 21 bp, Homo sapiens
agaacgaggtttatattttca

SEQ ID NO: 4543894 - DNA, 21 bp, Homo sapiens
agaacgcaccccactgggaga

SEQ ID NO: 4543895 - DNA, 19 bp, Homo sapiens
agaacggggctcttctcat

SEQ ID NO: 4543896 - DNA, 18 bp, Homo sapiens
agaactaaagctggagag

SEQ ID NO: 4543897 - DNA, 20 bp, Homo sapiens
agaactaaatttttcataga

SEQ ID NO: 4543898 - DNA, 16 bp, Homo sapiens
agaactactaaggaaa

SEQ ID NO: 4543899 - DNA, 22 bp, Homo sapiens
agaactatcatttttacactat

SEQ ID NO: 4543900 - DNA, 21 bp, Homo sapiens
agaactccatcagaaaaccaa

SEQ ID NO: 4543901 - DNA, 22 bp, Homo sapiens
agaactccatcagaaaaccaaa

SEQ ID NO: 4543902 - DNA, 13 bp, Homo sapiens
agaactctctgga

SEQ ID NO: 4543903 - DNA, 22 bp, Homo sapiens
agaactgagggctctgtttgtg

SEQ ID NO: 4543904 - DNA, 20 bp, Homo sapiens
agaactgcccttgctgcccg

SEQ ID NO: 4543905 - DNA, 22 bp, Homo sapiens
agaactgcccttgctgcccgcg

SEQ ID NO: 4543906 - DNA, 13 bp, Homo sapiens
agaactgtacatt

SEQ ID NO: 4543907 - DNA, 22 bp, Homo sapiens
agaacttagcctttacctgtga

SEQ ID NO: 4543908 - DNA, 23 bp, Homo sapiens
agaacttggatgtacctgccccc

SEQ ID NO: 4543909 - DNA, 21 bp, Homo sapiens
agaacttgttaacctttctaa

SEQ ID NO: 4543910 - DNA, 15 bp, Homo sapiens
agaactttcattttt

SEQ ID NO: 4543911 - DNA, 16 bp, Homo sapiens
agaactttgaaggaca

SEQ ID NO: 4543912 - DNA, 16 bp, Homo sapiens
agaagaaaattctcct

SEQ ID NO: 4543913 - DNA, 23 bp, Homo sapiens
agaagaaagcaaaagcaagggac

SEQ ID NO: 4543914 - DNA, 16 bp, Homo sapiens
agaagaatattgtatt

SEQ ID NO: 4543915 - DNA, 19 bp, Homo sapiens
agaagaatccgagtgtttg

SEQ ID NO: 4543916 - DNA, 22 bp, Homo sapiens
agaagaatctcatctcagtgaa

SEQ ID NO: 4543917 - DNA, 19 bp, Homo sapiens
agaagaatgcttaatcaga

SEQ ID NO: 4543918 - DNA, 14 bp, Homo sapiens
agaagacaacagaa

SEQ ID NO: 4543919 - DNA, 22 bp, Homo sapiens
agaagacacaaggtgatttcag

SEQ ID NO: 4543920 - DNA, 23 bp, Homo sapiens
agaagacacaaggtgatttcaga

SEQ ID NO: 4543921 - DNA, 18 bp, Homo sapiens
agaagacaggctggaaga

SEQ ID NO: 4543922 - DNA, 18 bp, Homo sapiens
agaagactttaattatat

SEQ ID NO: 4543923 - DNA, 19 bp, Homo sapiens
agaagagatgagaaatgat

SEQ ID NO: 4543924 - DNA, 11 bp, Homo sapiens
agaagagccat

SEQ ID NO: 4543925 - DNA, 20 bp, Homo sapiens
agaagagctgttcacagcca

SEQ ID NO: 4543926 - DNA, 17 bp, Homo sapiens
agaagagggcccagccc

SEQ ID NO: 4543927 - DNA, 15 bp, Homo sapiens
agaagagtctattgt

SEQ ID NO: 4543928 - DNA, 22 bp, Homo sapiens
agaagagttgaggaactgtaca

SEQ ID NO: 4543929 - DNA, 23 bp, Homo sapiens
agaagagttgaggaactgtacag

SEQ ID NO: 4543930 - DNA, 11 bp, Homo sapiens
agaagatatct

SEQ ID NO: 4543931 - DNA, 19 bp, Homo sapiens
agaagatggcacttataac

SEQ ID NO: 4543932 - DNA, 18 bp, Homo sapiens
agaagatgtgtaaacagg

SEQ ID NO: 4543933 - DNA, 16 bp, Homo sapiens
agaagattagaaacta

SEQ ID NO: 4543934 - DNA, 22 bp, Homo sapiens
agaagatttattatgaaccgca

SEQ ID NO: 4543935 - DNA, 14 bp, Homo sapiens
agaagcaaatatag

SEQ ID NO: 4543936 - DNA, 19 bp, Homo sapiens
agaagcaacccaaatgttc

SEQ ID NO: 4543937 - DNA, 23 bp, Homo sapiens
agaagcaacctcagtaatttaga

SEQ ID NO: 4543938 - DNA, 22 bp, Homo sapiens
agaagcaatctttgaaataaaa

SEQ ID NO: 4543939 - DNA, 21 bp, Homo sapiens
agaagcacagaatatttttat

SEQ ID NO: 4543940 - DNA, 13 bp, Homo sapiens
agaagcagtgagc

SEQ ID NO: 4543941 - DNA, 17 bp, Homo sapiens
agaagcagtgagccgca

SEQ ID NO: 4543942 - DNA, 16 bp, Homo sapiens
agaagccaagggaaag

SEQ ID NO: 4543943 - DNA, 22 bp, Homo sapiens
agaagccaagggaaaggggtgc

SEQ ID NO: 4543944 - DNA, 11 bp, Homo sapiens
agaagccacag

SEQ ID NO: 4543945 - DNA, 14 bp, Homo sapiens
agaagccacagaaa

SEQ ID NO: 4543946 - DNA, 16 bp, Homo sapiens
agaagccacaggcctg

SEQ ID NO: 4543947 - DNA, 17 bp, Homo sapiens
agaagccacaggcctga

SEQ ID NO: 4543948 - DNA, 18 bp, Homo sapiens
agaagccacaggcctgag

SEQ ID NO: 4543949 - DNA, 19 bp, Homo sapiens
agaagccacaggcctgaga

SEQ ID NO: 4543950 - DNA, 23 bp, Homo sapiens
agaagccatatatgaccagaagc

SEQ ID NO: 4543951 - DNA, 21 bp, Homo sapiens
agaagccccttccccatggga

SEQ ID NO: 4543952 - DNA, 20 bp, Homo sapiens
agaagcctccaagcacagag

SEQ ID NO: 4543953 - DNA, 13 bp, Homo sapiens
agaagcctctggc

SEQ ID NO: 4543954 - DNA, 16 bp, Homo sapiens
agaagcctctggctag

SEQ ID NO: 4543955 - DNA, 10 bp, Homo sapiens
agaagcctgc

SEQ ID NO: 4543956 - DNA, 19 bp, Homo sapiens
agaagccttatgaaaatta

SEQ ID NO: 4543957 - DNA, 22 bp, Homo sapiens
agaagccttggaaccagcccca

SEQ ID NO: 4543958 - DNA, 11 bp, Homo sapiens
agaagctattt

SEQ ID NO: 4543959 - DNA, 18 bp, Homo sapiens
agaagctgaagagcacgg

SEQ ID NO: 4543960 - DNA, 13 bp, Homo sapiens
agaagcttcagca

SEQ ID NO: 4543961 - DNA, 19 bp, Homo sapiens
agaagcttcatgccaggtt

SEQ ID NO: 4543962 - DNA, 16 bp, Homo sapiens
agaagctttatttcta

SEQ ID NO: 4543963 - DNA, 15 bp, Homo sapiens
agaaggaaagatggt

SEQ ID NO: 4543964 - DNA, 22 bp, Homo sapiens
agaaggaaggagactcacctct

SEQ ID NO: 4543965 - DNA, 18 bp, Homo sapiens
agaaggaaggatgccact

SEQ ID NO: 4543966 - DNA, 17 bp, Homo sapiens
agaaggaaggcctgagc

SEQ ID NO: 4543967 - DNA, 20 bp, Homo sapiens
agaaggaatggtgcgtggct

SEQ ID NO: 4543968 - DNA, 21 bp, Homo sapiens
agaaggaatggtgcgtggctt

SEQ ID NO: 4543969 - DNA, 16 bp, Homo sapiens
agaaggcaaaaatagt

SEQ ID NO: 4543970 - DNA, 14 bp, Homo sapiens
agaaggcaatatta

SEQ ID NO: 4543971 - DNA, 21 bp, Homo sapiens
agaaggcaattttagtgtatt

SEQ ID NO: 4543972 - DNA, 13 bp, Homo sapiens
agaaggcagccac

SEQ ID NO: 4543973 - DNA, 15 bp, Homo sapiens
agaagggagaagaaa

SEQ ID NO: 4543974 - DNA, 20 bp, Homo sapiens
agaagggccagtcctgcctg

SEQ ID NO: 4543975 - DNA, 21 bp, Homo sapiens
agaagggctagaacctggaga

SEQ ID NO: 4543976 - DNA, 23 bp, Homo sapiens
agaagggtgggagtggggccttt

SEQ ID NO: 4543977 - DNA, 20 bp, Homo sapiens
agaaggtaaggtgtgaacct

SEQ ID NO: 4543978 - DNA, 23 bp, Homo sapiens
agaagtagtgtctggatcagtaa

SEQ ID NO: 4543979 - DNA, 21 bp, Homo sapiens
agaagtatttaaactttcaat

SEQ ID NO: 4543980 - DNA, 16 bp, Homo sapiens
agaagtcatcttgcta

SEQ ID NO: 4543981 - DNA, 22 bp, Homo sapiens
agaagtcatcttgctaccagta

SEQ ID NO: 4543982 - DNA, 23 bp, Homo sapiens
agaagtcggaatgtcatagtctt

SEQ ID NO: 4543983 - DNA, 19 bp, Homo sapiens
agaagtggaccaggacagg

SEQ ID NO: 4543984 - DNA, 19 bp, Homo sapiens
agaagtgggccaggacagg

SEQ ID NO: 4543985 - DNA, 12 bp, Homo sapiens
agaagtggtttc

SEQ ID NO: 4543986 - DNA, 14 bp, Homo sapiens
agaagttaattctt

SEQ ID NO: 4543987 - DNA, 19 bp, Homo sapiens
agaagttaattcttaaaac

SEQ ID NO: 4543988 - DNA, 19 bp, Homo sapiens
agaagttagtttgtatata

SEQ ID NO: 4543989 - DNA, 23 bp, Homo sapiens
agaagtttcatcattttttactt

SEQ ID NO: 4543990 - DNA, 18 bp, Homo sapiens
agaagtttcctggagttt

SEQ ID NO: 4543991 - DNA, 15 bp, Homo sapiens
agaagttttttactt

SEQ ID NO: 4543992 - DNA, 17 bp, Homo sapiens
agaagttttttactttg

SEQ ID NO: 4543993 - DNA, 20 bp, Homo sapiens
agaagttttttactttggtt

SEQ ID NO: 4543994 - DNA, 16 bp, Homo sapiens
agaataaaaatgtggt

SEQ ID NO: 4543995 - DNA, 16 bp, Homo sapiens
agaataaaatgtttct

SEQ ID NO: 4543996 - DNA, 21 bp, Homo sapiens
agaataaaggcagttttctaa

SEQ ID NO: 4543997 - DNA, 13 bp, Homo sapiens
agaataaatgaag

SEQ ID NO: 4543998 - DNA, 21 bp, Homo sapiens
agaataaattctacctccttg

SEQ ID NO: 4543999 - DNA, 21 bp, Homo sapiens
agaataatcacgctttcctga

SEQ ID NO: 4544000 - DNA, 15 bp, Homo sapiens
agaatacttctcatt

SEQ ID NO: 4544001 - DNA, 12 bp, Homo sapiens
agaatacttgaa

SEQ ID NO: 4544002 - DNA, 16 bp, Homo sapiens
agaatacttgaacttg

SEQ ID NO: 4544003 - DNA, 14 bp, Homo sapiens
agaatagaaagaaa

SEQ ID NO: 4544004 - DNA, 19 bp, Homo sapiens
agaatagccacatttggaa

SEQ ID NO: 4544005 - DNA, 17 bp, Homo sapiens
agaataggggagccaag

SEQ ID NO: 4544006 - DNA, 15 bp, Homo sapiens
agaatagtttacaca

SEQ ID NO: 4544007 - DNA, 11 bp, Homo sapiens
agaatatacct

SEQ ID NO: 4544008 - DNA, 12 bp, Homo sapiens
agaatatacctt

SEQ ID NO: 4544009 - DNA, 13 bp, Homo sapiens
agaatatacctta

SEQ ID NO: 4544010 - DNA, 11 bp, Homo sapiens
agaatatatat

SEQ ID NO: 4544011 - DNA, 15 bp, Homo sapiens
agaatatatatatat

SEQ ID NO: 4544012 - DNA, 16 bp, Homo sapiens
agaatatgacttttta

SEQ ID NO: 4544013 - DNA, 13 bp, Homo sapiens
agaatatgataaa

SEQ ID NO: 4544014 - DNA, 18 bp, Homo sapiens
agaatatgttgctttgaa

SEQ ID NO: 4544015 - DNA, 19 bp, Homo sapiens
agaatatgttgctttgaaa

SEQ ID NO: 4544016 - DNA, 15 bp, Homo sapiens
agaatattaaatatt

SEQ ID NO: 4544017 - DNA, 20 bp, Homo sapiens
agaatattgcccaaataata

SEQ ID NO: 4544018 - DNA, 18 bp, Homo sapiens
agaatattgtattgttag

SEQ ID NO: 4544019 - DNA, 22 bp, Homo sapiens
agaatatttttatatttccttt

SEQ ID NO: 4544020 - DNA, 23 bp, Homo sapiens
agaatatttttatatttccttta

SEQ ID NO: 4544021 - DNA, 16 bp, Homo sapiens
agaatcagaagatagt

SEQ ID NO: 4544022 - DNA, 17 bp, Homo sapiens
agaatcccaaatttgat

SEQ ID NO: 4544023 - DNA, 17 bp, Homo sapiens
agaatcccaatgtttga

SEQ ID NO: 4544024 - DNA, 19 bp, Homo sapiens
agaatccgtattgaatttg

SEQ ID NO: 4544025 - DNA, 23 bp, Homo sapiens
agaatcgtaatgggtatattgat

SEQ ID NO: 4544026 - DNA, 21 bp, Homo sapiens
agaatctagaagatgtgtaaa

SEQ ID NO: 4544027 - DNA, 16 bp, Homo sapiens
agaatctcttcatgct

SEQ ID NO: 4544028 - DNA, 22 bp, Homo sapiens
agaatctcttcatgcttgacat

SEQ ID NO: 4544029 - DNA, 18 bp, Homo sapiens
agaatctgaatgtaattt

SEQ ID NO: 4544030 - DNA, 22 bp, Homo sapiens
agaatcttgttttgaaaataac

SEQ ID NO: 4544031 - DNA, 16 bp, Homo sapiens
agaatgaaatgaatga

SEQ ID NO: 4544032 - DNA, 12 bp, Homo sapiens
agaatgaagggc

SEQ ID NO: 4544033 - DNA, 13 bp, Homo sapiens
agaatgaatatag

SEQ ID NO: 4544034 - DNA, 19 bp, Homo sapiens
agaatgaatttatctttac

SEQ ID NO: 4544035 - DNA, 22 bp, Homo sapiens
agaatgagcagagagcaaagga

SEQ ID NO: 4544036 - DNA, 18 bp, Homo sapiens
agaatgcacagatatact

SEQ ID NO: 4544037 - DNA, 22 bp, Homo sapiens
agaatgcacagatatactttgt

SEQ ID NO: 4544038 - DNA, 20 bp, Homo sapiens
agaatgctgtacatctattt

SEQ ID NO: 4544039 - DNA, 21 bp, Homo sapiens
agaatggaaatttataatata

SEQ ID NO: 4544040 - DNA, 18 bp, Homo sapiens
agaatggaggctcccagg

SEQ ID NO: 4544041 - DNA, 17 bp, Homo sapiens
agaatggtggcttcttt

SEQ ID NO: 4544042 - DNA, 20 bp, Homo sapiens
agaatggtgtgaacccggga

SEQ ID NO: 4544043 - DNA, 12 bp, Homo sapiens
agaatgtaaagt

SEQ ID NO: 4544044 - DNA, 23 bp, Homo sapiens
agaatgtagtcagactgacacta

SEQ ID NO: 4544045 - DNA, 19 bp, Homo sapiens
agaatgtcagtatgtggaa

SEQ ID NO: 4544046 - DNA, 16 bp, Homo sapiens
agaatgtctgaagtac

SEQ ID NO: 4544047 - DNA, 19 bp, Homo sapiens
agaatgtctgaagtacaaa

SEQ ID NO: 4544048 - DNA, 17 bp, Homo sapiens
agaatgtgaaaaaggaa

SEQ ID NO: 4544049 - DNA, 17 bp, Homo sapiens
agaatgttactgcctta

SEQ ID NO: 4544050 - DNA, 17 bp, Homo sapiens
agaatgttattgtgtat

SEQ ID NO: 4544051 - DNA, 23 bp, Homo sapiens
agaatgttgttgtctatttgtct

SEQ ID NO: 4544052 - DNA, 22 bp, Homo sapiens
agaattaagggggttctgtttt

SEQ ID NO: 4544053 - DNA, 15 bp, Homo sapiens
agaattacagactct

SEQ ID NO: 4544054 - DNA, 13 bp, Homo sapiens
agaattactttgt

SEQ ID NO: 4544055 - DNA, 17 bp, Homo sapiens
agaattactttgtgttg

SEQ ID NO: 4544056 - DNA, 14 bp, Homo sapiens
agaattatctaatt

SEQ ID NO: 4544057 - DNA, 17 bp, Homo sapiens
agaattatctaatttat

SEQ ID NO: 4544058 - DNA, 20 bp, Homo sapiens
agaattatctaatttataaa

SEQ ID NO: 4544059 - DNA, 21 bp, Homo sapiens
agaattatctaatttataaaa

SEQ ID NO: 4544060 - DNA, 14 bp, Homo sapiens
agaattcaaaagtg

SEQ ID NO: 4544061 - DNA, 22 bp, Homo sapiens
agaattcaaatttgtaataaaa

SEQ ID NO: 4544062 - DNA, 13 bp, Homo sapiens
agaattcagacat

SEQ ID NO: 4544063 - DNA, 13 bp, Homo sapiens
agaattcattcat

SEQ ID NO: 4544064 - DNA, 18 bp, Homo sapiens
agaattcattcatactta

SEQ ID NO: 4544065 - DNA, 18 bp, Homo sapiens
agaattgaacccaggagg

SEQ ID NO: 4544066 - DNA, 19 bp, Homo sapiens
agaattgtgctttttctcc

SEQ ID NO: 4544067 - DNA, 19 bp, Homo sapiens
agaattgtgtcagactgtt

SEQ ID NO: 4544068 - DNA, 21 bp, Homo sapiens
agaattgttagcaaatgacag

SEQ ID NO: 4544069 - DNA, 19 bp, Homo sapiens
agaatttaccatcatctct

SEQ ID NO: 4544070 - DNA, 17 bp, Homo sapiens
agaatttcctgtaatat

SEQ ID NO: 4544071 - DNA, 13 bp, Homo sapiens
agaatttctaaag

SEQ ID NO: 4544072 - DNA, 19 bp, Homo sapiens
agaatttctaaagtaaaat

SEQ ID NO: 4544073 - DNA, 18 bp, Homo sapiens
agaatttctgctaaatat

SEQ ID NO: 4544074 - DNA, 22 bp, Homo sapiens
agaatttgaagacttcaaaata

SEQ ID NO: 4544075 - DNA, 21 bp, Homo sapiens
agaatttgtgttgaaggaact

SEQ ID NO: 4544076 - DNA, 21 bp, Homo sapiens
agaattttctggcctttcatg

SEQ ID NO: 4544077 - DNA, 22 bp, Homo sapiens
agaattttctggcctttcatgg

SEQ ID NO: 4544078 - DNA, 21 bp, Homo sapiens
agacaaaaacaagtaaatata

SEQ ID NO: 4544079 - DNA, 17 bp, Homo sapiens
agacaaaaacagcctca

SEQ ID NO: 4544080 - DNA, 14 bp, Homo sapiens
agacaaaaagtata

SEQ ID NO: 4544081 - DNA, 19 bp, Homo sapiens
agacaaaaagtatattaaa

SEQ ID NO: 4544082 - DNA, 23 bp, Homo sapiens
agacaaaaagtatattaaacaaa

SEQ ID NO: 4544083 - DNA, 12 bp, Homo sapiens
agacaaaaataa

SEQ ID NO: 4544084 - DNA, 19 bp, Homo sapiens
agacaaaaatatcaatggt

SEQ ID NO: 4544085 - DNA, 13 bp, Homo sapiens
agacaaaatcaaa

SEQ ID NO: 4544086 - DNA, 21 bp, Homo sapiens
agacaaactgtaaaaaatgtg

SEQ ID NO: 4544087 - DNA, 16 bp, Homo sapiens
agacaaagacattatt

SEQ ID NO: 4544088 - DNA, 12 bp, Homo sapiens
agacaaaggcct

SEQ ID NO: 4544089 - DNA, 13 bp, Homo sapiens
agacaaaggcctt

SEQ ID NO: 4544090 - DNA, 20 bp, Homo sapiens
agacaacagaaagagggaca

SEQ ID NO: 4544091 - DNA, 19 bp, Homo sapiens
agacaacaggtaaaacagg

SEQ ID NO: 4544092 - DNA, 15 bp, Homo sapiens
agacaagaacattct

SEQ ID NO: 4544093 - DNA, 20 bp, Homo sapiens
agacaagagatctacacatg

SEQ ID NO: 4544094 - DNA, 22 bp, Homo sapiens
agacaagagatctacacatgtt

SEQ ID NO: 4544095 - DNA, 14 bp, Homo sapiens
agacaagagggcaa

SEQ ID NO: 4544096 - DNA, 18 bp, Homo sapiens
agacaagagggcaagcct

SEQ ID NO: 4544097 - DNA, 12 bp, Homo sapiens
agacaaggtgct

SEQ ID NO: 4544098 - DNA, 14 bp, Homo sapiens
agacaaggtgctaa

SEQ ID NO: 4544099 - DNA, 15 bp, Homo sapiens
agacaagttttgttt

SEQ ID NO: 4544100 - DNA, 22 bp, Homo sapiens
agacaataaaccctcagagcct

SEQ ID NO: 4544101 - DNA, 14 bp, Homo sapiens
agacaataattcta

SEQ ID NO: 4544102 - DNA, 20 bp, Homo sapiens
agacaatagtatttctcctt

SEQ ID NO: 4544103 - DNA, 18 bp, Homo sapiens
agacaattcctccagaga

SEQ ID NO: 4544104 - DNA, 20 bp, Homo sapiens
agacaattcctccagagaca

SEQ ID NO: 4544105 - DNA, 23 bp, Homo sapiens
agacaattcctccagagacactg

SEQ ID NO: 4544106 - DNA, 20 bp, Homo sapiens
agacaattttttttcaaatg

SEQ ID NO: 4544107 - DNA, 21 bp, Homo sapiens
agacacagaatagtttacaca

SEQ ID NO: 4544108 - DNA, 19 bp, Homo sapiens
agacacatgaaggtaaata

SEQ ID NO: 4544109 - DNA, 21 bp, Homo sapiens
agacacatgaaggtaaataaa

SEQ ID NO: 4544110 - DNA, 23 bp, Homo sapiens
agacacatgaaggtaaataaaaa

SEQ ID NO: 4544111 - DNA, 18 bp, Homo sapiens
agacacattatcttctgg

SEQ ID NO: 4544112 - DNA, 14 bp, Homo sapiens
agacacattgcctt

SEQ ID NO: 4544113 - DNA, 16 bp, Homo sapiens
agacacattgccttct

SEQ ID NO: 4544114 - DNA, 22 bp, Homo sapiens
agacacatttttggatttctgt

SEQ ID NO: 4544115 - DNA, 18 bp, Homo sapiens
agacaccatgtgcaataa

SEQ ID NO: 4544116 - DNA, 17 bp, Homo sapiens
agacaccattcattcca

SEQ ID NO: 4544117 - DNA, 20 bp, Homo sapiens
agacacccgattcctgccca

SEQ ID NO: 4544118 - DNA, 16 bp, Homo sapiens
agacaccgtggacagc

SEQ ID NO: 4544119 - DNA, 21 bp, Homo sapiens
agacacctgcacctcccccca

SEQ ID NO: 4544120 - DNA, 15 bp, Homo sapiens
agacacctggactga

SEQ ID NO: 4544121 - DNA, 17 bp, Homo sapiens
agacacctggactgagc

SEQ ID NO: 4544122 - DNA, 21 bp, Homo sapiens
agacacgctggcgacacactc

SEQ ID NO: 4544123 - DNA, 13 bp, Homo sapiens
agacactttggaa

SEQ ID NO: 4544124 - DNA, 15 bp, Homo sapiens
agacagaagaaacaa

SEQ ID NO: 4544125 - DNA, 14 bp, Homo sapiens
agacagagacaagt

SEQ ID NO: 4544126 - DNA, 15 bp, Homo sapiens
agacagagacaagta

SEQ ID NO: 4544127 - DNA, 24 bp, Homo sapiens
agacagatgagcaggagcttgggt

SEQ ID NO: 4544128 - DNA, 16 bp, Homo sapiens
agacagatgccccaga

SEQ ID NO: 4544129 - DNA, 17 bp, Homo sapiens
agacagatgctggtgga

SEQ ID NO: 4544130 - DNA, 14 bp, Homo sapiens
agacagcagacaaa

SEQ ID NO: 4544131 - DNA, 13 bp, Homo sapiens
agacagcagcagc

SEQ ID NO: 4544132 - DNA, 14 bp, Homo sapiens
agacagcagcagcc

SEQ ID NO: 4544133 - DNA, 17 bp, Homo sapiens
agacagcagcagcctgc

SEQ ID NO: 4544134 - DNA, 22 bp, Homo sapiens
agacagccaggtggcacctgca

SEQ ID NO: 4544135 - DNA, 22 bp, Homo sapiens
agacagcccaggatactggcac

SEQ ID NO: 4544136 - DNA, 19 bp, Homo sapiens
agacagcctgtttctatcc

SEQ ID NO: 4544137 - DNA, 21 bp, Homo sapiens
agacaggaatttagaaaaagt

SEQ ID NO: 4544138 - DNA, 20 bp, Homo sapiens
agacaggacagaatgtgttc

SEQ ID NO: 4544139 - DNA, 14 bp, Homo sapiens
agacaggagaatca

SEQ ID NO: 4544140 - DNA, 14 bp, Homo sapiens
agacaggagcctag

SEQ ID NO: 4544141 - DNA, 18 bp, Homo sapiens
agacaggcagcccagcag

SEQ ID NO: 4544142 - DNA, 19 bp, Homo sapiens
agacaggccctccctgtct

SEQ ID NO: 4544143 - DNA, 15 bp, Homo sapiens
agacaggctggaaga

SEQ ID NO: 4544144 - DNA, 14 bp, Homo sapiens
agacaggctgggtc

SEQ ID NO: 4544145 - DNA, 16 bp, Homo sapiens
agacagggtgggaggg

SEQ ID NO: 4544146 - DNA, 23 bp, Homo sapiens
agacagggtttcaccatgttgcc

SEQ ID NO: 4544147 - DNA, 14 bp, Homo sapiens
agacaggtgaggcg

SEQ ID NO: 4544148 - DNA, 18 bp, Homo sapiens
agacagtcgctcagtctg

SEQ ID NO: 4544149 - DNA, 14 bp, Homo sapiens
agacagtgaatttg

SEQ ID NO: 4544150 - DNA, 14 bp, Homo sapiens
agacatagaattaa

SEQ ID NO: 4544151 - DNA, 19 bp, Homo sapiens
agacatatcactgctgctg

SEQ ID NO: 4544152 - DNA, 21 bp, Homo sapiens
agacatatcactgctgctggg

SEQ ID NO: 4544153 - DNA, 21 bp, Homo sapiens
agacatatttcagtgattttt

SEQ ID NO: 4544154 - DNA, 18 bp, Homo sapiens
agacatcaacagataaat

SEQ ID NO: 4544155 - DNA, 23 bp, Homo sapiens
agacatcagtctccaacatgttt

SEQ ID NO: 4544156 - DNA, 13 bp, Homo sapiens
agacatctgcctg

SEQ ID NO: 4544157 - DNA, 17 bp, Homo sapiens
agacatctgcctgtaat

SEQ ID NO: 4544158 - DNA, 15 bp, Homo sapiens
agacatggagatgta

SEQ ID NO: 4544159 - DNA, 14 bp, Homo sapiens
agacattctcacat

SEQ ID NO: 4544160 - DNA, 23 bp, Homo sapiens
agacattgctctatgtctgcctt

SEQ ID NO: 4544161 - DNA, 14 bp, Homo sapiens
agacatttaaagac

SEQ ID NO: 4544162 - DNA, 14 bp, Homo sapiens
agacatttatcttt

SEQ ID NO: 4544163 - DNA, 21 bp, Homo sapiens
agacatttatctttgtattct

SEQ ID NO: 4544164 - DNA, 13 bp, Homo sapiens
agacatttcaaaa

SEQ ID NO: 4544165 - DNA, 10 bp, Homo sapiens
agacatttct

SEQ ID NO: 4544166 - DNA, 21 bp, Homo sapiens
agacatttgctatgagctggg

SEQ ID NO: 4544167 - DNA, 23 bp, Homo sapiens
agacatttgctgaactcagcaca

SEQ ID NO: 4544168 - DNA, 19 bp, Homo sapiens
agacattttaaaaaatggt

SEQ ID NO: 4544169 - DNA, 22 bp, Homo sapiens
agacattttaaaaaatggtcac

SEQ ID NO: 4544170 - DNA, 23 bp, Homo sapiens
agacattttccgcccactcctgg

SEQ ID NO: 4544171 - DNA, 12 bp, Homo sapiens
agacattttgtt

SEQ ID NO: 4544172 - DNA, 18 bp, Homo sapiens
agacattttgtttttact

SEQ ID NO: 4544173 - DNA, 19 bp, Homo sapiens
agacattttgtttttactg

SEQ ID NO: 4544174 - DNA, 21 bp, Homo sapiens
agacattttgtttttactgta

SEQ ID NO: 4544175 - DNA, 22 bp, Homo sapiens
agacattttgtttttactgtat

SEQ ID NO: 4544176 - DNA, 14 bp, Homo sapiens
agacatttttcatt

SEQ ID NO: 4544177 - DNA, 15 bp, Homo sapiens
agacattttttaaaa

SEQ ID NO: 4544178 - DNA, 14 bp, Homo sapiens
agaccaacttttca

SEQ ID NO: 4544179 - DNA, 15 bp, Homo sapiens
agaccacacatttta

SEQ ID NO: 4544180 - DNA, 20 bp, Homo sapiens
agaccacccaacctcaccct

SEQ ID NO: 4544181 - DNA, 17 bp, Homo sapiens
agaccacccatatcatg

SEQ ID NO: 4544182 - DNA, 14 bp, Homo sapiens
agaccagaaattcc

SEQ ID NO: 4544183 - DNA, 18 bp, Homo sapiens
agaccagagctgtctgaa

SEQ ID NO: 4544184 - DNA, 14 bp, Homo sapiens
agaccagggatgct

SEQ ID NO: 4544185 - DNA, 16 bp, Homo sapiens
agaccagggtggccac

SEQ ID NO: 4544186 - DNA, 17 bp, Homo sapiens
agaccagggtggccaca

SEQ ID NO: 4544187 - DNA, 18 bp, Homo sapiens
agaccagggtggccacac

SEQ ID NO: 4544188 - DNA, 20 bp, Homo sapiens
agaccatgtggtttgctgtt

SEQ ID NO: 4544189 - DNA, 19 bp, Homo sapiens
agaccattggggctcccag

SEQ ID NO: 4544190 - DNA, 14 bp, Homo sapiens
agacccaaggagga

SEQ ID NO: 4544191 - DNA, 16 bp, Homo sapiens
agacccaaggaggaaa

SEQ ID NO: 4544192 - DNA, 16 bp, Homo sapiens
agacccagaggtccag

SEQ ID NO: 4544193 - DNA, 17 bp, Homo sapiens
agacccagccctcatcc

SEQ ID NO: 4544194 - DNA, 15 bp, Homo sapiens
agacccagcggtcca

SEQ ID NO: 4544195 - DNA, 13 bp, Homo sapiens
agacccaggagtc

SEQ ID NO: 4544196 - DNA, 19 bp, Homo sapiens
agacccaggagtccagccc

SEQ ID NO: 4544197 - DNA, 22 bp, Homo sapiens
agacccagtagctgcccttcct

SEQ ID NO: 4544198 - DNA, 18 bp, Homo sapiens
agaccccaagaggaagtt

SEQ ID NO: 4544199 - DNA, 17 bp, Homo sapiens
agacccccatttgtccc

SEQ ID NO: 4544200 - DNA, 16 bp, Homo sapiens
agaccccccagcccct

SEQ ID NO: 4544201 - DNA, 22 bp, Homo sapiens
agaccccccagcccctcctccc

SEQ ID NO: 4544202 - DNA, 18 bp, Homo sapiens
agacccccccccaactcc

SEQ ID NO: 4544203 - DNA, 16 bp, Homo sapiens
agacccctcagcccca

SEQ ID NO: 4544204 - DNA, 13 bp, Homo sapiens
agacccctgcctg

SEQ ID NO: 4544205 - DNA, 14 bp, Homo sapiens
agacccctggcctc

SEQ ID NO: 4544206 - DNA, 16 bp, Homo sapiens
agacccctggcctccg

SEQ ID NO: 4544207 - DNA, 12 bp, Homo sapiens
agaccctgaggc

SEQ ID NO: 4544208 - DNA, 15 bp, Homo sapiens
agaccctgccacagc

SEQ ID NO: 4544209 - DNA, 16 bp, Homo sapiens
agaccctgccacagcc

SEQ ID NO: 4544210 - DNA, 17 bp, Homo sapiens
agaccctgccacagcca

SEQ ID NO: 4544211 - DNA, 19 bp, Homo sapiens
agaccctgccacagccaga

SEQ ID NO: 4544212 - DNA, 20 bp, Homo sapiens
agaccctgccacagccagag

SEQ ID NO: 4544213 - DNA, 17 bp, Homo sapiens
agaccctgggagagaag

SEQ ID NO: 4544214 - DNA, 16 bp, Homo sapiens
agacctagcaggctgt

SEQ ID NO: 4544215 - DNA, 20 bp, Homo sapiens
agacctcagtgccttcctgt

SEQ ID NO: 4544216 - DNA, 13 bp, Homo sapiens
agacctcatcctg

SEQ ID NO: 4544217 - DNA, 22 bp, Homo sapiens
agacctgccagccactgtcacc

SEQ ID NO: 4544218 - DNA, 17 bp, Homo sapiens
agacctggctccactct

SEQ ID NO: 4544219 - DNA, 11 bp, Homo sapiens
agaccttaccc

SEQ ID NO: 4544220 - DNA, 21 bp, Homo sapiens
agaccttttttttttttccaa

SEQ ID NO: 4544221 - DNA, 20 bp, Homo sapiens
agacgcacacagctgagcac

SEQ ID NO: 4544222 - DNA, 23 bp, Homo sapiens
agacgccggcttcctccttccag

SEQ ID NO: 4544223 - DNA, 22 bp, Homo sapiens
agacgccggggacagaggcctg

SEQ ID NO: 4544224 - DNA, 17 bp, Homo sapiens
agacggagtgtgggagt

SEQ ID NO: 4544225 - DNA, 22 bp, Homo sapiens
agacggagtttcgctcttggtg

SEQ ID NO: 4544226 - DNA, 16 bp, Homo sapiens
agacggggcctcacta

SEQ ID NO: 4544227 - DNA, 13 bp, Homo sapiens
agacggtctgtgt

SEQ ID NO: 4544228 - DNA, 17 bp, Homo sapiens
agacgtgattttgctgt

SEQ ID NO: 4544229 - DNA, 22 bp, Homo sapiens
agacgtttttgtgctgtgggca

SEQ ID NO: 4544230 - DNA, 18 bp, Homo sapiens
agactaaaggatccagag

SEQ ID NO: 4544231 - DNA, 13 bp, Homo sapiens
agactagagaaac

SEQ ID NO: 4544232 - DNA, 15 bp, Homo sapiens
agactagagcaaaat

SEQ ID NO: 4544233 - DNA, 17 bp, Homo sapiens
agactagagcaaaataa

SEQ ID NO: 4544234 - DNA, 23 bp, Homo sapiens
agactagatgtagtattttttgt

SEQ ID NO: 4544235 - DNA, 15 bp, Homo sapiens
agactagcctggcca

SEQ ID NO: 4544236 - DNA, 14 bp, Homo sapiens
agactatggcctcg

SEQ ID NO: 4544237 - DNA, 23 bp, Homo sapiens
agactatggcctcgcctccccac

SEQ ID NO: 4544238 - DNA, 12 bp, Homo sapiens
agactattcaaa

SEQ ID NO: 4544239 - DNA, 12 bp, Homo sapiens
agactatttgct

SEQ ID NO: 4544240 - DNA, 15 bp, Homo sapiens
agactatttgctaat

SEQ ID NO: 4544241 - DNA, 13 bp, Homo sapiens
agactattttcta

SEQ ID NO: 4544242 - DNA, 14 bp, Homo sapiens
agactatttttcta

SEQ ID NO: 4544243 - DNA, 15 bp, Homo sapiens
agactcaaaacctgg

SEQ ID NO: 4544244 - DNA, 19 bp, Homo sapiens
agactcaaaacctggagat

SEQ ID NO: 4544245 - DNA, 16 bp, Homo sapiens
agactcacctctgcct

SEQ ID NO: 4544246 - DNA, 19 bp, Homo sapiens
agactcagaggtccaggcc

SEQ ID NO: 4544247 - DNA, 20 bp, Homo sapiens
agactcagatgaggacagag

SEQ ID NO: 4544248 - DNA, 19 bp, Homo sapiens
agactcaggagtctgccac

SEQ ID NO: 4544249 - DNA, 20 bp, Homo sapiens
agactcaggagtctgccact

SEQ ID NO: 4544250 - DNA, 19 bp, Homo sapiens
agactcaggccaagaaacg

SEQ ID NO: 4544251 - DNA, 20 bp, Homo sapiens
agactcaggccaagaaacgt

SEQ ID NO: 4544252 - DNA, 17 bp, Homo sapiens
agactcaggttccagaa

SEQ ID NO: 4544253 - DNA, 13 bp, Homo sapiens
agactccaaagaa

SEQ ID NO: 4544254 - DNA, 14 bp, Homo sapiens
agactccaaagaaa

SEQ ID NO: 4544255 - DNA, 22 bp, Homo sapiens
agactccaaagaaatgtaaggg

SEQ ID NO: 4544256 - DNA, 18 bp, Homo sapiens
agactccatctcttctgc

SEQ ID NO: 4544257 - DNA, 16 bp, Homo sapiens
agactcccatgaagcc

SEQ ID NO: 4544258 - DNA, 18 bp, Homo sapiens
agactcccatgaagcctt

SEQ ID NO: 4544259 - DNA, 14 bp, Homo sapiens
agactccctccata

SEQ ID NO: 4544260 - DNA, 23 bp, Homo sapiens
agactcctcctccaaaggccccc

SEQ ID NO: 4544261 - DNA, 17 bp, Homo sapiens
agactccttcaacaatt

SEQ ID NO: 4544262 - DNA, 18 bp, Homo sapiens
agactccttcgtccccag

SEQ ID NO: 4544263 - DNA, 13 bp, Homo sapiens
agactctaagata

SEQ ID NO: 4544264 - DNA, 15 bp, Homo sapiens
agactctagggtcca

SEQ ID NO: 4544265 - DNA, 15 bp, Homo sapiens
agactctagtattta

SEQ ID NO: 4544266 - DNA, 12 bp, Homo sapiens
agactctcacag

SEQ ID NO: 4544267 - DNA, 15 bp, Homo sapiens
agactctgtgtggct

SEQ ID NO: 4544268 - DNA, 22 bp, Homo sapiens
agactctgtgtggctgtgcaat

SEQ ID NO: 4544269 - DNA, 24 bp, Homo sapiens
agactgaatagatatgaaagctga

SEQ ID NO: 4544270 - DNA, 22 bp, Homo sapiens
agactgaccaatattgtacagt

SEQ ID NO: 4544271 - DNA, 21 bp, Homo sapiens
agactgataacttggggaggc

SEQ ID NO: 4544272 - DNA, 16 bp, Homo sapiens
agactgatgagcacat

SEQ ID NO: 4544273 - DNA, 12 bp, Homo sapiens
agactgattacc

SEQ ID NO: 4544274 - DNA, 15 bp, Homo sapiens
agactgcaagagatg

SEQ ID NO: 4544275 - DNA, 21 bp, Homo sapiens
agactgcaatgtgatctatgt

SEQ ID NO: 4544276 - DNA, 14 bp, Homo sapiens
agactgctcccggc

SEQ ID NO: 4544277 - DNA, 20 bp, Homo sapiens
agactggaagctaatttgca

SEQ ID NO: 4544278 - DNA, 14 bp, Homo sapiens
agactggcacagtt

SEQ ID NO: 4544279 - DNA, 15 bp, Homo sapiens
agactggcacagttt

SEQ ID NO: 4544280 - DNA, 23 bp, Homo sapiens
agactggcacagttttctgagaa

SEQ ID NO: 4544281 - DNA, 18 bp, Homo sapiens
agactggcttttattaat

SEQ ID NO: 4544282 - DNA, 19 bp, Homo sapiens
agactgggaaggcttggga

SEQ ID NO: 4544283 - DNA, 17 bp, Homo sapiens
agactgggccccacatg

SEQ ID NO: 4544284 - DNA, 14 bp, Homo sapiens
agactgggctgagg

SEQ ID NO: 4544285 - DNA, 15 bp, Homo sapiens
agactgtccagggaa

SEQ ID NO: 4544286 - DNA, 16 bp, Homo sapiens
agactgtgattcagaa

SEQ ID NO: 4544287 - DNA, 18 bp, Homo sapiens
agactgtggaaatgccaa

SEQ ID NO: 4544288 - DNA, 14 bp, Homo sapiens
agactgtttcacat

SEQ ID NO: 4544289 - DNA, 16 bp, Homo sapiens
agacttaatttcaaat

SEQ ID NO: 4544290 - DNA, 23 bp, Homo sapiens
agacttacagggataaggcctgt

SEQ ID NO: 4544291 - DNA, 17 bp, Homo sapiens
agacttcaaaatattga

SEQ ID NO: 4544292 - DNA, 17 bp, Homo sapiens
agacttccaaatcctgg

SEQ ID NO: 4544293 - DNA, 22 bp, Homo sapiens
agacttcccactgttctgaaag

SEQ ID NO: 4544294 - DNA, 20 bp, Homo sapiens
agacttccccatcccgaagc

SEQ ID NO: 4544295 - DNA, 19 bp, Homo sapiens
agacttctcggaattcata

SEQ ID NO: 4544296 - DNA, 16 bp, Homo sapiens
agacttgctccctctc

SEQ ID NO: 4544297 - DNA, 19 bp, Homo sapiens
agacttgctccctctccaa

SEQ ID NO: 4544298 - DNA, 20 bp, Homo sapiens
agacttgctccctctccaag

SEQ ID NO: 4544299 - DNA, 22 bp, Homo sapiens
agacttgctccctctccaagac

SEQ ID NO: 4544300 - DNA, 14 bp, Homo sapiens
agactttaattata

SEQ ID NO: 4544301 - DNA, 17 bp, Homo sapiens
agactttacaaaccttt

SEQ ID NO: 4544302 - DNA, 19 bp, Homo sapiens
agactttacaaacctttgt

SEQ ID NO: 4544303 - DNA, 17 bp, Homo sapiens
agactttatgtagtttt

SEQ ID NO: 4544304 - DNA, 12 bp, Homo sapiens
agactttcttct

SEQ ID NO: 4544305 - DNA, 23 bp, Homo sapiens
agactttctttttctacatgtga

SEQ ID NO: 4544306 - DNA, 16 bp, Homo sapiens
agactttgctgttact

SEQ ID NO: 4544307 - DNA, 17 bp, Homo sapiens
agactttgctgttactg

SEQ ID NO: 4544308 - DNA, 22 bp, Homo sapiens
agactttgctgttactgcttct

SEQ ID NO: 4544309 - DNA, 15 bp, Homo sapiens
agacttttatgtgag

SEQ ID NO: 4544310 - DNA, 17 bp, Homo sapiens
agacttttatgtgagat

SEQ ID NO: 4544311 - DNA, 13 bp, Homo sapiens
agacttttgaaaa

SEQ ID NO: 4544312 - DNA, 21 bp, Homo sapiens
agagaaaaaaagtttgccaga

SEQ ID NO: 4544313 - DNA, 14 bp, Homo sapiens
agagaaaatatatg

SEQ ID NO: 4544314 - DNA, 15 bp, Homo sapiens
agagaaaatatatgt

SEQ ID NO: 4544315 - DNA, 23 bp, Homo sapiens
agagaaaatatatgtatttttat

SEQ ID NO: 4544316 - DNA, 13 bp, Homo sapiens
agagaaaattcct

SEQ ID NO: 4544317 - DNA, 16 bp, Homo sapiens
agagaaacagttggta

SEQ ID NO: 4544318 - DNA, 20 bp, Homo sapiens
agagaaaccgtcctcttttt

SEQ ID NO: 4544319 - DNA, 23 bp, Homo sapiens
agagaaaccgtcctctttttcca

SEQ ID NO: 4544320 - DNA, 10 bp, Homo sapiens
agagaaactt

SEQ ID NO: 4544321 - DNA, 16 bp, Homo sapiens
agagaaagaaagggaa

SEQ ID NO: 4544322 - DNA, 16 bp, Homo sapiens
agagaaagaaatagaa

SEQ ID NO: 4544323 - DNA, 14 bp, Homo sapiens
agagaaatacaaaa

SEQ ID NO: 4544324 - DNA, 21 bp, Homo sapiens
agagaacagtattgggcagga

SEQ ID NO: 4544325 - DNA, 18 bp, Homo sapiens
agagaactactaaggaaa

SEQ ID NO: 4544326 - DNA, 19 bp, Homo sapiens
agagaactactaaggaaaa

SEQ ID NO: 4544327 - DNA, 20 bp, Homo sapiens
agagaagccccttccccatg

SEQ ID NO: 4544328 - DNA, 23 bp, Homo sapiens
agagaagccccttccccatggga

SEQ ID NO: 4544329 - DNA, 13 bp, Homo sapiens
agagaaggaaaag

SEQ ID NO: 4544330 - DNA, 22 bp, Homo sapiens
agagaaggaatcttcagaacaa

SEQ ID NO: 4544331 - DNA, 18 bp, Homo sapiens
agagaaggagcagaaaga

SEQ ID NO: 4544332 - DNA, 12 bp, Homo sapiens
agagaagttgta

SEQ ID NO: 4544333 - DNA, 13 bp, Homo sapiens
agagaataaattg

SEQ ID NO: 4544334 - DNA, 19 bp, Homo sapiens
agagaatgcacagatatac

SEQ ID NO: 4544335 - DNA, 18 bp, Homo sapiens
agagacacctgcacctcc

SEQ ID NO: 4544336 - DNA, 19 bp, Homo sapiens
agagacacctgcacctccc

SEQ ID NO: 4544337 - DNA, 20 bp, Homo sapiens
agagacacctgcacctcccc

SEQ ID NO: 4544338 - DNA, 21 bp, Homo sapiens
agagacacctgcacctccccc

SEQ ID NO: 4544339 - DNA, 22 bp, Homo sapiens
agagacacctgcacctcccccc

SEQ ID NO: 4544340 - DNA, 15 bp, Homo sapiens
agagacagaaagcag

SEQ ID NO: 4544341 - DNA, 24 bp, Homo sapiens
agagacagaaagcagaacagtgat

SEQ ID NO: 4544342 - DNA, 12 bp, Homo sapiens
agagacagagtt

SEQ ID NO: 4544343 - DNA, 16 bp, Homo sapiens
agagacagcccaggat

SEQ ID NO: 4544344 - DNA, 18 bp, Homo sapiens
agagacagcccaggatac

SEQ ID NO: 4544345 - DNA, 15 bp, Homo sapiens
agagaccacacattt

SEQ ID NO: 4544346 - DNA, 19 bp, Homo sapiens
agagaccacccatatcatg

SEQ ID NO: 4544347 - DNA, 16 bp, Homo sapiens
agagacccaaggagga

SEQ ID NO: 4544348 - DNA, 15 bp, Homo sapiens
agagacctcatcctg

SEQ ID NO: 4544349 - DNA, 15 bp, Homo sapiens
agagacgccactccc

SEQ ID NO: 4544350 - DNA, 20 bp, Homo sapiens
agagacgccctatttctatg

SEQ ID NO: 4544351 - DNA, 15 bp, Homo sapiens
agagacggtgttttg

SEQ ID NO: 4544352 - DNA, 20 bp, Homo sapiens
agagactcccatgaagcctt

SEQ ID NO: 4544353 - DNA, 21 bp, Homo sapiens
agagactcccatgaagccttt

SEQ ID NO: 4544354 - DNA, 22 bp, Homo sapiens
agagactgagcagccgccagct

SEQ ID NO: 4544355 - DNA, 22 bp, Homo sapiens
agagactgcgttctgcaagcat

SEQ ID NO: 4544356 - DNA, 13 bp, Homo sapiens
agagagaaagaga

SEQ ID NO: 4544357 - DNA, 19 bp, Homo sapiens
agagagacctcatcctgct

SEQ ID NO: 4544358 - DNA, 15 bp, Homo sapiens
agagagagagaaaga

SEQ ID NO: 4544359 - DNA, 15 bp, Homo sapiens
agagagagagagaga

SEQ ID NO: 4544360 - DNA, 14 bp, Homo sapiens
agagagagtgtttg

SEQ ID NO: 4544361 - DNA, 18 bp, Homo sapiens
agagagataaaaggtgga

SEQ ID NO: 4544362 - DNA, 12 bp, Homo sapiens
agagagatgaga

SEQ ID NO: 4544363 - DNA, 18 bp, Homo sapiens
agagagatgagaaagctt

SEQ ID NO: 4544364 - DNA, 14 bp, Homo sapiens
agagagcagcattc

SEQ ID NO: 4544365 - DNA, 23 bp, Homo sapiens
agagagcagctccctttctcagg

SEQ ID NO: 4544366 - DNA, 22 bp, Homo sapiens
agagagccctgggtgacttcag

SEQ ID NO: 4544367 - DNA, 11 bp, Homo sapiens
agagagccctt

SEQ ID NO: 4544368 - DNA, 18 bp, Homo sapiens
agagagcccttcccaggg

SEQ ID NO: 4544369 - DNA, 17 bp, Homo sapiens
agagagcttcctcccct

SEQ ID NO: 4544370 - DNA, 13 bp, Homo sapiens
agagaggacagct

SEQ ID NO: 4544371 - DNA, 18 bp, Homo sapiens
agagaggatacatttaat

SEQ ID NO: 4544372 - DNA, 19 bp, Homo sapiens
agagagtctccaagagaac

SEQ ID NO: 4544373 - DNA, 21 bp, Homo sapiens
agagagttaataggagtattt

SEQ ID NO: 4544374 - DNA, 21 bp, Homo sapiens
agagataaaccaataaatcca

SEQ ID NO: 4544375 - DNA, 21 bp, Homo sapiens
agagatagcttctcttctttc

SEQ ID NO: 4544376 - DNA, 21 bp, Homo sapiens
agagataggaaactgaagcat

SEQ ID NO: 4544377 - DNA, 21 bp, Homo sapiens
agagatatttaggaaaatgct

SEQ ID NO: 4544378 - DNA, 16 bp, Homo sapiens
agagatattttgtaaa

SEQ ID NO: 4544379 - DNA, 14 bp, Homo sapiens
agagatcaaagatg

SEQ ID NO: 4544380 - DNA, 15 bp, Homo sapiens
agagatcaaagatga

SEQ ID NO: 4544381 - DNA, 15 bp, Homo sapiens
agagatccctgcaga

SEQ ID NO: 4544382 - DNA, 19 bp, Homo sapiens
agagatctacacatgttgc

SEQ ID NO: 4544383 - DNA, 15 bp, Homo sapiens
agagatctcccttct

SEQ ID NO: 4544384 - DNA, 19 bp, Homo sapiens
agagatctttctttccaaa

SEQ ID NO: 4544385 - DNA, 19 bp, Homo sapiens
agagatgagcccaccctgc

SEQ ID NO: 4544386 - DNA, 12 bp, Homo sapiens
agagatgattca

SEQ ID NO: 4544387 - DNA, 14 bp, Homo sapiens
agagatgcaatgat

SEQ ID NO: 4544388 - DNA, 16 bp, Homo sapiens
agagatgcctccaccg

SEQ ID NO: 4544389 - DNA, 14 bp, Homo sapiens
agagatgcttggag

SEQ ID NO: 4544390 - DNA, 14 bp, Homo sapiens
agagatgtgcaccc

SEQ ID NO: 4544391 - DNA, 15 bp, Homo sapiens
agagatgtgcaccca

SEQ ID NO: 4544392 - DNA, 16 bp, Homo sapiens
agagattcattttcta

SEQ ID NO: 4544393 - DNA, 20 bp, Homo sapiens
agagattggatcaagtatta

SEQ ID NO: 4544394 - DNA, 22 bp, Homo sapiens
agagattgtggtggtgctaaag

SEQ ID NO: 4544395 - DNA, 20 bp, Homo sapiens
agagcaaagatggcttccgt

SEQ ID NO: 4544396 - DNA, 18 bp, Homo sapiens
agagcaaagggaaatcaa

SEQ ID NO: 4544397 - DNA, 23 bp, Homo sapiens
agagcaagagtctgtctcaaaaa

SEQ ID NO: 4544398 - DNA, 19 bp, Homo sapiens
agagcaaggtcatgaagga

SEQ ID NO: 4544399 - DNA, 22 bp, Homo sapiens
agagcaccccctgctccaccag

SEQ ID NO: 4544400 - DNA, 21 bp, Homo sapiens
agagcacggtcccccaggagg

SEQ ID NO: 4544401 - DNA, 22 bp, Homo sapiens
agagcacggtcccccaggaggc

SEQ ID NO: 4544402 - DNA, 17 bp, Homo sapiens
agagcagaaggaaggat

SEQ ID NO: 4544403 - DNA, 16 bp, Homo sapiens
agagcagcagcaccaa

SEQ ID NO: 4544404 - DNA, 20 bp, Homo sapiens
agagcagctccctttctcag

SEQ ID NO: 4544405 - DNA, 21 bp, Homo sapiens
agagcagctccctttctcagg

SEQ ID NO: 4544406 - DNA, 17 bp, Homo sapiens
agagcaggactccaggc

SEQ ID NO: 4544407 - DNA, 16 bp, Homo sapiens
agagcaggggctccag

SEQ ID NO: 4544408 - DNA, 17 bp, Homo sapiens
agagcaggggctccagc

SEQ ID NO: 4544409 - DNA, 17 bp, Homo sapiens
agagcagtcagagtcca

SEQ ID NO: 4544410 - DNA, 19 bp, Homo sapiens
agagcagtcagagtccagt

SEQ ID NO: 4544411 - DNA, 20 bp, Homo sapiens
agagcagtgaagactagaaa

SEQ ID NO: 4544412 - DNA, 17 bp, Homo sapiens
agagcatctgccccagg

SEQ ID NO: 4544413 - DNA, 10 bp, Homo sapiens
agagccacct

SEQ ID NO: 4544414 - DNA, 16 bp, Homo sapiens
agagccacctgcaaga

SEQ ID NO: 4544415 - DNA, 18 bp, Homo sapiens
agagccacctgcaagatg

SEQ ID NO: 4544416 - DNA, 19 bp, Homo sapiens
agagccacctgcaagatgg

SEQ ID NO: 4544417 - DNA, 12 bp, Homo sapiens
agagccagccct

SEQ ID NO: 4544418 - DNA, 16 bp, Homo sapiens
agagccagccctccct

SEQ ID NO: 4544419 - DNA, 17 bp, Homo sapiens
agagccagccctccctg

SEQ ID NO: 4544420 - DNA, 22 bp, Homo sapiens
agagccagccctccctgtcctc

SEQ ID NO: 4544421 - DNA, 17 bp, Homo sapiens
agagccagcctggctct

SEQ ID NO: 4544422 - DNA, 20 bp, Homo sapiens
agagccagcctggctctgcc

SEQ ID NO: 4544423 - DNA, 19 bp, Homo sapiens
agagccagcggctccaact

SEQ ID NO: 4544424 - DNA, 14 bp, Homo sapiens
agagccagggcagg

SEQ ID NO: 4544425 - DNA, 18 bp, Homo sapiens
agagcccaaggtcaggga

SEQ ID NO: 4544426 - DNA, 16 bp, Homo sapiens
agagccccaagcagga

SEQ ID NO: 4544427 - DNA, 20 bp, Homo sapiens
agagccctgctgtgggagag

SEQ ID NO: 4544428 - DNA, 17 bp, Homo sapiens
agagcccttcccagggc

SEQ ID NO: 4544429 - DNA, 14 bp, Homo sapiens
agagcccttgcctc

SEQ ID NO: 4544430 - DNA, 23 bp, Homo sapiens
agagccgggaggaaaaggcccct

SEQ ID NO: 4544431 - DNA, 15 bp, Homo sapiens
agagcctctggcccc

SEQ ID NO: 4544432 - DNA, 15 bp, Homo sapiens
agagcctgaatttgt

SEQ ID NO: 4544433 - DNA, 16 bp, Homo sapiens
agagcctgaatttgta

SEQ ID NO: 4544434 - DNA, 14 bp, Homo sapiens
agagcctgagggat

SEQ ID NO: 4544435 - DNA, 15 bp, Homo sapiens
agagcctgctccccc

SEQ ID NO: 4544436 - DNA, 16 bp, Homo sapiens
agagcctgctccccca

SEQ ID NO: 4544437 - DNA, 18 bp, Homo sapiens
agagcctgctcccccacc

SEQ ID NO: 4544438 - DNA, 19 bp, Homo sapiens
agagcctgctcccccaccc

SEQ ID NO: 4544439 - DNA, 12 bp, Homo sapiens
agagcctgctgc

SEQ ID NO: 4544440 - DNA, 17 bp, Homo sapiens
agagcctgctgcatggg

SEQ ID NO: 4544441 - DNA, 16 bp, Homo sapiens
agagcctggccccagg

SEQ ID NO: 4544442 - DNA, 12 bp, Homo sapiens
agagcctgtgga

SEQ ID NO: 4544443 - DNA, 18 bp, Homo sapiens
agagcctgtggaggggct

SEQ ID NO: 4544444 - DNA, 20 bp, Homo sapiens
agagcctgtggaggggcttg

SEQ ID NO: 4544445 - DNA, 13 bp, Homo sapiens
agagccttagcag

SEQ ID NO: 4544446 - DNA, 22 bp, Homo sapiens
agagccttagcagccctggatg

SEQ ID NO: 4544447 - DNA, 15 bp, Homo sapiens
agagccttctcagaa

SEQ ID NO: 4544448 - DNA, 16 bp, Homo sapiens
agagccttctcagaag

SEQ ID NO: 4544449 - DNA, 21 bp, Homo sapiens
agagccttggtgtccacctgg

SEQ ID NO: 4544450 - DNA, 21 bp, Homo sapiens
agagcgaggaaaggattttac

SEQ ID NO: 4544451 - DNA, 20 bp, Homo sapiens
agagcgccaggaagccagag

SEQ ID NO: 4544452 - DNA, 22 bp, Homo sapiens
agagcggtatctctggcaccac

SEQ ID NO: 4544453 - DNA, 20 bp, Homo sapiens
agagctaataaatctcttct

SEQ ID NO: 4544454 - DNA, 21 bp, Homo sapiens
agagctaataaatctcttctt

SEQ ID NO: 4544455 - DNA, 11 bp, Homo sapiens
agagctacata

SEQ ID NO: 4544456 - DNA, 16 bp, Homo sapiens
agagctacgtatttaa

SEQ ID NO: 4544457 - DNA, 16 bp, Homo sapiens
agagctagaacctgga

SEQ ID NO: 4544458 - DNA, 18 bp, Homo sapiens
agagctattttagaaagc

SEQ ID NO: 4544459 - DNA, 19 bp, Homo sapiens
agagctattttagaaagct

SEQ ID NO: 4544460 - DNA, 21 bp, Homo sapiens
agagctattttagaaagctaa

SEQ ID NO: 4544461 - DNA, 12 bp, Homo sapiens
agagctcttggc

SEQ ID NO: 4544462 - DNA, 10 bp, Homo sapiens
agagctgagt

SEQ ID NO: 4544463 - DNA, 13 bp, Homo sapiens
agagctgccctcc

SEQ ID NO: 4544464 - DNA, 22 bp, Homo sapiens
agagctggagcccccagcagag

SEQ ID NO: 4544465 - DNA, 23 bp, Homo sapiens
agagctggagcccccagcagagg

SEQ ID NO: 4544466 - DNA, 17 bp, Homo sapiens
agagctggcgctcagca

SEQ ID NO: 4544467 - DNA, 20 bp, Homo sapiens
agagctggcgctcagcagcc

SEQ ID NO: 4544468 - DNA, 16 bp, Homo sapiens
agagctggtgcccgga

SEQ ID NO: 4544469 - DNA, 23 bp, Homo sapiens
agagctggtggtgcagccttccc

SEQ ID NO: 4544470 - DNA, 21 bp, Homo sapiens
agagcttggacagtctgagct

SEQ ID NO: 4544471 - DNA, 23 bp, Homo sapiens
agagcttgttgtctccacttgta

SEQ ID NO: 4544472 - DNA, 19 bp, Homo sapiens
agagctttgtcacttgcca

SEQ ID NO: 4544473 - DNA, 21 bp, Homo sapiens
agagctttgtcacttgccaca

SEQ ID NO: 4544474 - DNA, 12 bp, Homo sapiens
agaggaaaagaa

SEQ ID NO: 4544475 - DNA, 16 bp, Homo sapiens
agaggaaattcaaatc

SEQ ID NO: 4544476 - DNA, 20 bp, Homo sapiens
agaggaacctctgatttatt

SEQ ID NO: 4544477 - DNA, 15 bp, Homo sapiens
agaggaagctgttgg

SEQ ID NO: 4544478 - DNA, 21 bp, Homo sapiens
agaggaataaggcccagagcg

SEQ ID NO: 4544479 - DNA, 12 bp, Homo sapiens
agaggaatctgt

SEQ ID NO: 4544480 - DNA, 20 bp, Homo sapiens
agaggaatctgtttctctgc

SEQ ID NO: 4544481 - DNA, 20 bp, Homo sapiens
agaggacagtatttgtgggg

SEQ ID NO: 4544482 - DNA, 16 bp, Homo sapiens
agaggacagtctggag

SEQ ID NO: 4544483 - DNA, 23 bp, Homo sapiens
agaggacctgtatttaagcaaat

SEQ ID NO: 4544484 - DNA, 18 bp, Homo sapiens
agaggagcagaccagcac

SEQ ID NO: 4544485 - DNA, 15 bp, Homo sapiens
agaggagctgcttgt

SEQ ID NO: 4544486 - DNA, 16 bp, Homo sapiens
agaggatgatttcaga

SEQ ID NO: 4544487 - DNA, 21 bp, Homo sapiens
agaggatgtggcctggttcaa

SEQ ID NO: 4544488 - DNA, 19 bp, Homo sapiens
agaggattagtaagatctc

SEQ ID NO: 4544489 - DNA, 13 bp, Homo sapiens
agaggcaataaat

SEQ ID NO: 4544490 - DNA, 14 bp, Homo sapiens
agaggcaccaggaa

SEQ ID NO: 4544491 - DNA, 17 bp, Homo sapiens
agaggcaccaggaagcc

SEQ ID NO: 4544492 - DNA, 16 bp, Homo sapiens
agaggcaccagtccag

SEQ ID NO: 4544493 - DNA, 13 bp, Homo sapiens
agaggcagagcct

SEQ ID NO: 4544494 - DNA, 21 bp, Homo sapiens
agaggccagccccacccagga

SEQ ID NO: 4544495 - DNA, 23 bp, Homo sapiens
agaggccaggcaggagcccttct

SEQ ID NO: 4544496 - DNA, 14 bp, Homo sapiens
agaggccctcgctg

SEQ ID NO: 4544497 - DNA, 13 bp, Homo sapiens
agaggccctgccc

SEQ ID NO: 4544498 - DNA, 17 bp, Homo sapiens
agaggccctgcccccac

SEQ ID NO: 4544499 - DNA, 11 bp, Homo sapiens
agaggccctgg

SEQ ID NO: 4544500 - DNA, 12 bp, Homo sapiens
agaggccctgga

SEQ ID NO: 4544501 - DNA, 15 bp, Homo sapiens
agaggccctggaggg

SEQ ID NO: 4544502 - DNA, 12 bp, Homo sapiens
agaggcctgccc

SEQ ID NO: 4544503 - DNA, 23 bp, Homo sapiens
agaggcctgctgccagtgcagcc

SEQ ID NO: 4544504 - DNA, 16 bp, Homo sapiens
agaggcggcctcgtgc

SEQ ID NO: 4544505 - DNA, 21 bp, Homo sapiens
agaggctaattcagtgtcaca

SEQ ID NO: 4544506 - DNA, 17 bp, Homo sapiens
agaggctagcttctgct

SEQ ID NO: 4544507 - DNA, 22 bp, Homo sapiens
agaggctcgttgactggctgtg

SEQ ID NO: 4544508 - DNA, 19 bp, Homo sapiens
agaggctctggacagcaga

SEQ ID NO: 4544509 - DNA, 23 bp, Homo sapiens
agaggctctggacagcagaagcc

SEQ ID NO: 4544510 - DNA, 16 bp, Homo sapiens
agaggctggaggcagg

SEQ ID NO: 4544511 - DNA, 12 bp, Homo sapiens
agaggcttctcc

SEQ ID NO: 4544512 - DNA, 17 bp, Homo sapiens
agaggctttggggtcct

SEQ ID NO: 4544513 - DNA, 14 bp, Homo sapiens
agagggagaatcca

SEQ ID NO: 4544514 - DNA, 22 bp, Homo sapiens
agagggagacagggctgctccc

SEQ ID NO: 4544515 - DNA, 12 bp, Homo sapiens
agagggagagag

SEQ ID NO: 4544516 - DNA, 21 bp, Homo sapiens
agagggcccagcccagagcca

SEQ ID NO: 4544517 - DNA, 12 bp, Homo sapiens
agagggctggag

SEQ ID NO: 4544518 - DNA, 22 bp, Homo sapiens
agagggcttcctctagaagcca

SEQ ID NO: 4544519 - DNA, 15 bp, Homo sapiens
agagggctttttaaa

SEQ ID NO: 4544520 - DNA, 16 bp, Homo sapiens
agagggctttttaaat

SEQ ID NO: 4544521 - DNA, 22 bp, Homo sapiens
agagggctttttaaatttggtg

SEQ ID NO: 4544522 - DNA, 15 bp, Homo sapiens
agaggggaaaaaatc

SEQ ID NO: 4544523 - DNA, 18 bp, Homo sapiens
agaggggccagctaaccc

SEQ ID NO: 4544524 - DNA, 15 bp, Homo sapiens
agaggggcgggctca

SEQ ID NO: 4544525 - DNA, 21 bp, Homo sapiens
agaggggcgggctcagagctt

SEQ ID NO: 4544526 - DNA, 22 bp, Homo sapiens
agaggggcgttctcccaaagat

SEQ ID NO: 4544527 - DNA, 16 bp, Homo sapiens
agagggggagtagcca

SEQ ID NO: 4544528 - DNA, 22 bp, Homo sapiens
agagggtctggagaagcagtga

SEQ ID NO: 4544529 - DNA, 21 bp, Homo sapiens
agagggttcacacagcccagt

SEQ ID NO: 4544530 - DNA, 15 bp, Homo sapiens
agaggtcagcacaca

SEQ ID NO: 4544531 - DNA, 19 bp, Homo sapiens
agaggtcaggacggctcct

SEQ ID NO: 4544532 - DNA, 22 bp, Homo sapiens
agaggtcaggacggctcctcag

SEQ ID NO: 4544533 - DNA, 20 bp, Homo sapiens
agaggtccaggtcccagccc

SEQ ID NO: 4544534 - DNA, 22 bp, Homo sapiens
agaggtccaggtcccagcccct

SEQ ID NO: 4544535 - DNA, 16 bp, Homo sapiens
agaggtctcatctccc

SEQ ID NO: 4544536 - DNA, 21 bp, Homo sapiens
agaggtctgagccctggtgtg

SEQ ID NO: 4544537 - DNA, 23 bp, Homo sapiens
agaggtggcaggagaatttctac

SEQ ID NO: 4544538 - DNA, 21 bp, Homo sapiens
agaggtgggatcctccctcat

SEQ ID NO: 4544539 - DNA, 15 bp, Homo sapiens
agaggttgcagtgag

SEQ ID NO: 4544540 - DNA, 20 bp, Homo sapiens
agaggttgtagtgagccaag

SEQ ID NO: 4544541 - DNA, 16 bp, Homo sapiens
agagtaacgagaagtg

SEQ ID NO: 4544542 - DNA, 17 bp, Homo sapiens
agagtacactcagccac

SEQ ID NO: 4544543 - DNA, 16 bp, Homo sapiens
agagtagaattgcatt

SEQ ID NO: 4544544 - DNA, 18 bp, Homo sapiens
agagtagccgagagcctg

SEQ ID NO: 4544545 - DNA, 16 bp, Homo sapiens
agagtccactgtggca

SEQ ID NO: 4544546 - DNA, 17 bp, Homo sapiens
agagtccagtgctctgc

SEQ ID NO: 4544547 - DNA, 23 bp, Homo sapiens
agagtccatcagcctccatccta

SEQ ID NO: 4544548 - DNA, 21 bp, Homo sapiens
agagtccttgcaaaattgtct

SEQ ID NO: 4544549 - DNA, 21 bp, Homo sapiens
agagtctaatagtctttgcca

SEQ ID NO: 4544550 - DNA, 17 bp, Homo sapiens
agagtctctcttcactt

SEQ ID NO: 4544551 - DNA, 20 bp, Homo sapiens
agagtctctgatacacagta

SEQ ID NO: 4544552 - DNA, 22 bp, Homo sapiens
agagtgaacaaatttacagaga

SEQ ID NO: 4544553 - DNA, 22 bp, Homo sapiens
agagtgaagggaagagacagcc

SEQ ID NO: 4544554 - DNA, 16 bp, Homo sapiens
agagtgacctcggaca

SEQ ID NO: 4544555 - DNA, 17 bp, Homo sapiens
agagtgacctcggacag

SEQ ID NO: 4544556 - DNA, 20 bp, Homo sapiens
agagtgagctttagctctct

SEQ ID NO: 4544557 - DNA, 14 bp, Homo sapiens
agagtgcacatgcc

SEQ ID NO: 4544558 - DNA, 13 bp, Homo sapiens
agagtgcaggtgc

SEQ ID NO: 4544559 - DNA, 23 bp, Homo sapiens
agagtgcaggtgcagtttcattc

SEQ ID NO: 4544560 - DNA, 16 bp, Homo sapiens
agagtggagtctgagt

SEQ ID NO: 4544561 - DNA, 17 bp, Homo sapiens
agagtggagtctgagtc

SEQ ID NO: 4544562 - DNA, 18 bp, Homo sapiens
agagtggcctccctgctg

SEQ ID NO: 4544563 - DNA, 16 bp, Homo sapiens
agagtggcctggccag

SEQ ID NO: 4544564 - DNA, 19 bp, Homo sapiens
agagtggcctggccaggag

SEQ ID NO: 4544565 - DNA, 22 bp, Homo sapiens
agagtggcctggccaggagctc

SEQ ID NO: 4544566 - DNA, 23 bp, Homo sapiens
agagtggtggcctatttcagctg

SEQ ID NO: 4544567 - DNA, 19 bp, Homo sapiens
agagtgtgggaagggagag

SEQ ID NO: 4544568 - DNA, 11 bp, Homo sapiens
agagtgtgtgt

SEQ ID NO: 4544569 - DNA, 15 bp, Homo sapiens
agagtgtgtgtttgt

SEQ ID NO: 4544570 - DNA, 15 bp, Homo sapiens
agagtgtgttataaa

SEQ ID NO: 4544571 - DNA, 20 bp, Homo sapiens
agagtgtgttataaaataat

SEQ ID NO: 4544572 - DNA, 14 bp, Homo sapiens
agagttatatgtgt

SEQ ID NO: 4544573 - DNA, 16 bp, Homo sapiens
agagttatcttcttta

SEQ ID NO: 4544574 - DNA, 20 bp, Homo sapiens
agagttatcttctttattat

SEQ ID NO: 4544575 - DNA, 19 bp, Homo sapiens
agagttattcaaatgaagg

SEQ ID NO: 4544576 - DNA, 18 bp, Homo sapiens
agagttcaagaaataagt

SEQ ID NO: 4544577 - DNA, 13 bp, Homo sapiens
agagttcagactt

SEQ ID NO: 4544578 - DNA, 19 bp, Homo sapiens
agagttgttgtttgccaag

SEQ ID NO: 4544579 - DNA, 20 bp, Homo sapiens
agagttgttgtttgccaagc

SEQ ID NO: 4544580 - DNA, 14 bp, Homo sapiens
agagtttaaaatca

SEQ ID NO: 4544581 - DNA, 19 bp, Homo sapiens
agagtttattattgtactt

SEQ ID NO: 4544582 - DNA, 17 bp, Homo sapiens
agagtttctgcagttcc

SEQ ID NO: 4544583 - DNA, 15 bp, Homo sapiens
agagtttctggatta

SEQ ID NO: 4544584 - DNA, 17 bp, Homo sapiens
agagtttctttacattg

SEQ ID NO: 4544585 - DNA, 18 bp, Homo sapiens
agagttttattcctttcc

SEQ ID NO: 4544586 - DNA, 15 bp, Homo sapiens
agataaaagcaattc

SEQ ID NO: 4544587 - DNA, 21 bp, Homo sapiens
agataaacacagctgctttct

SEQ ID NO: 4544588 - DNA, 23 bp, Homo sapiens
agataaagatttctagtaggcag

SEQ ID NO: 4544589 - DNA, 18 bp, Homo sapiens
agataaagcttaggtcaa

SEQ ID NO: 4544590 - DNA, 15 bp, Homo sapiens
agataactgaaaatt

SEQ ID NO: 4544591 - DNA, 16 bp, Homo sapiens
agataatctcagtgct

SEQ ID NO: 4544592 - DNA, 19 bp, Homo sapiens
agataatctcagtgctttc

SEQ ID NO: 4544593 - DNA, 18 bp, Homo sapiens
agataatgtgaaaatggt

SEQ ID NO: 4544594 - DNA, 18 bp, Homo sapiens
agatacaaggcccagaag

SEQ ID NO: 4544595 - DNA, 21 bp, Homo sapiens
agatacagatggagcaaatgt

SEQ ID NO: 4544596 - DNA, 19 bp, Homo sapiens
agataccagcgaggaggct

SEQ ID NO: 4544597 - DNA, 21 bp, Homo sapiens
agataccagcgaggaggctcc

SEQ ID NO: 4544598 - DNA, 19 bp, Homo sapiens
agataccttgaaaggaaga

SEQ ID NO: 4544599 - DNA, 16 bp, Homo sapiens
agatacttaagtgctg

SEQ ID NO: 4544600 - DNA, 16 bp, Homo sapiens
agatactttgcattgt

SEQ ID NO: 4544601 - DNA, 19 bp, Homo sapiens
agatactttgcattgtctg

SEQ ID NO: 4544602 - DNA, 20 bp, Homo sapiens
agatagaaagggtgctgcca

SEQ ID NO: 4544603 - DNA, 14 bp, Homo sapiens
agatagctgtgact

SEQ ID NO: 4544604 - DNA, 15 bp, Homo sapiens
agataggaaactgaa

SEQ ID NO: 4544605 - DNA, 13 bp, Homo sapiens
agatagttttcat

SEQ ID NO: 4544606 - DNA, 15 bp, Homo sapiens
agatataaaagactg

SEQ ID NO: 4544607 - DNA, 18 bp, Homo sapiens
agatataactgtcttgtt

SEQ ID NO: 4544608 - DNA, 22 bp, Homo sapiens
agatataactgtcttgtttcag

SEQ ID NO: 4544609 - DNA, 23 bp, Homo sapiens
agatatactttgtggaccaatta

SEQ ID NO: 4544610 - DNA, 19 bp, Homo sapiens
agatatatacatggaatcg

SEQ ID NO: 4544611 - DNA, 16 bp, Homo sapiens
agatatatttccaaga

SEQ ID NO: 4544612 - DNA, 14 bp, Homo sapiens
agatatcagtgtct

SEQ ID NO: 4544613 - DNA, 19 bp, Homo sapiens
agatatcttggacaaatca

SEQ ID NO: 4544614 - DNA, 21 bp, Homo sapiens
agatatcttggacaaatcaca

SEQ ID NO: 4544615 - DNA, 22 bp, Homo sapiens
agatatgcttactaaatcttca

SEQ ID NO: 4544616 - DNA, 18 bp, Homo sapiens
agatattattaattttta

SEQ ID NO: 4544617 - DNA, 19 bp, Homo sapiens
agatattattttaaatttc

SEQ ID NO: 4544618 - DNA, 17 bp, Homo sapiens
agatatttttatcttta

SEQ ID NO: 4544619 - DNA, 21 bp, Homo sapiens
agatatttttatctttatatg

SEQ ID NO: 4544620 - DNA, 19 bp, Homo sapiens
agatcactttctcagtttt

SEQ ID NO: 4544621 - DNA, 16 bp, Homo sapiens
agatcagcctgggcaa

SEQ ID NO: 4544622 - DNA, 18 bp, Homo sapiens
agatcagtgtaccatttg

SEQ ID NO: 4544623 - DNA, 17 bp, Homo sapiens
agatcatattaatgaca

SEQ ID NO: 4544624 - DNA, 22 bp, Homo sapiens
agatcatctggggacctggttt

SEQ ID NO: 4544625 - DNA, 24 bp, Homo sapiens
agatcatggacctggtgcccctgc

SEQ ID NO: 4544626 - DNA, 20 bp, Homo sapiens
agatcatttataatactgtt

SEQ ID NO: 4544627 - DNA, 13 bp, Homo sapiens
agatccccagccc

SEQ ID NO: 4544628 - DNA, 20 bp, Homo sapiens
agatccccagcccctcctcc

SEQ ID NO: 4544629 - DNA, 11 bp, Homo sapiens
agatcccctca

SEQ ID NO: 4544630 - DNA, 14 bp, Homo sapiens
agatcctaaactct

SEQ ID NO: 4544631 - DNA, 15 bp, Homo sapiens
agatcctaaactctc

SEQ ID NO: 4544632 - DNA, 19 bp, Homo sapiens
agatcctaaactctctagc

SEQ ID NO: 4544633 - DNA, 16 bp, Homo sapiens
agatcctaagatgtgt

SEQ ID NO: 4544634 - DNA, 14 bp, Homo sapiens
agatcctctctggg

SEQ ID NO: 4544635 - DNA, 16 bp, Homo sapiens
agatcctctctggggc

SEQ ID NO: 4544636 - DNA, 21 bp, Homo sapiens
agatcctgcaccccagcattc

SEQ ID NO: 4544637 - DNA, 22 bp, Homo sapiens
agatcgcaccactgcactccag

SEQ ID NO: 4544638 - DNA, 14 bp, Homo sapiens
agatctacacatgt

SEQ ID NO: 4544639 - DNA, 20 bp, Homo sapiens
agatctacatgtctagagaa

SEQ ID NO: 4544640 - DNA, 15 bp, Homo sapiens
agatctcccttctca

SEQ ID NO: 4544641 - DNA, 15 bp, Homo sapiens
agatctctcctgcaa

SEQ ID NO: 4544642 - DNA, 14 bp, Homo sapiens
agatctgcacagtc

SEQ ID NO: 4544643 - DNA, 17 bp, Homo sapiens
agatctgcacagtcaga

SEQ ID NO: 4544644 - DNA, 22 bp, Homo sapiens
agatctgttttgtggtttggaa

SEQ ID NO: 4544645 - DNA, 12 bp, Homo sapiens
agatcttaatat

SEQ ID NO: 4544646 - DNA, 17 bp, Homo sapiens
agatcttatattggttt

SEQ ID NO: 4544647 - DNA, 22 bp, Homo sapiens
agatcttatattggtttgcaca

SEQ ID NO: 4544648 - DNA, 22 bp, Homo sapiens
agatcttccgtggtcagagtgc

SEQ ID NO: 4544649 - DNA, 15 bp, Homo sapiens
agatcttcctgctga

SEQ ID NO: 4544650 - DNA, 22 bp, Homo sapiens
agatcttcctgctgagtccttt

SEQ ID NO: 4544651 - DNA, 18 bp, Homo sapiens
agatcttgcagaagttct

SEQ ID NO: 4544652 - DNA, 14 bp, Homo sapiens
agatctttgtaaat

SEQ ID NO: 4544653 - DNA, 13 bp, Homo sapiens
agatgaaacatca

SEQ ID NO: 4544654 - DNA, 20 bp, Homo sapiens
agatgaaactggttcctaca

SEQ ID NO: 4544655 - DNA, 21 bp, Homo sapiens
agatgaaataaagacccaggg

SEQ ID NO: 4544656 - DNA, 16 bp, Homo sapiens
agatgaaggagaggca

SEQ ID NO: 4544657 - DNA, 15 bp, Homo sapiens
agatgacaaatattc

SEQ ID NO: 4544658 - DNA, 12 bp, Homo sapiens
agatgacaacct

SEQ ID NO: 4544659 - DNA, 15 bp, Homo sapiens
agatgactattactt

SEQ ID NO: 4544660 - DNA, 13 bp, Homo sapiens
agatgagaaagct

SEQ ID NO: 4544661 - DNA, 15 bp, Homo sapiens
agatgagagtttctg

SEQ ID NO: 4544662 - DNA, 17 bp, Homo sapiens
agatgagatgaccacca

SEQ ID NO: 4544663 - DNA, 15 bp, Homo sapiens
agatgagcaggagct

SEQ ID NO: 4544664 - DNA, 13 bp, Homo sapiens
agatgagcccacc

SEQ ID NO: 4544665 - DNA, 15 bp, Homo sapiens
agatgagccgggtcc

SEQ ID NO: 4544666 - DNA, 20 bp, Homo sapiens
agatgaggagtaaaattcag

SEQ ID NO: 4544667 - DNA, 13 bp, Homo sapiens
agatgaggtcaac

SEQ ID NO: 4544668 - DNA, 21 bp, Homo sapiens
agatgaggtcagttgtgtttt

SEQ ID NO: 4544669 - DNA, 15 bp, Homo sapiens
agatgagtgggcttc

SEQ ID NO: 4544670 - DNA, 16 bp, Homo sapiens
agatgagtgggcttcg

SEQ ID NO: 4544671 - DNA, 20 bp, Homo sapiens
agatgataaaagagaagcca

SEQ ID NO: 4544672 - DNA, 14 bp, Homo sapiens
agatgatctctcca

SEQ ID NO: 4544673 - DNA, 19 bp, Homo sapiens
agatgatgccagctgtctc

SEQ ID NO: 4544674 - DNA, 22 bp, Homo sapiens
agatgatgctttgagaacatac

SEQ ID NO: 4544675 - DNA, 16 bp, Homo sapiens
agatgatggatgccaa

SEQ ID NO: 4544676 - DNA, 21 bp, Homo sapiens
agatgatttaatgttgatttt

SEQ ID NO: 4544677 - DNA, 22 bp, Homo sapiens
agatgatttcccccctccgcct

SEQ ID NO: 4544678 - DNA, 16 bp, Homo sapiens
agatgcaacctcacta

SEQ ID NO: 4544679 - DNA, 18 bp, Homo sapiens
agatgcaaggaccaggac

SEQ ID NO: 4544680 - DNA, 13 bp, Homo sapiens
agatgcctcagta

SEQ ID NO: 4544681 - DNA, 14 bp, Homo sapiens
agatgcctccaccg

SEQ ID NO: 4544682 - DNA, 17 bp, Homo sapiens
agatgcctccaccgctg

SEQ ID NO: 4544683 - DNA, 16 bp, Homo sapiens
agatgcctgttaattt

SEQ ID NO: 4544684 - DNA, 15 bp, Homo sapiens
agatgctgactggca

SEQ ID NO: 4544685 - DNA, 22 bp, Homo sapiens
agatgcttgcggcaaaaggaaa

SEQ ID NO: 4544686 - DNA, 18 bp, Homo sapiens
agatgcttggagcaatca

SEQ ID NO: 4544687 - DNA, 13 bp, Homo sapiens
agatggaaataca

SEQ ID NO: 4544688 - DNA, 22 bp, Homo sapiens
agatggaaatttttacctttat

SEQ ID NO: 4544689 - DNA, 19 bp, Homo sapiens
agatggacacgagccacaa

SEQ ID NO: 4544690 - DNA, 23 bp, Homo sapiens
agatggacacgagccacaagctg

SEQ ID NO: 4544691 - DNA, 14 bp, Homo sapiens
agatggagcccata

SEQ ID NO: 4544692 - DNA, 19 bp, Homo sapiens
agatggagggcttggccca

SEQ ID NO: 4544693 - DNA, 14 bp, Homo sapiens
agatggcaacattg

SEQ ID NO: 4544694 - DNA, 14 bp, Homo sapiens
agatggccatgctc

SEQ ID NO: 4544695 - DNA, 21 bp, Homo sapiens
agatggcccctccactgggga

SEQ ID NO: 4544696 - DNA, 19 bp, Homo sapiens
agatggcgcatagtgtgct

SEQ ID NO: 4544697 - DNA, 16 bp, Homo sapiens
agatggcttatgtcat

SEQ ID NO: 4544698 - DNA, 13 bp, Homo sapiens
agatgggaatgag

SEQ ID NO: 4544699 - DNA, 13 bp, Homo sapiens
agatgggacagca

SEQ ID NO: 4544700 - DNA, 23 bp, Homo sapiens
agatgggagctcctctcctggag

SEQ ID NO: 4544701 - DNA, 16 bp, Homo sapiens
agatgggttcttagct

SEQ ID NO: 4544702 - DNA, 15 bp, Homo sapiens
agatggttaaacatt

SEQ ID NO: 4544703 - DNA, 17 bp, Homo sapiens
agatggttaaacatttt

SEQ ID NO: 4544704 - DNA, 14 bp, Homo sapiens
agatggttacactg

SEQ ID NO: 4544705 - DNA, 15 bp, Homo sapiens
agatgtaaaatgagt

SEQ ID NO: 4544706 - DNA, 17 bp, Homo sapiens
agatgtaaaatgagttt

SEQ ID NO: 4544707 - DNA, 21 bp, Homo sapiens
agatgtacatagagatctatt

SEQ ID NO: 4544708 - DNA, 20 bp, Homo sapiens
agatgtatggatttccagtt

SEQ ID NO: 4544709 - DNA, 14 bp, Homo sapiens
agatgtattcttta

SEQ ID NO: 4544710 - DNA, 20 bp, Homo sapiens
agatgtcttaacctcaggga

SEQ ID NO: 4544711 - DNA, 17 bp, Homo sapiens
agatgtcttctgcctgt

SEQ ID NO: 4544712 - DNA, 13 bp, Homo sapiens
agatgtcttttat

SEQ ID NO: 4544713 - DNA, 13 bp, Homo sapiens
agatgtgaaaata

SEQ ID NO: 4544714 - DNA, 14 bp, Homo sapiens
agatgtgaattatt

SEQ ID NO: 4544715 - DNA, 18 bp, Homo sapiens
agatgtgaattattgaca

SEQ ID NO: 4544716 - DNA, 21 bp, Homo sapiens
agatgtgaattattgacactg

SEQ ID NO: 4544717 - DNA, 23 bp, Homo sapiens
agatgtgaattattgacactgaa

SEQ ID NO: 4544718 - DNA, 20 bp, Homo sapiens
agatgtgagccaccgtgcct

SEQ ID NO: 4544719 - DNA, 21 bp, Homo sapiens
agatgtgagccaccgtgcctg

SEQ ID NO: 4544720 - DNA, 13 bp, Homo sapiens
agatgtgcaccca

SEQ ID NO: 4544721 - DNA, 16 bp, Homo sapiens
agatgtgtaaacaggt

SEQ ID NO: 4544722 - DNA, 20 bp, Homo sapiens
agatgtgtcccccccaggcc

SEQ ID NO: 4544723 - DNA, 16 bp, Homo sapiens
agatgtgttcttattt

SEQ ID NO: 4544724 - DNA, 22 bp, Homo sapiens
agatgtgttttgttttggactc

SEQ ID NO: 4544725 - DNA, 23 bp, Homo sapiens
agatgtgttttgttttggactct

SEQ ID NO: 4544726 - DNA, 16 bp, Homo sapiens
agatgttccaaattta

SEQ ID NO: 4544727 - DNA, 19 bp, Homo sapiens
agatgtttcatcaatgcag

SEQ ID NO: 4544728 - DNA, 16 bp, Homo sapiens
agatgtttcattttac

SEQ ID NO: 4544729 - DNA, 23 bp, Homo sapiens
agatgtttcattttactgtatat

SEQ ID NO: 4544730 - DNA, 14 bp, Homo sapiens
agatgtttgttttc

SEQ ID NO: 4544731 - DNA, 18 bp, Homo sapiens
agatgtttttaattctag

SEQ ID NO: 4544732 - DNA, 20 bp, Homo sapiens
agattaaaaccagagagaaa

SEQ ID NO: 4544733 - DNA, 18 bp, Homo sapiens
agattaaatgtgtcattg

SEQ ID NO: 4544734 - DNA, 17 bp, Homo sapiens
agattaaattacagctt

SEQ ID NO: 4544735 - DNA, 22 bp, Homo sapiens
agattaactttcaaaagcaaac

SEQ ID NO: 4544736 - DNA, 20 bp, Homo sapiens
agattaagcttttcatttta

SEQ ID NO: 4544737 - DNA, 21 bp, Homo sapiens
agattaataagatttttcaaa

SEQ ID NO: 4544738 - DNA, 17 bp, Homo sapiens
agattaatactctattt

SEQ ID NO: 4544739 - DNA, 19 bp, Homo sapiens
agattacaggaatgaagaa

SEQ ID NO: 4544740 - DNA, 19 bp, Homo sapiens
agattacaggattaatata

SEQ ID NO: 4544741 - DNA, 18 bp, Homo sapiens
agattacatctgccttaa

SEQ ID NO: 4544742 - DNA, 23 bp, Homo sapiens
agattattataaactataaactt

SEQ ID NO: 4544743 - DNA, 22 bp, Homo sapiens
agattattgtgacttcactgta

SEQ ID NO: 4544744 - DNA, 23 bp, Homo sapiens
agattcaatattgaatttttcct

SEQ ID NO: 4544745 - DNA, 15 bp, Homo sapiens
agattcactttgaca

SEQ ID NO: 4544746 - DNA, 15 bp, Homo sapiens
agattcaggccagcc

SEQ ID NO: 4544747 - DNA, 16 bp, Homo sapiens
agattcaggccagccc

SEQ ID NO: 4544748 - DNA, 17 bp, Homo sapiens
agattcaggccagccca

SEQ ID NO: 4544749 - DNA, 20 bp, Homo sapiens
agattcagggagaatgttgt

SEQ ID NO: 4544750 - DNA, 16 bp, Homo sapiens
agattcatgaaaatgt

SEQ ID NO: 4544751 - DNA, 15 bp, Homo sapiens
agattcattttctag

SEQ ID NO: 4544752 - DNA, 14 bp, Homo sapiens
agattcctttccct

SEQ ID NO: 4544753 - DNA, 12 bp, Homo sapiens
agattctcacat

SEQ ID NO: 4544754 - DNA, 14 bp, Homo sapiens
agattctctgccca

SEQ ID NO: 4544755 - DNA, 14 bp, Homo sapiens
agattctgagcaaa

SEQ ID NO: 4544756 - DNA, 23 bp, Homo sapiens
agattctgagcaaaggccctggg

SEQ ID NO: 4544757 - DNA, 18 bp, Homo sapiens
agattctgcctatgtaaa

SEQ ID NO: 4544758 - DNA, 20 bp, Homo sapiens
agattctgcctatgtaaaat

SEQ ID NO: 4544759 - DNA, 15 bp, Homo sapiens
agattctgcctctct

SEQ ID NO: 4544760 - DNA, 16 bp, Homo sapiens
agattctgcctctctg

SEQ ID NO: 4544761 - DNA, 23 bp, Homo sapiens
agattctgtgtcagagcccagcc

SEQ ID NO: 4544762 - DNA, 20 bp, Homo sapiens
agattcttttaaattagaaa

SEQ ID NO: 4544763 - DNA, 21 bp, Homo sapiens
agattcttttaaattagaaaa

SEQ ID NO: 4544764 - DNA, 16 bp, Homo sapiens
agattgagaaatgtgt

SEQ ID NO: 4544765 - DNA, 14 bp, Homo sapiens
agattgagaagcca

SEQ ID NO: 4544766 - DNA, 18 bp, Homo sapiens
agattgagtaagatttac

SEQ ID NO: 4544767 - DNA, 19 bp, Homo sapiens
agattgcactgctgcattc

SEQ ID NO: 4544768 - DNA, 18 bp, Homo sapiens
agattgcagaaaattctg

SEQ ID NO: 4544769 - DNA, 20 bp, Homo sapiens
agattgcagaaaattctgtg

SEQ ID NO: 4544770 - DNA, 22 bp, Homo sapiens
agattgccccataacatagttt

SEQ ID NO: 4544771 - DNA, 14 bp, Homo sapiens
agattgctgaaatt

SEQ ID NO: 4544772 - DNA, 22 bp, Homo sapiens
agattgggagaagtggaaattt

SEQ ID NO: 4544773 - DNA, 16 bp, Homo sapiens
agattgggatactgta

SEQ ID NO: 4544774 - DNA, 17 bp, Homo sapiens
agattgggatactgtaa

SEQ ID NO: 4544775 - DNA, 15 bp, Homo sapiens
agattggtgttcgtt

SEQ ID NO: 4544776 - DNA, 19 bp, Homo sapiens
agattggttgcctctgcct

SEQ ID NO: 4544777 - DNA, 14 bp, Homo sapiens
agattgtattgctg

SEQ ID NO: 4544778 - DNA, 19 bp, Homo sapiens
agatttaaaggcagacagt

SEQ ID NO: 4544779 - DNA, 20 bp, Homo sapiens
agatttaaaggcagacagtt

SEQ ID NO: 4544780 - DNA, 20 bp, Homo sapiens
agatttaacctgttatttct

SEQ ID NO: 4544781 - DNA, 22 bp, Homo sapiens
agatttaacctgttatttctat

SEQ ID NO: 4544782 - DNA, 20 bp, Homo sapiens
agatttaatctgccaagggc

SEQ ID NO: 4544783 - DNA, 16 bp, Homo sapiens
agatttactaaatcaa

SEQ ID NO: 4544784 - DNA, 17 bp, Homo sapiens
agatttaggagcagaaa

SEQ ID NO: 4544785 - DNA, 20 bp, Homo sapiens
agatttaggagcagaaatgc

SEQ ID NO: 4544786 - DNA, 18 bp, Homo sapiens
agatttagtgaaagctag

SEQ ID NO: 4544787 - DNA, 14 bp, Homo sapiens
agatttcaaaaaaa

SEQ ID NO: 4544788 - DNA, 19 bp, Homo sapiens
agatttcatagttcagaat

SEQ ID NO: 4544789 - DNA, 15 bp, Homo sapiens
agatttcatatctaa

SEQ ID NO: 4544790 - DNA, 20 bp, Homo sapiens
agatttcatctgctctcctt

SEQ ID NO: 4544791 - DNA, 21 bp, Homo sapiens
agatttcatctgctctccttc

SEQ ID NO: 4544792 - DNA, 17 bp, Homo sapiens
agatttccttaacctta

SEQ ID NO: 4544793 - DNA, 18 bp, Homo sapiens
agatttctcctcttcctg

SEQ ID NO: 4544794 - DNA, 14 bp, Homo sapiens
agatttctgaggaa

SEQ ID NO: 4544795 - DNA, 12 bp, Homo sapiens
agatttgaaaat

SEQ ID NO: 4544796 - DNA, 14 bp, Homo sapiens
agatttgaaaattg

SEQ ID NO: 4544797 - DNA, 14 bp, Homo sapiens
agatttgcccattt

SEQ ID NO: 4544798 - DNA, 17 bp, Homo sapiens
agatttggcttgacaaa

SEQ ID NO: 4544799 - DNA, 16 bp, Homo sapiens
agatttgtgaactgga

SEQ ID NO: 4544800 - DNA, 18 bp, Homo sapiens
agatttgtgaactggaag

SEQ ID NO: 4544801 - DNA, 19 bp, Homo sapiens
agatttgtgaactggaaga

SEQ ID NO: 4544802 - DNA, 15 bp, Homo sapiens
agattttaaatttta

SEQ ID NO: 4544803 - DNA, 17 bp, Homo sapiens
agattttaaattttatg

SEQ ID NO: 4544804 - DNA, 14 bp, Homo sapiens
agattttattatgt

SEQ ID NO: 4544805 - DNA, 14 bp, Homo sapiens
agattttcatgcaa

SEQ ID NO: 4544806 - DNA, 16 bp, Homo sapiens
agattttgataactgt

SEQ ID NO: 4544807 - DNA, 23 bp, Homo sapiens
agattttgttttgttggacattt

SEQ ID NO: 4544808 - DNA, 21 bp, Homo sapiens
agatttttaaaatgaatctta

SEQ ID NO: 4544809 - DNA, 15 bp, Homo sapiens
agatttttatgtttt

SEQ ID NO: 4544810 - DNA, 13 bp, Homo sapiens
agatttttcaaaa

SEQ ID NO: 4544811 - DNA, 22 bp, Homo sapiens
agattttttcagacttgtcaag

SEQ ID NO: 4544812 - DNA, 19 bp, Homo sapiens
agattttttcatttatacc

SEQ ID NO: 4544813 - DNA, 14 bp, Homo sapiens
agatttttttcctg

SEQ ID NO: 4544814 - DNA, 12 bp, Homo sapiens
agatttttttgt

SEQ ID NO: 4544815 - DNA, 22 bp, Homo sapiens
agattttttttttaagtgacat

SEQ ID NO: 4544816 - DNA, 23 bp, Homo sapiens
agcaaaaaaaaaaaaaagcatct

SEQ ID NO: 4544817 - DNA, 12 bp, Homo sapiens
agcaaaaaagaa

SEQ ID NO: 4544818 - DNA, 17 bp, Homo sapiens
agcaaaaagtggggcag

SEQ ID NO: 4544819 - DNA, 21 bp, Homo sapiens
agcaaaaatctcccagtgaca

SEQ ID NO: 4544820 - DNA, 13 bp, Homo sapiens
agcaaaacaaaac

SEQ ID NO: 4544821 - DNA, 17 bp, Homo sapiens
agcaaaagaccaaatct

SEQ ID NO: 4544822 - DNA, 16 bp, Homo sapiens
agcaaaaggctgagaa

SEQ ID NO: 4544823 - DNA, 16 bp, Homo sapiens
agcaaaataaaaacta

SEQ ID NO: 4544824 - DNA, 21 bp, Homo sapiens
agcaaaatctaaaatgtttta

SEQ ID NO: 4544825 - DNA, 14 bp, Homo sapiens
agcaaacagaaaaa

SEQ ID NO: 4544826 - DNA, 21 bp, Homo sapiens
agcaaacagatgtttgttttc

SEQ ID NO: 4544827 - DNA, 17 bp, Homo sapiens
agcaaactatttcagtg

SEQ ID NO: 4544828 - DNA, 20 bp, Homo sapiens
agcaaagcaaaaggctgaga

SEQ ID NO: 4544829 - DNA, 19 bp, Homo sapiens
agcaaagcacccatttcaa

SEQ ID NO: 4544830 - DNA, 16 bp, Homo sapiens
agcaaaggagaaatct

SEQ ID NO: 4544831 - DNA, 15 bp, Homo sapiens
agcaaaggccctggg

SEQ ID NO: 4544832 - DNA, 12 bp, Homo sapiens
agcaaagtaaca

SEQ ID NO: 4544833 - DNA, 19 bp, Homo sapiens
agcaaatcatttgtttaaa

SEQ ID NO: 4544834 - DNA, 22 bp, Homo sapiens
agcaaatcatttgtttaaaaag

SEQ ID NO: 4544835 - DNA, 15 bp, Homo sapiens
agcaaatcgaatgaa

SEQ ID NO: 4544836 - DNA, 15 bp, Homo sapiens
agcaaattttcagca

SEQ ID NO: 4544837 - DNA, 14 bp, Homo sapiens
agcaacaaaatcat

SEQ ID NO: 4544838 - DNA, 22 bp, Homo sapiens
agcaacaaagattgagaagcca

SEQ ID NO: 4544839 - DNA, 23 bp, Homo sapiens
agcaacaggaatcaagagctgcc

SEQ ID NO: 4544840 - DNA, 14 bp, Homo sapiens
agcaaccacattta

SEQ ID NO: 4544841 - DNA, 14 bp, Homo sapiens
agcaacccagaatg

SEQ ID NO: 4544842 - DNA, 18 bp, Homo sapiens
agcaaccctacagtatat

SEQ ID NO: 4544843 - DNA, 18 bp, Homo sapiens
agcaaccggtggatcctc

SEQ ID NO: 4544844 - DNA, 15 bp, Homo sapiens
agcaacctcagtaat

SEQ ID NO: 4544845 - DNA, 23 bp, Homo sapiens
agcaacgcaggcccccaggtgcc

SEQ ID NO: 4544846 - DNA, 21 bp, Homo sapiens
agcaactacagtctaaagctg

SEQ ID NO: 4544847 - DNA, 19 bp, Homo sapiens
agcaactcttatttctttc

SEQ ID NO: 4544848 - DNA, 20 bp, Homo sapiens
agcaactcttatttctttcc

SEQ ID NO: 4544849 - DNA, 20 bp, Homo sapiens
agcaactcttgattatccat

SEQ ID NO: 4544850 - DNA, 20 bp, Homo sapiens
agcaactgttagctgggaag

SEQ ID NO: 4544851 - DNA, 13 bp, Homo sapiens
agcaacttgcttc

SEQ ID NO: 4544852 - DNA, 15 bp, Homo sapiens
agcaacttgcttcta

SEQ ID NO: 4544853 - DNA, 16 bp, Homo sapiens
agcaagaaggaaagat

SEQ ID NO: 4544854 - DNA, 15 bp, Homo sapiens
agcaagactgcaaga

SEQ ID NO: 4544855 - DNA, 15 bp, Homo sapiens
agcaagatgtttctt

SEQ ID NO: 4544856 - DNA, 14 bp, Homo sapiens
agcaagcagatgaa

SEQ ID NO: 4544857 - DNA, 16 bp, Homo sapiens
agcaagcctgaattgg

SEQ ID NO: 4544858 - DNA, 13 bp, Homo sapiens
agcaagcgggagc

SEQ ID NO: 4544859 - DNA, 20 bp, Homo sapiens
agcaagctgcccagccctgg

SEQ ID NO: 4544860 - DNA, 17 bp, Homo sapiens
agcaaggagaaaatata

SEQ ID NO: 4544861 - DNA, 19 bp, Homo sapiens
agcaagggaccttcatgcc

SEQ ID NO: 4544862 - DNA, 23 bp, Homo sapiens
agcaagggaccttcatgcccttc

SEQ ID NO: 4544863 - DNA, 19 bp, Homo sapiens
agcaagtaagaatggccaa

SEQ ID NO: 4544864 - DNA, 22 bp, Homo sapiens
agcaagtacagcggctcccctc

SEQ ID NO: 4544865 - DNA, 18 bp, Homo sapiens
agcaagtcctcactcttc

SEQ ID NO: 4544866 - DNA, 24 bp, Homo sapiens
agcaagtgagagagatgggagctc

SEQ ID NO: 4544867 - DNA, 18 bp, Homo sapiens
agcaataaatgttttaat

SEQ ID NO: 4544868 - DNA, 13 bp, Homo sapiens
agcaatacaggga

SEQ ID NO: 4544869 - DNA, 15 bp, Homo sapiens
agcaatacagggagg

SEQ ID NO: 4544870 - DNA, 13 bp, Homo sapiens
agcaatattttgt

SEQ ID NO: 4544871 - DNA, 22 bp, Homo sapiens
agcaatcaaggttataattttt

SEQ ID NO: 4544872 - DNA, 16 bp, Homo sapiens
agcaatcacaaaggct

SEQ ID NO: 4544873 - DNA, 17 bp, Homo sapiens
agcaatcagaacttcag

SEQ ID NO: 4544874 - DNA, 18 bp, Homo sapiens
agcaatccacctgccttg

SEQ ID NO: 4544875 - DNA, 13 bp, Homo sapiens
agcaatcctcctg

SEQ ID NO: 4544876 - DNA, 15 bp, Homo sapiens
agcaatcctcctgcc

SEQ ID NO: 4544877 - DNA, 18 bp, Homo sapiens
agcaatcctcctgcctca

SEQ ID NO: 4544878 - DNA, 21 bp, Homo sapiens
agcaatcctcctgcctcagcc

SEQ ID NO: 4544879 - DNA, 18 bp, Homo sapiens
agcaatctcttcattatt

SEQ ID NO: 4544880 - DNA, 19 bp, Homo sapiens
agcaatgataatgagcaga

SEQ ID NO: 4544881 - DNA, 23 bp, Homo sapiens
agcaatgataatgagcagatgag

SEQ ID NO: 4544882 - DNA, 14 bp, Homo sapiens
agcaatggccagag

SEQ ID NO: 4544883 - DNA, 15 bp, Homo sapiens
agcaatggccagagc

SEQ ID NO: 4544884 - DNA, 16 bp, Homo sapiens
agcaatggccagagcc

SEQ ID NO: 4544885 - DNA, 19 bp, Homo sapiens
agcaatggccagagcctct

SEQ ID NO: 4544886 - DNA, 15 bp, Homo sapiens
agcaattatattgtc

SEQ ID NO: 4544887 - DNA, 16 bp, Homo sapiens
agcaattctgactgtc

SEQ ID NO: 4544888 - DNA, 22 bp, Homo sapiens
agcaatttccccctaaaccaac

SEQ ID NO: 4544889 - DNA, 11 bp, Homo sapiens
agcaatttttg

SEQ ID NO: 4544890 - DNA, 20 bp, Homo sapiens
agcacaaaattcaaagcatg

SEQ ID NO: 4544891 - DNA, 22 bp, Homo sapiens
agcacaaaattcaaagcatgga

SEQ ID NO: 4544892 - DNA, 21 bp, Homo sapiens
agcacaaagttctcagagctc

SEQ ID NO: 4544893 - DNA, 11 bp, Homo sapiens
agcacaattaa

SEQ ID NO: 4544894 - DNA, 14 bp, Homo sapiens
agcacacattattt

SEQ ID NO: 4544895 - DNA, 14 bp, Homo sapiens
agcacactggaata

SEQ ID NO: 4544896 - DNA, 14 bp, Homo sapiens
agcacagagcctgg

SEQ ID NO: 4544897 - DNA, 15 bp, Homo sapiens
agcacagagcctggc

SEQ ID NO: 4544898 - DNA, 16 bp, Homo sapiens
agcacagagcctggcc

SEQ ID NO: 4544899 - DNA, 13 bp, Homo sapiens
agcacagaggcct

SEQ ID NO: 4544900 - DNA, 16 bp, Homo sapiens
agcacagcttagattt

SEQ ID NO: 4544901 - DNA, 16 bp, Homo sapiens
agcacaggctaatttt

SEQ ID NO: 4544902 - DNA, 21 bp, Homo sapiens
agcacatagagctttttaata

SEQ ID NO: 4544903 - DNA, 18 bp, Homo sapiens
agcacatctctctgccct

SEQ ID NO: 4544904 - DNA, 13 bp, Homo sapiens
agcacattcggga

SEQ ID NO: 4544905 - DNA, 23 bp, Homo sapiens
agcacattcgggaccaatatata

SEQ ID NO: 4544906 - DNA, 16 bp, Homo sapiens
agcaccaatacaaatt

SEQ ID NO: 4544907 - DNA, 15 bp, Homo sapiens
agcaccaccagggct

SEQ ID NO: 4544908 - DNA, 16 bp, Homo sapiens
agcaccaccagggctc

SEQ ID NO: 4544909 - DNA, 18 bp, Homo sapiens
agcaccaccagggctcca

SEQ ID NO: 4544910 - DNA, 19 bp, Homo sapiens
agcaccaccatttaatttc

SEQ ID NO: 4544911 - DNA, 21 bp, Homo sapiens
agcaccaccatttaatttcat

SEQ ID NO: 4544912 - DNA, 23 bp, Homo sapiens
agcaccagtgggactgtggtgac

SEQ ID NO: 4544913 - DNA, 22 bp, Homo sapiens
agcacccagagcaccccctgct

SEQ ID NO: 4544914 - DNA, 14 bp, Homo sapiens
agcacccatttcaa

SEQ ID NO: 4544915 - DNA, 20 bp, Homo sapiens
agcaccccctgctccaccag

SEQ ID NO: 4544916 - DNA, 21 bp, Homo sapiens
agcaccccctgctccaccagc

SEQ ID NO: 4544917 - DNA, 12 bp, Homo sapiens
agcaccctctcc

SEQ ID NO: 4544918 - DNA, 16 bp, Homo sapiens
agcaccctctcctggg

SEQ ID NO: 4544919 - DNA, 18 bp, Homo sapiens
agcaccctctcctggggg

SEQ ID NO: 4544920 - DNA, 19 bp, Homo sapiens
agcaccctctcctgggggt

SEQ ID NO: 4544921 - DNA, 16 bp, Homo sapiens
agcacctccccagatg

SEQ ID NO: 4544922 - DNA, 11 bp, Homo sapiens
agcacctgccg

SEQ ID NO: 4544923 - DNA, 15 bp, Homo sapiens
agcacctgccgacct

SEQ ID NO: 4544924 - DNA, 22 bp, Homo sapiens
agcacctgccgacctcgtcctc

SEQ ID NO: 4544925 - DNA, 22 bp, Homo sapiens
agcaccttcagggctgagttct

SEQ ID NO: 4544926 - DNA, 15 bp, Homo sapiens
agcaccttctttctg

SEQ ID NO: 4544927 - DNA, 16 bp, Homo sapiens
agcaccttctttctgg

SEQ ID NO: 4544928 - DNA, 19 bp, Homo sapiens
agcaccttctttctggact

SEQ ID NO: 4544929 - DNA, 17 bp, Homo sapiens
agcacgacagtggatgc

SEQ ID NO: 4544930 - DNA, 17 bp, Homo sapiens
agcacggactgtcagtt

SEQ ID NO: 4544931 - DNA, 17 bp, Homo sapiens
agcacggggctggcagg

SEQ ID NO: 4544932 - DNA, 19 bp, Homo sapiens
agcacggtcccccaggagg

SEQ ID NO: 4544933 - DNA, 17 bp, Homo sapiens
agcacgtggagatagtg

SEQ ID NO: 4544934 - DNA, 20 bp, Homo sapiens
agcactaaaaagttgaacca

SEQ ID NO: 4544935 - DNA, 19 bp, Homo sapiens
agcactaaacttggtgctt

SEQ ID NO: 4544936 - DNA, 15 bp, Homo sapiens
agcactactctacca

SEQ ID NO: 4544937 - DNA, 17 bp, Homo sapiens
agcactagagaatgcac

SEQ ID NO: 4544938 - DNA, 20 bp, Homo sapiens
agcactccgcatcacctcac

SEQ ID NO: 4544939 - DNA, 22 bp, Homo sapiens
agcactccgcatcacctcacca

SEQ ID NO: 4544940 - DNA, 18 bp, Homo sapiens
agcactgaactgctttta

SEQ ID NO: 4544941 - DNA, 17 bp, Homo sapiens
agcactgacttctaagt

SEQ ID NO: 4544942 - DNA, 19 bp, Homo sapiens
agcactgacttctaagtaa

SEQ ID NO: 4544943 - DNA, 21 bp, Homo sapiens
agcactgagctcacatgggac

SEQ ID NO: 4544944 - DNA, 10 bp, Homo sapiens
agcactgagg

SEQ ID NO: 4544945 - DNA, 21 bp, Homo sapiens
agcactgaggaagaacggggc

SEQ ID NO: 4544946 - DNA, 21 bp, Homo sapiens
agcactgatagtcctttttcc

SEQ ID NO: 4544947 - DNA, 18 bp, Homo sapiens
agcactgcatgtcagagc

SEQ ID NO: 4544948 - DNA, 18 bp, Homo sapiens
agcactgccccacatgca

SEQ ID NO: 4544949 - DNA, 15 bp, Homo sapiens
agcactggcctgcac

SEQ ID NO: 4544950 - DNA, 17 bp, Homo sapiens
agcactggcctgcacgg

SEQ ID NO: 4544951 - DNA, 20 bp, Homo sapiens
agcactggtgtgaactcacc

SEQ ID NO: 4544952 - DNA, 14 bp, Homo sapiens
agcacttaaacaga

SEQ ID NO: 4544953 - DNA, 17 bp, Homo sapiens
agcacttagacctgcca

SEQ ID NO: 4544954 - DNA, 21 bp, Homo sapiens
agcacttagacctgccagcca

SEQ ID NO: 4544955 - DNA, 23 bp, Homo sapiens
agcacttcccaggatctgctcca

SEQ ID NO: 4544956 - DNA, 23 bp, Homo sapiens
agcacttgaccttttcgacgctt

SEQ ID NO: 4544957 - DNA, 21 bp, Homo sapiens
agcacttgcttacatcctctg

SEQ ID NO: 4544958 - DNA, 22 bp, Homo sapiens
agcacttgggggttcaggcccg

SEQ ID NO: 4544959 - DNA, 16 bp, Homo sapiens
agcactttcattgcca

SEQ ID NO: 4544960 - DNA, 21 bp, Homo sapiens
agcactttgagaggctgaggt

SEQ ID NO: 4544961 - DNA, 11 bp, Homo sapiens
agcagaaacag

SEQ ID NO: 4544962 - DNA, 18 bp, Homo sapiens
agcagaaagaagagaagt

SEQ ID NO: 4544963 - DNA, 14 bp, Homo sapiens
agcagaacagtgat

SEQ ID NO: 4544964 - DNA, 13 bp, Homo sapiens
agcagaagcctcc

SEQ ID NO: 4544965 - DNA, 23 bp, Homo sapiens
agcagaagcctccaagcacagag

SEQ ID NO: 4544966 - DNA, 15 bp, Homo sapiens
agcagaaggaaggat

SEQ ID NO: 4544967 - DNA, 21 bp, Homo sapiens
agcagaaggaaggatgccact

SEQ ID NO: 4544968 - DNA, 23 bp, Homo sapiens
agcagaagggggtggtgtctcca

SEQ ID NO: 4544969 - DNA, 23 bp, Homo sapiens
agcagaccattggggctcccagc

SEQ ID NO: 4544970 - DNA, 14 bp, Homo sapiens
agcagactcctgct

SEQ ID NO: 4544971 - DNA, 23 bp, Homo sapiens
agcagactcctgctctctatcca

SEQ ID NO: 4544972 - DNA, 20 bp, Homo sapiens
agcagagagcaaaggagaaa

SEQ ID NO: 4544973 - DNA, 13 bp, Homo sapiens
agcagagagccct

SEQ ID NO: 4544974 - DNA, 22 bp, Homo sapiens
agcagagaggtggatcctgtag

SEQ ID NO: 4544975 - DNA, 13 bp, Homo sapiens
agcagagccaggg

SEQ ID NO: 4544976 - DNA, 17 bp, Homo sapiens
agcagagccagggcagg

SEQ ID NO: 4544977 - DNA, 20 bp, Homo sapiens
agcagagccagggcagggcg

SEQ ID NO: 4544978 - DNA, 15 bp, Homo sapiens
agcagagctctgccg

SEQ ID NO: 4544979 - DNA, 21 bp, Homo sapiens
agcagaggacagtctggagaa

SEQ ID NO: 4544980 - DNA, 13 bp, Homo sapiens
agcagaggccctg

SEQ ID NO: 4544981 - DNA, 14 bp, Homo sapiens
agcagaggccctgc

SEQ ID NO: 4544982 - DNA, 15 bp, Homo sapiens
agcagaggccctgcc

SEQ ID NO: 4544983 - DNA, 17 bp, Homo sapiens
agcagaggccctgcccc

SEQ ID NO: 4544984 - DNA, 14 bp, Homo sapiens
agcagagggggagt

SEQ ID NO: 4544985 - DNA, 12 bp, Homo sapiens
agcagagttaaa

SEQ ID NO: 4544986 - DNA, 14 bp, Homo sapiens
agcagagttaaatc

SEQ ID NO: 4544987 - DNA, 22 bp, Homo sapiens
agcagcaaaaccaaactgggtc

SEQ ID NO: 4544988 - DNA, 20 bp, Homo sapiens
agcagcaaattttcagcatt

SEQ ID NO: 4544989 - DNA, 18 bp, Homo sapiens
agcagcaatattttgtat

SEQ ID NO: 4544990 - DNA, 20 bp, Homo sapiens
agcagcacgattttgcacaa

SEQ ID NO: 4544991 - DNA, 14 bp, Homo sapiens
agcagcactgtgag

SEQ ID NO: 4544992 - DNA, 13 bp, Homo sapiens
agcagcagagagc

SEQ ID NO: 4544993 - DNA, 15 bp, Homo sapiens
agcagcagagagccc

SEQ ID NO: 4544994 - DNA, 18 bp, Homo sapiens
agcagcagagagccctgg

SEQ ID NO: 4544995 - DNA, 22 bp, Homo sapiens
agcagcagagagccctgggtga

SEQ ID NO: 4544996 - DNA, 13 bp, Homo sapiens
agcagcagcactt

SEQ ID NO: 4544997 - DNA, 17 bp, Homo sapiens
agcagcagcctgcacct

SEQ ID NO: 4544998 - DNA, 11 bp, Homo sapiens
agcagcagctc

SEQ ID NO: 4544999 - DNA, 19 bp, Homo sapiens
agcagcagctctgagccag

SEQ ID NO: 4545000 - DNA, 20 bp, Homo sapiens
agcagcagctctgagccaga

SEQ ID NO: 4545001 - DNA, 23 bp, Homo sapiens
agcagcagctctgagccagatta

SEQ ID NO: 4545002 - DNA, 13 bp, Homo sapiens
agcagcaggtagc

SEQ ID NO: 4545003 - DNA, 20 bp, Homo sapiens
agcagcaggtagcctgctgg

SEQ ID NO: 4545004 - DNA, 14 bp, Homo sapiens
agcagcagtgtcca

SEQ ID NO: 4545005 - DNA, 13 bp, Homo sapiens
agcagcattttta

SEQ ID NO: 4545006 - DNA, 14 bp, Homo sapiens
agcagcatttttat

SEQ ID NO: 4545007 - DNA, 16 bp, Homo sapiens
agcagccccaggagaa

SEQ ID NO: 4545008 - DNA, 19 bp, Homo sapiens
agcagcccccgggccgctg

SEQ ID NO: 4545009 - DNA, 19 bp, Homo sapiens
agcagcccctgagagcctg

SEQ ID NO: 4545010 - DNA, 20 bp, Homo sapiens
agcagcccctgagagcctgt

SEQ ID NO: 4545011 - DNA, 13 bp, Homo sapiens
agcagccctcctc

SEQ ID NO: 4545012 - DNA, 23 bp, Homo sapiens
agcagccctcctcaccccgtctg

SEQ ID NO: 4545013 - DNA, 18 bp, Homo sapiens
agcagccctggatggtgg

SEQ ID NO: 4545014 - DNA, 19 bp, Homo sapiens
agcagccctggatggtggc

SEQ ID NO: 4545015 - DNA, 13 bp, Homo sapiens
agcagcctctgga

SEQ ID NO: 4545016 - DNA, 14 bp, Homo sapiens
agcagcctctggac

SEQ ID NO: 4545017 - DNA, 14 bp, Homo sapiens
agcagcctgcacct

SEQ ID NO: 4545018 - DNA, 18 bp, Homo sapiens
agcagcctgcacctgccc

SEQ ID NO: 4545019 - DNA, 14 bp, Homo sapiens
agcagcctgtggca

SEQ ID NO: 4545020 - DNA, 18 bp, Homo sapiens
agcagcgaccacccctgc

SEQ ID NO: 4545021 - DNA, 20 bp, Homo sapiens
agcagcgaccacccctgcct

SEQ ID NO: 4545022 - DNA, 22 bp, Homo sapiens
agcagcgaccacccctgcctcc

SEQ ID NO: 4545023 - DNA, 19 bp, Homo sapiens
agcagctccctttctcagg

SEQ ID NO: 4545024 - DNA, 17 bp, Homo sapiens
agcagctctggctctgc

SEQ ID NO: 4545025 - DNA, 17 bp, Homo sapiens
agcagcttaagtccagc

SEQ ID NO: 4545026 - DNA, 18 bp, Homo sapiens
agcagcttagactaaggc

SEQ ID NO: 4545027 - DNA, 23 bp, Homo sapiens
agcagctttttattccctgccca

SEQ ID NO: 4545028 - DNA, 15 bp, Homo sapiens
agcaggaaatgaaaa

SEQ ID NO: 4545029 - DNA, 21 bp, Homo sapiens
agcaggaaatgaaaatgtctt

SEQ ID NO: 4545030 - DNA, 13 bp, Homo sapiens
agcaggacccagt

SEQ ID NO: 4545031 - DNA, 15 bp, Homo sapiens
agcaggacccagtgg

SEQ ID NO: 4545032 - DNA, 22 bp, Homo sapiens
agcaggactccaggcccaaggc

SEQ ID NO: 4545033 - DNA, 23 bp, Homo sapiens
agcaggactgaattgtccccagt

SEQ ID NO: 4545034 - DNA, 17 bp, Homo sapiens
agcaggagccccgccac

SEQ ID NO: 4545035 - DNA, 16 bp, Homo sapiens
agcaggccaaggtctg

SEQ ID NO: 4545036 - DNA, 19 bp, Homo sapiens
agcaggcctctggttgcct

SEQ ID NO: 4545037 - DNA, 17 bp, Homo sapiens
agcaggctactgtcagc

SEQ ID NO: 4545038 - DNA, 22 bp, Homo sapiens
agcaggctgccagtgcctgggt

SEQ ID NO: 4545039 - DNA, 12 bp, Homo sapiens
agcagggaaggc

SEQ ID NO: 4545040 - DNA, 14 bp, Homo sapiens
agcagggaaggcct

SEQ ID NO: 4545041 - DNA, 15 bp, Homo sapiens
agcagggaaggcctg

SEQ ID NO: 4545042 - DNA, 16 bp, Homo sapiens
agcagggaaggcctga

SEQ ID NO: 4545043 - DNA, 17 bp, Homo sapiens
agcagggaaggcctgac

SEQ ID NO: 4545044 - DNA, 23 bp, Homo sapiens
agcagggctaccctgagctgagg

SEQ ID NO: 4545045 - DNA, 14 bp, Homo sapiens
agcaggggctccag

SEQ ID NO: 4545046 - DNA, 16 bp, Homo sapiens
agcaggggctccagca

SEQ ID NO: 4545047 - DNA, 15 bp, Homo sapiens
agcaggggtctgagc

SEQ ID NO: 4545048 - DNA, 14 bp, Homo sapiens
agcaggtaccactg

SEQ ID NO: 4545049 - DNA, 14 bp, Homo sapiens
agcaggtttcaagg

SEQ ID NO: 4545050 - DNA, 13 bp, Homo sapiens
agcaggtttgttt

SEQ ID NO: 4545051 - DNA, 19 bp, Homo sapiens
agcagtaaactttctctgc

SEQ ID NO: 4545052 - DNA, 21 bp, Homo sapiens
agcagtaaactttctctgcaa

SEQ ID NO: 4545053 - DNA, 15 bp, Homo sapiens
agcagtatatgttaa

SEQ ID NO: 4545054 - DNA, 20 bp, Homo sapiens
agcagtcgcccaagcagaca

SEQ ID NO: 4545055 - DNA, 14 bp, Homo sapiens
agcagtcgcctgcc

SEQ ID NO: 4545056 - DNA, 23 bp, Homo sapiens
agcagtcgcctgcctgcagcagg

SEQ ID NO: 4545057 - DNA, 13 bp, Homo sapiens
agcagtcttgctc

SEQ ID NO: 4545058 - DNA, 17 bp, Homo sapiens
agcagtgagccaaatgt

SEQ ID NO: 4545059 - DNA, 21 bp, Homo sapiens
agcagtgagccaaatgtaaaa

SEQ ID NO: 4545060 - DNA, 23 bp, Homo sapiens
agcagtggcctacaaatcagtaa

SEQ ID NO: 4545061 - DNA, 17 bp, Homo sapiens
agcagtgtccagagacc

SEQ ID NO: 4545062 - DNA, 23 bp, Homo sapiens
agcagtgtggggggacagacagg

SEQ ID NO: 4545063 - DNA, 23 bp, Homo sapiens
agcagttaatcacccaccatagg

SEQ ID NO: 4545064 - DNA, 21 bp, Homo sapiens
agcagttataacagatgtgaa

SEQ ID NO: 4545065 - DNA, 17 bp, Homo sapiens
agcataaaagatgaaag

SEQ ID NO: 4545066 - DNA, 18 bp, Homo sapiens
agcataaagctcaaatga

SEQ ID NO: 4545067 - DNA, 23 bp, Homo sapiens
agcataaagctcaaatgaaatgt

SEQ ID NO: 4545068 - DNA, 19 bp, Homo sapiens
agcataatctgaaaacatc

SEQ ID NO: 4545069 - DNA, 15 bp, Homo sapiens
agcatacttctagga

SEQ ID NO: 4545070 - DNA, 14 bp, Homo sapiens
agcatactttgtaa

SEQ ID NO: 4545071 - DNA, 21 bp, Homo sapiens
agcatagaaggaagtgtgttt

SEQ ID NO: 4545072 - DNA, 19 bp, Homo sapiens
agcatagctacaatttgtt

SEQ ID NO: 4545073 - DNA, 14 bp, Homo sapiens
agcatataaatgtt

SEQ ID NO: 4545074 - DNA, 16 bp, Homo sapiens
agcatatctgattgtt

SEQ ID NO: 4545075 - DNA, 16 bp, Homo sapiens
agcatcaatcttgtta

SEQ ID NO: 4545076 - DNA, 19 bp, Homo sapiens
agcatcactagtgacaagt

SEQ ID NO: 4545077 - DNA, 13 bp, Homo sapiens
agcatcactgatg

SEQ ID NO: 4545078 - DNA, 14 bp, Homo sapiens
agcatccattaatt

SEQ ID NO: 4545079 - DNA, 12 bp, Homo sapiens
agcatccctgga

SEQ ID NO: 4545080 - DNA, 20 bp, Homo sapiens
agcatccctggagcaggagc

SEQ ID NO: 4545081 - DNA, 13 bp, Homo sapiens
agcatcccttccc

SEQ ID NO: 4545082 - DNA, 14 bp, Homo sapiens
agcatcccttccca

SEQ ID NO: 4545083 - DNA, 21 bp, Homo sapiens
agcatccgcaggtgctggtcc

SEQ ID NO: 4545084 - DNA, 22 bp, Homo sapiens
agcatcctgccttagagccagg

SEQ ID NO: 4545085 - DNA, 23 bp, Homo sapiens
agcatcctgccttagagccaggc

SEQ ID NO: 4545086 - DNA, 22 bp, Homo sapiens
agcatcggacaagacccccagc

SEQ ID NO: 4545087 - DNA, 12 bp, Homo sapiens
agcatcgggagc

SEQ ID NO: 4545088 - DNA, 18 bp, Homo sapiens
agcatctagtataagtct

SEQ ID NO: 4545089 - DNA, 15 bp, Homo sapiens
agcatctatctcatc

SEQ ID NO: 4545090 - DNA, 14 bp, Homo sapiens
agcatctgccccag

SEQ ID NO: 4545091 - DNA, 16 bp, Homo sapiens
agcatctgccccaggt

SEQ ID NO: 4545092 - DNA, 17 bp, Homo sapiens
agcatctgccccaggta

SEQ ID NO: 4545093 - DNA, 18 bp, Homo sapiens
agcatctgccccaggtac

SEQ ID NO: 4545094 - DNA, 12 bp, Homo sapiens
agcatcttctgg

SEQ ID NO: 4545095 - DNA, 22 bp, Homo sapiens
agcatgaagataaacacagctg

SEQ ID NO: 4545096 - DNA, 14 bp, Homo sapiens
agcatgaataaaat

SEQ ID NO: 4545097 - DNA, 15 bp, Homo sapiens
agcatgaataaaatt

SEQ ID NO: 4545098 - DNA, 18 bp, Homo sapiens
agcatgaataacatttaa

SEQ ID NO: 4545099 - DNA, 20 bp, Homo sapiens
agcatgaataacatttaaat

SEQ ID NO: 4545100 - DNA, 16 bp, Homo sapiens
agcatgacataacagt

SEQ ID NO: 4545101 - DNA, 20 bp, Homo sapiens
agcatgacataacagtgcag

SEQ ID NO: 4545102 - DNA, 17 bp, Homo sapiens
agcatgcacactgagaa

SEQ ID NO: 4545103 - DNA, 17 bp, Homo sapiens
agcatgcataaatcaat

SEQ ID NO: 4545104 - DNA, 19 bp, Homo sapiens
agcatgccgttctgcaccc

SEQ ID NO: 4545105 - DNA, 17 bp, Homo sapiens
agcatggacatttagaa

SEQ ID NO: 4545106 - DNA, 17 bp, Homo sapiens
agcatggagctgtcacc

SEQ ID NO: 4545107 - DNA, 16 bp, Homo sapiens
agcatggatgcatttc

SEQ ID NO: 4545108 - DNA, 18 bp, Homo sapiens
agcatggatgcatttcaa

SEQ ID NO: 4545109 - DNA, 20 bp, Homo sapiens
agcatggatgcatttcaaat

SEQ ID NO: 4545110 - DNA, 11 bp, Homo sapiens
agcatggcata

SEQ ID NO: 4545111 - DNA, 19 bp, Homo sapiens
agcatggcatagccccggc

SEQ ID NO: 4545112 - DNA, 13 bp, Homo sapiens
agcatggctgtga

SEQ ID NO: 4545113 - DNA, 16 bp, Homo sapiens
agcatggctgtgagga

SEQ ID NO: 4545114 - DNA, 13 bp, Homo sapiens
agcatggggccag

SEQ ID NO: 4545115 - DNA, 15 bp, Homo sapiens
agcatggggccagga

SEQ ID NO: 4545116 - DNA, 17 bp, Homo sapiens
agcatgtctattcagct

SEQ ID NO: 4545117 - DNA, 19 bp, Homo sapiens
agcatgtctattcagcttc

SEQ ID NO: 4545118 - DNA, 16 bp, Homo sapiens
agcatgtgttaatctt

SEQ ID NO: 4545119 - DNA, 14 bp, Homo sapiens
agcatgttcctcct

SEQ ID NO: 4545120 - DNA, 15 bp, Homo sapiens
agcatgtttaaaaca

SEQ ID NO: 4545121 - DNA, 19 bp, Homo sapiens
agcatgtttattctgttcc

SEQ ID NO: 4545122 - DNA, 20 bp, Homo sapiens
agcattaagctgttcctgtt

SEQ ID NO: 4545123 - DNA, 14 bp, Homo sapiens
agcattcagaagaa

SEQ ID NO: 4545124 - DNA, 17 bp, Homo sapiens
agcattccagctctgcc

SEQ ID NO: 4545125 - DNA, 20 bp, Homo sapiens
agcattccagctctgccccc

SEQ ID NO: 4545126 - DNA, 20 bp, Homo sapiens
agcattcccagggaccttgg

SEQ ID NO: 4545127 - DNA, 19 bp, Homo sapiens
agcattcttagcctgtggc

SEQ ID NO: 4545128 - DNA, 23 bp, Homo sapiens
agcattcttagcctgtggcagta

SEQ ID NO: 4545129 - DNA, 13 bp, Homo sapiens
agcattgcctggc

SEQ ID NO: 4545130 - DNA, 21 bp, Homo sapiens
agcattgcctggccttcctgt

SEQ ID NO: 4545131 - DNA, 15 bp, Homo sapiens
agcattgctggactc

SEQ ID NO: 4545132 - DNA, 14 bp, Homo sapiens
agcattgtaaaata

SEQ ID NO: 4545133 - DNA, 15 bp, Homo sapiens
agcattgtaaaataa

SEQ ID NO: 4545134 - DNA, 16 bp, Homo sapiens
agcattgtaaaataat

SEQ ID NO: 4545135 - DNA, 20 bp, Homo sapiens
agcatttaatggcagctagt

SEQ ID NO: 4545136 - DNA, 13 bp, Homo sapiens
agcatttatttct

SEQ ID NO: 4545137 - DNA, 22 bp, Homo sapiens
agcatttatttctctggcaaac

SEQ ID NO: 4545138 - DNA, 11 bp, Homo sapiens
agcatttcatg

SEQ ID NO: 4545139 - DNA, 18 bp, Homo sapiens
agcatttcatgaaaaagc

SEQ ID NO: 4545140 - DNA, 21 bp, Homo sapiens
agcatttccagagcagagcct

SEQ ID NO: 4545141 - DNA, 14 bp, Homo sapiens
agcatttctcatca

SEQ ID NO: 4545142 - DNA, 18 bp, Homo sapiens
agcatttcttttctcttt

SEQ ID NO: 4545143 - DNA, 21 bp, Homo sapiens
agcatttcttttctctttaat

SEQ ID NO: 4545144 - DNA, 15 bp, Homo sapiens
agcatttgataatga

SEQ ID NO: 4545145 - DNA, 17 bp, Homo sapiens
agcatttgataatgata

SEQ ID NO: 4545146 - DNA, 22 bp, Homo sapiens
agcatttgataatgataaaaca

SEQ ID NO: 4545147 - DNA, 16 bp, Homo sapiens
agcatttttataaact

SEQ ID NO: 4545148 - DNA, 22 bp, Homo sapiens
agcatttttcaatatattgaac

SEQ ID NO: 4545149 - DNA, 18 bp, Homo sapiens
agcatttttccatctgtg

SEQ ID NO: 4545150 - DNA, 14 bp, Homo sapiens
agccaaaaatagct

SEQ ID NO: 4545151 - DNA, 18 bp, Homo sapiens
agccaaaaatagctaaat

SEQ ID NO: 4545152 - DNA, 21 bp, Homo sapiens
agccaaaagtccctccctgcc

SEQ ID NO: 4545153 - DNA, 22 bp, Homo sapiens
agccaaaagtccctccctgcct

SEQ ID NO: 4545154 - DNA, 14 bp, Homo sapiens
agccaaagcatgcc

SEQ ID NO: 4545155 - DNA, 12 bp, Homo sapiens
agccaaatttaa

SEQ ID NO: 4545156 - DNA, 13 bp, Homo sapiens
agccaaatttaaa

SEQ ID NO: 4545157 - DNA, 16 bp, Homo sapiens
agccaacatgtggctc

SEQ ID NO: 4545158 - DNA, 20 bp, Homo sapiens
agccaacatgtggctcctcc

SEQ ID NO: 4545159 - DNA, 16 bp, Homo sapiens
agccaacgagacacat

SEQ ID NO: 4545160 - DNA, 21 bp, Homo sapiens
agccaacgagacacattgcct

SEQ ID NO: 4545161 - DNA, 22 bp, Homo sapiens
agccaagacctcacacacacaa

SEQ ID NO: 4545162 - DNA, 16 bp, Homo sapiens
agccaagctttaaatt

SEQ ID NO: 4545163 - DNA, 15 bp, Homo sapiens
agccaaggaggcctg

SEQ ID NO: 4545164 - DNA, 19 bp, Homo sapiens
agccaaggaggcctgggga

SEQ ID NO: 4545165 - DNA, 20 bp, Homo sapiens
agccaaggaggcctggggag

SEQ ID NO: 4545166 - DNA, 17 bp, Homo sapiens
agccaaggatagaagct

SEQ ID NO: 4545167 - DNA, 14 bp, Homo sapiens
agccaagggaaagg

SEQ ID NO: 4545168 - DNA, 17 bp, Homo sapiens
agccaagtagcctctcc

SEQ ID NO: 4545169 - DNA, 22 bp, Homo sapiens
agccaagtgttttgtattttat

SEQ ID NO: 4545170 - DNA, 15 bp, Homo sapiens
agccacaagctgcac

SEQ ID NO: 4545171 - DNA, 17 bp, Homo sapiens
agccacaattatataaa

SEQ ID NO: 4545172 - DNA, 21 bp, Homo sapiens
agccacaattatataaatcat

SEQ ID NO: 4545173 - DNA, 17 bp, Homo sapiens
agccacacaaacgttta

SEQ ID NO: 4545174 - DNA, 18 bp, Homo sapiens
agccacagctgctgttct

SEQ ID NO: 4545175 - DNA, 21 bp, Homo sapiens
agccacagctgctgttctcag

SEQ ID NO: 4545176 - DNA, 13 bp, Homo sapiens
agccacaggaagg

SEQ ID NO: 4545177 - DNA, 15 bp, Homo sapiens
agccacaggaaggag

SEQ ID NO: 4545178 - DNA, 23 bp, Homo sapiens
agccacaggaaggaggggagaga

SEQ ID NO: 4545179 - DNA, 17 bp, Homo sapiens
agccacaggcctgagat

SEQ ID NO: 4545180 - DNA, 21 bp, Homo sapiens
agccacaggcctgagatttca

SEQ ID NO: 4545181 - DNA, 22 bp, Homo sapiens
agccacaggcctgagatttcat

SEQ ID NO: 4545182 - DNA, 17 bp, Homo sapiens
agccacagtcactggat

SEQ ID NO: 4545183 - DNA, 14 bp, Homo sapiens
agccacatacttta

SEQ ID NO: 4545184 - DNA, 15 bp, Homo sapiens
agccacatgccccag

SEQ ID NO: 4545185 - DNA, 22 bp, Homo sapiens
agccacatttggaatacttttt

SEQ ID NO: 4545186 - DNA, 17 bp, Homo sapiens
agccacccaagcctgct

SEQ ID NO: 4545187 - DNA, 21 bp, Homo sapiens
agccaccccgggctctctgct

SEQ ID NO: 4545188 - DNA, 23 bp, Homo sapiens
agccaccccgggctctctgctgt

SEQ ID NO: 4545189 - DNA, 15 bp, Homo sapiens
agccaccgtgcctgg

SEQ ID NO: 4545190 - DNA, 12 bp, Homo sapiens
agccacctgcaa

SEQ ID NO: 4545191 - DNA, 14 bp, Homo sapiens
agccacctgcaaga

SEQ ID NO: 4545192 - DNA, 20 bp, Homo sapiens
agccacgccctccctgctag

SEQ ID NO: 4545193 - DNA, 17 bp, Homo sapiens
agccacgttccttactg

SEQ ID NO: 4545194 - DNA, 18 bp, Homo sapiens
agccacgttccttactgc

SEQ ID NO: 4545195 - DNA, 21 bp, Homo sapiens
agccacgttccttactgcaga

SEQ ID NO: 4545196 - DNA, 22 bp, Homo sapiens
agccactcctctgactcagggc

SEQ ID NO: 4545197 - DNA, 22 bp, Homo sapiens
agccactccttccttcaggact

SEQ ID NO: 4545198 - DNA, 23 bp, Homo sapiens
agccactccttccttcaggactc

SEQ ID NO: 4545199 - DNA, 14 bp, Homo sapiens
agccactgtcacag

SEQ ID NO: 4545200 - DNA, 16 bp, Homo sapiens
agccactgtcacaggc

SEQ ID NO: 4545201 - DNA, 14 bp, Homo sapiens
agccactgtcaccg

SEQ ID NO: 4545202 - DNA, 18 bp, Homo sapiens
agccacttctccccagaa

SEQ ID NO: 4545203 - DNA, 19 bp, Homo sapiens
agccacttgcctgtgctac

SEQ ID NO: 4545204 - DNA, 21 bp, Homo sapiens
agccagaccccacgctgacca

SEQ ID NO: 4545205 - DNA, 14 bp, Homo sapiens
agccagactggcac

SEQ ID NO: 4545206 - DNA, 16 bp, Homo sapiens
agccagactgtccagg

SEQ ID NO: 4545207 - DNA, 19 bp, Homo sapiens
agccagactgtccagggaa

SEQ ID NO: 4545208 - DNA, 22 bp, Homo sapiens
agccagagacagaggatgtggc

SEQ ID NO: 4545209 - DNA, 13 bp, Homo sapiens
agccagagcccca

SEQ ID NO: 4545210 - DNA, 15 bp, Homo sapiens
agccagagcctgggg

SEQ ID NO: 4545211 - DNA, 18 bp, Homo sapiens
agccagaggagggcagag

SEQ ID NO: 4545212 - DNA, 22 bp, Homo sapiens
agccagaggagggcagagggag

SEQ ID NO: 4545213 - DNA, 19 bp, Homo sapiens
agccagagggtgggagcct

SEQ ID NO: 4545214 - DNA, 22 bp, Homo sapiens
agccagatggactccagcctgc

SEQ ID NO: 4545215 - DNA, 14 bp, Homo sapiens
agccagattacagg

SEQ ID NO: 4545216 - DNA, 11 bp, Homo sapiens
agccagcagct

SEQ ID NO: 4545217 - DNA, 16 bp, Homo sapiens
agccagcccagcccag

SEQ ID NO: 4545218 - DNA, 13 bp, Homo sapiens
agccagccctccc

SEQ ID NO: 4545219 - DNA, 18 bp, Homo sapiens
agccagccctccctgtcc

SEQ ID NO: 4545220 - DNA, 16 bp, Homo sapiens
agccagccgccctggg

SEQ ID NO: 4545221 - DNA, 21 bp, Homo sapiens
agccagccgccctgggctgtc

SEQ ID NO: 4545222 - DNA, 10 bp, Homo sapiens
agccagcctc

SEQ ID NO: 4545223 - DNA, 19 bp, Homo sapiens
agccagcctggctctgccc

SEQ ID NO: 4545224 - DNA, 19 bp, Homo sapiens
agccagcgcctccctccac

SEQ ID NO: 4545225 - DNA, 21 bp, Homo sapiens
agccagcgcctccctccaccc

SEQ ID NO: 4545226 - DNA, 14 bp, Homo sapiens
agccagcggctcca

SEQ ID NO: 4545227 - DNA, 19 bp, Homo sapiens
agccagcgtcctcctctgt

SEQ ID NO: 4545228 - DNA, 15 bp, Homo sapiens
agccagctggacttc

SEQ ID NO: 4545229 - DNA, 13 bp, Homo sapiens
agccagctttccc

SEQ ID NO: 4545230 - DNA, 18 bp, Homo sapiens
agccagctttccctgcct

SEQ ID NO: 4545231 - DNA, 14 bp, Homo sapiens
agccaggaggcctg

SEQ ID NO: 4545232 - DNA, 16 bp, Homo sapiens
agccaggaggcctgct

SEQ ID NO: 4545233 - DNA, 12 bp, Homo sapiens
agccaggcacac

SEQ ID NO: 4545234 - DNA, 23 bp, Homo sapiens
agccaggcacacactgtgctttc

SEQ ID NO: 4545235 - DNA, 22 bp, Homo sapiens
agccaggcccttgtcggcccca

SEQ ID NO: 4545236 - DNA, 15 bp, Homo sapiens
agccaggcctggctg

SEQ ID NO: 4545237 - DNA, 17 bp, Homo sapiens
agccaggcctggctgga

SEQ ID NO: 4545238 - DNA, 14 bp, Homo sapiens
agccaggctctgtg

SEQ ID NO: 4545239 - DNA, 17 bp, Homo sapiens
agccaggctctgtgctg

SEQ ID NO: 4545240 - DNA, 21 bp, Homo sapiens
agccaggctgccaaggccaga

SEQ ID NO: 4545241 - DNA, 14 bp, Homo sapiens
agccaggcttttct

SEQ ID NO: 4545242 - DNA, 23 bp, Homo sapiens
agccaggcttttctcaggagctt

SEQ ID NO: 4545243 - DNA, 16 bp, Homo sapiens
agccagggcaagagag

SEQ ID NO: 4545244 - DNA, 12 bp, Homo sapiens
agccagggcagg

SEQ ID NO: 4545245 - DNA, 22 bp, Homo sapiens
agccagggcagggcgagctgca

SEQ ID NO: 4545246 - DNA, 23 bp, Homo sapiens
agccagggcagggcgagctgcag

SEQ ID NO: 4545247 - DNA, 13 bp, Homo sapiens
agccagggctggg

SEQ ID NO: 4545248 - DNA, 17 bp, Homo sapiens
agccagggctggggttg

SEQ ID NO: 4545249 - DNA, 21 bp, Homo sapiens
agccagggctggggttgccag

SEQ ID NO: 4545250 - DNA, 14 bp, Homo sapiens
agccaggtgccttg

SEQ ID NO: 4545251 - DNA, 19 bp, Homo sapiens
agccaggtggcacctgcag

SEQ ID NO: 4545252 - DNA, 14 bp, Homo sapiens
agccagtcagggcc

SEQ ID NO: 4545253 - DNA, 14 bp, Homo sapiens
agccagtctttgaa

SEQ ID NO: 4545254 - DNA, 22 bp, Homo sapiens
agccagtctttgaactgcagca

SEQ ID NO: 4545255 - DNA, 16 bp, Homo sapiens
agccagtgacctttga

SEQ ID NO: 4545256 - DNA, 13 bp, Homo sapiens
agccataataaaa

SEQ ID NO: 4545257 - DNA, 21 bp, Homo sapiens
agccatactgcgtccaccctg

SEQ ID NO: 4545258 - DNA, 19 bp, Homo sapiens
agccatacttatctctctg

SEQ ID NO: 4545259 - DNA, 17 bp, Homo sapiens
agccatagaccctgagg

SEQ ID NO: 4545260 - DNA, 21 bp, Homo sapiens
agccatagaccctgaggccct

SEQ ID NO: 4545261 - DNA, 19 bp, Homo sapiens
agccatatatgaccagaag

SEQ ID NO: 4545262 - DNA, 16 bp, Homo sapiens
agccatcaaaatgctt

SEQ ID NO: 4545263 - DNA, 17 bp, Homo sapiens
agccatcacttctcccc

SEQ ID NO: 4545264 - DNA, 21 bp, Homo sapiens
agccatccctttttttacatt

SEQ ID NO: 4545265 - DNA, 19 bp, Homo sapiens
agccatcctccctccacct

SEQ ID NO: 4545266 - DNA, 18 bp, Homo sapiens
agccatcgtcctgggact

SEQ ID NO: 4545267 - DNA, 19 bp, Homo sapiens
agccatctaatgcttgttt

SEQ ID NO: 4545268 - DNA, 16 bp, Homo sapiens
agccatcttggcaggg

SEQ ID NO: 4545269 - DNA, 20 bp, Homo sapiens
agccatgaggagttgctgtt

SEQ ID NO: 4545270 - DNA, 15 bp, Homo sapiens
agccatgatttccca

SEQ ID NO: 4545271 - DNA, 19 bp, Homo sapiens
agccatgctacagttagtc

SEQ ID NO: 4545272 - DNA, 15 bp, Homo sapiens
agccatgctttatgt

SEQ ID NO: 4545273 - DNA, 14 bp, Homo sapiens
agccattaaatgaa

SEQ ID NO: 4545274 - DNA, 19 bp, Homo sapiens
agccatttgtcccaagtgc

SEQ ID NO: 4545275 - DNA, 14 bp, Homo sapiens
agcccaaaatttga

SEQ ID NO: 4545276 - DNA, 15 bp, Homo sapiens
agcccaaaatttgat

SEQ ID NO: 4545277 - DNA, 23 bp, Homo sapiens
agcccaaagtggtatagaaatgc

SEQ ID NO: 4545278 - DNA, 15 bp, Homo sapiens
agcccaacagcactt

SEQ ID NO: 4545279 - DNA, 19 bp, Homo sapiens
agcccaagaggtctgagcc

SEQ ID NO: 4545280 - DNA, 23 bp, Homo sapiens
agcccaaggtgctgatgtcaaag

SEQ ID NO: 4545281 - DNA, 21 bp, Homo sapiens
agcccaagttcatgcagctgt

SEQ ID NO: 4545282 - DNA, 15 bp, Homo sapiens
agcccacagagcctg

SEQ ID NO: 4545283 - DNA, 20 bp, Homo sapiens
agcccacagtatattttatt

SEQ ID NO: 4545284 - DNA, 13 bp, Homo sapiens
agcccaccctcct

SEQ ID NO: 4545285 - DNA, 16 bp, Homo sapiens
agcccaccctcctgtc

SEQ ID NO: 4545286 - DNA, 11 bp, Homo sapiens
agcccactgag

SEQ ID NO: 4545287 - DNA, 13 bp, Homo sapiens
agcccagagccac

SEQ ID NO: 4545288 - DNA, 14 bp, Homo sapiens
agcccagagccacc

SEQ ID NO: 4545289 - DNA, 15 bp, Homo sapiens
agcccagagccacct

SEQ ID NO: 4545290 - DNA, 18 bp, Homo sapiens
agcccagagccacctgga

SEQ ID NO: 4545291 - DNA, 12 bp, Homo sapiens
agcccagaggag

SEQ ID NO: 4545292 - DNA, 19 bp, Homo sapiens
agcccagcagtgtggagac

SEQ ID NO: 4545293 - DNA, 22 bp, Homo sapiens
agcccagcagtgtggagaccct

SEQ ID NO: 4545294 - DNA, 16 bp, Homo sapiens
agcccagcctgggagc

SEQ ID NO: 4545295 - DNA, 17 bp, Homo sapiens
agcccagcctgggagcc

SEQ ID NO: 4545296 - DNA, 16 bp, Homo sapiens
agcccagcgtcagaag

SEQ ID NO: 4545297 - DNA, 13 bp, Homo sapiens
agcccagctggtg

SEQ ID NO: 4545298 - DNA, 22 bp, Homo sapiens
agcccagctgtgggcggctcct

SEQ ID NO: 4545299 - DNA, 21 bp, Homo sapiens
agcccaggatactggcacaga

SEQ ID NO: 4545300 - DNA, 22 bp, Homo sapiens
agcccaggtcctgctgcctctc

SEQ ID NO: 4545301 - DNA, 14 bp, Homo sapiens
agcccagtgcttct

SEQ ID NO: 4545302 - DNA, 16 bp, Homo sapiens
agcccatcctgaccag

SEQ ID NO: 4545303 - DNA, 17 bp, Homo sapiens
agcccatcctgaccagc

SEQ ID NO: 4545304 - DNA, 22 bp, Homo sapiens
agcccatgcccacctgcccatc

SEQ ID NO: 4545305 - DNA, 23 bp, Homo sapiens
agcccatggcccccaataaaggc

SEQ ID NO: 4545306 - DNA, 14 bp, Homo sapiens
agcccattcccacc

SEQ ID NO: 4545307 - DNA, 15 bp, Homo sapiens
agcccattctctctc

SEQ ID NO: 4545308 - DNA, 19 bp, Homo sapiens
agcccattctctctcctgt

SEQ ID NO: 4545309 - DNA, 22 bp, Homo sapiens
agcccattctctctcctgtcca

SEQ ID NO: 4545310 - DNA, 14 bp, Homo sapiens
agcccattcttctg

SEQ ID NO: 4545311 - DNA, 15 bp, Homo sapiens
agcccattggccgag

SEQ ID NO: 4545312 - DNA, 23 bp, Homo sapiens
agcccattggccgagctcctggg

SEQ ID NO: 4545313 - DNA, 17 bp, Homo sapiens
agccccaacatgttcag

SEQ ID NO: 4545314 - DNA, 18 bp, Homo sapiens
agccccaactccaggggc

SEQ ID NO: 4545315 - DNA, 19 bp, Homo sapiens
agccccaactccaggggca

SEQ ID NO: 4545316 - DNA, 20 bp, Homo sapiens
agccccacactggggtgccg

SEQ ID NO: 4545317 - DNA, 16 bp, Homo sapiens
agccccacccaggagg

SEQ ID NO: 4545318 - DNA, 20 bp, Homo sapiens
agccccacccaggagggagg

SEQ ID NO: 4545319 - DNA, 18 bp, Homo sapiens
agccccacttcaccccca

SEQ ID NO: 4545320 - DNA, 18 bp, Homo sapiens
agccccagccccctttgg

SEQ ID NO: 4545321 - DNA, 13 bp, Homo sapiens
agccccaggccag

SEQ ID NO: 4545322 - DNA, 22 bp, Homo sapiens
agccccagggtcttccctacct

SEQ ID NO: 4545323 - DNA, 23 bp, Homo sapiens
agccccagggtcttccctacctc

SEQ ID NO: 4545324 - DNA, 16 bp, Homo sapiens
agccccagtctcacct

SEQ ID NO: 4545325 - DNA, 13 bp, Homo sapiens
agccccattcctg

SEQ ID NO: 4545326 - DNA, 19 bp, Homo sapiens
agcccccactgcacccctg

SEQ ID NO: 4545327 - DNA, 18 bp, Homo sapiens
agcccccagcagaggcag

SEQ ID NO: 4545328 - DNA, 22 bp, Homo sapiens
agcccccatcacccaagccaca

SEQ ID NO: 4545329 - DNA, 18 bp, Homo sapiens
agccccccagctcccaca

SEQ ID NO: 4545330 - DNA, 13 bp, Homo sapiens
agcccccctagca

SEQ ID NO: 4545331 - DNA, 16 bp, Homo sapiens
agcccccgccccagag

SEQ ID NO: 4545332 - DNA, 14 bp, Homo sapiens
agccccctcccacc

SEQ ID NO: 4545333 - DNA, 17 bp, Homo sapiens
agccccctcccaccgct

SEQ ID NO: 4545334 - DNA, 18 bp, Homo sapiens
agccccctcccaccgctg

SEQ ID NO: 4545335 - DNA, 18 bp, Homo sapiens
agccccctttgggcccag

SEQ ID NO: 4545336 - DNA, 15 bp, Homo sapiens
agccccgactccagc

SEQ ID NO: 4545337 - DNA, 20 bp, Homo sapiens
agccccgactccagccagcg

SEQ ID NO: 4545338 - DNA, 20 bp, Homo sapiens
agccccggcaagccacagga

SEQ ID NO: 4545339 - DNA, 18 bp, Homo sapiens
agccccggccctgggctc

SEQ ID NO: 4545340 - DNA, 15 bp, Homo sapiens
agccccggggccccc

SEQ ID NO: 4545341 - DNA, 21 bp, Homo sapiens
agccccggggccccctggtca

SEQ ID NO: 4545342 - DNA, 16 bp, Homo sapiens
agccccgttttgggga

SEQ ID NO: 4545343 - DNA, 13 bp, Homo sapiens
agcccctccccag

SEQ ID NO: 4545344 - DNA, 17 bp, Homo sapiens
agcccctccccagccag

SEQ ID NO: 4545345 - DNA, 11 bp, Homo sapiens
agcccctcctc

SEQ ID NO: 4545346 - DNA, 17 bp, Homo sapiens
agcccctcctccctcag

SEQ ID NO: 4545347 - DNA, 21 bp, Homo sapiens
agcccctcctccctcagaccc

SEQ ID NO: 4545348 - DNA, 22 bp, Homo sapiens
agcccctcctccctcagaccca

SEQ ID NO: 4545349 - DNA, 23 bp, Homo sapiens
agcccctcctccctcaggcccag

SEQ ID NO: 4545350 - DNA, 13 bp, Homo sapiens
agcccctcctctg

SEQ ID NO: 4545351 - DNA, 15 bp, Homo sapiens
agcccctcctctgcc

SEQ ID NO: 4545352 - DNA, 19 bp, Homo sapiens
agcccctcctctgccacct

SEQ ID NO: 4545353 - DNA, 22 bp, Homo sapiens
agcccctctttctgtcccctct

SEQ ID NO: 4545354 - DNA, 19 bp, Homo sapiens
agcccctggggcccagccc

SEQ ID NO: 4545355 - DNA, 22 bp, Homo sapiens
agcccctggggtggccaccagt

SEQ ID NO: 4545356 - DNA, 20 bp, Homo sapiens
agcccctgtttactggttct

SEQ ID NO: 4545357 - DNA, 15 bp, Homo sapiens
agccccttccccatg

SEQ ID NO: 4545358 - DNA, 13 bp, Homo sapiens
agcccgcctgcca

SEQ ID NO: 4545359 - DNA, 18 bp, Homo sapiens
agcccgcctgccagtcct

SEQ ID NO: 4545360 - DNA, 20 bp, Homo sapiens
agcccgcctgccgtgcatgg

SEQ ID NO: 4545361 - DNA, 21 bp, Homo sapiens
agcccgcctgccgtgcatggc

SEQ ID NO: 4545362 - DNA, 15 bp, Homo sapiens
agcccggctcccacc

SEQ ID NO: 4545363 - DNA, 13 bp, Homo sapiens
agccctaaacatc

SEQ ID NO: 4545364 - DNA, 14 bp, Homo sapiens
agccctaaacatca

SEQ ID NO: 4545365 - DNA, 21 bp, Homo sapiens
agccctaaacatcattcttga

SEQ ID NO: 4545366 - DNA, 16 bp, Homo sapiens
agccctagagcctgcc

SEQ ID NO: 4545367 - DNA, 18 bp, Homo sapiens
agccctcagacatttata

SEQ ID NO: 4545368 - DNA, 17 bp, Homo sapiens
agccctcagttccttca

SEQ ID NO: 4545369 - DNA, 23 bp, Homo sapiens
agccctcagttccttcatttcca

SEQ ID NO: 4545370 - DNA, 16 bp, Homo sapiens
agccctcatcccgagc

SEQ ID NO: 4545371 - DNA, 12 bp, Homo sapiens
agccctccccct

SEQ ID NO: 4545372 - DNA, 20 bp, Homo sapiens
agccctccctgtcctcctcg

SEQ ID NO: 4545373 - DNA, 14 bp, Homo sapiens
agccctcctcaccc

SEQ ID NO: 4545374 - DNA, 12 bp, Homo sapiens
agccctcctgag

SEQ ID NO: 4545375 - DNA, 17 bp, Homo sapiens
agccctcctgagggccg

SEQ ID NO: 4545376 - DNA, 20 bp, Homo sapiens
agccctcctgagggccggtt

SEQ ID NO: 4545377 - DNA, 16 bp, Homo sapiens
agccctcggcctccga

SEQ ID NO: 4545378 - DNA, 23 bp, Homo sapiens
agccctcgggtccatagagatga

SEQ ID NO: 4545379 - DNA, 18 bp, Homo sapiens
agccctctctctcactcc

SEQ ID NO: 4545380 - DNA, 16 bp, Homo sapiens
agccctgactcctgga

SEQ ID NO: 4545381 - DNA, 22 bp, Homo sapiens
agccctgaggtgaaagggagct

SEQ ID NO: 4545382 - DNA, 16 bp, Homo sapiens
agccctgattgtgcca

SEQ ID NO: 4545383 - DNA, 16 bp, Homo sapiens
agccctgccccaccca

SEQ ID NO: 4545384 - DNA, 17 bp, Homo sapiens
agccctgccctcccaag

SEQ ID NO: 4545385 - DNA, 18 bp, Homo sapiens
agccctgccctcccaagt

SEQ ID NO: 4545386 - DNA, 18 bp, Homo sapiens
agccctgctccctgcctc

SEQ ID NO: 4545387 - DNA, 22 bp, Homo sapiens
agccctgctccctgcctcctgc

SEQ ID NO: 4545388 - DNA, 14 bp, Homo sapiens
agccctgctcttct

SEQ ID NO: 4545389 - DNA, 15 bp, Homo sapiens
agccctgctcttctc

SEQ ID NO: 4545390 - DNA, 22 bp, Homo sapiens
agccctgctcttctctccccag

SEQ ID NO: 4545391 - DNA, 16 bp, Homo sapiens
agccctggatggtggc

SEQ ID NO: 4545392 - DNA, 14 bp, Homo sapiens
agccctggcccagg

SEQ ID NO: 4545393 - DNA, 13 bp, Homo sapiens
agccctggctccc

SEQ ID NO: 4545394 - DNA, 22 bp, Homo sapiens
agccctgtctgctaggcgctgg

SEQ ID NO: 4545395 - DNA, 12 bp, Homo sapiens
agcccttcccag

SEQ ID NO: 4545396 - DNA, 18 bp, Homo sapiens
agcccttcccagggcacc

SEQ ID NO: 4545397 - DNA, 22 bp, Homo sapiens
agcccttcccagggcacccagg

SEQ ID NO: 4545398 - DNA, 11 bp, Homo sapiens
agcccttccct

SEQ ID NO: 4545399 - DNA, 19 bp, Homo sapiens
agcccttctatacccaccc

SEQ ID NO: 4545400 - DNA, 12 bp, Homo sapiens
agcccttgcctc

SEQ ID NO: 4545401 - DNA, 13 bp, Homo sapiens
agcccttgcctcc

SEQ ID NO: 4545402 - DNA, 13 bp, Homo sapiens
agccgagagcctg

SEQ ID NO: 4545403 - DNA, 15 bp, Homo sapiens
agccgagagcctgct

SEQ ID NO: 4545404 - DNA, 21 bp, Homo sapiens
agccgagagcctgctccccca

SEQ ID NO: 4545405 - DNA, 19 bp, Homo sapiens
agccgagattgcgccattg

SEQ ID NO: 4545406 - DNA, 19 bp, Homo sapiens
agccgatatcagaatttgt

SEQ ID NO: 4545407 - DNA, 14 bp, Homo sapiens
agccgcagagcctg

SEQ ID NO: 4545408 - DNA, 15 bp, Homo sapiens
agccgcagagcctga

SEQ ID NO: 4545409 - DNA, 15 bp, Homo sapiens
agccgcattggtgac

SEQ ID NO: 4545410 - DNA, 19 bp, Homo sapiens
agccgccattgccaccagg

SEQ ID NO: 4545411 - DNA, 16 bp, Homo sapiens
agccgcccaaggcctt

SEQ ID NO: 4545412 - DNA, 19 bp, Homo sapiens
agccgctgagcgaggagat

SEQ ID NO: 4545413 - DNA, 23 bp, Homo sapiens
agccgggaggaaaaggcccctgc

SEQ ID NO: 4545414 - DNA, 16 bp, Homo sapiens
agccgggcccctgggc

SEQ ID NO: 4545415 - DNA, 22 bp, Homo sapiens
agccgggtctgcctcttctggg

SEQ ID NO: 4545416 - DNA, 13 bp, Homo sapiens
agccgtcctggcg

SEQ ID NO: 4545417 - DNA, 23 bp, Homo sapiens
agccgtcctggcgcctggcagtc

SEQ ID NO: 4545418 - DNA, 23 bp, Homo sapiens
agccgtgctcgcccacaaactga

SEQ ID NO: 4545419 - DNA, 21 bp, Homo sapiens
agccgtttgaatatattttat

SEQ ID NO: 4545420 - DNA, 18 bp, Homo sapiens
agcctaaggctcctgttt

SEQ ID NO: 4545421 - DNA, 20 bp, Homo sapiens
agcctaatgagagtgcactg

SEQ ID NO: 4545422 - DNA, 12 bp, Homo sapiens
agcctacctctc

SEQ ID NO: 4545423 - DNA, 16 bp, Homo sapiens
agcctacctgctctcc

SEQ ID NO: 4545424 - DNA, 17 bp, Homo sapiens
agcctacctgctctcca

SEQ ID NO: 4545425 - DNA, 15 bp, Homo sapiens
agcctactgaaaatg

SEQ ID NO: 4545426 - DNA, 17 bp, Homo sapiens
agcctagcggagcccag

SEQ ID NO: 4545427 - DNA, 22 bp, Homo sapiens
agcctagcggagcccagcctgg

SEQ ID NO: 4545428 - DNA, 12 bp, Homo sapiens
agcctagctcct

SEQ ID NO: 4545429 - DNA, 19 bp, Homo sapiens
agcctatcaaaggaaatga

SEQ ID NO: 4545430 - DNA, 23 bp, Homo sapiens
agcctcactggggcagacaataa

SEQ ID NO: 4545431 - DNA, 19 bp, Homo sapiens
agcctcagagatctccctt

SEQ ID NO: 4545432 - DNA, 22 bp, Homo sapiens
agcctcatacctacatcagaca

SEQ ID NO: 4545433 - DNA, 15 bp, Homo sapiens
agcctcatccagcct

SEQ ID NO: 4545434 - DNA, 15 bp, Homo sapiens
agcctcatgacttta

SEQ ID NO: 4545435 - DNA, 15 bp, Homo sapiens
agcctcatgtccact

SEQ ID NO: 4545436 - DNA, 18 bp, Homo sapiens
agcctccaagcctgcctc

SEQ ID NO: 4545437 - DNA, 13 bp, Homo sapiens
agcctccagcctc

SEQ ID NO: 4545438 - DNA, 21 bp, Homo sapiens
agcctccaggcccccaactcc

SEQ ID NO: 4545439 - DNA, 14 bp, Homo sapiens
agcctccagggccc

SEQ ID NO: 4545440 - DNA, 15 bp, Homo sapiens
agcctcccatagctg

SEQ ID NO: 4545441 - DNA, 18 bp, Homo sapiens
agcctcccatagctggga

SEQ ID NO: 4545442 - DNA, 18 bp, Homo sapiens
agcctccccatctgtcca

SEQ ID NO: 4545443 - DNA, 19 bp, Homo sapiens
agcctccccatctgtccag

SEQ ID NO: 4545444 - DNA, 13 bp, Homo sapiens
agcctccccctca

SEQ ID NO: 4545445 - DNA, 10 bp, Homo sapiens
agcctcccct

SEQ ID NO: 4545446 - DNA, 12 bp, Homo sapiens
agcctcccctcc

SEQ ID NO: 4545447 - DNA, 16 bp, Homo sapiens
agcctcccctcccctg

SEQ ID NO: 4545448 - DNA, 16 bp, Homo sapiens
agcctcccctgccagg

SEQ ID NO: 4545449 - DNA, 18 bp, Homo sapiens
agcctcccctgccagggc

SEQ ID NO: 4545450 - DNA, 14 bp, Homo sapiens
agcctccgagaggg

SEQ ID NO: 4545451 - DNA, 16 bp, Homo sapiens
agcctccgagagggag

SEQ ID NO: 4545452 - DNA, 18 bp, Homo sapiens
agcctccgagagggagag

SEQ ID NO: 4545453 - DNA, 12 bp, Homo sapiens
agcctcctctgg

SEQ ID NO: 4545454 - DNA, 19 bp, Homo sapiens
agcctcctctgtctgccct

SEQ ID NO: 4545455 - DNA, 20 bp, Homo sapiens
agcctcctctgtctgccctt

SEQ ID NO: 4545456 - DNA, 20 bp, Homo sapiens
agcctcctgaagttgctgct

SEQ ID NO: 4545457 - DNA, 16 bp, Homo sapiens
agcctcctgccccctg

SEQ ID NO: 4545458 - DNA, 14 bp, Homo sapiens
agcctcctgtacct

SEQ ID NO: 4545459 - DNA, 14 bp, Homo sapiens
agcctcctgtgcct

SEQ ID NO: 4545460 - DNA, 21 bp, Homo sapiens
agcctcctgtgcctggcccca

SEQ ID NO: 4545461 - DNA, 16 bp, Homo sapiens
agcctctaaacagaca

SEQ ID NO: 4545462 - DNA, 23 bp, Homo sapiens
agcctctagtgtaccaagtgctt

SEQ ID NO: 4545463 - DNA, 16 bp, Homo sapiens
agcctctccactcatg

SEQ ID NO: 4545464 - DNA, 11 bp, Homo sapiens
agcctctccca

SEQ ID NO: 4545465 - DNA, 15 bp, Homo sapiens
agcctctcccacccg

SEQ ID NO: 4545466 - DNA, 20 bp, Homo sapiens
agcctctccccgctctggat

SEQ ID NO: 4545467 - DNA, 14 bp, Homo sapiens
agcctctccgactc

SEQ ID NO: 4545468 - DNA, 14 bp, Homo sapiens
agcctctctcccag

SEQ ID NO: 4545469 - DNA, 16 bp, Homo sapiens
agcctctctcccagtc

SEQ ID NO: 4545470 - DNA, 11 bp, Homo sapiens
agcctctgccg

SEQ ID NO: 4545471 - DNA, 13 bp, Homo sapiens
agcctctgccgct

SEQ ID NO: 4545472 - DNA, 16 bp, Homo sapiens
agcctctgccgctgcc

SEQ ID NO: 4545473 - DNA, 20 bp, Homo sapiens
agcctctgccgctgccatgc

SEQ ID NO: 4545474 - DNA, 22 bp, Homo sapiens
agcctctgccgctgccatgctt

SEQ ID NO: 4545475 - DNA, 13 bp, Homo sapiens
agcctctgctgga

SEQ ID NO: 4545476 - DNA, 23 bp, Homo sapiens
agcctctggacagccagtgacct

SEQ ID NO: 4545477 - DNA, 13 bp, Homo sapiens
agcctctggcccc

SEQ ID NO: 4545478 - DNA, 18 bp, Homo sapiens
agcctctggcccctcacc

SEQ ID NO: 4545479 - DNA, 12 bp, Homo sapiens
agcctctggcta

SEQ ID NO: 4545480 - DNA, 20 bp, Homo sapiens
agcctctggctagaggccag

SEQ ID NO: 4545481 - DNA, 16 bp, Homo sapiens
agcctctttttgatac

SEQ ID NO: 4545482 - DNA, 18 bp, Homo sapiens
agcctgaattgctttctg

SEQ ID NO: 4545483 - DNA, 21 bp, Homo sapiens
agcctgaattgctttctgctc

SEQ ID NO: 4545484 - DNA, 17 bp, Homo sapiens
agcctgacaacatttct

SEQ ID NO: 4545485 - DNA, 18 bp, Homo sapiens
agcctgacgctcagcccc

SEQ ID NO: 4545486 - DNA, 20 bp, Homo sapiens
agcctgacgctcagccccag

SEQ ID NO: 4545487 - DNA, 18 bp, Homo sapiens
agcctgagcgacagtgag

SEQ ID NO: 4545488 - DNA, 13 bp, Homo sapiens
agcctgagtgaca

SEQ ID NO: 4545489 - DNA, 23 bp, Homo sapiens
agcctgatactttagccatcata

SEQ ID NO: 4545490 - DNA, 14 bp, Homo sapiens
agcctgcacctgcc

SEQ ID NO: 4545491 - DNA, 15 bp, Homo sapiens
agcctgcacctgccc

SEQ ID NO: 4545492 - DNA, 19 bp, Homo sapiens
agcctgcacctgccccgtg

SEQ ID NO: 4545493 - DNA, 22 bp, Homo sapiens
agcctgcacctgccccgtgtgt

SEQ ID NO: 4545494 - DNA, 17 bp, Homo sapiens
agcctgcactttgatgt

SEQ ID NO: 4545495 - DNA, 23 bp, Homo sapiens
agcctgcattatgcacgtgtctg

SEQ ID NO: 4545496 - DNA, 22 bp, Homo sapiens
agcctgcattgagcttgcatgc

SEQ ID NO: 4545497 - DNA, 14 bp, Homo sapiens
agcctgcctggcag

SEQ ID NO: 4545498 - DNA, 23 bp, Homo sapiens
agcctgctcccccaccccctccc

SEQ ID NO: 4545499 - DNA, 20 bp, Homo sapiens
agcctgctccttcccaggag

SEQ ID NO: 4545500 - DNA, 11 bp, Homo sapiens
agcctgctggc

SEQ ID NO: 4545501 - DNA, 20 bp, Homo sapiens
agcctgctggtcacagcctc

SEQ ID NO: 4545502 - DNA, 10 bp, Homo sapiens
agcctggatg

SEQ ID NO: 4545503 - DNA, 11 bp, Homo sapiens
agcctggatgc

SEQ ID NO: 4545504 - DNA, 16 bp, Homo sapiens
agcctggatgccatcc

SEQ ID NO: 4545505 - DNA, 16 bp, Homo sapiens
agcctggccaccagcc

SEQ ID NO: 4545506 - DNA, 13 bp, Homo sapiens
agcctggccccag

SEQ ID NO: 4545507 - DNA, 12 bp, Homo sapiens
agcctggctctg

SEQ ID NO: 4545508 - DNA, 17 bp, Homo sapiens
agcctggctctgccccc

SEQ ID NO: 4545509 - DNA, 21 bp, Homo sapiens
agcctgggacagtttatcatg

SEQ ID NO: 4545510 - DNA, 17 bp, Homo sapiens
agcctgggcagccaggc

SEQ ID NO: 4545511 - DNA, 11 bp, Homo sapiens
agcctgggctc

SEQ ID NO: 4545512 - DNA, 15 bp, Homo sapiens
agcctgggctcactg

SEQ ID NO: 4545513 - DNA, 20 bp, Homo sapiens
agcctgggctcactgtgctg

SEQ ID NO: 4545514 - DNA, 17 bp, Homo sapiens
agcctggggctgaggct

SEQ ID NO: 4545515 - DNA, 16 bp, Homo sapiens
agcctgtatcttgggg

SEQ ID NO: 4545516 - DNA, 22 bp, Homo sapiens
agcctgtggcatctttgccttg

SEQ ID NO: 4545517 - DNA, 18 bp, Homo sapiens
agcctgtggcggtgcctg

SEQ ID NO: 4545518 - DNA, 22 bp, Homo sapiens
agcctgtggcggtgcctgggtg

SEQ ID NO: 4545519 - DNA, 15 bp, Homo sapiens
agccttaactttaaa

SEQ ID NO: 4545520 - DNA, 19 bp, Homo sapiens
agccttaagcacaattaat

SEQ ID NO: 4545521 - DNA, 15 bp, Homo sapiens
agccttaccttgaaa

SEQ ID NO: 4545522 - DNA, 14 bp, Homo sapiens
agccttactcacct

SEQ ID NO: 4545523 - DNA, 15 bp, Homo sapiens
agccttagggaagct

SEQ ID NO: 4545524 - DNA, 16 bp, Homo sapiens
agccttatgaaaatta

SEQ ID NO: 4545525 - DNA, 17 bp, Homo sapiens
agccttatgaaaattat

SEQ ID NO: 4545526 - DNA, 18 bp, Homo sapiens
agccttatgaaaattata

SEQ ID NO: 4545527 - DNA, 16 bp, Homo sapiens
agccttatttacctag

SEQ ID NO: 4545528 - DNA, 21 bp, Homo sapiens
agccttcaagaatcagaagaa

SEQ ID NO: 4545529 - DNA, 16 bp, Homo sapiens
agccttcaagtgccaa

SEQ ID NO: 4545530 - DNA, 24 bp, Homo sapiens
agccttcaagtgccaaacagagta

SEQ ID NO: 4545531 - DNA, 13 bp, Homo sapiens
agccttccagttt

SEQ ID NO: 4545532 - DNA, 13 bp, Homo sapiens
agccttcccctcc

SEQ ID NO: 4545533 - DNA, 12 bp, Homo sapiens
agccttctgcca

SEQ ID NO: 4545534 - DNA, 14 bp, Homo sapiens
agccttctgccacc

SEQ ID NO: 4545535 - DNA, 17 bp, Homo sapiens
agccttctgccaccagc

SEQ ID NO: 4545536 - DNA, 22 bp, Homo sapiens
agccttctgccaccagcccctc

SEQ ID NO: 4545537 - DNA, 18 bp, Homo sapiens
agccttgcagcggctcct

SEQ ID NO: 4545538 - DNA, 20 bp, Homo sapiens
agccttgcagcggctcctgc

SEQ ID NO: 4545539 - DNA, 22 bp, Homo sapiens
agccttgcagcggctcctgcaa

SEQ ID NO: 4545540 - DNA, 13 bp, Homo sapiens
agccttgcccagc

SEQ ID NO: 4545541 - DNA, 16 bp, Homo sapiens
agccttgctctcttca

SEQ ID NO: 4545542 - DNA, 22 bp, Homo sapiens
agccttgctctcttcaataaac

SEQ ID NO: 4545543 - DNA, 16 bp, Homo sapiens
agccttggtgtccacc

SEQ ID NO: 4545544 - DNA, 22 bp, Homo sapiens
agccttggtgtccacctggccc

SEQ ID NO: 4545545 - DNA, 20 bp, Homo sapiens
agcctttactgtttgatata

SEQ ID NO: 4545546 - DNA, 18 bp, Homo sapiens
agcctttatctatgggag

SEQ ID NO: 4545547 - DNA, 23 bp, Homo sapiens
agcctttcctcaaaactggagtc

SEQ ID NO: 4545548 - DNA, 15 bp, Homo sapiens
agcctttgtatcttt

SEQ ID NO: 4545549 - DNA, 13 bp, Homo sapiens
agccttttgaaag

SEQ ID NO: 4545550 - DNA, 23 bp, Homo sapiens
agcgaaaaaatcaggtggctttt

SEQ ID NO: 4545551 - DNA, 13 bp, Homo sapiens
agcgacagtgaga

SEQ ID NO: 4545552 - DNA, 13 bp, Homo sapiens
agcgagactccat

SEQ ID NO: 4545553 - DNA, 15 bp, Homo sapiens
agcgagactccatct

SEQ ID NO: 4545554 - DNA, 20 bp, Homo sapiens
agcgaggagatgctccttgg

SEQ ID NO: 4545555 - DNA, 15 bp, Homo sapiens
agcgaggaggctcca

SEQ ID NO: 4545556 - DNA, 19 bp, Homo sapiens
agcgaggaggctccagagg

SEQ ID NO: 4545557 - DNA, 22 bp, Homo sapiens
agcgatacacaaagctttcttt

SEQ ID NO: 4545558 - DNA, 16 bp, Homo sapiens
agcgattctcctgcct

SEQ ID NO: 4545559 - DNA, 20 bp, Homo sapiens
agcgccaagtggccactggc

SEQ ID NO: 4545560 - DNA, 16 bp, Homo sapiens
agcgcccccgagccct

SEQ ID NO: 4545561 - DNA, 18 bp, Homo sapiens
agcgcccccgagccctga

SEQ ID NO: 4545562 - DNA, 11 bp, Homo sapiens
agcgccctcac

SEQ ID NO: 4545563 - DNA, 12 bp, Homo sapiens
agcgcctccctc

SEQ ID NO: 4545564 - DNA, 20 bp, Homo sapiens
agcgcctccctccaccccag

SEQ ID NO: 4545565 - DNA, 15 bp, Homo sapiens
agcgctatccacaga

SEQ ID NO: 4545566 - DNA, 20 bp, Homo sapiens
agcgctcgatggacctcagc

SEQ ID NO: 4545567 - DNA, 18 bp, Homo sapiens
agcgctgccgcaccccag

SEQ ID NO: 4545568 - DNA, 20 bp, Homo sapiens
agcgctgccgcaccccagag

SEQ ID NO: 4545569 - DNA, 21 bp, Homo sapiens
agcgctgccgcaccccagagt

SEQ ID NO: 4545570 - DNA, 22 bp, Homo sapiens
agcggagcccgatattctccct

SEQ ID NO: 4545571 - DNA, 21 bp, Homo sapiens
agcggaggttgcagtgagctg

SEQ ID NO: 4545572 - DNA, 15 bp, Homo sapiens
agcggccctggagga

SEQ ID NO: 4545573 - DNA, 21 bp, Homo sapiens
agcggctcccctctgcttctc

SEQ ID NO: 4545574 - DNA, 16 bp, Homo sapiens
agcggctgagtcatga

SEQ ID NO: 4545575 - DNA, 21 bp, Homo sapiens
agcggctgagtcatgatctcc

SEQ ID NO: 4545576 - DNA, 16 bp, Homo sapiens
agcggctgccctctgg

SEQ ID NO: 4545577 - DNA, 11 bp, Homo sapiens
agcgggagccc

SEQ ID NO: 4545578 - DNA, 17 bp, Homo sapiens
agcggtccctgtccctc

SEQ ID NO: 4545579 - DNA, 16 bp, Homo sapiens
agcgtcaagacatttg

SEQ ID NO: 4545580 - DNA, 13 bp, Homo sapiens
agcgtcagaagtc

SEQ ID NO: 4545581 - DNA, 15 bp, Homo sapiens
agcgtccagaaatgg

SEQ ID NO: 4545582 - DNA, 22 bp, Homo sapiens
agcgtcccctgctactcctgtg

SEQ ID NO: 4545583 - DNA, 14 bp, Homo sapiens
agcgtccctggcgc

SEQ ID NO: 4545584 - DNA, 15 bp, Homo sapiens
agcgtccctggcgca

SEQ ID NO: 4545585 - DNA, 16 bp, Homo sapiens
agcgtcctcctctgtg

SEQ ID NO: 4545586 - DNA, 12 bp, Homo sapiens
agcgtctgggaa

SEQ ID NO: 4545587 - DNA, 23 bp, Homo sapiens
agcgtgtctgtatttatgtgtga

SEQ ID NO: 4545588 - DNA, 16 bp, Homo sapiens
agcgtgtgtgccacct

SEQ ID NO: 4545589 - DNA, 14 bp, Homo sapiens
agcgtgttctcagc

SEQ ID NO: 4545590 - DNA, 16 bp, Homo sapiens
agcgtgttctcagcac

SEQ ID NO: 4545591 - DNA, 15 bp, Homo sapiens
agcgttaatgtaaag

SEQ ID NO: 4545592 - DNA, 14 bp, Homo sapiens
agcgttctggactc

SEQ ID NO: 4545593 - DNA, 16 bp, Homo sapiens
agcgttctggactctg

SEQ ID NO: 4545594 - DNA, 19 bp, Homo sapiens
agcgttctggactctgccc

SEQ ID NO: 4545595 - DNA, 15 bp, Homo sapiens
agctaaaaatgaacc

SEQ ID NO: 4545596 - DNA, 18 bp, Homo sapiens
agctaaacggattccaaa

SEQ ID NO: 4545597 - DNA, 12 bp, Homo sapiens
agctaataatga

SEQ ID NO: 4545598 - DNA, 16 bp, Homo sapiens
agctaatctgaccgtt

SEQ ID NO: 4545599 - DNA, 14 bp, Homo sapiens
agctaatctgcctg

SEQ ID NO: 4545600 - DNA, 13 bp, Homo sapiens
agctaatttgcat

SEQ ID NO: 4545601 - DNA, 13 bp, Homo sapiens
agctaatttttgt

SEQ ID NO: 4545602 - DNA, 22 bp, Homo sapiens
agctacactcattgaaatgtaa

SEQ ID NO: 4545603 - DNA, 18 bp, Homo sapiens
agctacagtgcatagttg

SEQ ID NO: 4545604 - DNA, 22 bp, Homo sapiens
agctacctacatgctgaaaaat

SEQ ID NO: 4545605 - DNA, 23 bp, Homo sapiens
agctacctacatgctgaaaaata

SEQ ID NO: 4545606 - DNA, 16 bp, Homo sapiens
agctacctttttatat

SEQ ID NO: 4545607 - DNA, 15 bp, Homo sapiens
agctactcaggaggc

SEQ ID NO: 4545608 - DNA, 23 bp, Homo sapiens
agctactcgatagcctgaggtgg

SEQ ID NO: 4545609 - DNA, 22 bp, Homo sapiens
agctactctccccacgagggct

SEQ ID NO: 4545610 - DNA, 23 bp, Homo sapiens
agctactctccccacgagggctg

SEQ ID NO: 4545611 - DNA, 14 bp, Homo sapiens
agctactggggagg

SEQ ID NO: 4545612 - DNA, 17 bp, Homo sapiens
agctactggggaggctg

SEQ ID NO: 4545613 - DNA, 19 bp, Homo sapiens
agctactgtgtgtgtgaat

SEQ ID NO: 4545614 - DNA, 23 bp, Homo sapiens
agctactgtgtgtgtgaatgaac

SEQ ID NO: 4545615 - DNA, 18 bp, Homo sapiens
agctacttgggaggctga

SEQ ID NO: 4545616 - DNA, 12 bp, Homo sapiens
agctagaaatga

SEQ ID NO: 4545617 - DNA, 16 bp, Homo sapiens
agctagaacccggcag

SEQ ID NO: 4545618 - DNA, 16 bp, Homo sapiens
agctagaacctggagg

SEQ ID NO: 4545619 - DNA, 19 bp, Homo sapiens
agctagaactttgaaggac

SEQ ID NO: 4545620 - DNA, 19 bp, Homo sapiens
agctagaagtgggccagga

SEQ ID NO: 4545621 - DNA, 15 bp, Homo sapiens
agctagaatttctgg

SEQ ID NO: 4545622 - DNA, 22 bp, Homo sapiens
agctagcaataggtttgtaaaa

SEQ ID NO: 4545623 - DNA, 20 bp, Homo sapiens
agctagccagagggtgggag

SEQ ID NO: 4545624 - DNA, 18 bp, Homo sapiens
agctagcgctgccgcacc

SEQ ID NO: 4545625 - DNA, 20 bp, Homo sapiens
agctagcgctgccgcacccc

SEQ ID NO: 4545626 - DNA, 18 bp, Homo sapiens
agctaggaagagcaggac

SEQ ID NO: 4545627 - DNA, 19 bp, Homo sapiens
agctagtgccaaataattg

SEQ ID NO: 4545628 - DNA, 15 bp, Homo sapiens
agctataattctgtt

SEQ ID NO: 4545629 - DNA, 13 bp, Homo sapiens
agctatatttgat

SEQ ID NO: 4545630 - DNA, 14 bp, Homo sapiens
agctatcctttcaa

SEQ ID NO: 4545631 - DNA, 15 bp, Homo sapiens
agctatcctttcaaa

SEQ ID NO: 4545632 - DNA, 18 bp, Homo sapiens
agctatgcgcaatgtggc

SEQ ID NO: 4545633 - DNA, 20 bp, Homo sapiens
agctatgctgtatctgtgct

SEQ ID NO: 4545634 - DNA, 19 bp, Homo sapiens
agctatgggagccccaggg

SEQ ID NO: 4545635 - DNA, 22 bp, Homo sapiens
agctatgggagccccagggtct

SEQ ID NO: 4545636 - DNA, 18 bp, Homo sapiens
agctatgttatattgaaa

SEQ ID NO: 4545637 - DNA, 20 bp, Homo sapiens
agctatgttatattgaaaaa

SEQ ID NO: 4545638 - DNA, 14 bp, Homo sapiens
agctatttcatcta

SEQ ID NO: 4545639 - DNA, 15 bp, Homo sapiens
agctattttagaaag

SEQ ID NO: 4545640 - DNA, 16 bp, Homo sapiens
agctattttagaaagc

SEQ ID NO: 4545641 - DNA, 18 bp, Homo sapiens
agctattttagaaagcta

SEQ ID NO: 4545642 - DNA, 15 bp, Homo sapiens
agctattttcctctg

SEQ ID NO: 4545643 - DNA, 23 bp, Homo sapiens
agctatttttttcctaagacatt

SEQ ID NO: 4545644 - DNA, 13 bp, Homo sapiens
agctcaaaaatac

SEQ ID NO: 4545645 - DNA, 12 bp, Homo sapiens
agctcaaatgaa

SEQ ID NO: 4545646 - DNA, 16 bp, Homo sapiens
agctcaaatgaaatgt

SEQ ID NO: 4545647 - DNA, 17 bp, Homo sapiens
agctcaaatgaaatgta

SEQ ID NO: 4545648 - DNA, 23 bp, Homo sapiens
agctcaaatgaaatgtatgcatt

SEQ ID NO: 4545649 - DNA, 19 bp, Homo sapiens
agctcacacatcctgtcag

SEQ ID NO: 4545650 - DNA, 23 bp, Homo sapiens
agctcacagttcctcgccctggg

SEQ ID NO: 4545651 - DNA, 17 bp, Homo sapiens
agctcacatgggactgg

SEQ ID NO: 4545652 - DNA, 21 bp, Homo sapiens
agctcaccccccacactcact

SEQ ID NO: 4545653 - DNA, 17 bp, Homo sapiens
agctcactgcagcctca

SEQ ID NO: 4545654 - DNA, 20 bp, Homo sapiens
agctcagacccccactctca

SEQ ID NO: 4545655 - DNA, 18 bp, Homo sapiens
agctcagccccaactctt

SEQ ID NO: 4545656 - DNA, 20 bp, Homo sapiens
agctcaggaaccgaggcagg

SEQ ID NO: 4545657 - DNA, 16 bp, Homo sapiens
agctcaggaggtcaag

SEQ ID NO: 4545658 - DNA, 23 bp, Homo sapiens
agctcaggagtttgagaccaggc

SEQ ID NO: 4545659 - DNA, 16 bp, Homo sapiens
agctcaggtcctgctg

SEQ ID NO: 4545660 - DNA, 19 bp, Homo sapiens
agctcattaaactttttta

SEQ ID NO: 4545661 - DNA, 21 bp, Homo sapiens
agctcattaaacttttttaac

SEQ ID NO: 4545662 - DNA, 19 bp, Homo sapiens
agctccagcgatggtgctg

SEQ ID NO: 4545663 - DNA, 20 bp, Homo sapiens
agctccagcgatggtgctgc

SEQ ID NO: 4545664 - DNA, 22 bp, Homo sapiens
agctcccacaccgcgtcccagc

SEQ ID NO: 4545665 - DNA, 21 bp, Homo sapiens
agctcccccgtggtgcctgca

SEQ ID NO: 4545666 - DNA, 22 bp, Homo sapiens
agctcccccgtggtgcctgcac

SEQ ID NO: 4545667 - DNA, 17 bp, Homo sapiens
agctcccctcggagaag

SEQ ID NO: 4545668 - DNA, 22 bp, Homo sapiens
agctcccctcttttgtaagtat

SEQ ID NO: 4545669 - DNA, 16 bp, Homo sapiens
agctcccctggctggc

SEQ ID NO: 4545670 - DNA, 19 bp, Homo sapiens
agctcccctggctggctcc

SEQ ID NO: 4545671 - DNA, 18 bp, Homo sapiens
agctccctggcttctgtg

SEQ ID NO: 4545672 - DNA, 16 bp, Homo sapiens
agctccctttctcagg

SEQ ID NO: 4545673 - DNA, 17 bp, Homo sapiens
agctccgggggtacagc

SEQ ID NO: 4545674 - DNA, 15 bp, Homo sapiens
agctccgtggagcag

SEQ ID NO: 4545675 - DNA, 11 bp, Homo sapiens
agctcctccct

SEQ ID NO: 4545676 - DNA, 18 bp, Homo sapiens
agctcctccctccagctg

SEQ ID NO: 4545677 - DNA, 19 bp, Homo sapiens
agctcctccctccagctgc

SEQ ID NO: 4545678 - DNA, 14 bp, Homo sapiens
agctcctctcctgg

SEQ ID NO: 4545679 - DNA, 20 bp, Homo sapiens
agctcctggaccaggcccat

SEQ ID NO: 4545680 - DNA, 19 bp, Homo sapiens
agctcctggggagctcctg

SEQ ID NO: 4545681 - DNA, 21 bp, Homo sapiens
agctcctggggagctcctggg

SEQ ID NO: 4545682 - DNA, 22 bp, Homo sapiens
agctcctggggagctcctggga

SEQ ID NO: 4545683 - DNA, 17 bp, Homo sapiens
agctccttaaggctctt

SEQ ID NO: 4545684 - DNA, 15 bp, Homo sapiens
agctccttcctggag

SEQ ID NO: 4545685 - DNA, 17 bp, Homo sapiens
agctcctttctcctgtg

SEQ ID NO: 4545686 - DNA, 19 bp, Homo sapiens
agctcctttctcctgtgaa

SEQ ID NO: 4545687 - DNA, 20 bp, Homo sapiens
agctcctttctcctgtgaat

SEQ ID NO: 4545688 - DNA, 16 bp, Homo sapiens
agctcggggacaggtg

SEQ ID NO: 4545689 - DNA, 20 bp, Homo sapiens
agctctcaggaccgtgccct

SEQ ID NO: 4545690 - DNA, 21 bp, Homo sapiens
agctctcaggaccgtgccctc

SEQ ID NO: 4545691 - DNA, 17 bp, Homo sapiens
agctctcccagtgaact

SEQ ID NO: 4545692 - DNA, 11 bp, Homo sapiens
agctctccctc

SEQ ID NO: 4545693 - DNA, 15 bp, Homo sapiens
agctctccctctggc

SEQ ID NO: 4545694 - DNA, 16 bp, Homo sapiens
agctctccctctggcc

SEQ ID NO: 4545695 - DNA, 18 bp, Homo sapiens
agctctctctagaatgag

SEQ ID NO: 4545696 - DNA, 14 bp, Homo sapiens
agctctgaaaacaa

SEQ ID NO: 4545697 - DNA, 18 bp, Homo sapiens
agctctgaaaccagtgtt

SEQ ID NO: 4545698 - DNA, 15 bp, Homo sapiens
agctctgaatagtta

SEQ ID NO: 4545699 - DNA, 17 bp, Homo sapiens
agctctgagccagatta

SEQ ID NO: 4545700 - DNA, 23 bp, Homo sapiens
agctctgatctgaggctaagaca

SEQ ID NO: 4545701 - DNA, 15 bp, Homo sapiens
agctctgcccccgcg

SEQ ID NO: 4545702 - DNA, 11 bp, Homo sapiens
agctctgcctt

SEQ ID NO: 4545703 - DNA, 19 bp, Homo sapiens
agctctgtatggtcaggat

SEQ ID NO: 4545704 - DNA, 17 bp, Homo sapiens
agctcttcaggcctccc

SEQ ID NO: 4545705 - DNA, 11 bp, Homo sapiens
agctcttccct

SEQ ID NO: 4545706 - DNA, 13 bp, Homo sapiens
agctcttccctta

SEQ ID NO: 4545707 - DNA, 15 bp, Homo sapiens
agctcttgggtcaga

SEQ ID NO: 4545708 - DNA, 17 bp, Homo sapiens
agctcttgggtcagaga

SEQ ID NO: 4545709 - DNA, 21 bp, Homo sapiens
agctcttttttgtttgtttct

SEQ ID NO: 4545710 - DNA, 13 bp, Homo sapiens
agctgaaccacag

SEQ ID NO: 4545711 - DNA, 15 bp, Homo sapiens
agctgaaccacagaa

SEQ ID NO: 4545712 - DNA, 16 bp, Homo sapiens
agctgaaccacagaaa

SEQ ID NO: 4545713 - DNA, 22 bp, Homo sapiens
agctgaagagcacggtccccca

SEQ ID NO: 4545714 - DNA, 21 bp, Homo sapiens
agctgaagatccccaactgct

SEQ ID NO: 4545715 - DNA, 21 bp, Homo sapiens
agctgacccagagtggagtct

SEQ ID NO: 4545716 - DNA, 13 bp, Homo sapiens
agctgactcacac

SEQ ID NO: 4545717 - DNA, 23 bp, Homo sapiens
agctgactggtttctcctggtag

SEQ ID NO: 4545718 - DNA, 20 bp, Homo sapiens
agctgagcacccagctctgt

SEQ ID NO: 4545719 - DNA, 16 bp, Homo sapiens
agctgagcagcctctg

SEQ ID NO: 4545720 - DNA, 17 bp, Homo sapiens
agctgagcagcctctgg

SEQ ID NO: 4545721 - DNA, 18 bp, Homo sapiens
agctgagcagcctctgga

SEQ ID NO: 4545722 - DNA, 14 bp, Homo sapiens
agctgagcaggtgt

SEQ ID NO: 4545723 - DNA, 12 bp, Homo sapiens
agctgagcctga

SEQ ID NO: 4545724 - DNA, 16 bp, Homo sapiens
agctgaggcagcagtg

SEQ ID NO: 4545725 - DNA, 15 bp, Homo sapiens
agctgagttgggggt

SEQ ID NO: 4545726 - DNA, 20 bp, Homo sapiens
agctgatactttgacagtgt

SEQ ID NO: 4545727 - DNA, 23 bp, Homo sapiens
agctgatccagtaacctcggaga

SEQ ID NO: 4545728 - DNA, 18 bp, Homo sapiens
agctgattccagaacaaa

SEQ ID NO: 4545729 - DNA, 16 bp, Homo sapiens
agctgcaaatctgatg

SEQ ID NO: 4545730 - DNA, 22 bp, Homo sapiens
agctgcaggaatcacccctctg

SEQ ID NO: 4545731 - DNA, 14 bp, Homo sapiens
agctgcccagccct

SEQ ID NO: 4545732 - DNA, 17 bp, Homo sapiens
agctgcccagccctggc

SEQ ID NO: 4545733 - DNA, 18 bp, Homo sapiens
agctgcccagccctggcc

SEQ ID NO: 4545734 - DNA, 22 bp, Homo sapiens
agctgcccagccctggcccagg

SEQ ID NO: 4545735 - DNA, 17 bp, Homo sapiens
agctgccccggcccctc

SEQ ID NO: 4545736 - DNA, 16 bp, Homo sapiens
agctgcccttgcaggg

SEQ ID NO: 4545737 - DNA, 17 bp, Homo sapiens
agctgcccttgcagggt

SEQ ID NO: 4545738 - DNA, 20 bp, Homo sapiens
agctgcccttgcagggtggg

SEQ ID NO: 4545739 - DNA, 22 bp, Homo sapiens
agctgcccttgcagggtgggtg

SEQ ID NO: 4545740 - DNA, 13 bp, Homo sapiens
agctgcctctgct

SEQ ID NO: 4545741 - DNA, 14 bp, Homo sapiens
agctgcctctgctc

SEQ ID NO: 4545742 - DNA, 16 bp, Homo sapiens
agctgcctctgctccc

SEQ ID NO: 4545743 - DNA, 17 bp, Homo sapiens
agctgcctcttctcttg

SEQ ID NO: 4545744 - DNA, 14 bp, Homo sapiens
agctgcctgtgcct

SEQ ID NO: 4545745 - DNA, 13 bp, Homo sapiens
agctgccttagct

SEQ ID NO: 4545746 - DNA, 16 bp, Homo sapiens
agctgccttagcttca

SEQ ID NO: 4545747 - DNA, 20 bp, Homo sapiens
agctgccttagcttcaggaa

SEQ ID NO: 4545748 - DNA, 22 bp, Homo sapiens
agctgccttagcttcaggaacc

SEQ ID NO: 4545749 - DNA, 23 bp, Homo sapiens
agctgccttagcttcaggaacct

SEQ ID NO: 4545750 - DNA, 17 bp, Homo sapiens
agctgccttccctagct

SEQ ID NO: 4545751 - DNA, 20 bp, Homo sapiens
agctgcctttcgtgatctta

SEQ ID NO: 4545752 - DNA, 17 bp, Homo sapiens
agctgcgcttgcttttc

SEQ ID NO: 4545753 - DNA, 18 bp, Homo sapiens
agctgcgcttgcttttct

SEQ ID NO: 4545754 - DNA, 17 bp, Homo sapiens
agctgcggccaggcctg

SEQ ID NO: 4545755 - DNA, 14 bp, Homo sapiens
agctgctccccacg

SEQ ID NO: 4545756 - DNA, 17 bp, Homo sapiens
agctgctccccacgtca

SEQ ID NO: 4545757 - DNA, 15 bp, Homo sapiens
agctgctctccttca

SEQ ID NO: 4545758 - DNA, 18 bp, Homo sapiens
agctgctctccttcactc

SEQ ID NO: 4545759 - DNA, 23 bp, Homo sapiens
agctgctctccttcactctgaca

SEQ ID NO: 4545760 - DNA, 15 bp, Homo sapiens
agctgctgagtgaca

SEQ ID NO: 4545761 - DNA, 16 bp, Homo sapiens
agctgctgagtgacag

SEQ ID NO: 4545762 - DNA, 20 bp, Homo sapiens
agctgctggatgacttgaga

SEQ ID NO: 4545763 - DNA, 23 bp, Homo sapiens
agctgctggatgacttgagatga

SEQ ID NO: 4545764 - DNA, 14 bp, Homo sapiens
agctgctgtgtcct

SEQ ID NO: 4545765 - DNA, 18 bp, Homo sapiens
agctgctgttctcaggac

SEQ ID NO: 4545766 - DNA, 21 bp, Homo sapiens
agctgctgttctcaggacagc

SEQ ID NO: 4545767 - DNA, 19 bp, Homo sapiens
agctgcttttgcagaaatc

SEQ ID NO: 4545768 - DNA, 23 bp, Homo sapiens
agctggaatgtgccacagaggcc

SEQ ID NO: 4545769 - DNA, 20 bp, Homo sapiens
agctggaggaatacatttta

SEQ ID NO: 4545770 - DNA, 11 bp, Homo sapiens
agctggcctgc

SEQ ID NO: 4545771 - DNA, 18 bp, Homo sapiens
agctggcgctcagcagcc

SEQ ID NO: 4545772 - DNA, 20 bp, Homo sapiens
agctggcgctcagcagccct

SEQ ID NO: 4545773 - DNA, 21 bp, Homo sapiens
agctggctctgtgagggtgct

SEQ ID NO: 4545774 - DNA, 22 bp, Homo sapiens
agctggctctgtgagggtgctg

SEQ ID NO: 4545775 - DNA, 22 bp, Homo sapiens
agctggctttgaaacctcaggg

SEQ ID NO: 4545776 - DNA, 14 bp, Homo sapiens
agctgggaaattca

SEQ ID NO: 4545777 - DNA, 13 bp, Homo sapiens
agctgggaggaaa

SEQ ID NO: 4545778 - DNA, 18 bp, Homo sapiens
agctgggaggaaaagaaa

SEQ ID NO: 4545779 - DNA, 21 bp, Homo sapiens
agctgggcccaaccctgtctg

SEQ ID NO: 4545780 - DNA, 13 bp, Homo sapiens
agctgggccccag

SEQ ID NO: 4545781 - DNA, 15 bp, Homo sapiens
agctgggccccagcc

SEQ ID NO: 4545782 - DNA, 18 bp, Homo sapiens
agctgggccccagcccac

SEQ ID NO: 4545783 - DNA, 17 bp, Homo sapiens
agctgggcccctgcaca

SEQ ID NO: 4545784 - DNA, 14 bp, Homo sapiens
agctgggccctgcc

SEQ ID NO: 4545785 - DNA, 21 bp, Homo sapiens
agctgggccctgcctgcagcc

SEQ ID NO: 4545786 - DNA, 22 bp, Homo sapiens
agctgggccctgcctgcagcca

SEQ ID NO: 4545787 - DNA, 23 bp, Homo sapiens
agctgggccctgcctgcagccag

SEQ ID NO: 4545788 - DNA, 17 bp, Homo sapiens
agctgggctaagtaaat

SEQ ID NO: 4545789 - DNA, 18 bp, Homo sapiens
agctggggactcagggac

SEQ ID NO: 4545790 - DNA, 20 bp, Homo sapiens
agctggggccagaggctggg

SEQ ID NO: 4545791 - DNA, 13 bp, Homo sapiens
agctggggccggt

SEQ ID NO: 4545792 - DNA, 21 bp, Homo sapiens
agctgggggatagaggggctg

SEQ ID NO: 4545793 - DNA, 13 bp, Homo sapiens
agctggtaacatc

SEQ ID NO: 4545794 - DNA, 14 bp, Homo sapiens
agctggtcgagcag

SEQ ID NO: 4545795 - DNA, 19 bp, Homo sapiens
agctggtctggagttgctg

SEQ ID NO: 4545796 - DNA, 13 bp, Homo sapiens
agctggttgctcc

SEQ ID NO: 4545797 - DNA, 22 bp, Homo sapiens
agctgtaaacttccaatttcta

SEQ ID NO: 4545798 - DNA, 20 bp, Homo sapiens
agctgtaatttcgccttaaa

SEQ ID NO: 4545799 - DNA, 19 bp, Homo sapiens
agctgtacaaatcctctgt

SEQ ID NO: 4545800 - DNA, 23 bp, Homo sapiens
agctgtactcttctgactgcccc

SEQ ID NO: 4545801 - DNA, 21 bp, Homo sapiens
agctgtatagctgcttccagt

SEQ ID NO: 4545802 - DNA, 15 bp, Homo sapiens
agctgtcctgtgatg

SEQ ID NO: 4545803 - DNA, 16 bp, Homo sapiens
agctgtcctgtgatgt

SEQ ID NO: 4545804 - DNA, 18 bp, Homo sapiens
agctgtgcaggtggggag

SEQ ID NO: 4545805 - DNA, 21 bp, Homo sapiens
agctgtggcagagttacagtt

SEQ ID NO: 4545806 - DNA, 18 bp, Homo sapiens
agctgtgggcggctcctg

SEQ ID NO: 4545807 - DNA, 23 bp, Homo sapiens
agctgtgggcggctcctggtgct

SEQ ID NO: 4545808 - DNA, 18 bp, Homo sapiens
agctgtgtccttgcacct

SEQ ID NO: 4545809 - DNA, 20 bp, Homo sapiens
agctgtgtccttgcacctgc

SEQ ID NO: 4545810 - DNA, 24 bp, Homo sapiens
agctgtgtccttgcacctgcatcc

SEQ ID NO: 4545811 - DNA, 19 bp, Homo sapiens
agctgttaccattcacaat

SEQ ID NO: 4545812 - DNA, 18 bp, Homo sapiens
agctgttatttcttccct

SEQ ID NO: 4545813 - DNA, 14 bp, Homo sapiens
agctgttcacagcc

SEQ ID NO: 4545814 - DNA, 19 bp, Homo sapiens
agctgttcacagccagact

SEQ ID NO: 4545815 - DNA, 17 bp, Homo sapiens
agctgttctaatggatt

SEQ ID NO: 4545816 - DNA, 13 bp, Homo sapiens
agctgttcttgaa

SEQ ID NO: 4545817 - DNA, 17 bp, Homo sapiens
agctgtttatggcctca

SEQ ID NO: 4545818 - DNA, 18 bp, Homo sapiens
agctgtttatggcctcag

SEQ ID NO: 4545819 - DNA, 19 bp, Homo sapiens
agctgtttatggcctcagc

SEQ ID NO: 4545820 - DNA, 13 bp, Homo sapiens
agctgtttatgtt

SEQ ID NO: 4545821 - DNA, 17 bp, Homo sapiens
agctgtttatgttttta

SEQ ID NO: 4545822 - DNA, 16 bp, Homo sapiens
agctgtttggaaaaga

SEQ ID NO: 4545823 - DNA, 16 bp, Homo sapiens
agcttaaaacacttct

SEQ ID NO: 4545824 - DNA, 22 bp, Homo sapiens
agcttaaaactttgaagttagc

SEQ ID NO: 4545825 - DNA, 18 bp, Homo sapiens
agcttaaacccatacaat

SEQ ID NO: 4545826 - DNA, 20 bp, Homo sapiens
agcttaaacccatacaatgt

SEQ ID NO: 4545827 - DNA, 18 bp, Homo sapiens
agcttaaagcttgatttg

SEQ ID NO: 4545828 - DNA, 16 bp, Homo sapiens
agcttaaataggaaag

SEQ ID NO: 4545829 - DNA, 12 bp, Homo sapiens
agcttaacattt

SEQ ID NO: 4545830 - DNA, 19 bp, Homo sapiens
agcttaatggctgataatt

SEQ ID NO: 4545831 - DNA, 19 bp, Homo sapiens
agcttaatttttaaaaaca

SEQ ID NO: 4545832 - DNA, 23 bp, Homo sapiens
agcttactgagttatcaggtgca

SEQ ID NO: 4545833 - DNA, 18 bp, Homo sapiens
agcttagctttagaaaca

SEQ ID NO: 4545834 - DNA, 13 bp, Homo sapiens
agcttaggtcaaa

SEQ ID NO: 4545835 - DNA, 22 bp, Homo sapiens
agcttatcctaaggctgtccac

SEQ ID NO: 4545836 - DNA, 15 bp, Homo sapiens
agcttattaaaactc

SEQ ID NO: 4545837 - DNA, 13 bp, Homo sapiens
agcttcaatataa

SEQ ID NO: 4545838 - DNA, 14 bp, Homo sapiens
agcttcaatataag

SEQ ID NO: 4545839 - DNA, 18 bp, Homo sapiens
agcttcaatataagaagc

SEQ ID NO: 4545840 - DNA, 16 bp, Homo sapiens
agcttcagcaggaggc

SEQ ID NO: 4545841 - DNA, 19 bp, Homo sapiens
agcttcagtcattaaatta

SEQ ID NO: 4545842 - DNA, 20 bp, Homo sapiens
agcttcatgtggcttccctt

SEQ ID NO: 4545843 - DNA, 18 bp, Homo sapiens
agcttccatagctgctgc

SEQ ID NO: 4545844 - DNA, 21 bp, Homo sapiens
agcttccatagctgctgccct

SEQ ID NO: 4545845 - DNA, 22 bp, Homo sapiens
agcttcctacccacacctctgc

SEQ ID NO: 4545846 - DNA, 19 bp, Homo sapiens
agcttcgaggacaggaaag

SEQ ID NO: 4545847 - DNA, 14 bp, Homo sapiens
agcttcggagggcc

SEQ ID NO: 4545848 - DNA, 20 bp, Homo sapiens
agcttctgcttttctgccct

SEQ ID NO: 4545849 - DNA, 17 bp, Homo sapiens
agcttctgtctccagct

SEQ ID NO: 4545850 - DNA, 23 bp, Homo sapiens
agcttgaaagcagttaaactgat

SEQ ID NO: 4545851 - DNA, 22 bp, Homo sapiens
agcttgaaagttttcagaacct

SEQ ID NO: 4545852 - DNA, 17 bp, Homo sapiens
agcttgatttgatcttt

SEQ ID NO: 4545853 - DNA, 15 bp, Homo sapiens
agcttgcacagccaa

SEQ ID NO: 4545854 - DNA, 15 bp, Homo sapiens
agcttgccagggatg

SEQ ID NO: 4545855 - DNA, 20 bp, Homo sapiens
agcttgccctggtgcctcac

SEQ ID NO: 4545856 - DNA, 19 bp, Homo sapiens
agcttggacagtctgagct

SEQ ID NO: 4545857 - DNA, 18 bp, Homo sapiens
agcttggactacacaata

SEQ ID NO: 4545858 - DNA, 23 bp, Homo sapiens
agcttggactacacaatacagta

SEQ ID NO: 4545859 - DNA, 17 bp, Homo sapiens
agcttggccctttcctt

SEQ ID NO: 4545860 - DNA, 15 bp, Homo sapiens
agcttgggtctctct

SEQ ID NO: 4545861 - DNA, 16 bp, Homo sapiens
agcttgggtctctctc

SEQ ID NO: 4545862 - DNA, 14 bp, Homo sapiens
agcttgtggagccc

SEQ ID NO: 4545863 - DNA, 17 bp, Homo sapiens
agcttgtggagccccac

SEQ ID NO: 4545864 - DNA, 18 bp, Homo sapiens
agcttgtggagccccaca

SEQ ID NO: 4545865 - DNA, 22 bp, Homo sapiens
agcttgttgtctccacttgtat

SEQ ID NO: 4545866 - DNA, 22 bp, Homo sapiens
agctttaaatgacagtaatatt

SEQ ID NO: 4545867 - DNA, 18 bp, Homo sapiens
agctttaacttaaatagt

SEQ ID NO: 4545868 - DNA, 16 bp, Homo sapiens
agctttagaccctggg

SEQ ID NO: 4545869 - DNA, 19 bp, Homo sapiens
agctttagaccctgggtgg

SEQ ID NO: 4545870 - DNA, 22 bp, Homo sapiens
agctttagaccctgggtgggct

SEQ ID NO: 4545871 - DNA, 17 bp, Homo sapiens
agctttaggtaaggaga

SEQ ID NO: 4545872 - DNA, 15 bp, Homo sapiens
agctttatctgtctt

SEQ ID NO: 4545873 - DNA, 19 bp, Homo sapiens
agctttatctttgtgtaat

SEQ ID NO: 4545874 - DNA, 14 bp, Homo sapiens
agctttatgatttt

SEQ ID NO: 4545875 - DNA, 12 bp, Homo sapiens
agctttcctggt

SEQ ID NO: 4545876 - DNA, 19 bp, Homo sapiens
agctttgactctataagca

SEQ ID NO: 4545877 - DNA, 16 bp, Homo sapiens
agctttgctctttaga

SEQ ID NO: 4545878 - DNA, 12 bp, Homo sapiens
agctttggaata

SEQ ID NO: 4545879 - DNA, 13 bp, Homo sapiens
agctttggaatat

SEQ ID NO: 4545880 - DNA, 21 bp, Homo sapiens
agctttgtcacttgccacatg

SEQ ID NO: 4545881 - DNA, 17 bp, Homo sapiens
agcttttatggatgatt

SEQ ID NO: 4545882 - DNA, 15 bp, Homo sapiens
agcttttctgatggt

SEQ ID NO: 4545883 - DNA, 18 bp, Homo sapiens
agcttttctttttctgta

SEQ ID NO: 4545884 - DNA, 21 bp, Homo sapiens
agcttttgatgtctccaagta

SEQ ID NO: 4545885 - DNA, 16 bp, Homo sapiens
agcttttgttctagac

SEQ ID NO: 4545886 - DNA, 17 bp, Homo sapiens
agcttttgttctagact

SEQ ID NO: 4545887 - DNA, 23 bp, Homo sapiens
agcttttgttctagacttcccca

SEQ ID NO: 4545888 - DNA, 15 bp, Homo sapiens
agctttttaatagca

SEQ ID NO: 4545889 - DNA, 17 bp, Homo sapiens
agctttttaatagcact

SEQ ID NO: 4545890 - DNA, 18 bp, Homo sapiens
agctttttaatagcacta

SEQ ID NO: 4545891 - DNA, 15 bp, Homo sapiens
agctttttattattt

SEQ ID NO: 4545892 - DNA, 22 bp, Homo sapiens
agctttttattcctcctgctca

SEQ ID NO: 4545893 - DNA, 23 bp, Homo sapiens
aggaaaaaaactgggataactga

SEQ ID NO: 4545894 - DNA, 16 bp, Homo sapiens
aggaaaaaaactttta

SEQ ID NO: 4545895 - DNA, 17 bp, Homo sapiens
aggaaaaaaacttttat

SEQ ID NO: 4545896 - DNA, 14 bp, Homo sapiens
aggaaaaagaaaat

SEQ ID NO: 4545897 - DNA, 13 bp, Homo sapiens
aggaaaaagctcc

SEQ ID NO: 4545898 - DNA, 18 bp, Homo sapiens
aggaaaaagctccatgtg

SEQ ID NO: 4545899 - DNA, 13 bp, Homo sapiens
aggaaaaggattt

SEQ ID NO: 4545900 - DNA, 22 bp, Homo sapiens
aggaaaaggcccctgcaatgtg

SEQ ID NO: 4545901 - DNA, 18 bp, Homo sapiens
aggaaaagttctttcaac

SEQ ID NO: 4545902 - DNA, 16 bp, Homo sapiens
aggaaaattgaatgca

SEQ ID NO: 4545903 - DNA, 19 bp, Homo sapiens
aggaaacaaaccttgcctt

SEQ ID NO: 4545904 - DNA, 19 bp, Homo sapiens
aggaaacaaccatgtcatt

SEQ ID NO: 4545905 - DNA, 21 bp, Homo sapiens
aggaaacagttgcatgtagta

SEQ ID NO: 4545906 - DNA, 20 bp, Homo sapiens
aggaaactgagtcactcaca

SEQ ID NO: 4545907 - DNA, 19 bp, Homo sapiens
aggaaactttttaattgtg

SEQ ID NO: 4545908 - DNA, 11 bp, Homo sapiens
aggaaagaaat

SEQ ID NO: 4545909 - DNA, 12 bp, Homo sapiens
aggaaagaaata

SEQ ID NO: 4545910 - DNA, 19 bp, Homo sapiens
aggaaagcaataaatgaat

SEQ ID NO: 4545911 - DNA, 23 bp, Homo sapiens
aggaaagccctcccccttcccct

SEQ ID NO: 4545912 - DNA, 20 bp, Homo sapiens
aggaaaggacggctgagcat

SEQ ID NO: 4545913 - DNA, 16 bp, Homo sapiens
aggaaaggctcattta

SEQ ID NO: 4545914 - DNA, 17 bp, Homo sapiens
aggaaagggctggctcc

SEQ ID NO: 4545915 - DNA, 17 bp, Homo sapiens
aggaaataaaaaagtct

SEQ ID NO: 4545916 - DNA, 21 bp, Homo sapiens
aggaaataaaaaagtctctat

SEQ ID NO: 4545917 - DNA, 16 bp, Homo sapiens
aggaaataaacattac

SEQ ID NO: 4545918 - DNA, 23 bp, Homo sapiens
aggaaatcaaatatgcaaagcac

SEQ ID NO: 4545919 - DNA, 21 bp, Homo sapiens
aggaaatccggtcagccaagt

SEQ ID NO: 4545920 - DNA, 13 bp, Homo sapiens
aggaaatgtgctc

SEQ ID NO: 4545921 - DNA, 14 bp, Homo sapiens
aggaaatgtgctca

SEQ ID NO: 4545922 - DNA, 21 bp, Homo sapiens
aggaaatgtgctcaaattact

SEQ ID NO: 4545923 - DNA, 12 bp, Homo sapiens
aggaacacctga

SEQ ID NO: 4545924 - DNA, 13 bp, Homo sapiens
aggaacacctgat

SEQ ID NO: 4545925 - DNA, 21 bp, Homo sapiens
aggaaccaacaatcttcctgt

SEQ ID NO: 4545926 - DNA, 23 bp, Homo sapiens
aggaacccttgcatccattgttg

SEQ ID NO: 4545927 - DNA, 17 bp, Homo sapiens
aggaacctctgatttat

SEQ ID NO: 4545928 - DNA, 18 bp, Homo sapiens
aggaacctctgatttatt

SEQ ID NO: 4545929 - DNA, 22 bp, Homo sapiens
aggaacctctgatttattttgt

SEQ ID NO: 4545930 - DNA, 19 bp, Homo sapiens
aggaacgggcagcctgggc

SEQ ID NO: 4545931 - DNA, 16 bp, Homo sapiens
aggaactagaaagaag

SEQ ID NO: 4545932 - DNA, 21 bp, Homo sapiens
aggaacttgccctgagcactc

SEQ ID NO: 4545933 - DNA, 17 bp, Homo sapiens
aggaagaacaacaaaga

SEQ ID NO: 4545934 - DNA, 12 bp, Homo sapiens
aggaagaacggg

SEQ ID NO: 4545935 - DNA, 15 bp, Homo sapiens
aggaagagaagacat

SEQ ID NO: 4545936 - DNA, 14 bp, Homo sapiens
aggaagagccacct

SEQ ID NO: 4545937 - DNA, 16 bp, Homo sapiens
aggaagagccacctgc

SEQ ID NO: 4545938 - DNA, 20 bp, Homo sapiens
aggaagagccacctgcaaga

SEQ ID NO: 4545939 - DNA, 12 bp, Homo sapiens
aggaagagttta

SEQ ID NO: 4545940 - DNA, 14 bp, Homo sapiens
aggaagagtttatg

SEQ ID NO: 4545941 - DNA, 16 bp, Homo sapiens
aggaagatgggaggtg

SEQ ID NO: 4545942 - DNA, 13 bp, Homo sapiens
aggaagatttgga

SEQ ID NO: 4545943 - DNA, 16 bp, Homo sapiens
aggaagcattgtaaaa

SEQ ID NO: 4545944 - DNA, 20 bp, Homo sapiens
aggaagcccaggagcctcac

SEQ ID NO: 4545945 - DNA, 19 bp, Homo sapiens
aggaaggagactcacctct

SEQ ID NO: 4545946 - DNA, 14 bp, Homo sapiens
aggaaggaggggag

SEQ ID NO: 4545947 - DNA, 11 bp, Homo sapiens
aggaaggattt

SEQ ID NO: 4545948 - DNA, 14 bp, Homo sapiens
aggaaggccaaaat

SEQ ID NO: 4545949 - DNA, 19 bp, Homo sapiens
aggaaggccaaaatcaaga

SEQ ID NO: 4545950 - DNA, 15 bp, Homo sapiens
aggaagggctgggcc

SEQ ID NO: 4545951 - DNA, 16 bp, Homo sapiens
aggaaggggccagagg

SEQ ID NO: 4545952 - DNA, 18 bp, Homo sapiens
aggaaggggccagaggct

SEQ ID NO: 4545953 - DNA, 20 bp, Homo sapiens
aggaaggggccagaggctcg

SEQ ID NO: 4545954 - DNA, 14 bp, Homo sapiens
aggaagtagaaaca

SEQ ID NO: 4545955 - DNA, 15 bp, Homo sapiens
aggaagtaggaagta

SEQ ID NO: 4545956 - DNA, 17 bp, Homo sapiens
aggaagtctaggagctg

SEQ ID NO: 4545957 - DNA, 14 bp, Homo sapiens
aggaagtgaaccca

SEQ ID NO: 4545958 - DNA, 18 bp, Homo sapiens
aggaagtggctgtccctg

SEQ ID NO: 4545959 - DNA, 18 bp, Homo sapiens
aggaagttgacttatagt

SEQ ID NO: 4545960 - DNA, 23 bp, Homo sapiens
aggaagttgacttatagtacatg

SEQ ID NO: 4545961 - DNA, 21 bp, Homo sapiens
aggaataaataaaaatggata

SEQ ID NO: 4545962 - DNA, 19 bp, Homo sapiens
aggaataaggcccagagcg

SEQ ID NO: 4545963 - DNA, 16 bp, Homo sapiens
aggaatagaggaagaa

SEQ ID NO: 4545964 - DNA, 20 bp, Homo sapiens
aggaatagaggaagaaatgt

SEQ ID NO: 4545965 - DNA, 11 bp, Homo sapiens
aggaatataca

SEQ ID NO: 4545966 - DNA, 22 bp, Homo sapiens
aggaatatacatagtctttgtt

SEQ ID NO: 4545967 - DNA, 17 bp, Homo sapiens
aggaatcaagagctgcc

SEQ ID NO: 4545968 - DNA, 21 bp, Homo sapiens
aggaatcaagagctgccctcc

SEQ ID NO: 4545969 - DNA, 19 bp, Homo sapiens
aggaatcacccctctgccc

SEQ ID NO: 4545970 - DNA, 23 bp, Homo sapiens
aggaatcacccctctgcccctgc

SEQ ID NO: 4545971 - DNA, 19 bp, Homo sapiens
aggaatcacgttagaggaa

SEQ ID NO: 4545972 - DNA, 19 bp, Homo sapiens
aggaatcacttttaactgt

SEQ ID NO: 4545973 - DNA, 15 bp, Homo sapiens
aggaatcccagaggt

SEQ ID NO: 4545974 - DNA, 16 bp, Homo sapiens
aggaatcggctgggga

SEQ ID NO: 4545975 - DNA, 22 bp, Homo sapiens
aggaatctgtgggtctgggagt

SEQ ID NO: 4545976 - DNA, 14 bp, Homo sapiens
aggaatctgtttct

SEQ ID NO: 4545977 - DNA, 17 bp, Homo sapiens
aggaatctgtttctctg

SEQ ID NO: 4545978 - DNA, 13 bp, Homo sapiens
aggaatgaagaac

SEQ ID NO: 4545979 - DNA, 17 bp, Homo sapiens
aggaatgaagaactgtt

SEQ ID NO: 4545980 - DNA, 15 bp, Homo sapiens
aggaatgatattgct

SEQ ID NO: 4545981 - DNA, 14 bp, Homo sapiens
aggaatgttaaagt

SEQ ID NO: 4545982 - DNA, 15 bp, Homo sapiens
aggaattactttatt

SEQ ID NO: 4545983 - DNA, 20 bp, Homo sapiens
aggaattactttattataaa

SEQ ID NO: 4545984 - DNA, 21 bp, Homo sapiens
aggaattactttattataaaa

SEQ ID NO: 4545985 - DNA, 19 bp, Homo sapiens
aggaatttcttaacttctt

SEQ ID NO: 4545986 - DNA, 17 bp, Homo sapiens
aggaatttgcatccagc

SEQ ID NO: 4545987 - DNA, 15 bp, Homo sapiens
aggacaaataaaaca

SEQ ID NO: 4545988 - DNA, 21 bp, Homo sapiens
aggacaagttttagttaaaac

SEQ ID NO: 4545989 - DNA, 22 bp, Homo sapiens
aggacaagttttagttaaaact

SEQ ID NO: 4545990 - DNA, 16 bp, Homo sapiens
aggacacagtgatgaa

SEQ ID NO: 4545991 - DNA, 17 bp, Homo sapiens
aggacacagtgatgaat

SEQ ID NO: 4545992 - DNA, 22 bp, Homo sapiens
aggacaccctccctccagggtc

SEQ ID NO: 4545993 - DNA, 13 bp, Homo sapiens
aggacagagccag

SEQ ID NO: 4545994 - DNA, 14 bp, Homo sapiens
aggacagagccagc

SEQ ID NO: 4545995 - DNA, 17 bp, Homo sapiens
aggacagagggaagcca

SEQ ID NO: 4545996 - DNA, 20 bp, Homo sapiens
aggacagagggaagccagtc

SEQ ID NO: 4545997 - DNA, 21 bp, Homo sapiens
aggacagagggagacagggct

SEQ ID NO: 4545998 - DNA, 23 bp, Homo sapiens
aggacagcaaagcagcagtgtcc

SEQ ID NO: 4545999 - DNA, 13 bp, Homo sapiens
aggacagtctgga

SEQ ID NO: 4546000 - DNA, 15 bp, Homo sapiens
aggacagtctggaga

SEQ ID NO: 4546001 - DNA, 17 bp, Homo sapiens
aggacagtctggagaag

SEQ ID NO: 4546002 - DNA, 14 bp, Homo sapiens
aggacatcagcaaa

SEQ ID NO: 4546003 - DNA, 12 bp, Homo sapiens
aggaccagagga

SEQ ID NO: 4546004 - DNA, 20 bp, Homo sapiens
aggaccagtcaacctgggca

SEQ ID NO: 4546005 - DNA, 15 bp, Homo sapiens
aggacccagacccag

SEQ ID NO: 4546006 - DNA, 14 bp, Homo sapiens
aggacccaggcgct

SEQ ID NO: 4546007 - DNA, 17 bp, Homo sapiens
aggacccaggcgctgca

SEQ ID NO: 4546008 - DNA, 20 bp, Homo sapiens
aggacccaggcgctgcatac

SEQ ID NO: 4546009 - DNA, 21 bp, Homo sapiens
aggaccgaggctacagctcca

SEQ ID NO: 4546010 - DNA, 21 bp, Homo sapiens
aggacctcggatgaccatact

SEQ ID NO: 4546011 - DNA, 22 bp, Homo sapiens
aggacctcggatgaccatactc

SEQ ID NO: 4546012 - DNA, 23 bp, Homo sapiens
aggacctggcgtgctcagaccca

SEQ ID NO: 4546013 - DNA, 17 bp, Homo sapiens
aggacctgtatttaagc

SEQ ID NO: 4546014 - DNA, 20 bp, Homo sapiens
aggacctgtatttaagcaaa

SEQ ID NO: 4546015 - DNA, 22 bp, Homo sapiens
aggacctttaggtcaaactccc

SEQ ID NO: 4546016 - DNA, 21 bp, Homo sapiens
aggacggaaaatgcttaaaaa

SEQ ID NO: 4546017 - DNA, 23 bp, Homo sapiens
aggacggagtggggggacagaga

SEQ ID NO: 4546018 - DNA, 17 bp, Homo sapiens
aggacggtccccacccc

SEQ ID NO: 4546019 - DNA, 17 bp, Homo sapiens
aggactagaacctggag

SEQ ID NO: 4546020 - DNA, 23 bp, Homo sapiens
aggactattatgtggaataatac

SEQ ID NO: 4546021 - DNA, 14 bp, Homo sapiens
aggactccctcctc

SEQ ID NO: 4546022 - DNA, 19 bp, Homo sapiens
aggactccctcctcacctc

SEQ ID NO: 4546023 - DNA, 19 bp, Homo sapiens
aggactctgcgggaggctg

SEQ ID NO: 4546024 - DNA, 21 bp, Homo sapiens
aggactctttccgactgccca

SEQ ID NO: 4546025 - DNA, 23 bp, Homo sapiens
aggactctttccgactgcccaga

SEQ ID NO: 4546026 - DNA, 12 bp, Homo sapiens
aggactgagccc

SEQ ID NO: 4546027 - DNA, 14 bp, Homo sapiens
aggactgagccccc

SEQ ID NO: 4546028 - DNA, 16 bp, Homo sapiens
aggactgagcccccac

SEQ ID NO: 4546029 - DNA, 18 bp, Homo sapiens
aggactgagggactctga

SEQ ID NO: 4546030 - DNA, 18 bp, Homo sapiens
aggactgatttcagagtg

SEQ ID NO: 4546031 - DNA, 20 bp, Homo sapiens
aggactgcatggtaatttat

SEQ ID NO: 4546032 - DNA, 11 bp, Homo sapiens
aggactgggcc

SEQ ID NO: 4546033 - DNA, 12 bp, Homo sapiens
aggactgggcca

SEQ ID NO: 4546034 - DNA, 22 bp, Homo sapiens
aggactggtgaatataaatgat

SEQ ID NO: 4546035 - DNA, 15 bp, Homo sapiens
aggactggtgcctgg

SEQ ID NO: 4546036 - DNA, 11 bp, Homo sapiens
aggacttaaaa

SEQ ID NO: 4546037 - DNA, 20 bp, Homo sapiens
aggacttaaaattagtcttt

SEQ ID NO: 4546038 - DNA, 13 bp, Homo sapiens
aggacttctgcag

SEQ ID NO: 4546039 - DNA, 13 bp, Homo sapiens
aggactttgtaca

SEQ ID NO: 4546040 - DNA, 16 bp, Homo sapiens
aggagaaaagaaatgc

SEQ ID NO: 4546041 - DNA, 18 bp, Homo sapiens
aggagaaactggaactct

SEQ ID NO: 4546042 - DNA, 19 bp, Homo sapiens
aggagaaactggaactctc

SEQ ID NO: 4546043 - DNA, 15 bp, Homo sapiens
aggagaaagcttaat

SEQ ID NO: 4546044 - DNA, 16 bp, Homo sapiens
aggagaaatcaacagg

SEQ ID NO: 4546045 - DNA, 19 bp, Homo sapiens
aggagaaatgcaataactc

SEQ ID NO: 4546046 - DNA, 13 bp, Homo sapiens
aggagaacaaata

SEQ ID NO: 4546047 - DNA, 15 bp, Homo sapiens
aggagaagagttgag

SEQ ID NO: 4546048 - DNA, 18 bp, Homo sapiens
aggagaagagttgaggaa

SEQ ID NO: 4546049 - DNA, 20 bp, Homo sapiens
aggagaatcgtttgcacccg

SEQ ID NO: 4546050 - DNA, 20 bp, Homo sapiens
aggagaatctcttgaacccg

SEQ ID NO: 4546051 - DNA, 15 bp, Homo sapiens
aggagaatttctact

SEQ ID NO: 4546052 - DNA, 17 bp, Homo sapiens
aggagacatatcactgc

SEQ ID NO: 4546053 - DNA, 21 bp, Homo sapiens
aggagacatatcactgctgct

SEQ ID NO: 4546054 - DNA, 17 bp, Homo sapiens
aggagactcacctctgc

SEQ ID NO: 4546055 - DNA, 14 bp, Homo sapiens
aggagagaaaatat

SEQ ID NO: 4546056 - DNA, 23 bp, Homo sapiens
aggagagactcccatgaagcctt

SEQ ID NO: 4546057 - DNA, 15 bp, Homo sapiens
aggagagccagccct

SEQ ID NO: 4546058 - DNA, 16 bp, Homo sapiens
aggagagcctgctgca

SEQ ID NO: 4546059 - DNA, 18 bp, Homo sapiens
aggagagcctgctgcatg

SEQ ID NO: 4546060 - DNA, 20 bp, Homo sapiens
aggagagggcgctcctctct

SEQ ID NO: 4546061 - DNA, 19 bp, Homo sapiens
aggagagtctgaatatttt

SEQ ID NO: 4546062 - DNA, 22 bp, Homo sapiens
aggagatgaccagggatgctgg

SEQ ID NO: 4546063 - DNA, 13 bp, Homo sapiens
aggagatgctttc

SEQ ID NO: 4546064 - DNA, 16 bp, Homo sapiens
aggagatgggtccagg

SEQ ID NO: 4546065 - DNA, 12 bp, Homo sapiens
aggagcagcagc

SEQ ID NO: 4546066 - DNA, 11 bp, Homo sapiens
aggagcagggt

SEQ ID NO: 4546067 - DNA, 18 bp, Homo sapiens
aggagccccattcctggg

SEQ ID NO: 4546068 - DNA, 19 bp, Homo sapiens
aggagccccattcctggga

SEQ ID NO: 4546069 - DNA, 19 bp, Homo sapiens
aggagcctagcggagccca

SEQ ID NO: 4546070 - DNA, 14 bp, Homo sapiens
aggagcctcactgg

SEQ ID NO: 4546071 - DNA, 18 bp, Homo sapiens
aggagcctcatccagcct

SEQ ID NO: 4546072 - DNA, 12 bp, Homo sapiens
aggagcctctga

SEQ ID NO: 4546073 - DNA, 22 bp, Homo sapiens
aggagcctgctggtcacagcct

SEQ ID NO: 4546074 - DNA, 16 bp, Homo sapiens
aggagccttttgctct

SEQ ID NO: 4546075 - DNA, 18 bp, Homo sapiens
aggagctagttctcagct

SEQ ID NO: 4546076 - DNA, 17 bp, Homo sapiens
aggagctcttcaggcct

SEQ ID NO: 4546077 - DNA, 17 bp, Homo sapiens
aggagctgggaggaaaa

SEQ ID NO: 4546078 - DNA, 20 bp, Homo sapiens
aggagctgggcccctgcaca

SEQ ID NO: 4546079 - DNA, 19 bp, Homo sapiens
aggagcttgggcagtgccc

SEQ ID NO: 4546080 - DNA, 17 bp, Homo sapiens
aggagcttttgtgtgcc

SEQ ID NO: 4546081 - DNA, 17 bp, Homo sapiens
aggaggaaggcaagagg

SEQ ID NO: 4546082 - DNA, 17 bp, Homo sapiens
aggaggacaaaaggaat

SEQ ID NO: 4546083 - DNA, 14 bp, Homo sapiens
aggaggattgcctt

SEQ ID NO: 4546084 - DNA, 21 bp, Homo sapiens
aggaggattgcctttaatatt

SEQ ID NO: 4546085 - DNA, 17 bp, Homo sapiens
aggaggcagctcaggat

SEQ ID NO: 4546086 - DNA, 12 bp, Homo sapiens
aggaggcctcca

SEQ ID NO: 4546087 - DNA, 14 bp, Homo sapiens
aggaggcctgggga

SEQ ID NO: 4546088 - DNA, 15 bp, Homo sapiens
aggaggcctgtccca

SEQ ID NO: 4546089 - DNA, 17 bp, Homo sapiens
aggaggcgaataaatgt

SEQ ID NO: 4546090 - DNA, 13 bp, Homo sapiens
aggaggctccaga

SEQ ID NO: 4546091 - DNA, 19 bp, Homo sapiens
aggaggctccagagggcac

SEQ ID NO: 4546092 - DNA, 14 bp, Homo sapiens
aggaggctgagaca

SEQ ID NO: 4546093 - DNA, 13 bp, Homo sapiens
aggaggctggcag

SEQ ID NO: 4546094 - DNA, 15 bp, Homo sapiens
aggaggctttggtaa

SEQ ID NO: 4546095 - DNA, 13 bp, Homo sapiens
aggagggagaggg

SEQ ID NO: 4546096 - DNA, 14 bp, Homo sapiens
aggagggcagaggg

SEQ ID NO: 4546097 - DNA, 15 bp, Homo sapiens
aggagggcaggcatc

SEQ ID NO: 4546098 - DNA, 23 bp, Homo sapiens
aggagggctttgaatctgggact

SEQ ID NO: 4546099 - DNA, 19 bp, Homo sapiens
aggaggggagagacaggca

SEQ ID NO: 4546100 - DNA, 14 bp, Homo sapiens
aggaggggagggta

SEQ ID NO: 4546101 - DNA, 17 bp, Homo sapiens
aggagggggccgggcgc

SEQ ID NO: 4546102 - DNA, 16 bp, Homo sapiens
aggagggtgtaatgga

SEQ ID NO: 4546103 - DNA, 23 bp, Homo sapiens
aggagggttgggcgtgctacctg

SEQ ID NO: 4546104 - DNA, 18 bp, Homo sapiens
aggaggtccttaggcctc

SEQ ID NO: 4546105 - DNA, 20 bp, Homo sapiens
aggaggtgaaatccctgcct

SEQ ID NO: 4546106 - DNA, 13 bp, Homo sapiens
aggagtccagacc

SEQ ID NO: 4546107 - DNA, 14 bp, Homo sapiens
aggagtccagaccc

SEQ ID NO: 4546108 - DNA, 18 bp, Homo sapiens
aggagtccagacccccca

SEQ ID NO: 4546109 - DNA, 21 bp, Homo sapiens
aggagtccagaccccccagcc

SEQ ID NO: 4546110 - DNA, 16 bp, Homo sapiens
aggagtccagcccctc

SEQ ID NO: 4546111 - DNA, 17 bp, Homo sapiens
aggagtccagcccctcc

SEQ ID NO: 4546112 - DNA, 18 bp, Homo sapiens
aggagtccagcccctcct

SEQ ID NO: 4546113 - DNA, 20 bp, Homo sapiens
aggagtccagcccctcctcc

SEQ ID NO: 4546114 - DNA, 14 bp, Homo sapiens
aggagtccaggccc

SEQ ID NO: 4546115 - DNA, 15 bp, Homo sapiens
aggagtctattttgt

SEQ ID NO: 4546116 - DNA, 18 bp, Homo sapiens
aggagtgggttgatttca

SEQ ID NO: 4546117 - DNA, 19 bp, Homo sapiens
aggagttagaaccacagca

SEQ ID NO: 4546118 - DNA, 21 bp, Homo sapiens
aggagttagaaccacagcaga

SEQ ID NO: 4546119 - DNA, 24 bp, Homo sapiens
aggagttagaaccacagcagacac

SEQ ID NO: 4546120 - DNA, 17 bp, Homo sapiens
aggagttcaagaccagc

SEQ ID NO: 4546121 - DNA, 22 bp, Homo sapiens
aggagttcaagactagcctggc

SEQ ID NO: 4546122 - DNA, 14 bp, Homo sapiens
aggagttgctgttt

SEQ ID NO: 4546123 - DNA, 18 bp, Homo sapiens
aggagtttattacaatgt

SEQ ID NO: 4546124 - DNA, 23 bp, Homo sapiens
aggagtttattacaatgtatctt

SEQ ID NO: 4546125 - DNA, 16 bp, Homo sapiens
aggagtttgaggctgc

SEQ ID NO: 4546126 - DNA, 16 bp, Homo sapiens
aggatacatttaataa

SEQ ID NO: 4546127 - DNA, 15 bp, Homo sapiens
aggatataatgtgtg

SEQ ID NO: 4546128 - DNA, 18 bp, Homo sapiens
aggatcacagtgctgaga

SEQ ID NO: 4546129 - DNA, 19 bp, Homo sapiens
aggatcacctgaggtcagg

SEQ ID NO: 4546130 - DNA, 15 bp, Homo sapiens
aggatcagttaacta

SEQ ID NO: 4546131 - DNA, 17 bp, Homo sapiens
aggatcagttaactatt

SEQ ID NO: 4546132 - DNA, 16 bp, Homo sapiens
aggatccagagagcag

SEQ ID NO: 4546133 - DNA, 14 bp, Homo sapiens
aggatccggaaaga

SEQ ID NO: 4546134 - DNA, 23 bp, Homo sapiens
aggatcggactctgcccctggac

SEQ ID NO: 4546135 - DNA, 16 bp, Homo sapiens
aggatgaacaatgtat

SEQ ID NO: 4546136 - DNA, 22 bp, Homo sapiens
aggatgaacatcttttaactgc

SEQ ID NO: 4546137 - DNA, 18 bp, Homo sapiens
aggatgacaggctctcct

SEQ ID NO: 4546138 - DNA, 20 bp, Homo sapiens
aggatgacaggctctcctgg

SEQ ID NO: 4546139 - DNA, 19 bp, Homo sapiens
aggatgggaacaaggaagg

SEQ ID NO: 4546140 - DNA, 17 bp, Homo sapiens
aggatggggctcccagc

SEQ ID NO: 4546141 - DNA, 18 bp, Homo sapiens
aggatggggctcccagct

SEQ ID NO: 4546142 - DNA, 19 bp, Homo sapiens
aggatggtcttacagcagg

SEQ ID NO: 4546143 - DNA, 21 bp, Homo sapiens
aggatggtgctgagtaaacat

SEQ ID NO: 4546144 - DNA, 21 bp, Homo sapiens
aggatggtgtcctgaggcctc

SEQ ID NO: 4546145 - DNA, 23 bp, Homo sapiens
aggatgtactgttgaaaaagata

SEQ ID NO: 4546146 - DNA, 20 bp, Homo sapiens
aggatgtaggggttaacttg

SEQ ID NO: 4546147 - DNA, 22 bp, Homo sapiens
aggatgttagacttgctccctc

SEQ ID NO: 4546148 - DNA, 23 bp, Homo sapiens
aggatgttagacttgctccctct

SEQ ID NO: 4546149 - DNA, 14 bp, Homo sapiens
aggatgttgaaaaa

SEQ ID NO: 4546150 - DNA, 21 bp, Homo sapiens
aggattctttccccagaggct

SEQ ID NO: 4546151 - DNA, 17 bp, Homo sapiens
aggatttatttaaaata

SEQ ID NO: 4546152 - DNA, 15 bp, Homo sapiens
aggatttcctacccc

SEQ ID NO: 4546153 - DNA, 14 bp, Homo sapiens
aggattttaatttc

SEQ ID NO: 4546154 - DNA, 17 bp, Homo sapiens
aggattttaatttcagg

SEQ ID NO: 4546155 - DNA, 16 bp, Homo sapiens
aggattttaccaaagc

SEQ ID NO: 4546156 - DNA, 19 bp, Homo sapiens
aggattttaccaaagcatc

SEQ ID NO: 4546157 - DNA, 17 bp, Homo sapiens
aggattttctttttaac

SEQ ID NO: 4546158 - DNA, 15 bp, Homo sapiens
aggcaaaaatgtaaa

SEQ ID NO: 4546159 - DNA, 22 bp, Homo sapiens
aggcaaacccatcaacaaaaat

SEQ ID NO: 4546160 - DNA, 23 bp, Homo sapiens
aggcaaaggaggggaaacaatga

SEQ ID NO: 4546161 - DNA, 20 bp, Homo sapiens
aggcaaagtttacagatgtt

SEQ ID NO: 4546162 - DNA, 21 bp, Homo sapiens
aggcaaagtttacagatgttt

SEQ ID NO: 4546163 - DNA, 17 bp, Homo sapiens
aggcaaatattgaagtt

SEQ ID NO: 4546164 - DNA, 21 bp, Homo sapiens
aggcaaatattgaagttgttt

SEQ ID NO: 4546165 - DNA, 13 bp, Homo sapiens
aggcaacactgat

SEQ ID NO: 4546166 - DNA, 13 bp, Homo sapiens
aggcaagcatgaa

SEQ ID NO: 4546167 - DNA, 14 bp, Homo sapiens
aggcaagcatgaat

SEQ ID NO: 4546168 - DNA, 20 bp, Homo sapiens
aggcaagcgtgttctcagca

SEQ ID NO: 4546169 - DNA, 15 bp, Homo sapiens
aggcaagctgaaatt

SEQ ID NO: 4546170 - DNA, 14 bp, Homo sapiens
aggcaataaaaatc

SEQ ID NO: 4546171 - DNA, 17 bp, Homo sapiens
aggcaatcttgccttct

SEQ ID NO: 4546172 - DNA, 14 bp, Homo sapiens
aggcaatgctcacc

SEQ ID NO: 4546173 - DNA, 12 bp, Homo sapiens
aggcaattagac

SEQ ID NO: 4546174 - DNA, 19 bp, Homo sapiens
aggcaattttagtgtatta

SEQ ID NO: 4546175 - DNA, 14 bp, Homo sapiens
aggcacacacagcc

SEQ ID NO: 4546176 - DNA, 14 bp, Homo sapiens
aggcacacactgtg

SEQ ID NO: 4546177 - DNA, 19 bp, Homo sapiens
aggcacacactgtgctttc

SEQ ID NO: 4546178 - DNA, 11 bp, Homo sapiens
aggcacacagc

SEQ ID NO: 4546179 - DNA, 14 bp, Homo sapiens
aggcacacagcagc

SEQ ID NO: 4546180 - DNA, 23 bp, Homo sapiens
aggcacacagcagccccccagca

SEQ ID NO: 4546181 - DNA, 17 bp, Homo sapiens
aggcaccaaaagaagta

SEQ ID NO: 4546182 - DNA, 11 bp, Homo sapiens
aggcaccagga

SEQ ID NO: 4546183 - DNA, 14 bp, Homo sapiens
aggcaccaggaagc

SEQ ID NO: 4546184 - DNA, 14 bp, Homo sapiens
aggcacccatctgt

SEQ ID NO: 4546185 - DNA, 17 bp, Homo sapiens
aggcaccctcagggagc

SEQ ID NO: 4546186 - DNA, 14 bp, Homo sapiens
aggcaccgccacgt

SEQ ID NO: 4546187 - DNA, 15 bp, Homo sapiens
aggcactcagtgagc

SEQ ID NO: 4546188 - DNA, 23 bp, Homo sapiens
aggcactgagataccagcgagga

SEQ ID NO: 4546189 - DNA, 18 bp, Homo sapiens
aggcacttattgtaaatt

SEQ ID NO: 4546190 - DNA, 21 bp, Homo sapiens
aggcagaagaattgaacccag

SEQ ID NO: 4546191 - DNA, 22 bp, Homo sapiens
aggcagaagaattgaacccagg

SEQ ID NO: 4546192 - DNA, 23 bp, Homo sapiens
aggcagaagaattgaacccagga

SEQ ID NO: 4546193 - DNA, 19 bp, Homo sapiens
aggcagacgtctgtcaggg

SEQ ID NO: 4546194 - DNA, 13 bp, Homo sapiens
aggcagagctgga

SEQ ID NO: 4546195 - DNA, 20 bp, Homo sapiens
aggcagagctggagccccca

SEQ ID NO: 4546196 - DNA, 15 bp, Homo sapiens
aggcagatctgtgcc

SEQ ID NO: 4546197 - DNA, 21 bp, Homo sapiens
aggcagatctgtgccccatgc

SEQ ID NO: 4546198 - DNA, 22 bp, Homo sapiens
aggcagcagtgtgaggccaggg

SEQ ID NO: 4546199 - DNA, 20 bp, Homo sapiens
aggcagccagccgtggccag

SEQ ID NO: 4546200 - DNA, 22 bp, Homo sapiens
aggcagcccagcagtgtggaga

SEQ ID NO: 4546201 - DNA, 18 bp, Homo sapiens
aggcagctgcctctgctc

SEQ ID NO: 4546202 - DNA, 18 bp, Homo sapiens
aggcaggagaatggtgtg

SEQ ID NO: 4546203 - DNA, 18 bp, Homo sapiens
aggcaggattgaaaatgt

SEQ ID NO: 4546204 - DNA, 14 bp, Homo sapiens
aggcaggccagatg

SEQ ID NO: 4546205 - DNA, 22 bp, Homo sapiens
aggcaggccagatggcccctcc

SEQ ID NO: 4546206 - DNA, 23 bp, Homo sapiens
aggcaggctgggacggaccagca

SEQ ID NO: 4546207 - DNA, 15 bp, Homo sapiens
aggcagggagggctt

SEQ ID NO: 4546208 - DNA, 21 bp, Homo sapiens
aggcagggccttgcccagaga

SEQ ID NO: 4546209 - DNA, 23 bp, Homo sapiens
aggcagggccttgcccagagatg

SEQ ID NO: 4546210 - DNA, 15 bp, Homo sapiens
aggcagggctctccc

SEQ ID NO: 4546211 - DNA, 16 bp, Homo sapiens
aggcaggggaatgtat

SEQ ID NO: 4546212 - DNA, 20 bp, Homo sapiens
aggcaggggtgggggtggag

SEQ ID NO: 4546213 - DNA, 15 bp, Homo sapiens
aggcaggtcacagaa

SEQ ID NO: 4546214 - DNA, 23 bp, Homo sapiens
aggcaggtgcagggaagtgcaga

SEQ ID NO: 4546215 - DNA, 20 bp, Homo sapiens
aggcaggtttcatttcttat

SEQ ID NO: 4546216 - DNA, 15 bp, Homo sapiens
aggcagtagcctcct

SEQ ID NO: 4546217 - DNA, 11 bp, Homo sapiens
aggcagtctct

SEQ ID NO: 4546218 - DNA, 14 bp, Homo sapiens
aggcagttttctaa

SEQ ID NO: 4546219 - DNA, 15 bp, Homo sapiens
aggcatagaggcttc

SEQ ID NO: 4546220 - DNA, 22 bp, Homo sapiens
aggcatagaggcttctccgcca

SEQ ID NO: 4546221 - DNA, 22 bp, Homo sapiens
aggcatcttttctagagacaca

SEQ ID NO: 4546222 - DNA, 23 bp, Homo sapiens
aggcatcttttctagagacacat

SEQ ID NO: 4546223 - DNA, 12 bp, Homo sapiens
aggcatggtgga

SEQ ID NO: 4546224 - DNA, 16 bp, Homo sapiens
aggcatgtcccaccca

SEQ ID NO: 4546225 - DNA, 19 bp, Homo sapiens
aggcatgttttaaaatcta

SEQ ID NO: 4546226 - DNA, 20 bp, Homo sapiens
aggcatttaaaatggaaaag

SEQ ID NO: 4546227 - DNA, 19 bp, Homo sapiens
aggcatttcattatgcttt

SEQ ID NO: 4546228 - DNA, 23 bp, Homo sapiens
aggcatttgctaaggcagctgat

SEQ ID NO: 4546229 - DNA, 14 bp, Homo sapiens
aggcatttgtcttt

SEQ ID NO: 4546230 - DNA, 18 bp, Homo sapiens
aggccaacagcacctccc

SEQ ID NO: 4546231 - DNA, 14 bp, Homo sapiens
aggccaagaaacgt

SEQ ID NO: 4546232 - DNA, 21 bp, Homo sapiens
aggccaagaaacgtcttctaa

SEQ ID NO: 4546233 - DNA, 17 bp, Homo sapiens
aggccacaggcagtcca

SEQ ID NO: 4546234 - DNA, 12 bp, Homo sapiens
aggccaccccaa

SEQ ID NO: 4546235 - DNA, 18 bp, Homo sapiens
aggccacctagctttttg

SEQ ID NO: 4546236 - DNA, 14 bp, Homo sapiens
aggccacgtccagg

SEQ ID NO: 4546237 - DNA, 13 bp, Homo sapiens
aggccactcctcc

SEQ ID NO: 4546238 - DNA, 14 bp, Homo sapiens
aggccactggagac

SEQ ID NO: 4546239 - DNA, 19 bp, Homo sapiens
aggccagagcaaacagaaa

SEQ ID NO: 4546240 - DNA, 21 bp, Homo sapiens
aggccagagcaaacagaaaaa

SEQ ID NO: 4546241 - DNA, 21 bp, Homo sapiens
aggccagagtcaccttttctg

SEQ ID NO: 4546242 - DNA, 17 bp, Homo sapiens
aggccagagtggcctgg

SEQ ID NO: 4546243 - DNA, 16 bp, Homo sapiens
aggccagatggcccct

SEQ ID NO: 4546244 - DNA, 20 bp, Homo sapiens
aggccagatggcccctccac

SEQ ID NO: 4546245 - DNA, 12 bp, Homo sapiens
aggccagcccag

SEQ ID NO: 4546246 - DNA, 15 bp, Homo sapiens
aggccagcccagcca

SEQ ID NO: 4546247 - DNA, 14 bp, Homo sapiens
aggccagccccacc

SEQ ID NO: 4546248 - DNA, 15 bp, Homo sapiens
aggccagccccaccc

SEQ ID NO: 4546249 - DNA, 17 bp, Homo sapiens
aggccagcctccgagag

SEQ ID NO: 4546250 - DNA, 19 bp, Homo sapiens
aggccagctgccccagcca

SEQ ID NO: 4546251 - DNA, 16 bp, Homo sapiens
aggccagtggaagaaa

SEQ ID NO: 4546252 - DNA, 14 bp, Homo sapiens
aggccagtgtggtg

SEQ ID NO: 4546253 - DNA, 22 bp, Homo sapiens
aggccataagctacacagaggc

SEQ ID NO: 4546254 - DNA, 15 bp, Homo sapiens
aggccattctttccc

SEQ ID NO: 4546255 - DNA, 17 bp, Homo sapiens
aggccattctttcccaa

SEQ ID NO: 4546256 - DNA, 18 bp, Homo sapiens
aggccattctttcccaac

SEQ ID NO: 4546257 - DNA, 17 bp, Homo sapiens
aggccattgtgaaccaa

SEQ ID NO: 4546258 - DNA, 13 bp, Homo sapiens
aggcccaaatgat

SEQ ID NO: 4546259 - DNA, 14 bp, Homo sapiens
aggcccaaatgatg

SEQ ID NO: 4546260 - DNA, 19 bp, Homo sapiens
aggcccaaccaccagatga

SEQ ID NO: 4546261 - DNA, 17 bp, Homo sapiens
aggcccaaggctcccgg

SEQ ID NO: 4546262 - DNA, 23 bp, Homo sapiens
aggcccagccgcaggaaggcaga

SEQ ID NO: 4546263 - DNA, 16 bp, Homo sapiens
aggcccagctgctccc

SEQ ID NO: 4546264 - DNA, 11 bp, Homo sapiens
aggcccaggag

SEQ ID NO: 4546265 - DNA, 13 bp, Homo sapiens
aggcccaggagtc

SEQ ID NO: 4546266 - DNA, 13 bp, Homo sapiens
aggcccaggctgg

SEQ ID NO: 4546267 - DNA, 22 bp, Homo sapiens
aggccccaatcttgcccactgg

SEQ ID NO: 4546268 - DNA, 22 bp, Homo sapiens
aggccccagagagaccctgcaa

SEQ ID NO: 4546269 - DNA, 14 bp, Homo sapiens
aggccccagcctcc

SEQ ID NO: 4546270 - DNA, 19 bp, Homo sapiens
aggcccccaacccctcctc

SEQ ID NO: 4546271 - DNA, 23 bp, Homo sapiens
aggcccccaacccctcctccctc

SEQ ID NO: 4546272 - DNA, 21 bp, Homo sapiens
aggcccccaacccctccttcc

SEQ ID NO: 4546273 - DNA, 15 bp, Homo sapiens
aggcccccagcccct

SEQ ID NO: 4546274 - DNA, 19 bp, Homo sapiens
aggcccccagcccctcctc

SEQ ID NO: 4546275 - DNA, 21 bp, Homo sapiens
aggcccccagcccctcctccc

SEQ ID NO: 4546276 - DNA, 23 bp, Homo sapiens
aggccccgaggacccagacccag

SEQ ID NO: 4546277 - DNA, 20 bp, Homo sapiens
aggccccgcttgtccagcgc

SEQ ID NO: 4546278 - DNA, 12 bp, Homo sapiens
aggcccctgcct

SEQ ID NO: 4546279 - DNA, 14 bp, Homo sapiens
aggcccctggaggc

SEQ ID NO: 4546280 - DNA, 22 bp, Homo sapiens
aggcccctggaggctgcctccc

SEQ ID NO: 4546281 - DNA, 13 bp, Homo sapiens
aggcccggggctg

SEQ ID NO: 4546282 - DNA, 12 bp, Homo sapiens
aggccctccagt

SEQ ID NO: 4546283 - DNA, 13 bp, Homo sapiens
aggccctccagtg

SEQ ID NO: 4546284 - DNA, 14 bp, Homo sapiens
aggccctccctgac

SEQ ID NO: 4546285 - DNA, 23 bp, Homo sapiens
aggccctccctgactccctgtgg

SEQ ID NO: 4546286 - DNA, 13 bp, Homo sapiens
aggccctccctgt

SEQ ID NO: 4546287 - DNA, 15 bp, Homo sapiens
aggccctcgggccca

SEQ ID NO: 4546288 - DNA, 15 bp, Homo sapiens
aggccctgactcctc

SEQ ID NO: 4546289 - DNA, 19 bp, Homo sapiens
aggccctgactcctctggc

SEQ ID NO: 4546290 - DNA, 21 bp, Homo sapiens
aggccctgactcctctggctt

SEQ ID NO: 4546291 - DNA, 18 bp, Homo sapiens
aggccctgagatggggga

SEQ ID NO: 4546292 - DNA, 12 bp, Homo sapiens
aggccctgcccc

SEQ ID NO: 4546293 - DNA, 13 bp, Homo sapiens
aggccctgccccc

SEQ ID NO: 4546294 - DNA, 17 bp, Homo sapiens
aggccctgcccccaccc

SEQ ID NO: 4546295 - DNA, 13 bp, Homo sapiens
aggccctggaggg

SEQ ID NO: 4546296 - DNA, 17 bp, Homo sapiens
aggccctggagggaagg

SEQ ID NO: 4546297 - DNA, 21 bp, Homo sapiens
aggccctggagggaaggacag

SEQ ID NO: 4546298 - DNA, 12 bp, Homo sapiens
aggccctgggct

SEQ ID NO: 4546299 - DNA, 13 bp, Homo sapiens
aggccctgggctg

SEQ ID NO: 4546300 - DNA, 20 bp, Homo sapiens
aggccctgggctgggtgctg

SEQ ID NO: 4546301 - DNA, 17 bp, Homo sapiens
aggccctgggtaagaag

SEQ ID NO: 4546302 - DNA, 16 bp, Homo sapiens
aggccgaggcgggtgg

SEQ ID NO: 4546303 - DNA, 15 bp, Homo sapiens
aggccggcccagatg

SEQ ID NO: 4546304 - DNA, 16 bp, Homo sapiens
aggcctaccccagttc

SEQ ID NO: 4546305 - DNA, 12 bp, Homo sapiens
aggcctccactc

SEQ ID NO: 4546306 - DNA, 14 bp, Homo sapiens
aggcctccactcct

SEQ ID NO: 4546307 - DNA, 22 bp, Homo sapiens
aggcctccctctctcttctgct

SEQ ID NO: 4546308 - DNA, 13 bp, Homo sapiens
aggcctctgctgg

SEQ ID NO: 4546309 - DNA, 15 bp, Homo sapiens
aggcctctgctggct

SEQ ID NO: 4546310 - DNA, 11 bp, Homo sapiens
aggcctctggt

SEQ ID NO: 4546311 - DNA, 21 bp, Homo sapiens
aggcctctggttgcctccccc

SEQ ID NO: 4546312 - DNA, 14 bp, Homo sapiens
aggcctcttcctgt

SEQ ID NO: 4546313 - DNA, 15 bp, Homo sapiens
aggcctcttcctgtt

SEQ ID NO: 4546314 - DNA, 22 bp, Homo sapiens
aggcctcttcctgttgtgactg

SEQ ID NO: 4546315 - DNA, 18 bp, Homo sapiens
aggcctgaaatgacattt

SEQ ID NO: 4546316 - DNA, 20 bp, Homo sapiens
aggcctgaaatgacatttca

SEQ ID NO: 4546317 - DNA, 16 bp, Homo sapiens
aggcctgagatttcat

SEQ ID NO: 4546318 - DNA, 19 bp, Homo sapiens
aggcctgagatttcatctg

SEQ ID NO: 4546319 - DNA, 20 bp, Homo sapiens
aggcctgagatttcatctgc

SEQ ID NO: 4546320 - DNA, 23 bp, Homo sapiens
aggcctgagatttcatctgctct

SEQ ID NO: 4546321 - DNA, 14 bp, Homo sapiens
aggcctgagcgctc

SEQ ID NO: 4546322 - DNA, 19 bp, Homo sapiens
aggcctgagcgctcctgcc

SEQ ID NO: 4546323 - DNA, 22 bp, Homo sapiens
aggcctgagcgctcctgccgca

SEQ ID NO: 4546324 - DNA, 19 bp, Homo sapiens
aggcctgcaaaccttcctg

SEQ ID NO: 4546325 - DNA, 20 bp, Homo sapiens
aggcctgcaaaccttcctgg

SEQ ID NO: 4546326 - DNA, 17 bp, Homo sapiens
aggcctgcctccagggc

SEQ ID NO: 4546327 - DNA, 19 bp, Homo sapiens
aggcctgcctccagggctg

SEQ ID NO: 4546328 - DNA, 18 bp, Homo sapiens
aggcctgcctcccacttc

SEQ ID NO: 4546329 - DNA, 14 bp, Homo sapiens
aggcctgcctgcat

SEQ ID NO: 4546330 - DNA, 15 bp, Homo sapiens
aggcctgcgggcccc

SEQ ID NO: 4546331 - DNA, 18 bp, Homo sapiens
aggcctgctagtcactgg

SEQ ID NO: 4546332 - DNA, 19 bp, Homo sapiens
aggcctgctagtcactgga

SEQ ID NO: 4546333 - DNA, 18 bp, Homo sapiens
aggcctgctgccagtgca

SEQ ID NO: 4546334 - DNA, 22 bp, Homo sapiens
aggcctggctggaggagcagca

SEQ ID NO: 4546335 - DNA, 12 bp, Homo sapiens
aggcctgtccca

SEQ ID NO: 4546336 - DNA, 17 bp, Homo sapiens
aggcctgtccctgggag

SEQ ID NO: 4546337 - DNA, 18 bp, Homo sapiens
aggcctgtcccttgcctc

SEQ ID NO: 4546338 - DNA, 19 bp, Homo sapiens
aggcctgtcccttgcctct

SEQ ID NO: 4546339 - DNA, 17 bp, Homo sapiens
aggccttcccctggcac

SEQ ID NO: 4546340 - DNA, 19 bp, Homo sapiens
aggccttcccctggcactg

SEQ ID NO: 4546341 - DNA, 21 bp, Homo sapiens
aggccttgggtgttccacctg

SEQ ID NO: 4546342 - DNA, 14 bp, Homo sapiens
aggcgaagggtggt

SEQ ID NO: 4546343 - DNA, 13 bp, Homo sapiens
aggcgaataaatg

SEQ ID NO: 4546344 - DNA, 19 bp, Homo sapiens
aggcgaataaatgttcaaa

SEQ ID NO: 4546345 - DNA, 21 bp, Homo sapiens
aggcgaataaatgttcaaact

SEQ ID NO: 4546346 - DNA, 23 bp, Homo sapiens
aggcgagtctggggacctggcac

SEQ ID NO: 4546347 - DNA, 19 bp, Homo sapiens
aggcgcacagtgtgagccc

SEQ ID NO: 4546348 - DNA, 22 bp, Homo sapiens
aggcgcccgccaacacgcctgg

SEQ ID NO: 4546349 - DNA, 21 bp, Homo sapiens
aggcgctgcatacaggggagg

SEQ ID NO: 4546350 - DNA, 15 bp, Homo sapiens
aggcggacgttccag

SEQ ID NO: 4546351 - DNA, 22 bp, Homo sapiens
aggcggaggctgtgctccgcca

SEQ ID NO: 4546352 - DNA, 16 bp, Homo sapiens
aggcggcccctcccgc

SEQ ID NO: 4546353 - DNA, 12 bp, Homo sapiens
aggcgtgccccc

SEQ ID NO: 4546354 - DNA, 22 bp, Homo sapiens
aggcgtgcccccctcctccagt

SEQ ID NO: 4546355 - DNA, 18 bp, Homo sapiens
aggcgttcttcgaggtgg

SEQ ID NO: 4546356 - DNA, 15 bp, Homo sapiens
aggctaaaaagcaac

SEQ ID NO: 4546357 - DNA, 14 bp, Homo sapiens
aggctaagaaaaag

SEQ ID NO: 4546358 - DNA, 14 bp, Homo sapiens
aggctacagctcca

SEQ ID NO: 4546359 - DNA, 16 bp, Homo sapiens
aggctacccgctgtgg

SEQ ID NO: 4546360 - DNA, 20 bp, Homo sapiens
aggctacccgctgtggccgg

SEQ ID NO: 4546361 - DNA, 22 bp, Homo sapiens
aggctacccgctgtggccggtg

SEQ ID NO: 4546362 - DNA, 16 bp, Homo sapiens
aggctactgttcttga

SEQ ID NO: 4546363 - DNA, 23 bp, Homo sapiens
aggctagagacagatgctggtgg

SEQ ID NO: 4546364 - DNA, 13 bp, Homo sapiens
aggctatcctgct

SEQ ID NO: 4546365 - DNA, 19 bp, Homo sapiens
aggctatgaggaaactgag

SEQ ID NO: 4546366 - DNA, 19 bp, Homo sapiens
aggctatggggatagatgt

SEQ ID NO: 4546367 - DNA, 15 bp, Homo sapiens
aggctattaaaaaag

SEQ ID NO: 4546368 - DNA, 23 bp, Homo sapiens
aggctcaaccttccaacttcctg

SEQ ID NO: 4546369 - DNA, 22 bp, Homo sapiens
aggctcactgcaacttctgcct

SEQ ID NO: 4546370 - DNA, 15 bp, Homo sapiens
aggctcactgccagg

SEQ ID NO: 4546371 - DNA, 17 bp, Homo sapiens
aggctcactgccaggcc

SEQ ID NO: 4546372 - DNA, 20 bp, Homo sapiens
aggctcactgccaggccagc

SEQ ID NO: 4546373 - DNA, 22 bp, Homo sapiens
aggctcactgccaggccagcct

SEQ ID NO: 4546374 - DNA, 13 bp, Homo sapiens
aggctcagaagga

SEQ ID NO: 4546375 - DNA, 11 bp, Homo sapiens
aggctcagaga

SEQ ID NO: 4546376 - DNA, 20 bp, Homo sapiens
aggctcagagggtgtcctgc

SEQ ID NO: 4546377 - DNA, 18 bp, Homo sapiens
aggctcagtggtgggaga

SEQ ID NO: 4546378 - DNA, 17 bp, Homo sapiens
aggctcatttaaaacag

SEQ ID NO: 4546379 - DNA, 14 bp, Homo sapiens
aggctccagagggc

SEQ ID NO: 4546380 - DNA, 18 bp, Homo sapiens
aggctccagctctggcac

SEQ ID NO: 4546381 - DNA, 17 bp, Homo sapiens
aggctcccggggcctgg

SEQ ID NO: 4546382 - DNA, 20 bp, Homo sapiens
aggctcccggggcctggaca

SEQ ID NO: 4546383 - DNA, 22 bp, Homo sapiens
aggctcctgttttgcacagcca

SEQ ID NO: 4546384 - DNA, 15 bp, Homo sapiens
aggctctcaccccca

SEQ ID NO: 4546385 - DNA, 16 bp, Homo sapiens
aggctctcccctctcg

SEQ ID NO: 4546386 - DNA, 21 bp, Homo sapiens
aggctctggacagcagaagcc

SEQ ID NO: 4546387 - DNA, 22 bp, Homo sapiens
aggctctggacagcagaagcct

SEQ ID NO: 4546388 - DNA, 21 bp, Homo sapiens
aggctctgtgctgaccctcct

SEQ ID NO: 4546389 - DNA, 15 bp, Homo sapiens
aggctcttcacatcc

SEQ ID NO: 4546390 - DNA, 18 bp, Homo sapiens
aggctgacattcactgag

SEQ ID NO: 4546391 - DNA, 12 bp, Homo sapiens
aggctgaggcag

SEQ ID NO: 4546392 - DNA, 14 bp, Homo sapiens
aggctgaggcagaa

SEQ ID NO: 4546393 - DNA, 17 bp, Homo sapiens
aggctgaggcaggagga

SEQ ID NO: 4546394 - DNA, 18 bp, Homo sapiens
aggctgatgggcaaaaaa

SEQ ID NO: 4546395 - DNA, 14 bp, Homo sapiens
aggctgcaaaatta

SEQ ID NO: 4546396 - DNA, 20 bp, Homo sapiens
aggctgcaaaattaaatcta

SEQ ID NO: 4546397 - DNA, 21 bp, Homo sapiens
aggctgcaaaattaaatctag

SEQ ID NO: 4546398 - DNA, 18 bp, Homo sapiens
aggctgcagaggcacctc

SEQ ID NO: 4546399 - DNA, 17 bp, Homo sapiens
aggctgccaaggccaga

SEQ ID NO: 4546400 - DNA, 11 bp, Homo sapiens
aggctgccagt

SEQ ID NO: 4546401 - DNA, 20 bp, Homo sapiens
aggctgcccccggccccctg

SEQ ID NO: 4546402 - DNA, 14 bp, Homo sapiens
aggctgcctcctgc

SEQ ID NO: 4546403 - DNA, 14 bp, Homo sapiens
aggctgctggcgcc

SEQ ID NO: 4546404 - DNA, 19 bp, Homo sapiens
aggctgctggcgcctctgc

SEQ ID NO: 4546405 - DNA, 21 bp, Homo sapiens
aggctgctggcgcctctgcaa

SEQ ID NO: 4546406 - DNA, 18 bp, Homo sapiens
aggctggaagatagctgt

SEQ ID NO: 4546407 - DNA, 22 bp, Homo sapiens
aggctggaagatagctgtgact

SEQ ID NO: 4546408 - DNA, 13 bp, Homo sapiens
aggctggaaggca

SEQ ID NO: 4546409 - DNA, 16 bp, Homo sapiens
aggctggactgcagtg

SEQ ID NO: 4546410 - DNA, 12 bp, Homo sapiens
aggctggagacc

SEQ ID NO: 4546411 - DNA, 20 bp, Homo sapiens
aggctggagtgcagtggcat

SEQ ID NO: 4546412 - DNA, 20 bp, Homo sapiens
aggctggagtgcagtggcgt

SEQ ID NO: 4546413 - DNA, 21 bp, Homo sapiens
aggctggcctatgtggtctaa

SEQ ID NO: 4546414 - DNA, 19 bp, Homo sapiens
aggctgggacggaccagca

SEQ ID NO: 4546415 - DNA, 14 bp, Homo sapiens
aggctgggagtccc

SEQ ID NO: 4546416 - DNA, 22 bp, Homo sapiens
aggctgggccatgtccaaagag

SEQ ID NO: 4546417 - DNA, 14 bp, Homo sapiens
aggctgggcccctg

SEQ ID NO: 4546418 - DNA, 15 bp, Homo sapiens
aggctgggcccctgg

SEQ ID NO: 4546419 - DNA, 16 bp, Homo sapiens
aggctgggcccctggg

SEQ ID NO: 4546420 - DNA, 16 bp, Homo sapiens
aggctggggaggtgct

SEQ ID NO: 4546421 - DNA, 18 bp, Homo sapiens
aggctgggtcctgccagc

SEQ ID NO: 4546422 - DNA, 20 bp, Homo sapiens
aggctgggtcctgccagctg

SEQ ID NO: 4546423 - DNA, 12 bp, Homo sapiens
aggctgtaacta

SEQ ID NO: 4546424 - DNA, 15 bp, Homo sapiens
aggctgtaactactt

SEQ ID NO: 4546425 - DNA, 21 bp, Homo sapiens
aggctgtaactgagagaaaga

SEQ ID NO: 4546426 - DNA, 20 bp, Homo sapiens
aggctgtgtgtcttctgccc

SEQ ID NO: 4546427 - DNA, 21 bp, Homo sapiens
aggctgtgtgtcttctgcccc

SEQ ID NO: 4546428 - DNA, 20 bp, Homo sapiens
aggctgttaaatacaggaaa

SEQ ID NO: 4546429 - DNA, 15 bp, Homo sapiens
aggctgttaccattt

SEQ ID NO: 4546430 - DNA, 22 bp, Homo sapiens
aggctgttccatgttctatttt

SEQ ID NO: 4546431 - DNA, 16 bp, Homo sapiens
aggctgttctgtagct

SEQ ID NO: 4546432 - DNA, 21 bp, Homo sapiens
aggctgttggttcaaactttt

SEQ ID NO: 4546433 - DNA, 17 bp, Homo sapiens
aggctgtttttggctgt

SEQ ID NO: 4546434 - DNA, 22 bp, Homo sapiens
aggctgtttttggctgttttcc

SEQ ID NO: 4546435 - DNA, 22 bp, Homo sapiens
aggcttaaggagaggagaaact

SEQ ID NO: 4546436 - DNA, 20 bp, Homo sapiens
aggcttcctgcgtcctcctc

SEQ ID NO: 4546437 - DNA, 17 bp, Homo sapiens
aggcttctccgccagcc

SEQ ID NO: 4546438 - DNA, 23 bp, Homo sapiens
aggcttcttcagatcagtgcttg

SEQ ID NO: 4546439 - DNA, 12 bp, Homo sapiens
aggcttggtgtc

SEQ ID NO: 4546440 - DNA, 23 bp, Homo sapiens
aggctttggggtcctagcccagt

SEQ ID NO: 4546441 - DNA, 15 bp, Homo sapiens
aggcttttatttctg

SEQ ID NO: 4546442 - DNA, 22 bp, Homo sapiens
aggcttttgtttcctttttcag

SEQ ID NO: 4546443 - DNA, 16 bp, Homo sapiens
aggctttttcagtgat

SEQ ID NO: 4546444 - DNA, 14 bp, Homo sapiens
agggaaaacagaaa

SEQ ID NO: 4546445 - DNA, 22 bp, Homo sapiens
agggaaaagataaagaccagaa

SEQ ID NO: 4546446 - DNA, 14 bp, Homo sapiens
agggaaaagggaag

SEQ ID NO: 4546447 - DNA, 21 bp, Homo sapiens
agggaaaatggatatagaaaa

SEQ ID NO: 4546448 - DNA, 18 bp, Homo sapiens
agggaaaattatttgcat

SEQ ID NO: 4546449 - DNA, 22 bp, Homo sapiens
agggaaactaagattcttttaa

SEQ ID NO: 4546450 - DNA, 14 bp, Homo sapiens
agggaaactgccag

SEQ ID NO: 4546451 - DNA, 23 bp, Homo sapiens
agggaaactgccagcaacgcagg

SEQ ID NO: 4546452 - DNA, 13 bp, Homo sapiens
agggaaactggga

SEQ ID NO: 4546453 - DNA, 15 bp, Homo sapiens
agggaaactgggaaa

SEQ ID NO: 4546454 - DNA, 19 bp, Homo sapiens
agggaaaggggtgctttta

SEQ ID NO: 4546455 - DNA, 17 bp, Homo sapiens
agggaaatgtgactggt

SEQ ID NO: 4546456 - DNA, 21 bp, Homo sapiens
agggaaattgtaaatcctgtg

SEQ ID NO: 4546457 - DNA, 22 bp, Homo sapiens
agggaaattgtaaatcctgtgt

SEQ ID NO: 4546458 - DNA, 21 bp, Homo sapiens
agggaaattgtttatgtgtta

SEQ ID NO: 4546459 - DNA, 23 bp, Homo sapiens
agggaagctcacacatcctgtca

SEQ ID NO: 4546460 - DNA, 16 bp, Homo sapiens
agggaagctggccgag

SEQ ID NO: 4546461 - DNA, 22 bp, Homo sapiens
agggaaggatcccatgagctcc

SEQ ID NO: 4546462 - DNA, 12 bp, Homo sapiens
agggaaggcctg

SEQ ID NO: 4546463 - DNA, 16 bp, Homo sapiens
agggaaggcctgactt

SEQ ID NO: 4546464 - DNA, 13 bp, Homo sapiens
agggaagggcctg

SEQ ID NO: 4546465 - DNA, 15 bp, Homo sapiens
agggaaggggaatgg

SEQ ID NO: 4546466 - DNA, 13 bp, Homo sapiens
agggaaggtggcc

SEQ ID NO: 4546467 - DNA, 21 bp, Homo sapiens
agggaaggtggccacagcaag

SEQ ID NO: 4546468 - DNA, 16 bp, Homo sapiens
agggaagtgcagagct

SEQ ID NO: 4546469 - DNA, 17 bp, Homo sapiens
agggaagtgcagagctt

SEQ ID NO: 4546470 - DNA, 23 bp, Homo sapiens
agggaatccattgaactggaaga

SEQ ID NO: 4546471 - DNA, 18 bp, Homo sapiens
agggaatgaacctggagg

SEQ ID NO: 4546472 - DNA, 13 bp, Homo sapiens
agggaattcttac

SEQ ID NO: 4546473 - DNA, 21 bp, Homo sapiens
agggaattcttacagccaagt

SEQ ID NO: 4546474 - DNA, 23 bp, Homo sapiens
agggaattcttacagccaagttg

SEQ ID NO: 4546475 - DNA, 20 bp, Homo sapiens
agggacaaagaaatcccccc

SEQ ID NO: 4546476 - DNA, 16 bp, Homo sapiens
agggacaccagccagg

SEQ ID NO: 4546477 - DNA, 18 bp, Homo sapiens
agggacagagacacctgc

SEQ ID NO: 4546478 - DNA, 18 bp, Homo sapiens
agggacatgccctgtgtg

SEQ ID NO: 4546479 - DNA, 19 bp, Homo sapiens
agggacatgccctgtgtgg

SEQ ID NO: 4546480 - DNA, 19 bp, Homo sapiens
agggaccaaattgcttcta

SEQ ID NO: 4546481 - DNA, 16 bp, Homo sapiens
agggaccaactgggcc

SEQ ID NO: 4546482 - DNA, 20 bp, Homo sapiens
agggaccaggtttgcaggag

SEQ ID NO: 4546483 - DNA, 16 bp, Homo sapiens
agggacccccccccaa

SEQ ID NO: 4546484 - DNA, 20 bp, Homo sapiens
agggacccctcgccccagcc

SEQ ID NO: 4546485 - DNA, 21 bp, Homo sapiens
agggacccctcgccccagcct

SEQ ID NO: 4546486 - DNA, 21 bp, Homo sapiens
agggaccggtgctgcaggagt

SEQ ID NO: 4546487 - DNA, 13 bp, Homo sapiens
agggacctgctgc

SEQ ID NO: 4546488 - DNA, 15 bp, Homo sapiens
agggacctgctgctc

SEQ ID NO: 4546489 - DNA, 22 bp, Homo sapiens
agggaccttcatgcccttctga

SEQ ID NO: 4546490 - DNA, 13 bp, Homo sapiens
agggacgcctggg

SEQ ID NO: 4546491 - DNA, 15 bp, Homo sapiens
agggacgcctggggg

SEQ ID NO: 4546492 - DNA, 18 bp, Homo sapiens
agggacgcctgggggtgc

SEQ ID NO: 4546493 - DNA, 22 bp, Homo sapiens
agggacgcctgggggtgccagg

SEQ ID NO: 4546494 - DNA, 19 bp, Homo sapiens
agggactctgaagcctctg

SEQ ID NO: 4546495 - DNA, 20 bp, Homo sapiens
agggactctgaagcctctgg

SEQ ID NO: 4546496 - DNA, 16 bp, Homo sapiens
agggactgtcttttct

SEQ ID NO: 4546497 - DNA, 13 bp, Homo sapiens
agggacttagcaa

SEQ ID NO: 4546498 - DNA, 17 bp, Homo sapiens
agggagaagacaacaga

SEQ ID NO: 4546499 - DNA, 16 bp, Homo sapiens
agggagaatccaaggg

SEQ ID NO: 4546500 - DNA, 22 bp, Homo sapiens
agggagacaggcagggagggct

SEQ ID NO: 4546501 - DNA, 20 bp, Homo sapiens
agggagacagggctgctccc

SEQ ID NO: 4546502 - DNA, 23 bp, Homo sapiens
agggagagagagagagagaggac

SEQ ID NO: 4546503 - DNA, 16 bp, Homo sapiens
agggagagcggggcag

SEQ ID NO: 4546504 - DNA, 17 bp, Homo sapiens
agggagaggagtgactg

SEQ ID NO: 4546505 - DNA, 15 bp, Homo sapiens
agggaggaacacctg

SEQ ID NO: 4546506 - DNA, 18 bp, Homo sapiens
agggaggaaggaggccac

SEQ ID NO: 4546507 - DNA, 19 bp, Homo sapiens
agggaggctcccggggcct

SEQ ID NO: 4546508 - DNA, 23 bp, Homo sapiens
agggaggctcccggggcctggac

SEQ ID NO: 4546509 - DNA, 21 bp, Homo sapiens
agggagggaaggggaatggaa

SEQ ID NO: 4546510 - DNA, 21 bp, Homo sapiens
agggaggggaaaagcattttt

SEQ ID NO: 4546511 - DNA, 21 bp, Homo sapiens
agggaggtcactggaaagggg

SEQ ID NO: 4546512 - DNA, 21 bp, Homo sapiens
agggagtccagggtttctctg

SEQ ID NO: 4546513 - DNA, 16 bp, Homo sapiens
agggagtgagccagca

SEQ ID NO: 4546514 - DNA, 20 bp, Homo sapiens
agggagttcatctggagggt

SEQ ID NO: 4546515 - DNA, 19 bp, Homo sapiens
agggagttttaaagaaatt

SEQ ID NO: 4546516 - DNA, 20 bp, Homo sapiens
agggatattgccttatttgt

SEQ ID NO: 4546517 - DNA, 18 bp, Homo sapiens
agggatcacagaccacag

SEQ ID NO: 4546518 - DNA, 19 bp, Homo sapiens
agggatcacagaccacagg

SEQ ID NO: 4546519 - DNA, 23 bp, Homo sapiens
agggatcagccccgcctgtcaca

SEQ ID NO: 4546520 - DNA, 13 bp, Homo sapiens
agggatgctgggc

SEQ ID NO: 4546521 - DNA, 18 bp, Homo sapiens
agggatggagaggcggcc

SEQ ID NO: 4546522 - DNA, 19 bp, Homo sapiens
agggatggggaaaactaca

SEQ ID NO: 4546523 - DNA, 20 bp, Homo sapiens
agggatggggaaaactacaa

SEQ ID NO: 4546524 - DNA, 16 bp, Homo sapiens
agggatgggggatggg

SEQ ID NO: 4546525 - DNA, 15 bp, Homo sapiens
agggattcaggctgc

SEQ ID NO: 4546526 - DNA, 20 bp, Homo sapiens
agggattctgggcttggggt

SEQ ID NO: 4546527 - DNA, 20 bp, Homo sapiens
agggattggaccgagctgga

SEQ ID NO: 4546528 - DNA, 15 bp, Homo sapiens
agggcaactcttgga

SEQ ID NO: 4546529 - DNA, 20 bp, Homo sapiens
agggcaactcttggaagaaa

SEQ ID NO: 4546530 - DNA, 12 bp, Homo sapiens
agggcaagccct

SEQ ID NO: 4546531 - DNA, 18 bp, Homo sapiens
agggcaagccctgcccac

SEQ ID NO: 4546532 - DNA, 13 bp, Homo sapiens
agggcaagcctct

SEQ ID NO: 4546533 - DNA, 15 bp, Homo sapiens
agggcacccaggcag

SEQ ID NO: 4546534 - DNA, 13 bp, Homo sapiens
agggcactcagaa

SEQ ID NO: 4546535 - DNA, 14 bp, Homo sapiens
agggcactgccagc

SEQ ID NO: 4546536 - DNA, 17 bp, Homo sapiens
agggcactgccagccca

SEQ ID NO: 4546537 - DNA, 18 bp, Homo sapiens
agggcactgtgatacagt

SEQ ID NO: 4546538 - DNA, 20 bp, Homo sapiens
agggcagaaaggttctgccc

SEQ ID NO: 4546539 - DNA, 15 bp, Homo sapiens
agggcagaatgaatc

SEQ ID NO: 4546540 - DNA, 15 bp, Homo sapiens
agggcagaggctgga

SEQ ID NO: 4546541 - DNA, 17 bp, Homo sapiens
agggcagaggctggagg

SEQ ID NO: 4546542 - DNA, 18 bp, Homo sapiens
agggcagagggagaatcc

SEQ ID NO: 4546543 - DNA, 19 bp, Homo sapiens
agggcagagtgagacccag

SEQ ID NO: 4546544 - DNA, 24 bp, Homo sapiens
agggcagattcggaccactaggcc

SEQ ID NO: 4546545 - DNA, 21 bp, Homo sapiens
agggcagcagaagggggtggt

SEQ ID NO: 4546546 - DNA, 21 bp, Homo sapiens
agggcaggaaggagagcctgc

SEQ ID NO: 4546547 - DNA, 17 bp, Homo sapiens
agggcagggccccaggc

SEQ ID NO: 4546548 - DNA, 16 bp, Homo sapiens
agggcagggcgagctg

SEQ ID NO: 4546549 - DNA, 21 bp, Homo sapiens
agggcagggcgagctgcagga

SEQ ID NO: 4546550 - DNA, 23 bp, Homo sapiens
agggcagggcgagctgcaggaat

SEQ ID NO: 4546551 - DNA, 20 bp, Homo sapiens
agggccaaacgctgagccac

SEQ ID NO: 4546552 - DNA, 16 bp, Homo sapiens
agggccacgctccagc

SEQ ID NO: 4546553 - DNA, 20 bp, Homo sapiens
agggccacgtgccaggcccg

SEQ ID NO: 4546554 - DNA, 23 bp, Homo sapiens
agggccactcaacagagaggacc

SEQ ID NO: 4546555 - DNA, 21 bp, Homo sapiens
agggccaggcctctgctggct

SEQ ID NO: 4546556 - DNA, 16 bp, Homo sapiens
agggccagtcctgcct

SEQ ID NO: 4546557 - DNA, 17 bp, Homo sapiens
agggccatgtgctgccc

SEQ ID NO: 4546558 - DNA, 18 bp, Homo sapiens
agggccattttggtgctt

SEQ ID NO: 4546559 - DNA, 18 bp, Homo sapiens
agggcccacccatgtcac

SEQ ID NO: 4546560 - DNA, 13 bp, Homo sapiens
agggcccagccca

SEQ ID NO: 4546561 - DNA, 18 bp, Homo sapiens
agggcccagcccagagcc

SEQ ID NO: 4546562 - DNA, 19 bp, Homo sapiens
agggcccccaataaaccag

SEQ ID NO: 4546563 - DNA, 20 bp, Homo sapiens
agggcccccaataaaccagt

SEQ ID NO: 4546564 - DNA, 16 bp, Homo sapiens
agggcccggccacacc

SEQ ID NO: 4546565 - DNA, 19 bp, Homo sapiens
agggccgactaagagaagt

SEQ ID NO: 4546566 - DNA, 18 bp, Homo sapiens
agggcctgaaacccgccc

SEQ ID NO: 4546567 - DNA, 14 bp, Homo sapiens
agggcctggagccc

SEQ ID NO: 4546568 - DNA, 17 bp, Homo sapiens
agggcctggagccccat

SEQ ID NO: 4546569 - DNA, 21 bp, Homo sapiens
agggcctggagccccatcggc

SEQ ID NO: 4546570 - DNA, 14 bp, Homo sapiens
agggcctggctcca

SEQ ID NO: 4546571 - DNA, 14 bp, Homo sapiens
agggccttgcccag

SEQ ID NO: 4546572 - DNA, 18 bp, Homo sapiens
agggccttgcccagagat

SEQ ID NO: 4546573 - DNA, 15 bp, Homo sapiens
agggcgagctgcagg

SEQ ID NO: 4546574 - DNA, 16 bp, Homo sapiens
agggcgagctgcagga

SEQ ID NO: 4546575 - DNA, 18 bp, Homo sapiens
agggcggcctcccaggtc

SEQ ID NO: 4546576 - DNA, 15 bp, Homo sapiens
agggcgtgactcacc

SEQ ID NO: 4546577 - DNA, 20 bp, Homo sapiens
agggctaattctgggaaggg

SEQ ID NO: 4546578 - DNA, 21 bp, Homo sapiens
agggctaattctgggaaggga

SEQ ID NO: 4546579 - DNA, 23 bp, Homo sapiens
agggctaattctgggaagggaga

SEQ ID NO: 4546580 - DNA, 15 bp, Homo sapiens
agggctaccctgagc

SEQ ID NO: 4546581 - DNA, 17 bp, Homo sapiens
agggctaccctgagctg

SEQ ID NO: 4546582 - DNA, 18 bp, Homo sapiens
agggctagaacctggaag

SEQ ID NO: 4546583 - DNA, 22 bp, Homo sapiens
agggctagaacctggaagggct

SEQ ID NO: 4546584 - DNA, 17 bp, Homo sapiens
agggctagaacctggag

SEQ ID NO: 4546585 - DNA, 22 bp, Homo sapiens
agggctagaacctggagggcta

SEQ ID NO: 4546586 - DNA, 18 bp, Homo sapiens
agggctagaacctggcag

SEQ ID NO: 4546587 - DNA, 22 bp, Homo sapiens
agggctagaacctgtagagcta

SEQ ID NO: 4546588 - DNA, 17 bp, Homo sapiens
agggctagaactggaga

SEQ ID NO: 4546589 - DNA, 20 bp, Homo sapiens
agggctagaatctggagagc

SEQ ID NO: 4546590 - DNA, 20 bp, Homo sapiens
agggctagggaggtggggta

SEQ ID NO: 4546591 - DNA, 19 bp, Homo sapiens
agggctctgtttgtgggac

SEQ ID NO: 4546592 - DNA, 23 bp, Homo sapiens
agggctgcaggggattctgtgtt

SEQ ID NO: 4546593 - DNA, 13 bp, Homo sapiens
agggctgctgtga

SEQ ID NO: 4546594 - DNA, 14 bp, Homo sapiens
agggctggactgag

SEQ ID NO: 4546595 - DNA, 16 bp, Homo sapiens
agggctggaggcccag

SEQ ID NO: 4546596 - DNA, 17 bp, Homo sapiens
agggctggaggcccagg

SEQ ID NO: 4546597 - DNA, 13 bp, Homo sapiens
agggctggcccag

SEQ ID NO: 4546598 - DNA, 21 bp, Homo sapiens
agggctggccgggactgctgc

SEQ ID NO: 4546599 - DNA, 23 bp, Homo sapiens
agggctggccgggactgctgctc

SEQ ID NO: 4546600 - DNA, 14 bp, Homo sapiens
agggctggctcccc

SEQ ID NO: 4546601 - DNA, 16 bp, Homo sapiens
agggctggctccccct

SEQ ID NO: 4546602 - DNA, 13 bp, Homo sapiens
agggctggctggc

SEQ ID NO: 4546603 - DNA, 20 bp, Homo sapiens
agggctgggcaaggaaaaag

SEQ ID NO: 4546604 - DNA, 17 bp, Homo sapiens
agggctgggccaccagg

SEQ ID NO: 4546605 - DNA, 11 bp, Homo sapiens
agggctgggga

SEQ ID NO: 4546606 - DNA, 23 bp, Homo sapiens
agggctggggttgccagaggccc

SEQ ID NO: 4546607 - DNA, 14 bp, Homo sapiens
agggctggtcttgg

SEQ ID NO: 4546608 - DNA, 17 bp, Homo sapiens
agggctggttaatgtag

SEQ ID NO: 4546609 - DNA, 18 bp, Homo sapiens
agggctgtcccagccccg

SEQ ID NO: 4546610 - DNA, 15 bp, Homo sapiens
agggctgttttgcct

SEQ ID NO: 4546611 - DNA, 23 bp, Homo sapiens
agggcttcctcaaatacatgcac

SEQ ID NO: 4546612 - DNA, 20 bp, Homo sapiens
agggcttcctctagaagcca

SEQ ID NO: 4546613 - DNA, 16 bp, Homo sapiens
agggcttctcctcctc

SEQ ID NO: 4546614 - DNA, 20 bp, Homo sapiens
agggcttgtttttcttcagc

SEQ ID NO: 4546615 - DNA, 18 bp, Homo sapiens
agggctttgttttgcaca

SEQ ID NO: 4546616 - DNA, 22 bp, Homo sapiens
aggggaaaaaatcatattctaa

SEQ ID NO: 4546617 - DNA, 17 bp, Homo sapiens
aggggaaagacttccat

SEQ ID NO: 4546618 - DNA, 13 bp, Homo sapiens
aggggaacctgcc

SEQ ID NO: 4546619 - DNA, 14 bp, Homo sapiens
aggggaacctgcca

SEQ ID NO: 4546620 - DNA, 15 bp, Homo sapiens
aggggaacctgccat

SEQ ID NO: 4546621 - DNA, 12 bp, Homo sapiens
aggggaaggccc

SEQ ID NO: 4546622 - DNA, 21 bp, Homo sapiens
aggggaccaattctggacaga

SEQ ID NO: 4546623 - DNA, 24 bp, Homo sapiens
aggggaccaattctggacagacag

SEQ ID NO: 4546624 - DNA, 17 bp, Homo sapiens
aggggactcagccctga

SEQ ID NO: 4546625 - DNA, 22 bp, Homo sapiens
aggggactcagccctgaggtga

SEQ ID NO: 4546626 - DNA, 15 bp, Homo sapiens
aggggagacaggagc

SEQ ID NO: 4546627 - DNA, 20 bp, Homo sapiens
aggggagacattagaaaaaa

SEQ ID NO: 4546628 - DNA, 18 bp, Homo sapiens
aggggagagacaggcagc

SEQ ID NO: 4546629 - DNA, 15 bp, Homo sapiens
aggggagagcctgct

SEQ ID NO: 4546630 - DNA, 10 bp, Homo sapiens
aggggagagg

SEQ ID NO: 4546631 - DNA, 17 bp, Homo sapiens
aggggagagggtctgga

SEQ ID NO: 4546632 - DNA, 22 bp, Homo sapiens
aggggaggggcgcaccccacag

SEQ ID NO: 4546633 - DNA, 16 bp, Homo sapiens
aggggatatttactgc

SEQ ID NO: 4546634 - DNA, 15 bp, Homo sapiens
aggggattttgctga

SEQ ID NO: 4546635 - DNA, 20 bp, Homo sapiens
aggggcaaccaactgcccca

SEQ ID NO: 4546636 - DNA, 22 bp, Homo sapiens
aggggcaaccaactgccccagg

SEQ ID NO: 4546637 - DNA, 22 bp, Homo sapiens
aggggcacctatgagatggcca

SEQ ID NO: 4546638 - DNA, 15 bp, Homo sapiens
aggggcatctgcccc

SEQ ID NO: 4546639 - DNA, 20 bp, Homo sapiens
aggggcatctgcccctcccc

SEQ ID NO: 4546640 - DNA, 21 bp, Homo sapiens
aggggccaacctcaggctcct

SEQ ID NO: 4546641 - DNA, 19 bp, Homo sapiens
aggggccaataaaatgtat

SEQ ID NO: 4546642 - DNA, 20 bp, Homo sapiens
aggggccaattttggatgag

SEQ ID NO: 4546643 - DNA, 13 bp, Homo sapiens
aggggccagaggc

SEQ ID NO: 4546644 - DNA, 17 bp, Homo sapiens
aggggcccaaggcggcc

SEQ ID NO: 4546645 - DNA, 20 bp, Homo sapiens
aggggcccaaggcggcccct

SEQ ID NO: 4546646 - DNA, 15 bp, Homo sapiens
aggggcccctgggga

SEQ ID NO: 4546647 - DNA, 16 bp, Homo sapiens
aggggcccctggggac

SEQ ID NO: 4546648 - DNA, 18 bp, Homo sapiens
aggggccggctgtttcct

SEQ ID NO: 4546649 - DNA, 17 bp, Homo sapiens
aggggccgggggcagtc

SEQ ID NO: 4546650 - DNA, 14 bp, Homo sapiens
aggggcctctctcc

SEQ ID NO: 4546651 - DNA, 15 bp, Homo sapiens
aggggcctctctcct

SEQ ID NO: 4546652 - DNA, 16 bp, Homo sapiens
aggggcctctctcctg

SEQ ID NO: 4546653 - DNA, 19 bp, Homo sapiens
aggggcctctctcctgcct

SEQ ID NO: 4546654 - DNA, 23 bp, Homo sapiens
aggggcgcaccccacagctgggg

SEQ ID NO: 4546655 - DNA, 14 bp, Homo sapiens
aggggcgggctcag

SEQ ID NO: 4546656 - DNA, 15 bp, Homo sapiens
aggggcgggctcaga

SEQ ID NO: 4546657 - DNA, 17 bp, Homo sapiens
aggggcgggctcagagc

SEQ ID NO: 4546658 - DNA, 23 bp, Homo sapiens
aggggcgggctcagagctttgtc

SEQ ID NO: 4546659 - DNA, 20 bp, Homo sapiens
aggggcgggtggatcacctg

SEQ ID NO: 4546660 - DNA, 22 bp, Homo sapiens
aggggcgggtggatcacctgag

SEQ ID NO: 4546661 - DNA, 21 bp, Homo sapiens
aggggcgttctcccaaagatt

SEQ ID NO: 4546662 - DNA, 18 bp, Homo sapiens
aggggctccatgctgggt

SEQ ID NO: 4546663 - DNA, 20 bp, Homo sapiens
aggggctccatgctgggtct

SEQ ID NO: 4546664 - DNA, 21 bp, Homo sapiens
aggggctgtggccgtctcctc

SEQ ID NO: 4546665 - DNA, 16 bp, Homo sapiens
aggggcttgggcctgc

SEQ ID NO: 4546666 - DNA, 16 bp, Homo sapiens
agggggagagggctgc

SEQ ID NO: 4546667 - DNA, 18 bp, Homo sapiens
agggggccccgccagggc

SEQ ID NO: 4546668 - DNA, 16 bp, Homo sapiens
agggggccctgcccca

SEQ ID NO: 4546669 - DNA, 14 bp, Homo sapiens
agggggctgctccc

SEQ ID NO: 4546670 - DNA, 15 bp, Homo sapiens
agggggctgctccca

SEQ ID NO: 4546671 - DNA, 19 bp, Homo sapiens
agggggctgctcccacctg

SEQ ID NO: 4546672 - DNA, 12 bp, Homo sapiens
agggggctgggg

SEQ ID NO: 4546673 - DNA, 22 bp, Homo sapiens
agggggctggggtcacagaggc

SEQ ID NO: 4546674 - DNA, 23 bp, Homo sapiens
aggggggggtatttcaattacct

SEQ ID NO: 4546675 - DNA, 15 bp, Homo sapiens
aggggtcccagccac

SEQ ID NO: 4546676 - DNA, 18 bp, Homo sapiens
aggggtcccagccacccc

SEQ ID NO: 4546677 - DNA, 14 bp, Homo sapiens
aggggtctccctgg

SEQ ID NO: 4546678 - DNA, 15 bp, Homo sapiens
aggggtctccctggc

SEQ ID NO: 4546679 - DNA, 17 bp, Homo sapiens
aggggtctccctggctc

SEQ ID NO: 4546680 - DNA, 18 bp, Homo sapiens
aggggtctccctggctcc

SEQ ID NO: 4546681 - DNA, 18 bp, Homo sapiens
aggggtgagagacctgct

SEQ ID NO: 4546682 - DNA, 22 bp, Homo sapiens
aggggtgagagacctgctcagg

SEQ ID NO: 4546683 - DNA, 20 bp, Homo sapiens
aggggtgcttcctcctcagg

SEQ ID NO: 4546684 - DNA, 12 bp, Homo sapiens
aggggtggccca

SEQ ID NO: 4546685 - DNA, 19 bp, Homo sapiens
aggggtggcccagagccat

SEQ ID NO: 4546686 - DNA, 17 bp, Homo sapiens
aggggtggccgggcaca

SEQ ID NO: 4546687 - DNA, 18 bp, Homo sapiens
aggggtggggagatgctt

SEQ ID NO: 4546688 - DNA, 19 bp, Homo sapiens
aggggttggttgaggtgga

SEQ ID NO: 4546689 - DNA, 15 bp, Homo sapiens
aggggtttacagtga

SEQ ID NO: 4546690 - DNA, 22 bp, Homo sapiens
agggtaaataaaccactgtgcg

SEQ ID NO: 4546691 - DNA, 14 bp, Homo sapiens
agggtaaggtgcct

SEQ ID NO: 4546692 - DNA, 20 bp, Homo sapiens
agggtacagatccccagccc

SEQ ID NO: 4546693 - DNA, 14 bp, Homo sapiens
agggtagcccgcct

SEQ ID NO: 4546694 - DNA, 17 bp, Homo sapiens
agggtcactggcctctc

SEQ ID NO: 4546695 - DNA, 21 bp, Homo sapiens
agggtcagacgcctgaggaac

SEQ ID NO: 4546696 - DNA, 21 bp, Homo sapiens
agggtcagaggacctgtattt

SEQ ID NO: 4546697 - DNA, 10 bp, Homo sapiens
agggtcaggc

SEQ ID NO: 4546698 - DNA, 13 bp, Homo sapiens
agggtcaggcccg

SEQ ID NO: 4546699 - DNA, 17 bp, Homo sapiens
agggtcaggcggagctg

SEQ ID NO: 4546700 - DNA, 16 bp, Homo sapiens
agggtcataagtgggg

SEQ ID NO: 4546701 - DNA, 15 bp, Homo sapiens
agggtccaggaatgg

SEQ ID NO: 4546702 - DNA, 12 bp, Homo sapiens
agggtcccaagc

SEQ ID NO: 4546703 - DNA, 17 bp, Homo sapiens
agggtcccaagctgggc

SEQ ID NO: 4546704 - DNA, 14 bp, Homo sapiens
agggtccctgccca

SEQ ID NO: 4546705 - DNA, 16 bp, Homo sapiens
agggtcccttttgcat

SEQ ID NO: 4546706 - DNA, 16 bp, Homo sapiens
agggtcctctcttcca

SEQ ID NO: 4546707 - DNA, 23 bp, Homo sapiens
agggtcctctcttccacagtggc

SEQ ID NO: 4546708 - DNA, 14 bp, Homo sapiens
agggtcctggctcc

SEQ ID NO: 4546709 - DNA, 23 bp, Homo sapiens
agggtcctggtcctaaagagtta

SEQ ID NO: 4546710 - DNA, 17 bp, Homo sapiens
agggtccttttgacact

SEQ ID NO: 4546711 - DNA, 18 bp, Homo sapiens
agggtcggaggtgctgtc

SEQ ID NO: 4546712 - DNA, 16 bp, Homo sapiens
agggtctagggagaga

SEQ ID NO: 4546713 - DNA, 19 bp, Homo sapiens
agggtctagggagagaccc

SEQ ID NO: 4546714 - DNA, 23 bp, Homo sapiens
agggtctagggagagacccttgt

SEQ ID NO: 4546715 - DNA, 22 bp, Homo sapiens
agggtcttgctctgtcccccag

SEQ ID NO: 4546716 - DNA, 23 bp, Homo sapiens
agggtcttgctctgtcccccagg

SEQ ID NO: 4546717 - DNA, 18 bp, Homo sapiens
agggtctttggtgttttt

SEQ ID NO: 4546718 - DNA, 21 bp, Homo sapiens
agggtgatgggaaagcattgt

SEQ ID NO: 4546719 - DNA, 23 bp, Homo sapiens
agggtgctacgtacatgtgaggc

SEQ ID NO: 4546720 - DNA, 17 bp, Homo sapiens
agggtggaaaaatgccc

SEQ ID NO: 4546721 - DNA, 16 bp, Homo sapiens
agggtggatgtgctgg

SEQ ID NO: 4546722 - DNA, 17 bp, Homo sapiens
agggtggatgtgctgga

SEQ ID NO: 4546723 - DNA, 18 bp, Homo sapiens
agggtggatgtgctggag

SEQ ID NO: 4546724 - DNA, 19 bp, Homo sapiens
agggtggatgtgctggagg

SEQ ID NO: 4546725 - DNA, 13 bp, Homo sapiens
agggtggccacac

SEQ ID NO: 4546726 - DNA, 17 bp, Homo sapiens
agggtggccacacaggc

SEQ ID NO: 4546727 - DNA, 19 bp, Homo sapiens
agggtggccacacaggcag

SEQ ID NO: 4546728 - DNA, 15 bp, Homo sapiens
agggtggctttgctg

SEQ ID NO: 4546729 - DNA, 12 bp, Homo sapiens
agggtgggaagg

SEQ ID NO: 4546730 - DNA, 13 bp, Homo sapiens
agggtgggaggga

SEQ ID NO: 4546731 - DNA, 16 bp, Homo sapiens
agggtgggagggagga

SEQ ID NO: 4546732 - DNA, 20 bp, Homo sapiens
agggtgggagtggggccttt

SEQ ID NO: 4546733 - DNA, 18 bp, Homo sapiens
agggtgggatggaggaga

SEQ ID NO: 4546734 - DNA, 17 bp, Homo sapiens
agggtgggggagggagg

SEQ ID NO: 4546735 - DNA, 11 bp, Homo sapiens
agggtgggggg

SEQ ID NO: 4546736 - DNA, 22 bp, Homo sapiens
agggtgggggggaccgggcccc

SEQ ID NO: 4546737 - DNA, 22 bp, Homo sapiens
agggtgggtgagctctcaggcc

SEQ ID NO: 4546738 - DNA, 20 bp, Homo sapiens
agggtggttcaacaaagaaa

SEQ ID NO: 4546739 - DNA, 16 bp, Homo sapiens
agggtgtatagtgttc

SEQ ID NO: 4546740 - DNA, 23 bp, Homo sapiens
agggtgtggctttccaggcaccc

SEQ ID NO: 4546741 - DNA, 18 bp, Homo sapiens
agggttcacacagcccag

SEQ ID NO: 4546742 - DNA, 19 bp, Homo sapiens
agggttcacacagcccagt

SEQ ID NO: 4546743 - DNA, 18 bp, Homo sapiens
agggttctaaatgcaata

SEQ ID NO: 4546744 - DNA, 23 bp, Homo sapiens
agggttctgcttttaagtttttc

SEQ ID NO: 4546745 - DNA, 16 bp, Homo sapiens
agggttgaccccagag

SEQ ID NO: 4546746 - DNA, 18 bp, Homo sapiens
agggtttacccagtggga

SEQ ID NO: 4546747 - DNA, 14 bp, Homo sapiens
agggtttctctatt

SEQ ID NO: 4546748 - DNA, 16 bp, Homo sapiens
agggtttctctgcaga

SEQ ID NO: 4546749 - DNA, 14 bp, Homo sapiens
agggtttgtggctg

SEQ ID NO: 4546750 - DNA, 14 bp, Homo sapiens
aggtaaaacagggc

SEQ ID NO: 4546751 - DNA, 14 bp, Homo sapiens
aggtaaaatgtatt

SEQ ID NO: 4546752 - DNA, 18 bp, Homo sapiens
aggtaaagggcaaataat

SEQ ID NO: 4546753 - DNA, 20 bp, Homo sapiens
aggtaaataaaaagaaaggc

SEQ ID NO: 4546754 - DNA, 19 bp, Homo sapiens
aggtaactaactgcataca

SEQ ID NO: 4546755 - DNA, 17 bp, Homo sapiens
aggtaactatcaatatt

SEQ ID NO: 4546756 - DNA, 20 bp, Homo sapiens
aggtaagttgctattttcat

SEQ ID NO: 4546757 - DNA, 15 bp, Homo sapiens
aggtaatcattttaa

SEQ ID NO: 4546758 - DNA, 16 bp, Homo sapiens
aggtacaagaagcatt

SEQ ID NO: 4546759 - DNA, 13 bp, Homo sapiens
aggtaccagctgc

SEQ ID NO: 4546760 - DNA, 16 bp, Homo sapiens
aggtaccagctgcgct

SEQ ID NO: 4546761 - DNA, 21 bp, Homo sapiens
aggtaccatttgtgtctcttt

SEQ ID NO: 4546762 - DNA, 18 bp, Homo sapiens
aggtagaaaaagggtcaa

SEQ ID NO: 4546763 - DNA, 17 bp, Homo sapiens
aggtagaatgttttcaa

SEQ ID NO: 4546764 - DNA, 12 bp, Homo sapiens
aggtagcctatt

SEQ ID NO: 4546765 - DNA, 15 bp, Homo sapiens
aggtagtctcactgc

SEQ ID NO: 4546766 - DNA, 17 bp, Homo sapiens
aggtatactttagtaga

SEQ ID NO: 4546767 - DNA, 21 bp, Homo sapiens
aggtatactttagtagacatt

SEQ ID NO: 4546768 - DNA, 23 bp, Homo sapiens
aggtattaaaggttaaattgctt

SEQ ID NO: 4546769 - DNA, 17 bp, Homo sapiens
aggtattacaagtaatg

SEQ ID NO: 4546770 - DNA, 17 bp, Homo sapiens
aggtatttttttaaatc

SEQ ID NO: 4546771 - DNA, 22 bp, Homo sapiens
aggtatttttttaaatcaagga

SEQ ID NO: 4546772 - DNA, 23 bp, Homo sapiens
aggtatttttttaaatcaaggaa

SEQ ID NO: 4546773 - DNA, 16 bp, Homo sapiens
aggtcaaactccctag

SEQ ID NO: 4546774 - DNA, 17 bp, Homo sapiens
aggtcaacagagaaggc

SEQ ID NO: 4546775 - DNA, 23 bp, Homo sapiens
aggtcacctgccgccctgtggga

SEQ ID NO: 4546776 - DNA, 16 bp, Homo sapiens
aggtcactggaaaggg

SEQ ID NO: 4546777 - DNA, 22 bp, Homo sapiens
aggtcagcgcggtcctgactcc

SEQ ID NO: 4546778 - DNA, 14 bp, Homo sapiens
aggtcattaaaaca

SEQ ID NO: 4546779 - DNA, 12 bp, Homo sapiens
aggtccaaggac

SEQ ID NO: 4546780 - DNA, 18 bp, Homo sapiens
aggtcccacgccaggcca

SEQ ID NO: 4546781 - DNA, 16 bp, Homo sapiens
aggtcccagcccctcc

SEQ ID NO: 4546782 - DNA, 20 bp, Homo sapiens
aggtcccagcccctcctccc

SEQ ID NO: 4546783 - DNA, 24 bp, Homo sapiens
aggtcccagcccctcctccctcag

SEQ ID NO: 4546784 - DNA, 21 bp, Homo sapiens
aggtcccataagggtagcccc

SEQ ID NO: 4546785 - DNA, 20 bp, Homo sapiens
aggtccgcaccctgtcctgc

SEQ ID NO: 4546786 - DNA, 21 bp, Homo sapiens
aggtccgcaccctgtcctgca

SEQ ID NO: 4546787 - DNA, 16 bp, Homo sapiens
aggtccgtagctcccc

SEQ ID NO: 4546788 - DNA, 17 bp, Homo sapiens
aggtcctcccctctctt

SEQ ID NO: 4546789 - DNA, 15 bp, Homo sapiens
aggtcctgcccatgt

SEQ ID NO: 4546790 - DNA, 23 bp, Homo sapiens
aggtcctgctgcctctctttcac

SEQ ID NO: 4546791 - DNA, 16 bp, Homo sapiens
aggtcctgtgttaaac

SEQ ID NO: 4546792 - DNA, 20 bp, Homo sapiens
aggtccttaggcctctgaga

SEQ ID NO: 4546793 - DNA, 22 bp, Homo sapiens
aggtccttgcctgaactccaga

SEQ ID NO: 4546794 - DNA, 23 bp, Homo sapiens
aggtccttgcctgaactccagag

SEQ ID NO: 4546795 - DNA, 18 bp, Homo sapiens
aggtcgggacagctgtgc

SEQ ID NO: 4546796 - DNA, 20 bp, Homo sapiens
aggtctacattcttggttgt

SEQ ID NO: 4546797 - DNA, 20 bp, Homo sapiens
aggtctcatctcccaggccc

SEQ ID NO: 4546798 - DNA, 21 bp, Homo sapiens
aggtctccaaaccagacggtg

SEQ ID NO: 4546799 - DNA, 15 bp, Homo sapiens
aggtctccacctgca

SEQ ID NO: 4546800 - DNA, 21 bp, Homo sapiens
aggtctcggactaagcctacc

SEQ ID NO: 4546801 - DNA, 14 bp, Homo sapiens
aggtctgagccctg

SEQ ID NO: 4546802 - DNA, 22 bp, Homo sapiens
aggtctgagccctggtgtgttt

SEQ ID NO: 4546803 - DNA, 21 bp, Homo sapiens
aggtctgggctaggtagaaaa

SEQ ID NO: 4546804 - DNA, 12 bp, Homo sapiens
aggtctgtttaa

SEQ ID NO: 4546805 - DNA, 14 bp, Homo sapiens
aggtcttaaagtag

SEQ ID NO: 4546806 - DNA, 20 bp, Homo sapiens
aggtcttcatcgaatctact

SEQ ID NO: 4546807 - DNA, 17 bp, Homo sapiens
aggtcttgccaactcca

SEQ ID NO: 4546808 - DNA, 18 bp, Homo sapiens
aggtctttcagtactttt

SEQ ID NO: 4546809 - DNA, 12 bp, Homo sapiens
aggtctttctct

SEQ ID NO: 4546810 - DNA, 14 bp, Homo sapiens
aggtcttttgaggg

SEQ ID NO: 4546811 - DNA, 21 bp, Homo sapiens
aggtgaaagggagctatcagg

SEQ ID NO: 4546812 - DNA, 19 bp, Homo sapiens
aggtgaaagttaatccact

SEQ ID NO: 4546813 - DNA, 15 bp, Homo sapiens
aggtgaacattaaaa

SEQ ID NO: 4546814 - DNA, 22 bp, Homo sapiens
aggtgaaggctctcacccccat

SEQ ID NO: 4546815 - DNA, 18 bp, Homo sapiens
aggtgacacgcttctgag

SEQ ID NO: 4546816 - DNA, 15 bp, Homo sapiens
aggtgacagtggctg

SEQ ID NO: 4546817 - DNA, 19 bp, Homo sapiens
aggtgacatcggaaaaata

SEQ ID NO: 4546818 - DNA, 20 bp, Homo sapiens
aggtgaggctacaaggggtg

SEQ ID NO: 4546819 - DNA, 13 bp, Homo sapiens
aggtgaggggaag

SEQ ID NO: 4546820 - DNA, 22 bp, Homo sapiens
aggtgaggggaagacaaagcac

SEQ ID NO: 4546821 - DNA, 17 bp, Homo sapiens
aggtgaggtctgttcct

SEQ ID NO: 4546822 - DNA, 21 bp, Homo sapiens
aggtgagtttgagctgccttc

SEQ ID NO: 4546823 - DNA, 15 bp, Homo sapiens
aggtgataaaatttt

SEQ ID NO: 4546824 - DNA, 16 bp, Homo sapiens
aggtgataaagaggca

SEQ ID NO: 4546825 - DNA, 21 bp, Homo sapiens
aggtgataagggaaaagataa

SEQ ID NO: 4546826 - DNA, 21 bp, Homo sapiens
aggtgatgccattacagaacc

SEQ ID NO: 4546827 - DNA, 15 bp, Homo sapiens
aggtgcagtttcatt

SEQ ID NO: 4546828 - DNA, 20 bp, Homo sapiens
aggtgcagtttcattcaaca

SEQ ID NO: 4546829 - DNA, 13 bp, Homo sapiens
aggtgccaaccca

SEQ ID NO: 4546830 - DNA, 19 bp, Homo sapiens
aggtgccccgactgtggga

SEQ ID NO: 4546831 - DNA, 17 bp, Homo sapiens
aggtgcctgtgaggcag

SEQ ID NO: 4546832 - DNA, 22 bp, Homo sapiens
aggtgcctgtgaggcaggggcg

SEQ ID NO: 4546833 - DNA, 10 bp, Homo sapiens
aggtgccttg

SEQ ID NO: 4546834 - DNA, 21 bp, Homo sapiens
aggtgccttggagggtcccaa

SEQ ID NO: 4546835 - DNA, 19 bp, Homo sapiens
aggtgcctttcaaatttag

SEQ ID NO: 4546836 - DNA, 20 bp, Homo sapiens
aggtgcgcgccaccgtgcct

SEQ ID NO: 4546837 - DNA, 23 bp, Homo sapiens
aggtgcgcgccaccgtgcctggc

SEQ ID NO: 4546838 - DNA, 15 bp, Homo sapiens
aggtgctaaattgtc

SEQ ID NO: 4546839 - DNA, 16 bp, Homo sapiens
aggtgctaacatagat

SEQ ID NO: 4546840 - DNA, 21 bp, Homo sapiens
aggtgctacaaaaacacagca

SEQ ID NO: 4546841 - DNA, 15 bp, Homo sapiens
aggtgctcattggct

SEQ ID NO: 4546842 - DNA, 18 bp, Homo sapiens
aggtgctgatgtcaaagt

SEQ ID NO: 4546843 - DNA, 20 bp, Homo sapiens
aggtgctgatgtcaaagtgt

SEQ ID NO: 4546844 - DNA, 12 bp, Homo sapiens
aggtgctggggg

SEQ ID NO: 4546845 - DNA, 14 bp, Homo sapiens
aggtgctgttatgt

SEQ ID NO: 4546846 - DNA, 21 bp, Homo sapiens
aggtgcttctagttctgccag

SEQ ID NO: 4546847 - DNA, 14 bp, Homo sapiens
aggtgcttgctccc

SEQ ID NO: 4546848 - DNA, 23 bp, Homo sapiens
aggtggaaattttatatgtaaat

SEQ ID NO: 4546849 - DNA, 16 bp, Homo sapiens
aggtggaagaagggag

SEQ ID NO: 4546850 - DNA, 18 bp, Homo sapiens
aggtggaagaagggagaa

SEQ ID NO: 4546851 - DNA, 22 bp, Homo sapiens
aggtggaagaagggagaagaaa

SEQ ID NO: 4546852 - DNA, 16 bp, Homo sapiens
aggtggaagcagaggc

SEQ ID NO: 4546853 - DNA, 17 bp, Homo sapiens
aggtggaagcagaggcc

SEQ ID NO: 4546854 - DNA, 22 bp, Homo sapiens
aggtggaagcagaggccctgcc

SEQ ID NO: 4546855 - DNA, 13 bp, Homo sapiens
aggtggaagccct

SEQ ID NO: 4546856 - DNA, 14 bp, Homo sapiens
aggtggaagccctc

SEQ ID NO: 4546857 - DNA, 15 bp, Homo sapiens
aggtggacaaatgtt

SEQ ID NO: 4546858 - DNA, 14 bp, Homo sapiens
aggtggagggaggg

SEQ ID NO: 4546859 - DNA, 14 bp, Homo sapiens
aggtggcagagtga

SEQ ID NO: 4546860 - DNA, 23 bp, Homo sapiens
aggtggcagatgtcttccctggg

SEQ ID NO: 4546861 - DNA, 23 bp, Homo sapiens
aggtggctcagtgccacctatgc

SEQ ID NO: 4546862 - DNA, 20 bp, Homo sapiens
aggtgggcagatcacttgag

SEQ ID NO: 4546863 - DNA, 18 bp, Homo sapiens
aggtggggagactgggct

SEQ ID NO: 4546864 - DNA, 17 bp, Homo sapiens
aggtggggatcctgcct

SEQ ID NO: 4546865 - DNA, 16 bp, Homo sapiens
aggtgggtcccggctc

SEQ ID NO: 4546866 - DNA, 21 bp, Homo sapiens
aggtgggttttcttcccatca

SEQ ID NO: 4546867 - DNA, 23 bp, Homo sapiens
aggtgggttttcttcccatcact

SEQ ID NO: 4546868 - DNA, 14 bp, Homo sapiens
aggtgtaaagttgt

SEQ ID NO: 4546869 - DNA, 16 bp, Homo sapiens
aggtgtacacatgcca

SEQ ID NO: 4546870 - DNA, 19 bp, Homo sapiens
aggtgtccagcattgctgg

SEQ ID NO: 4546871 - DNA, 20 bp, Homo sapiens
aggtgtccccaacgtcccct

SEQ ID NO: 4546872 - DNA, 18 bp, Homo sapiens
aggtgtcgggacatggtt

SEQ ID NO: 4546873 - DNA, 15 bp, Homo sapiens
aggtgtctgccttca

SEQ ID NO: 4546874 - DNA, 14 bp, Homo sapiens
aggtgtcttcctcc

SEQ ID NO: 4546875 - DNA, 15 bp, Homo sapiens
aggtgtcttcctccc

SEQ ID NO: 4546876 - DNA, 20 bp, Homo sapiens
aggtgtcttcctcccaagtg

SEQ ID NO: 4546877 - DNA, 18 bp, Homo sapiens
aggtgtgaaccactgtgc

SEQ ID NO: 4546878 - DNA, 22 bp, Homo sapiens
aggtgtgaacctacctgccttg

SEQ ID NO: 4546879 - DNA, 21 bp, Homo sapiens
aggtgtgaaggtgatttaagg

SEQ ID NO: 4546880 - DNA, 16 bp, Homo sapiens
aggtgtgactctagca

SEQ ID NO: 4546881 - DNA, 15 bp, Homo sapiens
aggtgtgagactggg

SEQ ID NO: 4546882 - DNA, 17 bp, Homo sapiens
aggtgtgctctgagcca

SEQ ID NO: 4546883 - DNA, 15 bp, Homo sapiens
aggtgtgtactcagg

SEQ ID NO: 4546884 - DNA, 21 bp, Homo sapiens
aggtgttgggtcagtggccag

SEQ ID NO: 4546885 - DNA, 18 bp, Homo sapiens
aggtgtttattaaaattc

SEQ ID NO: 4546886 - DNA, 18 bp, Homo sapiens
aggttaaaaaaaaaagtc

SEQ ID NO: 4546887 - DNA, 20 bp, Homo sapiens
aggttaaacgtagcatgtgg

SEQ ID NO: 4546888 - DNA, 18 bp, Homo sapiens
aggttactcagcagcaga

SEQ ID NO: 4546889 - DNA, 18 bp, Homo sapiens
aggttagaacctagaagg

SEQ ID NO: 4546890 - DNA, 17 bp, Homo sapiens
aggttcagtgcggcccc

SEQ ID NO: 4546891 - DNA, 12 bp, Homo sapiens
aggttcatggat

SEQ ID NO: 4546892 - DNA, 18 bp, Homo sapiens
aggttccagaacagccct

SEQ ID NO: 4546893 - DNA, 19 bp, Homo sapiens
aggttcccagggctggaga

SEQ ID NO: 4546894 - DNA, 13 bp, Homo sapiens
aggttcctctgcc

SEQ ID NO: 4546895 - DNA, 14 bp, Homo sapiens
aggttcctctgcct

SEQ ID NO: 4546896 - DNA, 14 bp, Homo sapiens
aggttctcccagcc

SEQ ID NO: 4546897 - DNA, 17 bp, Homo sapiens
aggttcttaaaaaggaa

SEQ ID NO: 4546898 - DNA, 19 bp, Homo sapiens
aggttcttaaaaaggaaca

SEQ ID NO: 4546899 - DNA, 11 bp, Homo sapiens
aggttcttgct

SEQ ID NO: 4546900 - DNA, 15 bp, Homo sapiens
aggttgaagccaagt

SEQ ID NO: 4546901 - DNA, 16 bp, Homo sapiens
aggttgcagtgagctg

SEQ ID NO: 4546902 - DNA, 17 bp, Homo sapiens
aggttgcagtgagctga

SEQ ID NO: 4546903 - DNA, 12 bp, Homo sapiens
aggttgcattgg

SEQ ID NO: 4546904 - DNA, 12 bp, Homo sapiens
aggttgcctgaa

SEQ ID NO: 4546905 - DNA, 17 bp, Homo sapiens
aggttggcttttttccc

SEQ ID NO: 4546906 - DNA, 23 bp, Homo sapiens
aggttgggagaatgtcagtatgt

SEQ ID NO: 4546907 - DNA, 14 bp, Homo sapiens
aggttgtggggcct

SEQ ID NO: 4546908 - DNA, 18 bp, Homo sapiens
aggttgtggggcctcagg

SEQ ID NO: 4546909 - DNA, 17 bp, Homo sapiens
aggtttcccaaaacaat

SEQ ID NO: 4546910 - DNA, 15 bp, Homo sapiens
aggtttctggagcag

SEQ ID NO: 4546911 - DNA, 21 bp, Homo sapiens
aggttttggttatggagtctt

SEQ ID NO: 4546912 - DNA, 15 bp, Homo sapiens
aggtttttaaagact

SEQ ID NO: 4546913 - DNA, 19 bp, Homo sapiens
aggtttttgtagtgatttt

SEQ ID NO: 4546914 - DNA, 14 bp, Homo sapiens
aggtttttttaatg

SEQ ID NO: 4546915 - DNA, 14 bp, Homo sapiens
agtaaaaagacatt

SEQ ID NO: 4546916 - DNA, 17 bp, Homo sapiens
agtaaaaataaaatact

SEQ ID NO: 4546917 - DNA, 13 bp, Homo sapiens
agtaaaacacatt

SEQ ID NO: 4546918 - DNA, 12 bp, Homo sapiens
agtaaaacagtc

SEQ ID NO: 4546919 - DNA, 20 bp, Homo sapiens
agtaaaaccacagcagttga

SEQ ID NO: 4546920 - DNA, 12 bp, Homo sapiens
agtaaaagcaaa

SEQ ID NO: 4546921 - DNA, 18 bp, Homo sapiens
agtaaaattatactgtgt

SEQ ID NO: 4546922 - DNA, 12 bp, Homo sapiens
agtaaaattcag

SEQ ID NO: 4546923 - DNA, 23 bp, Homo sapiens
agtaaaccactgaaaaaatatat

SEQ ID NO: 4546924 - DNA, 15 bp, Homo sapiens
agtaaacggcccagg

SEQ ID NO: 4546925 - DNA, 17 bp, Homo sapiens
agtaaacggcccaggcc

SEQ ID NO: 4546926 - DNA, 19 bp, Homo sapiens
agtaaacggcccaggccag

SEQ ID NO: 4546927 - DNA, 14 bp, Homo sapiens
agtaaactaaagta

SEQ ID NO: 4546928 - DNA, 14 bp, Homo sapiens
agtaaactgaggcc

SEQ ID NO: 4546929 - DNA, 15 bp, Homo sapiens
agtaaacttgtgtat

SEQ ID NO: 4546930 - DNA, 18 bp, Homo sapiens
agtaaacttgtgtattga

SEQ ID NO: 4546931 - DNA, 18 bp, Homo sapiens
agtaaagagaaactttgt

SEQ ID NO: 4546932 - DNA, 18 bp, Homo sapiens
agtaaagagtacactcag

SEQ ID NO: 4546933 - DNA, 22 bp, Homo sapiens
agtaaagtggttctctgccttt

SEQ ID NO: 4546934 - DNA, 21 bp, Homo sapiens
agtaaagttgtatgtaagctg

SEQ ID NO: 4546935 - DNA, 20 bp, Homo sapiens
agtaaatccaggctttatgt

SEQ ID NO: 4546936 - DNA, 10 bp, Homo sapiens
agtaaatgtt

SEQ ID NO: 4546937 - DNA, 14 bp, Homo sapiens
agtaaatgttaact

SEQ ID NO: 4546938 - DNA, 15 bp, Homo sapiens
agtaaatgttaactg

SEQ ID NO: 4546939 - DNA, 16 bp, Homo sapiens
agtaaatgttacttct

SEQ ID NO: 4546940 - DNA, 22 bp, Homo sapiens
agtaaatgttatcttatactgt

SEQ ID NO: 4546941 - DNA, 17 bp, Homo sapiens
agtaacactaatatatt

SEQ ID NO: 4546942 - DNA, 20 bp, Homo sapiens
agtaacactgtgatttatct

SEQ ID NO: 4546943 - DNA, 21 bp, Homo sapiens
agtaacactgtgatttatctt

SEQ ID NO: 4546944 - DNA, 17 bp, Homo sapiens
agtaacagggcagaaat

SEQ ID NO: 4546945 - DNA, 19 bp, Homo sapiens
agtaacataactgcttctt

SEQ ID NO: 4546946 - DNA, 23 bp, Homo sapiens
agtaacatgacttccttatttct

SEQ ID NO: 4546947 - DNA, 17 bp, Homo sapiens
agtaacgagaagtgctt

SEQ ID NO: 4546948 - DNA, 16 bp, Homo sapiens
agtaacgggacagtaa

SEQ ID NO: 4546949 - DNA, 21 bp, Homo sapiens
agtaacgggacagtaaacact

SEQ ID NO: 4546950 - DNA, 16 bp, Homo sapiens
agtaacttatttgact

SEQ ID NO: 4546951 - DNA, 21 bp, Homo sapiens
agtaactttgcgggatattta

SEQ ID NO: 4546952 - DNA, 22 bp, Homo sapiens
agtaactttgcgggatatttag

SEQ ID NO: 4546953 - DNA, 23 bp, Homo sapiens
agtaagatttacccagaatgtca

SEQ ID NO: 4546954 - DNA, 14 bp, Homo sapiens
agtaagcatttcca

SEQ ID NO: 4546955 - DNA, 12 bp, Homo sapiens
agtaagcctcat

SEQ ID NO: 4546956 - DNA, 15 bp, Homo sapiens
agtaaggattttatg

SEQ ID NO: 4546957 - DNA, 22 bp, Homo sapiens
agtaagggcactgacggactca

SEQ ID NO: 4546958 - DNA, 14 bp, Homo sapiens
agtaagtatttcca

SEQ ID NO: 4546959 - DNA, 16 bp, Homo sapiens
agtaagtgccttccat

SEQ ID NO: 4546960 - DNA, 14 bp, Homo sapiens
agtaagttcagcac

SEQ ID NO: 4546961 - DNA, 17 bp, Homo sapiens
agtaagttcagcacttg

SEQ ID NO: 4546962 - DNA, 18 bp, Homo sapiens
agtaataggcattttaag

SEQ ID NO: 4546963 - DNA, 17 bp, Homo sapiens
agtaatatctttcagtt

SEQ ID NO: 4546964 - DNA, 20 bp, Homo sapiens
agtaatcagattactgcttt

SEQ ID NO: 4546965 - DNA, 22 bp, Homo sapiens
agtaatcagattactgctttaa

SEQ ID NO: 4546966 - DNA, 22 bp, Homo sapiens
agtaatcatgttttaatgtaga

SEQ ID NO: 4546967 - DNA, 19 bp, Homo sapiens
agtaatctaatatggccac

SEQ ID NO: 4546968 - DNA, 13 bp, Homo sapiens
agtaatctgcatt

SEQ ID NO: 4546969 - DNA, 13 bp, Homo sapiens
agtaatctgtata

SEQ ID NO: 4546970 - DNA, 19 bp, Homo sapiens
agtaatctgtataatactt

SEQ ID NO: 4546971 - DNA, 22 bp, Homo sapiens
agtaatctgtataatactttgt

SEQ ID NO: 4546972 - DNA, 23 bp, Homo sapiens
agtaatctgtataatactttgta

SEQ ID NO: 4546973 - DNA, 14 bp, Homo sapiens
agtaatctgtcagt

SEQ ID NO: 4546974 - DNA, 13 bp, Homo sapiens
agtaatgaagaat

SEQ ID NO: 4546975 - DNA, 19 bp, Homo sapiens
agtaatgaagaatcacgat

SEQ ID NO: 4546976 - DNA, 16 bp, Homo sapiens
agtaatgcagttttta

SEQ ID NO: 4546977 - DNA, 23 bp, Homo sapiens
agtaatgtcataaagtgagaaaa

SEQ ID NO: 4546978 - DNA, 21 bp, Homo sapiens
agtaattatgcactaaatatg

SEQ ID NO: 4546979 - DNA, 20 bp, Homo sapiens
agtaattcaagcctctaaac

SEQ ID NO: 4546980 - DNA, 20 bp, Homo sapiens
agtaattgacatgtgccagg

SEQ ID NO: 4546981 - DNA, 16 bp, Homo sapiens
agtaattgtgaaaaag

SEQ ID NO: 4546982 - DNA, 12 bp, Homo sapiens
agtaatttagaa

SEQ ID NO: 4546983 - DNA, 14 bp, Homo sapiens
agtaatttagaaat

SEQ ID NO: 4546984 - DNA, 17 bp, Homo sapiens
agtaatttagaaatcat

SEQ ID NO: 4546985 - DNA, 16 bp, Homo sapiens
agtaatttagaagata

SEQ ID NO: 4546986 - DNA, 14 bp, Homo sapiens
agtaatttcagtgt

SEQ ID NO: 4546987 - DNA, 22 bp, Homo sapiens
agtaatttcatttaaatatctg

SEQ ID NO: 4546988 - DNA, 14 bp, Homo sapiens
agtaatttcttttt

SEQ ID NO: 4546989 - DNA, 13 bp, Homo sapiens
agtacaaacatga

SEQ ID NO: 4546990 - DNA, 14 bp, Homo sapiens
agtacaaacatgaa

SEQ ID NO: 4546991 - DNA, 19 bp, Homo sapiens
agtacaatagtatacattt

SEQ ID NO: 4546992 - DNA, 17 bp, Homo sapiens
agtacaatgtgtttttc

SEQ ID NO: 4546993 - DNA, 18 bp, Homo sapiens
agtacaatgtgtttttct

SEQ ID NO: 4546994 - DNA, 17 bp, Homo sapiens
agtacacaataagcaaa

SEQ ID NO: 4546995 - DNA, 16 bp, Homo sapiens
agtacactcagccact

SEQ ID NO: 4546996 - DNA, 18 bp, Homo sapiens
agtacagcggctcccctc

SEQ ID NO: 4546997 - DNA, 21 bp, Homo sapiens
agtacagcggctcccctctgc

SEQ ID NO: 4546998 - DNA, 13 bp, Homo sapiens
agtacattgctta

SEQ ID NO: 4546999 - DNA, 21 bp, Homo sapiens
agtacatttaaattttttggc

SEQ ID NO: 4547000 - DNA, 23 bp, Homo sapiens
agtaccagtaggggcttataata

SEQ ID NO: 4547001 - DNA, 19 bp, Homo sapiens
agtaccctccattgggcac

SEQ ID NO: 4547002 - DNA, 16 bp, Homo sapiens
agtacgaacctacagt

SEQ ID NO: 4547003 - DNA, 16 bp, Homo sapiens
agtacgatcaagttgt

SEQ ID NO: 4547004 - DNA, 14 bp, Homo sapiens
agtacggatttgtc

SEQ ID NO: 4547005 - DNA, 19 bp, Homo sapiens
agtacggatttgtccaaat

SEQ ID NO: 4547006 - DNA, 16 bp, Homo sapiens
agtactattactagta

SEQ ID NO: 4547007 - DNA, 12 bp, Homo sapiens
agtactctttct

SEQ ID NO: 4547008 - DNA, 21 bp, Homo sapiens
agtactggtaagattgttatt

SEQ ID NO: 4547009 - DNA, 15 bp, Homo sapiens
agtactggttacttt

SEQ ID NO: 4547010 - DNA, 18 bp, Homo sapiens
agtactggttactttcaa

SEQ ID NO: 4547011 - DNA, 21 bp, Homo sapiens
agtactggttactttcaaaat

SEQ ID NO: 4547012 - DNA, 23 bp, Homo sapiens
agtactgtaagaataatttatag

SEQ ID NO: 4547013 - DNA, 19 bp, Homo sapiens
agtactgtgggcaatttag

SEQ ID NO: 4547014 - DNA, 22 bp, Homo sapiens
agtactgtgggcaatttagaaa

SEQ ID NO: 4547015 - DNA, 21 bp, Homo sapiens
agtactgtttaccatttttca

SEQ ID NO: 4547016 - DNA, 16 bp, Homo sapiens
agtacttacattccag

SEQ ID NO: 4547017 - DNA, 13 bp, Homo sapiens
agtacttctaaga

SEQ ID NO: 4547018 - DNA, 17 bp, Homo sapiens
agtacttcttctgtaat

SEQ ID NO: 4547019 - DNA, 18 bp, Homo sapiens
agtacttcttctgtaata

SEQ ID NO: 4547020 - DNA, 13 bp, Homo sapiens
agtactttgtgca

SEQ ID NO: 4547021 - DNA, 14 bp, Homo sapiens
agtacttttctctg

SEQ ID NO: 4547022 - DNA, 16 bp, Homo sapiens
agtacttttttaaata

SEQ ID NO: 4547023 - DNA, 22 bp, Homo sapiens
agtagaaagacatctgcctgta

SEQ ID NO: 4547024 - DNA, 20 bp, Homo sapiens
agtagactgattacactgag

SEQ ID NO: 4547025 - DNA, 19 bp, Homo sapiens
agtagattcatgaaaatgt

SEQ ID NO: 4547026 - DNA, 16 bp, Homo sapiens
agtagcaaatgtttac

SEQ ID NO: 4547027 - DNA, 14 bp, Homo sapiens
agtagcaatgtgcc

SEQ ID NO: 4547028 - DNA, 14 bp, Homo sapiens
agtagcagtgattg

SEQ ID NO: 4547029 - DNA, 18 bp, Homo sapiens
agtagccgagagcctgct

SEQ ID NO: 4547030 - DNA, 22 bp, Homo sapiens
agtagcctcctcctgggctcca

SEQ ID NO: 4547031 - DNA, 15 bp, Homo sapiens
agtagctagtagcaa

SEQ ID NO: 4547032 - DNA, 20 bp, Homo sapiens
agtagctcaaaaatactctt

SEQ ID NO: 4547033 - DNA, 21 bp, Homo sapiens
agtagctcaaaaatactcttg

SEQ ID NO: 4547034 - DNA, 13 bp, Homo sapiens
agtagctgggatg

SEQ ID NO: 4547035 - DNA, 21 bp, Homo sapiens
agtaggaatgtacatgaagca

SEQ ID NO: 4547036 - DNA, 18 bp, Homo sapiens
agtagtacttcttctgta

SEQ ID NO: 4547037 - DNA, 20 bp, Homo sapiens
agtagtacttcttctgtaat

SEQ ID NO: 4547038 - DNA, 15 bp, Homo sapiens
agtagtccaccttca

SEQ ID NO: 4547039 - DNA, 16 bp, Homo sapiens
agtagtccaccttcat

SEQ ID NO: 4547040 - DNA, 14 bp, Homo sapiens
agtagtggccactg

SEQ ID NO: 4547041 - DNA, 19 bp, Homo sapiens
agtagtggccactggggtg

SEQ ID NO: 4547042 - DNA, 13 bp, Homo sapiens
agtagttagaaat

SEQ ID NO: 4547043 - DNA, 12 bp, Homo sapiens
agtagttcacat

SEQ ID NO: 4547044 - DNA, 13 bp, Homo sapiens
agtagtttgaatg

SEQ ID NO: 4547045 - DNA, 15 bp, Homo sapiens
agtagtttgaatgtt

SEQ ID NO: 4547046 - DNA, 13 bp, Homo sapiens
agtataaatctgg

SEQ ID NO: 4547047 - DNA, 15 bp, Homo sapiens
agtataaatgtacat

SEQ ID NO: 4547048 - DNA, 13 bp, Homo sapiens
agtataagataaa

SEQ ID NO: 4547049 - DNA, 15 bp, Homo sapiens
agtataatctcctct

SEQ ID NO: 4547050 - DNA, 18 bp, Homo sapiens
agtatacattgtcttgat

SEQ ID NO: 4547051 - DNA, 13 bp, Homo sapiens
agtatacatttta

SEQ ID NO: 4547052 - DNA, 16 bp, Homo sapiens
agtatagagagaagtt

SEQ ID NO: 4547053 - DNA, 17 bp, Homo sapiens
agtatataagctttttt

SEQ ID NO: 4547054 - DNA, 14 bp, Homo sapiens
agtatattgttgaa

SEQ ID NO: 4547055 - DNA, 18 bp, Homo sapiens
agtatattgttgaagaga

SEQ ID NO: 4547056 - DNA, 20 bp, Homo sapiens
agtatattgttgaagagaca

SEQ ID NO: 4547057 - DNA, 19 bp, Homo sapiens
agtatattttctgtattta

SEQ ID NO: 4547058 - DNA, 22 bp, Homo sapiens
agtatattttctgtatttaatt

SEQ ID NO: 4547059 - DNA, 13 bp, Homo sapiens
agtatcttgtgct

SEQ ID NO: 4547060 - DNA, 23 bp, Homo sapiens
agtatgaatttgagcaggtctca

SEQ ID NO: 4547061 - DNA, 18 bp, Homo sapiens
agtatgcactatatacat

SEQ ID NO: 4547062 - DNA, 14 bp, Homo sapiens
agtatggtacattt

SEQ ID NO: 4547063 - DNA, 16 bp, Homo sapiens
agtatggtacattttt

SEQ ID NO: 4547064 - DNA, 15 bp, Homo sapiens
agtatgtcactctgg

SEQ ID NO: 4547065 - DNA, 17 bp, Homo sapiens
agtatgtggaagtgtgg

SEQ ID NO: 4547066 - DNA, 19 bp, Homo sapiens
agtatgtggaagtgtgggt

SEQ ID NO: 4547067 - DNA, 15 bp, Homo sapiens
agtatgttttaacaa

SEQ ID NO: 4547068 - DNA, 17 bp, Homo sapiens
agtatgttttttatgtt

SEQ ID NO: 4547069 - DNA, 17 bp, Homo sapiens
agtattaacatcaaaga

SEQ ID NO: 4547070 - DNA, 15 bp, Homo sapiens
agtattaactattag

SEQ ID NO: 4547071 - DNA, 21 bp, Homo sapiens
agtattaccaccctttcacaa

SEQ ID NO: 4547072 - DNA, 17 bp, Homo sapiens
agtattactaaattgac

SEQ ID NO: 4547073 - DNA, 20 bp, Homo sapiens
agtattatataaactgtgcc

SEQ ID NO: 4547074 - DNA, 23 bp, Homo sapiens
agtattatcttgttcaggaaaag

SEQ ID NO: 4547075 - DNA, 18 bp, Homo sapiens
agtattcagagtctctga

SEQ ID NO: 4547076 - DNA, 14 bp, Homo sapiens
agtattcaggcact

SEQ ID NO: 4547077 - DNA, 22 bp, Homo sapiens
agtattccaccttaaattaaac

SEQ ID NO: 4547078 - DNA, 18 bp, Homo sapiens
agtattgacttctttttg

SEQ ID NO: 4547079 - DNA, 15 bp, Homo sapiens
agtattgggcaggag

SEQ ID NO: 4547080 - DNA, 16 bp, Homo sapiens
agtattgggcaggagg

SEQ ID NO: 4547081 - DNA, 22 bp, Homo sapiens
agtattgtaaattatatttgtg

SEQ ID NO: 4547082 - DNA, 18 bp, Homo sapiens
agtatttactttttaaaa

SEQ ID NO: 4547083 - DNA, 21 bp, Homo sapiens
agtatttactttttaaaaata

SEQ ID NO: 4547084 - DNA, 23 bp, Homo sapiens
agtatttactttttaaaaataac

SEQ ID NO: 4547085 - DNA, 16 bp, Homo sapiens
agtatttataaaaata

SEQ ID NO: 4547086 - DNA, 17 bp, Homo sapiens
agtatttataaaaatat

SEQ ID NO: 4547087 - DNA, 18 bp, Homo sapiens
agtatttataaaaatata

SEQ ID NO: 4547088 - DNA, 13 bp, Homo sapiens
agtatttatgggt

SEQ ID NO: 4547089 - DNA, 20 bp, Homo sapiens
agtatttcaaattggagctt

SEQ ID NO: 4547090 - DNA, 22 bp, Homo sapiens
agtatttccatagtcaatgatg

SEQ ID NO: 4547091 - DNA, 13 bp, Homo sapiens
agtatttctcctt

SEQ ID NO: 4547092 - DNA, 19 bp, Homo sapiens
agtatttgatgtacattac

SEQ ID NO: 4547093 - DNA, 13 bp, Homo sapiens
agtatttgattca

SEQ ID NO: 4547094 - DNA, 21 bp, Homo sapiens
agtatttgggaagtgaagact

SEQ ID NO: 4547095 - DNA, 14 bp, Homo sapiens
agtatttgtgggga

SEQ ID NO: 4547096 - DNA, 14 bp, Homo sapiens
agtatttttatcca

SEQ ID NO: 4547097 - DNA, 16 bp, Homo sapiens
agtatttttgctgctt

SEQ ID NO: 4547098 - DNA, 19 bp, Homo sapiens
agtatttttgctgcttctg

SEQ ID NO: 4547099 - DNA, 11 bp, Homo sapiens
agtatttttgg

SEQ ID NO: 4547100 - DNA, 14 bp, Homo sapiens
agtattttttcaag

SEQ ID NO: 4547101 - DNA, 13 bp, Homo sapiens
agtattttttgta

SEQ ID NO: 4547102 - DNA, 15 bp, Homo sapiens
agtatttttttaatt

SEQ ID NO: 4547103 - DNA, 18 bp, Homo sapiens
agtatttttttaatttct

SEQ ID NO: 4547104 - DNA, 13 bp, Homo sapiens
agtcaaaaacaaa

SEQ ID NO: 4547105 - DNA, 17 bp, Homo sapiens
agtcaaaactacaaatc

SEQ ID NO: 4547106 - DNA, 23 bp, Homo sapiens
agtcaaaagatccttcattttag

SEQ ID NO: 4547107 - DNA, 18 bp, Homo sapiens
agtcaaaaggtgcctgtg

SEQ ID NO: 4547108 - DNA, 23 bp, Homo sapiens
agtcaaatggtaggcatttccta

SEQ ID NO: 4547109 - DNA, 16 bp, Homo sapiens
agtcaacagtaaacca

SEQ ID NO: 4547110 - DNA, 18 bp, Homo sapiens
agtcaacagtaaaccact

SEQ ID NO: 4547111 - DNA, 21 bp, Homo sapiens
agtcaacagtaaaccactgaa

SEQ ID NO: 4547112 - DNA, 15 bp, Homo sapiens
agtcaacctgggcaa

SEQ ID NO: 4547113 - DNA, 14 bp, Homo sapiens
agtcaactggctgg

SEQ ID NO: 4547114 - DNA, 19 bp, Homo sapiens
agtcaactggctggccagt

SEQ ID NO: 4547115 - DNA, 17 bp, Homo sapiens
agtcaatagcttgtctt

SEQ ID NO: 4547116 - DNA, 14 bp, Homo sapiens
agtcaataggccta

SEQ ID NO: 4547117 - DNA, 21 bp, Homo sapiens
agtcacaccagggcaactctt

SEQ ID NO: 4547118 - DNA, 21 bp, Homo sapiens
agtcacagatgaggcccccgc

SEQ ID NO: 4547119 - DNA, 14 bp, Homo sapiens
agtcacatctcttc

SEQ ID NO: 4547120 - DNA, 20 bp, Homo sapiens
agtcaccaaatagtgtgaaa

SEQ ID NO: 4547121 - DNA, 13 bp, Homo sapiens
agtcaccaggaat

SEQ ID NO: 4547122 - DNA, 21 bp, Homo sapiens
agtcactaaaaggaagacagt

SEQ ID NO: 4547123 - DNA, 12 bp, Homo sapiens
agtcactgagca

SEQ ID NO: 4547124 - DNA, 19 bp, Homo sapiens
agtcactgcatttgcctgc

SEQ ID NO: 4547125 - DNA, 22 bp, Homo sapiens
agtcactggaggttgaagccaa

SEQ ID NO: 4547126 - DNA, 22 bp, Homo sapiens
agtcactggcatactgagaata

SEQ ID NO: 4547127 - DNA, 23 bp, Homo sapiens
agtcactggcatactgagaatat

SEQ ID NO: 4547128 - DNA, 17 bp, Homo sapiens
agtcagaaggacggcag

SEQ ID NO: 4547129 - DNA, 13 bp, Homo sapiens
agtcagaggagaa

SEQ ID NO: 4547130 - DNA, 20 bp, Homo sapiens
agtcagaggagaagagacat

SEQ ID NO: 4547131 - DNA, 14 bp, Homo sapiens
agtcagagtccagt

SEQ ID NO: 4547132 - DNA, 17 bp, Homo sapiens
agtcagatcctgttact

SEQ ID NO: 4547133 - DNA, 21 bp, Homo sapiens
agtcagatgtttgagcagtgg

SEQ ID NO: 4547134 - DNA, 13 bp, Homo sapiens
agtcagcagcagc

SEQ ID NO: 4547135 - DNA, 15 bp, Homo sapiens
agtcagcagcagctc

SEQ ID NO: 4547136 - DNA, 16 bp, Homo sapiens
agtcagcagtcatgca

SEQ ID NO: 4547137 - DNA, 16 bp, Homo sapiens
agtcagcctctctccc

SEQ ID NO: 4547138 - DNA, 17 bp, Homo sapiens
agtcagcctctctccca

SEQ ID NO: 4547139 - DNA, 21 bp, Homo sapiens
agtcagcctctctcccagtct

SEQ ID NO: 4547140 - DNA, 12 bp, Homo sapiens
agtcaggaaagg

SEQ ID NO: 4547141 - DNA, 16 bp, Homo sapiens
agtcaggctgcagagg

SEQ ID NO: 4547142 - DNA, 22 bp, Homo sapiens
agtcagtgggaacgtgactgcc

SEQ ID NO: 4547143 - DNA, 21 bp, Homo sapiens
agtcagttgctcaaaaagaaa

SEQ ID NO: 4547144 - DNA, 21 bp, Homo sapiens
agtcataacggttaagaaagc

SEQ ID NO: 4547145 - DNA, 17 bp, Homo sapiens
agtcataccaatgaaaa

SEQ ID NO: 4547146 - DNA, 13 bp, Homo sapiens
agtcatccagtct

SEQ ID NO: 4547147 - DNA, 20 bp, Homo sapiens
agtcatgatctccctgccgc

SEQ ID NO: 4547148 - DNA, 16 bp, Homo sapiens
agtcatggataactac

SEQ ID NO: 4547149 - DNA, 12 bp, Homo sapiens
agtcatggtact

SEQ ID NO: 4547150 - DNA, 18 bp, Homo sapiens
agtcatggtactacccca

SEQ ID NO: 4547151 - DNA, 19 bp, Homo sapiens
agtcatggtactaccccag

SEQ ID NO: 4547152 - DNA, 14 bp, Homo sapiens
agtcatggtcacag

SEQ ID NO: 4547153 - DNA, 18 bp, Homo sapiens
agtcattaaattactata

SEQ ID NO: 4547154 - DNA, 16 bp, Homo sapiens
agtcattagactcctc

SEQ ID NO: 4547155 - DNA, 18 bp, Homo sapiens
agtcattagactcctcct

SEQ ID NO: 4547156 - DNA, 21 bp, Homo sapiens
agtcatttaggatccatgcag

SEQ ID NO: 4547157 - DNA, 19 bp, Homo sapiens
agtcattttcacttttaaa

SEQ ID NO: 4547158 - DNA, 15 bp, Homo sapiens
agtcattttttactt

SEQ ID NO: 4547159 - DNA, 18 bp, Homo sapiens
agtcattttttacttgaa

SEQ ID NO: 4547160 - DNA, 19 bp, Homo sapiens
agtcattttttacttgaat

SEQ ID NO: 4547161 - DNA, 16 bp, Homo sapiens
agtccaaatgtcctcc

SEQ ID NO: 4547162 - DNA, 19 bp, Homo sapiens
agtccaaatgtcctccaga

SEQ ID NO: 4547163 - DNA, 21 bp, Homo sapiens
agtccaattttaatttagtaa

SEQ ID NO: 4547164 - DNA, 12 bp, Homo sapiens
agtccacagaca

SEQ ID NO: 4547165 - DNA, 23 bp, Homo sapiens
agtccacaggacgcacagcccag

SEQ ID NO: 4547166 - DNA, 24 bp, Homo sapiens
agtccacaggacgcacagcccagg

SEQ ID NO: 4547167 - DNA, 14 bp, Homo sapiens
agtccacaggggcc

SEQ ID NO: 4547168 - DNA, 19 bp, Homo sapiens
agtccacgcccaccagcct

SEQ ID NO: 4547169 - DNA, 21 bp, Homo sapiens
agtccacgcccaccagccttg

SEQ ID NO: 4547170 - DNA, 22 bp, Homo sapiens
agtccagaccccccagcccctc

SEQ ID NO: 4547171 - DNA, 14 bp, Homo sapiens
agtccagcccctcc

SEQ ID NO: 4547172 - DNA, 17 bp, Homo sapiens
agtccagcccctcctcc

SEQ ID NO: 4547173 - DNA, 21 bp, Homo sapiens
agtccagcccctcctccctca

SEQ ID NO: 4547174 - DNA, 23 bp, Homo sapiens
agtccagcccctcctccctcaga

SEQ ID NO: 4547175 - DNA, 13 bp, Homo sapiens
agtccagctcccc

SEQ ID NO: 4547176 - DNA, 12 bp, Homo sapiens
agtccaggcccc

SEQ ID NO: 4547177 - DNA, 16 bp, Homo sapiens
agtccaggcctctctc

SEQ ID NO: 4547178 - DNA, 18 bp, Homo sapiens
agtccagggtttctctgc

SEQ ID NO: 4547179 - DNA, 19 bp, Homo sapiens
agtccagggtttctctgca

SEQ ID NO: 4547180 - DNA, 18 bp, Homo sapiens
agtccatcaccatttctt

SEQ ID NO: 4547181 - DNA, 16 bp, Homo sapiens
agtccatcagcctcca

SEQ ID NO: 4547182 - DNA, 20 bp, Homo sapiens
agtccatgcatgacagcctc

SEQ ID NO: 4547183 - DNA, 13 bp, Homo sapiens
agtccatgctcca

SEQ ID NO: 4547184 - DNA, 20 bp, Homo sapiens
agtccatgctccagggtcag

SEQ ID NO: 4547185 - DNA, 16 bp, Homo sapiens
agtcccaagctaggct

SEQ ID NO: 4547186 - DNA, 13 bp, Homo sapiens
agtcccaggggca

SEQ ID NO: 4547187 - DNA, 18 bp, Homo sapiens
agtcccaggggcagccac

SEQ ID NO: 4547188 - DNA, 19 bp, Homo sapiens
agtcccaggggcagccaca

SEQ ID NO: 4547189 - DNA, 14 bp, Homo sapiens
agtcccatgctggc

SEQ ID NO: 4547190 - DNA, 20 bp, Homo sapiens
agtcccatgctggctgaaga

SEQ ID NO: 4547191 - DNA, 17 bp, Homo sapiens
agtccccacccctgccc

SEQ ID NO: 4547192 - DNA, 17 bp, Homo sapiens
agtccccagagctcccc

SEQ ID NO: 4547193 - DNA, 22 bp, Homo sapiens
agtccccgaggagctgggcccc

SEQ ID NO: 4547194 - DNA, 22 bp, Homo sapiens
agtccccgtggccatccctgtg

SEQ ID NO: 4547195 - DNA, 10 bp, Homo sapiens
agtccctccc

SEQ ID NO: 4547196 - DNA, 17 bp, Homo sapiens
agtccctccctgcctga

SEQ ID NO: 4547197 - DNA, 22 bp, Homo sapiens
agtccctgcctggaccagcctc

SEQ ID NO: 4547198 - DNA, 23 bp, Homo sapiens
agtccctgcctggaccagcctct

SEQ ID NO: 4547199 - DNA, 15 bp, Homo sapiens
agtccctgctgggga

SEQ ID NO: 4547200 - DNA, 22 bp, Homo sapiens
agtccctgggggaagccctgga

SEQ ID NO: 4547201 - DNA, 14 bp, Homo sapiens
agtccctgtcacct

SEQ ID NO: 4547202 - DNA, 16 bp, Homo sapiens
agtccctgtcacctct

SEQ ID NO: 4547203 - DNA, 23 bp, Homo sapiens
agtccctgtcatttgaacctgga

SEQ ID NO: 4547204 - DNA, 19 bp, Homo sapiens
agtcccttcccctccctgg

SEQ ID NO: 4547205 - DNA, 18 bp, Homo sapiens
agtccgcagaagccctga

SEQ ID NO: 4547206 - DNA, 20 bp, Homo sapiens
agtccgctgaagatggaggg

SEQ ID NO: 4547207 - DNA, 19 bp, Homo sapiens
agtcctagaatgtttcatt

SEQ ID NO: 4547208 - DNA, 16 bp, Homo sapiens
agtcctagctgcacag

SEQ ID NO: 4547209 - DNA, 22 bp, Homo sapiens
agtcctagctgcacagggcagc

SEQ ID NO: 4547210 - DNA, 16 bp, Homo sapiens
agtcctaggacttaaa

SEQ ID NO: 4547211 - DNA, 14 bp, Homo sapiens
agtcctatttcagt

SEQ ID NO: 4547212 - DNA, 18 bp, Homo sapiens
agtcctcactcttcaagg

SEQ ID NO: 4547213 - DNA, 16 bp, Homo sapiens
agtcctccactcgacc

SEQ ID NO: 4547214 - DNA, 17 bp, Homo sapiens
agtcctccctgactttt

SEQ ID NO: 4547215 - DNA, 20 bp, Homo sapiens
agtcctgatcagagccgtgg

SEQ ID NO: 4547216 - DNA, 15 bp, Homo sapiens
agtcctgcctggcca

SEQ ID NO: 4547217 - DNA, 23 bp, Homo sapiens
agtcctggaagccagctttccct

SEQ ID NO: 4547218 - DNA, 16 bp, Homo sapiens
agtcctgtctctgcct

SEQ ID NO: 4547219 - DNA, 21 bp, Homo sapiens
agtcctgtctctgcctgcggc

SEQ ID NO: 4547220 - DNA, 22 bp, Homo sapiens
agtccttcagtgagcccctccc

SEQ ID NO: 4547221 - DNA, 22 bp, Homo sapiens
agtcgaaccatggtgaactcca

SEQ ID NO: 4547222 - DNA, 14 bp, Homo sapiens
agtcgcctgcctgc

SEQ ID NO: 4547223 - DNA, 15 bp, Homo sapiens
agtcgcctgcctgca

SEQ ID NO: 4547224 - DNA, 14 bp, Homo sapiens
agtcgttttccaaa

SEQ ID NO: 4547225 - DNA, 19 bp, Homo sapiens
agtctaaaccaagattatg

SEQ ID NO: 4547226 - DNA, 20 bp, Homo sapiens
agtctaaagctggtttaatg

SEQ ID NO: 4547227 - DNA, 20 bp, Homo sapiens
agtctaactttggttttctt

SEQ ID NO: 4547228 - DNA, 18 bp, Homo sapiens
agtctacctgagcattca

SEQ ID NO: 4547229 - DNA, 21 bp, Homo sapiens
agtctagaatgttattgtgta

SEQ ID NO: 4547230 - DNA, 24 bp, Homo sapiens
agtctagacacaatttcatttcca

SEQ ID NO: 4547231 - DNA, 18 bp, Homo sapiens
agtctaggagctgggagg

SEQ ID NO: 4547232 - DNA, 17 bp, Homo sapiens
agtctatagatgcctct

SEQ ID NO: 4547233 - DNA, 19 bp, Homo sapiens
agtctatctggtattaaat

SEQ ID NO: 4547234 - DNA, 23 bp, Homo sapiens
agtctatctggtattaaatgcca

SEQ ID NO: 4547235 - DNA, 15 bp, Homo sapiens
agtctatttttaatg

SEQ ID NO: 4547236 - DNA, 16 bp, Homo sapiens
agtctatttttaatgc

SEQ ID NO: 4547237 - DNA, 16 bp, Homo sapiens
agtctcaatgaaatag

SEQ ID NO: 4547238 - DNA, 21 bp, Homo sapiens
agtctcactttgacacccagg

SEQ ID NO: 4547239 - DNA, 13 bp, Homo sapiens
agtctcagaagag

SEQ ID NO: 4547240 - DNA, 19 bp, Homo sapiens
agtctcagaatgtcatttt

SEQ ID NO: 4547241 - DNA, 16 bp, Homo sapiens
agtctcaggaaatcaa

SEQ ID NO: 4547242 - DNA, 22 bp, Homo sapiens
agtctcaggaaatcaaatatgc

SEQ ID NO: 4547243 - DNA, 14 bp, Homo sapiens
agtctcatcctccc

SEQ ID NO: 4547244 - DNA, 16 bp, Homo sapiens
agtctcatcctcccat

SEQ ID NO: 4547245 - DNA, 18 bp, Homo sapiens
agtctcatcctcccattg

SEQ ID NO: 4547246 - DNA, 15 bp, Homo sapiens
agtctccaagagaac

SEQ ID NO: 4547247 - DNA, 15 bp, Homo sapiens
agtctcctctttaaa

SEQ ID NO: 4547248 - DNA, 11 bp, Homo sapiens
agtctctcctg

SEQ ID NO: 4547249 - DNA, 22 bp, Homo sapiens
agtctctcctgtaagccaaaga

SEQ ID NO: 4547250 - DNA, 15 bp, Homo sapiens
agtctctcttctctc

SEQ ID NO: 4547251 - DNA, 18 bp, Homo sapiens
agtctctcttctctccag

SEQ ID NO: 4547252 - DNA, 19 bp, Homo sapiens
agtctctgaatacacagta

SEQ ID NO: 4547253 - DNA, 13 bp, Homo sapiens
agtctctgagcag

SEQ ID NO: 4547254 - DNA, 16 bp, Homo sapiens
agtctctgagcagtga

SEQ ID NO: 4547255 - DNA, 13 bp, Homo sapiens
agtctgaatattt

SEQ ID NO: 4547256 - DNA, 20 bp, Homo sapiens
agtctgagtcctgtctctgc

SEQ ID NO: 4547257 - DNA, 14 bp, Homo sapiens
agtctgagtctgag

SEQ ID NO: 4547258 - DNA, 15 bp, Homo sapiens
agtctgataaactga

SEQ ID NO: 4547259 - DNA, 20 bp, Homo sapiens
agtctgataaactgacgatt

SEQ ID NO: 4547260 - DNA, 21 bp, Homo sapiens
agtctgattataccatgtgtg

SEQ ID NO: 4547261 - DNA, 18 bp, Homo sapiens
agtctgcatttcatatta

SEQ ID NO: 4547262 - DNA, 17 bp, Homo sapiens
agtctgccgattttgta

SEQ ID NO: 4547263 - DNA, 14 bp, Homo sapiens
agtctgctctgctg

SEQ ID NO: 4547264 - DNA, 12 bp, Homo sapiens
agtctggcacca

SEQ ID NO: 4547265 - DNA, 21 bp, Homo sapiens
agtctggcaccatgttggcct

SEQ ID NO: 4547266 - DNA, 16 bp, Homo sapiens
agtctggggacctggc

SEQ ID NO: 4547267 - DNA, 16 bp, Homo sapiens
agtctgtctttcctga

SEQ ID NO: 4547268 - DNA, 21 bp, Homo sapiens
agtctgtctttcctgaaccat

SEQ ID NO: 4547269 - DNA, 17 bp, Homo sapiens
agtctgtgtgggactgt

SEQ ID NO: 4547270 - DNA, 20 bp, Homo sapiens
agtctgttatttattattaa

SEQ ID NO: 4547271 - DNA, 16 bp, Homo sapiens
agtcttaactgtattt

SEQ ID NO: 4547272 - DNA, 20 bp, Homo sapiens
agtcttccacaaagaaaatt

SEQ ID NO: 4547273 - DNA, 16 bp, Homo sapiens
agtcttccatttgcaa

SEQ ID NO: 4547274 - DNA, 17 bp, Homo sapiens
agtcttgaaatgaaagg

SEQ ID NO: 4547275 - DNA, 17 bp, Homo sapiens
agtcttgctctgtcacc

SEQ ID NO: 4547276 - DNA, 14 bp, Homo sapiens
agtcttgtgaaagt

SEQ ID NO: 4547277 - DNA, 16 bp, Homo sapiens
agtcttgtgaaagtgt

SEQ ID NO: 4547278 - DNA, 12 bp, Homo sapiens
agtcttgtgaac

SEQ ID NO: 4547279 - DNA, 15 bp, Homo sapiens
agtctttgccttctc

SEQ ID NO: 4547280 - DNA, 22 bp, Homo sapiens
agtcttttgttcgcatggtcac

SEQ ID NO: 4547281 - DNA, 20 bp, Homo sapiens
agtgaaatttctagcctgca

SEQ ID NO: 4547282 - DNA, 16 bp, Homo sapiens
agtgaacaaatttaca

SEQ ID NO: 4547283 - DNA, 21 bp, Homo sapiens
agtgaacaaatttacagagac

SEQ ID NO: 4547284 - DNA, 22 bp, Homo sapiens
agtgaacaaatttacagagaca

SEQ ID NO: 4547285 - DNA, 15 bp, Homo sapiens
agtgaacacatttta

SEQ ID NO: 4547286 - DNA, 17 bp, Homo sapiens
agtgaactcctgccagg

SEQ ID NO: 4547287 - DNA, 21 bp, Homo sapiens
agtgaactcctgccaggcaca

SEQ ID NO: 4547288 - DNA, 22 bp, Homo sapiens
agtgaagaatacttctcatttt

SEQ ID NO: 4547289 - DNA, 12 bp, Homo sapiens
agtgaagcagca

SEQ ID NO: 4547290 - DNA, 23 bp, Homo sapiens
agtgaagggaagagacagcccag

SEQ ID NO: 4547291 - DNA, 18 bp, Homo sapiens
agtgaagtctagaatcat

SEQ ID NO: 4547292 - DNA, 22 bp, Homo sapiens
agtgaatacattaacggtgcta

SEQ ID NO: 4547293 - DNA, 16 bp, Homo sapiens
agtgaatgattcagtg

SEQ ID NO: 4547294 - DNA, 17 bp, Homo sapiens
agtgaatgattcagtgt

SEQ ID NO: 4547295 - DNA, 19 bp, Homo sapiens
agtgaatgattcagtgtta

SEQ ID NO: 4547296 - DNA, 19 bp, Homo sapiens
agtgaatttgggctgctgt

SEQ ID NO: 4547297 - DNA, 23 bp, Homo sapiens
agtgaatttttgcaataatgcag

SEQ ID NO: 4547298 - DNA, 21 bp, Homo sapiens
agtgacagagcgagactccat

SEQ ID NO: 4547299 - DNA, 23 bp, Homo sapiens
agtgacagctttcctcaaaaagc

SEQ ID NO: 4547300 - DNA, 21 bp, Homo sapiens
agtgacagtcataaatactgt

SEQ ID NO: 4547301 - DNA, 16 bp, Homo sapiens
agtgacataattgtcc

SEQ ID NO: 4547302 - DNA, 19 bp, Homo sapiens
agtgacctcggacagagcc

SEQ ID NO: 4547303 - DNA, 19 bp, Homo sapiens
agtgacgaaaacattgtcc

SEQ ID NO: 4547304 - DNA, 21 bp, Homo sapiens
agtgactcagaacttctgcct

SEQ ID NO: 4547305 - DNA, 19 bp, Homo sapiens
agtgactgaacgatccttc

SEQ ID NO: 4547306 - DNA, 19 bp, Homo sapiens
agtgagaccatgtttcaaa

SEQ ID NO: 4547307 - DNA, 15 bp, Homo sapiens
agtgagactgtacat

SEQ ID NO: 4547308 - DNA, 18 bp, Homo sapiens
agtgagcagtcgcctgcc

SEQ ID NO: 4547309 - DNA, 19 bp, Homo sapiens
agtgagcagtcgcctgcct

SEQ ID NO: 4547310 - DNA, 15 bp, Homo sapiens
agtgagccaaaatca

SEQ ID NO: 4547311 - DNA, 20 bp, Homo sapiens
agtgagcccctccccagcca

SEQ ID NO: 4547312 - DNA, 21 bp, Homo sapiens
agtgagcccctccccagccag

SEQ ID NO: 4547313 - DNA, 19 bp, Homo sapiens
agtgagccgcatcttctcc

SEQ ID NO: 4547314 - DNA, 18 bp, Homo sapiens
agtgagcctcctgtgcct

SEQ ID NO: 4547315 - DNA, 17 bp, Homo sapiens
agtgagctgtaggtgtg

SEQ ID NO: 4547316 - DNA, 15 bp, Homo sapiens
agtgaggcaggagaa

SEQ ID NO: 4547317 - DNA, 17 bp, Homo sapiens
agtgagggagacaggaa

SEQ ID NO: 4547318 - DNA, 22 bp, Homo sapiens
agtgaggtgtgtcacaatgaga

SEQ ID NO: 4547319 - DNA, 17 bp, Homo sapiens
agtgagtaattttggat

SEQ ID NO: 4547320 - DNA, 16 bp, Homo sapiens
agtgagtgccatgctt

SEQ ID NO: 4547321 - DNA, 20 bp, Homo sapiens
agtgagttgttgccctgggt

SEQ ID NO: 4547322 - DNA, 17 bp, Homo sapiens
agtgatacaacttcaag

SEQ ID NO: 4547323 - DNA, 18 bp, Homo sapiens
agtgatactggctcagaa

SEQ ID NO: 4547324 - DNA, 16 bp, Homo sapiens
agtgatccttacaagt

SEQ ID NO: 4547325 - DNA, 23 bp, Homo sapiens
agtgatgaatgtactatgtctga

SEQ ID NO: 4547326 - DNA, 21 bp, Homo sapiens
agtgatgctgtgctatgaatt

SEQ ID NO: 4547327 - DNA, 16 bp, Homo sapiens
agtgatggagttcctt

SEQ ID NO: 4547328 - DNA, 20 bp, Homo sapiens
agtgatgggagaattggtat

SEQ ID NO: 4547329 - DNA, 19 bp, Homo sapiens
agtgatgtattttcatagt

SEQ ID NO: 4547330 - DNA, 15 bp, Homo sapiens
agtgatgtcatttga

SEQ ID NO: 4547331 - DNA, 13 bp, Homo sapiens
agtgatgtgctga

SEQ ID NO: 4547332 - DNA, 22 bp, Homo sapiens
agtgattaaatatatctagaac

SEQ ID NO: 4547333 - DNA, 15 bp, Homo sapiens
agtgattaccaggga

SEQ ID NO: 4547334 - DNA, 16 bp, Homo sapiens
agtgattatctctttg

SEQ ID NO: 4547335 - DNA, 17 bp, Homo sapiens
agtgattgtcttaatat

SEQ ID NO: 4547336 - DNA, 12 bp, Homo sapiens
agtgattgtgaa

SEQ ID NO: 4547337 - DNA, 13 bp, Homo sapiens
agtgattgtgaag

SEQ ID NO: 4547338 - DNA, 17 bp, Homo sapiens
agtgcaaaaactgtaaa

SEQ ID NO: 4547339 - DNA, 18 bp, Homo sapiens
agtgcaaaaactgtaaaa

SEQ ID NO: 4547340 - DNA, 14 bp, Homo sapiens
agtgcaagattttt

SEQ ID NO: 4547341 - DNA, 14 bp, Homo sapiens
agtgcaatgcgtgt

SEQ ID NO: 4547342 - DNA, 19 bp, Homo sapiens
agtgcaatgcgtgttgtac

SEQ ID NO: 4547343 - DNA, 22 bp, Homo sapiens
agtgcaattaacatatgtcacg

SEQ ID NO: 4547344 - DNA, 14 bp, Homo sapiens
agtgcacaaaatga

SEQ ID NO: 4547345 - DNA, 22 bp, Homo sapiens
agtgcagacacctaaccccagg

SEQ ID NO: 4547346 - DNA, 19 bp, Homo sapiens
agtgcagagccttctcaga

SEQ ID NO: 4547347 - DNA, 21 bp, Homo sapiens
agtgcagagcttgtggaaagc

SEQ ID NO: 4547348 - DNA, 23 bp, Homo sapiens
agtgcagcagaggacagtctgga

SEQ ID NO: 4547349 - DNA, 21 bp, Homo sapiens
agtgcagcaggttaagaattt

SEQ ID NO: 4547350 - DNA, 22 bp, Homo sapiens
agtgcagtcctgatcagagccg

SEQ ID NO: 4547351 - DNA, 19 bp, Homo sapiens
agtgcagtggcacaatctt

SEQ ID NO: 4547352 - DNA, 21 bp, Homo sapiens
agtgcagtggcacaatcttgg

SEQ ID NO: 4547353 - DNA, 21 bp, Homo sapiens
agtgcatagttgtagacaaag

SEQ ID NO: 4547354 - DNA, 19 bp, Homo sapiens
agtgcatctggagagaaca

SEQ ID NO: 4547355 - DNA, 15 bp, Homo sapiens
agtgcatgctctctg

SEQ ID NO: 4547356 - DNA, 23 bp, Homo sapiens
agtgcatttttaaacttgaaata

SEQ ID NO: 4547357 - DNA, 14 bp, Homo sapiens
agtgccaaataatt

SEQ ID NO: 4547358 - DNA, 16 bp, Homo sapiens
agtgccaagtttgcaa

SEQ ID NO: 4547359 - DNA, 21 bp, Homo sapiens
agtgccacccacctttgccac

SEQ ID NO: 4547360 - DNA, 23 bp, Homo sapiens
agtgccacctatgcctgtggtga

SEQ ID NO: 4547361 - DNA, 13 bp, Homo sapiens
agtgccactgccc

SEQ ID NO: 4547362 - DNA, 21 bp, Homo sapiens
agtgccagcattccagacttc

SEQ ID NO: 4547363 - DNA, 23 bp, Homo sapiens
agtgccagcattccagacttcaa

SEQ ID NO: 4547364 - DNA, 17 bp, Homo sapiens
agtgccaggtggctcag

SEQ ID NO: 4547365 - DNA, 13 bp, Homo sapiens
agtgccatgcttt

SEQ ID NO: 4547366 - DNA, 15 bp, Homo sapiens
agtgccattgtcttt

SEQ ID NO: 4547367 - DNA, 21 bp, Homo sapiens
agtgccattgtctttatatga

SEQ ID NO: 4547368 - DNA, 17 bp, Homo sapiens
agtgcctagactgttac

SEQ ID NO: 4547369 - DNA, 23 bp, Homo sapiens
agtgcctctccctgctgctccta

SEQ ID NO: 4547370 - DNA, 12 bp, Homo sapiens
agtgcctgccac

SEQ ID NO: 4547371 - DNA, 12 bp, Homo sapiens
agtgcctgctga

SEQ ID NO: 4547372 - DNA, 16 bp, Homo sapiens
agtgccttacctcctg

SEQ ID NO: 4547373 - DNA, 21 bp, Homo sapiens
agtgccttacctcctgcccag

SEQ ID NO: 4547374 - DNA, 14 bp, Homo sapiens
agtgccttctgggc

SEQ ID NO: 4547375 - DNA, 15 bp, Homo sapiens
agtgccttctgtggg

SEQ ID NO: 4547376 - DNA, 20 bp, Homo sapiens
agtgccttctttagaccctc

SEQ ID NO: 4547377 - DNA, 21 bp, Homo sapiens
agtgccttggggaatttcctc

SEQ ID NO: 4547378 - DNA, 19 bp, Homo sapiens
agtgcgggctgaggccaga

SEQ ID NO: 4547379 - DNA, 15 bp, Homo sapiens
agtgctcaccagccc

SEQ ID NO: 4547380 - DNA, 17 bp, Homo sapiens
agtgctcaccagccctg

SEQ ID NO: 4547381 - DNA, 22 bp, Homo sapiens
agtgctcaccagccctgcagcc

SEQ ID NO: 4547382 - DNA, 18 bp, Homo sapiens
agtgctcacccacaccat

SEQ ID NO: 4547383 - DNA, 14 bp, Homo sapiens
agtgctccctcaca

SEQ ID NO: 4547384 - DNA, 21 bp, Homo sapiens
agtgctcctggaaacttagct

SEQ ID NO: 4547385 - DNA, 16 bp, Homo sapiens
agtgctctgatccctc

SEQ ID NO: 4547386 - DNA, 15 bp, Homo sapiens
agtgctctgcctcag

SEQ ID NO: 4547387 - DNA, 17 bp, Homo sapiens
agtgctcttttctcctc

SEQ ID NO: 4547388 - DNA, 13 bp, Homo sapiens
agtgctgaaaatg

SEQ ID NO: 4547389 - DNA, 12 bp, Homo sapiens
agtgctgagacc

SEQ ID NO: 4547390 - DNA, 21 bp, Homo sapiens
agtgctgcagctccctggctt

SEQ ID NO: 4547391 - DNA, 23 bp, Homo sapiens
agtgctgcagctccctggcttct

SEQ ID NO: 4547392 - DNA, 21 bp, Homo sapiens
agtgctgcccatgagcaagcc

SEQ ID NO: 4547393 - DNA, 17 bp, Homo sapiens
agtgctgggattacagg

SEQ ID NO: 4547394 - DNA, 19 bp, Homo sapiens
agtgctgggattacaggct

SEQ ID NO: 4547395 - DNA, 22 bp, Homo sapiens
agtgctggtcagagagacctca

SEQ ID NO: 4547396 - DNA, 19 bp, Homo sapiens
agtgctgtctgatctgtgc

SEQ ID NO: 4547397 - DNA, 22 bp, Homo sapiens
agtgctgtgttttagtctctta

SEQ ID NO: 4547398 - DNA, 17 bp, Homo sapiens
agtgcttcctacaaaga

SEQ ID NO: 4547399 - DNA, 21 bp, Homo sapiens
agtgcttgtatagcttttatc

SEQ ID NO: 4547400 - DNA, 23 bp, Homo sapiens
agtgcttgtatagcttttatctg

SEQ ID NO: 4547401 - DNA, 18 bp, Homo sapiens
agtgcttgttagagagaa

SEQ ID NO: 4547402 - DNA, 22 bp, Homo sapiens
agtgcttgttagagagaaagag

SEQ ID NO: 4547403 - DNA, 23 bp, Homo sapiens
agtgcttttaagtgaaaatggtc

SEQ ID NO: 4547404 - DNA, 16 bp, Homo sapiens
agtggaacgaaaatga

SEQ ID NO: 4547405 - DNA, 13 bp, Homo sapiens
agtggaagaaaca

SEQ ID NO: 4547406 - DNA, 20 bp, Homo sapiens
agtggaccaggacaggacca

SEQ ID NO: 4547407 - DNA, 20 bp, Homo sapiens
agtggaccgaaatctgtatt

SEQ ID NO: 4547408 - DNA, 17 bp, Homo sapiens
agtggactggcccctgg

SEQ ID NO: 4547409 - DNA, 19 bp, Homo sapiens
agtggagtctgagtctgag

SEQ ID NO: 4547410 - DNA, 21 bp, Homo sapiens
agtggatcttcagaactgccc

SEQ ID NO: 4547411 - DNA, 22 bp, Homo sapiens
agtggatcttcagaactgccct

SEQ ID NO: 4547412 - DNA, 16 bp, Homo sapiens
agtggatgctgggtcc

SEQ ID NO: 4547413 - DNA, 12 bp, Homo sapiens
agtggatgtata

SEQ ID NO: 4547414 - DNA, 18 bp, Homo sapiens
agtggccaagaagcagtg

SEQ ID NO: 4547415 - DNA, 14 bp, Homo sapiens
agtggccactcagc

SEQ ID NO: 4547416 - DNA, 13 bp, Homo sapiens
agtggccaggtgc

SEQ ID NO: 4547417 - DNA, 19 bp, Homo sapiens
agtggcccatggcatttta

SEQ ID NO: 4547418 - DNA, 22 bp, Homo sapiens
agtggcctacaaatcagtaatt

SEQ ID NO: 4547419 - DNA, 12 bp, Homo sapiens
agtggcctccct

SEQ ID NO: 4547420 - DNA, 17 bp, Homo sapiens
agtggcctccctgctgt

SEQ ID NO: 4547421 - DNA, 18 bp, Homo sapiens
agtggcctgatctctgct

SEQ ID NO: 4547422 - DNA, 19 bp, Homo sapiens
agtggcctgatctctgctc

SEQ ID NO: 4547423 - DNA, 23 bp, Homo sapiens
agtggcctgctaaggctcctcct

SEQ ID NO: 4547424 - DNA, 18 bp, Homo sapiens
agtggcctggccaggagc

SEQ ID NO: 4547425 - DNA, 20 bp, Homo sapiens
agtggcctggccaggagctc

SEQ ID NO: 4547426 - DNA, 22 bp, Homo sapiens
agtggcctggccaggagctctt

SEQ ID NO: 4547427 - DNA, 17 bp, Homo sapiens
agtggctagtcctcact

SEQ ID NO: 4547428 - DNA, 15 bp, Homo sapiens
agtggctcccctgcc

SEQ ID NO: 4547429 - DNA, 17 bp, Homo sapiens
agtggctcccctgccca

SEQ ID NO: 4547430 - DNA, 22 bp, Homo sapiens
agtggctcccctgcccagcctg

SEQ ID NO: 4547431 - DNA, 16 bp, Homo sapiens
agtggctcgctccctg

SEQ ID NO: 4547432 - DNA, 20 bp, Homo sapiens
agtggctgccacacccaggg

SEQ ID NO: 4547433 - DNA, 19 bp, Homo sapiens
agtggctgccttctttcca

SEQ ID NO: 4547434 - DNA, 22 bp, Homo sapiens
agtggctttctaccacacacag

SEQ ID NO: 4547435 - DNA, 14 bp, Homo sapiens
agtgggaagatttt

SEQ ID NO: 4547436 - DNA, 17 bp, Homo sapiens
agtgggaagcccatcct

SEQ ID NO: 4547437 - DNA, 21 bp, Homo sapiens
agtgggaagcccatcctgacc

SEQ ID NO: 4547438 - DNA, 21 bp, Homo sapiens
agtgggactgtggtgacttct

SEQ ID NO: 4547439 - DNA, 14 bp, Homo sapiens
agtgggagaaaaca

SEQ ID NO: 4547440 - DNA, 18 bp, Homo sapiens
agtgggaggcgtgccccc

SEQ ID NO: 4547441 - DNA, 14 bp, Homo sapiens
agtgggcaaaagct

SEQ ID NO: 4547442 - DNA, 16 bp, Homo sapiens
agtgggccaggacagg

SEQ ID NO: 4547443 - DNA, 20 bp, Homo sapiens
agtgggctgatgctgggacc

SEQ ID NO: 4547444 - DNA, 18 bp, Homo sapiens
agtggggaacaggtccca

SEQ ID NO: 4547445 - DNA, 18 bp, Homo sapiens
agtggggggtcgtgggcc

SEQ ID NO: 4547446 - DNA, 12 bp, Homo sapiens
agtgggggtgga

SEQ ID NO: 4547447 - DNA, 18 bp, Homo sapiens
agtggggtctccctctcc

SEQ ID NO: 4547448 - DNA, 23 bp, Homo sapiens
agtggggtctccctctcctgcct

SEQ ID NO: 4547449 - DNA, 18 bp, Homo sapiens
agtgggtagaagccttat

SEQ ID NO: 4547450 - DNA, 23 bp, Homo sapiens
agtgggtctgggatatggctgcc

SEQ ID NO: 4547451 - DNA, 19 bp, Homo sapiens
agtggtaaatactgtgaaa

SEQ ID NO: 4547452 - DNA, 15 bp, Homo sapiens
agtggtatagaaatg

SEQ ID NO: 4547453 - DNA, 20 bp, Homo sapiens
agtggtattttccagcactt

SEQ ID NO: 4547454 - DNA, 15 bp, Homo sapiens
agtggtcagcaggtg

SEQ ID NO: 4547455 - DNA, 14 bp, Homo sapiens
agtggtgaaatctt

SEQ ID NO: 4547456 - DNA, 11 bp, Homo sapiens
agtggtgccta

SEQ ID NO: 4547457 - DNA, 17 bp, Homo sapiens
agtggttaggcagcaag

SEQ ID NO: 4547458 - DNA, 21 bp, Homo sapiens
agtgtaaaatattttgaatca

SEQ ID NO: 4547459 - DNA, 13 bp, Homo sapiens
agtgtaaatgaag

SEQ ID NO: 4547460 - DNA, 20 bp, Homo sapiens
agtgtaacttgcttaaattt

SEQ ID NO: 4547461 - DNA, 14 bp, Homo sapiens
agtgtaagaactgt

SEQ ID NO: 4547462 - DNA, 23 bp, Homo sapiens
agtgtaagaactgtacattgtga

SEQ ID NO: 4547463 - DNA, 17 bp, Homo sapiens
agtgtacacgtctggac

SEQ ID NO: 4547464 - DNA, 13 bp, Homo sapiens
agtgtacagtctt

SEQ ID NO: 4547465 - DNA, 17 bp, Homo sapiens
agtgtacagtcttgtat

SEQ ID NO: 4547466 - DNA, 13 bp, Homo sapiens
agtgtaccaagtg

SEQ ID NO: 4547467 - DNA, 17 bp, Homo sapiens
agtgtattaatcataga

SEQ ID NO: 4547468 - DNA, 14 bp, Homo sapiens
agtgtatttggaaa

SEQ ID NO: 4547469 - DNA, 23 bp, Homo sapiens
agtgtatttggaaataaagtcag

SEQ ID NO: 4547470 - DNA, 17 bp, Homo sapiens
agtgtcaaataaacact

SEQ ID NO: 4547471 - DNA, 20 bp, Homo sapiens
agtgtcaaataaacactgtg

SEQ ID NO: 4547472 - DNA, 21 bp, Homo sapiens
agtgtcaaataaacactgtgt

SEQ ID NO: 4547473 - DNA, 17 bp, Homo sapiens
agtgtcaagttgtgctt

SEQ ID NO: 4547474 - DNA, 16 bp, Homo sapiens
agtgtcacatgaggaa

SEQ ID NO: 4547475 - DNA, 18 bp, Homo sapiens
agtgtcctgcccatgccc

SEQ ID NO: 4547476 - DNA, 13 bp, Homo sapiens
agtgtcctttcca

SEQ ID NO: 4547477 - DNA, 16 bp, Homo sapiens
agtgtctgtgttttga

SEQ ID NO: 4547478 - DNA, 23 bp, Homo sapiens
agtgtctttctagccataataaa

SEQ ID NO: 4547479 - DNA, 22 bp, Homo sapiens
agtgtctttctttggtgccttt

SEQ ID NO: 4547480 - DNA, 23 bp, Homo sapiens
agtgtctttctttggtgcctttc

SEQ ID NO: 4547481 - DNA, 15 bp, Homo sapiens
agtgtcttttaaaca

SEQ ID NO: 4547482 - DNA, 14 bp, Homo sapiens
agtgtgaatataaa

SEQ ID NO: 4547483 - DNA, 15 bp, Homo sapiens
agtgtgagctcttcc

SEQ ID NO: 4547484 - DNA, 18 bp, Homo sapiens
agtgtgagctcttccctt

SEQ ID NO: 4547485 - DNA, 15 bp, Homo sapiens
agtgtgaggccaggg

SEQ ID NO: 4547486 - DNA, 17 bp, Homo sapiens
agtgtgagtcagaatgt

SEQ ID NO: 4547487 - DNA, 14 bp, Homo sapiens
agtgtgctaaaaat

SEQ ID NO: 4547488 - DNA, 15 bp, Homo sapiens
agtgtgctgggcaga

SEQ ID NO: 4547489 - DNA, 20 bp, Homo sapiens
agtgtgggagtgcagagaaa

SEQ ID NO: 4547490 - DNA, 15 bp, Homo sapiens
agtgtggggggtcct

SEQ ID NO: 4547491 - DNA, 15 bp, Homo sapiens
agtgtgggtctgtgt

SEQ ID NO: 4547492 - DNA, 23 bp, Homo sapiens
agtgtgggtctgtgtgtgtgtat

SEQ ID NO: 4547493 - DNA, 16 bp, Homo sapiens
agtgtggtgtcttgcg

SEQ ID NO: 4547494 - DNA, 9 bp, Homo sapiens
agtgtgtaa

SEQ ID NO: 4547495 - DNA, 17 bp, Homo sapiens
agtgtgtaaaattaatg

SEQ ID NO: 4547496 - DNA, 21 bp, Homo sapiens
agtgtgtaaaattaatgtaat

SEQ ID NO: 4547497 - DNA, 21 bp, Homo sapiens
agtgtgtaaatgcttaaattt

SEQ ID NO: 4547498 - DNA, 16 bp, Homo sapiens
agtgtgtataaaacat

SEQ ID NO: 4547499 - DNA, 15 bp, Homo sapiens
agtgtgtgccaagag

SEQ ID NO: 4547500 - DNA, 19 bp, Homo sapiens
agtgtgtggtcaacatttc

SEQ ID NO: 4547501 - DNA, 18 bp, Homo sapiens
agtgtgttataaaataat

SEQ ID NO: 4547502 - DNA, 14 bp, Homo sapiens
agtgttaatacatc

SEQ ID NO: 4547503 - DNA, 17 bp, Homo sapiens
agtgttagtgctggtca

SEQ ID NO: 4547504 - DNA, 21 bp, Homo sapiens
agtgttagtgctggtcagaga

SEQ ID NO: 4547505 - DNA, 13 bp, Homo sapiens
agtgttatgtatt

SEQ ID NO: 4547506 - DNA, 23 bp, Homo sapiens
agtgttcaaaacaaaatgaaaca

SEQ ID NO: 4547507 - DNA, 13 bp, Homo sapiens
agtgttcacaaac

SEQ ID NO: 4547508 - DNA, 17 bp, Homo sapiens
agtgttcacaaactgtg

SEQ ID NO: 4547509 - DNA, 19 bp, Homo sapiens
agtgttcccaaagtgaact

SEQ ID NO: 4547510 - DNA, 15 bp, Homo sapiens
agtgttcctgaagct

SEQ ID NO: 4547511 - DNA, 19 bp, Homo sapiens
agtgttctgtttgaaacta

SEQ ID NO: 4547512 - DNA, 20 bp, Homo sapiens
agtgttgggattacaggcgt

SEQ ID NO: 4547513 - DNA, 19 bp, Homo sapiens
agtgttgggattacaggtg

SEQ ID NO: 4547514 - DNA, 22 bp, Homo sapiens
agtgtttaaaaggctaagaata

SEQ ID NO: 4547515 - DNA, 13 bp, Homo sapiens
agtgtttaagtca

SEQ ID NO: 4547516 - DNA, 19 bp, Homo sapiens
agtgtttcagattttttaa

SEQ ID NO: 4547517 - DNA, 20 bp, Homo sapiens
agtgtttcagattttttaaa

SEQ ID NO: 4547518 - DNA, 20 bp, Homo sapiens
agtgtttggtgctcatttaa

SEQ ID NO: 4547519 - DNA, 12 bp, Homo sapiens
agtgtttttcct

SEQ ID NO: 4547520 - DNA, 22 bp, Homo sapiens
agtgtttttcctgtgtattaaa

SEQ ID NO: 4547521 - DNA, 18 bp, Homo sapiens
agttaaaaattaaatatt

SEQ ID NO: 4547522 - DNA, 19 bp, Homo sapiens
agttaaaaattaaatattt

SEQ ID NO: 4547523 - DNA, 20 bp, Homo sapiens
agttaaaaattaaatattta

SEQ ID NO: 4547524 - DNA, 21 bp, Homo sapiens
agttaaaaattaaatatttat

SEQ ID NO: 4547525 - DNA, 20 bp, Homo sapiens
agttaaaactcatcacataa

SEQ ID NO: 4547526 - DNA, 14 bp, Homo sapiens
agttaaactgatta

SEQ ID NO: 4547527 - DNA, 13 bp, Homo sapiens
agttaaagaaagg

SEQ ID NO: 4547528 - DNA, 15 bp, Homo sapiens
agttaactattgcat

SEQ ID NO: 4547529 - DNA, 19 bp, Homo sapiens
agttaactattgcatttat

SEQ ID NO: 4547530 - DNA, 20 bp, Homo sapiens
agttaactattgcatttata

SEQ ID NO: 4547531 - DNA, 24 bp, Homo sapiens
agttaactattgcatttatatgta

SEQ ID NO: 4547532 - DNA, 18 bp, Homo sapiens
agttaactgtgaaatacc

SEQ ID NO: 4547533 - DNA, 12 bp, Homo sapiens
agttaacttgga

SEQ ID NO: 4547534 - DNA, 20 bp, Homo sapiens
agttaataggagtatttttg

SEQ ID NO: 4547535 - DNA, 13 bp, Homo sapiens
agttaatataaat

SEQ ID NO: 4547536 - DNA, 17 bp, Homo sapiens
agttaatataaatgttg

SEQ ID NO: 4547537 - DNA, 18 bp, Homo sapiens
agttaatcagaaagaaaa

SEQ ID NO: 4547538 - DNA, 19 bp, Homo sapiens
agttaatgtatataaaaat

SEQ ID NO: 4547539 - DNA, 20 bp, Homo sapiens
agttaatgtatataaaaatg

SEQ ID NO: 4547540 - DNA, 21 bp, Homo sapiens
agttaattcttaaaactataa

SEQ ID NO: 4547541 - DNA, 17 bp, Homo sapiens
agttaatttttccaact

SEQ ID NO: 4547542 - DNA, 13 bp, Homo sapiens
agttacacatttt

SEQ ID NO: 4547543 - DNA, 15 bp, Homo sapiens
agttacagttctgtg

SEQ ID NO: 4547544 - DNA, 16 bp, Homo sapiens
agttacagttgatgtt

SEQ ID NO: 4547545 - DNA, 15 bp, Homo sapiens
agttactaaaattta

SEQ ID NO: 4547546 - DNA, 17 bp, Homo sapiens
agttactaaaatttaca

SEQ ID NO: 4547547 - DNA, 19 bp, Homo sapiens
agttactaaaatttacaca

SEQ ID NO: 4547548 - DNA, 15 bp, Homo sapiens
agttactcagccctg

SEQ ID NO: 4547549 - DNA, 18 bp, Homo sapiens
agttactcagccctgggc

SEQ ID NO: 4547550 - DNA, 19 bp, Homo sapiens
agttactcagccctgggcc

SEQ ID NO: 4547551 - DNA, 23 bp, Homo sapiens
agttactcccttctcgtgtttgc

SEQ ID NO: 4547552 - DNA, 11 bp, Homo sapiens
agttactgtgt

SEQ ID NO: 4547553 - DNA, 15 bp, Homo sapiens
agttactgtgtaatt

SEQ ID NO: 4547554 - DNA, 15 bp, Homo sapiens
agttacttaatgacc

SEQ ID NO: 4547555 - DNA, 13 bp, Homo sapiens
agttactttagat

SEQ ID NO: 4547556 - DNA, 15 bp, Homo sapiens
agttactttagatgg

SEQ ID NO: 4547557 - DNA, 14 bp, Homo sapiens
agttagaaccacag

SEQ ID NO: 4547558 - DNA, 15 bp, Homo sapiens
agttagaaccacagc

SEQ ID NO: 4547559 - DNA, 15 bp, Homo sapiens
agttagatctttgta

SEQ ID NO: 4547560 - DNA, 22 bp, Homo sapiens
agttagatctttgtaaatgcat

SEQ ID NO: 4547561 - DNA, 17 bp, Homo sapiens
agttagattcactttga

SEQ ID NO: 4547562 - DNA, 11 bp, Homo sapiens
agttagcacca

SEQ ID NO: 4547563 - DNA, 20 bp, Homo sapiens
agttagcactgaactgcttt

SEQ ID NO: 4547564 - DNA, 18 bp, Homo sapiens
agttagcatccaggctgg

SEQ ID NO: 4547565 - DNA, 19 bp, Homo sapiens
agttagcatccaggctggc

SEQ ID NO: 4547566 - DNA, 17 bp, Homo sapiens
agttagtggaaatctga

SEQ ID NO: 4547567 - DNA, 20 bp, Homo sapiens
agttagtggattactgccat

SEQ ID NO: 4547568 - DNA, 15 bp, Homo sapiens
agttagtttgtatat

SEQ ID NO: 4547569 - DNA, 22 bp, Homo sapiens
agttagtttgtatatattatta

SEQ ID NO: 4547570 - DNA, 14 bp, Homo sapiens
agttataaaactat

SEQ ID NO: 4547571 - DNA, 20 bp, Homo sapiens
agttataaaattaaaagttt

SEQ ID NO: 4547572 - DNA, 14 bp, Homo sapiens
agttataacagatg

SEQ ID NO: 4547573 - DNA, 20 bp, Homo sapiens
agttatacagttataaaatt

SEQ ID NO: 4547574 - DNA, 20 bp, Homo sapiens
agttatacttatttgtatat

SEQ ID NO: 4547575 - DNA, 14 bp, Homo sapiens
agttatatgtgtgt

SEQ ID NO: 4547576 - DNA, 13 bp, Homo sapiens
agttatattcact

SEQ ID NO: 4547577 - DNA, 16 bp, Homo sapiens
agttatcacactttgt

SEQ ID NO: 4547578 - DNA, 18 bp, Homo sapiens
agttatcatgaattttaa

SEQ ID NO: 4547579 - DNA, 22 bp, Homo sapiens
agttatcatgaattttaaagta

SEQ ID NO: 4547580 - DNA, 13 bp, Homo sapiens
agttatcttcttt

SEQ ID NO: 4547581 - DNA, 21 bp, Homo sapiens
agttatcttctttattattcc

SEQ ID NO: 4547582 - DNA, 20 bp, Homo sapiens
agttatgatttttttttcat

SEQ ID NO: 4547583 - DNA, 13 bp, Homo sapiens
agttattaaatgt

SEQ ID NO: 4547584 - DNA, 14 bp, Homo sapiens
agttattaaatgtt

SEQ ID NO: 4547585 - DNA, 16 bp, Homo sapiens
agttattaaatgtttc

SEQ ID NO: 4547586 - DNA, 21 bp, Homo sapiens
agttattaaatgtttcaaaat

SEQ ID NO: 4547587 - DNA, 18 bp, Homo sapiens
agttattccacaaacaca

SEQ ID NO: 4547588 - DNA, 16 bp, Homo sapiens
agttattgcagtttat

SEQ ID NO: 4547589 - DNA, 14 bp, Homo sapiens
agttatttctgttt

SEQ ID NO: 4547590 - DNA, 14 bp, Homo sapiens
agttattttatagg

SEQ ID NO: 4547591 - DNA, 14 bp, Homo sapiens
agttcaaatacttt

SEQ ID NO: 4547592 - DNA, 15 bp, Homo sapiens
agttcaagaccagcc

SEQ ID NO: 4547593 - DNA, 24 bp, Homo sapiens
agttcaatctggattcatatttaa

SEQ ID NO: 4547594 - DNA, 19 bp, Homo sapiens
agttcacaaaaaaatgttc

SEQ ID NO: 4547595 - DNA, 21 bp, Homo sapiens
agttcacaaaaaaatgttcat

SEQ ID NO: 4547596 - DNA, 22 bp, Homo sapiens
agttcacaaaaaaatgttcatt

SEQ ID NO: 4547597 - DNA, 15 bp, Homo sapiens
agttcagaatttagt

SEQ ID NO: 4547598 - DNA, 11 bp, Homo sapiens
agttcagatct

SEQ ID NO: 4547599 - DNA, 22 bp, Homo sapiens
agttcagatcttaatataaatt

SEQ ID NO: 4547600 - DNA, 15 bp, Homo sapiens
agttcagcaccaccc

SEQ ID NO: 4547601 - DNA, 18 bp, Homo sapiens
agttcagcaccaccctag

SEQ ID NO: 4547602 - DNA, 21 bp, Homo sapiens
agttcagcatccgcaggtgct

SEQ ID NO: 4547603 - DNA, 17 bp, Homo sapiens
agttcataacagtgcca

SEQ ID NO: 4547604 - DNA, 20 bp, Homo sapiens
agttcataacagtgccattg

SEQ ID NO: 4547605 - DNA, 22 bp, Homo sapiens
agttcataacagtgccattgtc

SEQ ID NO: 4547606 - DNA, 21 bp, Homo sapiens
agttcatacaacatgcatgtt

SEQ ID NO: 4547607 - DNA, 17 bp, Homo sapiens
agttcatcgattttcta

SEQ ID NO: 4547608 - DNA, 13 bp, Homo sapiens
agttccacagcag

SEQ ID NO: 4547609 - DNA, 22 bp, Homo sapiens
agttccacttccaggtctgcct

SEQ ID NO: 4547610 - DNA, 16 bp, Homo sapiens
agttccagaaagtaaa

SEQ ID NO: 4547611 - DNA, 14 bp, Homo sapiens
agttccagaagtgt

SEQ ID NO: 4547612 - DNA, 18 bp, Homo sapiens
agttccagaagtgtgact

SEQ ID NO: 4547613 - DNA, 17 bp, Homo sapiens
agttccattatgaaaat

SEQ ID NO: 4547614 - DNA, 18 bp, Homo sapiens
agttccattatgaaaatc

SEQ ID NO: 4547615 - DNA, 20 bp, Homo sapiens
agttccattatgaaaatctt

SEQ ID NO: 4547616 - DNA, 23 bp, Homo sapiens
agttcccgggagctgggccctgc

SEQ ID NO: 4547617 - DNA, 14 bp, Homo sapiens
agttccctggagaa

SEQ ID NO: 4547618 - DNA, 23 bp, Homo sapiens
agttccctggagaaaaaaattgc

SEQ ID NO: 4547619 - DNA, 15 bp, Homo sapiens
agttcccttggcctc

SEQ ID NO: 4547620 - DNA, 18 bp, Homo sapiens
agttcccttggcctcaga

SEQ ID NO: 4547621 - DNA, 15 bp, Homo sapiens
agttcctagcactgc

SEQ ID NO: 4547622 - DNA, 13 bp, Homo sapiens
agttcctgggaac

SEQ ID NO: 4547623 - DNA, 21 bp, Homo sapiens
agttccttactgtttacagtt

SEQ ID NO: 4547624 - DNA, 19 bp, Homo sapiens
agttctataagtgaggaag

SEQ ID NO: 4547625 - DNA, 21 bp, Homo sapiens
agttctatggagactttgctg

SEQ ID NO: 4547626 - DNA, 16 bp, Homo sapiens
agttctatttcttgaa

SEQ ID NO: 4547627 - DNA, 18 bp, Homo sapiens
agttctgaagaaaaatta

SEQ ID NO: 4547628 - DNA, 18 bp, Homo sapiens
agttctgagctgtaattt

SEQ ID NO: 4547629 - DNA, 15 bp, Homo sapiens
agttctgcaaataga

SEQ ID NO: 4547630 - DNA, 16 bp, Homo sapiens
agttctgcaaatagaa

SEQ ID NO: 4547631 - DNA, 12 bp, Homo sapiens
agttctgccagg

SEQ ID NO: 4547632 - DNA, 13 bp, Homo sapiens
agttctgccagga

SEQ ID NO: 4547633 - DNA, 14 bp, Homo sapiens
agttctgccaggag

SEQ ID NO: 4547634 - DNA, 20 bp, Homo sapiens
agttctgccaggagacaggt

SEQ ID NO: 4547635 - DNA, 22 bp, Homo sapiens
agttctggatggtgtgccttcc

SEQ ID NO: 4547636 - DNA, 23 bp, Homo sapiens
agttctggatggtgtgccttcca

SEQ ID NO: 4547637 - DNA, 23 bp, Homo sapiens
agttctgtactcaaatgtagcca

SEQ ID NO: 4547638 - DNA, 15 bp, Homo sapiens
agttctgtgcctccc

SEQ ID NO: 4547639 - DNA, 17 bp, Homo sapiens
agttctgtgcctccccc

SEQ ID NO: 4547640 - DNA, 22 bp, Homo sapiens
agttctgtgcctccccccagac

SEQ ID NO: 4547641 - DNA, 23 bp, Homo sapiens
agttctgtggtttcatgttagtt

SEQ ID NO: 4547642 - DNA, 16 bp, Homo sapiens
agttctgtgtatttaa

SEQ ID NO: 4547643 - DNA, 21 bp, Homo sapiens
agttctgtgtatttaattgta

SEQ ID NO: 4547644 - DNA, 22 bp, Homo sapiens
agttctgtgtatttaattgtaa

SEQ ID NO: 4547645 - DNA, 20 bp, Homo sapiens
agttcttagttgctgtatgt

SEQ ID NO: 4547646 - DNA, 21 bp, Homo sapiens
agttcttatgaggaggggagg

SEQ ID NO: 4547647 - DNA, 14 bp, Homo sapiens
agttcttattttag

SEQ ID NO: 4547648 - DNA, 22 bp, Homo sapiens
agttcttattttagtatacgta

SEQ ID NO: 4547649 - DNA, 16 bp, Homo sapiens
agttcttgggggaggc

SEQ ID NO: 4547650 - DNA, 19 bp, Homo sapiens
agttcttggtgactgtccc

SEQ ID NO: 4547651 - DNA, 19 bp, Homo sapiens
agttctttcctccccctgc

SEQ ID NO: 4547652 - DNA, 15 bp, Homo sapiens
agttctttgctgccc

SEQ ID NO: 4547653 - DNA, 20 bp, Homo sapiens
agttgaaaagactccaaaga

SEQ ID NO: 4547654 - DNA, 22 bp, Homo sapiens
agttgaaaagactccaaagaaa

SEQ ID NO: 4547655 - DNA, 19 bp, Homo sapiens
agttgaaccattatacttt

SEQ ID NO: 4547656 - DNA, 13 bp, Homo sapiens
agttgaataaaaa

SEQ ID NO: 4547657 - DNA, 14 bp, Homo sapiens
agttgaataaacat

SEQ ID NO: 4547658 - DNA, 22 bp, Homo sapiens
agttgaatgttgcaatgtgaaa

SEQ ID NO: 4547659 - DNA, 20 bp, Homo sapiens
agttgacctttatttattaa

SEQ ID NO: 4547660 - DNA, 17 bp, Homo sapiens
agttgacttatagtaca

SEQ ID NO: 4547661 - DNA, 22 bp, Homo sapiens
agttgagattcaaacccaggct

SEQ ID NO: 4547662 - DNA, 17 bp, Homo sapiens
agttgaggagtttccta

SEQ ID NO: 4547663 - DNA, 23 bp, Homo sapiens
agttgatacttgaataaccatct

SEQ ID NO: 4547664 - DNA, 17 bp, Homo sapiens
agttgatattcaaggct

SEQ ID NO: 4547665 - DNA, 21 bp, Homo sapiens
agttgatcgcctttcccaggt

SEQ ID NO: 4547666 - DNA, 20 bp, Homo sapiens
agttgcaattgaattaaatt

SEQ ID NO: 4547667 - DNA, 17 bp, Homo sapiens
agttgcatagcagtata

SEQ ID NO: 4547668 - DNA, 17 bp, Homo sapiens
agttgcatgtagtaaca

SEQ ID NO: 4547669 - DNA, 18 bp, Homo sapiens
agttgcatgtttttgaaa

SEQ ID NO: 4547670 - DNA, 14 bp, Homo sapiens
agttgccaacagtt

SEQ ID NO: 4547671 - DNA, 23 bp, Homo sapiens
agttgcccgaaactaagccaggc

SEQ ID NO: 4547672 - DNA, 21 bp, Homo sapiens
agttgctcgcttttcctgccc

SEQ ID NO: 4547673 - DNA, 17 bp, Homo sapiens
agttgctgcaaacctga

SEQ ID NO: 4547674 - DNA, 18 bp, Homo sapiens
agttgctgtaaaatttgt

SEQ ID NO: 4547675 - DNA, 16 bp, Homo sapiens
agttggactctcaggg

SEQ ID NO: 4547676 - DNA, 20 bp, Homo sapiens
agttggccatgatgtctttt

SEQ ID NO: 4547677 - DNA, 17 bp, Homo sapiens
agttggggacagaactc

SEQ ID NO: 4547678 - DNA, 20 bp, Homo sapiens
agttggtaacttttgtgaat

SEQ ID NO: 4547679 - DNA, 14 bp, Homo sapiens
agttggtattaata

SEQ ID NO: 4547680 - DNA, 21 bp, Homo sapiens
agttggtgtaatcattttaaa

SEQ ID NO: 4547681 - DNA, 22 bp, Homo sapiens
agttgtaaataatttatttaat

SEQ ID NO: 4547682 - DNA, 21 bp, Homo sapiens
agttgtacatgataagacatt

SEQ ID NO: 4547683 - DNA, 21 bp, Homo sapiens
agttgtataaactgtattttg

SEQ ID NO: 4547684 - DNA, 20 bp, Homo sapiens
agttgtatcagcacgtgtgg

SEQ ID NO: 4547685 - DNA, 15 bp, Homo sapiens
agttgtatgtttgct

SEQ ID NO: 4547686 - DNA, 14 bp, Homo sapiens
agttgtatttcaaa

SEQ ID NO: 4547687 - DNA, 21 bp, Homo sapiens
agttgtcacagtcttgtgaac

SEQ ID NO: 4547688 - DNA, 21 bp, Homo sapiens
agttgtctctcttcagactct

SEQ ID NO: 4547689 - DNA, 14 bp, Homo sapiens
agttgtgcttgagc

SEQ ID NO: 4547690 - DNA, 21 bp, Homo sapiens
agttgtgtctggcagtttata

SEQ ID NO: 4547691 - DNA, 16 bp, Homo sapiens
agttgtgtggcccagc

SEQ ID NO: 4547692 - DNA, 18 bp, Homo sapiens
agttgtgtgtatgtgtgt

SEQ ID NO: 4547693 - DNA, 16 bp, Homo sapiens
agttgttggtctgtag

SEQ ID NO: 4547694 - DNA, 23 bp, Homo sapiens
agttgtttctagactataaatgt

SEQ ID NO: 4547695 - DNA, 23 bp, Homo sapiens
agtttaaaaaataacttcattgt

SEQ ID NO: 4547696 - DNA, 19 bp, Homo sapiens
agtttaacaaatgactgta

SEQ ID NO: 4547697 - DNA, 23 bp, Homo sapiens
agtttaagggtggaaaaatgccc

SEQ ID NO: 4547698 - DNA, 18 bp, Homo sapiens
agtttaattgacttattt

SEQ ID NO: 4547699 - DNA, 14 bp, Homo sapiens
agtttacacactgt

SEQ ID NO: 4547700 - DNA, 15 bp, Homo sapiens
agtttacacactgtg

SEQ ID NO: 4547701 - DNA, 16 bp, Homo sapiens
agtttaccatctgaaa

SEQ ID NO: 4547702 - DNA, 18 bp, Homo sapiens
agtttacctggcttattt

SEQ ID NO: 4547703 - DNA, 14 bp, Homo sapiens
agtttacttataaa

SEQ ID NO: 4547704 - DNA, 13 bp, Homo sapiens
agtttagaacaga

SEQ ID NO: 4547705 - DNA, 15 bp, Homo sapiens
agtttagaacagagg

SEQ ID NO: 4547706 - DNA, 20 bp, Homo sapiens
agtttagaagcgctcatctg

SEQ ID NO: 4547707 - DNA, 21 bp, Homo sapiens
agtttagaagcgctcatctgg

SEQ ID NO: 4547708 - DNA, 18 bp, Homo sapiens
agtttagaatggaggaag

SEQ ID NO: 4547709 - DNA, 14 bp, Homo sapiens
agtttatacagttt

SEQ ID NO: 4547710 - DNA, 14 bp, Homo sapiens
agtttatcatgaag

SEQ ID NO: 4547711 - DNA, 16 bp, Homo sapiens
agtttatcattcaagt

SEQ ID NO: 4547712 - DNA, 17 bp, Homo sapiens
agtttatcattcaagtg

SEQ ID NO: 4547713 - DNA, 17 bp, Homo sapiens
agtttatggcaaagatt

SEQ ID NO: 4547714 - DNA, 21 bp, Homo sapiens
agtttattacaatgtatcttt

SEQ ID NO: 4547715 - DNA, 19 bp, Homo sapiens
agtttattattgtacttta

SEQ ID NO: 4547716 - DNA, 13 bp, Homo sapiens
agtttattctaat

SEQ ID NO: 4547717 - DNA, 18 bp, Homo sapiens
agtttatttctgtgaaag

SEQ ID NO: 4547718 - DNA, 18 bp, Homo sapiens
agtttcaagttttaaagt

SEQ ID NO: 4547719 - DNA, 22 bp, Homo sapiens
agtttcacagaaaataaggcac

SEQ ID NO: 4547720 - DNA, 17 bp, Homo sapiens
agtttcagagtatattg

SEQ ID NO: 4547721 - DNA, 20 bp, Homo sapiens
agtttcagtagattgcagaa

SEQ ID NO: 4547722 - DNA, 16 bp, Homo sapiens
agtttccagaaaagaa

SEQ ID NO: 4547723 - DNA, 20 bp, Homo sapiens
agtttccgaatctctttccc

SEQ ID NO: 4547724 - DNA, 19 bp, Homo sapiens
agtttcgtctaatgggggc

SEQ ID NO: 4547725 - DNA, 13 bp, Homo sapiens
agtttctaaaatt

SEQ ID NO: 4547726 - DNA, 17 bp, Homo sapiens
agtttctctagaagctc

SEQ ID NO: 4547727 - DNA, 19 bp, Homo sapiens
agtttctgacaattaacat

SEQ ID NO: 4547728 - DNA, 22 bp, Homo sapiens
agtttctggtgccatttctgaa

SEQ ID NO: 4547729 - DNA, 14 bp, Homo sapiens
agtttctgtttgat

SEQ ID NO: 4547730 - DNA, 23 bp, Homo sapiens
agtttcttaaactgaaagcttta

SEQ ID NO: 4547731 - DNA, 17 bp, Homo sapiens
agtttcttgtgtagatt

SEQ ID NO: 4547732 - DNA, 22 bp, Homo sapiens
agtttcttgtgtagatttgaaa

SEQ ID NO: 4547733 - DNA, 17 bp, Homo sapiens
agtttgaaagttgtaca

SEQ ID NO: 4547734 - DNA, 18 bp, Homo sapiens
agtttgaaagttgtacat

SEQ ID NO: 4547735 - DNA, 19 bp, Homo sapiens
agtttgaaagttgtacatg

SEQ ID NO: 4547736 - DNA, 21 bp, Homo sapiens
agtttgaaagttgtacatgat

SEQ ID NO: 4547737 - DNA, 15 bp, Homo sapiens
agtttgaaattctga

SEQ ID NO: 4547738 - DNA, 17 bp, Homo sapiens
agtttgaaattctgaat

SEQ ID NO: 4547739 - DNA, 20 bp, Homo sapiens
agtttgaaattctgaatttg

SEQ ID NO: 4547740 - DNA, 22 bp, Homo sapiens
agtttgaaattctgaatttgca

SEQ ID NO: 4547741 - DNA, 21 bp, Homo sapiens
agtttgaagcacaactccctt

SEQ ID NO: 4547742 - DNA, 14 bp, Homo sapiens
agtttgaatgtttt

SEQ ID NO: 4547743 - DNA, 14 bp, Homo sapiens
agtttgagctgcct

SEQ ID NO: 4547744 - DNA, 14 bp, Homo sapiens
agtttgattattca

SEQ ID NO: 4547745 - DNA, 17 bp, Homo sapiens
agtttgcaaaaaatgtt

SEQ ID NO: 4547746 - DNA, 23 bp, Homo sapiens
agtttgcagaaaagcacctgccg

SEQ ID NO: 4547747 - DNA, 15 bp, Homo sapiens
agtttgccaggagga

SEQ ID NO: 4547748 - DNA, 18 bp, Homo sapiens
agtttgcctgcagtttct

SEQ ID NO: 4547749 - DNA, 15 bp, Homo sapiens
agtttgctaatgttt

SEQ ID NO: 4547750 - DNA, 16 bp, Homo sapiens
agtttgctaatgtttc

SEQ ID NO: 4547751 - DNA, 14 bp, Homo sapiens
agtttggatatgta

SEQ ID NO: 4547752 - DNA, 16 bp, Homo sapiens
agtttggatgtctgta

SEQ ID NO: 4547753 - DNA, 20 bp, Homo sapiens
agtttggctataagtgctca

SEQ ID NO: 4547754 - DNA, 13 bp, Homo sapiens
agtttgggctgga

SEQ ID NO: 4547755 - DNA, 17 bp, Homo sapiens
agtttgtaggtaaaatg

SEQ ID NO: 4547756 - DNA, 22 bp, Homo sapiens
agtttgttatgcactttaaatg

SEQ ID NO: 4547757 - DNA, 17 bp, Homo sapiens
agtttgttcttcagatt

SEQ ID NO: 4547758 - DNA, 17 bp, Homo sapiens
agtttgttgctgtcaag

SEQ ID NO: 4547759 - DNA, 21 bp, Homo sapiens
agttttaaacccaaaatatat

SEQ ID NO: 4547760 - DNA, 22 bp, Homo sapiens
agttttaaagaaattttagtag

SEQ ID NO: 4547761 - DNA, 22 bp, Homo sapiens
agttttacagagaggatacatt

SEQ ID NO: 4547762 - DNA, 23 bp, Homo sapiens
agttttacagagaggatacattt

SEQ ID NO: 4547763 - DNA, 14 bp, Homo sapiens
agttttacatttta

SEQ ID NO: 4547764 - DNA, 18 bp, Homo sapiens
agttttactcttaaatca

SEQ ID NO: 4547765 - DNA, 15 bp, Homo sapiens
agttttagttaaaac

SEQ ID NO: 4547766 - DNA, 20 bp, Homo sapiens
agttttcagaacctcttccc

SEQ ID NO: 4547767 - DNA, 22 bp, Homo sapiens
agttttcagaacctcttcccca

SEQ ID NO: 4547768 - DNA, 12 bp, Homo sapiens
agttttcatttt

SEQ ID NO: 4547769 - DNA, 12 bp, Homo sapiens
agttttccctgg

SEQ ID NO: 4547770 - DNA, 13 bp, Homo sapiens
agttttccttgct

SEQ ID NO: 4547771 - DNA, 17 bp, Homo sapiens
agttttgaagattctat

SEQ ID NO: 4547772 - DNA, 16 bp, Homo sapiens
agttttgtgtttgttg

SEQ ID NO: 4547773 - DNA, 19 bp, Homo sapiens
agttttgtgtttgttgtag

SEQ ID NO: 4547774 - DNA, 21 bp, Homo sapiens
agttttgtgtttgttgtagat

SEQ ID NO: 4547775 - DNA, 16 bp, Homo sapiens
agttttgtttcctcat

SEQ ID NO: 4547776 - DNA, 21 bp, Homo sapiens
agtttttaaaatttatttgca

SEQ ID NO: 4547777 - DNA, 22 bp, Homo sapiens
agtttttaaaatttatttgcaa

SEQ ID NO: 4547778 - DNA, 23 bp, Homo sapiens
agtttttaactctactgtgtaat

SEQ ID NO: 4547779 - DNA, 16 bp, Homo sapiens
agtttttatgagaaac

SEQ ID NO: 4547780 - DNA, 17 bp, Homo sapiens
agtttttcatactgtac

SEQ ID NO: 4547781 - DNA, 18 bp, Homo sapiens
agtttttcatactgtaca

SEQ ID NO: 4547782 - DNA, 18 bp, Homo sapiens
agtttttcattaaataaa

SEQ ID NO: 4547783 - DNA, 22 bp, Homo sapiens
agtttttcattaaataaatttg

SEQ ID NO: 4547784 - DNA, 14 bp, Homo sapiens
agtttttcctccca

SEQ ID NO: 4547785 - DNA, 19 bp, Homo sapiens
agttttttactttggttta

SEQ ID NO: 4547786 - DNA, 21 bp, Homo sapiens
agttttttacttttgtttatt

SEQ ID NO: 4547787 - DNA, 17 bp, Homo sapiens
agttttttattatgcat

SEQ ID NO: 4547788 - DNA, 16 bp, Homo sapiens
ataaaaaagtctctat

SEQ ID NO: 4547789 - DNA, 13 bp, Homo sapiens
ataaaaaatatgt

SEQ ID NO: 4547790 - DNA, 13 bp, Homo sapiens
ataaaaaatcatg

SEQ ID NO: 4547791 - DNA, 17 bp, Homo sapiens
ataaaaacaagtcattt

SEQ ID NO: 4547792 - DNA, 14 bp, Homo sapiens
ataaaaagaaaggc

SEQ ID NO: 4547793 - DNA, 16 bp, Homo sapiens
ataaaaagagatgaaa

SEQ ID NO: 4547794 - DNA, 14 bp, Homo sapiens
ataaaaagatcact

SEQ ID NO: 4547795 - DNA, 22 bp, Homo sapiens
ataaaaagatcactttctcagt

SEQ ID NO: 4547796 - DNA, 21 bp, Homo sapiens
ataaaaagcttccatgattct

SEQ ID NO: 4547797 - DNA, 13 bp, Homo sapiens
ataaaaaggaata

SEQ ID NO: 4547798 - DNA, 19 bp, Homo sapiens
ataaaaaggacatcagcaa

SEQ ID NO: 4547799 - DNA, 17 bp, Homo sapiens
ataaaaagtcacaatga

SEQ ID NO: 4547800 - DNA, 13 bp, Homo sapiens
ataaaaatataaa

SEQ ID NO: 4547801 - DNA, 20 bp, Homo sapiens
ataaaaattatcaaaaagct

SEQ ID NO: 4547802 - DNA, 21 bp, Homo sapiens
ataaaacaaataaatatgaaa

SEQ ID NO: 4547803 - DNA, 13 bp, Homo sapiens
ataaaacagtcat

SEQ ID NO: 4547804 - DNA, 20 bp, Homo sapiens
ataaaactaaggcttttatt

SEQ ID NO: 4547805 - DNA, 14 bp, Homo sapiens
ataaaactatgtgt

SEQ ID NO: 4547806 - DNA, 19 bp, Homo sapiens
ataaaactcactcactgtt

SEQ ID NO: 4547807 - DNA, 22 bp, Homo sapiens
ataaaactgcgaggacatcaaa

SEQ ID NO: 4547808 - DNA, 14 bp, Homo sapiens
ataaaactgtttca

SEQ ID NO: 4547809 - DNA, 15 bp, Homo sapiens
ataaaactgtttcaa

SEQ ID NO: 4547810 - DNA, 21 bp, Homo sapiens
ataaaactgtttcaagccctc

SEQ ID NO: 4547811 - DNA, 13 bp, Homo sapiens
ataaaagataaaa

SEQ ID NO: 4547812 - DNA, 12 bp, Homo sapiens
ataaaagcaatt

SEQ ID NO: 4547813 - DNA, 17 bp, Homo sapiens
ataaaataactaaaatg

SEQ ID NO: 4547814 - DNA, 19 bp, Homo sapiens
ataaaatactttttatcac

SEQ ID NO: 4547815 - DNA, 16 bp, Homo sapiens
ataaaatgaaaattgt

SEQ ID NO: 4547816 - DNA, 13 bp, Homo sapiens
ataaaatgctcct

SEQ ID NO: 4547817 - DNA, 14 bp, Homo sapiens
ataaaatggaataa

SEQ ID NO: 4547818 - DNA, 17 bp, Homo sapiens
ataaaattaggttaaac

SEQ ID NO: 4547819 - DNA, 15 bp, Homo sapiens
ataaaattatttgca

SEQ ID NO: 4547820 - DNA, 13 bp, Homo sapiens
ataaaattctgta

SEQ ID NO: 4547821 - DNA, 20 bp, Homo sapiens
ataaaattctgtaatttgaa

SEQ ID NO: 4547822 - DNA, 22 bp, Homo sapiens
ataaaattgcagtttcatgtat

SEQ ID NO: 4547823 - DNA, 21 bp, Homo sapiens
ataaaattttattttaaattt

SEQ ID NO: 4547824 - DNA, 11 bp, Homo sapiens
ataaaattttt

SEQ ID NO: 4547825 - DNA, 14 bp, Homo sapiens
ataaacaatgatgc

SEQ ID NO: 4547826 - DNA, 18 bp, Homo sapiens
ataaacaatgatgccctg

SEQ ID NO: 4547827 - DNA, 14 bp, Homo sapiens
ataaacacatagat

SEQ ID NO: 4547828 - DNA, 15 bp, Homo sapiens
ataaacagatgaata

SEQ ID NO: 4547829 - DNA, 20 bp, Homo sapiens
ataaacatatttttatactt

SEQ ID NO: 4547830 - DNA, 21 bp, Homo sapiens
ataaacatatttttatacttt

SEQ ID NO: 4547831 - DNA, 22 bp, Homo sapiens
ataaacatatttttatacttta

SEQ ID NO: 4547832 - DNA, 13 bp, Homo sapiens
ataaaccaaaaac

SEQ ID NO: 4547833 - DNA, 18 bp, Homo sapiens
ataaaccaaaaacatttg

SEQ ID NO: 4547834 - DNA, 15 bp, Homo sapiens
ataaaccactgtgcg

SEQ ID NO: 4547835 - DNA, 10 bp, Homo sapiens
ataaaccagt

SEQ ID NO: 4547836 - DNA, 23 bp, Homo sapiens
ataaaccctccttggtgcctctg

SEQ ID NO: 4547837 - DNA, 14 bp, Homo sapiens
ataaacctgttctt

SEQ ID NO: 4547838 - DNA, 14 bp, Homo sapiens
ataaaccttatgaa

SEQ ID NO: 4547839 - DNA, 21 bp, Homo sapiens
ataaaccttatgaactacagt

SEQ ID NO: 4547840 - DNA, 16 bp, Homo sapiens
ataaactataaactta

SEQ ID NO: 4547841 - DNA, 17 bp, Homo sapiens
ataaactatttatatca

SEQ ID NO: 4547842 - DNA, 19 bp, Homo sapiens
ataaacttaagggcaagga

SEQ ID NO: 4547843 - DNA, 16 bp, Homo sapiens
ataaagaatacttgaa

SEQ ID NO: 4547844 - DNA, 12 bp, Homo sapiens
ataaagaatata

SEQ ID NO: 4547845 - DNA, 14 bp, Homo sapiens
ataaagacaaccat

SEQ ID NO: 4547846 - DNA, 22 bp, Homo sapiens
ataaagacaaccatatttagca

SEQ ID NO: 4547847 - DNA, 15 bp, Homo sapiens
ataaagatcacacat

SEQ ID NO: 4547848 - DNA, 13 bp, Homo sapiens
ataaagatcattt

SEQ ID NO: 4547849 - DNA, 16 bp, Homo sapiens
ataaagatggtccaaa

SEQ ID NO: 4547850 - DNA, 11 bp, Homo sapiens
ataaagccttt

SEQ ID NO: 4547851 - DNA, 15 bp, Homo sapiens
ataaaggaaaacaaa

SEQ ID NO: 4547852 - DNA, 17 bp, Homo sapiens
ataaaggaaaacaaaaa

SEQ ID NO: 4547853 - DNA, 21 bp, Homo sapiens
ataaaggatgtgattgtggaa

SEQ ID NO: 4547854 - DNA, 11 bp, Homo sapiens
ataaaggcagc

SEQ ID NO: 4547855 - DNA, 15 bp, Homo sapiens
ataaaggcagctgcc

SEQ ID NO: 4547856 - DNA, 19 bp, Homo sapiens
ataaaggcagctgcctctg

SEQ ID NO: 4547857 - DNA, 18 bp, Homo sapiens
ataaaggcagttttctaa

SEQ ID NO: 4547858 - DNA, 14 bp, Homo sapiens
ataaagggaacaaa

SEQ ID NO: 4547859 - DNA, 23 bp, Homo sapiens
ataaagggagaatggtgctgttt

SEQ ID NO: 4547860 - DNA, 17 bp, Homo sapiens
ataaagggtcaggcccg

SEQ ID NO: 4547861 - DNA, 22 bp, Homo sapiens
ataaaggtgaggggaagacaaa

SEQ ID NO: 4547862 - DNA, 19 bp, Homo sapiens
ataaagtagttattttata

SEQ ID NO: 4547863 - DNA, 16 bp, Homo sapiens
ataaagtgaactttgt

SEQ ID NO: 4547864 - DNA, 14 bp, Homo sapiens
ataaagtgccttct

SEQ ID NO: 4547865 - DNA, 13 bp, Homo sapiens
ataaagtgttttc

SEQ ID NO: 4547866 - DNA, 17 bp, Homo sapiens
ataaagtgttttcagag

SEQ ID NO: 4547867 - DNA, 11 bp, Homo sapiens
ataaagttaaa

SEQ ID NO: 4547868 - DNA, 16 bp, Homo sapiens
ataaagttgataaaga

SEQ ID NO: 4547869 - DNA, 20 bp, Homo sapiens
ataaagttgataaagatttt

SEQ ID NO: 4547870 - DNA, 16 bp, Homo sapiens
ataaagttgtattgca

SEQ ID NO: 4547871 - DNA, 17 bp, Homo sapiens
ataaagttgtattgcat

SEQ ID NO: 4547872 - DNA, 20 bp, Homo sapiens
ataaagttgtatttcaaata

SEQ ID NO: 4547873 - DNA, 15 bp, Homo sapiens
ataaataaaaatgca

SEQ ID NO: 4547874 - DNA, 17 bp, Homo sapiens
ataaataaaaatgcatt

SEQ ID NO: 4547875 - DNA, 15 bp, Homo sapiens
ataaataaaaatgga

SEQ ID NO: 4547876 - DNA, 14 bp, Homo sapiens
ataaataacttttt

SEQ ID NO: 4547877 - DNA, 15 bp, Homo sapiens
ataaatagaaaagta

SEQ ID NO: 4547878 - DNA, 13 bp, Homo sapiens
ataaatagaaaga

SEQ ID NO: 4547879 - DNA, 18 bp, Homo sapiens
ataaatagcatttggaaa

SEQ ID NO: 4547880 - DNA, 15 bp, Homo sapiens
ataaatagtttatga

SEQ ID NO: 4547881 - DNA, 21 bp, Homo sapiens
ataaatatatataaagaatat

SEQ ID NO: 4547882 - DNA, 21 bp, Homo sapiens
ataaatatatctaccccagac

SEQ ID NO: 4547883 - DNA, 23 bp, Homo sapiens
ataaatcacagaaaatttaactt

SEQ ID NO: 4547884 - DNA, 12 bp, Homo sapiens
ataaatcataaa

SEQ ID NO: 4547885 - DNA, 20 bp, Homo sapiens
ataaatctaggatgtgatga

SEQ ID NO: 4547886 - DNA, 14 bp, Homo sapiens
ataaatctcttctt

SEQ ID NO: 4547887 - DNA, 12 bp, Homo sapiens
ataaatgaatgt

SEQ ID NO: 4547888 - DNA, 15 bp, Homo sapiens
ataaatgaatgtgct

SEQ ID NO: 4547889 - DNA, 15 bp, Homo sapiens
ataaatgcataattt

SEQ ID NO: 4547890 - DNA, 12 bp, Homo sapiens
ataaatgtacat

SEQ ID NO: 4547891 - DNA, 13 bp, Homo sapiens
ataaatgtacatc

SEQ ID NO: 4547892 - DNA, 15 bp, Homo sapiens
ataaatgtgtttata

SEQ ID NO: 4547893 - DNA, 20 bp, Homo sapiens
ataaatgttctggtatgcat

SEQ ID NO: 4547894 - DNA, 11 bp, Homo sapiens
ataaattaaat

SEQ ID NO: 4547895 - DNA, 23 bp, Homo sapiens
ataaattagtttgggttctctac

SEQ ID NO: 4547896 - DNA, 17 bp, Homo sapiens
ataaattatggcatttc

SEQ ID NO: 4547897 - DNA, 19 bp, Homo sapiens
ataaattatggcatttcta

SEQ ID NO: 4547898 - DNA, 12 bp, Homo sapiens
ataaattattac

SEQ ID NO: 4547899 - DNA, 14 bp, Homo sapiens
ataaattattactt

SEQ ID NO: 4547900 - DNA, 16 bp, Homo sapiens
ataaattattacttta

SEQ ID NO: 4547901 - DNA, 20 bp, Homo sapiens
ataaattattactttaaatt

SEQ ID NO: 4547902 - DNA, 23 bp, Homo sapiens
ataaattcccaacttctcttgct

SEQ ID NO: 4547903 - DNA, 19 bp, Homo sapiens
ataaattgatttttataaa

SEQ ID NO: 4547904 - DNA, 14 bp, Homo sapiens
ataaattgtacatt

SEQ ID NO: 4547905 - DNA, 22 bp, Homo sapiens
ataaattgtctttaaaaactgt

SEQ ID NO: 4547906 - DNA, 15 bp, Homo sapiens
ataaatttatatgaa

SEQ ID NO: 4547907 - DNA, 23 bp, Homo sapiens
ataaatttcccagttaaagatta

SEQ ID NO: 4547908 - DNA, 12 bp, Homo sapiens
ataaatttgact

SEQ ID NO: 4547909 - DNA, 13 bp, Homo sapiens
ataaattttcaaa

SEQ ID NO: 4547910 - DNA, 17 bp, Homo sapiens
ataaattttcaaatcct

SEQ ID NO: 4547911 - DNA, 15 bp, Homo sapiens
ataaattttttataa

SEQ ID NO: 4547912 - DNA, 22 bp, Homo sapiens
ataaattttttgacctatttta

SEQ ID NO: 4547913 - DNA, 19 bp, Homo sapiens
ataaattttttttgtttca

SEQ ID NO: 4547914 - DNA, 17 bp, Homo sapiens
ataacaaaaaaggtttc

SEQ ID NO: 4547915 - DNA, 11 bp, Homo sapiens
ataacaaatgc

SEQ ID NO: 4547916 - DNA, 17 bp, Homo sapiens
ataacaagcatgcataa

SEQ ID NO: 4547917 - DNA, 23 bp, Homo sapiens
ataacactctaggatgtatattt

SEQ ID NO: 4547918 - DNA, 13 bp, Homo sapiens
ataacactgtatt

SEQ ID NO: 4547919 - DNA, 18 bp, Homo sapiens
ataacagatggtgctgct

SEQ ID NO: 4547920 - DNA, 18 bp, Homo sapiens
ataacagatgtgaaaata

SEQ ID NO: 4547921 - DNA, 21 bp, Homo sapiens
ataacagtgccattgtcttta

SEQ ID NO: 4547922 - DNA, 11 bp, Homo sapiens
ataacataaaa

SEQ ID NO: 4547923 - DNA, 12 bp, Homo sapiens
ataacataaaag

SEQ ID NO: 4547924 - DNA, 14 bp, Homo sapiens
ataacataaaagca

SEQ ID NO: 4547925 - DNA, 21 bp, Homo sapiens
ataacatctttattgaaattc

SEQ ID NO: 4547926 - DNA, 13 bp, Homo sapiens
ataacattatata

SEQ ID NO: 4547927 - DNA, 15 bp, Homo sapiens
ataacattatataac

SEQ ID NO: 4547928 - DNA, 20 bp, Homo sapiens
ataacattatataacaaaaa

SEQ ID NO: 4547929 - DNA, 13 bp, Homo sapiens
ataacattttcta

SEQ ID NO: 4547930 - DNA, 16 bp, Homo sapiens
ataaccaatttgtaat

SEQ ID NO: 4547931 - DNA, 14 bp, Homo sapiens
ataaccaattttca

SEQ ID NO: 4547932 - DNA, 23 bp, Homo sapiens
ataaccatttaaagaaagaatgc

SEQ ID NO: 4547933 - DNA, 14 bp, Homo sapiens
ataacctaattaat

SEQ ID NO: 4547934 - DNA, 17 bp, Homo sapiens
ataacctttacactcct

SEQ ID NO: 4547935 - DNA, 18 bp, Homo sapiens
ataacggttaagaaagca

SEQ ID NO: 4547936 - DNA, 20 bp, Homo sapiens
ataacgtttaagccaaaaca

SEQ ID NO: 4547937 - DNA, 16 bp, Homo sapiens
ataactaagcatcctt

SEQ ID NO: 4547938 - DNA, 17 bp, Homo sapiens
ataactcctgtcccttt

SEQ ID NO: 4547939 - DNA, 11 bp, Homo sapiens
ataactctgca

SEQ ID NO: 4547940 - DNA, 19 bp, Homo sapiens
ataactctgcactactcct

SEQ ID NO: 4547941 - DNA, 21 bp, Homo sapiens
ataactctgcactactcctct

SEQ ID NO: 4547942 - DNA, 13 bp, Homo sapiens
ataactgaaaatg

SEQ ID NO: 4547943 - DNA, 14 bp, Homo sapiens
ataactgaaaatta

SEQ ID NO: 4547944 - DNA, 17 bp, Homo sapiens
ataactgaaaattattt

SEQ ID NO: 4547945 - DNA, 20 bp, Homo sapiens
ataactgaaaattatttaaa

SEQ ID NO: 4547946 - DNA, 13 bp, Homo sapiens
ataactgatttct

SEQ ID NO: 4547947 - DNA, 16 bp, Homo sapiens
ataactgatttctatg

SEQ ID NO: 4547948 - DNA, 12 bp, Homo sapiens
ataactgtcttg

SEQ ID NO: 4547949 - DNA, 20 bp, Homo sapiens
ataactgtttatatgtgttg

SEQ ID NO: 4547950 - DNA, 21 bp, Homo sapiens
ataactgtttatatgtgttga

SEQ ID NO: 4547951 - DNA, 18 bp, Homo sapiens
ataacttattgctgattt

SEQ ID NO: 4547952 - DNA, 16 bp, Homo sapiens
ataacttcaaattttt

SEQ ID NO: 4547953 - DNA, 16 bp, Homo sapiens
ataacttcttgaaaaa

SEQ ID NO: 4547954 - DNA, 12 bp, Homo sapiens
ataacttgtaag

SEQ ID NO: 4547955 - DNA, 20 bp, Homo sapiens
ataacttttttgagtcattg

SEQ ID NO: 4547956 - DNA, 14 bp, Homo sapiens
ataagaaaagtaat

SEQ ID NO: 4547957 - DNA, 13 bp, Homo sapiens
ataagaaactttt

SEQ ID NO: 4547958 - DNA, 14 bp, Homo sapiens
ataagaaacttttt

SEQ ID NO: 4547959 - DNA, 13 bp, Homo sapiens
ataagaacagatc

SEQ ID NO: 4547960 - DNA, 15 bp, Homo sapiens
ataagaagaatgctt

SEQ ID NO: 4547961 - DNA, 23 bp, Homo sapiens
ataagaagcaatctttgaaataa

SEQ ID NO: 4547962 - DNA, 18 bp, Homo sapiens
ataagaaggcaattttag

SEQ ID NO: 4547963 - DNA, 17 bp, Homo sapiens
ataagaattattttgat

SEQ ID NO: 4547964 - DNA, 21 bp, Homo sapiens
ataagacaatagtatttctcc

SEQ ID NO: 4547965 - DNA, 21 bp, Homo sapiens
ataagagaaagaggccagaca

SEQ ID NO: 4547966 - DNA, 17 bp, Homo sapiens
ataagagggctttttaa

SEQ ID NO: 4547967 - DNA, 16 bp, Homo sapiens
ataagagtagaaactg

SEQ ID NO: 4547968 - DNA, 13 bp, Homo sapiens
ataagataaaata

SEQ ID NO: 4547969 - DNA, 16 bp, Homo sapiens
ataagattaataagat

SEQ ID NO: 4547970 - DNA, 12 bp, Homo sapiens
ataagattccaa

SEQ ID NO: 4547971 - DNA, 19 bp, Homo sapiens
ataagattccaaaaagcac

SEQ ID NO: 4547972 - DNA, 13 bp, Homo sapiens
ataagatttttca

SEQ ID NO: 4547973 - DNA, 17 bp, Homo sapiens
ataagatttttcaaaat

SEQ ID NO: 4547974 - DNA, 19 bp, Homo sapiens
ataagcagaacatactgtt

SEQ ID NO: 4547975 - DNA, 21 bp, Homo sapiens
ataagccagacatcaacagat

SEQ ID NO: 4547976 - DNA, 22 bp, Homo sapiens
ataagccagacatcaacagata

SEQ ID NO: 4547977 - DNA, 14 bp, Homo sapiens
ataagctactgcca

SEQ ID NO: 4547978 - DNA, 20 bp, Homo sapiens
ataagctatccgtgttgcag

SEQ ID NO: 4547979 - DNA, 17 bp, Homo sapiens
ataagcttggtgacaaa

SEQ ID NO: 4547980 - DNA, 13 bp, Homo sapiens
ataaggaaaagct

SEQ ID NO: 4547981 - DNA, 18 bp, Homo sapiens
ataaggaaagcaataaat

SEQ ID NO: 4547982 - DNA, 11 bp, Homo sapiens
ataaggactgc

SEQ ID NO: 4547983 - DNA, 16 bp, Homo sapiens
ataaggactttttgat

SEQ ID NO: 4547984 - DNA, 13 bp, Homo sapiens
ataaggatgactt

SEQ ID NO: 4547985 - DNA, 15 bp, Homo sapiens
ataaggatgactttt

SEQ ID NO: 4547986 - DNA, 19 bp, Homo sapiens
ataaggattctgaagtttt

SEQ ID NO: 4547987 - DNA, 13 bp, Homo sapiens
ataagggaaaaga

SEQ ID NO: 4547988 - DNA, 15 bp, Homo sapiens
ataagggaaaagata

SEQ ID NO: 4547989 - DNA, 23 bp, Homo sapiens
ataagtaaagtgattaaagtgct

SEQ ID NO: 4547990 - DNA, 15 bp, Homo sapiens
ataagtaatatcttt

SEQ ID NO: 4547991 - DNA, 17 bp, Homo sapiens
ataagtagcattcatgt

SEQ ID NO: 4547992 - DNA, 20 bp, Homo sapiens
ataagtctacattaaacaat

SEQ ID NO: 4547993 - DNA, 18 bp, Homo sapiens
ataagtgaagggaaagat

SEQ ID NO: 4547994 - DNA, 19 bp, Homo sapiens
ataagtgaggaagagttta

SEQ ID NO: 4547995 - DNA, 13 bp, Homo sapiens
ataagttattgca

SEQ ID NO: 4547996 - DNA, 14 bp, Homo sapiens
ataagttattgcag

SEQ ID NO: 4547997 - DNA, 24 bp, Homo sapiens
ataagttcaaattcttctgaactc

SEQ ID NO: 4547998 - DNA, 14 bp, Homo sapiens
ataagttcctatac

SEQ ID NO: 4547999 - DNA, 15 bp, Homo sapiens
ataagttgaccttta

SEQ ID NO: 4548000 - DNA, 13 bp, Homo sapiens
ataagttgctgta

SEQ ID NO: 4548001 - DNA, 16 bp, Homo sapiens
ataagttgctgtaaaa

SEQ ID NO: 4548002 - DNA, 18 bp, Homo sapiens
ataagtttctttgcttca

SEQ ID NO: 4548003 - DNA, 12 bp, Homo sapiens
ataataaagtat

SEQ ID NO: 4548004 - DNA, 23 bp, Homo sapiens
ataataaagtattccaccttaaa

SEQ ID NO: 4548005 - DNA, 13 bp, Homo sapiens
ataataaattttc

SEQ ID NO: 4548006 - DNA, 15 bp, Homo sapiens
ataataaattttcta

SEQ ID NO: 4548007 - DNA, 17 bp, Homo sapiens
ataataaattttctaaa

SEQ ID NO: 4548008 - DNA, 18 bp, Homo sapiens
ataataaattttctaaaa

SEQ ID NO: 4548009 - DNA, 21 bp, Homo sapiens
ataataagtgatgtgctgaat

SEQ ID NO: 4548010 - DNA, 15 bp, Homo sapiens
ataataatattgttt

SEQ ID NO: 4548011 - DNA, 14 bp, Homo sapiens
ataataatgccaat

SEQ ID NO: 4548012 - DNA, 15 bp, Homo sapiens
ataatacatactaat

SEQ ID NO: 4548013 - DNA, 19 bp, Homo sapiens
ataatactttgtatacaag

SEQ ID NO: 4548014 - DNA, 17 bp, Homo sapiens
ataatagagataagtcc

SEQ ID NO: 4548015 - DNA, 15 bp, Homo sapiens
ataatatattttctg

SEQ ID NO: 4548016 - DNA, 14 bp, Homo sapiens
ataatatctaaagt

SEQ ID NO: 4548017 - DNA, 17 bp, Homo sapiens
ataatatctaaagttat

SEQ ID NO: 4548018 - DNA, 18 bp, Homo sapiens
ataatatctaaagttata

SEQ ID NO: 4548019 - DNA, 23 bp, Homo sapiens
ataatatggaaccttccctccaa

SEQ ID NO: 4548020 - DNA, 15 bp, Homo sapiens
ataatatgtttagtt

SEQ ID NO: 4548021 - DNA, 21 bp, Homo sapiens
ataatatgtttagttttacat

SEQ ID NO: 4548022 - DNA, 18 bp, Homo sapiens
ataatattgaaaattgaa

SEQ ID NO: 4548023 - DNA, 15 bp, Homo sapiens
ataatattgtctgtc

SEQ ID NO: 4548024 - DNA, 20 bp, Homo sapiens
ataatattgtctgtctctat

SEQ ID NO: 4548025 - DNA, 14 bp, Homo sapiens
ataatatttcaagt

SEQ ID NO: 4548026 - DNA, 18 bp, Homo sapiens
ataatatttcaagtgcct

SEQ ID NO: 4548027 - DNA, 13 bp, Homo sapiens
ataatcaaatgat

SEQ ID NO: 4548028 - DNA, 16 bp, Homo sapiens
ataatcaaatgatttc

SEQ ID NO: 4548029 - DNA, 19 bp, Homo sapiens
ataatcacagttgtgttcc

SEQ ID NO: 4548030 - DNA, 15 bp, Homo sapiens
ataatcagaatatgt

SEQ ID NO: 4548031 - DNA, 15 bp, Homo sapiens
ataatcagatgctgg

SEQ ID NO: 4548032 - DNA, 14 bp, Homo sapiens
ataatcattttaga

SEQ ID NO: 4548033 - DNA, 23 bp, Homo sapiens
ataatcattttagaattaaaatt

SEQ ID NO: 4548034 - DNA, 16 bp, Homo sapiens
ataatcctagagtctt

SEQ ID NO: 4548035 - DNA, 17 bp, Homo sapiens
ataatcctagagtctta

SEQ ID NO: 4548036 - DNA, 14 bp, Homo sapiens
ataatcctgtttta

SEQ ID NO: 4548037 - DNA, 13 bp, Homo sapiens
ataatctatatta

SEQ ID NO: 4548038 - DNA, 18 bp, Homo sapiens
ataatctatattaaatga

SEQ ID NO: 4548039 - DNA, 15 bp, Homo sapiens
ataatctcctctgct

SEQ ID NO: 4548040 - DNA, 18 bp, Homo sapiens
ataatctcctctgctcat

SEQ ID NO: 4548041 - DNA, 20 bp, Homo sapiens
ataatcttctgccttctcat

SEQ ID NO: 4548042 - DNA, 22 bp, Homo sapiens
ataatgaaaataaaacacacct

SEQ ID NO: 4548043 - DNA, 16 bp, Homo sapiens
ataatgaacaaaatta

SEQ ID NO: 4548044 - DNA, 14 bp, Homo sapiens
ataatgaacaattg

SEQ ID NO: 4548045 - DNA, 16 bp, Homo sapiens
ataatgataaaacacc

SEQ ID NO: 4548046 - DNA, 15 bp, Homo sapiens
ataatgatcaaagtt

SEQ ID NO: 4548047 - DNA, 16 bp, Homo sapiens
ataatgatgatgatga

SEQ ID NO: 4548048 - DNA, 20 bp, Homo sapiens
ataatgattaagggacattt

SEQ ID NO: 4548049 - DNA, 22 bp, Homo sapiens
ataatgattaagggacatttct

SEQ ID NO: 4548050 - DNA, 19 bp, Homo sapiens
ataatgcagtatggtacat

SEQ ID NO: 4548051 - DNA, 18 bp, Homo sapiens
ataatgcatccagcagta

SEQ ID NO: 4548052 - DNA, 19 bp, Homo sapiens
ataatgccaccaaaggaga

SEQ ID NO: 4548053 - DNA, 16 bp, Homo sapiens
ataatgcctttgtaac

SEQ ID NO: 4548054 - DNA, 21 bp, Homo sapiens
ataatgcctttttggttttgt

SEQ ID NO: 4548055 - DNA, 14 bp, Homo sapiens
ataatgctttggaa

SEQ ID NO: 4548056 - DNA, 15 bp, Homo sapiens
ataatgctttggaaa

SEQ ID NO: 4548057 - DNA, 22 bp, Homo sapiens
ataatgtacagaggaagctgtt

SEQ ID NO: 4548058 - DNA, 14 bp, Homo sapiens
ataatgtatttgaa

SEQ ID NO: 4548059 - DNA, 19 bp, Homo sapiens
ataatgtctctgtgagact

SEQ ID NO: 4548060 - DNA, 12 bp, Homo sapiens
ataatgtgaaat

SEQ ID NO: 4548061 - DNA, 15 bp, Homo sapiens
ataatgtgaaatgta

SEQ ID NO: 4548062 - DNA, 11 bp, Homo sapiens
ataatgtgaac

SEQ ID NO: 4548063 - DNA, 18 bp, Homo sapiens
ataatgtgcagaaaatat

SEQ ID NO: 4548064 - DNA, 20 bp, Homo sapiens
ataatgtgtctgtgttgctt

SEQ ID NO: 4548065 - DNA, 22 bp, Homo sapiens
ataatgtgtctgtgttgcttca

SEQ ID NO: 4548066 - DNA, 20 bp, Homo sapiens
ataatgtgtgctttattgaa

SEQ ID NO: 4548067 - DNA, 14 bp, Homo sapiens
ataatgttcatttt

SEQ ID NO: 4548068 - DNA, 18 bp, Homo sapiens
ataatgttcattttgaaa

SEQ ID NO: 4548069 - DNA, 22 bp, Homo sapiens
ataatgttcattttgaaaatat

SEQ ID NO: 4548070 - DNA, 22 bp, Homo sapiens
ataatgtttaatattgagaaag

SEQ ID NO: 4548071 - DNA, 13 bp, Homo sapiens
ataattaaagact

SEQ ID NO: 4548072 - DNA, 13 bp, Homo sapiens
ataattaatgctt

SEQ ID NO: 4548073 - DNA, 14 bp, Homo sapiens
ataattaattgtca

SEQ ID NO: 4548074 - DNA, 21 bp, Homo sapiens
ataattagatccattaattta

SEQ ID NO: 4548075 - DNA, 17 bp, Homo sapiens
ataattatataactgta

SEQ ID NO: 4548076 - DNA, 14 bp, Homo sapiens
ataattatgaaaac

SEQ ID NO: 4548077 - DNA, 22 bp, Homo sapiens
ataattatttattacataattt

SEQ ID NO: 4548078 - DNA, 19 bp, Homo sapiens
ataattctacatgttgtct

SEQ ID NO: 4548079 - DNA, 15 bp, Homo sapiens
ataattctcattaaa

SEQ ID NO: 4548080 - DNA, 23 bp, Homo sapiens
ataattctcattaaaagaatatc

SEQ ID NO: 4548081 - DNA, 15 bp, Homo sapiens
ataattctgaaacaa

SEQ ID NO: 4548082 - DNA, 13 bp, Homo sapiens
ataattcttcctt

SEQ ID NO: 4548083 - DNA, 15 bp, Homo sapiens
ataattgcatgaaaa

SEQ ID NO: 4548084 - DNA, 22 bp, Homo sapiens
ataattggttattaaactgaat

SEQ ID NO: 4548085 - DNA, 17 bp, Homo sapiens
ataattggtttgactgt

SEQ ID NO: 4548086 - DNA, 22 bp, Homo sapiens
ataattgtgtaccttaagatat

SEQ ID NO: 4548087 - DNA, 23 bp, Homo sapiens
ataattgtgtaccttaagatatt

SEQ ID NO: 4548088 - DNA, 15 bp, Homo sapiens
ataattgttctcaga

SEQ ID NO: 4548089 - DNA, 23 bp, Homo sapiens
ataattgttctcagaatccctta

SEQ ID NO: 4548090 - DNA, 13 bp, Homo sapiens
ataatttaatgta

SEQ ID NO: 4548091 - DNA, 15 bp, Homo sapiens
ataatttaatgtaaa

SEQ ID NO: 4548092 - DNA, 18 bp, Homo sapiens
ataatttaatgtaaataa

SEQ ID NO: 4548093 - DNA, 19 bp, Homo sapiens
ataatttaatgtaaataaa

SEQ ID NO: 4548094 - DNA, 20 bp, Homo sapiens
ataatttaatgtaaataaaa

SEQ ID NO: 4548095 - DNA, 17 bp, Homo sapiens
ataatttacaagatatt

SEQ ID NO: 4548096 - DNA, 23 bp, Homo sapiens
ataatttacctaagattacaaat

SEQ ID NO: 4548097 - DNA, 20 bp, Homo sapiens
ataatttcagttattttgct

SEQ ID NO: 4548098 - DNA, 13 bp, Homo sapiens
ataatttctgttt

SEQ ID NO: 4548099 - DNA, 13 bp, Homo sapiens
ataatttgtttcc

SEQ ID NO: 4548100 - DNA, 14 bp, Homo sapiens
ataatttgtttcca

SEQ ID NO: 4548101 - DNA, 15 bp, Homo sapiens
ataattttattacat

SEQ ID NO: 4548102 - DNA, 12 bp, Homo sapiens
ataattttgcaa

SEQ ID NO: 4548103 - DNA, 18 bp, Homo sapiens
ataattttttttaaaata

SEQ ID NO: 4548104 - DNA, 22 bp, Homo sapiens
atacaaaaaaaaaaaaaaatta

SEQ ID NO: 4548105 - DNA, 16 bp, Homo sapiens
atacaaaagagcatgg

SEQ ID NO: 4548106 - DNA, 18 bp, Homo sapiens
atacaaaatatttaagtg

SEQ ID NO: 4548107 - DNA, 16 bp, Homo sapiens
atacaaacaatctctt

SEQ ID NO: 4548108 - DNA, 19 bp, Homo sapiens
atacaaagttagagaacta

SEQ ID NO: 4548109 - DNA, 23 bp, Homo sapiens
atacaaattggttggttttgact

SEQ ID NO: 4548110 - DNA, 16 bp, Homo sapiens
atacaaatttataaag

SEQ ID NO: 4548111 - DNA, 19 bp, Homo sapiens
atacaaatttggccttaag

SEQ ID NO: 4548112 - DNA, 23 bp, Homo sapiens
atacaaatttggccttaagaact

SEQ ID NO: 4548113 - DNA, 23 bp, Homo sapiens
atacaacctaacttatggactgt

SEQ ID NO: 4548114 - DNA, 18 bp, Homo sapiens
atacaaccttcatttaaa

SEQ ID NO: 4548115 - DNA, 19 bp, Homo sapiens
atacaaccttcatttaaaa

SEQ ID NO: 4548116 - DNA, 16 bp, Homo sapiens
atacaacttaaataat

SEQ ID NO: 4548117 - DNA, 16 bp, Homo sapiens
atacaagcaagcaaaa

SEQ ID NO: 4548118 - DNA, 22 bp, Homo sapiens
atacaaggcccagaagcctgat

SEQ ID NO: 4548119 - DNA, 17 bp, Homo sapiens
atacaataaattgctaa

SEQ ID NO: 4548120 - DNA, 16 bp, Homo sapiens
atacaataattgaagt

SEQ ID NO: 4548121 - DNA, 13 bp, Homo sapiens
atacaatgcactt

SEQ ID NO: 4548122 - DNA, 12 bp, Homo sapiens
atacaatgtaca

SEQ ID NO: 4548123 - DNA, 15 bp, Homo sapiens
atacaatgtatgtac

SEQ ID NO: 4548124 - DNA, 18 bp, Homo sapiens
atacaatgtatgtacaat

SEQ ID NO: 4548125 - DNA, 17 bp, Homo sapiens
atacacactcaaatcaa

SEQ ID NO: 4548126 - DNA, 23 bp, Homo sapiens
atacacatagttctgtaataaaa

SEQ ID NO: 4548127 - DNA, 20 bp, Homo sapiens
atacacatttttaaaacaac

SEQ ID NO: 4548128 - DNA, 22 bp, Homo sapiens
atacaccagaagacaaacaata

SEQ ID NO: 4548129 - DNA, 18 bp, Homo sapiens
atacactgcactttgttt

SEQ ID NO: 4548130 - DNA, 17 bp, Homo sapiens
atacactttgttgcaag

SEQ ID NO: 4548131 - DNA, 23 bp, Homo sapiens
atacagaactctttcaaaacctt

SEQ ID NO: 4548132 - DNA, 18 bp, Homo sapiens
atacagaggtaactatca

SEQ ID NO: 4548133 - DNA, 14 bp, Homo sapiens
atacaggaaacagt

SEQ ID NO: 4548134 - DNA, 15 bp, Homo sapiens
atacaggaacaacat

SEQ ID NO: 4548135 - DNA, 17 bp, Homo sapiens
atacaggaggatgtgaa

SEQ ID NO: 4548136 - DNA, 19 bp, Homo sapiens
atacaggggaggggcgcac

SEQ ID NO: 4548137 - DNA, 23 bp, Homo sapiens
atacagtacggatttgtccaaat

SEQ ID NO: 4548138 - DNA, 23 bp, Homo sapiens
atacagtattatagacaaaagaa

SEQ ID NO: 4548139 - DNA, 22 bp, Homo sapiens
atacagtcttccacaaagaaaa

SEQ ID NO: 4548140 - DNA, 17 bp, Homo sapiens
atacagttataaaatta

SEQ ID NO: 4548141 - DNA, 18 bp, Homo sapiens
atacagttataaaattaa

SEQ ID NO: 4548142 - DNA, 17 bp, Homo sapiens
atacagtttgacttttt

SEQ ID NO: 4548143 - DNA, 15 bp, Homo sapiens
atacagttttaaaga

SEQ ID NO: 4548144 - DNA, 14 bp, Homo sapiens
atacagttttcatt

SEQ ID NO: 4548145 - DNA, 14 bp, Homo sapiens
atacataaactgtc

SEQ ID NO: 4548146 - DNA, 13 bp, Homo sapiens
atacataatacaa

SEQ ID NO: 4548147 - DNA, 22 bp, Homo sapiens
atacataatgggccactgaaat

SEQ ID NO: 4548148 - DNA, 15 bp, Homo sapiens
atacatatgagaata

SEQ ID NO: 4548149 - DNA, 22 bp, Homo sapiens
atacatattgtatatatattca

SEQ ID NO: 4548150 - DNA, 15 bp, Homo sapiens
atacatcaacaagaa

SEQ ID NO: 4548151 - DNA, 17 bp, Homo sapiens
atacatcacatcttatt

SEQ ID NO: 4548152 - DNA, 13 bp, Homo sapiens
atacatgagaaag

SEQ ID NO: 4548153 - DNA, 15 bp, Homo sapiens
atacatgatacattt

SEQ ID NO: 4548154 - DNA, 15 bp, Homo sapiens
atacatgcacagtca

SEQ ID NO: 4548155 - DNA, 16 bp, Homo sapiens
atacatgcacagtcat

SEQ ID NO: 4548156 - DNA, 21 bp, Homo sapiens
atacattgtattaataccaaa

SEQ ID NO: 4548157 - DNA, 22 bp, Homo sapiens
atacattgtcttgatgtttttt

SEQ ID NO: 4548158 - DNA, 20 bp, Homo sapiens
atacatttgtggtcacatgc

SEQ ID NO: 4548159 - DNA, 12 bp, Homo sapiens
atacattttata

SEQ ID NO: 4548160 - DNA, 12 bp, Homo sapiens
atacatttttat

SEQ ID NO: 4548161 - DNA, 17 bp, Homo sapiens
ataccaaattaaaaaaa

SEQ ID NO: 4548162 - DNA, 19 bp, Homo sapiens
ataccaatgtgttttctgt

SEQ ID NO: 4548163 - DNA, 20 bp, Homo sapiens
ataccaatgtgttttctgta

SEQ ID NO: 4548164 - DNA, 20 bp, Homo sapiens
ataccacaagcctgagaact

SEQ ID NO: 4548165 - DNA, 16 bp, Homo sapiens
ataccacccatagtgc

SEQ ID NO: 4548166 - DNA, 17 bp, Homo sapiens
ataccagcttaatagct

SEQ ID NO: 4548167 - DNA, 17 bp, Homo sapiens
ataccccaagactccca

SEQ ID NO: 4548168 - DNA, 19 bp, Homo sapiens
ataccccaagactcccatg

SEQ ID NO: 4548169 - DNA, 18 bp, Homo sapiens
ataccccttacaaatgaa

SEQ ID NO: 4548170 - DNA, 15 bp, Homo sapiens
atacctcaccctgct

SEQ ID NO: 4548171 - DNA, 17 bp, Homo sapiens
atacctcaggaaagaat

SEQ ID NO: 4548172 - DNA, 13 bp, Homo sapiens
atacctgcctttt

SEQ ID NO: 4548173 - DNA, 15 bp, Homo sapiens
ataccttatttattt

SEQ ID NO: 4548174 - DNA, 20 bp, Homo sapiens
ataccttcggggtacaagtc

SEQ ID NO: 4548175 - DNA, 15 bp, Homo sapiens
ataccttctatgtat

SEQ ID NO: 4548176 - DNA, 22 bp, Homo sapiens
ataccttctatgtattagtgtc

SEQ ID NO: 4548177 - DNA, 14 bp, Homo sapiens
atacgctaataagt

SEQ ID NO: 4548178 - DNA, 23 bp, Homo sapiens
atacgctaataagtgacaaataa

SEQ ID NO: 4548179 - DNA, 21 bp, Homo sapiens
atacgctcagctcatccatgc

SEQ ID NO: 4548180 - DNA, 18 bp, Homo sapiens
atacgtataaatatcagt

SEQ ID NO: 4548181 - DNA, 18 bp, Homo sapiens
atactaaaccaactctaa

SEQ ID NO: 4548182 - DNA, 19 bp, Homo sapiens
atactaaaccaactctaat

SEQ ID NO: 4548183 - DNA, 20 bp, Homo sapiens
atactaaaccaactctaata

SEQ ID NO: 4548184 - DNA, 17 bp, Homo sapiens
atactaagcattgaatg

SEQ ID NO: 4548185 - DNA, 12 bp, Homo sapiens
atactacaatag

SEQ ID NO: 4548186 - DNA, 14 bp, Homo sapiens
atactaccttgaaa

SEQ ID NO: 4548187 - DNA, 18 bp, Homo sapiens
atactatgcagtatctct

SEQ ID NO: 4548188 - DNA, 19 bp, Homo sapiens
atactatgcagtatctctt

SEQ ID NO: 4548189 - DNA, 17 bp, Homo sapiens
atactatggaatttctc

SEQ ID NO: 4548190 - DNA, 17 bp, Homo sapiens
atactcatttttcatga

SEQ ID NO: 4548191 - DNA, 13 bp, Homo sapiens
atactcctgggct

SEQ ID NO: 4548192 - DNA, 21 bp, Homo sapiens
atactcctgtcacctagaacg

SEQ ID NO: 4548193 - DNA, 17 bp, Homo sapiens
atactctagatgaagtt

SEQ ID NO: 4548194 - DNA, 16 bp, Homo sapiens
atactctttctgtata

SEQ ID NO: 4548195 - DNA, 15 bp, Homo sapiens
atactgaaggaaaaa

SEQ ID NO: 4548196 - DNA, 22 bp, Homo sapiens
atactgaaggaaaaacacaagc

SEQ ID NO: 4548197 - DNA, 15 bp, Homo sapiens
atactgacagaagtt

SEQ ID NO: 4548198 - DNA, 13 bp, Homo sapiens
atactgagaacct

SEQ ID NO: 4548199 - DNA, 17 bp, Homo sapiens
atactgagaatatacaa

SEQ ID NO: 4548200 - DNA, 21 bp, Homo sapiens
atactgagcttttgagtgttc

SEQ ID NO: 4548201 - DNA, 13 bp, Homo sapiens
atactgattatga

SEQ ID NO: 4548202 - DNA, 15 bp, Homo sapiens
atactgattatgaaa

SEQ ID NO: 4548203 - DNA, 18 bp, Homo sapiens
atactgccttgtttaatg

SEQ ID NO: 4548204 - DNA, 23 bp, Homo sapiens
atactgggacaccattaccaaaa

SEQ ID NO: 4548205 - DNA, 23 bp, Homo sapiens
atactggggagtaaacggcccag

SEQ ID NO: 4548206 - DNA, 13 bp, Homo sapiens
atactgtacaata

SEQ ID NO: 4548207 - DNA, 12 bp, Homo sapiens
atactgtacaca

SEQ ID NO: 4548208 - DNA, 14 bp, Homo sapiens
atactgtacacatt

SEQ ID NO: 4548209 - DNA, 17 bp, Homo sapiens
atactgtacacatttct

SEQ ID NO: 4548210 - DNA, 18 bp, Homo sapiens
atactgtacacatttctt

SEQ ID NO: 4548211 - DNA, 19 bp, Homo sapiens
atactgtacacatttctta

SEQ ID NO: 4548212 - DNA, 21 bp, Homo sapiens
atactgtacacatttcttaaa

SEQ ID NO: 4548213 - DNA, 19 bp, Homo sapiens
atactgtatattcaggact

SEQ ID NO: 4548214 - DNA, 14 bp, Homo sapiens
atactgtgaaatac

SEQ ID NO: 4548215 - DNA, 16 bp, Homo sapiens
atactgtgcaggcctg

SEQ ID NO: 4548216 - DNA, 22 bp, Homo sapiens
atacttaaaaaatcctgcccaa

SEQ ID NO: 4548217 - DNA, 20 bp, Homo sapiens
atacttatctctctgtgctg

SEQ ID NO: 4548218 - DNA, 17 bp, Homo sapiens
atacttattattttgca

SEQ ID NO: 4548219 - DNA, 16 bp, Homo sapiens
atacttctcatttttt

SEQ ID NO: 4548220 - DNA, 19 bp, Homo sapiens
atacttctttgttattata

SEQ ID NO: 4548221 - DNA, 22 bp, Homo sapiens
atacttctttgttattataaca

SEQ ID NO: 4548222 - DNA, 16 bp, Homo sapiens
atacttctttttcatt

SEQ ID NO: 4548223 - DNA, 18 bp, Homo sapiens
atacttgaaaccagtatt

SEQ ID NO: 4548224 - DNA, 20 bp, Homo sapiens
atacttgaaaccagtattta

SEQ ID NO: 4548225 - DNA, 12 bp, Homo sapiens
atacttgaactt

SEQ ID NO: 4548226 - DNA, 13 bp, Homo sapiens
atacttgaacttg

SEQ ID NO: 4548227 - DNA, 17 bp, Homo sapiens
atacttgaagaaacaga

SEQ ID NO: 4548228 - DNA, 16 bp, Homo sapiens
atacttgactctaata

SEQ ID NO: 4548229 - DNA, 19 bp, Homo sapiens
atacttgagaccaactttt

SEQ ID NO: 4548230 - DNA, 23 bp, Homo sapiens
atacttgcagctcccattctatg

SEQ ID NO: 4548231 - DNA, 16 bp, Homo sapiens
atacttggatttagtt

SEQ ID NO: 4548232 - DNA, 16 bp, Homo sapiens
atactttacagtaaaa

SEQ ID NO: 4548233 - DNA, 20 bp, Homo sapiens
atactttagtacaatttcaa

SEQ ID NO: 4548234 - DNA, 20 bp, Homo sapiens
atactttagtagacatttat

SEQ ID NO: 4548235 - DNA, 13 bp, Homo sapiens
atactttatatct

SEQ ID NO: 4548236 - DNA, 17 bp, Homo sapiens
atactttatatctgtaa

SEQ ID NO: 4548237 - DNA, 21 bp, Homo sapiens
atactttatatctgtaatgat

SEQ ID NO: 4548238 - DNA, 21 bp, Homo sapiens
atactttatcaatgtgtcttt

SEQ ID NO: 4548239 - DNA, 13 bp, Homo sapiens
atactttattgaa

SEQ ID NO: 4548240 - DNA, 14 bp, Homo sapiens
atactttattgaaa

SEQ ID NO: 4548241 - DNA, 13 bp, Homo sapiens
atactttatttct

SEQ ID NO: 4548242 - DNA, 16 bp, Homo sapiens
atactttgagttttga

SEQ ID NO: 4548243 - DNA, 16 bp, Homo sapiens
atactttgcattgtct

SEQ ID NO: 4548244 - DNA, 14 bp, Homo sapiens
atactttgtaaata

SEQ ID NO: 4548245 - DNA, 14 bp, Homo sapiens
atactttttatcac

SEQ ID NO: 4548246 - DNA, 13 bp, Homo sapiens
atactttttctaa

SEQ ID NO: 4548247 - DNA, 17 bp, Homo sapiens
atactttttctaatgag

SEQ ID NO: 4548248 - DNA, 12 bp, Homo sapiens
atagaaaaatgt

SEQ ID NO: 4548249 - DNA, 21 bp, Homo sapiens
atagaaaacaggaaaaaaact

SEQ ID NO: 4548250 - DNA, 13 bp, Homo sapiens
atagaaaagttat

SEQ ID NO: 4548251 - DNA, 21 bp, Homo sapiens
atagaaacgtaaactatgacc

SEQ ID NO: 4548252 - DNA, 18 bp, Homo sapiens
atagaaacttcatggttt

SEQ ID NO: 4548253 - DNA, 23 bp, Homo sapiens
atagaaagaaactaaacagaaaa

SEQ ID NO: 4548254 - DNA, 13 bp, Homo sapiens
atagaaagaaagt

SEQ ID NO: 4548255 - DNA, 15 bp, Homo sapiens
atagaaagaagccat

SEQ ID NO: 4548256 - DNA, 15 bp, Homo sapiens
atagaaagagttcta

SEQ ID NO: 4548257 - DNA, 13 bp, Homo sapiens
atagaaatgctgg

SEQ ID NO: 4548258 - DNA, 20 bp, Homo sapiens
atagaaatggaaattttgct

SEQ ID NO: 4548259 - DNA, 16 bp, Homo sapiens
atagaaattttgtaag

SEQ ID NO: 4548260 - DNA, 17 bp, Homo sapiens
atagaacattgatctgt

SEQ ID NO: 4548261 - DNA, 19 bp, Homo sapiens
atagaagcttcagcaggag

SEQ ID NO: 4548262 - DNA, 19 bp, Homo sapiens
atagaaggctatggggata

SEQ ID NO: 4548263 - DNA, 13 bp, Homo sapiens
atagaaggtgatg

SEQ ID NO: 4548264 - DNA, 17 bp, Homo sapiens
atagaataaaggcagtt

SEQ ID NO: 4548265 - DNA, 19 bp, Homo sapiens
atagaataaaggcagtttt

SEQ ID NO: 4548266 - DNA, 22 bp, Homo sapiens
atagaataaaggcagttttcta

SEQ ID NO: 4548267 - DNA, 15 bp, Homo sapiens
atagaatttcctgta

SEQ ID NO: 4548268 - DNA, 21 bp, Homo sapiens
atagaatttcctgtaatatat

SEQ ID NO: 4548269 - DNA, 16 bp, Homo sapiens
atagacaattcctcca

SEQ ID NO: 4548270 - DNA, 14 bp, Homo sapiens
atagacagaagaaa

SEQ ID NO: 4548271 - DNA, 22 bp, Homo sapiens
atagaccttttttttttttcca

SEQ ID NO: 4548272 - DNA, 12 bp, Homo sapiens
atagagaatgtt

SEQ ID NO: 4548273 - DNA, 14 bp, Homo sapiens
atagagaatgttcc

SEQ ID NO: 4548274 - DNA, 20 bp, Homo sapiens
atagagatatttttgtacgt

SEQ ID NO: 4548275 - DNA, 20 bp, Homo sapiens
atagagctccatttcccctc

SEQ ID NO: 4548276 - DNA, 14 bp, Homo sapiens
atagagctgtatta

SEQ ID NO: 4548277 - DNA, 12 bp, Homo sapiens
atagaggctagc

SEQ ID NO: 4548278 - DNA, 19 bp, Homo sapiens
atagaggctagcttctgct

SEQ ID NO: 4548279 - DNA, 23 bp, Homo sapiens
atagaggcttctccgccagcctc

SEQ ID NO: 4548280 - DNA, 14 bp, Homo sapiens
atagataaccaatt

SEQ ID NO: 4548281 - DNA, 20 bp, Homo sapiens
atagataaccaattttcaga

SEQ ID NO: 4548282 - DNA, 23 bp, Homo sapiens
atagatataatgaacaaaattat

SEQ ID NO: 4548283 - DNA, 18 bp, Homo sapiens
atagatgataaaagagaa

SEQ ID NO: 4548284 - DNA, 14 bp, Homo sapiens
atagatgtctttta

SEQ ID NO: 4548285 - DNA, 15 bp, Homo sapiens
atagatgtcttttat

SEQ ID NO: 4548286 - DNA, 16 bp, Homo sapiens
atagatgtcttttata

SEQ ID NO: 4548287 - DNA, 20 bp, Homo sapiens
atagatgtcttttatagtgg

SEQ ID NO: 4548288 - DNA, 13 bp, Homo sapiens
atagatgtgtgga

SEQ ID NO: 4548289 - DNA, 18 bp, Homo sapiens
atagattcacctgtaaaa

SEQ ID NO: 4548290 - DNA, 21 bp, Homo sapiens
atagattcacctgtaaaactt

SEQ ID NO: 4548291 - DNA, 23 bp, Homo sapiens
atagattcacctgtaaaacttta

SEQ ID NO: 4548292 - DNA, 14 bp, Homo sapiens
atagattgtcttaa

SEQ ID NO: 4548293 - DNA, 21 bp, Homo sapiens
atagcaaaaatgttttccaat

SEQ ID NO: 4548294 - DNA, 15 bp, Homo sapiens
atagcaaaagaagaa

SEQ ID NO: 4548295 - DNA, 15 bp, Homo sapiens
atagcaaagaattga

SEQ ID NO: 4548296 - DNA, 17 bp, Homo sapiens
atagcaacaacaattgg

SEQ ID NO: 4548297 - DNA, 18 bp, Homo sapiens
atagcaacaacaattggt

SEQ ID NO: 4548298 - DNA, 18 bp, Homo sapiens
atagcaagacctcatctc

SEQ ID NO: 4548299 - DNA, 15 bp, Homo sapiens
atagcaataactgaa

SEQ ID NO: 4548300 - DNA, 16 bp, Homo sapiens
atagcaataactgaaa

SEQ ID NO: 4548301 - DNA, 17 bp, Homo sapiens
atagcaatgtaaaaatg

SEQ ID NO: 4548302 - DNA, 18 bp, Homo sapiens
atagcacccctactcaca

SEQ ID NO: 4548303 - DNA, 17 bp, Homo sapiens
atagcagacattgttac

SEQ ID NO: 4548304 - DNA, 15 bp, Homo sapiens
atagcagcttattca

SEQ ID NO: 4548305 - DNA, 18 bp, Homo sapiens
atagcagttataacagat

SEQ ID NO: 4548306 - DNA, 19 bp, Homo sapiens
atagcagttataacagatg

SEQ ID NO: 4548307 - DNA, 22 bp, Homo sapiens
atagcagttataacagatgtga

SEQ ID NO: 4548308 - DNA, 15 bp, Homo sapiens
atagccaaaaatagc

SEQ ID NO: 4548309 - DNA, 16 bp, Homo sapiens
atagccaaaaatagct

SEQ ID NO: 4548310 - DNA, 18 bp, Homo sapiens
atagccaaaaatagctaa

SEQ ID NO: 4548311 - DNA, 21 bp, Homo sapiens
atagccacatttggaatactt

SEQ ID NO: 4548312 - DNA, 18 bp, Homo sapiens
atagccctgccctcccaa

SEQ ID NO: 4548313 - DNA, 18 bp, Homo sapiens
atagccgggcatggtggc

SEQ ID NO: 4548314 - DNA, 12 bp, Homo sapiens
atagcggccctg

SEQ ID NO: 4548315 - DNA, 13 bp, Homo sapiens
atagcggccctgg

SEQ ID NO: 4548316 - DNA, 15 bp, Homo sapiens
atagcggccctggag

SEQ ID NO: 4548317 - DNA, 15 bp, Homo sapiens
atagcgtgtgtagat

SEQ ID NO: 4548318 - DNA, 16 bp, Homo sapiens
atagctaactgtaaat

SEQ ID NO: 4548319 - DNA, 13 bp, Homo sapiens
atagctaagtaca

SEQ ID NO: 4548320 - DNA, 14 bp, Homo sapiens
atagctaagtacac

SEQ ID NO: 4548321 - DNA, 18 bp, Homo sapiens
atagctaagtacacaata

SEQ ID NO: 4548322 - DNA, 15 bp, Homo sapiens
atagctacaggaagc

SEQ ID NO: 4548323 - DNA, 19 bp, Homo sapiens
atagctcactgcagcctca

SEQ ID NO: 4548324 - DNA, 19 bp, Homo sapiens
atagctctggggtgggcag

SEQ ID NO: 4548325 - DNA, 12 bp, Homo sapiens
atagctgctgcc

SEQ ID NO: 4548326 - DNA, 16 bp, Homo sapiens
atagctggcaagaatg

SEQ ID NO: 4548327 - DNA, 15 bp, Homo sapiens
atagctgtacttctt

SEQ ID NO: 4548328 - DNA, 22 bp, Homo sapiens
atagctgtacttcttgaatata

SEQ ID NO: 4548329 - DNA, 22 bp, Homo sapiens
atagcttgtcttcgtccatctg

SEQ ID NO: 4548330 - DNA, 23 bp, Homo sapiens
atagctttgtatttttgtcattg

SEQ ID NO: 4548331 - DNA, 16 bp, Homo sapiens
ataggaacatatgaaa

SEQ ID NO: 4548332 - DNA, 21 bp, Homo sapiens
ataggaattgacccacaagaa

SEQ ID NO: 4548333 - DNA, 12 bp, Homo sapiens
ataggagcctgc

SEQ ID NO: 4548334 - DNA, 16 bp, Homo sapiens
ataggagcctgctggt

SEQ ID NO: 4548335 - DNA, 17 bp, Homo sapiens
ataggagggaaaccttt

SEQ ID NO: 4548336 - DNA, 16 bp, Homo sapiens
ataggatttttagaat

SEQ ID NO: 4548337 - DNA, 14 bp, Homo sapiens
ataggcaaattaat

SEQ ID NO: 4548338 - DNA, 14 bp, Homo sapiens
ataggcagggggcc

SEQ ID NO: 4548339 - DNA, 16 bp, Homo sapiens
ataggcagggggccct

SEQ ID NO: 4548340 - DNA, 20 bp, Homo sapiens
ataggcagggggccctgccc

SEQ ID NO: 4548341 - DNA, 15 bp, Homo sapiens
ataggcctgtccctt

SEQ ID NO: 4548342 - DNA, 18 bp, Homo sapiens
ataggcctgtcccttgcc

SEQ ID NO: 4548343 - DNA, 20 bp, Homo sapiens
ataggcctgtcccttgcctc

SEQ ID NO: 4548344 - DNA, 22 bp, Homo sapiens
ataggcctgtcccttgcctctg

SEQ ID NO: 4548345 - DNA, 18 bp, Homo sapiens
ataggctattaaaaaagt

SEQ ID NO: 4548346 - DNA, 15 bp, Homo sapiens
ataggggagccaagg

SEQ ID NO: 4548347 - DNA, 14 bp, Homo sapiens
atagggtctaactc

SEQ ID NO: 4548348 - DNA, 22 bp, Homo sapiens
ataggtgtccagcattgctgga

SEQ ID NO: 4548349 - DNA, 14 bp, Homo sapiens
ataggttatatgca

SEQ ID NO: 4548350 - DNA, 12 bp, Homo sapiens
ataggtttctaa

SEQ ID NO: 4548351 - DNA, 18 bp, Homo sapiens
atagtaaactaaagtatg

SEQ ID NO: 4548352 - DNA, 13 bp, Homo sapiens
atagtaaatcacg

SEQ ID NO: 4548353 - DNA, 21 bp, Homo sapiens
atagtaactataagatacaat

SEQ ID NO: 4548354 - DNA, 19 bp, Homo sapiens
atagtaatttgtaaagttg

SEQ ID NO: 4548355 - DNA, 22 bp, Homo sapiens
atagtactagagatattttgta

SEQ ID NO: 4548356 - DNA, 23 bp, Homo sapiens
atagtactagagatattttgtaa

SEQ ID NO: 4548357 - DNA, 13 bp, Homo sapiens
atagtactattac

SEQ ID NO: 4548358 - DNA, 18 bp, Homo sapiens
atagtactctttgtagca

SEQ ID NO: 4548359 - DNA, 14 bp, Homo sapiens
atagtatacattgt

SEQ ID NO: 4548360 - DNA, 15 bp, Homo sapiens
atagtatacattgtc

SEQ ID NO: 4548361 - DNA, 12 bp, Homo sapiens
atagtattccat

SEQ ID NO: 4548362 - DNA, 19 bp, Homo sapiens
atagtatttctcctttgca

SEQ ID NO: 4548363 - DNA, 20 bp, Homo sapiens
atagtatttgattcaaaata

SEQ ID NO: 4548364 - DNA, 16 bp, Homo sapiens
atagtatttttatcca

SEQ ID NO: 4548365 - DNA, 21 bp, Homo sapiens
atagtcaaaaattaaatatat

SEQ ID NO: 4548366 - DNA, 14 bp, Homo sapiens
atagtcaaagagag

SEQ ID NO: 4548367 - DNA, 15 bp, Homo sapiens
atagtcagcagcagc

SEQ ID NO: 4548368 - DNA, 19 bp, Homo sapiens
atagtcagcagcagctctg

SEQ ID NO: 4548369 - DNA, 17 bp, Homo sapiens
atagtcctttttccaat

SEQ ID NO: 4548370 - DNA, 19 bp, Homo sapiens
atagtcctttttccaatgt

SEQ ID NO: 4548371 - DNA, 16 bp, Homo sapiens
atagtctatgtgattc

SEQ ID NO: 4548372 - DNA, 15 bp, Homo sapiens
atagtcttgaaatga

SEQ ID NO: 4548373 - DNA, 18 bp, Homo sapiens
atagtgaaacatgtactt

SEQ ID NO: 4548374 - DNA, 13 bp, Homo sapiens
atagtgaagtgtt

SEQ ID NO: 4548375 - DNA, 22 bp, Homo sapiens
atagtgaagtgttaatacatca

SEQ ID NO: 4548376 - DNA, 23 bp, Homo sapiens
atagtgaagtgttaatacatcac

SEQ ID NO: 4548377 - DNA, 21 bp, Homo sapiens
atagtgagacactgtctctac

SEQ ID NO: 4548378 - DNA, 18 bp, Homo sapiens
atagtggaaaaacacatg

SEQ ID NO: 4548379 - DNA, 20 bp, Homo sapiens
atagtggaacattttcatat

SEQ ID NO: 4548380 - DNA, 21 bp, Homo sapiens
atagtggggttccatgagtta

SEQ ID NO: 4548381 - DNA, 16 bp, Homo sapiens
atagtgtaagaactgt

SEQ ID NO: 4548382 - DNA, 16 bp, Homo sapiens
atagtgtcctatgcaa

SEQ ID NO: 4548383 - DNA, 20 bp, Homo sapiens
atagtgtcctatgcaataaa

SEQ ID NO: 4548384 - DNA, 19 bp, Homo sapiens
atagtgtgctcggacacag

SEQ ID NO: 4548385 - DNA, 14 bp, Homo sapiens
atagtgttcacaaa

SEQ ID NO: 4548386 - DNA, 16 bp, Homo sapiens
atagtgttcacaaact

SEQ ID NO: 4548387 - DNA, 19 bp, Homo sapiens
atagtgttcacaaactgtg

SEQ ID NO: 4548388 - DNA, 21 bp, Homo sapiens
atagtgttcacaaactgtgaa

SEQ ID NO: 4548389 - DNA, 20 bp, Homo sapiens
atagttaaaaattaaatatt

SEQ ID NO: 4548390 - DNA, 22 bp, Homo sapiens
atagttaacatagtaagttcag

SEQ ID NO: 4548391 - DNA, 18 bp, Homo sapiens
atagttaagcaaatttca

SEQ ID NO: 4548392 - DNA, 17 bp, Homo sapiens
atagttattaaatgttt

SEQ ID NO: 4548393 - DNA, 21 bp, Homo sapiens
atagttcaggagactttacaa

SEQ ID NO: 4548394 - DNA, 16 bp, Homo sapiens
atagttctatcctttt

SEQ ID NO: 4548395 - DNA, 20 bp, Homo sapiens
atagttgcatagcagtatat

SEQ ID NO: 4548396 - DNA, 15 bp, Homo sapiens
atagttgcttttgaa

SEQ ID NO: 4548397 - DNA, 20 bp, Homo sapiens
atagttgtaccgcaatgtga

SEQ ID NO: 4548398 - DNA, 13 bp, Homo sapiens
atagtttacacac

SEQ ID NO: 4548399 - DNA, 13 bp, Homo sapiens
atagtttatctta

SEQ ID NO: 4548400 - DNA, 12 bp, Homo sapiens
atagtttatttc

SEQ ID NO: 4548401 - DNA, 15 bp, Homo sapiens
atagtttatttctgt

SEQ ID NO: 4548402 - DNA, 17 bp, Homo sapiens
atagtttatttctgtga

SEQ ID NO: 4548403 - DNA, 23 bp, Homo sapiens
atagtttggatatgtaaaacatt

SEQ ID NO: 4548404 - DNA, 21 bp, Homo sapiens
atagttttacttttaaactgt

SEQ ID NO: 4548405 - DNA, 23 bp, Homo sapiens
atagttttacttttaaactgtgt

SEQ ID NO: 4548406 - DNA, 23 bp, Homo sapiens
atagttttttctttcccatgtat

SEQ ID NO: 4548407 - DNA, 13 bp, Homo sapiens
atataaaacttaa

SEQ ID NO: 4548408 - DNA, 16 bp, Homo sapiens
atataaaagactgacc

SEQ ID NO: 4548409 - DNA, 18 bp, Homo sapiens
atataaaataaaaagtca

SEQ ID NO: 4548410 - DNA, 14 bp, Homo sapiens
atataaacatattt

SEQ ID NO: 4548411 - DNA, 14 bp, Homo sapiens
atataaagtataga

SEQ ID NO: 4548412 - DNA, 24 bp, Homo sapiens
atataaagtatcatcagtgtagaa

SEQ ID NO: 4548413 - DNA, 16 bp, Homo sapiens
atataaatatatattc

SEQ ID NO: 4548414 - DNA, 22 bp, Homo sapiens
atataaatatattttctttcta

SEQ ID NO: 4548415 - DNA, 11 bp, Homo sapiens
atataaatgtg

SEQ ID NO: 4548416 - DNA, 12 bp, Homo sapiens
atataaatgtgt

SEQ ID NO: 4548417 - DNA, 15 bp, Homo sapiens
atataaattgtacat

SEQ ID NO: 4548418 - DNA, 19 bp, Homo sapiens
atataaattgtacattttg

SEQ ID NO: 4548419 - DNA, 12 bp, Homo sapiens
atataacaaaaa

SEQ ID NO: 4548420 - DNA, 22 bp, Homo sapiens
atataacacttaggactagaag

SEQ ID NO: 4548421 - DNA, 17 bp, Homo sapiens
atataactgtcttgttt

SEQ ID NO: 4548422 - DNA, 15 bp, Homo sapiens
atataactttagaaa

SEQ ID NO: 4548423 - DNA, 22 bp, Homo sapiens
atataagaagcaatctttgaaa

SEQ ID NO: 4548424 - DNA, 16 bp, Homo sapiens
atataagactgctgca

SEQ ID NO: 4548425 - DNA, 14 bp, Homo sapiens
atataagtaaagtg

SEQ ID NO: 4548426 - DNA, 14 bp, Homo sapiens
atataagtttcttt

SEQ ID NO: 4548427 - DNA, 23 bp, Homo sapiens
atataataaagaagctactattt

SEQ ID NO: 4548428 - DNA, 16 bp, Homo sapiens
atataataatgatgat

SEQ ID NO: 4548429 - DNA, 13 bp, Homo sapiens
atataatattcag

SEQ ID NO: 4548430 - DNA, 17 bp, Homo sapiens
atataatctttcaaacc

SEQ ID NO: 4548431 - DNA, 11 bp, Homo sapiens
atataatgaac

SEQ ID NO: 4548432 - DNA, 15 bp, Homo sapiens
atataattgtactgt

SEQ ID NO: 4548433 - DNA, 21 bp, Homo sapiens
atataattgtactgtgttttt

SEQ ID NO: 4548434 - DNA, 17 bp, Homo sapiens
atataatttaatgtaaa

SEQ ID NO: 4548435 - DNA, 23 bp, Homo sapiens
atataatttaatgtaaataaaac

SEQ ID NO: 4548436 - DNA, 18 bp, Homo sapiens
atatacaagcaagcaaaa

SEQ ID NO: 4548437 - DNA, 20 bp, Homo sapiens
atatacacattagaaatatt

SEQ ID NO: 4548438 - DNA, 11 bp, Homo sapiens
atatacagttt

SEQ ID NO: 4548439 - DNA, 17 bp, Homo sapiens
atatacagtttgacttt

SEQ ID NO: 4548440 - DNA, 15 bp, Homo sapiens
atatacatattgtat

SEQ ID NO: 4548441 - DNA, 18 bp, Homo sapiens
atatacattcaaacttaa

SEQ ID NO: 4548442 - DNA, 16 bp, Homo sapiens
atataccaaattaaaa

SEQ ID NO: 4548443 - DNA, 20 bp, Homo sapiens
atataccactctttaccttt

SEQ ID NO: 4548444 - DNA, 18 bp, Homo sapiens
atataccccaaattgtgt

SEQ ID NO: 4548445 - DNA, 14 bp, Homo sapiens
atatacttgactct

SEQ ID NO: 4548446 - DNA, 17 bp, Homo sapiens
atatacttgactctaat

SEQ ID NO: 4548447 - DNA, 14 bp, Homo sapiens
atatactttgtgga

SEQ ID NO: 4548448 - DNA, 11 bp, Homo sapiens
atatacttttt

SEQ ID NO: 4548449 - DNA, 20 bp, Homo sapiens
atatacttttttttctttaa

SEQ ID NO: 4548450 - DNA, 18 bp, Homo sapiens
atatagaatttcctgtaa

SEQ ID NO: 4548451 - DNA, 21 bp, Homo sapiens
atatagagactgtgttcatgt

SEQ ID NO: 4548452 - DNA, 19 bp, Homo sapiens
atataggtttctattcttg

SEQ ID NO: 4548453 - DNA, 13 bp, Homo sapiens
atatagtgaaaaa

SEQ ID NO: 4548454 - DNA, 17 bp, Homo sapiens
atatagtgggtacatca

SEQ ID NO: 4548455 - DNA, 18 bp, Homo sapiens
atatagttttacttttaa

SEQ ID NO: 4548456 - DNA, 13 bp, Homo sapiens
atatataaagtat

SEQ ID NO: 4548457 - DNA, 14 bp, Homo sapiens
atatataatatact

SEQ ID NO: 4548458 - DNA, 17 bp, Homo sapiens
atatataatatactaaa

SEQ ID NO: 4548459 - DNA, 20 bp, Homo sapiens
atatatagctggcaagaatg

SEQ ID NO: 4548460 - DNA, 16 bp, Homo sapiens
atatatagtgaaaaat

SEQ ID NO: 4548461 - DNA, 22 bp, Homo sapiens
atatatagtgaaaaatgtcact

SEQ ID NO: 4548462 - DNA, 19 bp, Homo sapiens
atatatagtgggtacatca

SEQ ID NO: 4548463 - DNA, 12 bp, Homo sapiens
atatatataaag

SEQ ID NO: 4548464 - DNA, 14 bp, Homo sapiens
atatatataaatat

SEQ ID NO: 4548465 - DNA, 15 bp, Homo sapiens
atatatataaatata

SEQ ID NO: 4548466 - DNA, 15 bp, Homo sapiens
atatatatagtcaaa

SEQ ID NO: 4548467 - DNA, 21 bp, Homo sapiens
atatatatctgctgtccagac

SEQ ID NO: 4548468 - DNA, 17 bp, Homo sapiens
atatatcctgaaagcat

SEQ ID NO: 4548469 - DNA, 13 bp, Homo sapiens
atatatcctgtgt

SEQ ID NO: 4548470 - DNA, 15 bp, Homo sapiens
atatatcctgtgtac

SEQ ID NO: 4548471 - DNA, 24 bp, Homo sapiens
atatatctaccccagactagatgt

SEQ ID NO: 4548472 - DNA, 16 bp, Homo sapiens
atatatctagaactat

SEQ ID NO: 4548473 - DNA, 19 bp, Homo sapiens
atatatctatctatttgag

SEQ ID NO: 4548474 - DNA, 17 bp, Homo sapiens
atatatctctatttgag

SEQ ID NO: 4548475 - DNA, 17 bp, Homo sapiens
atatatcttataactgt

SEQ ID NO: 4548476 - DNA, 19 bp, Homo sapiens
atatatgaagacaataatt

SEQ ID NO: 4548477 - DNA, 18 bp, Homo sapiens
atatatgaccagaagcct

SEQ ID NO: 4548478 - DNA, 22 bp, Homo sapiens
atatatgctgtatttctttgta

SEQ ID NO: 4548479 - DNA, 15 bp, Homo sapiens
atatatggcatttgc

SEQ ID NO: 4548480 - DNA, 16 bp, Homo sapiens
atatatggcatttgca

SEQ ID NO: 4548481 - DNA, 20 bp, Homo sapiens
atatatgggggaaaattatt

SEQ ID NO: 4548482 - DNA, 15 bp, Homo sapiens
atatatgtatataca

SEQ ID NO: 4548483 - DNA, 12 bp, Homo sapiens
atatatgtattt

SEQ ID NO: 4548484 - DNA, 15 bp, Homo sapiens
atatatgtgtataca

SEQ ID NO: 4548485 - DNA, 20 bp, Homo sapiens
atatattaaaattccaaatt

SEQ ID NO: 4548486 - DNA, 12 bp, Homo sapiens
atatattatata

SEQ ID NO: 4548487 - DNA, 16 bp, Homo sapiens
atatattatatacata

SEQ ID NO: 4548488 - DNA, 17 bp, Homo sapiens
atatattatgtgaagaa

SEQ ID NO: 4548489 - DNA, 18 bp, Homo sapiens
atatattatgtgaagaat

SEQ ID NO: 4548490 - DNA, 18 bp, Homo sapiens
atatattattataatctt

SEQ ID NO: 4548491 - DNA, 13 bp, Homo sapiens
atatattgaacac

SEQ ID NO: 4548492 - DNA, 14 bp, Homo sapiens
atatattgctttat

SEQ ID NO: 4548493 - DNA, 15 bp, Homo sapiens
atatatttattttat

SEQ ID NO: 4548494 - DNA, 18 bp, Homo sapiens
atatatttattttattct

SEQ ID NO: 4548495 - DNA, 12 bp, Homo sapiens
atatatttctat

SEQ ID NO: 4548496 - DNA, 17 bp, Homo sapiens
atatatttctattatta

SEQ ID NO: 4548497 - DNA, 23 bp, Homo sapiens
atatatttctattattaattgca

SEQ ID NO: 4548498 - DNA, 19 bp, Homo sapiens
atatatttgaaatagtata

SEQ ID NO: 4548499 - DNA, 16 bp, Homo sapiens
atatattttacaattt

SEQ ID NO: 4548500 - DNA, 16 bp, Homo sapiens
atatattttgtttaca

SEQ ID NO: 4548501 - DNA, 17 bp, Homo sapiens
atatcaaaaaaccttta

SEQ ID NO: 4548502 - DNA, 20 bp, Homo sapiens
atatcaaaaaacctttacag

SEQ ID NO: 4548503 - DNA, 22 bp, Homo sapiens
atatcaaagagaagatgcctgt

SEQ ID NO: 4548504 - DNA, 24 bp, Homo sapiens
atatcaaagagaagatgcctgtta

SEQ ID NO: 4548505 - DNA, 13 bp, Homo sapiens
atatcaaatgcag

SEQ ID NO: 4548506 - DNA, 20 bp, Homo sapiens
atatcaatattttctgcaat

SEQ ID NO: 4548507 - DNA, 14 bp, Homo sapiens
atatcacacaatat

SEQ ID NO: 4548508 - DNA, 14 bp, Homo sapiens
atatcacacacatt

SEQ ID NO: 4548509 - DNA, 18 bp, Homo sapiens
atatcacatgttttctct

SEQ ID NO: 4548510 - DNA, 15 bp, Homo sapiens
atatcactaaataaa

SEQ ID NO: 4548511 - DNA, 15 bp, Homo sapiens
atatcactcattaat

SEQ ID NO: 4548512 - DNA, 17 bp, Homo sapiens
atatcactcattaatta

SEQ ID NO: 4548513 - DNA, 17 bp, Homo sapiens
atatcagagctgggaaa

SEQ ID NO: 4548514 - DNA, 15 bp, Homo sapiens
atatcagtattctga

SEQ ID NO: 4548515 - DNA, 18 bp, Homo sapiens
atatcagttactcagccc

SEQ ID NO: 4548516 - DNA, 13 bp, Homo sapiens
atatcatacagtt

SEQ ID NO: 4548517 - DNA, 15 bp, Homo sapiens
atatcatacagtttt

SEQ ID NO: 4548518 - DNA, 20 bp, Homo sapiens
atatcatcacgtatgttata

SEQ ID NO: 4548519 - DNA, 16 bp, Homo sapiens
atatcatccacacatg

SEQ ID NO: 4548520 - DNA, 18 bp, Homo sapiens
atatcatccacacatgaa

SEQ ID NO: 4548521 - DNA, 24 bp, Homo sapiens
atatcatccacacatgaatctgca

SEQ ID NO: 4548522 - DNA, 15 bp, Homo sapiens
atatcatctgtcatt

SEQ ID NO: 4548523 - DNA, 18 bp, Homo sapiens
atatcatctgtcattata

SEQ ID NO: 4548524 - DNA, 20 bp, Homo sapiens
atatcatctgtcattatatt

SEQ ID NO: 4548525 - DNA, 23 bp, Homo sapiens
atatcatctgtcattatattcta

SEQ ID NO: 4548526 - DNA, 24 bp, Homo sapiens
atatcatctgtcattatattctaa

SEQ ID NO: 4548527 - DNA, 14 bp, Homo sapiens
atatcatggggagt

SEQ ID NO: 4548528 - DNA, 19 bp, Homo sapiens
atatcatgttaaattagaa

SEQ ID NO: 4548529 - DNA, 13 bp, Homo sapiens
atatcatttataa

SEQ ID NO: 4548530 - DNA, 19 bp, Homo sapiens
atatccaaaagctttttat

SEQ ID NO: 4548531 - DNA, 19 bp, Homo sapiens
atatcccttggacatttta

SEQ ID NO: 4548532 - DNA, 22 bp, Homo sapiens
atatcccttggacattttatgt

SEQ ID NO: 4548533 - DNA, 20 bp, Homo sapiens
atatcctctccccctcctcc

SEQ ID NO: 4548534 - DNA, 16 bp, Homo sapiens
atatctaaagttatat

SEQ ID NO: 4548535 - DNA, 19 bp, Homo sapiens
atatctaaagttatatttc

SEQ ID NO: 4548536 - DNA, 20 bp, Homo sapiens
atatctaaagttatatttca

SEQ ID NO: 4548537 - DNA, 15 bp, Homo sapiens
atatctaactttgta

SEQ ID NO: 4548538 - DNA, 23 bp, Homo sapiens
atatctaactttgtaaccagaat

SEQ ID NO: 4548539 - DNA, 13 bp, Homo sapiens
atatctagaacta

SEQ ID NO: 4548540 - DNA, 14 bp, Homo sapiens
atatctagaactat

SEQ ID NO: 4548541 - DNA, 22 bp, Homo sapiens
atatctatagtagacacactat

SEQ ID NO: 4548542 - DNA, 16 bp, Homo sapiens
atatctatttgaataa

SEQ ID NO: 4548543 - DNA, 15 bp, Homo sapiens
atatctcctgaaaag

SEQ ID NO: 4548544 - DNA, 22 bp, Homo sapiens
atatctctatttaattttgaca

SEQ ID NO: 4548545 - DNA, 23 bp, Homo sapiens
atatctctgccatcacatagtat

SEQ ID NO: 4548546 - DNA, 14 bp, Homo sapiens
atatctcttggaaa

SEQ ID NO: 4548547 - DNA, 20 bp, Homo sapiens
atatctcttggaaaataaga

SEQ ID NO: 4548548 - DNA, 22 bp, Homo sapiens
atatctgattgttgtcaggcca

SEQ ID NO: 4548549 - DNA, 19 bp, Homo sapiens
atatctggcctctgctttc

SEQ ID NO: 4548550 - DNA, 15 bp, Homo sapiens
atatctgtgaaatat

SEQ ID NO: 4548551 - DNA, 21 bp, Homo sapiens
atatctgttattcaaatttga

SEQ ID NO: 4548552 - DNA, 21 bp, Homo sapiens
atatcttataactgttttaga

SEQ ID NO: 4548553 - DNA, 17 bp, Homo sapiens
atatcttcccatttaac

SEQ ID NO: 4548554 - DNA, 18 bp, Homo sapiens
atatcttcgttagtaatc

SEQ ID NO: 4548555 - DNA, 19 bp, Homo sapiens
atatcttctgatttgtccc

SEQ ID NO: 4548556 - DNA, 13 bp, Homo sapiens
atatcttgttatt

SEQ ID NO: 4548557 - DNA, 21 bp, Homo sapiens
atatcttgtttacaataaaga

SEQ ID NO: 4548558 - DNA, 20 bp, Homo sapiens
atatctttaataagtaatct

SEQ ID NO: 4548559 - DNA, 13 bp, Homo sapiens
atatgaaagctga

SEQ ID NO: 4548560 - DNA, 17 bp, Homo sapiens
atatgaaagctgatttt

SEQ ID NO: 4548561 - DNA, 19 bp, Homo sapiens
atatgaaataagtaaatgt

SEQ ID NO: 4548562 - DNA, 15 bp, Homo sapiens
atatgacagctgtcc

SEQ ID NO: 4548563 - DNA, 21 bp, Homo sapiens
atatgacagctgtccctgtca

SEQ ID NO: 4548564 - DNA, 16 bp, Homo sapiens
atatgaccagaagcct

SEQ ID NO: 4548565 - DNA, 15 bp, Homo sapiens
atatgactttttata

SEQ ID NO: 4548566 - DNA, 13 bp, Homo sapiens
atatgagcttcaa

SEQ ID NO: 4548567 - DNA, 17 bp, Homo sapiens
atatgagcttcaatata

SEQ ID NO: 4548568 - DNA, 21 bp, Homo sapiens
atatgatacaccattatgttt

SEQ ID NO: 4548569 - DNA, 12 bp, Homo sapiens
atatgatatgca

SEQ ID NO: 4548570 - DNA, 15 bp, Homo sapiens
atatgatatgcatgt

SEQ ID NO: 4548571 - DNA, 23 bp, Homo sapiens
atatgatatgcatgtagcatata

SEQ ID NO: 4548572 - DNA, 16 bp, Homo sapiens
atatgatctgtctgtg

SEQ ID NO: 4548573 - DNA, 17 bp, Homo sapiens
atatgatctgtctgtgg

SEQ ID NO: 4548574 - DNA, 21 bp, Homo sapiens
atatgatgttaaaaaaataag

SEQ ID NO: 4548575 - DNA, 13 bp, Homo sapiens
atatgattataca

SEQ ID NO: 4548576 - DNA, 14 bp, Homo sapiens
atatgattatacaa

SEQ ID NO: 4548577 - DNA, 14 bp, Homo sapiens
atatgcaagcagct

SEQ ID NO: 4548578 - DNA, 13 bp, Homo sapiens
atatgcaagtaag

SEQ ID NO: 4548579 - DNA, 14 bp, Homo sapiens
atatgcacttataa

SEQ ID NO: 4548580 - DNA, 18 bp, Homo sapiens
atatgcagaaatagacaa

SEQ ID NO: 4548581 - DNA, 22 bp, Homo sapiens
atatgctccaggatctttgact

SEQ ID NO: 4548582 - DNA, 14 bp, Homo sapiens
atatgctgtatttc

SEQ ID NO: 4548583 - DNA, 19 bp, Homo sapiens
atatgctgtatttctttgt

SEQ ID NO: 4548584 - DNA, 18 bp, Homo sapiens
atatgcttactaaatctt

SEQ ID NO: 4548585 - DNA, 14 bp, Homo sapiens
atatggaaatcttt

SEQ ID NO: 4548586 - DNA, 19 bp, Homo sapiens
atatggaaatcttttacat

SEQ ID NO: 4548587 - DNA, 23 bp, Homo sapiens
atatggaaatcttttacattttt

SEQ ID NO: 4548588 - DNA, 13 bp, Homo sapiens
atatggaaccttc

SEQ ID NO: 4548589 - DNA, 20 bp, Homo sapiens
atatggaaccttccctccaa

SEQ ID NO: 4548590 - DNA, 14 bp, Homo sapiens
atatggaagaaagt

SEQ ID NO: 4548591 - DNA, 20 bp, Homo sapiens
atatggacacttaatactac

SEQ ID NO: 4548592 - DNA, 21 bp, Homo sapiens
atatggagaattgctgaaggg

SEQ ID NO: 4548593 - DNA, 23 bp, Homo sapiens
atatggaggattctttccccaga

SEQ ID NO: 4548594 - DNA, 16 bp, Homo sapiens
atatggcatttgcaga

SEQ ID NO: 4548595 - DNA, 13 bp, Homo sapiens
atatggccacagt

SEQ ID NO: 4548596 - DNA, 12 bp, Homo sapiens
atatggctgccc

SEQ ID NO: 4548597 - DNA, 14 bp, Homo sapiens
atatggctgcccag

SEQ ID NO: 4548598 - DNA, 15 bp, Homo sapiens
atatgggggaaaatt

SEQ ID NO: 4548599 - DNA, 16 bp, Homo sapiens
atatgtaaaacattta

SEQ ID NO: 4548600 - DNA, 24 bp, Homo sapiens
atatgtaaaacatttattttgaca

SEQ ID NO: 4548601 - DNA, 15 bp, Homo sapiens
atatgtaaattacaa

SEQ ID NO: 4548602 - DNA, 12 bp, Homo sapiens
atatgtatttaa

SEQ ID NO: 4548603 - DNA, 16 bp, Homo sapiens
atatgtatttaccaaa

SEQ ID NO: 4548604 - DNA, 17 bp, Homo sapiens
atatgtatttttatata

SEQ ID NO: 4548605 - DNA, 15 bp, Homo sapiens
atatgtgaagttttc

SEQ ID NO: 4548606 - DNA, 14 bp, Homo sapiens
atatgtgagaaatc

SEQ ID NO: 4548607 - DNA, 14 bp, Homo sapiens
atatgtgtgccctg

SEQ ID NO: 4548608 - DNA, 21 bp, Homo sapiens
atatgttgtaatatttcttca

SEQ ID NO: 4548609 - DNA, 21 bp, Homo sapiens
atatgtttaaaataaaatgaa

SEQ ID NO: 4548610 - DNA, 22 bp, Homo sapiens
atattaaaattccaaattcatg

SEQ ID NO: 4548611 - DNA, 12 bp, Homo sapiens
atattaaacaaa

SEQ ID NO: 4548612 - DNA, 18 bp, Homo sapiens
atattaaacaaagtttca

SEQ ID NO: 4548613 - DNA, 19 bp, Homo sapiens
atattaaacactaaatgca

SEQ ID NO: 4548614 - DNA, 22 bp, Homo sapiens
atattaaatgagggtttctgat

SEQ ID NO: 4548615 - DNA, 15 bp, Homo sapiens
atattaacattcttt

SEQ ID NO: 4548616 - DNA, 13 bp, Homo sapiens
atattaagaatct

SEQ ID NO: 4548617 - DNA, 20 bp, Homo sapiens
atattaagagctattttaga

SEQ ID NO: 4548618 - DNA, 18 bp, Homo sapiens
atattacaacatttatgt

SEQ ID NO: 4548619 - DNA, 15 bp, Homo sapiens
atattacaatgatca

SEQ ID NO: 4548620 - DNA, 16 bp, Homo sapiens
atattacaatgatcac

SEQ ID NO: 4548621 - DNA, 12 bp, Homo sapiens
atattacaccaa

SEQ ID NO: 4548622 - DNA, 22 bp, Homo sapiens
atattactcctatttttgtaaa

SEQ ID NO: 4548623 - DNA, 17 bp, Homo sapiens
atattactttgtctttt

SEQ ID NO: 4548624 - DNA, 18 bp, Homo sapiens
atattagttgctttgtta

SEQ ID NO: 4548625 - DNA, 16 bp, Homo sapiens
atattataactctgta

SEQ ID NO: 4548626 - DNA, 10 bp, Homo sapiens
atattataag

SEQ ID NO: 4548627 - DNA, 11 bp, Homo sapiens
atattataagt

SEQ ID NO: 4548628 - DNA, 20 bp, Homo sapiens
atattataagttgaccttta

SEQ ID NO: 4548629 - DNA, 11 bp, Homo sapiens
atattatagaa

SEQ ID NO: 4548630 - DNA, 15 bp, Homo sapiens
atattatattaaaca

SEQ ID NO: 4548631 - DNA, 16 bp, Homo sapiens
atattatgtgaagaat

SEQ ID NO: 4548632 - DNA, 18 bp, Homo sapiens
atattatgtgaagaattt

SEQ ID NO: 4548633 - DNA, 22 bp, Homo sapiens
atattattagttttgatttaat

SEQ ID NO: 4548634 - DNA, 17 bp, Homo sapiens
atattatttgtcttaaa

SEQ ID NO: 4548635 - DNA, 17 bp, Homo sapiens
atattatttgtgtttcc

SEQ ID NO: 4548636 - DNA, 15 bp, Homo sapiens
atattcaaggcttta

SEQ ID NO: 4548637 - DNA, 21 bp, Homo sapiens
atattcaaggctttaaaagtc

SEQ ID NO: 4548638 - DNA, 21 bp, Homo sapiens
atattcacagactgattggaa

SEQ ID NO: 4548639 - DNA, 13 bp, Homo sapiens
atattcacatctt

SEQ ID NO: 4548640 - DNA, 16 bp, Homo sapiens
atattcactgggccaa

SEQ ID NO: 4548641 - DNA, 21 bp, Homo sapiens
atattcactggttttacacag

SEQ ID NO: 4548642 - DNA, 18 bp, Homo sapiens
atattcagacaaaatgga

SEQ ID NO: 4548643 - DNA, 22 bp, Homo sapiens
atattcagacaaaatggataca

SEQ ID NO: 4548644 - DNA, 18 bp, Homo sapiens
atattcagccagcttaaa

SEQ ID NO: 4548645 - DNA, 18 bp, Homo sapiens
atattcatggatggctca

SEQ ID NO: 4548646 - DNA, 17 bp, Homo sapiens
atattccctagaaactt

SEQ ID NO: 4548647 - DNA, 16 bp, Homo sapiens
atattccctgcacaca

SEQ ID NO: 4548648 - DNA, 20 bp, Homo sapiens
atattccctgcacacacatg

SEQ ID NO: 4548649 - DNA, 22 bp, Homo sapiens
atattccctgcacacacatgca

SEQ ID NO: 4548650 - DNA, 23 bp, Homo sapiens
atattcctttttctatgaaataa

SEQ ID NO: 4548651 - DNA, 21 bp, Homo sapiens
atattctaacttattaaattt

SEQ ID NO: 4548652 - DNA, 18 bp, Homo sapiens
atattctaagaaatatct

SEQ ID NO: 4548653 - DNA, 23 bp, Homo sapiens
atattctaagaaatatctgtgaa

SEQ ID NO: 4548654 - DNA, 13 bp, Homo sapiens
atattctccctga

SEQ ID NO: 4548655 - DNA, 18 bp, Homo sapiens
atattctgttgctttaca

SEQ ID NO: 4548656 - DNA, 19 bp, Homo sapiens
atattgaaaagcacagagg

SEQ ID NO: 4548657 - DNA, 23 bp, Homo sapiens
atattgaaaattgaaaagtacaa

SEQ ID NO: 4548658 - DNA, 13 bp, Homo sapiens
atattgaagttgt

SEQ ID NO: 4548659 - DNA, 22 bp, Homo sapiens
atattgaagttgtttatcaact

SEQ ID NO: 4548660 - DNA, 18 bp, Homo sapiens
atattgaatgtgaaacat

SEQ ID NO: 4548661 - DNA, 16 bp, Homo sapiens
atattgaatttttcct

SEQ ID NO: 4548662 - DNA, 22 bp, Homo sapiens
atattgataagctattgtctgt

SEQ ID NO: 4548663 - DNA, 13 bp, Homo sapiens
atattgatgtgtg

SEQ ID NO: 4548664 - DNA, 15 bp, Homo sapiens
atattgccttatttg

SEQ ID NO: 4548665 - DNA, 16 bp, Homo sapiens
atattgctaaaagcat

SEQ ID NO: 4548666 - DNA, 20 bp, Homo sapiens
atattgctaaaagcatgtat

SEQ ID NO: 4548667 - DNA, 18 bp, Homo sapiens
atattgctactataatca

SEQ ID NO: 4548668 - DNA, 21 bp, Homo sapiens
atattgctactataatcaaat

SEQ ID NO: 4548669 - DNA, 19 bp, Homo sapiens
atattgctgaagaatctac

SEQ ID NO: 4548670 - DNA, 23 bp, Homo sapiens
atattgctgtatggtatatgcat

SEQ ID NO: 4548671 - DNA, 18 bp, Homo sapiens
atattgcttagtaagtat

SEQ ID NO: 4548672 - DNA, 18 bp, Homo sapiens
atattgcttcaatttcaa

SEQ ID NO: 4548673 - DNA, 19 bp, Homo sapiens
atattgcttcaatttcaaa

SEQ ID NO: 4548674 - DNA, 14 bp, Homo sapiens
atattgcttcctgt

SEQ ID NO: 4548675 - DNA, 12 bp, Homo sapiens
atattgcttctt

SEQ ID NO: 4548676 - DNA, 20 bp, Homo sapiens
atattggggaccaaatcaaa

SEQ ID NO: 4548677 - DNA, 15 bp, Homo sapiens
atattgggtgtagat

SEQ ID NO: 4548678 - DNA, 15 bp, Homo sapiens
atattggtcacgtca

SEQ ID NO: 4548679 - DNA, 16 bp, Homo sapiens
atattggtttgcacaa

SEQ ID NO: 4548680 - DNA, 22 bp, Homo sapiens
atattggtttgcacaagttccc

SEQ ID NO: 4548681 - DNA, 16 bp, Homo sapiens
atattgtaaaacaggt

SEQ ID NO: 4548682 - DNA, 12 bp, Homo sapiens
atattgtaaaga

SEQ ID NO: 4548683 - DNA, 13 bp, Homo sapiens
atattgtcattgt

SEQ ID NO: 4548684 - DNA, 19 bp, Homo sapiens
atattgtgggtgttaattt

SEQ ID NO: 4548685 - DNA, 21 bp, Homo sapiens
atattgtgggtgttaattttt

SEQ ID NO: 4548686 - DNA, 13 bp, Homo sapiens
atattgtgtttgt

SEQ ID NO: 4548687 - DNA, 17 bp, Homo sapiens
atattgtgtttgtgtat

SEQ ID NO: 4548688 - DNA, 14 bp, Homo sapiens
atattgttctgctg

SEQ ID NO: 4548689 - DNA, 19 bp, Homo sapiens
atattgtttctgcattcat

SEQ ID NO: 4548690 - DNA, 14 bp, Homo sapiens
atattgtttgctgt

SEQ ID NO: 4548691 - DNA, 16 bp, Homo sapiens
atattgtttgctgttg

SEQ ID NO: 4548692 - DNA, 19 bp, Homo sapiens
atattgttttacaatagtt

SEQ ID NO: 4548693 - DNA, 16 bp, Homo sapiens
atattgttttcctaca

SEQ ID NO: 4548694 - DNA, 19 bp, Homo sapiens
atattgtttttatatatta

SEQ ID NO: 4548695 - DNA, 13 bp, Homo sapiens
atattgtttttct

SEQ ID NO: 4548696 - DNA, 22 bp, Homo sapiens
atatttaaaaaattaaaaatga

SEQ ID NO: 4548697 - DNA, 13 bp, Homo sapiens
atatttaaaaata

SEQ ID NO: 4548698 - DNA, 16 bp, Homo sapiens
atatttaaaaataagt

SEQ ID NO: 4548699 - DNA, 14 bp, Homo sapiens
atatttaaaaatgt

SEQ ID NO: 4548700 - DNA, 13 bp, Homo sapiens
atatttaaatcat

SEQ ID NO: 4548701 - DNA, 14 bp, Homo sapiens
atatttaaatcatt

SEQ ID NO: 4548702 - DNA, 13 bp, Homo sapiens
atatttaactggt

SEQ ID NO: 4548703 - DNA, 14 bp, Homo sapiens
atatttaatatcaa

SEQ ID NO: 4548704 - DNA, 22 bp, Homo sapiens
atatttaatgttttaaatgtac

SEQ ID NO: 4548705 - DNA, 16 bp, Homo sapiens
atatttaattatgaaa

SEQ ID NO: 4548706 - DNA, 18 bp, Homo sapiens
atatttaattatgaaaac

SEQ ID NO: 4548707 - DNA, 21 bp, Homo sapiens
atatttacaatgtattaagcc

SEQ ID NO: 4548708 - DNA, 16 bp, Homo sapiens
atatttacagaagaaa

SEQ ID NO: 4548709 - DNA, 15 bp, Homo sapiens
atatttactgctctt

SEQ ID NO: 4548710 - DNA, 18 bp, Homo sapiens
atatttagcatccctgga

SEQ ID NO: 4548711 - DNA, 15 bp, Homo sapiens
atatttagctgtttt

SEQ ID NO: 4548712 - DNA, 19 bp, Homo sapiens
atatttaggaaaatgctta

SEQ ID NO: 4548713 - DNA, 15 bp, Homo sapiens
atatttatactttgc

SEQ ID NO: 4548714 - DNA, 13 bp, Homo sapiens
atatttatatact

SEQ ID NO: 4548715 - DNA, 19 bp, Homo sapiens
atatttatgttgttgaact

SEQ ID NO: 4548716 - DNA, 23 bp, Homo sapiens
atatttattcattatttgtcaaa

SEQ ID NO: 4548717 - DNA, 14 bp, Homo sapiens
atatttattgatta

SEQ ID NO: 4548718 - DNA, 19 bp, Homo sapiens
atatttattgttagaaaat

SEQ ID NO: 4548719 - DNA, 12 bp, Homo sapiens
atatttcactta

SEQ ID NO: 4548720 - DNA, 19 bp, Homo sapiens
atatttcacttaaactttg

SEQ ID NO: 4548721 - DNA, 22 bp, Homo sapiens
atatttcacttaaactttgtca

SEQ ID NO: 4548722 - DNA, 20 bp, Homo sapiens
atatttcagatgtaatgttt

SEQ ID NO: 4548723 - DNA, 20 bp, Homo sapiens
atatttcagtgatttttagt

SEQ ID NO: 4548724 - DNA, 22 bp, Homo sapiens
atatttcagtgatttttagtaa

SEQ ID NO: 4548725 - DNA, 12 bp, Homo sapiens
atatttccttta

SEQ ID NO: 4548726 - DNA, 14 bp, Homo sapiens
atatttcctttatg

SEQ ID NO: 4548727 - DNA, 17 bp, Homo sapiens
atatttcctttatgtga

SEQ ID NO: 4548728 - DNA, 12 bp, Homo sapiens
atatttcttaag

SEQ ID NO: 4548729 - DNA, 12 bp, Homo sapiens
atatttcttcaa

SEQ ID NO: 4548730 - DNA, 14 bp, Homo sapiens
atatttcttcaaat

SEQ ID NO: 4548731 - DNA, 24 bp, Homo sapiens
atatttcttcttctaagaagacat

SEQ ID NO: 4548732 - DNA, 14 bp, Homo sapiens
atatttcttgcttt

SEQ ID NO: 4548733 - DNA, 20 bp, Homo sapiens
atatttcttttgttgtactt

SEQ ID NO: 4548734 - DNA, 15 bp, Homo sapiens
atatttgattatgta

SEQ ID NO: 4548735 - DNA, 19 bp, Homo sapiens
atatttgcagtttttcatt

SEQ ID NO: 4548736 - DNA, 19 bp, Homo sapiens
atatttgcatgggaggggg

SEQ ID NO: 4548737 - DNA, 15 bp, Homo sapiens
atatttgctttatac

SEQ ID NO: 4548738 - DNA, 23 bp, Homo sapiens
atatttgctttatactgagcttt

SEQ ID NO: 4548739 - DNA, 22 bp, Homo sapiens
atatttgtatgtttttctgtat

SEQ ID NO: 4548740 - DNA, 17 bp, Homo sapiens
atatttgtgctatagta

SEQ ID NO: 4548741 - DNA, 17 bp, Homo sapiens
atattttaactccactg

SEQ ID NO: 4548742 - DNA, 13 bp, Homo sapiens
atattttaataaa

SEQ ID NO: 4548743 - DNA, 14 bp, Homo sapiens
atattttaataaag

SEQ ID NO: 4548744 - DNA, 16 bp, Homo sapiens
atattttaataaagta

SEQ ID NO: 4548745 - DNA, 14 bp, Homo sapiens
atattttaatcatt

SEQ ID NO: 4548746 - DNA, 21 bp, Homo sapiens
atattttaatcattatttgag

SEQ ID NO: 4548747 - DNA, 17 bp, Homo sapiens
atattttatcctgtatt

SEQ ID NO: 4548748 - DNA, 15 bp, Homo sapiens
atattttatgaacat

SEQ ID NO: 4548749 - DNA, 18 bp, Homo sapiens
atattttatgaacattgt

SEQ ID NO: 4548750 - DNA, 20 bp, Homo sapiens
atattttatgaacattgtac

SEQ ID NO: 4548751 - DNA, 21 bp, Homo sapiens
atattttcaccatttgattat

SEQ ID NO: 4548752 - DNA, 14 bp, Homo sapiens
atattttcagtaat

SEQ ID NO: 4548753 - DNA, 22 bp, Homo sapiens
atattttccataaatttggact

SEQ ID NO: 4548754 - DNA, 14 bp, Homo sapiens
atattttctatttt

SEQ ID NO: 4548755 - DNA, 13 bp, Homo sapiens
atattttctgtat

SEQ ID NO: 4548756 - DNA, 14 bp, Homo sapiens
atattttctgtatt

SEQ ID NO: 4548757 - DNA, 13 bp, Homo sapiens
atattttctgttt

SEQ ID NO: 4548758 - DNA, 13 bp, Homo sapiens
atattttgaatca

SEQ ID NO: 4548759 - DNA, 16 bp, Homo sapiens
atattttgagaaactg

SEQ ID NO: 4548760 - DNA, 19 bp, Homo sapiens
atattttgtaaaatgtatt

SEQ ID NO: 4548761 - DNA, 14 bp, Homo sapiens
atattttgtaatat

SEQ ID NO: 4548762 - DNA, 17 bp, Homo sapiens
atattttgtaatattct

SEQ ID NO: 4548763 - DNA, 21 bp, Homo sapiens
atattttgtagttaatataaa

SEQ ID NO: 4548764 - DNA, 21 bp, Homo sapiens
atattttgtatattatgttta

SEQ ID NO: 4548765 - DNA, 16 bp, Homo sapiens
atattttgttaacttt

SEQ ID NO: 4548766 - DNA, 21 bp, Homo sapiens
atattttgttgccttcatctt

SEQ ID NO: 4548767 - DNA, 16 bp, Homo sapiens
atatttttatacttta

SEQ ID NO: 4548768 - DNA, 18 bp, Homo sapiens
atatttttatactttatt

SEQ ID NO: 4548769 - DNA, 20 bp, Homo sapiens
atatttttatctttatatga

SEQ ID NO: 4548770 - DNA, 22 bp, Homo sapiens
atatttttgtacgttatatatt

SEQ ID NO: 4548771 - DNA, 22 bp, Homo sapiens
atattttttatatctggaatga

SEQ ID NO: 4548772 - DNA, 19 bp, Homo sapiens
atattttttgaaggtttca

SEQ ID NO: 4548773 - DNA, 18 bp, Homo sapiens
atattttttgttaaatga

SEQ ID NO: 4548774 - DNA, 20 bp, Homo sapiens
atattttttgttaaatgatt

SEQ ID NO: 4548775 - DNA, 17 bp, Homo sapiens
atcaaaacctgcgcagt

SEQ ID NO: 4548776 - DNA, 22 bp, Homo sapiens
atcaaaagaaaattgatatttt

SEQ ID NO: 4548777 - DNA, 21 bp, Homo sapiens
atcaaaataaaaattaaatgt

SEQ ID NO: 4548778 - DNA, 22 bp, Homo sapiens
atcaaaatgctttttatttctg

SEQ ID NO: 4548779 - DNA, 15 bp, Homo sapiens
atcaaacattttctg

SEQ ID NO: 4548780 - DNA, 16 bp, Homo sapiens
atcaaacattttctgg

SEQ ID NO: 4548781 - DNA, 13 bp, Homo sapiens
atcaaactgaaac

SEQ ID NO: 4548782 - DNA, 11 bp, Homo sapiens
atcaaactgct

SEQ ID NO: 4548783 - DNA, 13 bp, Homo sapiens
atcaaacttatgg

SEQ ID NO: 4548784 - DNA, 21 bp, Homo sapiens
atcaaaggaaaatagtaatgt

SEQ ID NO: 4548785 - DNA, 19 bp, Homo sapiens
atcaaagtggtaaatactg

SEQ ID NO: 4548786 - DNA, 21 bp, Homo sapiens
atcaaagtggtaaatactgtg

SEQ ID NO: 4548787 - DNA, 17 bp, Homo sapiens
atcaaatgatttcatat

SEQ ID NO: 4548788 - DNA, 20 bp, Homo sapiens
atcaaatgatttcatattga

SEQ ID NO: 4548789 - DNA, 19 bp, Homo sapiens
atcaaatgcagtatatttc

SEQ ID NO: 4548790 - DNA, 14 bp, Homo sapiens
atcaacagataaat

SEQ ID NO: 4548791 - DNA, 13 bp, Homo sapiens
atcaacatctttt

SEQ ID NO: 4548792 - DNA, 14 bp, Homo sapiens
atcaactaaaacat

SEQ ID NO: 4548793 - DNA, 14 bp, Homo sapiens
atcaactcccaact

SEQ ID NO: 4548794 - DNA, 13 bp, Homo sapiens
atcaactttttat

SEQ ID NO: 4548795 - DNA, 12 bp, Homo sapiens
atcaagagaaac

SEQ ID NO: 4548796 - DNA, 16 bp, Homo sapiens
atcaagagaaacttca

SEQ ID NO: 4548797 - DNA, 17 bp, Homo sapiens
atcaagatttttttcct

SEQ ID NO: 4548798 - DNA, 16 bp, Homo sapiens
atcaagcaacattctt

SEQ ID NO: 4548799 - DNA, 18 bp, Homo sapiens
atcaagcacttcccagga

SEQ ID NO: 4548800 - DNA, 19 bp, Homo sapiens
atcaaggttataatttttt

SEQ ID NO: 4548801 - DNA, 15 bp, Homo sapiens
atcaagtaatacaaa

SEQ ID NO: 4548802 - DNA, 12 bp, Homo sapiens
atcaagtattac

SEQ ID NO: 4548803 - DNA, 17 bp, Homo sapiens
atcaagtccatctgaca

SEQ ID NO: 4548804 - DNA, 12 bp, Homo sapiens
atcaataaaatt

SEQ ID NO: 4548805 - DNA, 16 bp, Homo sapiens
atcaataaaattctgt

SEQ ID NO: 4548806 - DNA, 16 bp, Homo sapiens
atcaataatatatttt

SEQ ID NO: 4548807 - DNA, 12 bp, Homo sapiens
atcaatacacta

SEQ ID NO: 4548808 - DNA, 23 bp, Homo sapiens
atcaatagtgtcctatgcaataa

SEQ ID NO: 4548809 - DNA, 17 bp, Homo sapiens
atcaatagttgaattag

SEQ ID NO: 4548810 - DNA, 14 bp, Homo sapiens
atcaatcctttatt

SEQ ID NO: 4548811 - DNA, 15 bp, Homo sapiens
atcaatctggcttct

SEQ ID NO: 4548812 - DNA, 21 bp, Homo sapiens
atcaatctggcttctgcatta

SEQ ID NO: 4548813 - DNA, 16 bp, Homo sapiens
atcaatcttgttactg

SEQ ID NO: 4548814 - DNA, 18 bp, Homo sapiens
atcaatcttgttactgct

SEQ ID NO: 4548815 - DNA, 22 bp, Homo sapiens
atcaatgggatatgattggttc

SEQ ID NO: 4548816 - DNA, 15 bp, Homo sapiens
atcaatttctaatgt

SEQ ID NO: 4548817 - DNA, 21 bp, Homo sapiens
atcaatttctaatgtttacta

SEQ ID NO: 4548818 - DNA, 18 bp, Homo sapiens
atcaatttgtttgtgttc

SEQ ID NO: 4548819 - DNA, 15 bp, Homo sapiens
atcacaatattcagt

SEQ ID NO: 4548820 - DNA, 19 bp, Homo sapiens
atcacaatattcagtggtg

SEQ ID NO: 4548821 - DNA, 18 bp, Homo sapiens
atcacaattttcctgtgg

SEQ ID NO: 4548822 - DNA, 15 bp, Homo sapiens
atcacaatttttaat

SEQ ID NO: 4548823 - DNA, 16 bp, Homo sapiens
atcacaatttttaatg

SEQ ID NO: 4548824 - DNA, 14 bp, Homo sapiens
atcacacaatatag

SEQ ID NO: 4548825 - DNA, 20 bp, Homo sapiens
atcacacacattgctgtgaa

SEQ ID NO: 4548826 - DNA, 23 bp, Homo sapiens
atcacacatcaagactatctaca

SEQ ID NO: 4548827 - DNA, 23 bp, Homo sapiens
atcacacatgaataaagcctttg

SEQ ID NO: 4548828 - DNA, 16 bp, Homo sapiens
atcacacatgttcaga

SEQ ID NO: 4548829 - DNA, 21 bp, Homo sapiens
atcacacccagcccatgtggc

SEQ ID NO: 4548830 - DNA, 16 bp, Homo sapiens
atcacacccatttaaa

SEQ ID NO: 4548831 - DNA, 14 bp, Homo sapiens
atcacacctgccct

SEQ ID NO: 4548832 - DNA, 19 bp, Homo sapiens
atcacactcaaggacagga

SEQ ID NO: 4548833 - DNA, 18 bp, Homo sapiens
atcacacttatattttat

SEQ ID NO: 4548834 - DNA, 21 bp, Homo sapiens
atcacacttatattttatgaa

SEQ ID NO: 4548835 - DNA, 16 bp, Homo sapiens
atcacacttctgtgag

SEQ ID NO: 4548836 - DNA, 15 bp, Homo sapiens
atcacagaccacagg

SEQ ID NO: 4548837 - DNA, 15 bp, Homo sapiens
atcacagagcagcaa

SEQ ID NO: 4548838 - DNA, 15 bp, Homo sapiens
atcacagaggcttct

SEQ ID NO: 4548839 - DNA, 21 bp, Homo sapiens
atcacagtgtttttattgctc

SEQ ID NO: 4548840 - DNA, 14 bp, Homo sapiens
atcacataaagaaa

SEQ ID NO: 4548841 - DNA, 22 bp, Homo sapiens
atcacataaagaaattcaagaa

SEQ ID NO: 4548842 - DNA, 20 bp, Homo sapiens
atcacataagagagatgaga

SEQ ID NO: 4548843 - DNA, 23 bp, Homo sapiens
atcacattttgtatggagttaaa

SEQ ID NO: 4548844 - DNA, 21 bp, Homo sapiens
atcacatttttttatgctctt

SEQ ID NO: 4548845 - DNA, 15 bp, Homo sapiens
atcacccctctgccc

SEQ ID NO: 4548846 - DNA, 16 bp, Homo sapiens
atcacccctctgcccc

SEQ ID NO: 4548847 - DNA, 17 bp, Homo sapiens
atcacccctctgcccct

SEQ ID NO: 4548848 - DNA, 20 bp, Homo sapiens
atcacccctctgcccctgca

SEQ ID NO: 4548849 - DNA, 21 bp, Homo sapiens
atcacccctctgcccctgcag

SEQ ID NO: 4548850 - DNA, 19 bp, Homo sapiens
atcacccttccgacaggag

SEQ ID NO: 4548851 - DNA, 22 bp, Homo sapiens
atcacctaagcacttctagaat

SEQ ID NO: 4548852 - DNA, 13 bp, Homo sapiens
atcacctctctgt

SEQ ID NO: 4548853 - DNA, 15 bp, Homo sapiens
atcacctgaacccca

SEQ ID NO: 4548854 - DNA, 19 bp, Homo sapiens
atcacctgaaccccagagg

SEQ ID NO: 4548855 - DNA, 13 bp, Homo sapiens
atcacgatttcat

SEQ ID NO: 4548856 - DNA, 16 bp, Homo sapiens
atcacgatttcatcct

SEQ ID NO: 4548857 - DNA, 18 bp, Homo sapiens
atcacgctttcctgaatc

SEQ ID NO: 4548858 - DNA, 14 bp, Homo sapiens
atcacgtaaagcta

SEQ ID NO: 4548859 - DNA, 22 bp, Homo sapiens
atcacgttagaggaaaaatatt

SEQ ID NO: 4548860 - DNA, 14 bp, Homo sapiens
atcactaacattat

SEQ ID NO: 4548861 - DNA, 15 bp, Homo sapiens
atcactcattaatta

SEQ ID NO: 4548862 - DNA, 13 bp, Homo sapiens
atcactgatggga

SEQ ID NO: 4548863 - DNA, 13 bp, Homo sapiens
atcactgctccag

SEQ ID NO: 4548864 - DNA, 15 bp, Homo sapiens
atcactgctccaggc

SEQ ID NO: 4548865 - DNA, 22 bp, Homo sapiens
atcactgtaaagacaaataaat

SEQ ID NO: 4548866 - DNA, 20 bp, Homo sapiens
atcacttaggaaatggcttt

SEQ ID NO: 4548867 - DNA, 20 bp, Homo sapiens
atcacttgagctcaggaggt

SEQ ID NO: 4548868 - DNA, 12 bp, Homo sapiens
atcactttcata

SEQ ID NO: 4548869 - DNA, 16 bp, Homo sapiens
atcactttctcagttt

SEQ ID NO: 4548870 - DNA, 18 bp, Homo sapiens
atcactttctcagttttc

SEQ ID NO: 4548871 - DNA, 22 bp, Homo sapiens
atcagaaaacagggtccaggaa

SEQ ID NO: 4548872 - DNA, 22 bp, Homo sapiens
atcagaaaggaaaaacaaactc

SEQ ID NO: 4548873 - DNA, 17 bp, Homo sapiens
atcagaagaaaggccaa

SEQ ID NO: 4548874 - DNA, 19 bp, Homo sapiens
atcagaagtcatcttgcta

SEQ ID NO: 4548875 - DNA, 23 bp, Homo sapiens
atcagaataaagttgtatttcaa

SEQ ID NO: 4548876 - DNA, 19 bp, Homo sapiens
atcagaatagccacatttg

SEQ ID NO: 4548877 - DNA, 16 bp, Homo sapiens
atcagaatatgttgct

SEQ ID NO: 4548878 - DNA, 18 bp, Homo sapiens
atcagaatggaagagaga

SEQ ID NO: 4548879 - DNA, 14 bp, Homo sapiens
atcagaatttgtgt

SEQ ID NO: 4548880 - DNA, 15 bp, Homo sapiens
atcagaccctacccc

SEQ ID NO: 4548881 - DNA, 16 bp, Homo sapiens
atcagaccctacccca

SEQ ID NO: 4548882 - DNA, 18 bp, Homo sapiens
atcagaccctaccccacc

SEQ ID NO: 4548883 - DNA, 19 bp, Homo sapiens
atcagaccctaccccacca

SEQ ID NO: 4548884 - DNA, 18 bp, Homo sapiens
atcagacttcacactgca

SEQ ID NO: 4548885 - DNA, 17 bp, Homo sapiens
atcagagttgctgcaaa

SEQ ID NO: 4548886 - DNA, 20 bp, Homo sapiens
atcagatatgcttactaaat

SEQ ID NO: 4548887 - DNA, 12 bp, Homo sapiens
atcagcaaaaaa

SEQ ID NO: 4548888 - DNA, 14 bp, Homo sapiens
atcagcactctgta

SEQ ID NO: 4548889 - DNA, 20 bp, Homo sapiens
atcagccagcccatggcccc

SEQ ID NO: 4548890 - DNA, 14 bp, Homo sapiens
atcagccccgcctg

SEQ ID NO: 4548891 - DNA, 17 bp, Homo sapiens
atcagccccgcctgtca

SEQ ID NO: 4548892 - DNA, 19 bp, Homo sapiens
atcagccccgcctgtcaca

SEQ ID NO: 4548893 - DNA, 22 bp, Homo sapiens
atcagccccgcctgtcacaata

SEQ ID NO: 4548894 - DNA, 23 bp, Homo sapiens
atcagccccgcctgtcacaataa

SEQ ID NO: 4548895 - DNA, 14 bp, Homo sapiens
atcagcctgggcaa

SEQ ID NO: 4548896 - DNA, 17 bp, Homo sapiens
atcagctattttgtgaa

SEQ ID NO: 4548897 - DNA, 12 bp, Homo sapiens
atcagctctgcc

SEQ ID NO: 4548898 - DNA, 17 bp, Homo sapiens
atcagctgctgaaacaa

SEQ ID NO: 4548899 - DNA, 21 bp, Homo sapiens
atcagcttttcttattccttt

SEQ ID NO: 4548900 - DNA, 22 bp, Homo sapiens
atcaggaattctaaataaattt

SEQ ID NO: 4548901 - DNA, 13 bp, Homo sapiens
atcaggccattgt

SEQ ID NO: 4548902 - DNA, 13 bp, Homo sapiens
atcaggtgcaggt

SEQ ID NO: 4548903 - DNA, 17 bp, Homo sapiens
atcaggtgtgctcaggg

SEQ ID NO: 4548904 - DNA, 13 bp, Homo sapiens
atcagtaaaatta

SEQ ID NO: 4548905 - DNA, 14 bp, Homo sapiens
atcagtagcatttt

SEQ ID NO: 4548906 - DNA, 18 bp, Homo sapiens
atcagtatattttctgta

SEQ ID NO: 4548907 - DNA, 22 bp, Homo sapiens
atcagtatattttctgtattta

SEQ ID NO: 4548908 - DNA, 12 bp, Homo sapiens
atcagtattctg

SEQ ID NO: 4548909 - DNA, 20 bp, Homo sapiens
atcagtattctgacatgtaa

SEQ ID NO: 4548910 - DNA, 13 bp, Homo sapiens
atcagtcaatatt

SEQ ID NO: 4548911 - DNA, 23 bp, Homo sapiens
atcagtcaatggaagaaatggct

SEQ ID NO: 4548912 - DNA, 22 bp, Homo sapiens
atcagtcctagaatgtttcatt

SEQ ID NO: 4548913 - DNA, 20 bp, Homo sapiens
atcagtgataattggtttga

SEQ ID NO: 4548914 - DNA, 19 bp, Homo sapiens
atcagtgtaccatttgcct

SEQ ID NO: 4548915 - DNA, 22 bp, Homo sapiens
atcagtgtttatgtgctattaa

SEQ ID NO: 4548916 - DNA, 18 bp, Homo sapiens
atcagttactcagccctg

SEQ ID NO: 4548917 - DNA, 21 bp, Homo sapiens
atcagttactcagccctgggc

SEQ ID NO: 4548918 - DNA, 17 bp, Homo sapiens
atcagttcattagaaat

SEQ ID NO: 4548919 - DNA, 18 bp, Homo sapiens
atcagttcattagaaata

SEQ ID NO: 4548920 - DNA, 15 bp, Homo sapiens
atcagttgatttttc

SEQ ID NO: 4548921 - DNA, 17 bp, Homo sapiens
atcagttgccccccatc

SEQ ID NO: 4548922 - DNA, 22 bp, Homo sapiens
atcagtttaaaagcacgacagt

SEQ ID NO: 4548923 - DNA, 21 bp, Homo sapiens
atcagtttgttccttttgtac

SEQ ID NO: 4548924 - DNA, 20 bp, Homo sapiens
atcataaggagttggtgtaa

SEQ ID NO: 4548925 - DNA, 21 bp, Homo sapiens
atcatactgttttgaataaat

SEQ ID NO: 4548926 - DNA, 21 bp, Homo sapiens
atcatagcaagacctcatctc

SEQ ID NO: 4548927 - DNA, 19 bp, Homo sapiens
atcatatattaaaacaata

SEQ ID NO: 4548928 - DNA, 17 bp, Homo sapiens
atcatattatttttaaa

SEQ ID NO: 4548929 - DNA, 20 bp, Homo sapiens
atcatattttgttgtgcact

SEQ ID NO: 4548930 - DNA, 20 bp, Homo sapiens
atcatcaacaagatttcctt

SEQ ID NO: 4548931 - DNA, 18 bp, Homo sapiens
atcatcaagtaatacaaa

SEQ ID NO: 4548932 - DNA, 12 bp, Homo sapiens
atcatcactgta

SEQ ID NO: 4548933 - DNA, 14 bp, Homo sapiens
atcatcactgtaaa

SEQ ID NO: 4548934 - DNA, 16 bp, Homo sapiens
atcatcagtgtagaac

SEQ ID NO: 4548935 - DNA, 23 bp, Homo sapiens
atcatcataggtaaggttttcaa

SEQ ID NO: 4548936 - DNA, 18 bp, Homo sapiens
atcatcatgtgtgtccac

SEQ ID NO: 4548937 - DNA, 14 bp, Homo sapiens
atcatccacacatg

SEQ ID NO: 4548938 - DNA, 16 bp, Homo sapiens
atcatccacacatgaa

SEQ ID NO: 4548939 - DNA, 23 bp, Homo sapiens
atcatctccaatggaaagctttt

SEQ ID NO: 4548940 - DNA, 23 bp, Homo sapiens
atcatctgaaggggcaaattctt

SEQ ID NO: 4548941 - DNA, 12 bp, Homo sapiens
atcatgaagcct

SEQ ID NO: 4548942 - DNA, 12 bp, Homo sapiens
atcatgcaaaat

SEQ ID NO: 4548943 - DNA, 18 bp, Homo sapiens
atcatgcacacaattaga

SEQ ID NO: 4548944 - DNA, 21 bp, Homo sapiens
atcatgcatgtcctgtaaagg

SEQ ID NO: 4548945 - DNA, 21 bp, Homo sapiens
atcatgcggtgggtgctgcca

SEQ ID NO: 4548946 - DNA, 17 bp, Homo sapiens
atcatgctcatgtatat

SEQ ID NO: 4548947 - DNA, 17 bp, Homo sapiens
atcatggaaatgtattt

SEQ ID NO: 4548948 - DNA, 13 bp, Homo sapiens
atcatggaagaaa

SEQ ID NO: 4548949 - DNA, 17 bp, Homo sapiens
atcatgtactttttagt

SEQ ID NO: 4548950 - DNA, 14 bp, Homo sapiens
atcatgtctattgt

SEQ ID NO: 4548951 - DNA, 16 bp, Homo sapiens
atcatgtctattgtcc

SEQ ID NO: 4548952 - DNA, 17 bp, Homo sapiens
atcatgtctattgtcca

SEQ ID NO: 4548953 - DNA, 12 bp, Homo sapiens
atcatgtctgta

SEQ ID NO: 4548954 - DNA, 22 bp, Homo sapiens
atcatgtctgtatactcctgtc

SEQ ID NO: 4548955 - DNA, 23 bp, Homo sapiens
atcatgtcttcattttttaatgt

SEQ ID NO: 4548956 - DNA, 21 bp, Homo sapiens
atcatgttgttgtgtgtatat

SEQ ID NO: 4548957 - DNA, 15 bp, Homo sapiens
atcatgtttattttg

SEQ ID NO: 4548958 - DNA, 22 bp, Homo sapiens
atcattataactgaaggagaag

SEQ ID NO: 4548959 - DNA, 15 bp, Homo sapiens
atcattattgtagtt

SEQ ID NO: 4548960 - DNA, 19 bp, Homo sapiens
atcattattgtagtttgaa

SEQ ID NO: 4548961 - DNA, 14 bp, Homo sapiens
atcattatttgaga

SEQ ID NO: 4548962 - DNA, 12 bp, Homo sapiens
atcattcatctt

SEQ ID NO: 4548963 - DNA, 22 bp, Homo sapiens
atcattccacactccttgtcaa

SEQ ID NO: 4548964 - DNA, 19 bp, Homo sapiens
atcatttataatactgttt

SEQ ID NO: 4548965 - DNA, 14 bp, Homo sapiens
atcatttcagccaa

SEQ ID NO: 4548966 - DNA, 18 bp, Homo sapiens
atcatttctattaaatga

SEQ ID NO: 4548967 - DNA, 21 bp, Homo sapiens
atcatttctattaaatgagca

SEQ ID NO: 4548968 - DNA, 15 bp, Homo sapiens
atcatttctatttct

SEQ ID NO: 4548969 - DNA, 13 bp, Homo sapiens
atcattttccccc

SEQ ID NO: 4548970 - DNA, 20 bp, Homo sapiens
atcatttttacactattgtg

SEQ ID NO: 4548971 - DNA, 17 bp, Homo sapiens
atcatttttatattata

SEQ ID NO: 4548972 - DNA, 14 bp, Homo sapiens
atcattttttactt

SEQ ID NO: 4548973 - DNA, 17 bp, Homo sapiens
atccaaaataaagatca

SEQ ID NO: 4548974 - DNA, 14 bp, Homo sapiens
atccaaataaagat

SEQ ID NO: 4548975 - DNA, 18 bp, Homo sapiens
atccaactaatgccttac

SEQ ID NO: 4548976 - DNA, 16 bp, Homo sapiens
atccaaggaaacatgc

SEQ ID NO: 4548977 - DNA, 16 bp, Homo sapiens
atccaatattttgcct

SEQ ID NO: 4548978 - DNA, 13 bp, Homo sapiens
atccacaattatt

SEQ ID NO: 4548979 - DNA, 17 bp, Homo sapiens
atccacacaaattcagt

SEQ ID NO: 4548980 - DNA, 22 bp, Homo sapiens
atccacagccttgcagcggctc

SEQ ID NO: 4548981 - DNA, 19 bp, Homo sapiens
atccaccactttaacctta

SEQ ID NO: 4548982 - DNA, 13 bp, Homo sapiens
atccacccagccc

SEQ ID NO: 4548983 - DNA, 22 bp, Homo sapiens
atccacccgggggagcccagtg

SEQ ID NO: 4548984 - DNA, 17 bp, Homo sapiens
atccacctgccttggcc

SEQ ID NO: 4548985 - DNA, 16 bp, Homo sapiens
atccacgctgggccta

SEQ ID NO: 4548986 - DNA, 18 bp, Homo sapiens
atccactctaccctccca

SEQ ID NO: 4548987 - DNA, 19 bp, Homo sapiens
atccactctaccctcccac

SEQ ID NO: 4548988 - DNA, 15 bp, Homo sapiens
atccagaagagccca

SEQ ID NO: 4548989 - DNA, 18 bp, Homo sapiens
atccagactttctttttc

SEQ ID NO: 4548990 - DNA, 14 bp, Homo sapiens
atccagagatgact

SEQ ID NO: 4548991 - DNA, 22 bp, Homo sapiens
atccagagattcattttctaga

SEQ ID NO: 4548992 - DNA, 21 bp, Homo sapiens
atccagagtccctgcctggac

SEQ ID NO: 4548993 - DNA, 18 bp, Homo sapiens
atccagcagtacaataaa

SEQ ID NO: 4548994 - DNA, 19 bp, Homo sapiens
atccagccggaggccagag

SEQ ID NO: 4548995 - DNA, 19 bp, Homo sapiens
atccagcctggggctgagg

SEQ ID NO: 4548996 - DNA, 22 bp, Homo sapiens
atccagcgtgacggagcccaca

SEQ ID NO: 4548997 - DNA, 18 bp, Homo sapiens
atccagctagtgccaaat

SEQ ID NO: 4548998 - DNA, 16 bp, Homo sapiens
atccagtaggatccag

SEQ ID NO: 4548999 - DNA, 23 bp, Homo sapiens
atccagtcattttattttgtaat

SEQ ID NO: 4549000 - DNA, 15 bp, Homo sapiens
atccagtttgttctc

SEQ ID NO: 4549001 - DNA, 14 bp, Homo sapiens
atccatagacacag

SEQ ID NO: 4549002 - DNA, 22 bp, Homo sapiens
atccatgacaggcctgaagata

SEQ ID NO: 4549003 - DNA, 13 bp, Homo sapiens
atccatgcttcac

SEQ ID NO: 4549004 - DNA, 14 bp, Homo sapiens
atccatgcttcact

SEQ ID NO: 4549005 - DNA, 21 bp, Homo sapiens
atccattcacaagcctcctgt

SEQ ID NO: 4549006 - DNA, 17 bp, Homo sapiens
atccattccaggtagct

SEQ ID NO: 4549007 - DNA, 14 bp, Homo sapiens
atccattcctcagg

SEQ ID NO: 4549008 - DNA, 11 bp, Homo sapiens
atccattgttg

SEQ ID NO: 4549009 - DNA, 11 bp, Homo sapiens
atccattttag

SEQ ID NO: 4549010 - DNA, 15 bp, Homo sapiens
atcccaaagcaagga

SEQ ID NO: 4549011 - DNA, 17 bp, Homo sapiens
atcccaaatcctattta

SEQ ID NO: 4549012 - DNA, 18 bp, Homo sapiens
atcccaacctctttttcc

SEQ ID NO: 4549013 - DNA, 19 bp, Homo sapiens
atcccaaggcaagcatgaa

SEQ ID NO: 4549014 - DNA, 15 bp, Homo sapiens
atcccaccccctcct

SEQ ID NO: 4549015 - DNA, 19 bp, Homo sapiens
atcccaccccctcctcccc

SEQ ID NO: 4549016 - DNA, 20 bp, Homo sapiens
atcccaccccctcctccccc

SEQ ID NO: 4549017 - DNA, 15 bp, Homo sapiens
atcccaccttcccac

SEQ ID NO: 4549018 - DNA, 20 bp, Homo sapiens
atcccactgtatagatccac

SEQ ID NO: 4549019 - DNA, 14 bp, Homo sapiens
atcccagaccagcc

SEQ ID NO: 4549020 - DNA, 18 bp, Homo sapiens
atcccagaccagccaagg

SEQ ID NO: 4549021 - DNA, 13 bp, Homo sapiens
atcccagcacttt

SEQ ID NO: 4549022 - DNA, 18 bp, Homo sapiens
atcccagctactcaggag

SEQ ID NO: 4549023 - DNA, 15 bp, Homo sapiens
atcccatctctacaa

SEQ ID NO: 4549024 - DNA, 19 bp, Homo sapiens
atcccatttagtgtgaata

SEQ ID NO: 4549025 - DNA, 21 bp, Homo sapiens
atcccatttagtgtgaatatt

SEQ ID NO: 4549026 - DNA, 12 bp, Homo sapiens
atccccaactcc

SEQ ID NO: 4549027 - DNA, 21 bp, Homo sapiens
atccccaactgctccagcctc

SEQ ID NO: 4549028 - DNA, 17 bp, Homo sapiens
atccccagcccctcctc

SEQ ID NO: 4549029 - DNA, 19 bp, Homo sapiens
atccccagcccctcctccc

SEQ ID NO: 4549030 - DNA, 23 bp, Homo sapiens
atccccagcccctcctccctcag

SEQ ID NO: 4549031 - DNA, 18 bp, Homo sapiens
atcccccttgccacccca

SEQ ID NO: 4549032 - DNA, 18 bp, Homo sapiens
atccccgtttcttgcaag

SEQ ID NO: 4549033 - DNA, 21 bp, Homo sapiens
atcccctccctgcctgctcct

SEQ ID NO: 4549034 - DNA, 20 bp, Homo sapiens
atccccttcccccatcccta

SEQ ID NO: 4549035 - DNA, 17 bp, Homo sapiens
atcccgaagccatcact

SEQ ID NO: 4549036 - DNA, 23 bp, Homo sapiens
atcccggcggaaagcctctgtcc

SEQ ID NO: 4549037 - DNA, 14 bp, Homo sapiens
atcccgggggtggg

SEQ ID NO: 4549038 - DNA, 14 bp, Homo sapiens
atccctaccactgt

SEQ ID NO: 4549039 - DNA, 16 bp, Homo sapiens
atccctaccactgtgg

SEQ ID NO: 4549040 - DNA, 17 bp, Homo sapiens
atccctccttaagagat

SEQ ID NO: 4549041 - DNA, 20 bp, Homo sapiens
atccctctacagagcttccc

SEQ ID NO: 4549042 - DNA, 14 bp, Homo sapiens
atccctctcctccc

SEQ ID NO: 4549043 - DNA, 12 bp, Homo sapiens
atccctctcttc

SEQ ID NO: 4549044 - DNA, 13 bp, Homo sapiens
atccctctcttcc

SEQ ID NO: 4549045 - DNA, 14 bp, Homo sapiens
atccctctcttccc

SEQ ID NO: 4549046 - DNA, 11 bp, Homo sapiens
atccctgcaga

SEQ ID NO: 4549047 - DNA, 17 bp, Homo sapiens
atccctggagcaggagc

SEQ ID NO: 4549048 - DNA, 17 bp, Homo sapiens
atccctgggcccctcca

SEQ ID NO: 4549049 - DNA, 19 bp, Homo sapiens
atccctgggggccttgggt

SEQ ID NO: 4549050 - DNA, 15 bp, Homo sapiens
atccctgtaaattgc

SEQ ID NO: 4549051 - DNA, 20 bp, Homo sapiens
atcccttcccacatgcctgc

SEQ ID NO: 4549052 - DNA, 17 bp, Homo sapiens
atcccttctcctgccct

SEQ ID NO: 4549053 - DNA, 19 bp, Homo sapiens
atcccttggacattttatg

SEQ ID NO: 4549054 - DNA, 21 bp, Homo sapiens
atcccttggacattttatgtc

SEQ ID NO: 4549055 - DNA, 15 bp, Homo sapiens
atcccttgtttataa

SEQ ID NO: 4549056 - DNA, 19 bp, Homo sapiens
atcccttgtttataaatag

SEQ ID NO: 4549057 - DNA, 15 bp, Homo sapiens
atccctttttcaatg

SEQ ID NO: 4549058 - DNA, 15 bp, Homo sapiens
atccgactgcccctg

SEQ ID NO: 4549059 - DNA, 13 bp, Homo sapiens
atccggaaagaag

SEQ ID NO: 4549060 - DNA, 15 bp, Homo sapiens
atccggtcagccaag

SEQ ID NO: 4549061 - DNA, 17 bp, Homo sapiens
atccgtaggacaagttt

SEQ ID NO: 4549062 - DNA, 18 bp, Homo sapiens
atccgtaggacaagtttt

SEQ ID NO: 4549063 - DNA, 16 bp, Homo sapiens
atccgtagttccctga

SEQ ID NO: 4549064 - DNA, 12 bp, Homo sapiens
atccgtattgaa

SEQ ID NO: 4549065 - DNA, 15 bp, Homo sapiens
atccgtcccacatca

SEQ ID NO: 4549066 - DNA, 19 bp, Homo sapiens
atccgtcccacatcagggc

SEQ ID NO: 4549067 - DNA, 11 bp, Homo sapiens
atcctaaactc

SEQ ID NO: 4549068 - DNA, 18 bp, Homo sapiens
atcctaaatttaccctct

SEQ ID NO: 4549069 - DNA, 21 bp, Homo sapiens
atcctaaggttcttgctttct

SEQ ID NO: 4549070 - DNA, 18 bp, Homo sapiens
atcctaatttctcctccc

SEQ ID NO: 4549071 - DNA, 19 bp, Homo sapiens
atcctaatttctcctccct

SEQ ID NO: 4549072 - DNA, 14 bp, Homo sapiens
atcctatttaaaga

SEQ ID NO: 4549073 - DNA, 17 bp, Homo sapiens
atcctatttaaagacct

SEQ ID NO: 4549074 - DNA, 20 bp, Homo sapiens
atcctatttaaagacctgac

SEQ ID NO: 4549075 - DNA, 22 bp, Homo sapiens
atcctatttaaagacctgacag

SEQ ID NO: 4549076 - DNA, 16 bp, Homo sapiens
atcctcaaagaaagtg

SEQ ID NO: 4549077 - DNA, 19 bp, Homo sapiens
atcctcagccgagaaattg

SEQ ID NO: 4549078 - DNA, 12 bp, Homo sapiens
atcctccacaga

SEQ ID NO: 4549079 - DNA, 15 bp, Homo sapiens
atcctccacagagag

SEQ ID NO: 4549080 - DNA, 16 bp, Homo sapiens
atcctccacagagagg

SEQ ID NO: 4549081 - DNA, 18 bp, Homo sapiens
atcctcccattgcccagt

SEQ ID NO: 4549082 - DNA, 20 bp, Homo sapiens
atcctcccattgcccagtga

SEQ ID NO: 4549083 - DNA, 18 bp, Homo sapiens
atcctccctccacctcaa

SEQ ID NO: 4549084 - DNA, 19 bp, Homo sapiens
atcctccctccacctcaag

SEQ ID NO: 4549085 - DNA, 21 bp, Homo sapiens
atcctccctgaccctgctcct

SEQ ID NO: 4549086 - DNA, 17 bp, Homo sapiens
atcctccctggcagaca

SEQ ID NO: 4549087 - DNA, 19 bp, Homo sapiens
atcctccctggcagacaca

SEQ ID NO: 4549088 - DNA, 15 bp, Homo sapiens
atcctccgtccagcc

SEQ ID NO: 4549089 - DNA, 16 bp, Homo sapiens
atcctccgtccagccg

SEQ ID NO: 4549090 - DNA, 12 bp, Homo sapiens
atcctcctgcct

SEQ ID NO: 4549091 - DNA, 19 bp, Homo sapiens
atcctcctgcctcagcctt

SEQ ID NO: 4549092 - DNA, 17 bp, Homo sapiens
atcctctccccctcctc

SEQ ID NO: 4549093 - DNA, 19 bp, Homo sapiens
atcctctctggggctgtgt

SEQ ID NO: 4549094 - DNA, 20 bp, Homo sapiens
atcctctctggggctgtgtt

SEQ ID NO: 4549095 - DNA, 20 bp, Homo sapiens
atcctctgtaaactttttgt

SEQ ID NO: 4549096 - DNA, 14 bp, Homo sapiens
atcctctgttaatg

SEQ ID NO: 4549097 - DNA, 19 bp, Homo sapiens
atcctctgttttctctctg

SEQ ID NO: 4549098 - DNA, 14 bp, Homo sapiens
atcctgactctgcc

SEQ ID NO: 4549099 - DNA, 15 bp, Homo sapiens
atcctgagtccagaa

SEQ ID NO: 4549100 - DNA, 15 bp, Homo sapiens
atcctgcaccccagc

SEQ ID NO: 4549101 - DNA, 19 bp, Homo sapiens
atcctgcagggcttctcct

SEQ ID NO: 4549102 - DNA, 20 bp, Homo sapiens
atcctgcagggcttctcctc

SEQ ID NO: 4549103 - DNA, 16 bp, Homo sapiens
atcctgcattgttagc

SEQ ID NO: 4549104 - DNA, 13 bp, Homo sapiens
atcctgcccctga

SEQ ID NO: 4549105 - DNA, 12 bp, Homo sapiens
atcctgcctgcc

SEQ ID NO: 4549106 - DNA, 21 bp, Homo sapiens
atcctgccttagagccaggca

SEQ ID NO: 4549107 - DNA, 23 bp, Homo sapiens
atcctgccttagagccaggcaca

SEQ ID NO: 4549108 - DNA, 23 bp, Homo sapiens
atcctgctgctttgggctgggat

SEQ ID NO: 4549109 - DNA, 18 bp, Homo sapiens
atcctggcccagggcatc

SEQ ID NO: 4549110 - DNA, 15 bp, Homo sapiens
atcctgtcagtgtca

SEQ ID NO: 4549111 - DNA, 22 bp, Homo sapiens
atcctgtgtacctcactgtcca

SEQ ID NO: 4549112 - DNA, 23 bp, Homo sapiens
atcctgtgtttcattacttgaat

SEQ ID NO: 4549113 - DNA, 13 bp, Homo sapiens
atccttacaagtt

SEQ ID NO: 4549114 - DNA, 14 bp, Homo sapiens
atccttattgttca

SEQ ID NO: 4549115 - DNA, 19 bp, Homo sapiens
atccttcattttagattaa

SEQ ID NO: 4549116 - DNA, 21 bp, Homo sapiens
atccttccagggctcttccag

SEQ ID NO: 4549117 - DNA, 20 bp, Homo sapiens
atccttcttccactgtctca

SEQ ID NO: 4549118 - DNA, 20 bp, Homo sapiens
atccttctttgtaatacttt

SEQ ID NO: 4549119 - DNA, 17 bp, Homo sapiens
atccttgaatcctatgt

SEQ ID NO: 4549120 - DNA, 14 bp, Homo sapiens
atccttgataatat

SEQ ID NO: 4549121 - DNA, 23 bp, Homo sapiens
atccttggagtcccaggggcagc

SEQ ID NO: 4549122 - DNA, 19 bp, Homo sapiens
atccttggctttcagagcc

SEQ ID NO: 4549123 - DNA, 22 bp, Homo sapiens
atccttgggccataattatgaa

SEQ ID NO: 4549124 - DNA, 11 bp, Homo sapiens
atcctttcaaa

SEQ ID NO: 4549125 - DNA, 18 bp, Homo sapiens
atcctttggtcctggtgc

SEQ ID NO: 4549126 - DNA, 12 bp, Homo sapiens
atccttttcctt

SEQ ID NO: 4549127 - DNA, 22 bp, Homo sapiens
atccttttccttatttgccttc

SEQ ID NO: 4549128 - DNA, 16 bp, Homo sapiens
atcgacttagcctgag

SEQ ID NO: 4549129 - DNA, 16 bp, Homo sapiens
atcgagaccatcctgg

SEQ ID NO: 4549130 - DNA, 19 bp, Homo sapiens
atcgagaccatcctggcta

SEQ ID NO: 4549131 - DNA, 12 bp, Homo sapiens
atcgatgtgctc

SEQ ID NO: 4549132 - DNA, 15 bp, Homo sapiens
atcgatgtgctcagc

SEQ ID NO: 4549133 - DNA, 21 bp, Homo sapiens
atcgcaagttaacttggaaat

SEQ ID NO: 4549134 - DNA, 20 bp, Homo sapiens
atcgcagaccttttttagga

SEQ ID NO: 4549135 - DNA, 20 bp, Homo sapiens
atcgcagcttcctgtctgtt

SEQ ID NO: 4549136 - DNA, 15 bp, Homo sapiens
atcgctgcacatggc

SEQ ID NO: 4549137 - DNA, 22 bp, Homo sapiens
atcgctgcacatggcctgagca

SEQ ID NO: 4549138 - DNA, 18 bp, Homo sapiens
atcgctgttctgggcatg

SEQ ID NO: 4549139 - DNA, 15 bp, Homo sapiens
atcggaaagctcttc

SEQ ID NO: 4549140 - DNA, 14 bp, Homo sapiens
atcggactctgccc

SEQ ID NO: 4549141 - DNA, 22 bp, Homo sapiens
atcggaggctgggcccctggga

SEQ ID NO: 4549142 - DNA, 23 bp, Homo sapiens
atcggcccacagctcccacccca

SEQ ID NO: 4549143 - DNA, 18 bp, Homo sapiens
atcgggaaagaagaaact

SEQ ID NO: 4549144 - DNA, 16 bp, Homo sapiens
atcggggagccgggag

SEQ ID NO: 4549145 - DNA, 18 bp, Homo sapiens
atcggggagccgggagcc

SEQ ID NO: 4549146 - DNA, 19 bp, Homo sapiens
atcggtcttgcccagagga

SEQ ID NO: 4549147 - DNA, 16 bp, Homo sapiens
atcgtaaccagccaga

SEQ ID NO: 4549148 - DNA, 14 bp, Homo sapiens
atcgtcctgggact

SEQ ID NO: 4549149 - DNA, 13 bp, Homo sapiens
atcgtccttcctc

SEQ ID NO: 4549150 - DNA, 15 bp, Homo sapiens
atcgtggcacgtatt

SEQ ID NO: 4549151 - DNA, 15 bp, Homo sapiens
atcgttatcactgtg

SEQ ID NO: 4549152 - DNA, 13 bp, Homo sapiens
atctaaaatgttt

SEQ ID NO: 4549153 - DNA, 21 bp, Homo sapiens
atctaaaatgttttatgacat

SEQ ID NO: 4549154 - DNA, 14 bp, Homo sapiens
atctaaagctttat

SEQ ID NO: 4549155 - DNA, 12 bp, Homo sapiens
atctaaagttat

SEQ ID NO: 4549156 - DNA, 14 bp, Homo sapiens
atctaaagttatat

SEQ ID NO: 4549157 - DNA, 16 bp, Homo sapiens
atctaaagttatattt

SEQ ID NO: 4549158 - DNA, 18 bp, Homo sapiens
atctaaagttatatttca

SEQ ID NO: 4549159 - DNA, 14 bp, Homo sapiens
atctaaatagtatt

SEQ ID NO: 4549160 - DNA, 15 bp, Homo sapiens
atctaaatgaaagtg

SEQ ID NO: 4549161 - DNA, 19 bp, Homo sapiens
atctaacaataatatttca

SEQ ID NO: 4549162 - DNA, 23 bp, Homo sapiens
atctaacaataatatttcaagtg

SEQ ID NO: 4549163 - DNA, 15 bp, Homo sapiens
atctaacctcatctt

SEQ ID NO: 4549164 - DNA, 20 bp, Homo sapiens
atctaactgatgagtaaact

SEQ ID NO: 4549165 - DNA, 21 bp, Homo sapiens
atctaacttcgaatatatctg

SEQ ID NO: 4549166 - DNA, 16 bp, Homo sapiens
atctaatatggccaca

SEQ ID NO: 4549167 - DNA, 16 bp, Homo sapiens
atctaatctgaactga

SEQ ID NO: 4549168 - DNA, 23 bp, Homo sapiens
atctaatctgaactgaccttgaa

SEQ ID NO: 4549169 - DNA, 14 bp, Homo sapiens
atctaatttataaa

SEQ ID NO: 4549170 - DNA, 12 bp, Homo sapiens
atctacaaagaa

SEQ ID NO: 4549171 - DNA, 13 bp, Homo sapiens
atctacaagccaa

SEQ ID NO: 4549172 - DNA, 17 bp, Homo sapiens
atctacaagccaaaagt

SEQ ID NO: 4549173 - DNA, 14 bp, Homo sapiens
atctacacacggtg

SEQ ID NO: 4549174 - DNA, 15 bp, Homo sapiens
atctacaccaatgaa

SEQ ID NO: 4549175 - DNA, 19 bp, Homo sapiens
atctacaccaatgaaaaca

SEQ ID NO: 4549176 - DNA, 18 bp, Homo sapiens
atctacactccagtgaga

SEQ ID NO: 4549177 - DNA, 16 bp, Homo sapiens
atctacagtaatgaaa

SEQ ID NO: 4549178 - DNA, 23 bp, Homo sapiens
atctacagtaatgaaatgtttac

SEQ ID NO: 4549179 - DNA, 21 bp, Homo sapiens
atctaccccagactagatgta

SEQ ID NO: 4549180 - DNA, 15 bp, Homo sapiens
atctactaattccac

SEQ ID NO: 4549181 - DNA, 17 bp, Homo sapiens
atctactggaaatgtag

SEQ ID NO: 4549182 - DNA, 13 bp, Homo sapiens
atctacttttttt

SEQ ID NO: 4549183 - DNA, 19 bp, Homo sapiens
atctagaagagtctattgt

SEQ ID NO: 4549184 - DNA, 14 bp, Homo sapiens
atctagaattcact

SEQ ID NO: 4549185 - DNA, 15 bp, Homo sapiens
atctagaattcactg

SEQ ID NO: 4549186 - DNA, 14 bp, Homo sapiens
atctagagaacagt

SEQ ID NO: 4549187 - DNA, 17 bp, Homo sapiens
atctagagaacagtatt

SEQ ID NO: 4549188 - DNA, 17 bp, Homo sapiens
atctataacataaagaa

SEQ ID NO: 4549189 - DNA, 23 bp, Homo sapiens
atctataaggtgctctctttctg

SEQ ID NO: 4549190 - DNA, 11 bp, Homo sapiens
atctataattt

SEQ ID NO: 4549191 - DNA, 13 bp, Homo sapiens
atctataatttac

SEQ ID NO: 4549192 - DNA, 23 bp, Homo sapiens
atctataatttacctaagattac

SEQ ID NO: 4549193 - DNA, 11 bp, Homo sapiens
atctatataaa

SEQ ID NO: 4549194 - DNA, 16 bp, Homo sapiens
atctatataaaataac

SEQ ID NO: 4549195 - DNA, 17 bp, Homo sapiens
atctatataaaataact

SEQ ID NO: 4549196 - DNA, 14 bp, Homo sapiens
atctatattaaatg

SEQ ID NO: 4549197 - DNA, 12 bp, Homo sapiens
atctatattaga

SEQ ID NO: 4549198 - DNA, 23 bp, Homo sapiens
atctatctacaaagaaaaattaa

SEQ ID NO: 4549199 - DNA, 15 bp, Homo sapiens
atctatctatttgag

SEQ ID NO: 4549200 - DNA, 19 bp, Homo sapiens
atctatctcatctatctca

SEQ ID NO: 4549201 - DNA, 20 bp, Homo sapiens
atctatctggtgatttctag

SEQ ID NO: 4549202 - DNA, 21 bp, Homo sapiens
atctatgagggtgtttcctct

SEQ ID NO: 4549203 - DNA, 19 bp, Homo sapiens
atctatggctttaaataaa

SEQ ID NO: 4549204 - DNA, 21 bp, Homo sapiens
atctatgggagattaaaacca

SEQ ID NO: 4549205 - DNA, 14 bp, Homo sapiens
atctatggttctaa

SEQ ID NO: 4549206 - DNA, 23 bp, Homo sapiens
atctatggttctaaatattgctt

SEQ ID NO: 4549207 - DNA, 20 bp, Homo sapiens
atctattgaaaatatatatt

SEQ ID NO: 4549208 - DNA, 17 bp, Homo sapiens
atctattgatttgaaaa

SEQ ID NO: 4549209 - DNA, 15 bp, Homo sapiens
atctatttaaaaaac

SEQ ID NO: 4549210 - DNA, 20 bp, Homo sapiens
atctatttaaaaaactgtat

SEQ ID NO: 4549211 - DNA, 14 bp, Homo sapiens
atctatttacataa

SEQ ID NO: 4549212 - DNA, 15 bp, Homo sapiens
atctatttacataaa

SEQ ID NO: 4549213 - DNA, 12 bp, Homo sapiens
atctatttgtac

SEQ ID NO: 4549214 - DNA, 15 bp, Homo sapiens
atctatttgtacaat

SEQ ID NO: 4549215 - DNA, 23 bp, Homo sapiens
atctatttgtacaattttaaagt

SEQ ID NO: 4549216 - DNA, 12 bp, Homo sapiens
atctattttatt

SEQ ID NO: 4549217 - DNA, 12 bp, Homo sapiens
atctattttgat

SEQ ID NO: 4549218 - DNA, 16 bp, Homo sapiens
atctattttgatgcag

SEQ ID NO: 4549219 - DNA, 18 bp, Homo sapiens
atctattttgatgcagca

SEQ ID NO: 4549220 - DNA, 21 bp, Homo sapiens
atctattttgatgcagcattt

SEQ ID NO: 4549221 - DNA, 15 bp, Homo sapiens
atctcaaaactgcac

SEQ ID NO: 4549222 - DNA, 19 bp, Homo sapiens
atctcaaaactgcactgtc

SEQ ID NO: 4549223 - DNA, 12 bp, Homo sapiens
atctcaaaatta

SEQ ID NO: 4549224 - DNA, 22 bp, Homo sapiens
atctcaatgtgcaataacttgt

SEQ ID NO: 4549225 - DNA, 18 bp, Homo sapiens
atctcaattgaaagcttt

SEQ ID NO: 4549226 - DNA, 13 bp, Homo sapiens
atctcacaggctg

SEQ ID NO: 4549227 - DNA, 16 bp, Homo sapiens
atctcacaggctgaga

SEQ ID NO: 4549228 - DNA, 16 bp, Homo sapiens
atctcacttagtcctt

SEQ ID NO: 4549229 - DNA, 16 bp, Homo sapiens
atctcactttgtaaat

SEQ ID NO: 4549230 - DNA, 22 bp, Homo sapiens
atctcactttgtaaataaaaac

SEQ ID NO: 4549231 - DNA, 23 bp, Homo sapiens
atctcactttgtaaataaaaaca

SEQ ID NO: 4549232 - DNA, 13 bp, Homo sapiens
atctcagaccctg

SEQ ID NO: 4549233 - DNA, 15 bp, Homo sapiens
atctcagagtccact

SEQ ID NO: 4549234 - DNA, 18 bp, Homo sapiens
atctcagatgttaaaata

SEQ ID NO: 4549235 - DNA, 14 bp, Homo sapiens
atctcagccatagg

SEQ ID NO: 4549236 - DNA, 12 bp, Homo sapiens
atctcagccatt

SEQ ID NO: 4549237 - DNA, 19 bp, Homo sapiens
atctcaggaagtccagcca

SEQ ID NO: 4549238 - DNA, 12 bp, Homo sapiens
atctcaggtgag

SEQ ID NO: 4549239 - DNA, 14 bp, Homo sapiens
atctcagtgaagaa

SEQ ID NO: 4549240 - DNA, 15 bp, Homo sapiens
atctcagtgaagaat

SEQ ID NO: 4549241 - DNA, 14 bp, Homo sapiens
atctcagtgctttc

SEQ ID NO: 4549242 - DNA, 17 bp, Homo sapiens
atctcagttgtttgctt

SEQ ID NO: 4549243 - DNA, 20 bp, Homo sapiens
atctcagttgtttgcttctt

SEQ ID NO: 4549244 - DNA, 15 bp, Homo sapiens
atctcatctatctca

SEQ ID NO: 4549245 - DNA, 20 bp, Homo sapiens
atctcatctcagtgaagaat

SEQ ID NO: 4549246 - DNA, 20 bp, Homo sapiens
atctcatgccagtgccttat

SEQ ID NO: 4549247 - DNA, 11 bp, Homo sapiens
atctcattatt

SEQ ID NO: 4549248 - DNA, 13 bp, Homo sapiens
atctcattatttc

SEQ ID NO: 4549249 - DNA, 17 bp, Homo sapiens
atctcattatttcaaaa

SEQ ID NO: 4549250 - DNA, 15 bp, Homo sapiens
atctcattggaccct

SEQ ID NO: 4549251 - DNA, 17 bp, Homo sapiens
atctcatttaagggaaa

SEQ ID NO: 4549252 - DNA, 23 bp, Homo sapiens
atctcatttaagggaaaaatata

SEQ ID NO: 4549253 - DNA, 18 bp, Homo sapiens
atctccaaggcagggacc

SEQ ID NO: 4549254 - DNA, 16 bp, Homo sapiens
atctccaatggaaagc

SEQ ID NO: 4549255 - DNA, 15 bp, Homo sapiens
atctccaattgcctc

SEQ ID NO: 4549256 - DNA, 15 bp, Homo sapiens
atctccatggccctg

SEQ ID NO: 4549257 - DNA, 22 bp, Homo sapiens
atctccatggccctgtcccagg

SEQ ID NO: 4549258 - DNA, 18 bp, Homo sapiens
atctcccattttggaatt

SEQ ID NO: 4549259 - DNA, 15 bp, Homo sapiens
atctccctgccgcct

SEQ ID NO: 4549260 - DNA, 19 bp, Homo sapiens
atctccctgccgcctcaat

SEQ ID NO: 4549261 - DNA, 15 bp, Homo sapiens
atctccctgcctggc

SEQ ID NO: 4549262 - DNA, 21 bp, Homo sapiens
atctccgttccatctgggctt

SEQ ID NO: 4549263 - DNA, 18 bp, Homo sapiens
atctcctatttttttaaa

SEQ ID NO: 4549264 - DNA, 20 bp, Homo sapiens
atctcctatttttttaaaat

SEQ ID NO: 4549265 - DNA, 22 bp, Homo sapiens
atctcctatttttttaaaatca

SEQ ID NO: 4549266 - DNA, 16 bp, Homo sapiens
atctcctctgctcatt

SEQ ID NO: 4549267 - DNA, 21 bp, Homo sapiens
atctcctctgctcattaaact

SEQ ID NO: 4549268 - DNA, 12 bp, Homo sapiens
atctcctgaaaa

SEQ ID NO: 4549269 - DNA, 22 bp, Homo sapiens
atctcgcagtgtttctgtgaat

SEQ ID NO: 4549270 - DNA, 19 bp, Homo sapiens
atctctcaaaacaatatta

SEQ ID NO: 4549271 - DNA, 23 bp, Homo sapiens
atctctcatattcgctagtgttt

SEQ ID NO: 4549272 - DNA, 21 bp, Homo sapiens
atctctctgccctctccctgt

SEQ ID NO: 4549273 - DNA, 20 bp, Homo sapiens
atctctctggggccctgggc

SEQ ID NO: 4549274 - DNA, 20 bp, Homo sapiens
atctctctgtcttttttctc

SEQ ID NO: 4549275 - DNA, 18 bp, Homo sapiens
atctctctgtgctgtgga

SEQ ID NO: 4549276 - DNA, 23 bp, Homo sapiens
atctctgactttctttagtcttt

SEQ ID NO: 4549277 - DNA, 20 bp, Homo sapiens
atctctgagttctgtgtatt

SEQ ID NO: 4549278 - DNA, 18 bp, Homo sapiens
atctctggcaccacacta

SEQ ID NO: 4549279 - DNA, 15 bp, Homo sapiens
atctctgttcttttc

SEQ ID NO: 4549280 - DNA, 22 bp, Homo sapiens
atctctgttcttttcccgcctc

SEQ ID NO: 4549281 - DNA, 20 bp, Homo sapiens
atctcttaagacagcatgtg

SEQ ID NO: 4549282 - DNA, 22 bp, Homo sapiens
atctcttaagacagcatgtgtt

SEQ ID NO: 4549283 - DNA, 18 bp, Homo sapiens
atctcttagctcccctcc

SEQ ID NO: 4549284 - DNA, 22 bp, Homo sapiens
atctcttagctcccctccaacc

SEQ ID NO: 4549285 - DNA, 20 bp, Homo sapiens
atctcttcattattctctgc

SEQ ID NO: 4549286 - DNA, 11 bp, Homo sapiens
atctcttcctt

SEQ ID NO: 4549287 - DNA, 13 bp, Homo sapiens
atctcttccttca

SEQ ID NO: 4549288 - DNA, 13 bp, Homo sapiens
atctcttctggtg

SEQ ID NO: 4549289 - DNA, 14 bp, Homo sapiens
atctcttcttccct

SEQ ID NO: 4549290 - DNA, 18 bp, Homo sapiens
atctcttggaaaataaga

SEQ ID NO: 4549291 - DNA, 20 bp, Homo sapiens
atctcttggaaaataagaca

SEQ ID NO: 4549292 - DNA, 14 bp, Homo sapiens
atctctttcccttc

SEQ ID NO: 4549293 - DNA, 15 bp, Homo sapiens
atctctttctaaaga

SEQ ID NO: 4549294 - DNA, 15 bp, Homo sapiens
atctctttgatctac

SEQ ID NO: 4549295 - DNA, 16 bp, Homo sapiens
atctctttgatctact

SEQ ID NO: 4549296 - DNA, 23 bp, Homo sapiens
atctcttttccactccattgtcg

SEQ ID NO: 4549297 - DNA, 19 bp, Homo sapiens
atctctttttgctttcgaa

SEQ ID NO: 4549298 - DNA, 23 bp, Homo sapiens
atctgaaggggcaaattcttttg

SEQ ID NO: 4549299 - DNA, 18 bp, Homo sapiens
atctgaatgtaatttgtg

SEQ ID NO: 4549300 - DNA, 14 bp, Homo sapiens
atctgaatttttaa

SEQ ID NO: 4549301 - DNA, 18 bp, Homo sapiens
atctgaatttttaaacaa

SEQ ID NO: 4549302 - DNA, 13 bp, Homo sapiens
atctgacaaaatg

SEQ ID NO: 4549303 - DNA, 18 bp, Homo sapiens
atctgaccgttctattgt

SEQ ID NO: 4549304 - DNA, 18 bp, Homo sapiens
atctgagcaaggagttta

SEQ ID NO: 4549305 - DNA, 19 bp, Homo sapiens
atctgaggaggctttggta

SEQ ID NO: 4549306 - DNA, 16 bp, Homo sapiens
atctgagtccagctcc

SEQ ID NO: 4549307 - DNA, 17 bp, Homo sapiens
atctgagtccagctccc

SEQ ID NO: 4549308 - DNA, 21 bp, Homo sapiens
atctgatggccttaatttcct

SEQ ID NO: 4549309 - DNA, 11 bp, Homo sapiens
atctgcaaaag

SEQ ID NO: 4549310 - DNA, 10 bp, Homo sapiens
atctgcaccc

SEQ ID NO: 4549311 - DNA, 21 bp, Homo sapiens
atctgcaccccttctctcctc

SEQ ID NO: 4549312 - DNA, 15 bp, Homo sapiens
atctgcaggacagag

SEQ ID NO: 4549313 - DNA, 13 bp, Homo sapiens
atctgcatatgtt

SEQ ID NO: 4549314 - DNA, 16 bp, Homo sapiens
atctgccaagggccga

SEQ ID NO: 4549315 - DNA, 11 bp, Homo sapiens
atctgccccag

SEQ ID NO: 4549316 - DNA, 11 bp, Homo sapiens
atctgcccctc

SEQ ID NO: 4549317 - DNA, 19 bp, Homo sapiens
atctgccttaaaaccaaag

SEQ ID NO: 4549318 - DNA, 20 bp, Homo sapiens
atctgcgggggcagtgctca

SEQ ID NO: 4549319 - DNA, 11 bp, Homo sapiens
atctgctgtcc

SEQ ID NO: 4549320 - DNA, 21 bp, Homo sapiens
atctgctgtccagacagcctg

SEQ ID NO: 4549321 - DNA, 16 bp, Homo sapiens
atctgctgtcctgttt

SEQ ID NO: 4549322 - DNA, 17 bp, Homo sapiens
atctgcttttcctctgc

SEQ ID NO: 4549323 - DNA, 16 bp, Homo sapiens
atctggagagaacagg

SEQ ID NO: 4549324 - DNA, 15 bp, Homo sapiens
atctggagagctaga

SEQ ID NO: 4549325 - DNA, 23 bp, Homo sapiens
atctggagagctagaacctggag

SEQ ID NO: 4549326 - DNA, 17 bp, Homo sapiens
atctggataggagcctg

SEQ ID NO: 4549327 - DNA, 18 bp, Homo sapiens
atctggataggagcctgc

SEQ ID NO: 4549328 - DNA, 20 bp, Homo sapiens
atctggataggagcctgctg

SEQ ID NO: 4549329 - DNA, 22 bp, Homo sapiens
atctggctgcagttttgctatc

SEQ ID NO: 4549330 - DNA, 16 bp, Homo sapiens
atctggcttagtgcca

SEQ ID NO: 4549331 - DNA, 17 bp, Homo sapiens
atctggcttagtgccac

SEQ ID NO: 4549332 - DNA, 23 bp, Homo sapiens
atctggcttagtgccacccacct

SEQ ID NO: 4549333 - DNA, 19 bp, Homo sapiens
atctggcttctgcattact

SEQ ID NO: 4549334 - DNA, 23 bp, Homo sapiens
atctggcttttcgcttgcttctg

SEQ ID NO: 4549335 - DNA, 20 bp, Homo sapiens
atctgggaaatgaggttttt

SEQ ID NO: 4549336 - DNA, 20 bp, Homo sapiens
atctgggaccctttccttcc

SEQ ID NO: 4549337 - DNA, 22 bp, Homo sapiens
atctgggaccctttccttcctt

SEQ ID NO: 4549338 - DNA, 20 bp, Homo sapiens
atctgggactgtgcctggct

SEQ ID NO: 4549339 - DNA, 21 bp, Homo sapiens
atctgggcattttcctcctct

SEQ ID NO: 4549340 - DNA, 22 bp, Homo sapiens
atctgggcattttcctcctctg

SEQ ID NO: 4549341 - DNA, 23 bp, Homo sapiens
atctggggtgggagtaacagggc

SEQ ID NO: 4549342 - DNA, 17 bp, Homo sapiens
atctggtgatttctagc

SEQ ID NO: 4549343 - DNA, 16 bp, Homo sapiens
atctggtgcctcctca

SEQ ID NO: 4549344 - DNA, 17 bp, Homo sapiens
atctggtgcctcctcaa

SEQ ID NO: 4549345 - DNA, 13 bp, Homo sapiens
atctgtaaactgt

SEQ ID NO: 4549346 - DNA, 16 bp, Homo sapiens
atctgtacctctgcct

SEQ ID NO: 4549347 - DNA, 15 bp, Homo sapiens
atctgtactttgtgt

SEQ ID NO: 4549348 - DNA, 13 bp, Homo sapiens
atctgtagtaatt

SEQ ID NO: 4549349 - DNA, 22 bp, Homo sapiens
atctgtagtaatttattgtctg

SEQ ID NO: 4549350 - DNA, 15 bp, Homo sapiens
atctgtagtgatgga

SEQ ID NO: 4549351 - DNA, 20 bp, Homo sapiens
atctgtagtgatggagttcc

SEQ ID NO: 4549352 - DNA, 20 bp, Homo sapiens
atctgtataatactttgtat

SEQ ID NO: 4549353 - DNA, 21 bp, Homo sapiens
atctgtataatactttgtata

SEQ ID NO: 4549354 - DNA, 23 bp, Homo sapiens
atctgtcaagtgggatctgtcac

SEQ ID NO: 4549355 - DNA, 13 bp, Homo sapiens
atctgtcagtgtt

SEQ ID NO: 4549356 - DNA, 21 bp, Homo sapiens
atctgtcatccatatttgcta

SEQ ID NO: 4549357 - DNA, 19 bp, Homo sapiens
atctgtccaaaggaggctg

SEQ ID NO: 4549358 - DNA, 16 bp, Homo sapiens
atctgtccctgcctca

SEQ ID NO: 4549359 - DNA, 23 bp, Homo sapiens
atctgtctgccaacctaaaactc

SEQ ID NO: 4549360 - DNA, 14 bp, Homo sapiens
atctgtctgtgcac

SEQ ID NO: 4549361 - DNA, 19 bp, Homo sapiens
atctgtctgtggcaaaagt

SEQ ID NO: 4549362 - DNA, 21 bp, Homo sapiens
atctgtcttgactttttaaaa

SEQ ID NO: 4549363 - DNA, 21 bp, Homo sapiens
atctgtcttttatttaacaaa

SEQ ID NO: 4549364 - DNA, 20 bp, Homo sapiens
atctgtgaagcctttatcta

SEQ ID NO: 4549365 - DNA, 20 bp, Homo sapiens
atctgtgacctgtcagaata

SEQ ID NO: 4549366 - DNA, 15 bp, Homo sapiens
atctgtgcaaacagt

SEQ ID NO: 4549367 - DNA, 17 bp, Homo sapiens
atctgtgctttccagct

SEQ ID NO: 4549368 - DNA, 16 bp, Homo sapiens
atctgtgggatgctga

SEQ ID NO: 4549369 - DNA, 12 bp, Homo sapiens
atctgtgtcttg

SEQ ID NO: 4549370 - DNA, 15 bp, Homo sapiens
atctgtgtgaaactt

SEQ ID NO: 4549371 - DNA, 18 bp, Homo sapiens
atctgttatagctttaaa

SEQ ID NO: 4549372 - DNA, 23 bp, Homo sapiens
atctgttattcaaatttgatgat

SEQ ID NO: 4549373 - DNA, 14 bp, Homo sapiens
atctgttgacaaat

SEQ ID NO: 4549374 - DNA, 20 bp, Homo sapiens
atctgttgacaaatgacaga

SEQ ID NO: 4549375 - DNA, 15 bp, Homo sapiens
atctgttttacagga

SEQ ID NO: 4549376 - DNA, 18 bp, Homo sapiens
atctgttttgaaggcaaa

SEQ ID NO: 4549377 - DNA, 10 bp, Homo sapiens
atcttaaaat

SEQ ID NO: 4549378 - DNA, 13 bp, Homo sapiens
atcttaaaataat

SEQ ID NO: 4549379 - DNA, 10 bp, Homo sapiens
atcttaaact

SEQ ID NO: 4549380 - DNA, 12 bp, Homo sapiens
atcttaaactaa

SEQ ID NO: 4549381 - DNA, 16 bp, Homo sapiens
atcttaaactaatacg

SEQ ID NO: 4549382 - DNA, 17 bp, Homo sapiens
atcttaaactaatacgt

SEQ ID NO: 4549383 - DNA, 13 bp, Homo sapiens
atcttaaattcat

SEQ ID NO: 4549384 - DNA, 17 bp, Homo sapiens
atcttaaattcatttct

SEQ ID NO: 4549385 - DNA, 18 bp, Homo sapiens
atcttaagcaggtttgtt

SEQ ID NO: 4549386 - DNA, 15 bp, Homo sapiens
atcttaagcagtaat

SEQ ID NO: 4549387 - DNA, 12 bp, Homo sapiens
atcttaatataa

SEQ ID NO: 4549388 - DNA, 13 bp, Homo sapiens
atcttaatataaa

SEQ ID NO: 4549389 - DNA, 16 bp, Homo sapiens
atcttaatatatttga

SEQ ID NO: 4549390 - DNA, 15 bp, Homo sapiens
atcttaatttattat

SEQ ID NO: 4549391 - DNA, 22 bp, Homo sapiens
atcttagggatgattaaaggca

SEQ ID NO: 4549392 - DNA, 18 bp, Homo sapiens
atcttaggggattatctt

SEQ ID NO: 4549393 - DNA, 13 bp, Homo sapiens
atcttagtgtatg

SEQ ID NO: 4549394 - DNA, 15 bp, Homo sapiens
atcttagtgtatgat

SEQ ID NO: 4549395 - DNA, 14 bp, Homo sapiens
atcttataattgtt

SEQ ID NO: 4549396 - DNA, 19 bp, Homo sapiens
atcttatactgtacaataa

SEQ ID NO: 4549397 - DNA, 21 bp, Homo sapiens
atcttatattggtttgcacaa

SEQ ID NO: 4549398 - DNA, 13 bp, Homo sapiens
atcttattgcttg

SEQ ID NO: 4549399 - DNA, 18 bp, Homo sapiens
atcttatttttcctgtcc

SEQ ID NO: 4549400 - DNA, 18 bp, Homo sapiens
atcttcaccctcatcctt

SEQ ID NO: 4549401 - DNA, 17 bp, Homo sapiens
atcttcagaactgccct

SEQ ID NO: 4549402 - DNA, 18 bp, Homo sapiens
atcttcagaactgccctt

SEQ ID NO: 4549403 - DNA, 18 bp, Homo sapiens
atcttcagaggtgctaaa

SEQ ID NO: 4549404 - DNA, 15 bp, Homo sapiens
atcttcgttagtaat

SEQ ID NO: 4549405 - DNA, 15 bp, Homo sapiens
atcttctccatctgg

SEQ ID NO: 4549406 - DNA, 19 bp, Homo sapiens
atcttctccatctggcagg

SEQ ID NO: 4549407 - DNA, 14 bp, Homo sapiens
atcttctgccttct

SEQ ID NO: 4549408 - DNA, 18 bp, Homo sapiens
atcttctgccttctcatg

SEQ ID NO: 4549409 - DNA, 12 bp, Homo sapiens
atcttctggctt

SEQ ID NO: 4549410 - DNA, 14 bp, Homo sapiens
atcttcttcaccat

SEQ ID NO: 4549411 - DNA, 18 bp, Homo sapiens
atcttctttattattcct

SEQ ID NO: 4549412 - DNA, 23 bp, Homo sapiens
atcttgaaattaagaaggcaaaa

SEQ ID NO: 4549413 - DNA, 15 bp, Homo sapiens
atcttgagaaccttt

SEQ ID NO: 4549414 - DNA, 23 bp, Homo sapiens
atcttgagccacagtcactggat

SEQ ID NO: 4549415 - DNA, 18 bp, Homo sapiens
atcttgatctttgagccc

SEQ ID NO: 4549416 - DNA, 12 bp, Homo sapiens
atcttgcccact

SEQ ID NO: 4549417 - DNA, 16 bp, Homo sapiens
atcttgctaccagtat

SEQ ID NO: 4549418 - DNA, 23 bp, Homo sapiens
atcttgctaccagtatttagaag

SEQ ID NO: 4549419 - DNA, 14 bp, Homo sapiens
atcttgcttcagac

SEQ ID NO: 4549420 - DNA, 22 bp, Homo sapiens
atcttggacaaatcacatattt

SEQ ID NO: 4549421 - DNA, 20 bp, Homo sapiens
atcttggcctaaacctcagt

SEQ ID NO: 4549422 - DNA, 21 bp, Homo sapiens
atcttggcctaaacctcagtt

SEQ ID NO: 4549423 - DNA, 22 bp, Homo sapiens
atcttggctgtttcaaaaaaat

SEQ ID NO: 4549424 - DNA, 18 bp, Homo sapiens
atcttgtacaaactttgt

SEQ ID NO: 4549425 - DNA, 20 bp, Homo sapiens
atcttgttattaatgtttct

SEQ ID NO: 4549426 - DNA, 14 bp, Homo sapiens
atcttgttcaggaa

SEQ ID NO: 4549427 - DNA, 21 bp, Homo sapiens
atcttgtttacaataaagaat

SEQ ID NO: 4549428 - DNA, 14 bp, Homo sapiens
atcttgtttatagc

SEQ ID NO: 4549429 - DNA, 17 bp, Homo sapiens
atcttgttttgaaaata

SEQ ID NO: 4549430 - DNA, 14 bp, Homo sapiens
atctttaagaaaaa

SEQ ID NO: 4549431 - DNA, 16 bp, Homo sapiens
atctttaagaatgctt

SEQ ID NO: 4549432 - DNA, 17 bp, Homo sapiens
atctttacaaaactaca

SEQ ID NO: 4549433 - DNA, 18 bp, Homo sapiens
atctttaccaaaaaccat

SEQ ID NO: 4549434 - DNA, 13 bp, Homo sapiens
atctttattaaaa

SEQ ID NO: 4549435 - DNA, 19 bp, Homo sapiens
atctttattaaaacaaaag

SEQ ID NO: 4549436 - DNA, 23 bp, Homo sapiens
atctttattggcttgataaacat

SEQ ID NO: 4549437 - DNA, 18 bp, Homo sapiens
atctttcaaaccagcttc

SEQ ID NO: 4549438 - DNA, 14 bp, Homo sapiens
atctttcagttatt

SEQ ID NO: 4549439 - DNA, 18 bp, Homo sapiens
atctttccctaaagaaga

SEQ ID NO: 4549440 - DNA, 22 bp, Homo sapiens
atctttcctagtacattttcac

SEQ ID NO: 4549441 - DNA, 13 bp, Homo sapiens
atctttgaaataa

SEQ ID NO: 4549442 - DNA, 13 bp, Homo sapiens
atctttgactgaa

SEQ ID NO: 4549443 - DNA, 13 bp, Homo sapiens
atctttgagccca

SEQ ID NO: 4549444 - DNA, 15 bp, Homo sapiens
atctttgattctcct

SEQ ID NO: 4549445 - DNA, 18 bp, Homo sapiens
atctttgattctccttca

SEQ ID NO: 4549446 - DNA, 19 bp, Homo sapiens
atctttgccaagtaagagt

SEQ ID NO: 4549447 - DNA, 12 bp, Homo sapiens
atctttgctgtt

SEQ ID NO: 4549448 - DNA, 17 bp, Homo sapiens
atctttgtattcttcat

SEQ ID NO: 4549449 - DNA, 20 bp, Homo sapiens
atctttgtattcttcatgaa

SEQ ID NO: 4549450 - DNA, 16 bp, Homo sapiens
atctttgtttaaatgc

SEQ ID NO: 4549451 - DNA, 18 bp, Homo sapiens
atcttttatcctgggagc

SEQ ID NO: 4549452 - DNA, 14 bp, Homo sapiens
atcttttatttaag

SEQ ID NO: 4549453 - DNA, 13 bp, Homo sapiens
atcttttgaagag

SEQ ID NO: 4549454 - DNA, 13 bp, Homo sapiens
atcttttgaattc

SEQ ID NO: 4549455 - DNA, 21 bp, Homo sapiens
atcttttgtatatctaagact

SEQ ID NO: 4549456 - DNA, 17 bp, Homo sapiens
atcttttgtgcctagat

SEQ ID NO: 4549457 - DNA, 15 bp, Homo sapiens
atctttttaaagctt

SEQ ID NO: 4549458 - DNA, 18 bp, Homo sapiens
atctttttacctttcata

SEQ ID NO: 4549459 - DNA, 19 bp, Homo sapiens
atctttttacctttcatac

SEQ ID NO: 4549460 - DNA, 19 bp, Homo sapiens
atctttttatcatgatcct

SEQ ID NO: 4549461 - DNA, 17 bp, Homo sapiens
atcttttttaaactgta

SEQ ID NO: 4549462 - DNA, 21 bp, Homo sapiens
atcttttttaaactgtaaagt

SEQ ID NO: 4549463 - DNA, 13 bp, Homo sapiens
atcttttttcctt

SEQ ID NO: 4549464 - DNA, 16 bp, Homo sapiens
atgaaaaaatgtatat

SEQ ID NO: 4549465 - DNA, 15 bp, Homo sapiens
atgaaaaagaagaat

SEQ ID NO: 4549466 - DNA, 16 bp, Homo sapiens
atgaaaaagctgcttc

SEQ ID NO: 4549467 - DNA, 18 bp, Homo sapiens
atgaaaaattggggagga

SEQ ID NO: 4549468 - DNA, 21 bp, Homo sapiens
atgaaaaccgtaaagtgcctt

SEQ ID NO: 4549469 - DNA, 16 bp, Homo sapiens
atgaaaactctttgct

SEQ ID NO: 4549470 - DNA, 22 bp, Homo sapiens
atgaaaagacaagaaaatcagg

SEQ ID NO: 4549471 - DNA, 18 bp, Homo sapiens
atgaaaaggtgattgtca

SEQ ID NO: 4549472 - DNA, 21 bp, Homo sapiens
atgaaaaggttgcctgaaaaa

SEQ ID NO: 4549473 - DNA, 17 bp, Homo sapiens
atgaaaataaaacacac

SEQ ID NO: 4549474 - DNA, 19 bp, Homo sapiens
atgaaaataactgaatttg

SEQ ID NO: 4549475 - DNA, 22 bp, Homo sapiens
atgaaaatacaacttaaataat

SEQ ID NO: 4549476 - DNA, 10 bp, Homo sapiens
atgaaaatat

SEQ ID NO: 4549477 - DNA, 12 bp, Homo sapiens
atgaaaatctta

SEQ ID NO: 4549478 - DNA, 13 bp, Homo sapiens
atgaaaatgagcc

SEQ ID NO: 4549479 - DNA, 14 bp, Homo sapiens
atgaaaatgagccc

SEQ ID NO: 4549480 - DNA, 21 bp, Homo sapiens
atgaaaatgtattcctttaaa

SEQ ID NO: 4549481 - DNA, 15 bp, Homo sapiens
atgaaaatgtcttgt

SEQ ID NO: 4549482 - DNA, 16 bp, Homo sapiens
atgaaaatgtcttgtg

SEQ ID NO: 4549483 - DNA, 15 bp, Homo sapiens
atgaaacatcatttc

SEQ ID NO: 4549484 - DNA, 15 bp, Homo sapiens
atgaaagcagggact

SEQ ID NO: 4549485 - DNA, 22 bp, Homo sapiens
atgaaaggtgccatggaagagg

SEQ ID NO: 4549486 - DNA, 21 bp, Homo sapiens
atgaaagtgttaattttacct

SEQ ID NO: 4549487 - DNA, 14 bp, Homo sapiens
atgaaataaaatat

SEQ ID NO: 4549488 - DNA, 22 bp, Homo sapiens
atgaaataggagggaaaccttt

SEQ ID NO: 4549489 - DNA, 17 bp, Homo sapiens
atgaaatgataaagact

SEQ ID NO: 4549490 - DNA, 19 bp, Homo sapiens
atgaaatgataaagacttt

SEQ ID NO: 4549491 - DNA, 23 bp, Homo sapiens
atgaaatgataaagacttttatg

SEQ ID NO: 4549492 - DNA, 14 bp, Homo sapiens
atgaaatgccaaag

SEQ ID NO: 4549493 - DNA, 15 bp, Homo sapiens
atgaaattttttagt

SEQ ID NO: 4549494 - DNA, 15 bp, Homo sapiens
atgaacaaaattatt

SEQ ID NO: 4549495 - DNA, 14 bp, Homo sapiens
atgaacaatgtata

SEQ ID NO: 4549496 - DNA, 16 bp, Homo sapiens
atgaacacttaataaa

SEQ ID NO: 4549497 - DNA, 21 bp, Homo sapiens
atgaacagaacatagacagaa

SEQ ID NO: 4549498 - DNA, 21 bp, Homo sapiens
atgaacatagactagagaaac

SEQ ID NO: 4549499 - DNA, 14 bp, Homo sapiens
atgaacatattcat

SEQ ID NO: 4549500 - DNA, 14 bp, Homo sapiens
atgaacatcccttt

SEQ ID NO: 4549501 - DNA, 13 bp, Homo sapiens
atgaacattccaa

SEQ ID NO: 4549502 - DNA, 13 bp, Homo sapiens
atgaacattgtac

SEQ ID NO: 4549503 - DNA, 14 bp, Homo sapiens
atgaacattgtact

SEQ ID NO: 4549504 - DNA, 15 bp, Homo sapiens
atgaacgccaaggaa

SEQ ID NO: 4549505 - DNA, 13 bp, Homo sapiens
atgaactttaaaa

SEQ ID NO: 4549506 - DNA, 23 bp, Homo sapiens
atgaagaaagggaggcccagccg

SEQ ID NO: 4549507 - DNA, 14 bp, Homo sapiens
atgaagaaagtgga

SEQ ID NO: 4549508 - DNA, 17 bp, Homo sapiens
atgaagagctagagaaa

SEQ ID NO: 4549509 - DNA, 18 bp, Homo sapiens
atgaagagctagagaaat

SEQ ID NO: 4549510 - DNA, 17 bp, Homo sapiens
atgaagcaattagtctg

SEQ ID NO: 4549511 - DNA, 18 bp, Homo sapiens
atgaaggctggaaggcag

SEQ ID NO: 4549512 - DNA, 13 bp, Homo sapiens
atgaagtactcat

SEQ ID NO: 4549513 - DNA, 20 bp, Homo sapiens
atgaagtcataggttacaga

SEQ ID NO: 4549514 - DNA, 14 bp, Homo sapiens
atgaagttttacat

SEQ ID NO: 4549515 - DNA, 21 bp, Homo sapiens
atgaagtttttaaaaataaag

SEQ ID NO: 4549516 - DNA, 23 bp, Homo sapiens
atgaagtttttaaaaataaagga

SEQ ID NO: 4549517 - DNA, 14 bp, Homo sapiens
atgaataaaattag

SEQ ID NO: 4549518 - DNA, 23 bp, Homo sapiens
atgaataaagaatgccatttctc

SEQ ID NO: 4549519 - DNA, 19 bp, Homo sapiens
atgaataacatttaaattc

SEQ ID NO: 4549520 - DNA, 18 bp, Homo sapiens
atgaataatgcctttgta

SEQ ID NO: 4549521 - DNA, 19 bp, Homo sapiens
atgaataatgcctttgtaa

SEQ ID NO: 4549522 - DNA, 21 bp, Homo sapiens
atgaatatcatgcaaataaat

SEQ ID NO: 4549523 - DNA, 14 bp, Homo sapiens
atgaatatgatgac

SEQ ID NO: 4549524 - DNA, 21 bp, Homo sapiens
atgaatattttcaagtttttc

SEQ ID NO: 4549525 - DNA, 23 bp, Homo sapiens
atgaatattttcaagtttttcat

SEQ ID NO: 4549526 - DNA, 12 bp, Homo sapiens
atgaatattttg

SEQ ID NO: 4549527 - DNA, 19 bp, Homo sapiens
atgaatattttgataataa

SEQ ID NO: 4549528 - DNA, 16 bp, Homo sapiens
atgaatcgcaagttaa

SEQ ID NO: 4549529 - DNA, 21 bp, Homo sapiens
atgaatcttatgcaaaacttt

SEQ ID NO: 4549530 - DNA, 15 bp, Homo sapiens
atgaatgattaaatt

SEQ ID NO: 4549531 - DNA, 18 bp, Homo sapiens
atgaatgattaaattatg

SEQ ID NO: 4549532 - DNA, 20 bp, Homo sapiens
atgaatgattaaattatgaa

SEQ ID NO: 4549533 - DNA, 12 bp, Homo sapiens
atgaatgcagat

SEQ ID NO: 4549534 - DNA, 16 bp, Homo sapiens
atgaatgcttttagtg

SEQ ID NO: 4549535 - DNA, 18 bp, Homo sapiens
atgaatggactcatctta

SEQ ID NO: 4549536 - DNA, 15 bp, Homo sapiens
atgaatgtactatgt

SEQ ID NO: 4549537 - DNA, 14 bp, Homo sapiens
atgaattaaagtgg

SEQ ID NO: 4549538 - DNA, 20 bp, Homo sapiens
atgaattctttgtttatgca

SEQ ID NO: 4549539 - DNA, 15 bp, Homo sapiens
atgaatttatcttta

SEQ ID NO: 4549540 - DNA, 14 bp, Homo sapiens
atgaattttaaagt

SEQ ID NO: 4549541 - DNA, 15 bp, Homo sapiens
atgaattttaaagta

SEQ ID NO: 4549542 - DNA, 22 bp, Homo sapiens
atgaattttaaagtatgcatta

SEQ ID NO: 4549543 - DNA, 22 bp, Homo sapiens
atgaattttcaagtaattgtga

SEQ ID NO: 4549544 - DNA, 14 bp, Homo sapiens
atgacaaaaaatgt

SEQ ID NO: 4549545 - DNA, 16 bp, Homo sapiens
atgacacccatgccag

SEQ ID NO: 4549546 - DNA, 18 bp, Homo sapiens
atgacagcctctatccta

SEQ ID NO: 4549547 - DNA, 16 bp, Homo sapiens
atgacagctgtccctg

SEQ ID NO: 4549548 - DNA, 17 bp, Homo sapiens
atgacaggcctgaagat

SEQ ID NO: 4549549 - DNA, 11 bp, Homo sapiens
atgacagtgaa

SEQ ID NO: 4549550 - DNA, 20 bp, Homo sapiens
atgacataacagtgcagggc

SEQ ID NO: 4549551 - DNA, 20 bp, Homo sapiens
atgacatctttttaaagctt

SEQ ID NO: 4549552 - DNA, 23 bp, Homo sapiens
atgaccacataagaaggcaattt

SEQ ID NO: 4549553 - DNA, 12 bp, Homo sapiens
atgaccagaagc

SEQ ID NO: 4549554 - DNA, 14 bp, Homo sapiens
atgaccagaagcct

SEQ ID NO: 4549555 - DNA, 18 bp, Homo sapiens
atgaccagggatgctggg

SEQ ID NO: 4549556 - DNA, 23 bp, Homo sapiens
atgaccagggatgctgggctggg

SEQ ID NO: 4549557 - DNA, 15 bp, Homo sapiens
atgaccatgttatat

SEQ ID NO: 4549558 - DNA, 17 bp, Homo sapiens
atgaccttggggtacaa

SEQ ID NO: 4549559 - DNA, 16 bp, Homo sapiens
atgacgacaaagctgc

SEQ ID NO: 4549560 - DNA, 16 bp, Homo sapiens
atgacgggatgctctt

SEQ ID NO: 4549561 - DNA, 17 bp, Homo sapiens
atgacgtggtaaaatgt

SEQ ID NO: 4549562 - DNA, 23 bp, Homo sapiens
atgacgtggtaaaatgtgaaaaa

SEQ ID NO: 4549563 - DNA, 20 bp, Homo sapiens
atgacttagcgtcaagacat

SEQ ID NO: 4549564 - DNA, 22 bp, Homo sapiens
atgacttccttatttctgaaca

SEQ ID NO: 4549565 - DNA, 18 bp, Homo sapiens
atgacttttaaaatttgt

SEQ ID NO: 4549566 - DNA, 13 bp, Homo sapiens
atgactttttata

SEQ ID NO: 4549567 - DNA, 15 bp, Homo sapiens
atgactttttataaa

SEQ ID NO: 4549568 - DNA, 20 bp, Homo sapiens
atgagaaacttaaatgttat

SEQ ID NO: 4549569 - DNA, 18 bp, Homo sapiens
atgagaaaggacagagcc

SEQ ID NO: 4549570 - DNA, 16 bp, Homo sapiens
atgagaatcatgcact

SEQ ID NO: 4549571 - DNA, 23 bp, Homo sapiens
atgagaatctacccccagatcca

SEQ ID NO: 4549572 - DNA, 19 bp, Homo sapiens
atgagacagacattcacct

SEQ ID NO: 4549573 - DNA, 18 bp, Homo sapiens
atgagactctagggtcca

SEQ ID NO: 4549574 - DNA, 15 bp, Homo sapiens
atgagatactttgca

SEQ ID NO: 4549575 - DNA, 22 bp, Homo sapiens
atgagatttactgctctagaaa

SEQ ID NO: 4549576 - DNA, 20 bp, Homo sapiens
atgagatttttaaaaaatat

SEQ ID NO: 4549577 - DNA, 20 bp, Homo sapiens
atgagcaaccacatttagaa

SEQ ID NO: 4549578 - DNA, 20 bp, Homo sapiens
atgagcacatctctctgccc

SEQ ID NO: 4549579 - DNA, 21 bp, Homo sapiens
atgagcacatctctctgccct

SEQ ID NO: 4549580 - DNA, 12 bp, Homo sapiens
atgagcaggagc

SEQ ID NO: 4549581 - DNA, 16 bp, Homo sapiens
atgagcaggagcttgg

SEQ ID NO: 4549582 - DNA, 19 bp, Homo sapiens
atgagccatgatttcccac

SEQ ID NO: 4549583 - DNA, 14 bp, Homo sapiens
atgagccctggctc

SEQ ID NO: 4549584 - DNA, 15 bp, Homo sapiens
atgagccgcccaagg

SEQ ID NO: 4549585 - DNA, 21 bp, Homo sapiens
atgagccgcccaaggccttcc

SEQ ID NO: 4549586 - DNA, 19 bp, Homo sapiens
atgagctatcctttcaaac

SEQ ID NO: 4549587 - DNA, 20 bp, Homo sapiens
atgagctatcctttcaaaca

SEQ ID NO: 4549588 - DNA, 22 bp, Homo sapiens
atgagctcgcatttgtcaatga

SEQ ID NO: 4549589 - DNA, 18 bp, Homo sapiens
atgaggagagaaaatata

SEQ ID NO: 4549590 - DNA, 19 bp, Homo sapiens
atgaggagagaaaatatat

SEQ ID NO: 4549591 - DNA, 14 bp, Homo sapiens
atgaggaggggagg

SEQ ID NO: 4549592 - DNA, 17 bp, Homo sapiens
atgaggccatctcagga

SEQ ID NO: 4549593 - DNA, 20 bp, Homo sapiens
atgaggccatctcaggagat

SEQ ID NO: 4549594 - DNA, 17 bp, Homo sapiens
atgagggagatgccatg

SEQ ID NO: 4549595 - DNA, 14 bp, Homo sapiens
atgaggtgggaggt

SEQ ID NO: 4549596 - DNA, 18 bp, Homo sapiens
atgagtcactgagcatca

SEQ ID NO: 4549597 - DNA, 22 bp, Homo sapiens
atgagtcatttgtttaaacaat

SEQ ID NO: 4549598 - DNA, 21 bp, Homo sapiens
atgagtctacctgagcattca

SEQ ID NO: 4549599 - DNA, 22 bp, Homo sapiens
atgagtgggcttcggagtgaat

SEQ ID NO: 4549600 - DNA, 17 bp, Homo sapiens
atgagttaactgtgaaa

SEQ ID NO: 4549601 - DNA, 20 bp, Homo sapiens
atgagttattggattagacc

SEQ ID NO: 4549602 - DNA, 15 bp, Homo sapiens
atgagttcaaatact

SEQ ID NO: 4549603 - DNA, 16 bp, Homo sapiens
atgagttcaaatactt

SEQ ID NO: 4549604 - DNA, 19 bp, Homo sapiens
atgagttcaaatacttttg

SEQ ID NO: 4549605 - DNA, 18 bp, Homo sapiens
atgagttccagaaagtaa

SEQ ID NO: 4549606 - DNA, 20 bp, Homo sapiens
atgagttgttttcagactca

SEQ ID NO: 4549607 - DNA, 23 bp, Homo sapiens
atgagttgttttcagactcagac

SEQ ID NO: 4549608 - DNA, 13 bp, Homo sapiens
atgagtttaaaaa

SEQ ID NO: 4549609 - DNA, 22 bp, Homo sapiens
atgagtttaaaaatcaactttt

SEQ ID NO: 4549610 - DNA, 23 bp, Homo sapiens
atgagtttgtattattacaaata

SEQ ID NO: 4549611 - DNA, 17 bp, Homo sapiens
atgataaagagacagtg

SEQ ID NO: 4549612 - DNA, 15 bp, Homo sapiens
atgataagacatttt

SEQ ID NO: 4549613 - DNA, 16 bp, Homo sapiens
atgataattatttaca

SEQ ID NO: 4549614 - DNA, 16 bp, Homo sapiens
atgatacagtgttaaa

SEQ ID NO: 4549615 - DNA, 21 bp, Homo sapiens
atgataccagcagcaactgaa

SEQ ID NO: 4549616 - DNA, 17 bp, Homo sapiens
atgatacccaacagttt

SEQ ID NO: 4549617 - DNA, 17 bp, Homo sapiens
atgatactgattatgaa

SEQ ID NO: 4549618 - DNA, 20 bp, Homo sapiens
atgatactgattatgaaatg

SEQ ID NO: 4549619 - DNA, 18 bp, Homo sapiens
atgatagcagacattgtt

SEQ ID NO: 4549620 - DNA, 20 bp, Homo sapiens
atgatagcgggaaaaggaga

SEQ ID NO: 4549621 - DNA, 19 bp, Homo sapiens
atgatagcgtgcagtagag

SEQ ID NO: 4549622 - DNA, 12 bp, Homo sapiens
atgatatgcatg

SEQ ID NO: 4549623 - DNA, 19 bp, Homo sapiens
atgatatgcatgtagcata

SEQ ID NO: 4549624 - DNA, 18 bp, Homo sapiens
atgatcaatcctttatta

SEQ ID NO: 4549625 - DNA, 18 bp, Homo sapiens
atgatcacatctaaagct

SEQ ID NO: 4549626 - DNA, 18 bp, Homo sapiens
atgatcaccgactgaaaa

SEQ ID NO: 4549627 - DNA, 12 bp, Homo sapiens
atgatcctccca

SEQ ID NO: 4549628 - DNA, 13 bp, Homo sapiens
atgatcctcccac

SEQ ID NO: 4549629 - DNA, 14 bp, Homo sapiens
atgatctccctgcc

SEQ ID NO: 4549630 - DNA, 15 bp, Homo sapiens
atgatctcggctcac

SEQ ID NO: 4549631 - DNA, 22 bp, Homo sapiens
atgatgaacttataatgattaa

SEQ ID NO: 4549632 - DNA, 12 bp, Homo sapiens
atgatgaatgag

SEQ ID NO: 4549633 - DNA, 15 bp, Homo sapiens
atgatgaatgagaat

SEQ ID NO: 4549634 - DNA, 18 bp, Homo sapiens
atgatgatacagtgttaa

SEQ ID NO: 4549635 - DNA, 15 bp, Homo sapiens
atgatgcagtctcct

SEQ ID NO: 4549636 - DNA, 15 bp, Homo sapiens
atgatgcctttataa

SEQ ID NO: 4549637 - DNA, 22 bp, Homo sapiens
atgatgctcaaaatctttccaa

SEQ ID NO: 4549638 - DNA, 12 bp, Homo sapiens
atgatggagcaa

SEQ ID NO: 4549639 - DNA, 15 bp, Homo sapiens
atgatggatgccaat

SEQ ID NO: 4549640 - DNA, 14 bp, Homo sapiens
atgatggtttaata

SEQ ID NO: 4549641 - DNA, 21 bp, Homo sapiens
atgatgttaaaaaaataagaa

SEQ ID NO: 4549642 - DNA, 20 bp, Homo sapiens
atgatgttaaatgtaatata

SEQ ID NO: 4549643 - DNA, 18 bp, Homo sapiens
atgattaaattatgaagc

SEQ ID NO: 4549644 - DNA, 21 bp, Homo sapiens
atgattaaattttagtacatt

SEQ ID NO: 4549645 - DNA, 23 bp, Homo sapiens
atgattaagggacatttctataa

SEQ ID NO: 4549646 - DNA, 22 bp, Homo sapiens
atgattagaaattacctgtgga

SEQ ID NO: 4549647 - DNA, 23 bp, Homo sapiens
atgattagaaattacctgtggat

SEQ ID NO: 4549648 - DNA, 23 bp, Homo sapiens
atgattagcaagttacagtgatg

SEQ ID NO: 4549649 - DNA, 23 bp, Homo sapiens
atgattatacaaaagagcatgga

SEQ ID NO: 4549650 - DNA, 17 bp, Homo sapiens
atgattatattcacaga

SEQ ID NO: 4549651 - DNA, 12 bp, Homo sapiens
atgattcaagcc

SEQ ID NO: 4549652 - DNA, 23 bp, Homo sapiens
atgattctatttatatgtacatg

SEQ ID NO: 4549653 - DNA, 15 bp, Homo sapiens
atgattggttcagtt

SEQ ID NO: 4549654 - DNA, 16 bp, Homo sapiens
atgattggttcagttt

SEQ ID NO: 4549655 - DNA, 19 bp, Homo sapiens
atgatttaaagactacaat

SEQ ID NO: 4549656 - DNA, 21 bp, Homo sapiens
atgatttactcttagagatga

SEQ ID NO: 4549657 - DNA, 15 bp, Homo sapiens
atgatttagtgttgt

SEQ ID NO: 4549658 - DNA, 13 bp, Homo sapiens
atgatttcattca

SEQ ID NO: 4549659 - DNA, 18 bp, Homo sapiens
atgatttccttgaatgtg

SEQ ID NO: 4549660 - DNA, 19 bp, Homo sapiens
atgatttccttgaatgtgg

SEQ ID NO: 4549661 - DNA, 15 bp, Homo sapiens
atgattttcataact

SEQ ID NO: 4549662 - DNA, 17 bp, Homo sapiens
atgatttttttttcata

SEQ ID NO: 4549663 - DNA, 22 bp, Homo sapiens
atgcaaacgttggagtttgggc

SEQ ID NO: 4549664 - DNA, 14 bp, Homo sapiens
atgcaaactgcttt

SEQ ID NO: 4549665 - DNA, 12 bp, Homo sapiens
atgcaaagcact

SEQ ID NO: 4549666 - DNA, 13 bp, Homo sapiens
atgcaaagcactg

SEQ ID NO: 4549667 - DNA, 14 bp, Homo sapiens
atgcaaagcactga

SEQ ID NO: 4549668 - DNA, 15 bp, Homo sapiens
atgcaaagcactgac

SEQ ID NO: 4549669 - DNA, 17 bp, Homo sapiens
atgcaaagtacaatgtg

SEQ ID NO: 4549670 - DNA, 14 bp, Homo sapiens
atgcaaattgtgaa

SEQ ID NO: 4549671 - DNA, 15 bp, Homo sapiens
atgcaaattgtgaaa

SEQ ID NO: 4549672 - DNA, 16 bp, Homo sapiens
atgcaaattgtgaaat

SEQ ID NO: 4549673 - DNA, 16 bp, Homo sapiens
atgcaacaaatgtggc

SEQ ID NO: 4549674 - DNA, 23 bp, Homo sapiens
atgcaacaaatgtggccaagcct

SEQ ID NO: 4549675 - DNA, 23 bp, Homo sapiens
atgcaacatacgggaagtttatt

SEQ ID NO: 4549676 - DNA, 23 bp, Homo sapiens
atgcaacgggattgaagggtcct

SEQ ID NO: 4549677 - DNA, 23 bp, Homo sapiens
atgcaactggagttccttatccc

SEQ ID NO: 4549678 - DNA, 18 bp, Homo sapiens
atgcaagagtggactgaa

SEQ ID NO: 4549679 - DNA, 16 bp, Homo sapiens
atgcaagcagcttttt

SEQ ID NO: 4549680 - DNA, 14 bp, Homo sapiens
atgcaaggaccagg

SEQ ID NO: 4549681 - DNA, 22 bp, Homo sapiens
atgcaaggaccaggactccctc

SEQ ID NO: 4549682 - DNA, 15 bp, Homo sapiens
atgcaataaaattat

SEQ ID NO: 4549683 - DNA, 22 bp, Homo sapiens
atgcaataaaattatttgcagg

SEQ ID NO: 4549684 - DNA, 15 bp, Homo sapiens
atgcaataactctgg

SEQ ID NO: 4549685 - DNA, 14 bp, Homo sapiens
atgcaatatttgta

SEQ ID NO: 4549686 - DNA, 15 bp, Homo sapiens
atgcaattagaattt

SEQ ID NO: 4549687 - DNA, 19 bp, Homo sapiens
atgcaatttgaagtaactt

SEQ ID NO: 4549688 - DNA, 15 bp, Homo sapiens
atgcacaaaactact

SEQ ID NO: 4549689 - DNA, 18 bp, Homo sapiens
atgcacagatatactttg

SEQ ID NO: 4549690 - DNA, 19 bp, Homo sapiens
atgcacagatatactttgt

SEQ ID NO: 4549691 - DNA, 12 bp, Homo sapiens
atgcacagtcat

SEQ ID NO: 4549692 - DNA, 22 bp, Homo sapiens
atgcacatgctgtctggccctg

SEQ ID NO: 4549693 - DNA, 23 bp, Homo sapiens
atgcacatgctgtctggccctgg

SEQ ID NO: 4549694 - DNA, 20 bp, Homo sapiens
atgcaccaatcagcaggatt

SEQ ID NO: 4549695 - DNA, 21 bp, Homo sapiens
atgcacccatcagcactctgt

SEQ ID NO: 4549696 - DNA, 23 bp, Homo sapiens
atgcacctaaagaaaaacaaact

SEQ ID NO: 4549697 - DNA, 18 bp, Homo sapiens
atgcacgtggggcccact

SEQ ID NO: 4549698 - DNA, 14 bp, Homo sapiens
atgcactcgctgtg

SEQ ID NO: 4549699 - DNA, 17 bp, Homo sapiens
atgcactgaagagctct

SEQ ID NO: 4549700 - DNA, 16 bp, Homo sapiens
atgcactgtaaatatc

SEQ ID NO: 4549701 - DNA, 20 bp, Homo sapiens
atgcacttcaaattcaaata

SEQ ID NO: 4549702 - DNA, 13 bp, Homo sapiens
atgcacttctatt

SEQ ID NO: 4549703 - DNA, 22 bp, Homo sapiens
atgcactttctatcctctgtaa

SEQ ID NO: 4549704 - DNA, 21 bp, Homo sapiens
atgcacttttatgaagttttt

SEQ ID NO: 4549705 - DNA, 22 bp, Homo sapiens
atgcactttttccttactgtgc

SEQ ID NO: 4549706 - DNA, 20 bp, Homo sapiens
atgcagaaatagacaaaaag

SEQ ID NO: 4549707 - DNA, 20 bp, Homo sapiens
atgcagaataatcctgtttt

SEQ ID NO: 4549708 - DNA, 19 bp, Homo sapiens
atgcagacaacaccttcct

SEQ ID NO: 4549709 - DNA, 22 bp, Homo sapiens
atgcagacaacaccttcctcct

SEQ ID NO: 4549710 - DNA, 23 bp, Homo sapiens
atgcagacaacaccttcctcctg

SEQ ID NO: 4549711 - DNA, 16 bp, Homo sapiens
atgcagattacactga

SEQ ID NO: 4549712 - DNA, 15 bp, Homo sapiens
atgcagcaaatatat

SEQ ID NO: 4549713 - DNA, 16 bp, Homo sapiens
atgcagcaaatatatg

SEQ ID NO: 4549714 - DNA, 21 bp, Homo sapiens
atgcagcccatgcccacctgc

SEQ ID NO: 4549715 - DNA, 23 bp, Homo sapiens
atgcagcccatgcccacctgccc

SEQ ID NO: 4549716 - DNA, 23 bp, Homo sapiens
atgcagctcaactttctgttgga

SEQ ID NO: 4549717 - DNA, 22 bp, Homo sapiens
atgcagctcttcaacatgacat

SEQ ID NO: 4549718 - DNA, 22 bp, Homo sapiens
atgcaggagcttctgggagatt

SEQ ID NO: 4549719 - DNA, 17 bp, Homo sapiens
atgcagtctcctcttta

SEQ ID NO: 4549720 - DNA, 18 bp, Homo sapiens
atgcagtctcctctttaa

SEQ ID NO: 4549721 - DNA, 21 bp, Homo sapiens
atgcagtctcctctttaaaac

SEQ ID NO: 4549722 - DNA, 23 bp, Homo sapiens
atgcagtgtagattttatagtgt

SEQ ID NO: 4549723 - DNA, 13 bp, Homo sapiens
atgcagtttgaaa

SEQ ID NO: 4549724 - DNA, 14 bp, Homo sapiens
atgcagtttgaaat

SEQ ID NO: 4549725 - DNA, 23 bp, Homo sapiens
atgcagtttgaaattctgaattt

SEQ ID NO: 4549726 - DNA, 19 bp, Homo sapiens
atgcataaactaaaaacta

SEQ ID NO: 4549727 - DNA, 14 bp, Homo sapiens
atgcataaatcaat

SEQ ID NO: 4549728 - DNA, 17 bp, Homo sapiens
atgcataccacaagaca

SEQ ID NO: 4549729 - DNA, 22 bp, Homo sapiens
atgcatatcattaaacaaataa

SEQ ID NO: 4549730 - DNA, 12 bp, Homo sapiens
atgcatatttgt

SEQ ID NO: 4549731 - DNA, 17 bp, Homo sapiens
atgcatccattcctcag

SEQ ID NO: 4549732 - DNA, 19 bp, Homo sapiens
atgcatcgggaaagaagaa

SEQ ID NO: 4549733 - DNA, 20 bp, Homo sapiens
atgcatcgggaaagaagaaa

SEQ ID NO: 4549734 - DNA, 16 bp, Homo sapiens
atgcatctacttggca

SEQ ID NO: 4549735 - DNA, 18 bp, Homo sapiens
atgcatgacacttccaaa

SEQ ID NO: 4549736 - DNA, 17 bp, Homo sapiens
atgcatgcactgttccc

SEQ ID NO: 4549737 - DNA, 16 bp, Homo sapiens
atgcatggaaacatgg

SEQ ID NO: 4549738 - DNA, 13 bp, Homo sapiens
atgcatgggatgt

SEQ ID NO: 4549739 - DNA, 15 bp, Homo sapiens
atgcatgtagcatat

SEQ ID NO: 4549740 - DNA, 19 bp, Homo sapiens
atgcatgtagcatataaat

SEQ ID NO: 4549741 - DNA, 16 bp, Homo sapiens
atgcatgtcctgtaaa

SEQ ID NO: 4549742 - DNA, 15 bp, Homo sapiens
atgcatgtcttttaa

SEQ ID NO: 4549743 - DNA, 17 bp, Homo sapiens
atgcatgttctcctcta

SEQ ID NO: 4549744 - DNA, 21 bp, Homo sapiens
atgcattccagaacaaattgt

SEQ ID NO: 4549745 - DNA, 17 bp, Homo sapiens
atgcattcttctctgtt

SEQ ID NO: 4549746 - DNA, 22 bp, Homo sapiens
atgcattgaacatcttgcattc

SEQ ID NO: 4549747 - DNA, 15 bp, Homo sapiens
atgcattgctctgga

SEQ ID NO: 4549748 - DNA, 17 bp, Homo sapiens
atgcattgttgtaaagt

SEQ ID NO: 4549749 - DNA, 18 bp, Homo sapiens
atgcatttggcaacccaa

SEQ ID NO: 4549750 - DNA, 18 bp, Homo sapiens
atgccaaaaaaaaataca

SEQ ID NO: 4549751 - DNA, 22 bp, Homo sapiens
atgccaaagctagggtggccct

SEQ ID NO: 4549752 - DNA, 14 bp, Homo sapiens
atgccaacacttaa

SEQ ID NO: 4549753 - DNA, 23 bp, Homo sapiens
atgccaacacttaatcattttat

SEQ ID NO: 4549754 - DNA, 20 bp, Homo sapiens
atgccaccaacttacaaaaa

SEQ ID NO: 4549755 - DNA, 16 bp, Homo sapiens
atgccaccaggtaaca

SEQ ID NO: 4549756 - DNA, 20 bp, Homo sapiens
atgccacctagactctccct

SEQ ID NO: 4549757 - DNA, 17 bp, Homo sapiens
atgccacgggaagttta

SEQ ID NO: 4549758 - DNA, 22 bp, Homo sapiens
atgccaggttaggaaggcagca

SEQ ID NO: 4549759 - DNA, 13 bp, Homo sapiens
atgccagtatttt

SEQ ID NO: 4549760 - DNA, 14 bp, Homo sapiens
atgccagtgcctta

SEQ ID NO: 4549761 - DNA, 23 bp, Homo sapiens
atgccataaaattgcagtttcat

SEQ ID NO: 4549762 - DNA, 16 bp, Homo sapiens
atgccatcatctcctg

SEQ ID NO: 4549763 - DNA, 19 bp, Homo sapiens
atgccatccagatgtgtgc

SEQ ID NO: 4549764 - DNA, 15 bp, Homo sapiens
atgccatcctctttc

SEQ ID NO: 4549765 - DNA, 16 bp, Homo sapiens
atgcccaccccctgcc

SEQ ID NO: 4549766 - DNA, 15 bp, Homo sapiens
atgcccacctgccca

SEQ ID NO: 4549767 - DNA, 15 bp, Homo sapiens
atgcccagctaattt

SEQ ID NO: 4549768 - DNA, 12 bp, Homo sapiens
atgcccagttca

SEQ ID NO: 4549769 - DNA, 18 bp, Homo sapiens
atgcccattcctgcctgg

SEQ ID NO: 4549770 - DNA, 21 bp, Homo sapiens
atgcccattcctgcctggtcc

SEQ ID NO: 4549771 - DNA, 15 bp, Homo sapiens
atgccccagagctgt

SEQ ID NO: 4549772 - DNA, 12 bp, Homo sapiens
atgccccagtcg

SEQ ID NO: 4549773 - DNA, 15 bp, Homo sapiens
atgccccctgtggat

SEQ ID NO: 4549774 - DNA, 18 bp, Homo sapiens
atgccccctttcagatgt

SEQ ID NO: 4549775 - DNA, 15 bp, Homo sapiens
atgccccttggtcct

SEQ ID NO: 4549776 - DNA, 19 bp, Homo sapiens
atgccccttggtcctggca

SEQ ID NO: 4549777 - DNA, 20 bp, Homo sapiens
atgccgaatttggtacacat

SEQ ID NO: 4549778 - DNA, 21 bp, Homo sapiens
atgccgaatttggtacacatg

SEQ ID NO: 4549779 - DNA, 19 bp, Homo sapiens
atgccgatatactctagat

SEQ ID NO: 4549780 - DNA, 15 bp, Homo sapiens
atgccgatttctgta

SEQ ID NO: 4549781 - DNA, 18 bp, Homo sapiens
atgccggtacacagccag

SEQ ID NO: 4549782 - DNA, 16 bp, Homo sapiens
atgccgttctgcaccc

SEQ ID NO: 4549783 - DNA, 23 bp, Homo sapiens
atgccgttctgcaccctacccag

SEQ ID NO: 4549784 - DNA, 19 bp, Homo sapiens
atgcctagcacaagtacca

SEQ ID NO: 4549785 - DNA, 18 bp, Homo sapiens
atgcctagcagagaactg

SEQ ID NO: 4549786 - DNA, 17 bp, Homo sapiens
atgcctataaaatgccc

SEQ ID NO: 4549787 - DNA, 15 bp, Homo sapiens
atgcctatgggccag

SEQ ID NO: 4549788 - DNA, 19 bp, Homo sapiens
atgcctatggtggatccaa

SEQ ID NO: 4549789 - DNA, 12 bp, Homo sapiens
atgcctattgta

SEQ ID NO: 4549790 - DNA, 23 bp, Homo sapiens
atgcctcactaatttttgtatta

SEQ ID NO: 4549791 - DNA, 16 bp, Homo sapiens
atgcctcagaagtgca

SEQ ID NO: 4549792 - DNA, 12 bp, Homo sapiens
atgcctccaccg

SEQ ID NO: 4549793 - DNA, 13 bp, Homo sapiens
atgcctccaccgc

SEQ ID NO: 4549794 - DNA, 16 bp, Homo sapiens
atgcctgcgcctgctg

SEQ ID NO: 4549795 - DNA, 23 bp, Homo sapiens
atgcctgcgcctgctgcctgctg

SEQ ID NO: 4549796 - DNA, 21 bp, Homo sapiens
atgcctgtagctttcctggtc

SEQ ID NO: 4549797 - DNA, 13 bp, Homo sapiens
atgcctgttaatt

SEQ ID NO: 4549798 - DNA, 15 bp, Homo sapiens
atgcctgttaattta

SEQ ID NO: 4549799 - DNA, 19 bp, Homo sapiens
atgcctgttaatttataat

SEQ ID NO: 4549800 - DNA, 16 bp, Homo sapiens
atgccttactcttctt

SEQ ID NO: 4549801 - DNA, 18 bp, Homo sapiens
atgccttggaggaaatgt

SEQ ID NO: 4549802 - DNA, 21 bp, Homo sapiens
atgccttggaggaaatgtgct

SEQ ID NO: 4549803 - DNA, 21 bp, Homo sapiens
atgcctttaaatctgtgatga

SEQ ID NO: 4549804 - DNA, 23 bp, Homo sapiens
atgccttttcccaaaatgttgaa

SEQ ID NO: 4549805 - DNA, 17 bp, Homo sapiens
atgcctttttggttttg

SEQ ID NO: 4549806 - DNA, 16 bp, Homo sapiens
atgcgcaatgtggcat

SEQ ID NO: 4549807 - DNA, 16 bp, Homo sapiens
atgcgcattctaacct

SEQ ID NO: 4549808 - DNA, 15 bp, Homo sapiens
atgcgcccgaggcag

SEQ ID NO: 4549809 - DNA, 21 bp, Homo sapiens
atgcgccttcgtgcctgagac

SEQ ID NO: 4549810 - DNA, 12 bp, Homo sapiens
atgcggcccagc

SEQ ID NO: 4549811 - DNA, 21 bp, Homo sapiens
atgcggcccagcccggctccc

SEQ ID NO: 4549812 - DNA, 17 bp, Homo sapiens
atgcgtgtttctgactc

SEQ ID NO: 4549813 - DNA, 21 bp, Homo sapiens
atgctaagcaagctaacctta

SEQ ID NO: 4549814 - DNA, 12 bp, Homo sapiens
atgctacagtta

SEQ ID NO: 4549815 - DNA, 14 bp, Homo sapiens
atgctatggcattt

SEQ ID NO: 4549816 - DNA, 14 bp, Homo sapiens
atgctattgacaat

SEQ ID NO: 4549817 - DNA, 18 bp, Homo sapiens
atgctattgacaataaaa

SEQ ID NO: 4549818 - DNA, 19 bp, Homo sapiens
atgctcaacccccctccca

SEQ ID NO: 4549819 - DNA, 22 bp, Homo sapiens
atgctcaacccccctcccagac

SEQ ID NO: 4549820 - DNA, 23 bp, Homo sapiens
atgctcaacccccctcccagaca

SEQ ID NO: 4549821 - DNA, 17 bp, Homo sapiens
atgctcaagaatgtagt

SEQ ID NO: 4549822 - DNA, 16 bp, Homo sapiens
atgctcaatttcagca

SEQ ID NO: 4549823 - DNA, 23 bp, Homo sapiens
atgctcacctcttctttaccaga

SEQ ID NO: 4549824 - DNA, 22 bp, Homo sapiens
atgctccaggatctttgactga

SEQ ID NO: 4549825 - DNA, 13 bp, Homo sapiens
atgctccagggtc

SEQ ID NO: 4549826 - DNA, 20 bp, Homo sapiens
atgctcccagctgtgctgtg

SEQ ID NO: 4549827 - DNA, 22 bp, Homo sapiens
atgctcccagctgtgctgtgga

SEQ ID NO: 4549828 - DNA, 13 bp, Homo sapiens
atgctccccacag

SEQ ID NO: 4549829 - DNA, 21 bp, Homo sapiens
atgctccccacagcgtccctg

SEQ ID NO: 4549830 - DNA, 23 bp, Homo sapiens
atgctccccacagcgtccctggc

SEQ ID NO: 4549831 - DNA, 14 bp, Homo sapiens
atgctccctcccct

SEQ ID NO: 4549832 - DNA, 18 bp, Homo sapiens
atgctccctcccctgccc

SEQ ID NO: 4549833 - DNA, 13 bp, Homo sapiens
atgctcctagaag

SEQ ID NO: 4549834 - DNA, 18 bp, Homo sapiens
atgctcctagaagtctta

SEQ ID NO: 4549835 - DNA, 16 bp, Homo sapiens
atgctccttgggccct

SEQ ID NO: 4549836 - DNA, 22 bp, Homo sapiens
atgctctcactgtttgttttta

SEQ ID NO: 4549837 - DNA, 23 bp, Homo sapiens
atgctctctcacctgctcccagt

SEQ ID NO: 4549838 - DNA, 15 bp, Homo sapiens
atgctctttaaataa

SEQ ID NO: 4549839 - DNA, 16 bp, Homo sapiens
atgctgaattgaacat

SEQ ID NO: 4549840 - DNA, 16 bp, Homo sapiens
atgctgcaacaaaatg

SEQ ID NO: 4549841 - DNA, 14 bp, Homo sapiens
atgctgcatatgtt

SEQ ID NO: 4549842 - DNA, 11 bp, Homo sapiens
atgctgctctc

SEQ ID NO: 4549843 - DNA, 15 bp, Homo sapiens
atgctgctgcccctg

SEQ ID NO: 4549844 - DNA, 22 bp, Homo sapiens
atgctgctgcccctgcacagca

SEQ ID NO: 4549845 - DNA, 18 bp, Homo sapiens
atgctggaacctgcaaaa

SEQ ID NO: 4549846 - DNA, 16 bp, Homo sapiens
atgctggccagcaccc

SEQ ID NO: 4549847 - DNA, 17 bp, Homo sapiens
atgctggccagcaccct

SEQ ID NO: 4549848 - DNA, 21 bp, Homo sapiens
atgctggccagcaccctctcc

SEQ ID NO: 4549849 - DNA, 19 bp, Homo sapiens
atgctgggccactggggac

SEQ ID NO: 4549850 - DNA, 17 bp, Homo sapiens
atgctgggctgggccct

SEQ ID NO: 4549851 - DNA, 20 bp, Homo sapiens
atgctgggtctgaggcccct

SEQ ID NO: 4549852 - DNA, 22 bp, Homo sapiens
atgctgggtctgaggcccctgc

SEQ ID NO: 4549853 - DNA, 14 bp, Homo sapiens
atgctggtggagga

SEQ ID NO: 4549854 - DNA, 16 bp, Homo sapiens
atgctgtacatctatt

SEQ ID NO: 4549855 - DNA, 21 bp, Homo sapiens
atgctgtatttctttgtagaa

SEQ ID NO: 4549856 - DNA, 18 bp, Homo sapiens
atgctgtatttttacagc

SEQ ID NO: 4549857 - DNA, 18 bp, Homo sapiens
atgctgtgctatgaattt

SEQ ID NO: 4549858 - DNA, 14 bp, Homo sapiens
atgctgttgcctca

SEQ ID NO: 4549859 - DNA, 16 bp, Homo sapiens
atgctgtttatgaatt

SEQ ID NO: 4549860 - DNA, 22 bp, Homo sapiens
atgctgtttgtagtgaaataat

SEQ ID NO: 4549861 - DNA, 14 bp, Homo sapiens
atgcttaaatttta

SEQ ID NO: 4549862 - DNA, 21 bp, Homo sapiens
atgcttaataaacatgtcaca

SEQ ID NO: 4549863 - DNA, 16 bp, Homo sapiens
atgcttactaaatctt

SEQ ID NO: 4549864 - DNA, 21 bp, Homo sapiens
atgcttagtccctcatgcaaa

SEQ ID NO: 4549865 - DNA, 14 bp, Homo sapiens
atgcttcattgaaa

SEQ ID NO: 4549866 - DNA, 21 bp, Homo sapiens
atgcttcatttgtatgtcaaa

SEQ ID NO: 4549867 - DNA, 22 bp, Homo sapiens
atgcttccatatttttaaattt

SEQ ID NO: 4549868 - DNA, 19 bp, Homo sapiens
atgcttctcatcttgtgaa

SEQ ID NO: 4549869 - DNA, 22 bp, Homo sapiens
atgcttctcatcttgtgaaatg

SEQ ID NO: 4549870 - DNA, 17 bp, Homo sapiens
atgcttgaatggagctg

SEQ ID NO: 4549871 - DNA, 17 bp, Homo sapiens
atgcttgacatacctac

SEQ ID NO: 4549872 - DNA, 17 bp, Homo sapiens
atgcttgcataagagct

SEQ ID NO: 4549873 - DNA, 23 bp, Homo sapiens
atgcttgcggcaaaaggaaagct

SEQ ID NO: 4549874 - DNA, 22 bp, Homo sapiens
atgcttgtttatgatatttctt

SEQ ID NO: 4549875 - DNA, 22 bp, Homo sapiens
atgctttcctaaagtctctgct

SEQ ID NO: 4549876 - DNA, 12 bp, Homo sapiens
atgctttccttc

SEQ ID NO: 4549877 - DNA, 22 bp, Homo sapiens
atgcttttcactttctgtctag

SEQ ID NO: 4549878 - DNA, 22 bp, Homo sapiens
atgctttttattattattattt

SEQ ID NO: 4549879 - DNA, 23 bp, Homo sapiens
atgctttttatttctgcatatgt

SEQ ID NO: 4549880 - DNA, 14 bp, Homo sapiens
atggaaactgccaa

SEQ ID NO: 4549881 - DNA, 18 bp, Homo sapiens
atggaaatacagttattt

SEQ ID NO: 4549882 - DNA, 21 bp, Homo sapiens
atggaaatcttttacattttt

SEQ ID NO: 4549883 - DNA, 17 bp, Homo sapiens
atggaacagatttcaaa

SEQ ID NO: 4549884 - DNA, 16 bp, Homo sapiens
atggaacataaaatac

SEQ ID NO: 4549885 - DNA, 13 bp, Homo sapiens
atggaaccttccc

SEQ ID NO: 4549886 - DNA, 22 bp, Homo sapiens
atggaactgtgtatttatttaa

SEQ ID NO: 4549887 - DNA, 12 bp, Homo sapiens
atggaagaaagt

SEQ ID NO: 4549888 - DNA, 14 bp, Homo sapiens
atggaagaaagtaa

SEQ ID NO: 4549889 - DNA, 16 bp, Homo sapiens
atggaaggagacttag

SEQ ID NO: 4549890 - DNA, 20 bp, Homo sapiens
atggaagtaattaaggtaca

SEQ ID NO: 4549891 - DNA, 20 bp, Homo sapiens
atggaataaattatggcatt

SEQ ID NO: 4549892 - DNA, 15 bp, Homo sapiens
atggaatatcatctg

SEQ ID NO: 4549893 - DNA, 16 bp, Homo sapiens
atggaatcgaagtgtt

SEQ ID NO: 4549894 - DNA, 13 bp, Homo sapiens
atggaattgattt

SEQ ID NO: 4549895 - DNA, 14 bp, Homo sapiens
atggaattgatttg

SEQ ID NO: 4549896 - DNA, 17 bp, Homo sapiens
atggaattgatttgcat

SEQ ID NO: 4549897 - DNA, 15 bp, Homo sapiens
atggacaaggagctg

SEQ ID NO: 4549898 - DNA, 20 bp, Homo sapiens
atggacacgagccacaagct

SEQ ID NO: 4549899 - DNA, 17 bp, Homo sapiens
atggacaggagaaacat

SEQ ID NO: 4549900 - DNA, 17 bp, Homo sapiens
atggacatttagaagaa

SEQ ID NO: 4549901 - DNA, 18 bp, Homo sapiens
atggacatttagaagaaa

SEQ ID NO: 4549902 - DNA, 22 bp, Homo sapiens
atggaccagcccattggccgag

SEQ ID NO: 4549903 - DNA, 18 bp, Homo sapiens
atggacctcagcaagctg

SEQ ID NO: 4549904 - DNA, 20 bp, Homo sapiens
atggagacgtggtgggactc

SEQ ID NO: 4549905 - DNA, 19 bp, Homo sapiens
atggagattcagttttcat

SEQ ID NO: 4549906 - DNA, 22 bp, Homo sapiens
atggagctcagtaacataactg

SEQ ID NO: 4549907 - DNA, 14 bp, Homo sapiens
atggagctgggcta

SEQ ID NO: 4549908 - DNA, 14 bp, Homo sapiens
atggagctgtcatc

SEQ ID NO: 4549909 - DNA, 15 bp, Homo sapiens
atggaggaagaacaa

SEQ ID NO: 4549910 - DNA, 23 bp, Homo sapiens
atggaggaagaacaacaaagaca

SEQ ID NO: 4549911 - DNA, 21 bp, Homo sapiens
atggaggatggtgtcctgagg

SEQ ID NO: 4549912 - DNA, 16 bp, Homo sapiens
atggaggcagagacct

SEQ ID NO: 4549913 - DNA, 20 bp, Homo sapiens
atggaggcagagacctccaa

SEQ ID NO: 4549914 - DNA, 18 bp, Homo sapiens
atggagggcttggcccag

SEQ ID NO: 4549915 - DNA, 18 bp, Homo sapiens
atggagggggctggggtc

SEQ ID NO: 4549916 - DNA, 19 bp, Homo sapiens
atggagtcttgctctgtca

SEQ ID NO: 4549917 - DNA, 21 bp, Homo sapiens
atggagtcttgctctgtcacc

SEQ ID NO: 4549918 - DNA, 13 bp, Homo sapiens
atggatacataaa

SEQ ID NO: 4549919 - DNA, 14 bp, Homo sapiens
atggatacataaag

SEQ ID NO: 4549920 - DNA, 18 bp, Homo sapiens
atggatatagaaaatctt

SEQ ID NO: 4549921 - DNA, 13 bp, Homo sapiens
atggatatatttg

SEQ ID NO: 4549922 - DNA, 15 bp, Homo sapiens
atggatatatttgaa

SEQ ID NO: 4549923 - DNA, 18 bp, Homo sapiens
atggatatatttgaaata

SEQ ID NO: 4549924 - DNA, 23 bp, Homo sapiens
atggatatatttgaaatagtata

SEQ ID NO: 4549925 - DNA, 16 bp, Homo sapiens
atggatgcatcacact

SEQ ID NO: 4549926 - DNA, 12 bp, Homo sapiens
atggatgcattt

SEQ ID NO: 4549927 - DNA, 15 bp, Homo sapiens
atggatgcatttcaa

SEQ ID NO: 4549928 - DNA, 17 bp, Homo sapiens
atggatgcatttcaaat

SEQ ID NO: 4549929 - DNA, 20 bp, Homo sapiens
atggatgcatttcaaatgtt

SEQ ID NO: 4549930 - DNA, 23 bp, Homo sapiens
atggatgccaatattaaatctgc

SEQ ID NO: 4549931 - DNA, 19 bp, Homo sapiens
atggattacttctctataa

SEQ ID NO: 4549932 - DNA, 18 bp, Homo sapiens
atggattataatcagaat

SEQ ID NO: 4549933 - DNA, 18 bp, Homo sapiens
atggattcacttctattt

SEQ ID NO: 4549934 - DNA, 12 bp, Homo sapiens
atggattctaaa

SEQ ID NO: 4549935 - DNA, 13 bp, Homo sapiens
atggattctaaaa

SEQ ID NO: 4549936 - DNA, 14 bp, Homo sapiens
atggattctaaaat

SEQ ID NO: 4549937 - DNA, 22 bp, Homo sapiens
atggattgttaatttcagtcct

SEQ ID NO: 4549938 - DNA, 15 bp, Homo sapiens
atggatttttcttta

SEQ ID NO: 4549939 - DNA, 19 bp, Homo sapiens
atggatttttctttaactg

SEQ ID NO: 4549940 - DNA, 22 bp, Homo sapiens
atggcaacattggacagaaaat

SEQ ID NO: 4549941 - DNA, 14 bp, Homo sapiens
atggcaatgaaaat

SEQ ID NO: 4549942 - DNA, 18 bp, Homo sapiens
atggcaatgaaaatttta

SEQ ID NO: 4549943 - DNA, 18 bp, Homo sapiens
atggcacttgggggactg

SEQ ID NO: 4549944 - DNA, 15 bp, Homo sapiens
atggcagaaggcaaa

SEQ ID NO: 4549945 - DNA, 20 bp, Homo sapiens
atggcagaaggcaaacccat

SEQ ID NO: 4549946 - DNA, 12 bp, Homo sapiens
atggcagaaggg

SEQ ID NO: 4549947 - DNA, 16 bp, Homo sapiens
atggcaggacagctcc

SEQ ID NO: 4549948 - DNA, 17 bp, Homo sapiens
atggcagggccaggcct

SEQ ID NO: 4549949 - DNA, 24 bp, Homo sapiens
atggcagggggtggaattattact

SEQ ID NO: 4549950 - DNA, 21 bp, Homo sapiens
atggcatagccccggcccccc

SEQ ID NO: 4549951 - DNA, 13 bp, Homo sapiens
atggcatttgcag

SEQ ID NO: 4549952 - DNA, 14 bp, Homo sapiens
atggcatttgcaga

SEQ ID NO: 4549953 - DNA, 18 bp, Homo sapiens
atggccaaggctctctct

SEQ ID NO: 4549954 - DNA, 15 bp, Homo sapiens
atggccagagcctct

SEQ ID NO: 4549955 - DNA, 22 bp, Homo sapiens
atggccagcccctggggcccag

SEQ ID NO: 4549956 - DNA, 18 bp, Homo sapiens
atggccaggatcctctcc

SEQ ID NO: 4549957 - DNA, 13 bp, Homo sapiens
atggccatgctca

SEQ ID NO: 4549958 - DNA, 15 bp, Homo sapiens
atggcccccaataaa

SEQ ID NO: 4549959 - DNA, 22 bp, Homo sapiens
atggcccccaataaaggcagct

SEQ ID NO: 4549960 - DNA, 15 bp, Homo sapiens
atggccctgtcccag

SEQ ID NO: 4549961 - DNA, 20 bp, Homo sapiens
atggccctgtcccaggccgg

SEQ ID NO: 4549962 - DNA, 14 bp, Homo sapiens
atggcctcagccct

SEQ ID NO: 4549963 - DNA, 17 bp, Homo sapiens
atggcctcagccctgct

SEQ ID NO: 4549964 - DNA, 22 bp, Homo sapiens
atggcctcagccctgctccctg

SEQ ID NO: 4549965 - DNA, 15 bp, Homo sapiens
atggcctcagctgcc

SEQ ID NO: 4549966 - DNA, 17 bp, Homo sapiens
atggcctcagctgcctc

SEQ ID NO: 4549967 - DNA, 18 bp, Homo sapiens
atggcctcagctgcctca

SEQ ID NO: 4549968 - DNA, 20 bp, Homo sapiens
atggcctcgcctccccaccc

SEQ ID NO: 4549969 - DNA, 17 bp, Homo sapiens
atggccttaatttcctt

SEQ ID NO: 4549970 - DNA, 20 bp, Homo sapiens
atggcctttggacccagggc

SEQ ID NO: 4549971 - DNA, 15 bp, Homo sapiens
atggcgaacatgtgt

SEQ ID NO: 4549972 - DNA, 23 bp, Homo sapiens
atggctataggtgctacaaaaac

SEQ ID NO: 4549973 - DNA, 13 bp, Homo sapiens
atggctattttat

SEQ ID NO: 4549974 - DNA, 17 bp, Homo sapiens
atggctatttttgaagc

SEQ ID NO: 4549975 - DNA, 18 bp, Homo sapiens
atggctcaagtctgcaca

SEQ ID NO: 4549976 - DNA, 14 bp, Homo sapiens
atggctgtgaggat

SEQ ID NO: 4549977 - DNA, 18 bp, Homo sapiens
atgggaaaactgccaata

SEQ ID NO: 4549978 - DNA, 19 bp, Homo sapiens
atgggaaatagcggccctg

SEQ ID NO: 4549979 - DNA, 21 bp, Homo sapiens
atgggaaatagcggccctgga

SEQ ID NO: 4549980 - DNA, 18 bp, Homo sapiens
atgggaattgcgctcagg

SEQ ID NO: 4549981 - DNA, 15 bp, Homo sapiens
atgggaatttggctt

SEQ ID NO: 4549982 - DNA, 14 bp, Homo sapiens
atgggacagcaaca

SEQ ID NO: 4549983 - DNA, 18 bp, Homo sapiens
atgggagaggcaataaat

SEQ ID NO: 4549984 - DNA, 17 bp, Homo sapiens
atgggagccgggtctgc

SEQ ID NO: 4549985 - DNA, 20 bp, Homo sapiens
atgggagccgggtctgcctc

SEQ ID NO: 4549986 - DNA, 22 bp, Homo sapiens
atgggagctcctctcctggagg

SEQ ID NO: 4549987 - DNA, 13 bp, Homo sapiens
atgggagggatca

SEQ ID NO: 4549988 - DNA, 22 bp, Homo sapiens
atgggagggggcttgaagccaa

SEQ ID NO: 4549989 - DNA, 18 bp, Homo sapiens
atgggatggtggagggcc

SEQ ID NO: 4549990 - DNA, 14 bp, Homo sapiens
atgggcagagccca

SEQ ID NO: 4549991 - DNA, 16 bp, Homo sapiens
atgggcatcttttgta

SEQ ID NO: 4549992 - DNA, 20 bp, Homo sapiens
atgggcattttacaagaagt

SEQ ID NO: 4549993 - DNA, 18 bp, Homo sapiens
atgggccaccgccttgcc

SEQ ID NO: 4549994 - DNA, 16 bp, Homo sapiens
atgggccactgaaatc

SEQ ID NO: 4549995 - DNA, 14 bp, Homo sapiens
atgggccagagttg

SEQ ID NO: 4549996 - DNA, 11 bp, Homo sapiens
atgggccaggg

SEQ ID NO: 4549997 - DNA, 23 bp, Homo sapiens
atgggcccgcctcggcctcccaa

SEQ ID NO: 4549998 - DNA, 23 bp, Homo sapiens
atgggctcgccgtgtctcagcct

SEQ ID NO: 4549999 - DNA, 17 bp, Homo sapiens
atggggaaaaaaatcat

SEQ ID NO: 4550000 - DNA, 17 bp, Homo sapiens
atggggaggcaagtgtg

SEQ ID NO: 4550001 - DNA, 20 bp, Homo sapiens
atggggcagaagagaaagga

SEQ ID NO: 4550002 - DNA, 13 bp, Homo sapiens
atggggccaggaa

SEQ ID NO: 4550003 - DNA, 21 bp, Homo sapiens
atgggggacaggatttggcca

SEQ ID NO: 4550004 - DNA, 16 bp, Homo sapiens
atgggggatgggccag

SEQ ID NO: 4550005 - DNA, 16 bp, Homo sapiens
atgggggatgtggcca

SEQ ID NO: 4550006 - DNA, 23 bp, Homo sapiens
atgggggcatctcttccccagag

SEQ ID NO: 4550007 - DNA, 19 bp, Homo sapiens
atggggtggggtagggctg

SEQ ID NO: 4550008 - DNA, 18 bp, Homo sapiens
atgggtaagggagggaag

SEQ ID NO: 4550009 - DNA, 21 bp, Homo sapiens
atgggtcttttataggaaaaa

SEQ ID NO: 4550010 - DNA, 13 bp, Homo sapiens
atgggtggaaagg

SEQ ID NO: 4550011 - DNA, 21 bp, Homo sapiens
atgggtttattttcattctgc

SEQ ID NO: 4550012 - DNA, 15 bp, Homo sapiens
atggtaactgctttc

SEQ ID NO: 4550013 - DNA, 23 bp, Homo sapiens
atggtaactgctttctgttccaa

SEQ ID NO: 4550014 - DNA, 20 bp, Homo sapiens
atggtaatctttacctgtat

SEQ ID NO: 4550015 - DNA, 20 bp, Homo sapiens
atggtaatttatagtttata

SEQ ID NO: 4550016 - DNA, 12 bp, Homo sapiens
atggtacatttt

SEQ ID NO: 4550017 - DNA, 19 bp, Homo sapiens
atggtacatttttcaactt

SEQ ID NO: 4550018 - DNA, 13 bp, Homo sapiens
atggtacttcctc

SEQ ID NO: 4550019 - DNA, 16 bp, Homo sapiens
atggtacttcctctgt

SEQ ID NO: 4550020 - DNA, 18 bp, Homo sapiens
atggtaggcatttcctat

SEQ ID NO: 4550021 - DNA, 22 bp, Homo sapiens
atggtagttttacagtgtttct

SEQ ID NO: 4550022 - DNA, 22 bp, Homo sapiens
atggtcacagtaaagagtacac

SEQ ID NO: 4550023 - DNA, 20 bp, Homo sapiens
atggtcacgtttggtgcttc

SEQ ID NO: 4550024 - DNA, 24 bp, Homo sapiens
atggtcacgtttggtgcttctcag

SEQ ID NO: 4550025 - DNA, 16 bp, Homo sapiens
atggtccaggagaagg

SEQ ID NO: 4550026 - DNA, 19 bp, Homo sapiens
atggtccaggagaaggcca

SEQ ID NO: 4550027 - DNA, 15 bp, Homo sapiens
atggtcctagacaaa

SEQ ID NO: 4550028 - DNA, 19 bp, Homo sapiens
atggtgaaaccccgtctct

SEQ ID NO: 4550029 - DNA, 17 bp, Homo sapiens
atggtgactcctgaaac

SEQ ID NO: 4550030 - DNA, 19 bp, Homo sapiens
atggtgagtctatttttaa

SEQ ID NO: 4550031 - DNA, 14 bp, Homo sapiens
atggtgatgactta

SEQ ID NO: 4550032 - DNA, 15 bp, Homo sapiens
atggtgcattgtata

SEQ ID NO: 4550033 - DNA, 21 bp, Homo sapiens
atggtgcctgagaggcaggca

SEQ ID NO: 4550034 - DNA, 13 bp, Homo sapiens
atggtgctgccca

SEQ ID NO: 4550035 - DNA, 14 bp, Homo sapiens
atggtggagggcca

SEQ ID NO: 4550036 - DNA, 17 bp, Homo sapiens
atggtggctcatgcctg

SEQ ID NO: 4550037 - DNA, 22 bp, Homo sapiens
atggtggcttcttttctttgta

SEQ ID NO: 4550038 - DNA, 12 bp, Homo sapiens
atggtgtcattt

SEQ ID NO: 4550039 - DNA, 20 bp, Homo sapiens
atggtgtcctgaggcctcca

SEQ ID NO: 4550040 - DNA, 19 bp, Homo sapiens
atggtgtctcccaacatgg

SEQ ID NO: 4550041 - DNA, 15 bp, Homo sapiens
atggttacactgtta

SEQ ID NO: 4550042 - DNA, 17 bp, Homo sapiens
atggttacactgttaga

SEQ ID NO: 4550043 - DNA, 13 bp, Homo sapiens
atggttctgtgac

SEQ ID NO: 4550044 - DNA, 22 bp, Homo sapiens
atggtttgttgttctgcctgga

SEQ ID NO: 4550045 - DNA, 20 bp, Homo sapiens
atggttttctccaagagcta

SEQ ID NO: 4550046 - DNA, 22 bp, Homo sapiens
atgtaaaaatccttttgaatga

SEQ ID NO: 4550047 - DNA, 17 bp, Homo sapiens
atgtaaaagactttttt

SEQ ID NO: 4550048 - DNA, 14 bp, Homo sapiens
atgtaaaatgaatt

SEQ ID NO: 4550049 - DNA, 16 bp, Homo sapiens
atgtaaaatgaattga

SEQ ID NO: 4550050 - DNA, 15 bp, Homo sapiens
atgtaaactctcttc

SEQ ID NO: 4550051 - DNA, 20 bp, Homo sapiens
atgtaaactctcttctcttt

SEQ ID NO: 4550052 - DNA, 14 bp, Homo sapiens
atgtaaagatattt

SEQ ID NO: 4550053 - DNA, 19 bp, Homo sapiens
atgtaaagatgatttaagt

SEQ ID NO: 4550054 - DNA, 23 bp, Homo sapiens
atgtaaataaaacatcactatca

SEQ ID NO: 4550055 - DNA, 17 bp, Homo sapiens
atgtaaataaactattt

SEQ ID NO: 4550056 - DNA, 17 bp, Homo sapiens
atgtaaatattgttctg

SEQ ID NO: 4550057 - DNA, 20 bp, Homo sapiens
atgtaaatattttaaagaat

SEQ ID NO: 4550058 - DNA, 19 bp, Homo sapiens
atgtaaattacaaatgtgg

SEQ ID NO: 4550059 - DNA, 23 bp, Homo sapiens
atgtaacacaggataaagttatt

SEQ ID NO: 4550060 - DNA, 23 bp, Homo sapiens
atgtaacctacaattcagttagg

SEQ ID NO: 4550061 - DNA, 17 bp, Homo sapiens
atgtaaccttaaaagca

SEQ ID NO: 4550062 - DNA, 16 bp, Homo sapiens
atgtaagaaaatgtta

SEQ ID NO: 4550063 - DNA, 14 bp, Homo sapiens
atgtaagaacacat

SEQ ID NO: 4550064 - DNA, 16 bp, Homo sapiens
atgtaagaacacattt

SEQ ID NO: 4550065 - DNA, 17 bp, Homo sapiens
atgtaagaacacatttt

SEQ ID NO: 4550066 - DNA, 22 bp, Homo sapiens
atgtaagaacacattttaaata

SEQ ID NO: 4550067 - DNA, 19 bp, Homo sapiens
atgtaagggaaactgccag

SEQ ID NO: 4550068 - DNA, 22 bp, Homo sapiens
atgtaagggaaactgccagcaa

SEQ ID NO: 4550069 - DNA, 21 bp, Homo sapiens
atgtaagggtctttggtgttt

SEQ ID NO: 4550070 - DNA, 16 bp, Homo sapiens
atgtaagttgagaaaa

SEQ ID NO: 4550071 - DNA, 22 bp, Homo sapiens
atgtaagttgagaaaaatttat

SEQ ID NO: 4550072 - DNA, 13 bp, Homo sapiens
atgtaataaagtg

SEQ ID NO: 4550073 - DNA, 22 bp, Homo sapiens
atgtaataaagtgaactttgtt

SEQ ID NO: 4550074 - DNA, 23 bp, Homo sapiens
atgtaataatcattttagaatta

SEQ ID NO: 4550075 - DNA, 19 bp, Homo sapiens
atgtaataatgtacagagg

SEQ ID NO: 4550076 - DNA, 14 bp, Homo sapiens
atgtaatagtttat

SEQ ID NO: 4550077 - DNA, 21 bp, Homo sapiens
atgtaatataatgtattttct

SEQ ID NO: 4550078 - DNA, 12 bp, Homo sapiens
atgtaatgtttt

SEQ ID NO: 4550079 - DNA, 23 bp, Homo sapiens
atgtaatgttttctttgcaaagt

SEQ ID NO: 4550080 - DNA, 19 bp, Homo sapiens
atgtaattaaactgttaac

SEQ ID NO: 4550081 - DNA, 15 bp, Homo sapiens
atgtaatttctttaa

SEQ ID NO: 4550082 - DNA, 22 bp, Homo sapiens
atgtaatttctttaaatgtgta

SEQ ID NO: 4550083 - DNA, 20 bp, Homo sapiens
atgtaattttattttaaaat

SEQ ID NO: 4550084 - DNA, 13 bp, Homo sapiens
atgtacaaccctg

SEQ ID NO: 4550085 - DNA, 14 bp, Homo sapiens
atgtacaaccctga

SEQ ID NO: 4550086 - DNA, 15 bp, Homo sapiens
atgtacaaccctgac

SEQ ID NO: 4550087 - DNA, 16 bp, Homo sapiens
atgtacaaccctgacc

SEQ ID NO: 4550088 - DNA, 15 bp, Homo sapiens
atgtacaatacaatg

SEQ ID NO: 4550089 - DNA, 16 bp, Homo sapiens
atgtacaatacaatgt

SEQ ID NO: 4550090 - DNA, 15 bp, Homo sapiens
atgtacaattatgtc

SEQ ID NO: 4550091 - DNA, 19 bp, Homo sapiens
atgtacaattatgtctctt

SEQ ID NO: 4550092 - DNA, 14 bp, Homo sapiens
atgtacagtctgtc

SEQ ID NO: 4550093 - DNA, 17 bp, Homo sapiens
atgtacagtctgtcatg

SEQ ID NO: 4550094 - DNA, 16 bp, Homo sapiens
atgtacagttgaaata

SEQ ID NO: 4550095 - DNA, 17 bp, Homo sapiens
atgtacatcagtttgtt

SEQ ID NO: 4550096 - DNA, 21 bp, Homo sapiens
atgtacatcagtttgttcctt

SEQ ID NO: 4550097 - DNA, 12 bp, Homo sapiens
atgtacattaca

SEQ ID NO: 4550098 - DNA, 16 bp, Homo sapiens
atgtacattacagatt

SEQ ID NO: 4550099 - DNA, 18 bp, Homo sapiens
atgtacattacagattaa

SEQ ID NO: 4550100 - DNA, 23 bp, Homo sapiens
atgtacattacagattaaagaag

SEQ ID NO: 4550101 - DNA, 17 bp, Homo sapiens
atgtacatttaataata

SEQ ID NO: 4550102 - DNA, 22 bp, Homo sapiens
atgtaccttctttcactctgtc

SEQ ID NO: 4550103 - DNA, 15 bp, Homo sapiens
atgtactacagctat

SEQ ID NO: 4550104 - DNA, 17 bp, Homo sapiens
atgtactacagctatat

SEQ ID NO: 4550105 - DNA, 20 bp, Homo sapiens
atgtactacagctatatttg

SEQ ID NO: 4550106 - DNA, 12 bp, Homo sapiens
atgtactgtata

SEQ ID NO: 4550107 - DNA, 19 bp, Homo sapiens
atgtactgtatattacaga

SEQ ID NO: 4550108 - DNA, 17 bp, Homo sapiens
atgtactgttgaaaaag

SEQ ID NO: 4550109 - DNA, 14 bp, Homo sapiens
atgtacttaaatga

SEQ ID NO: 4550110 - DNA, 15 bp, Homo sapiens
atgtactttttagta

SEQ ID NO: 4550111 - DNA, 14 bp, Homo sapiens
atgtagaaaatttg

SEQ ID NO: 4550112 - DNA, 13 bp, Homo sapiens
atgtagaaactta

SEQ ID NO: 4550113 - DNA, 14 bp, Homo sapiens
atgtagaaataaat

SEQ ID NO: 4550114 - DNA, 17 bp, Homo sapiens
atgtagaaataaattac

SEQ ID NO: 4550115 - DNA, 18 bp, Homo sapiens
atgtagaaataaattact

SEQ ID NO: 4550116 - DNA, 12 bp, Homo sapiens
atgtagaggaga

SEQ ID NO: 4550117 - DNA, 13 bp, Homo sapiens
atgtagcacttac

SEQ ID NO: 4550118 - DNA, 21 bp, Homo sapiens
atgtagcacttacgtaaaaca

SEQ ID NO: 4550119 - DNA, 14 bp, Homo sapiens
atgtagccagctgt

SEQ ID NO: 4550120 - DNA, 20 bp, Homo sapiens
atgtagcttcagtcattaaa

SEQ ID NO: 4550121 - DNA, 23 bp, Homo sapiens
atgtaggggttaacttggtcaga

SEQ ID NO: 4550122 - DNA, 20 bp, Homo sapiens
atgtagtaacactaatatat

SEQ ID NO: 4550123 - DNA, 12 bp, Homo sapiens
atgtagtatttt

SEQ ID NO: 4550124 - DNA, 21 bp, Homo sapiens
atgtagtattttttgtataat

SEQ ID NO: 4550125 - DNA, 21 bp, Homo sapiens
atgtagtgcatttttaaactt

SEQ ID NO: 4550126 - DNA, 20 bp, Homo sapiens
atgtagtttttatatgttgt

SEQ ID NO: 4550127 - DNA, 21 bp, Homo sapiens
atgtagtttttatatgttgta

SEQ ID NO: 4550128 - DNA, 21 bp, Homo sapiens
atgtataaaaattatcaaaaa

SEQ ID NO: 4550129 - DNA, 18 bp, Homo sapiens
atgtataatgacttttaa

SEQ ID NO: 4550130 - DNA, 19 bp, Homo sapiens
atgtataatgacttttaaa

SEQ ID NO: 4550131 - DNA, 22 bp, Homo sapiens
atgtataatgtgcagaaaatat

SEQ ID NO: 4550132 - DNA, 20 bp, Homo sapiens
atgtatacaatgcactttta

SEQ ID NO: 4550133 - DNA, 15 bp, Homo sapiens
atgtatataagtact

SEQ ID NO: 4550134 - DNA, 21 bp, Homo sapiens
atgtatataatcatgctcatg

SEQ ID NO: 4550135 - DNA, 16 bp, Homo sapiens
atgtatatatctatta

SEQ ID NO: 4550136 - DNA, 18 bp, Homo sapiens
atgtatattttatataaa

SEQ ID NO: 4550137 - DNA, 21 bp, Homo sapiens
atgtatcagtgtcctttccag

SEQ ID NO: 4550138 - DNA, 15 bp, Homo sapiens
atgtatctatttgta

SEQ ID NO: 4550139 - DNA, 16 bp, Homo sapiens
atgtatctatttgtac

SEQ ID NO: 4550140 - DNA, 19 bp, Homo sapiens
atgtatctatttgtacaat

SEQ ID NO: 4550141 - DNA, 19 bp, Homo sapiens
atgtatggatttccagttt

SEQ ID NO: 4550142 - DNA, 14 bp, Homo sapiens
atgtatgtaaaaat

SEQ ID NO: 4550143 - DNA, 15 bp, Homo sapiens
atgtatgtaaaaatg

SEQ ID NO: 4550144 - DNA, 15 bp, Homo sapiens
atgtatgtacaatac

SEQ ID NO: 4550145 - DNA, 12 bp, Homo sapiens
atgtatgttaat

SEQ ID NO: 4550146 - DNA, 13 bp, Homo sapiens
atgtatgttacca

SEQ ID NO: 4550147 - DNA, 19 bp, Homo sapiens
atgtattcctttaaaatat

SEQ ID NO: 4550148 - DNA, 22 bp, Homo sapiens
atgtattcctttaaaatattgt

SEQ ID NO: 4550149 - DNA, 15 bp, Homo sapiens
atgtattctttataa

SEQ ID NO: 4550150 - DNA, 19 bp, Homo sapiens
atgtatttaaagttgtatc

SEQ ID NO: 4550151 - DNA, 21 bp, Homo sapiens
atgtatttaccaaaaattttg

SEQ ID NO: 4550152 - DNA, 21 bp, Homo sapiens
atgtatttgtagtgttattgc

SEQ ID NO: 4550153 - DNA, 20 bp, Homo sapiens
atgtatttgttatatataat

SEQ ID NO: 4550154 - DNA, 15 bp, Homo sapiens
atgtattttaaaata

SEQ ID NO: 4550155 - DNA, 19 bp, Homo sapiens
atgtattttcaaatgtaaa

SEQ ID NO: 4550156 - DNA, 14 bp, Homo sapiens
atgtattttcatag

SEQ ID NO: 4550157 - DNA, 20 bp, Homo sapiens
atgtattttcctaatgtgat

SEQ ID NO: 4550158 - DNA, 20 bp, Homo sapiens
atgtcaaaggtcgggacagc

SEQ ID NO: 4550159 - DNA, 23 bp, Homo sapiens
atgtcacaacatggtgctacttc

SEQ ID NO: 4550160 - DNA, 17 bp, Homo sapiens
atgtcacacaaactgat

SEQ ID NO: 4550161 - DNA, 13 bp, Homo sapiens
atgtcaccacctt

SEQ ID NO: 4550162 - DNA, 23 bp, Homo sapiens
atgtcaccaccttcccagctctc

SEQ ID NO: 4550163 - DNA, 18 bp, Homo sapiens
atgtcaccggtcagtgcc

SEQ ID NO: 4550164 - DNA, 21 bp, Homo sapiens
atgtcaccggtcagtgccttt

SEQ ID NO: 4550165 - DNA, 22 bp, Homo sapiens
atgtcaccggtcagtgcctttt

SEQ ID NO: 4550166 - DNA, 15 bp, Homo sapiens
atgtcactatatctt

SEQ ID NO: 4550167 - DNA, 17 bp, Homo sapiens
atgtcactatttgttgg

SEQ ID NO: 4550168 - DNA, 21 bp, Homo sapiens
atgtcagatgcgtgcccagct

SEQ ID NO: 4550169 - DNA, 23 bp, Homo sapiens
atgtcagatgtacatagagatct

SEQ ID NO: 4550170 - DNA, 16 bp, Homo sapiens
atgtcagattcctttc

SEQ ID NO: 4550171 - DNA, 18 bp, Homo sapiens
atgtcagattcctttccc

SEQ ID NO: 4550172 - DNA, 12 bp, Homo sapiens
atgtcagcaatt

SEQ ID NO: 4550173 - DNA, 15 bp, Homo sapiens
atgtcaggaatttaa

SEQ ID NO: 4550174 - DNA, 19 bp, Homo sapiens
atgtcaggaatttaagaat

SEQ ID NO: 4550175 - DNA, 22 bp, Homo sapiens
atgtcaggaatttaagaatttg

SEQ ID NO: 4550176 - DNA, 20 bp, Homo sapiens
atgtcagggtacctggggcc

SEQ ID NO: 4550177 - DNA, 17 bp, Homo sapiens
atgtcagtaccttcaaa

SEQ ID NO: 4550178 - DNA, 14 bp, Homo sapiens
atgtcataaagtga

SEQ ID NO: 4550179 - DNA, 14 bp, Homo sapiens
atgtcatagaaata

SEQ ID NO: 4550180 - DNA, 13 bp, Homo sapiens
atgtcatgtgttc

SEQ ID NO: 4550181 - DNA, 16 bp, Homo sapiens
atgtcatttcagaagt

SEQ ID NO: 4550182 - DNA, 16 bp, Homo sapiens
atgtcatttgcacaca

SEQ ID NO: 4550183 - DNA, 20 bp, Homo sapiens
atgtcatttgcacacaaaaa

SEQ ID NO: 4550184 - DNA, 21 bp, Homo sapiens
atgtcatttttaatgtatcta

SEQ ID NO: 4550185 - DNA, 12 bp, Homo sapiens
atgtccaaagag

SEQ ID NO: 4550186 - DNA, 19 bp, Homo sapiens
atgtccaaagaggctgccc

SEQ ID NO: 4550187 - DNA, 16 bp, Homo sapiens
atgtccactggttctt

SEQ ID NO: 4550188 - DNA, 17 bp, Homo sapiens
atgtcccaccctcccta

SEQ ID NO: 4550189 - DNA, 19 bp, Homo sapiens
atgtcccctcaaactcatt

SEQ ID NO: 4550190 - DNA, 21 bp, Homo sapiens
atgtccgatggtatctgggta

SEQ ID NO: 4550191 - DNA, 16 bp, Homo sapiens
atgtcctattactgat

SEQ ID NO: 4550192 - DNA, 16 bp, Homo sapiens
atgtcctccagaagcc

SEQ ID NO: 4550193 - DNA, 20 bp, Homo sapiens
atgtcctgcctattatctgt

SEQ ID NO: 4550194 - DNA, 14 bp, Homo sapiens
atgtcctgtaaagg

SEQ ID NO: 4550195 - DNA, 20 bp, Homo sapiens
atgtcctgtgagatgtgtat

SEQ ID NO: 4550196 - DNA, 15 bp, Homo sapiens
atgtcctttctcaga

SEQ ID NO: 4550197 - DNA, 16 bp, Homo sapiens
atgtctacctggcaga

SEQ ID NO: 4550198 - DNA, 14 bp, Homo sapiens
atgtctattcagct

SEQ ID NO: 4550199 - DNA, 14 bp, Homo sapiens
atgtctattgtcca

SEQ ID NO: 4550200 - DNA, 18 bp, Homo sapiens
atgtctccaagtagtcca

SEQ ID NO: 4550201 - DNA, 13 bp, Homo sapiens
atgtctccccagt

SEQ ID NO: 4550202 - DNA, 21 bp, Homo sapiens
atgtctcctctatggaaggag

SEQ ID NO: 4550203 - DNA, 13 bp, Homo sapiens
atgtctcttctga

SEQ ID NO: 4550204 - DNA, 16 bp, Homo sapiens
atgtctcttctgagct

SEQ ID NO: 4550205 - DNA, 16 bp, Homo sapiens
atgtctcttgagcatc

SEQ ID NO: 4550206 - DNA, 18 bp, Homo sapiens
atgtctcttgagcatcaa

SEQ ID NO: 4550207 - DNA, 21 bp, Homo sapiens
atgtctcttgagcatcaatct

SEQ ID NO: 4550208 - DNA, 18 bp, Homo sapiens
atgtctgaagtacaaaca

SEQ ID NO: 4550209 - DNA, 23 bp, Homo sapiens
atgtctgaagtacaaacatgaaa

SEQ ID NO: 4550210 - DNA, 22 bp, Homo sapiens
atgtctgccaaaatgcaacata

SEQ ID NO: 4550211 - DNA, 16 bp, Homo sapiens
atgtctgcctatgcac

SEQ ID NO: 4550212 - DNA, 20 bp, Homo sapiens
atgtctgcctatgcactgaa

SEQ ID NO: 4550213 - DNA, 21 bp, Homo sapiens
atgtctgccttcgaccacagc

SEQ ID NO: 4550214 - DNA, 13 bp, Homo sapiens
atgtctgctgagt

SEQ ID NO: 4550215 - DNA, 21 bp, Homo sapiens
atgtctgctgagttggcctgg

SEQ ID NO: 4550216 - DNA, 12 bp, Homo sapiens
atgtctggggca

SEQ ID NO: 4550217 - DNA, 21 bp, Homo sapiens
atgtcttcattttttaatgtg

SEQ ID NO: 4550218 - DNA, 24 bp, Homo sapiens
atgtcttcattttttaatgtgctc

SEQ ID NO: 4550219 - DNA, 19 bp, Homo sapiens
atgtcttgctgttgacata

SEQ ID NO: 4550220 - DNA, 20 bp, Homo sapiens
atgtcttgtatttaaaaaca

SEQ ID NO: 4550221 - DNA, 17 bp, Homo sapiens
atgtcttgtcatacaaa

SEQ ID NO: 4550222 - DNA, 13 bp, Homo sapiens
atgtcttttaaaa

SEQ ID NO: 4550223 - DNA, 14 bp, Homo sapiens
atgtcttttaaaat

SEQ ID NO: 4550224 - DNA, 18 bp, Homo sapiens
atgtcttttatagtggaa

SEQ ID NO: 4550225 - DNA, 15 bp, Homo sapiens
atgtgaaaaactaat

SEQ ID NO: 4550226 - DNA, 15 bp, Homo sapiens
atgtgaaaaaggaat

SEQ ID NO: 4550227 - DNA, 13 bp, Homo sapiens
atgtgaaaaatct

SEQ ID NO: 4550228 - DNA, 14 bp, Homo sapiens
atgtgaaaaatctg

SEQ ID NO: 4550229 - DNA, 20 bp, Homo sapiens
atgtgaaaatatacttgact

SEQ ID NO: 4550230 - DNA, 14 bp, Homo sapiens
atgtgaaaggatat

SEQ ID NO: 4550231 - DNA, 18 bp, Homo sapiens
atgtgaaaggatatgaat

SEQ ID NO: 4550232 - DNA, 14 bp, Homo sapiens
atgtgaaatgcttt

SEQ ID NO: 4550233 - DNA, 17 bp, Homo sapiens
atgtgaaatgctttctg

SEQ ID NO: 4550234 - DNA, 17 bp, Homo sapiens
atgtgaaatgtaactgt

SEQ ID NO: 4550235 - DNA, 11 bp, Homo sapiens
atgtgaagaat

SEQ ID NO: 4550236 - DNA, 14 bp, Homo sapiens
atgtgaagaattta

SEQ ID NO: 4550237 - DNA, 19 bp, Homo sapiens
atgtgaagaatttagatct

SEQ ID NO: 4550238 - DNA, 21 bp, Homo sapiens
atgtgaagttttccttgctat

SEQ ID NO: 4550239 - DNA, 15 bp, Homo sapiens
atgtgaatcagaccc

SEQ ID NO: 4550240 - DNA, 13 bp, Homo sapiens
atgtgaattttta

SEQ ID NO: 4550241 - DNA, 21 bp, Homo sapiens
atgtgacattaacaaataaaa

SEQ ID NO: 4550242 - DNA, 16 bp, Homo sapiens
atgtgactctttccaa

SEQ ID NO: 4550243 - DNA, 19 bp, Homo sapiens
atgtgactggttcagaaat

SEQ ID NO: 4550244 - DNA, 12 bp, Homo sapiens
atgtgagaaatc

SEQ ID NO: 4550245 - DNA, 18 bp, Homo sapiens
atgtgagatagttttcat

SEQ ID NO: 4550246 - DNA, 22 bp, Homo sapiens
atgtgagatagttttcatttta

SEQ ID NO: 4550247 - DNA, 16 bp, Homo sapiens
atgtgagatttcctta

SEQ ID NO: 4550248 - DNA, 17 bp, Homo sapiens
atgtgagccaccgtgcc

SEQ ID NO: 4550249 - DNA, 19 bp, Homo sapiens
atgtgaggtaattattgct

SEQ ID NO: 4550250 - DNA, 20 bp, Homo sapiens
atgtgatattctgttgcttt

SEQ ID NO: 4550251 - DNA, 14 bp, Homo sapiens
atgtgatcatatga

SEQ ID NO: 4550252 - DNA, 21 bp, Homo sapiens
atgtgatctatgtttcatctt

SEQ ID NO: 4550253 - DNA, 19 bp, Homo sapiens
atgtgatgaatactgtatt

SEQ ID NO: 4550254 - DNA, 17 bp, Homo sapiens
atgtgattctggaagca

SEQ ID NO: 4550255 - DNA, 14 bp, Homo sapiens
atgtgattgtggaa

SEQ ID NO: 4550256 - DNA, 17 bp, Homo sapiens
atgtgattgtggaatgg

SEQ ID NO: 4550257 - DNA, 20 bp, Homo sapiens
atgtgcagaaaatatttaat

SEQ ID NO: 4550258 - DNA, 22 bp, Homo sapiens
atgtgcagaaaatatttaatat

SEQ ID NO: 4550259 - DNA, 17 bp, Homo sapiens
atgtgcatgcataccac

SEQ ID NO: 4550260 - DNA, 18 bp, Homo sapiens
atgtgcatgcataccaca

SEQ ID NO: 4550261 - DNA, 18 bp, Homo sapiens
atgtgcattattcataaa

SEQ ID NO: 4550262 - DNA, 12 bp, Homo sapiens
atgtgccacaga

SEQ ID NO: 4550263 - DNA, 13 bp, Homo sapiens
atgtgccacagag

SEQ ID NO: 4550264 - DNA, 16 bp, Homo sapiens
atgtgccacagaggcc

SEQ ID NO: 4550265 - DNA, 19 bp, Homo sapiens
atgtgccacagaggcccca

SEQ ID NO: 4550266 - DNA, 15 bp, Homo sapiens
atgtgccacattttc

SEQ ID NO: 4550267 - DNA, 17 bp, Homo sapiens
atgtgccttatgttgaa

SEQ ID NO: 4550268 - DNA, 20 bp, Homo sapiens
atgtgccttgattgattaga

SEQ ID NO: 4550269 - DNA, 10 bp, Homo sapiens
atgtgccttt

SEQ ID NO: 4550270 - DNA, 21 bp, Homo sapiens
atgtgcctttctttgcctctg

SEQ ID NO: 4550271 - DNA, 22 bp, Homo sapiens
atgtgctataatctgtttttac

SEQ ID NO: 4550272 - DNA, 18 bp, Homo sapiens
atgtgctatactgcatac

SEQ ID NO: 4550273 - DNA, 18 bp, Homo sapiens
atgtgctatataaatatg

SEQ ID NO: 4550274 - DNA, 13 bp, Homo sapiens
atgtgctattaat

SEQ ID NO: 4550275 - DNA, 21 bp, Homo sapiens
atgtgctcaaattactaatga

SEQ ID NO: 4550276 - DNA, 13 bp, Homo sapiens
atgtggaagtgtg

SEQ ID NO: 4550277 - DNA, 14 bp, Homo sapiens
atgtggaggaagag

SEQ ID NO: 4550278 - DNA, 15 bp, Homo sapiens
atgtggcagatctac

SEQ ID NO: 4550279 - DNA, 14 bp, Homo sapiens
atgtggccctggcc

SEQ ID NO: 4550280 - DNA, 15 bp, Homo sapiens
atgtggccctggcct

SEQ ID NO: 4550281 - DNA, 16 bp, Homo sapiens
atgtggccctggcctg

SEQ ID NO: 4550282 - DNA, 13 bp, Homo sapiens
atgtggctcctcc

SEQ ID NO: 4550283 - DNA, 22 bp, Homo sapiens
atgtgggagctgaaccacagaa

SEQ ID NO: 4550284 - DNA, 17 bp, Homo sapiens
atgtgggggtctgtgtg

SEQ ID NO: 4550285 - DNA, 18 bp, Homo sapiens
atgtgggggtctgtgtgt

SEQ ID NO: 4550286 - DNA, 15 bp, Homo sapiens
atgtggtcacagctg

SEQ ID NO: 4550287 - DNA, 16 bp, Homo sapiens
atgtggtcacagctgt

SEQ ID NO: 4550288 - DNA, 17 bp, Homo sapiens
atgtggtcacagctgta

SEQ ID NO: 4550289 - DNA, 19 bp, Homo sapiens
atgtggtgacacctccccc

SEQ ID NO: 4550290 - DNA, 20 bp, Homo sapiens
atgtggtgacacctccccct

SEQ ID NO: 4550291 - DNA, 22 bp, Homo sapiens
atgtggtttgtacatatcaaat

SEQ ID NO: 4550292 - DNA, 21 bp, Homo sapiens
atgtgtaaacaattttatata

SEQ ID NO: 4550293 - DNA, 14 bp, Homo sapiens
atgtgtaaacaggt

SEQ ID NO: 4550294 - DNA, 15 bp, Homo sapiens
atgtgtaaagattta

SEQ ID NO: 4550295 - DNA, 18 bp, Homo sapiens
atgtgtacaatgtacaca

SEQ ID NO: 4550296 - DNA, 22 bp, Homo sapiens
atgtgtacatgtagttgaattt

SEQ ID NO: 4550297 - DNA, 21 bp, Homo sapiens
atgtgtagctgcaaaaataat

SEQ ID NO: 4550298 - DNA, 22 bp, Homo sapiens
atgtgtagttgtctctcttcag

SEQ ID NO: 4550299 - DNA, 13 bp, Homo sapiens
atgtgtataaatt

SEQ ID NO: 4550300 - DNA, 16 bp, Homo sapiens
atgtgtatcagtgttt

SEQ ID NO: 4550301 - DNA, 14 bp, Homo sapiens
atgtgtatttctta

SEQ ID NO: 4550302 - DNA, 18 bp, Homo sapiens
atgtgtatttcttaagaa

SEQ ID NO: 4550303 - DNA, 20 bp, Homo sapiens
atgtgtcattggaagccatc

SEQ ID NO: 4550304 - DNA, 21 bp, Homo sapiens
atgtgtcatttccggctgctg

SEQ ID NO: 4550305 - DNA, 19 bp, Homo sapiens
atgtgtcccccccaggcct

SEQ ID NO: 4550306 - DNA, 14 bp, Homo sapiens
atgtgtcccctcac

SEQ ID NO: 4550307 - DNA, 20 bp, Homo sapiens
atgtgtctcaggctcaagtt

SEQ ID NO: 4550308 - DNA, 22 bp, Homo sapiens
atgtgtctcaggctcaagtttt

SEQ ID NO: 4550309 - DNA, 23 bp, Homo sapiens
atgtgtctgtgttgcttcaaatt

SEQ ID NO: 4550310 - DNA, 14 bp, Homo sapiens
atgtgtctttctaa

SEQ ID NO: 4550311 - DNA, 20 bp, Homo sapiens
atgtgtgaagtgagaactcc

SEQ ID NO: 4550312 - DNA, 12 bp, Homo sapiens
atgtgtgacttt

SEQ ID NO: 4550313 - DNA, 14 bp, Homo sapiens
atgtgtgactttca

SEQ ID NO: 4550314 - DNA, 18 bp, Homo sapiens
atgtgtgactttcaggct

SEQ ID NO: 4550315 - DNA, 15 bp, Homo sapiens
atgtgtgaggagctg

SEQ ID NO: 4550316 - DNA, 16 bp, Homo sapiens
atgtgtgccctggact

SEQ ID NO: 4550317 - DNA, 18 bp, Homo sapiens
atgtgtgcctggccgcag

SEQ ID NO: 4550318 - DNA, 15 bp, Homo sapiens
atgtgtggcagattt

SEQ ID NO: 4550319 - DNA, 13 bp, Homo sapiens
atgtgtgtatgtg

SEQ ID NO: 4550320 - DNA, 21 bp, Homo sapiens
atgtgtgtccacgactgtctc

SEQ ID NO: 4550321 - DNA, 20 bp, Homo sapiens
atgtgtgtgccaagccctgg

SEQ ID NO: 4550322 - DNA, 10 bp, Homo sapiens
atgtgtgtgt

SEQ ID NO: 4550323 - DNA, 23 bp, Homo sapiens
atgtgtgtgtgttgtgtgtggga

SEQ ID NO: 4550324 - DNA, 14 bp, Homo sapiens
atgtgtgtttctgt

SEQ ID NO: 4550325 - DNA, 15 bp, Homo sapiens
atgtgttacattatt

SEQ ID NO: 4550326 - DNA, 12 bp, Homo sapiens
atgtgttatcta

SEQ ID NO: 4550327 - DNA, 17 bp, Homo sapiens
atgtgttatctacctca

SEQ ID NO: 4550328 - DNA, 21 bp, Homo sapiens
atgtgttcttttctcctttac

SEQ ID NO: 4550329 - DNA, 19 bp, Homo sapiens
atgtgttttcatcatttca

SEQ ID NO: 4550330 - DNA, 16 bp, Homo sapiens
atgtgtttttctccag

SEQ ID NO: 4550331 - DNA, 21 bp, Homo sapiens
atgtgttttttgcaacatatg

SEQ ID NO: 4550332 - DNA, 19 bp, Homo sapiens
atgttaaaaaaataagaag

SEQ ID NO: 4550333 - DNA, 21 bp, Homo sapiens
atgttaaaaaaataagaagaa

SEQ ID NO: 4550334 - DNA, 21 bp, Homo sapiens
atgttaaacttacttagtgtt

SEQ ID NO: 4550335 - DNA, 19 bp, Homo sapiens
atgttaacctctgctttta

SEQ ID NO: 4550336 - DNA, 14 bp, Homo sapiens
atgttactgcctta

SEQ ID NO: 4550337 - DNA, 19 bp, Homo sapiens
atgttagacttgctccctc

SEQ ID NO: 4550338 - DNA, 19 bp, Homo sapiens
atgttagacttgtgtgcat

SEQ ID NO: 4550339 - DNA, 24 bp, Homo sapiens
atgttagacttgtgtgcatggaag

SEQ ID NO: 4550340 - DNA, 15 bp, Homo sapiens
atgttagatattgct

SEQ ID NO: 4550341 - DNA, 18 bp, Homo sapiens
atgttagatattgctact

SEQ ID NO: 4550342 - DNA, 23 bp, Homo sapiens
atgttagggtataagttgctgta

SEQ ID NO: 4550343 - DNA, 20 bp, Homo sapiens
atgttagttaccttatagtt

SEQ ID NO: 4550344 - DNA, 22 bp, Homo sapiens
atgttagttaccttatagttac

SEQ ID NO: 4550345 - DNA, 13 bp, Homo sapiens
atgttatattgct

SEQ ID NO: 4550346 - DNA, 14 bp, Homo sapiens
atgttatattgctt

SEQ ID NO: 4550347 - DNA, 19 bp, Homo sapiens
atgttatattgcttcctgt

SEQ ID NO: 4550348 - DNA, 21 bp, Homo sapiens
atgttatcttatactgtacaa

SEQ ID NO: 4550349 - DNA, 13 bp, Homo sapiens
atgttattatctg

SEQ ID NO: 4550350 - DNA, 12 bp, Homo sapiens
atgttattgtgt

SEQ ID NO: 4550351 - DNA, 13 bp, Homo sapiens
atgttattgtgta

SEQ ID NO: 4550352 - DNA, 18 bp, Homo sapiens
atgttattttctgttgaa

SEQ ID NO: 4550353 - DNA, 19 bp, Homo sapiens
atgttattttcttctaagt

SEQ ID NO: 4550354 - DNA, 14 bp, Homo sapiens
atgttcacttttga

SEQ ID NO: 4550355 - DNA, 20 bp, Homo sapiens
atgttcatatttattgatta

SEQ ID NO: 4550356 - DNA, 20 bp, Homo sapiens
atgttcatgatagaaagaat

SEQ ID NO: 4550357 - DNA, 16 bp, Homo sapiens
atgttccaaatttaga

SEQ ID NO: 4550358 - DNA, 17 bp, Homo sapiens
atgttccacctgccaca

SEQ ID NO: 4550359 - DNA, 15 bp, Homo sapiens
atgttccactaaccc

SEQ ID NO: 4550360 - DNA, 15 bp, Homo sapiens
atgttcccttgacca

SEQ ID NO: 4550361 - DNA, 16 bp, Homo sapiens
atgttcccttgaccat

SEQ ID NO: 4550362 - DNA, 22 bp, Homo sapiens
atgttcccttgaccattggctg

SEQ ID NO: 4550363 - DNA, 17 bp, Homo sapiens
atgttcctagtgaaaga

SEQ ID NO: 4550364 - DNA, 16 bp, Homo sapiens
atgttcctcaaatcag

SEQ ID NO: 4550365 - DNA, 23 bp, Homo sapiens
atgttcctgaattctatttgctg

SEQ ID NO: 4550366 - DNA, 14 bp, Homo sapiens
atgttccttaccaa

SEQ ID NO: 4550367 - DNA, 17 bp, Homo sapiens
atgttccttttttgtat

SEQ ID NO: 4550368 - DNA, 17 bp, Homo sapiens
atgttctaagaagtgaa

SEQ ID NO: 4550369 - DNA, 18 bp, Homo sapiens
atgttctaagtctttcca

SEQ ID NO: 4550370 - DNA, 20 bp, Homo sapiens
atgttctggtatgcattctt

SEQ ID NO: 4550371 - DNA, 23 bp, Homo sapiens
atgttcttggtgtttgactgtaa

SEQ ID NO: 4550372 - DNA, 16 bp, Homo sapiens
atgttctttggaaagt

SEQ ID NO: 4550373 - DNA, 21 bp, Homo sapiens
atgttgaaaaaatttaaaagt

SEQ ID NO: 4550374 - DNA, 22 bp, Homo sapiens
atgttgaaatatgatgttaaaa

SEQ ID NO: 4550375 - DNA, 14 bp, Homo sapiens
atgttgaacttttt

SEQ ID NO: 4550376 - DNA, 19 bp, Homo sapiens
atgttgaatactttttaca

SEQ ID NO: 4550377 - DNA, 20 bp, Homo sapiens
atgttgagggaacagacagg

SEQ ID NO: 4550378 - DNA, 22 bp, Homo sapiens
atgttgataaaccaaaaacatt

SEQ ID NO: 4550379 - DNA, 18 bp, Homo sapiens
atgttgatcatgtacttt

SEQ ID NO: 4550380 - DNA, 19 bp, Homo sapiens
atgttgcattaattgtgct

SEQ ID NO: 4550381 - DNA, 22 bp, Homo sapiens
atgttgcattaattgtgctgtt

SEQ ID NO: 4550382 - DNA, 16 bp, Homo sapiens
atgttggataaggaat

SEQ ID NO: 4550383 - DNA, 23 bp, Homo sapiens
atgttggccaccaggtgcctttc

SEQ ID NO: 4550384 - DNA, 15 bp, Homo sapiens
atgttggttgcactt

SEQ ID NO: 4550385 - DNA, 16 bp, Homo sapiens
atgttggttgcacttt

SEQ ID NO: 4550386 - DNA, 15 bp, Homo sapiens
atgttgttcaaatgc

SEQ ID NO: 4550387 - DNA, 20 bp, Homo sapiens
atgttgttcaaatgcatttt

SEQ ID NO: 4550388 - DNA, 16 bp, Homo sapiens
atgttgttgtctattt

SEQ ID NO: 4550389 - DNA, 23 bp, Homo sapiens
atgttgttgtctatttgtctctt

SEQ ID NO: 4550390 - DNA, 15 bp, Homo sapiens
atgtttaaaataaaa

SEQ ID NO: 4550391 - DNA, 14 bp, Homo sapiens
atgtttaaaccttt

SEQ ID NO: 4550392 - DNA, 19 bp, Homo sapiens
atgtttacagaggacagta

SEQ ID NO: 4550393 - DNA, 14 bp, Homo sapiens
atgtttactatata

SEQ ID NO: 4550394 - DNA, 20 bp, Homo sapiens
atgtttagttttacatttta

SEQ ID NO: 4550395 - DNA, 18 bp, Homo sapiens
atgtttatattgttttta

SEQ ID NO: 4550396 - DNA, 17 bp, Homo sapiens
atgtttatggaaatatt

SEQ ID NO: 4550397 - DNA, 13 bp, Homo sapiens
atgtttattaaat

SEQ ID NO: 4550398 - DNA, 22 bp, Homo sapiens
atgtttatttcatgtggtgaat

SEQ ID NO: 4550399 - DNA, 22 bp, Homo sapiens
atgtttatttttgtacatttga

SEQ ID NO: 4550400 - DNA, 19 bp, Homo sapiens
atgtttcatcaatgcagtt

SEQ ID NO: 4550401 - DNA, 19 bp, Homo sapiens
atgtttcttgccttttgtt

SEQ ID NO: 4550402 - DNA, 21 bp, Homo sapiens
atgtttgatagattttctgct

SEQ ID NO: 4550403 - DNA, 22 bp, Homo sapiens
atgtttgctgattatttatgac

SEQ ID NO: 4550404 - DNA, 19 bp, Homo sapiens
atgtttggggatcgatgtg

SEQ ID NO: 4550405 - DNA, 13 bp, Homo sapiens
atgtttggtaaga

SEQ ID NO: 4550406 - DNA, 14 bp, Homo sapiens
atgtttgtggcctc

SEQ ID NO: 4550407 - DNA, 18 bp, Homo sapiens
atgtttgtggcctcagaa

SEQ ID NO: 4550408 - DNA, 22 bp, Homo sapiens
atgttttaaagaatatgacttt

SEQ ID NO: 4550409 - DNA, 15 bp, Homo sapiens
atgttttaaatgtac

SEQ ID NO: 4550410 - DNA, 15 bp, Homo sapiens
atgttttaacaaaaa

SEQ ID NO: 4550411 - DNA, 15 bp, Homo sapiens
atgttttcaaatgtt

SEQ ID NO: 4550412 - DNA, 16 bp, Homo sapiens
atgttttccacataaa

SEQ ID NO: 4550413 - DNA, 15 bp, Homo sapiens
atgttttctttctca

SEQ ID NO: 4550414 - DNA, 14 bp, Homo sapiens
atgtttttactgaa

SEQ ID NO: 4550415 - DNA, 18 bp, Homo sapiens
atgtttttactgaatgat

SEQ ID NO: 4550416 - DNA, 17 bp, Homo sapiens
atgtttttccctcccca

SEQ ID NO: 4550417 - DNA, 19 bp, Homo sapiens
atgtttttccctccccaga

SEQ ID NO: 4550418 - DNA, 15 bp, Homo sapiens
atgtttttgaaaaaa

SEQ ID NO: 4550419 - DNA, 14 bp, Homo sapiens
atgttttttcatgg

SEQ ID NO: 4550420 - DNA, 14 bp, Homo sapiens
atgttttttctgta

SEQ ID NO: 4550421 - DNA, 21 bp, Homo sapiens
atgttttttctgtaatgtaaa

SEQ ID NO: 4550422 - DNA, 15 bp, Homo sapiens
attaaaaaaaaattg

SEQ ID NO: 4550423 - DNA, 17 bp, Homo sapiens
attaaaaactttaaaga

SEQ ID NO: 4550424 - DNA, 13 bp, Homo sapiens
attaaaacaaaag

SEQ ID NO: 4550425 - DNA, 15 bp, Homo sapiens
attaaaacaataatg

SEQ ID NO: 4550426 - DNA, 11 bp, Homo sapiens
attaaaatata

SEQ ID NO: 4550427 - DNA, 23 bp, Homo sapiens
attaaaatatagagacaggacag

SEQ ID NO: 4550428 - DNA, 14 bp, Homo sapiens
attaaaatcctcaa

SEQ ID NO: 4550429 - DNA, 14 bp, Homo sapiens
attaaaattctgaa

SEQ ID NO: 4550430 - DNA, 22 bp, Homo sapiens
attaaaattgtgcataatgctt

SEQ ID NO: 4550431 - DNA, 15 bp, Homo sapiens
attaaacaatttatt

SEQ ID NO: 4550432 - DNA, 20 bp, Homo sapiens
attaaacaatttattttatt

SEQ ID NO: 4550433 - DNA, 14 bp, Homo sapiens
attaaaccgcatgt

SEQ ID NO: 4550434 - DNA, 15 bp, Homo sapiens
attaaacttcagcaa

SEQ ID NO: 4550435 - DNA, 17 bp, Homo sapiens
attaaacttccaaagaa

SEQ ID NO: 4550436 - DNA, 13 bp, Homo sapiens
attaaaggcagca

SEQ ID NO: 4550437 - DNA, 21 bp, Homo sapiens
attaaaggcagcatttgatga

SEQ ID NO: 4550438 - DNA, 22 bp, Homo sapiens
attaaaggtgaaaattgtataa

SEQ ID NO: 4550439 - DNA, 16 bp, Homo sapiens
attaaagttgtttccc

SEQ ID NO: 4550440 - DNA, 11 bp, Homo sapiens
attaaatagtg

SEQ ID NO: 4550441 - DNA, 17 bp, Homo sapiens
attaaatatatctagaa

SEQ ID NO: 4550442 - DNA, 15 bp, Homo sapiens
attaaatatatgtat

SEQ ID NO: 4550443 - DNA, 18 bp, Homo sapiens
attaaatatatgtatgta

SEQ ID NO: 4550444 - DNA, 22 bp, Homo sapiens
attaaatatttcttaagtataa

SEQ ID NO: 4550445 - DNA, 23 bp, Homo sapiens
attaaatcccaaatcctatttaa

SEQ ID NO: 4550446 - DNA, 18 bp, Homo sapiens
attaaatgaatattttga

SEQ ID NO: 4550447 - DNA, 19 bp, Homo sapiens
attaaatgaatattttgat

SEQ ID NO: 4550448 - DNA, 18 bp, Homo sapiens
attaaatggtttttaaat

SEQ ID NO: 4550449 - DNA, 21 bp, Homo sapiens
attaaatgtagcttcagtcat

SEQ ID NO: 4550450 - DNA, 22 bp, Homo sapiens
attaaatgtagcttcagtcatt

SEQ ID NO: 4550451 - DNA, 22 bp, Homo sapiens
attaaatgtttcaaaatagaca

SEQ ID NO: 4550452 - DNA, 11 bp, Homo sapiens
attaaattaca

SEQ ID NO: 4550453 - DNA, 15 bp, Homo sapiens
attaaattacagctt

SEQ ID NO: 4550454 - DNA, 13 bp, Homo sapiens
attaaattaggaa

SEQ ID NO: 4550455 - DNA, 13 bp, Homo sapiens
attaaattcacaa

SEQ ID NO: 4550456 - DNA, 17 bp, Homo sapiens
attaaattcacaaactt

SEQ ID NO: 4550457 - DNA, 18 bp, Homo sapiens
attaaattcacaaacttt

SEQ ID NO: 4550458 - DNA, 15 bp, Homo sapiens
attaaattggaaagc

SEQ ID NO: 4550459 - DNA, 18 bp, Homo sapiens
attaacaaaatgtatgtc

SEQ ID NO: 4550460 - DNA, 13 bp, Homo sapiens
attaacctctcac

SEQ ID NO: 4550461 - DNA, 14 bp, Homo sapiens
attaacggtgctaa

SEQ ID NO: 4550462 - DNA, 15 bp, Homo sapiens
attaactctgcatag

SEQ ID NO: 4550463 - DNA, 23 bp, Homo sapiens
attaactctgcatagacaaaggc

SEQ ID NO: 4550464 - DNA, 16 bp, Homo sapiens
attaactgtgaaatgt

SEQ ID NO: 4550465 - DNA, 19 bp, Homo sapiens
attaactgtgaaatgtacg

SEQ ID NO: 4550466 - DNA, 20 bp, Homo sapiens
attaactttcaaaagcaaac

SEQ ID NO: 4550467 - DNA, 21 bp, Homo sapiens
attaagaaaaacaataaagat

SEQ ID NO: 4550468 - DNA, 13 bp, Homo sapiens
attaagaaaacta

SEQ ID NO: 4550469 - DNA, 11 bp, Homo sapiens
attaagaaacc

SEQ ID NO: 4550470 - DNA, 17 bp, Homo sapiens
attaagaaaggaagcat

SEQ ID NO: 4550471 - DNA, 15 bp, Homo sapiens
attaagaaaggaagt

SEQ ID NO: 4550472 - DNA, 12 bp, Homo sapiens
attaagaacatt

SEQ ID NO: 4550473 - DNA, 14 bp, Homo sapiens
attaagaacatttt

SEQ ID NO: 4550474 - DNA, 15 bp, Homo sapiens
attaagaacatttta

SEQ ID NO: 4550475 - DNA, 14 bp, Homo sapiens
attaagagctattt

SEQ ID NO: 4550476 - DNA, 18 bp, Homo sapiens
attaagagctattttaga

SEQ ID NO: 4550477 - DNA, 21 bp, Homo sapiens
attaagagctattttagaaag

SEQ ID NO: 4550478 - DNA, 15 bp, Homo sapiens
attaagcagaaacag

SEQ ID NO: 4550479 - DNA, 19 bp, Homo sapiens
attaagcccacagtatatt

SEQ ID NO: 4550480 - DNA, 20 bp, Homo sapiens
attaagcccacagtatattt

SEQ ID NO: 4550481 - DNA, 22 bp, Homo sapiens
attaagccccaacatgttcaga

SEQ ID NO: 4550482 - DNA, 16 bp, Homo sapiens
attaaggcgtgagcca

SEQ ID NO: 4550483 - DNA, 21 bp, Homo sapiens
attaagggacatttctataaa

SEQ ID NO: 4550484 - DNA, 15 bp, Homo sapiens
attaaggtacatcat

SEQ ID NO: 4550485 - DNA, 22 bp, Homo sapiens
attaaggtacatcattattgta

SEQ ID NO: 4550486 - DNA, 13 bp, Homo sapiens
attaagttgttaa

SEQ ID NO: 4550487 - DNA, 19 bp, Homo sapiens
attaagttgttaataaaag

SEQ ID NO: 4550488 - DNA, 13 bp, Homo sapiens
attaataaaatat

SEQ ID NO: 4550489 - DNA, 22 bp, Homo sapiens
attaataaaatatctatttgaa

SEQ ID NO: 4550490 - DNA, 22 bp, Homo sapiens
attaataactttctctgtgaaa

SEQ ID NO: 4550491 - DNA, 17 bp, Homo sapiens
attaataagatttttca

SEQ ID NO: 4550492 - DNA, 20 bp, Homo sapiens
attaataagatttttcaaaa

SEQ ID NO: 4550493 - DNA, 21 bp, Homo sapiens
attaatagtaatttgtaaagt

SEQ ID NO: 4550494 - DNA, 13 bp, Homo sapiens
attaatatattaa

SEQ ID NO: 4550495 - DNA, 17 bp, Homo sapiens
attaatatctttctgca

SEQ ID NO: 4550496 - DNA, 13 bp, Homo sapiens
attaatattatta

SEQ ID NO: 4550497 - DNA, 20 bp, Homo sapiens
attaatattcccattttatt

SEQ ID NO: 4550498 - DNA, 11 bp, Homo sapiens
attaatattta

SEQ ID NO: 4550499 - DNA, 21 bp, Homo sapiens
attaatatttaggagtctatt

SEQ ID NO: 4550500 - DNA, 16 bp, Homo sapiens
attaatcaagagaaac

SEQ ID NO: 4550501 - DNA, 21 bp, Homo sapiens
attaatcaagagaaacttcaa

SEQ ID NO: 4550502 - DNA, 16 bp, Homo sapiens
attaatcagttcatta

SEQ ID NO: 4550503 - DNA, 16 bp, Homo sapiens
attaatcatacaaact

SEQ ID NO: 4550504 - DNA, 22 bp, Homo sapiens
attaatcatagattattataaa

SEQ ID NO: 4550505 - DNA, 17 bp, Homo sapiens
attaatccacatgtttc

SEQ ID NO: 4550506 - DNA, 18 bp, Homo sapiens
attaatccattttaacaa

SEQ ID NO: 4550507 - DNA, 20 bp, Homo sapiens
attaatcttagtgtatgatt

SEQ ID NO: 4550508 - DNA, 22 bp, Homo sapiens
attaatgagacacacttaacta

SEQ ID NO: 4550509 - DNA, 11 bp, Homo sapiens
attaatgcact

SEQ ID NO: 4550510 - DNA, 15 bp, Homo sapiens
attaatgcactttct

SEQ ID NO: 4550511 - DNA, 20 bp, Homo sapiens
attaatgccattatccctga

SEQ ID NO: 4550512 - DNA, 16 bp, Homo sapiens
attaatgtaataaagt

SEQ ID NO: 4550513 - DNA, 15 bp, Homo sapiens
attaattaatttgga

SEQ ID NO: 4550514 - DNA, 13 bp, Homo sapiens
attaattaggaat

SEQ ID NO: 4550515 - DNA, 13 bp, Homo sapiens
attaattctataa

SEQ ID NO: 4550516 - DNA, 14 bp, Homo sapiens
attaattgtcatta

SEQ ID NO: 4550517 - DNA, 14 bp, Homo sapiens
attaatttcaaaat

SEQ ID NO: 4550518 - DNA, 20 bp, Homo sapiens
attaatttctgccatttcat

SEQ ID NO: 4550519 - DNA, 21 bp, Homo sapiens
attaatttggagcacaaaatt

SEQ ID NO: 4550520 - DNA, 14 bp, Homo sapiens
attacaaatcagaa

SEQ ID NO: 4550521 - DNA, 19 bp, Homo sapiens
attacaaatcagaagtcat

SEQ ID NO: 4550522 - DNA, 14 bp, Homo sapiens
attacaacatttat

SEQ ID NO: 4550523 - DNA, 18 bp, Homo sapiens
attacaactgaccaagtt

SEQ ID NO: 4550524 - DNA, 17 bp, Homo sapiens
attacaagtaatgtaaa

SEQ ID NO: 4550525 - DNA, 14 bp, Homo sapiens
attacaatgtatct

SEQ ID NO: 4550526 - DNA, 17 bp, Homo sapiens
attacaatgtatcttta

SEQ ID NO: 4550527 - DNA, 14 bp, Homo sapiens
attacaattttatc

SEQ ID NO: 4550528 - DNA, 18 bp, Homo sapiens
attacaattttatctgtt

SEQ ID NO: 4550529 - DNA, 16 bp, Homo sapiens
attacagactctgatt

SEQ ID NO: 4550530 - DNA, 15 bp, Homo sapiens
attacagcttttatg

SEQ ID NO: 4550531 - DNA, 16 bp, Homo sapiens
attacaggaatgaaga

SEQ ID NO: 4550532 - DNA, 20 bp, Homo sapiens
attacaggaatgaagaactg

SEQ ID NO: 4550533 - DNA, 16 bp, Homo sapiens
attacaggattaatat

SEQ ID NO: 4550534 - DNA, 19 bp, Homo sapiens
attacaggattaatatatt

SEQ ID NO: 4550535 - DNA, 21 bp, Homo sapiens
attacaggattaatatattga

SEQ ID NO: 4550536 - DNA, 20 bp, Homo sapiens
attacagtgtcctaccactc

SEQ ID NO: 4550537 - DNA, 23 bp, Homo sapiens
attacagtgtcctaccactctaa

SEQ ID NO: 4550538 - DNA, 22 bp, Homo sapiens
attacatccgtaggacaagttt

SEQ ID NO: 4550539 - DNA, 14 bp, Homo sapiens
attacatctgcctt

SEQ ID NO: 4550540 - DNA, 17 bp, Homo sapiens
attacattattaaacga

SEQ ID NO: 4550541 - DNA, 18 bp, Homo sapiens
attacattttatatgtga

SEQ ID NO: 4550542 - DNA, 20 bp, Homo sapiens
attaccaataggcaaattaa

SEQ ID NO: 4550543 - DNA, 14 bp, Homo sapiens
attaccaccctttc

SEQ ID NO: 4550544 - DNA, 12 bp, Homo sapiens
attaccagggac

SEQ ID NO: 4550545 - DNA, 22 bp, Homo sapiens
attaccagggactatctttgct

SEQ ID NO: 4550546 - DNA, 21 bp, Homo sapiens
attaccagtggcgttgttgca

SEQ ID NO: 4550547 - DNA, 14 bp, Homo sapiens
attaccatttgtta

SEQ ID NO: 4550548 - DNA, 14 bp, Homo sapiens
attacctattaggt

SEQ ID NO: 4550549 - DNA, 12 bp, Homo sapiens
attacctgccaa

SEQ ID NO: 4550550 - DNA, 19 bp, Homo sapiens
attacctgccaattgctac

SEQ ID NO: 4550551 - DNA, 15 bp, Homo sapiens
attacctgtggatat

SEQ ID NO: 4550552 - DNA, 19 bp, Homo sapiens
attacctgtggatatttgt

SEQ ID NO: 4550553 - DNA, 18 bp, Homo sapiens
attacctgtgtgagattt

SEQ ID NO: 4550554 - DNA, 17 bp, Homo sapiens
attacgatgtaaatttt

SEQ ID NO: 4550555 - DNA, 14 bp, Homo sapiens
attactagtactat

SEQ ID NO: 4550556 - DNA, 14 bp, Homo sapiens
attactgaccgtat

SEQ ID NO: 4550557 - DNA, 15 bp, Homo sapiens
attactgaccgtatg

SEQ ID NO: 4550558 - DNA, 20 bp, Homo sapiens
attactgctttaatcagaaa

SEQ ID NO: 4550559 - DNA, 21 bp, Homo sapiens
attactgctttaatcagaaac

SEQ ID NO: 4550560 - DNA, 17 bp, Homo sapiens
attactggaattcttct

SEQ ID NO: 4550561 - DNA, 15 bp, Homo sapiens
attactgttcttatt

SEQ ID NO: 4550562 - DNA, 14 bp, Homo sapiens
attacttaaggcag

SEQ ID NO: 4550563 - DNA, 22 bp, Homo sapiens
attacttcactatacaaacaaa

SEQ ID NO: 4550564 - DNA, 16 bp, Homo sapiens
attacttctctataaa

SEQ ID NO: 4550565 - DNA, 13 bp, Homo sapiens
attacttgaactt

SEQ ID NO: 4550566 - DNA, 14 bp, Homo sapiens
attacttgaacttt

SEQ ID NO: 4550567 - DNA, 16 bp, Homo sapiens
attacttgaactttcc

SEQ ID NO: 4550568 - DNA, 14 bp, Homo sapiens
attactttgtgaat

SEQ ID NO: 4550569 - DNA, 17 bp, Homo sapiens
attagaaaatattctct

SEQ ID NO: 4550570 - DNA, 22 bp, Homo sapiens
attagaaagtgctgaatttaca

SEQ ID NO: 4550571 - DNA, 12 bp, Homo sapiens
attagaaatatt

SEQ ID NO: 4550572 - DNA, 17 bp, Homo sapiens
attagaaatattttaaa

SEQ ID NO: 4550573 - DNA, 24 bp, Homo sapiens
attagaaatattttaaaatcagct

SEQ ID NO: 4550574 - DNA, 21 bp, Homo sapiens
attagaattaccatttgttaa

SEQ ID NO: 4550575 - DNA, 18 bp, Homo sapiens
attagactgtgattcaga

SEQ ID NO: 4550576 - DNA, 20 bp, Homo sapiens
attagagattacctcctgag

SEQ ID NO: 4550577 - DNA, 19 bp, Homo sapiens
attagagggatgagacaga

SEQ ID NO: 4550578 - DNA, 23 bp, Homo sapiens
attagatatcaatgttaatgata

SEQ ID NO: 4550579 - DNA, 21 bp, Homo sapiens
attagatcaaatagttgcata

SEQ ID NO: 4550580 - DNA, 18 bp, Homo sapiens
attagatccattaattta

SEQ ID NO: 4550581 - DNA, 18 bp, Homo sapiens
attagatctaaacagtta

SEQ ID NO: 4550582 - DNA, 20 bp, Homo sapiens
attagcagccatattgtcac

SEQ ID NO: 4550583 - DNA, 17 bp, Homo sapiens
attagccctgcattttc

SEQ ID NO: 4550584 - DNA, 18 bp, Homo sapiens
attagccgggcatgatgg

SEQ ID NO: 4550585 - DNA, 21 bp, Homo sapiens
attagccgggcatggtggcag

SEQ ID NO: 4550586 - DNA, 13 bp, Homo sapiens
attaggaaaataa

SEQ ID NO: 4550587 - DNA, 14 bp, Homo sapiens
attaggaaaataaa

SEQ ID NO: 4550588 - DNA, 11 bp, Homo sapiens
attaggaatta

SEQ ID NO: 4550589 - DNA, 17 bp, Homo sapiens
attaggaattactttat

SEQ ID NO: 4550590 - DNA, 19 bp, Homo sapiens
attaggtggaaattttata

SEQ ID NO: 4550591 - DNA, 13 bp, Homo sapiens
attagtaacatgt

SEQ ID NO: 4550592 - DNA, 21 bp, Homo sapiens
attagtaagatctctttctaa

SEQ ID NO: 4550593 - DNA, 15 bp, Homo sapiens
attagtattcaggca

SEQ ID NO: 4550594 - DNA, 18 bp, Homo sapiens
attagtcttttgtaatat

SEQ ID NO: 4550595 - DNA, 16 bp, Homo sapiens
attagtgccacttaat

SEQ ID NO: 4550596 - DNA, 18 bp, Homo sapiens
attagttccccaaataca

SEQ ID NO: 4550597 - DNA, 18 bp, Homo sapiens
attagttggctttcataa

SEQ ID NO: 4550598 - DNA, 22 bp, Homo sapiens
attataaaaaattaacttagtt

SEQ ID NO: 4550599 - DNA, 13 bp, Homo sapiens
attataaaaatta

SEQ ID NO: 4550600 - DNA, 15 bp, Homo sapiens
attataaaaattaca

SEQ ID NO: 4550601 - DNA, 14 bp, Homo sapiens
attataaactataa

SEQ ID NO: 4550602 - DNA, 19 bp, Homo sapiens
attataaactataaactta

SEQ ID NO: 4550603 - DNA, 21 bp, Homo sapiens
attataaagccaattatctga

SEQ ID NO: 4550604 - DNA, 17 bp, Homo sapiens
attataaatatatataa

SEQ ID NO: 4550605 - DNA, 20 bp, Homo sapiens
attataaatatatataaaga

SEQ ID NO: 4550606 - DNA, 15 bp, Homo sapiens
attataaatgtgttt

SEQ ID NO: 4550607 - DNA, 19 bp, Homo sapiens
attataacaactatttact

SEQ ID NO: 4550608 - DNA, 16 bp, Homo sapiens
attataacataaaagc

SEQ ID NO: 4550609 - DNA, 12 bp, Homo sapiens
attataaggact

SEQ ID NO: 4550610 - DNA, 15 bp, Homo sapiens
attataaggactgca

SEQ ID NO: 4550611 - DNA, 16 bp, Homo sapiens
attataaggactgcat

SEQ ID NO: 4550612 - DNA, 18 bp, Homo sapiens
attataaggactgcatgg

SEQ ID NO: 4550613 - DNA, 21 bp, Homo sapiens
attataagtgagagaaatgaa

SEQ ID NO: 4550614 - DNA, 16 bp, Homo sapiens
attataagttgacctt

SEQ ID NO: 4550615 - DNA, 17 bp, Homo sapiens
attataagttgaccttt

SEQ ID NO: 4550616 - DNA, 16 bp, Homo sapiens
attataataaaatttc

SEQ ID NO: 4550617 - DNA, 22 bp, Homo sapiens
attatacaaaagagcatggatg

SEQ ID NO: 4550618 - DNA, 18 bp, Homo sapiens
attataccatgtgtgcta

SEQ ID NO: 4550619 - DNA, 16 bp, Homo sapiens
attatactgtgtgtga

SEQ ID NO: 4550620 - DNA, 12 bp, Homo sapiens
attatactttat

SEQ ID NO: 4550621 - DNA, 16 bp, Homo sapiens
attatactttatatct

SEQ ID NO: 4550622 - DNA, 14 bp, Homo sapiens
attatagaaaatta

SEQ ID NO: 4550623 - DNA, 19 bp, Homo sapiens
attatagacaaaagaataa

SEQ ID NO: 4550624 - DNA, 21 bp, Homo sapiens
attatagacaaaagaataaga

SEQ ID NO: 4550625 - DNA, 14 bp, Homo sapiens
attatagtgaaaca

SEQ ID NO: 4550626 - DNA, 15 bp, Homo sapiens
attatagtgaaacat

SEQ ID NO: 4550627 - DNA, 19 bp, Homo sapiens
attatagttaagcaaattt

SEQ ID NO: 4550628 - DNA, 16 bp, Homo sapiens
attatataaactgtgc

SEQ ID NO: 4550629 - DNA, 17 bp, Homo sapiens
attatataactgtattt

SEQ ID NO: 4550630 - DNA, 16 bp, Homo sapiens
attatatatttacaga

SEQ ID NO: 4550631 - DNA, 17 bp, Homo sapiens
attatatatttacagaa

SEQ ID NO: 4550632 - DNA, 19 bp, Homo sapiens
attatatatttacagaaga

SEQ ID NO: 4550633 - DNA, 15 bp, Homo sapiens
attatatgatatgca

SEQ ID NO: 4550634 - DNA, 15 bp, Homo sapiens
attatattaaacata

SEQ ID NO: 4550635 - DNA, 16 bp, Homo sapiens
attatattaaacatac

SEQ ID NO: 4550636 - DNA, 16 bp, Homo sapiens
attatattcattcttt

SEQ ID NO: 4550637 - DNA, 22 bp, Homo sapiens
attatattctaattaaaattgt

SEQ ID NO: 4550638 - DNA, 20 bp, Homo sapiens
attatattggtccagaagtt

SEQ ID NO: 4550639 - DNA, 15 bp, Homo sapiens
attatcagcaaagaa

SEQ ID NO: 4550640 - DNA, 16 bp, Homo sapiens
attatcagcaaagaaa

SEQ ID NO: 4550641 - DNA, 19 bp, Homo sapiens
attatccttttatctcaca

SEQ ID NO: 4550642 - DNA, 18 bp, Homo sapiens
attatctcaaaactgcac

SEQ ID NO: 4550643 - DNA, 21 bp, Homo sapiens
attatctctttgatctacttg

SEQ ID NO: 4550644 - DNA, 14 bp, Homo sapiens
attatctgggctta

SEQ ID NO: 4550645 - DNA, 20 bp, Homo sapiens
attatctgttgccttatttc

SEQ ID NO: 4550646 - DNA, 20 bp, Homo sapiens
attatcttcaccctcatcct

SEQ ID NO: 4550647 - DNA, 12 bp, Homo sapiens
attatgaaaatc

SEQ ID NO: 4550648 - DNA, 20 bp, Homo sapiens
attatgagctatcctttcaa

SEQ ID NO: 4550649 - DNA, 18 bp, Homo sapiens
attatgcactaaatatga

SEQ ID NO: 4550650 - DNA, 16 bp, Homo sapiens
attatgctttgaactt

SEQ ID NO: 4550651 - DNA, 15 bp, Homo sapiens
attatggaaaaataa

SEQ ID NO: 4550652 - DNA, 14 bp, Homo sapiens
attatgtaaagttt

SEQ ID NO: 4550653 - DNA, 14 bp, Homo sapiens
attatgtatggata

SEQ ID NO: 4550654 - DNA, 22 bp, Homo sapiens
attatgtcctgtgagatgtgta

SEQ ID NO: 4550655 - DNA, 13 bp, Homo sapiens
attatgtgaagaa

SEQ ID NO: 4550656 - DNA, 20 bp, Homo sapiens
attatgtgaccataatgtac

SEQ ID NO: 4550657 - DNA, 13 bp, Homo sapiens
attatgtgacttg

SEQ ID NO: 4550658 - DNA, 16 bp, Homo sapiens
attatgtggaataata

SEQ ID NO: 4550659 - DNA, 16 bp, Homo sapiens
attatgtgttgccaaa

SEQ ID NO: 4550660 - DNA, 17 bp, Homo sapiens
attatgttaatatttct

SEQ ID NO: 4550661 - DNA, 17 bp, Homo sapiens
attatgttagtttaaaa

SEQ ID NO: 4550662 - DNA, 18 bp, Homo sapiens
attatgttagtttaaaag

SEQ ID NO: 4550663 - DNA, 19 bp, Homo sapiens
attatgttagtttaaaagg

SEQ ID NO: 4550664 - DNA, 15 bp, Homo sapiens
attatgtttatttca

SEQ ID NO: 4550665 - DNA, 19 bp, Homo sapiens
attatgtttatttcatgtg

SEQ ID NO: 4550666 - DNA, 22 bp, Homo sapiens
attatgtttcctaactgtgatt

SEQ ID NO: 4550667 - DNA, 15 bp, Homo sapiens
attattaacactaat

SEQ ID NO: 4550668 - DNA, 14 bp, Homo sapiens
attattataaacta

SEQ ID NO: 4550669 - DNA, 17 bp, Homo sapiens
attattataaactataa

SEQ ID NO: 4550670 - DNA, 15 bp, Homo sapiens
attattatatacata

SEQ ID NO: 4550671 - DNA, 14 bp, Homo sapiens
attattattactgt

SEQ ID NO: 4550672 - DNA, 19 bp, Homo sapiens
attattcaaaaaatcatgt

SEQ ID NO: 4550673 - DNA, 15 bp, Homo sapiens
attattcagtgtcac

SEQ ID NO: 4550674 - DNA, 12 bp, Homo sapiens
attattctctgc

SEQ ID NO: 4550675 - DNA, 12 bp, Homo sapiens
attattgacact

SEQ ID NO: 4550676 - DNA, 13 bp, Homo sapiens
attattgctgttg

SEQ ID NO: 4550677 - DNA, 11 bp, Homo sapiens
attattgctta

SEQ ID NO: 4550678 - DNA, 20 bp, Homo sapiens
attattggaatataattgtt

SEQ ID NO: 4550679 - DNA, 19 bp, Homo sapiens
attattgtagtttgaaagt

SEQ ID NO: 4550680 - DNA, 20 bp, Homo sapiens
attattgtgacttcactgta

SEQ ID NO: 4550681 - DNA, 23 bp, Homo sapiens
attattgtgacttcactgtatat

SEQ ID NO: 4550682 - DNA, 19 bp, Homo sapiens
attatttaaactcgctcct

SEQ ID NO: 4550683 - DNA, 13 bp, Homo sapiens
attatttacaaaa

SEQ ID NO: 4550684 - DNA, 14 bp, Homo sapiens
attatttacaagaa

SEQ ID NO: 4550685 - DNA, 17 bp, Homo sapiens
attatttcaaaatgata

SEQ ID NO: 4550686 - DNA, 19 bp, Homo sapiens
attatttctaatccttttc

SEQ ID NO: 4550687 - DNA, 11 bp, Homo sapiens
attatttgcat

SEQ ID NO: 4550688 - DNA, 18 bp, Homo sapiens
attatttgggggaactgg

SEQ ID NO: 4550689 - DNA, 21 bp, Homo sapiens
attatttgggggaactggaca

SEQ ID NO: 4550690 - DNA, 17 bp, Homo sapiens
attatttgtcaaattgt

SEQ ID NO: 4550691 - DNA, 17 bp, Homo sapiens
attatttgtttagatgt

SEQ ID NO: 4550692 - DNA, 17 bp, Homo sapiens
attattttaaattataa

SEQ ID NO: 4550693 - DNA, 16 bp, Homo sapiens
attattttaaatttct

SEQ ID NO: 4550694 - DNA, 21 bp, Homo sapiens
attattttagtgtgtaaaatt

SEQ ID NO: 4550695 - DNA, 23 bp, Homo sapiens
attattttagtgtgtaaaattaa

SEQ ID NO: 4550696 - DNA, 13 bp, Homo sapiens
attattttatatc

SEQ ID NO: 4550697 - DNA, 12 bp, Homo sapiens
attattttgatg

SEQ ID NO: 4550698 - DNA, 20 bp, Homo sapiens
attatttttcttttaaagat

SEQ ID NO: 4550699 - DNA, 20 bp, Homo sapiens
attatttttgttagcaaaga

SEQ ID NO: 4550700 - DNA, 15 bp, Homo sapiens
attattttttatttc

SEQ ID NO: 4550701 - DNA, 22 bp, Homo sapiens
attcaaaaaactctctcccagg

SEQ ID NO: 4550702 - DNA, 16 bp, Homo sapiens
attcaaaatgctctaa

SEQ ID NO: 4550703 - DNA, 15 bp, Homo sapiens
attcaaaatggcttg

SEQ ID NO: 4550704 - DNA, 16 bp, Homo sapiens
attcaaacagtctcag

SEQ ID NO: 4550705 - DNA, 13 bp, Homo sapiens
attcaaagaagta

SEQ ID NO: 4550706 - DNA, 12 bp, Homo sapiens
attcaaagcatg

SEQ ID NO: 4550707 - DNA, 15 bp, Homo sapiens
attcaaatcctcttt

SEQ ID NO: 4550708 - DNA, 13 bp, Homo sapiens
attcaaatgaagg

SEQ ID NO: 4550709 - DNA, 14 bp, Homo sapiens
attcaaatgtttta

SEQ ID NO: 4550710 - DNA, 18 bp, Homo sapiens
attcaaattgctgcttgg

SEQ ID NO: 4550711 - DNA, 22 bp, Homo sapiens
attcaagaagtatttttttaat

SEQ ID NO: 4550712 - DNA, 15 bp, Homo sapiens
attcaagcctctaaa

SEQ ID NO: 4550713 - DNA, 16 bp, Homo sapiens
attcaagcctctaaac

SEQ ID NO: 4550714 - DNA, 19 bp, Homo sapiens
attcaaggaatttcttaac

SEQ ID NO: 4550715 - DNA, 22 bp, Homo sapiens
attcaaggaatttcttaacttc

SEQ ID NO: 4550716 - DNA, 18 bp, Homo sapiens
attcaaggagaatatgat

SEQ ID NO: 4550717 - DNA, 19 bp, Homo sapiens
attcaaggctcagaaggaa

SEQ ID NO: 4550718 - DNA, 21 bp, Homo sapiens
attcaatattgaatttttcct

SEQ ID NO: 4550719 - DNA, 16 bp, Homo sapiens
attcaatctgtaaact

SEQ ID NO: 4550720 - DNA, 13 bp, Homo sapiens
attcacaaacttt

SEQ ID NO: 4550721 - DNA, 22 bp, Homo sapiens
attcacaaacttttatactctt

SEQ ID NO: 4550722 - DNA, 19 bp, Homo sapiens
attcacaagacccaaaagg

SEQ ID NO: 4550723 - DNA, 22 bp, Homo sapiens
attcacaagcctcctgtacctc

SEQ ID NO: 4550724 - DNA, 16 bp, Homo sapiens
attcacaataaaagct

SEQ ID NO: 4550725 - DNA, 20 bp, Homo sapiens
attcacatctaacctcatct

SEQ ID NO: 4550726 - DNA, 14 bp, Homo sapiens
attcacatttagaa

SEQ ID NO: 4550727 - DNA, 16 bp, Homo sapiens
attcaccagtgttcct

SEQ ID NO: 4550728 - DNA, 12 bp, Homo sapiens
attcacctgtaa

SEQ ID NO: 4550729 - DNA, 16 bp, Homo sapiens
attcacctgtaaaact

SEQ ID NO: 4550730 - DNA, 17 bp, Homo sapiens
attcacctgtaaaactt

SEQ ID NO: 4550731 - DNA, 14 bp, Homo sapiens
attcactcttcctg

SEQ ID NO: 4550732 - DNA, 16 bp, Homo sapiens
attcactggttttaca

SEQ ID NO: 4550733 - DNA, 18 bp, Homo sapiens
attcactggttttacaca

SEQ ID NO: 4550734 - DNA, 15 bp, Homo sapiens
attcactttcatttt

SEQ ID NO: 4550735 - DNA, 18 bp, Homo sapiens
attcactttcatttttga

SEQ ID NO: 4550736 - DNA, 14 bp, Homo sapiens
attcacttttgtta

SEQ ID NO: 4550737 - DNA, 19 bp, Homo sapiens
attcagaaaatgttctgtt

SEQ ID NO: 4550738 - DNA, 22 bp, Homo sapiens
attcagaactaaatttttcata

SEQ ID NO: 4550739 - DNA, 15 bp, Homo sapiens
attcagacaaaatgg

SEQ ID NO: 4550740 - DNA, 13 bp, Homo sapiens
attcagagtcctt

SEQ ID NO: 4550741 - DNA, 13 bp, Homo sapiens
attcagcagtttt

SEQ ID NO: 4550742 - DNA, 13 bp, Homo sapiens
attcagctctgat

SEQ ID NO: 4550743 - DNA, 14 bp, Homo sapiens
attcagctctgatc

SEQ ID NO: 4550744 - DNA, 17 bp, Homo sapiens
attcagctgaggttcat

SEQ ID NO: 4550745 - DNA, 19 bp, Homo sapiens
attcaggacttgaaagaaa

SEQ ID NO: 4550746 - DNA, 15 bp, Homo sapiens
attcaggcactgaga

SEQ ID NO: 4550747 - DNA, 17 bp, Homo sapiens
attcaggcactgagaat

SEQ ID NO: 4550748 - DNA, 15 bp, Homo sapiens
attcaggccagccca

SEQ ID NO: 4550749 - DNA, 17 bp, Homo sapiens
attcaggccagcccagc

SEQ ID NO: 4550750 - DNA, 20 bp, Homo sapiens
attcaggccagcccagccag

SEQ ID NO: 4550751 - DNA, 11 bp, Homo sapiens
attcaggctgc

SEQ ID NO: 4550752 - DNA, 15 bp, Homo sapiens
attcaggtttttcct

SEQ ID NO: 4550753 - DNA, 22 bp, Homo sapiens
attcagtatttattgagcatct

SEQ ID NO: 4550754 - DNA, 23 bp, Homo sapiens
attcagtctctgaatacacagta

SEQ ID NO: 4550755 - DNA, 18 bp, Homo sapiens
attcagtggcaacttgtg

SEQ ID NO: 4550756 - DNA, 21 bp, Homo sapiens
attcagtgtaaattaattaca

SEQ ID NO: 4550757 - DNA, 14 bp, Homo sapiens
attcagtgtcactg

SEQ ID NO: 4550758 - DNA, 18 bp, Homo sapiens
attcagtttctaaaattg

SEQ ID NO: 4550759 - DNA, 20 bp, Homo sapiens
attcagtttctaaaattgag

SEQ ID NO: 4550760 - DNA, 14 bp, Homo sapiens
attcagttttcatt

SEQ ID NO: 4550761 - DNA, 19 bp, Homo sapiens
attcagtttttttccagtt

SEQ ID NO: 4550762 - DNA, 19 bp, Homo sapiens
attcataataaattttcta

SEQ ID NO: 4550763 - DNA, 20 bp, Homo sapiens
attcataataaattttctaa

SEQ ID NO: 4550764 - DNA, 13 bp, Homo sapiens
attcatacttaaa

SEQ ID NO: 4550765 - DNA, 19 bp, Homo sapiens
attcatagtaacttcttat

SEQ ID NO: 4550766 - DNA, 16 bp, Homo sapiens
attcatatctaaatag

SEQ ID NO: 4550767 - DNA, 19 bp, Homo sapiens
attcatctaataaatcagt

SEQ ID NO: 4550768 - DNA, 16 bp, Homo sapiens
attcatcttcttcttt

SEQ ID NO: 4550769 - DNA, 15 bp, Homo sapiens
attcatgacattatg

SEQ ID NO: 4550770 - DNA, 14 bp, Homo sapiens
attcatgtaataaa

SEQ ID NO: 4550771 - DNA, 13 bp, Homo sapiens
attcattcctcac

SEQ ID NO: 4550772 - DNA, 22 bp, Homo sapiens
attcattcctcacaatgaggct

SEQ ID NO: 4550773 - DNA, 13 bp, Homo sapiens
attcatttctaga

SEQ ID NO: 4550774 - DNA, 21 bp, Homo sapiens
attcattttctagatacaata

SEQ ID NO: 4550775 - DNA, 22 bp, Homo sapiens
attcattttctagatacaataa

SEQ ID NO: 4550776 - DNA, 16 bp, Homo sapiens
attccaaaaagcacat

SEQ ID NO: 4550777 - DNA, 12 bp, Homo sapiens
attccaaaatat

SEQ ID NO: 4550778 - DNA, 13 bp, Homo sapiens
attccaaaatatt

SEQ ID NO: 4550779 - DNA, 20 bp, Homo sapiens
attccaaagagtagaattgc

SEQ ID NO: 4550780 - DNA, 15 bp, Homo sapiens
attccaaagctttat

SEQ ID NO: 4550781 - DNA, 13 bp, Homo sapiens
attccaaattcat

SEQ ID NO: 4550782 - DNA, 14 bp, Homo sapiens
attccaagaaaata

SEQ ID NO: 4550783 - DNA, 19 bp, Homo sapiens
attccaagccttattttga

SEQ ID NO: 4550784 - DNA, 13 bp, Homo sapiens
attccaagcttcc

SEQ ID NO: 4550785 - DNA, 23 bp, Homo sapiens
attccaagcttccatagctgctg

SEQ ID NO: 4550786 - DNA, 23 bp, Homo sapiens
attccaatgatacccaacagttt

SEQ ID NO: 4550787 - DNA, 15 bp, Homo sapiens
attccacaaacacat

SEQ ID NO: 4550788 - DNA, 14 bp, Homo sapiens
attccaccttaaat

SEQ ID NO: 4550789 - DNA, 17 bp, Homo sapiens
attccactacacctggc

SEQ ID NO: 4550790 - DNA, 16 bp, Homo sapiens
attccagaacaaattg

SEQ ID NO: 4550791 - DNA, 15 bp, Homo sapiens
attccagacttcaaa

SEQ ID NO: 4550792 - DNA, 12 bp, Homo sapiens
attccagaggaa

SEQ ID NO: 4550793 - DNA, 15 bp, Homo sapiens
attccagctctgccc

SEQ ID NO: 4550794 - DNA, 16 bp, Homo sapiens
attccaggtttaagta

SEQ ID NO: 4550795 - DNA, 17 bp, Homo sapiens
attccatgctaagcaag

SEQ ID NO: 4550796 - DNA, 19 bp, Homo sapiens
attccatgtccatatgcat

SEQ ID NO: 4550797 - DNA, 19 bp, Homo sapiens
attccattgcctagctctt

SEQ ID NO: 4550798 - DNA, 20 bp, Homo sapiens
attccattgcctagctcttt

SEQ ID NO: 4550799 - DNA, 14 bp, Homo sapiens
attcccaacatttc

SEQ ID NO: 4550800 - DNA, 22 bp, Homo sapiens
attcccaagctgaatgttcttg

SEQ ID NO: 4550801 - DNA, 12 bp, Homo sapiens
attcccagagac

SEQ ID NO: 4550802 - DNA, 23 bp, Homo sapiens
attcccagagacaggaaaatcct

SEQ ID NO: 4550803 - DNA, 14 bp, Homo sapiens
attcccccaaactt

SEQ ID NO: 4550804 - DNA, 22 bp, Homo sapiens
attcccctccccactcctctcc

SEQ ID NO: 4550805 - DNA, 23 bp, Homo sapiens
attcccgttttgtcactttttct

SEQ ID NO: 4550806 - DNA, 13 bp, Homo sapiens
attccctccccct

SEQ ID NO: 4550807 - DNA, 16 bp, Homo sapiens
attccctccccctcct

SEQ ID NO: 4550808 - DNA, 19 bp, Homo sapiens
attccctgagtcaccagga

SEQ ID NO: 4550809 - DNA, 14 bp, Homo sapiens
attccctgcacaca

SEQ ID NO: 4550810 - DNA, 12 bp, Homo sapiens
attccctggaaa

SEQ ID NO: 4550811 - DNA, 16 bp, Homo sapiens
attcccttctttttca

SEQ ID NO: 4550812 - DNA, 17 bp, Homo sapiens
attcctaaagaaaaata

SEQ ID NO: 4550813 - DNA, 15 bp, Homo sapiens
attcctacagcacta

SEQ ID NO: 4550814 - DNA, 17 bp, Homo sapiens
attcctacagcactact

SEQ ID NO: 4550815 - DNA, 18 bp, Homo sapiens
attcctagaaattgaaca

SEQ ID NO: 4550816 - DNA, 14 bp, Homo sapiens
attcctagtctttc

SEQ ID NO: 4550817 - DNA, 21 bp, Homo sapiens
attcctatacgcagcgtgctt

SEQ ID NO: 4550818 - DNA, 16 bp, Homo sapiens
attcctattaatgtct

SEQ ID NO: 4550819 - DNA, 14 bp, Homo sapiens
attcctcagggaca

SEQ ID NO: 4550820 - DNA, 15 bp, Homo sapiens
attcctccagagaca

SEQ ID NO: 4550821 - DNA, 17 bp, Homo sapiens
attcctccagagacact

SEQ ID NO: 4550822 - DNA, 21 bp, Homo sapiens
attcctccagagacactgagc

SEQ ID NO: 4550823 - DNA, 13 bp, Homo sapiens
attcctccagcct

SEQ ID NO: 4550824 - DNA, 16 bp, Homo sapiens
attcctccagcctccc

SEQ ID NO: 4550825 - DNA, 18 bp, Homo sapiens
attcctccagcctcccct

SEQ ID NO: 4550826 - DNA, 14 bp, Homo sapiens
attcctcctgctca

SEQ ID NO: 4550827 - DNA, 19 bp, Homo sapiens
attcctctcaaattcagct

SEQ ID NO: 4550828 - DNA, 20 bp, Homo sapiens
attcctctcaaattcagctc

SEQ ID NO: 4550829 - DNA, 21 bp, Homo sapiens
attcctctcaaattcagctct

SEQ ID NO: 4550830 - DNA, 13 bp, Homo sapiens
attcctgcctggt

SEQ ID NO: 4550831 - DNA, 12 bp, Homo sapiens
attcctgccttt

SEQ ID NO: 4550832 - DNA, 22 bp, Homo sapiens
attcctggtttaattcagcaga

SEQ ID NO: 4550833 - DNA, 13 bp, Homo sapiens
attccttcactca

SEQ ID NO: 4550834 - DNA, 16 bp, Homo sapiens
attccttgcgcctcag

SEQ ID NO: 4550835 - DNA, 16 bp, Homo sapiens
attcctttacaactaa

SEQ ID NO: 4550836 - DNA, 20 bp, Homo sapiens
attcctttacaactaaataa

SEQ ID NO: 4550837 - DNA, 21 bp, Homo sapiens
attcctttacaactaaataac

SEQ ID NO: 4550838 - DNA, 22 bp, Homo sapiens
attccttttcgtttagaatcag

SEQ ID NO: 4550839 - DNA, 21 bp, Homo sapiens
attcctttttattccttttaa

SEQ ID NO: 4550840 - DNA, 15 bp, Homo sapiens
attcctttttctatg

SEQ ID NO: 4550841 - DNA, 19 bp, Homo sapiens
attcgaatctctgcccctc

SEQ ID NO: 4550842 - DNA, 19 bp, Homo sapiens
attcgcccgagctgtttat

SEQ ID NO: 4550843 - DNA, 15 bp, Homo sapiens
attcgctagtgttta

SEQ ID NO: 4550844 - DNA, 19 bp, Homo sapiens
attcggaccactaggcctg

SEQ ID NO: 4550845 - DNA, 14 bp, Homo sapiens
attcggtgtgctgc

SEQ ID NO: 4550846 - DNA, 21 bp, Homo sapiens
attcgtgattttcaagcagca

SEQ ID NO: 4550847 - DNA, 20 bp, Homo sapiens
attcgttgtgttttttaaga

SEQ ID NO: 4550848 - DNA, 22 bp, Homo sapiens
attcgttgtgttttttaagata

SEQ ID NO: 4550849 - DNA, 14 bp, Homo sapiens
attctaaaatgatt

SEQ ID NO: 4550850 - DNA, 15 bp, Homo sapiens
attctaaaatgcctt

SEQ ID NO: 4550851 - DNA, 18 bp, Homo sapiens
attctaagaaatatctgt

SEQ ID NO: 4550852 - DNA, 24 bp, Homo sapiens
attctaagaaatatctgtgaaata

SEQ ID NO: 4550853 - DNA, 12 bp, Homo sapiens
attctaattaaa

SEQ ID NO: 4550854 - DNA, 16 bp, Homo sapiens
attctaattaaaattg

SEQ ID NO: 4550855 - DNA, 17 bp, Homo sapiens
attctagatcctgcacc

SEQ ID NO: 4550856 - DNA, 21 bp, Homo sapiens
attctagatcctgcaccccag

SEQ ID NO: 4550857 - DNA, 17 bp, Homo sapiens
attctagttttgtcaaa

SEQ ID NO: 4550858 - DNA, 13 bp, Homo sapiens
attctatgtgtca

SEQ ID NO: 4550859 - DNA, 18 bp, Homo sapiens
attctatgttaatatttt

SEQ ID NO: 4550860 - DNA, 18 bp, Homo sapiens
attctatttgctgggctt

SEQ ID NO: 4550861 - DNA, 12 bp, Homo sapiens
attctcacaata

SEQ ID NO: 4550862 - DNA, 14 bp, Homo sapiens
attctcactccacc

SEQ ID NO: 4550863 - DNA, 21 bp, Homo sapiens
attctcataagtagcattcat

SEQ ID NO: 4550864 - DNA, 22 bp, Homo sapiens
attctcataattcctacagcac

SEQ ID NO: 4550865 - DNA, 12 bp, Homo sapiens
attctcattaaa

SEQ ID NO: 4550866 - DNA, 22 bp, Homo sapiens
attctcccaggtaccagctgcg

SEQ ID NO: 4550867 - DNA, 16 bp, Homo sapiens
attctcctcagtggct

SEQ ID NO: 4550868 - DNA, 21 bp, Homo sapiens
attctcctcagtggcttctcc

SEQ ID NO: 4550869 - DNA, 13 bp, Homo sapiens
attctcctcggac

SEQ ID NO: 4550870 - DNA, 13 bp, Homo sapiens
attctcctgcctc

SEQ ID NO: 4550871 - DNA, 17 bp, Homo sapiens
attctcctgcctcagcc

SEQ ID NO: 4550872 - DNA, 13 bp, Homo sapiens
attctccttcagc

SEQ ID NO: 4550873 - DNA, 14 bp, Homo sapiens
attctccttcagcc

SEQ ID NO: 4550874 - DNA, 16 bp, Homo sapiens
attctccttcagccct

SEQ ID NO: 4550875 - DNA, 17 bp, Homo sapiens
attctccttcagccctc

SEQ ID NO: 4550876 - DNA, 18 bp, Homo sapiens
attctccttcagccctca

SEQ ID NO: 4550877 - DNA, 22 bp, Homo sapiens
attctccttcagccctcacccc

SEQ ID NO: 4550878 - DNA, 23 bp, Homo sapiens
attctccttcagccctcacccct

SEQ ID NO: 4550879 - DNA, 17 bp, Homo sapiens
attctcgcttccctgaa

SEQ ID NO: 4550880 - DNA, 17 bp, Homo sapiens
attctctcatagaacat

SEQ ID NO: 4550881 - DNA, 15 bp, Homo sapiens
attctctctcctgtc

SEQ ID NO: 4550882 - DNA, 11 bp, Homo sapiens
attctctctta

SEQ ID NO: 4550883 - DNA, 19 bp, Homo sapiens
attctctcttattgttctt

SEQ ID NO: 4550884 - DNA, 12 bp, Homo sapiens
attctctcttta

SEQ ID NO: 4550885 - DNA, 13 bp, Homo sapiens
attctctgagctg

SEQ ID NO: 4550886 - DNA, 16 bp, Homo sapiens
attctctgcaatttta

SEQ ID NO: 4550887 - DNA, 18 bp, Homo sapiens
attctctgcaattttact

SEQ ID NO: 4550888 - DNA, 12 bp, Homo sapiens
attctctgtctc

SEQ ID NO: 4550889 - DNA, 16 bp, Homo sapiens
attctctgtctcatcc

SEQ ID NO: 4550890 - DNA, 19 bp, Homo sapiens
attctctgtctcatccatc

SEQ ID NO: 4550891 - DNA, 16 bp, Homo sapiens
attctctttttaacaa

SEQ ID NO: 4550892 - DNA, 14 bp, Homo sapiens
attctgaaatactt

SEQ ID NO: 4550893 - DNA, 13 bp, Homo sapiens
attctgaagtttt

SEQ ID NO: 4550894 - DNA, 15 bp, Homo sapiens
attctgaatcaccaa

SEQ ID NO: 4550895 - DNA, 22 bp, Homo sapiens
attctgacatgtaagaaaatgt

SEQ ID NO: 4550896 - DNA, 20 bp, Homo sapiens
attctgactgtccaggagct

SEQ ID NO: 4550897 - DNA, 19 bp, Homo sapiens
attctgagcaaaggccctg

SEQ ID NO: 4550898 - DNA, 15 bp, Homo sapiens
attctgaggccctgc

SEQ ID NO: 4550899 - DNA, 17 bp, Homo sapiens
attctgaggccctgccc

SEQ ID NO: 4550900 - DNA, 17 bp, Homo sapiens
attctgagttttgtgtt

SEQ ID NO: 4550901 - DNA, 22 bp, Homo sapiens
attctgataatttaaaatccat

SEQ ID NO: 4550902 - DNA, 23 bp, Homo sapiens
attctgattattgagttccagtt

SEQ ID NO: 4550903 - DNA, 12 bp, Homo sapiens
attctgattcag

SEQ ID NO: 4550904 - DNA, 11 bp, Homo sapiens
attctgcacca

SEQ ID NO: 4550905 - DNA, 17 bp, Homo sapiens
attctgcactcagaaaa

SEQ ID NO: 4550906 - DNA, 20 bp, Homo sapiens
attctgcatcctggcttgaa

SEQ ID NO: 4550907 - DNA, 15 bp, Homo sapiens
attctgccaaagtaa

SEQ ID NO: 4550908 - DNA, 18 bp, Homo sapiens
attctgcctatgtaaaat

SEQ ID NO: 4550909 - DNA, 14 bp, Homo sapiens
attctgcctctctg

SEQ ID NO: 4550910 - DNA, 21 bp, Homo sapiens
attctgcctctctggaaagag

SEQ ID NO: 4550911 - DNA, 11 bp, Homo sapiens
attctgccttg

SEQ ID NO: 4550912 - DNA, 14 bp, Homo sapiens
attctgggaaggga

SEQ ID NO: 4550913 - DNA, 22 bp, Homo sapiens
attctggggaaacaacatttat

SEQ ID NO: 4550914 - DNA, 22 bp, Homo sapiens
attctgtccatgaagcatacac

SEQ ID NO: 4550915 - DNA, 13 bp, Homo sapiens
attctgtgcaggc

SEQ ID NO: 4550916 - DNA, 16 bp, Homo sapiens
attctgtgcaggctgc

SEQ ID NO: 4550917 - DNA, 17 bp, Homo sapiens
attctgtgttttcagac

SEQ ID NO: 4550918 - DNA, 16 bp, Homo sapiens
attctgttatctcagg

SEQ ID NO: 4550919 - DNA, 20 bp, Homo sapiens
attctgttggagttccctca

SEQ ID NO: 4550920 - DNA, 14 bp, Homo sapiens
attctgttttgtta

SEQ ID NO: 4550921 - DNA, 19 bp, Homo sapiens
attctgtttttaatgctat

SEQ ID NO: 4550922 - DNA, 17 bp, Homo sapiens
attcttaaaaattgaat

SEQ ID NO: 4550923 - DNA, 18 bp, Homo sapiens
attcttaaaactataaca

SEQ ID NO: 4550924 - DNA, 15 bp, Homo sapiens
attcttacagccaag

SEQ ID NO: 4550925 - DNA, 16 bp, Homo sapiens
attcttacagccaagt

SEQ ID NO: 4550926 - DNA, 17 bp, Homo sapiens
attcttcagtttttcac

SEQ ID NO: 4550927 - DNA, 20 bp, Homo sapiens
attcttcatgaaatgtgttt

SEQ ID NO: 4550928 - DNA, 12 bp, Homo sapiens
attcttcattta

SEQ ID NO: 4550929 - DNA, 18 bp, Homo sapiens
attcttccatcatcactg

SEQ ID NO: 4550930 - DNA, 19 bp, Homo sapiens
attcttccatcatcactgt

SEQ ID NO: 4550931 - DNA, 21 bp, Homo sapiens
attcttccatcatcactgtaa

SEQ ID NO: 4550932 - DNA, 22 bp, Homo sapiens
attcttccttccctccttttaa

SEQ ID NO: 4550933 - DNA, 23 bp, Homo sapiens
attcttccttccctccttttaaa

SEQ ID NO: 4550934 - DNA, 15 bp, Homo sapiens
attcttctctgttgt

SEQ ID NO: 4550935 - DNA, 21 bp, Homo sapiens
attcttggaccatgccagatt

SEQ ID NO: 4550936 - DNA, 18 bp, Homo sapiens
attcttggcttaatcatt

SEQ ID NO: 4550937 - DNA, 18 bp, Homo sapiens
attcttggttgaggaaac

SEQ ID NO: 4550938 - DNA, 14 bp, Homo sapiens
attcttgtaaatct

SEQ ID NO: 4550939 - DNA, 16 bp, Homo sapiens
attctttatagtgaag

SEQ ID NO: 4550940 - DNA, 16 bp, Homo sapiens
attctttcccaacacc

SEQ ID NO: 4550941 - DNA, 19 bp, Homo sapiens
attctttcccaacacctct

SEQ ID NO: 4550942 - DNA, 21 bp, Homo sapiens
attctttcccaattcacatct

SEQ ID NO: 4550943 - DNA, 12 bp, Homo sapiens
attctttcccag

SEQ ID NO: 4550944 - DNA, 14 bp, Homo sapiens
attctttccccaga

SEQ ID NO: 4550945 - DNA, 19 bp, Homo sapiens
attctttgcttgaacacag

SEQ ID NO: 4550946 - DNA, 23 bp, Homo sapiens
attctttgcttgaacacagtatt

SEQ ID NO: 4550947 - DNA, 18 bp, Homo sapiens
attcttttaaattagaaa

SEQ ID NO: 4550948 - DNA, 19 bp, Homo sapiens
attcttttaaattagaaaa

SEQ ID NO: 4550949 - DNA, 15 bp, Homo sapiens
attcttttgaattgt

SEQ ID NO: 4550950 - DNA, 16 bp, Homo sapiens
attgaaaaacaatttt

SEQ ID NO: 4550951 - DNA, 15 bp, Homo sapiens
attgaaaaatttcta

SEQ ID NO: 4550952 - DNA, 23 bp, Homo sapiens
attgaaaagacgctaataaaaat

SEQ ID NO: 4550953 - DNA, 17 bp, Homo sapiens
attgaaaagcacagagg

SEQ ID NO: 4550954 - DNA, 12 bp, Homo sapiens
attgaaaagtac

SEQ ID NO: 4550955 - DNA, 21 bp, Homo sapiens
attgaaaatggctttctcagc

SEQ ID NO: 4550956 - DNA, 14 bp, Homo sapiens
attgaaagcttcaa

SEQ ID NO: 4550957 - DNA, 20 bp, Homo sapiens
attgaaagcttcaaagttta

SEQ ID NO: 4550958 - DNA, 19 bp, Homo sapiens
attgaaagcttttaaaatg

SEQ ID NO: 4550959 - DNA, 16 bp, Homo sapiens
attgaaagttgctttt

SEQ ID NO: 4550960 - DNA, 22 bp, Homo sapiens
attgaaagttgcttttattgca

SEQ ID NO: 4550961 - DNA, 14 bp, Homo sapiens
attgaacacaaact

SEQ ID NO: 4550962 - DNA, 15 bp, Homo sapiens
attgaacacaaactg

SEQ ID NO: 4550963 - DNA, 16 bp, Homo sapiens
attgaacacaaactgt

SEQ ID NO: 4550964 - DNA, 17 bp, Homo sapiens
attgaacacaaactgta

SEQ ID NO: 4550965 - DNA, 14 bp, Homo sapiens
attgaacccaggag

SEQ ID NO: 4550966 - DNA, 16 bp, Homo sapiens
attgaacttttgtact

SEQ ID NO: 4550967 - DNA, 19 bp, Homo sapiens
attgaacttttgtactgaa

SEQ ID NO: 4550968 - DNA, 15 bp, Homo sapiens
attgaaggcttaaac

SEQ ID NO: 4550969 - DNA, 15 bp, Homo sapiens
attgaagtttcaagt

SEQ ID NO: 4550970 - DNA, 20 bp, Homo sapiens
attgaatggtgcattgtata

SEQ ID NO: 4550971 - DNA, 12 bp, Homo sapiens
attgaatgtgaa

SEQ ID NO: 4550972 - DNA, 16 bp, Homo sapiens
attgaatgtgaaacat

SEQ ID NO: 4550973 - DNA, 14 bp, Homo sapiens
attgaattagaaaa

SEQ ID NO: 4550974 - DNA, 21 bp, Homo sapiens
attgaattatcttggttgaaa

SEQ ID NO: 4550975 - DNA, 14 bp, Homo sapiens
attgaatttttcct

SEQ ID NO: 4550976 - DNA, 16 bp, Homo sapiens
attgacaataaaatat

SEQ ID NO: 4550977 - DNA, 17 bp, Homo sapiens
attgacaataaaatatt

SEQ ID NO: 4550978 - DNA, 17 bp, Homo sapiens
attgacacagaaaatgt

SEQ ID NO: 4550979 - DNA, 15 bp, Homo sapiens
attgacactgaactt

SEQ ID NO: 4550980 - DNA, 18 bp, Homo sapiens
attgacactgaacttaat

SEQ ID NO: 4550981 - DNA, 17 bp, Homo sapiens
attgaccgcgactaatt

SEQ ID NO: 4550982 - DNA, 23 bp, Homo sapiens
attgaccgcgactaatttcaaaa

SEQ ID NO: 4550983 - DNA, 22 bp, Homo sapiens
attgactcctttccaatagaaa

SEQ ID NO: 4550984 - DNA, 11 bp, Homo sapiens
attgacttcat

SEQ ID NO: 4550985 - DNA, 12 bp, Homo sapiens
attgacttcatt

SEQ ID NO: 4550986 - DNA, 17 bp, Homo sapiens
attgacttcattttata

SEQ ID NO: 4550987 - DNA, 22 bp, Homo sapiens
attgacttcattttatatttaa

SEQ ID NO: 4550988 - DNA, 21 bp, Homo sapiens
attgactttagaaagctgaca

SEQ ID NO: 4550989 - DNA, 16 bp, Homo sapiens
attgagaaagaaacta

SEQ ID NO: 4550990 - DNA, 17 bp, Homo sapiens
attgagaataagaattt

SEQ ID NO: 4550991 - DNA, 21 bp, Homo sapiens
attgagaattcaaatcctctt

SEQ ID NO: 4550992 - DNA, 17 bp, Homo sapiens
attgagactttcttcta

SEQ ID NO: 4550993 - DNA, 21 bp, Homo sapiens
attgagcagaattcattcata

SEQ ID NO: 4550994 - DNA, 19 bp, Homo sapiens
attgagcatattttcttac

SEQ ID NO: 4550995 - DNA, 23 bp, Homo sapiens
attgagcatattttcttactttt

SEQ ID NO: 4550996 - DNA, 14 bp, Homo sapiens
attgagcttgcatg

SEQ ID NO: 4550997 - DNA, 15 bp, Homo sapiens
attgaggggccctgg

SEQ ID NO: 4550998 - DNA, 15 bp, Homo sapiens
attgagtcaaatggt

SEQ ID NO: 4550999 - DNA, 20 bp, Homo sapiens
attgagtgagcacctcccca

SEQ ID NO: 4551000 - DNA, 17 bp, Homo sapiens
attgagttccagttgaa

SEQ ID NO: 4551001 - DNA, 17 bp, Homo sapiens
attgagttcttcctgta

SEQ ID NO: 4551002 - DNA, 16 bp, Homo sapiens
attgagtttgtaggta

SEQ ID NO: 4551003 - DNA, 20 bp, Homo sapiens
attgagtttgtaggtaaaat

SEQ ID NO: 4551004 - DNA, 21 bp, Homo sapiens
attgagtttgtaggtaaaatg

SEQ ID NO: 4551005 - DNA, 12 bp, Homo sapiens
attgatacctgt

SEQ ID NO: 4551006 - DNA, 17 bp, Homo sapiens
attgatatcgtgaaatc

SEQ ID NO: 4551007 - DNA, 16 bp, Homo sapiens
attgatattctaagaa

SEQ ID NO: 4551008 - DNA, 23 bp, Homo sapiens
attgatattctaagaaatatctg

SEQ ID NO: 4551009 - DNA, 20 bp, Homo sapiens
attgatatttttatacaagt

SEQ ID NO: 4551010 - DNA, 17 bp, Homo sapiens
attgatcacacagtgtt

SEQ ID NO: 4551011 - DNA, 21 bp, Homo sapiens
attgatcattttccccccact

SEQ ID NO: 4551012 - DNA, 18 bp, Homo sapiens
attgatccagtcatttta

SEQ ID NO: 4551013 - DNA, 22 bp, Homo sapiens
attgatcccttctcctgccctt

SEQ ID NO: 4551014 - DNA, 13 bp, Homo sapiens
attgatctgtttt

SEQ ID NO: 4551015 - DNA, 19 bp, Homo sapiens
attgatctttttatcatga

SEQ ID NO: 4551016 - DNA, 20 bp, Homo sapiens
attgatgcatgctattcaca

SEQ ID NO: 4551017 - DNA, 14 bp, Homo sapiens
attgatttgaaaag

SEQ ID NO: 4551018 - DNA, 16 bp, Homo sapiens
attgatttgaagaaca

SEQ ID NO: 4551019 - DNA, 12 bp, Homo sapiens
attgcaaatctt

SEQ ID NO: 4551020 - DNA, 20 bp, Homo sapiens
attgcaactcttttaagtgc

SEQ ID NO: 4551021 - DNA, 14 bp, Homo sapiens
attgcaataaagta

SEQ ID NO: 4551022 - DNA, 15 bp, Homo sapiens
attgcaataaagtat

SEQ ID NO: 4551023 - DNA, 21 bp, Homo sapiens
attgcaccagaaatgtttatg

SEQ ID NO: 4551024 - DNA, 19 bp, Homo sapiens
attgcaccattttcaattt

SEQ ID NO: 4551025 - DNA, 19 bp, Homo sapiens
attgcacctatctcagcca

SEQ ID NO: 4551026 - DNA, 20 bp, Homo sapiens
attgcacctatctcagccat

SEQ ID NO: 4551027 - DNA, 17 bp, Homo sapiens
attgcactcatcatatt

SEQ ID NO: 4551028 - DNA, 19 bp, Homo sapiens
attgcactgttctgattat

SEQ ID NO: 4551029 - DNA, 18 bp, Homo sapiens
attgcagaaaattctgtg

SEQ ID NO: 4551030 - DNA, 16 bp, Homo sapiens
attgcagcagataact

SEQ ID NO: 4551031 - DNA, 17 bp, Homo sapiens
attgcaggtggaactca

SEQ ID NO: 4551032 - DNA, 18 bp, Homo sapiens
attgcagtttatcattca

SEQ ID NO: 4551033 - DNA, 19 bp, Homo sapiens
attgcagtttatcattcaa

SEQ ID NO: 4551034 - DNA, 23 bp, Homo sapiens
attgcatctcccagataatgtga

SEQ ID NO: 4551035 - DNA, 22 bp, Homo sapiens
attgcatgaaaatagctatttt

SEQ ID NO: 4551036 - DNA, 14 bp, Homo sapiens
attgccaccaggag

SEQ ID NO: 4551037 - DNA, 21 bp, Homo sapiens
attgccaccaggagaaccact

SEQ ID NO: 4551038 - DNA, 21 bp, Homo sapiens
attgccagtgtctttctttgg

SEQ ID NO: 4551039 - DNA, 10 bp, Homo sapiens
attgcccagt

SEQ ID NO: 4551040 - DNA, 21 bp, Homo sapiens
attgcccagtgagccctgctc

SEQ ID NO: 4551041 - DNA, 22 bp, Homo sapiens
attgcccagtgagccctgctct

SEQ ID NO: 4551042 - DNA, 16 bp, Homo sapiens
attgccccctctcact

SEQ ID NO: 4551043 - DNA, 14 bp, Homo sapiens
attgcccctctgcc

SEQ ID NO: 4551044 - DNA, 14 bp, Homo sapiens
attgcccctggctt

SEQ ID NO: 4551045 - DNA, 16 bp, Homo sapiens
attgcccctggctttg

SEQ ID NO: 4551046 - DNA, 20 bp, Homo sapiens
attgcccctggctttgcctc

SEQ ID NO: 4551047 - DNA, 21 bp, Homo sapiens
attgcccctggctttgcctct

SEQ ID NO: 4551048 - DNA, 11 bp, Homo sapiens
attgccctggt

SEQ ID NO: 4551049 - DNA, 17 bp, Homo sapiens
attgcctttgaatgtta

SEQ ID NO: 4551050 - DNA, 21 bp, Homo sapiens
attgcgtttgaccttttatgt

SEQ ID NO: 4551051 - DNA, 13 bp, Homo sapiens
attgctaaaagca

SEQ ID NO: 4551052 - DNA, 19 bp, Homo sapiens
attgctaaaagcatgtata

SEQ ID NO: 4551053 - DNA, 13 bp, Homo sapiens
attgctacctcag

SEQ ID NO: 4551054 - DNA, 21 bp, Homo sapiens
attgctacctcagtgctcctg

SEQ ID NO: 4551055 - DNA, 18 bp, Homo sapiens
attgctcgcccagacacc

SEQ ID NO: 4551056 - DNA, 19 bp, Homo sapiens
attgctctatgtctgcctt

SEQ ID NO: 4551057 - DNA, 19 bp, Homo sapiens
attgctctgtgtatatctc

SEQ ID NO: 4551058 - DNA, 21 bp, Homo sapiens
attgctgaagggcattctttc

SEQ ID NO: 4551059 - DNA, 13 bp, Homo sapiens
attgctgatttta

SEQ ID NO: 4551060 - DNA, 15 bp, Homo sapiens
attgctgattttaat

SEQ ID NO: 4551061 - DNA, 17 bp, Homo sapiens
attgctgattttaatgg

SEQ ID NO: 4551062 - DNA, 20 bp, Homo sapiens
attgctgccccatcagtgct

SEQ ID NO: 4551063 - DNA, 13 bp, Homo sapiens
attgctgcttgga

SEQ ID NO: 4551064 - DNA, 23 bp, Homo sapiens
attgctgtcaagttcctttgggt

SEQ ID NO: 4551065 - DNA, 17 bp, Homo sapiens
attgctgtccttgggta

SEQ ID NO: 4551066 - DNA, 16 bp, Homo sapiens
attgcttcaatttcaa

SEQ ID NO: 4551067 - DNA, 13 bp, Homo sapiens
attgcttcatgtt

SEQ ID NO: 4551068 - DNA, 18 bp, Homo sapiens
attgcttcctgtgtaaca

SEQ ID NO: 4551069 - DNA, 11 bp, Homo sapiens
attgcttcttg

SEQ ID NO: 4551070 - DNA, 16 bp, Homo sapiens
attgcttgagctcagg

SEQ ID NO: 4551071 - DNA, 16 bp, Homo sapiens
attgcttgttggattt

SEQ ID NO: 4551072 - DNA, 16 bp, Homo sapiens
attgctttctgctctt

SEQ ID NO: 4551073 - DNA, 18 bp, Homo sapiens
attgctttctgctcttta

SEQ ID NO: 4551074 - DNA, 13 bp, Homo sapiens
attgctttgaagc

SEQ ID NO: 4551075 - DNA, 12 bp, Homo sapiens
attgctttgcca

SEQ ID NO: 4551076 - DNA, 15 bp, Homo sapiens
attgctttgccaaaa

SEQ ID NO: 4551077 - DNA, 21 bp, Homo sapiens
attgcttttttccaaaacaaa

SEQ ID NO: 4551078 - DNA, 14 bp, Homo sapiens
attggaaaaatcac

SEQ ID NO: 4551079 - DNA, 19 bp, Homo sapiens
attggaagctgctgaggcc

SEQ ID NO: 4551080 - DNA, 14 bp, Homo sapiens
attggaatgccttg

SEQ ID NO: 4551081 - DNA, 18 bp, Homo sapiens
attggaattctactggaa

SEQ ID NO: 4551082 - DNA, 17 bp, Homo sapiens
attggacagaaaatgca

SEQ ID NO: 4551083 - DNA, 12 bp, Homo sapiens
attggagctgac

SEQ ID NO: 4551084 - DNA, 22 bp, Homo sapiens
attggatattttttactttaga

SEQ ID NO: 4551085 - DNA, 15 bp, Homo sapiens
attggatttgctgtg

SEQ ID NO: 4551086 - DNA, 22 bp, Homo sapiens
attggcatagaaaaaagtagca

SEQ ID NO: 4551087 - DNA, 15 bp, Homo sapiens
attggctcacactga

SEQ ID NO: 4551088 - DNA, 17 bp, Homo sapiens
attggcttgataaacat

SEQ ID NO: 4551089 - DNA, 15 bp, Homo sapiens
attgggaccctccag

SEQ ID NO: 4551090 - DNA, 16 bp, Homo sapiens
attggggaattaaata

SEQ ID NO: 4551091 - DNA, 14 bp, Homo sapiens
attggggaggaggg

SEQ ID NO: 4551092 - DNA, 23 bp, Homo sapiens
attggggctcccagccaggccct

SEQ ID NO: 4551093 - DNA, 13 bp, Homo sapiens
attggggtagttg

SEQ ID NO: 4551094 - DNA, 13 bp, Homo sapiens
attggggttcctc

SEQ ID NO: 4551095 - DNA, 23 bp, Homo sapiens
attggggttcctctgtacagcaa

SEQ ID NO: 4551096 - DNA, 19 bp, Homo sapiens
attgggttcatgatgcagt

SEQ ID NO: 4551097 - DNA, 22 bp, Homo sapiens
attgggttcatgatgcagtctc

SEQ ID NO: 4551098 - DNA, 15 bp, Homo sapiens
attggtgtcattttc

SEQ ID NO: 4551099 - DNA, 15 bp, Homo sapiens
attggttaaaatgtg

SEQ ID NO: 4551100 - DNA, 19 bp, Homo sapiens
attggttattaaactgaat

SEQ ID NO: 4551101 - DNA, 16 bp, Homo sapiens
attggttggcaaacta

SEQ ID NO: 4551102 - DNA, 18 bp, Homo sapiens
attggtttaaagaaagtg

SEQ ID NO: 4551103 - DNA, 12 bp, Homo sapiens
attggttttgaa

SEQ ID NO: 4551104 - DNA, 14 bp, Homo sapiens
attgtaaaacaggt

SEQ ID NO: 4551105 - DNA, 20 bp, Homo sapiens
attgtaaaattatttcatga

SEQ ID NO: 4551106 - DNA, 16 bp, Homo sapiens
attgtaaactagtact

SEQ ID NO: 4551107 - DNA, 13 bp, Homo sapiens
attgtaaactgta

SEQ ID NO: 4551108 - DNA, 12 bp, Homo sapiens
attgtaaagtaa

SEQ ID NO: 4551109 - DNA, 13 bp, Homo sapiens
attgtaaatgtgg

SEQ ID NO: 4551110 - DNA, 14 bp, Homo sapiens
attgtaaatgtgga

SEQ ID NO: 4551111 - DNA, 15 bp, Homo sapiens
attgtaaattatatt

SEQ ID NO: 4551112 - DNA, 15 bp, Homo sapiens
attgtaatatagaaa

SEQ ID NO: 4551113 - DNA, 13 bp, Homo sapiens
attgtacagtttt

SEQ ID NO: 4551114 - DNA, 13 bp, Homo sapiens
attgtagacatgc

SEQ ID NO: 4551115 - DNA, 18 bp, Homo sapiens
attgtagagccagaggtc

SEQ ID NO: 4551116 - DNA, 16 bp, Homo sapiens
attgtagattttgtta

SEQ ID NO: 4551117 - DNA, 23 bp, Homo sapiens
attgtagtttgaaagttgtacat

SEQ ID NO: 4551118 - DNA, 18 bp, Homo sapiens
attgtataccaatgtgtt

SEQ ID NO: 4551119 - DNA, 20 bp, Homo sapiens
attgtatatatattcatata

SEQ ID NO: 4551120 - DNA, 17 bp, Homo sapiens
attgtatattacaatga

SEQ ID NO: 4551121 - DNA, 20 bp, Homo sapiens
attgtatattacaatgatca

SEQ ID NO: 4551122 - DNA, 13 bp, Homo sapiens
attgtatattgta

SEQ ID NO: 4551123 - DNA, 16 bp, Homo sapiens
attgtatcaatttgtt

SEQ ID NO: 4551124 - DNA, 18 bp, Homo sapiens
attgtatgttgaggatct

SEQ ID NO: 4551125 - DNA, 13 bp, Homo sapiens
attgtattgttag

SEQ ID NO: 4551126 - DNA, 15 bp, Homo sapiens
attgtcaaagaggat

SEQ ID NO: 4551127 - DNA, 16 bp, Homo sapiens
attgtcacctcagcac

SEQ ID NO: 4551128 - DNA, 20 bp, Homo sapiens
attgtcagaaatattcttat

SEQ ID NO: 4551129 - DNA, 21 bp, Homo sapiens
attgtcagccatcgtcctggg

SEQ ID NO: 4551130 - DNA, 13 bp, Homo sapiens
attgtccaggaaa

SEQ ID NO: 4551131 - DNA, 22 bp, Homo sapiens
attgtcgaaaagagtcttccaa

SEQ ID NO: 4551132 - DNA, 18 bp, Homo sapiens
attgtctactcctagaag

SEQ ID NO: 4551133 - DNA, 18 bp, Homo sapiens
attgtctattttatatct

SEQ ID NO: 4551134 - DNA, 21 bp, Homo sapiens
attgtctgtctacatttctgc

SEQ ID NO: 4551135 - DNA, 15 bp, Homo sapiens
attgtgaaaatgaat

SEQ ID NO: 4551136 - DNA, 11 bp, Homo sapiens
attgtgaaata

SEQ ID NO: 4551137 - DNA, 18 bp, Homo sapiens
attgtgaatatttggaat

SEQ ID NO: 4551138 - DNA, 19 bp, Homo sapiens
attgtgacttcactgtata

SEQ ID NO: 4551139 - DNA, 20 bp, Homo sapiens
attgtgacttcactgtatat

SEQ ID NO: 4551140 - DNA, 22 bp, Homo sapiens
attgtgacttcactgtatataa

SEQ ID NO: 4551141 - DNA, 19 bp, Homo sapiens
attgtgagctctggttatt

SEQ ID NO: 4551142 - DNA, 15 bp, Homo sapiens
attgtgcaaaggata

SEQ ID NO: 4551143 - DNA, 19 bp, Homo sapiens
attgtgcaaaggataaatt

SEQ ID NO: 4551144 - DNA, 22 bp, Homo sapiens
attgtgcaaaggataaattttt

SEQ ID NO: 4551145 - DNA, 18 bp, Homo sapiens
attgtgcaatgtaaatat

SEQ ID NO: 4551146 - DNA, 16 bp, Homo sapiens
attgtgcataatgctt

SEQ ID NO: 4551147 - DNA, 23 bp, Homo sapiens
attgtgcataatgctttggaaaa

SEQ ID NO: 4551148 - DNA, 20 bp, Homo sapiens
attgtgcttctccccagaat

SEQ ID NO: 4551149 - DNA, 16 bp, Homo sapiens
attgtgctttggttaa

SEQ ID NO: 4551150 - DNA, 23 bp, Homo sapiens
attgtgctttggttaatacatct

SEQ ID NO: 4551151 - DNA, 14 bp, Homo sapiens
attgtggaatgttg

SEQ ID NO: 4551152 - DNA, 20 bp, Homo sapiens
attgtggaatgttggataag

SEQ ID NO: 4551153 - DNA, 16 bp, Homo sapiens
attgtgggtgttaatt

SEQ ID NO: 4551154 - DNA, 23 bp, Homo sapiens
attgtggtggtgctaaaggaggc

SEQ ID NO: 4551155 - DNA, 16 bp, Homo sapiens
attgtgtcttaatctc

SEQ ID NO: 4551156 - DNA, 23 bp, Homo sapiens
attgtgtggtctggttcctgtgt

SEQ ID NO: 4551157 - DNA, 18 bp, Homo sapiens
attgtgtgttgattgtat

SEQ ID NO: 4551158 - DNA, 18 bp, Homo sapiens
attgtgttgactttataa

SEQ ID NO: 4551159 - DNA, 20 bp, Homo sapiens
attgtgttgtgcagcattaa

SEQ ID NO: 4551160 - DNA, 22 bp, Homo sapiens
attgtgtttctaccggagagag

SEQ ID NO: 4551161 - DNA, 13 bp, Homo sapiens
attgtgtttgtgt

SEQ ID NO: 4551162 - DNA, 15 bp, Homo sapiens
attgttaatttcagt

SEQ ID NO: 4551163 - DNA, 16 bp, Homo sapiens
attgttagaaaatgac

SEQ ID NO: 4551164 - DNA, 15 bp, Homo sapiens
attgttagatgtttg

SEQ ID NO: 4551165 - DNA, 19 bp, Homo sapiens
attgttagcaaactatttc

SEQ ID NO: 4551166 - DNA, 21 bp, Homo sapiens
attgttaggaaatgtcatcaa

SEQ ID NO: 4551167 - DNA, 20 bp, Homo sapiens
attgttataaataaaattgt

SEQ ID NO: 4551168 - DNA, 18 bp, Homo sapiens
attgttcaactcccttct

SEQ ID NO: 4551169 - DNA, 13 bp, Homo sapiens
attgttcctgtca

SEQ ID NO: 4551170 - DNA, 13 bp, Homo sapiens
attgttctgcttt

SEQ ID NO: 4551171 - DNA, 19 bp, Homo sapiens
attgttgaaaaagtttgtt

SEQ ID NO: 4551172 - DNA, 16 bp, Homo sapiens
attgttgagctattgc

SEQ ID NO: 4551173 - DNA, 19 bp, Homo sapiens
attgttgagctattgctgt

SEQ ID NO: 4551174 - DNA, 13 bp, Homo sapiens
attgttgtgtctg

SEQ ID NO: 4551175 - DNA, 15 bp, Homo sapiens
attgttgtgtctgtg

SEQ ID NO: 4551176 - DNA, 21 bp, Homo sapiens
attgtttaccatagaaagatg

SEQ ID NO: 4551177 - DNA, 21 bp, Homo sapiens
attgtttatgtgttatgaaca

SEQ ID NO: 4551178 - DNA, 13 bp, Homo sapiens
attgtttctacaa

SEQ ID NO: 4551179 - DNA, 19 bp, Homo sapiens
attgttttacaatagttct

SEQ ID NO: 4551180 - DNA, 17 bp, Homo sapiens
attgttttgaatattac

SEQ ID NO: 4551181 - DNA, 17 bp, Homo sapiens
attgtttttatatatta

SEQ ID NO: 4551182 - DNA, 19 bp, Homo sapiens
attgtttttatatattata

SEQ ID NO: 4551183 - DNA, 16 bp, Homo sapiens
attgtttttatttcta

SEQ ID NO: 4551184 - DNA, 22 bp, Homo sapiens
attgtttttccctaatcttccg

SEQ ID NO: 4551185 - DNA, 19 bp, Homo sapiens
attgtttttctttctacaa

SEQ ID NO: 4551186 - DNA, 16 bp, Homo sapiens
attgtttttgtatatt

SEQ ID NO: 4551187 - DNA, 15 bp, Homo sapiens
attgttttttaaaga

SEQ ID NO: 4551188 - DNA, 17 bp, Homo sapiens
atttaaaaaactaaaaa

SEQ ID NO: 4551189 - DNA, 18 bp, Homo sapiens
atttaaaaaactgtataa

SEQ ID NO: 4551190 - DNA, 17 bp, Homo sapiens
atttaaaaaattaaaaa

SEQ ID NO: 4551191 - DNA, 14 bp, Homo sapiens
atttaaaaacattt

SEQ ID NO: 4551192 - DNA, 21 bp, Homo sapiens
atttaaaaaggtttaaaacta

SEQ ID NO: 4551193 - DNA, 18 bp, Homo sapiens
atttaaaaatctccatta

SEQ ID NO: 4551194 - DNA, 16 bp, Homo sapiens
atttaaaaatgtcttg

SEQ ID NO: 4551195 - DNA, 15 bp, Homo sapiens
atttaaaacagacac

SEQ ID NO: 4551196 - DNA, 23 bp, Homo sapiens
atttaaaacagacactggcatgg

SEQ ID NO: 4551197 - DNA, 13 bp, Homo sapiens
atttaaaacaggc

SEQ ID NO: 4551198 - DNA, 14 bp, Homo sapiens
atttaaaacaggca

SEQ ID NO: 4551199 - DNA, 13 bp, Homo sapiens
atttaaaactctg

SEQ ID NO: 4551200 - DNA, 20 bp, Homo sapiens
atttaaaagtaaaatgtctt

SEQ ID NO: 4551201 - DNA, 16 bp, Homo sapiens
atttaaaataattata

SEQ ID NO: 4551202 - DNA, 19 bp, Homo sapiens
atttaaaattgtgatgtgt

SEQ ID NO: 4551203 - DNA, 20 bp, Homo sapiens
atttaaaattgtgatgtgtc

SEQ ID NO: 4551204 - DNA, 22 bp, Homo sapiens
atttaaactttttaaaatactt

SEQ ID NO: 4551205 - DNA, 18 bp, Homo sapiens
atttaaaggcagacagtt

SEQ ID NO: 4551206 - DNA, 14 bp, Homo sapiens
atttaaagtatttt

SEQ ID NO: 4551207 - DNA, 20 bp, Homo sapiens
atttaaagtattttaatttt

SEQ ID NO: 4551208 - DNA, 13 bp, Homo sapiens
atttaaatatctg

SEQ ID NO: 4551209 - DNA, 20 bp, Homo sapiens
atttaaatatctgaacattt

SEQ ID NO: 4551210 - DNA, 23 bp, Homo sapiens
atttaaatatctgaacatttact

SEQ ID NO: 4551211 - DNA, 22 bp, Homo sapiens
atttaaatatctgttattcaaa

SEQ ID NO: 4551212 - DNA, 21 bp, Homo sapiens
atttaaatcattttaacttct

SEQ ID NO: 4551213 - DNA, 19 bp, Homo sapiens
atttaaattcttttttaaa

SEQ ID NO: 4551214 - DNA, 19 bp, Homo sapiens
atttaacaaaaaatgtaat

SEQ ID NO: 4551215 - DNA, 13 bp, Homo sapiens
atttaacagaaat

SEQ ID NO: 4551216 - DNA, 16 bp, Homo sapiens
atttaacagaaattgt

SEQ ID NO: 4551217 - DNA, 22 bp, Homo sapiens
atttaacagaaattgtatattg

SEQ ID NO: 4551218 - DNA, 14 bp, Homo sapiens
atttaacattttac

SEQ ID NO: 4551219 - DNA, 15 bp, Homo sapiens
atttaacattttaca

SEQ ID NO: 4551220 - DNA, 19 bp, Homo sapiens
atttaacattttacagtaa

SEQ ID NO: 4551221 - DNA, 19 bp, Homo sapiens
atttaacccctccactgct

SEQ ID NO: 4551222 - DNA, 19 bp, Homo sapiens
atttaactacccttaatta

SEQ ID NO: 4551223 - DNA, 21 bp, Homo sapiens
atttaactacccttaattact

SEQ ID NO: 4551224 - DNA, 13 bp, Homo sapiens
atttaactctctt

SEQ ID NO: 4551225 - DNA, 21 bp, Homo sapiens
atttaactctttgaaactgta

SEQ ID NO: 4551226 - DNA, 22 bp, Homo sapiens
atttaactggtgcactttgtaa

SEQ ID NO: 4551227 - DNA, 20 bp, Homo sapiens
atttaagaatgaaactataa

SEQ ID NO: 4551228 - DNA, 13 bp, Homo sapiens
atttaagatatat

SEQ ID NO: 4551229 - DNA, 16 bp, Homo sapiens
atttaagatgtacatt

SEQ ID NO: 4551230 - DNA, 20 bp, Homo sapiens
atttaagatgtacatttaat

SEQ ID NO: 4551231 - DNA, 15 bp, Homo sapiens
atttaagcaaatact

SEQ ID NO: 4551232 - DNA, 22 bp, Homo sapiens
atttaagctttaaatgacagta

SEQ ID NO: 4551233 - DNA, 18 bp, Homo sapiens
atttaagggaaaaatata

SEQ ID NO: 4551234 - DNA, 15 bp, Homo sapiens
atttaagtatcttgt

SEQ ID NO: 4551235 - DNA, 17 bp, Homo sapiens
atttaagtgcaattaac

SEQ ID NO: 4551236 - DNA, 21 bp, Homo sapiens
atttaagtttgttgctgtcaa

SEQ ID NO: 4551237 - DNA, 22 bp, Homo sapiens
atttaagtttgttgctgtcaag

SEQ ID NO: 4551238 - DNA, 16 bp, Homo sapiens
atttaataaaaaggaa

SEQ ID NO: 4551239 - DNA, 13 bp, Homo sapiens
atttaataatatc

SEQ ID NO: 4551240 - DNA, 15 bp, Homo sapiens
atttaataatctgta

SEQ ID NO: 4551241 - DNA, 12 bp, Homo sapiens
atttaatacagc

SEQ ID NO: 4551242 - DNA, 13 bp, Homo sapiens
atttaatactttt

SEQ ID NO: 4551243 - DNA, 18 bp, Homo sapiens
atttaatagcaaagaatt

SEQ ID NO: 4551244 - DNA, 17 bp, Homo sapiens
atttaatatcaaaagaa

SEQ ID NO: 4551245 - DNA, 20 bp, Homo sapiens
atttaatatcaaaagaaaat

SEQ ID NO: 4551246 - DNA, 20 bp, Homo sapiens
atttaatggtttttatttct

SEQ ID NO: 4551247 - DNA, 12 bp, Homo sapiens
atttaatgtttt

SEQ ID NO: 4551248 - DNA, 16 bp, Homo sapiens
atttaattatgaaaac

SEQ ID NO: 4551249 - DNA, 23 bp, Homo sapiens
atttaattcctctttttagggct

SEQ ID NO: 4551250 - DNA, 14 bp, Homo sapiens
atttaattgctttg

SEQ ID NO: 4551251 - DNA, 14 bp, Homo sapiens
atttaattgtaaac

SEQ ID NO: 4551252 - DNA, 20 bp, Homo sapiens
atttaattttgacactgaaa

SEQ ID NO: 4551253 - DNA, 19 bp, Homo sapiens
atttacaaaagatttattg

SEQ ID NO: 4551254 - DNA, 20 bp, Homo sapiens
atttacaagatattattaat

SEQ ID NO: 4551255 - DNA, 13 bp, Homo sapiens
atttacaatgtat

SEQ ID NO: 4551256 - DNA, 16 bp, Homo sapiens
atttacaatgtattaa

SEQ ID NO: 4551257 - DNA, 14 bp, Homo sapiens
atttacacagtgag

SEQ ID NO: 4551258 - DNA, 19 bp, Homo sapiens
atttacacagtgagactgt

SEQ ID NO: 4551259 - DNA, 22 bp, Homo sapiens
atttacacagtgagactgtaca

SEQ ID NO: 4551260 - DNA, 17 bp, Homo sapiens
atttacacatcttaaaa

SEQ ID NO: 4551261 - DNA, 23 bp, Homo sapiens
atttacactcctctatcatgcaa

SEQ ID NO: 4551262 - DNA, 22 bp, Homo sapiens
atttacagacacacccagtgcg

SEQ ID NO: 4551263 - DNA, 19 bp, Homo sapiens
atttacagataacttcttt

SEQ ID NO: 4551264 - DNA, 19 bp, Homo sapiens
atttacatgttttaaagaa

SEQ ID NO: 4551265 - DNA, 16 bp, Homo sapiens
atttacattcaactct

SEQ ID NO: 4551266 - DNA, 15 bp, Homo sapiens
atttacatttaatag

SEQ ID NO: 4551267 - DNA, 13 bp, Homo sapiens
atttactgctcta

SEQ ID NO: 4551268 - DNA, 19 bp, Homo sapiens
atttactgctctagaaagt

SEQ ID NO: 4551269 - DNA, 20 bp, Homo sapiens
atttactttttaaaaataac

SEQ ID NO: 4551270 - DNA, 22 bp, Homo sapiens
atttagaaaaagaacatgcagt

SEQ ID NO: 4551271 - DNA, 18 bp, Homo sapiens
atttagaaactaattgac

SEQ ID NO: 4551272 - DNA, 14 bp, Homo sapiens
atttagaagaaaga

SEQ ID NO: 4551273 - DNA, 18 bp, Homo sapiens
atttagaagaaagatgtt

SEQ ID NO: 4551274 - DNA, 19 bp, Homo sapiens
atttagaagctgaagatcc

SEQ ID NO: 4551275 - DNA, 16 bp, Homo sapiens
atttagacaagagatg

SEQ ID NO: 4551276 - DNA, 18 bp, Homo sapiens
atttagagcgtttggtta

SEQ ID NO: 4551277 - DNA, 19 bp, Homo sapiens
atttagaggtaaaagtaca

SEQ ID NO: 4551278 - DNA, 17 bp, Homo sapiens
atttagatcttatattg

SEQ ID NO: 4551279 - DNA, 21 bp, Homo sapiens
atttagatcttatattggttt

SEQ ID NO: 4551280 - DNA, 23 bp, Homo sapiens
atttagcccgagatctggtcttt

SEQ ID NO: 4551281 - DNA, 21 bp, Homo sapiens
atttagctaaacggattccaa

SEQ ID NO: 4551282 - DNA, 14 bp, Homo sapiens
atttaggaaaatgc

SEQ ID NO: 4551283 - DNA, 23 bp, Homo sapiens
atttaggaagttgacttatagta

SEQ ID NO: 4551284 - DNA, 17 bp, Homo sapiens
atttagtaaataaacaa

SEQ ID NO: 4551285 - DNA, 14 bp, Homo sapiens
atttagtaaatgtt

SEQ ID NO: 4551286 - DNA, 18 bp, Homo sapiens
atttagtaaggattttat

SEQ ID NO: 4551287 - DNA, 23 bp, Homo sapiens
atttagtctagacacaatttcat

SEQ ID NO: 4551288 - DNA, 14 bp, Homo sapiens
atttagtgctcagt

SEQ ID NO: 4551289 - DNA, 15 bp, Homo sapiens
atttagtgtgaatat

SEQ ID NO: 4551290 - DNA, 21 bp, Homo sapiens
atttagttacgtataatgctt

SEQ ID NO: 4551291 - DNA, 20 bp, Homo sapiens
atttagtttcagtagattgc

SEQ ID NO: 4551292 - DNA, 13 bp, Homo sapiens
atttagtttgtta

SEQ ID NO: 4551293 - DNA, 14 bp, Homo sapiens
atttagtttgttaa

SEQ ID NO: 4551294 - DNA, 16 bp, Homo sapiens
atttataaaaaggtgt

SEQ ID NO: 4551295 - DNA, 12 bp, Homo sapiens
atttataaaggg

SEQ ID NO: 4551296 - DNA, 20 bp, Homo sapiens
atttataacgtgttcaatat

SEQ ID NO: 4551297 - DNA, 18 bp, Homo sapiens
atttataatacagaatct

SEQ ID NO: 4551298 - DNA, 15 bp, Homo sapiens
atttataatactgtt

SEQ ID NO: 4551299 - DNA, 18 bp, Homo sapiens
atttataatactgtttta

SEQ ID NO: 4551300 - DNA, 18 bp, Homo sapiens
atttataatataaatata

SEQ ID NO: 4551301 - DNA, 15 bp, Homo sapiens
atttataatgtattt

SEQ ID NO: 4551302 - DNA, 20 bp, Homo sapiens
atttataatgtatttgaaaa

SEQ ID NO: 4551303 - DNA, 15 bp, Homo sapiens
atttataggaccttc

SEQ ID NO: 4551304 - DNA, 18 bp, Homo sapiens
atttatagtttatacagt

SEQ ID NO: 4551305 - DNA, 14 bp, Homo sapiens
atttatatactttt

SEQ ID NO: 4551306 - DNA, 22 bp, Homo sapiens
atttatatcacacaatatagtt

SEQ ID NO: 4551307 - DNA, 15 bp, Homo sapiens
atttatatcacatgt

SEQ ID NO: 4551308 - DNA, 15 bp, Homo sapiens
atttatatcttgtta

SEQ ID NO: 4551309 - DNA, 17 bp, Homo sapiens
atttatatgtacatgag

SEQ ID NO: 4551310 - DNA, 16 bp, Homo sapiens
atttatcacacttctg

SEQ ID NO: 4551311 - DNA, 17 bp, Homo sapiens
atttatcgcagaccttt

SEQ ID NO: 4551312 - DNA, 14 bp, Homo sapiens
atttatctttacca

SEQ ID NO: 4551313 - DNA, 21 bp, Homo sapiens
atttatctttgtattcttcat

SEQ ID NO: 4551314 - DNA, 18 bp, Homo sapiens
atttatgtaatgaagtaa

SEQ ID NO: 4551315 - DNA, 15 bp, Homo sapiens
atttatgtgaacaac

SEQ ID NO: 4551316 - DNA, 17 bp, Homo sapiens
atttatgtgaacaactg

SEQ ID NO: 4551317 - DNA, 22 bp, Homo sapiens
atttatgtgtgaggagctgctg

SEQ ID NO: 4551318 - DNA, 22 bp, Homo sapiens
atttatgttccttttaaagaaa

SEQ ID NO: 4551319 - DNA, 14 bp, Homo sapiens
atttattaaacttc

SEQ ID NO: 4551320 - DNA, 15 bp, Homo sapiens
atttattaaacttca

SEQ ID NO: 4551321 - DNA, 16 bp, Homo sapiens
atttattgcattgctg

SEQ ID NO: 4551322 - DNA, 13 bp, Homo sapiens
atttattgtctgt

SEQ ID NO: 4551323 - DNA, 17 bp, Homo sapiens
atttattgtctgtctac

SEQ ID NO: 4551324 - DNA, 23 bp, Homo sapiens
atttattgttagaaaatgactta

SEQ ID NO: 4551325 - DNA, 17 bp, Homo sapiens
atttatttaaaactctg

SEQ ID NO: 4551326 - DNA, 15 bp, Homo sapiens
atttatttcatttac

SEQ ID NO: 4551327 - DNA, 22 bp, Homo sapiens
atttatttccactaaaaatatt

SEQ ID NO: 4551328 - DNA, 15 bp, Homo sapiens
atttatttcctccct

SEQ ID NO: 4551329 - DNA, 14 bp, Homo sapiens
atttatttctctgg

SEQ ID NO: 4551330 - DNA, 23 bp, Homo sapiens
atttatttgcaaatatactttac

SEQ ID NO: 4551331 - DNA, 16 bp, Homo sapiens
atttatttgcttcttc

SEQ ID NO: 4551332 - DNA, 12 bp, Homo sapiens
atttattttatt

SEQ ID NO: 4551333 - DNA, 18 bp, Homo sapiens
atttattttattctatgt

SEQ ID NO: 4551334 - DNA, 22 bp, Homo sapiens
atttattttattctatgtatgt

SEQ ID NO: 4551335 - DNA, 21 bp, Homo sapiens
atttattttcttccccaagct

SEQ ID NO: 4551336 - DNA, 14 bp, Homo sapiens
atttattttgacat

SEQ ID NO: 4551337 - DNA, 20 bp, Homo sapiens
atttattttgtatgaaatat

SEQ ID NO: 4551338 - DNA, 17 bp, Homo sapiens
atttattttttcttttc

SEQ ID NO: 4551339 - DNA, 14 bp, Homo sapiens
atttcaaaatgata

SEQ ID NO: 4551340 - DNA, 21 bp, Homo sapiens
atttcaaaatgctttttatta

SEQ ID NO: 4551341 - DNA, 14 bp, Homo sapiens
atttcaaaatttaa

SEQ ID NO: 4551342 - DNA, 21 bp, Homo sapiens
atttcaaaccattgctcttag

SEQ ID NO: 4551343 - DNA, 18 bp, Homo sapiens
atttcaaacttttgaaag

SEQ ID NO: 4551344 - DNA, 19 bp, Homo sapiens
atttcaaacttttgaaaga

SEQ ID NO: 4551345 - DNA, 14 bp, Homo sapiens
atttcaagtgccta

SEQ ID NO: 4551346 - DNA, 23 bp, Homo sapiens
atttcaagtgcctagactgttac

SEQ ID NO: 4551347 - DNA, 16 bp, Homo sapiens
atttcaagttccaagt

SEQ ID NO: 4551348 - DNA, 13 bp, Homo sapiens
atttcaatgtaat

SEQ ID NO: 4551349 - DNA, 16 bp, Homo sapiens
atttcaatgtaattaa

SEQ ID NO: 4551350 - DNA, 15 bp, Homo sapiens
atttcaatgtgtata

SEQ ID NO: 4551351 - DNA, 22 bp, Homo sapiens
atttcaatgtgtataaattgtc

SEQ ID NO: 4551352 - DNA, 19 bp, Homo sapiens
atttcacaacagcctgaca

SEQ ID NO: 4551353 - DNA, 16 bp, Homo sapiens
atttcacagttctgta

SEQ ID NO: 4551354 - DNA, 16 bp, Homo sapiens
atttcacatttctact

SEQ ID NO: 4551355 - DNA, 15 bp, Homo sapiens
atttcacatttttgt

SEQ ID NO: 4551356 - DNA, 20 bp, Homo sapiens
atttcacatttttgtaatgc

SEQ ID NO: 4551357 - DNA, 23 bp, Homo sapiens
atttcacccagacagcctgtttc

SEQ ID NO: 4551358 - DNA, 23 bp, Homo sapiens
atttcaccccatccctccttaag

SEQ ID NO: 4551359 - DNA, 15 bp, Homo sapiens
atttcacccctccct

SEQ ID NO: 4551360 - DNA, 21 bp, Homo sapiens
atttcacccctccctttctcc

SEQ ID NO: 4551361 - DNA, 16 bp, Homo sapiens
atttcacctgtaaacc

SEQ ID NO: 4551362 - DNA, 15 bp, Homo sapiens
atttcactaaaagtc

SEQ ID NO: 4551363 - DNA, 20 bp, Homo sapiens
atttcactaaaagtctccaa

SEQ ID NO: 4551364 - DNA, 14 bp, Homo sapiens
atttcagaaacatc

SEQ ID NO: 4551365 - DNA, 12 bp, Homo sapiens
atttcagaagtt

SEQ ID NO: 4551366 - DNA, 20 bp, Homo sapiens
atttcagactgcagagggga

SEQ ID NO: 4551367 - DNA, 14 bp, Homo sapiens
atttcagagggtaa

SEQ ID NO: 4551368 - DNA, 15 bp, Homo sapiens
atttcagatgtaatg

SEQ ID NO: 4551369 - DNA, 17 bp, Homo sapiens
atttcagatgtaatgtt

SEQ ID NO: 4551370 - DNA, 17 bp, Homo sapiens
atttcagattttgataa

SEQ ID NO: 4551371 - DNA, 16 bp, Homo sapiens
atttcagccaaagtcc

SEQ ID NO: 4551372 - DNA, 12 bp, Homo sapiens
atttcaggaaaa

SEQ ID NO: 4551373 - DNA, 13 bp, Homo sapiens
atttcagtatttt

SEQ ID NO: 4551374 - DNA, 15 bp, Homo sapiens
atttcagtattttcc

SEQ ID NO: 4551375 - DNA, 23 bp, Homo sapiens
atttcagtgataatgttcatttt

SEQ ID NO: 4551376 - DNA, 13 bp, Homo sapiens
atttcagtttcta

SEQ ID NO: 4551377 - DNA, 17 bp, Homo sapiens
atttcatatctaacttt

SEQ ID NO: 4551378 - DNA, 20 bp, Homo sapiens
atttcatattattttagtgt

SEQ ID NO: 4551379 - DNA, 14 bp, Homo sapiens
atttcatctcattt

SEQ ID NO: 4551380 - DNA, 15 bp, Homo sapiens
atttcatctcattta

SEQ ID NO: 4551381 - DNA, 14 bp, Homo sapiens
atttcatctgctct

SEQ ID NO: 4551382 - DNA, 16 bp, Homo sapiens
atttcatctgctctcc

SEQ ID NO: 4551383 - DNA, 17 bp, Homo sapiens
atttcatctgctctcct

SEQ ID NO: 4551384 - DNA, 14 bp, Homo sapiens
atttcatgaaaaag

SEQ ID NO: 4551385 - DNA, 17 bp, Homo sapiens
atttcatgaaaaagctg

SEQ ID NO: 4551386 - DNA, 18 bp, Homo sapiens
atttcatgaaaaagctgc

SEQ ID NO: 4551387 - DNA, 13 bp, Homo sapiens
atttcatgtccat

SEQ ID NO: 4551388 - DNA, 12 bp, Homo sapiens
atttcatttcac

SEQ ID NO: 4551389 - DNA, 23 bp, Homo sapiens
atttcatttttcaatagcacata

SEQ ID NO: 4551390 - DNA, 18 bp, Homo sapiens
atttccaaaataatctat

SEQ ID NO: 4551391 - DNA, 16 bp, Homo sapiens
atttccaaagagaaaa

SEQ ID NO: 4551392 - DNA, 20 bp, Homo sapiens
atttccaactcgaatctgtg

SEQ ID NO: 4551393 - DNA, 14 bp, Homo sapiens
atttccaatgtttc

SEQ ID NO: 4551394 - DNA, 14 bp, Homo sapiens
atttccacaccaag

SEQ ID NO: 4551395 - DNA, 17 bp, Homo sapiens
atttccagtttttcttt

SEQ ID NO: 4551396 - DNA, 14 bp, Homo sapiens
atttccatttctct

SEQ ID NO: 4551397 - DNA, 16 bp, Homo sapiens
atttcccagttaaaga

SEQ ID NO: 4551398 - DNA, 21 bp, Homo sapiens
atttcccagttaaagattatt

SEQ ID NO: 4551399 - DNA, 18 bp, Homo sapiens
atttcccccctccgcctc

SEQ ID NO: 4551400 - DNA, 22 bp, Homo sapiens
atttccccgatgtcccctgcgg

SEQ ID NO: 4551401 - DNA, 17 bp, Homo sapiens
atttccctatcttctcc

SEQ ID NO: 4551402 - DNA, 19 bp, Homo sapiens
atttccctcccaagtaaat

SEQ ID NO: 4551403 - DNA, 14 bp, Homo sapiens
atttcctgtaatat

SEQ ID NO: 4551404 - DNA, 20 bp, Homo sapiens
atttcctgtaatatatttat

SEQ ID NO: 4551405 - DNA, 14 bp, Homo sapiens
atttcctgtttgaa

SEQ ID NO: 4551406 - DNA, 16 bp, Homo sapiens
atttccttatcacaga

SEQ ID NO: 4551407 - DNA, 20 bp, Homo sapiens
atttccttatcacagaaata

SEQ ID NO: 4551408 - DNA, 10 bp, Homo sapiens
atttccttta

SEQ ID NO: 4551409 - DNA, 16 bp, Homo sapiens
atttcctttatgtgaa

SEQ ID NO: 4551410 - DNA, 20 bp, Homo sapiens
atttcctttatgtgaatttt

SEQ ID NO: 4551411 - DNA, 14 bp, Homo sapiens
atttcgaagatata

SEQ ID NO: 4551412 - DNA, 17 bp, Homo sapiens
atttcgaccctggggcg

SEQ ID NO: 4551413 - DNA, 15 bp, Homo sapiens
atttcgccttaaact

SEQ ID NO: 4551414 - DNA, 22 bp, Homo sapiens
atttcgccttaaactctggaca

SEQ ID NO: 4551415 - DNA, 17 bp, Homo sapiens
atttcggattttttcca

SEQ ID NO: 4551416 - DNA, 17 bp, Homo sapiens
atttcgtgtgccgctgc

SEQ ID NO: 4551417 - DNA, 23 bp, Homo sapiens
atttctaaagtaaaattgaagca

SEQ ID NO: 4551418 - DNA, 23 bp, Homo sapiens
atttctaagactactaaggcctt

SEQ ID NO: 4551419 - DNA, 19 bp, Homo sapiens
atttctaatccttttcctt

SEQ ID NO: 4551420 - DNA, 15 bp, Homo sapiens
atttctaatgtttac

SEQ ID NO: 4551421 - DNA, 19 bp, Homo sapiens
atttctactatgatcagaa

SEQ ID NO: 4551422 - DNA, 23 bp, Homo sapiens
atttctactatgatcagaagaac

SEQ ID NO: 4551423 - DNA, 18 bp, Homo sapiens
atttctactttgaagtca

SEQ ID NO: 4551424 - DNA, 14 bp, Homo sapiens
atttctagactcaa

SEQ ID NO: 4551425 - DNA, 21 bp, Homo sapiens
atttctagactcaaaacctgg

SEQ ID NO: 4551426 - DNA, 23 bp, Homo sapiens
atttctagcctgcactttgatgt

SEQ ID NO: 4551427 - DNA, 20 bp, Homo sapiens
atttctagtaggcagcaaaa

SEQ ID NO: 4551428 - DNA, 21 bp, Homo sapiens
atttctagttctttcctcccc

SEQ ID NO: 4551429 - DNA, 15 bp, Homo sapiens
atttctataaaaata

SEQ ID NO: 4551430 - DNA, 22 bp, Homo sapiens
atttctataaaaatactacaat

SEQ ID NO: 4551431 - DNA, 14 bp, Homo sapiens
atttctataaattt

SEQ ID NO: 4551432 - DNA, 13 bp, Homo sapiens
atttctatggctt

SEQ ID NO: 4551433 - DNA, 17 bp, Homo sapiens
atttctatggctttcaa

SEQ ID NO: 4551434 - DNA, 12 bp, Homo sapiens
atttctatgtca

SEQ ID NO: 4551435 - DNA, 23 bp, Homo sapiens
atttctatgtcatttttaatgta

SEQ ID NO: 4551436 - DNA, 15 bp, Homo sapiens
atttctatttctcct

SEQ ID NO: 4551437 - DNA, 18 bp, Homo sapiens
atttctatttctcctcca

SEQ ID NO: 4551438 - DNA, 20 bp, Homo sapiens
atttctatttctcctccatg

SEQ ID NO: 4551439 - DNA, 18 bp, Homo sapiens
atttctcataattttgca

SEQ ID NO: 4551440 - DNA, 20 bp, Homo sapiens
atttctcataattttgcaaa

SEQ ID NO: 4551441 - DNA, 20 bp, Homo sapiens
atttctccatcccctccctg

SEQ ID NO: 4551442 - DNA, 23 bp, Homo sapiens
atttctccatcccctccctgcct

SEQ ID NO: 4551443 - DNA, 14 bp, Homo sapiens
atttctcctccctt

SEQ ID NO: 4551444 - DNA, 14 bp, Homo sapiens
atttctcctttgca

SEQ ID NO: 4551445 - DNA, 16 bp, Homo sapiens
atttctcctttgcaat

SEQ ID NO: 4551446 - DNA, 20 bp, Homo sapiens
atttctcctttgcaatagca

SEQ ID NO: 4551447 - DNA, 21 bp, Homo sapiens
atttctcctttgcaatagcag

SEQ ID NO: 4551448 - DNA, 20 bp, Homo sapiens
atttctctaactcctgccat

SEQ ID NO: 4551449 - DNA, 18 bp, Homo sapiens
atttctctacttgtcata

SEQ ID NO: 4551450 - DNA, 13 bp, Homo sapiens
atttctctgagca

SEQ ID NO: 4551451 - DNA, 19 bp, Homo sapiens
atttctcttttattctgtt

SEQ ID NO: 4551452 - DNA, 14 bp, Homo sapiens
atttctgaagaagt

SEQ ID NO: 4551453 - DNA, 20 bp, Homo sapiens
atttctgaaggtagcattct

SEQ ID NO: 4551454 - DNA, 14 bp, Homo sapiens
atttctgacatcaa

SEQ ID NO: 4551455 - DNA, 21 bp, Homo sapiens
atttctgcagatcttccgtgg

SEQ ID NO: 4551456 - DNA, 18 bp, Homo sapiens
atttctgcatatgttgaa

SEQ ID NO: 4551457 - DNA, 21 bp, Homo sapiens
atttctgctaaatatcaccta

SEQ ID NO: 4551458 - DNA, 14 bp, Homo sapiens
atttctgctctgga

SEQ ID NO: 4551459 - DNA, 16 bp, Homo sapiens
atttctgctttctttg

SEQ ID NO: 4551460 - DNA, 18 bp, Homo sapiens
atttctgggggccgcaga

SEQ ID NO: 4551461 - DNA, 13 bp, Homo sapiens
atttctgtacatt

SEQ ID NO: 4551462 - DNA, 18 bp, Homo sapiens
atttctgtacatttgcaa

SEQ ID NO: 4551463 - DNA, 19 bp, Homo sapiens
atttctgtacatttgcaat

SEQ ID NO: 4551464 - DNA, 20 bp, Homo sapiens
atttctgtcacagtaaaaat

SEQ ID NO: 4551465 - DNA, 21 bp, Homo sapiens
atttctgtcacagtaaaaata

SEQ ID NO: 4551466 - DNA, 18 bp, Homo sapiens
atttcttaaaacacatga

SEQ ID NO: 4551467 - DNA, 19 bp, Homo sapiens
atttcttaaaacacatgat

SEQ ID NO: 4551468 - DNA, 13 bp, Homo sapiens
atttcttaaatta

SEQ ID NO: 4551469 - DNA, 15 bp, Homo sapiens
atttcttaaattatt

SEQ ID NO: 4551470 - DNA, 15 bp, Homo sapiens
atttcttaagaattc

SEQ ID NO: 4551471 - DNA, 18 bp, Homo sapiens
atttcttaattattataa

SEQ ID NO: 4551472 - DNA, 11 bp, Homo sapiens
atttcttccca

SEQ ID NO: 4551473 - DNA, 15 bp, Homo sapiens
atttcttccctgctt

SEQ ID NO: 4551474 - DNA, 19 bp, Homo sapiens
atttcttccctgctttgca

SEQ ID NO: 4551475 - DNA, 21 bp, Homo sapiens
atttcttcttctaagaagaca

SEQ ID NO: 4551476 - DNA, 22 bp, Homo sapiens
atttcttcttctaagaagacat

SEQ ID NO: 4551477 - DNA, 20 bp, Homo sapiens
atttcttgaagaataaattc

SEQ ID NO: 4551478 - DNA, 17 bp, Homo sapiens
atttcttggcattggaa

SEQ ID NO: 4551479 - DNA, 20 bp, Homo sapiens
atttctttaaaagaatgact

SEQ ID NO: 4551480 - DNA, 15 bp, Homo sapiens
atttctttaaatgtg

SEQ ID NO: 4551481 - DNA, 23 bp, Homo sapiens
atttctttctttgcaccaaagac

SEQ ID NO: 4551482 - DNA, 15 bp, Homo sapiens
atttcttttaaaata

SEQ ID NO: 4551483 - DNA, 14 bp, Homo sapiens
atttcttttattaa

SEQ ID NO: 4551484 - DNA, 20 bp, Homo sapiens
atttcttttgttgtacttta

SEQ ID NO: 4551485 - DNA, 15 bp, Homo sapiens
atttctttttatagg

SEQ ID NO: 4551486 - DNA, 16 bp, Homo sapiens
atttctttttttcctt

SEQ ID NO: 4551487 - DNA, 12 bp, Homo sapiens
atttgaaaattg

SEQ ID NO: 4551488 - DNA, 15 bp, Homo sapiens
atttgaaaattgtat

SEQ ID NO: 4551489 - DNA, 16 bp, Homo sapiens
atttgaaataagaatt

SEQ ID NO: 4551490 - DNA, 17 bp, Homo sapiens
atttgaaatagtataca

SEQ ID NO: 4551491 - DNA, 16 bp, Homo sapiens
atttgaacctggatcc

SEQ ID NO: 4551492 - DNA, 16 bp, Homo sapiens
atttgaagacttcaaa

SEQ ID NO: 4551493 - DNA, 18 bp, Homo sapiens
atttgaattatcagcaaa

SEQ ID NO: 4551494 - DNA, 23 bp, Homo sapiens
atttgaattatcagcaaagaaaa

SEQ ID NO: 4551495 - DNA, 17 bp, Homo sapiens
atttgaattatttctgt

SEQ ID NO: 4551496 - DNA, 13 bp, Homo sapiens
atttgactatgaa

SEQ ID NO: 4551497 - DNA, 14 bp, Homo sapiens
atttgactgaagat

SEQ ID NO: 4551498 - DNA, 16 bp, Homo sapiens
atttgacttttctgta

SEQ ID NO: 4551499 - DNA, 14 bp, Homo sapiens
atttgagagaagcc

SEQ ID NO: 4551500 - DNA, 12 bp, Homo sapiens
atttgagagaat

SEQ ID NO: 4551501 - DNA, 23 bp, Homo sapiens
atttgaggagtgttaagattgca

SEQ ID NO: 4551502 - DNA, 21 bp, Homo sapiens
atttgaggtctacattcttgg

SEQ ID NO: 4551503 - DNA, 17 bp, Homo sapiens
atttgatctttgtttaa

SEQ ID NO: 4551504 - DNA, 23 bp, Homo sapiens
atttgatctttgtttaaatgcca

SEQ ID NO: 4551505 - DNA, 19 bp, Homo sapiens
atttgatgatgttaaatgt

SEQ ID NO: 4551506 - DNA, 18 bp, Homo sapiens
atttgatggttgaataca

SEQ ID NO: 4551507 - DNA, 14 bp, Homo sapiens
atttgattaataaa

SEQ ID NO: 4551508 - DNA, 16 bp, Homo sapiens
atttgattaataaaat

SEQ ID NO: 4551509 - DNA, 15 bp, Homo sapiens
atttgattcaaaata

SEQ ID NO: 4551510 - DNA, 16 bp, Homo sapiens
atttgattcaaaatat

SEQ ID NO: 4551511 - DNA, 16 bp, Homo sapiens
atttgattgatttgaa

SEQ ID NO: 4551512 - DNA, 11 bp, Homo sapiens
atttgcaaagt

SEQ ID NO: 4551513 - DNA, 18 bp, Homo sapiens
atttgcaaagtactgtaa

SEQ ID NO: 4551514 - DNA, 18 bp, Homo sapiens
atttgcacaatatttctt

SEQ ID NO: 4551515 - DNA, 15 bp, Homo sapiens
atttgcacacaaaaa

SEQ ID NO: 4551516 - DNA, 19 bp, Homo sapiens
atttgcagaagctgtgagt

SEQ ID NO: 4551517 - DNA, 14 bp, Homo sapiens
atttgcatccagca

SEQ ID NO: 4551518 - DNA, 18 bp, Homo sapiens
atttgcatgattatagtt

SEQ ID NO: 4551519 - DNA, 22 bp, Homo sapiens
atttgcattgaacacaaactgt

SEQ ID NO: 4551520 - DNA, 20 bp, Homo sapiens
atttgcccatttacactttt

SEQ ID NO: 4551521 - DNA, 16 bp, Homo sapiens
atttgcctgcttcttt

SEQ ID NO: 4551522 - DNA, 21 bp, Homo sapiens
atttgcctgcttctttccaga

SEQ ID NO: 4551523 - DNA, 19 bp, Homo sapiens
atttgccttctactcccct

SEQ ID NO: 4551524 - DNA, 23 bp, Homo sapiens
atttgctaaatgctgttcttaca

SEQ ID NO: 4551525 - DNA, 14 bp, Homo sapiens
atttgctaatgtat

SEQ ID NO: 4551526 - DNA, 16 bp, Homo sapiens
atttgctatgagctgg

SEQ ID NO: 4551527 - DNA, 20 bp, Homo sapiens
atttgctatgagctggggat

SEQ ID NO: 4551528 - DNA, 21 bp, Homo sapiens
atttgctgaactcagcacatt

SEQ ID NO: 4551529 - DNA, 21 bp, Homo sapiens
atttgctgacaaccattaaag

SEQ ID NO: 4551530 - DNA, 22 bp, Homo sapiens
atttgctgacaaccattaaagt

SEQ ID NO: 4551531 - DNA, 14 bp, Homo sapiens
atttgctgccaaat

SEQ ID NO: 4551532 - DNA, 22 bp, Homo sapiens
atttgcttgcaatctaatctga

SEQ ID NO: 4551533 - DNA, 23 bp, Homo sapiens
atttgcttgcaatctaatctgaa

SEQ ID NO: 4551534 - DNA, 14 bp, Homo sapiens
atttggaatacttt

SEQ ID NO: 4551535 - DNA, 21 bp, Homo sapiens
atttggagagccacatacttt

SEQ ID NO: 4551536 - DNA, 21 bp, Homo sapiens
atttggagcattaactaaatg

SEQ ID NO: 4551537 - DNA, 23 bp, Homo sapiens
atttggagcattaactaaatgct

SEQ ID NO: 4551538 - DNA, 18 bp, Homo sapiens
atttggatttaaaagcct

SEQ ID NO: 4551539 - DNA, 15 bp, Homo sapiens
atttggccacactgg

SEQ ID NO: 4551540 - DNA, 14 bp, Homo sapiens
atttgggaagtgaa

SEQ ID NO: 4551541 - DNA, 18 bp, Homo sapiens
atttgggaagtgaagact

SEQ ID NO: 4551542 - DNA, 20 bp, Homo sapiens
atttgggagaagcaaatata

SEQ ID NO: 4551543 - DNA, 17 bp, Homo sapiens
atttgggagggaaaagg

SEQ ID NO: 4551544 - DNA, 18 bp, Homo sapiens
atttgggctgaatgtatg

SEQ ID NO: 4551545 - DNA, 19 bp, Homo sapiens
atttgggctgaatgtatgt

SEQ ID NO: 4551546 - DNA, 21 bp, Homo sapiens
atttgggctgaatgtatgtaa

SEQ ID NO: 4551547 - DNA, 21 bp, Homo sapiens
atttgggcttggaccagatct

SEQ ID NO: 4551548 - DNA, 19 bp, Homo sapiens
atttggtacacatgtgtta

SEQ ID NO: 4551549 - DNA, 21 bp, Homo sapiens
atttggtagatgacaaatatt

SEQ ID NO: 4551550 - DNA, 17 bp, Homo sapiens
atttggtgctctgctaa

SEQ ID NO: 4551551 - DNA, 14 bp, Homo sapiens
atttggttaaatca

SEQ ID NO: 4551552 - DNA, 15 bp, Homo sapiens
atttggttatggtta

SEQ ID NO: 4551553 - DNA, 20 bp, Homo sapiens
atttgtaaaaataatgaatg

SEQ ID NO: 4551554 - DNA, 23 bp, Homo sapiens
atttgtaaaaatgagtcatttgt

SEQ ID NO: 4551555 - DNA, 18 bp, Homo sapiens
atttgtaagatatttgca

SEQ ID NO: 4551556 - DNA, 19 bp, Homo sapiens
atttgtaagcaacttgctt

SEQ ID NO: 4551557 - DNA, 16 bp, Homo sapiens
atttgtaaggcttgtt

SEQ ID NO: 4551558 - DNA, 16 bp, Homo sapiens
atttgtaatgagcacc

SEQ ID NO: 4551559 - DNA, 19 bp, Homo sapiens
atttgtaattaaaagcaaa

SEQ ID NO: 4551560 - DNA, 13 bp, Homo sapiens
atttgtacaattt

SEQ ID NO: 4551561 - DNA, 16 bp, Homo sapiens
atttgtacaattttaa

SEQ ID NO: 4551562 - DNA, 15 bp, Homo sapiens
atttgtagacttaag

SEQ ID NO: 4551563 - DNA, 16 bp, Homo sapiens
atttgtatatggtatt

SEQ ID NO: 4551564 - DNA, 15 bp, Homo sapiens
atttgtatcacaaat

SEQ ID NO: 4551565 - DNA, 23 bp, Homo sapiens
atttgtatccacacaaattcagt

SEQ ID NO: 4551566 - DNA, 23 bp, Homo sapiens
atttgtatgaataatgaaaataa

SEQ ID NO: 4551567 - DNA, 23 bp, Homo sapiens
atttgtattctctgcaattttac

SEQ ID NO: 4551568 - DNA, 14 bp, Homo sapiens
atttgtcaaattgt

SEQ ID NO: 4551569 - DNA, 14 bp, Homo sapiens
atttgtcaatgaca

SEQ ID NO: 4551570 - DNA, 13 bp, Homo sapiens
atttgtccaaata

SEQ ID NO: 4551571 - DNA, 15 bp, Homo sapiens
atttgtccagataat

SEQ ID NO: 4551572 - DNA, 14 bp, Homo sapiens
atttgtcccaagtg

SEQ ID NO: 4551573 - DNA, 18 bp, Homo sapiens
atttgtcccaagtgccaa

SEQ ID NO: 4551574 - DNA, 11 bp, Homo sapiens
atttgtcccag

SEQ ID NO: 4551575 - DNA, 12 bp, Homo sapiens
atttgtctctta

SEQ ID NO: 4551576 - DNA, 17 bp, Homo sapiens
atttgtctcttacatct

SEQ ID NO: 4551577 - DNA, 21 bp, Homo sapiens
atttgtctgaaacatttcata

SEQ ID NO: 4551578 - DNA, 19 bp, Homo sapiens
atttgtctgtaaaaaatgg

SEQ ID NO: 4551579 - DNA, 22 bp, Homo sapiens
atttgtctttttgttgtaaaac

SEQ ID NO: 4551580 - DNA, 23 bp, Homo sapiens
atttgtctttttgttgtaaaaca

SEQ ID NO: 4551581 - DNA, 20 bp, Homo sapiens
atttgtgctagaaattttca

SEQ ID NO: 4551582 - DNA, 22 bp, Homo sapiens
atttgtggcaattttatgtttt

SEQ ID NO: 4551583 - DNA, 19 bp, Homo sapiens
atttgtggtcacatgcttt

SEQ ID NO: 4551584 - DNA, 17 bp, Homo sapiens
atttgtgtaataaagtg

SEQ ID NO: 4551585 - DNA, 13 bp, Homo sapiens
atttgtgtctctt

SEQ ID NO: 4551586 - DNA, 22 bp, Homo sapiens
atttgtgtgtttttagctgtga

SEQ ID NO: 4551587 - DNA, 16 bp, Homo sapiens
atttgttaattaaata

SEQ ID NO: 4551588 - DNA, 19 bp, Homo sapiens
atttgttaatttagaaaac

SEQ ID NO: 4551589 - DNA, 23 bp, Homo sapiens
atttgttaatttagaaaacttta

SEQ ID NO: 4551590 - DNA, 15 bp, Homo sapiens
atttgttactttact

SEQ ID NO: 4551591 - DNA, 20 bp, Homo sapiens
atttgttaggatagatctta

SEQ ID NO: 4551592 - DNA, 14 bp, Homo sapiens
atttgttatatata

SEQ ID NO: 4551593 - DNA, 19 bp, Homo sapiens
atttgttatatataataaa

SEQ ID NO: 4551594 - DNA, 18 bp, Homo sapiens
atttgttatatcagcaga

SEQ ID NO: 4551595 - DNA, 17 bp, Homo sapiens
atttgttcttgtattta

SEQ ID NO: 4551596 - DNA, 17 bp, Homo sapiens
atttgttctttttctga

SEQ ID NO: 4551597 - DNA, 14 bp, Homo sapiens
atttgtttaaacaa

SEQ ID NO: 4551598 - DNA, 14 bp, Homo sapiens
atttgtttaatcta

SEQ ID NO: 4551599 - DNA, 16 bp, Homo sapiens
atttgtttattttttg

SEQ ID NO: 4551600 - DNA, 20 bp, Homo sapiens
atttgtttgtgtttatgaaa

SEQ ID NO: 4551601 - DNA, 21 bp, Homo sapiens
atttgtttgtgtttatgaaac

SEQ ID NO: 4551602 - DNA, 15 bp, Homo sapiens
atttgttttggatat

SEQ ID NO: 4551603 - DNA, 16 bp, Homo sapiens
atttgttttggatata

SEQ ID NO: 4551604 - DNA, 12 bp, Homo sapiens
attttaaaaaag

SEQ ID NO: 4551605 - DNA, 16 bp, Homo sapiens
attttaaaatatatga

SEQ ID NO: 4551606 - DNA, 13 bp, Homo sapiens
attttaaaatttc

SEQ ID NO: 4551607 - DNA, 14 bp, Homo sapiens
attttaaaatttca

SEQ ID NO: 4551608 - DNA, 15 bp, Homo sapiens
attttaaaatttcat

SEQ ID NO: 4551609 - DNA, 14 bp, Homo sapiens
attttaaaatttgt

SEQ ID NO: 4551610 - DNA, 17 bp, Homo sapiens
attttaaagtatgcatt

SEQ ID NO: 4551611 - DNA, 22 bp, Homo sapiens
attttaaagtatgcattattaa

SEQ ID NO: 4551612 - DNA, 12 bp, Homo sapiens
attttaaagtta

SEQ ID NO: 4551613 - DNA, 18 bp, Homo sapiens
attttaaagttagtatct

SEQ ID NO: 4551614 - DNA, 18 bp, Homo sapiens
attttaaagttcttattt

SEQ ID NO: 4551615 - DNA, 23 bp, Homo sapiens
attttaaagttcttattttagta

SEQ ID NO: 4551616 - DNA, 23 bp, Homo sapiens
attttaaattataaggactgcat

SEQ ID NO: 4551617 - DNA, 14 bp, Homo sapiens
attttaaattccac

SEQ ID NO: 4551618 - DNA, 21 bp, Homo sapiens
attttaaattccactgaaaat

SEQ ID NO: 4551619 - DNA, 13 bp, Homo sapiens
attttaaattctc

SEQ ID NO: 4551620 - DNA, 14 bp, Homo sapiens
attttaaattctca

SEQ ID NO: 4551621 - DNA, 15 bp, Homo sapiens
attttaaatttcttt

SEQ ID NO: 4551622 - DNA, 21 bp, Homo sapiens
attttaactaaattttaaagc

SEQ ID NO: 4551623 - DNA, 19 bp, Homo sapiens
attttaagaagaaagattt

SEQ ID NO: 4551624 - DNA, 19 bp, Homo sapiens
attttaagatccagaaata

SEQ ID NO: 4551625 - DNA, 16 bp, Homo sapiens
attttaaggatatgat

SEQ ID NO: 4551626 - DNA, 21 bp, Homo sapiens
attttaagggtaatattttct

SEQ ID NO: 4551627 - DNA, 18 bp, Homo sapiens
attttaagtaacgtgctc

SEQ ID NO: 4551628 - DNA, 15 bp, Homo sapiens
attttaatatataat

SEQ ID NO: 4551629 - DNA, 17 bp, Homo sapiens
attttaatattaattcc

SEQ ID NO: 4551630 - DNA, 16 bp, Homo sapiens
attttaatcattattt

SEQ ID NO: 4551631 - DNA, 23 bp, Homo sapiens
attttaatgaagaaagtggaaaa

SEQ ID NO: 4551632 - DNA, 20 bp, Homo sapiens
attttaatggattgttaatt

SEQ ID NO: 4551633 - DNA, 22 bp, Homo sapiens
attttaatgtaaagatttgctt

SEQ ID NO: 4551634 - DNA, 17 bp, Homo sapiens
attttaatgtacttgaa

SEQ ID NO: 4551635 - DNA, 19 bp, Homo sapiens
attttaatgtacttgaaaa

SEQ ID NO: 4551636 - DNA, 19 bp, Homo sapiens
attttaatttagtaaatgt

SEQ ID NO: 4551637 - DNA, 20 bp, Homo sapiens
attttaatttagtaaatgtt

SEQ ID NO: 4551638 - DNA, 21 bp, Homo sapiens
attttaatttagtaaatgtta

SEQ ID NO: 4551639 - DNA, 14 bp, Homo sapiens
attttaatttcagg

SEQ ID NO: 4551640 - DNA, 18 bp, Homo sapiens
attttaatttcaggaaaa

SEQ ID NO: 4551641 - DNA, 15 bp, Homo sapiens
attttacagatttct

SEQ ID NO: 4551642 - DNA, 18 bp, Homo sapiens
attttacagctcattaaa

SEQ ID NO: 4551643 - DNA, 17 bp, Homo sapiens
attttacagtaaatgtt

SEQ ID NO: 4551644 - DNA, 12 bp, Homo sapiens
attttaccaaag

SEQ ID NO: 4551645 - DNA, 14 bp, Homo sapiens
attttaccaaagca

SEQ ID NO: 4551646 - DNA, 15 bp, Homo sapiens
attttaccaaagcat

SEQ ID NO: 4551647 - DNA, 21 bp, Homo sapiens
attttaccatcacacatgttc

SEQ ID NO: 4551648 - DNA, 14 bp, Homo sapiens
attttaccttgttt

SEQ ID NO: 4551649 - DNA, 22 bp, Homo sapiens
attttacgttttagaaaatttt

SEQ ID NO: 4551650 - DNA, 15 bp, Homo sapiens
attttactgtgaaaa

SEQ ID NO: 4551651 - DNA, 19 bp, Homo sapiens
attttacttttctgccaaa

SEQ ID NO: 4551652 - DNA, 16 bp, Homo sapiens
attttagaataaattc

SEQ ID NO: 4551653 - DNA, 16 bp, Homo sapiens
attttagaattaaaat

SEQ ID NO: 4551654 - DNA, 13 bp, Homo sapiens
attttagcagaga

SEQ ID NO: 4551655 - DNA, 21 bp, Homo sapiens
attttagcagttctgcaaata

SEQ ID NO: 4551656 - DNA, 15 bp, Homo sapiens
attttagctgcagaa

SEQ ID NO: 4551657 - DNA, 15 bp, Homo sapiens
attttaggaaaggat

SEQ ID NO: 4551658 - DNA, 22 bp, Homo sapiens
attttagggtgggtaagaaagc

SEQ ID NO: 4551659 - DNA, 13 bp, Homo sapiens
attttagtgtatt

SEQ ID NO: 4551660 - DNA, 15 bp, Homo sapiens
attttagtgtgtaaa

SEQ ID NO: 4551661 - DNA, 18 bp, Homo sapiens
attttagtgtgtaaaatt

SEQ ID NO: 4551662 - DNA, 22 bp, Homo sapiens
attttagtgtgtaaaattaatg

SEQ ID NO: 4551663 - DNA, 19 bp, Homo sapiens
attttagtttttcattaaa

SEQ ID NO: 4551664 - DNA, 20 bp, Homo sapiens
attttagtttttcattaaat

SEQ ID NO: 4551665 - DNA, 14 bp, Homo sapiens
attttataaaacat

SEQ ID NO: 4551666 - DNA, 20 bp, Homo sapiens
attttataggggatacttga

SEQ ID NO: 4551667 - DNA, 15 bp, Homo sapiens
attttatataaagta

SEQ ID NO: 4551668 - DNA, 16 bp, Homo sapiens
attttatataaagtat

SEQ ID NO: 4551669 - DNA, 19 bp, Homo sapiens
attttatatcatacagttt

SEQ ID NO: 4551670 - DNA, 16 bp, Homo sapiens
attttatatgcttact

SEQ ID NO: 4551671 - DNA, 20 bp, Homo sapiens
attttatctttgattctcct

SEQ ID NO: 4551672 - DNA, 23 bp, Homo sapiens
attttatctttgattctccttca

SEQ ID NO: 4551673 - DNA, 19 bp, Homo sapiens
attttatgaacattgtact

SEQ ID NO: 4551674 - DNA, 21 bp, Homo sapiens
attttatgaacattgtactgt

SEQ ID NO: 4551675 - DNA, 19 bp, Homo sapiens
attttatgagagtttggaa

SEQ ID NO: 4551676 - DNA, 12 bp, Homo sapiens
attttatgagtt

SEQ ID NO: 4551677 - DNA, 13 bp, Homo sapiens
attttatgtcttt

SEQ ID NO: 4551678 - DNA, 13 bp, Homo sapiens
attttattaataa

SEQ ID NO: 4551679 - DNA, 19 bp, Homo sapiens
attttattctatgtatgtt

SEQ ID NO: 4551680 - DNA, 17 bp, Homo sapiens
attttattgaatactgt

SEQ ID NO: 4551681 - DNA, 18 bp, Homo sapiens
attttattgatgcagtgt

SEQ ID NO: 4551682 - DNA, 17 bp, Homo sapiens
attttatttaattttca

SEQ ID NO: 4551683 - DNA, 22 bp, Homo sapiens
attttatttacccctcccctat

SEQ ID NO: 4551684 - DNA, 19 bp, Homo sapiens
attttatttcaatgtaatt

SEQ ID NO: 4551685 - DNA, 22 bp, Homo sapiens
attttatttgttctttttctga

SEQ ID NO: 4551686 - DNA, 15 bp, Homo sapiens
attttattttaaatt

SEQ ID NO: 4551687 - DNA, 15 bp, Homo sapiens
attttattttattga

SEQ ID NO: 4551688 - DNA, 16 bp, Homo sapiens
attttattttattgaa

SEQ ID NO: 4551689 - DNA, 21 bp, Homo sapiens
attttattttgacagaagcta

SEQ ID NO: 4551690 - DNA, 12 bp, Homo sapiens
attttattttgt

SEQ ID NO: 4551691 - DNA, 13 bp, Homo sapiens
attttcaaaagat

SEQ ID NO: 4551692 - DNA, 24 bp, Homo sapiens
attttcaaaagataatattttaca

SEQ ID NO: 4551693 - DNA, 16 bp, Homo sapiens
attttcaaatgtaaac

SEQ ID NO: 4551694 - DNA, 20 bp, Homo sapiens
attttcaactgtcttcctca

SEQ ID NO: 4551695 - DNA, 24 bp, Homo sapiens
attttcaagaataatcacgctttc

SEQ ID NO: 4551696 - DNA, 12 bp, Homo sapiens
attttcaagtaa

SEQ ID NO: 4551697 - DNA, 14 bp, Homo sapiens
attttcaagttttt

SEQ ID NO: 4551698 - DNA, 17 bp, Homo sapiens
attttcaagtttttcat

SEQ ID NO: 4551699 - DNA, 22 bp, Homo sapiens
attttcaagtttttcatactgt

SEQ ID NO: 4551700 - DNA, 23 bp, Homo sapiens
attttcaataacaaaacgaaact

SEQ ID NO: 4551701 - DNA, 15 bp, Homo sapiens
attttcacacattca

SEQ ID NO: 4551702 - DNA, 14 bp, Homo sapiens
attttcaccgagca

SEQ ID NO: 4551703 - DNA, 14 bp, Homo sapiens
attttcagaatctg

SEQ ID NO: 4551704 - DNA, 16 bp, Homo sapiens
attttcagacacattt

SEQ ID NO: 4551705 - DNA, 19 bp, Homo sapiens
attttcagcaaactctttt

SEQ ID NO: 4551706 - DNA, 19 bp, Homo sapiens
attttcagcattaagctgt

SEQ ID NO: 4551707 - DNA, 20 bp, Homo sapiens
attttcagcattaagctgtt

SEQ ID NO: 4551708 - DNA, 15 bp, Homo sapiens
attttcagtgatctt

SEQ ID NO: 4551709 - DNA, 13 bp, Homo sapiens
attttcatagtga

SEQ ID NO: 4551710 - DNA, 20 bp, Homo sapiens
attttcatgtggtactactg

SEQ ID NO: 4551711 - DNA, 20 bp, Homo sapiens
attttcattctgccaaagta

SEQ ID NO: 4551712 - DNA, 13 bp, Homo sapiens
attttcattgtga

SEQ ID NO: 4551713 - DNA, 16 bp, Homo sapiens
attttcattgtgattt

SEQ ID NO: 4551714 - DNA, 21 bp, Homo sapiens
attttccacaagattcccaga

SEQ ID NO: 4551715 - DNA, 23 bp, Homo sapiens
attttccacaagattcccagaga

SEQ ID NO: 4551716 - DNA, 17 bp, Homo sapiens
attttccagccttatgt

SEQ ID NO: 4551717 - DNA, 20 bp, Homo sapiens
attttcccaatagcactttc

SEQ ID NO: 4551718 - DNA, 21 bp, Homo sapiens
attttccccccactctcccca

SEQ ID NO: 4551719 - DNA, 23 bp, Homo sapiens
attttccccgtgacattcactgg

SEQ ID NO: 4551720 - DNA, 21 bp, Homo sapiens
attttccgcccactcctggga

SEQ ID NO: 4551721 - DNA, 22 bp, Homo sapiens
attttcctaatgtgatcatatg

SEQ ID NO: 4551722 - DNA, 16 bp, Homo sapiens
attttcctacaggcag

SEQ ID NO: 4551723 - DNA, 15 bp, Homo sapiens
attttcctcctctgc

SEQ ID NO: 4551724 - DNA, 18 bp, Homo sapiens
attttcctcctctgccta

SEQ ID NO: 4551725 - DNA, 12 bp, Homo sapiens
attttcctctgg

SEQ ID NO: 4551726 - DNA, 13 bp, Homo sapiens
attttcctctggc

SEQ ID NO: 4551727 - DNA, 15 bp, Homo sapiens
attttcctctggccg

SEQ ID NO: 4551728 - DNA, 18 bp, Homo sapiens
attttcgatgaagttctg

SEQ ID NO: 4551729 - DNA, 21 bp, Homo sapiens
attttctaaaagctttcatgt

SEQ ID NO: 4551730 - DNA, 14 bp, Homo sapiens
attttctacagtgg

SEQ ID NO: 4551731 - DNA, 14 bp, Homo sapiens
attttctagataca

SEQ ID NO: 4551732 - DNA, 16 bp, Homo sapiens
attttctagatacaat

SEQ ID NO: 4551733 - DNA, 18 bp, Homo sapiens
attttctagatacaataa

SEQ ID NO: 4551734 - DNA, 17 bp, Homo sapiens
attttctctgtactttt

SEQ ID NO: 4551735 - DNA, 13 bp, Homo sapiens
attttctgcaatc

SEQ ID NO: 4551736 - DNA, 17 bp, Homo sapiens
attttctgtaatctttt

SEQ ID NO: 4551737 - DNA, 14 bp, Homo sapiens
attttctgtattta

SEQ ID NO: 4551738 - DNA, 16 bp, Homo sapiens
attttctgtatttaat

SEQ ID NO: 4551739 - DNA, 22 bp, Homo sapiens
attttctgtatttaattataaa

SEQ ID NO: 4551740 - DNA, 23 bp, Homo sapiens
attttctgtatttaattataaaa

SEQ ID NO: 4551741 - DNA, 20 bp, Homo sapiens
attttcttctaagtgaaatt

SEQ ID NO: 4551742 - DNA, 18 bp, Homo sapiens
attttctttatcattgct

SEQ ID NO: 4551743 - DNA, 12 bp, Homo sapiens
attttctttcta

SEQ ID NO: 4551744 - DNA, 21 bp, Homo sapiens
attttgaaaatatgtactgta

SEQ ID NO: 4551745 - DNA, 13 bp, Homo sapiens
attttgaagtgct

SEQ ID NO: 4551746 - DNA, 12 bp, Homo sapiens
attttgaatcaa

SEQ ID NO: 4551747 - DNA, 14 bp, Homo sapiens
attttgaatcaata

SEQ ID NO: 4551748 - DNA, 22 bp, Homo sapiens
attttgaatctgtgtgcatatt

SEQ ID NO: 4551749 - DNA, 12 bp, Homo sapiens
attttgaatgta

SEQ ID NO: 4551750 - DNA, 17 bp, Homo sapiens
attttgacataaagttg

SEQ ID NO: 4551751 - DNA, 14 bp, Homo sapiens
attttgagaaactg

SEQ ID NO: 4551752 - DNA, 21 bp, Homo sapiens
attttgagaaactgctgcaga

SEQ ID NO: 4551753 - DNA, 23 bp, Homo sapiens
attttgagaaactgctgcagatt

SEQ ID NO: 4551754 - DNA, 18 bp, Homo sapiens
attttgaggtaaagatat

SEQ ID NO: 4551755 - DNA, 19 bp, Homo sapiens
attttgagtcctaggactt

SEQ ID NO: 4551756 - DNA, 21 bp, Homo sapiens
attttgagtcctaggacttaa

SEQ ID NO: 4551757 - DNA, 18 bp, Homo sapiens
attttgatataattgtac

SEQ ID NO: 4551758 - DNA, 18 bp, Homo sapiens
attttgcaaggtgcattt

SEQ ID NO: 4551759 - DNA, 10 bp, Homo sapiens
attttgcaca

SEQ ID NO: 4551760 - DNA, 12 bp, Homo sapiens
attttgcacaaa

SEQ ID NO: 4551761 - DNA, 19 bp, Homo sapiens
attttgctatcaacaataa

SEQ ID NO: 4551762 - DNA, 15 bp, Homo sapiens
attttgctgatgggt

SEQ ID NO: 4551763 - DNA, 19 bp, Homo sapiens
attttggaactgtgtttca

SEQ ID NO: 4551764 - DNA, 21 bp, Homo sapiens
attttggaactgtgtttcaaa

SEQ ID NO: 4551765 - DNA, 11 bp, Homo sapiens
attttggaatt

SEQ ID NO: 4551766 - DNA, 14 bp, Homo sapiens
attttggaggtgct

SEQ ID NO: 4551767 - DNA, 15 bp, Homo sapiens
attttggatgtcatt

SEQ ID NO: 4551768 - DNA, 20 bp, Homo sapiens
attttggatttttacacaac

SEQ ID NO: 4551769 - DNA, 21 bp, Homo sapiens
attttggcgaatctcaaaatt

SEQ ID NO: 4551770 - DNA, 16 bp, Homo sapiens
attttggttttgttcc

SEQ ID NO: 4551771 - DNA, 21 bp, Homo sapiens
attttggttttgttcccctcc

SEQ ID NO: 4551772 - DNA, 12 bp, Homo sapiens
attttgtaaaat

SEQ ID NO: 4551773 - DNA, 17 bp, Homo sapiens
attttgtaaaatgtatt

SEQ ID NO: 4551774 - DNA, 18 bp, Homo sapiens
attttgtaaaatgtatta

SEQ ID NO: 4551775 - DNA, 19 bp, Homo sapiens
attttgtaaaatgtattat

SEQ ID NO: 4551776 - DNA, 12 bp, Homo sapiens
attttgtaagaa

SEQ ID NO: 4551777 - DNA, 17 bp, Homo sapiens
attttgtaagaaggcaa

SEQ ID NO: 4551778 - DNA, 12 bp, Homo sapiens
attttgtaagtt

SEQ ID NO: 4551779 - DNA, 16 bp, Homo sapiens
attttgtaatgaattc

SEQ ID NO: 4551780 - DNA, 14 bp, Homo sapiens
attttgtactttgt

SEQ ID NO: 4551781 - DNA, 21 bp, Homo sapiens
attttgtatgaaatatatgtg

SEQ ID NO: 4551782 - DNA, 12 bp, Homo sapiens
attttgtatgga

SEQ ID NO: 4551783 - DNA, 13 bp, Homo sapiens
attttgtatggag

SEQ ID NO: 4551784 - DNA, 19 bp, Homo sapiens
attttgtattgtttcaatt

SEQ ID NO: 4551785 - DNA, 17 bp, Homo sapiens
attttgtgacattcctt

SEQ ID NO: 4551786 - DNA, 17 bp, Homo sapiens
attttgtggttaagaga

SEQ ID NO: 4551787 - DNA, 19 bp, Homo sapiens
attttgtggttaagagaat

SEQ ID NO: 4551788 - DNA, 14 bp, Homo sapiens
attttgttaacttt

SEQ ID NO: 4551789 - DNA, 17 bp, Homo sapiens
attttgttaacttttgt

SEQ ID NO: 4551790 - DNA, 22 bp, Homo sapiens
attttgttacataaggatgact

SEQ ID NO: 4551791 - DNA, 11 bp, Homo sapiens
attttgtttac

SEQ ID NO: 4551792 - DNA, 16 bp, Homo sapiens
attttgttttttaagt

SEQ ID NO: 4551793 - DNA, 13 bp, Homo sapiens
atttttaaacaag

SEQ ID NO: 4551794 - DNA, 14 bp, Homo sapiens
atttttaaacaagt

SEQ ID NO: 4551795 - DNA, 21 bp, Homo sapiens
atttttaaacttgaaatatat

SEQ ID NO: 4551796 - DNA, 12 bp, Homo sapiens
atttttaagctg

SEQ ID NO: 4551797 - DNA, 11 bp, Homo sapiens
atttttaatgc

SEQ ID NO: 4551798 - DNA, 16 bp, Homo sapiens
atttttaatggcagca

SEQ ID NO: 4551799 - DNA, 13 bp, Homo sapiens
atttttaatgtat

SEQ ID NO: 4551800 - DNA, 19 bp, Homo sapiens
atttttaatgtatctattt

SEQ ID NO: 4551801 - DNA, 21 bp, Homo sapiens
atttttaatgtatctatttgt

SEQ ID NO: 4551802 - DNA, 17 bp, Homo sapiens
atttttacactattgtg

SEQ ID NO: 4551803 - DNA, 14 bp, Homo sapiens
atttttacatttaa

SEQ ID NO: 4551804 - DNA, 21 bp, Homo sapiens
atttttacatttaaacctttt

SEQ ID NO: 4551805 - DNA, 15 bp, Homo sapiens
atttttacctgcttt

SEQ ID NO: 4551806 - DNA, 21 bp, Homo sapiens
atttttagatagttagaacct

SEQ ID NO: 4551807 - DNA, 20 bp, Homo sapiens
atttttagatggttacactg

SEQ ID NO: 4551808 - DNA, 13 bp, Homo sapiens
atttttagtagag

SEQ ID NO: 4551809 - DNA, 18 bp, Homo sapiens
atttttataacatcttta

SEQ ID NO: 4551810 - DNA, 23 bp, Homo sapiens
atttttatacaagtaatttcctg

SEQ ID NO: 4551811 - DNA, 17 bp, Homo sapiens
atttttatatcatgcaa

SEQ ID NO: 4551812 - DNA, 22 bp, Homo sapiens
atttttatatcatgcaaaatat

SEQ ID NO: 4551813 - DNA, 19 bp, Homo sapiens
atttttatattagttgctt

SEQ ID NO: 4551814 - DNA, 16 bp, Homo sapiens
atttttatatttcctt

SEQ ID NO: 4551815 - DNA, 23 bp, Homo sapiens
atttttatgttttgaaagacaga

SEQ ID NO: 4551816 - DNA, 17 bp, Homo sapiens
atttttattaattttag

SEQ ID NO: 4551817 - DNA, 13 bp, Homo sapiens
atttttatttatg

SEQ ID NO: 4551818 - DNA, 17 bp, Homo sapiens
atttttatttcagattt

SEQ ID NO: 4551819 - DNA, 17 bp, Homo sapiens
atttttatttcttccta

SEQ ID NO: 4551820 - DNA, 19 bp, Homo sapiens
atttttcaatagcgtgtgt

SEQ ID NO: 4551821 - DNA, 22 bp, Homo sapiens
atttttcaatatattgaacttt

SEQ ID NO: 4551822 - DNA, 13 bp, Homo sapiens
atttttcagaaat

SEQ ID NO: 4551823 - DNA, 12 bp, Homo sapiens
atttttcagcag

SEQ ID NO: 4551824 - DNA, 23 bp, Homo sapiens
atttttcctatgctattgacaat

SEQ ID NO: 4551825 - DNA, 15 bp, Homo sapiens
atttttcctgtcctg

SEQ ID NO: 4551826 - DNA, 16 bp, Homo sapiens
atttttcctgtcctgc

SEQ ID NO: 4551827 - DNA, 16 bp, Homo sapiens
atttttctcccaagaa

SEQ ID NO: 4551828 - DNA, 19 bp, Homo sapiens
atttttctgaggtccttat

SEQ ID NO: 4551829 - DNA, 19 bp, Homo sapiens
atttttcttatttcatttc

SEQ ID NO: 4551830 - DNA, 21 bp, Homo sapiens
atttttcttcaggtaacacta

SEQ ID NO: 4551831 - DNA, 13 bp, Homo sapiens
atttttgaagact

SEQ ID NO: 4551832 - DNA, 12 bp, Homo sapiens
atttttgacaga

SEQ ID NO: 4551833 - DNA, 17 bp, Homo sapiens
atttttgatgtatatat

SEQ ID NO: 4551834 - DNA, 17 bp, Homo sapiens
atttttgcaataatgca

SEQ ID NO: 4551835 - DNA, 20 bp, Homo sapiens
atttttgcaataatgcagta

SEQ ID NO: 4551836 - DNA, 12 bp, Homo sapiens
atttttgcctct

SEQ ID NO: 4551837 - DNA, 21 bp, Homo sapiens
atttttgcctcttccagtctt

SEQ ID NO: 4551838 - DNA, 20 bp, Homo sapiens
atttttgctccaatatccat

SEQ ID NO: 4551839 - DNA, 18 bp, Homo sapiens
atttttggatttctgtga

SEQ ID NO: 4551840 - DNA, 19 bp, Homo sapiens
atttttggtgggaatccaa

SEQ ID NO: 4551841 - DNA, 19 bp, Homo sapiens
atttttgtaaactggaatt

SEQ ID NO: 4551842 - DNA, 13 bp, Homo sapiens
atttttgtatttt

SEQ ID NO: 4551843 - DNA, 16 bp, Homo sapiens
atttttgttactctct

SEQ ID NO: 4551844 - DNA, 15 bp, Homo sapiens
atttttgttttgaaa

SEQ ID NO: 4551845 - DNA, 17 bp, Homo sapiens
atttttgttttgaaagt

SEQ ID NO: 4551846 - DNA, 17 bp, Homo sapiens
attttttaaaaaagctt

SEQ ID NO: 4551847 - DNA, 20 bp, Homo sapiens
attttttaaaaaagcttaaa

SEQ ID NO: 4551848 - DNA, 18 bp, Homo sapiens
attttttaaaaagtgttt

SEQ ID NO: 4551849 - DNA, 17 bp, Homo sapiens
attttttaaaagccttc

SEQ ID NO: 4551850 - DNA, 17 bp, Homo sapiens
attttttatgtacaacc

SEQ ID NO: 4551851 - DNA, 20 bp, Homo sapiens
attttttatgtacaaccctg

SEQ ID NO: 4551852 - DNA, 20 bp, Homo sapiens
attttttcagacttgtcaag

SEQ ID NO: 4551853 - DNA, 23 bp, Homo sapiens
attttttccaaaatctcccattt

SEQ ID NO: 4551854 - DNA, 20 bp, Homo sapiens
attttttccttcaaagttta

SEQ ID NO: 4551855 - DNA, 21 bp, Homo sapiens
attttttccttcaaagtttaa

SEQ ID NO: 4551856 - DNA, 12 bp, Homo sapiens
attttttcttct

SEQ ID NO: 4551857 - DNA, 17 bp, Homo sapiens
attttttggtacaaaaa

SEQ ID NO: 4551858 - DNA, 15 bp, Homo sapiens
attttttgtataatt

SEQ ID NO: 4551859 - DNA, 18 bp, Homo sapiens
attttttgttaaatgatt

SEQ ID NO: 4551860 - DNA, 14 bp, Homo sapiens
atttttttaaatca

SEQ ID NO: 4551861 - DNA, 16 bp, Homo sapiens
atttttttaatttctg

SEQ ID NO: 4551862 - DNA, 15 bp, Homo sapiens
atttttttagattga

SEQ ID NO: 4551863 - DNA, 16 bp, Homo sapiens
atttttttagtttgtt

SEQ ID NO: 4551864 - DNA, 19 bp, Homo sapiens
atttttttcccaattgaga

SEQ ID NO: 4551865 - DNA, 19 bp, Homo sapiens
atttttttcctaagacatt

SEQ ID NO: 4551866 - DNA, 21 bp, Homo sapiens
atttttttcctaagacatttt

SEQ ID NO: 4551867 - DNA, 15 bp, Homo sapiens
atttttttctaccta

SEQ ID NO: 4551868 - DNA, 19 bp, Homo sapiens
atttttttgtaataagcaa

SEQ ID NO: 4551869 - DNA, 19 bp, Homo sapiens
attttttttaaaatagaaa

SEQ ID NO: 4551870 - DNA, 14 bp, Homo sapiens
attttttttacatt

SEQ ID NO: 4551871 - DNA, 16 bp, Homo sapiens
attttttttatattta

SEQ ID NO: 4551872 - DNA, 14 bp, Homo sapiens
attttttttccgtg

SEQ ID NO: 4551873 - DNA, 16 bp, Homo sapiens
attttttttgtaactt

SEQ ID NO: 4551874 - DNA, 20 bp, Homo sapiens
atttttttttcatacactta

SEQ ID NO: 4551875 - DNA, 18 bp, Homo sapiens
attttttttttttaggaa

SEQ ID NO: 4551876 - DNA, 21 bp, Homo sapiens
attttttttttttgaaaaaag

SEQ ID NO: 4551877 - DNA, 21 bp, Homo sapiens
caaaaaaattaaaatggatgc

SEQ ID NO: 4551878 - DNA, 14 bp, Homo sapiens
caaaaaagaaaacc

SEQ ID NO: 4551879 - DNA, 12 bp, Homo sapiens
caaaaaatacat

SEQ ID NO: 4551880 - DNA, 19 bp, Homo sapiens
caaaaaatactttttctaa

SEQ ID NO: 4551881 - DNA, 15 bp, Homo sapiens
caaaaaatgttttaa

SEQ ID NO: 4551882 - DNA, 16 bp, Homo sapiens
caaaaaatgttttaaa

SEQ ID NO: 4551883 - DNA, 14 bp, Homo sapiens
caaaaacaaaatta

SEQ ID NO: 4551884 - DNA, 13 bp, Homo sapiens
caaaaacacagca

SEQ ID NO: 4551885 - DNA, 14 bp, Homo sapiens
caaaaacacagcaa

SEQ ID NO: 4551886 - DNA, 15 bp, Homo sapiens
caaaaacacagcaag

SEQ ID NO: 4551887 - DNA, 18 bp, Homo sapiens
caaaaacatacttcaaaa

SEQ ID NO: 4551888 - DNA, 22 bp, Homo sapiens
caaaaacatttgattaataaaa

SEQ ID NO: 4551889 - DNA, 23 bp, Homo sapiens
caaaaacatttgattaataaaat

SEQ ID NO: 4551890 - DNA, 15 bp, Homo sapiens
caaaaaccatgttgc

SEQ ID NO: 4551891 - DNA, 16 bp, Homo sapiens
caaaaagcagaaggag

SEQ ID NO: 4551892 - DNA, 15 bp, Homo sapiens
caaaaagctctgaaa

SEQ ID NO: 4551893 - DNA, 21 bp, Homo sapiens
caaaaaggagccttttgctct

SEQ ID NO: 4551894 - DNA, 17 bp, Homo sapiens
caaaaaggatacataat

SEQ ID NO: 4551895 - DNA, 17 bp, Homo sapiens
caaaaaggcaaatattg

SEQ ID NO: 4551896 - DNA, 18 bp, Homo sapiens
caaaaaggcaaatattga

SEQ ID NO: 4551897 - DNA, 19 bp, Homo sapiens
caaaaaggcaaatattgaa

SEQ ID NO: 4551898 - DNA, 15 bp, Homo sapiens
caaaaagtgcttcat

SEQ ID NO: 4551899 - DNA, 10 bp, Homo sapiens
caaaaataaa

SEQ ID NO: 4551900 - DNA, 14 bp, Homo sapiens
caaaaataaattta

SEQ ID NO: 4551901 - DNA, 13 bp, Homo sapiens
caaaaatagaaat

SEQ ID NO: 4551902 - DNA, 18 bp, Homo sapiens
caaaaatagaaattagat

SEQ ID NO: 4551903 - DNA, 14 bp, Homo sapiens
caaaaatagctaaa

SEQ ID NO: 4551904 - DNA, 20 bp, Homo sapiens
caaaaatcccaccttcccac

SEQ ID NO: 4551905 - DNA, 22 bp, Homo sapiens
caaaaatgtatgccacatctca

SEQ ID NO: 4551906 - DNA, 17 bp, Homo sapiens
caaaaatgtttccactg

SEQ ID NO: 4551907 - DNA, 21 bp, Homo sapiens
caaaaatttctgtaaaacagg

SEQ ID NO: 4551908 - DNA, 17 bp, Homo sapiens
caaaaattttgtgacat

SEQ ID NO: 4551909 - DNA, 16 bp, Homo sapiens
caaaacaaaaagatgt

SEQ ID NO: 4551910 - DNA, 11 bp, Homo sapiens
caaaacaaaac

SEQ ID NO: 4551911 - DNA, 16 bp, Homo sapiens
caaaacaaaacaaaac

SEQ ID NO: 4551912 - DNA, 15 bp, Homo sapiens
caaaacaagccaaag

SEQ ID NO: 4551913 - DNA, 14 bp, Homo sapiens
caaaacaatgttta

SEQ ID NO: 4551914 - DNA, 12 bp, Homo sapiens
caaaacatttct

SEQ ID NO: 4551915 - DNA, 14 bp, Homo sapiens
caaaacatttctaa

SEQ ID NO: 4551916 - DNA, 15 bp, Homo sapiens
caaaaccaaacccag

SEQ ID NO: 4551917 - DNA, 14 bp, Homo sapiens
caaaaccaaactgg

SEQ ID NO: 4551918 - DNA, 17 bp, Homo sapiens
caaaaccaaactgggtc

SEQ ID NO: 4551919 - DNA, 18 bp, Homo sapiens
caaaacctgattggccac

SEQ ID NO: 4551920 - DNA, 14 bp, Homo sapiens
caaaacctggagat

SEQ ID NO: 4551921 - DNA, 15 bp, Homo sapiens
caaaacgatgaagtt

SEQ ID NO: 4551922 - DNA, 19 bp, Homo sapiens
caaaactactgacagggag

SEQ ID NO: 4551923 - DNA, 17 bp, Homo sapiens
caaaactacttttctaa

SEQ ID NO: 4551924 - DNA, 19 bp, Homo sapiens
caaaactacttttctaaaa

SEQ ID NO: 4551925 - DNA, 17 bp, Homo sapiens
caaaactatacttgaac

SEQ ID NO: 4551926 - DNA, 17 bp, Homo sapiens
caaaagaaaattgatat

SEQ ID NO: 4551927 - DNA, 17 bp, Homo sapiens
caaaagagcatggatgc

SEQ ID NO: 4551928 - DNA, 22 bp, Homo sapiens
caaaagagcatggatgcatttc

SEQ ID NO: 4551929 - DNA, 23 bp, Homo sapiens
caaaagagcatggatgcatttca

SEQ ID NO: 4551930 - DNA, 20 bp, Homo sapiens
caaaagataatattttacat

SEQ ID NO: 4551931 - DNA, 19 bp, Homo sapiens
caaaagatccttcatttta

SEQ ID NO: 4551932 - DNA, 20 bp, Homo sapiens
caaaagattgctgaaatttt

SEQ ID NO: 4551933 - DNA, 21 bp, Homo sapiens
caaaagcaaaccctacattaa

SEQ ID NO: 4551934 - DNA, 20 bp, Homo sapiens
caaaagcccgcttgctcgct

SEQ ID NO: 4551935 - DNA, 17 bp, Homo sapiens
caaaaggaaaaagctcc

SEQ ID NO: 4551936 - DNA, 11 bp, Homo sapiens
caaaaggaaag

SEQ ID NO: 4551937 - DNA, 16 bp, Homo sapiens
caaaaggaaagctgtg

SEQ ID NO: 4551938 - DNA, 15 bp, Homo sapiens
caaaaggaggtgaaa

SEQ ID NO: 4551939 - DNA, 15 bp, Homo sapiens
caaaaggcagaagca

SEQ ID NO: 4551940 - DNA, 16 bp, Homo sapiens
caaaaggcctcttgta

SEQ ID NO: 4551941 - DNA, 23 bp, Homo sapiens
caaaaggcctcttgtaaagactg

SEQ ID NO: 4551942 - DNA, 15 bp, Homo sapiens
caaaaggctgagaag

SEQ ID NO: 4551943 - DNA, 18 bp, Homo sapiens
caaaaggctgagaaggaa

SEQ ID NO: 4551944 - DNA, 11 bp, Homo sapiens
caaaagggtca

SEQ ID NO: 4551945 - DNA, 19 bp, Homo sapiens
caaaagggtgtatagtgtt

SEQ ID NO: 4551946 - DNA, 16 bp, Homo sapiens
caaaaggtaaatacaa

SEQ ID NO: 4551947 - DNA, 18 bp, Homo sapiens
caaaaggtgcctgtgagg

SEQ ID NO: 4551948 - DNA, 23 bp, Homo sapiens
caaaaggtgcctgtgaggcaggg

SEQ ID NO: 4551949 - DNA, 15 bp, Homo sapiens
caaaagtaatcactt

SEQ ID NO: 4551950 - DNA, 19 bp, Homo sapiens
caaaagtaatcacttaaag

SEQ ID NO: 4551951 - DNA, 19 bp, Homo sapiens
caaaagtcaaaaggtgcct

SEQ ID NO: 4551952 - DNA, 21 bp, Homo sapiens
caaaagtccctccctgcctga

SEQ ID NO: 4551953 - DNA, 22 bp, Homo sapiens
caaaagtccctccctgcctgag

SEQ ID NO: 4551954 - DNA, 12 bp, Homo sapiens
caaaataaaaac

SEQ ID NO: 4551955 - DNA, 19 bp, Homo sapiens
caaaataaagattctcaca

SEQ ID NO: 4551956 - DNA, 14 bp, Homo sapiens
caaaataataaaaa

SEQ ID NO: 4551957 - DNA, 21 bp, Homo sapiens
caaaataatctatattaaatg

SEQ ID NO: 4551958 - DNA, 22 bp, Homo sapiens
caaaatacacattcttgcttgt

SEQ ID NO: 4551959 - DNA, 19 bp, Homo sapiens
caaaatacacgtttatctt

SEQ ID NO: 4551960 - DNA, 20 bp, Homo sapiens
caaaatacacgtttatctta

SEQ ID NO: 4551961 - DNA, 16 bp, Homo sapiens
caaaataccagagcct

SEQ ID NO: 4551962 - DNA, 12 bp, Homo sapiens
caaaatagaaaa

SEQ ID NO: 4551963 - DNA, 17 bp, Homo sapiens
caaaatagaaaagttat

SEQ ID NO: 4551964 - DNA, 18 bp, Homo sapiens
caaaatatacaaaacttt

SEQ ID NO: 4551965 - DNA, 22 bp, Homo sapiens
caaaatatattttgtttacaaa

SEQ ID NO: 4551966 - DNA, 13 bp, Homo sapiens
caaaatattaaca

SEQ ID NO: 4551967 - DNA, 18 bp, Homo sapiens
caaaatattgagcagaat

SEQ ID NO: 4551968 - DNA, 12 bp, Homo sapiens
caaaatatttaa

SEQ ID NO: 4551969 - DNA, 19 bp, Homo sapiens
caaaatatttaagtgaagg

SEQ ID NO: 4551970 - DNA, 22 bp, Homo sapiens
caaaatccaaaaagctctgaaa

SEQ ID NO: 4551971 - DNA, 15 bp, Homo sapiens
caaaatcctcaggaa

SEQ ID NO: 4551972 - DNA, 17 bp, Homo sapiens
caaaatcctcaggaaat

SEQ ID NO: 4551973 - DNA, 17 bp, Homo sapiens
caaaatctaaaatgttt

SEQ ID NO: 4551974 - DNA, 19 bp, Homo sapiens
caaaatctcccattttgga

SEQ ID NO: 4551975 - DNA, 15 bp, Homo sapiens
caaaatgaattttta

SEQ ID NO: 4551976 - DNA, 18 bp, Homo sapiens
caaaatgacatcttttta

SEQ ID NO: 4551977 - DNA, 22 bp, Homo sapiens
caaaatgacatctttttaaagc

SEQ ID NO: 4551978 - DNA, 22 bp, Homo sapiens
caaaatgatagacatataccaa

SEQ ID NO: 4551979 - DNA, 21 bp, Homo sapiens
caaaatggcttgtctttgcta

SEQ ID NO: 4551980 - DNA, 19 bp, Homo sapiens
caaaatggttatctttgag

SEQ ID NO: 4551981 - DNA, 14 bp, Homo sapiens
caaaatgtagaaat

SEQ ID NO: 4551982 - DNA, 15 bp, Homo sapiens
caaaatgtagaaata

SEQ ID NO: 4551983 - DNA, 18 bp, Homo sapiens
caaaatgtagaaataaat

SEQ ID NO: 4551984 - DNA, 22 bp, Homo sapiens
caaaatgttgaaatatgatgtt

SEQ ID NO: 4551985 - DNA, 12 bp, Homo sapiens
caaaattagaaa

SEQ ID NO: 4551986 - DNA, 13 bp, Homo sapiens
caaaattatttgt

SEQ ID NO: 4551987 - DNA, 15 bp, Homo sapiens
caaaattcatttcta

SEQ ID NO: 4551988 - DNA, 16 bp, Homo sapiens
caaaattgcaaatctt

SEQ ID NO: 4551989 - DNA, 12 bp, Homo sapiens
caaaattttaaa

SEQ ID NO: 4551990 - DNA, 15 bp, Homo sapiens
caaacacattataaa

SEQ ID NO: 4551991 - DNA, 16 bp, Homo sapiens
caaacaccaacataaa

SEQ ID NO: 4551992 - DNA, 18 bp, Homo sapiens
caaacagaaatgactgtg

SEQ ID NO: 4551993 - DNA, 22 bp, Homo sapiens
caaacagagtatgtccgatggt

SEQ ID NO: 4551994 - DNA, 23 bp, Homo sapiens
caaacagctattggcaagtttta

SEQ ID NO: 4551995 - DNA, 13 bp, Homo sapiens
caaacaggaacta

SEQ ID NO: 4551996 - DNA, 20 bp, Homo sapiens
caaacaggatcagttaacta

SEQ ID NO: 4551997 - DNA, 14 bp, Homo sapiens
caaacagtatttct

SEQ ID NO: 4551998 - DNA, 15 bp, Homo sapiens
caaacagtctcagga

SEQ ID NO: 4551999 - DNA, 17 bp, Homo sapiens
caaacagtctcaggaaa

SEQ ID NO: 4552000 - DNA, 12 bp, Homo sapiens
caaacatgaaaa

SEQ ID NO: 4552001 - DNA, 19 bp, Homo sapiens
caaacatgcttataacatt

SEQ ID NO: 4552002 - DNA, 21 bp, Homo sapiens
caaacatgcttataacattaa

SEQ ID NO: 4552003 - DNA, 14 bp, Homo sapiens
caaacatggagaaa

SEQ ID NO: 4552004 - DNA, 16 bp, Homo sapiens
caaacatgtatttatg

SEQ ID NO: 4552005 - DNA, 21 bp, Homo sapiens
caaacattcgtgagctgggga

SEQ ID NO: 4552006 - DNA, 18 bp, Homo sapiens
caaaccaacaccccatat

SEQ ID NO: 4552007 - DNA, 19 bp, Homo sapiens
caaaccaagggtacagatc

SEQ ID NO: 4552008 - DNA, 14 bp, Homo sapiens
caaaccaggaccct

SEQ ID NO: 4552009 - DNA, 16 bp, Homo sapiens
caaacccaggctgtct

SEQ ID NO: 4552010 - DNA, 13 bp, Homo sapiens
caaaccccagccc

SEQ ID NO: 4552011 - DNA, 14 bp, Homo sapiens
caaaccctggtgct

SEQ ID NO: 4552012 - DNA, 15 bp, Homo sapiens
caaaccctggtgctt

SEQ ID NO: 4552013 - DNA, 18 bp, Homo sapiens
caaaccctggtgctttcc

SEQ ID NO: 4552014 - DNA, 17 bp, Homo sapiens
caaacccttaactgaca

SEQ ID NO: 4552015 - DNA, 18 bp, Homo sapiens
caaacccttaactgacat

SEQ ID NO: 4552016 - DNA, 23 bp, Homo sapiens
caaacccttaactgacatgggcc

SEQ ID NO: 4552017 - DNA, 16 bp, Homo sapiens
caaacccttgctttcc

SEQ ID NO: 4552018 - DNA, 18 bp, Homo sapiens
caaacctatggaagttgt

SEQ ID NO: 4552019 - DNA, 20 bp, Homo sapiens
caaacctgcagtttttaatt

SEQ ID NO: 4552020 - DNA, 21 bp, Homo sapiens
caaacctgcagtttttaattt

SEQ ID NO: 4552021 - DNA, 22 bp, Homo sapiens
caaacctgcagtttttaatttg

SEQ ID NO: 4552022 - DNA, 12 bp, Homo sapiens
caaaccttcctg

SEQ ID NO: 4552023 - DNA, 13 bp, Homo sapiens
caaaccttcctgg

SEQ ID NO: 4552024 - DNA, 14 bp, Homo sapiens
caaaccttcctggg

SEQ ID NO: 4552025 - DNA, 19 bp, Homo sapiens
caaaccttcctgggaggac

SEQ ID NO: 4552026 - DNA, 16 bp, Homo sapiens
caaaccttgccttgaa

SEQ ID NO: 4552027 - DNA, 18 bp, Homo sapiens
caaacctttattttagaa

SEQ ID NO: 4552028 - DNA, 16 bp, Homo sapiens
caaacctttgtttcaa

SEQ ID NO: 4552029 - DNA, 23 bp, Homo sapiens
caaacgctaaagagcccttgcct

SEQ ID NO: 4552030 - DNA, 20 bp, Homo sapiens
caaacggcaacgtagcctgg

SEQ ID NO: 4552031 - DNA, 18 bp, Homo sapiens
caaacgtaatttgttata

SEQ ID NO: 4552032 - DNA, 23 bp, Homo sapiens
caaacgttggagtttgggctgga

SEQ ID NO: 4552033 - DNA, 16 bp, Homo sapiens
caaacgtttgacaaac

SEQ ID NO: 4552034 - DNA, 16 bp, Homo sapiens
caaactaaattcaaag

SEQ ID NO: 4552035 - DNA, 16 bp, Homo sapiens
caaactactgaatgaa

SEQ ID NO: 4552036 - DNA, 22 bp, Homo sapiens
caaactactgaatgaagcagta

SEQ ID NO: 4552037 - DNA, 23 bp, Homo sapiens
caaactactgaatgaagcagtat

SEQ ID NO: 4552038 - DNA, 17 bp, Homo sapiens
caaactaggagatgaaa

SEQ ID NO: 4552039 - DNA, 13 bp, Homo sapiens
caaactagggcca

SEQ ID NO: 4552040 - DNA, 14 bp, Homo sapiens
caaactcattgcag

SEQ ID NO: 4552041 - DNA, 17 bp, Homo sapiens
caaactgaggaatttca

SEQ ID NO: 4552042 - DNA, 22 bp, Homo sapiens
caaactgaggaatttcacctgt

SEQ ID NO: 4552043 - DNA, 18 bp, Homo sapiens
caaactgatctaaaatgt

SEQ ID NO: 4552044 - DNA, 14 bp, Homo sapiens
caaactgctttatt

SEQ ID NO: 4552045 - DNA, 21 bp, Homo sapiens
caaactgtaaaaaatgtgtgt

SEQ ID NO: 4552046 - DNA, 18 bp, Homo sapiens
caaactgtaaaaataaca

SEQ ID NO: 4552047 - DNA, 14 bp, Homo sapiens
caaactgtaaataa

SEQ ID NO: 4552048 - DNA, 11 bp, Homo sapiens
caaactgtgaa

SEQ ID NO: 4552049 - DNA, 20 bp, Homo sapiens
caaactgtgaaaatagtgta

SEQ ID NO: 4552050 - DNA, 21 bp, Homo sapiens
caaacttacaggtcctgctga

SEQ ID NO: 4552051 - DNA, 21 bp, Homo sapiens
caaactttaggtttttttaat

SEQ ID NO: 4552052 - DNA, 23 bp, Homo sapiens
caaactttaggtttttttaatga

SEQ ID NO: 4552053 - DNA, 12 bp, Homo sapiens
caaactttgttt

SEQ ID NO: 4552054 - DNA, 14 bp, Homo sapiens
caaacttttctttc

SEQ ID NO: 4552055 - DNA, 14 bp, Homo sapiens
caaacttttgaaag

SEQ ID NO: 4552056 - DNA, 20 bp, Homo sapiens
caaactttttgttcatgtgg

SEQ ID NO: 4552057 - DNA, 23 bp, Homo sapiens
caaagaaaaattaattaggaatt

SEQ ID NO: 4552058 - DNA, 19 bp, Homo sapiens
caaagaaaattcctataag

SEQ ID NO: 4552059 - DNA, 17 bp, Homo sapiens
caaagaaacaaagatgt

SEQ ID NO: 4552060 - DNA, 13 bp, Homo sapiens
caaagaaacccaa

SEQ ID NO: 4552061 - DNA, 17 bp, Homo sapiens
caaagaaatgaacattc

SEQ ID NO: 4552062 - DNA, 18 bp, Homo sapiens
caaagaaatgaacattcc

SEQ ID NO: 4552063 - DNA, 19 bp, Homo sapiens
caaagaaatgaacattcca

SEQ ID NO: 4552064 - DNA, 20 bp, Homo sapiens
caaagaagtcggaatgtcat

SEQ ID NO: 4552065 - DNA, 17 bp, Homo sapiens
caaagaattccaaagca

SEQ ID NO: 4552066 - DNA, 14 bp, Homo sapiens
caaagacaggcaaa

SEQ ID NO: 4552067 - DNA, 13 bp, Homo sapiens
caaagacatcagt

SEQ ID NO: 4552068 - DNA, 20 bp, Homo sapiens
caaagacatgctttccattt

SEQ ID NO: 4552069 - DNA, 21 bp, Homo sapiens
caaagagagtttttaatagaa

SEQ ID NO: 4552070 - DNA, 22 bp, Homo sapiens
caaagagatatttaggaaaatg

SEQ ID NO: 4552071 - DNA, 19 bp, Homo sapiens
caaagagcctcccaccaga

SEQ ID NO: 4552072 - DNA, 22 bp, Homo sapiens
caaagagggcttcctctagaag

SEQ ID NO: 4552073 - DNA, 14 bp, Homo sapiens
caaagagtagaatt

SEQ ID NO: 4552074 - DNA, 21 bp, Homo sapiens
caaagagttcaagaaataagt

SEQ ID NO: 4552075 - DNA, 17 bp, Homo sapiens
caaagatcaccagccat

SEQ ID NO: 4552076 - DNA, 22 bp, Homo sapiens
caaagatctgaattaaataaat

SEQ ID NO: 4552077 - DNA, 14 bp, Homo sapiens
caaagatggcttcc

SEQ ID NO: 4552078 - DNA, 13 bp, Homo sapiens
caaagatttttgg

SEQ ID NO: 4552079 - DNA, 19 bp, Homo sapiens
caaagcagcaggcctctgg

SEQ ID NO: 4552080 - DNA, 16 bp, Homo sapiens
caaagcagcagtgtcc

SEQ ID NO: 4552081 - DNA, 15 bp, Homo sapiens
caaagcataaaatgg

SEQ ID NO: 4552082 - DNA, 17 bp, Homo sapiens
caaagccattctccccc

SEQ ID NO: 4552083 - DNA, 19 bp, Homo sapiens
caaagcccaaagtggtata

SEQ ID NO: 4552084 - DNA, 16 bp, Homo sapiens
caaagctaggatggtt

SEQ ID NO: 4552085 - DNA, 23 bp, Homo sapiens
caaagctaggatggttctgtgac

SEQ ID NO: 4552086 - DNA, 22 bp, Homo sapiens
caaagctagggtggcccttgca

SEQ ID NO: 4552087 - DNA, 19 bp, Homo sapiens
caaagctctgaatagttaa

SEQ ID NO: 4552088 - DNA, 16 bp, Homo sapiens
caaagctgctaaatct

SEQ ID NO: 4552089 - DNA, 23 bp, Homo sapiens
caaaggaatttgcatccagcagc

SEQ ID NO: 4552090 - DNA, 20 bp, Homo sapiens
caaaggagacgggggagcag

SEQ ID NO: 4552091 - DNA, 21 bp, Homo sapiens
caaaggaggggaaacaatgaa

SEQ ID NO: 4552092 - DNA, 22 bp, Homo sapiens
caaaggaggggaaacaatgaaa

SEQ ID NO: 4552093 - DNA, 14 bp, Homo sapiens
caaaggataaattt

SEQ ID NO: 4552094 - DNA, 17 bp, Homo sapiens
caaaggccacaggcagt

SEQ ID NO: 4552095 - DNA, 18 bp, Homo sapiens
caaaggccagtggaagaa

SEQ ID NO: 4552096 - DNA, 19 bp, Homo sapiens
caaaggccagtggaagaaa

SEQ ID NO: 4552097 - DNA, 19 bp, Homo sapiens
caaaggctgacattcactg

SEQ ID NO: 4552098 - DNA, 22 bp, Homo sapiens
caaaggctgacattcactgagt

SEQ ID NO: 4552099 - DNA, 20 bp, Homo sapiens
caaaggtccgcaccctgtcc

SEQ ID NO: 4552100 - DNA, 19 bp, Homo sapiens
caaaggtcgggacagctgt

SEQ ID NO: 4552101 - DNA, 19 bp, Homo sapiens
caaagtaaagcagaggatg

SEQ ID NO: 4552102 - DNA, 16 bp, Homo sapiens
caaagtacagaatttg

SEQ ID NO: 4552103 - DNA, 22 bp, Homo sapiens
caaagtactgtaagaataattt

SEQ ID NO: 4552104 - DNA, 20 bp, Homo sapiens
caaagtctgatttgtgatga

SEQ ID NO: 4552105 - DNA, 24 bp, Homo sapiens
caaagtgatgggagaattggtata

SEQ ID NO: 4552106 - DNA, 22 bp, Homo sapiens
caaagtgctgagattgcagatg

SEQ ID NO: 4552107 - DNA, 18 bp, Homo sapiens
caaagtggtatagaaatg

SEQ ID NO: 4552108 - DNA, 17 bp, Homo sapiens
caaagtgttttgtacca

SEQ ID NO: 4552109 - DNA, 14 bp, Homo sapiens
caaagttcaacttg

SEQ ID NO: 4552110 - DNA, 17 bp, Homo sapiens
caaagttctcagagctc

SEQ ID NO: 4552111 - DNA, 23 bp, Homo sapiens
caaagttgattaagaaaggaagt

SEQ ID NO: 4552112 - DNA, 20 bp, Homo sapiens
caaagtttcagagtatattg

SEQ ID NO: 4552113 - DNA, 13 bp, Homo sapiens
caaataaacactg

SEQ ID NO: 4552114 - DNA, 14 bp, Homo sapiens
caaataaacactgt

SEQ ID NO: 4552115 - DNA, 23 bp, Homo sapiens
caaataaatgattatattcacag

SEQ ID NO: 4552116 - DNA, 22 bp, Homo sapiens
caaataagattaataagatttt

SEQ ID NO: 4552117 - DNA, 14 bp, Homo sapiens
caaataagtaatat

SEQ ID NO: 4552118 - DNA, 17 bp, Homo sapiens
caaataatgcttttcta

SEQ ID NO: 4552119 - DNA, 13 bp, Homo sapiens
caaataatgtctc

SEQ ID NO: 4552120 - DNA, 20 bp, Homo sapiens
caaataatgtctctgtgaga

SEQ ID NO: 4552121 - DNA, 23 bp, Homo sapiens
caaataatgtctctgtgagactc

SEQ ID NO: 4552122 - DNA, 13 bp, Homo sapiens
caaatacatgcac

SEQ ID NO: 4552123 - DNA, 12 bp, Homo sapiens
caaatacctcaa

SEQ ID NO: 4552124 - DNA, 16 bp, Homo sapiens
caaatactaaaaagaa

SEQ ID NO: 4552125 - DNA, 15 bp, Homo sapiens
caaatacttagcaaa

SEQ ID NO: 4552126 - DNA, 17 bp, Homo sapiens
caaatagaaaacaggaa

SEQ ID NO: 4552127 - DNA, 13 bp, Homo sapiens
caaatagaacaag

SEQ ID NO: 4552128 - DNA, 16 bp, Homo sapiens
caaatagccacaatta

SEQ ID NO: 4552129 - DNA, 20 bp, Homo sapiens
caaatagcctctcctttgta

SEQ ID NO: 4552130 - DNA, 17 bp, Homo sapiens
caaataggctattaaaa

SEQ ID NO: 4552131 - DNA, 12 bp, Homo sapiens
caaatagtgtga

SEQ ID NO: 4552132 - DNA, 21 bp, Homo sapiens
caaatagtgtgaaatatatta

SEQ ID NO: 4552133 - DNA, 13 bp, Homo sapiens
caaatagttgcat

SEQ ID NO: 4552134 - DNA, 22 bp, Homo sapiens
caaatatagagatatttttgta

SEQ ID NO: 4552135 - DNA, 21 bp, Homo sapiens
caaatataggtcctgtgttaa

SEQ ID NO: 4552136 - DNA, 15 bp, Homo sapiens
caaatatcaaataaa

SEQ ID NO: 4552137 - DNA, 16 bp, Homo sapiens
caaatatctctattta

SEQ ID NO: 4552138 - DNA, 14 bp, Homo sapiens
caaatatgcaaagc

SEQ ID NO: 4552139 - DNA, 17 bp, Homo sapiens
caaatattagcaaagaa

SEQ ID NO: 4552140 - DNA, 15 bp, Homo sapiens
caaatattcagaata

SEQ ID NO: 4552141 - DNA, 14 bp, Homo sapiens
caaatattgaagtt

SEQ ID NO: 4552142 - DNA, 15 bp, Homo sapiens
caaatattgtcatct

SEQ ID NO: 4552143 - DNA, 14 bp, Homo sapiens
caaatatttcactt

SEQ ID NO: 4552144 - DNA, 17 bp, Homo sapiens
caaatcaaaaacaggca

SEQ ID NO: 4552145 - DNA, 17 bp, Homo sapiens
caaatcaaatgaatgat

SEQ ID NO: 4552146 - DNA, 16 bp, Homo sapiens
caaatcaattactggt

SEQ ID NO: 4552147 - DNA, 15 bp, Homo sapiens
caaatcacatatttt

SEQ ID NO: 4552148 - DNA, 22 bp, Homo sapiens
caaatcagaagtcatcttgcta

SEQ ID NO: 4552149 - DNA, 15 bp, Homo sapiens
caaatcagtatattt

SEQ ID NO: 4552150 - DNA, 22 bp, Homo sapiens
caaatcagtatattttctgtat

SEQ ID NO: 4552151 - DNA, 16 bp, Homo sapiens
caaatcattatgtttc

SEQ ID NO: 4552152 - DNA, 14 bp, Homo sapiens
caaatcatttgttt

SEQ ID NO: 4552153 - DNA, 17 bp, Homo sapiens
caaatcatttgtttaaa

SEQ ID NO: 4552154 - DNA, 19 bp, Homo sapiens
caaatcccttttatctatt

SEQ ID NO: 4552155 - DNA, 17 bp, Homo sapiens
caaatcctctgttttct

SEQ ID NO: 4552156 - DNA, 18 bp, Homo sapiens
caaatcctctgttttctc

SEQ ID NO: 4552157 - DNA, 21 bp, Homo sapiens
caaatcctctgttttctctct

SEQ ID NO: 4552158 - DNA, 12 bp, Homo sapiens
caaatcctcttt

SEQ ID NO: 4552159 - DNA, 13 bp, Homo sapiens
caaatcctggaag

SEQ ID NO: 4552160 - DNA, 20 bp, Homo sapiens
caaatcctggaaggacacag

SEQ ID NO: 4552161 - DNA, 17 bp, Homo sapiens
caaatccttattgttca

SEQ ID NO: 4552162 - DNA, 11 bp, Homo sapiens
caaatccttgg

SEQ ID NO: 4552163 - DNA, 22 bp, Homo sapiens
caaatcgatttagtaagtatgt

SEQ ID NO: 4552164 - DNA, 20 bp, Homo sapiens
caaatctaaaatgcaaagaa

SEQ ID NO: 4552165 - DNA, 14 bp, Homo sapiens
caaatctagaattt

SEQ ID NO: 4552166 - DNA, 13 bp, Homo sapiens
caaatctcagttg

SEQ ID NO: 4552167 - DNA, 21 bp, Homo sapiens
caaatctcagttgtttgcttc

SEQ ID NO: 4552168 - DNA, 15 bp, Homo sapiens
caaatctctcatatt

SEQ ID NO: 4552169 - DNA, 16 bp, Homo sapiens
caaatctgatggcctt

SEQ ID NO: 4552170 - DNA, 21 bp, Homo sapiens
caaatcttaacttgaaggagt

SEQ ID NO: 4552171 - DNA, 22 bp, Homo sapiens
caaatcttggttgatgccaaaa

SEQ ID NO: 4552172 - DNA, 18 bp, Homo sapiens
caaatgaaatgtatgcat

SEQ ID NO: 4552173 - DNA, 14 bp, Homo sapiens
caaatgaactttaa

SEQ ID NO: 4552174 - DNA, 18 bp, Homo sapiens
caaatgaataatgccttt

SEQ ID NO: 4552175 - DNA, 23 bp, Homo sapiens
caaatgaataatgcctttgtaac

SEQ ID NO: 4552176 - DNA, 19 bp, Homo sapiens
caaatgaatgattaaatta

SEQ ID NO: 4552177 - DNA, 15 bp, Homo sapiens
caaatgatcctccca

SEQ ID NO: 4552178 - DNA, 18 bp, Homo sapiens
caaatgatcctcccacct

SEQ ID NO: 4552179 - DNA, 18 bp, Homo sapiens
caaatgcagtatatttct

SEQ ID NO: 4552180 - DNA, 12 bp, Homo sapiens
caaatgcataaa

SEQ ID NO: 4552181 - DNA, 15 bp, Homo sapiens
caaatgcctgactca

SEQ ID NO: 4552182 - DNA, 17 bp, Homo sapiens
caaatgcgcgtgtgcac

SEQ ID NO: 4552183 - DNA, 18 bp, Homo sapiens
caaatggcgtctggaagt

SEQ ID NO: 4552184 - DNA, 22 bp, Homo sapiens
caaatggcgtctggaagtccaa

SEQ ID NO: 4552185 - DNA, 17 bp, Homo sapiens
caaatgggagctgagca

SEQ ID NO: 4552186 - DNA, 20 bp, Homo sapiens
caaatgggagctgagcagcc

SEQ ID NO: 4552187 - DNA, 13 bp, Homo sapiens
caaatggtaggca

SEQ ID NO: 4552188 - DNA, 15 bp, Homo sapiens
caaatggtaggcatt

SEQ ID NO: 4552189 - DNA, 23 bp, Homo sapiens
caaatggttccagatacttcagc

SEQ ID NO: 4552190 - DNA, 13 bp, Homo sapiens
caaatgtcattgt

SEQ ID NO: 4552191 - DNA, 15 bp, Homo sapiens
caaatgtcctttctc

SEQ ID NO: 4552192 - DNA, 23 bp, Homo sapiens
caaatgtgcaatttgtaaatatt

SEQ ID NO: 4552193 - DNA, 14 bp, Homo sapiens
caaatgtgctttga

SEQ ID NO: 4552194 - DNA, 18 bp, Homo sapiens
caaatgttagacttgtgt

SEQ ID NO: 4552195 - DNA, 20 bp, Homo sapiens
caaatgttagacttgtgtgc

SEQ ID NO: 4552196 - DNA, 20 bp, Homo sapiens
caaatgttcatatttattga

SEQ ID NO: 4552197 - DNA, 14 bp, Homo sapiens
caaatgttcatcaa

SEQ ID NO: 4552198 - DNA, 12 bp, Homo sapiens
caaatgtttact

SEQ ID NO: 4552199 - DNA, 13 bp, Homo sapiens
caaatgtttactg

SEQ ID NO: 4552200 - DNA, 14 bp, Homo sapiens
caaatgtttactgt

SEQ ID NO: 4552201 - DNA, 15 bp, Homo sapiens
caaatgtttactgta

SEQ ID NO: 4552202 - DNA, 18 bp, Homo sapiens
caaatgtttactgtatca

SEQ ID NO: 4552203 - DNA, 21 bp, Homo sapiens
caaattaaaaaaaaattgtat

SEQ ID NO: 4552204 - DNA, 21 bp, Homo sapiens
caaattagaaacaccattcat

SEQ ID NO: 4552205 - DNA, 17 bp, Homo sapiens
caaattattaatgaaaa

SEQ ID NO: 4552206 - DNA, 15 bp, Homo sapiens
caaattcagctctga

SEQ ID NO: 4552207 - DNA, 14 bp, Homo sapiens
caaattcagtttca

SEQ ID NO: 4552208 - DNA, 15 bp, Homo sapiens
caaattctactttaa

SEQ ID NO: 4552209 - DNA, 18 bp, Homo sapiens
caaattcttttgaattgt

SEQ ID NO: 4552210 - DNA, 23 bp, Homo sapiens
caaattcttttgaattgttacat

SEQ ID NO: 4552211 - DNA, 22 bp, Homo sapiens
caaattgagtttaacaataata

SEQ ID NO: 4552212 - DNA, 15 bp, Homo sapiens
caaattgctgcttgg

SEQ ID NO: 4552213 - DNA, 14 bp, Homo sapiens
caaattgcttctag

SEQ ID NO: 4552214 - DNA, 14 bp, Homo sapiens
caaattgtgaaata

SEQ ID NO: 4552215 - DNA, 22 bp, Homo sapiens
caaattgtgcttctccccagaa

SEQ ID NO: 4552216 - DNA, 20 bp, Homo sapiens
caaatttaattaaagcctta

SEQ ID NO: 4552217 - DNA, 15 bp, Homo sapiens
caaatttacagagac

SEQ ID NO: 4552218 - DNA, 16 bp, Homo sapiens
caaatttacagagaca

SEQ ID NO: 4552219 - DNA, 17 bp, Homo sapiens
caaatttacagagacag

SEQ ID NO: 4552220 - DNA, 12 bp, Homo sapiens
caaatttagttt

SEQ ID NO: 4552221 - DNA, 14 bp, Homo sapiens
caaatttatttcca

SEQ ID NO: 4552222 - DNA, 13 bp, Homo sapiens
caaatttcctgtt

SEQ ID NO: 4552223 - DNA, 19 bp, Homo sapiens
caaatttcctgtttgaaat

SEQ ID NO: 4552224 - DNA, 23 bp, Homo sapiens
caaatttctataaatttaagaaa

SEQ ID NO: 4552225 - DNA, 19 bp, Homo sapiens
caaatttgatgatgttaaa

SEQ ID NO: 4552226 - DNA, 16 bp, Homo sapiens
caaatttggccttaag

SEQ ID NO: 4552227 - DNA, 20 bp, Homo sapiens
caaatttggccttaagaact

SEQ ID NO: 4552228 - DNA, 21 bp, Homo sapiens
caaatttggccttaagaactg

SEQ ID NO: 4552229 - DNA, 19 bp, Homo sapiens
caaattttgagttgccaca

SEQ ID NO: 4552230 - DNA, 15 bp, Homo sapiens
caacaaagaaacaaa

SEQ ID NO: 4552231 - DNA, 15 bp, Homo sapiens
caacaaagacatgct

SEQ ID NO: 4552232 - DNA, 17 bp, Homo sapiens
caacaaagattgagaag

SEQ ID NO: 4552233 - DNA, 19 bp, Homo sapiens
caacaaagattgagaagcc

SEQ ID NO: 4552234 - DNA, 23 bp, Homo sapiens
caacaaatgtggccaagcctatc

SEQ ID NO: 4552235 - DNA, 19 bp, Homo sapiens
caacaacctcaactgccta

SEQ ID NO: 4552236 - DNA, 14 bp, Homo sapiens
caacaagaagaaac

SEQ ID NO: 4552237 - DNA, 18 bp, Homo sapiens
caacaagaagaatttgaa

SEQ ID NO: 4552238 - DNA, 14 bp, Homo sapiens
caacaagagcgaaa

SEQ ID NO: 4552239 - DNA, 13 bp, Homo sapiens
caacaattctaaa

SEQ ID NO: 4552240 - DNA, 13 bp, Homo sapiens
caacaatttctac

SEQ ID NO: 4552241 - DNA, 22 bp, Homo sapiens
caacacctgcctctgaccccag

SEQ ID NO: 4552242 - DNA, 14 bp, Homo sapiens
caacaccttcctcc

SEQ ID NO: 4552243 - DNA, 18 bp, Homo sapiens
caacaccttcctcctgca

SEQ ID NO: 4552244 - DNA, 14 bp, Homo sapiens
caacacgcctggct

SEQ ID NO: 4552245 - DNA, 22 bp, Homo sapiens
caacactgaagtgcttgcagat

SEQ ID NO: 4552246 - DNA, 22 bp, Homo sapiens
caacactggtctgctgttccag

SEQ ID NO: 4552247 - DNA, 18 bp, Homo sapiens
caacactggtgtgacctg

SEQ ID NO: 4552248 - DNA, 22 bp, Homo sapiens
caacactggtgtgacctgaggg

SEQ ID NO: 4552249 - DNA, 16 bp, Homo sapiens
caacacttaatcattt

SEQ ID NO: 4552250 - DNA, 18 bp, Homo sapiens
caacacttaatcatttta

SEQ ID NO: 4552251 - DNA, 15 bp, Homo sapiens
caacagaacccacag

SEQ ID NO: 4552252 - DNA, 17 bp, Homo sapiens
caacagagaaggcagga

SEQ ID NO: 4552253 - DNA, 15 bp, Homo sapiens
caacagagacagtga

SEQ ID NO: 4552254 - DNA, 14 bp, Homo sapiens
caacagatcagtaa

SEQ ID NO: 4552255 - DNA, 14 bp, Homo sapiens
caacagcacacagg

SEQ ID NO: 4552256 - DNA, 15 bp, Homo sapiens
caacagcacacaggc

SEQ ID NO: 4552257 - DNA, 16 bp, Homo sapiens
caacagcacacaggca

SEQ ID NO: 4552258 - DNA, 17 bp, Homo sapiens
caacagcacctccccgc

SEQ ID NO: 4552259 - DNA, 22 bp, Homo sapiens
caacagcacctccccgctggga

SEQ ID NO: 4552260 - DNA, 20 bp, Homo sapiens
caacagcttttcccaggaga

SEQ ID NO: 4552261 - DNA, 19 bp, Homo sapiens
caacaggaatcaagagctg

SEQ ID NO: 4552262 - DNA, 23 bp, Homo sapiens
caacaggaatcaagagctgccct

SEQ ID NO: 4552263 - DNA, 14 bp, Homo sapiens
caacaggagggcag

SEQ ID NO: 4552264 - DNA, 16 bp, Homo sapiens
caacaggagggcagcc

SEQ ID NO: 4552265 - DNA, 23 bp, Homo sapiens
caacagggccatgtgctgccctg

SEQ ID NO: 4552266 - DNA, 17 bp, Homo sapiens
caacaggtaaaacaggg

SEQ ID NO: 4552267 - DNA, 22 bp, Homo sapiens
caacagtaaaccactgaaaaaa

SEQ ID NO: 4552268 - DNA, 22 bp, Homo sapiens
caacatacgggaagtttatttc

SEQ ID NO: 4552269 - DNA, 17 bp, Homo sapiens
caacatagtgagacact

SEQ ID NO: 4552270 - DNA, 15 bp, Homo sapiens
caacatcccattgcc

SEQ ID NO: 4552271 - DNA, 22 bp, Homo sapiens
caacatggagaaaccctgtctc

SEQ ID NO: 4552272 - DNA, 12 bp, Homo sapiens
caacatgggagg

SEQ ID NO: 4552273 - DNA, 17 bp, Homo sapiens
caacatgggagggatca

SEQ ID NO: 4552274 - DNA, 12 bp, Homo sapiens
caacatggtgct

SEQ ID NO: 4552275 - DNA, 14 bp, Homo sapiens
caacatggtgctac

SEQ ID NO: 4552276 - DNA, 21 bp, Homo sapiens
caacatgtggctcctcccagc

SEQ ID NO: 4552277 - DNA, 23 bp, Homo sapiens
caacatgttatttgtaatagatg

SEQ ID NO: 4552278 - DNA, 16 bp, Homo sapiens
caacattccagggatg

SEQ ID NO: 4552279 - DNA, 20 bp, Homo sapiens
caacattgatccagtcattt

SEQ ID NO: 4552280 - DNA, 12 bp, Homo sapiens
caacatttatgt

SEQ ID NO: 4552281 - DNA, 22 bp, Homo sapiens
caacatttctcatgttgaaact

SEQ ID NO: 4552282 - DNA, 17 bp, Homo sapiens
caacatttcttaaatta

SEQ ID NO: 4552283 - DNA, 18 bp, Homo sapiens
caacatttcttaaattat

SEQ ID NO: 4552284 - DNA, 23 bp, Homo sapiens
caacatttcttaaattattttat

SEQ ID NO: 4552285 - DNA, 17 bp, Homo sapiens
caaccaactgccccagg

SEQ ID NO: 4552286 - DNA, 19 bp, Homo sapiens
caaccaactgccccagggg

SEQ ID NO: 4552287 - DNA, 23 bp, Homo sapiens
caaccacatttagaaatgtttat

SEQ ID NO: 4552288 - DNA, 15 bp, Homo sapiens
caaccatatttagca

SEQ ID NO: 4552289 - DNA, 19 bp, Homo sapiens
caaccatgcaaattgtgaa

SEQ ID NO: 4552290 - DNA, 20 bp, Homo sapiens
caaccatgcaaattgtgaaa

SEQ ID NO: 4552291 - DNA, 21 bp, Homo sapiens
caaccatgcaaattgtgaaat

SEQ ID NO: 4552292 - DNA, 17 bp, Homo sapiens
caaccattaaagtcaga

SEQ ID NO: 4552293 - DNA, 22 bp, Homo sapiens
caacccaaggactgagggactc

SEQ ID NO: 4552294 - DNA, 14 bp, Homo sapiens
caacccaatgggct

SEQ ID NO: 4552295 - DNA, 17 bp, Homo sapiens
caacccccaccccacac

SEQ ID NO: 4552296 - DNA, 18 bp, Homo sapiens
caacccccaccccacact

SEQ ID NO: 4552297 - DNA, 15 bp, Homo sapiens
caaccccccagcact

SEQ ID NO: 4552298 - DNA, 19 bp, Homo sapiens
caaccccccagcactgagg

SEQ ID NO: 4552299 - DNA, 13 bp, Homo sapiens
caacccccctccc

SEQ ID NO: 4552300 - DNA, 13 bp, Homo sapiens
caacccctcctcc

SEQ ID NO: 4552301 - DNA, 15 bp, Homo sapiens
caacccctcctccct

SEQ ID NO: 4552302 - DNA, 16 bp, Homo sapiens
caacccctcctccctc

SEQ ID NO: 4552303 - DNA, 21 bp, Homo sapiens
caacccctcctccctcagact

SEQ ID NO: 4552304 - DNA, 13 bp, Homo sapiens
caacccctccttc

SEQ ID NO: 4552305 - DNA, 15 bp, Homo sapiens
caacccctccttccc

SEQ ID NO: 4552306 - DNA, 16 bp, Homo sapiens
caacccctccttcccc

SEQ ID NO: 4552307 - DNA, 22 bp, Homo sapiens
caacccgtctggcccaccaggg

SEQ ID NO: 4552308 - DNA, 22 bp, Homo sapiens
caaccggctttgtggcactggg

SEQ ID NO: 4552309 - DNA, 21 bp, Homo sapiens
caaccggtggatcctcaaaca

SEQ ID NO: 4552310 - DNA, 15 bp, Homo sapiens
caacctaaaactctt

SEQ ID NO: 4552311 - DNA, 18 bp, Homo sapiens
caacctaacccctttcct

SEQ ID NO: 4552312 - DNA, 16 bp, Homo sapiens
caacctcaccctcctg

SEQ ID NO: 4552313 - DNA, 20 bp, Homo sapiens
caacctcagggctcccaggg

SEQ ID NO: 4552314 - DNA, 19 bp, Homo sapiens
caacctccgcctcccgggt

SEQ ID NO: 4552315 - DNA, 20 bp, Homo sapiens
caacctctacctcctgggtt

SEQ ID NO: 4552316 - DNA, 14 bp, Homo sapiens
caacctctgcctcc

SEQ ID NO: 4552317 - DNA, 19 bp, Homo sapiens
caacctctttttcctcctg

SEQ ID NO: 4552318 - DNA, 21 bp, Homo sapiens
caacctgcctgacatttggag

SEQ ID NO: 4552319 - DNA, 13 bp, Homo sapiens
caacctgctctgt

SEQ ID NO: 4552320 - DNA, 19 bp, Homo sapiens
caacctgctctgtccccaa

SEQ ID NO: 4552321 - DNA, 18 bp, Homo sapiens
caacctggtggcaccaga

SEQ ID NO: 4552322 - DNA, 12 bp, Homo sapiens
caacctgtaaat

SEQ ID NO: 4552323 - DNA, 17 bp, Homo sapiens
caaccttagatgttcta

SEQ ID NO: 4552324 - DNA, 14 bp, Homo sapiens
caaccttcaagtat

SEQ ID NO: 4552325 - DNA, 13 bp, Homo sapiens
caaccttcattta

SEQ ID NO: 4552326 - DNA, 18 bp, Homo sapiens
caaccttccaacttcctg

SEQ ID NO: 4552327 - DNA, 22 bp, Homo sapiens
caaccttccaacttcctgtggc

SEQ ID NO: 4552328 - DNA, 13 bp, Homo sapiens
caaccttgtttat

SEQ ID NO: 4552329 - DNA, 15 bp, Homo sapiens
caacctttccctcac

SEQ ID NO: 4552330 - DNA, 19 bp, Homo sapiens
caacgagacacattgcctt

SEQ ID NO: 4552331 - DNA, 21 bp, Homo sapiens
caacgagacacattgccttct

SEQ ID NO: 4552332 - DNA, 22 bp, Homo sapiens
caacgcaggaggagaaaagaaa

SEQ ID NO: 4552333 - DNA, 18 bp, Homo sapiens
caacgccgagtgcactgc

SEQ ID NO: 4552334 - DNA, 23 bp, Homo sapiens
caacgggattgaagggtcctgcc

SEQ ID NO: 4552335 - DNA, 16 bp, Homo sapiens
caacggggggctcctg

SEQ ID NO: 4552336 - DNA, 21 bp, Homo sapiens
caacggggggctcctgcccag

SEQ ID NO: 4552337 - DNA, 23 bp, Homo sapiens
caacggggggctcctgcccaggc

SEQ ID NO: 4552338 - DNA, 13 bp, Homo sapiens
caacgtcccctcc

SEQ ID NO: 4552339 - DNA, 14 bp, Homo sapiens
caactaacaatgcc

SEQ ID NO: 4552340 - DNA, 18 bp, Homo sapiens
caactacacaaagcaggc

SEQ ID NO: 4552341 - DNA, 11 bp, Homo sapiens
caactacctga

SEQ ID NO: 4552342 - DNA, 21 bp, Homo sapiens
caactacctgagctaaataaa

SEQ ID NO: 4552343 - DNA, 15 bp, Homo sapiens
caactactaatagaa

SEQ ID NO: 4552344 - DNA, 15 bp, Homo sapiens
caactagctgggact

SEQ ID NO: 4552345 - DNA, 18 bp, Homo sapiens
caactatggaatagatta

SEQ ID NO: 4552346 - DNA, 21 bp, Homo sapiens
caactcacattgttcaactcc

SEQ ID NO: 4552347 - DNA, 11 bp, Homo sapiens
caactccacag

SEQ ID NO: 4552348 - DNA, 19 bp, Homo sapiens
caactccaggaaagagcag

SEQ ID NO: 4552349 - DNA, 13 bp, Homo sapiens
caactccaggggc

SEQ ID NO: 4552350 - DNA, 15 bp, Homo sapiens
caactcccaacttct

SEQ ID NO: 4552351 - DNA, 15 bp, Homo sapiens
caactccgcccagcc

SEQ ID NO: 4552352 - DNA, 14 bp, Homo sapiens
caactcgctttagg

SEQ ID NO: 4552353 - DNA, 19 bp, Homo sapiens
caactctccccagtgcctg

SEQ ID NO: 4552354 - DNA, 20 bp, Homo sapiens
caactctccccagtgcctgc

SEQ ID NO: 4552355 - DNA, 14 bp, Homo sapiens
caactcttatttct

SEQ ID NO: 4552356 - DNA, 18 bp, Homo sapiens
caactcttatttctttcc

SEQ ID NO: 4552357 - DNA, 19 bp, Homo sapiens
caactcttatttctttcct

SEQ ID NO: 4552358 - DNA, 16 bp, Homo sapiens
caactcttgattatcc

SEQ ID NO: 4552359 - DNA, 13 bp, Homo sapiens
caactctttgaga

SEQ ID NO: 4552360 - DNA, 14 bp, Homo sapiens
caactctttgagaa

SEQ ID NO: 4552361 - DNA, 21 bp, Homo sapiens
caactgaaggctaaaaagcaa

SEQ ID NO: 4552362 - DNA, 13 bp, Homo sapiens
caactgacctgcc

SEQ ID NO: 4552363 - DNA, 20 bp, Homo sapiens
caactgccaggctgcctcct

SEQ ID NO: 4552364 - DNA, 11 bp, Homo sapiens
caactgcccag

SEQ ID NO: 4552365 - DNA, 13 bp, Homo sapiens
caactgcccagca

SEQ ID NO: 4552366 - DNA, 13 bp, Homo sapiens
caactgccccagg

SEQ ID NO: 4552367 - DNA, 18 bp, Homo sapiens
caactgcctactccaaaa

SEQ ID NO: 4552368 - DNA, 19 bp, Homo sapiens
caactgctccagcctctgc

SEQ ID NO: 4552369 - DNA, 20 bp, Homo sapiens
caactgctccagcctctgcc

SEQ ID NO: 4552370 - DNA, 22 bp, Homo sapiens
caactgctccagcctctgccgc

SEQ ID NO: 4552371 - DNA, 13 bp, Homo sapiens
caactgtatttat

SEQ ID NO: 4552372 - DNA, 21 bp, Homo sapiens
caactgtctcgatgcaatgaa

SEQ ID NO: 4552373 - DNA, 20 bp, Homo sapiens
caactgtggtagctccagcg

SEQ ID NO: 4552374 - DNA, 23 bp, Homo sapiens
caactgtggtagctccagcgatg

SEQ ID NO: 4552375 - DNA, 16 bp, Homo sapiens
caacttcaagtgcatg

SEQ ID NO: 4552376 - DNA, 17 bp, Homo sapiens
caacttcaagtgcatgc

SEQ ID NO: 4552377 - DNA, 16 bp, Homo sapiens
caacttcaccaccccc

SEQ ID NO: 4552378 - DNA, 14 bp, Homo sapiens
caacttcctgtggc

SEQ ID NO: 4552379 - DNA, 15 bp, Homo sapiens
caacttcctgtggcc

SEQ ID NO: 4552380 - DNA, 17 bp, Homo sapiens
caacttcctgtggcctg

SEQ ID NO: 4552381 - DNA, 23 bp, Homo sapiens
caacttcgctagaaaaaaaaaac

SEQ ID NO: 4552382 - DNA, 15 bp, Homo sapiens
caacttctcttgctt

SEQ ID NO: 4552383 - DNA, 18 bp, Homo sapiens
caacttcttcctgtgaag

SEQ ID NO: 4552384 - DNA, 20 bp, Homo sapiens
caacttgatgttccacctgc

SEQ ID NO: 4552385 - DNA, 13 bp, Homo sapiens
caacttgcttcta

SEQ ID NO: 4552386 - DNA, 22 bp, Homo sapiens
caacttgcttctaaatgcccag

SEQ ID NO: 4552387 - DNA, 12 bp, Homo sapiens
caactttcctca

SEQ ID NO: 4552388 - DNA, 12 bp, Homo sapiens
caactttgaata

SEQ ID NO: 4552389 - DNA, 14 bp, Homo sapiens
caactttgaataaa

SEQ ID NO: 4552390 - DNA, 16 bp, Homo sapiens
caactttgaataaaga

SEQ ID NO: 4552391 - DNA, 17 bp, Homo sapiens
caactttgaataaagaa

SEQ ID NO: 4552392 - DNA, 14 bp, Homo sapiens
caactttttattgc

SEQ ID NO: 4552393 - DNA, 20 bp, Homo sapiens
caactttttattgccttctc

SEQ ID NO: 4552394 - DNA, 23 bp, Homo sapiens
caactttttattgccttctcacc

SEQ ID NO: 4552395 - DNA, 15 bp, Homo sapiens
caacttttttccctt

SEQ ID NO: 4552396 - DNA, 12 bp, Homo sapiens
caagaaactgtc

SEQ ID NO: 4552397 - DNA, 14 bp, Homo sapiens
caagaaagatgtat

SEQ ID NO: 4552398 - DNA, 17 bp, Homo sapiens
caagaaatgaaagcagg

SEQ ID NO: 4552399 - DNA, 19 bp, Homo sapiens
caagaaatgaaagcaggga

SEQ ID NO: 4552400 - DNA, 18 bp, Homo sapiens
caagaaatgacagtcaaa

SEQ ID NO: 4552401 - DNA, 22 bp, Homo sapiens
caagaaatgacagtcaaaagat

SEQ ID NO: 4552402 - DNA, 21 bp, Homo sapiens
caagaaatgattcaaattgct

SEQ ID NO: 4552403 - DNA, 21 bp, Homo sapiens
caagaacctatatcttacaaa

SEQ ID NO: 4552404 - DNA, 17 bp, Homo sapiens
caagaagaatttgaaga

SEQ ID NO: 4552405 - DNA, 13 bp, Homo sapiens
caagaagcagtgg

SEQ ID NO: 4552406 - DNA, 18 bp, Homo sapiens
caagaagcagtggcctta

SEQ ID NO: 4552407 - DNA, 23 bp, Homo sapiens
caagaagcattttgtaagttgaa

SEQ ID NO: 4552408 - DNA, 21 bp, Homo sapiens
caagaaggaaagatttgtgaa

SEQ ID NO: 4552409 - DNA, 15 bp, Homo sapiens
caagaaggtttctgt

SEQ ID NO: 4552410 - DNA, 23 bp, Homo sapiens
caagaagtatttttttaatttct

SEQ ID NO: 4552411 - DNA, 23 bp, Homo sapiens
caagaagttaaaaaacagctgca

SEQ ID NO: 4552412 - DNA, 13 bp, Homo sapiens
caagaatacttga

SEQ ID NO: 4552413 - DNA, 17 bp, Homo sapiens
caagaatctagaagatg

SEQ ID NO: 4552414 - DNA, 16 bp, Homo sapiens
caagaatgaaatgaat

SEQ ID NO: 4552415 - DNA, 23 bp, Homo sapiens
caagaatgaaatgaatgattcta

SEQ ID NO: 4552416 - DNA, 20 bp, Homo sapiens
caagaatggtggcttctttt

SEQ ID NO: 4552417 - DNA, 20 bp, Homo sapiens
caagacagatgagcaggagc

SEQ ID NO: 4552418 - DNA, 13 bp, Homo sapiens
caagacagatgcc

SEQ ID NO: 4552419 - DNA, 16 bp, Homo sapiens
caagacagatgcccca

SEQ ID NO: 4552420 - DNA, 17 bp, Homo sapiens
caagacatgtctgttct

SEQ ID NO: 4552421 - DNA, 23 bp, Homo sapiens
caagacatttctttctgttttgt

SEQ ID NO: 4552422 - DNA, 16 bp, Homo sapiens
caagacatttgctgaa

SEQ ID NO: 4552423 - DNA, 20 bp, Homo sapiens
caagacatttgctgaactca

SEQ ID NO: 4552424 - DNA, 13 bp, Homo sapiens
caagaccagcctg

SEQ ID NO: 4552425 - DNA, 17 bp, Homo sapiens
caagaccagcctgtcca

SEQ ID NO: 4552426 - DNA, 16 bp, Homo sapiens
caagacctcacacaca

SEQ ID NO: 4552427 - DNA, 14 bp, Homo sapiens
caagacctcatctc

SEQ ID NO: 4552428 - DNA, 22 bp, Homo sapiens
caagaccttggcctctccttgg

SEQ ID NO: 4552429 - DNA, 13 bp, Homo sapiens
caagacgtaaaga

SEQ ID NO: 4552430 - DNA, 14 bp, Homo sapiens
caagactatctaca

SEQ ID NO: 4552431 - DNA, 20 bp, Homo sapiens
caagactatctacaaaaatt

SEQ ID NO: 4552432 - DNA, 15 bp, Homo sapiens
caagactcagatgat

SEQ ID NO: 4552433 - DNA, 15 bp, Homo sapiens
caagactcctcaggc

SEQ ID NO: 4552434 - DNA, 15 bp, Homo sapiens
caagactgcaagaga

SEQ ID NO: 4552435 - DNA, 20 bp, Homo sapiens
caagagaaaattcctagaaa

SEQ ID NO: 4552436 - DNA, 18 bp, Homo sapiens
caagagaaggcttttcta

SEQ ID NO: 4552437 - DNA, 14 bp, Homo sapiens
caagagatctacac

SEQ ID NO: 4552438 - DNA, 16 bp, Homo sapiens
caagagatctacacat

SEQ ID NO: 4552439 - DNA, 21 bp, Homo sapiens
caagagatctttctttccaaa

SEQ ID NO: 4552440 - DNA, 16 bp, Homo sapiens
caagagatgggaatga

SEQ ID NO: 4552441 - DNA, 17 bp, Homo sapiens
caagagcagcctgtggc

SEQ ID NO: 4552442 - DNA, 21 bp, Homo sapiens
caagagcagcctgtggcatct

SEQ ID NO: 4552443 - DNA, 17 bp, Homo sapiens
caagagcatgcacatgc

SEQ ID NO: 4552444 - DNA, 12 bp, Homo sapiens
caagagccttgg

SEQ ID NO: 4552445 - DNA, 18 bp, Homo sapiens
caagagccttggtgtcca

SEQ ID NO: 4552446 - DNA, 20 bp, Homo sapiens
caagagctactcccacagca

SEQ ID NO: 4552447 - DNA, 21 bp, Homo sapiens
caagagctactcccacagcag

SEQ ID NO: 4552448 - DNA, 20 bp, Homo sapiens
caagagctgccctccttgtc

SEQ ID NO: 4552449 - DNA, 15 bp, Homo sapiens
caagaggactgagac

SEQ ID NO: 4552450 - DNA, 19 bp, Homo sapiens
caagaggcaagctgaaatt

SEQ ID NO: 4552451 - DNA, 17 bp, Homo sapiens
caagagggacgcctggg

SEQ ID NO: 4552452 - DNA, 19 bp, Homo sapiens
caagagggacgcctggggg

SEQ ID NO: 4552453 - DNA, 15 bp, Homo sapiens
caagagggcaagcct

SEQ ID NO: 4552454 - DNA, 17 bp, Homo sapiens
caagaggggcgggctca

SEQ ID NO: 4552455 - DNA, 22 bp, Homo sapiens
caagaggggcgggctcagagct

SEQ ID NO: 4552456 - DNA, 17 bp, Homo sapiens
caagagggggtggaggg

SEQ ID NO: 4552457 - DNA, 18 bp, Homo sapiens
caagagggggtggagggg

SEQ ID NO: 4552458 - DNA, 22 bp, Homo sapiens
caagagggttcacacagcccag

SEQ ID NO: 4552459 - DNA, 15 bp, Homo sapiens
caagaggtctgagcc

SEQ ID NO: 4552460 - DNA, 16 bp, Homo sapiens
caagaggtctgagccc

SEQ ID NO: 4552461 - DNA, 18 bp, Homo sapiens
caagaggtctgagccctg

SEQ ID NO: 4552462 - DNA, 19 bp, Homo sapiens
caagaggtgtgcacaccaa

SEQ ID NO: 4552463 - DNA, 13 bp, Homo sapiens
caagataaggaga

SEQ ID NO: 4552464 - DNA, 19 bp, Homo sapiens
caagataaggagaaagaaa

SEQ ID NO: 4552465 - DNA, 12 bp, Homo sapiens
caagatagaaag

SEQ ID NO: 4552466 - DNA, 21 bp, Homo sapiens
caagatattttaaaatctgtc

SEQ ID NO: 4552467 - DNA, 21 bp, Homo sapiens
caagatgagctgcagcccccc

SEQ ID NO: 4552468 - DNA, 13 bp, Homo sapiens
caagatgcttggt

SEQ ID NO: 4552469 - DNA, 18 bp, Homo sapiens
caagatgggacagcaaca

SEQ ID NO: 4552470 - DNA, 17 bp, Homo sapiens
caagatgggcatctttt

SEQ ID NO: 4552471 - DNA, 18 bp, Homo sapiens
caagatgggcatcttttg

SEQ ID NO: 4552472 - DNA, 21 bp, Homo sapiens
caagatgggcatcttttgtat

SEQ ID NO: 4552473 - DNA, 14 bp, Homo sapiens
caagatgtgaatta

SEQ ID NO: 4552474 - DNA, 19 bp, Homo sapiens
caagatgtgaattattgac

SEQ ID NO: 4552475 - DNA, 19 bp, Homo sapiens
caagatgtttcttgccttt

SEQ ID NO: 4552476 - DNA, 17 bp, Homo sapiens
caagattcccagagaca

SEQ ID NO: 4552477 - DNA, 23 bp, Homo sapiens
caagattcccagagacaggaaaa

SEQ ID NO: 4552478 - DNA, 17 bp, Homo sapiens
caagatttaaaattaaa

SEQ ID NO: 4552479 - DNA, 20 bp, Homo sapiens
caagatttaaaattaaattt

SEQ ID NO: 4552480 - DNA, 22 bp, Homo sapiens
caagatttaaaattaaatttga

SEQ ID NO: 4552481 - DNA, 19 bp, Homo sapiens
caagattttcctcttgtga

SEQ ID NO: 4552482 - DNA, 20 bp, Homo sapiens
caagattttttttgtaactt

SEQ ID NO: 4552483 - DNA, 23 bp, Homo sapiens
caagattttttttttaagtgaca

SEQ ID NO: 4552484 - DNA, 19 bp, Homo sapiens
caagcaaaatctaaaatgt

SEQ ID NO: 4552485 - DNA, 17 bp, Homo sapiens
caagcaaggatatcaga

SEQ ID NO: 4552486 - DNA, 20 bp, Homo sapiens
caagcaatcctcctgcctca

SEQ ID NO: 4552487 - DNA, 14 bp, Homo sapiens
caagcacagagcct

SEQ ID NO: 4552488 - DNA, 18 bp, Homo sapiens
caagcacagagcctggcc

SEQ ID NO: 4552489 - DNA, 21 bp, Homo sapiens
caagcacagagcctggcccca

SEQ ID NO: 4552490 - DNA, 22 bp, Homo sapiens
caagcacagagcctggccccag

SEQ ID NO: 4552491 - DNA, 13 bp, Homo sapiens
caagcacttccca

SEQ ID NO: 4552492 - DNA, 17 bp, Homo sapiens
caagcacttcccaggat

SEQ ID NO: 4552493 - DNA, 15 bp, Homo sapiens
caagcagacagccct

SEQ ID NO: 4552494 - DNA, 17 bp, Homo sapiens
caagcagctttttattc

SEQ ID NO: 4552495 - DNA, 17 bp, Homo sapiens
caagcaggaaatgaaaa

SEQ ID NO: 4552496 - DNA, 21 bp, Homo sapiens
caagcataccaacacgagcag

SEQ ID NO: 4552497 - DNA, 14 bp, Homo sapiens
caagcatgaataaa

SEQ ID NO: 4552498 - DNA, 22 bp, Homo sapiens
caagcattcagaagaaaaagaa

SEQ ID NO: 4552499 - DNA, 16 bp, Homo sapiens
caagccacaggaagga

SEQ ID NO: 4552500 - DNA, 15 bp, Homo sapiens
caagcccacgtcagg

SEQ ID NO: 4552501 - DNA, 17 bp, Homo sapiens
caagcccagcactgctt

SEQ ID NO: 4552502 - DNA, 14 bp, Homo sapiens
caagccccatttcc

SEQ ID NO: 4552503 - DNA, 21 bp, Homo sapiens
caagccctcctccccagagct

SEQ ID NO: 4552504 - DNA, 16 bp, Homo sapiens
caagccctgcccacag

SEQ ID NO: 4552505 - DNA, 17 bp, Homo sapiens
caagccctgcccacaga

SEQ ID NO: 4552506 - DNA, 23 bp, Homo sapiens
caagcctatggagtgaaattatt

SEQ ID NO: 4552507 - DNA, 18 bp, Homo sapiens
caagcctcactattactt

SEQ ID NO: 4552508 - DNA, 14 bp, Homo sapiens
caagcctgagaact

SEQ ID NO: 4552509 - DNA, 15 bp, Homo sapiens
caagcctgcctccca

SEQ ID NO: 4552510 - DNA, 20 bp, Homo sapiens
caagcctgctggctgcggcc

SEQ ID NO: 4552511 - DNA, 18 bp, Homo sapiens
caagcctgtaatcccagc

SEQ ID NO: 4552512 - DNA, 21 bp, Homo sapiens
caagcctgtaatcccagctac

SEQ ID NO: 4552513 - DNA, 17 bp, Homo sapiens
caagccttggctctacc

SEQ ID NO: 4552514 - DNA, 14 bp, Homo sapiens
caagcgttcctggc

SEQ ID NO: 4552515 - DNA, 13 bp, Homo sapiens
caagctaacctta

SEQ ID NO: 4552516 - DNA, 16 bp, Homo sapiens
caagctaatctgcctg

SEQ ID NO: 4552517 - DNA, 18 bp, Homo sapiens
caagctagaacctggagg

SEQ ID NO: 4552518 - DNA, 22 bp, Homo sapiens
caagctagccagagggtgggag

SEQ ID NO: 4552519 - DNA, 16 bp, Homo sapiens
caagctcacagttcct

SEQ ID NO: 4552520 - DNA, 19 bp, Homo sapiens
caagctcacagttcctcgc

SEQ ID NO: 4552521 - DNA, 20 bp, Homo sapiens
caagctcacagttcctcgcc

SEQ ID NO: 4552522 - DNA, 21 bp, Homo sapiens
caagctgaaattttagaaata

SEQ ID NO: 4552523 - DNA, 13 bp, Homo sapiens
caagctgcactgt

SEQ ID NO: 4552524 - DNA, 14 bp, Homo sapiens
caagctgcccagcc

SEQ ID NO: 4552525 - DNA, 12 bp, Homo sapiens
caagctgggccc

SEQ ID NO: 4552526 - DNA, 18 bp, Homo sapiens
caagctgggccccagccc

SEQ ID NO: 4552527 - DNA, 23 bp, Homo sapiens
caagctgtataaacagaactcca

SEQ ID NO: 4552528 - DNA, 14 bp, Homo sapiens
caagcttaaagctt

SEQ ID NO: 4552529 - DNA, 21 bp, Homo sapiens
caagcttccatagctgctgcc

SEQ ID NO: 4552530 - DNA, 20 bp, Homo sapiens
caagctttgatttagattga

SEQ ID NO: 4552531 - DNA, 12 bp, Homo sapiens
caagctttggtt

SEQ ID NO: 4552532 - DNA, 14 bp, Homo sapiens
caagcttttgctca

SEQ ID NO: 4552533 - DNA, 15 bp, Homo sapiens
caagcttttgcttga

SEQ ID NO: 4552534 - DNA, 12 bp, Homo sapiens
caaggaaaaaga

SEQ ID NO: 4552535 - DNA, 19 bp, Homo sapiens
caaggaaaggctcatttaa

SEQ ID NO: 4552536 - DNA, 17 bp, Homo sapiens
caaggaagggatgtatt

SEQ ID NO: 4552537 - DNA, 12 bp, Homo sapiens
caaggaagtcaa

SEQ ID NO: 4552538 - DNA, 16 bp, Homo sapiens
caaggaataaatgaga

SEQ ID NO: 4552539 - DNA, 20 bp, Homo sapiens
caaggaataaatgagaggga

SEQ ID NO: 4552540 - DNA, 21 bp, Homo sapiens
caaggaatttcttaacttctt

SEQ ID NO: 4552541 - DNA, 13 bp, Homo sapiens
caaggaccaggac

SEQ ID NO: 4552542 - DNA, 17 bp, Homo sapiens
caaggacccaggcgctg

SEQ ID NO: 4552543 - DNA, 18 bp, Homo sapiens
caaggaggggctgtaaaa

SEQ ID NO: 4552544 - DNA, 17 bp, Homo sapiens
caaggatagaagtatac

SEQ ID NO: 4552545 - DNA, 22 bp, Homo sapiens
caaggatcggactctgcccctg

SEQ ID NO: 4552546 - DNA, 22 bp, Homo sapiens
caaggattctgttctgcaactc

SEQ ID NO: 4552547 - DNA, 17 bp, Homo sapiens
caaggcaccttcttaaa

SEQ ID NO: 4552548 - DNA, 21 bp, Homo sapiens
caaggcaggaaacaaaagatt

SEQ ID NO: 4552549 - DNA, 18 bp, Homo sapiens
caaggccacagggagctc

SEQ ID NO: 4552550 - DNA, 17 bp, Homo sapiens
caaggccagagtggcct

SEQ ID NO: 4552551 - DNA, 22 bp, Homo sapiens
caaggccgctgttcacccacag

SEQ ID NO: 4552552 - DNA, 20 bp, Homo sapiens
caaggcctaccccagttcct

SEQ ID NO: 4552553 - DNA, 18 bp, Homo sapiens
caaggccttcccctggca

SEQ ID NO: 4552554 - DNA, 14 bp, Homo sapiens
caaggcggcccctc

SEQ ID NO: 4552555 - DNA, 15 bp, Homo sapiens
caaggcggcccctcc

SEQ ID NO: 4552556 - DNA, 16 bp, Homo sapiens
caaggcggcccctccc

SEQ ID NO: 4552557 - DNA, 14 bp, Homo sapiens
caaggctctcccct

SEQ ID NO: 4552558 - DNA, 17 bp, Homo sapiens
caaggctctcccctctc

SEQ ID NO: 4552559 - DNA, 12 bp, Homo sapiens
caagggaaaggg

SEQ ID NO: 4552560 - DNA, 20 bp, Homo sapiens
caagggaaaggggtgctttt

SEQ ID NO: 4552561 - DNA, 17 bp, Homo sapiens
caagggaagagccttta

SEQ ID NO: 4552562 - DNA, 19 bp, Homo sapiens
caagggcaaaaagtctaca

SEQ ID NO: 4552563 - DNA, 15 bp, Homo sapiens
caaggggactaaagt

SEQ ID NO: 4552564 - DNA, 21 bp, Homo sapiens
caaggggatttttatgtctgg

SEQ ID NO: 4552565 - DNA, 15 bp, Homo sapiens
caagggtcctcaccc

SEQ ID NO: 4552566 - DNA, 16 bp, Homo sapiens
caagggtctagggaga

SEQ ID NO: 4552567 - DNA, 20 bp, Homo sapiens
caagggttggaggcaatgtg

SEQ ID NO: 4552568 - DNA, 17 bp, Homo sapiens
caagggttttccaggtg

SEQ ID NO: 4552569 - DNA, 13 bp, Homo sapiens
caaggtaaacttc

SEQ ID NO: 4552570 - DNA, 18 bp, Homo sapiens
caaggtacaactgtattt

SEQ ID NO: 4552571 - DNA, 14 bp, Homo sapiens
caaggtactctggt

SEQ ID NO: 4552572 - DNA, 14 bp, Homo sapiens
caaggtaggctgca

SEQ ID NO: 4552573 - DNA, 20 bp, Homo sapiens
caaggtaggctgcaaaatta

SEQ ID NO: 4552574 - DNA, 13 bp, Homo sapiens
caaggtcagggag

SEQ ID NO: 4552575 - DNA, 22 bp, Homo sapiens
caaggtcagggaggggcaacca

SEQ ID NO: 4552576 - DNA, 14 bp, Homo sapiens
caaggtcatgaagg

SEQ ID NO: 4552577 - DNA, 23 bp, Homo sapiens
caaggtccatggagtacggctgg

SEQ ID NO: 4552578 - DNA, 15 bp, Homo sapiens
caaggtcctctcagt

SEQ ID NO: 4552579 - DNA, 15 bp, Homo sapiens
caaggtctgagccac

SEQ ID NO: 4552580 - DNA, 20 bp, Homo sapiens
caaggtctgagccacagcag

SEQ ID NO: 4552581 - DNA, 15 bp, Homo sapiens
caaggtgatttcaga

SEQ ID NO: 4552582 - DNA, 23 bp, Homo sapiens
caaggtgatttcagactgcagag

SEQ ID NO: 4552583 - DNA, 12 bp, Homo sapiens
caaggtggcaga

SEQ ID NO: 4552584 - DNA, 16 bp, Homo sapiens
caaggtgtgctctgag

SEQ ID NO: 4552585 - DNA, 21 bp, Homo sapiens
caaggttataattttttttaa

SEQ ID NO: 4552586 - DNA, 13 bp, Homo sapiens
caagtaaaatgtt

SEQ ID NO: 4552587 - DNA, 14 bp, Homo sapiens
caagtaaaatgttt

SEQ ID NO: 4552588 - DNA, 14 bp, Homo sapiens
caagtaatttcagt

SEQ ID NO: 4552589 - DNA, 20 bp, Homo sapiens
caagtacagcggctcccctc

SEQ ID NO: 4552590 - DNA, 20 bp, Homo sapiens
caagtaccaccaagggatct

SEQ ID NO: 4552591 - DNA, 17 bp, Homo sapiens
caagtatataatttact

SEQ ID NO: 4552592 - DNA, 20 bp, Homo sapiens
caagtatatcagctactgta

SEQ ID NO: 4552593 - DNA, 16 bp, Homo sapiens
caagtatccaattcag

SEQ ID NO: 4552594 - DNA, 19 bp, Homo sapiens
caagtattactaaattgac

SEQ ID NO: 4552595 - DNA, 22 bp, Homo sapiens
caagtatttgttaatttagaaa

SEQ ID NO: 4552596 - DNA, 13 bp, Homo sapiens
caagtatttttat

SEQ ID NO: 4552597 - DNA, 21 bp, Homo sapiens
caagtatttttatttaaatta

SEQ ID NO: 4552598 - DNA, 21 bp, Homo sapiens
caagtcaggaatcattaattt

SEQ ID NO: 4552599 - DNA, 17 bp, Homo sapiens
caagtcatttttgtatt

SEQ ID NO: 4552600 - DNA, 19 bp, Homo sapiens
caagtcatttttgtatttt

SEQ ID NO: 4552601 - DNA, 14 bp, Homo sapiens
caagtccaagcata

SEQ ID NO: 4552602 - DNA, 22 bp, Homo sapiens
caagtcccaccctcttcccatg

SEQ ID NO: 4552603 - DNA, 14 bp, Homo sapiens
caagtctcagaaga

SEQ ID NO: 4552604 - DNA, 16 bp, Homo sapiens
caagtctcagtggctt

SEQ ID NO: 4552605 - DNA, 23 bp, Homo sapiens
caagtctcagtggcttcatctgt

SEQ ID NO: 4552606 - DNA, 11 bp, Homo sapiens
caagtctggca

SEQ ID NO: 4552607 - DNA, 12 bp, Homo sapiens
caagtgccaaac

SEQ ID NO: 4552608 - DNA, 18 bp, Homo sapiens
caagtgccaaacagagta

SEQ ID NO: 4552609 - DNA, 20 bp, Homo sapiens
caagtgcctagactgttact

SEQ ID NO: 4552610 - DNA, 14 bp, Homo sapiens
caagtgcctgcacc

SEQ ID NO: 4552611 - DNA, 21 bp, Homo sapiens
caagtgctgcacaaaagcaga

SEQ ID NO: 4552612 - DNA, 13 bp, Homo sapiens
caagtgctggccc

SEQ ID NO: 4552613 - DNA, 15 bp, Homo sapiens
caagtgcttcctaca

SEQ ID NO: 4552614 - DNA, 17 bp, Homo sapiens
caagtgggatctgtcac

SEQ ID NO: 4552615 - DNA, 14 bp, Homo sapiens
caagtgggggcaga

SEQ ID NO: 4552616 - DNA, 13 bp, Homo sapiens
caagtggtgccta

SEQ ID NO: 4552617 - DNA, 15 bp, Homo sapiens
caagtgtaaaatatt

SEQ ID NO: 4552618 - DNA, 22 bp, Homo sapiens
caagtgtgtgccaccatgcctc

SEQ ID NO: 4552619 - DNA, 22 bp, Homo sapiens
caagttcaagctctaaattgat

SEQ ID NO: 4552620 - DNA, 17 bp, Homo sapiens
caagttcatgcagctgt

SEQ ID NO: 4552621 - DNA, 13 bp, Homo sapiens
caagttgctctga

SEQ ID NO: 4552622 - DNA, 23 bp, Homo sapiens
caagttgctctgacctcctctgg

SEQ ID NO: 4552623 - DNA, 15 bp, Homo sapiens
caagttgtaaataat

SEQ ID NO: 4552624 - DNA, 13 bp, Homo sapiens
caagttgtgcttg

SEQ ID NO: 4552625 - DNA, 22 bp, Homo sapiens
caagttgttgactgtgattaga

SEQ ID NO: 4552626 - DNA, 18 bp, Homo sapiens
caagtttgcaaacctgca

SEQ ID NO: 4552627 - DNA, 22 bp, Homo sapiens
caagttttaaacccaaaatata

SEQ ID NO: 4552628 - DNA, 14 bp, Homo sapiens
caagttttagttaa

SEQ ID NO: 4552629 - DNA, 13 bp, Homo sapiens
caagtttttatag

SEQ ID NO: 4552630 - DNA, 21 bp, Homo sapiens
caagtttttatagttattaaa

SEQ ID NO: 4552631 - DNA, 14 bp, Homo sapiens
caagtttttcatac

SEQ ID NO: 4552632 - DNA, 18 bp, Homo sapiens
caagtttttcatactgta

SEQ ID NO: 4552633 - DNA, 19 bp, Homo sapiens
caagtttttcatactgtac

SEQ ID NO: 4552634 - DNA, 22 bp, Homo sapiens
caagtttttcatactgtacaca

SEQ ID NO: 4552635 - DNA, 13 bp, Homo sapiens
caataaaaatgtt

SEQ ID NO: 4552636 - DNA, 15 bp, Homo sapiens
caataaaacaaataa

SEQ ID NO: 4552637 - DNA, 22 bp, Homo sapiens
caataaaagcaattccaacctt

SEQ ID NO: 4552638 - DNA, 20 bp, Homo sapiens
caataaaccacaagcatctc

SEQ ID NO: 4552639 - DNA, 13 bp, Homo sapiens
caataaaccagtg

SEQ ID NO: 4552640 - DNA, 16 bp, Homo sapiens
caataaaccagtgtga

SEQ ID NO: 4552641 - DNA, 17 bp, Homo sapiens
caataaaccctccttgg

SEQ ID NO: 4552642 - DNA, 12 bp, Homo sapiens
caataaagaatt

SEQ ID NO: 4552643 - DNA, 11 bp, Homo sapiens
caataaaggca

SEQ ID NO: 4552644 - DNA, 15 bp, Homo sapiens
caataaaggcagctg

SEQ ID NO: 4552645 - DNA, 16 bp, Homo sapiens
caataaaggcagctgc

SEQ ID NO: 4552646 - DNA, 22 bp, Homo sapiens
caataaaggcagctgcctctgc

SEQ ID NO: 4552647 - DNA, 19 bp, Homo sapiens
caataaagggagaatggtg

SEQ ID NO: 4552648 - DNA, 16 bp, Homo sapiens
caataaagtgccttct

SEQ ID NO: 4552649 - DNA, 22 bp, Homo sapiens
caataaagtgccttctgggctt

SEQ ID NO: 4552650 - DNA, 18 bp, Homo sapiens
caataaagttattcagaa

SEQ ID NO: 4552651 - DNA, 14 bp, Homo sapiens
caataaatctttca

SEQ ID NO: 4552652 - DNA, 15 bp, Homo sapiens
caataaatctttcaa

SEQ ID NO: 4552653 - DNA, 20 bp, Homo sapiens
caataaattgctaatgttgc

SEQ ID NO: 4552654 - DNA, 21 bp, Homo sapiens
caataacagatggtgctgcta

SEQ ID NO: 4552655 - DNA, 23 bp, Homo sapiens
caataacgtttaagccaaaacaa

SEQ ID NO: 4552656 - DNA, 21 bp, Homo sapiens
caataagaattactttgtgtt

SEQ ID NO: 4552657 - DNA, 14 bp, Homo sapiens
caataatatatttt

SEQ ID NO: 4552658 - DNA, 17 bp, Homo sapiens
caataatatattttctg

SEQ ID NO: 4552659 - DNA, 19 bp, Homo sapiens
caataatatttcaagtgcc

SEQ ID NO: 4552660 - DNA, 20 bp, Homo sapiens
caataatatttcaagtgcct

SEQ ID NO: 4552661 - DNA, 11 bp, Homo sapiens
caataatgcag

SEQ ID NO: 4552662 - DNA, 17 bp, Homo sapiens
caataatgcagtatggt

SEQ ID NO: 4552663 - DNA, 15 bp, Homo sapiens
caataattgaagtgt

SEQ ID NO: 4552664 - DNA, 23 bp, Homo sapiens
caatacaaattgaggacttaatt

SEQ ID NO: 4552665 - DNA, 12 bp, Homo sapiens
caatacaatgta

SEQ ID NO: 4552666 - DNA, 16 bp, Homo sapiens
caatacaatgtacaat

SEQ ID NO: 4552667 - DNA, 21 bp, Homo sapiens
caatacaatgtacaattatgt

SEQ ID NO: 4552668 - DNA, 13 bp, Homo sapiens
caatacagggagg

SEQ ID NO: 4552669 - DNA, 15 bp, Homo sapiens
caatacatgagaaag

SEQ ID NO: 4552670 - DNA, 17 bp, Homo sapiens
caatagcactttcattg

SEQ ID NO: 4552671 - DNA, 20 bp, Homo sapiens
caatagcactttcattgcca

SEQ ID NO: 4552672 - DNA, 18 bp, Homo sapiens
caatagcgtgtgtagata

SEQ ID NO: 4552673 - DNA, 16 bp, Homo sapiens
caatagggctaaatgt

SEQ ID NO: 4552674 - DNA, 17 bp, Homo sapiens
caatagggctaaatgtt

SEQ ID NO: 4552675 - DNA, 19 bp, Homo sapiens
caataggtctttctctcag

SEQ ID NO: 4552676 - DNA, 20 bp, Homo sapiens
caatagtatacattttataa

SEQ ID NO: 4552677 - DNA, 22 bp, Homo sapiens
caatagtatttctcctttgcaa

SEQ ID NO: 4552678 - DNA, 14 bp, Homo sapiens
caatagtgtcatcc

SEQ ID NO: 4552679 - DNA, 20 bp, Homo sapiens
caatagtgtcctatgcaata

SEQ ID NO: 4552680 - DNA, 20 bp, Homo sapiens
caatatagaaaaataaaaat

SEQ ID NO: 4552681 - DNA, 22 bp, Homo sapiens
caatatagaaaaataaaaatct

SEQ ID NO: 4552682 - DNA, 17 bp, Homo sapiens
caatatcagctttgata

SEQ ID NO: 4552683 - DNA, 17 bp, Homo sapiens
caatatccattctgtag

SEQ ID NO: 4552684 - DNA, 21 bp, Homo sapiens
caatatcttttttttaataaa

SEQ ID NO: 4552685 - DNA, 11 bp, Homo sapiens
caatatgcaag

SEQ ID NO: 4552686 - DNA, 20 bp, Homo sapiens
caatatgcaagcagcttttt

SEQ ID NO: 4552687 - DNA, 13 bp, Homo sapiens
caatatgggagga

SEQ ID NO: 4552688 - DNA, 12 bp, Homo sapiens
caatatgtgcca

SEQ ID NO: 4552689 - DNA, 15 bp, Homo sapiens
caatattaaatctgc

SEQ ID NO: 4552690 - DNA, 21 bp, Homo sapiens
caatattactttgtcttttca

SEQ ID NO: 4552691 - DNA, 22 bp, Homo sapiens
caatattactttgtcttttcaa

SEQ ID NO: 4552692 - DNA, 23 bp, Homo sapiens
caatattactttgtcttttcaat

SEQ ID NO: 4552693 - DNA, 14 bp, Homo sapiens
caatattcagtggt

SEQ ID NO: 4552694 - DNA, 21 bp, Homo sapiens
caatattgaatttttcctatg

SEQ ID NO: 4552695 - DNA, 12 bp, Homo sapiens
caatattgtata

SEQ ID NO: 4552696 - DNA, 14 bp, Homo sapiens
caatatttttagat

SEQ ID NO: 4552697 - DNA, 20 bp, Homo sapiens
caatatttttatatcatgca

SEQ ID NO: 4552698 - DNA, 19 bp, Homo sapiens
caatcagaacttcaggtgt

SEQ ID NO: 4552699 - DNA, 17 bp, Homo sapiens
caatcattgttttgaat

SEQ ID NO: 4552700 - DNA, 12 bp, Homo sapiens
caatcatttcct

SEQ ID NO: 4552701 - DNA, 15 bp, Homo sapiens
caatccacctgcctt

SEQ ID NO: 4552702 - DNA, 23 bp, Homo sapiens
caatccaccttcaggccccgccc

SEQ ID NO: 4552703 - DNA, 16 bp, Homo sapiens
caatccaggctgttct

SEQ ID NO: 4552704 - DNA, 22 bp, Homo sapiens
caatccaggctgttctcagcgt

SEQ ID NO: 4552705 - DNA, 21 bp, Homo sapiens
caatcctaatttctcctccct

SEQ ID NO: 4552706 - DNA, 13 bp, Homo sapiens
caatcctcctgcc

SEQ ID NO: 4552707 - DNA, 16 bp, Homo sapiens
caatcctcctgcctca

SEQ ID NO: 4552708 - DNA, 16 bp, Homo sapiens
caatcggactgccaaa

SEQ ID NO: 4552709 - DNA, 16 bp, Homo sapiens
caatcgttctgctggc

SEQ ID NO: 4552710 - DNA, 17 bp, Homo sapiens
caatctaacaataatat

SEQ ID NO: 4552711 - DNA, 21 bp, Homo sapiens
caatctaacaataatatttca

SEQ ID NO: 4552712 - DNA, 14 bp, Homo sapiens
caatctactggaaa

SEQ ID NO: 4552713 - DNA, 21 bp, Homo sapiens
caatctatttaaaaaactgta

SEQ ID NO: 4552714 - DNA, 15 bp, Homo sapiens
caatctcttcattat

SEQ ID NO: 4552715 - DNA, 22 bp, Homo sapiens
caatctcttcattattctctgc

SEQ ID NO: 4552716 - DNA, 12 bp, Homo sapiens
caatctgtaaac

SEQ ID NO: 4552717 - DNA, 16 bp, Homo sapiens
caatctgtaaactgtg

SEQ ID NO: 4552718 - DNA, 22 bp, Homo sapiens
caatctgtcacataaaagtctg

SEQ ID NO: 4552719 - DNA, 23 bp, Homo sapiens
caatctgtgaagcctttatctat

SEQ ID NO: 4552720 - DNA, 21 bp, Homo sapiens
caatcttctacttttaactaa

SEQ ID NO: 4552721 - DNA, 18 bp, Homo sapiens
caatcttggagctgcttg

SEQ ID NO: 4552722 - DNA, 14 bp, Homo sapiens
caatcttgttactg

SEQ ID NO: 4552723 - DNA, 15 bp, Homo sapiens
caatcttgtttatag

SEQ ID NO: 4552724 - DNA, 16 bp, Homo sapiens
caatcttgtttatagc

SEQ ID NO: 4552725 - DNA, 22 bp, Homo sapiens
caatctttcatgtcttgtcata

SEQ ID NO: 4552726 - DNA, 15 bp, Homo sapiens
caatctttgaaataa

SEQ ID NO: 4552727 - DNA, 13 bp, Homo sapiens
caatgaaaacaaa

SEQ ID NO: 4552728 - DNA, 14 bp, Homo sapiens
caatgaaaacatgt

SEQ ID NO: 4552729 - DNA, 16 bp, Homo sapiens
caatgaaaacatgtac

SEQ ID NO: 4552730 - DNA, 16 bp, Homo sapiens
caatgaaaactctttg

SEQ ID NO: 4552731 - DNA, 20 bp, Homo sapiens
caatgaaaagtcgttttcca

SEQ ID NO: 4552732 - DNA, 18 bp, Homo sapiens
caatgaaaattttaagaa

SEQ ID NO: 4552733 - DNA, 15 bp, Homo sapiens
caatgaaacaacaga

SEQ ID NO: 4552734 - DNA, 21 bp, Homo sapiens
caatgaaatgaattaaagtgg

SEQ ID NO: 4552735 - DNA, 13 bp, Homo sapiens
caatgaacatctc

SEQ ID NO: 4552736 - DNA, 20 bp, Homo sapiens
caatgaaggaaataaaaaag

SEQ ID NO: 4552737 - DNA, 17 bp, Homo sapiens
caatgaatatactcatt

SEQ ID NO: 4552738 - DNA, 22 bp, Homo sapiens
caatgaatgaatgaatggctaa

SEQ ID NO: 4552739 - DNA, 20 bp, Homo sapiens
caatgacacccatgccagag

SEQ ID NO: 4552740 - DNA, 14 bp, Homo sapiens
caatgactgagcag

SEQ ID NO: 4552741 - DNA, 21 bp, Homo sapiens
caatgagactctagggtccag

SEQ ID NO: 4552742 - DNA, 19 bp, Homo sapiens
caatgagatcattgtgaag

SEQ ID NO: 4552743 - DNA, 23 bp, Homo sapiens
caatgatacccaacagtttattt

SEQ ID NO: 4552744 - DNA, 14 bp, Homo sapiens
caatgatgaatgag

SEQ ID NO: 4552745 - DNA, 17 bp, Homo sapiens
caatgcacctaaagaaa

SEQ ID NO: 4552746 - DNA, 18 bp, Homo sapiens
caatgcacctaaagaaaa

SEQ ID NO: 4552747 - DNA, 16 bp, Homo sapiens
caatgcctataaaatg

SEQ ID NO: 4552748 - DNA, 15 bp, Homo sapiens
caatgccttgttgta

SEQ ID NO: 4552749 - DNA, 14 bp, Homo sapiens
caatgcctttttag

SEQ ID NO: 4552750 - DNA, 17 bp, Homo sapiens
caatgcctttttagatg

SEQ ID NO: 4552751 - DNA, 22 bp, Homo sapiens
caatgcctttttagatgtattt

SEQ ID NO: 4552752 - DNA, 14 bp, Homo sapiens
caatgcgtgttgta

SEQ ID NO: 4552753 - DNA, 22 bp, Homo sapiens
caatgctagcacaatattccta

SEQ ID NO: 4552754 - DNA, 17 bp, Homo sapiens
caatggaagatttgccc

SEQ ID NO: 4552755 - DNA, 12 bp, Homo sapiens
caatggccagag

SEQ ID NO: 4552756 - DNA, 14 bp, Homo sapiens
caatggccagagcc

SEQ ID NO: 4552757 - DNA, 17 bp, Homo sapiens
caatggccagagcctct

SEQ ID NO: 4552758 - DNA, 19 bp, Homo sapiens
caatggccagagcctctgg

SEQ ID NO: 4552759 - DNA, 23 bp, Homo sapiens
caatgggctttcccccaactcag

SEQ ID NO: 4552760 - DNA, 20 bp, Homo sapiens
caatggggctggttttgctt

SEQ ID NO: 4552761 - DNA, 16 bp, Homo sapiens
caatggtcctgacttt

SEQ ID NO: 4552762 - DNA, 15 bp, Homo sapiens
caatggttcaagtct

SEQ ID NO: 4552763 - DNA, 17 bp, Homo sapiens
caatggtttttaaattt

SEQ ID NO: 4552764 - DNA, 21 bp, Homo sapiens
caatggtttttaaattttgta

SEQ ID NO: 4552765 - DNA, 23 bp, Homo sapiens
caatggtttttaaattttgtaat

SEQ ID NO: 4552766 - DNA, 14 bp, Homo sapiens
caatgtaaaaatgg

SEQ ID NO: 4552767 - DNA, 18 bp, Homo sapiens
caatgtaattaaactgtt

SEQ ID NO: 4552768 - DNA, 18 bp, Homo sapiens
caatgtacaattatgtct

SEQ ID NO: 4552769 - DNA, 22 bp, Homo sapiens
caatgtacaattatgtctcttg

SEQ ID NO: 4552770 - DNA, 17 bp, Homo sapiens
caatgtacttgtttgaa

SEQ ID NO: 4552771 - DNA, 17 bp, Homo sapiens
caatgtagaaagctttg

SEQ ID NO: 4552772 - DNA, 13 bp, Homo sapiens
caatgtatacaat

SEQ ID NO: 4552773 - DNA, 18 bp, Homo sapiens
caatgtatctttattaaa

SEQ ID NO: 4552774 - DNA, 19 bp, Homo sapiens
caatgtatctttattaaaa

SEQ ID NO: 4552775 - DNA, 17 bp, Homo sapiens
caatgtccagcagtctg

SEQ ID NO: 4552776 - DNA, 15 bp, Homo sapiens
caatgtctaaaaaca

SEQ ID NO: 4552777 - DNA, 11 bp, Homo sapiens
caatgtcttga

SEQ ID NO: 4552778 - DNA, 23 bp, Homo sapiens
caatgtcttgatgcatgcactgt

SEQ ID NO: 4552779 - DNA, 14 bp, Homo sapiens
caatgtgaaaaatc

SEQ ID NO: 4552780 - DNA, 19 bp, Homo sapiens
caatgtgaatcagacccta

SEQ ID NO: 4552781 - DNA, 22 bp, Homo sapiens
caatgtgacttaatgccactaa

SEQ ID NO: 4552782 - DNA, 22 bp, Homo sapiens
caatgtgattcttctaaagcac

SEQ ID NO: 4552783 - DNA, 14 bp, Homo sapiens
caatgtgccttgat

SEQ ID NO: 4552784 - DNA, 21 bp, Homo sapiens
caatgtggttgcaaggccgct

SEQ ID NO: 4552785 - DNA, 22 bp, Homo sapiens
caatgtgtctttctaagaaatc

SEQ ID NO: 4552786 - DNA, 14 bp, Homo sapiens
caatgtgtttttct

SEQ ID NO: 4552787 - DNA, 21 bp, Homo sapiens
caatgttaaacttataaccca

SEQ ID NO: 4552788 - DNA, 20 bp, Homo sapiens
caatgttccttttttgtata

SEQ ID NO: 4552789 - DNA, 14 bp, Homo sapiens
caattaaaaacctt

SEQ ID NO: 4552790 - DNA, 19 bp, Homo sapiens
caattaacatatgtcacga

SEQ ID NO: 4552791 - DNA, 15 bp, Homo sapiens
caattactttggtag

SEQ ID NO: 4552792 - DNA, 19 bp, Homo sapiens
caattagaaatattaaaga

SEQ ID NO: 4552793 - DNA, 22 bp, Homo sapiens
caattagatctaaacagttatt

SEQ ID NO: 4552794 - DNA, 15 bp, Homo sapiens
caattagatttctca

SEQ ID NO: 4552795 - DNA, 14 bp, Homo sapiens
caattattgatata

SEQ ID NO: 4552796 - DNA, 15 bp, Homo sapiens
caattattgatatat

SEQ ID NO: 4552797 - DNA, 18 bp, Homo sapiens
caattatttgcatatttt

SEQ ID NO: 4552798 - DNA, 23 bp, Homo sapiens
caattatttgcatattttgagaa

SEQ ID NO: 4552799 - DNA, 14 bp, Homo sapiens
caattccaagaaaa

SEQ ID NO: 4552800 - DNA, 15 bp, Homo sapiens
caattccaagaaaat

SEQ ID NO: 4552801 - DNA, 17 bp, Homo sapiens
caattccaagaaaatat

SEQ ID NO: 4552802 - DNA, 18 bp, Homo sapiens
caattccaagaaaatatc

SEQ ID NO: 4552803 - DNA, 10 bp, Homo sapiens
caattccaat

SEQ ID NO: 4552804 - DNA, 16 bp, Homo sapiens
caattccaatatttct

SEQ ID NO: 4552805 - DNA, 18 bp, Homo sapiens
caattcctccagagacac

SEQ ID NO: 4552806 - DNA, 23 bp, Homo sapiens
caattcctccagagacactgagc

SEQ ID NO: 4552807 - DNA, 16 bp, Homo sapiens
caattctcctgcctca

SEQ ID NO: 4552808 - DNA, 18 bp, Homo sapiens
caattctgaaatactttt

SEQ ID NO: 4552809 - DNA, 16 bp, Homo sapiens
caattctgactgtcca

SEQ ID NO: 4552810 - DNA, 14 bp, Homo sapiens
caattctgcccgct

SEQ ID NO: 4552811 - DNA, 13 bp, Homo sapiens
caattgaaagctt

SEQ ID NO: 4552812 - DNA, 21 bp, Homo sapiens
caattgaattaaattaggaat

SEQ ID NO: 4552813 - DNA, 23 bp, Homo sapiens
caattgagaaaaatatatactaa

SEQ ID NO: 4552814 - DNA, 19 bp, Homo sapiens
caattgatgtgattatttt

SEQ ID NO: 4552815 - DNA, 23 bp, Homo sapiens
caattgcacgcggagtgagtttt

SEQ ID NO: 4552816 - DNA, 13 bp, Homo sapiens
caattgctcccat

SEQ ID NO: 4552817 - DNA, 12 bp, Homo sapiens
caattggaggaa

SEQ ID NO: 4552818 - DNA, 20 bp, Homo sapiens
caattgggagctgccaagag

SEQ ID NO: 4552819 - DNA, 15 bp, Homo sapiens
caattgtcacttttt

SEQ ID NO: 4552820 - DNA, 23 bp, Homo sapiens
caatttaagtgttggaaaaaatt

SEQ ID NO: 4552821 - DNA, 20 bp, Homo sapiens
caatttatccattcaatcat

SEQ ID NO: 4552822 - DNA, 14 bp, Homo sapiens
caatttatgaattg

SEQ ID NO: 4552823 - DNA, 12 bp, Homo sapiens
caatttcctggc

SEQ ID NO: 4552824 - DNA, 13 bp, Homo sapiens
caatttcctggcc

SEQ ID NO: 4552825 - DNA, 14 bp, Homo sapiens
caatttcctggccc

SEQ ID NO: 4552826 - DNA, 13 bp, Homo sapiens
caatttcggattt

SEQ ID NO: 4552827 - DNA, 17 bp, Homo sapiens
caatttctaatgtttac

SEQ ID NO: 4552828 - DNA, 16 bp, Homo sapiens
caatttctactttgaa

SEQ ID NO: 4552829 - DNA, 21 bp, Homo sapiens
caatttctactttgaagtcat

SEQ ID NO: 4552830 - DNA, 15 bp, Homo sapiens
caatttctgtacatt

SEQ ID NO: 4552831 - DNA, 24 bp, Homo sapiens
caatttgaagtaacttatttgact

SEQ ID NO: 4552832 - DNA, 20 bp, Homo sapiens
caatttggagcattaactaa

SEQ ID NO: 4552833 - DNA, 13 bp, Homo sapiens
caatttgtaaata

SEQ ID NO: 4552834 - DNA, 16 bp, Homo sapiens
caatttgtttgtgttc

SEQ ID NO: 4552835 - DNA, 20 bp, Homo sapiens
caatttgtttttgcattttt

SEQ ID NO: 4552836 - DNA, 22 bp, Homo sapiens
caatttgtttttgcatttttgt

SEQ ID NO: 4552837 - DNA, 12 bp, Homo sapiens
caattttaaagt

SEQ ID NO: 4552838 - DNA, 19 bp, Homo sapiens
caattttaaagttcttatt

SEQ ID NO: 4552839 - DNA, 18 bp, Homo sapiens
caattttaatttagtaaa

SEQ ID NO: 4552840 - DNA, 17 bp, Homo sapiens
caattttagtgtattaa

SEQ ID NO: 4552841 - DNA, 20 bp, Homo sapiens
caattttagtgtattaatca

SEQ ID NO: 4552842 - DNA, 22 bp, Homo sapiens
caattttagtgtattaatcata

SEQ ID NO: 4552843 - DNA, 13 bp, Homo sapiens
caattttctgtaa

SEQ ID NO: 4552844 - DNA, 18 bp, Homo sapiens
caatttttatttctttta

SEQ ID NO: 4552845 - DNA, 22 bp, Homo sapiens
caatttttcttatttcatttct

SEQ ID NO: 4552846 - DNA, 15 bp, Homo sapiens
caatttttttttcaa

SEQ ID NO: 4552847 - DNA, 22 bp, Homo sapiens
cacaaaaaggcaaatattgaag

SEQ ID NO: 4552848 - DNA, 22 bp, Homo sapiens
cacaaaataaccaatcctggac

SEQ ID NO: 4552849 - DNA, 13 bp, Homo sapiens
cacaaaattcaaa

SEQ ID NO: 4552850 - DNA, 15 bp, Homo sapiens
cacaaactgaatgac

SEQ ID NO: 4552851 - DNA, 12 bp, Homo sapiens
cacaaactgtaa

SEQ ID NO: 4552852 - DNA, 13 bp, Homo sapiens
cacaaactgtgaa

SEQ ID NO: 4552853 - DNA, 21 bp, Homo sapiens
cacaaacttgtgagcatcaga

SEQ ID NO: 4552854 - DNA, 19 bp, Homo sapiens
cacaaagaaaattcctata

SEQ ID NO: 4552855 - DNA, 15 bp, Homo sapiens
cacaaagagatattt

SEQ ID NO: 4552856 - DNA, 19 bp, Homo sapiens
cacaaagctttcttttcta

SEQ ID NO: 4552857 - DNA, 19 bp, Homo sapiens
cacaaaggctgacattcac

SEQ ID NO: 4552858 - DNA, 16 bp, Homo sapiens
cacaaagttctcagag

SEQ ID NO: 4552859 - DNA, 15 bp, Homo sapiens
cacaaatgtcattgt

SEQ ID NO: 4552860 - DNA, 16 bp, Homo sapiens
cacaaatgtcattgtc

SEQ ID NO: 4552861 - DNA, 17 bp, Homo sapiens
cacaaatgtcattgtct

SEQ ID NO: 4552862 - DNA, 17 bp, Homo sapiens
cacaaattattaatgaa

SEQ ID NO: 4552863 - DNA, 12 bp, Homo sapiens
cacaaattcagt

SEQ ID NO: 4552864 - DNA, 14 bp, Homo sapiens
cacaacatggtgct

SEQ ID NO: 4552865 - DNA, 17 bp, Homo sapiens
cacaactaacaatgcct

SEQ ID NO: 4552866 - DNA, 20 bp, Homo sapiens
cacaacttcccattaaaaat

SEQ ID NO: 4552867 - DNA, 20 bp, Homo sapiens
cacaacttgtttttggtttt

SEQ ID NO: 4552868 - DNA, 20 bp, Homo sapiens
cacaagaaatgaaagcaggg

SEQ ID NO: 4552869 - DNA, 21 bp, Homo sapiens
cacaagaaatgaaagcaggga

SEQ ID NO: 4552870 - DNA, 23 bp, Homo sapiens
cacaagaaatgaaagcagggact

SEQ ID NO: 4552871 - DNA, 14 bp, Homo sapiens
cacaagattcccag

SEQ ID NO: 4552872 - DNA, 16 bp, Homo sapiens
cacaagattcccagag

SEQ ID NO: 4552873 - DNA, 12 bp, Homo sapiens
cacaagcctcct

SEQ ID NO: 4552874 - DNA, 19 bp, Homo sapiens
cacaagcctgagaactgaa

SEQ ID NO: 4552875 - DNA, 18 bp, Homo sapiens
cacaagccttactcacct

SEQ ID NO: 4552876 - DNA, 20 bp, Homo sapiens
cacaagccttactcacctct

SEQ ID NO: 4552877 - DNA, 11 bp, Homo sapiens
cacaagctgca

SEQ ID NO: 4552878 - DNA, 15 bp, Homo sapiens
cacaagctgcactgt

SEQ ID NO: 4552879 - DNA, 20 bp, Homo sapiens
cacaagctgcactgtgaacc

SEQ ID NO: 4552880 - DNA, 16 bp, Homo sapiens
cacaaggattgaaaat

SEQ ID NO: 4552881 - DNA, 19 bp, Homo sapiens
cacaagtgccgcaaattgt

SEQ ID NO: 4552882 - DNA, 13 bp, Homo sapiens
cacaataagcaaa

SEQ ID NO: 4552883 - DNA, 17 bp, Homo sapiens
cacaatggtttttaaat

SEQ ID NO: 4552884 - DNA, 22 bp, Homo sapiens
cacaatggtttttaaattttgt

SEQ ID NO: 4552885 - DNA, 19 bp, Homo sapiens
cacaattaaaccgcatgtg

SEQ ID NO: 4552886 - DNA, 17 bp, Homo sapiens
cacaattagatttctca

SEQ ID NO: 4552887 - DNA, 17 bp, Homo sapiens
cacaatttcatttccag

SEQ ID NO: 4552888 - DNA, 16 bp, Homo sapiens
cacaatttttaatggc

SEQ ID NO: 4552889 - DNA, 13 bp, Homo sapiens
cacacacagcctg

SEQ ID NO: 4552890 - DNA, 15 bp, Homo sapiens
cacacacaggagcat

SEQ ID NO: 4552891 - DNA, 14 bp, Homo sapiens
cacacaccctgagc

SEQ ID NO: 4552892 - DNA, 14 bp, Homo sapiens
cacacacctagcca

SEQ ID NO: 4552893 - DNA, 23 bp, Homo sapiens
cacacactgtgctttctattgta

SEQ ID NO: 4552894 - DNA, 20 bp, Homo sapiens
cacacagacctcgagtttct

SEQ ID NO: 4552895 - DNA, 13 bp, Homo sapiens
cacacagcagccc

SEQ ID NO: 4552896 - DNA, 20 bp, Homo sapiens
cacacagcagccccccagca

SEQ ID NO: 4552897 - DNA, 21 bp, Homo sapiens
cacacagccaggtgccttgga

SEQ ID NO: 4552898 - DNA, 12 bp, Homo sapiens
cacacaggcagg

SEQ ID NO: 4552899 - DNA, 18 bp, Homo sapiens
cacacaggcagggcctgg

SEQ ID NO: 4552900 - DNA, 19 bp, Homo sapiens
cacacaggcagggcctggc

SEQ ID NO: 4552901 - DNA, 22 bp, Homo sapiens
cacacaggcagggcctggctcc

SEQ ID NO: 4552902 - DNA, 22 bp, Homo sapiens
cacacagggcccggccacaccc

SEQ ID NO: 4552903 - DNA, 18 bp, Homo sapiens
cacacagtgttagtgctg

SEQ ID NO: 4552904 - DNA, 16 bp, Homo sapiens
cacacatcctgtcagt

SEQ ID NO: 4552905 - DNA, 14 bp, Homo sapiens
cacacattttatga

SEQ ID NO: 4552906 - DNA, 18 bp, Homo sapiens
cacaccaagcagcaacag

SEQ ID NO: 4552907 - DNA, 18 bp, Homo sapiens
cacaccactaaccatccc

SEQ ID NO: 4552908 - DNA, 23 bp, Homo sapiens
cacaccactaaccatccccaact

SEQ ID NO: 4552909 - DNA, 13 bp, Homo sapiens
cacaccagagaac

SEQ ID NO: 4552910 - DNA, 12 bp, Homo sapiens
cacaccagccat

SEQ ID NO: 4552911 - DNA, 18 bp, Homo sapiens
cacaccagggcaactctt

SEQ ID NO: 4552912 - DNA, 15 bp, Homo sapiens
cacaccataagctac

SEQ ID NO: 4552913 - DNA, 21 bp, Homo sapiens
cacaccataagctactgccat

SEQ ID NO: 4552914 - DNA, 13 bp, Homo sapiens
cacacccaggaag

SEQ ID NO: 4552915 - DNA, 19 bp, Homo sapiens
cacacccagtgggaagagt

SEQ ID NO: 4552916 - DNA, 18 bp, Homo sapiens
cacacccctctgctgcaa

SEQ ID NO: 4552917 - DNA, 17 bp, Homo sapiens
cacaccgcgtcccagct

SEQ ID NO: 4552918 - DNA, 20 bp, Homo sapiens
cacaccgcgtcccagctccc

SEQ ID NO: 4552919 - DNA, 22 bp, Homo sapiens
cacacctactagtcaccagaga

SEQ ID NO: 4552920 - DNA, 18 bp, Homo sapiens
cacacctcagttcccttg

SEQ ID NO: 4552921 - DNA, 13 bp, Homo sapiens
cacacctctgcca

SEQ ID NO: 4552922 - DNA, 16 bp, Homo sapiens
cacacctgaacttgcc

SEQ ID NO: 4552923 - DNA, 17 bp, Homo sapiens
cacacctgagccagcct

SEQ ID NO: 4552924 - DNA, 15 bp, Homo sapiens
cacacctgggcattt

SEQ ID NO: 4552925 - DNA, 22 bp, Homo sapiens
cacaccttttattgacacagaa

SEQ ID NO: 4552926 - DNA, 20 bp, Homo sapiens
cacacgatgttgtcaaggat

SEQ ID NO: 4552927 - DNA, 13 bp, Homo sapiens
cacacgccccggt

SEQ ID NO: 4552928 - DNA, 21 bp, Homo sapiens
cacacgccccggtcccccaga

SEQ ID NO: 4552929 - DNA, 18 bp, Homo sapiens
cacacgtttaatcccagc

SEQ ID NO: 4552930 - DNA, 19 bp, Homo sapiens
cacactagggactatcagg

SEQ ID NO: 4552931 - DNA, 14 bp, Homo sapiens
cacactcagccaca

SEQ ID NO: 4552932 - DNA, 21 bp, Homo sapiens
cacactcagccacaaagcccc

SEQ ID NO: 4552933 - DNA, 18 bp, Homo sapiens
cacactgatgcttagatg

SEQ ID NO: 4552934 - DNA, 19 bp, Homo sapiens
cacactgcaagagccttgg

SEQ ID NO: 4552935 - DNA, 14 bp, Homo sapiens
cacactgcacatct

SEQ ID NO: 4552936 - DNA, 13 bp, Homo sapiens
cacactggaatat

SEQ ID NO: 4552937 - DNA, 12 bp, Homo sapiens
cacactggggct

SEQ ID NO: 4552938 - DNA, 20 bp, Homo sapiens
cacactgtgctttctattgt

SEQ ID NO: 4552939 - DNA, 15 bp, Homo sapiens
cacacttatatttta

SEQ ID NO: 4552940 - DNA, 23 bp, Homo sapiens
cacacttatattttatgaacatt

SEQ ID NO: 4552941 - DNA, 18 bp, Homo sapiens
cacacttgttccagctct

SEQ ID NO: 4552942 - DNA, 18 bp, Homo sapiens
cacactttggcccagggt

SEQ ID NO: 4552943 - DNA, 15 bp, Homo sapiens
cacagaaccttcaac

SEQ ID NO: 4552944 - DNA, 19 bp, Homo sapiens
cacagaaccttcaacccag

SEQ ID NO: 4552945 - DNA, 22 bp, Homo sapiens
cacagaaccttcaacccagtgg

SEQ ID NO: 4552946 - DNA, 16 bp, Homo sapiens
cacagaacctttgtca

SEQ ID NO: 4552947 - DNA, 17 bp, Homo sapiens
cacagaacctttgtcaa

SEQ ID NO: 4552948 - DNA, 15 bp, Homo sapiens
cacagaatagtttac

SEQ ID NO: 4552949 - DNA, 20 bp, Homo sapiens
cacagacaactcacattgtt

SEQ ID NO: 4552950 - DNA, 14 bp, Homo sapiens
cacagacccaggac

SEQ ID NO: 4552951 - DNA, 16 bp, Homo sapiens
cacagaccccagctgg

SEQ ID NO: 4552952 - DNA, 17 bp, Homo sapiens
cacagaccccagctggg

SEQ ID NO: 4552953 - DNA, 14 bp, Homo sapiens
cacagactattttt

SEQ ID NO: 4552954 - DNA, 18 bp, Homo sapiens
cacagagaacctgagttc

SEQ ID NO: 4552955 - DNA, 19 bp, Homo sapiens
cacagagaggaggggacca

SEQ ID NO: 4552956 - DNA, 17 bp, Homo sapiens
cacagagattctgaact

SEQ ID NO: 4552957 - DNA, 21 bp, Homo sapiens
cacagagcaagtcctcactct

SEQ ID NO: 4552958 - DNA, 19 bp, Homo sapiens
cacagagcctgaatttgta

SEQ ID NO: 4552959 - DNA, 15 bp, Homo sapiens
cacagagcctggccc

SEQ ID NO: 4552960 - DNA, 16 bp, Homo sapiens
cacagaggagtgcagc

SEQ ID NO: 4552961 - DNA, 15 bp, Homo sapiens
cacagaggccccacc

SEQ ID NO: 4552962 - DNA, 14 bp, Homo sapiens
cacagaggcctgac

SEQ ID NO: 4552963 - DNA, 15 bp, Homo sapiens
cacagaggcctgact

SEQ ID NO: 4552964 - DNA, 18 bp, Homo sapiens
cacagaggcttcttcaga

SEQ ID NO: 4552965 - DNA, 15 bp, Homo sapiens
cacagagtgagactc

SEQ ID NO: 4552966 - DNA, 18 bp, Homo sapiens
cacagagtgctggactgt

SEQ ID NO: 4552967 - DNA, 22 bp, Homo sapiens
cacagataactgaaaattattt

SEQ ID NO: 4552968 - DNA, 19 bp, Homo sapiens
cacagataccttgaaagga

SEQ ID NO: 4552969 - DNA, 17 bp, Homo sapiens
cacagatatactttgtg

SEQ ID NO: 4552970 - DNA, 19 bp, Homo sapiens
cacagatatactttgtgga

SEQ ID NO: 4552971 - DNA, 23 bp, Homo sapiens
cacagatatatacacacagtgga

SEQ ID NO: 4552972 - DNA, 20 bp, Homo sapiens
cacagatattgttataaata

SEQ ID NO: 4552973 - DNA, 13 bp, Homo sapiens
cacagatgaggcc

SEQ ID NO: 4552974 - DNA, 15 bp, Homo sapiens
cacagatgaggcccc

SEQ ID NO: 4552975 - DNA, 17 bp, Homo sapiens
cacagatgaggcccccg

SEQ ID NO: 4552976 - DNA, 16 bp, Homo sapiens
cacagatgctccaggg

SEQ ID NO: 4552977 - DNA, 18 bp, Homo sapiens
cacagatgggcaaaccct

SEQ ID NO: 4552978 - DNA, 14 bp, Homo sapiens
cacagattttgaat

SEQ ID NO: 4552979 - DNA, 17 bp, Homo sapiens
cacagcaccaaaggctc

SEQ ID NO: 4552980 - DNA, 13 bp, Homo sapiens
cacagcagacacc

SEQ ID NO: 4552981 - DNA, 12 bp, Homo sapiens
cacagcagcatt

SEQ ID NO: 4552982 - DNA, 13 bp, Homo sapiens
cacagcagcattt

SEQ ID NO: 4552983 - DNA, 12 bp, Homo sapiens
cacagcagcccc

SEQ ID NO: 4552984 - DNA, 20 bp, Homo sapiens
cacagcagccccaggagaag

SEQ ID NO: 4552985 - DNA, 20 bp, Homo sapiens
cacagcagccccccagcact

SEQ ID NO: 4552986 - DNA, 13 bp, Homo sapiens
cacagcaggctgc

SEQ ID NO: 4552987 - DNA, 17 bp, Homo sapiens
cacagcaggctgccagt

SEQ ID NO: 4552988 - DNA, 22 bp, Homo sapiens
cacagcaggctgccagtgcctg

SEQ ID NO: 4552989 - DNA, 13 bp, Homo sapiens
cacagcagtgtga

SEQ ID NO: 4552990 - DNA, 23 bp, Homo sapiens
cacagcagtgtgaatagcctggc

SEQ ID NO: 4552991 - DNA, 16 bp, Homo sapiens
cacagcattgtatatg

SEQ ID NO: 4552992 - DNA, 20 bp, Homo sapiens
cacagccaacgagacacatt

SEQ ID NO: 4552993 - DNA, 16 bp, Homo sapiens
cacagccacacctgga

SEQ ID NO: 4552994 - DNA, 15 bp, Homo sapiens
cacagccacccgtgg

SEQ ID NO: 4552995 - DNA, 22 bp, Homo sapiens
cacagccacccgtggggtgctg

SEQ ID NO: 4552996 - DNA, 17 bp, Homo sapiens
cacagccagactggcac

SEQ ID NO: 4552997 - DNA, 14 bp, Homo sapiens
cacagccagaggag

SEQ ID NO: 4552998 - DNA, 18 bp, Homo sapiens
cacagcccaaaatttgat

SEQ ID NO: 4552999 - DNA, 14 bp, Homo sapiens
cacagccccatctg

SEQ ID NO: 4553000 - DNA, 16 bp, Homo sapiens
cacagcccctggagcc

SEQ ID NO: 4553001 - DNA, 14 bp, Homo sapiens
cacagcctcctctg

SEQ ID NO: 4553002 - DNA, 20 bp, Homo sapiens
cacagcctcctctgtctgcc

SEQ ID NO: 4553003 - DNA, 21 bp, Homo sapiens
cacagcctcctctgtctgccc

SEQ ID NO: 4553004 - DNA, 23 bp, Homo sapiens
cacagccttcggacagacatatg

SEQ ID NO: 4553005 - DNA, 17 bp, Homo sapiens
cacagccttgcagcggc

SEQ ID NO: 4553006 - DNA, 19 bp, Homo sapiens
cacagccttgcagcggctc

SEQ ID NO: 4553007 - DNA, 14 bp, Homo sapiens
cacagcgtccctgg

SEQ ID NO: 4553008 - DNA, 22 bp, Homo sapiens
cacagctaaccacttcgcacac

SEQ ID NO: 4553009 - DNA, 18 bp, Homo sapiens
cacagctgagcacttagc

SEQ ID NO: 4553010 - DNA, 12 bp, Homo sapiens
cacagctgctgg

SEQ ID NO: 4553011 - DNA, 13 bp, Homo sapiens
cacagctgctgga

SEQ ID NO: 4553012 - DNA, 16 bp, Homo sapiens
cacagctgctgttctc

SEQ ID NO: 4553013 - DNA, 20 bp, Homo sapiens
cacaggaagatgggaggtgg

SEQ ID NO: 4553014 - DNA, 13 bp, Homo sapiens
cacaggagggcca

SEQ ID NO: 4553015 - DNA, 15 bp, Homo sapiens
cacaggagggccagc

SEQ ID NO: 4553016 - DNA, 20 bp, Homo sapiens
cacaggcacacaggtctcat

SEQ ID NO: 4553017 - DNA, 20 bp, Homo sapiens
cacaggcagccagccgtggc

SEQ ID NO: 4553018 - DNA, 12 bp, Homo sapiens
cacaggcagggc

SEQ ID NO: 4553019 - DNA, 13 bp, Homo sapiens
cacaggcagggcc

SEQ ID NO: 4553020 - DNA, 15 bp, Homo sapiens
cacaggcagggcctg

SEQ ID NO: 4553021 - DNA, 16 bp, Homo sapiens
cacaggcagggcctgg

SEQ ID NO: 4553022 - DNA, 20 bp, Homo sapiens
cacaggcagtccaggcctct

SEQ ID NO: 4553023 - DNA, 22 bp, Homo sapiens
cacaggcatattccctgcacac

SEQ ID NO: 4553024 - DNA, 18 bp, Homo sapiens
cacaggccaaatccttgg

SEQ ID NO: 4553025 - DNA, 13 bp, Homo sapiens
cacaggcctgaga

SEQ ID NO: 4553026 - DNA, 22 bp, Homo sapiens
cacaggcctgagatttcatctg

SEQ ID NO: 4553027 - DNA, 22 bp, Homo sapiens
cacagggaagctcacacatcct

SEQ ID NO: 4553028 - DNA, 15 bp, Homo sapiens
cacagggagctccgt

SEQ ID NO: 4553029 - DNA, 19 bp, Homo sapiens
cacagggcagctgggccca

SEQ ID NO: 4553030 - DNA, 15 bp, Homo sapiens
cacagggcccggcca

SEQ ID NO: 4553031 - DNA, 13 bp, Homo sapiens
cacagggctaaga

SEQ ID NO: 4553032 - DNA, 14 bp, Homo sapiens
cacagggttgggcc

SEQ ID NO: 4553033 - DNA, 22 bp, Homo sapiens
cacagggttgggcccagatctg

SEQ ID NO: 4553034 - DNA, 23 bp, Homo sapiens
cacagggttgggcccagatctgg

SEQ ID NO: 4553035 - DNA, 13 bp, Homo sapiens
cacaggtccaagg

SEQ ID NO: 4553036 - DNA, 16 bp, Homo sapiens
cacagtaaaaataaaa

SEQ ID NO: 4553037 - DNA, 18 bp, Homo sapiens
cacagtaccggattctct

SEQ ID NO: 4553038 - DNA, 19 bp, Homo sapiens
cacagtacgaacctacagt

SEQ ID NO: 4553039 - DNA, 16 bp, Homo sapiens
cacagtagtcttgatg

SEQ ID NO: 4553040 - DNA, 19 bp, Homo sapiens
cacagtcaaggtcacttaa

SEQ ID NO: 4553041 - DNA, 19 bp, Homo sapiens
cacagtcactgatgtacaa

SEQ ID NO: 4553042 - DNA, 13 bp, Homo sapiens
cacagtcatacaa

SEQ ID NO: 4553043 - DNA, 14 bp, Homo sapiens
cacagtccagaccc

SEQ ID NO: 4553044 - DNA, 18 bp, Homo sapiens
cacagtccagacccaagt

SEQ ID NO: 4553045 - DNA, 23 bp, Homo sapiens
cacagtcttgtgaactttgaatg

SEQ ID NO: 4553046 - DNA, 20 bp, Homo sapiens
cacagtgagactgtacataa

SEQ ID NO: 4553047 - DNA, 19 bp, Homo sapiens
cacagtgatgaatgtacta

SEQ ID NO: 4553048 - DNA, 16 bp, Homo sapiens
cacagtgctcttttct

SEQ ID NO: 4553049 - DNA, 13 bp, Homo sapiens
cacagtgctgtct

SEQ ID NO: 4553050 - DNA, 20 bp, Homo sapiens
cacagtggcgggcccactca

SEQ ID NO: 4553051 - DNA, 17 bp, Homo sapiens
cacagtggctcacgcct

SEQ ID NO: 4553052 - DNA, 21 bp, Homo sapiens
cacagtgtaatccaggggtgt

SEQ ID NO: 4553053 - DNA, 14 bp, Homo sapiens
cacagtgtgagccc

SEQ ID NO: 4553054 - DNA, 21 bp, Homo sapiens
cacagtgtgtggtcaacattt

SEQ ID NO: 4553055 - DNA, 16 bp, Homo sapiens
cacagtgttagtgctg

SEQ ID NO: 4553056 - DNA, 19 bp, Homo sapiens
cacagttcctcgccctggg

SEQ ID NO: 4553057 - DNA, 14 bp, Homo sapiens
cacagttcctggga

SEQ ID NO: 4553058 - DNA, 16 bp, Homo sapiens
cacagtttagaacaga

SEQ ID NO: 4553059 - DNA, 13 bp, Homo sapiens
cacagttttaata

SEQ ID NO: 4553060 - DNA, 17 bp, Homo sapiens
cacagttttaataagaa

SEQ ID NO: 4553061 - DNA, 21 bp, Homo sapiens
cacagttttctgagaaagact

SEQ ID NO: 4553062 - DNA, 13 bp, Homo sapiens
cacataaatttta

SEQ ID NO: 4553063 - DNA, 14 bp, Homo sapiens
cacataagaaggca

SEQ ID NO: 4553064 - DNA, 15 bp, Homo sapiens
cacataagagagatg

SEQ ID NO: 4553065 - DNA, 20 bp, Homo sapiens
cacatacacccaaacactta

SEQ ID NO: 4553066 - DNA, 13 bp, Homo sapiens
cacataccaggtc

SEQ ID NO: 4553067 - DNA, 18 bp, Homo sapiens
cacatagagctttttaat

SEQ ID NO: 4553068 - DNA, 19 bp, Homo sapiens
cacatagagctttttaata

SEQ ID NO: 4553069 - DNA, 23 bp, Homo sapiens
cacatagagctttttaatagcac

SEQ ID NO: 4553070 - DNA, 16 bp, Homo sapiens
cacatagattcacctg

SEQ ID NO: 4553071 - DNA, 15 bp, Homo sapiens
cacatagccaactct

SEQ ID NO: 4553072 - DNA, 16 bp, Homo sapiens
cacatagtttttcagt

SEQ ID NO: 4553073 - DNA, 22 bp, Homo sapiens
cacatcaagactatctacaaaa

SEQ ID NO: 4553074 - DNA, 20 bp, Homo sapiens
cacatcacaagactatgcca

SEQ ID NO: 4553075 - DNA, 16 bp, Homo sapiens
cacatcacaatattca

SEQ ID NO: 4553076 - DNA, 17 bp, Homo sapiens
cacatcacaatattcag

SEQ ID NO: 4553077 - DNA, 16 bp, Homo sapiens
cacatcaggaaagaga

SEQ ID NO: 4553078 - DNA, 15 bp, Homo sapiens
cacatcccatgttga

SEQ ID NO: 4553079 - DNA, 23 bp, Homo sapiens
cacatcccattgggactccatgc

SEQ ID NO: 4553080 - DNA, 21 bp, Homo sapiens
cacatccctatagaccactgg

SEQ ID NO: 4553081 - DNA, 22 bp, Homo sapiens
cacatcctccacgttctgctca

SEQ ID NO: 4553082 - DNA, 21 bp, Homo sapiens
cacatctacatgccatgccta

SEQ ID NO: 4553083 - DNA, 13 bp, Homo sapiens
cacatctctctgc

SEQ ID NO: 4553084 - DNA, 12 bp, Homo sapiens
cacatctgtgtc

SEQ ID NO: 4553085 - DNA, 17 bp, Homo sapiens
cacatctgtgtcttgtt

SEQ ID NO: 4553086 - DNA, 23 bp, Homo sapiens
cacatctgtgtcttgtttggaat

SEQ ID NO: 4553087 - DNA, 15 bp, Homo sapiens
cacatctgttttgta

SEQ ID NO: 4553088 - DNA, 16 bp, Homo sapiens
cacatcttaaaagtgt

SEQ ID NO: 4553089 - DNA, 23 bp, Homo sapiens
cacatcttaaagctaaaaatgaa

SEQ ID NO: 4553090 - DNA, 18 bp, Homo sapiens
cacatcttttggtgatcg

SEQ ID NO: 4553091 - DNA, 20 bp, Homo sapiens
cacatgaatctgcacatctg

SEQ ID NO: 4553092 - DNA, 22 bp, Homo sapiens
cacatgataccagcagcaactg

SEQ ID NO: 4553093 - DNA, 20 bp, Homo sapiens
cacatgcatgtctgcctatg

SEQ ID NO: 4553094 - DNA, 14 bp, Homo sapiens
cacatgccacctgg

SEQ ID NO: 4553095 - DNA, 23 bp, Homo sapiens
cacatgccccttggtcctggcag

SEQ ID NO: 4553096 - DNA, 22 bp, Homo sapiens
cacatgcccttggtgacagctg

SEQ ID NO: 4553097 - DNA, 13 bp, Homo sapiens
cacatgcctctgt

SEQ ID NO: 4553098 - DNA, 15 bp, Homo sapiens
cacatgctattgtct

SEQ ID NO: 4553099 - DNA, 22 bp, Homo sapiens
cacatggagccccctctgccgg

SEQ ID NO: 4553100 - DNA, 23 bp, Homo sapiens
cacatggcccctccccctgccag

SEQ ID NO: 4553101 - DNA, 23 bp, Homo sapiens
cacatggcctgagcatccagacc

SEQ ID NO: 4553102 - DNA, 17 bp, Homo sapiens
cacatggtgtctcccaa

SEQ ID NO: 4553103 - DNA, 22 bp, Homo sapiens
cacatggtgtctcccaacatgg

SEQ ID NO: 4553104 - DNA, 15 bp, Homo sapiens
cacatgtgttatcta

SEQ ID NO: 4553105 - DNA, 18 bp, Homo sapiens
cacattcgggaccaatat

SEQ ID NO: 4553106 - DNA, 14 bp, Homo sapiens
cacattctgccttg

SEQ ID NO: 4553107 - DNA, 13 bp, Homo sapiens
cacattgcccctc

SEQ ID NO: 4553108 - DNA, 11 bp, Homo sapiens
cacattgcctt

SEQ ID NO: 4553109 - DNA, 12 bp, Homo sapiens
cacattgccttc

SEQ ID NO: 4553110 - DNA, 13 bp, Homo sapiens
cacattgccttct

SEQ ID NO: 4553111 - DNA, 15 bp, Homo sapiens
cacattgctacctca

SEQ ID NO: 4553112 - DNA, 17 bp, Homo sapiens
cacattggaccagatga

SEQ ID NO: 4553113 - DNA, 22 bp, Homo sapiens
cacatttagaaatgtttattga

SEQ ID NO: 4553114 - DNA, 12 bp, Homo sapiens
cacatttcttaa

SEQ ID NO: 4553115 - DNA, 24 bp, Homo sapiens
cacatttcttaaaacacatgatac

SEQ ID NO: 4553116 - DNA, 22 bp, Homo sapiens
cacatttgggatgttccttttt

SEQ ID NO: 4553117 - DNA, 15 bp, Homo sapiens
cacattttgtatgga

SEQ ID NO: 4553118 - DNA, 20 bp, Homo sapiens
cacatttttaagatgcatgt

SEQ ID NO: 4553119 - DNA, 18 bp, Homo sapiens
cacatttttcagatataa

SEQ ID NO: 4553120 - DNA, 23 bp, Homo sapiens
cacatttttggatttctgtgaag

SEQ ID NO: 4553121 - DNA, 14 bp, Homo sapiens
cacatttttttcta

SEQ ID NO: 4553122 - DNA, 16 bp, Homo sapiens
caccaaaggagacata

SEQ ID NO: 4553123 - DNA, 18 bp, Homo sapiens
caccaaaggagacatatc

SEQ ID NO: 4553124 - DNA, 18 bp, Homo sapiens
caccaactgaattaaact

SEQ ID NO: 4553125 - DNA, 16 bp, Homo sapiens
caccaagctaggtgct

SEQ ID NO: 4553126 - DNA, 15 bp, Homo sapiens
caccaagctcacagt

SEQ ID NO: 4553127 - DNA, 19 bp, Homo sapiens
caccaagctcacagttcct

SEQ ID NO: 4553128 - DNA, 22 bp, Homo sapiens
caccaagctgctctccttcact

SEQ ID NO: 4553129 - DNA, 14 bp, Homo sapiens
caccaagggatctg

SEQ ID NO: 4553130 - DNA, 17 bp, Homo sapiens
caccaatcagcactctg

SEQ ID NO: 4553131 - DNA, 18 bp, Homo sapiens
caccaatcagcgctctgt

SEQ ID NO: 4553132 - DNA, 22 bp, Homo sapiens
caccaatgccgccgtgtttcct

SEQ ID NO: 4553133 - DNA, 12 bp, Homo sapiens
caccacaaaata

SEQ ID NO: 4553134 - DNA, 19 bp, Homo sapiens
caccacaactaacaatgcc

SEQ ID NO: 4553135 - DNA, 14 bp, Homo sapiens
caccacacataata

SEQ ID NO: 4553136 - DNA, 20 bp, Homo sapiens
caccacatcccttcatatca

SEQ ID NO: 4553137 - DNA, 18 bp, Homo sapiens
caccacatcctccgtcca

SEQ ID NO: 4553138 - DNA, 18 bp, Homo sapiens
caccaccagggctccagg

SEQ ID NO: 4553139 - DNA, 20 bp, Homo sapiens
caccaccagggctccaggag

SEQ ID NO: 4553140 - DNA, 14 bp, Homo sapiens
caccaccatttaat

SEQ ID NO: 4553141 - DNA, 11 bp, Homo sapiens
caccacccaaa

SEQ ID NO: 4553142 - DNA, 22 bp, Homo sapiens
caccacctaggccactcctcca

SEQ ID NO: 4553143 - DNA, 15 bp, Homo sapiens
caccaccttcccagc

SEQ ID NO: 4553144 - DNA, 19 bp, Homo sapiens
caccacgatgtggccctgg

SEQ ID NO: 4553145 - DNA, 23 bp, Homo sapiens
caccacgtcgggcttccctggcc

SEQ ID NO: 4553146 - DNA, 19 bp, Homo sapiens
caccactaggaatcccaga

SEQ ID NO: 4553147 - DNA, 23 bp, Homo sapiens
caccactatctccgttccatctg

SEQ ID NO: 4553148 - DNA, 13 bp, Homo sapiens
caccactgcactc

SEQ ID NO: 4553149 - DNA, 19 bp, Homo sapiens
caccactgcactccagcct

SEQ ID NO: 4553150 - DNA, 16 bp, Homo sapiens
caccagaatttctaag

SEQ ID NO: 4553151 - DNA, 11 bp, Homo sapiens
caccagcacca

SEQ ID NO: 4553152 - DNA, 18 bp, Homo sapiens
caccagccaggctctgtg

SEQ ID NO: 4553153 - DNA, 18 bp, Homo sapiens
caccagcccccgccccag

SEQ ID NO: 4553154 - DNA, 20 bp, Homo sapiens
caccagcccccgccccagag

SEQ ID NO: 4553155 - DNA, 23 bp, Homo sapiens
caccagcccccgccccagagtgg

SEQ ID NO: 4553156 - DNA, 20 bp, Homo sapiens
caccagccctgcagcccacc

SEQ ID NO: 4553157 - DNA, 18 bp, Homo sapiens
caccagcctagcctggct

SEQ ID NO: 4553158 - DNA, 12 bp, Homo sapiens
caccagccttgc

SEQ ID NO: 4553159 - DNA, 16 bp, Homo sapiens
caccagccttgctctc

SEQ ID NO: 4553160 - DNA, 17 bp, Homo sapiens
caccagccttgctctct

SEQ ID NO: 4553161 - DNA, 18 bp, Homo sapiens
caccagccttgctctctt

SEQ ID NO: 4553162 - DNA, 19 bp, Homo sapiens
caccagccttgctctcttc

SEQ ID NO: 4553163 - DNA, 22 bp, Homo sapiens
caccagccttgctctcttcaat

SEQ ID NO: 4553164 - DNA, 21 bp, Homo sapiens
caccaggaatgttaaagtcag

SEQ ID NO: 4553165 - DNA, 23 bp, Homo sapiens
caccaggaatgttaaagtcagtg

SEQ ID NO: 4553166 - DNA, 23 bp, Homo sapiens
caccaggcacgaacccacctgct

SEQ ID NO: 4553167 - DNA, 13 bp, Homo sapiens
caccaggccagct

SEQ ID NO: 4553168 - DNA, 19 bp, Homo sapiens
caccaggccgtgccttgtt

SEQ ID NO: 4553169 - DNA, 19 bp, Homo sapiens
caccaggctggagtgcagt

SEQ ID NO: 4553170 - DNA, 20 bp, Homo sapiens
caccagggatcacagaccac

SEQ ID NO: 4553171 - DNA, 21 bp, Homo sapiens
caccagggcaactcttggaag

SEQ ID NO: 4553172 - DNA, 20 bp, Homo sapiens
caccagggctccaggagcct

SEQ ID NO: 4553173 - DNA, 21 bp, Homo sapiens
caccaggggccaacctcaggc

SEQ ID NO: 4553174 - DNA, 22 bp, Homo sapiens
caccagggtccttttgacactg

SEQ ID NO: 4553175 - DNA, 12 bp, Homo sapiens
caccagtgcctc

SEQ ID NO: 4553176 - DNA, 14 bp, Homo sapiens
caccagtgcctctc

SEQ ID NO: 4553177 - DNA, 20 bp, Homo sapiens
caccagtgggactgtggtga

SEQ ID NO: 4553178 - DNA, 14 bp, Homo sapiens
caccagtgttcctg

SEQ ID NO: 4553179 - DNA, 15 bp, Homo sapiens
caccagtgttcctga

SEQ ID NO: 4553180 - DNA, 21 bp, Homo sapiens
caccagtgttcctgaagctgc

SEQ ID NO: 4553181 - DNA, 16 bp, Homo sapiens
caccataagctactgc

SEQ ID NO: 4553182 - DNA, 20 bp, Homo sapiens
caccataagctactgccatc

SEQ ID NO: 4553183 - DNA, 22 bp, Homo sapiens
caccatgactggctaattttct

SEQ ID NO: 4553184 - DNA, 18 bp, Homo sapiens
caccatgcactgtaaata

SEQ ID NO: 4553185 - DNA, 20 bp, Homo sapiens
caccatgcactgtaaatatc

SEQ ID NO: 4553186 - DNA, 23 bp, Homo sapiens
caccatgcactgtaaatatccct

SEQ ID NO: 4553187 - DNA, 20 bp, Homo sapiens
caccatgcccagctaatttt

SEQ ID NO: 4553188 - DNA, 12 bp, Homo sapiens
caccatgctctc

SEQ ID NO: 4553189 - DNA, 15 bp, Homo sapiens
caccatgcttgcctg

SEQ ID NO: 4553190 - DNA, 16 bp, Homo sapiens
caccatgcttgcctga

SEQ ID NO: 4553191 - DNA, 20 bp, Homo sapiens
caccatgcttgcctgaagct

SEQ ID NO: 4553192 - DNA, 15 bp, Homo sapiens
caccatgtgcaataa

SEQ ID NO: 4553193 - DNA, 20 bp, Homo sapiens
caccatgttgcccaggctgg

SEQ ID NO: 4553194 - DNA, 23 bp, Homo sapiens
caccatgtttgagctcagacccc

SEQ ID NO: 4553195 - DNA, 19 bp, Homo sapiens
caccattatattttgaaag

SEQ ID NO: 4553196 - DNA, 13 bp, Homo sapiens
caccattgaaggc

SEQ ID NO: 4553197 - DNA, 14 bp, Homo sapiens
caccatttaatttc

SEQ ID NO: 4553198 - DNA, 21 bp, Homo sapiens
caccatttctgggggccgcag

SEQ ID NO: 4553199 - DNA, 18 bp, Homo sapiens
caccatttcttggcattg

SEQ ID NO: 4553200 - DNA, 20 bp, Homo sapiens
caccattttaagtccctgtc

SEQ ID NO: 4553201 - DNA, 14 bp, Homo sapiens
cacccaagccacaa

SEQ ID NO: 4553202 - DNA, 15 bp, Homo sapiens
cacccaagccacaag

SEQ ID NO: 4553203 - DNA, 18 bp, Homo sapiens
cacccaagcctgctggct

SEQ ID NO: 4553204 - DNA, 20 bp, Homo sapiens
cacccaagcctgctggctgc

SEQ ID NO: 4553205 - DNA, 15 bp, Homo sapiens
cacccacaccataag

SEQ ID NO: 4553206 - DNA, 22 bp, Homo sapiens
cacccaccaggccagctcagga

SEQ ID NO: 4553207 - DNA, 13 bp, Homo sapiens
cacccaccatgga

SEQ ID NO: 4553208 - DNA, 16 bp, Homo sapiens
cacccacccctgcaca

SEQ ID NO: 4553209 - DNA, 15 bp, Homo sapiens
cacccacctcttgtg

SEQ ID NO: 4553210 - DNA, 20 bp, Homo sapiens
cacccagacagcctgtttct

SEQ ID NO: 4553211 - DNA, 12 bp, Homo sapiens
cacccagccctg

SEQ ID NO: 4553212 - DNA, 13 bp, Homo sapiens
cacccagccctgg

SEQ ID NO: 4553213 - DNA, 11 bp, Homo sapiens
cacccaggagg

SEQ ID NO: 4553214 - DNA, 21 bp, Homo sapiens
cacccagtccatgctccaggg

SEQ ID NO: 4553215 - DNA, 16 bp, Homo sapiens
cacccagtgggaagag

SEQ ID NO: 4553216 - DNA, 13 bp, Homo sapiens
cacccatatcatg

SEQ ID NO: 4553217 - DNA, 14 bp, Homo sapiens
cacccatcagcact

SEQ ID NO: 4553218 - DNA, 18 bp, Homo sapiens
cacccatctgtctgccaa

SEQ ID NO: 4553219 - DNA, 16 bp, Homo sapiens
cacccatgccagagag

SEQ ID NO: 4553220 - DNA, 14 bp, Homo sapiens
cacccatggcctca

SEQ ID NO: 4553221 - DNA, 18 bp, Homo sapiens
cacccatggcctcagccc

SEQ ID NO: 4553222 - DNA, 24 bp, Homo sapiens
cacccatggcctcagccctgctcc

SEQ ID NO: 4553223 - DNA, 17 bp, Homo sapiens
caccccaaaccccagcc

SEQ ID NO: 4553224 - DNA, 15 bp, Homo sapiens
caccccaactctccc

SEQ ID NO: 4553225 - DNA, 15 bp, Homo sapiens
caccccacagaacct

SEQ ID NO: 4553226 - DNA, 16 bp, Homo sapiens
caccccacagaacctt

SEQ ID NO: 4553227 - DNA, 11 bp, Homo sapiens
caccccacagc

SEQ ID NO: 4553228 - DNA, 19 bp, Homo sapiens
caccccaccctccctggag

SEQ ID NO: 4553229 - DNA, 21 bp, Homo sapiens
caccccagcattccagctctg

SEQ ID NO: 4553230 - DNA, 14 bp, Homo sapiens
caccccagccctcg

SEQ ID NO: 4553231 - DNA, 17 bp, Homo sapiens
caccccaggacgccact

SEQ ID NO: 4553232 - DNA, 17 bp, Homo sapiens
caccccatgccaaagct

SEQ ID NO: 4553233 - DNA, 14 bp, Homo sapiens
cacccccaacttca

SEQ ID NO: 4553234 - DNA, 17 bp, Homo sapiens
cacccccacccccagtg

SEQ ID NO: 4553235 - DNA, 12 bp, Homo sapiens
cacccccagccc

SEQ ID NO: 4553236 - DNA, 20 bp, Homo sapiens
cacccccagccttgcccagc

SEQ ID NO: 4553237 - DNA, 24 bp, Homo sapiens
cacccccagccttgcccagctttc

SEQ ID NO: 4553238 - DNA, 13 bp, Homo sapiens
cacccccatccct

SEQ ID NO: 4553239 - DNA, 14 bp, Homo sapiens
cacccccatgctgc

SEQ ID NO: 4553240 - DNA, 13 bp, Homo sapiens
caccccccacact

SEQ ID NO: 4553241 - DNA, 17 bp, Homo sapiens
cacccccctccccaact

SEQ ID NO: 4553242 - DNA, 21 bp, Homo sapiens
cacccccctctctttctctgg

SEQ ID NO: 4553243 - DNA, 16 bp, Homo sapiens
caccccctcccacccc

SEQ ID NO: 4553244 - DNA, 17 bp, Homo sapiens
caccccctccccagggg

SEQ ID NO: 4553245 - DNA, 18 bp, Homo sapiens
caccccctccccagggga

SEQ ID NO: 4553246 - DNA, 16 bp, Homo sapiens
caccccctccccgccc

SEQ ID NO: 4553247 - DNA, 15 bp, Homo sapiens
caccccctcctcccc

SEQ ID NO: 4553248 - DNA, 13 bp, Homo sapiens
caccccctgctcc

SEQ ID NO: 4553249 - DNA, 13 bp, Homo sapiens
caccccctgtccc

SEQ ID NO: 4553250 - DNA, 14 bp, Homo sapiens
caccccctgtccca

SEQ ID NO: 4553251 - DNA, 23 bp, Homo sapiens
caccccctgtcccattctagatc

SEQ ID NO: 4553252 - DNA, 17 bp, Homo sapiens
cacccccttcagtgccc

SEQ ID NO: 4553253 - DNA, 16 bp, Homo sapiens
cacccccttctctgct

SEQ ID NO: 4553254 - DNA, 15 bp, Homo sapiens
caccccgctctgcat

SEQ ID NO: 4553255 - DNA, 18 bp, Homo sapiens
caccccgggctctctgct

SEQ ID NO: 4553256 - DNA, 23 bp, Homo sapiens
caccccgtctggggttcagcccc

SEQ ID NO: 4553257 - DNA, 15 bp, Homo sapiens
cacccctccctttct

SEQ ID NO: 4553258 - DNA, 18 bp, Homo sapiens
cacccctccctttctccc

SEQ ID NO: 4553259 - DNA, 17 bp, Homo sapiens
cacccctcgccaccttt

SEQ ID NO: 4553260 - DNA, 13 bp, Homo sapiens
cacccctctgccc

SEQ ID NO: 4553261 - DNA, 15 bp, Homo sapiens
cacccctctgcccct

SEQ ID NO: 4553262 - DNA, 16 bp, Homo sapiens
cacccctctgcccctg

SEQ ID NO: 4553263 - DNA, 15 bp, Homo sapiens
cacccctgcctccac

SEQ ID NO: 4553264 - DNA, 22 bp, Homo sapiens
cacccctgcctccaccctctga

SEQ ID NO: 4553265 - DNA, 22 bp, Homo sapiens
cacccctgggccagcggggctg

SEQ ID NO: 4553266 - DNA, 23 bp, Homo sapiens
cacccctggggctgagtctccag

SEQ ID NO: 4553267 - DNA, 17 bp, Homo sapiens
cacccctggttctcatc

SEQ ID NO: 4553268 - DNA, 18 bp, Homo sapiens
cacccctggttctcatct

SEQ ID NO: 4553269 - DNA, 12 bp, Homo sapiens
caccccttcctg

SEQ ID NO: 4553270 - DNA, 15 bp, Homo sapiens
caccccttcctgtct

SEQ ID NO: 4553271 - DNA, 16 bp, Homo sapiens
cacccctttctgtccc

SEQ ID NO: 4553272 - DNA, 18 bp, Homo sapiens
cacccctttctgtcccac

SEQ ID NO: 4553273 - DNA, 18 bp, Homo sapiens
cacccgagttcctctggg

SEQ ID NO: 4553274 - DNA, 13 bp, Homo sapiens
cacccgcccaccc

SEQ ID NO: 4553275 - DNA, 17 bp, Homo sapiens
cacccgccttgtgagat

SEQ ID NO: 4553276 - DNA, 16 bp, Homo sapiens
cacccggccacagctg

SEQ ID NO: 4553277 - DNA, 19 bp, Homo sapiens
cacccggccacagctgctg

SEQ ID NO: 4553278 - DNA, 23 bp, Homo sapiens
cacccgggggagcccagtgaagc

SEQ ID NO: 4553279 - DNA, 15 bp, Homo sapiens
cacccgtccccacac

SEQ ID NO: 4553280 - DNA, 17 bp, Homo sapiens
cacccgtctctctgccc

SEQ ID NO: 4553281 - DNA, 13 bp, Homo sapiens
caccctcagggag

SEQ ID NO: 4553282 - DNA, 18 bp, Homo sapiens
caccctcagggagcctcc

SEQ ID NO: 4553283 - DNA, 21 bp, Homo sapiens
caccctccatgctcctcacct

SEQ ID NO: 4553284 - DNA, 14 bp, Homo sapiens
caccctccctagag

SEQ ID NO: 4553285 - DNA, 16 bp, Homo sapiens
caccctccctccaggg

SEQ ID NO: 4553286 - DNA, 20 bp, Homo sapiens
caccctccctccagggtcct

SEQ ID NO: 4553287 - DNA, 14 bp, Homo sapiens
caccctccctggag

SEQ ID NO: 4553288 - DNA, 10 bp, Homo sapiens
caccctcctc

SEQ ID NO: 4553289 - DNA, 16 bp, Homo sapiens
caccctcctgtcttcc

SEQ ID NO: 4553290 - DNA, 18 bp, Homo sapiens
caccctcctgtcttccca

SEQ ID NO: 4553291 - DNA, 21 bp, Homo sapiens
caccctcctgtcttcccaggg

SEQ ID NO: 4553292 - DNA, 14 bp, Homo sapiens
caccctgagctcgg

SEQ ID NO: 4553293 - DNA, 17 bp, Homo sapiens
caccctgagctcgggga

SEQ ID NO: 4553294 - DNA, 20 bp, Homo sapiens
caccctgagctcggggacag

SEQ ID NO: 4553295 - DNA, 12 bp, Homo sapiens
caccctgggagc

SEQ ID NO: 4553296 - DNA, 21 bp, Homo sapiens
caccctgtcctgcacaccctg

SEQ ID NO: 4553297 - DNA, 22 bp, Homo sapiens
cacccttccacagctggcctgg

SEQ ID NO: 4553298 - DNA, 18 bp, Homo sapiens
cacccttcccggcccccg

SEQ ID NO: 4553299 - DNA, 17 bp, Homo sapiens
cacccttccgacaggag

SEQ ID NO: 4553300 - DNA, 20 bp, Homo sapiens
cacccttccgacaggagcac

SEQ ID NO: 4553301 - DNA, 21 bp, Homo sapiens
caccgaagtggactggcccct

SEQ ID NO: 4553302 - DNA, 14 bp, Homo sapiens
caccgagactcagc

SEQ ID NO: 4553303 - DNA, 16 bp, Homo sapiens
caccgagactcagcct

SEQ ID NO: 4553304 - DNA, 16 bp, Homo sapiens
caccgaggttcccagg

SEQ ID NO: 4553305 - DNA, 16 bp, Homo sapiens
caccgccacgtcccag

SEQ ID NO: 4553306 - DNA, 20 bp, Homo sapiens
caccgcctgaaggcacagct

SEQ ID NO: 4553307 - DNA, 18 bp, Homo sapiens
caccgccttgcccagcct

SEQ ID NO: 4553308 - DNA, 23 bp, Homo sapiens
caccgccttgcccagcctggatg

SEQ ID NO: 4553309 - DNA, 14 bp, Homo sapiens
caccgcgtcccagc

SEQ ID NO: 4553310 - DNA, 18 bp, Homo sapiens
caccgcgtcccagctccc

SEQ ID NO: 4553311 - DNA, 20 bp, Homo sapiens
caccgcgtcccagctcccct

SEQ ID NO: 4553312 - DNA, 19 bp, Homo sapiens
caccgctgcctaagtggct

SEQ ID NO: 4553313 - DNA, 16 bp, Homo sapiens
caccggaactgggctg

SEQ ID NO: 4553314 - DNA, 18 bp, Homo sapiens
caccggaactgggctggc

SEQ ID NO: 4553315 - DNA, 21 bp, Homo sapiens
caccggcctgtgggtctctga

SEQ ID NO: 4553316 - DNA, 21 bp, Homo sapiens
caccgggagcctccccctcag

SEQ ID NO: 4553317 - DNA, 21 bp, Homo sapiens
caccggggcctgggcaggagg

SEQ ID NO: 4553318 - DNA, 22 bp, Homo sapiens
caccggggcctgggcaggaggg

SEQ ID NO: 4553319 - DNA, 15 bp, Homo sapiens
caccggtcagtgcct

SEQ ID NO: 4553320 - DNA, 22 bp, Homo sapiens
caccgtacatctgcaatatgaa

SEQ ID NO: 4553321 - DNA, 18 bp, Homo sapiens
caccgtgaaccagagggt

SEQ ID NO: 4553322 - DNA, 18 bp, Homo sapiens
caccgtgatggagaggac

SEQ ID NO: 4553323 - DNA, 15 bp, Homo sapiens
caccgtgcctggcca

SEQ ID NO: 4553324 - DNA, 15 bp, Homo sapiens
caccgtgtcgggcag

SEQ ID NO: 4553325 - DNA, 16 bp, Homo sapiens
caccgttatcggtgtc

SEQ ID NO: 4553326 - DNA, 13 bp, Homo sapiens
cacctaaagaaaa

SEQ ID NO: 4553327 - DNA, 15 bp, Homo sapiens
cacctaaccccaggg

SEQ ID NO: 4553328 - DNA, 15 bp, Homo sapiens
cacctaagcacttct

SEQ ID NO: 4553329 - DNA, 22 bp, Homo sapiens
cacctaagcacttctagaatgt

SEQ ID NO: 4553330 - DNA, 19 bp, Homo sapiens
cacctaatggttgtacata

SEQ ID NO: 4553331 - DNA, 13 bp, Homo sapiens
cacctacagtgta

SEQ ID NO: 4553332 - DNA, 16 bp, Homo sapiens
cacctagactctccct

SEQ ID NO: 4553333 - DNA, 17 bp, Homo sapiens
cacctaggccactcctc

SEQ ID NO: 4553334 - DNA, 18 bp, Homo sapiens
cacctaggccactcctcc

SEQ ID NO: 4553335 - DNA, 19 bp, Homo sapiens
cacctaggccactcctcca

SEQ ID NO: 4553336 - DNA, 17 bp, Homo sapiens
cacctaggctagggtgg

SEQ ID NO: 4553337 - DNA, 13 bp, Homo sapiens
cacctatctcagc

SEQ ID NO: 4553338 - DNA, 20 bp, Homo sapiens
cacctatgagatggccatgc

SEQ ID NO: 4553339 - DNA, 21 bp, Homo sapiens
cacctatgagatggccatgct

SEQ ID NO: 4553340 - DNA, 14 bp, Homo sapiens
cacctatgtgccaa

SEQ ID NO: 4553341 - DNA, 17 bp, Homo sapiens
cacctatgtgccaactg

SEQ ID NO: 4553342 - DNA, 21 bp, Homo sapiens
cacctatgtgccaactgttgt

SEQ ID NO: 4553343 - DNA, 23 bp, Homo sapiens
cacctcaaaataccatgccattt

SEQ ID NO: 4553344 - DNA, 21 bp, Homo sapiens
cacctcaccaaggatcggact

SEQ ID NO: 4553345 - DNA, 11 bp, Homo sapiens
cacctcagcct

SEQ ID NO: 4553346 - DNA, 14 bp, Homo sapiens
cacctcagcctcct

SEQ ID NO: 4553347 - DNA, 12 bp, Homo sapiens
cacctcagcctt

SEQ ID NO: 4553348 - DNA, 22 bp, Homo sapiens
cacctcagttcccttggcctca

SEQ ID NO: 4553349 - DNA, 18 bp, Homo sapiens
cacctcatgcccaccccc

SEQ ID NO: 4553350 - DNA, 22 bp, Homo sapiens
cacctcatgcccaccccctgcc

SEQ ID NO: 4553351 - DNA, 17 bp, Homo sapiens
cacctccaagcatttca

SEQ ID NO: 4553352 - DNA, 22 bp, Homo sapiens
cacctccaagcatttcatgaaa

SEQ ID NO: 4553353 - DNA, 14 bp, Homo sapiens
cacctccccccact

SEQ ID NO: 4553354 - DNA, 16 bp, Homo sapiens
cacctccccccactgc

SEQ ID NO: 4553355 - DNA, 18 bp, Homo sapiens
cacctccccccactgcag

SEQ ID NO: 4553356 - DNA, 21 bp, Homo sapiens
cacctccccccactgcaggcc

SEQ ID NO: 4553357 - DNA, 22 bp, Homo sapiens
cacctccccccactgcaggccc

SEQ ID NO: 4553358 - DNA, 14 bp, Homo sapiens
cacctccccctgcg

SEQ ID NO: 4553359 - DNA, 15 bp, Homo sapiens
cacctccccctttca

SEQ ID NO: 4553360 - DNA, 20 bp, Homo sapiens
cacctccccctttcacactg

SEQ ID NO: 4553361 - DNA, 16 bp, Homo sapiens
cacctccccgctggga

SEQ ID NO: 4553362 - DNA, 14 bp, Homo sapiens
cacctcccctatcc

SEQ ID NO: 4553363 - DNA, 19 bp, Homo sapiens
cacctcccctatccaccca

SEQ ID NO: 4553364 - DNA, 20 bp, Homo sapiens
cacctcccctatccacccag

SEQ ID NO: 4553365 - DNA, 11 bp, Homo sapiens
cacctccctgc

SEQ ID NO: 4553366 - DNA, 17 bp, Homo sapiens
cacctcctaccctccca

SEQ ID NO: 4553367 - DNA, 16 bp, Homo sapiens
cacctcgagaagtaat

SEQ ID NO: 4553368 - DNA, 18 bp, Homo sapiens
cacctcggggacaccaga

SEQ ID NO: 4553369 - DNA, 21 bp, Homo sapiens
cacctcggggacaccagagct

SEQ ID NO: 4553370 - DNA, 12 bp, Homo sapiens
cacctctcagct

SEQ ID NO: 4553371 - DNA, 12 bp, Homo sapiens
cacctctcctgc

SEQ ID NO: 4553372 - DNA, 13 bp, Homo sapiens
cacctctgccaga

SEQ ID NO: 4553373 - DNA, 18 bp, Homo sapiens
cacctctggactggctag

SEQ ID NO: 4553374 - DNA, 23 bp, Homo sapiens
cacctcttgtgcaaggtggcctt

SEQ ID NO: 4553375 - DNA, 16 bp, Homo sapiens
cacctgaaccccagag

SEQ ID NO: 4553376 - DNA, 17 bp, Homo sapiens
cacctgaactgaacacc

SEQ ID NO: 4553377 - DNA, 14 bp, Homo sapiens
cacctgaagggtgg

SEQ ID NO: 4553378 - DNA, 17 bp, Homo sapiens
cacctgacacaccaggc

SEQ ID NO: 4553379 - DNA, 20 bp, Homo sapiens
cacctgacacaccaggcgct

SEQ ID NO: 4553380 - DNA, 16 bp, Homo sapiens
cacctgcactaacaga

SEQ ID NO: 4553381 - DNA, 15 bp, Homo sapiens
cacctgcagcggctg

SEQ ID NO: 4553382 - DNA, 22 bp, Homo sapiens
cacctgcatccgtagttccctg

SEQ ID NO: 4553383 - DNA, 13 bp, Homo sapiens
cacctgccccgtg

SEQ ID NO: 4553384 - DNA, 14 bp, Homo sapiens
cacctgccccgtgt

SEQ ID NO: 4553385 - DNA, 21 bp, Homo sapiens
cacctgccccgtgtgtgtggc

SEQ ID NO: 4553386 - DNA, 23 bp, Homo sapiens
cacctgcccttttttctgcctcc

SEQ ID NO: 4553387 - DNA, 23 bp, Homo sapiens
cacctgccgacctcgtcctcccc

SEQ ID NO: 4553388 - DNA, 18 bp, Homo sapiens
cacctgccgccctgtggg

SEQ ID NO: 4553389 - DNA, 13 bp, Homo sapiens
cacctgcctctga

SEQ ID NO: 4553390 - DNA, 21 bp, Homo sapiens
cacctgcctctgaccccagca

SEQ ID NO: 4553391 - DNA, 16 bp, Homo sapiens
cacctgccttctaccc

SEQ ID NO: 4553392 - DNA, 21 bp, Homo sapiens
cacctgctcccagtcctgcct

SEQ ID NO: 4553393 - DNA, 18 bp, Homo sapiens
cacctgctgagagaccca

SEQ ID NO: 4553394 - DNA, 22 bp, Homo sapiens
cacctgctgagagacccaagga

SEQ ID NO: 4553395 - DNA, 20 bp, Homo sapiens
cacctgcttccacccgtctc

SEQ ID NO: 4553396 - DNA, 13 bp, Homo sapiens
cacctggacatgt

SEQ ID NO: 4553397 - DNA, 19 bp, Homo sapiens
cacctggatctatccctgc

SEQ ID NO: 4553398 - DNA, 16 bp, Homo sapiens
cacctggcaaaggacc

SEQ ID NO: 4553399 - DNA, 11 bp, Homo sapiens
cacctggcccc

SEQ ID NO: 4553400 - DNA, 13 bp, Homo sapiens
cacctggctctgt

SEQ ID NO: 4553401 - DNA, 15 bp, Homo sapiens
cacctggctctgtgg

SEQ ID NO: 4553402 - DNA, 23 bp, Homo sapiens
cacctggcttcatacagaaggca

SEQ ID NO: 4553403 - DNA, 22 bp, Homo sapiens
cacctggttgacccaaaaatgt

SEQ ID NO: 4553404 - DNA, 22 bp, Homo sapiens
cacctgtagtcccagctacttg

SEQ ID NO: 4553405 - DNA, 15 bp, Homo sapiens
cacctgtggggcctg

SEQ ID NO: 4553406 - DNA, 15 bp, Homo sapiens
caccttaaattaaac

SEQ ID NO: 4553407 - DNA, 14 bp, Homo sapiens
caccttaatatgct

SEQ ID NO: 4553408 - DNA, 15 bp, Homo sapiens
caccttcatattggc

SEQ ID NO: 4553409 - DNA, 22 bp, Homo sapiens
caccttcccagctctccctctg

SEQ ID NO: 4553410 - DNA, 15 bp, Homo sapiens
caccttccgacatcc

SEQ ID NO: 4553411 - DNA, 14 bp, Homo sapiens
caccttcctcctgc

SEQ ID NO: 4553412 - DNA, 23 bp, Homo sapiens
cacctttggctggtagcagcagg

SEQ ID NO: 4553413 - DNA, 21 bp, Homo sapiens
caccttttaggctgcatatgg

SEQ ID NO: 4553414 - DNA, 21 bp, Homo sapiens
caccttttcatggtctctgca

SEQ ID NO: 4553415 - DNA, 21 bp, Homo sapiens
caccttttccaggagttctga

SEQ ID NO: 4553416 - DNA, 22 bp, Homo sapiens
cacgactgcgggagccagactg

SEQ ID NO: 4553417 - DNA, 23 bp, Homo sapiens
cacgactgcgggagccagactgt

SEQ ID NO: 4553418 - DNA, 16 bp, Homo sapiens
cacgactgtctccatg

SEQ ID NO: 4553419 - DNA, 20 bp, Homo sapiens
cacgagcaggctactgtcag

SEQ ID NO: 4553420 - DNA, 22 bp, Homo sapiens
cacgagcaggctactgtcagct

SEQ ID NO: 4553421 - DNA, 14 bp, Homo sapiens
cacgagccacaagc

SEQ ID NO: 4553422 - DNA, 22 bp, Homo sapiens
cacgagccacaagctgcactgt

SEQ ID NO: 4553423 - DNA, 22 bp, Homo sapiens
cacgaggaatctgtgggtctgg

SEQ ID NO: 4553424 - DNA, 22 bp, Homo sapiens
cacgagggctggctggcctcac

SEQ ID NO: 4553425 - DNA, 14 bp, Homo sapiens
cacgagttccagac

SEQ ID NO: 4553426 - DNA, 21 bp, Homo sapiens
cacgatgtggccctggcctgc

SEQ ID NO: 4553427 - DNA, 20 bp, Homo sapiens
cacgcatgatggagctgatc

SEQ ID NO: 4553428 - DNA, 17 bp, Homo sapiens
cacgcccaccagccttg

SEQ ID NO: 4553429 - DNA, 22 bp, Homo sapiens
cacgccccggtcccccagagca

SEQ ID NO: 4553430 - DNA, 16 bp, Homo sapiens
cacgccctccctgcta

SEQ ID NO: 4553431 - DNA, 18 bp, Homo sapiens
cacgcctcaccagccccc

SEQ ID NO: 4553432 - DNA, 17 bp, Homo sapiens
cacgcctcctggccaga

SEQ ID NO: 4553433 - DNA, 16 bp, Homo sapiens
cacgctagggctggct

SEQ ID NO: 4553434 - DNA, 14 bp, Homo sapiens
cacgctccagctgc

SEQ ID NO: 4553435 - DNA, 18 bp, Homo sapiens
cacgctccagctgccccg

SEQ ID NO: 4553436 - DNA, 19 bp, Homo sapiens
cacgctccagctgccccgg

SEQ ID NO: 4553437 - DNA, 22 bp, Homo sapiens
cacgctgtcctctcgagcccag

SEQ ID NO: 4553438 - DNA, 16 bp, Homo sapiens
cacgcttctgagcagg

SEQ ID NO: 4553439 - DNA, 14 bp, Homo sapiens
cacggaagcacagt

SEQ ID NO: 4553440 - DNA, 22 bp, Homo sapiens
cacggaaggcgggctgaggaga

SEQ ID NO: 4553441 - DNA, 18 bp, Homo sapiens
cacggaccactcgaggcc

SEQ ID NO: 4553442 - DNA, 20 bp, Homo sapiens
cacggaccactcgaggcctg

SEQ ID NO: 4553443 - DNA, 15 bp, Homo sapiens
cacggagccactcct

SEQ ID NO: 4553444 - DNA, 17 bp, Homo sapiens
cacggagccactcctct

SEQ ID NO: 4553445 - DNA, 20 bp, Homo sapiens
cacggatggtgcatgggctc

SEQ ID NO: 4553446 - DNA, 17 bp, Homo sapiens
cacggcgggatcctcca

SEQ ID NO: 4553447 - DNA, 22 bp, Homo sapiens
cacggcgggatcctccacagag

SEQ ID NO: 4553448 - DNA, 22 bp, Homo sapiens
cacggctcctcgagatcccaac

SEQ ID NO: 4553449 - DNA, 16 bp, Homo sapiens
cacgggaatcacaggt

SEQ ID NO: 4553450 - DNA, 22 bp, Homo sapiens
cacgggggagtgagacaggctg

SEQ ID NO: 4553451 - DNA, 14 bp, Homo sapiens
cacggtagtgcctg

SEQ ID NO: 4553452 - DNA, 15 bp, Homo sapiens
cacggtagtgcctga

SEQ ID NO: 4553453 - DNA, 16 bp, Homo sapiens
cacggtcccccaggag

SEQ ID NO: 4553454 - DNA, 21 bp, Homo sapiens
cacggtcccccaggaggcagc

SEQ ID NO: 4553455 - DNA, 16 bp, Homo sapiens
cacggtgggccttgct

SEQ ID NO: 4553456 - DNA, 15 bp, Homo sapiens
cacggttatttaagc

SEQ ID NO: 4553457 - DNA, 20 bp, Homo sapiens
cacgtcaaatgcatacaagt

SEQ ID NO: 4553458 - DNA, 17 bp, Homo sapiens
cacgtcaggcctggcct

SEQ ID NO: 4553459 - DNA, 19 bp, Homo sapiens
cacgtcaggcctggcctca

SEQ ID NO: 4553460 - DNA, 20 bp, Homo sapiens
cacgtcaggcctggcctcat

SEQ ID NO: 4553461 - DNA, 21 bp, Homo sapiens
cacgtcaggcctggcctcatc

SEQ ID NO: 4553462 - DNA, 15 bp, Homo sapiens
cacgtctggaccccg

SEQ ID NO: 4553463 - DNA, 13 bp, Homo sapiens
cacgtggagagct

SEQ ID NO: 4553464 - DNA, 19 bp, Homo sapiens
cacgttccttactgcagaa

SEQ ID NO: 4553465 - DNA, 12 bp, Homo sapiens
cacgttctgatt

SEQ ID NO: 4553466 - DNA, 22 bp, Homo sapiens
cacgttcttactagtttccctt

SEQ ID NO: 4553467 - DNA, 22 bp, Homo sapiens
cacgttgcccaaggttgcacag

SEQ ID NO: 4553468 - DNA, 18 bp, Homo sapiens
cacgttggccggcggcta

SEQ ID NO: 4553469 - DNA, 16 bp, Homo sapiens
cacgtttaatcccagc

SEQ ID NO: 4553470 - DNA, 18 bp, Homo sapiens
cacgtttaatcccagcac

SEQ ID NO: 4553471 - DNA, 22 bp, Homo sapiens
cactaaagtagggaagttttat

SEQ ID NO: 4553472 - DNA, 23 bp, Homo sapiens
cactaacactttagttatattca

SEQ ID NO: 4553473 - DNA, 18 bp, Homo sapiens
cactaacattatattgca

SEQ ID NO: 4553474 - DNA, 15 bp, Homo sapiens
cactaaccaaaaact

SEQ ID NO: 4553475 - DNA, 17 bp, Homo sapiens
cactaaccaatgccttt

SEQ ID NO: 4553476 - DNA, 16 bp, Homo sapiens
cactaaccatccccaa

SEQ ID NO: 4553477 - DNA, 17 bp, Homo sapiens
cactaaccatccccaac

SEQ ID NO: 4553478 - DNA, 14 bp, Homo sapiens
cactaacctgaccg

SEQ ID NO: 4553479 - DNA, 13 bp, Homo sapiens
cactaagacaaga

SEQ ID NO: 4553480 - DNA, 15 bp, Homo sapiens
cactaagagggcaga

SEQ ID NO: 4553481 - DNA, 23 bp, Homo sapiens
cactaaggccgtgtctctgagga

SEQ ID NO: 4553482 - DNA, 19 bp, Homo sapiens
cactaaggtggacagcaga

SEQ ID NO: 4553483 - DNA, 20 bp, Homo sapiens
cactaagtttgcaacattta

SEQ ID NO: 4553484 - DNA, 16 bp, Homo sapiens
cactaataatagtact

SEQ ID NO: 4553485 - DNA, 17 bp, Homo sapiens
cactaatatatttaaaa

SEQ ID NO: 4553486 - DNA, 19 bp, Homo sapiens
cactaatatatttaaaaat

SEQ ID NO: 4553487 - DNA, 20 bp, Homo sapiens
cactaatatatttaaaaata

SEQ ID NO: 4553488 - DNA, 18 bp, Homo sapiens
cactaatttttgtattat

SEQ ID NO: 4553489 - DNA, 19 bp, Homo sapiens
cactaatttttgtattatt

SEQ ID NO: 4553490 - DNA, 23 bp, Homo sapiens
cactacacctggctgaggttcct

SEQ ID NO: 4553491 - DNA, 21 bp, Homo sapiens
cactacaggtgaaggctctca

SEQ ID NO: 4553492 - DNA, 15 bp, Homo sapiens
cactaccagccagcc

SEQ ID NO: 4553493 - DNA, 19 bp, Homo sapiens
cactactcctctgcagtgc

SEQ ID NO: 4553494 - DNA, 20 bp, Homo sapiens
cactactcctctgcagtgcc

SEQ ID NO: 4553495 - DNA, 14 bp, Homo sapiens
cactactgggtgtc

SEQ ID NO: 4553496 - DNA, 16 bp, Homo sapiens
cactagcccaatgaaa

SEQ ID NO: 4553497 - DNA, 19 bp, Homo sapiens
cactagcccaatgaaatga

SEQ ID NO: 4553498 - DNA, 23 bp, Homo sapiens
cactagcccaatgaaatgaatta

SEQ ID NO: 4553499 - DNA, 23 bp, Homo sapiens
cactaggcctgaaatgacatttc

SEQ ID NO: 4553500 - DNA, 21 bp, Homo sapiens
cactagggcagggacaggata

SEQ ID NO: 4553501 - DNA, 17 bp, Homo sapiens
cactaggtgtccccaac

SEQ ID NO: 4553502 - DNA, 21 bp, Homo sapiens
cactaggtgtccccaacgtcc

SEQ ID NO: 4553503 - DNA, 17 bp, Homo sapiens
cactataatgtgaaatg

SEQ ID NO: 4553504 - DNA, 17 bp, Homo sapiens
cactatacaggctggga

SEQ ID NO: 4553505 - DNA, 20 bp, Homo sapiens
cactatggtatgctggccag

SEQ ID NO: 4553506 - DNA, 21 bp, Homo sapiens
cactatggtatgctggccagc

SEQ ID NO: 4553507 - DNA, 22 bp, Homo sapiens
cactatggtatgctggccagca

SEQ ID NO: 4553508 - DNA, 15 bp, Homo sapiens
cactatttccaaaag

SEQ ID NO: 4553509 - DNA, 16 bp, Homo sapiens
cactattttcagaatc

SEQ ID NO: 4553510 - DNA, 18 bp, Homo sapiens
cactattttcagaatctg

SEQ ID NO: 4553511 - DNA, 18 bp, Homo sapiens
cactcaaggacaggagcc

SEQ ID NO: 4553512 - DNA, 18 bp, Homo sapiens
cactcacacagccaggtg

SEQ ID NO: 4553513 - DNA, 23 bp, Homo sapiens
cactcacacagccaggtgccttg

SEQ ID NO: 4553514 - DNA, 13 bp, Homo sapiens
cactcacattgag

SEQ ID NO: 4553515 - DNA, 18 bp, Homo sapiens
cactcaccactaccagcc

SEQ ID NO: 4553516 - DNA, 15 bp, Homo sapiens
cactcactcactcat

SEQ ID NO: 4553517 - DNA, 14 bp, Homo sapiens
cactcactgtttat

SEQ ID NO: 4553518 - DNA, 22 bp, Homo sapiens
cactcagccacaaagcccccca

SEQ ID NO: 4553519 - DNA, 18 bp, Homo sapiens
cactcagccactgtcaca

SEQ ID NO: 4553520 - DNA, 22 bp, Homo sapiens
cactcagccactgtcacaggca

SEQ ID NO: 4553521 - DNA, 14 bp, Homo sapiens
cactcagtgagcct

SEQ ID NO: 4553522 - DNA, 22 bp, Homo sapiens
cactcagtgagcctcctgtgcc

SEQ ID NO: 4553523 - DNA, 19 bp, Homo sapiens
cactcatgcaaactgcttt

SEQ ID NO: 4553524 - DNA, 16 bp, Homo sapiens
cactcatgtgactctt

SEQ ID NO: 4553525 - DNA, 12 bp, Homo sapiens
cactcatttcat

SEQ ID NO: 4553526 - DNA, 14 bp, Homo sapiens
cactcatttcatct

SEQ ID NO: 4553527 - DNA, 14 bp, Homo sapiens
cactccaccaccca

SEQ ID NO: 4553528 - DNA, 15 bp, Homo sapiens
cactccaccacccaa

SEQ ID NO: 4553529 - DNA, 18 bp, Homo sapiens
cactccaccacccaaaag

SEQ ID NO: 4553530 - DNA, 12 bp, Homo sapiens
cactccaccatc

SEQ ID NO: 4553531 - DNA, 15 bp, Homo sapiens
cactccagcctgggg

SEQ ID NO: 4553532 - DNA, 17 bp, Homo sapiens
cactcccacctgacaca

SEQ ID NO: 4553533 - DNA, 13 bp, Homo sapiens
cactccccacttc

SEQ ID NO: 4553534 - DNA, 21 bp, Homo sapiens
cactccccacttcactttctt

SEQ ID NO: 4553535 - DNA, 17 bp, Homo sapiens
cactccccagccccagc

SEQ ID NO: 4553536 - DNA, 18 bp, Homo sapiens
cactccccgaagtctttt

SEQ ID NO: 4553537 - DNA, 22 bp, Homo sapiens
cactcccctctcctccccttcc

SEQ ID NO: 4553538 - DNA, 16 bp, Homo sapiens
cactcccttgggctcc

SEQ ID NO: 4553539 - DNA, 20 bp, Homo sapiens
cactcccttgggctccctgt

SEQ ID NO: 4553540 - DNA, 20 bp, Homo sapiens
cactccgcgccgatgccacc

SEQ ID NO: 4553541 - DNA, 22 bp, Homo sapiens
cactccgcgccgatgccaccgg

SEQ ID NO: 4553542 - DNA, 18 bp, Homo sapiens
cactccggccctccagag

SEQ ID NO: 4553543 - DNA, 20 bp, Homo sapiens
cactccggccctccagagcc

SEQ ID NO: 4553544 - DNA, 23 bp, Homo sapiens
cactccggcctgggtgacagagt

SEQ ID NO: 4553545 - DNA, 21 bp, Homo sapiens
cactcctctgactcagggctc

SEQ ID NO: 4553546 - DNA, 14 bp, Homo sapiens
cactcctgagaccc

SEQ ID NO: 4553547 - DNA, 21 bp, Homo sapiens
cactcctgagacccctggcct

SEQ ID NO: 4553548 - DNA, 22 bp, Homo sapiens
cactcctgagacccctggcctc

SEQ ID NO: 4553549 - DNA, 23 bp, Homo sapiens
cactccttccatctcttccttca

SEQ ID NO: 4553550 - DNA, 17 bp, Homo sapiens
cactccttccttcagga

SEQ ID NO: 4553551 - DNA, 19 bp, Homo sapiens
cactcctttatctgtaatt

SEQ ID NO: 4553552 - DNA, 14 bp, Homo sapiens
cactcgaggcctgc

SEQ ID NO: 4553553 - DNA, 13 bp, Homo sapiens
cactcgccttctt

SEQ ID NO: 4553554 - DNA, 14 bp, Homo sapiens
cactcgccttctta

SEQ ID NO: 4553555 - DNA, 22 bp, Homo sapiens
cactcggatggaccaacctgct

SEQ ID NO: 4553556 - DNA, 21 bp, Homo sapiens
cactcggggtccctggagggc

SEQ ID NO: 4553557 - DNA, 15 bp, Homo sapiens
cactcgtgtgtttct

SEQ ID NO: 4553558 - DNA, 16 bp, Homo sapiens
cactcgtgtgtttcta

SEQ ID NO: 4553559 - DNA, 18 bp, Homo sapiens
cactctaactgtatattt

SEQ ID NO: 4553560 - DNA, 16 bp, Homo sapiens
cactctaccctcccac

SEQ ID NO: 4553561 - DNA, 13 bp, Homo sapiens
cactctagttcta

SEQ ID NO: 4553562 - DNA, 16 bp, Homo sapiens
cactctagttctagat

SEQ ID NO: 4553563 - DNA, 17 bp, Homo sapiens
cactctagttctagatg

SEQ ID NO: 4553564 - DNA, 17 bp, Homo sapiens
cactctcattccccagg

SEQ ID NO: 4553565 - DNA, 11 bp, Homo sapiens
cactctcctgg

SEQ ID NO: 4553566 - DNA, 20 bp, Homo sapiens
cactctcctgggcccctccc

SEQ ID NO: 4553567 - DNA, 21 bp, Homo sapiens
cactctctgggactctcctcc

SEQ ID NO: 4553568 - DNA, 15 bp, Homo sapiens
cactctgacagtatt

SEQ ID NO: 4553569 - DNA, 15 bp, Homo sapiens
cactctgcaggaaat

SEQ ID NO: 4553570 - DNA, 17 bp, Homo sapiens
cactctgggtctggcca

SEQ ID NO: 4553571 - DNA, 13 bp, Homo sapiens
cactctgtaaaat

SEQ ID NO: 4553572 - DNA, 12 bp, Homo sapiens
cactctgtcagc

SEQ ID NO: 4553573 - DNA, 17 bp, Homo sapiens
cactctgtcagccagcc

SEQ ID NO: 4553574 - DNA, 22 bp, Homo sapiens
cactcttgtactgcctgccacc

SEQ ID NO: 4553575 - DNA, 19 bp, Homo sapiens
cactctttacctttattga

SEQ ID NO: 4553576 - DNA, 13 bp, Homo sapiens
cactgaaaaaata

SEQ ID NO: 4553577 - DNA, 13 bp, Homo sapiens
cactgaaagtttt

SEQ ID NO: 4553578 - DNA, 16 bp, Homo sapiens
cactgaaagttttgta

SEQ ID NO: 4553579 - DNA, 23 bp, Homo sapiens
cactgaaagttttgtaaaagaaa

SEQ ID NO: 4553580 - DNA, 23 bp, Homo sapiens
cactgaaataaccgtaaaggttt

SEQ ID NO: 4553581 - DNA, 17 bp, Homo sapiens
cactgaaatctgtcaag

SEQ ID NO: 4553582 - DNA, 13 bp, Homo sapiens
cactgaagagctc

SEQ ID NO: 4553583 - DNA, 17 bp, Homo sapiens
cactgaagagctcttgg

SEQ ID NO: 4553584 - DNA, 18 bp, Homo sapiens
cactgaagagctcttggc

SEQ ID NO: 4553585 - DNA, 17 bp, Homo sapiens
cactgaatatcaactct

SEQ ID NO: 4553586 - DNA, 21 bp, Homo sapiens
cactgacccactcggatggac

SEQ ID NO: 4553587 - DNA, 17 bp, Homo sapiens
cactgagaatgatagta

SEQ ID NO: 4553588 - DNA, 20 bp, Homo sapiens
cactgagaatgtaagaacta

SEQ ID NO: 4553589 - DNA, 18 bp, Homo sapiens
cactgagataccagcgag

SEQ ID NO: 4553590 - DNA, 19 bp, Homo sapiens
cactgagataccagcgagg

SEQ ID NO: 4553591 - DNA, 13 bp, Homo sapiens
cactgagcatcac

SEQ ID NO: 4553592 - DNA, 21 bp, Homo sapiens
cactgagccaggcttttctca

SEQ ID NO: 4553593 - DNA, 18 bp, Homo sapiens
cactgagctgtgacccag

SEQ ID NO: 4553594 - DNA, 14 bp, Homo sapiens
cactgagggcagtc

SEQ ID NO: 4553595 - DNA, 18 bp, Homo sapiens
cactgaggggccagggag

SEQ ID NO: 4553596 - DNA, 15 bp, Homo sapiens
cactgaggggtggca

SEQ ID NO: 4553597 - DNA, 20 bp, Homo sapiens
cactgagttttgtttcactt

SEQ ID NO: 4553598 - DNA, 18 bp, Homo sapiens
cactgataatcacactgc

SEQ ID NO: 4553599 - DNA, 15 bp, Homo sapiens
cactgatgcttagat

SEQ ID NO: 4553600 - DNA, 21 bp, Homo sapiens
cactgatgggaataaaagtat

SEQ ID NO: 4553601 - DNA, 16 bp, Homo sapiens
cactgcaaattttaac

SEQ ID NO: 4553602 - DNA, 19 bp, Homo sapiens
cactgcaacctcacctccc

SEQ ID NO: 4553603 - DNA, 20 bp, Homo sapiens
cactgcaacctcacctcccg

SEQ ID NO: 4553604 - DNA, 20 bp, Homo sapiens
cactgcaagagccttggtgt

SEQ ID NO: 4553605 - DNA, 13 bp, Homo sapiens
cactgcaagtctg

SEQ ID NO: 4553606 - DNA, 16 bp, Homo sapiens
cactgcacccctgccc

SEQ ID NO: 4553607 - DNA, 14 bp, Homo sapiens
cactgcactccagc

SEQ ID NO: 4553608 - DNA, 24 bp, Homo sapiens
cactgcactccagcctgagtgaca

SEQ ID NO: 4553609 - DNA, 21 bp, Homo sapiens
cactgcagaagacagtatggc

SEQ ID NO: 4553610 - DNA, 19 bp, Homo sapiens
cactgcagcctcatactcc

SEQ ID NO: 4553611 - DNA, 24 bp, Homo sapiens
cactgcatgggaaatagcggccct

SEQ ID NO: 4553612 - DNA, 18 bp, Homo sapiens
cactgcatgtcagagcac

SEQ ID NO: 4553613 - DNA, 17 bp, Homo sapiens
cactgcattcctgtgcc

SEQ ID NO: 4553614 - DNA, 18 bp, Homo sapiens
cactgcattcctgtgccc

SEQ ID NO: 4553615 - DNA, 19 bp, Homo sapiens
cactgcatttgcctgcttc

SEQ ID NO: 4553616 - DNA, 11 bp, Homo sapiens
cactgccagcc

SEQ ID NO: 4553617 - DNA, 14 bp, Homo sapiens
cactgccagcccac

SEQ ID NO: 4553618 - DNA, 18 bp, Homo sapiens
cactgccagcccaccccc

SEQ ID NO: 4553619 - DNA, 18 bp, Homo sapiens
cactgccaggccagcctc

SEQ ID NO: 4553620 - DNA, 19 bp, Homo sapiens
cactgccaggccagcctcc

SEQ ID NO: 4553621 - DNA, 21 bp, Homo sapiens
cactgccaggccagcctccga

SEQ ID NO: 4553622 - DNA, 15 bp, Homo sapiens
cactgccccacatgc

SEQ ID NO: 4553623 - DNA, 16 bp, Homo sapiens
cactgccccacatgca

SEQ ID NO: 4553624 - DNA, 17 bp, Homo sapiens
cactgccccacatgcat

SEQ ID NO: 4553625 - DNA, 19 bp, Homo sapiens
cactgccccacgttgtccc

SEQ ID NO: 4553626 - DNA, 19 bp, Homo sapiens
cactgccccccgaggctgc

SEQ ID NO: 4553627 - DNA, 20 bp, Homo sapiens
cactgccccccgaggctgct

SEQ ID NO: 4553628 - DNA, 19 bp, Homo sapiens
cactgcctaaaattttaga

SEQ ID NO: 4553629 - DNA, 21 bp, Homo sapiens
cactgctcgtggactgtgctg

SEQ ID NO: 4553630 - DNA, 18 bp, Homo sapiens
cactgctctaacagccct

SEQ ID NO: 4553631 - DNA, 19 bp, Homo sapiens
cactgctctaacagccctc

SEQ ID NO: 4553632 - DNA, 17 bp, Homo sapiens
cactgctgctgggactt

SEQ ID NO: 4553633 - DNA, 20 bp, Homo sapiens
cactgcttgaggaaaacaag

SEQ ID NO: 4553634 - DNA, 12 bp, Homo sapiens
cactggaaaggg

SEQ ID NO: 4553635 - DNA, 22 bp, Homo sapiens
cactggaaaggggagagcctgc

SEQ ID NO: 4553636 - DNA, 11 bp, Homo sapiens
cactggaatat

SEQ ID NO: 4553637 - DNA, 12 bp, Homo sapiens
cactggacagca

SEQ ID NO: 4553638 - DNA, 20 bp, Homo sapiens
cactggagccatctcttcct

SEQ ID NO: 4553639 - DNA, 21 bp, Homo sapiens
cactggaggttgaagccaagt

SEQ ID NO: 4553640 - DNA, 18 bp, Homo sapiens
cactggcaaacagggcct

SEQ ID NO: 4553641 - DNA, 20 bp, Homo sapiens
cactggcaaacagggcctct

SEQ ID NO: 4553642 - DNA, 21 bp, Homo sapiens
cactggcaaacagggcctctg

SEQ ID NO: 4553643 - DNA, 21 bp, Homo sapiens
cactggcagagaggtaaaggg

SEQ ID NO: 4553644 - DNA, 23 bp, Homo sapiens
cactggcagagaggtaaagggtg

SEQ ID NO: 4553645 - DNA, 15 bp, Homo sapiens
cactggccgctgagc

SEQ ID NO: 4553646 - DNA, 18 bp, Homo sapiens
cactggcctctccccagg

SEQ ID NO: 4553647 - DNA, 17 bp, Homo sapiens
cactgggaggcagggct

SEQ ID NO: 4553648 - DNA, 11 bp, Homo sapiens
cactgggccaa

SEQ ID NO: 4553649 - DNA, 22 bp, Homo sapiens
cactgggccataatgttgcttc

SEQ ID NO: 4553650 - DNA, 19 bp, Homo sapiens
cactgggcccgagcctgaa

SEQ ID NO: 4553651 - DNA, 16 bp, Homo sapiens
cactggggaatgctcc

SEQ ID NO: 4553652 - DNA, 20 bp, Homo sapiens
cactggggaatgctcccagc

SEQ ID NO: 4553653 - DNA, 18 bp, Homo sapiens
cactggggactttattta

SEQ ID NO: 4553654 - DNA, 15 bp, Homo sapiens
cactggggcaggggc

SEQ ID NO: 4553655 - DNA, 21 bp, Homo sapiens
cactggggtgccgcctgcccg

SEQ ID NO: 4553656 - DNA, 13 bp, Homo sapiens
cactgggtgagag

SEQ ID NO: 4553657 - DNA, 15 bp, Homo sapiens
cactgggtggtggcc

SEQ ID NO: 4553658 - DNA, 20 bp, Homo sapiens
cactgggtggtggcctggtc

SEQ ID NO: 4553659 - DNA, 20 bp, Homo sapiens
cactggtccaggtcttcagt

SEQ ID NO: 4553660 - DNA, 20 bp, Homo sapiens
cactggtctgtttgcatttg

SEQ ID NO: 4553661 - DNA, 19 bp, Homo sapiens
cactggtgtgacctgaggg

SEQ ID NO: 4553662 - DNA, 14 bp, Homo sapiens
cactgtaaagacaa

SEQ ID NO: 4553663 - DNA, 15 bp, Homo sapiens
cactgtaaatatccc

SEQ ID NO: 4553664 - DNA, 21 bp, Homo sapiens
cactgtaaggtgcttgctccc

SEQ ID NO: 4553665 - DNA, 22 bp, Homo sapiens
cactgtaaggtgcttgctcccc

SEQ ID NO: 4553666 - DNA, 23 bp, Homo sapiens
cactgtaaggtgcttgctcccca

SEQ ID NO: 4553667 - DNA, 23 bp, Homo sapiens
cactgtatagatccacagggagc

SEQ ID NO: 4553668 - DNA, 14 bp, Homo sapiens
cactgtatataaac

SEQ ID NO: 4553669 - DNA, 15 bp, Homo sapiens
cactgtatataaaca

SEQ ID NO: 4553670 - DNA, 18 bp, Homo sapiens
cactgtatataaacatat

SEQ ID NO: 4553671 - DNA, 16 bp, Homo sapiens
cactgtatatgtaaat

SEQ ID NO: 4553672 - DNA, 15 bp, Homo sapiens
cactgtatgagtgga

SEQ ID NO: 4553673 - DNA, 15 bp, Homo sapiens
cactgtcacaggcat

SEQ ID NO: 4553674 - DNA, 18 bp, Homo sapiens
cactgtctagctgtttca

SEQ ID NO: 4553675 - DNA, 22 bp, Homo sapiens
cactgtctcaactactcagctc

SEQ ID NO: 4553676 - DNA, 18 bp, Homo sapiens
cactgtctttaattctgt

SEQ ID NO: 4553677 - DNA, 19 bp, Homo sapiens
cactgtctttaattctgta

SEQ ID NO: 4553678 - DNA, 20 bp, Homo sapiens
cactgtgaacctgggcactc

SEQ ID NO: 4553679 - DNA, 20 bp, Homo sapiens
cactgtgatacagttttgag

SEQ ID NO: 4553680 - DNA, 22 bp, Homo sapiens
cactgtgcacatctgtgtcttg

SEQ ID NO: 4553681 - DNA, 17 bp, Homo sapiens
cactgtgctttctattg

SEQ ID NO: 4553682 - DNA, 23 bp, Homo sapiens
cactgtgctttctattgtacaga

SEQ ID NO: 4553683 - DNA, 21 bp, Homo sapiens
cactgtgggaaggccagctgc

SEQ ID NO: 4553684 - DNA, 15 bp, Homo sapiens
cactgtgtataggaa

SEQ ID NO: 4553685 - DNA, 22 bp, Homo sapiens
cactgttaaaataaagcttaca

SEQ ID NO: 4553686 - DNA, 20 bp, Homo sapiens
cactgttagaacactatttt

SEQ ID NO: 4553687 - DNA, 17 bp, Homo sapiens
cactgttccccctgtgc

SEQ ID NO: 4553688 - DNA, 19 bp, Homo sapiens
cactgttctgattatgtaa

SEQ ID NO: 4553689 - DNA, 14 bp, Homo sapiens
cactgttctgttca

SEQ ID NO: 4553690 - DNA, 21 bp, Homo sapiens
cactgttctgttcatttccta

SEQ ID NO: 4553691 - DNA, 22 bp, Homo sapiens
cactgtttgtttacaaaatcag

SEQ ID NO: 4553692 - DNA, 18 bp, Homo sapiens
cactgtttgtttttattt

SEQ ID NO: 4553693 - DNA, 16 bp, Homo sapiens
cacttaaacagaagca

SEQ ID NO: 4553694 - DNA, 16 bp, Homo sapiens
cacttaaactttgtca

SEQ ID NO: 4553695 - DNA, 11 bp, Homo sapiens
cacttaacagg

SEQ ID NO: 4553696 - DNA, 12 bp, Homo sapiens
cacttaatgtat

SEQ ID NO: 4553697 - DNA, 15 bp, Homo sapiens
cacttaatgtatgtt

SEQ ID NO: 4553698 - DNA, 13 bp, Homo sapiens
cacttaatttgaa

SEQ ID NO: 4553699 - DNA, 16 bp, Homo sapiens
cacttacgtaaaacat

SEQ ID NO: 4553700 - DNA, 22 bp, Homo sapiens
cacttagacctgccagccactg

SEQ ID NO: 4553701 - DNA, 12 bp, Homo sapiens
cacttagtcctt

SEQ ID NO: 4553702 - DNA, 16 bp, Homo sapiens
cacttatattttatga

SEQ ID NO: 4553703 - DNA, 18 bp, Homo sapiens
cacttatattttatgaac

SEQ ID NO: 4553704 - DNA, 21 bp, Homo sapiens
cacttatattttatgaacatt

SEQ ID NO: 4553705 - DNA, 18 bp, Homo sapiens
cacttatggaatttttaa

SEQ ID NO: 4553706 - DNA, 21 bp, Homo sapiens
cacttattggaactctgcttg

SEQ ID NO: 4553707 - DNA, 15 bp, Homo sapiens
cacttcactttcttc

SEQ ID NO: 4553708 - DNA, 16 bp, Homo sapiens
cacttcactttcttca

SEQ ID NO: 4553709 - DNA, 22 bp, Homo sapiens
cacttcactttcttcaaagcca

SEQ ID NO: 4553710 - DNA, 17 bp, Homo sapiens
cacttccaggtctgcct

SEQ ID NO: 4553711 - DNA, 12 bp, Homo sapiens
cacttcccagga

SEQ ID NO: 4553712 - DNA, 13 bp, Homo sapiens
cacttcccaggat

SEQ ID NO: 4553713 - DNA, 21 bp, Homo sapiens
cacttcccaggatctgctcca

SEQ ID NO: 4553714 - DNA, 23 bp, Homo sapiens
cacttcctacaagagcagcctgt

SEQ ID NO: 4553715 - DNA, 14 bp, Homo sapiens
cacttcgcacacac

SEQ ID NO: 4553716 - DNA, 14 bp, Homo sapiens
cacttctccccgca

SEQ ID NO: 4553717 - DNA, 20 bp, Homo sapiens
cacttctgtgagacccccac

SEQ ID NO: 4553718 - DNA, 21 bp, Homo sapiens
cacttgaacccgggaggcaga

SEQ ID NO: 4553719 - DNA, 20 bp, Homo sapiens
cacttgaagcctaaatttgt

SEQ ID NO: 4553720 - DNA, 13 bp, Homo sapiens
cacttgaatttat

SEQ ID NO: 4553721 - DNA, 23 bp, Homo sapiens
cacttgagaaccagtctcctcac

SEQ ID NO: 4553722 - DNA, 14 bp, Homo sapiens
cacttgaggaggag

SEQ ID NO: 4553723 - DNA, 22 bp, Homo sapiens
cacttgaggaggagctggcctg

SEQ ID NO: 4553724 - DNA, 23 bp, Homo sapiens
cacttgaggaggagctggcctgc

SEQ ID NO: 4553725 - DNA, 19 bp, Homo sapiens
cacttgatatttattagtg

SEQ ID NO: 4553726 - DNA, 16 bp, Homo sapiens
cacttgccaaaatcca

SEQ ID NO: 4553727 - DNA, 13 bp, Homo sapiens
cacttgccacatg

SEQ ID NO: 4553728 - DNA, 14 bp, Homo sapiens
cacttgcttgctga

SEQ ID NO: 4553729 - DNA, 17 bp, Homo sapiens
cacttgtcaaagaaggt

SEQ ID NO: 4553730 - DNA, 16 bp, Homo sapiens
cacttgtctcatttta

SEQ ID NO: 4553731 - DNA, 22 bp, Homo sapiens
cacttgtgggtttttgttttgt

SEQ ID NO: 4553732 - DNA, 24 bp, Homo sapiens
cacttgtgtgtgtacctgtggctg

SEQ ID NO: 4553733 - DNA, 19 bp, Homo sapiens
cactttaaaatatctacat

SEQ ID NO: 4553734 - DNA, 19 bp, Homo sapiens
cactttaaatggaataatt

SEQ ID NO: 4553735 - DNA, 17 bp, Homo sapiens
cactttatttacttcgt

SEQ ID NO: 4553736 - DNA, 16 bp, Homo sapiens
cactttcattgccagt

SEQ ID NO: 4553737 - DNA, 17 bp, Homo sapiens
cactttccaatgccaca

SEQ ID NO: 4553738 - DNA, 20 bp, Homo sapiens
cactttccaatgccacagac

SEQ ID NO: 4553739 - DNA, 23 bp, Homo sapiens
cactttgatgtcatgtgttccct

SEQ ID NO: 4553740 - DNA, 13 bp, Homo sapiens
cactttggcccag

SEQ ID NO: 4553741 - DNA, 12 bp, Homo sapiens
cactttgtaaat

SEQ ID NO: 4553742 - DNA, 15 bp, Homo sapiens
cactttgtaattttt

SEQ ID NO: 4553743 - DNA, 18 bp, Homo sapiens
cactttgtaatttttgct

SEQ ID NO: 4553744 - DNA, 21 bp, Homo sapiens
cactttgttgcaagatgtgaa

SEQ ID NO: 4553745 - DNA, 13 bp, Homo sapiens
cactttgtttaga

SEQ ID NO: 4553746 - DNA, 17 bp, Homo sapiens
cactttgtttagaaaaa

SEQ ID NO: 4553747 - DNA, 13 bp, Homo sapiens
cacttttatgttt

SEQ ID NO: 4553748 - DNA, 18 bp, Homo sapiens
cacttttcatatcatttc

SEQ ID NO: 4553749 - DNA, 17 bp, Homo sapiens
cacttttgacaaaggca

SEQ ID NO: 4553750 - DNA, 18 bp, Homo sapiens
cacttttgatgaaataaa

SEQ ID NO: 4553751 - DNA, 19 bp, Homo sapiens
cacttttgatgaaataaaa

SEQ ID NO: 4553752 - DNA, 21 bp, Homo sapiens
cacttttgttaacagtatttc

SEQ ID NO: 4553753 - DNA, 22 bp, Homo sapiens
cacttttgttaacagtatttct

SEQ ID NO: 4553754 - DNA, 17 bp, Homo sapiens
cactttttctctttcca

SEQ ID NO: 4553755 - DNA, 22 bp, Homo sapiens
cagaaaaaaaaaatgcatttac

SEQ ID NO: 4553756 - DNA, 20 bp, Homo sapiens
cagaaaacataatatagctt

SEQ ID NO: 4553757 - DNA, 21 bp, Homo sapiens
cagaaaacctctcctgacccc

SEQ ID NO: 4553758 - DNA, 23 bp, Homo sapiens
cagaaaataaggcacccatctgt

SEQ ID NO: 4553759 - DNA, 17 bp, Homo sapiens
cagaaaatatttaatat

SEQ ID NO: 4553760 - DNA, 14 bp, Homo sapiens
cagaaaatgttgag

SEQ ID NO: 4553761 - DNA, 21 bp, Homo sapiens
cagaaacagggacaaagaaat

SEQ ID NO: 4553762 - DNA, 20 bp, Homo sapiens
cagaaagatttgatgggcca

SEQ ID NO: 4553763 - DNA, 19 bp, Homo sapiens
cagaaagcctcctgccccc

SEQ ID NO: 4553764 - DNA, 21 bp, Homo sapiens
cagaaagcctcctgccccctg

SEQ ID NO: 4553765 - DNA, 22 bp, Homo sapiens
cagaaagcctcctgccccctgc

SEQ ID NO: 4553766 - DNA, 22 bp, Homo sapiens
cagaaaggcaggtttcatttct

SEQ ID NO: 4553767 - DNA, 16 bp, Homo sapiens
cagaaaggttctgccc

SEQ ID NO: 4553768 - DNA, 17 bp, Homo sapiens
cagaaaggttctgcccg

SEQ ID NO: 4553769 - DNA, 14 bp, Homo sapiens
cagaaagtgggggt

SEQ ID NO: 4553770 - DNA, 12 bp, Homo sapiens
cagaaataaaat

SEQ ID NO: 4553771 - DNA, 20 bp, Homo sapiens
cagaaatagacaaaaagtat

SEQ ID NO: 4553772 - DNA, 16 bp, Homo sapiens
cagaaatcaaactgct

SEQ ID NO: 4553773 - DNA, 20 bp, Homo sapiens
cagaaatcacagtcaatgga

SEQ ID NO: 4553774 - DNA, 16 bp, Homo sapiens
cagaaattattttcta

SEQ ID NO: 4553775 - DNA, 12 bp, Homo sapiens
cagaaattgtat

SEQ ID NO: 4553776 - DNA, 15 bp, Homo sapiens
cagaaattgtatatt

SEQ ID NO: 4553777 - DNA, 22 bp, Homo sapiens
cagaaattgtatattgtaattt

SEQ ID NO: 4553778 - DNA, 12 bp, Homo sapiens
cagaacaaattg

SEQ ID NO: 4553779 - DNA, 13 bp, Homo sapiens
cagaacagccctc

SEQ ID NO: 4553780 - DNA, 14 bp, Homo sapiens
cagaacagccctcg

SEQ ID NO: 4553781 - DNA, 18 bp, Homo sapiens
cagaacagtatgaatttg

SEQ ID NO: 4553782 - DNA, 18 bp, Homo sapiens
cagaacagtgattaccag

SEQ ID NO: 4553783 - DNA, 16 bp, Homo sapiens
cagaacatagacagaa

SEQ ID NO: 4553784 - DNA, 14 bp, Homo sapiens
cagaaccagcacta

SEQ ID NO: 4553785 - DNA, 21 bp, Homo sapiens
cagaaccagcactaaggtgga

SEQ ID NO: 4553786 - DNA, 19 bp, Homo sapiens
cagaaccatttcacccaga

SEQ ID NO: 4553787 - DNA, 17 bp, Homo sapiens
cagaacctcaattgaca

SEQ ID NO: 4553788 - DNA, 12 bp, Homo sapiens
cagaacctcttc

SEQ ID NO: 4553789 - DNA, 13 bp, Homo sapiens
cagaacctgagct

SEQ ID NO: 4553790 - DNA, 18 bp, Homo sapiens
cagaacctgagctatttt

SEQ ID NO: 4553791 - DNA, 13 bp, Homo sapiens
cagaacctggagg

SEQ ID NO: 4553792 - DNA, 20 bp, Homo sapiens
cagaacctggagggctagaa

SEQ ID NO: 4553793 - DNA, 21 bp, Homo sapiens
cagaaccttcaacccagtggg

SEQ ID NO: 4553794 - DNA, 14 bp, Homo sapiens
cagaacgcacccca

SEQ ID NO: 4553795 - DNA, 17 bp, Homo sapiens
cagaacgcaccccactg

SEQ ID NO: 4553796 - DNA, 23 bp, Homo sapiens
cagaacggttctttgaccagcac

SEQ ID NO: 4553797 - DNA, 22 bp, Homo sapiens
cagaacgtggtttgcctgaggc

SEQ ID NO: 4553798 - DNA, 19 bp, Homo sapiens
cagaactaaatttttcata

SEQ ID NO: 4553799 - DNA, 20 bp, Homo sapiens
cagaactaaatttttcatag

SEQ ID NO: 4553800 - DNA, 15 bp, Homo sapiens
cagaactctttcaaa

SEQ ID NO: 4553801 - DNA, 16 bp, Homo sapiens
cagaactctttcaaaa

SEQ ID NO: 4553802 - DNA, 17 bp, Homo sapiens
cagaactgcccttgctg

SEQ ID NO: 4553803 - DNA, 19 bp, Homo sapiens
cagaactgcccttgctgcc

SEQ ID NO: 4553804 - DNA, 14 bp, Homo sapiens
cagaagaaaattct

SEQ ID NO: 4553805 - DNA, 14 bp, Homo sapiens
cagaagaaacaagg

SEQ ID NO: 4553806 - DNA, 12 bp, Homo sapiens
cagaagaaaggc

SEQ ID NO: 4553807 - DNA, 17 bp, Homo sapiens
cagaagaaataaatata

SEQ ID NO: 4553808 - DNA, 19 bp, Homo sapiens
cagaagaattgaacccagg

SEQ ID NO: 4553809 - DNA, 21 bp, Homo sapiens
cagaagaattgaacccaggag

SEQ ID NO: 4553810 - DNA, 22 bp, Homo sapiens
cagaagaattgaacccaggagg

SEQ ID NO: 4553811 - DNA, 13 bp, Homo sapiens
cagaagaatttaa

SEQ ID NO: 4553812 - DNA, 18 bp, Homo sapiens
cagaagatcccctcagga

SEQ ID NO: 4553813 - DNA, 23 bp, Homo sapiens
cagaagatcccctcaggactgca

SEQ ID NO: 4553814 - DNA, 14 bp, Homo sapiens
cagaagcaagccag

SEQ ID NO: 4553815 - DNA, 16 bp, Homo sapiens
cagaagcaagccagac

SEQ ID NO: 4553816 - DNA, 20 bp, Homo sapiens
cagaagccccacagcctggc

SEQ ID NO: 4553817 - DNA, 15 bp, Homo sapiens
cagaagcctccaagc

SEQ ID NO: 4553818 - DNA, 16 bp, Homo sapiens
cagaagcctccaagca

SEQ ID NO: 4553819 - DNA, 20 bp, Homo sapiens
cagaagcctccaagcacaga

SEQ ID NO: 4553820 - DNA, 21 bp, Homo sapiens
cagaagcctccaagcacagag

SEQ ID NO: 4553821 - DNA, 14 bp, Homo sapiens
cagaagcctctggc

SEQ ID NO: 4553822 - DNA, 15 bp, Homo sapiens
cagaagcctctggct

SEQ ID NO: 4553823 - DNA, 14 bp, Homo sapiens
cagaagctatttca

SEQ ID NO: 4553824 - DNA, 23 bp, Homo sapiens
cagaaggaaggatgccacttggg

SEQ ID NO: 4553825 - DNA, 20 bp, Homo sapiens
cagaaggagaaggaaggaga

SEQ ID NO: 4553826 - DNA, 19 bp, Homo sapiens
cagaaggagagtgagtgcc

SEQ ID NO: 4553827 - DNA, 17 bp, Homo sapiens
cagaaggccccagagag

SEQ ID NO: 4553828 - DNA, 18 bp, Homo sapiens
cagaaggccccagagaga

SEQ ID NO: 4553829 - DNA, 20 bp, Homo sapiens
cagaaggccccagagagacc

SEQ ID NO: 4553830 - DNA, 11 bp, Homo sapiens
cagaagggaat

SEQ ID NO: 4553831 - DNA, 13 bp, Homo sapiens
cagaagggcagtg

SEQ ID NO: 4553832 - DNA, 15 bp, Homo sapiens
cagaagtcaataggc

SEQ ID NO: 4553833 - DNA, 14 bp, Homo sapiens
cagaagtcatcttg

SEQ ID NO: 4553834 - DNA, 20 bp, Homo sapiens
cagaagtcatcttgctacca

SEQ ID NO: 4553835 - DNA, 22 bp, Homo sapiens
cagaagtcatcttgctaccagt

SEQ ID NO: 4553836 - DNA, 12 bp, Homo sapiens
cagaagtgcatc

SEQ ID NO: 4553837 - DNA, 17 bp, Homo sapiens
cagaagttgtgctaaac

SEQ ID NO: 4553838 - DNA, 19 bp, Homo sapiens
cagaagtttgtcaagtcaa

SEQ ID NO: 4553839 - DNA, 15 bp, Homo sapiens
cagaataagttattg

SEQ ID NO: 4553840 - DNA, 14 bp, Homo sapiens
cagaataatcctgt

SEQ ID NO: 4553841 - DNA, 21 bp, Homo sapiens
cagaatagccacatttggaat

SEQ ID NO: 4553842 - DNA, 15 bp, Homo sapiens
cagaatagtttacac

SEQ ID NO: 4553843 - DNA, 16 bp, Homo sapiens
cagaatattaaatatt

SEQ ID NO: 4553844 - DNA, 23 bp, Homo sapiens
cagaatatttttatatttccttt

SEQ ID NO: 4553845 - DNA, 13 bp, Homo sapiens
cagaatcccttaa

SEQ ID NO: 4553846 - DNA, 14 bp, Homo sapiens
cagaatctgaatgt

SEQ ID NO: 4553847 - DNA, 17 bp, Homo sapiens
cagaatgctgtacatct

SEQ ID NO: 4553848 - DNA, 21 bp, Homo sapiens
cagaatgctgtacatctattt

SEQ ID NO: 4553849 - DNA, 22 bp, Homo sapiens
cagaatgtcagattcctttccc

SEQ ID NO: 4553850 - DNA, 22 bp, Homo sapiens
cagaattcattcatacttaaaa

SEQ ID NO: 4553851 - DNA, 16 bp, Homo sapiens
cagaattcggtgtgct

SEQ ID NO: 4553852 - DNA, 22 bp, Homo sapiens
cagaattcggtgtgctgccaac

SEQ ID NO: 4553853 - DNA, 23 bp, Homo sapiens
cagaattggcataatttgtctta

SEQ ID NO: 4553854 - DNA, 15 bp, Homo sapiens
cagaatttgaattat

SEQ ID NO: 4553855 - DNA, 14 bp, Homo sapiens
cagacaaaatgaaa

SEQ ID NO: 4553856 - DNA, 20 bp, Homo sapiens
cagacaaaatggatacataa

SEQ ID NO: 4553857 - DNA, 11 bp, Homo sapiens
cagacaaatta

SEQ ID NO: 4553858 - DNA, 17 bp, Homo sapiens
cagacaacaccttcctc

SEQ ID NO: 4553859 - DNA, 18 bp, Homo sapiens
cagacaacaccttcctcc

SEQ ID NO: 4553860 - DNA, 13 bp, Homo sapiens
cagacaaggagga

SEQ ID NO: 4553861 - DNA, 17 bp, Homo sapiens
cagacaccatgtgcaat

SEQ ID NO: 4553862 - DNA, 16 bp, Homo sapiens
cagacacctaacccca

SEQ ID NO: 4553863 - DNA, 17 bp, Homo sapiens
cagacacctaaccccag

SEQ ID NO: 4553864 - DNA, 22 bp, Homo sapiens
cagacaggaatttagaaaaagt

SEQ ID NO: 4553865 - DNA, 13 bp, Homo sapiens
cagacaggagaaa

SEQ ID NO: 4553866 - DNA, 22 bp, Homo sapiens
cagacagggtgggcttcctgcc

SEQ ID NO: 4553867 - DNA, 19 bp, Homo sapiens
cagacatagaattaacaca

SEQ ID NO: 4553868 - DNA, 13 bp, Homo sapiens
cagacatatttaa

SEQ ID NO: 4553869 - DNA, 22 bp, Homo sapiens
cagacatccaaactaaaaggaa

SEQ ID NO: 4553870 - DNA, 20 bp, Homo sapiens
cagacatggagatgtaaaat

SEQ ID NO: 4553871 - DNA, 22 bp, Homo sapiens
cagacattgagtttacttataa

SEQ ID NO: 4553872 - DNA, 12 bp, Homo sapiens
cagacatttata

SEQ ID NO: 4553873 - DNA, 15 bp, Homo sapiens
cagaccacaggaaga

SEQ ID NO: 4553874 - DNA, 17 bp, Homo sapiens
cagaccacttgccacgc

SEQ ID NO: 4553875 - DNA, 18 bp, Homo sapiens
cagaccacttgccacgct

SEQ ID NO: 4553876 - DNA, 17 bp, Homo sapiens
cagaccagagctgtctg

SEQ ID NO: 4553877 - DNA, 15 bp, Homo sapiens
cagacccacccccag

SEQ ID NO: 4553878 - DNA, 20 bp, Homo sapiens
cagacccacgggctcatgca

SEQ ID NO: 4553879 - DNA, 16 bp, Homo sapiens
cagacccagaggtcca

SEQ ID NO: 4553880 - DNA, 16 bp, Homo sapiens
cagacccagcggtcca

SEQ ID NO: 4553881 - DNA, 21 bp, Homo sapiens
cagacccagcggtccaatgcc

SEQ ID NO: 4553882 - DNA, 11 bp, Homo sapiens
cagacccagga

SEQ ID NO: 4553883 - DNA, 19 bp, Homo sapiens
cagacccaggagtccagac

SEQ ID NO: 4553884 - DNA, 20 bp, Homo sapiens
cagacccaggagtccagacc

SEQ ID NO: 4553885 - DNA, 18 bp, Homo sapiens
cagaccccacgctgacca

SEQ ID NO: 4553886 - DNA, 14 bp, Homo sapiens
cagaccccagcggc

SEQ ID NO: 4553887 - DNA, 21 bp, Homo sapiens
cagaccccccagcccctcctc

SEQ ID NO: 4553888 - DNA, 12 bp, Homo sapiens
cagaccccgccc

SEQ ID NO: 4553889 - DNA, 13 bp, Homo sapiens
cagaccccgcccc

SEQ ID NO: 4553890 - DNA, 15 bp, Homo sapiens
cagaccccgcccctg

SEQ ID NO: 4553891 - DNA, 20 bp, Homo sapiens
cagaccccgcccctggggaa

SEQ ID NO: 4553892 - DNA, 18 bp, Homo sapiens
cagacccctcagccccag

SEQ ID NO: 4553893 - DNA, 14 bp, Homo sapiens
cagacccctgcctg

SEQ ID NO: 4553894 - DNA, 16 bp, Homo sapiens
cagaccctaccccacc

SEQ ID NO: 4553895 - DNA, 17 bp, Homo sapiens
cagaccctaccccacca

SEQ ID NO: 4553896 - DNA, 18 bp, Homo sapiens
cagaccctaccccaccac

SEQ ID NO: 4553897 - DNA, 15 bp, Homo sapiens
cagaccgcagagagg

SEQ ID NO: 4553898 - DNA, 17 bp, Homo sapiens
cagacctaaagcaagcc

SEQ ID NO: 4553899 - DNA, 18 bp, Homo sapiens
cagacctaaagcaagcct

SEQ ID NO: 4553900 - DNA, 21 bp, Homo sapiens
cagacctgagcgggagtcagg

SEQ ID NO: 4553901 - DNA, 11 bp, Homo sapiens
cagacctggct

SEQ ID NO: 4553902 - DNA, 12 bp, Homo sapiens
cagacctgtcct

SEQ ID NO: 4553903 - DNA, 17 bp, Homo sapiens
cagacctgtcctcctgg

SEQ ID NO: 4553904 - DNA, 15 bp, Homo sapiens
cagaccttttttagg

SEQ ID NO: 4553905 - DNA, 17 bp, Homo sapiens
cagacgagacaacagca

SEQ ID NO: 4553906 - DNA, 16 bp, Homo sapiens
cagacgcctgaggaac

SEQ ID NO: 4553907 - DNA, 14 bp, Homo sapiens
cagacggtctgtgt

SEQ ID NO: 4553908 - DNA, 20 bp, Homo sapiens
cagacggtctgtgtgctgtt

SEQ ID NO: 4553909 - DNA, 17 bp, Homo sapiens
cagacgtgtgacctcca

SEQ ID NO: 4553910 - DNA, 20 bp, Homo sapiens
cagactaaaggatccagaga

SEQ ID NO: 4553911 - DNA, 14 bp, Homo sapiens
cagactatttgcta

SEQ ID NO: 4553912 - DNA, 22 bp, Homo sapiens
cagactatttttagattttctt

SEQ ID NO: 4553913 - DNA, 16 bp, Homo sapiens
cagactcaggttccag

SEQ ID NO: 4553914 - DNA, 17 bp, Homo sapiens
cagactcaggttccaga

SEQ ID NO: 4553915 - DNA, 18 bp, Homo sapiens
cagactcaggttccagaa

SEQ ID NO: 4553916 - DNA, 16 bp, Homo sapiens
cagactccatctcttc

SEQ ID NO: 4553917 - DNA, 14 bp, Homo sapiens
cagactcctccacg

SEQ ID NO: 4553918 - DNA, 13 bp, Homo sapiens
cagactcctgctc

SEQ ID NO: 4553919 - DNA, 18 bp, Homo sapiens
cagactctcagcccagaa

SEQ ID NO: 4553920 - DNA, 19 bp, Homo sapiens
cagactctcagcccagaag

SEQ ID NO: 4553921 - DNA, 17 bp, Homo sapiens
cagactgaactcgcagg

SEQ ID NO: 4553922 - DNA, 19 bp, Homo sapiens
cagactgaactcgcaggga

SEQ ID NO: 4553923 - DNA, 15 bp, Homo sapiens
cagactgatgagcac

SEQ ID NO: 4553924 - DNA, 22 bp, Homo sapiens
cagactgatgagcacatctctc

SEQ ID NO: 4553925 - DNA, 17 bp, Homo sapiens
cagactgcctgtctgct

SEQ ID NO: 4553926 - DNA, 23 bp, Homo sapiens
cagactggcacagttttctgaga

SEQ ID NO: 4553927 - DNA, 18 bp, Homo sapiens
cagactggcggagaagga

SEQ ID NO: 4553928 - DNA, 18 bp, Homo sapiens
cagactgggcactggggc

SEQ ID NO: 4553929 - DNA, 19 bp, Homo sapiens
cagactgggcactggggcc

SEQ ID NO: 4553930 - DNA, 16 bp, Homo sapiens
cagactgtccagggaa

SEQ ID NO: 4553931 - DNA, 11 bp, Homo sapiens
cagactgtggt

SEQ ID NO: 4553932 - DNA, 20 bp, Homo sapiens
cagacttcccagctaggaag

SEQ ID NO: 4553933 - DNA, 20 bp, Homo sapiens
cagactttctttttctacat

SEQ ID NO: 4553934 - DNA, 20 bp, Homo sapiens
cagactttgtgttcatttca

SEQ ID NO: 4553935 - DNA, 17 bp, Homo sapiens
cagagaaaaagggaggg

SEQ ID NO: 4553936 - DNA, 18 bp, Homo sapiens
cagagaaaaagggagggg

SEQ ID NO: 4553937 - DNA, 23 bp, Homo sapiens
cagagaaaaatgctccccacagc

SEQ ID NO: 4553938 - DNA, 23 bp, Homo sapiens
cagagaaaatgagaaaggacaga

SEQ ID NO: 4553939 - DNA, 17 bp, Homo sapiens
cagagaaatacaaaata

SEQ ID NO: 4553940 - DNA, 24 bp, Homo sapiens
cagagaagccccttccccatggga

SEQ ID NO: 4553941 - DNA, 22 bp, Homo sapiens
cagagaaggaaaagactgaatc

SEQ ID NO: 4553942 - DNA, 20 bp, Homo sapiens
cagagaaggcaggaatgtgt

SEQ ID NO: 4553943 - DNA, 22 bp, Homo sapiens
cagagacaacaggtaaaacagg

SEQ ID NO: 4553944 - DNA, 15 bp, Homo sapiens
cagagacacctgcac

SEQ ID NO: 4553945 - DNA, 16 bp, Homo sapiens
cagagacacctgcacc

SEQ ID NO: 4553946 - DNA, 18 bp, Homo sapiens
cagagacacctgcacctc

SEQ ID NO: 4553947 - DNA, 19 bp, Homo sapiens
cagagacactgagccagtc

SEQ ID NO: 4553948 - DNA, 13 bp, Homo sapiens
cagagacctccaa

SEQ ID NO: 4553949 - DNA, 15 bp, Homo sapiens
cagagactgtgcttg

SEQ ID NO: 4553950 - DNA, 15 bp, Homo sapiens
cagagagaccctgca

SEQ ID NO: 4553951 - DNA, 17 bp, Homo sapiens
cagagagaccctgcaag

SEQ ID NO: 4553952 - DNA, 16 bp, Homo sapiens
cagagagcaaaggaga

SEQ ID NO: 4553953 - DNA, 14 bp, Homo sapiens
cagagagcagctcc

SEQ ID NO: 4553954 - DNA, 21 bp, Homo sapiens
cagagagcagctccctttctc

SEQ ID NO: 4553955 - DNA, 15 bp, Homo sapiens
cagagagcatctttc

SEQ ID NO: 4553956 - DNA, 13 bp, Homo sapiens
cagagaggaatca

SEQ ID NO: 4553957 - DNA, 17 bp, Homo sapiens
cagagaggtaaagggtg

SEQ ID NO: 4553958 - DNA, 21 bp, Homo sapiens
cagagaggtggatcctgtagg

SEQ ID NO: 4553959 - DNA, 16 bp, Homo sapiens
cagagatctcccttct

SEQ ID NO: 4553960 - DNA, 14 bp, Homo sapiens
cagagatgcctcca

SEQ ID NO: 4553961 - DNA, 16 bp, Homo sapiens
cagagatgcctccacc

SEQ ID NO: 4553962 - DNA, 16 bp, Homo sapiens
cagagatgtgcaccca

SEQ ID NO: 4553963 - DNA, 21 bp, Homo sapiens
cagagattcattttctagata

SEQ ID NO: 4553964 - DNA, 19 bp, Homo sapiens
cagagcaccccctgctcca

SEQ ID NO: 4553965 - DNA, 13 bp, Homo sapiens
cagagcagagcct

SEQ ID NO: 4553966 - DNA, 11 bp, Homo sapiens
cagagcagcaa

SEQ ID NO: 4553967 - DNA, 19 bp, Homo sapiens
cagagcaggggctccagca

SEQ ID NO: 4553968 - DNA, 18 bp, Homo sapiens
cagagcatctgccccagg

SEQ ID NO: 4553969 - DNA, 22 bp, Homo sapiens
cagagcatctgccccaggtaca

SEQ ID NO: 4553970 - DNA, 17 bp, Homo sapiens
cagagccactctatgag

SEQ ID NO: 4553971 - DNA, 18 bp, Homo sapiens
cagagccagcctggctct

SEQ ID NO: 4553972 - DNA, 21 bp, Homo sapiens
cagagccagcctggctctgcc

SEQ ID NO: 4553973 - DNA, 17 bp, Homo sapiens
cagagccagggcagggc

SEQ ID NO: 4553974 - DNA, 11 bp, Homo sapiens
cagagcccagc

SEQ ID NO: 4553975 - DNA, 15 bp, Homo sapiens
cagagcccagcccag

SEQ ID NO: 4553976 - DNA, 18 bp, Homo sapiens
cagagcccagcccaggag

SEQ ID NO: 4553977 - DNA, 15 bp, Homo sapiens
cagagcccccctagc

SEQ ID NO: 4553978 - DNA, 23 bp, Homo sapiens
cagagccgggaggaaaaggcccc

SEQ ID NO: 4553979 - DNA, 19 bp, Homo sapiens
cagagccgtggtcctttgg

SEQ ID NO: 4553980 - DNA, 13 bp, Homo sapiens
cagagcctctggc

SEQ ID NO: 4553981 - DNA, 16 bp, Homo sapiens
cagagcctctggcccc

SEQ ID NO: 4553982 - DNA, 17 bp, Homo sapiens
cagagcctctggcccct

SEQ ID NO: 4553983 - DNA, 21 bp, Homo sapiens
cagagcctctggcccctcacc

SEQ ID NO: 4553984 - DNA, 19 bp, Homo sapiens
cagagcctgacgctcagcc

SEQ ID NO: 4553985 - DNA, 14 bp, Homo sapiens
cagagcctggcccc

SEQ ID NO: 4553986 - DNA, 19 bp, Homo sapiens
cagagcctggccccaggcc

SEQ ID NO: 4553987 - DNA, 18 bp, Homo sapiens
cagagccttctcagaagc

SEQ ID NO: 4553988 - DNA, 19 bp, Homo sapiens
cagagccttctcagaagca

SEQ ID NO: 4553989 - DNA, 20 bp, Homo sapiens
cagagccttctcagaagcac

SEQ ID NO: 4553990 - DNA, 15 bp, Homo sapiens
cagagcgccaggaag

SEQ ID NO: 4553991 - DNA, 21 bp, Homo sapiens
cagagcgccaggaagccagag

SEQ ID NO: 4553992 - DNA, 18 bp, Homo sapiens
cagagcgggtaaagtgca

SEQ ID NO: 4553993 - DNA, 22 bp, Homo sapiens
cagagcggtatctctggcacca

SEQ ID NO: 4553994 - DNA, 22 bp, Homo sapiens
cagagctcatttcggggtcagg

SEQ ID NO: 4553995 - DNA, 22 bp, Homo sapiens
cagagctctcgaggaaagtggt

SEQ ID NO: 4553996 - DNA, 18 bp, Homo sapiens
cagagctgagttgggggt

SEQ ID NO: 4553997 - DNA, 15 bp, Homo sapiens
cagagctggagcccc

SEQ ID NO: 4553998 - DNA, 21 bp, Homo sapiens
cagagctggagcccccagcag

SEQ ID NO: 4553999 - DNA, 17 bp, Homo sapiens
cagagctggcgctcagc

SEQ ID NO: 4554000 - DNA, 21 bp, Homo sapiens
cagagctggcgctcagcagcc

SEQ ID NO: 4554001 - DNA, 21 bp, Homo sapiens
cagagctgtttatggcctcag

SEQ ID NO: 4554002 - DNA, 13 bp, Homo sapiens
cagagcttccctg

SEQ ID NO: 4554003 - DNA, 18 bp, Homo sapiens
cagagcttccctgactca

SEQ ID NO: 4554004 - DNA, 14 bp, Homo sapiens
cagagcttgtggaa

SEQ ID NO: 4554005 - DNA, 19 bp, Homo sapiens
cagagctttgtcacttgcc

SEQ ID NO: 4554006 - DNA, 18 bp, Homo sapiens
cagaggaaggggccagag

SEQ ID NO: 4554007 - DNA, 20 bp, Homo sapiens
cagaggaaggggccagaggc

SEQ ID NO: 4554008 - DNA, 22 bp, Homo sapiens
cagaggacagtatttgtgggga

SEQ ID NO: 4554009 - DNA, 15 bp, Homo sapiens
cagaggacagtctgg

SEQ ID NO: 4554010 - DNA, 18 bp, Homo sapiens
cagaggacagtctggaga

SEQ ID NO: 4554011 - DNA, 17 bp, Homo sapiens
cagaggagcaaggttta

SEQ ID NO: 4554012 - DNA, 15 bp, Homo sapiens
cagaggagcttttct

SEQ ID NO: 4554013 - DNA, 18 bp, Homo sapiens
cagaggagggcagcagaa

SEQ ID NO: 4554014 - DNA, 13 bp, Homo sapiens
cagaggcacctca

SEQ ID NO: 4554015 - DNA, 11 bp, Homo sapiens
cagaggcagag

SEQ ID NO: 4554016 - DNA, 13 bp, Homo sapiens
cagaggcagaggt

SEQ ID NO: 4554017 - DNA, 14 bp, Homo sapiens
cagaggcaggctgg

SEQ ID NO: 4554018 - DNA, 18 bp, Homo sapiens
cagaggccccacctgaag

SEQ ID NO: 4554019 - DNA, 19 bp, Homo sapiens
cagaggccccacctgaagg

SEQ ID NO: 4554020 - DNA, 20 bp, Homo sapiens
cagaggccccacctgaaggg

SEQ ID NO: 4554021 - DNA, 12 bp, Homo sapiens
cagaggccctgc

SEQ ID NO: 4554022 - DNA, 19 bp, Homo sapiens
cagaggccctgcccccacc

SEQ ID NO: 4554023 - DNA, 13 bp, Homo sapiens
cagaggccctgga

SEQ ID NO: 4554024 - DNA, 16 bp, Homo sapiens
cagaggccctggaggg

SEQ ID NO: 4554025 - DNA, 16 bp, Homo sapiens
cagaggctggaggcag

SEQ ID NO: 4554026 - DNA, 18 bp, Homo sapiens
cagaggctggaggcaggg

SEQ ID NO: 4554027 - DNA, 19 bp, Homo sapiens
cagaggctggaggcagggc

SEQ ID NO: 4554028 - DNA, 20 bp, Homo sapiens
cagaggctggaggcagggcc

SEQ ID NO: 4554029 - DNA, 19 bp, Homo sapiens
cagagggaagccagtcagg

SEQ ID NO: 4554030 - DNA, 23 bp, Homo sapiens
cagagggaagccagtcagggccc

SEQ ID NO: 4554031 - DNA, 18 bp, Homo sapiens
cagagggaccaaattgct

SEQ ID NO: 4554032 - DNA, 22 bp, Homo sapiens
cagagggagacagggctgctcc

SEQ ID NO: 4554033 - DNA, 20 bp, Homo sapiens
cagagggagtttaatacagg

SEQ ID NO: 4554034 - DNA, 14 bp, Homo sapiens
cagagggcacatga

SEQ ID NO: 4554035 - DNA, 18 bp, Homo sapiens
cagagggcagaggctgga

SEQ ID NO: 4554036 - DNA, 13 bp, Homo sapiens
cagagggctaggg

SEQ ID NO: 4554037 - DNA, 14 bp, Homo sapiens
cagagggctaggga

SEQ ID NO: 4554038 - DNA, 14 bp, Homo sapiens
cagagggctggagg

SEQ ID NO: 4554039 - DNA, 14 bp, Homo sapiens
cagaggggccagct

SEQ ID NO: 4554040 - DNA, 23 bp, Homo sapiens
cagaggggcgttctcccaaagat

SEQ ID NO: 4554041 - DNA, 22 bp, Homo sapiens
cagagggggagtagccaagctg

SEQ ID NO: 4554042 - DNA, 16 bp, Homo sapiens
cagagggtgtcaaaca

SEQ ID NO: 4554043 - DNA, 20 bp, Homo sapiens
cagagggtgtggctttccag

SEQ ID NO: 4554044 - DNA, 14 bp, Homo sapiens
cagaggtccaggcc

SEQ ID NO: 4554045 - DNA, 15 bp, Homo sapiens
cagaggtccaggccc

SEQ ID NO: 4554046 - DNA, 22 bp, Homo sapiens
cagaggtccaggtcccagcccc

SEQ ID NO: 4554047 - DNA, 19 bp, Homo sapiens
cagaggtctcatctcccag

SEQ ID NO: 4554048 - DNA, 20 bp, Homo sapiens
cagaggtctcatctcccagg

SEQ ID NO: 4554049 - DNA, 21 bp, Homo sapiens
cagaggtctcatctcccaggc

SEQ ID NO: 4554050 - DNA, 13 bp, Homo sapiens
cagaggtctccca

SEQ ID NO: 4554051 - DNA, 16 bp, Homo sapiens
cagaggttgcagtgag

SEQ ID NO: 4554052 - DNA, 18 bp, Homo sapiens
cagaggttgcagtgagct

SEQ ID NO: 4554053 - DNA, 21 bp, Homo sapiens
cagaggttgcagtgagctgag

SEQ ID NO: 4554054 - DNA, 18 bp, Homo sapiens
cagaggttgtagtgagcc

SEQ ID NO: 4554055 - DNA, 14 bp, Homo sapiens
cagagtaacaggat

SEQ ID NO: 4554056 - DNA, 22 bp, Homo sapiens
cagagtcaccttttctgtggct

SEQ ID NO: 4554057 - DNA, 17 bp, Homo sapiens
cagagtcagaggagaag

SEQ ID NO: 4554058 - DNA, 13 bp, Homo sapiens
cagagtccagtgc

SEQ ID NO: 4554059 - DNA, 15 bp, Homo sapiens
cagagtccagtgctc

SEQ ID NO: 4554060 - DNA, 20 bp, Homo sapiens
cagagtccagtgctctgcct

SEQ ID NO: 4554061 - DNA, 14 bp, Homo sapiens
cagagtccctgcct

SEQ ID NO: 4554062 - DNA, 15 bp, Homo sapiens
cagagtgacagtcat

SEQ ID NO: 4554063 - DNA, 16 bp, Homo sapiens
cagagtgacagtcata

SEQ ID NO: 4554064 - DNA, 19 bp, Homo sapiens
cagagtgacagtcataaat

SEQ ID NO: 4554065 - DNA, 15 bp, Homo sapiens
cagagtgagacccag

SEQ ID NO: 4554066 - DNA, 17 bp, Homo sapiens
cagagtgagacccagcc

SEQ ID NO: 4554067 - DNA, 20 bp, Homo sapiens
cagagtgagacccagccctc

SEQ ID NO: 4554068 - DNA, 20 bp, Homo sapiens
cagagtgagaccctgtctca

SEQ ID NO: 4554069 - DNA, 11 bp, Homo sapiens
cagagtgccac

SEQ ID NO: 4554070 - DNA, 15 bp, Homo sapiens
cagagtgccactgcg

SEQ ID NO: 4554071 - DNA, 22 bp, Homo sapiens
cagagtgctggactgttccagg

SEQ ID NO: 4554072 - DNA, 13 bp, Homo sapiens
cagagtggagtct

SEQ ID NO: 4554073 - DNA, 17 bp, Homo sapiens
cagagtggcctccctgc

SEQ ID NO: 4554074 - DNA, 18 bp, Homo sapiens
cagagtggcctccctgct

SEQ ID NO: 4554075 - DNA, 19 bp, Homo sapiens
cagagtgtgggaagggaga

SEQ ID NO: 4554076 - DNA, 15 bp, Homo sapiens
cagagttacagttct

SEQ ID NO: 4554077 - DNA, 23 bp, Homo sapiens
cagagttcagacttcgctaaggg

SEQ ID NO: 4554078 - DNA, 17 bp, Homo sapiens
cagagttgcttaatgaa

SEQ ID NO: 4554079 - DNA, 17 bp, Homo sapiens
cagagtttcaccatgtt

SEQ ID NO: 4554080 - DNA, 15 bp, Homo sapiens
cagataaaatatttt

SEQ ID NO: 4554081 - DNA, 22 bp, Homo sapiens
cagataaaatattttgttaact

SEQ ID NO: 4554082 - DNA, 23 bp, Homo sapiens
cagataaatagtttatgattcca

SEQ ID NO: 4554083 - DNA, 19 bp, Homo sapiens
cagataactgaaaattatt

SEQ ID NO: 4554084 - DNA, 13 bp, Homo sapiens
cagataatgtgaa

SEQ ID NO: 4554085 - DNA, 16 bp, Homo sapiens
cagataatgtgaaaat

SEQ ID NO: 4554086 - DNA, 15 bp, Homo sapiens
cagatacctcaccct

SEQ ID NO: 4554087 - DNA, 22 bp, Homo sapiens
cagatataaaagactgaccaat

SEQ ID NO: 4554088 - DNA, 15 bp, Homo sapiens
cagatataactgtct

SEQ ID NO: 4554089 - DNA, 20 bp, Homo sapiens
cagatataactgtcttgttt

SEQ ID NO: 4554090 - DNA, 22 bp, Homo sapiens
cagatataactgtcttgtttca

SEQ ID NO: 4554091 - DNA, 15 bp, Homo sapiens
cagatatactttgtg

SEQ ID NO: 4554092 - DNA, 16 bp, Homo sapiens
cagatcagtgtaccat

SEQ ID NO: 4554093 - DNA, 13 bp, Homo sapiens
cagatcatctggg

SEQ ID NO: 4554094 - DNA, 15 bp, Homo sapiens
cagatcatctgggga

SEQ ID NO: 4554095 - DNA, 22 bp, Homo sapiens
cagatcccaggcccctggaggc

SEQ ID NO: 4554096 - DNA, 22 bp, Homo sapiens
cagatccccagcccctcctccc

SEQ ID NO: 4554097 - DNA, 14 bp, Homo sapiens
cagatcctcttggt

SEQ ID NO: 4554098 - DNA, 23 bp, Homo sapiens
cagatctggggcagcaccctata

SEQ ID NO: 4554099 - DNA, 13 bp, Homo sapiens
cagatctgtctga

SEQ ID NO: 4554100 - DNA, 13 bp, Homo sapiens
cagatctgtgccc

SEQ ID NO: 4554101 - DNA, 12 bp, Homo sapiens
cagatctgtttt

SEQ ID NO: 4554102 - DNA, 13 bp, Homo sapiens
cagatctgttttg

SEQ ID NO: 4554103 - DNA, 18 bp, Homo sapiens
cagatcttaatataaatt

SEQ ID NO: 4554104 - DNA, 23 bp, Homo sapiens
cagatcttccgtggtcagagtgc

SEQ ID NO: 4554105 - DNA, 18 bp, Homo sapiens
cagatgaaaaggagcctg

SEQ ID NO: 4554106 - DNA, 13 bp, Homo sapiens
cagatgaataaac

SEQ ID NO: 4554107 - DNA, 16 bp, Homo sapiens
cagatgagagtttctg

SEQ ID NO: 4554108 - DNA, 16 bp, Homo sapiens
cagatgagcaggagct

SEQ ID NO: 4554109 - DNA, 18 bp, Homo sapiens
cagatgagcaggagcttg

SEQ ID NO: 4554110 - DNA, 18 bp, Homo sapiens
cagatgatctctccacgg

SEQ ID NO: 4554111 - DNA, 21 bp, Homo sapiens
cagatgatgctttgagaacat

SEQ ID NO: 4554112 - DNA, 18 bp, Homo sapiens
cagatgatttcccccctc

SEQ ID NO: 4554113 - DNA, 19 bp, Homo sapiens
cagatgcaacctcactatg

SEQ ID NO: 4554114 - DNA, 15 bp, Homo sapiens
cagatgccccagagc

SEQ ID NO: 4554115 - DNA, 16 bp, Homo sapiens
cagatgccccagagct

SEQ ID NO: 4554116 - DNA, 19 bp, Homo sapiens
cagatgcccgagggagggg

SEQ ID NO: 4554117 - DNA, 15 bp, Homo sapiens
cagatgcctggtgag

SEQ ID NO: 4554118 - DNA, 20 bp, Homo sapiens
cagatgcctggtgagcaggg

SEQ ID NO: 4554119 - DNA, 12 bp, Homo sapiens
cagatgctgaat

SEQ ID NO: 4554120 - DNA, 17 bp, Homo sapiens
cagatgctggtggagga

SEQ ID NO: 4554121 - DNA, 13 bp, Homo sapiens
cagatggaaaaat

SEQ ID NO: 4554122 - DNA, 21 bp, Homo sapiens
cagatggaaagacgtttttgt

SEQ ID NO: 4554123 - DNA, 23 bp, Homo sapiens
cagatgtaatgttttctttgcaa

SEQ ID NO: 4554124 - DNA, 15 bp, Homo sapiens
cagatgtcttccctg

SEQ ID NO: 4554125 - DNA, 17 bp, Homo sapiens
cagatgtcttccctggg

SEQ ID NO: 4554126 - DNA, 19 bp, Homo sapiens
cagatgtcttccctgggct

SEQ ID NO: 4554127 - DNA, 23 bp, Homo sapiens
cagatgtcttccctgggctgcca

SEQ ID NO: 4554128 - DNA, 17 bp, Homo sapiens
cagatgtcttctgcctg

SEQ ID NO: 4554129 - DNA, 18 bp, Homo sapiens
cagatgtgtcccccccag

SEQ ID NO: 4554130 - DNA, 21 bp, Homo sapiens
cagatgtgtcccccccaggcc

SEQ ID NO: 4554131 - DNA, 22 bp, Homo sapiens
cagatgtgtcccccccaggcct

SEQ ID NO: 4554132 - DNA, 17 bp, Homo sapiens
cagatgttaaaataaat

SEQ ID NO: 4554133 - DNA, 14 bp, Homo sapiens
cagatgtttcatca

SEQ ID NO: 4554134 - DNA, 19 bp, Homo sapiens
cagatgtttcatcaatgca

SEQ ID NO: 4554135 - DNA, 19 bp, Homo sapiens
cagattaaattacagcttt

SEQ ID NO: 4554136 - DNA, 16 bp, Homo sapiens
cagattcaggccagcc

SEQ ID NO: 4554137 - DNA, 19 bp, Homo sapiens
cagattcaggccagcccag

SEQ ID NO: 4554138 - DNA, 16 bp, Homo sapiens
cagattccaacatttc

SEQ ID NO: 4554139 - DNA, 20 bp, Homo sapiens
cagattcggaccactaggcc

SEQ ID NO: 4554140 - DNA, 14 bp, Homo sapiens
cagattctgcctct

SEQ ID NO: 4554141 - DNA, 16 bp, Homo sapiens
cagattctgcctctct

SEQ ID NO: 4554142 - DNA, 18 bp, Homo sapiens
cagattctttttttctgt

SEQ ID NO: 4554143 - DNA, 21 bp, Homo sapiens
cagatttaacctgttatttct

SEQ ID NO: 4554144 - DNA, 14 bp, Homo sapiens
cagatttccagcct

SEQ ID NO: 4554145 - DNA, 14 bp, Homo sapiens
cagatttctgagga

SEQ ID NO: 4554146 - DNA, 17 bp, Homo sapiens
cagatttctgaggaaat

SEQ ID NO: 4554147 - DNA, 13 bp, Homo sapiens
cagatttctgtaa

SEQ ID NO: 4554148 - DNA, 13 bp, Homo sapiens
cagattttgataa

SEQ ID NO: 4554149 - DNA, 22 bp, Homo sapiens
cagatttttatcttaattgcaa

SEQ ID NO: 4554150 - DNA, 14 bp, Homo sapiens
cagattttttaaaa

SEQ ID NO: 4554151 - DNA, 14 bp, Homo sapiens
cagatttttttgta

SEQ ID NO: 4554152 - DNA, 19 bp, Homo sapiens
cagatttttttgtaagggg

SEQ ID NO: 4554153 - DNA, 22 bp, Homo sapiens
cagcaaagcagcagtgtccaga

SEQ ID NO: 4554154 - DNA, 13 bp, Homo sapiens
cagcaaaggaact

SEQ ID NO: 4554155 - DNA, 18 bp, Homo sapiens
cagcaaataaagcagtca

SEQ ID NO: 4554156 - DNA, 18 bp, Homo sapiens
cagcaaatgggcatttta

SEQ ID NO: 4554157 - DNA, 16 bp, Homo sapiens
cagcaaccctacagta

SEQ ID NO: 4554158 - DNA, 19 bp, Homo sapiens
cagcaacccttcctgctgc

SEQ ID NO: 4554159 - DNA, 15 bp, Homo sapiens
cagcaagatgtttct

SEQ ID NO: 4554160 - DNA, 22 bp, Homo sapiens
cagcaagggtgatgggaaagca

SEQ ID NO: 4554161 - DNA, 17 bp, Homo sapiens
cagcaagttcacatgga

SEQ ID NO: 4554162 - DNA, 15 bp, Homo sapiens
cagcaatattttgta

SEQ ID NO: 4554163 - DNA, 15 bp, Homo sapiens
cagcaattaggcaga

SEQ ID NO: 4554164 - DNA, 17 bp, Homo sapiens
cagcaattcagacccct

SEQ ID NO: 4554165 - DNA, 13 bp, Homo sapiens
cagcacacaggca

SEQ ID NO: 4554166 - DNA, 18 bp, Homo sapiens
cagcacacaggcagccag

SEQ ID NO: 4554167 - DNA, 19 bp, Homo sapiens
cagcacacaggcagccagc

SEQ ID NO: 4554168 - DNA, 20 bp, Homo sapiens
cagcacacaggcagccagcc

SEQ ID NO: 4554169 - DNA, 22 bp, Homo sapiens
cagcacacaggcagccagccgt

SEQ ID NO: 4554170 - DNA, 20 bp, Homo sapiens
cagcacattcgggaccaata

SEQ ID NO: 4554171 - DNA, 23 bp, Homo sapiens
cagcacattcgggaccaatatat

SEQ ID NO: 4554172 - DNA, 16 bp, Homo sapiens
cagcaccaaccacagc

SEQ ID NO: 4554173 - DNA, 17 bp, Homo sapiens
cagcaccaaccacagca

SEQ ID NO: 4554174 - DNA, 23 bp, Homo sapiens
cagcaccaccatttaatttcatg

SEQ ID NO: 4554175 - DNA, 17 bp, Homo sapiens
cagcaccctataaatca

SEQ ID NO: 4554176 - DNA, 14 bp, Homo sapiens
cagcaccctctcct

SEQ ID NO: 4554177 - DNA, 19 bp, Homo sapiens
cagcacctattgaattacc

SEQ ID NO: 4554178 - DNA, 18 bp, Homo sapiens
cagcactaaggccgtgtc

SEQ ID NO: 4554179 - DNA, 22 bp, Homo sapiens
cagcactaaggccgtgtctctg

SEQ ID NO: 4554180 - DNA, 15 bp, Homo sapiens
cagcactactgggtg

SEQ ID NO: 4554181 - DNA, 20 bp, Homo sapiens
cagcactactgggtgtcatt

SEQ ID NO: 4554182 - DNA, 19 bp, Homo sapiens
cagcactatgctttccttc

SEQ ID NO: 4554183 - DNA, 21 bp, Homo sapiens
cagcactccgcatcacctcac

SEQ ID NO: 4554184 - DNA, 18 bp, Homo sapiens
cagcactgcttgaggaaa

SEQ ID NO: 4554185 - DNA, 22 bp, Homo sapiens
cagcactggtgaactgagctgg

SEQ ID NO: 4554186 - DNA, 12 bp, Homo sapiens
cagcactgtgag

SEQ ID NO: 4554187 - DNA, 13 bp, Homo sapiens
cagcacttattta

SEQ ID NO: 4554188 - DNA, 14 bp, Homo sapiens
cagcacttgtctca

SEQ ID NO: 4554189 - DNA, 20 bp, Homo sapiens
cagcacttgtctcattttaa

SEQ ID NO: 4554190 - DNA, 23 bp, Homo sapiens
cagcacttgtctcattttaatgt

SEQ ID NO: 4554191 - DNA, 21 bp, Homo sapiens
cagcactttgagaggctgagg

SEQ ID NO: 4554192 - DNA, 23 bp, Homo sapiens
cagcactttgagaggctgaggtg

SEQ ID NO: 4554193 - DNA, 16 bp, Homo sapiens
cagcactttgggaggc

SEQ ID NO: 4554194 - DNA, 18 bp, Homo sapiens
cagcactttgggaggccg

SEQ ID NO: 4554195 - DNA, 20 bp, Homo sapiens
cagcagaagcctccaagcac

SEQ ID NO: 4554196 - DNA, 23 bp, Homo sapiens
cagcagaagcctccaagcacaga

SEQ ID NO: 4554197 - DNA, 17 bp, Homo sapiens
cagcagaagggggtggt

SEQ ID NO: 4554198 - DNA, 18 bp, Homo sapiens
cagcagagccagggcagg

SEQ ID NO: 4554199 - DNA, 20 bp, Homo sapiens
cagcagagccagggcagggc

SEQ ID NO: 4554200 - DNA, 22 bp, Homo sapiens
cagcagaggacagtctggagaa

SEQ ID NO: 4554201 - DNA, 23 bp, Homo sapiens
cagcagaggacagtctggagaag

SEQ ID NO: 4554202 - DNA, 12 bp, Homo sapiens
cagcagaggcag

SEQ ID NO: 4554203 - DNA, 13 bp, Homo sapiens
cagcagaggcagg

SEQ ID NO: 4554204 - DNA, 15 bp, Homo sapiens
cagcagaggcaggct

SEQ ID NO: 4554205 - DNA, 18 bp, Homo sapiens
cagcagcaccaaccacag

SEQ ID NO: 4554206 - DNA, 15 bp, Homo sapiens
cagcagcagcaacct

SEQ ID NO: 4554207 - DNA, 13 bp, Homo sapiens
cagcagcagcctg

SEQ ID NO: 4554208 - DNA, 14 bp, Homo sapiens
cagcagcagcctgc

SEQ ID NO: 4554209 - DNA, 15 bp, Homo sapiens
cagcagcagctctga

SEQ ID NO: 4554210 - DNA, 12 bp, Homo sapiens
cagcagcccccc

SEQ ID NO: 4554211 - DNA, 15 bp, Homo sapiens
cagcagccccccagc

SEQ ID NO: 4554212 - DNA, 17 bp, Homo sapiens
cagcagccccccagcac

SEQ ID NO: 4554213 - DNA, 16 bp, Homo sapiens
cagcagcccctgagag

SEQ ID NO: 4554214 - DNA, 21 bp, Homo sapiens
cagcagcccctgagagcctgt

SEQ ID NO: 4554215 - DNA, 17 bp, Homo sapiens
cagcagccctcctcacc

SEQ ID NO: 4554216 - DNA, 19 bp, Homo sapiens
cagcagccctcctcacccc

SEQ ID NO: 4554217 - DNA, 11 bp, Homo sapiens
cagcagcctgc

SEQ ID NO: 4554218 - DNA, 18 bp, Homo sapiens
cagcagcctgcacctgcc

SEQ ID NO: 4554219 - DNA, 21 bp, Homo sapiens
cagcagcgaccacccctgcct

SEQ ID NO: 4554220 - DNA, 15 bp, Homo sapiens
cagcagctctgagcc

SEQ ID NO: 4554221 - DNA, 17 bp, Homo sapiens
cagcagctctgagccag

SEQ ID NO: 4554222 - DNA, 18 bp, Homo sapiens
cagcagctctgagccaga

SEQ ID NO: 4554223 - DNA, 22 bp, Homo sapiens
cagcagctctgagccagattac

SEQ ID NO: 4554224 - DNA, 15 bp, Homo sapiens
cagcagctctggctc

SEQ ID NO: 4554225 - DNA, 20 bp, Homo sapiens
cagcagctctggctctgcct

SEQ ID NO: 4554226 - DNA, 24 bp, Homo sapiens
cagcagctctggctctgcctcagg

SEQ ID NO: 4554227 - DNA, 20 bp, Homo sapiens
cagcagcttggggagaggga

SEQ ID NO: 4554228 - DNA, 20 bp, Homo sapiens
cagcaggagagactgagcag

SEQ ID NO: 4554229 - DNA, 23 bp, Homo sapiens
cagcaggaggcaagcgtgttctc

SEQ ID NO: 4554230 - DNA, 23 bp, Homo sapiens
cagcaggcatttgctaaggcagc

SEQ ID NO: 4554231 - DNA, 15 bp, Homo sapiens
cagcaggcctctggt

SEQ ID NO: 4554232 - DNA, 16 bp, Homo sapiens
cagcaggctcaggcac

SEQ ID NO: 4554233 - DNA, 15 bp, Homo sapiens
cagcaggctgccagt

SEQ ID NO: 4554234 - DNA, 18 bp, Homo sapiens
cagcaggctgccagtgcc

SEQ ID NO: 4554235 - DNA, 14 bp, Homo sapiens
cagcaggctggcct

SEQ ID NO: 4554236 - DNA, 11 bp, Homo sapiens
cagcagggcta

SEQ ID NO: 4554237 - DNA, 19 bp, Homo sapiens
cagcaggtagcctgctggt

SEQ ID NO: 4554238 - DNA, 15 bp, Homo sapiens
cagcagtacaataaa

SEQ ID NO: 4554239 - DNA, 22 bp, Homo sapiens
cagcagtcgcccaagcagacag

SEQ ID NO: 4554240 - DNA, 15 bp, Homo sapiens
cagcagtgtccagag

SEQ ID NO: 4554241 - DNA, 18 bp, Homo sapiens
cagcagtgttctgggtga

SEQ ID NO: 4554242 - DNA, 11 bp, Homo sapiens
cagcagtttta

SEQ ID NO: 4554243 - DNA, 13 bp, Homo sapiens
cagcatccctgga

SEQ ID NO: 4554244 - DNA, 14 bp, Homo sapiens
cagcatccctggag

SEQ ID NO: 4554245 - DNA, 15 bp, Homo sapiens
cagcatccctggagc

SEQ ID NO: 4554246 - DNA, 19 bp, Homo sapiens
cagcatccctggagcagga

SEQ ID NO: 4554247 - DNA, 21 bp, Homo sapiens
cagcatcccttcccacatgcc

SEQ ID NO: 4554248 - DNA, 13 bp, Homo sapiens
cagcatctcttct

SEQ ID NO: 4554249 - DNA, 14 bp, Homo sapiens
cagcatctggaaga

SEQ ID NO: 4554250 - DNA, 21 bp, Homo sapiens
cagcatgacataacagtgcag

SEQ ID NO: 4554251 - DNA, 15 bp, Homo sapiens
cagcatggcatagcc

SEQ ID NO: 4554252 - DNA, 20 bp, Homo sapiens
cagcatgtacggattttcag

SEQ ID NO: 4554253 - DNA, 23 bp, Homo sapiens
cagcatgtgttaatcttaatgta

SEQ ID NO: 4554254 - DNA, 21 bp, Homo sapiens
cagcattccagacttcaaaaa

SEQ ID NO: 4554255 - DNA, 19 bp, Homo sapiens
cagcattccagctctgccc

SEQ ID NO: 4554256 - DNA, 20 bp, Homo sapiens
cagcattccagctctgcccc

SEQ ID NO: 4554257 - DNA, 23 bp, Homo sapiens
cagcattcccagggaccttggaa

SEQ ID NO: 4554258 - DNA, 19 bp, Homo sapiens
cagcattgctactgctcag

SEQ ID NO: 4554259 - DNA, 21 bp, Homo sapiens
cagcattgctactgctcagct

SEQ ID NO: 4554260 - DNA, 16 bp, Homo sapiens
cagcattgtatatgtg

SEQ ID NO: 4554261 - DNA, 14 bp, Homo sapiens
cagcatttgataat

SEQ ID NO: 4554262 - DNA, 14 bp, Homo sapiens
cagcatttgatctg

SEQ ID NO: 4554263 - DNA, 16 bp, Homo sapiens
cagcatttgatctgtt

SEQ ID NO: 4554264 - DNA, 18 bp, Homo sapiens
cagcatttttatttcaga

SEQ ID NO: 4554265 - DNA, 19 bp, Homo sapiens
cagccaacgagacacattg

SEQ ID NO: 4554266 - DNA, 14 bp, Homo sapiens
cagccaactagccc

SEQ ID NO: 4554267 - DNA, 16 bp, Homo sapiens
cagccaagattttcct

SEQ ID NO: 4554268 - DNA, 13 bp, Homo sapiens
cagccaagtgcag

SEQ ID NO: 4554269 - DNA, 17 bp, Homo sapiens
cagccaagtgcagagtt

SEQ ID NO: 4554270 - DNA, 18 bp, Homo sapiens
cagccaagttgtgacagt

SEQ ID NO: 4554271 - DNA, 17 bp, Homo sapiens
cagccacaaagcccccc

SEQ ID NO: 4554272 - DNA, 22 bp, Homo sapiens
cagccacaaagccccccagctc

SEQ ID NO: 4554273 - DNA, 16 bp, Homo sapiens
cagccacaccactgcc

SEQ ID NO: 4554274 - DNA, 23 bp, Homo sapiens
cagccacacctggactgaccctg

SEQ ID NO: 4554275 - DNA, 13 bp, Homo sapiens
cagccacaggcca

SEQ ID NO: 4554276 - DNA, 14 bp, Homo sapiens
cagccacaggccaa

SEQ ID NO: 4554277 - DNA, 12 bp, Homo sapiens
cagccacatgcc

SEQ ID NO: 4554278 - DNA, 18 bp, Homo sapiens
cagccacatgccccaggc

SEQ ID NO: 4554279 - DNA, 19 bp, Homo sapiens
cagccacatgccccaggct

SEQ ID NO: 4554280 - DNA, 23 bp, Homo sapiens
cagccacattgagactttcttct

SEQ ID NO: 4554281 - DNA, 12 bp, Homo sapiens
cagccaccagcg

SEQ ID NO: 4554282 - DNA, 11 bp, Homo sapiens
cagccaccccg

SEQ ID NO: 4554283 - DNA, 17 bp, Homo sapiens
cagccacctaaaaacat

SEQ ID NO: 4554284 - DNA, 15 bp, Homo sapiens
cagccactaagaacc

SEQ ID NO: 4554285 - DNA, 19 bp, Homo sapiens
cagccactaagaacccctc

SEQ ID NO: 4554286 - DNA, 12 bp, Homo sapiens
cagccactggct

SEQ ID NO: 4554287 - DNA, 18 bp, Homo sapiens
cagccagaggagggcaga

SEQ ID NO: 4554288 - DNA, 17 bp, Homo sapiens
cagccagatcctcttgg

SEQ ID NO: 4554289 - DNA, 12 bp, Homo sapiens
cagccagcagag

SEQ ID NO: 4554290 - DNA, 11 bp, Homo sapiens
cagccagccca

SEQ ID NO: 4554291 - DNA, 12 bp, Homo sapiens
cagccagcccag

SEQ ID NO: 4554292 - DNA, 15 bp, Homo sapiens
cagccagcccttccc

SEQ ID NO: 4554293 - DNA, 14 bp, Homo sapiens
cagccagccgccct

SEQ ID NO: 4554294 - DNA, 13 bp, Homo sapiens
cagccagcctcag

SEQ ID NO: 4554295 - DNA, 19 bp, Homo sapiens
cagccagcctcagaaggcc

SEQ ID NO: 4554296 - DNA, 12 bp, Homo sapiens
cagccagcctcc

SEQ ID NO: 4554297 - DNA, 19 bp, Homo sapiens
cagccagcgcctccctcca

SEQ ID NO: 4554298 - DNA, 21 bp, Homo sapiens
cagccagcgcctccctccacc

SEQ ID NO: 4554299 - DNA, 22 bp, Homo sapiens
cagccagcgcctccctccaccc

SEQ ID NO: 4554300 - DNA, 16 bp, Homo sapiens
cagccaggctctgtgc

SEQ ID NO: 4554301 - DNA, 23 bp, Homo sapiens
cagccaggctctgtgctgaccct

SEQ ID NO: 4554302 - DNA, 12 bp, Homo sapiens
cagccagggctg

SEQ ID NO: 4554303 - DNA, 18 bp, Homo sapiens
cagccagggctggggttg

SEQ ID NO: 4554304 - DNA, 13 bp, Homo sapiens
cagccaggtgcct

SEQ ID NO: 4554305 - DNA, 16 bp, Homo sapiens
cagccaggtggcacct

SEQ ID NO: 4554306 - DNA, 19 bp, Homo sapiens
cagccaggtggcacctgca

SEQ ID NO: 4554307 - DNA, 21 bp, Homo sapiens
cagccatacttatctctctgt

SEQ ID NO: 4554308 - DNA, 23 bp, Homo sapiens
cagccatcctccctccacctcaa

SEQ ID NO: 4554309 - DNA, 16 bp, Homo sapiens
cagccatcgtcctggg

SEQ ID NO: 4554310 - DNA, 17 bp, Homo sapiens
cagccatcgtcctggga

SEQ ID NO: 4554311 - DNA, 16 bp, Homo sapiens
cagccatgaagtcacc

SEQ ID NO: 4554312 - DNA, 22 bp, Homo sapiens
cagccatgaggagttgctgttt

SEQ ID NO: 4554313 - DNA, 17 bp, Homo sapiens
cagccattctaactcat

SEQ ID NO: 4554314 - DNA, 16 bp, Homo sapiens
cagcccaaaatttgat

SEQ ID NO: 4554315 - DNA, 13 bp, Homo sapiens
cagcccaacagca

SEQ ID NO: 4554316 - DNA, 14 bp, Homo sapiens
cagcccaacagcac

SEQ ID NO: 4554317 - DNA, 15 bp, Homo sapiens
cagcccaacagcact

SEQ ID NO: 4554318 - DNA, 16 bp, Homo sapiens
cagcccaacagcactt

SEQ ID NO: 4554319 - DNA, 16 bp, Homo sapiens
cagcccacagagcctg

SEQ ID NO: 4554320 - DNA, 23 bp, Homo sapiens
cagcccaccccctttgactctgg

SEQ ID NO: 4554321 - DNA, 11 bp, Homo sapiens
cagcccagagc

SEQ ID NO: 4554322 - DNA, 12 bp, Homo sapiens
cagcccagccag

SEQ ID NO: 4554323 - DNA, 21 bp, Homo sapiens
cagcccaggagtttgaggctg

SEQ ID NO: 4554324 - DNA, 16 bp, Homo sapiens
cagcccatgcccacct

SEQ ID NO: 4554325 - DNA, 17 bp, Homo sapiens
cagcccatgcccacctg

SEQ ID NO: 4554326 - DNA, 19 bp, Homo sapiens
cagcccatggcccccaata

SEQ ID NO: 4554327 - DNA, 20 bp, Homo sapiens
cagcccatggcccccaataa

SEQ ID NO: 4554328 - DNA, 23 bp, Homo sapiens
cagcccattctctctcctgtcca

SEQ ID NO: 4554329 - DNA, 24 bp, Homo sapiens
cagcccattggccgagctcctggg

SEQ ID NO: 4554330 - DNA, 21 bp, Homo sapiens
cagccccaactccaggggcac

SEQ ID NO: 4554331 - DNA, 12 bp, Homo sapiens
cagccccaccca

SEQ ID NO: 4554332 - DNA, 15 bp, Homo sapiens
cagccccacccagga

SEQ ID NO: 4554333 - DNA, 16 bp, Homo sapiens
cagccccacccaggag

SEQ ID NO: 4554334 - DNA, 18 bp, Homo sapiens
cagccccacttcaccccc

SEQ ID NO: 4554335 - DNA, 15 bp, Homo sapiens
cagccccaggccagc

SEQ ID NO: 4554336 - DNA, 17 bp, Homo sapiens
cagccccaggccagctg

SEQ ID NO: 4554337 - DNA, 18 bp, Homo sapiens
cagccccaggccagctgc

SEQ ID NO: 4554338 - DNA, 13 bp, Homo sapiens
cagccccatcaga

SEQ ID NO: 4554339 - DNA, 17 bp, Homo sapiens
cagccccatcagaacct

SEQ ID NO: 4554340 - DNA, 13 bp, Homo sapiens
cagcccccacagt

SEQ ID NO: 4554341 - DNA, 17 bp, Homo sapiens
cagcccccacagtgctg

SEQ ID NO: 4554342 - DNA, 17 bp, Homo sapiens
cagcccccactgcaccc

SEQ ID NO: 4554343 - DNA, 19 bp, Homo sapiens
cagcccccgccccagagtg

SEQ ID NO: 4554344 - DNA, 18 bp, Homo sapiens
cagccccctcccaccgct

SEQ ID NO: 4554345 - DNA, 15 bp, Homo sapiens
cagccccctttgggc

SEQ ID NO: 4554346 - DNA, 19 bp, Homo sapiens
cagccccctttgggcccag

SEQ ID NO: 4554347 - DNA, 20 bp, Homo sapiens
cagccccctttgggcccagg

SEQ ID NO: 4554348 - DNA, 22 bp, Homo sapiens
cagccccctttgggcccaggga

SEQ ID NO: 4554349 - DNA, 15 bp, Homo sapiens
cagccccgactccag

SEQ ID NO: 4554350 - DNA, 16 bp, Homo sapiens
cagccccgactccagc

SEQ ID NO: 4554351 - DNA, 17 bp, Homo sapiens
cagccccgactccagcc

SEQ ID NO: 4554352 - DNA, 13 bp, Homo sapiens
cagccccgcctgt

SEQ ID NO: 4554353 - DNA, 21 bp, Homo sapiens
cagccccgcctgtcacaataa

SEQ ID NO: 4554354 - DNA, 19 bp, Homo sapiens
cagccccggcaagccacag

SEQ ID NO: 4554355 - DNA, 13 bp, Homo sapiens
cagccccggggcc

SEQ ID NO: 4554356 - DNA, 18 bp, Homo sapiens
cagccccggggccccctg

SEQ ID NO: 4554357 - DNA, 20 bp, Homo sapiens
cagcccctatagcactgagc

SEQ ID NO: 4554358 - DNA, 23 bp, Homo sapiens
cagcccctcctccctcagaccca

SEQ ID NO: 4554359 - DNA, 23 bp, Homo sapiens
cagcccctcctccctcaggccca

SEQ ID NO: 4554360 - DNA, 16 bp, Homo sapiens
cagcccctcctctgcc

SEQ ID NO: 4554361 - DNA, 17 bp, Homo sapiens
cagcccctcctctgcca

SEQ ID NO: 4554362 - DNA, 22 bp, Homo sapiens
cagcccctcctctgccacctcc

SEQ ID NO: 4554363 - DNA, 17 bp, Homo sapiens
cagcccctggagcctca

SEQ ID NO: 4554364 - DNA, 18 bp, Homo sapiens
cagcccctggagcctcag

SEQ ID NO: 4554365 - DNA, 19 bp, Homo sapiens
cagcccctggggcccagcc

SEQ ID NO: 4554366 - DNA, 20 bp, Homo sapiens
cagcccctgtttactggttc

SEQ ID NO: 4554367 - DNA, 19 bp, Homo sapiens
cagcccgcctgccgtgcat

SEQ ID NO: 4554368 - DNA, 23 bp, Homo sapiens
cagcccgcctgccgtgcatggct

SEQ ID NO: 4554369 - DNA, 14 bp, Homo sapiens
cagcccgctgagtg

SEQ ID NO: 4554370 - DNA, 18 bp, Homo sapiens
cagccctagagcctgcct

SEQ ID NO: 4554371 - DNA, 16 bp, Homo sapiens
cagccctagcggctgc

SEQ ID NO: 4554372 - DNA, 14 bp, Homo sapiens
cagccctcacccct

SEQ ID NO: 4554373 - DNA, 13 bp, Homo sapiens
cagccctcagttc

SEQ ID NO: 4554374 - DNA, 19 bp, Homo sapiens
cagccctccctgtcctcct

SEQ ID NO: 4554375 - DNA, 12 bp, Homo sapiens
cagccctcctca

SEQ ID NO: 4554376 - DNA, 16 bp, Homo sapiens
cagccctcctcacccc

SEQ ID NO: 4554377 - DNA, 22 bp, Homo sapiens
cagccctcctcaccccgtctgg

SEQ ID NO: 4554378 - DNA, 17 bp, Homo sapiens
cagccctcctctgcact

SEQ ID NO: 4554379 - DNA, 12 bp, Homo sapiens
cagccctgcacg

SEQ ID NO: 4554380 - DNA, 13 bp, Homo sapiens
cagccctgcagcc

SEQ ID NO: 4554381 - DNA, 12 bp, Homo sapiens
cagccctgctag

SEQ ID NO: 4554382 - DNA, 13 bp, Homo sapiens
cagccctgctccc

SEQ ID NO: 4554383 - DNA, 20 bp, Homo sapiens
cagccctgctccctgcctcc

SEQ ID NO: 4554384 - DNA, 22 bp, Homo sapiens
cagccctgctccctgcctcctg

SEQ ID NO: 4554385 - DNA, 18 bp, Homo sapiens
cagccctgctggccgcct

SEQ ID NO: 4554386 - DNA, 21 bp, Homo sapiens
cagccctgctggccgcctcac

SEQ ID NO: 4554387 - DNA, 12 bp, Homo sapiens
cagccctggcaa

SEQ ID NO: 4554388 - DNA, 15 bp, Homo sapiens
cagccctggcccagg

SEQ ID NO: 4554389 - DNA, 17 bp, Homo sapiens
cagccctggcccaggtg

SEQ ID NO: 4554390 - DNA, 12 bp, Homo sapiens
cagccctgggcc

SEQ ID NO: 4554391 - DNA, 13 bp, Homo sapiens
cagccctgggccc

SEQ ID NO: 4554392 - DNA, 23 bp, Homo sapiens
cagccctgggccccaccacctag

SEQ ID NO: 4554393 - DNA, 18 bp, Homo sapiens
cagccctggtctcagcag

SEQ ID NO: 4554394 - DNA, 12 bp, Homo sapiens
cagcccttcatg

SEQ ID NO: 4554395 - DNA, 15 bp, Homo sapiens
cagcccttccctggc

SEQ ID NO: 4554396 - DNA, 16 bp, Homo sapiens
cagcccttccctggcc

SEQ ID NO: 4554397 - DNA, 20 bp, Homo sapiens
cagccgcattggtgactcac

SEQ ID NO: 4554398 - DNA, 17 bp, Homo sapiens
cagccgccattgccacc

SEQ ID NO: 4554399 - DNA, 23 bp, Homo sapiens
cagccgccattgccaccaggaga

SEQ ID NO: 4554400 - DNA, 15 bp, Homo sapiens
cagccgccctgggct

SEQ ID NO: 4554401 - DNA, 16 bp, Homo sapiens
cagccgccctgggctg

SEQ ID NO: 4554402 - DNA, 19 bp, Homo sapiens
cagccgcgggccaggaggc

SEQ ID NO: 4554403 - DNA, 19 bp, Homo sapiens
cagccgctgagcgaggaga

SEQ ID NO: 4554404 - DNA, 16 bp, Homo sapiens
cagccgggcacagtgg

SEQ ID NO: 4554405 - DNA, 19 bp, Homo sapiens
cagccggtacctgggaagg

SEQ ID NO: 4554406 - DNA, 13 bp, Homo sapiens
cagccgtatttta

SEQ ID NO: 4554407 - DNA, 23 bp, Homo sapiens
cagccgtcccgcgttcaagactt

SEQ ID NO: 4554408 - DNA, 20 bp, Homo sapiens
cagcctaaagtacagcctgg

SEQ ID NO: 4554409 - DNA, 21 bp, Homo sapiens
cagcctaatgagagtgcactg

SEQ ID NO: 4554410 - DNA, 12 bp, Homo sapiens
cagcctcacaga

SEQ ID NO: 4554411 - DNA, 14 bp, Homo sapiens
cagcctcacagaag

SEQ ID NO: 4554412 - DNA, 18 bp, Homo sapiens
cagcctcagaaggcccca

SEQ ID NO: 4554413 - DNA, 22 bp, Homo sapiens
cagcctcagagatctcccttct

SEQ ID NO: 4554414 - DNA, 21 bp, Homo sapiens
cagcctccatcctaccccctg

SEQ ID NO: 4554415 - DNA, 12 bp, Homo sapiens
cagcctcccaca

SEQ ID NO: 4554416 - DNA, 17 bp, Homo sapiens
cagcctcccatagctgg

SEQ ID NO: 4554417 - DNA, 13 bp, Homo sapiens
cagcctcccctcc

SEQ ID NO: 4554418 - DNA, 14 bp, Homo sapiens
cagcctcccctccc

SEQ ID NO: 4554419 - DNA, 18 bp, Homo sapiens
cagcctcccctcccctgg

SEQ ID NO: 4554420 - DNA, 12 bp, Homo sapiens
cagcctcctctg

SEQ ID NO: 4554421 - DNA, 21 bp, Homo sapiens
cagcctcctctggacggcagg

SEQ ID NO: 4554422 - DNA, 16 bp, Homo sapiens
cagcctctgccgctgc

SEQ ID NO: 4554423 - DNA, 19 bp, Homo sapiens
cagcctctgccgctgccat

SEQ ID NO: 4554424 - DNA, 22 bp, Homo sapiens
cagcctctgccgctgccatgct

SEQ ID NO: 4554425 - DNA, 14 bp, Homo sapiens
cagcctctgctgga

SEQ ID NO: 4554426 - DNA, 15 bp, Homo sapiens
cagcctctgctggag

SEQ ID NO: 4554427 - DNA, 12 bp, Homo sapiens
cagcctctggac

SEQ ID NO: 4554428 - DNA, 18 bp, Homo sapiens
cagcctctggacagccag

SEQ ID NO: 4554429 - DNA, 19 bp, Homo sapiens
cagcctctggacagccagt

SEQ ID NO: 4554430 - DNA, 20 bp, Homo sapiens
cagcctctggacagccagtg

SEQ ID NO: 4554431 - DNA, 13 bp, Homo sapiens
cagcctcttactt

SEQ ID NO: 4554432 - DNA, 20 bp, Homo sapiens
cagcctgagcaactcttgat

SEQ ID NO: 4554433 - DNA, 15 bp, Homo sapiens
cagcctgagtgacag

SEQ ID NO: 4554434 - DNA, 15 bp, Homo sapiens
cagcctgcacccctc

SEQ ID NO: 4554435 - DNA, 13 bp, Homo sapiens
cagcctgcacctg

SEQ ID NO: 4554436 - DNA, 18 bp, Homo sapiens
cagcctgcacctgccccg

SEQ ID NO: 4554437 - DNA, 15 bp, Homo sapiens
cagcctgcctggcag

SEQ ID NO: 4554438 - DNA, 19 bp, Homo sapiens
cagcctgcctggcaggctg

SEQ ID NO: 4554439 - DNA, 21 bp, Homo sapiens
cagcctgctccttcccaggag

SEQ ID NO: 4554440 - DNA, 13 bp, Homo sapiens
cagcctgctctcc

SEQ ID NO: 4554441 - DNA, 15 bp, Homo sapiens
cagcctggatgccat

SEQ ID NO: 4554442 - DNA, 18 bp, Homo sapiens
cagcctggctctgccccc

SEQ ID NO: 4554443 - DNA, 20 bp, Homo sapiens
cagcctgggagcccagaggg

SEQ ID NO: 4554444 - DNA, 20 bp, Homo sapiens
cagcctgggcaacaagagca

SEQ ID NO: 4554445 - DNA, 18 bp, Homo sapiens
cagcctgggcagccaggc

SEQ ID NO: 4554446 - DNA, 19 bp, Homo sapiens
cagcctgggcagccaggct

SEQ ID NO: 4554447 - DNA, 20 bp, Homo sapiens
cagcctgggccatctcttag

SEQ ID NO: 4554448 - DNA, 23 bp, Homo sapiens
cagcctgtttctatcctgtttaa

SEQ ID NO: 4554449 - DNA, 15 bp, Homo sapiens
cagccttatgtgtta

SEQ ID NO: 4554450 - DNA, 15 bp, Homo sapiens
cagccttcccctccc

SEQ ID NO: 4554451 - DNA, 18 bp, Homo sapiens
cagccttcccctccctgt

SEQ ID NO: 4554452 - DNA, 19 bp, Homo sapiens
cagccttcccctccctgta

SEQ ID NO: 4554453 - DNA, 20 bp, Homo sapiens
cagccttccgggaactggag

SEQ ID NO: 4554454 - DNA, 16 bp, Homo sapiens
cagccttctccatatc

SEQ ID NO: 4554455 - DNA, 13 bp, Homo sapiens
cagccttgcccag

SEQ ID NO: 4554456 - DNA, 11 bp, Homo sapiens
cagccttgctc

SEQ ID NO: 4554457 - DNA, 12 bp, Homo sapiens
cagccttgctct

SEQ ID NO: 4554458 - DNA, 18 bp, Homo sapiens
cagccttgctctcttcaa

SEQ ID NO: 4554459 - DNA, 21 bp, Homo sapiens
cagccttgctctcttcaataa

SEQ ID NO: 4554460 - DNA, 20 bp, Homo sapiens
cagcctttctggcaggtcct

SEQ ID NO: 4554461 - DNA, 14 bp, Homo sapiens
cagcgaccacccct

SEQ ID NO: 4554462 - DNA, 16 bp, Homo sapiens
cagcgcatcctgcagg

SEQ ID NO: 4554463 - DNA, 23 bp, Homo sapiens
cagcgcctagtggggtctccctc

SEQ ID NO: 4554464 - DNA, 20 bp, Homo sapiens
cagcgcctccctccacccca

SEQ ID NO: 4554465 - DNA, 18 bp, Homo sapiens
cagcgcggtcctgactcc

SEQ ID NO: 4554466 - DNA, 22 bp, Homo sapiens
cagcgctgtatttacagacaca

SEQ ID NO: 4554467 - DNA, 15 bp, Homo sapiens
cagcggctccaactc

SEQ ID NO: 4554468 - DNA, 17 bp, Homo sapiens
cagcggctccaactcct

SEQ ID NO: 4554469 - DNA, 22 bp, Homo sapiens
cagcggctgccctctggggcca

SEQ ID NO: 4554470 - DNA, 22 bp, Homo sapiens
cagcgtcccctgctactcctgt

SEQ ID NO: 4554471 - DNA, 14 bp, Homo sapiens
cagcgtcctgtcca

SEQ ID NO: 4554472 - DNA, 15 bp, Homo sapiens
cagcgtgctttaaaa

SEQ ID NO: 4554473 - DNA, 22 bp, Homo sapiens
cagcgtgggaactcactttccc

SEQ ID NO: 4554474 - DNA, 12 bp, Homo sapiens
cagctaaagcaa

SEQ ID NO: 4554475 - DNA, 21 bp, Homo sapiens
cagctaaggaggggaaaaaaa

SEQ ID NO: 4554476 - DNA, 19 bp, Homo sapiens
cagctaatttttgtatttt

SEQ ID NO: 4554477 - DNA, 22 bp, Homo sapiens
cagctaatttttgtatttttag

SEQ ID NO: 4554478 - DNA, 17 bp, Homo sapiens
cagctaccctgtgtata

SEQ ID NO: 4554479 - DNA, 17 bp, Homo sapiens
cagctactcaggaggct

SEQ ID NO: 4554480 - DNA, 15 bp, Homo sapiens
cagctactctcccca

SEQ ID NO: 4554481 - DNA, 20 bp, Homo sapiens
cagctactggggaggctgag

SEQ ID NO: 4554482 - DNA, 23 bp, Homo sapiens
cagctactggggaggctgaggca

SEQ ID NO: 4554483 - DNA, 16 bp, Homo sapiens
cagctacttggaaggc

SEQ ID NO: 4554484 - DNA, 16 bp, Homo sapiens
cagctataattctgtt

SEQ ID NO: 4554485 - DNA, 22 bp, Homo sapiens
cagctatctgtcatctctctgg

SEQ ID NO: 4554486 - DNA, 17 bp, Homo sapiens
cagctatgggagcccca

SEQ ID NO: 4554487 - DNA, 18 bp, Homo sapiens
cagctatgggagccccag

SEQ ID NO: 4554488 - DNA, 22 bp, Homo sapiens
cagctatgggagccccagggtc

SEQ ID NO: 4554489 - DNA, 21 bp, Homo sapiens
cagctatgttatattgaaaaa

SEQ ID NO: 4554490 - DNA, 22 bp, Homo sapiens
cagctcaccccccacactcact

SEQ ID NO: 4554491 - DNA, 20 bp, Homo sapiens
cagctcaggaattccctgga

SEQ ID NO: 4554492 - DNA, 21 bp, Homo sapiens
cagctcaggtgacaaccatta

SEQ ID NO: 4554493 - DNA, 14 bp, Homo sapiens
cagctcattaaact

SEQ ID NO: 4554494 - DNA, 14 bp, Homo sapiens
cagctccacacgcc

SEQ ID NO: 4554495 - DNA, 17 bp, Homo sapiens
cagctccacacgccccg

SEQ ID NO: 4554496 - DNA, 20 bp, Homo sapiens
cagctccatgttctcccaaa

SEQ ID NO: 4554497 - DNA, 23 bp, Homo sapiens
cagctcccacaccgcgtcccagc

SEQ ID NO: 4554498 - DNA, 15 bp, Homo sapiens
cagctcccaccccac

SEQ ID NO: 4554499 - DNA, 20 bp, Homo sapiens
cagctcccaccccaccccct

SEQ ID NO: 4554500 - DNA, 17 bp, Homo sapiens
cagctcccctcggagaa

SEQ ID NO: 4554501 - DNA, 15 bp, Homo sapiens
cagctcccctctttt

SEQ ID NO: 4554502 - DNA, 21 bp, Homo sapiens
cagctccctttctcaggagct

SEQ ID NO: 4554503 - DNA, 19 bp, Homo sapiens
cagctccgggatcagcaac

SEQ ID NO: 4554504 - DNA, 15 bp, Homo sapiens
cagctcctggaccag

SEQ ID NO: 4554505 - DNA, 13 bp, Homo sapiens
cagctccttcctg

SEQ ID NO: 4554506 - DNA, 16 bp, Homo sapiens
cagctccttcctggag

SEQ ID NO: 4554507 - DNA, 19 bp, Homo sapiens
cagctcctttctcctgtga

SEQ ID NO: 4554508 - DNA, 14 bp, Homo sapiens
cagctcgatccaaa

SEQ ID NO: 4554509 - DNA, 20 bp, Homo sapiens
cagctcgatccaaattgtgc

SEQ ID NO: 4554510 - DNA, 22 bp, Homo sapiens
cagctctaggctgttctgtagc

SEQ ID NO: 4554511 - DNA, 16 bp, Homo sapiens
cagctctccctctggc

SEQ ID NO: 4554512 - DNA, 20 bp, Homo sapiens
cagctctccctctggccctg

SEQ ID NO: 4554513 - DNA, 16 bp, Homo sapiens
cagctctgagccagat

SEQ ID NO: 4554514 - DNA, 19 bp, Homo sapiens
cagctctgagccagattac

SEQ ID NO: 4554515 - DNA, 20 bp, Homo sapiens
cagctctgagccagattaca

SEQ ID NO: 4554516 - DNA, 12 bp, Homo sapiens
cagctctgcccc

SEQ ID NO: 4554517 - DNA, 20 bp, Homo sapiens
cagctctgcccccgcgggtt

SEQ ID NO: 4554518 - DNA, 22 bp, Homo sapiens
cagctctgcccccgcgggttct

SEQ ID NO: 4554519 - DNA, 16 bp, Homo sapiens
cagctctgctatgagt

SEQ ID NO: 4554520 - DNA, 12 bp, Homo sapiens
cagctctggcac

SEQ ID NO: 4554521 - DNA, 13 bp, Homo sapiens
cagctctggcaca

SEQ ID NO: 4554522 - DNA, 16 bp, Homo sapiens
cagctctggctctgcc

SEQ ID NO: 4554523 - DNA, 21 bp, Homo sapiens
cagctctggctctgcctcagg

SEQ ID NO: 4554524 - DNA, 14 bp, Homo sapiens
cagctctggggcag

SEQ ID NO: 4554525 - DNA, 15 bp, Homo sapiens
cagctctggggcaga

SEQ ID NO: 4554526 - DNA, 19 bp, Homo sapiens
cagctctggggcagaggaa

SEQ ID NO: 4554527 - DNA, 13 bp, Homo sapiens
cagctgagcctga

SEQ ID NO: 4554528 - DNA, 17 bp, Homo sapiens
cagctgagtgggaaccg

SEQ ID NO: 4554529 - DNA, 15 bp, Homo sapiens
cagctgcaaagtgtt

SEQ ID NO: 4554530 - DNA, 20 bp, Homo sapiens
cagctgcaaggtactctggt

SEQ ID NO: 4554531 - DNA, 17 bp, Homo sapiens
cagctgccccggcccct

SEQ ID NO: 4554532 - DNA, 14 bp, Homo sapiens
cagctgcccttgca

SEQ ID NO: 4554533 - DNA, 13 bp, Homo sapiens
cagctgcctctgc

SEQ ID NO: 4554534 - DNA, 18 bp, Homo sapiens
cagctgcctctgctccct

SEQ ID NO: 4554535 - DNA, 19 bp, Homo sapiens
cagctgcctctgctccctc

SEQ ID NO: 4554536 - DNA, 20 bp, Homo sapiens
cagctgcctctgctccctct

SEQ ID NO: 4554537 - DNA, 20 bp, Homo sapiens
cagctgccttagcttcagga

SEQ ID NO: 4554538 - DNA, 21 bp, Homo sapiens
cagctgccttagcttcaggaa

SEQ ID NO: 4554539 - DNA, 23 bp, Homo sapiens
cagctgccttagcttcaggaacc

SEQ ID NO: 4554540 - DNA, 15 bp, Homo sapiens
cagctgcggccaggc

SEQ ID NO: 4554541 - DNA, 23 bp, Homo sapiens
cagctgctccgaggacccaggaa

SEQ ID NO: 4554542 - DNA, 20 bp, Homo sapiens
cagctgctgaaacaacaaat

SEQ ID NO: 4554543 - DNA, 19 bp, Homo sapiens
cagctgctgagatcctgga

SEQ ID NO: 4554544 - DNA, 13 bp, Homo sapiens
cagctgctggaga

SEQ ID NO: 4554545 - DNA, 14 bp, Homo sapiens
cagctgctggagaa

SEQ ID NO: 4554546 - DNA, 12 bp, Homo sapiens
cagctgctgtct

SEQ ID NO: 4554547 - DNA, 13 bp, Homo sapiens
cagctgctgtctg

SEQ ID NO: 4554548 - DNA, 16 bp, Homo sapiens
cagctgctgtctgagt

SEQ ID NO: 4554549 - DNA, 23 bp, Homo sapiens
cagctgctgtctgagtagtggcc

SEQ ID NO: 4554550 - DNA, 13 bp, Homo sapiens
cagctgctgtggg

SEQ ID NO: 4554551 - DNA, 16 bp, Homo sapiens
cagctgctgttctcag

SEQ ID NO: 4554552 - DNA, 22 bp, Homo sapiens
cagctgctgttctcaggacagc

SEQ ID NO: 4554553 - DNA, 15 bp, Homo sapiens
cagctgctttcttct

SEQ ID NO: 4554554 - DNA, 16 bp, Homo sapiens
cagctgctttgacaaa

SEQ ID NO: 4554555 - DNA, 21 bp, Homo sapiens
cagctggaatgtgccacagag

SEQ ID NO: 4554556 - DNA, 22 bp, Homo sapiens
cagctggaatgtgccacagagg

SEQ ID NO: 4554557 - DNA, 22 bp, Homo sapiens
cagctggatcgctgcacatggc

SEQ ID NO: 4554558 - DNA, 16 bp, Homo sapiens
cagctgggaagccctt

SEQ ID NO: 4554559 - DNA, 17 bp, Homo sapiens
cagctgggaagcccttt

SEQ ID NO: 4554560 - DNA, 15 bp, Homo sapiens
cagctgggcccaacc

SEQ ID NO: 4554561 - DNA, 21 bp, Homo sapiens
cagctgggcccaaccctgtct

SEQ ID NO: 4554562 - DNA, 15 bp, Homo sapiens
cagctggggccagag

SEQ ID NO: 4554563 - DNA, 21 bp, Homo sapiens
cagctggggccagaggctggg

SEQ ID NO: 4554564 - DNA, 22 bp, Homo sapiens
cagctggggccagaggctggga

SEQ ID NO: 4554565 - DNA, 21 bp, Homo sapiens
cagctgtcagaacactccaag

SEQ ID NO: 4554566 - DNA, 16 bp, Homo sapiens
cagctgtcctgtgatg

SEQ ID NO: 4554567 - DNA, 20 bp, Homo sapiens
cagctgtcctgtgatgtcag

SEQ ID NO: 4554568 - DNA, 22 bp, Homo sapiens
cagctgtgccgggaggcagcca

SEQ ID NO: 4554569 - DNA, 18 bp, Homo sapiens
cagctgtgctgtggagag

SEQ ID NO: 4554570 - DNA, 16 bp, Homo sapiens
cagctgtggcagagtt

SEQ ID NO: 4554571 - DNA, 17 bp, Homo sapiens
cagctgtggcagagtta

SEQ ID NO: 4554572 - DNA, 19 bp, Homo sapiens
cagctgtggcagagttaca

SEQ ID NO: 4554573 - DNA, 21 bp, Homo sapiens
cagctgtttatgcatagataa

SEQ ID NO: 4554574 - DNA, 17 bp, Homo sapiens
cagcttagatttcatag

SEQ ID NO: 4554575 - DNA, 21 bp, Homo sapiens
cagcttcaacttttctcttta

SEQ ID NO: 4554576 - DNA, 14 bp, Homo sapiens
cagcttcacccacc

SEQ ID NO: 4554577 - DNA, 15 bp, Homo sapiens
cagcttcacccacca

SEQ ID NO: 4554578 - DNA, 17 bp, Homo sapiens
cagcttcacccaccagg

SEQ ID NO: 4554579 - DNA, 19 bp, Homo sapiens
cagcttcacccaccaggcc

SEQ ID NO: 4554580 - DNA, 17 bp, Homo sapiens
cagcttcctgagggcta

SEQ ID NO: 4554581 - DNA, 20 bp, Homo sapiens
cagcttcctgtctgtttata

SEQ ID NO: 4554582 - DNA, 15 bp, Homo sapiens
cagcttcgaggacag

SEQ ID NO: 4554583 - DNA, 20 bp, Homo sapiens
cagcttcgtttattttcaag

SEQ ID NO: 4554584 - DNA, 17 bp, Homo sapiens
cagcttctactcctgcc

SEQ ID NO: 4554585 - DNA, 21 bp, Homo sapiens
cagcttctactcctgcctcat

SEQ ID NO: 4554586 - DNA, 19 bp, Homo sapiens
cagcttcttcacaggcact

SEQ ID NO: 4554587 - DNA, 21 bp, Homo sapiens
cagcttgagccgggcccctgg

SEQ ID NO: 4554588 - DNA, 14 bp, Homo sapiens
cagcttgccaggga

SEQ ID NO: 4554589 - DNA, 16 bp, Homo sapiens
cagcttgcgaataaca

SEQ ID NO: 4554590 - DNA, 15 bp, Homo sapiens
cagcttgctcttcag

SEQ ID NO: 4554591 - DNA, 17 bp, Homo sapiens
cagcttgtggagcccca

SEQ ID NO: 4554592 - DNA, 21 bp, Homo sapiens
cagctttaacctgctgggaat

SEQ ID NO: 4554593 - DNA, 20 bp, Homo sapiens
cagctttcatgattagcaag

SEQ ID NO: 4554594 - DNA, 17 bp, Homo sapiens
cagctttccctgcctct

SEQ ID NO: 4554595 - DNA, 19 bp, Homo sapiens
cagctttccctgcctctca

SEQ ID NO: 4554596 - DNA, 21 bp, Homo sapiens
cagctttgacgtattatctgt

SEQ ID NO: 4554597 - DNA, 16 bp, Homo sapiens
cagcttttatggatga

SEQ ID NO: 4554598 - DNA, 22 bp, Homo sapiens
cagcttttatggatgattaaat

SEQ ID NO: 4554599 - DNA, 15 bp, Homo sapiens
cagcttttcccagga

SEQ ID NO: 4554600 - DNA, 15 bp, Homo sapiens
cagcttttctgatgg

SEQ ID NO: 4554601 - DNA, 19 bp, Homo sapiens
cagcttttgttctagactt

SEQ ID NO: 4554602 - DNA, 19 bp, Homo sapiens
cagctttttaaagtgggtt

SEQ ID NO: 4554603 - DNA, 14 bp, Homo sapiens
caggaaaaaaactt

SEQ ID NO: 4554604 - DNA, 19 bp, Homo sapiens
caggaaaactgacagagga

SEQ ID NO: 4554605 - DNA, 20 bp, Homo sapiens
caggaaaaggctaagaaaaa

SEQ ID NO: 4554606 - DNA, 16 bp, Homo sapiens
caggaaaatcctctgg

SEQ ID NO: 4554607 - DNA, 13 bp, Homo sapiens
caggaaaattgaa

SEQ ID NO: 4554608 - DNA, 22 bp, Homo sapiens
caggaaacaaaccttgccttga

SEQ ID NO: 4554609 - DNA, 23 bp, Homo sapiens
caggaaacagttgcatgtagtaa

SEQ ID NO: 4554610 - DNA, 21 bp, Homo sapiens
caggaaactcctgtgaccaca

SEQ ID NO: 4554611 - DNA, 17 bp, Homo sapiens
caggaaagccctccccc

SEQ ID NO: 4554612 - DNA, 20 bp, Homo sapiens
caggaaagccctcccccttc

SEQ ID NO: 4554613 - DNA, 19 bp, Homo sapiens
caggaaaggaatcatttct

SEQ ID NO: 4554614 - DNA, 20 bp, Homo sapiens
caggaaatgaaaatgtcttg

SEQ ID NO: 4554615 - DNA, 12 bp, Homo sapiens
caggaaatgtag

SEQ ID NO: 4554616 - DNA, 14 bp, Homo sapiens
caggaacagctatg

SEQ ID NO: 4554617 - DNA, 20 bp, Homo sapiens
caggaacagctatgggagcc

SEQ ID NO: 4554618 - DNA, 20 bp, Homo sapiens
caggaacccttgcatccatt

SEQ ID NO: 4554619 - DNA, 14 bp, Homo sapiens
caggaactgggctg

SEQ ID NO: 4554620 - DNA, 19 bp, Homo sapiens
caggaactgggctgggcct

SEQ ID NO: 4554621 - DNA, 17 bp, Homo sapiens
caggaagaaagaatgtt

SEQ ID NO: 4554622 - DNA, 17 bp, Homo sapiens
caggaagcaccccatgc

SEQ ID NO: 4554623 - DNA, 12 bp, Homo sapiens
caggaagccaga

SEQ ID NO: 4554624 - DNA, 14 bp, Homo sapiens
caggaagccagagc

SEQ ID NO: 4554625 - DNA, 18 bp, Homo sapiens
caggaagccgtcctggcg

SEQ ID NO: 4554626 - DNA, 13 bp, Homo sapiens
caggaaggagagc

SEQ ID NO: 4554627 - DNA, 15 bp, Homo sapiens
caggaaggagagcct

SEQ ID NO: 4554628 - DNA, 22 bp, Homo sapiens
caggaaggaggggagagacagg

SEQ ID NO: 4554629 - DNA, 23 bp, Homo sapiens
caggaagggaaagcgggcagccc

SEQ ID NO: 4554630 - DNA, 17 bp, Homo sapiens
caggaagtggctcagac

SEQ ID NO: 4554631 - DNA, 22 bp, Homo sapiens
caggaagtggctcagacccctc

SEQ ID NO: 4554632 - DNA, 19 bp, Homo sapiens
caggaatattgtcatcctt

SEQ ID NO: 4554633 - DNA, 16 bp, Homo sapiens
caggaatcaagagctg

SEQ ID NO: 4554634 - DNA, 18 bp, Homo sapiens
caggaatcaagagctgcc

SEQ ID NO: 4554635 - DNA, 23 bp, Homo sapiens
caggaatcacccctctgcccctg

SEQ ID NO: 4554636 - DNA, 24 bp, Homo sapiens
caggaatcacccctctgcccctgc

SEQ ID NO: 4554637 - DNA, 21 bp, Homo sapiens
caggaatcagtttaaaagcac

SEQ ID NO: 4554638 - DNA, 14 bp, Homo sapiens
caggaatgaagaac

SEQ ID NO: 4554639 - DNA, 14 bp, Homo sapiens
caggaatggtgctt

SEQ ID NO: 4554640 - DNA, 16 bp, Homo sapiens
caggaattccctggaa

SEQ ID NO: 4554641 - DNA, 24 bp, Homo sapiens
caggacagcatcccttcccacatg

SEQ ID NO: 4554642 - DNA, 12 bp, Homo sapiens
caggacaggacc

SEQ ID NO: 4554643 - DNA, 21 bp, Homo sapiens
caggaccagtcaacctgggca

SEQ ID NO: 4554644 - DNA, 19 bp, Homo sapiens
caggacccagtggtcagca

SEQ ID NO: 4554645 - DNA, 20 bp, Homo sapiens
caggaccctgacctccgccc

SEQ ID NO: 4554646 - DNA, 17 bp, Homo sapiens
caggacctgtggccaag

SEQ ID NO: 4554647 - DNA, 17 bp, Homo sapiens
caggacgccactcattt

SEQ ID NO: 4554648 - DNA, 13 bp, Homo sapiens
caggacggctcct

SEQ ID NO: 4554649 - DNA, 15 bp, Homo sapiens
caggacggctcctca

SEQ ID NO: 4554650 - DNA, 19 bp, Homo sapiens
caggacggctcctcagagc

SEQ ID NO: 4554651 - DNA, 17 bp, Homo sapiens
caggacgtctggggtgt

SEQ ID NO: 4554652 - DNA, 17 bp, Homo sapiens
caggactccaggcccaa

SEQ ID NO: 4554653 - DNA, 19 bp, Homo sapiens
caggactccaggcccaagg

SEQ ID NO: 4554654 - DNA, 17 bp, Homo sapiens
caggactccctcctcac

SEQ ID NO: 4554655 - DNA, 22 bp, Homo sapiens
caggactccctcctcacctctg

SEQ ID NO: 4554656 - DNA, 21 bp, Homo sapiens
caggactctgcgggaggctgg

SEQ ID NO: 4554657 - DNA, 23 bp, Homo sapiens
caggactctgcgggaggctgggg

SEQ ID NO: 4554658 - DNA, 21 bp, Homo sapiens
caggactgaattgtccccagt

SEQ ID NO: 4554659 - DNA, 13 bp, Homo sapiens
caggactgggcca

SEQ ID NO: 4554660 - DNA, 23 bp, Homo sapiens
caggactggtgaatataaatgat

SEQ ID NO: 4554661 - DNA, 15 bp, Homo sapiens
caggagaagaacaag

SEQ ID NO: 4554662 - DNA, 19 bp, Homo sapiens
caggagaatttctactgag

SEQ ID NO: 4554663 - DNA, 23 bp, Homo sapiens
caggagacaggttagctgctccc

SEQ ID NO: 4554664 - DNA, 21 bp, Homo sapiens
caggagagactgagcagccgc

SEQ ID NO: 4554665 - DNA, 13 bp, Homo sapiens
caggagagccagc

SEQ ID NO: 4554666 - DNA, 16 bp, Homo sapiens
caggagagccagccct

SEQ ID NO: 4554667 - DNA, 21 bp, Homo sapiens
caggagagccagccctccctg

SEQ ID NO: 4554668 - DNA, 23 bp, Homo sapiens
caggagagccagccctccctgtc

SEQ ID NO: 4554669 - DNA, 18 bp, Homo sapiens
caggagatggagggcttg

SEQ ID NO: 4554670 - DNA, 20 bp, Homo sapiens
caggagatggagggcttggc

SEQ ID NO: 4554671 - DNA, 15 bp, Homo sapiens
caggagccccgccac

SEQ ID NO: 4554672 - DNA, 18 bp, Homo sapiens
caggagcctagcggagcc

SEQ ID NO: 4554673 - DNA, 17 bp, Homo sapiens
caggagcctcatccagc

SEQ ID NO: 4554674 - DNA, 19 bp, Homo sapiens
caggagcctggtccttccc

SEQ ID NO: 4554675 - DNA, 23 bp, Homo sapiens
caggagctagttctcagcttgca

SEQ ID NO: 4554676 - DNA, 20 bp, Homo sapiens
caggagctcttcaggcctcc

SEQ ID NO: 4554677 - DNA, 17 bp, Homo sapiens
caggagcttgggcagtg

SEQ ID NO: 4554678 - DNA, 13 bp, Homo sapiens
caggagcttgggt

SEQ ID NO: 4554679 - DNA, 15 bp, Homo sapiens
caggagcttgggtct

SEQ ID NO: 4554680 - DNA, 16 bp, Homo sapiens
caggagcttgggtctc

SEQ ID NO: 4554681 - DNA, 24 bp, Homo sapiens
caggagcttgggtctctctcggcc

SEQ ID NO: 4554682 - DNA, 17 bp, Homo sapiens
caggagctttggaccta

SEQ ID NO: 4554683 - DNA, 16 bp, Homo sapiens
caggaggagaaaagaa

SEQ ID NO: 4554684 - DNA, 18 bp, Homo sapiens
caggaggagaaaagaaat

SEQ ID NO: 4554685 - DNA, 23 bp, Homo sapiens
caggaggagctgcctcttctctt

SEQ ID NO: 4554686 - DNA, 14 bp, Homo sapiens
caggaggattgcct

SEQ ID NO: 4554687 - DNA, 12 bp, Homo sapiens
caggaggcaagc

SEQ ID NO: 4554688 - DNA, 20 bp, Homo sapiens
caggaggcaagcgtgttctc

SEQ ID NO: 4554689 - DNA, 21 bp, Homo sapiens
caggaggcaagcgtgttctca

SEQ ID NO: 4554690 - DNA, 23 bp, Homo sapiens
caggaggcaagcgtgttctcagc

SEQ ID NO: 4554691 - DNA, 18 bp, Homo sapiens
caggaggcagctcaggat

SEQ ID NO: 4554692 - DNA, 18 bp, Homo sapiens
caggaggcgaataaatgt

SEQ ID NO: 4554693 - DNA, 20 bp, Homo sapiens
caggaggcgaataaatgttc

SEQ ID NO: 4554694 - DNA, 21 bp, Homo sapiens
caggaggctgagacaggagaa

SEQ ID NO: 4554695 - DNA, 13 bp, Homo sapiens
caggaggctgagg

SEQ ID NO: 4554696 - DNA, 15 bp, Homo sapiens
caggaggctgaggca

SEQ ID NO: 4554697 - DNA, 12 bp, Homo sapiens
caggagggaggg

SEQ ID NO: 4554698 - DNA, 15 bp, Homo sapiens
caggagggcagcccg

SEQ ID NO: 4554699 - DNA, 18 bp, Homo sapiens
caggagggccagcgctgt

SEQ ID NO: 4554700 - DNA, 22 bp, Homo sapiens
caggaggtcaagatcagcctgg

SEQ ID NO: 4554701 - DNA, 13 bp, Homo sapiens
caggagtcacaga

SEQ ID NO: 4554702 - DNA, 22 bp, Homo sapiens
caggagtcacagatgaggcccc

SEQ ID NO: 4554703 - DNA, 17 bp, Homo sapiens
caggagtccagaccccc

SEQ ID NO: 4554704 - DNA, 20 bp, Homo sapiens
caggagtccagaccccccag

SEQ ID NO: 4554705 - DNA, 12 bp, Homo sapiens
caggagtccagc

SEQ ID NO: 4554706 - DNA, 13 bp, Homo sapiens
caggagtccagcc

SEQ ID NO: 4554707 - DNA, 19 bp, Homo sapiens
caggagtccaggcccccag

SEQ ID NO: 4554708 - DNA, 17 bp, Homo sapiens
caggagtgtcctcttcc

SEQ ID NO: 4554709 - DNA, 23 bp, Homo sapiens
caggagtgtcctgcccatgcccc

SEQ ID NO: 4554710 - DNA, 22 bp, Homo sapiens
caggagtgtcctggctgtgaat

SEQ ID NO: 4554711 - DNA, 18 bp, Homo sapiens
caggagttcaagaccagc

SEQ ID NO: 4554712 - DNA, 12 bp, Homo sapiens
caggagttctga

SEQ ID NO: 4554713 - DNA, 17 bp, Homo sapiens
caggagtttgagaccag

SEQ ID NO: 4554714 - DNA, 18 bp, Homo sapiens
caggagtttgagaccagg

SEQ ID NO: 4554715 - DNA, 20 bp, Homo sapiens
caggagtttgagaccaggct

SEQ ID NO: 4554716 - DNA, 20 bp, Homo sapiens
caggatactggcacagaggt

SEQ ID NO: 4554717 - DNA, 22 bp, Homo sapiens
caggatcccaggggcccaaggc

SEQ ID NO: 4554718 - DNA, 18 bp, Homo sapiens
caggatctgctccaacag

SEQ ID NO: 4554719 - DNA, 15 bp, Homo sapiens
caggatctgtctgtg

SEQ ID NO: 4554720 - DNA, 17 bp, Homo sapiens
caggatctttgactgaa

SEQ ID NO: 4554721 - DNA, 17 bp, Homo sapiens
caggatggcctttcctt

SEQ ID NO: 4554722 - DNA, 18 bp, Homo sapiens
caggatggcctttccttc

SEQ ID NO: 4554723 - DNA, 20 bp, Homo sapiens
caggatggcctttccttccc

SEQ ID NO: 4554724 - DNA, 12 bp, Homo sapiens
caggattaatat

SEQ ID NO: 4554725 - DNA, 16 bp, Homo sapiens
caggattagataaggc

SEQ ID NO: 4554726 - DNA, 19 bp, Homo sapiens
caggattagataaggctgt

SEQ ID NO: 4554727 - DNA, 21 bp, Homo sapiens
caggatttgaactcagatctg

SEQ ID NO: 4554728 - DNA, 14 bp, Homo sapiens
caggatttggccac

SEQ ID NO: 4554729 - DNA, 22 bp, Homo sapiens
caggatttggccacactggggc

SEQ ID NO: 4554730 - DNA, 22 bp, Homo sapiens
caggattttaatttcaggaaaa

SEQ ID NO: 4554731 - DNA, 22 bp, Homo sapiens
caggcaaagttttacagagagg

SEQ ID NO: 4554732 - DNA, 18 bp, Homo sapiens
caggcacacagcagcccc

SEQ ID NO: 4554733 - DNA, 21 bp, Homo sapiens
caggcacacagcagcccccca

SEQ ID NO: 4554734 - DNA, 15 bp, Homo sapiens
caggcacacagggcc

SEQ ID NO: 4554735 - DNA, 16 bp, Homo sapiens
caggcaccaaaagaag

SEQ ID NO: 4554736 - DNA, 19 bp, Homo sapiens
caggcaccaaaagaagtaa

SEQ ID NO: 4554737 - DNA, 17 bp, Homo sapiens
caggcacccgtccccac

SEQ ID NO: 4554738 - DNA, 13 bp, Homo sapiens
caggcaccctcag

SEQ ID NO: 4554739 - DNA, 20 bp, Homo sapiens
caggcaccgccacgtcccag

SEQ ID NO: 4554740 - DNA, 23 bp, Homo sapiens
caggcaccgccacgtcccagcat

SEQ ID NO: 4554741 - DNA, 22 bp, Homo sapiens
caggcactgagataccagcgag

SEQ ID NO: 4554742 - DNA, 12 bp, Homo sapiens
caggcagagctg

SEQ ID NO: 4554743 - DNA, 22 bp, Homo sapiens
caggcagagctggagcccccag

SEQ ID NO: 4554744 - DNA, 13 bp, Homo sapiens
caggcagatctgt

SEQ ID NO: 4554745 - DNA, 16 bp, Homo sapiens
caggcagatctgtgcc

SEQ ID NO: 4554746 - DNA, 18 bp, Homo sapiens
caggcagatctgtgcccc

SEQ ID NO: 4554747 - DNA, 16 bp, Homo sapiens
caggcagccacgtctc

SEQ ID NO: 4554748 - DNA, 13 bp, Homo sapiens
caggcagcccagc

SEQ ID NO: 4554749 - DNA, 20 bp, Homo sapiens
caggcagcccagcagtgtgg

SEQ ID NO: 4554750 - DNA, 11 bp, Homo sapiens
caggcagcctc

SEQ ID NO: 4554751 - DNA, 20 bp, Homo sapiens
caggcaggaacaaacagggc

SEQ ID NO: 4554752 - DNA, 19 bp, Homo sapiens
caggcaggccagatggccc

SEQ ID NO: 4554753 - DNA, 21 bp, Homo sapiens
caggcaggccagatggcccct

SEQ ID NO: 4554754 - DNA, 13 bp, Homo sapiens
caggcagggaggg

SEQ ID NO: 4554755 - DNA, 12 bp, Homo sapiens
caggcagggcct

SEQ ID NO: 4554756 - DNA, 13 bp, Homo sapiens
caggcagggcctg

SEQ ID NO: 4554757 - DNA, 12 bp, Homo sapiens
caggcaggggtg

SEQ ID NO: 4554758 - DNA, 17 bp, Homo sapiens
caggcaggggtgggggt

SEQ ID NO: 4554759 - DNA, 22 bp, Homo sapiens
caggcaggggtgggggtggagg

SEQ ID NO: 4554760 - DNA, 14 bp, Homo sapiens
caggcaggtcacag

SEQ ID NO: 4554761 - DNA, 15 bp, Homo sapiens
caggcaggtgcaggg

SEQ ID NO: 4554762 - DNA, 15 bp, Homo sapiens
caggcagtccaggcc

SEQ ID NO: 4554763 - DNA, 21 bp, Homo sapiens
caggcatcggggagccgggag

SEQ ID NO: 4554764 - DNA, 15 bp, Homo sapiens
caggcattggatatt

SEQ ID NO: 4554765 - DNA, 19 bp, Homo sapiens
caggcattggctcagcccg

SEQ ID NO: 4554766 - DNA, 21 bp, Homo sapiens
caggcattggctcagcccgct

SEQ ID NO: 4554767 - DNA, 16 bp, Homo sapiens
caggcatttagccctc

SEQ ID NO: 4554768 - DNA, 23 bp, Homo sapiens
caggcatttgactgaagatgcag

SEQ ID NO: 4554769 - DNA, 12 bp, Homo sapiens
caggccacagag

SEQ ID NO: 4554770 - DNA, 18 bp, Homo sapiens
caggccacagagaacctg

SEQ ID NO: 4554771 - DNA, 12 bp, Homo sapiens
caggccacagcc

SEQ ID NO: 4554772 - DNA, 23 bp, Homo sapiens
caggccagatggcccctccactg

SEQ ID NO: 4554773 - DNA, 13 bp, Homo sapiens
caggccagcccag

SEQ ID NO: 4554774 - DNA, 16 bp, Homo sapiens
caggccagcccagcca

SEQ ID NO: 4554775 - DNA, 17 bp, Homo sapiens
caggccagcccagccag

SEQ ID NO: 4554776 - DNA, 13 bp, Homo sapiens
caggccagcctcc

SEQ ID NO: 4554777 - DNA, 19 bp, Homo sapiens
caggccagcctccgagagg

SEQ ID NO: 4554778 - DNA, 23 bp, Homo sapiens
caggccagcctccgagagggaga

SEQ ID NO: 4554779 - DNA, 17 bp, Homo sapiens
caggccagctcaggaat

SEQ ID NO: 4554780 - DNA, 14 bp, Homo sapiens
caggccagctgcgg

SEQ ID NO: 4554781 - DNA, 16 bp, Homo sapiens
caggccagctgcggcc

SEQ ID NO: 4554782 - DNA, 17 bp, Homo sapiens
caggccaggtgcccagg

SEQ ID NO: 4554783 - DNA, 19 bp, Homo sapiens
caggccaggtgcccaggaa

SEQ ID NO: 4554784 - DNA, 21 bp, Homo sapiens
caggcccacagcgtgggaact

SEQ ID NO: 4554785 - DNA, 12 bp, Homo sapiens
caggcccactcc

SEQ ID NO: 4554786 - DNA, 19 bp, Homo sapiens
caggcccactccccagccc

SEQ ID NO: 4554787 - DNA, 21 bp, Homo sapiens
caggcccagctgctcccctgg

SEQ ID NO: 4554788 - DNA, 13 bp, Homo sapiens
caggccccagaca

SEQ ID NO: 4554789 - DNA, 14 bp, Homo sapiens
caggcccccaaccc

SEQ ID NO: 4554790 - DNA, 17 bp, Homo sapiens
caggcccccaacccctc

SEQ ID NO: 4554791 - DNA, 23 bp, Homo sapiens
caggcccccaacccctcctccct

SEQ ID NO: 4554792 - DNA, 20 bp, Homo sapiens
caggcccccaacccctcctt

SEQ ID NO: 4554793 - DNA, 22 bp, Homo sapiens
caggcccccaacccctccttcc

SEQ ID NO: 4554794 - DNA, 13 bp, Homo sapiens
caggcccccagcc

SEQ ID NO: 4554795 - DNA, 16 bp, Homo sapiens
caggcccccagcccct

SEQ ID NO: 4554796 - DNA, 17 bp, Homo sapiens
caggccccgaggaccca

SEQ ID NO: 4554797 - DNA, 18 bp, Homo sapiens
caggccccgaggacccag

SEQ ID NO: 4554798 - DNA, 20 bp, Homo sapiens
caggccccgaggacccagac

SEQ ID NO: 4554799 - DNA, 23 bp, Homo sapiens
caggccccgaggacccagaccca

SEQ ID NO: 4554800 - DNA, 17 bp, Homo sapiens
caggccccgcttgtcca

SEQ ID NO: 4554801 - DNA, 19 bp, Homo sapiens
caggccccgcttgtccagc

SEQ ID NO: 4554802 - DNA, 14 bp, Homo sapiens
caggcccctggagg

SEQ ID NO: 4554803 - DNA, 19 bp, Homo sapiens
caggcccctggaggctgcc

SEQ ID NO: 4554804 - DNA, 20 bp, Homo sapiens
caggcccctggaggctgcct

SEQ ID NO: 4554805 - DNA, 16 bp, Homo sapiens
caggcccggcagggcg

SEQ ID NO: 4554806 - DNA, 17 bp, Homo sapiens
caggcccgtcagcatca

SEQ ID NO: 4554807 - DNA, 14 bp, Homo sapiens
caggccctccagtg

SEQ ID NO: 4554808 - DNA, 19 bp, Homo sapiens
caggccctccctgactccc

SEQ ID NO: 4554809 - DNA, 23 bp, Homo sapiens
caggccctccctgactccctgtg

SEQ ID NO: 4554810 - DNA, 13 bp, Homo sapiens
caggccctgactc

SEQ ID NO: 4554811 - DNA, 15 bp, Homo sapiens
caggccctgactcct

SEQ ID NO: 4554812 - DNA, 19 bp, Homo sapiens
caggccctgactcctctgg

SEQ ID NO: 4554813 - DNA, 14 bp, Homo sapiens
caggccgagagcct

SEQ ID NO: 4554814 - DNA, 14 bp, Homo sapiens
caggccgtgccttg

SEQ ID NO: 4554815 - DNA, 15 bp, Homo sapiens
caggcctatttaaca

SEQ ID NO: 4554816 - DNA, 15 bp, Homo sapiens
caggcctccctctct

SEQ ID NO: 4554817 - DNA, 22 bp, Homo sapiens
caggcctccctctctcttctgc

SEQ ID NO: 4554818 - DNA, 15 bp, Homo sapiens
caggcctctctctgc

SEQ ID NO: 4554819 - DNA, 17 bp, Homo sapiens
caggcctctctctgctc

SEQ ID NO: 4554820 - DNA, 18 bp, Homo sapiens
caggcctctctctgctcc

SEQ ID NO: 4554821 - DNA, 19 bp, Homo sapiens
caggcctctctctgctcca

SEQ ID NO: 4554822 - DNA, 16 bp, Homo sapiens
caggcctctgctggct

SEQ ID NO: 4554823 - DNA, 17 bp, Homo sapiens
caggcctctgctggctc

SEQ ID NO: 4554824 - DNA, 19 bp, Homo sapiens
caggcctctgctggctcag

SEQ ID NO: 4554825 - DNA, 16 bp, Homo sapiens
caggcctcttcctgtt

SEQ ID NO: 4554826 - DNA, 12 bp, Homo sapiens
caggcctcttgg

SEQ ID NO: 4554827 - DNA, 18 bp, Homo sapiens
caggcctcttggcagtca

SEQ ID NO: 4554828 - DNA, 18 bp, Homo sapiens
caggcctgagatttcatc

SEQ ID NO: 4554829 - DNA, 13 bp, Homo sapiens
caggcctgcctcc

SEQ ID NO: 4554830 - DNA, 19 bp, Homo sapiens
caggcctgcgggcccctgg

SEQ ID NO: 4554831 - DNA, 16 bp, Homo sapiens
caggcctggcctcatc

SEQ ID NO: 4554832 - DNA, 19 bp, Homo sapiens
caggcctggcctcatctca

SEQ ID NO: 4554833 - DNA, 16 bp, Homo sapiens
caggcctgtccaccct

SEQ ID NO: 4554834 - DNA, 21 bp, Homo sapiens
caggcctgtccaccctgccaa

SEQ ID NO: 4554835 - DNA, 16 bp, Homo sapiens
caggcctgtccctggg

SEQ ID NO: 4554836 - DNA, 19 bp, Homo sapiens
caggcctgtccctgggagt

SEQ ID NO: 4554837 - DNA, 21 bp, Homo sapiens
caggcctgtccctgggagtgt

SEQ ID NO: 4554838 - DNA, 23 bp, Homo sapiens
caggccttgtcctacgtccaagg

SEQ ID NO: 4554839 - DNA, 20 bp, Homo sapiens
caggcgcctataatcccagc

SEQ ID NO: 4554840 - DNA, 21 bp, Homo sapiens
caggcgcctataatcccagct

SEQ ID NO: 4554841 - DNA, 15 bp, Homo sapiens
caggcgctaattcaa

SEQ ID NO: 4554842 - DNA, 14 bp, Homo sapiens
caggctactgtcag

SEQ ID NO: 4554843 - DNA, 15 bp, Homo sapiens
caggctactgttctt

SEQ ID NO: 4554844 - DNA, 19 bp, Homo sapiens
caggctatatgcagtcctt

SEQ ID NO: 4554845 - DNA, 11 bp, Homo sapiens
caggctcagag

SEQ ID NO: 4554846 - DNA, 13 bp, Homo sapiens
caggctctgtgct

SEQ ID NO: 4554847 - DNA, 22 bp, Homo sapiens
caggctctgtgctgaccctcct

SEQ ID NO: 4554848 - DNA, 14 bp, Homo sapiens
caggctgagaactc

SEQ ID NO: 4554849 - DNA, 20 bp, Homo sapiens
caggctgcagaggcacctca

SEQ ID NO: 4554850 - DNA, 17 bp, Homo sapiens
caggctgccagtgcctg

SEQ ID NO: 4554851 - DNA, 20 bp, Homo sapiens
caggctgccagtgcctgggt

SEQ ID NO: 4554852 - DNA, 21 bp, Homo sapiens
caggctgccagtgcctgggtg

SEQ ID NO: 4554853 - DNA, 16 bp, Homo sapiens
caggctgcctcccttg

SEQ ID NO: 4554854 - DNA, 20 bp, Homo sapiens
caggctgcctcctgccctta

SEQ ID NO: 4554855 - DNA, 18 bp, Homo sapiens
caggctggagtgcagtgg

SEQ ID NO: 4554856 - DNA, 12 bp, Homo sapiens
caggctgggcca

SEQ ID NO: 4554857 - DNA, 20 bp, Homo sapiens
caggctgggccatgtccaaa

SEQ ID NO: 4554858 - DNA, 23 bp, Homo sapiens
caggctgggccatgtccaaagag

SEQ ID NO: 4554859 - DNA, 13 bp, Homo sapiens
caggctggggagg

SEQ ID NO: 4554860 - DNA, 18 bp, Homo sapiens
caggctggggaggtgctg

SEQ ID NO: 4554861 - DNA, 19 bp, Homo sapiens
caggctggggaggtgctgg

SEQ ID NO: 4554862 - DNA, 17 bp, Homo sapiens
caggctgggtcctgcca

SEQ ID NO: 4554863 - DNA, 18 bp, Homo sapiens
caggctgggtcctgccag

SEQ ID NO: 4554864 - DNA, 20 bp, Homo sapiens
caggctgggtcctgccagct

SEQ ID NO: 4554865 - DNA, 22 bp, Homo sapiens
caggctgggtcctgccagctgg

SEQ ID NO: 4554866 - DNA, 16 bp, Homo sapiens
caggctgtctggccag

SEQ ID NO: 4554867 - DNA, 16 bp, Homo sapiens
caggctgttctcagcg

SEQ ID NO: 4554868 - DNA, 20 bp, Homo sapiens
caggcttccctgacttgctt

SEQ ID NO: 4554869 - DNA, 19 bp, Homo sapiens
caggctttgtacagagtgc

SEQ ID NO: 4554870 - DNA, 19 bp, Homo sapiens
caggcttttctcaggagct

SEQ ID NO: 4554871 - DNA, 20 bp, Homo sapiens
caggcttttctcaggagctt

SEQ ID NO: 4554872 - DNA, 20 bp, Homo sapiens
cagggaacattggagctgac

SEQ ID NO: 4554873 - DNA, 16 bp, Homo sapiens
cagggaacttagtaag

SEQ ID NO: 4554874 - DNA, 13 bp, Homo sapiens
cagggaagctggc

SEQ ID NO: 4554875 - DNA, 13 bp, Homo sapiens
cagggaaggatcc

SEQ ID NO: 4554876 - DNA, 18 bp, Homo sapiens
cagggaaggatcccatga

SEQ ID NO: 4554877 - DNA, 15 bp, Homo sapiens
cagggaaggcctgac

SEQ ID NO: 4554878 - DNA, 15 bp, Homo sapiens
cagggaattcttaca

SEQ ID NO: 4554879 - DNA, 23 bp, Homo sapiens
cagggacaccagccaggctctgt

SEQ ID NO: 4554880 - DNA, 18 bp, Homo sapiens
cagggacaggataagagg

SEQ ID NO: 4554881 - DNA, 23 bp, Homo sapiens
cagggacatgccctgtgtggctg

SEQ ID NO: 4554882 - DNA, 24 bp, Homo sapiens
cagggaccactgggtgagagagga

SEQ ID NO: 4554883 - DNA, 18 bp, Homo sapiens
cagggaccggtgctgcag

SEQ ID NO: 4554884 - DNA, 22 bp, Homo sapiens
cagggaccggtgctgcaggagt

SEQ ID NO: 4554885 - DNA, 14 bp, Homo sapiens
cagggacctgctgc

SEQ ID NO: 4554886 - DNA, 18 bp, Homo sapiens
cagggaccttggaaacag

SEQ ID NO: 4554887 - DNA, 23 bp, Homo sapiens
cagggactgttcctgtctcagca

SEQ ID NO: 4554888 - DNA, 15 bp, Homo sapiens
cagggagcagccccc

SEQ ID NO: 4554889 - DNA, 16 bp, Homo sapiens
cagggagcagggaagg

SEQ ID NO: 4554890 - DNA, 15 bp, Homo sapiens
cagggagcatggctg

SEQ ID NO: 4554891 - DNA, 22 bp, Homo sapiens
cagggagcatttaatggcagct

SEQ ID NO: 4554892 - DNA, 23 bp, Homo sapiens
cagggagcatttaatggcagcta

SEQ ID NO: 4554893 - DNA, 15 bp, Homo sapiens
cagggagcctcccca

SEQ ID NO: 4554894 - DNA, 23 bp, Homo sapiens
cagggagcctccccatctgtcca

SEQ ID NO: 4554895 - DNA, 18 bp, Homo sapiens
cagggagccttctgccac

SEQ ID NO: 4554896 - DNA, 20 bp, Homo sapiens
cagggagggcttggggctgc

SEQ ID NO: 4554897 - DNA, 16 bp, Homo sapiens
cagggaggggaggcag

SEQ ID NO: 4554898 - DNA, 16 bp, Homo sapiens
cagggaggggcaacca

SEQ ID NO: 4554899 - DNA, 14 bp, Homo sapiens
cagggagtccaggg

SEQ ID NO: 4554900 - DNA, 15 bp, Homo sapiens
cagggagtccagggt

SEQ ID NO: 4554901 - DNA, 22 bp, Homo sapiens
cagggagtccagggtttctctg

SEQ ID NO: 4554902 - DNA, 19 bp, Homo sapiens
cagggataaggcctgtggg

SEQ ID NO: 4554903 - DNA, 21 bp, Homo sapiens
cagggatgctgggctgggccc

SEQ ID NO: 4554904 - DNA, 14 bp, Homo sapiens
cagggatgggcagc

SEQ ID NO: 4554905 - DNA, 17 bp, Homo sapiens
cagggatgggcagccca

SEQ ID NO: 4554906 - DNA, 23 bp, Homo sapiens
cagggcaaaatattcactgggcc

SEQ ID NO: 4554907 - DNA, 20 bp, Homo sapiens
cagggcacagtctccatgtg

SEQ ID NO: 4554908 - DNA, 14 bp, Homo sapiens
cagggcacccaggc

SEQ ID NO: 4554909 - DNA, 16 bp, Homo sapiens
cagggcacccaggcag

SEQ ID NO: 4554910 - DNA, 19 bp, Homo sapiens
cagggcagagtgagaccca

SEQ ID NO: 4554911 - DNA, 22 bp, Homo sapiens
cagggcagggcgagctgcagga

SEQ ID NO: 4554912 - DNA, 14 bp, Homo sapiens
cagggcatctggga

SEQ ID NO: 4554913 - DNA, 22 bp, Homo sapiens
cagggccaaacgctgagccacc

SEQ ID NO: 4554914 - DNA, 20 bp, Homo sapiens
cagggccacgctccagctgc

SEQ ID NO: 4554915 - DNA, 15 bp, Homo sapiens
cagggccacgtgcca

SEQ ID NO: 4554916 - DNA, 16 bp, Homo sapiens
cagggccactcaacag

SEQ ID NO: 4554917 - DNA, 15 bp, Homo sapiens
cagggccaggcctct

SEQ ID NO: 4554918 - DNA, 17 bp, Homo sapiens
cagggccatgtgctgcc

SEQ ID NO: 4554919 - DNA, 18 bp, Homo sapiens
cagggccatgtgctgccc

SEQ ID NO: 4554920 - DNA, 16 bp, Homo sapiens
cagggcccccaataaa

SEQ ID NO: 4554921 - DNA, 18 bp, Homo sapiens
cagggcccccaataaacc

SEQ ID NO: 4554922 - DNA, 14 bp, Homo sapiens
cagggcctcaggca

SEQ ID NO: 4554923 - DNA, 12 bp, Homo sapiens
cagggcctctgc

SEQ ID NO: 4554924 - DNA, 15 bp, Homo sapiens
cagggcctctgcgga

SEQ ID NO: 4554925 - DNA, 18 bp, Homo sapiens
cagggcctgaaacccgcc

SEQ ID NO: 4554926 - DNA, 17 bp, Homo sapiens
cagggcctgacttgagc

SEQ ID NO: 4554927 - DNA, 18 bp, Homo sapiens
cagggcctgacttgagcc

SEQ ID NO: 4554928 - DNA, 19 bp, Homo sapiens
cagggcctgacttgagcca

SEQ ID NO: 4554929 - DNA, 17 bp, Homo sapiens
cagggcctggagcccca

SEQ ID NO: 4554930 - DNA, 18 bp, Homo sapiens
cagggcctggagccccat

SEQ ID NO: 4554931 - DNA, 19 bp, Homo sapiens
cagggcctggctccagtct

SEQ ID NO: 4554932 - DNA, 17 bp, Homo sapiens
cagggccttgcccagag

SEQ ID NO: 4554933 - DNA, 20 bp, Homo sapiens
cagggccttgcccagagatg

SEQ ID NO: 4554934 - DNA, 15 bp, Homo sapiens
cagggcgagctgcag

SEQ ID NO: 4554935 - DNA, 13 bp, Homo sapiens
cagggcgcaagcc

SEQ ID NO: 4554936 - DNA, 21 bp, Homo sapiens
cagggcgccaagtctggcacc

SEQ ID NO: 4554937 - DNA, 13 bp, Homo sapiens
cagggcggcctcc

SEQ ID NO: 4554938 - DNA, 16 bp, Homo sapiens
cagggctaccctgagc

SEQ ID NO: 4554939 - DNA, 18 bp, Homo sapiens
cagggctaccctgagctg

SEQ ID NO: 4554940 - DNA, 19 bp, Homo sapiens
cagggctaccctgagctga

SEQ ID NO: 4554941 - DNA, 12 bp, Homo sapiens
cagggctcccag

SEQ ID NO: 4554942 - DNA, 18 bp, Homo sapiens
cagggctgaggcctctca

SEQ ID NO: 4554943 - DNA, 14 bp, Homo sapiens
cagggctgctcccc

SEQ ID NO: 4554944 - DNA, 19 bp, Homo sapiens
cagggctggactgaggcct

SEQ ID NO: 4554945 - DNA, 17 bp, Homo sapiens
cagggctggcccagccc

SEQ ID NO: 4554946 - DNA, 19 bp, Homo sapiens
cagggctggcccagccctg

SEQ ID NO: 4554947 - DNA, 20 bp, Homo sapiens
cagggctggcccagccctgc

SEQ ID NO: 4554948 - DNA, 22 bp, Homo sapiens
cagggctggcccagccctgctg

SEQ ID NO: 4554949 - DNA, 17 bp, Homo sapiens
cagggctggggacagag

SEQ ID NO: 4554950 - DNA, 20 bp, Homo sapiens
cagggctggggacagagggt

SEQ ID NO: 4554951 - DNA, 23 bp, Homo sapiens
cagggctggggttgccagaggcc

SEQ ID NO: 4554952 - DNA, 24 bp, Homo sapiens
cagggctggggttgccagaggccc

SEQ ID NO: 4554953 - DNA, 15 bp, Homo sapiens
cagggctggtcttgg

SEQ ID NO: 4554954 - DNA, 12 bp, Homo sapiens
cagggctgtccc

SEQ ID NO: 4554955 - DNA, 17 bp, Homo sapiens
cagggctgtcccagccc

SEQ ID NO: 4554956 - DNA, 13 bp, Homo sapiens
cagggctgtgcac

SEQ ID NO: 4554957 - DNA, 22 bp, Homo sapiens
cagggctttactccgtaacaga

SEQ ID NO: 4554958 - DNA, 16 bp, Homo sapiens
caggggaacctgccat

SEQ ID NO: 4554959 - DNA, 17 bp, Homo sapiens
caggggaagcaggaccc

SEQ ID NO: 4554960 - DNA, 22 bp, Homo sapiens
caggggaattccctccccctcc

SEQ ID NO: 4554961 - DNA, 17 bp, Homo sapiens
caggggactcagccctg

SEQ ID NO: 4554962 - DNA, 21 bp, Homo sapiens
caggggactcagccctgaggt

SEQ ID NO: 4554963 - DNA, 16 bp, Homo sapiens
caggggagacaggagc

SEQ ID NO: 4554964 - DNA, 17 bp, Homo sapiens
caggggagacaggagcc

SEQ ID NO: 4554965 - DNA, 22 bp, Homo sapiens
caggggagacaggagcctagcg

SEQ ID NO: 4554966 - DNA, 21 bp, Homo sapiens
caggggagagggtctggagaa

SEQ ID NO: 4554967 - DNA, 21 bp, Homo sapiens
caggggaggggcgcaccccac

SEQ ID NO: 4554968 - DNA, 13 bp, Homo sapiens
caggggcagccac

SEQ ID NO: 4554969 - DNA, 23 bp, Homo sapiens
caggggcagccacaccactgcca

SEQ ID NO: 4554970 - DNA, 21 bp, Homo sapiens
caggggccaacctcaggctcc

SEQ ID NO: 4554971 - DNA, 21 bp, Homo sapiens
caggggcccaaggcggcccct

SEQ ID NO: 4554972 - DNA, 13 bp, Homo sapiens
caggggcccctcc

SEQ ID NO: 4554973 - DNA, 15 bp, Homo sapiens
caggggcccctccag

SEQ ID NO: 4554974 - DNA, 16 bp, Homo sapiens
caggggcccctccagc

SEQ ID NO: 4554975 - DNA, 17 bp, Homo sapiens
caggggcccctccagct

SEQ ID NO: 4554976 - DNA, 19 bp, Homo sapiens
caggggcccctccagcttg

SEQ ID NO: 4554977 - DNA, 13 bp, Homo sapiens
caggggcccctgg

SEQ ID NO: 4554978 - DNA, 16 bp, Homo sapiens
caggggcccctgggga

SEQ ID NO: 4554979 - DNA, 19 bp, Homo sapiens
caggggcctaaggagggtc

SEQ ID NO: 4554980 - DNA, 14 bp, Homo sapiens
caggggctccagca

SEQ ID NO: 4554981 - DNA, 23 bp, Homo sapiens
caggggctccatgctgggtctga

SEQ ID NO: 4554982 - DNA, 13 bp, Homo sapiens
caggggcttgact

SEQ ID NO: 4554983 - DNA, 16 bp, Homo sapiens
caggggcttgactttt

SEQ ID NO: 4554984 - DNA, 22 bp, Homo sapiens
cagggggatatgggtcctctgg

SEQ ID NO: 4554985 - DNA, 12 bp, Homo sapiens
cagggggccccg

SEQ ID NO: 4554986 - DNA, 20 bp, Homo sapiens
cagggggccccgccagggct

SEQ ID NO: 4554987 - DNA, 22 bp, Homo sapiens
cagggggccccgccagggctgg

SEQ ID NO: 4554988 - DNA, 23 bp, Homo sapiens
cagggggccccgccagggctggg

SEQ ID NO: 4554989 - DNA, 13 bp, Homo sapiens
caggggggagaag

SEQ ID NO: 4554990 - DNA, 15 bp, Homo sapiens
caggggtcagtgcag

SEQ ID NO: 4554991 - DNA, 16 bp, Homo sapiens
caggggtctccctggc

SEQ ID NO: 4554992 - DNA, 20 bp, Homo sapiens
caggggtctccctggctccc

SEQ ID NO: 4554993 - DNA, 22 bp, Homo sapiens
caggggtctccctggctccctc

SEQ ID NO: 4554994 - DNA, 13 bp, Homo sapiens
caggggtctgagc

SEQ ID NO: 4554995 - DNA, 14 bp, Homo sapiens
caggggtctgagcc

SEQ ID NO: 4554996 - DNA, 16 bp, Homo sapiens
caggggtgctcctgtg

SEQ ID NO: 4554997 - DNA, 22 bp, Homo sapiens
caggggtgggggtggaggcttc

SEQ ID NO: 4554998 - DNA, 13 bp, Homo sapiens
cagggtagcccgc

SEQ ID NO: 4554999 - DNA, 20 bp, Homo sapiens
cagggtagcccgcctgccag

SEQ ID NO: 4555000 - DNA, 21 bp, Homo sapiens
cagggtagcccgcctgccagt

SEQ ID NO: 4555001 - DNA, 14 bp, Homo sapiens
cagggtcaggcgga

SEQ ID NO: 4555002 - DNA, 20 bp, Homo sapiens
cagggtccaggaatggtgct

SEQ ID NO: 4555003 - DNA, 22 bp, Homo sapiens
cagggtccaggaatggtgcttt

SEQ ID NO: 4555004 - DNA, 19 bp, Homo sapiens
cagggtcctctcttccaca

SEQ ID NO: 4555005 - DNA, 20 bp, Homo sapiens
cagggtcctcttctgggcct

SEQ ID NO: 4555006 - DNA, 21 bp, Homo sapiens
cagggtccttttgacactgct

SEQ ID NO: 4555007 - DNA, 18 bp, Homo sapiens
cagggtcttgctctgtcc

SEQ ID NO: 4555008 - DNA, 22 bp, Homo sapiens
cagggtcttggctgcctgtggg

SEQ ID NO: 4555009 - DNA, 13 bp, Homo sapiens
cagggtggccaca

SEQ ID NO: 4555010 - DNA, 18 bp, Homo sapiens
cagggtggccacacaggc

SEQ ID NO: 4555011 - DNA, 23 bp, Homo sapiens
cagggtggccacacaggcagggc

SEQ ID NO: 4555012 - DNA, 20 bp, Homo sapiens
cagggtgggaagaaagaatg

SEQ ID NO: 4555013 - DNA, 12 bp, Homo sapiens
cagggtgggagg

SEQ ID NO: 4555014 - DNA, 15 bp, Homo sapiens
cagggtgggagggag

SEQ ID NO: 4555015 - DNA, 18 bp, Homo sapiens
cagggtgggagggaggag

SEQ ID NO: 4555016 - DNA, 16 bp, Homo sapiens
cagggtgggcttcctg

SEQ ID NO: 4555017 - DNA, 15 bp, Homo sapiens
cagggtgggtgagct

SEQ ID NO: 4555018 - DNA, 18 bp, Homo sapiens
cagggtgggtgagctctc

SEQ ID NO: 4555019 - DNA, 17 bp, Homo sapiens
cagggtttacccagtgg

SEQ ID NO: 4555020 - DNA, 14 bp, Homo sapiens
caggtaaaacaggg

SEQ ID NO: 4555021 - DNA, 20 bp, Homo sapiens
caggtaaaacagggccacat

SEQ ID NO: 4555022 - DNA, 12 bp, Homo sapiens
caggtaactttc

SEQ ID NO: 4555023 - DNA, 17 bp, Homo sapiens
caggtacacctccccct

SEQ ID NO: 4555024 - DNA, 13 bp, Homo sapiens
caggtaccagctg

SEQ ID NO: 4555025 - DNA, 14 bp, Homo sapiens
caggtaccagctgc

SEQ ID NO: 4555026 - DNA, 21 bp, Homo sapiens
caggtacccttctcgcttttg

SEQ ID NO: 4555027 - DNA, 21 bp, Homo sapiens
caggtagcacagattttgaat

SEQ ID NO: 4555028 - DNA, 13 bp, Homo sapiens
caggtagcctatt

SEQ ID NO: 4555029 - DNA, 13 bp, Homo sapiens
caggtagggggga

SEQ ID NO: 4555030 - DNA, 18 bp, Homo sapiens
caggtagtgggctcacaa

SEQ ID NO: 4555031 - DNA, 15 bp, Homo sapiens
caggtcagccactgt

SEQ ID NO: 4555032 - DNA, 13 bp, Homo sapiens
caggtccaaggac

SEQ ID NO: 4555033 - DNA, 21 bp, Homo sapiens
caggtccaaggacaccctccc

SEQ ID NO: 4555034 - DNA, 22 bp, Homo sapiens
caggtccaaggacaccctccct

SEQ ID NO: 4555035 - DNA, 23 bp, Homo sapiens
caggtcccagcccctcctccctc

SEQ ID NO: 4555036 - DNA, 21 bp, Homo sapiens
caggtccgtagctcccctggc

SEQ ID NO: 4555037 - DNA, 22 bp, Homo sapiens
caggtccgtagctcccctggct

SEQ ID NO: 4555038 - DNA, 12 bp, Homo sapiens
caggtcctgccc

SEQ ID NO: 4555039 - DNA, 23 bp, Homo sapiens
caggtcctgcccatgtgtcccct

SEQ ID NO: 4555040 - DNA, 22 bp, Homo sapiens
caggtccttcctttaggtctgg

SEQ ID NO: 4555041 - DNA, 17 bp, Homo sapiens
caggtctcattgcttct

SEQ ID NO: 4555042 - DNA, 16 bp, Homo sapiens
caggtctccacctgca

SEQ ID NO: 4555043 - DNA, 17 bp, Homo sapiens
caggtctccacctgcac

SEQ ID NO: 4555044 - DNA, 14 bp, Homo sapiens
caggtctgcctggt

SEQ ID NO: 4555045 - DNA, 20 bp, Homo sapiens
caggtcttcatcgaatctac

SEQ ID NO: 4555046 - DNA, 16 bp, Homo sapiens
caggtgaggtctgttc

SEQ ID NO: 4555047 - DNA, 20 bp, Homo sapiens
caggtgcaatctactggaaa

SEQ ID NO: 4555048 - DNA, 14 bp, Homo sapiens
caggtgcagggaag

SEQ ID NO: 4555049 - DNA, 19 bp, Homo sapiens
caggtgccagttatggcta

SEQ ID NO: 4555050 - DNA, 21 bp, Homo sapiens
caggtgccgacactgagctgt

SEQ ID NO: 4555051 - DNA, 22 bp, Homo sapiens
caggtgccgacactgagctgtg

SEQ ID NO: 4555052 - DNA, 13 bp, Homo sapiens
caggtgccttgga

SEQ ID NO: 4555053 - DNA, 14 bp, Homo sapiens
caggtgccttggag

SEQ ID NO: 4555054 - DNA, 20 bp, Homo sapiens
caggtgcgcgccaccgtgcc

SEQ ID NO: 4555055 - DNA, 18 bp, Homo sapiens
caggtgctattgttactc

SEQ ID NO: 4555056 - DNA, 20 bp, Homo sapiens
caggtgctattgttactctt

SEQ ID NO: 4555057 - DNA, 22 bp, Homo sapiens
caggtgctgacaatactgctgc

SEQ ID NO: 4555058 - DNA, 15 bp, Homo sapiens
caggtgctggtcccg

SEQ ID NO: 4555059 - DNA, 21 bp, Homo sapiens
caggtggaggtgtcaggctgc

SEQ ID NO: 4555060 - DNA, 14 bp, Homo sapiens
caggtggctgaccc

SEQ ID NO: 4555061 - DNA, 22 bp, Homo sapiens
caggtggctgacccagtccctg

SEQ ID NO: 4555062 - DNA, 22 bp, Homo sapiens
caggtgggctggacttctacct

SEQ ID NO: 4555063 - DNA, 23 bp, Homo sapiens
caggtgggctggacttctacctg

SEQ ID NO: 4555064 - DNA, 15 bp, Homo sapiens
caggtgtcctgagca

SEQ ID NO: 4555065 - DNA, 23 bp, Homo sapiens
caggtgtgactctagcaaggctc

SEQ ID NO: 4555066 - DNA, 17 bp, Homo sapiens
caggtgttccgtgggac

SEQ ID NO: 4555067 - DNA, 12 bp, Homo sapiens
caggtgttcttc

SEQ ID NO: 4555068 - DNA, 14 bp, Homo sapiens
caggtgtttttcca

SEQ ID NO: 4555069 - DNA, 18 bp, Homo sapiens
caggttaggaaggcagca

SEQ ID NO: 4555070 - DNA, 15 bp, Homo sapiens
caggttataacagtg

SEQ ID NO: 4555071 - DNA, 16 bp, Homo sapiens
caggttataacagtgt

SEQ ID NO: 4555072 - DNA, 22 bp, Homo sapiens
caggttcagtgcggcccctcgg

SEQ ID NO: 4555073 - DNA, 13 bp, Homo sapiens
caggttcatggat

SEQ ID NO: 4555074 - DNA, 13 bp, Homo sapiens
caggttccagaac

SEQ ID NO: 4555075 - DNA, 15 bp, Homo sapiens
caggttcccccagca

SEQ ID NO: 4555076 - DNA, 15 bp, Homo sapiens
caggttccctcccag

SEQ ID NO: 4555077 - DNA, 18 bp, Homo sapiens
caggttccctcccagagg

SEQ ID NO: 4555078 - DNA, 13 bp, Homo sapiens
caggttctctttg

SEQ ID NO: 4555079 - DNA, 16 bp, Homo sapiens
caggttggcttttttc

SEQ ID NO: 4555080 - DNA, 15 bp, Homo sapiens
caggtttttcctttt

SEQ ID NO: 4555081 - DNA, 15 bp, Homo sapiens
cagtaaaacacattt

SEQ ID NO: 4555082 - DNA, 21 bp, Homo sapiens
cagtaaaattaagtgtgtata

SEQ ID NO: 4555083 - DNA, 19 bp, Homo sapiens
cagtaaactttctctgcaa

SEQ ID NO: 4555084 - DNA, 15 bp, Homo sapiens
cagtaaagagaaact

SEQ ID NO: 4555085 - DNA, 20 bp, Homo sapiens
cagtaaagagaaactttgtg

SEQ ID NO: 4555086 - DNA, 22 bp, Homo sapiens
cagtaaagagtacactcagcca

SEQ ID NO: 4555087 - DNA, 22 bp, Homo sapiens
cagtaaagtggttctctgcctt

SEQ ID NO: 4555088 - DNA, 14 bp, Homo sapiens
cagtaaggtagaaa

SEQ ID NO: 4555089 - DNA, 14 bp, Homo sapiens
cagtaattatgaga

SEQ ID NO: 4555090 - DNA, 14 bp, Homo sapiens
cagtacagaaggca

SEQ ID NO: 4555091 - DNA, 15 bp, Homo sapiens
cagtacatttaaatt

SEQ ID NO: 4555092 - DNA, 23 bp, Homo sapiens
cagtaccttcaaactagggccaa

SEQ ID NO: 4555093 - DNA, 20 bp, Homo sapiens
cagtactggttactttcaaa

SEQ ID NO: 4555094 - DNA, 14 bp, Homo sapiens
cagtacttctaaga

SEQ ID NO: 4555095 - DNA, 12 bp, Homo sapiens
cagtacttgtca

SEQ ID NO: 4555096 - DNA, 18 bp, Homo sapiens
cagtactttgtgcattct

SEQ ID NO: 4555097 - DNA, 21 bp, Homo sapiens
cagtagaaagctaaagtgatc

SEQ ID NO: 4555098 - DNA, 17 bp, Homo sapiens
cagtagcatttttctaa

SEQ ID NO: 4555099 - DNA, 21 bp, Homo sapiens
cagtagcctcctcctgggctc

SEQ ID NO: 4555100 - DNA, 15 bp, Homo sapiens
cagtaggagcccagc

SEQ ID NO: 4555101 - DNA, 19 bp, Homo sapiens
cagtaggggcttataataa

SEQ ID NO: 4555102 - DNA, 22 bp, Homo sapiens
cagtaggggcttataataaagg

SEQ ID NO: 4555103 - DNA, 12 bp, Homo sapiens
cagtagtgatag

SEQ ID NO: 4555104 - DNA, 23 bp, Homo sapiens
cagtataattgagttttcagtgg

SEQ ID NO: 4555105 - DNA, 23 bp, Homo sapiens
cagtatatgttaatttgtgtgtt

SEQ ID NO: 4555106 - DNA, 14 bp, Homo sapiens
cagtatattttatt

SEQ ID NO: 4555107 - DNA, 19 bp, Homo sapiens
cagtatattttatttcaat

SEQ ID NO: 4555108 - DNA, 19 bp, Homo sapiens
cagtatattttctgtattt

SEQ ID NO: 4555109 - DNA, 18 bp, Homo sapiens
cagtatggtacatttttc

SEQ ID NO: 4555110 - DNA, 19 bp, Homo sapiens
cagtatgttttaacaaaaa

SEQ ID NO: 4555111 - DNA, 18 bp, Homo sapiens
cagtattctgacatgtaa

SEQ ID NO: 4555112 - DNA, 15 bp, Homo sapiens
cagtattgacttctt

SEQ ID NO: 4555113 - DNA, 20 bp, Homo sapiens
cagtattgccccctctcact

SEQ ID NO: 4555114 - DNA, 15 bp, Homo sapiens
cagtattgggcagga

SEQ ID NO: 4555115 - DNA, 19 bp, Homo sapiens
cagtattgggcaggaggaa

SEQ ID NO: 4555116 - DNA, 21 bp, Homo sapiens
cagtatttctcttttattctg

SEQ ID NO: 4555117 - DNA, 14 bp, Homo sapiens
cagtatttgtaatt

SEQ ID NO: 4555118 - DNA, 21 bp, Homo sapiens
cagtattttcccaatagcact

SEQ ID NO: 4555119 - DNA, 19 bp, Homo sapiens
cagtatttttaaaggcatt

SEQ ID NO: 4555120 - DNA, 14 bp, Homo sapiens
cagtatttttgctg

SEQ ID NO: 4555121 - DNA, 24 bp, Homo sapiens
cagtcaaaaccaagtcacttaggt

SEQ ID NO: 4555122 - DNA, 20 bp, Homo sapiens
cagtcaaaggacggaagtgg

SEQ ID NO: 4555123 - DNA, 21 bp, Homo sapiens
cagtcaacctgggcaaagcct

SEQ ID NO: 4555124 - DNA, 16 bp, Homo sapiens
cagtcaagctgttgaa

SEQ ID NO: 4555125 - DNA, 14 bp, Homo sapiens
cagtcacattgcca

SEQ ID NO: 4555126 - DNA, 12 bp, Homo sapiens
cagtcagcagtc

SEQ ID NO: 4555127 - DNA, 12 bp, Homo sapiens
cagtcagcctct

SEQ ID NO: 4555128 - DNA, 21 bp, Homo sapiens
cagtcaggaaaggaatcattt

SEQ ID NO: 4555129 - DNA, 20 bp, Homo sapiens
cagtcaggctgcagaggcac

SEQ ID NO: 4555130 - DNA, 15 bp, Homo sapiens
cagtcataaatactg

SEQ ID NO: 4555131 - DNA, 21 bp, Homo sapiens
cagtcatggcctgagatgcag

SEQ ID NO: 4555132 - DNA, 13 bp, Homo sapiens
cagtcatggtact

SEQ ID NO: 4555133 - DNA, 13 bp, Homo sapiens
cagtcattatgag

SEQ ID NO: 4555134 - DNA, 18 bp, Homo sapiens
cagtccaaatgtcctcca

SEQ ID NO: 4555135 - DNA, 13 bp, Homo sapiens
cagtccacagggg

SEQ ID NO: 4555136 - DNA, 14 bp, Homo sapiens
cagtccacaggggc

SEQ ID NO: 4555137 - DNA, 17 bp, Homo sapiens
cagtccacaggggccac

SEQ ID NO: 4555138 - DNA, 21 bp, Homo sapiens
cagtccacaggggccaccacc

SEQ ID NO: 4555139 - DNA, 13 bp, Homo sapiens
cagtccatgaaga

SEQ ID NO: 4555140 - DNA, 14 bp, Homo sapiens
cagtccatgctcca

SEQ ID NO: 4555141 - DNA, 15 bp, Homo sapiens
cagtccatttcctaa

SEQ ID NO: 4555142 - DNA, 15 bp, Homo sapiens
cagtcccactgtgca

SEQ ID NO: 4555143 - DNA, 13 bp, Homo sapiens
cagtccccacccc

SEQ ID NO: 4555144 - DNA, 17 bp, Homo sapiens
cagtccccacccctgcc

SEQ ID NO: 4555145 - DNA, 21 bp, Homo sapiens
cagtccccacccctgccccca

SEQ ID NO: 4555146 - DNA, 16 bp, Homo sapiens
cagtccctgctgggga

SEQ ID NO: 4555147 - DNA, 12 bp, Homo sapiens
cagtccctgggg

SEQ ID NO: 4555148 - DNA, 18 bp, Homo sapiens
cagtcctagaatgtttca

SEQ ID NO: 4555149 - DNA, 23 bp, Homo sapiens
cagtcctccactcgacccagaat

SEQ ID NO: 4555150 - DNA, 22 bp, Homo sapiens
cagtcctgatcagagccgtggt

SEQ ID NO: 4555151 - DNA, 12 bp, Homo sapiens
cagtcctgcctg

SEQ ID NO: 4555152 - DNA, 16 bp, Homo sapiens
cagtcctgcctggcca

SEQ ID NO: 4555153 - DNA, 17 bp, Homo sapiens
cagtcctgcctggccag

SEQ ID NO: 4555154 - DNA, 17 bp, Homo sapiens
cagtcctggaagccagc

SEQ ID NO: 4555155 - DNA, 22 bp, Homo sapiens
cagtcctggaagccagctttcc

SEQ ID NO: 4555156 - DNA, 17 bp, Homo sapiens
cagtcctgtagttttat

SEQ ID NO: 4555157 - DNA, 14 bp, Homo sapiens
cagtcgcctgcctg

SEQ ID NO: 4555158 - DNA, 12 bp, Homo sapiens
cagtcgtgatgt

SEQ ID NO: 4555159 - DNA, 18 bp, Homo sapiens
cagtcgtgatgtggagga

SEQ ID NO: 4555160 - DNA, 20 bp, Homo sapiens
cagtcgtggggaacggagga

SEQ ID NO: 4555161 - DNA, 22 bp, Homo sapiens
cagtctaaagctggtttaatgt

SEQ ID NO: 4555162 - DNA, 15 bp, Homo sapiens
cagtctacccagaga

SEQ ID NO: 4555163 - DNA, 19 bp, Homo sapiens
cagtctacccagagaagcc

SEQ ID NO: 4555164 - DNA, 22 bp, Homo sapiens
cagtctacccagagaagcccct

SEQ ID NO: 4555165 - DNA, 21 bp, Homo sapiens
cagtctaggagctccttctgg

SEQ ID NO: 4555166 - DNA, 17 bp, Homo sapiens
cagtctattcacagaag

SEQ ID NO: 4555167 - DNA, 23 bp, Homo sapiens
cagtctcactgtgggaaggccag

SEQ ID NO: 4555168 - DNA, 19 bp, Homo sapiens
cagtctcagaatgtcattt

SEQ ID NO: 4555169 - DNA, 12 bp, Homo sapiens
cagtctcccctt

SEQ ID NO: 4555170 - DNA, 14 bp, Homo sapiens
cagtctccccttcc

SEQ ID NO: 4555171 - DNA, 17 bp, Homo sapiens
cagtctccccttcctgg

SEQ ID NO: 4555172 - DNA, 19 bp, Homo sapiens
cagtctccccttcctggca

SEQ ID NO: 4555173 - DNA, 20 bp, Homo sapiens
cagtctccccttcctggcac

SEQ ID NO: 4555174 - DNA, 15 bp, Homo sapiens
cagtctcctctttaa

SEQ ID NO: 4555175 - DNA, 16 bp, Homo sapiens
cagtctcctctttaaa

SEQ ID NO: 4555176 - DNA, 20 bp, Homo sapiens
cagtctcctctttaaaacaa

SEQ ID NO: 4555177 - DNA, 15 bp, Homo sapiens
cagtctcgggtggct

SEQ ID NO: 4555178 - DNA, 17 bp, Homo sapiens
cagtctcttagaatttg

SEQ ID NO: 4555179 - DNA, 18 bp, Homo sapiens
cagtctcttagaatttgt

SEQ ID NO: 4555180 - DNA, 22 bp, Homo sapiens
cagtctcttagaatttgtttca

SEQ ID NO: 4555181 - DNA, 24 bp, Homo sapiens
cagtctcttagaatttgtttcatc

SEQ ID NO: 4555182 - DNA, 17 bp, Homo sapiens
cagtctgagagaggcca

SEQ ID NO: 4555183 - DNA, 16 bp, Homo sapiens
cagtctgataaactga

SEQ ID NO: 4555184 - DNA, 11 bp, Homo sapiens
cagtctgctct

SEQ ID NO: 4555185 - DNA, 12 bp, Homo sapiens
cagtctgctctg

SEQ ID NO: 4555186 - DNA, 23 bp, Homo sapiens
cagtctgggtctgggtttggatc

SEQ ID NO: 4555187 - DNA, 23 bp, Homo sapiens
cagtctgtcatgaacatgttcct

SEQ ID NO: 4555188 - DNA, 16 bp, Homo sapiens
cagtcttccacaaaga

SEQ ID NO: 4555189 - DNA, 17 bp, Homo sapiens
cagtcttccacaaagaa

SEQ ID NO: 4555190 - DNA, 18 bp, Homo sapiens
cagtcttccacaaagaaa

SEQ ID NO: 4555191 - DNA, 21 bp, Homo sapiens
cagtcttccacaaagaaaatt

SEQ ID NO: 4555192 - DNA, 21 bp, Homo sapiens
cagtcttccatttgcaaggga

SEQ ID NO: 4555193 - DNA, 17 bp, Homo sapiens
cagtcttcctgacactt

SEQ ID NO: 4555194 - DNA, 21 bp, Homo sapiens
cagtcttggtaaaacattact

SEQ ID NO: 4555195 - DNA, 17 bp, Homo sapiens
cagtcttgtattaagtt

SEQ ID NO: 4555196 - DNA, 12 bp, Homo sapiens
cagtcttttgtc

SEQ ID NO: 4555197 - DNA, 13 bp, Homo sapiens
cagtgaagcagca

SEQ ID NO: 4555198 - DNA, 18 bp, Homo sapiens
cagtgaagcagcactgtg

SEQ ID NO: 4555199 - DNA, 18 bp, Homo sapiens
cagtgaatgattcagtgt

SEQ ID NO: 4555200 - DNA, 18 bp, Homo sapiens
cagtgaatttttgcaata

SEQ ID NO: 4555201 - DNA, 19 bp, Homo sapiens
cagtgacctttgacctcgg

SEQ ID NO: 4555202 - DNA, 15 bp, Homo sapiens
cagtgagactgtaca

SEQ ID NO: 4555203 - DNA, 16 bp, Homo sapiens
cagtgagactgtacat

SEQ ID NO: 4555204 - DNA, 17 bp, Homo sapiens
cagtgagactgtacata

SEQ ID NO: 4555205 - DNA, 20 bp, Homo sapiens
cagtgagactgtacataatt

SEQ ID NO: 4555206 - DNA, 21 bp, Homo sapiens
cagtgagagacgccctatttc

SEQ ID NO: 4555207 - DNA, 14 bp, Homo sapiens
cagtgagcccctcc

SEQ ID NO: 4555208 - DNA, 15 bp, Homo sapiens
cagtgagcccctccc

SEQ ID NO: 4555209 - DNA, 19 bp, Homo sapiens
cagtgagcccctccccagc

SEQ ID NO: 4555210 - DNA, 15 bp, Homo sapiens
cagtgagccctgctc

SEQ ID NO: 4555211 - DNA, 18 bp, Homo sapiens
cagtgagcctcctgtgcc

SEQ ID NO: 4555212 - DNA, 22 bp, Homo sapiens
cagtgaggactctttccgactg

SEQ ID NO: 4555213 - DNA, 17 bp, Homo sapiens
cagtgaggcaggagaag

SEQ ID NO: 4555214 - DNA, 20 bp, Homo sapiens
cagtgaggttatcttgctgc

SEQ ID NO: 4555215 - DNA, 18 bp, Homo sapiens
cagtgagtctctggggca

SEQ ID NO: 4555216 - DNA, 13 bp, Homo sapiens
cagtgagtgccat

SEQ ID NO: 4555217 - DNA, 18 bp, Homo sapiens
cagtgagtgccatgcttt

SEQ ID NO: 4555218 - DNA, 19 bp, Homo sapiens
cagtgataatgttcatttt

SEQ ID NO: 4555219 - DNA, 22 bp, Homo sapiens
cagtgattaccagggactgagg

SEQ ID NO: 4555220 - DNA, 15 bp, Homo sapiens
cagtgattcatgtag

SEQ ID NO: 4555221 - DNA, 20 bp, Homo sapiens
cagtgattgtcttaatattg

SEQ ID NO: 4555222 - DNA, 14 bp, Homo sapiens
cagtgatttttagt

SEQ ID NO: 4555223 - DNA, 22 bp, Homo sapiens
cagtgatttttagtaaccttta

SEQ ID NO: 4555224 - DNA, 15 bp, Homo sapiens
cagtgcaacactggt

SEQ ID NO: 4555225 - DNA, 12 bp, Homo sapiens
cagtgcagccac

SEQ ID NO: 4555226 - DNA, 17 bp, Homo sapiens
cagtgcagggcaaaata

SEQ ID NO: 4555227 - DNA, 20 bp, Homo sapiens
cagtgcagtccatttcctaa

SEQ ID NO: 4555228 - DNA, 10 bp, Homo sapiens
cagtgcagtt

SEQ ID NO: 4555229 - DNA, 21 bp, Homo sapiens
cagtgcagtttcttttcacat

SEQ ID NO: 4555230 - DNA, 22 bp, Homo sapiens
cagtgcatagttgtagacaaag

SEQ ID NO: 4555231 - DNA, 23 bp, Homo sapiens
cagtgcatagttgtagacaaagt

SEQ ID NO: 4555232 - DNA, 18 bp, Homo sapiens
cagtgcatgtgcatgcat

SEQ ID NO: 4555233 - DNA, 14 bp, Homo sapiens
cagtgccacctatg

SEQ ID NO: 4555234 - DNA, 24 bp, Homo sapiens
cagtgccacctatgcctgtggtga

SEQ ID NO: 4555235 - DNA, 17 bp, Homo sapiens
cagtgccactgcccccc

SEQ ID NO: 4555236 - DNA, 16 bp, Homo sapiens
cagtgccattgtcttt

SEQ ID NO: 4555237 - DNA, 13 bp, Homo sapiens
cagtgccccaggg

SEQ ID NO: 4555238 - DNA, 16 bp, Homo sapiens
cagtgccccagggagt

SEQ ID NO: 4555239 - DNA, 19 bp, Homo sapiens
cagtgccccagggagtcca

SEQ ID NO: 4555240 - DNA, 21 bp, Homo sapiens
cagtgccccagggagtccagg

SEQ ID NO: 4555241 - DNA, 23 bp, Homo sapiens
cagtgccccagggagtccagggt

SEQ ID NO: 4555242 - DNA, 12 bp, Homo sapiens
cagtgcccttgg

SEQ ID NO: 4555243 - DNA, 12 bp, Homo sapiens
cagtgcctctcc

SEQ ID NO: 4555244 - DNA, 20 bp, Homo sapiens
cagtgcctctccctgctgct

SEQ ID NO: 4555245 - DNA, 10 bp, Homo sapiens
cagtgcctgc

SEQ ID NO: 4555246 - DNA, 12 bp, Homo sapiens
cagtgcctgcca

SEQ ID NO: 4555247 - DNA, 22 bp, Homo sapiens
cagtgcctgggtggatgggcca

SEQ ID NO: 4555248 - DNA, 20 bp, Homo sapiens
cagtgccttacctcctgccc

SEQ ID NO: 4555249 - DNA, 21 bp, Homo sapiens
cagtgccttacctcctgccca

SEQ ID NO: 4555250 - DNA, 19 bp, Homo sapiens
cagtgccttattacccagg

SEQ ID NO: 4555251 - DNA, 22 bp, Homo sapiens
cagtgccttcctgtttttcaca

SEQ ID NO: 4555252 - DNA, 15 bp, Homo sapiens
cagtgctaaagcctg

SEQ ID NO: 4555253 - DNA, 19 bp, Homo sapiens
cagtgctaaagcctgtggg

SEQ ID NO: 4555254 - DNA, 16 bp, Homo sapiens
cagtgctcaccagccc

SEQ ID NO: 4555255 - DNA, 17 bp, Homo sapiens
cagtgctcaccagccct

SEQ ID NO: 4555256 - DNA, 18 bp, Homo sapiens
cagtgctcaccagccctg

SEQ ID NO: 4555257 - DNA, 17 bp, Homo sapiens
cagtgctcacccacacc

SEQ ID NO: 4555258 - DNA, 18 bp, Homo sapiens
cagtgctcacccacacca

SEQ ID NO: 4555259 - DNA, 14 bp, Homo sapiens
cagtgctccctcac

SEQ ID NO: 4555260 - DNA, 18 bp, Homo sapiens
cagtgctctgcctcagac

SEQ ID NO: 4555261 - DNA, 12 bp, Homo sapiens
cagtgctctgta

SEQ ID NO: 4555262 - DNA, 15 bp, Homo sapiens
cagtgctctgtaaaa

SEQ ID NO: 4555263 - DNA, 18 bp, Homo sapiens
cagtgctgcccatgagca

SEQ ID NO: 4555264 - DNA, 20 bp, Homo sapiens
cagtgctgcccatgagcaag

SEQ ID NO: 4555265 - DNA, 22 bp, Homo sapiens
cagtgctgtccatgcttctcat

SEQ ID NO: 4555266 - DNA, 20 bp, Homo sapiens
cagtgcttgagtttggggaa

SEQ ID NO: 4555267 - DNA, 16 bp, Homo sapiens
cagtgcttgggctcca

SEQ ID NO: 4555268 - DNA, 18 bp, Homo sapiens
cagtgcttgggctccacg

SEQ ID NO: 4555269 - DNA, 23 bp, Homo sapiens
cagtggaatataaggaaagcaat

SEQ ID NO: 4555270 - DNA, 19 bp, Homo sapiens
cagtggatcttcagaactg

SEQ ID NO: 4555271 - DNA, 15 bp, Homo sapiens
cagtggcaacttgtg

SEQ ID NO: 4555272 - DNA, 14 bp, Homo sapiens
cagtggccaggtgc

SEQ ID NO: 4555273 - DNA, 16 bp, Homo sapiens
cagtggcccatggcat

SEQ ID NO: 4555274 - DNA, 21 bp, Homo sapiens
cagtggcccatggcattttat

SEQ ID NO: 4555275 - DNA, 22 bp, Homo sapiens
cagtggcctacaaatcagtaat

SEQ ID NO: 4555276 - DNA, 17 bp, Homo sapiens
cagtggcgcatgcctgt

SEQ ID NO: 4555277 - DNA, 19 bp, Homo sapiens
cagtggcgttgttgcatgt

SEQ ID NO: 4555278 - DNA, 18 bp, Homo sapiens
cagtggctcacacctgta

SEQ ID NO: 4555279 - DNA, 11 bp, Homo sapiens
cagtggctccc

SEQ ID NO: 4555280 - DNA, 15 bp, Homo sapiens
cagtggctgctctgg

SEQ ID NO: 4555281 - DNA, 16 bp, Homo sapiens
cagtggctggatctgt

SEQ ID NO: 4555282 - DNA, 20 bp, Homo sapiens
cagtggcttatgcctataat

SEQ ID NO: 4555283 - DNA, 11 bp, Homo sapiens
cagtggcttct

SEQ ID NO: 4555284 - DNA, 19 bp, Homo sapiens
cagtgggaacgtgactgcc

SEQ ID NO: 4555285 - DNA, 20 bp, Homo sapiens
cagtgggaacgtgactgccc

SEQ ID NO: 4555286 - DNA, 22 bp, Homo sapiens
cagtgggcgttgggagcctagc

SEQ ID NO: 4555287 - DNA, 16 bp, Homo sapiens
cagtggggcagcctct

SEQ ID NO: 4555288 - DNA, 14 bp, Homo sapiens
cagtggtgccatca

SEQ ID NO: 4555289 - DNA, 22 bp, Homo sapiens
cagtggtggcaacattcattgc

SEQ ID NO: 4555290 - DNA, 17 bp, Homo sapiens
cagtgtacacgtctgga

SEQ ID NO: 4555291 - DNA, 22 bp, Homo sapiens
cagtgtacacgtctggaccccg

SEQ ID NO: 4555292 - DNA, 12 bp, Homo sapiens
cagtgtacagtc

SEQ ID NO: 4555293 - DNA, 16 bp, Homo sapiens
cagtgtagattttata

SEQ ID NO: 4555294 - DNA, 20 bp, Homo sapiens
cagtgtcaaataaacactgt

SEQ ID NO: 4555295 - DNA, 20 bp, Homo sapiens
cagtgtcaagttgtgcttgt

SEQ ID NO: 4555296 - DNA, 24 bp, Homo sapiens
cagtgtccagagacccctcaatcc

SEQ ID NO: 4555297 - DNA, 15 bp, Homo sapiens
cagtgtctttctagc

SEQ ID NO: 4555298 - DNA, 20 bp, Homo sapiens
cagtgtctttctagccataa

SEQ ID NO: 4555299 - DNA, 16 bp, Homo sapiens
cagtgtgaggccaggg

SEQ ID NO: 4555300 - DNA, 17 bp, Homo sapiens
cagtgtgaggccagggc

SEQ ID NO: 4555301 - DNA, 22 bp, Homo sapiens
cagtgtgcctggttaatattaa

SEQ ID NO: 4555302 - DNA, 15 bp, Homo sapiens
cagtgtggagaccct

SEQ ID NO: 4555303 - DNA, 18 bp, Homo sapiens
cagtgtggaggccactgt

SEQ ID NO: 4555304 - DNA, 15 bp, Homo sapiens
cagtgtgtacttctt

SEQ ID NO: 4555305 - DNA, 17 bp, Homo sapiens
cagtgtgtggtcaacat

SEQ ID NO: 4555306 - DNA, 14 bp, Homo sapiens
cagtgttaaatgtg

SEQ ID NO: 4555307 - DNA, 16 bp, Homo sapiens
cagtgttcctgaagct

SEQ ID NO: 4555308 - DNA, 19 bp, Homo sapiens
cagtgttcctgaagctgct

SEQ ID NO: 4555309 - DNA, 20 bp, Homo sapiens
cagtgttcctgaagctgctg

SEQ ID NO: 4555310 - DNA, 19 bp, Homo sapiens
cagtgttttcagaagaaat

SEQ ID NO: 4555311 - DNA, 13 bp, Homo sapiens
cagtgtttttcct

SEQ ID NO: 4555312 - DNA, 19 bp, Homo sapiens
cagttaaaaaaaattttaa

SEQ ID NO: 4555313 - DNA, 12 bp, Homo sapiens
cagttaattttt

SEQ ID NO: 4555314 - DNA, 14 bp, Homo sapiens
cagttaatttttcc

SEQ ID NO: 4555315 - DNA, 13 bp, Homo sapiens
cagttactcagcc

SEQ ID NO: 4555316 - DNA, 15 bp, Homo sapiens
cagttactcagccct

SEQ ID NO: 4555317 - DNA, 15 bp, Homo sapiens
cagttagcagggatg

SEQ ID NO: 4555318 - DNA, 21 bp, Homo sapiens
cagttagcagggatgttcctt

SEQ ID NO: 4555319 - DNA, 15 bp, Homo sapiens
cagttaggctagaga

SEQ ID NO: 4555320 - DNA, 20 bp, Homo sapiens
cagttataacagatgtgaaa

SEQ ID NO: 4555321 - DNA, 20 bp, Homo sapiens
cagttatacagttataaaat

SEQ ID NO: 4555322 - DNA, 19 bp, Homo sapiens
cagttatctgtttgttact

SEQ ID NO: 4555323 - DNA, 19 bp, Homo sapiens
cagttatggctataggtgc

SEQ ID NO: 4555324 - DNA, 20 bp, Homo sapiens
cagttatggctataggtgct

SEQ ID NO: 4555325 - DNA, 16 bp, Homo sapiens
cagttcaacctggtgg

SEQ ID NO: 4555326 - DNA, 19 bp, Homo sapiens
cagttcacaaaaaaatgtt

SEQ ID NO: 4555327 - DNA, 13 bp, Homo sapiens
cagttcagcacca

SEQ ID NO: 4555328 - DNA, 16 bp, Homo sapiens
cagttcagcaccaccc

SEQ ID NO: 4555329 - DNA, 23 bp, Homo sapiens
cagttcagtaataaactgtgttt

SEQ ID NO: 4555330 - DNA, 20 bp, Homo sapiens
cagttcattagaaatatttt

SEQ ID NO: 4555331 - DNA, 17 bp, Homo sapiens
cagttcattcccagaag

SEQ ID NO: 4555332 - DNA, 14 bp, Homo sapiens
cagttccacagcag

SEQ ID NO: 4555333 - DNA, 19 bp, Homo sapiens
cagttcccgtgacgaggct

SEQ ID NO: 4555334 - DNA, 14 bp, Homo sapiens
cagttcccttggcc

SEQ ID NO: 4555335 - DNA, 18 bp, Homo sapiens
cagttcccttggcctcag

SEQ ID NO: 4555336 - DNA, 20 bp, Homo sapiens
cagttcccttggcctcagaa

SEQ ID NO: 4555337 - DNA, 22 bp, Homo sapiens
cagttcctcccaggaagcccag

SEQ ID NO: 4555338 - DNA, 17 bp, Homo sapiens
cagttctacagaaaaac

SEQ ID NO: 4555339 - DNA, 19 bp, Homo sapiens
cagttctcacgaaagtatt

SEQ ID NO: 4555340 - DNA, 15 bp, Homo sapiens
cagttctgagctgta

SEQ ID NO: 4555341 - DNA, 12 bp, Homo sapiens
cagttctgcaaa

SEQ ID NO: 4555342 - DNA, 22 bp, Homo sapiens
cagttctggatggtgtgccttc

SEQ ID NO: 4555343 - DNA, 20 bp, Homo sapiens
cagttctgtggtttcatgtt

SEQ ID NO: 4555344 - DNA, 17 bp, Homo sapiens
cagttgaaaacttgtaa

SEQ ID NO: 4555345 - DNA, 14 bp, Homo sapiens
cagttgaaaagact

SEQ ID NO: 4555346 - DNA, 15 bp, Homo sapiens
cagttgagctcaggt

SEQ ID NO: 4555347 - DNA, 16 bp, Homo sapiens
cagttgccccccatca

SEQ ID NO: 4555348 - DNA, 22 bp, Homo sapiens
cagttgcccgaaactaagccag

SEQ ID NO: 4555349 - DNA, 18 bp, Homo sapiens
cagttgccgtctaggatt

SEQ ID NO: 4555350 - DNA, 19 bp, Homo sapiens
cagttgccgtctaggattg

SEQ ID NO: 4555351 - DNA, 20 bp, Homo sapiens
cagttggactttttaaaaat

SEQ ID NO: 4555352 - DNA, 14 bp, Homo sapiens
cagttggtaacttt

SEQ ID NO: 4555353 - DNA, 16 bp, Homo sapiens
cagttgtatgtttgct

SEQ ID NO: 4555354 - DNA, 16 bp, Homo sapiens
cagttgtttgcttctt

SEQ ID NO: 4555355 - DNA, 14 bp, Homo sapiens
cagtttaaaagcac

SEQ ID NO: 4555356 - DNA, 16 bp, Homo sapiens
cagtttagaacagagg

SEQ ID NO: 4555357 - DNA, 18 bp, Homo sapiens
cagtttagaacagaggga

SEQ ID NO: 4555358 - DNA, 17 bp, Homo sapiens
cagtttatatttaactc

SEQ ID NO: 4555359 - DNA, 14 bp, Homo sapiens
cagtttcacagaaa

SEQ ID NO: 4555360 - DNA, 15 bp, Homo sapiens
cagtttcacagaaaa

SEQ ID NO: 4555361 - DNA, 17 bp, Homo sapiens
cagtttcacagaaaata

SEQ ID NO: 4555362 - DNA, 23 bp, Homo sapiens
cagtttcataaaaggagaaccag

SEQ ID NO: 4555363 - DNA, 18 bp, Homo sapiens
cagtttcatgtatgtata

SEQ ID NO: 4555364 - DNA, 12 bp, Homo sapiens
cagtttcttaaa

SEQ ID NO: 4555365 - DNA, 17 bp, Homo sapiens
cagtttcttgtgtagat

SEQ ID NO: 4555366 - DNA, 23 bp, Homo sapiens
cagtttcttgtgtagatttgaaa

SEQ ID NO: 4555367 - DNA, 13 bp, Homo sapiens
cagtttgaaattc

SEQ ID NO: 4555368 - DNA, 16 bp, Homo sapiens
cagtttgaaattctga

SEQ ID NO: 4555369 - DNA, 17 bp, Homo sapiens
cagtttgaaattctgaa

SEQ ID NO: 4555370 - DNA, 19 bp, Homo sapiens
cagtttgaaattctgaatt

SEQ ID NO: 4555371 - DNA, 21 bp, Homo sapiens
cagtttgaaattctgaatttg

SEQ ID NO: 4555372 - DNA, 21 bp, Homo sapiens
cagtttgaggaagtggctgtc

SEQ ID NO: 4555373 - DNA, 22 bp, Homo sapiens
cagtttgcagaaaagcacctgc

SEQ ID NO: 4555374 - DNA, 22 bp, Homo sapiens
cagtttggagagtcagatcttt

SEQ ID NO: 4555375 - DNA, 12 bp, Homo sapiens
cagttttaactg

SEQ ID NO: 4555376 - DNA, 13 bp, Homo sapiens
cagttttaactgt

SEQ ID NO: 4555377 - DNA, 23 bp, Homo sapiens
cagttttaactgtggatattgtt

SEQ ID NO: 4555378 - DNA, 16 bp, Homo sapiens
cagttttatgccccat

SEQ ID NO: 4555379 - DNA, 13 bp, Homo sapiens
cagttttccctgg

SEQ ID NO: 4555380 - DNA, 15 bp, Homo sapiens
cagttttctgagaaa

SEQ ID NO: 4555381 - DNA, 19 bp, Homo sapiens
cagttttctgagaaagact

SEQ ID NO: 4555382 - DNA, 20 bp, Homo sapiens
cagttttctgagaaagacta

SEQ ID NO: 4555383 - DNA, 15 bp, Homo sapiens
cagttttctttatga

SEQ ID NO: 4555384 - DNA, 21 bp, Homo sapiens
cagttttgtggattaaacctt

SEQ ID NO: 4555385 - DNA, 16 bp, Homo sapiens
cagtttttattaatct

SEQ ID NO: 4555386 - DNA, 15 bp, Homo sapiens
cagtttttattgctt

SEQ ID NO: 4555387 - DNA, 13 bp, Homo sapiens
cagtttttcactt

SEQ ID NO: 4555388 - DNA, 15 bp, Homo sapiens
cagtttttcacttct

SEQ ID NO: 4555389 - DNA, 12 bp, Homo sapiens
cagtttttcatt

SEQ ID NO: 4555390 - DNA, 17 bp, Homo sapiens
cagtttttggagtgtta

SEQ ID NO: 4555391 - DNA, 20 bp, Homo sapiens
cagtttttgtttttgcatga

SEQ ID NO: 4555392 - DNA, 13 bp, Homo sapiens
cataaaaaggaca

SEQ ID NO: 4555393 - DNA, 19 bp, Homo sapiens
cataaaaaggacatcagca

SEQ ID NO: 4555394 - DNA, 12 bp, Homo sapiens
cataaaacaggt

SEQ ID NO: 4555395 - DNA, 21 bp, Homo sapiens
cataaaccatttttgttactc

SEQ ID NO: 4555396 - DNA, 20 bp, Homo sapiens
cataaagccttttgctttat

SEQ ID NO: 4555397 - DNA, 14 bp, Homo sapiens
cataaagtgagaaa

SEQ ID NO: 4555398 - DNA, 14 bp, Homo sapiens
cataaatactgtca

SEQ ID NO: 4555399 - DNA, 11 bp, Homo sapiens
cataaatcaac

SEQ ID NO: 4555400 - DNA, 19 bp, Homo sapiens
cataaatgcataatttatg

SEQ ID NO: 4555401 - DNA, 17 bp, Homo sapiens
cataaattttaattcaa

SEQ ID NO: 4555402 - DNA, 20 bp, Homo sapiens
cataaattttaattcaagaa

SEQ ID NO: 4555403 - DNA, 14 bp, Homo sapiens
cataacaattcctc

SEQ ID NO: 4555404 - DNA, 15 bp, Homo sapiens
cataacaattcctct

SEQ ID NO: 4555405 - DNA, 13 bp, Homo sapiens
cataacagtgcag

SEQ ID NO: 4555406 - DNA, 14 bp, Homo sapiens
cataacagtgccat

SEQ ID NO: 4555407 - DNA, 22 bp, Homo sapiens
cataacggaaaaataattgcca

SEQ ID NO: 4555408 - DNA, 22 bp, Homo sapiens
cataactcctgtcccttttccc

SEQ ID NO: 4555409 - DNA, 14 bp, Homo sapiens
cataactgaaaatg

SEQ ID NO: 4555410 - DNA, 20 bp, Homo sapiens
cataactgcttcttggagct

SEQ ID NO: 4555411 - DNA, 23 bp, Homo sapiens
cataacttattgctgattttaat

SEQ ID NO: 4555412 - DNA, 22 bp, Homo sapiens
cataagagaaagaggccagaca

SEQ ID NO: 4555413 - DNA, 14 bp, Homo sapiens
cataagctacacag

SEQ ID NO: 4555414 - DNA, 18 bp, Homo sapiens
cataaggatgactttttt

SEQ ID NO: 4555415 - DNA, 17 bp, Homo sapiens
cataagtggggagagag

SEQ ID NO: 4555416 - DNA, 20 bp, Homo sapiens
cataagttatgcctctgaca

SEQ ID NO: 4555417 - DNA, 17 bp, Homo sapiens
cataagtttgtttaaac

SEQ ID NO: 4555418 - DNA, 16 bp, Homo sapiens
cataataaattttcta

SEQ ID NO: 4555419 - DNA, 18 bp, Homo sapiens
cataatcattcatttcga

SEQ ID NO: 4555420 - DNA, 22 bp, Homo sapiens
cataatcttctgccttctcatg

SEQ ID NO: 4555421 - DNA, 21 bp, Homo sapiens
cataatgcattcttctctgtt

SEQ ID NO: 4555422 - DNA, 17 bp, Homo sapiens
cataatgctttggaaaa

SEQ ID NO: 4555423 - DNA, 21 bp, Homo sapiens
cataatgggccactgaaatct

SEQ ID NO: 4555424 - DNA, 22 bp, Homo sapiens
cataatgggccactgaaatctg

SEQ ID NO: 4555425 - DNA, 15 bp, Homo sapiens
cataatgttgcttct

SEQ ID NO: 4555426 - DNA, 21 bp, Homo sapiens
cataatgtttctggatttcat

SEQ ID NO: 4555427 - DNA, 23 bp, Homo sapiens
cataatgtttctggatttcatac

SEQ ID NO: 4555428 - DNA, 14 bp, Homo sapiens
cataattatgaaaa

SEQ ID NO: 4555429 - DNA, 16 bp, Homo sapiens
cataattatgaaaact

SEQ ID NO: 4555430 - DNA, 22 bp, Homo sapiens
cataattatgaaaactcatgat

SEQ ID NO: 4555431 - DNA, 19 bp, Homo sapiens
cataattcctacagcacta

SEQ ID NO: 4555432 - DNA, 15 bp, Homo sapiens
cataattgcatgaaa

SEQ ID NO: 4555433 - DNA, 16 bp, Homo sapiens
cataattgcatgaaaa

SEQ ID NO: 4555434 - DNA, 20 bp, Homo sapiens
cataatttagttgtttctag

SEQ ID NO: 4555435 - DNA, 14 bp, Homo sapiens
cataatttgtttcc

SEQ ID NO: 4555436 - DNA, 13 bp, Homo sapiens
cataattttgcaa

SEQ ID NO: 4555437 - DNA, 18 bp, Homo sapiens
catacaaagcgtgcacaa

SEQ ID NO: 4555438 - DNA, 17 bp, Homo sapiens
catacaacagaaaccag

SEQ ID NO: 4555439 - DNA, 22 bp, Homo sapiens
catacaagtcatggtcacagta

SEQ ID NO: 4555440 - DNA, 14 bp, Homo sapiens
catacaatgtatgt

SEQ ID NO: 4555441 - DNA, 15 bp, Homo sapiens
catacaatgtatgta

SEQ ID NO: 4555442 - DNA, 17 bp, Homo sapiens
catacaatgtatgtaca

SEQ ID NO: 4555443 - DNA, 18 bp, Homo sapiens
catacaatgtatgtacaa

SEQ ID NO: 4555444 - DNA, 14 bp, Homo sapiens
catacacacagcag

SEQ ID NO: 4555445 - DNA, 22 bp, Homo sapiens
catacaccagaagacaaacaat

SEQ ID NO: 4555446 - DNA, 23 bp, Homo sapiens
catacacttattggaactctgct

SEQ ID NO: 4555447 - DNA, 22 bp, Homo sapiens
catacaggggaggggcgcaccc

SEQ ID NO: 4555448 - DNA, 17 bp, Homo sapiens
catacattaaggagcag

SEQ ID NO: 4555449 - DNA, 23 bp, Homo sapiens
catacattaaggagcagggtcct

SEQ ID NO: 4555450 - DNA, 17 bp, Homo sapiens
catacctaccagtatta

SEQ ID NO: 4555451 - DNA, 20 bp, Homo sapiens
catacctcagataatatgtt

SEQ ID NO: 4555452 - DNA, 15 bp, Homo sapiens
catacctggccctgt

SEQ ID NO: 4555453 - DNA, 22 bp, Homo sapiens
catacgcttttaatgaaaagga

SEQ ID NO: 4555454 - DNA, 16 bp, Homo sapiens
catacgggaagtttat

SEQ ID NO: 4555455 - DNA, 22 bp, Homo sapiens
catactaatgaagtattacatg

SEQ ID NO: 4555456 - DNA, 23 bp, Homo sapiens
catactacattgagtagacacat

SEQ ID NO: 4555457 - DNA, 16 bp, Homo sapiens
catactcctgggctca

SEQ ID NO: 4555458 - DNA, 12 bp, Homo sapiens
catactgtacac

SEQ ID NO: 4555459 - DNA, 13 bp, Homo sapiens
catactgtacaca

SEQ ID NO: 4555460 - DNA, 14 bp, Homo sapiens
catactgtacacat

SEQ ID NO: 4555461 - DNA, 12 bp, Homo sapiens
catactttatca

SEQ ID NO: 4555462 - DNA, 20 bp, Homo sapiens
catactttttaaatgtaaag

SEQ ID NO: 4555463 - DNA, 22 bp, Homo sapiens
catactttttaaatgtaaagat

SEQ ID NO: 4555464 - DNA, 20 bp, Homo sapiens
catagaaaaaagtagcaaat

SEQ ID NO: 4555465 - DNA, 13 bp, Homo sapiens
catagaaaaatgt

SEQ ID NO: 4555466 - DNA, 19 bp, Homo sapiens
catagaaaacactacagtg

SEQ ID NO: 4555467 - DNA, 20 bp, Homo sapiens
catagaaatggaaattttgc

SEQ ID NO: 4555468 - DNA, 18 bp, Homo sapiens
catagaaggaagtgtgtt

SEQ ID NO: 4555469 - DNA, 21 bp, Homo sapiens
catagaaggaagtgtgtttgc

SEQ ID NO: 4555470 - DNA, 13 bp, Homo sapiens
catagacaaaggc

SEQ ID NO: 4555471 - DNA, 17 bp, Homo sapiens
catagacaaaggcctta

SEQ ID NO: 4555472 - DNA, 20 bp, Homo sapiens
catagacttatattttataa

SEQ ID NO: 4555473 - DNA, 13 bp, Homo sapiens
catagagatgagc

SEQ ID NO: 4555474 - DNA, 14 bp, Homo sapiens
catagagatgagcc

SEQ ID NO: 4555475 - DNA, 15 bp, Homo sapiens
catagagatgagccc

SEQ ID NO: 4555476 - DNA, 13 bp, Homo sapiens
catagagcttttt

SEQ ID NO: 4555477 - DNA, 19 bp, Homo sapiens
catagaggcttctccgcca

SEQ ID NO: 4555478 - DNA, 20 bp, Homo sapiens
catagaggcttctccgccag

SEQ ID NO: 4555479 - DNA, 22 bp, Homo sapiens
catagaggcttctccgccagcc

SEQ ID NO: 4555480 - DNA, 14 bp, Homo sapiens
catagattattata

SEQ ID NO: 4555481 - DNA, 17 bp, Homo sapiens
catagattcacctgtaa

SEQ ID NO: 4555482 - DNA, 20 bp, Homo sapiens
catagattcacctgtaaaac

SEQ ID NO: 4555483 - DNA, 22 bp, Homo sapiens
catagattcacctgtaaaactt

SEQ ID NO: 4555484 - DNA, 13 bp, Homo sapiens
catagcactgcag

SEQ ID NO: 4555485 - DNA, 19 bp, Homo sapiens
catagcagcttattcacaa

SEQ ID NO: 4555486 - DNA, 19 bp, Homo sapiens
catagccccggccccccgc

SEQ ID NO: 4555487 - DNA, 18 bp, Homo sapiens
catagctacaatttgttt

SEQ ID NO: 4555488 - DNA, 13 bp, Homo sapiens
catagctgctgcc

SEQ ID NO: 4555489 - DNA, 22 bp, Homo sapiens
catagctgggactacaggcgcc

SEQ ID NO: 4555490 - DNA, 16 bp, Homo sapiens
catagctgtacttctt

SEQ ID NO: 4555491 - DNA, 15 bp, Homo sapiens
cataggaaggctgtg

SEQ ID NO: 4555492 - DNA, 18 bp, Homo sapiens
catagggtcactttgcca

SEQ ID NO: 4555493 - DNA, 19 bp, Homo sapiens
catagggtcactttgccat

SEQ ID NO: 4555494 - DNA, 21 bp, Homo sapiens
cataggtaaggttttcaaggt

SEQ ID NO: 4555495 - DNA, 22 bp, Homo sapiens
cataggttaaaaaaaaaagtca

SEQ ID NO: 4555496 - DNA, 23 bp, Homo sapiens
cataggttaaaaaaaaaagtcac

SEQ ID NO: 4555497 - DNA, 23 bp, Homo sapiens
catagtaacttcttatggaattg

SEQ ID NO: 4555498 - DNA, 14 bp, Homo sapiens
catagtcaatgatg

SEQ ID NO: 4555499 - DNA, 13 bp, Homo sapiens
catagtccccaga

SEQ ID NO: 4555500 - DNA, 20 bp, Homo sapiens
catagtccccagagctcccc

SEQ ID NO: 4555501 - DNA, 11 bp, Homo sapiens
catagtcttga

SEQ ID NO: 4555502 - DNA, 21 bp, Homo sapiens
catagtcttgaaatgaaaggg

SEQ ID NO: 4555503 - DNA, 22 bp, Homo sapiens
catagtcttgaaatgaaaggga

SEQ ID NO: 4555504 - DNA, 16 bp, Homo sapiens
catagtctttgtttac

SEQ ID NO: 4555505 - DNA, 22 bp, Homo sapiens
catagtgtgctcggacacagtt

SEQ ID NO: 4555506 - DNA, 17 bp, Homo sapiens
catagttctgtaataaa

SEQ ID NO: 4555507 - DNA, 12 bp, Homo sapiens
catataaagtat

SEQ ID NO: 4555508 - DNA, 20 bp, Homo sapiens
catataaatgtttatattgt

SEQ ID NO: 4555509 - DNA, 22 bp, Homo sapiens
catataaatgtttatattgttt

SEQ ID NO: 4555510 - DNA, 17 bp, Homo sapiens
catatacatattgtata

SEQ ID NO: 4555511 - DNA, 21 bp, Homo sapiens
catataccacccatagtgctt

SEQ ID NO: 4555512 - DNA, 15 bp, Homo sapiens
catatagattttatt

SEQ ID NO: 4555513 - DNA, 18 bp, Homo sapiens
catatagattttattatg

SEQ ID NO: 4555514 - DNA, 13 bp, Homo sapiens
catatataaatta

SEQ ID NO: 4555515 - DNA, 16 bp, Homo sapiens
catatataaattatta

SEQ ID NO: 4555516 - DNA, 20 bp, Homo sapiens
catatataaattattacttt

SEQ ID NO: 4555517 - DNA, 18 bp, Homo sapiens
catatataagactgctgc

SEQ ID NO: 4555518 - DNA, 22 bp, Homo sapiens
catatataagactgctgcagtc

SEQ ID NO: 4555519 - DNA, 18 bp, Homo sapiens
catatatgaccagaagcc

SEQ ID NO: 4555520 - DNA, 14 bp, Homo sapiens
catatatgctgtat

SEQ ID NO: 4555521 - DNA, 19 bp, Homo sapiens
catatattgaggttcattg

SEQ ID NO: 4555522 - DNA, 18 bp, Homo sapiens
catatcacacacattgct

SEQ ID NO: 4555523 - DNA, 18 bp, Homo sapiens
catatcatccacacatga

SEQ ID NO: 4555524 - DNA, 14 bp, Homo sapiens
catatcattaaaca

SEQ ID NO: 4555525 - DNA, 19 bp, Homo sapiens
catatcattaaacaaataa

SEQ ID NO: 4555526 - DNA, 14 bp, Homo sapiens
catatccttgccct

SEQ ID NO: 4555527 - DNA, 21 bp, Homo sapiens
catatgaaaggtgccatggaa

SEQ ID NO: 4555528 - DNA, 19 bp, Homo sapiens
catatgaggacctttatat

SEQ ID NO: 4555529 - DNA, 20 bp, Homo sapiens
catatgaggacctttatatc

SEQ ID NO: 4555530 - DNA, 23 bp, Homo sapiens
catatgaggacctttatatctgt

SEQ ID NO: 4555531 - DNA, 14 bp, Homo sapiens
catatgcagaaata

SEQ ID NO: 4555532 - DNA, 15 bp, Homo sapiens
catatggcccagtgt

SEQ ID NO: 4555533 - DNA, 18 bp, Homo sapiens
catatgggaactatgagg

SEQ ID NO: 4555534 - DNA, 21 bp, Homo sapiens
catatgggtgggattttgcaa

SEQ ID NO: 4555535 - DNA, 24 bp, Homo sapiens
catatgtagccttcacacagatag

SEQ ID NO: 4555536 - DNA, 19 bp, Homo sapiens
catatgtgtaaagatttat

SEQ ID NO: 4555537 - DNA, 17 bp, Homo sapiens
catatgttgaatacttt

SEQ ID NO: 4555538 - DNA, 15 bp, Homo sapiens
catattaaataataa

SEQ ID NO: 4555539 - DNA, 14 bp, Homo sapiens
catattaattttct

SEQ ID NO: 4555540 - DNA, 15 bp, Homo sapiens
catattacctggatt

SEQ ID NO: 4555541 - DNA, 20 bp, Homo sapiens
catattattttagtgtgtaa

SEQ ID NO: 4555542 - DNA, 23 bp, Homo sapiens
catattattttagtgtgtaaaat

SEQ ID NO: 4555543 - DNA, 20 bp, Homo sapiens
catattgagaacctaatgca

SEQ ID NO: 4555544 - DNA, 16 bp, Homo sapiens
catattgttgaaaggt

SEQ ID NO: 4555545 - DNA, 14 bp, Homo sapiens
catatttaatgttt

SEQ ID NO: 4555546 - DNA, 20 bp, Homo sapiens
catatttaatgttttaaatg

SEQ ID NO: 4555547 - DNA, 23 bp, Homo sapiens
catatttaatgttttaaatgtac

SEQ ID NO: 4555548 - DNA, 17 bp, Homo sapiens
catatttaatttgaagg

SEQ ID NO: 4555549 - DNA, 18 bp, Homo sapiens
catatttagctgttttgg

SEQ ID NO: 4555550 - DNA, 16 bp, Homo sapiens
catatttatactttgc

SEQ ID NO: 4555551 - DNA, 16 bp, Homo sapiens
catatttattgcattg

SEQ ID NO: 4555552 - DNA, 20 bp, Homo sapiens
catatttattgcattgctgg

SEQ ID NO: 4555553 - DNA, 18 bp, Homo sapiens
catatttatttttacctg

SEQ ID NO: 4555554 - DNA, 22 bp, Homo sapiens
catatttatttttacctgcttt

SEQ ID NO: 4555555 - DNA, 22 bp, Homo sapiens
catatttgtatgtttttctgta

SEQ ID NO: 4555556 - DNA, 16 bp, Homo sapiens
catatttgttacttta

SEQ ID NO: 4555557 - DNA, 15 bp, Homo sapiens
catattttaaattct

SEQ ID NO: 4555558 - DNA, 16 bp, Homo sapiens
catattttaaattctc

SEQ ID NO: 4555559 - DNA, 13 bp, Homo sapiens
catattttcttac

SEQ ID NO: 4555560 - DNA, 15 bp, Homo sapiens
catatttttatactt

SEQ ID NO: 4555561 - DNA, 23 bp, Homo sapiens
catatttttatactttattgaaa

SEQ ID NO: 4555562 - DNA, 17 bp, Homo sapiens
catcaaaggaatataag

SEQ ID NO: 4555563 - DNA, 21 bp, Homo sapiens
catcaaaggaatataagaaaa

SEQ ID NO: 4555564 - DNA, 13 bp, Homo sapiens
catcaacaaaaat

SEQ ID NO: 4555565 - DNA, 15 bp, Homo sapiens
catcaacattccagg

SEQ ID NO: 4555566 - DNA, 14 bp, Homo sapiens
catcaactgaatga

SEQ ID NO: 4555567 - DNA, 20 bp, Homo sapiens
catcaagactatctacaaaa

SEQ ID NO: 4555568 - DNA, 15 bp, Homo sapiens
catcaagactttgct

SEQ ID NO: 4555569 - DNA, 16 bp, Homo sapiens
catcaagactttgcta

SEQ ID NO: 4555570 - DNA, 22 bp, Homo sapiens
catcaagactttgctaaagaca

SEQ ID NO: 4555571 - DNA, 12 bp, Homo sapiens
catcaagccact

SEQ ID NO: 4555572 - DNA, 23 bp, Homo sapiens
catcaatagtgtcctatgcaata

SEQ ID NO: 4555573 - DNA, 12 bp, Homo sapiens
catcaatcttgt

SEQ ID NO: 4555574 - DNA, 18 bp, Homo sapiens
catcaatgaatgaatgaa

SEQ ID NO: 4555575 - DNA, 18 bp, Homo sapiens
catcacaatattcagtgg

SEQ ID NO: 4555576 - DNA, 15 bp, Homo sapiens
catcacacctgccct

SEQ ID NO: 4555577 - DNA, 14 bp, Homo sapiens
catcacactgggtg

SEQ ID NO: 4555578 - DNA, 20 bp, Homo sapiens
catcacacttatattttatg

SEQ ID NO: 4555579 - DNA, 19 bp, Homo sapiens
catcacagaccccagctgg

SEQ ID NO: 4555580 - DNA, 20 bp, Homo sapiens
catcacagaccccagctggg

SEQ ID NO: 4555581 - DNA, 18 bp, Homo sapiens
catcacatcttatttatt

SEQ ID NO: 4555582 - DNA, 13 bp, Homo sapiens
catcaccagagtc

SEQ ID NO: 4555583 - DNA, 14 bp, Homo sapiens
catcacctatttaa

SEQ ID NO: 4555584 - DNA, 11 bp, Homo sapiens
catcacctcac

SEQ ID NO: 4555585 - DNA, 23 bp, Homo sapiens
catcacggatggtgcatgggctc

SEQ ID NO: 4555586 - DNA, 19 bp, Homo sapiens
catcacgttagctgtccca

SEQ ID NO: 4555587 - DNA, 14 bp, Homo sapiens
catcactagtgaca

SEQ ID NO: 4555588 - DNA, 18 bp, Homo sapiens
catcactatcaattttaa

SEQ ID NO: 4555589 - DNA, 20 bp, Homo sapiens
catcactgatgggaataaaa

SEQ ID NO: 4555590 - DNA, 23 bp, Homo sapiens
catcactggtccaggtcttcagt

SEQ ID NO: 4555591 - DNA, 13 bp, Homo sapiens
catcactgtaaag

SEQ ID NO: 4555592 - DNA, 15 bp, Homo sapiens
catcactgtaaagac

SEQ ID NO: 4555593 - DNA, 15 bp, Homo sapiens
catcagaaaaccaaa

SEQ ID NO: 4555594 - DNA, 18 bp, Homo sapiens
catcagaaaggaaaaaca

SEQ ID NO: 4555595 - DNA, 16 bp, Homo sapiens
catcagaacctgagct

SEQ ID NO: 4555596 - DNA, 17 bp, Homo sapiens
catcagatatgcttact

SEQ ID NO: 4555597 - DNA, 11 bp, Homo sapiens
catcagcaaac

SEQ ID NO: 4555598 - DNA, 12 bp, Homo sapiens
catcagcactct

SEQ ID NO: 4555599 - DNA, 11 bp, Homo sapiens
catcagccctg

SEQ ID NO: 4555600 - DNA, 14 bp, Homo sapiens
catcagccctgcta

SEQ ID NO: 4555601 - DNA, 17 bp, Homo sapiens
catcagctctgccttgc

SEQ ID NO: 4555602 - DNA, 18 bp, Homo sapiens
catcagctctgccttgca

SEQ ID NO: 4555603 - DNA, 18 bp, Homo sapiens
catcagctgctgaaacaa

SEQ ID NO: 4555604 - DNA, 22 bp, Homo sapiens
catcagggcggcctcccaggtc

SEQ ID NO: 4555605 - DNA, 18 bp, Homo sapiens
catcaggtcccccccagg

SEQ ID NO: 4555606 - DNA, 15 bp, Homo sapiens
catcagtcaatggaa

SEQ ID NO: 4555607 - DNA, 24 bp, Homo sapiens
catcagtgctccctcacatgtcag

SEQ ID NO: 4555608 - DNA, 16 bp, Homo sapiens
catcagtgctctgtaa

SEQ ID NO: 4555609 - DNA, 22 bp, Homo sapiens
catcatagcaagacctcatctc

SEQ ID NO: 4555610 - DNA, 12 bp, Homo sapiens
catcatcactgt

SEQ ID NO: 4555611 - DNA, 15 bp, Homo sapiens
catcatctgtttgta

SEQ ID NO: 4555612 - DNA, 20 bp, Homo sapiens
catcatctgtttgtaatcat

SEQ ID NO: 4555613 - DNA, 16 bp, Homo sapiens
catcatgagttctgct

SEQ ID NO: 4555614 - DNA, 17 bp, Homo sapiens
catcatgtctgtatact

SEQ ID NO: 4555615 - DNA, 19 bp, Homo sapiens
catcatgtggcccaactct

SEQ ID NO: 4555616 - DNA, 19 bp, Homo sapiens
catcatgtttacagaggac

SEQ ID NO: 4555617 - DNA, 15 bp, Homo sapiens
catcattctctgtct

SEQ ID NO: 4555618 - DNA, 21 bp, Homo sapiens
catcattctctgtctcatcca

SEQ ID NO: 4555619 - DNA, 14 bp, Homo sapiens
catcattgtcagcc

SEQ ID NO: 4555620 - DNA, 20 bp, Homo sapiens
catcattgtcagccttgcta

SEQ ID NO: 4555621 - DNA, 13 bp, Homo sapiens
catcatttcagcc

SEQ ID NO: 4555622 - DNA, 21 bp, Homo sapiens
catcatttcagccaaagtcct

SEQ ID NO: 4555623 - DNA, 23 bp, Homo sapiens
catccaaaatagttaagacatga

SEQ ID NO: 4555624 - DNA, 17 bp, Homo sapiens
catccaaccactgtaca

SEQ ID NO: 4555625 - DNA, 19 bp, Homo sapiens
catccacccgggggagccc

SEQ ID NO: 4555626 - DNA, 22 bp, Homo sapiens
catccactctaccctcccaccc

SEQ ID NO: 4555627 - DNA, 12 bp, Homo sapiens
catccagacagt

SEQ ID NO: 4555628 - DNA, 15 bp, Homo sapiens
catccagacctggct

SEQ ID NO: 4555629 - DNA, 17 bp, Homo sapiens
catccagaggaataaaa

SEQ ID NO: 4555630 - DNA, 13 bp, Homo sapiens
catccagagtccc

SEQ ID NO: 4555631 - DNA, 21 bp, Homo sapiens
catccagagtccctgcctgga

SEQ ID NO: 4555632 - DNA, 20 bp, Homo sapiens
catccagatgtgtgcaatgt

SEQ ID NO: 4555633 - DNA, 14 bp, Homo sapiens
catccagcagcagc

SEQ ID NO: 4555634 - DNA, 18 bp, Homo sapiens
catccagcagcagcactt

SEQ ID NO: 4555635 - DNA, 18 bp, Homo sapiens
catccatagacacagtat

SEQ ID NO: 4555636 - DNA, 19 bp, Homo sapiens
catccattcctcagggaca

SEQ ID NO: 4555637 - DNA, 21 bp, Homo sapiens
catcccaacctctttttcctc

SEQ ID NO: 4555638 - DNA, 17 bp, Homo sapiens
catcccacgttctgtta

SEQ ID NO: 4555639 - DNA, 16 bp, Homo sapiens
catcccagaccagcca

SEQ ID NO: 4555640 - DNA, 15 bp, Homo sapiens
catcccattgccctg

SEQ ID NO: 4555641 - DNA, 15 bp, Homo sapiens
catccccaactccat

SEQ ID NO: 4555642 - DNA, 20 bp, Homo sapiens
catccccaactccatggggt

SEQ ID NO: 4555643 - DNA, 19 bp, Homo sapiens
catccccacaatctggctt

SEQ ID NO: 4555644 - DNA, 11 bp, Homo sapiens
catccccaggg

SEQ ID NO: 4555645 - DNA, 17 bp, Homo sapiens
catcccccacctactct

SEQ ID NO: 4555646 - DNA, 20 bp, Homo sapiens
catccccttcccccatccct

SEQ ID NO: 4555647 - DNA, 22 bp, Homo sapiens
catccccttcccccatccctac

SEQ ID NO: 4555648 - DNA, 13 bp, Homo sapiens
catccctaccact

SEQ ID NO: 4555649 - DNA, 14 bp, Homo sapiens
catccctaccccct

SEQ ID NO: 4555650 - DNA, 20 bp, Homo sapiens
catccctatagaccactggg

SEQ ID NO: 4555651 - DNA, 13 bp, Homo sapiens
catccctcaccca

SEQ ID NO: 4555652 - DNA, 16 bp, Homo sapiens
catccctgactggcca

SEQ ID NO: 4555653 - DNA, 17 bp, Homo sapiens
catccctgactggccaa

SEQ ID NO: 4555654 - DNA, 20 bp, Homo sapiens
catccctgactggccaaacc

SEQ ID NO: 4555655 - DNA, 23 bp, Homo sapiens
catccctgcttgcccgctcccac

SEQ ID NO: 4555656 - DNA, 22 bp, Homo sapiens
catccctggagcaggagccccg

SEQ ID NO: 4555657 - DNA, 17 bp, Homo sapiens
catccctgggcccctcc

SEQ ID NO: 4555658 - DNA, 13 bp, Homo sapiens
catcccttcccac

SEQ ID NO: 4555659 - DNA, 16 bp, Homo sapiens
catccctttgcccaga

SEQ ID NO: 4555660 - DNA, 18 bp, Homo sapiens
catccctttttttacatt

SEQ ID NO: 4555661 - DNA, 14 bp, Homo sapiens
catccgactgcccc

SEQ ID NO: 4555662 - DNA, 15 bp, Homo sapiens
catccgactgcccct

SEQ ID NO: 4555663 - DNA, 16 bp, Homo sapiens
catccgactgcccctg

SEQ ID NO: 4555664 - DNA, 16 bp, Homo sapiens
catccgtagttccctg

SEQ ID NO: 4555665 - DNA, 21 bp, Homo sapiens
catccgtagttccctgaaaac

SEQ ID NO: 4555666 - DNA, 15 bp, Homo sapiens
catccgttgtgactc

SEQ ID NO: 4555667 - DNA, 23 bp, Homo sapiens
catccgttgtgactctaggcttc

SEQ ID NO: 4555668 - DNA, 19 bp, Homo sapiens
catcctaaggttcttgctt

SEQ ID NO: 4555669 - DNA, 18 bp, Homo sapiens
catcctaccccctgtgcc

SEQ ID NO: 4555670 - DNA, 19 bp, Homo sapiens
catcctaccccctgtgcct

SEQ ID NO: 4555671 - DNA, 21 bp, Homo sapiens
catcctcaaacgacagaggag

SEQ ID NO: 4555672 - DNA, 17 bp, Homo sapiens
catcctcatccctgact

SEQ ID NO: 4555673 - DNA, 18 bp, Homo sapiens
catcctccacgttctgct

SEQ ID NO: 4555674 - DNA, 21 bp, Homo sapiens
catcctccacgttctgctcat

SEQ ID NO: 4555675 - DNA, 11 bp, Homo sapiens
catcctccctc

SEQ ID NO: 4555676 - DNA, 19 bp, Homo sapiens
catcctccctccacctcaa

SEQ ID NO: 4555677 - DNA, 21 bp, Homo sapiens
catcctccctgaccctgctcc

SEQ ID NO: 4555678 - DNA, 22 bp, Homo sapiens
catcctccctgaccctgctcct

SEQ ID NO: 4555679 - DNA, 16 bp, Homo sapiens
catcctccgtccagcc

SEQ ID NO: 4555680 - DNA, 20 bp, Homo sapiens
catcctccgtccagccgcca

SEQ ID NO: 4555681 - DNA, 19 bp, Homo sapiens
catcctgactctgccccct

SEQ ID NO: 4555682 - DNA, 20 bp, Homo sapiens
catcctgactctgccccctg

SEQ ID NO: 4555683 - DNA, 21 bp, Homo sapiens
catcctgcagggcttctcctc

SEQ ID NO: 4555684 - DNA, 20 bp, Homo sapiens
catcctgccttagagccagg

SEQ ID NO: 4555685 - DNA, 16 bp, Homo sapiens
catcctgtcagtgtca

SEQ ID NO: 4555686 - DNA, 20 bp, Homo sapiens
catccttcttccactgtctc

SEQ ID NO: 4555687 - DNA, 18 bp, Homo sapiens
catcgaagggattgtgta

SEQ ID NO: 4555688 - DNA, 20 bp, Homo sapiens
catcgcaatagttttttact

SEQ ID NO: 4555689 - DNA, 17 bp, Homo sapiens
catcgctgttctgggca

SEQ ID NO: 4555690 - DNA, 14 bp, Homo sapiens
catcggaaaaataa

SEQ ID NO: 4555691 - DNA, 17 bp, Homo sapiens
catcggaggctgggccc

SEQ ID NO: 4555692 - DNA, 20 bp, Homo sapiens
catcggaggctgggcccctg

SEQ ID NO: 4555693 - DNA, 21 bp, Homo sapiens
catcggaggctgggcccctgg

SEQ ID NO: 4555694 - DNA, 22 bp, Homo sapiens
catcggaggctgggcccctggg

SEQ ID NO: 4555695 - DNA, 17 bp, Homo sapiens
catcgggaaagaagaaa

SEQ ID NO: 4555696 - DNA, 19 bp, Homo sapiens
catcgggagcacccagagc

SEQ ID NO: 4555697 - DNA, 20 bp, Homo sapiens
catcgggagcacccagagca

SEQ ID NO: 4555698 - DNA, 16 bp, Homo sapiens
catcgtccttcctctc

SEQ ID NO: 4555699 - DNA, 19 bp, Homo sapiens
catctaaagctttatcttt

SEQ ID NO: 4555700 - DNA, 15 bp, Homo sapiens
catctaaattctgat

SEQ ID NO: 4555701 - DNA, 20 bp, Homo sapiens
catctaaattctgataattt

SEQ ID NO: 4555702 - DNA, 15 bp, Homo sapiens
catctaacctcatct

SEQ ID NO: 4555703 - DNA, 19 bp, Homo sapiens
catctaatgcttgtttatg

SEQ ID NO: 4555704 - DNA, 21 bp, Homo sapiens
catctacatgccatgcctatg

SEQ ID NO: 4555705 - DNA, 20 bp, Homo sapiens
catctaccttttctggcaaa

SEQ ID NO: 4555706 - DNA, 19 bp, Homo sapiens
catctacttggcaaggtca

SEQ ID NO: 4555707 - DNA, 22 bp, Homo sapiens
catctataatgtcagcttatcc

SEQ ID NO: 4555708 - DNA, 19 bp, Homo sapiens
catctatgagggtgtttcc

SEQ ID NO: 4555709 - DNA, 20 bp, Homo sapiens
catctatgagggtgtttcct

SEQ ID NO: 4555710 - DNA, 16 bp, Homo sapiens
catctatggttctaaa

SEQ ID NO: 4555711 - DNA, 11 bp, Homo sapiens
catctattttg

SEQ ID NO: 4555712 - DNA, 13 bp, Homo sapiens
catctattttgat

SEQ ID NO: 4555713 - DNA, 13 bp, Homo sapiens
catctcaaaaaaa

SEQ ID NO: 4555714 - DNA, 13 bp, Homo sapiens
catctcagaccct

SEQ ID NO: 4555715 - DNA, 19 bp, Homo sapiens
catctcatgagtgtgcccc

SEQ ID NO: 4555716 - DNA, 20 bp, Homo sapiens
catctcatgtatcatctgga

SEQ ID NO: 4555717 - DNA, 21 bp, Homo sapiens
catctccatgtagaataaatg

SEQ ID NO: 4555718 - DNA, 22 bp, Homo sapiens
catctccatgtagaataaatga

SEQ ID NO: 4555719 - DNA, 17 bp, Homo sapiens
catctcccagataatgt

SEQ ID NO: 4555720 - DNA, 17 bp, Homo sapiens
catctcccaggccccag

SEQ ID NO: 4555721 - DNA, 11 bp, Homo sapiens
catctccccac

SEQ ID NO: 4555722 - DNA, 15 bp, Homo sapiens
catctccctgcctgg

SEQ ID NO: 4555723 - DNA, 16 bp, Homo sapiens
catctccctgcctggc

SEQ ID NO: 4555724 - DNA, 21 bp, Homo sapiens
catctccctgcctggccccca

SEQ ID NO: 4555725 - DNA, 19 bp, Homo sapiens
catctccgcctccacactg

SEQ ID NO: 4555726 - DNA, 20 bp, Homo sapiens
catctccgcctccacactga

SEQ ID NO: 4555727 - DNA, 22 bp, Homo sapiens
catctcctgccttcctcctggg

SEQ ID NO: 4555728 - DNA, 13 bp, Homo sapiens
catctctcctccc

SEQ ID NO: 4555729 - DNA, 13 bp, Homo sapiens
catctctctgggg

SEQ ID NO: 4555730 - DNA, 21 bp, Homo sapiens
catctctctggggccctgggc

SEQ ID NO: 4555731 - DNA, 23 bp, Homo sapiens
catctctgaactggtagaaaaac

SEQ ID NO: 4555732 - DNA, 13 bp, Homo sapiens
catctctgacttt

SEQ ID NO: 4555733 - DNA, 18 bp, Homo sapiens
catctcttagctcccctc

SEQ ID NO: 4555734 - DNA, 20 bp, Homo sapiens
catctcttaggtgagacagt

SEQ ID NO: 4555735 - DNA, 18 bp, Homo sapiens
catctcttccccagagag

SEQ ID NO: 4555736 - DNA, 22 bp, Homo sapiens
catctgcaaaaggcctcttgta

SEQ ID NO: 4555737 - DNA, 23 bp, Homo sapiens
catctgcaaaaggcctcttgtaa

SEQ ID NO: 4555738 - DNA, 19 bp, Homo sapiens
catctgcaccccttctctc

SEQ ID NO: 4555739 - DNA, 16 bp, Homo sapiens
catctgcaggacagag

SEQ ID NO: 4555740 - DNA, 17 bp, Homo sapiens
catctgccatttatttc

SEQ ID NO: 4555741 - DNA, 19 bp, Homo sapiens
catctgccatttatttcct

SEQ ID NO: 4555742 - DNA, 23 bp, Homo sapiens
catctgccccaggtacacctccc

SEQ ID NO: 4555743 - DNA, 17 bp, Homo sapiens
catctgcccctccccca

SEQ ID NO: 4555744 - DNA, 15 bp, Homo sapiens
catctgcctgtaatt

SEQ ID NO: 4555745 - DNA, 16 bp, Homo sapiens
catctgcctgtaatta

SEQ ID NO: 4555746 - DNA, 17 bp, Homo sapiens
catctgcgggggcagtg

SEQ ID NO: 4555747 - DNA, 15 bp, Homo sapiens
catctgctctccttc

SEQ ID NO: 4555748 - DNA, 20 bp, Homo sapiens
catctgctctccttcctgga

SEQ ID NO: 4555749 - DNA, 16 bp, Homo sapiens
catctggataggagcc

SEQ ID NO: 4555750 - DNA, 22 bp, Homo sapiens
catctggataggagcctgctgg

SEQ ID NO: 4555751 - DNA, 23 bp, Homo sapiens
catctggataggagcctgctggt

SEQ ID NO: 4555752 - DNA, 14 bp, Homo sapiens
catctgtcattata

SEQ ID NO: 4555753 - DNA, 19 bp, Homo sapiens
catctgtcattatattcta

SEQ ID NO: 4555754 - DNA, 13 bp, Homo sapiens
catcttaaactaa

SEQ ID NO: 4555755 - DNA, 15 bp, Homo sapiens
catcttattgaataa

SEQ ID NO: 4555756 - DNA, 19 bp, Homo sapiens
catcttattgaataaagag

SEQ ID NO: 4555757 - DNA, 19 bp, Homo sapiens
catcttatttattttagca

SEQ ID NO: 4555758 - DNA, 15 bp, Homo sapiens
catcttcactgcaat

SEQ ID NO: 4555759 - DNA, 16 bp, Homo sapiens
catcttctccatctgg

SEQ ID NO: 4555760 - DNA, 12 bp, Homo sapiens
catcttgctacc

SEQ ID NO: 4555761 - DNA, 20 bp, Homo sapiens
catcttgctaccagtattta

SEQ ID NO: 4555762 - DNA, 22 bp, Homo sapiens
catcttgctaccagtatttaga

SEQ ID NO: 4555763 - DNA, 12 bp, Homo sapiens
catcttgtacaa

SEQ ID NO: 4555764 - DNA, 17 bp, Homo sapiens
catctttattgaaattc

SEQ ID NO: 4555765 - DNA, 20 bp, Homo sapiens
catctttgttacttccttat

SEQ ID NO: 4555766 - DNA, 16 bp, Homo sapiens
catcttttcttgcctc

SEQ ID NO: 4555767 - DNA, 21 bp, Homo sapiens
catcttttcttgcctctgtcc

SEQ ID NO: 4555768 - DNA, 14 bp, Homo sapiens
catcttttgaagag

SEQ ID NO: 4555769 - DNA, 15 bp, Homo sapiens
catcttttgtattaa

SEQ ID NO: 4555770 - DNA, 16 bp, Homo sapiens
catctttttaaagctt

SEQ ID NO: 4555771 - DNA, 14 bp, Homo sapiens
catctttttctaga

SEQ ID NO: 4555772 - DNA, 21 bp, Homo sapiens
catctttttctagagttatct

SEQ ID NO: 4555773 - DNA, 13 bp, Homo sapiens
catgaaaaatttt

SEQ ID NO: 4555774 - DNA, 19 bp, Homo sapiens
catgaaaatagctattttt

SEQ ID NO: 4555775 - DNA, 23 bp, Homo sapiens
catgaaaatgtattcctttaaaa

SEQ ID NO: 4555776 - DNA, 17 bp, Homo sapiens
catgaaattgtatctca

SEQ ID NO: 4555777 - DNA, 17 bp, Homo sapiens
catgaacgccaaggaat

SEQ ID NO: 4555778 - DNA, 18 bp, Homo sapiens
catgaactcatcattttt

SEQ ID NO: 4555779 - DNA, 18 bp, Homo sapiens
catgaagattctttccca

SEQ ID NO: 4555780 - DNA, 22 bp, Homo sapiens
catgaagccacgggtgccagaa

SEQ ID NO: 4555781 - DNA, 11 bp, Homo sapiens
catgaagcctg

SEQ ID NO: 4555782 - DNA, 12 bp, Homo sapiens
catgaagcctgt

SEQ ID NO: 4555783 - DNA, 13 bp, Homo sapiens
catgaagcctttt

SEQ ID NO: 4555784 - DNA, 15 bp, Homo sapiens
catgaagctgttgtg

SEQ ID NO: 4555785 - DNA, 15 bp, Homo sapiens
catgaaggctggaag

SEQ ID NO: 4555786 - DNA, 22 bp, Homo sapiens
catgaaggctggaaggcagcag

SEQ ID NO: 4555787 - DNA, 21 bp, Homo sapiens
catgaaggtaaataaaaagaa

SEQ ID NO: 4555788 - DNA, 22 bp, Homo sapiens
catgaaggtaaataaaaagaaa

SEQ ID NO: 4555789 - DNA, 15 bp, Homo sapiens
catgaataaaattag

SEQ ID NO: 4555790 - DNA, 21 bp, Homo sapiens
catgaataaaattaggttaaa

SEQ ID NO: 4555791 - DNA, 22 bp, Homo sapiens
catgaataaagcctttgtatct

SEQ ID NO: 4555792 - DNA, 23 bp, Homo sapiens
catgaataaagcctttgtatctt

SEQ ID NO: 4555793 - DNA, 24 bp, Homo sapiens
catgaatatggtgtctattatagt

SEQ ID NO: 4555794 - DNA, 14 bp, Homo sapiens
catgaatattttca

SEQ ID NO: 4555795 - DNA, 22 bp, Homo sapiens
catgaatattttcaagtttttc

SEQ ID NO: 4555796 - DNA, 19 bp, Homo sapiens
catgaatctgcacatctgt

SEQ ID NO: 4555797 - DNA, 13 bp, Homo sapiens
catgaatgctttt

SEQ ID NO: 4555798 - DNA, 20 bp, Homo sapiens
catgaatttctcctttccta

SEQ ID NO: 4555799 - DNA, 14 bp, Homo sapiens
catgaattttaaag

SEQ ID NO: 4555800 - DNA, 15 bp, Homo sapiens
catgaattttaaagt

SEQ ID NO: 4555801 - DNA, 17 bp, Homo sapiens
catgacaagatgggaca

SEQ ID NO: 4555802 - DNA, 12 bp, Homo sapiens
catgacagaggc

SEQ ID NO: 4555803 - DNA, 13 bp, Homo sapiens
catgacagaggct

SEQ ID NO: 4555804 - DNA, 14 bp, Homo sapiens
catgacagcctcca

SEQ ID NO: 4555805 - DNA, 18 bp, Homo sapiens
catgacaggcctgaagat

SEQ ID NO: 4555806 - DNA, 15 bp, Homo sapiens
catgacataacagtg

SEQ ID NO: 4555807 - DNA, 18 bp, Homo sapiens
catgacataacagtgcag

SEQ ID NO: 4555808 - DNA, 18 bp, Homo sapiens
catgaccatactgaggga

SEQ ID NO: 4555809 - DNA, 20 bp, Homo sapiens
catgacctaccaggacagaa

SEQ ID NO: 4555810 - DNA, 21 bp, Homo sapiens
catgacctaccaggacagaac

SEQ ID NO: 4555811 - DNA, 23 bp, Homo sapiens
catgacctaccaggacagaactt

SEQ ID NO: 4555812 - DNA, 23 bp, Homo sapiens
catgacgacaaagctgctaaatc

SEQ ID NO: 4555813 - DNA, 20 bp, Homo sapiens
catgacgggttgtgagactt

SEQ ID NO: 4555814 - DNA, 18 bp, Homo sapiens
catgacgtggtaaaatgt

SEQ ID NO: 4555815 - DNA, 19 bp, Homo sapiens
catgacgtggtaaaatgtg

SEQ ID NO: 4555816 - DNA, 19 bp, Homo sapiens
catgactggctaattttct

SEQ ID NO: 4555817 - DNA, 20 bp, Homo sapiens
catgacttccttatttctga

SEQ ID NO: 4555818 - DNA, 17 bp, Homo sapiens
catgagccgcccaaggc

SEQ ID NO: 4555819 - DNA, 23 bp, Homo sapiens
catgagctccttaaggctctttt

SEQ ID NO: 4555820 - DNA, 18 bp, Homo sapiens
catgagctgtgttcacag

SEQ ID NO: 4555821 - DNA, 16 bp, Homo sapiens
catgaggagttgctgt

SEQ ID NO: 4555822 - DNA, 14 bp, Homo sapiens
catgaggccatctc

SEQ ID NO: 4555823 - DNA, 21 bp, Homo sapiens
catgaggccatctcaggagat

SEQ ID NO: 4555824 - DNA, 16 bp, Homo sapiens
catgaggtactgagag

SEQ ID NO: 4555825 - DNA, 19 bp, Homo sapiens
catgaggtactgagagtga

SEQ ID NO: 4555826 - DNA, 15 bp, Homo sapiens
catgagttcaaatac

SEQ ID NO: 4555827 - DNA, 15 bp, Homo sapiens
catgataagacattt

SEQ ID NO: 4555828 - DNA, 16 bp, Homo sapiens
catgataagacatttt

SEQ ID NO: 4555829 - DNA, 17 bp, Homo sapiens
catgataagacattttg

SEQ ID NO: 4555830 - DNA, 13 bp, Homo sapiens
catgatagaaaga

SEQ ID NO: 4555831 - DNA, 23 bp, Homo sapiens
catgatagaaagaataaaatgtt

SEQ ID NO: 4555832 - DNA, 14 bp, Homo sapiens
catgatataacttt

SEQ ID NO: 4555833 - DNA, 21 bp, Homo sapiens
catgatcatagctcactgcag

SEQ ID NO: 4555834 - DNA, 13 bp, Homo sapiens
catgatctccctg

SEQ ID NO: 4555835 - DNA, 18 bp, Homo sapiens
catgatctccctgccgcc

SEQ ID NO: 4555836 - DNA, 21 bp, Homo sapiens
catgatctccctgccgcctca

SEQ ID NO: 4555837 - DNA, 23 bp, Homo sapiens
catgatctgtatttaatggtttt

SEQ ID NO: 4555838 - DNA, 12 bp, Homo sapiens
catgatgcagtc

SEQ ID NO: 4555839 - DNA, 23 bp, Homo sapiens
catgatgcagtctcctctttaaa

SEQ ID NO: 4555840 - DNA, 22 bp, Homo sapiens
catgatgtgaagagtttcacaa

SEQ ID NO: 4555841 - DNA, 12 bp, Homo sapiens
catgattagcaa

SEQ ID NO: 4555842 - DNA, 14 bp, Homo sapiens
catgattctattta

SEQ ID NO: 4555843 - DNA, 16 bp, Homo sapiens
catgatttcccactgc

SEQ ID NO: 4555844 - DNA, 17 bp, Homo sapiens
catgatttccttgaatg

SEQ ID NO: 4555845 - DNA, 17 bp, Homo sapiens
catgattttacaagtat

SEQ ID NO: 4555846 - DNA, 17 bp, Homo sapiens
catgcaaaatatgttta

SEQ ID NO: 4555847 - DNA, 14 bp, Homo sapiens
catgcaaattgtga

SEQ ID NO: 4555848 - DNA, 15 bp, Homo sapiens
catgcaaattgtgaa

SEQ ID NO: 4555849 - DNA, 16 bp, Homo sapiens
catgcaaattgtgaaa

SEQ ID NO: 4555850 - DNA, 10 bp, Homo sapiens
catgcaataa

SEQ ID NO: 4555851 - DNA, 16 bp, Homo sapiens
catgcaatacatacca

SEQ ID NO: 4555852 - DNA, 15 bp, Homo sapiens
catgcacactgagaa

SEQ ID NO: 4555853 - DNA, 18 bp, Homo sapiens
catgcacagtatttgtaa

SEQ ID NO: 4555854 - DNA, 19 bp, Homo sapiens
catgcacagtatttgtaat

SEQ ID NO: 4555855 - DNA, 15 bp, Homo sapiens
catgcacagtcatac

SEQ ID NO: 4555856 - DNA, 22 bp, Homo sapiens
catgcacatgctgtctggccct

SEQ ID NO: 4555857 - DNA, 23 bp, Homo sapiens
catgcacccctgagccagcaggg

SEQ ID NO: 4555858 - DNA, 14 bp, Homo sapiens
catgcactgatgtt

SEQ ID NO: 4555859 - DNA, 15 bp, Homo sapiens
catgcactgtaaata

SEQ ID NO: 4555860 - DNA, 20 bp, Homo sapiens
catgcactgtaaatatccct

SEQ ID NO: 4555861 - DNA, 18 bp, Homo sapiens
catgcagaataatcctgt

SEQ ID NO: 4555862 - DNA, 19 bp, Homo sapiens
catgcagaataatcctgtt

SEQ ID NO: 4555863 - DNA, 16 bp, Homo sapiens
catgcagcccatgccc

SEQ ID NO: 4555864 - DNA, 19 bp, Homo sapiens
catgcagcccatgcccacc

SEQ ID NO: 4555865 - DNA, 22 bp, Homo sapiens
catgcagcccatgcccacctgc

SEQ ID NO: 4555866 - DNA, 23 bp, Homo sapiens
catgcagcccatgcccacctgcc

SEQ ID NO: 4555867 - DNA, 20 bp, Homo sapiens
catgcagctcaactttctgt

SEQ ID NO: 4555868 - DNA, 19 bp, Homo sapiens
catgcaggggtcagtgcag

SEQ ID NO: 4555869 - DNA, 10 bp, Homo sapiens
catgcagttt

SEQ ID NO: 4555870 - DNA, 13 bp, Homo sapiens
catgcagtttgaa

SEQ ID NO: 4555871 - DNA, 17 bp, Homo sapiens
catgcagtttgaaattc

SEQ ID NO: 4555872 - DNA, 22 bp, Homo sapiens
catgcataaatcaatggttcaa

SEQ ID NO: 4555873 - DNA, 15 bp, Homo sapiens
catgcatgacagcct

SEQ ID NO: 4555874 - DNA, 16 bp, Homo sapiens
catgcatgtcctgtaa

SEQ ID NO: 4555875 - DNA, 20 bp, Homo sapiens
catgccaaccctgggctatt

SEQ ID NO: 4555876 - DNA, 16 bp, Homo sapiens
catgccacctggcaaa

SEQ ID NO: 4555877 - DNA, 19 bp, Homo sapiens
catgccagtatttttaaag

SEQ ID NO: 4555878 - DNA, 14 bp, Homo sapiens
catgccagtgcctt

SEQ ID NO: 4555879 - DNA, 13 bp, Homo sapiens
catgcccaccccc

SEQ ID NO: 4555880 - DNA, 18 bp, Homo sapiens
catgcccaccccctgccc

SEQ ID NO: 4555881 - DNA, 19 bp, Homo sapiens
catgcccaccccctgccct

SEQ ID NO: 4555882 - DNA, 21 bp, Homo sapiens
catgcccaccccctgccctgc

SEQ ID NO: 4555883 - DNA, 14 bp, Homo sapiens
catgcccacctgcc

SEQ ID NO: 4555884 - DNA, 16 bp, Homo sapiens
catgcccacctgccca

SEQ ID NO: 4555885 - DNA, 15 bp, Homo sapiens
catgccccctttcag

SEQ ID NO: 4555886 - DNA, 16 bp, Homo sapiens
catgccccttggtcct

SEQ ID NO: 4555887 - DNA, 17 bp, Homo sapiens
catgccccttggtcctg

SEQ ID NO: 4555888 - DNA, 23 bp, Homo sapiens
catgccgggcccctccatccacc

SEQ ID NO: 4555889 - DNA, 18 bp, Homo sapiens
catgccggtacacagcca

SEQ ID NO: 4555890 - DNA, 17 bp, Homo sapiens
catgcctatgggccaga

SEQ ID NO: 4555891 - DNA, 18 bp, Homo sapiens
catgcctcactaattttt

SEQ ID NO: 4555892 - DNA, 20 bp, Homo sapiens
catgcctctgtagagagcag

SEQ ID NO: 4555893 - DNA, 12 bp, Homo sapiens
catgcctgcgcc

SEQ ID NO: 4555894 - DNA, 16 bp, Homo sapiens
catgcctgcgcctgct

SEQ ID NO: 4555895 - DNA, 23 bp, Homo sapiens
catgcctgcgcctgctgcctgct

SEQ ID NO: 4555896 - DNA, 24 bp, Homo sapiens
catgcctgcgcctgctgcctgctg

SEQ ID NO: 4555897 - DNA, 23 bp, Homo sapiens
catgcctgtaatcccagaacttt

SEQ ID NO: 4555898 - DNA, 22 bp, Homo sapiens
catgcctgtagctttcctggtc

SEQ ID NO: 4555899 - DNA, 13 bp, Homo sapiens
catgcggcccagc

SEQ ID NO: 4555900 - DNA, 21 bp, Homo sapiens
catgcggcccagcccggctcc

SEQ ID NO: 4555901 - DNA, 15 bp, Homo sapiens
catgcgtcaggggcc

SEQ ID NO: 4555902 - DNA, 16 bp, Homo sapiens
catgcgtcaggggcct

SEQ ID NO: 4555903 - DNA, 17 bp, Homo sapiens
catgctaacaaagacaa

SEQ ID NO: 4555904 - DNA, 17 bp, Homo sapiens
catgctaagagaagtag

SEQ ID NO: 4555905 - DNA, 19 bp, Homo sapiens
catgctaagagaagtagaa

SEQ ID NO: 4555906 - DNA, 22 bp, Homo sapiens
catgctaatataagtttctttg

SEQ ID NO: 4555907 - DNA, 16 bp, Homo sapiens
catgctatctgttcct

SEQ ID NO: 4555908 - DNA, 17 bp, Homo sapiens
catgctatctgttccta

SEQ ID NO: 4555909 - DNA, 17 bp, Homo sapiens
catgctcaacccccctc

SEQ ID NO: 4555910 - DNA, 14 bp, Homo sapiens
catgctcaatgaaa

SEQ ID NO: 4555911 - DNA, 13 bp, Homo sapiens
catgctctctcac

SEQ ID NO: 4555912 - DNA, 21 bp, Homo sapiens
catgctctctcacctgctccc

SEQ ID NO: 4555913 - DNA, 16 bp, Homo sapiens
catgctctgcaaaagg

SEQ ID NO: 4555914 - DNA, 21 bp, Homo sapiens
catgctcttgaccttgtagag

SEQ ID NO: 4555915 - DNA, 19 bp, Homo sapiens
catgctcttgttctgttcc

SEQ ID NO: 4555916 - DNA, 15 bp, Homo sapiens
catgctgaaaaatat

SEQ ID NO: 4555917 - DNA, 20 bp, Homo sapiens
catgctgaaaaatatagcct

SEQ ID NO: 4555918 - DNA, 14 bp, Homo sapiens
catgctgccttcag

SEQ ID NO: 4555919 - DNA, 23 bp, Homo sapiens
catgctggaacctgcaaaaaata

SEQ ID NO: 4555920 - DNA, 19 bp, Homo sapiens
catgctgggatttccaact

SEQ ID NO: 4555921 - DNA, 14 bp, Homo sapiens
catgctgggtctga

SEQ ID NO: 4555922 - DNA, 21 bp, Homo sapiens
catgctgggtctgaggcccct

SEQ ID NO: 4555923 - DNA, 13 bp, Homo sapiens
catgcttaaattt

SEQ ID NO: 4555924 - DNA, 14 bp, Homo sapiens
catgcttaaatttt

SEQ ID NO: 4555925 - DNA, 23 bp, Homo sapiens
catgcttctcatcttgtgaaatg

SEQ ID NO: 4555926 - DNA, 14 bp, Homo sapiens
catgcttgacatac

SEQ ID NO: 4555927 - DNA, 14 bp, Homo sapiens
catgctttatgtgg

SEQ ID NO: 4555928 - DNA, 12 bp, Homo sapiens
catgctttccat

SEQ ID NO: 4555929 - DNA, 12 bp, Homo sapiens
catgctttgagt

SEQ ID NO: 4555930 - DNA, 15 bp, Homo sapiens
catggaaaaatgcca

SEQ ID NO: 4555931 - DNA, 14 bp, Homo sapiens
catggaagaaaagg

SEQ ID NO: 4555932 - DNA, 16 bp, Homo sapiens
catggaagtaattaag

SEQ ID NO: 4555933 - DNA, 22 bp, Homo sapiens
catggaagtaattaaggtacat

SEQ ID NO: 4555934 - DNA, 16 bp, Homo sapiens
catggacaaggagctg

SEQ ID NO: 4555935 - DNA, 15 bp, Homo sapiens
catggacatttagaa

SEQ ID NO: 4555936 - DNA, 20 bp, Homo sapiens
catggacatttagaagaaag

SEQ ID NO: 4555937 - DNA, 22 bp, Homo sapiens
catggacctggtgcccctgctc

SEQ ID NO: 4555938 - DNA, 11 bp, Homo sapiens
catggagaaac

SEQ ID NO: 4555939 - DNA, 14 bp, Homo sapiens
catggagaaaccct

SEQ ID NO: 4555940 - DNA, 17 bp, Homo sapiens
catggagaaaccctgtc

SEQ ID NO: 4555941 - DNA, 16 bp, Homo sapiens
catggagatgtaaaat

SEQ ID NO: 4555942 - DNA, 15 bp, Homo sapiens
catggagccccagcc

SEQ ID NO: 4555943 - DNA, 17 bp, Homo sapiens
catggagccccagcccc

SEQ ID NO: 4555944 - DNA, 14 bp, Homo sapiens
catggagctgtcac

SEQ ID NO: 4555945 - DNA, 21 bp, Homo sapiens
catggaggatggtgtcctgag

SEQ ID NO: 4555946 - DNA, 22 bp, Homo sapiens
catggaggatggtgtcctgagg

SEQ ID NO: 4555947 - DNA, 14 bp, Homo sapiens
catggatgattctt

SEQ ID NO: 4555948 - DNA, 13 bp, Homo sapiens
catggatgcattt

SEQ ID NO: 4555949 - DNA, 16 bp, Homo sapiens
catggatgcatttcaa

SEQ ID NO: 4555950 - DNA, 17 bp, Homo sapiens
catggatgcatttcaaa

SEQ ID NO: 4555951 - DNA, 18 bp, Homo sapiens
catggatgcatttcaaat

SEQ ID NO: 4555952 - DNA, 19 bp, Homo sapiens
catggatgcatttcaaatg

SEQ ID NO: 4555953 - DNA, 21 bp, Homo sapiens
catggatgcatttcaaatgtt

SEQ ID NO: 4555954 - DNA, 13 bp, Homo sapiens
catggatggctca

SEQ ID NO: 4555955 - DNA, 17 bp, Homo sapiens
catggatttccactgct

SEQ ID NO: 4555956 - DNA, 16 bp, Homo sapiens
catggcaatgaaaatt

SEQ ID NO: 4555957 - DNA, 17 bp, Homo sapiens
catggcaatgaaaattt

SEQ ID NO: 4555958 - DNA, 13 bp, Homo sapiens
catggcagaaggc

SEQ ID NO: 4555959 - DNA, 16 bp, Homo sapiens
catggcagggccaggc

SEQ ID NO: 4555960 - DNA, 17 bp, Homo sapiens
catggcagggccaggcc

SEQ ID NO: 4555961 - DNA, 18 bp, Homo sapiens
catggcagggccaggcct

SEQ ID NO: 4555962 - DNA, 19 bp, Homo sapiens
catggcatgcttaaatttt

SEQ ID NO: 4555963 - DNA, 15 bp, Homo sapiens
catggccccaggccc

SEQ ID NO: 4555964 - DNA, 12 bp, Homo sapiens
catggcccccaa

SEQ ID NO: 4555965 - DNA, 16 bp, Homo sapiens
catggcccccaataaa

SEQ ID NO: 4555966 - DNA, 18 bp, Homo sapiens
catggcccccaataaagg

SEQ ID NO: 4555967 - DNA, 20 bp, Homo sapiens
catggcccccaataaaggca

SEQ ID NO: 4555968 - DNA, 16 bp, Homo sapiens
catggccctgtcccag

SEQ ID NO: 4555969 - DNA, 18 bp, Homo sapiens
catggcctcagccctgct

SEQ ID NO: 4555970 - DNA, 19 bp, Homo sapiens
catggcctcagccctgctc

SEQ ID NO: 4555971 - DNA, 19 bp, Homo sapiens
catggctacctcagaaaga

SEQ ID NO: 4555972 - DNA, 15 bp, Homo sapiens
catggctattttata

SEQ ID NO: 4555973 - DNA, 12 bp, Homo sapiens
catgggaagaac

SEQ ID NO: 4555974 - DNA, 19 bp, Homo sapiens
catgggaagacgaggccct

SEQ ID NO: 4555975 - DNA, 15 bp, Homo sapiens
catgggagcagtcca

SEQ ID NO: 4555976 - DNA, 13 bp, Homo sapiens
catgggagccggg

SEQ ID NO: 4555977 - DNA, 22 bp, Homo sapiens
catgggagccgggtctgcctct

SEQ ID NO: 4555978 - DNA, 17 bp, Homo sapiens
catgggagggatcagcc

SEQ ID NO: 4555979 - DNA, 19 bp, Homo sapiens
catgggagggatcagcccc

SEQ ID NO: 4555980 - DNA, 22 bp, Homo sapiens
catgggagggggcttgaagcca

SEQ ID NO: 4555981 - DNA, 17 bp, Homo sapiens
catgggcccaggaatgc

SEQ ID NO: 4555982 - DNA, 22 bp, Homo sapiens
catgggcctttaagaaccttaa

SEQ ID NO: 4555983 - DNA, 13 bp, Homo sapiens
catgggctctgac

SEQ ID NO: 4555984 - DNA, 13 bp, Homo sapiens
catgggctgtgtc

SEQ ID NO: 4555985 - DNA, 20 bp, Homo sapiens
catggggaaaaaaatcatct

SEQ ID NO: 4555986 - DNA, 11 bp, Homo sapiens
catggggccag

SEQ ID NO: 4555987 - DNA, 17 bp, Homo sapiens
catgggggtaagaaaag

SEQ ID NO: 4555988 - DNA, 21 bp, Homo sapiens
catggggtggggtagggctga

SEQ ID NO: 4555989 - DNA, 14 bp, Homo sapiens
catggggttcgaga

SEQ ID NO: 4555990 - DNA, 16 bp, Homo sapiens
catggggttcgagact

SEQ ID NO: 4555991 - DNA, 17 bp, Homo sapiens
catggggttcgagactc

SEQ ID NO: 4555992 - DNA, 21 bp, Homo sapiens
catggggttcgagactccatc

SEQ ID NO: 4555993 - DNA, 22 bp, Homo sapiens
catgggtcctagcccttccctg

SEQ ID NO: 4555994 - DNA, 13 bp, Homo sapiens
catggtaatttat

SEQ ID NO: 4555995 - DNA, 16 bp, Homo sapiens
catggtactaccccag

SEQ ID NO: 4555996 - DNA, 15 bp, Homo sapiens
catggtacttcctct

SEQ ID NO: 4555997 - DNA, 24 bp, Homo sapiens
catggtacttcctctgtgaactgt

SEQ ID NO: 4555998 - DNA, 21 bp, Homo sapiens
catggtagatttttttcatag

SEQ ID NO: 4555999 - DNA, 14 bp, Homo sapiens
catggtatcatata

SEQ ID NO: 4556000 - DNA, 14 bp, Homo sapiens
catggtcacacact

SEQ ID NO: 4556001 - DNA, 15 bp, Homo sapiens
catggtcacacactg

SEQ ID NO: 4556002 - DNA, 19 bp, Homo sapiens
catggtcctttctggaagt

SEQ ID NO: 4556003 - DNA, 17 bp, Homo sapiens
catggtctctgcaccca

SEQ ID NO: 4556004 - DNA, 20 bp, Homo sapiens
catggtgaaacccccatctc

SEQ ID NO: 4556005 - DNA, 19 bp, Homo sapiens
catggtgagtctattttta

SEQ ID NO: 4556006 - DNA, 13 bp, Homo sapiens
catggtgcctgag

SEQ ID NO: 4556007 - DNA, 15 bp, Homo sapiens
catggtgcctgagag

SEQ ID NO: 4556008 - DNA, 17 bp, Homo sapiens
catggtgcctgagaggc

SEQ ID NO: 4556009 - DNA, 14 bp, Homo sapiens
catggtggcaggcg

SEQ ID NO: 4556010 - DNA, 12 bp, Homo sapiens
catggtggcgca

SEQ ID NO: 4556011 - DNA, 22 bp, Homo sapiens
catggtgggtccatgggcagag

SEQ ID NO: 4556012 - DNA, 19 bp, Homo sapiens
catggtgggttcaggggac

SEQ ID NO: 4556013 - DNA, 18 bp, Homo sapiens
catggttctgcctcctgg

SEQ ID NO: 4556014 - DNA, 19 bp, Homo sapiens
catggttctgcctcctggc

SEQ ID NO: 4556015 - DNA, 20 bp, Homo sapiens
catggtttaaaagaaaaaat

SEQ ID NO: 4556016 - DNA, 15 bp, Homo sapiens
catggtttaaagtca

SEQ ID NO: 4556017 - DNA, 13 bp, Homo sapiens
catggtttgatat

SEQ ID NO: 4556018 - DNA, 14 bp, Homo sapiens
catggtttggagct

SEQ ID NO: 4556019 - DNA, 16 bp, Homo sapiens
catggtttggagctga

SEQ ID NO: 4556020 - DNA, 15 bp, Homo sapiens
catgtaaaggccttt

SEQ ID NO: 4556021 - DNA, 15 bp, Homo sapiens
catgtaaataagatg

SEQ ID NO: 4556022 - DNA, 17 bp, Homo sapiens
catgtaaattgactgta

SEQ ID NO: 4556023 - DNA, 16 bp, Homo sapiens
catgtaaccactgcac

SEQ ID NO: 4556024 - DNA, 15 bp, Homo sapiens
catgtaagaaaatgt

SEQ ID NO: 4556025 - DNA, 15 bp, Homo sapiens
catgtaataaacagg

SEQ ID NO: 4556026 - DNA, 21 bp, Homo sapiens
catgtactacagctatatttg

SEQ ID NO: 4556027 - DNA, 19 bp, Homo sapiens
catgtactgggaaggcaat

SEQ ID NO: 4556028 - DNA, 22 bp, Homo sapiens
catgtactttttagtaatttct

SEQ ID NO: 4556029 - DNA, 20 bp, Homo sapiens
catgtagaaaatttgttatt

SEQ ID NO: 4556030 - DNA, 17 bp, Homo sapiens
catgtagaataaatgaa

SEQ ID NO: 4556031 - DNA, 10 bp, Homo sapiens
catgtagcat

SEQ ID NO: 4556032 - DNA, 23 bp, Homo sapiens
catgtagcatataaatgtttata

SEQ ID NO: 4556033 - DNA, 18 bp, Homo sapiens
catgtaggaagtaggaag

SEQ ID NO: 4556034 - DNA, 17 bp, Homo sapiens
catgtagtaacactaat

SEQ ID NO: 4556035 - DNA, 21 bp, Homo sapiens
catgtagtaacactaatatat

SEQ ID NO: 4556036 - DNA, 21 bp, Homo sapiens
catgtataaatataagtctat

SEQ ID NO: 4556037 - DNA, 15 bp, Homo sapiens
catgtatagttgctt

SEQ ID NO: 4556038 - DNA, 20 bp, Homo sapiens
catgtatagttgcttttgaa

SEQ ID NO: 4556039 - DNA, 14 bp, Homo sapiens
catgtatgtataca

SEQ ID NO: 4556040 - DNA, 14 bp, Homo sapiens
catgtatttgttat

SEQ ID NO: 4556041 - DNA, 17 bp, Homo sapiens
catgtatttgttatata

SEQ ID NO: 4556042 - DNA, 20 bp, Homo sapiens
catgtatttgttatatataa

SEQ ID NO: 4556043 - DNA, 22 bp, Homo sapiens
catgtatttgttatatataata

SEQ ID NO: 4556044 - DNA, 15 bp, Homo sapiens
catgtcaacagcgtt

SEQ ID NO: 4556045 - DNA, 20 bp, Homo sapiens
catgtcacacaaactgatga

SEQ ID NO: 4556046 - DNA, 21 bp, Homo sapiens
catgtcaccggtcagtgcctt

SEQ ID NO: 4556047 - DNA, 18 bp, Homo sapiens
catgtcatttcagaagtt

SEQ ID NO: 4556048 - DNA, 13 bp, Homo sapiens
catgtccaaagag

SEQ ID NO: 4556049 - DNA, 19 bp, Homo sapiens
catgtccaaagaggctgcc

SEQ ID NO: 4556050 - DNA, 21 bp, Homo sapiens
catgtccaaagaggctgcccc

SEQ ID NO: 4556051 - DNA, 16 bp, Homo sapiens
catgtcccgtgtctcc

SEQ ID NO: 4556052 - DNA, 17 bp, Homo sapiens
catgtctattcagcttc

SEQ ID NO: 4556053 - DNA, 14 bp, Homo sapiens
catgtctattgtcc

SEQ ID NO: 4556054 - DNA, 20 bp, Homo sapiens
catgtctgcctatgcactga

SEQ ID NO: 4556055 - DNA, 15 bp, Homo sapiens
catgtgagatagttt

SEQ ID NO: 4556056 - DNA, 18 bp, Homo sapiens
catgtgcatgcataccac

SEQ ID NO: 4556057 - DNA, 12 bp, Homo sapiens
catgtgcctttc

SEQ ID NO: 4556058 - DNA, 17 bp, Homo sapiens
catgtgcctttctttgc

SEQ ID NO: 4556059 - DNA, 19 bp, Homo sapiens
catgtgctgccctgttgcc

SEQ ID NO: 4556060 - DNA, 13 bp, Homo sapiens
catgtgcttcatc

SEQ ID NO: 4556061 - DNA, 14 bp, Homo sapiens
catgtgcttcatct

SEQ ID NO: 4556062 - DNA, 16 bp, Homo sapiens
catgtgcttcatctgt

SEQ ID NO: 4556063 - DNA, 23 bp, Homo sapiens
catgtgtatccatgcattatata

SEQ ID NO: 4556064 - DNA, 14 bp, Homo sapiens
catgtgtcccctca

SEQ ID NO: 4556065 - DNA, 15 bp, Homo sapiens
catgtgtcccctcac

SEQ ID NO: 4556066 - DNA, 17 bp, Homo sapiens
catgtgtgcctggccgc

SEQ ID NO: 4556067 - DNA, 22 bp, Homo sapiens
catgtgtgctcacaatgttctg

SEQ ID NO: 4556068 - DNA, 20 bp, Homo sapiens
catgtgtgtgccaagccctg

SEQ ID NO: 4556069 - DNA, 22 bp, Homo sapiens
catgtgttccctttgtctttca

SEQ ID NO: 4556070 - DNA, 15 bp, Homo sapiens
catgtgttttcatca

SEQ ID NO: 4556071 - DNA, 15 bp, Homo sapiens
catgttaatatttga

SEQ ID NO: 4556072 - DNA, 17 bp, Homo sapiens
catgttaatatttgaat

SEQ ID NO: 4556073 - DNA, 19 bp, Homo sapiens
catgttaatatttgaattg

SEQ ID NO: 4556074 - DNA, 18 bp, Homo sapiens
catgttagcaaacgcagc

SEQ ID NO: 4556075 - DNA, 13 bp, Homo sapiens
catgttagccagg

SEQ ID NO: 4556076 - DNA, 24 bp, Homo sapiens
catgttagttaccttatagttact

SEQ ID NO: 4556077 - DNA, 19 bp, Homo sapiens
catgttatattgcttcctg

SEQ ID NO: 4556078 - DNA, 23 bp, Homo sapiens
catgttatttgtaatagatgttt

SEQ ID NO: 4556079 - DNA, 15 bp, Homo sapiens
catgttcagaaaaga

SEQ ID NO: 4556080 - DNA, 19 bp, Homo sapiens
catgttcagaaaagaagtg

SEQ ID NO: 4556081 - DNA, 16 bp, Homo sapiens
catgttccactaaccc

SEQ ID NO: 4556082 - DNA, 20 bp, Homo sapiens
catgttctatttttgactgt

SEQ ID NO: 4556083 - DNA, 18 bp, Homo sapiens
catgttgaagtaattctt

SEQ ID NO: 4556084 - DNA, 23 bp, Homo sapiens
catgttgaagtaattcttctgcc

SEQ ID NO: 4556085 - DNA, 13 bp, Homo sapiens
catgttgctgaat

SEQ ID NO: 4556086 - DNA, 13 bp, Homo sapiens
catgttggcctct

SEQ ID NO: 4556087 - DNA, 16 bp, Homo sapiens
catgttggttgcactt

SEQ ID NO: 4556088 - DNA, 21 bp, Homo sapiens
catgttggttgcactttgtag

SEQ ID NO: 4556089 - DNA, 13 bp, Homo sapiens
catgtttataaat

SEQ ID NO: 4556090 - DNA, 18 bp, Homo sapiens
catgtttatttttcttgt

SEQ ID NO: 4556091 - DNA, 23 bp, Homo sapiens
catgtttgagctcagacccccac

SEQ ID NO: 4556092 - DNA, 14 bp, Homo sapiens
catgtttttgaaaa

SEQ ID NO: 4556093 - DNA, 13 bp, Homo sapiens
cattaaaagaata

SEQ ID NO: 4556094 - DNA, 13 bp, Homo sapiens
cattaaacttttt

SEQ ID NO: 4556095 - DNA, 18 bp, Homo sapiens
cattaaagtcagaagttt

SEQ ID NO: 4556096 - DNA, 13 bp, Homo sapiens
cattaaataaatt

SEQ ID NO: 4556097 - DNA, 14 bp, Homo sapiens
cattaaatgaatat

SEQ ID NO: 4556098 - DNA, 15 bp, Homo sapiens
cattaaatgaatatt

SEQ ID NO: 4556099 - DNA, 22 bp, Homo sapiens
cattaaattactatagcaaagt

SEQ ID NO: 4556100 - DNA, 13 bp, Homo sapiens
cattaaattcaca

SEQ ID NO: 4556101 - DNA, 17 bp, Homo sapiens
cattaaattcacaaact

SEQ ID NO: 4556102 - DNA, 19 bp, Homo sapiens
cattaagaaaaacaataaa

SEQ ID NO: 4556103 - DNA, 15 bp, Homo sapiens
cattaagaaaatatt

SEQ ID NO: 4556104 - DNA, 17 bp, Homo sapiens
cattaatccacatgttt

SEQ ID NO: 4556105 - DNA, 19 bp, Homo sapiens
cattaatccacatgtttca

SEQ ID NO: 4556106 - DNA, 21 bp, Homo sapiens
cattaatccacatgtttcaga

SEQ ID NO: 4556107 - DNA, 22 bp, Homo sapiens
cattaatccacatgtttcagag

SEQ ID NO: 4556108 - DNA, 19 bp, Homo sapiens
cattaatgatgatcttcag

SEQ ID NO: 4556109 - DNA, 17 bp, Homo sapiens
cattaatgcctgctttt

SEQ ID NO: 4556110 - DNA, 21 bp, Homo sapiens
cattaatgcctgctttttgga

SEQ ID NO: 4556111 - DNA, 16 bp, Homo sapiens
cattaatggcatatgg

SEQ ID NO: 4556112 - DNA, 22 bp, Homo sapiens
cattaatggcatatggtcctag

SEQ ID NO: 4556113 - DNA, 20 bp, Homo sapiens
cattaccaaaataataaaaa

SEQ ID NO: 4556114 - DNA, 21 bp, Homo sapiens
cattacctcagtgagaagcca

SEQ ID NO: 4556115 - DNA, 18 bp, Homo sapiens
cattaccttttaccagct

SEQ ID NO: 4556116 - DNA, 22 bp, Homo sapiens
cattaccttttaccagctttta

SEQ ID NO: 4556117 - DNA, 23 bp, Homo sapiens
cattactgtacagggttatctgc

SEQ ID NO: 4556118 - DNA, 15 bp, Homo sapiens
cattagactcctcct

SEQ ID NO: 4556119 - DNA, 18 bp, Homo sapiens
cattagccagatttgtct

SEQ ID NO: 4556120 - DNA, 19 bp, Homo sapiens
cattaggctgttggttcaa

SEQ ID NO: 4556121 - DNA, 14 bp, Homo sapiens
cattagttttgaag

SEQ ID NO: 4556122 - DNA, 15 bp, Homo sapiens
cattagttttgaaga

SEQ ID NO: 4556123 - DNA, 16 bp, Homo sapiens
cattagttttgaagat

SEQ ID NO: 4556124 - DNA, 14 bp, Homo sapiens
cattatactttata

SEQ ID NO: 4556125 - DNA, 15 bp, Homo sapiens
cattatactttatat

SEQ ID NO: 4556126 - DNA, 16 bp, Homo sapiens
cattatactttatatc

SEQ ID NO: 4556127 - DNA, 13 bp, Homo sapiens
cattatattttga

SEQ ID NO: 4556128 - DNA, 20 bp, Homo sapiens
cattatattttgaaagaagc

SEQ ID NO: 4556129 - DNA, 15 bp, Homo sapiens
cattatccttttatc

SEQ ID NO: 4556130 - DNA, 12 bp, Homo sapiens
cattatctcaaa

SEQ ID NO: 4556131 - DNA, 13 bp, Homo sapiens
cattatctcaaaa

SEQ ID NO: 4556132 - DNA, 16 bp, Homo sapiens
cattatgagaggcaat

SEQ ID NO: 4556133 - DNA, 18 bp, Homo sapiens
cattatgcaaatggagat

SEQ ID NO: 4556134 - DNA, 13 bp, Homo sapiens
cattattaaattg

SEQ ID NO: 4556135 - DNA, 17 bp, Homo sapiens
cattattaaattgtaaa

SEQ ID NO: 4556136 - DNA, 16 bp, Homo sapiens
cattattgcttattgc

SEQ ID NO: 4556137 - DNA, 18 bp, Homo sapiens
cattattggaatataatt

SEQ ID NO: 4556138 - DNA, 17 bp, Homo sapiens
cattatttattaaattt

SEQ ID NO: 4556139 - DNA, 12 bp, Homo sapiens
cattatttgaga

SEQ ID NO: 4556140 - DNA, 16 bp, Homo sapiens
cattatttgagactgt

SEQ ID NO: 4556141 - DNA, 21 bp, Homo sapiens
cattatttgagactgtcctgt

SEQ ID NO: 4556142 - DNA, 14 bp, Homo sapiens
cattatttgtcaaa

SEQ ID NO: 4556143 - DNA, 19 bp, Homo sapiens
cattattttttatttctga

SEQ ID NO: 4556144 - DNA, 19 bp, Homo sapiens
cattcaaaaaactctctcc

SEQ ID NO: 4556145 - DNA, 14 bp, Homo sapiens
cattcaaaaatttc

SEQ ID NO: 4556146 - DNA, 23 bp, Homo sapiens
cattcaactttagtatttttact

SEQ ID NO: 4556147 - DNA, 17 bp, Homo sapiens
cattcaagcatgtttaa

SEQ ID NO: 4556148 - DNA, 18 bp, Homo sapiens
cattcaagtgtaaaatat

SEQ ID NO: 4556149 - DNA, 19 bp, Homo sapiens
cattcaagtgtaaaatatt

SEQ ID NO: 4556150 - DNA, 20 bp, Homo sapiens
cattcaagtgtaaaatattt

SEQ ID NO: 4556151 - DNA, 18 bp, Homo sapiens
cattcaattccagagaac

SEQ ID NO: 4556152 - DNA, 15 bp, Homo sapiens
cattcacatttagaa

SEQ ID NO: 4556153 - DNA, 19 bp, Homo sapiens
cattcacctgtatatttct

SEQ ID NO: 4556154 - DNA, 11 bp, Homo sapiens
cattcacttca

SEQ ID NO: 4556155 - DNA, 14 bp, Homo sapiens
cattcacttcataa

SEQ ID NO: 4556156 - DNA, 15 bp, Homo sapiens
cattcacttttgtta

SEQ ID NO: 4556157 - DNA, 13 bp, Homo sapiens
cattcagaagaaa

SEQ ID NO: 4556158 - DNA, 17 bp, Homo sapiens
cattcagaagaaaaaga

SEQ ID NO: 4556159 - DNA, 18 bp, Homo sapiens
cattcagaagaaaaagaa

SEQ ID NO: 4556160 - DNA, 21 bp, Homo sapiens
cattcagctgaggttcattac

SEQ ID NO: 4556161 - DNA, 19 bp, Homo sapiens
cattcaggtgacctcctgc

SEQ ID NO: 4556162 - DNA, 11 bp, Homo sapiens
cattcattttt

SEQ ID NO: 4556163 - DNA, 13 bp, Homo sapiens
cattcatttttat

SEQ ID NO: 4556164 - DNA, 16 bp, Homo sapiens
cattccaaagctttat

SEQ ID NO: 4556165 - DNA, 17 bp, Homo sapiens
cattccaaagctttatt

SEQ ID NO: 4556166 - DNA, 22 bp, Homo sapiens
cattccaaggagttggaagtga

SEQ ID NO: 4556167 - DNA, 19 bp, Homo sapiens
cattccagacttcaaaaat

SEQ ID NO: 4556168 - DNA, 14 bp, Homo sapiens
cattccagaggaag

SEQ ID NO: 4556169 - DNA, 12 bp, Homo sapiens
cattccagctct

SEQ ID NO: 4556170 - DNA, 15 bp, Homo sapiens
cattccagctctgcc

SEQ ID NO: 4556171 - DNA, 16 bp, Homo sapiens
cattccagctctgccc

SEQ ID NO: 4556172 - DNA, 15 bp, Homo sapiens
cattccatctagttt

SEQ ID NO: 4556173 - DNA, 13 bp, Homo sapiens
cattccatgtcca

SEQ ID NO: 4556174 - DNA, 23 bp, Homo sapiens
cattcccagagtcagaggagaag

SEQ ID NO: 4556175 - DNA, 23 bp, Homo sapiens
cattccccaggtggctgacccag

SEQ ID NO: 4556176 - DNA, 18 bp, Homo sapiens
cattccctgagtcaccag

SEQ ID NO: 4556177 - DNA, 15 bp, Homo sapiens
cattcctcacaatga

SEQ ID NO: 4556178 - DNA, 13 bp, Homo sapiens
cattcctgtgccc

SEQ ID NO: 4556179 - DNA, 20 bp, Homo sapiens
cattccttgcgcctcagccc

SEQ ID NO: 4556180 - DNA, 16 bp, Homo sapiens
cattcgggaccaatat

SEQ ID NO: 4556181 - DNA, 23 bp, Homo sapiens
cattcgtgagctggggactcagg

SEQ ID NO: 4556182 - DNA, 10 bp, Homo sapiens
cattctagat

SEQ ID NO: 4556183 - DNA, 11 bp, Homo sapiens
cattctagatc

SEQ ID NO: 4556184 - DNA, 13 bp, Homo sapiens
cattctagatcct

SEQ ID NO: 4556185 - DNA, 23 bp, Homo sapiens
cattctagatcctgcaccccagc

SEQ ID NO: 4556186 - DNA, 15 bp, Homo sapiens
cattctatctactga

SEQ ID NO: 4556187 - DNA, 18 bp, Homo sapiens
cattctatctactgattt

SEQ ID NO: 4556188 - DNA, 16 bp, Homo sapiens
cattctcataattcct

SEQ ID NO: 4556189 - DNA, 12 bp, Homo sapiens
cattctcccagg

SEQ ID NO: 4556190 - DNA, 15 bp, Homo sapiens
cattctcccaggtac

SEQ ID NO: 4556191 - DNA, 15 bp, Homo sapiens
cattctctcatagaa

SEQ ID NO: 4556192 - DNA, 22 bp, Homo sapiens
cattctctcatagaacattgat

SEQ ID NO: 4556193 - DNA, 16 bp, Homo sapiens
cattctctctcctgtc

SEQ ID NO: 4556194 - DNA, 18 bp, Homo sapiens
cattctctctcctgtcca

SEQ ID NO: 4556195 - DNA, 12 bp, Homo sapiens
cattctgaatta

SEQ ID NO: 4556196 - DNA, 21 bp, Homo sapiens
cattctgaattaattaatttg

SEQ ID NO: 4556197 - DNA, 15 bp, Homo sapiens
cattctgagaccaaa

SEQ ID NO: 4556198 - DNA, 11 bp, Homo sapiens
cattctgccaa

SEQ ID NO: 4556199 - DNA, 21 bp, Homo sapiens
cattctgccaaagtaaaacaa

SEQ ID NO: 4556200 - DNA, 14 bp, Homo sapiens
cattctgtgcaggc

SEQ ID NO: 4556201 - DNA, 18 bp, Homo sapiens
cattctgtgcaggctgca

SEQ ID NO: 4556202 - DNA, 14 bp, Homo sapiens
cattctgtgtccca

SEQ ID NO: 4556203 - DNA, 22 bp, Homo sapiens
cattcttagcctgtggcagtaa

SEQ ID NO: 4556204 - DNA, 18 bp, Homo sapiens
cattcttccatcatcact

SEQ ID NO: 4556205 - DNA, 19 bp, Homo sapiens
cattcttccatcatcactg

SEQ ID NO: 4556206 - DNA, 13 bp, Homo sapiens
cattcttctgggt

SEQ ID NO: 4556207 - DNA, 12 bp, Homo sapiens
cattcttggctt

SEQ ID NO: 4556208 - DNA, 20 bp, Homo sapiens
cattcttggcttaatcattt

SEQ ID NO: 4556209 - DNA, 14 bp, Homo sapiens
cattctttatagtg

SEQ ID NO: 4556210 - DNA, 21 bp, Homo sapiens
cattctttatagtgaagtgtt

SEQ ID NO: 4556211 - DNA, 12 bp, Homo sapiens
cattctttgctt

SEQ ID NO: 4556212 - DNA, 19 bp, Homo sapiens
cattcttttgccacatccc

SEQ ID NO: 4556213 - DNA, 14 bp, Homo sapiens
cattctttttgaaa

SEQ ID NO: 4556214 - DNA, 17 bp, Homo sapiens
cattgaaagaagagatg

SEQ ID NO: 4556215 - DNA, 13 bp, Homo sapiens
cattgaaatgtaa

SEQ ID NO: 4556216 - DNA, 18 bp, Homo sapiens
cattgaacacaaactgta

SEQ ID NO: 4556217 - DNA, 13 bp, Homo sapiens
cattgaaggctta

SEQ ID NO: 4556218 - DNA, 21 bp, Homo sapiens
cattgaatagtggaacatttt

SEQ ID NO: 4556219 - DNA, 21 bp, Homo sapiens
cattgaattcttggttgagga

SEQ ID NO: 4556220 - DNA, 22 bp, Homo sapiens
cattgaattcttggttgaggaa

SEQ ID NO: 4556221 - DNA, 18 bp, Homo sapiens
cattgactcctttccaat

SEQ ID NO: 4556222 - DNA, 13 bp, Homo sapiens
cattgacttcatt

SEQ ID NO: 4556223 - DNA, 14 bp, Homo sapiens
cattgacttcattt

SEQ ID NO: 4556224 - DNA, 18 bp, Homo sapiens
cattgacttcattttata

SEQ ID NO: 4556225 - DNA, 15 bp, Homo sapiens
cattgagagtaagca

SEQ ID NO: 4556226 - DNA, 18 bp, Homo sapiens
cattgagatcttcctgct

SEQ ID NO: 4556227 - DNA, 15 bp, Homo sapiens
cattgagcatatttt

SEQ ID NO: 4556228 - DNA, 21 bp, Homo sapiens
cattgagtagacacatttaag

SEQ ID NO: 4556229 - DNA, 23 bp, Homo sapiens
cattgatctgttttacaggaaac

SEQ ID NO: 4556230 - DNA, 21 bp, Homo sapiens
cattgcactcatcatattttg

SEQ ID NO: 4556231 - DNA, 13 bp, Homo sapiens
cattgcagcttca

SEQ ID NO: 4556232 - DNA, 15 bp, Homo sapiens
cattgccaagggctt

SEQ ID NO: 4556233 - DNA, 17 bp, Homo sapiens
cattgccagtgtctttc

SEQ ID NO: 4556234 - DNA, 21 bp, Homo sapiens
cattgcccagtgagccctgct

SEQ ID NO: 4556235 - DNA, 17 bp, Homo sapiens
cattgcccctctgcctt

SEQ ID NO: 4556236 - DNA, 17 bp, Homo sapiens
cattgccgctgtataaa

SEQ ID NO: 4556237 - DNA, 14 bp, Homo sapiens
cattgcctttgaat

SEQ ID NO: 4556238 - DNA, 17 bp, Homo sapiens
cattgcctttgaatgtt

SEQ ID NO: 4556239 - DNA, 13 bp, Homo sapiens
cattgctacctca

SEQ ID NO: 4556240 - DNA, 16 bp, Homo sapiens
cattgctacctcagtg

SEQ ID NO: 4556241 - DNA, 17 bp, Homo sapiens
cattgctggtagagacc

SEQ ID NO: 4556242 - DNA, 20 bp, Homo sapiens
cattgctggtagagaccccc

SEQ ID NO: 4556243 - DNA, 14 bp, Homo sapiens
cattgctgtgaaca

SEQ ID NO: 4556244 - DNA, 10 bp, Homo sapiens
cattggagct

SEQ ID NO: 4556245 - DNA, 12 bp, Homo sapiens
cattggagctga

SEQ ID NO: 4556246 - DNA, 16 bp, Homo sapiens
cattgggaccctccag

SEQ ID NO: 4556247 - DNA, 17 bp, Homo sapiens
cattgggaccctccagt

SEQ ID NO: 4556248 - DNA, 16 bp, Homo sapiens
cattgggcacagtcca

SEQ ID NO: 4556249 - DNA, 22 bp, Homo sapiens
cattgggcacagtccagaccca

SEQ ID NO: 4556250 - DNA, 18 bp, Homo sapiens
cattggggctcccagcca

SEQ ID NO: 4556251 - DNA, 19 bp, Homo sapiens
cattggggctcccagccag

SEQ ID NO: 4556252 - DNA, 19 bp, Homo sapiens
cattggggggccgggcagg

SEQ ID NO: 4556253 - DNA, 22 bp, Homo sapiens
cattggggttcctctgtacagc

SEQ ID NO: 4556254 - DNA, 20 bp, Homo sapiens
cattgggtggggctcctggg

SEQ ID NO: 4556255 - DNA, 20 bp, Homo sapiens
cattggtggcatcacagacc

SEQ ID NO: 4556256 - DNA, 15 bp, Homo sapiens
cattggttttgaaat

SEQ ID NO: 4556257 - DNA, 18 bp, Homo sapiens
cattgtacaagtattaca

SEQ ID NO: 4556258 - DNA, 17 bp, Homo sapiens
cattgtactccagcctg

SEQ ID NO: 4556259 - DNA, 18 bp, Homo sapiens
cattgtactccagcctgg

SEQ ID NO: 4556260 - DNA, 18 bp, Homo sapiens
cattgtagattttgttat

SEQ ID NO: 4556261 - DNA, 20 bp, Homo sapiens
cattgtatagatataatgaa

SEQ ID NO: 4556262 - DNA, 13 bp, Homo sapiens
cattgtcagcctt

SEQ ID NO: 4556263 - DNA, 19 bp, Homo sapiens
cattgtccaatcctatgtt

SEQ ID NO: 4556264 - DNA, 19 bp, Homo sapiens
cattgtccccaatgaatat

SEQ ID NO: 4556265 - DNA, 19 bp, Homo sapiens
cattgtccctgaagagaag

SEQ ID NO: 4556266 - DNA, 15 bp, Homo sapiens
cattgtctgtctgca

SEQ ID NO: 4556267 - DNA, 17 bp, Homo sapiens
cattgtgaaccaatgca

SEQ ID NO: 4556268 - DNA, 12 bp, Homo sapiens
cattgtgattta

SEQ ID NO: 4556269 - DNA, 15 bp, Homo sapiens
cattgtgtgtggaat

SEQ ID NO: 4556270 - DNA, 11 bp, Homo sapiens
cattgttacaa

SEQ ID NO: 4556271 - DNA, 23 bp, Homo sapiens
cattgttcacttctaaaccaaaa

SEQ ID NO: 4556272 - DNA, 13 bp, Homo sapiens
cattgttgtaaag

SEQ ID NO: 4556273 - DNA, 15 bp, Homo sapiens
cattgttgtaaagta

SEQ ID NO: 4556274 - DNA, 16 bp, Homo sapiens
cattgttgtgtctgtg

SEQ ID NO: 4556275 - DNA, 19 bp, Homo sapiens
cattgttttgaatattact

SEQ ID NO: 4556276 - DNA, 12 bp, Homo sapiens
catttaaaacag

SEQ ID NO: 4556277 - DNA, 13 bp, Homo sapiens
catttaaaacaga

SEQ ID NO: 4556278 - DNA, 19 bp, Homo sapiens
catttaaactttttaaaat

SEQ ID NO: 4556279 - DNA, 17 bp, Homo sapiens
catttaaatacagtctt

SEQ ID NO: 4556280 - DNA, 18 bp, Homo sapiens
catttaaatacagtcttc

SEQ ID NO: 4556281 - DNA, 16 bp, Homo sapiens
catttaaatatctgaa

SEQ ID NO: 4556282 - DNA, 16 bp, Homo sapiens
catttaaatatctgtt

SEQ ID NO: 4556283 - DNA, 15 bp, Homo sapiens
catttaaattccaca

SEQ ID NO: 4556284 - DNA, 15 bp, Homo sapiens
catttaagggaaaaa

SEQ ID NO: 4556285 - DNA, 22 bp, Homo sapiens
catttaagggaaaaatatatat

SEQ ID NO: 4556286 - DNA, 23 bp, Homo sapiens
catttaagtatcttgtgcttctt

SEQ ID NO: 4556287 - DNA, 15 bp, Homo sapiens
catttaataaaactg

SEQ ID NO: 4556288 - DNA, 19 bp, Homo sapiens
catttaataatatcaaaga

SEQ ID NO: 4556289 - DNA, 13 bp, Homo sapiens
catttaatagact

SEQ ID NO: 4556290 - DNA, 14 bp, Homo sapiens
catttaatttcatg

SEQ ID NO: 4556291 - DNA, 19 bp, Homo sapiens
catttaatttcatgtatat

SEQ ID NO: 4556292 - DNA, 15 bp, Homo sapiens
catttagaaatgttt

SEQ ID NO: 4556293 - DNA, 18 bp, Homo sapiens
catttagaaatgtttatt

SEQ ID NO: 4556294 - DNA, 15 bp, Homo sapiens
catttagtgtgaata

SEQ ID NO: 4556295 - DNA, 17 bp, Homo sapiens
catttagtgtgaatatt

SEQ ID NO: 4556296 - DNA, 17 bp, Homo sapiens
catttagtttgattatt

SEQ ID NO: 4556297 - DNA, 23 bp, Homo sapiens
catttagtttgattattcagtgt

SEQ ID NO: 4556298 - DNA, 16 bp, Homo sapiens
catttataatactgtt

SEQ ID NO: 4556299 - DNA, 23 bp, Homo sapiens
catttatataaaacttaaaaaca

SEQ ID NO: 4556300 - DNA, 14 bp, Homo sapiens
catttatctataat

SEQ ID NO: 4556301 - DNA, 21 bp, Homo sapiens
catttatctataatttaccta

SEQ ID NO: 4556302 - DNA, 22 bp, Homo sapiens
catttatctataatttacctaa

SEQ ID NO: 4556303 - DNA, 17 bp, Homo sapiens
catttatctttgtattc

SEQ ID NO: 4556304 - DNA, 19 bp, Homo sapiens
catttatctttgtattctt

SEQ ID NO: 4556305 - DNA, 21 bp, Homo sapiens
catttatctttgtattcttca

SEQ ID NO: 4556306 - DNA, 12 bp, Homo sapiens
catttatctttt

SEQ ID NO: 4556307 - DNA, 18 bp, Homo sapiens
catttatttacactcttg

SEQ ID NO: 4556308 - DNA, 14 bp, Homo sapiens
catttattttgaca

SEQ ID NO: 4556309 - DNA, 14 bp, Homo sapiens
catttcaaggcagt

SEQ ID NO: 4556310 - DNA, 17 bp, Homo sapiens
catttcaatcgtaaaat

SEQ ID NO: 4556311 - DNA, 14 bp, Homo sapiens
catttcaatgtgta

SEQ ID NO: 4556312 - DNA, 20 bp, Homo sapiens
catttcaatgtgtataaatt

SEQ ID NO: 4556313 - DNA, 18 bp, Homo sapiens
catttcacccctcccttt

SEQ ID NO: 4556314 - DNA, 19 bp, Homo sapiens
catttcacccctccctttc

SEQ ID NO: 4556315 - DNA, 20 bp, Homo sapiens
catttcacccctccctttct

SEQ ID NO: 4556316 - DNA, 14 bp, Homo sapiens
catttcagccaaag

SEQ ID NO: 4556317 - DNA, 23 bp, Homo sapiens
catttcaggccagtgtggtgtct

SEQ ID NO: 4556318 - DNA, 22 bp, Homo sapiens
catttcataatttgtttccagc

SEQ ID NO: 4556319 - DNA, 16 bp, Homo sapiens
catttcatacaacaga

SEQ ID NO: 4556320 - DNA, 14 bp, Homo sapiens
catttcatctcatt

SEQ ID NO: 4556321 - DNA, 16 bp, Homo sapiens
catttcatctcattta

SEQ ID NO: 4556322 - DNA, 14 bp, Homo sapiens
catttcatgaaaaa

SEQ ID NO: 4556323 - DNA, 21 bp, Homo sapiens
catttcatgaaaaagctgctt

SEQ ID NO: 4556324 - DNA, 22 bp, Homo sapiens
catttcatgctctgcaaaagga

SEQ ID NO: 4556325 - DNA, 18 bp, Homo sapiens
catttcatgtccataaaa

SEQ ID NO: 4556326 - DNA, 15 bp, Homo sapiens
catttcattatgctt

SEQ ID NO: 4556327 - DNA, 15 bp, Homo sapiens
catttcattccattg

SEQ ID NO: 4556328 - DNA, 19 bp, Homo sapiens
catttcattccattgccta

SEQ ID NO: 4556329 - DNA, 14 bp, Homo sapiens
catttcattgtaca

SEQ ID NO: 4556330 - DNA, 19 bp, Homo sapiens
catttccacaccaagcagc

SEQ ID NO: 4556331 - DNA, 12 bp, Homo sapiens
catttccagcct

SEQ ID NO: 4556332 - DNA, 18 bp, Homo sapiens
catttccctatcttctcc

SEQ ID NO: 4556333 - DNA, 15 bp, Homo sapiens
catttccttgtcccg

SEQ ID NO: 4556334 - DNA, 12 bp, Homo sapiens
catttctattaa

SEQ ID NO: 4556335 - DNA, 21 bp, Homo sapiens
catttctctaactcctgccat

SEQ ID NO: 4556336 - DNA, 15 bp, Homo sapiens
catttctctaagaga

SEQ ID NO: 4556337 - DNA, 11 bp, Homo sapiens
catttctctgc

SEQ ID NO: 4556338 - DNA, 17 bp, Homo sapiens
catttctgaactgttac

SEQ ID NO: 4556339 - DNA, 18 bp, Homo sapiens
catttcttaaaacacatg

SEQ ID NO: 4556340 - DNA, 13 bp, Homo sapiens
catttcttttaaa

SEQ ID NO: 4556341 - DNA, 16 bp, Homo sapiens
catttcttttaaaata

SEQ ID NO: 4556342 - DNA, 15 bp, Homo sapiens
catttcttttctctt

SEQ ID NO: 4556343 - DNA, 22 bp, Homo sapiens
catttgaacctggatccagcac

SEQ ID NO: 4556344 - DNA, 23 bp, Homo sapiens
catttgaacctggatccagcact

SEQ ID NO: 4556345 - DNA, 13 bp, Homo sapiens
catttgaatgctt

SEQ ID NO: 4556346 - DNA, 21 bp, Homo sapiens
catttgacaaaactaaccttg

SEQ ID NO: 4556347 - DNA, 17 bp, Homo sapiens
catttgatgatagcaga

SEQ ID NO: 4556348 - DNA, 12 bp, Homo sapiens
catttgcaatta

SEQ ID NO: 4556349 - DNA, 15 bp, Homo sapiens
catttgcctgcttct

SEQ ID NO: 4556350 - DNA, 22 bp, Homo sapiens
catttgcctgcttctttccaga

SEQ ID NO: 4556351 - DNA, 15 bp, Homo sapiens
catttgctaaggcag

SEQ ID NO: 4556352 - DNA, 18 bp, Homo sapiens
catttgctaaggcagctg

SEQ ID NO: 4556353 - DNA, 15 bp, Homo sapiens
catttggaggcaatc

SEQ ID NO: 4556354 - DNA, 23 bp, Homo sapiens
catttggagtgttccccttccac

SEQ ID NO: 4556355 - DNA, 20 bp, Homo sapiens
catttggcaatgccatcatc

SEQ ID NO: 4556356 - DNA, 15 bp, Homo sapiens
catttggcttgctgt

SEQ ID NO: 4556357 - DNA, 21 bp, Homo sapiens
catttggttcattaattctat

SEQ ID NO: 4556358 - DNA, 14 bp, Homo sapiens
catttgtaaaaatg

SEQ ID NO: 4556359 - DNA, 14 bp, Homo sapiens
catttgtacatctt

SEQ ID NO: 4556360 - DNA, 19 bp, Homo sapiens
catttgtatgtcaaagctt

SEQ ID NO: 4556361 - DNA, 21 bp, Homo sapiens
catttgtattattttttaata

SEQ ID NO: 4556362 - DNA, 12 bp, Homo sapiens
catttgtcccaa

SEQ ID NO: 4556363 - DNA, 13 bp, Homo sapiens
catttgtcccaag

SEQ ID NO: 4556364 - DNA, 16 bp, Homo sapiens
catttgtcccaagtgc

SEQ ID NO: 4556365 - DNA, 21 bp, Homo sapiens
catttgtgctagaaattttca

SEQ ID NO: 4556366 - DNA, 21 bp, Homo sapiens
catttgtggtaatctacacca

SEQ ID NO: 4556367 - DNA, 19 bp, Homo sapiens
catttgtgtacacagtcag

SEQ ID NO: 4556368 - DNA, 22 bp, Homo sapiens
catttgtttattttttggaaga

SEQ ID NO: 4556369 - DNA, 13 bp, Homo sapiens
cattttaaaaagt

SEQ ID NO: 4556370 - DNA, 16 bp, Homo sapiens
cattttaaaatgttta

SEQ ID NO: 4556371 - DNA, 20 bp, Homo sapiens
cattttaaattccactgaaa

SEQ ID NO: 4556372 - DNA, 16 bp, Homo sapiens
cattttaatatataat

SEQ ID NO: 4556373 - DNA, 16 bp, Homo sapiens
cattttacagatttct

SEQ ID NO: 4556374 - DNA, 22 bp, Homo sapiens
cattttacgttttagaaaattt

SEQ ID NO: 4556375 - DNA, 17 bp, Homo sapiens
cattttactatttgcca

SEQ ID NO: 4556376 - DNA, 18 bp, Homo sapiens
cattttactatttgccaa

SEQ ID NO: 4556377 - DNA, 14 bp, Homo sapiens
cattttactgtata

SEQ ID NO: 4556378 - DNA, 15 bp, Homo sapiens
cattttataaaacat

SEQ ID NO: 4556379 - DNA, 15 bp, Homo sapiens
cattttataaagtta

SEQ ID NO: 4556380 - DNA, 22 bp, Homo sapiens
cattttataatgatgaacttat

SEQ ID NO: 4556381 - DNA, 22 bp, Homo sapiens
cattttattaagctttttggaa

SEQ ID NO: 4556382 - DNA, 23 bp, Homo sapiens
cattttattaagctttttggaat

SEQ ID NO: 4556383 - DNA, 13 bp, Homo sapiens
cattttattaata

SEQ ID NO: 4556384 - DNA, 22 bp, Homo sapiens
cattttattaataatatttatg

SEQ ID NO: 4556385 - DNA, 17 bp, Homo sapiens
cattttattttgtaata

SEQ ID NO: 4556386 - DNA, 16 bp, Homo sapiens
cattttcagactgcaa

SEQ ID NO: 4556387 - DNA, 14 bp, Homo sapiens
cattttccccccac

SEQ ID NO: 4556388 - DNA, 22 bp, Homo sapiens
cattttccccccactctcccca

SEQ ID NO: 4556389 - DNA, 15 bp, Homo sapiens
cattttcctcctctg

SEQ ID NO: 4556390 - DNA, 16 bp, Homo sapiens
cattttcctcctctgc

SEQ ID NO: 4556391 - DNA, 13 bp, Homo sapiens
cattttctagata

SEQ ID NO: 4556392 - DNA, 18 bp, Homo sapiens
cattttctagatacaata

SEQ ID NO: 4556393 - DNA, 20 bp, Homo sapiens
cattttctagatacaataaa

SEQ ID NO: 4556394 - DNA, 22 bp, Homo sapiens
cattttctggccagtgtttaaa

SEQ ID NO: 4556395 - DNA, 12 bp, Homo sapiens
cattttgaagtg

SEQ ID NO: 4556396 - DNA, 14 bp, Homo sapiens
cattttgacctact

SEQ ID NO: 4556397 - DNA, 16 bp, Homo sapiens
cattttggatgtcatt

SEQ ID NO: 4556398 - DNA, 17 bp, Homo sapiens
cattttggtttttcctc

SEQ ID NO: 4556399 - DNA, 13 bp, Homo sapiens
cattttgtaaaat

SEQ ID NO: 4556400 - DNA, 19 bp, Homo sapiens
cattttgtatggagttaaa

SEQ ID NO: 4556401 - DNA, 23 bp, Homo sapiens
cattttgtatggagttaaataaa

SEQ ID NO: 4556402 - DNA, 12 bp, Homo sapiens
cattttgttaca

SEQ ID NO: 4556403 - DNA, 14 bp, Homo sapiens
cattttgttacata

SEQ ID NO: 4556404 - DNA, 13 bp, Homo sapiens
catttttaaactt

SEQ ID NO: 4556405 - DNA, 19 bp, Homo sapiens
catttttaaacttgaaata

SEQ ID NO: 4556406 - DNA, 14 bp, Homo sapiens
catttttacaagtt

SEQ ID NO: 4556407 - DNA, 23 bp, Homo sapiens
catttttacaccaatttggtaaa

SEQ ID NO: 4556408 - DNA, 22 bp, Homo sapiens
catttttatttcagattttgat

SEQ ID NO: 4556409 - DNA, 10 bp, Homo sapiens
catttttcaa

SEQ ID NO: 4556410 - DNA, 14 bp, Homo sapiens
catttttcaacttt

SEQ ID NO: 4556411 - DNA, 19 bp, Homo sapiens
catttttcaactttgaata

SEQ ID NO: 4556412 - DNA, 15 bp, Homo sapiens
catttttcaatatat

SEQ ID NO: 4556413 - DNA, 18 bp, Homo sapiens
catttttcagatataaaa

SEQ ID NO: 4556414 - DNA, 16 bp, Homo sapiens
catttttcatgataat

SEQ ID NO: 4556415 - DNA, 12 bp, Homo sapiens
catttttcattc

SEQ ID NO: 4556416 - DNA, 21 bp, Homo sapiens
catttttcattcacttctctt

SEQ ID NO: 4556417 - DNA, 21 bp, Homo sapiens
catttttctcccaagaaacct

SEQ ID NO: 4556418 - DNA, 13 bp, Homo sapiens
catttttgctaat

SEQ ID NO: 4556419 - DNA, 15 bp, Homo sapiens
catttttgctaatta

SEQ ID NO: 4556420 - DNA, 20 bp, Homo sapiens
catttttggatttctgtgaa

SEQ ID NO: 4556421 - DNA, 20 bp, Homo sapiens
catttttgtactaactagca

SEQ ID NO: 4556422 - DNA, 14 bp, Homo sapiens
catttttgtatttt

SEQ ID NO: 4556423 - DNA, 15 bp, Homo sapiens
catttttgttttgaa

SEQ ID NO: 4556424 - DNA, 16 bp, Homo sapiens
catttttgttttgaaa

SEQ ID NO: 4556425 - DNA, 18 bp, Homo sapiens
catttttgttttgaaagt

SEQ ID NO: 4556426 - DNA, 22 bp, Homo sapiens
cattttttaaaagccttccagt

SEQ ID NO: 4556427 - DNA, 14 bp, Homo sapiens
cattttttcttctg

SEQ ID NO: 4556428 - DNA, 17 bp, Homo sapiens
cattttttcttctgaag

SEQ ID NO: 4556429 - DNA, 16 bp, Homo sapiens
catttttttctaccta

SEQ ID NO: 4556430 - DNA, 21 bp, Homo sapiens
ccaaaaacatttgattaataa

SEQ ID NO: 4556431 - DNA, 15 bp, Homo sapiens
ccaaaaagaccagac

SEQ ID NO: 4556432 - DNA, 17 bp, Homo sapiens
ccaaaaagctctgaaaa

SEQ ID NO: 4556433 - DNA, 23 bp, Homo sapiens
ccaaaaagctctgaaaacaaggt

SEQ ID NO: 4556434 - DNA, 16 bp, Homo sapiens
ccaaaaatagaaatta

SEQ ID NO: 4556435 - DNA, 22 bp, Homo sapiens
ccaaaaatagaaattagatttg

SEQ ID NO: 4556436 - DNA, 16 bp, Homo sapiens
ccaaaaatctgcctgg

SEQ ID NO: 4556437 - DNA, 16 bp, Homo sapiens
ccaaaaattagccgag

SEQ ID NO: 4556438 - DNA, 13 bp, Homo sapiens
ccaaaacatttct

SEQ ID NO: 4556439 - DNA, 18 bp, Homo sapiens
ccaaaacatttctggaca

SEQ ID NO: 4556440 - DNA, 11 bp, Homo sapiens
ccaaaaccaaa

SEQ ID NO: 4556441 - DNA, 12 bp, Homo sapiens
ccaaaaggaaaa

SEQ ID NO: 4556442 - DNA, 18 bp, Homo sapiens
ccaaaaggaaaaagctcc

SEQ ID NO: 4556443 - DNA, 23 bp, Homo sapiens
ccaaaaggtttaagaaatagaat

SEQ ID NO: 4556444 - DNA, 21 bp, Homo sapiens
ccaaaagtcaaaaggtgcctg

SEQ ID NO: 4556445 - DNA, 23 bp, Homo sapiens
ccaaaataatctatattaaatga

SEQ ID NO: 4556446 - DNA, 20 bp, Homo sapiens
ccaaaataccagagccttca

SEQ ID NO: 4556447 - DNA, 12 bp, Homo sapiens
ccaaaatgcaac

SEQ ID NO: 4556448 - DNA, 11 bp, Homo sapiens
ccaaaatgtga

SEQ ID NO: 4556449 - DNA, 12 bp, Homo sapiens
ccaaaatgtgaa

SEQ ID NO: 4556450 - DNA, 20 bp, Homo sapiens
ccaaaatgttggtcatttta

SEQ ID NO: 4556451 - DNA, 18 bp, Homo sapiens
ccaaacagcaagaagctg

SEQ ID NO: 4556452 - DNA, 15 bp, Homo sapiens
ccaaacatgtattta

SEQ ID NO: 4556453 - DNA, 16 bp, Homo sapiens
ccaaaccaggaccctg

SEQ ID NO: 4556454 - DNA, 12 bp, Homo sapiens
ccaaaccataaa

SEQ ID NO: 4556455 - DNA, 12 bp, Homo sapiens
ccaaaccccagc

SEQ ID NO: 4556456 - DNA, 17 bp, Homo sapiens
ccaaaccccagccccaa

SEQ ID NO: 4556457 - DNA, 19 bp, Homo sapiens
ccaaaccctataaacctga

SEQ ID NO: 4556458 - DNA, 23 bp, Homo sapiens
ccaaacccttgctttcctgggcc

SEQ ID NO: 4556459 - DNA, 20 bp, Homo sapiens
ccaaacctcctgtcagtgag

SEQ ID NO: 4556460 - DNA, 21 bp, Homo sapiens
ccaaacgccctttcctcctca

SEQ ID NO: 4556461 - DNA, 20 bp, Homo sapiens
ccaaacgctgagccacctgc

SEQ ID NO: 4556462 - DNA, 19 bp, Homo sapiens
ccaaactgggtcttcagct

SEQ ID NO: 4556463 - DNA, 23 bp, Homo sapiens
ccaaagaaatgaacattccaagg

SEQ ID NO: 4556464 - DNA, 14 bp, Homo sapiens
ccaaagaattggaa

SEQ ID NO: 4556465 - DNA, 14 bp, Homo sapiens
ccaaagaggctgcc

SEQ ID NO: 4556466 - DNA, 22 bp, Homo sapiens
ccaaagagtagaattgcattga

SEQ ID NO: 4556467 - DNA, 19 bp, Homo sapiens
ccaaagatttcatatctaa

SEQ ID NO: 4556468 - DNA, 12 bp, Homo sapiens
ccaaagcatgcc

SEQ ID NO: 4556469 - DNA, 21 bp, Homo sapiens
ccaaagccattctccccctct

SEQ ID NO: 4556470 - DNA, 18 bp, Homo sapiens
ccaaagctagggtggccc

SEQ ID NO: 4556471 - DNA, 12 bp, Homo sapiens
ccaaagctttat

SEQ ID NO: 4556472 - DNA, 12 bp, Homo sapiens
ccaaaggaggct

SEQ ID NO: 4556473 - DNA, 17 bp, Homo sapiens
ccaaaggaggctggcag

SEQ ID NO: 4556474 - DNA, 12 bp, Homo sapiens
ccaaaggccccc

SEQ ID NO: 4556475 - DNA, 14 bp, Homo sapiens
ccaaaggcccccta

SEQ ID NO: 4556476 - DNA, 23 bp, Homo sapiens
ccaaagggcacacccctggggct

SEQ ID NO: 4556477 - DNA, 22 bp, Homo sapiens
ccaaaggtaagttgctattttc

SEQ ID NO: 4556478 - DNA, 21 bp, Homo sapiens
ccaaaggtccgcaccctgtcc

SEQ ID NO: 4556479 - DNA, 17 bp, Homo sapiens
ccaaagtgaactctcaa

SEQ ID NO: 4556480 - DNA, 16 bp, Homo sapiens
ccaaagtgttgggatt

SEQ ID NO: 4556481 - DNA, 21 bp, Homo sapiens
ccaaatagcctctcctttgta

SEQ ID NO: 4556482 - DNA, 22 bp, Homo sapiens
ccaaatagcctctcctttgtag

SEQ ID NO: 4556483 - DNA, 21 bp, Homo sapiens
ccaaatcctggaaggacacag

SEQ ID NO: 4556484 - DNA, 21 bp, Homo sapiens
ccaaatgcagggaggggaggc

SEQ ID NO: 4556485 - DNA, 19 bp, Homo sapiens
ccaaatggaattacagact

SEQ ID NO: 4556486 - DNA, 21 bp, Homo sapiens
ccaaattagtgaaccaaaaat

SEQ ID NO: 4556487 - DNA, 19 bp, Homo sapiens
ccaaattgagtttaacaat

SEQ ID NO: 4556488 - DNA, 13 bp, Homo sapiens
ccaaattgcttct

SEQ ID NO: 4556489 - DNA, 14 bp, Homo sapiens
ccaaattgtgcttc

SEQ ID NO: 4556490 - DNA, 16 bp, Homo sapiens
ccaaattgtgcttctc

SEQ ID NO: 4556491 - DNA, 21 bp, Homo sapiens
ccaaattgtgcttctccccag

SEQ ID NO: 4556492 - DNA, 11 bp, Homo sapiens
ccaaatttaat

SEQ ID NO: 4556493 - DNA, 22 bp, Homo sapiens
ccaaatttcctgtttgaaatat

SEQ ID NO: 4556494 - DNA, 14 bp, Homo sapiens
ccaacactgccagc

SEQ ID NO: 4556495 - DNA, 20 bp, Homo sapiens
ccaacacttaatcattttat

SEQ ID NO: 4556496 - DNA, 16 bp, Homo sapiens
ccaacagaacccacag

SEQ ID NO: 4556497 - DNA, 18 bp, Homo sapiens
ccaacagaacccacagta

SEQ ID NO: 4556498 - DNA, 19 bp, Homo sapiens
ccaacagaacccacagtag

SEQ ID NO: 4556499 - DNA, 17 bp, Homo sapiens
ccaacagcacctccccg

SEQ ID NO: 4556500 - DNA, 20 bp, Homo sapiens
ccaacagcttttcccaggag

SEQ ID NO: 4556501 - DNA, 16 bp, Homo sapiens
ccaacagtttattttt

SEQ ID NO: 4556502 - DNA, 20 bp, Homo sapiens
ccaacatcccattgccctgg

SEQ ID NO: 4556503 - DNA, 17 bp, Homo sapiens
ccaacatgcactgatgt

SEQ ID NO: 4556504 - DNA, 23 bp, Homo sapiens
ccaacatgcactgatgttgtgtt

SEQ ID NO: 4556505 - DNA, 23 bp, Homo sapiens
ccaacatggagaaaccctgtctc

SEQ ID NO: 4556506 - DNA, 15 bp, Homo sapiens
ccaacatgggaggga

SEQ ID NO: 4556507 - DNA, 17 bp, Homo sapiens
ccaacatgtggctcctc

SEQ ID NO: 4556508 - DNA, 19 bp, Homo sapiens
ccaaccacagcatcgggag

SEQ ID NO: 4556509 - DNA, 14 bp, Homo sapiens
ccaacccatcagaa

SEQ ID NO: 4556510 - DNA, 14 bp, Homo sapiens
ccaaccccccagca

SEQ ID NO: 4556511 - DNA, 14 bp, Homo sapiens
ccaacccctcctcc

SEQ ID NO: 4556512 - DNA, 15 bp, Homo sapiens
ccaacccctcctccc

SEQ ID NO: 4556513 - DNA, 16 bp, Homo sapiens
ccaacccctcctccct

SEQ ID NO: 4556514 - DNA, 18 bp, Homo sapiens
ccaacccctcctccctca

SEQ ID NO: 4556515 - DNA, 19 bp, Homo sapiens
ccaacccctcctccctcag

SEQ ID NO: 4556516 - DNA, 15 bp, Homo sapiens
ccaacccctccttcc

SEQ ID NO: 4556517 - DNA, 16 bp, Homo sapiens
ccaacccctccttccc

SEQ ID NO: 4556518 - DNA, 20 bp, Homo sapiens
ccaacccctccttccccaga

SEQ ID NO: 4556519 - DNA, 22 bp, Homo sapiens
ccaacccgtctggcccaccagg

SEQ ID NO: 4556520 - DNA, 12 bp, Homo sapiens
ccaaccctgtct

SEQ ID NO: 4556521 - DNA, 13 bp, Homo sapiens
ccaaccctgtctg

SEQ ID NO: 4556522 - DNA, 14 bp, Homo sapiens
ccaacctaaatttc

SEQ ID NO: 4556523 - DNA, 18 bp, Homo sapiens
ccaacctaacccctttcc

SEQ ID NO: 4556524 - DNA, 14 bp, Homo sapiens
ccaacctcagggct

SEQ ID NO: 4556525 - DNA, 20 bp, Homo sapiens
ccaacctcagggctcccagg

SEQ ID NO: 4556526 - DNA, 22 bp, Homo sapiens
ccaacctgaccaacatggagaa

SEQ ID NO: 4556527 - DNA, 18 bp, Homo sapiens
ccaacctgctctgtcccc

SEQ ID NO: 4556528 - DNA, 14 bp, Homo sapiens
ccaacctggacaac

SEQ ID NO: 4556529 - DNA, 14 bp, Homo sapiens
ccaacctggggggc

SEQ ID NO: 4556530 - DNA, 21 bp, Homo sapiens
ccaacgagacacattgccttc

SEQ ID NO: 4556531 - DNA, 15 bp, Homo sapiens
ccaacggcaacagca

SEQ ID NO: 4556532 - DNA, 15 bp, Homo sapiens
ccaactagcccctgg

SEQ ID NO: 4556533 - DNA, 13 bp, Homo sapiens
ccaactccacagg

SEQ ID NO: 4556534 - DNA, 17 bp, Homo sapiens
ccaactccacagggctg

SEQ ID NO: 4556535 - DNA, 14 bp, Homo sapiens
ccaactccaggggc

SEQ ID NO: 4556536 - DNA, 16 bp, Homo sapiens
ccaactccaggggcac

SEQ ID NO: 4556537 - DNA, 18 bp, Homo sapiens
ccaactccaggggcacct

SEQ ID NO: 4556538 - DNA, 22 bp, Homo sapiens
ccaactccatggggttcgagac

SEQ ID NO: 4556539 - DNA, 19 bp, Homo sapiens
ccaactccgcccagcctct

SEQ ID NO: 4556540 - DNA, 21 bp, Homo sapiens
ccaactccgcccagcctctcc

SEQ ID NO: 4556541 - DNA, 15 bp, Homo sapiens
ccaactcctggaagc

SEQ ID NO: 4556542 - DNA, 19 bp, Homo sapiens
ccaactcctggaagctgtg

SEQ ID NO: 4556543 - DNA, 11 bp, Homo sapiens
ccaactctaat

SEQ ID NO: 4556544 - DNA, 13 bp, Homo sapiens
ccaactctaatat

SEQ ID NO: 4556545 - DNA, 13 bp, Homo sapiens
ccaactctcccaa

SEQ ID NO: 4556546 - DNA, 13 bp, Homo sapiens
ccaactctcccca

SEQ ID NO: 4556547 - DNA, 13 bp, Homo sapiens
ccaactctcctgg

SEQ ID NO: 4556548 - DNA, 23 bp, Homo sapiens
ccaactgaaggctaaaaagcaac

SEQ ID NO: 4556549 - DNA, 18 bp, Homo sapiens
ccaactgaattaaactta

SEQ ID NO: 4556550 - DNA, 18 bp, Homo sapiens
ccaactgacctgccagcc

SEQ ID NO: 4556551 - DNA, 19 bp, Homo sapiens
ccaactgccaggctgcctc

SEQ ID NO: 4556552 - DNA, 21 bp, Homo sapiens
ccaactgctccagcctctgcc

SEQ ID NO: 4556553 - DNA, 19 bp, Homo sapiens
ccaactgtggtagctccag

SEQ ID NO: 4556554 - DNA, 12 bp, Homo sapiens
ccaacttcctgt

SEQ ID NO: 4556555 - DNA, 15 bp, Homo sapiens
ccaacttcctgtggc

SEQ ID NO: 4556556 - DNA, 16 bp, Homo sapiens
ccaacttcctgtggcc

SEQ ID NO: 4556557 - DNA, 20 bp, Homo sapiens
ccaacttctcttgctttcta

SEQ ID NO: 4556558 - DNA, 13 bp, Homo sapiens
ccaagaaaatatc

SEQ ID NO: 4556559 - DNA, 15 bp, Homo sapiens
ccaagaaacctgact

SEQ ID NO: 4556560 - DNA, 22 bp, Homo sapiens
ccaagaaagatgtatataggtg

SEQ ID NO: 4556561 - DNA, 19 bp, Homo sapiens
ccaagaacctatatcttac

SEQ ID NO: 4556562 - DNA, 12 bp, Homo sapiens
ccaagaagggct

SEQ ID NO: 4556563 - DNA, 22 bp, Homo sapiens
ccaagaagggctagaacctgga

SEQ ID NO: 4556564 - DNA, 15 bp, Homo sapiens
ccaagaatacttgaa

SEQ ID NO: 4556565 - DNA, 18 bp, Homo sapiens
ccaagacagatgccccag

SEQ ID NO: 4556566 - DNA, 22 bp, Homo sapiens
ccaagacagatgccccagagct

SEQ ID NO: 4556567 - DNA, 13 bp, Homo sapiens
ccaagacagcagc

SEQ ID NO: 4556568 - DNA, 23 bp, Homo sapiens
ccaagacagcagcagcctgcacc

SEQ ID NO: 4556569 - DNA, 23 bp, Homo sapiens
ccaagactccctcgtcgagctgg

SEQ ID NO: 4556570 - DNA, 15 bp, Homo sapiens
ccaagactcctcagg

SEQ ID NO: 4556571 - DNA, 16 bp, Homo sapiens
ccaagactcctcaggc

SEQ ID NO: 4556572 - DNA, 22 bp, Homo sapiens
ccaagagaataggggagccaag

SEQ ID NO: 4556573 - DNA, 21 bp, Homo sapiens
ccaagagctactcccacagca

SEQ ID NO: 4556574 - DNA, 19 bp, Homo sapiens
ccaagaggaagttcagatc

SEQ ID NO: 4556575 - DNA, 17 bp, Homo sapiens
ccaagaggggcgggctc

SEQ ID NO: 4556576 - DNA, 21 bp, Homo sapiens
ccaagaggggcgggctcagag

SEQ ID NO: 4556577 - DNA, 14 bp, Homo sapiens
ccaagaggtctgag

SEQ ID NO: 4556578 - DNA, 16 bp, Homo sapiens
ccaagaggtctgagcc

SEQ ID NO: 4556579 - DNA, 16 bp, Homo sapiens
ccaagagtgcactact

SEQ ID NO: 4556580 - DNA, 18 bp, Homo sapiens
ccaagatacttaagtgct

SEQ ID NO: 4556581 - DNA, 16 bp, Homo sapiens
ccaagatgagctgcag

SEQ ID NO: 4556582 - DNA, 14 bp, Homo sapiens
ccaagattatgtga

SEQ ID NO: 4556583 - DNA, 15 bp, Homo sapiens
ccaagatttaaaatt

SEQ ID NO: 4556584 - DNA, 16 bp, Homo sapiens
ccaagattttcctctt

SEQ ID NO: 4556585 - DNA, 19 bp, Homo sapiens
ccaagattttcctcttgtg

SEQ ID NO: 4556586 - DNA, 14 bp, Homo sapiens
ccaagcacagagcc

SEQ ID NO: 4556587 - DNA, 18 bp, Homo sapiens
ccaagcacagagcctggc

SEQ ID NO: 4556588 - DNA, 18 bp, Homo sapiens
ccaagcaggaaatgaaaa

SEQ ID NO: 4556589 - DNA, 19 bp, Homo sapiens
ccaagcaggacagtgcttg

SEQ ID NO: 4556590 - DNA, 17 bp, Homo sapiens
ccaagccgaccttccct

SEQ ID NO: 4556591 - DNA, 18 bp, Homo sapiens
ccaagcctgctggctgcg

SEQ ID NO: 4556592 - DNA, 15 bp, Homo sapiens
ccaagcgttcctggc

SEQ ID NO: 4556593 - DNA, 19 bp, Homo sapiens
ccaagcgttcctggccttc

SEQ ID NO: 4556594 - DNA, 13 bp, Homo sapiens
ccaagctcacagt

SEQ ID NO: 4556595 - DNA, 18 bp, Homo sapiens
ccaagctcacagttcctc

SEQ ID NO: 4556596 - DNA, 22 bp, Homo sapiens
ccaagctcacagttcctcgccc

SEQ ID NO: 4556597 - DNA, 11 bp, Homo sapiens
ccaagctgggc

SEQ ID NO: 4556598 - DNA, 12 bp, Homo sapiens
ccaagctgggcc

SEQ ID NO: 4556599 - DNA, 13 bp, Homo sapiens
ccaagctgggccc

SEQ ID NO: 4556600 - DNA, 15 bp, Homo sapiens
ccaagctttaaatta

SEQ ID NO: 4556601 - DNA, 18 bp, Homo sapiens
ccaagctttaaattatgt

SEQ ID NO: 4556602 - DNA, 23 bp, Homo sapiens
ccaaggactgagggactctgaag

SEQ ID NO: 4556603 - DNA, 15 bp, Homo sapiens
ccaaggagaacaaat

SEQ ID NO: 4556604 - DNA, 21 bp, Homo sapiens
ccaaggaggaaaaacagacaa

SEQ ID NO: 4556605 - DNA, 21 bp, Homo sapiens
ccaaggaggtgggccacaccc

SEQ ID NO: 4556606 - DNA, 20 bp, Homo sapiens
ccaaggatcggactctgccc

SEQ ID NO: 4556607 - DNA, 19 bp, Homo sapiens
ccaaggccagagtggcctg

SEQ ID NO: 4556608 - DNA, 11 bp, Homo sapiens
ccaaggccagt

SEQ ID NO: 4556609 - DNA, 20 bp, Homo sapiens
ccaaggcctaccccagttcc

SEQ ID NO: 4556610 - DNA, 22 bp, Homo sapiens
ccaaggcctaccccagttccta

SEQ ID NO: 4556611 - DNA, 15 bp, Homo sapiens
ccaaggcggcccctc

SEQ ID NO: 4556612 - DNA, 18 bp, Homo sapiens
ccaaggctctcccctctc

SEQ ID NO: 4556613 - DNA, 17 bp, Homo sapiens
ccaagggaaaggggtgc

SEQ ID NO: 4556614 - DNA, 21 bp, Homo sapiens
ccaagggaaaggggtgctttt

SEQ ID NO: 4556615 - DNA, 22 bp, Homo sapiens
ccaagggaaaggggtgctttta

SEQ ID NO: 4556616 - DNA, 13 bp, Homo sapiens
ccaagggaccagg

SEQ ID NO: 4556617 - DNA, 20 bp, Homo sapiens
ccaaggggtggccgggcaca

SEQ ID NO: 4556618 - DNA, 17 bp, Homo sapiens
ccaagggtacagatccc

SEQ ID NO: 4556619 - DNA, 22 bp, Homo sapiens
ccaagggtacagatccccagcc

SEQ ID NO: 4556620 - DNA, 23 bp, Homo sapiens
ccaagggtacagatccccagccc

SEQ ID NO: 4556621 - DNA, 15 bp, Homo sapiens
ccaagggttgagagc

SEQ ID NO: 4556622 - DNA, 14 bp, Homo sapiens
ccaaggtcctctca

SEQ ID NO: 4556623 - DNA, 15 bp, Homo sapiens
ccaaggtctgagcca

SEQ ID NO: 4556624 - DNA, 21 bp, Homo sapiens
ccaaggtctgagccacagcag

SEQ ID NO: 4556625 - DNA, 14 bp, Homo sapiens
ccaaggtgctgatg

SEQ ID NO: 4556626 - DNA, 22 bp, Homo sapiens
ccaaggtggcagatgtcttccc

SEQ ID NO: 4556627 - DNA, 14 bp, Homo sapiens
ccaaggttgcacag

SEQ ID NO: 4556628 - DNA, 18 bp, Homo sapiens
ccaaggttgcacagcaag

SEQ ID NO: 4556629 - DNA, 20 bp, Homo sapiens
ccaaggttgcacagcaagaa

SEQ ID NO: 4556630 - DNA, 20 bp, Homo sapiens
ccaagtaaccaggccccagc

SEQ ID NO: 4556631 - DNA, 19 bp, Homo sapiens
ccaagtaagagtggtggcc

SEQ ID NO: 4556632 - DNA, 15 bp, Homo sapiens
ccaagtagtccacct

SEQ ID NO: 4556633 - DNA, 14 bp, Homo sapiens
ccaagtctggcacc

SEQ ID NO: 4556634 - DNA, 17 bp, Homo sapiens
ccaagtctggcaccatg

SEQ ID NO: 4556635 - DNA, 15 bp, Homo sapiens
ccaagtggggtgctg

SEQ ID NO: 4556636 - DNA, 12 bp, Homo sapiens
ccaagtgtgcta

SEQ ID NO: 4556637 - DNA, 20 bp, Homo sapiens
ccaagttgtgcttgagccag

SEQ ID NO: 4556638 - DNA, 22 bp, Homo sapiens
ccaagttgtgcttgagccagga

SEQ ID NO: 4556639 - DNA, 13 bp, Homo sapiens
ccaataaaaacat

SEQ ID NO: 4556640 - DNA, 9 bp, Homo sapiens
ccaataaac

SEQ ID NO: 4556641 - DNA, 11 bp, Homo sapiens
ccaataaacca

SEQ ID NO: 4556642 - DNA, 15 bp, Homo sapiens
ccaataaaccagtgt

SEQ ID NO: 4556643 - DNA, 12 bp, Homo sapiens
ccaataaagcct

SEQ ID NO: 4556644 - DNA, 15 bp, Homo sapiens
ccaataaagcctttt

SEQ ID NO: 4556645 - DNA, 15 bp, Homo sapiens
ccaataaaggcagct

SEQ ID NO: 4556646 - DNA, 16 bp, Homo sapiens
ccaataaaggcagctg

SEQ ID NO: 4556647 - DNA, 18 bp, Homo sapiens
ccaataaaggcagctgcc

SEQ ID NO: 4556648 - DNA, 21 bp, Homo sapiens
ccaataaaggcagctgcctct

SEQ ID NO: 4556649 - DNA, 15 bp, Homo sapiens
ccaataaagtgcctt

SEQ ID NO: 4556650 - DNA, 18 bp, Homo sapiens
ccaataaagtgccttctg

SEQ ID NO: 4556651 - DNA, 23 bp, Homo sapiens
ccaataaagtgccttctgggctt

SEQ ID NO: 4556652 - DNA, 13 bp, Homo sapiens
ccaataggagtct

SEQ ID NO: 4556653 - DNA, 18 bp, Homo sapiens
ccaataggcaaattaatc

SEQ ID NO: 4556654 - DNA, 19 bp, Homo sapiens
ccaataggcaaattaatca

SEQ ID NO: 4556655 - DNA, 18 bp, Homo sapiens
ccaatagggctgagctct

SEQ ID NO: 4556656 - DNA, 22 bp, Homo sapiens
ccaatatgaaaaccgtaaagtg

SEQ ID NO: 4556657 - DNA, 15 bp, Homo sapiens
ccaatattaaatctg

SEQ ID NO: 4556658 - DNA, 20 bp, Homo sapiens
ccaatattcatagcagctta

SEQ ID NO: 4556659 - DNA, 18 bp, Homo sapiens
ccaatattgtacagtttt

SEQ ID NO: 4556660 - DNA, 19 bp, Homo sapiens
ccaatatttctgctttctt

SEQ ID NO: 4556661 - DNA, 18 bp, Homo sapiens
ccaatcagcactctgtaa

SEQ ID NO: 4556662 - DNA, 18 bp, Homo sapiens
ccaatcagcgctctgtag

SEQ ID NO: 4556663 - DNA, 20 bp, Homo sapiens
ccaatcagcttttgttctag

SEQ ID NO: 4556664 - DNA, 23 bp, Homo sapiens
ccaatcagcttttgttctagact

SEQ ID NO: 4556665 - DNA, 15 bp, Homo sapiens
ccaatcgggtccaga

SEQ ID NO: 4556666 - DNA, 21 bp, Homo sapiens
ccaatcttgcccactggccgc

SEQ ID NO: 4556667 - DNA, 15 bp, Homo sapiens
ccaatcttgtttata

SEQ ID NO: 4556668 - DNA, 20 bp, Homo sapiens
ccaatcttgtttatagcaaa

SEQ ID NO: 4556669 - DNA, 12 bp, Homo sapiens
ccaatgaataat

SEQ ID NO: 4556670 - DNA, 21 bp, Homo sapiens
ccaatgatacccaacagttta

SEQ ID NO: 4556671 - DNA, 13 bp, Homo sapiens
ccaatgccacaga

SEQ ID NO: 4556672 - DNA, 17 bp, Homo sapiens
ccaatgttatgccagct

SEQ ID NO: 4556673 - DNA, 21 bp, Homo sapiens
ccaatgttatgccagctccat

SEQ ID NO: 4556674 - DNA, 20 bp, Homo sapiens
ccaattacagggtgactcac

SEQ ID NO: 4556675 - DNA, 22 bp, Homo sapiens
ccaattacagggtgactcacag

SEQ ID NO: 4556676 - DNA, 17 bp, Homo sapiens
ccaattacttgaagtat

SEQ ID NO: 4556677 - DNA, 16 bp, Homo sapiens
ccaattatcatctttt

SEQ ID NO: 4556678 - DNA, 22 bp, Homo sapiens
ccaattattgatatatattata

SEQ ID NO: 4556679 - DNA, 18 bp, Homo sapiens
ccaattctggacagacag

SEQ ID NO: 4556680 - DNA, 16 bp, Homo sapiens
ccaattttaatttagt

SEQ ID NO: 4556681 - DNA, 21 bp, Homo sapiens
ccaattttaatttagtaaatg

SEQ ID NO: 4556682 - DNA, 15 bp, Homo sapiens
ccaattttggatgag

SEQ ID NO: 4556683 - DNA, 21 bp, Homo sapiens
ccacaaacacattataaagtt

SEQ ID NO: 4556684 - DNA, 18 bp, Homo sapiens
ccacaactaacaatgcct

SEQ ID NO: 4556685 - DNA, 16 bp, Homo sapiens
ccacaagaaatgaaag

SEQ ID NO: 4556686 - DNA, 20 bp, Homo sapiens
ccacaagattcccagagaca

SEQ ID NO: 4556687 - DNA, 21 bp, Homo sapiens
ccacaagattcccagagacag

SEQ ID NO: 4556688 - DNA, 13 bp, Homo sapiens
ccacaagcatctc

SEQ ID NO: 4556689 - DNA, 15 bp, Homo sapiens
ccacaagcctgagaa

SEQ ID NO: 4556690 - DNA, 20 bp, Homo sapiens
ccacaagccttactcacctc

SEQ ID NO: 4556691 - DNA, 21 bp, Homo sapiens
ccacaagctgcactgtgaacc

SEQ ID NO: 4556692 - DNA, 21 bp, Homo sapiens
ccacaagtgccgcaaattgta

SEQ ID NO: 4556693 - DNA, 19 bp, Homo sapiens
ccacaattattggcaaagt

SEQ ID NO: 4556694 - DNA, 14 bp, Homo sapiens
ccacacacagcctg

SEQ ID NO: 4556695 - DNA, 13 bp, Homo sapiens
ccacacaggcagg

SEQ ID NO: 4556696 - DNA, 17 bp, Homo sapiens
ccacacaggcagggcct

SEQ ID NO: 4556697 - DNA, 21 bp, Homo sapiens
ccacacaggcagggcctggct

SEQ ID NO: 4556698 - DNA, 12 bp, Homo sapiens
ccacacaggtgt

SEQ ID NO: 4556699 - DNA, 12 bp, Homo sapiens
ccacacatttta

SEQ ID NO: 4556700 - DNA, 13 bp, Homo sapiens
ccacaccactgcc

SEQ ID NO: 4556701 - DNA, 22 bp, Homo sapiens
ccacaccataagctactgccat

SEQ ID NO: 4556702 - DNA, 16 bp, Homo sapiens
ccacacccagctcagc

SEQ ID NO: 4556703 - DNA, 13 bp, Homo sapiens
ccacacccaggaa

SEQ ID NO: 4556704 - DNA, 14 bp, Homo sapiens
ccacacccagggga

SEQ ID NO: 4556705 - DNA, 22 bp, Homo sapiens
ccacacccaggggaaggccctg

SEQ ID NO: 4556706 - DNA, 16 bp, Homo sapiens
ccacaccctcactgct

SEQ ID NO: 4556707 - DNA, 18 bp, Homo sapiens
ccacaccgcgtcccagct

SEQ ID NO: 4556708 - DNA, 22 bp, Homo sapiens
ccacacctcagttcccttggcc

SEQ ID NO: 4556709 - DNA, 14 bp, Homo sapiens
ccacacctctgcca

SEQ ID NO: 4556710 - DNA, 16 bp, Homo sapiens
ccacacctctgccaga

SEQ ID NO: 4556711 - DNA, 17 bp, Homo sapiens
ccacacggaagcaagca

SEQ ID NO: 4556712 - DNA, 22 bp, Homo sapiens
ccacactaacctgggttccctt

SEQ ID NO: 4556713 - DNA, 22 bp, Homo sapiens
ccacactagggactatcaggta

SEQ ID NO: 4556714 - DNA, 18 bp, Homo sapiens
ccacactccttgtcaaca

SEQ ID NO: 4556715 - DNA, 14 bp, Homo sapiens
ccacactgaccaag

SEQ ID NO: 4556716 - DNA, 13 bp, Homo sapiens
ccacactggggct

SEQ ID NO: 4556717 - DNA, 15 bp, Homo sapiens
ccacactggggctga

SEQ ID NO: 4556718 - DNA, 18 bp, Homo sapiens
ccacactggggctgacac

SEQ ID NO: 4556719 - DNA, 23 bp, Homo sapiens
ccacactggggctgacacccagg

SEQ ID NO: 4556720 - DNA, 23 bp, Homo sapiens
ccacactggggtgccgcctgccc

SEQ ID NO: 4556721 - DNA, 20 bp, Homo sapiens
ccacacttgttccagctctt

SEQ ID NO: 4556722 - DNA, 22 bp, Homo sapiens
ccacagaaagccaggagcagcc

SEQ ID NO: 4556723 - DNA, 18 bp, Homo sapiens
ccacagaacctttgtcaa

SEQ ID NO: 4556724 - DNA, 16 bp, Homo sapiens
ccacagaggccccacc

SEQ ID NO: 4556725 - DNA, 19 bp, Homo sapiens
ccacagaggccccacctga

SEQ ID NO: 4556726 - DNA, 23 bp, Homo sapiens
ccacagaggccccacctgaaggg

SEQ ID NO: 4556727 - DNA, 18 bp, Homo sapiens
ccacagataactgaaaat

SEQ ID NO: 4556728 - DNA, 22 bp, Homo sapiens
ccacagcaagtacagcggctcc

SEQ ID NO: 4556729 - DNA, 23 bp, Homo sapiens
ccacagcaagtacagcggctccc

SEQ ID NO: 4556730 - DNA, 13 bp, Homo sapiens
ccacagcagacac

SEQ ID NO: 4556731 - DNA, 14 bp, Homo sapiens
ccacagcagacacc

SEQ ID NO: 4556732 - DNA, 15 bp, Homo sapiens
ccacagcagacacca

SEQ ID NO: 4556733 - DNA, 16 bp, Homo sapiens
ccacagcagccccagg

SEQ ID NO: 4556734 - DNA, 19 bp, Homo sapiens
ccacagcagccccaggaga

SEQ ID NO: 4556735 - DNA, 17 bp, Homo sapiens
ccacagcagttgaaaag

SEQ ID NO: 4556736 - DNA, 15 bp, Homo sapiens
ccacagcatcgggag

SEQ ID NO: 4556737 - DNA, 22 bp, Homo sapiens
ccacagcatcgggagcacccag

SEQ ID NO: 4556738 - DNA, 21 bp, Homo sapiens
ccacagccagaggagggcaga

SEQ ID NO: 4556739 - DNA, 20 bp, Homo sapiens
ccacagccagggctccacgg

SEQ ID NO: 4556740 - DNA, 18 bp, Homo sapiens
ccacagccttgcagcggc

SEQ ID NO: 4556741 - DNA, 23 bp, Homo sapiens
ccacagccttgcagcggctcctg

SEQ ID NO: 4556742 - DNA, 21 bp, Homo sapiens
ccacagcgtccctggcgcagg

SEQ ID NO: 4556743 - DNA, 17 bp, Homo sapiens
ccacagcgtgggaactc

SEQ ID NO: 4556744 - DNA, 15 bp, Homo sapiens
ccacagctcccaccc

SEQ ID NO: 4556745 - DNA, 17 bp, Homo sapiens
ccacagctcccacccca

SEQ ID NO: 4556746 - DNA, 11 bp, Homo sapiens
ccacagctgct

SEQ ID NO: 4556747 - DNA, 12 bp, Homo sapiens
ccacagctgctg

SEQ ID NO: 4556748 - DNA, 20 bp, Homo sapiens
ccacagctgctgttctcagg

SEQ ID NO: 4556749 - DNA, 23 bp, Homo sapiens
ccacagctgctgttctcaggaca

SEQ ID NO: 4556750 - DNA, 22 bp, Homo sapiens
ccacagctggcctggtttcctc

SEQ ID NO: 4556751 - DNA, 17 bp, Homo sapiens
ccacagcttcctgaggg

SEQ ID NO: 4556752 - DNA, 19 bp, Homo sapiens
ccacaggaaggaggggaga

SEQ ID NO: 4556753 - DNA, 14 bp, Homo sapiens
ccacaggcagtcca

SEQ ID NO: 4556754 - DNA, 22 bp, Homo sapiens
ccacaggcctgagatttcatct

SEQ ID NO: 4556755 - DNA, 17 bp, Homo sapiens
ccacagggaagctcaca

SEQ ID NO: 4556756 - DNA, 23 bp, Homo sapiens
ccacagggaagctcacacatcct

SEQ ID NO: 4556757 - DNA, 22 bp, Homo sapiens
ccacagggctgttttgcctccc

SEQ ID NO: 4556758 - DNA, 14 bp, Homo sapiens
ccacaggtccaagg

SEQ ID NO: 4556759 - DNA, 23 bp, Homo sapiens
ccacagtatattttatttcaatg

SEQ ID NO: 4556760 - DNA, 15 bp, Homo sapiens
ccacagtcactggat

SEQ ID NO: 4556761 - DNA, 20 bp, Homo sapiens
ccacagtggcgggcccactc

SEQ ID NO: 4556762 - DNA, 18 bp, Homo sapiens
ccacatactttacagtaa

SEQ ID NO: 4556763 - DNA, 19 bp, Homo sapiens
ccacatcaacattccaggg

SEQ ID NO: 4556764 - DNA, 20 bp, Homo sapiens
ccacatcaacattccaggga

SEQ ID NO: 4556765 - DNA, 22 bp, Homo sapiens
ccacatcccatgttgaagtaat

SEQ ID NO: 4556766 - DNA, 12 bp, Homo sapiens
ccacatctgcct

SEQ ID NO: 4556767 - DNA, 23 bp, Homo sapiens
ccacatctgccttaaaaccaaag

SEQ ID NO: 4556768 - DNA, 18 bp, Homo sapiens
ccacatgcatgtctgcct

SEQ ID NO: 4556769 - DNA, 13 bp, Homo sapiens
ccacatgccccag

SEQ ID NO: 4556770 - DNA, 21 bp, Homo sapiens
ccacatgcctgcgcctgctgc

SEQ ID NO: 4556771 - DNA, 15 bp, Homo sapiens
ccacatggagccccc

SEQ ID NO: 4556772 - DNA, 16 bp, Homo sapiens
ccacatgggaggctca

SEQ ID NO: 4556773 - DNA, 21 bp, Homo sapiens
ccacatggtcttcgtccttga

SEQ ID NO: 4556774 - DNA, 14 bp, Homo sapiens
ccacattcttcagt

SEQ ID NO: 4556775 - DNA, 16 bp, Homo sapiens
ccacattcttcagttt

SEQ ID NO: 4556776 - DNA, 17 bp, Homo sapiens
ccacattcttcagtttt

SEQ ID NO: 4556777 - DNA, 22 bp, Homo sapiens
ccacatttggaatactttttgt

SEQ ID NO: 4556778 - DNA, 13 bp, Homo sapiens
ccaccaaacttta

SEQ ID NO: 4556779 - DNA, 20 bp, Homo sapiens
ccaccaataaatcagaccat

SEQ ID NO: 4556780 - DNA, 21 bp, Homo sapiens
ccaccaataaatcagaccatg

SEQ ID NO: 4556781 - DNA, 15 bp, Homo sapiens
ccaccaccagaaagc

SEQ ID NO: 4556782 - DNA, 11 bp, Homo sapiens
ccaccacccaa

SEQ ID NO: 4556783 - DNA, 21 bp, Homo sapiens
ccaccacctaggccactcctc

SEQ ID NO: 4556784 - DNA, 15 bp, Homo sapiens
ccaccacctttggct

SEQ ID NO: 4556785 - DNA, 19 bp, Homo sapiens
ccaccacgatgtggccctg

SEQ ID NO: 4556786 - DNA, 16 bp, Homo sapiens
ccaccacgcccagcta

SEQ ID NO: 4556787 - DNA, 13 bp, Homo sapiens
ccaccagcagcat

SEQ ID NO: 4556788 - DNA, 13 bp, Homo sapiens
ccaccagccttgc

SEQ ID NO: 4556789 - DNA, 14 bp, Homo sapiens
ccaccagccttgct

SEQ ID NO: 4556790 - DNA, 13 bp, Homo sapiens
ccaccaggccagc

SEQ ID NO: 4556791 - DNA, 18 bp, Homo sapiens
ccaccaggccagctcagg

SEQ ID NO: 4556792 - DNA, 19 bp, Homo sapiens
ccaccaggccagctcagga

SEQ ID NO: 4556793 - DNA, 21 bp, Homo sapiens
ccaccatgcactgtaaatatc

SEQ ID NO: 4556794 - DNA, 16 bp, Homo sapiens
ccaccatgcctcacta

SEQ ID NO: 4556795 - DNA, 16 bp, Homo sapiens
ccaccatgctctctca

SEQ ID NO: 4556796 - DNA, 17 bp, Homo sapiens
ccaccatgctctctcac

SEQ ID NO: 4556797 - DNA, 13 bp, Homo sapiens
ccaccatgcttgc

SEQ ID NO: 4556798 - DNA, 17 bp, Homo sapiens
ccaccatggaccagccc

SEQ ID NO: 4556799 - DNA, 19 bp, Homo sapiens
ccacccaactccacagggc

SEQ ID NO: 4556800 - DNA, 15 bp, Homo sapiens
ccacccaagcctgct

SEQ ID NO: 4556801 - DNA, 12 bp, Homo sapiens
ccacccagccca

SEQ ID NO: 4556802 - DNA, 22 bp, Homo sapiens
ccacccagcccattctctctcc

SEQ ID NO: 4556803 - DNA, 17 bp, Homo sapiens
ccacccaggagggaggg

SEQ ID NO: 4556804 - DNA, 14 bp, Homo sapiens
ccacccagtccatg

SEQ ID NO: 4556805 - DNA, 11 bp, Homo sapiens
ccacccatgcg

SEQ ID NO: 4556806 - DNA, 21 bp, Homo sapiens
ccaccccaaaccccagcccca

SEQ ID NO: 4556807 - DNA, 12 bp, Homo sapiens
ccaccccacact

SEQ ID NO: 4556808 - DNA, 11 bp, Homo sapiens
ccaccccaccc

SEQ ID NO: 4556809 - DNA, 17 bp, Homo sapiens
ccaccccacccccttca

SEQ ID NO: 4556810 - DNA, 12 bp, Homo sapiens
ccaccccagggt

SEQ ID NO: 4556811 - DNA, 16 bp, Homo sapiens
ccaccccatccagcca

SEQ ID NO: 4556812 - DNA, 13 bp, Homo sapiens
ccacccccagcct

SEQ ID NO: 4556813 - DNA, 15 bp, Homo sapiens
ccaccccctgccctg

SEQ ID NO: 4556814 - DNA, 17 bp, Homo sapiens
ccaccccctgccctgca

SEQ ID NO: 4556815 - DNA, 18 bp, Homo sapiens
ccaccccctgccctgcac

SEQ ID NO: 4556816 - DNA, 24 bp, Homo sapiens
ccaccccctgtcccattctagatc

SEQ ID NO: 4556817 - DNA, 17 bp, Homo sapiens
ccacccccttcagtgcc

SEQ ID NO: 4556818 - DNA, 15 bp, Homo sapiens
ccaccccgctctgca

SEQ ID NO: 4556819 - DNA, 16 bp, Homo sapiens
ccaccccgctctgcat

SEQ ID NO: 4556820 - DNA, 11 bp, Homo sapiens
ccacccctccc

SEQ ID NO: 4556821 - DNA, 13 bp, Homo sapiens
ccacccctgcccc

SEQ ID NO: 4556822 - DNA, 22 bp, Homo sapiens
ccacccctgcccccagccccgg

SEQ ID NO: 4556823 - DNA, 15 bp, Homo sapiens
ccacccctgcctcca

SEQ ID NO: 4556824 - DNA, 16 bp, Homo sapiens
ccacccctgcctccac

SEQ ID NO: 4556825 - DNA, 16 bp, Homo sapiens
ccaccccttcctgtct

SEQ ID NO: 4556826 - DNA, 15 bp, Homo sapiens
ccacccgccgcctcc

SEQ ID NO: 4556827 - DNA, 21 bp, Homo sapiens
ccacccgccgcctcccacggc

SEQ ID NO: 4556828 - DNA, 14 bp, Homo sapiens
ccacccgccttgtg

SEQ ID NO: 4556829 - DNA, 17 bp, Homo sapiens
ccacccgccttgtgaga

SEQ ID NO: 4556830 - DNA, 18 bp, Homo sapiens
ccacccggccacagctgc

SEQ ID NO: 4556831 - DNA, 19 bp, Homo sapiens
ccacccggccacagctgct

SEQ ID NO: 4556832 - DNA, 22 bp, Homo sapiens
ccacccggccacagctgctgga

SEQ ID NO: 4556833 - DNA, 17 bp, Homo sapiens
ccaccctccatgctcct

SEQ ID NO: 4556834 - DNA, 12 bp, Homo sapiens
ccaccctcccta

SEQ ID NO: 4556835 - DNA, 12 bp, Homo sapiens
ccaccctcctct

SEQ ID NO: 4556836 - DNA, 14 bp, Homo sapiens
ccaccctcctgtct

SEQ ID NO: 4556837 - DNA, 22 bp, Homo sapiens
ccaccctgagccggccccaggc

SEQ ID NO: 4556838 - DNA, 13 bp, Homo sapiens
ccaccctgagctc

SEQ ID NO: 4556839 - DNA, 13 bp, Homo sapiens
ccacccttggcct

SEQ ID NO: 4556840 - DNA, 19 bp, Homo sapiens
ccacccttggcctgtctca

SEQ ID NO: 4556841 - DNA, 22 bp, Homo sapiens
ccaccgaagtggactggcccct

SEQ ID NO: 4556842 - DNA, 23 bp, Homo sapiens
ccaccgaagtggactggcccctg

SEQ ID NO: 4556843 - DNA, 15 bp, Homo sapiens
ccaccgcggaggagg

SEQ ID NO: 4556844 - DNA, 13 bp, Homo sapiens
ccaccgctgccta

SEQ ID NO: 4556845 - DNA, 14 bp, Homo sapiens
ccaccgggagcctc

SEQ ID NO: 4556846 - DNA, 17 bp, Homo sapiens
ccaccgggagcctcccc

SEQ ID NO: 4556847 - DNA, 22 bp, Homo sapiens
ccaccgggagcctccccctcag

SEQ ID NO: 4556848 - DNA, 18 bp, Homo sapiens
ccaccgtgaaccagaggg

SEQ ID NO: 4556849 - DNA, 13 bp, Homo sapiens
ccaccgtgcctgg

SEQ ID NO: 4556850 - DNA, 16 bp, Homo sapiens
ccaccgtgcctggcta

SEQ ID NO: 4556851 - DNA, 16 bp, Homo sapiens
ccaccgtggaggagga

SEQ ID NO: 4556852 - DNA, 16 bp, Homo sapiens
ccacctaggccactcc

SEQ ID NO: 4556853 - DNA, 17 bp, Homo sapiens
ccacctaggccactcct

SEQ ID NO: 4556854 - DNA, 16 bp, Homo sapiens
ccacctatgcctgtgg

SEQ ID NO: 4556855 - DNA, 14 bp, Homo sapiens
ccacctcttgtgca

SEQ ID NO: 4556856 - DNA, 20 bp, Homo sapiens
ccacctgaataaagaatgaa

SEQ ID NO: 4556857 - DNA, 23 bp, Homo sapiens
ccacctgacacaccaggcgctaa

SEQ ID NO: 4556858 - DNA, 17 bp, Homo sapiens
ccacctgcaagatggac

SEQ ID NO: 4556859 - DNA, 20 bp, Homo sapiens
ccacctgcccatcacagggt

SEQ ID NO: 4556860 - DNA, 22 bp, Homo sapiens
ccacctgctagtgtgaattaaa

SEQ ID NO: 4556861 - DNA, 21 bp, Homo sapiens
ccacctggaaactgctcagac

SEQ ID NO: 4556862 - DNA, 11 bp, Homo sapiens
ccacctggcaa

SEQ ID NO: 4556863 - DNA, 23 bp, Homo sapiens
ccacctggcaaaggacccttgag

SEQ ID NO: 4556864 - DNA, 12 bp, Homo sapiens
ccacctggctct

SEQ ID NO: 4556865 - DNA, 16 bp, Homo sapiens
ccacctggctctgtgg

SEQ ID NO: 4556866 - DNA, 16 bp, Homo sapiens
ccacctgtggggcctg

SEQ ID NO: 4556867 - DNA, 21 bp, Homo sapiens
ccacctgtttctggaagactg

SEQ ID NO: 4556868 - DNA, 16 bp, Homo sapiens
ccaccttaaattaaac

SEQ ID NO: 4556869 - DNA, 22 bp, Homo sapiens
ccaccttaaattaaacaattta

SEQ ID NO: 4556870 - DNA, 15 bp, Homo sapiens
ccaccttcaggcccc

SEQ ID NO: 4556871 - DNA, 22 bp, Homo sapiens
ccaccttcatttaactctttga

SEQ ID NO: 4556872 - DNA, 14 bp, Homo sapiens
ccaccttcccagct

SEQ ID NO: 4556873 - DNA, 15 bp, Homo sapiens
ccacgactggccagg

SEQ ID NO: 4556874 - DNA, 12 bp, Homo sapiens
ccacgagggctg

SEQ ID NO: 4556875 - DNA, 15 bp, Homo sapiens
ccacgagggctggct

SEQ ID NO: 4556876 - DNA, 22 bp, Homo sapiens
ccacgagggctggctggcctca

SEQ ID NO: 4556877 - DNA, 17 bp, Homo sapiens
ccacgatgtggccctgg

SEQ ID NO: 4556878 - DNA, 20 bp, Homo sapiens
ccacgatgtggccctggcct

SEQ ID NO: 4556879 - DNA, 13 bp, Homo sapiens
ccacgccacaggg

SEQ ID NO: 4556880 - DNA, 14 bp, Homo sapiens
ccacgccacagggt

SEQ ID NO: 4556881 - DNA, 13 bp, Homo sapiens
ccacgccaggcca

SEQ ID NO: 4556882 - DNA, 15 bp, Homo sapiens
ccacgccaggccagc

SEQ ID NO: 4556883 - DNA, 15 bp, Homo sapiens
ccacgcccaccagcc

SEQ ID NO: 4556884 - DNA, 19 bp, Homo sapiens
ccacgcccaccagccttgc

SEQ ID NO: 4556885 - DNA, 19 bp, Homo sapiens
ccacgcccgtctctttctc

SEQ ID NO: 4556886 - DNA, 19 bp, Homo sapiens
ccacgccctccctgctagc

SEQ ID NO: 4556887 - DNA, 20 bp, Homo sapiens
ccacgccctccctgctagca

SEQ ID NO: 4556888 - DNA, 18 bp, Homo sapiens
ccacgcctcctggccaga

SEQ ID NO: 4556889 - DNA, 21 bp, Homo sapiens
ccacgcctcttgaccaggctg

SEQ ID NO: 4556890 - DNA, 14 bp, Homo sapiens
ccacgccttgacct

SEQ ID NO: 4556891 - DNA, 12 bp, Homo sapiens
ccacgctccagc

SEQ ID NO: 4556892 - DNA, 21 bp, Homo sapiens
ccacgctgaccatgcgtcagg

SEQ ID NO: 4556893 - DNA, 18 bp, Homo sapiens
ccacgctgggcctaggat

SEQ ID NO: 4556894 - DNA, 12 bp, Homo sapiens
ccacggagccac

SEQ ID NO: 4556895 - DNA, 20 bp, Homo sapiens
ccacggagccactcctctga

SEQ ID NO: 4556896 - DNA, 21 bp, Homo sapiens
ccacggagccactcctctgac

SEQ ID NO: 4556897 - DNA, 19 bp, Homo sapiens
ccacggagcgggaggcagc

SEQ ID NO: 4556898 - DNA, 22 bp, Homo sapiens
ccacgtcaggcctggcctcatc

SEQ ID NO: 4556899 - DNA, 12 bp, Homo sapiens
ccacgtcccagc

SEQ ID NO: 4556900 - DNA, 14 bp, Homo sapiens
ccacgtcccagcat

SEQ ID NO: 4556901 - DNA, 23 bp, Homo sapiens
ccacgtgccaggcccggggctgg

SEQ ID NO: 4556902 - DNA, 15 bp, Homo sapiens
ccacgttgtccctga

SEQ ID NO: 4556903 - DNA, 23 bp, Homo sapiens
ccactaaaaatattgtttctgca

SEQ ID NO: 4556904 - DNA, 18 bp, Homo sapiens
ccactaaccatccccaac

SEQ ID NO: 4556905 - DNA, 20 bp, Homo sapiens
ccactaaccatccccaactc

SEQ ID NO: 4556906 - DNA, 15 bp, Homo sapiens
ccactaccagccagc

SEQ ID NO: 4556907 - DNA, 16 bp, Homo sapiens
ccactaccagccagcc

SEQ ID NO: 4556908 - DNA, 19 bp, Homo sapiens
ccactaccagccagcctca

SEQ ID NO: 4556909 - DNA, 21 bp, Homo sapiens
ccactacttgtggggctaagg

SEQ ID NO: 4556910 - DNA, 23 bp, Homo sapiens
ccactaggaatcccagaggtggg

SEQ ID NO: 4556911 - DNA, 20 bp, Homo sapiens
ccactatctccgttccatct

SEQ ID NO: 4556912 - DNA, 23 bp, Homo sapiens
ccactcacacagccaggtgcctt

SEQ ID NO: 4556913 - DNA, 13 bp, Homo sapiens
ccactcagcttcc

SEQ ID NO: 4556914 - DNA, 13 bp, Homo sapiens
ccactcatttcat

SEQ ID NO: 4556915 - DNA, 15 bp, Homo sapiens
ccactcatttcatct

SEQ ID NO: 4556916 - DNA, 15 bp, Homo sapiens
ccactccccagcccc

SEQ ID NO: 4556917 - DNA, 22 bp, Homo sapiens
ccactccccagccccagcccct

SEQ ID NO: 4556918 - DNA, 19 bp, Homo sapiens
ccactcccccgtttctcct

SEQ ID NO: 4556919 - DNA, 22 bp, Homo sapiens
ccactccggccctccagagccc

SEQ ID NO: 4556920 - DNA, 13 bp, Homo sapiens
ccactcctctgac

SEQ ID NO: 4556921 - DNA, 20 bp, Homo sapiens
ccactcctctgactcagggc

SEQ ID NO: 4556922 - DNA, 12 bp, Homo sapiens
ccactcctggga

SEQ ID NO: 4556923 - DNA, 20 bp, Homo sapiens
ccactcgacccagaatggag

SEQ ID NO: 4556924 - DNA, 13 bp, Homo sapiens
ccactcgccttct

SEQ ID NO: 4556925 - DNA, 17 bp, Homo sapiens
ccactcgccttcttaga

SEQ ID NO: 4556926 - DNA, 17 bp, Homo sapiens
ccactctccccacacta

SEQ ID NO: 4556927 - DNA, 19 bp, Homo sapiens
ccactcttctttaagccat

SEQ ID NO: 4556928 - DNA, 12 bp, Homo sapiens
ccactgaaaatt

SEQ ID NO: 4556929 - DNA, 14 bp, Homo sapiens
ccactgaaatctgt

SEQ ID NO: 4556930 - DNA, 16 bp, Homo sapiens
ccactgagcaagcaag

SEQ ID NO: 4556931 - DNA, 21 bp, Homo sapiens
ccactgagccaggcttttctc

SEQ ID NO: 4556932 - DNA, 22 bp, Homo sapiens
ccactgatagatgtctattctt

SEQ ID NO: 4556933 - DNA, 13 bp, Homo sapiens
ccactgcactcca

SEQ ID NO: 4556934 - DNA, 17 bp, Homo sapiens
ccactgcactccagcct

SEQ ID NO: 4556935 - DNA, 19 bp, Homo sapiens
ccactgcactccagcctga

SEQ ID NO: 4556936 - DNA, 18 bp, Homo sapiens
ccactgcagaagacagta

SEQ ID NO: 4556937 - DNA, 17 bp, Homo sapiens
ccactgcaggccccgct

SEQ ID NO: 4556938 - DNA, 14 bp, Homo sapiens
ccactgccccacgt

SEQ ID NO: 4556939 - DNA, 21 bp, Homo sapiens
ccactgccccccgaggctgct

SEQ ID NO: 4556940 - DNA, 19 bp, Homo sapiens
ccactgcgcccggcccaag

SEQ ID NO: 4556941 - DNA, 21 bp, Homo sapiens
ccactgcgggagctctgtatg

SEQ ID NO: 4556942 - DNA, 16 bp, Homo sapiens
ccactggaaggaacat

SEQ ID NO: 4556943 - DNA, 19 bp, Homo sapiens
ccactggaaggaacatgga

SEQ ID NO: 4556944 - DNA, 20 bp, Homo sapiens
ccactggcatcgcagcttcc

SEQ ID NO: 4556945 - DNA, 22 bp, Homo sapiens
ccactggcatcgcagcttcctg

SEQ ID NO: 4556946 - DNA, 16 bp, Homo sapiens
ccactggccgctgagc

SEQ ID NO: 4556947 - DNA, 18 bp, Homo sapiens
ccactggggaatgctccc

SEQ ID NO: 4556948 - DNA, 17 bp, Homo sapiens
ccactgggtgagagagg

SEQ ID NO: 4556949 - DNA, 15 bp, Homo sapiens
ccactggttcttctt

SEQ ID NO: 4556950 - DNA, 22 bp, Homo sapiens
ccactgtaatacgtagctctct

SEQ ID NO: 4556951 - DNA, 21 bp, Homo sapiens
ccactgtatatgcatatagtg

SEQ ID NO: 4556952 - DNA, 13 bp, Homo sapiens
ccactgtcacagg

SEQ ID NO: 4556953 - DNA, 15 bp, Homo sapiens
ccactgtcacaggca

SEQ ID NO: 4556954 - DNA, 18 bp, Homo sapiens
ccactgtgcaggttccca

SEQ ID NO: 4556955 - DNA, 16 bp, Homo sapiens
ccactgtggcactggc

SEQ ID NO: 4556956 - DNA, 19 bp, Homo sapiens
ccactgttcagcggagctg

SEQ ID NO: 4556957 - DNA, 22 bp, Homo sapiens
ccactgttctgttcatttccta

SEQ ID NO: 4556958 - DNA, 15 bp, Homo sapiens
ccactgtttggaaat

SEQ ID NO: 4556959 - DNA, 13 bp, Homo sapiens
ccacttaaaatgt

SEQ ID NO: 4556960 - DNA, 16 bp, Homo sapiens
ccacttcactttcttc

SEQ ID NO: 4556961 - DNA, 18 bp, Homo sapiens
ccacttccaggggaacct

SEQ ID NO: 4556962 - DNA, 15 bp, Homo sapiens
ccacttcgcacacac

SEQ ID NO: 4556963 - DNA, 10 bp, Homo sapiens
ccacttgtat

SEQ ID NO: 4556964 - DNA, 21 bp, Homo sapiens
ccacttgtatatatggatcag

SEQ ID NO: 4556965 - DNA, 18 bp, Homo sapiens
ccactttgtaatttttgc

SEQ ID NO: 4556966 - DNA, 18 bp, Homo sapiens
ccagaaaatgtaaggcaa

SEQ ID NO: 4556967 - DNA, 19 bp, Homo sapiens
ccagaaagcctcctgcccc

SEQ ID NO: 4556968 - DNA, 15 bp, Homo sapiens
ccagaacagtatgaa

SEQ ID NO: 4556969 - DNA, 16 bp, Homo sapiens
ccagaacccagtgttt

SEQ ID NO: 4556970 - DNA, 16 bp, Homo sapiens
ccagaacgcaccccac

SEQ ID NO: 4556971 - DNA, 21 bp, Homo sapiens
ccagaacgtggtttgcctgag

SEQ ID NO: 4556972 - DNA, 15 bp, Homo sapiens
ccagaactttctgtc

SEQ ID NO: 4556973 - DNA, 18 bp, Homo sapiens
ccagaagaaaattctcct

SEQ ID NO: 4556974 - DNA, 13 bp, Homo sapiens
ccagaagagccca

SEQ ID NO: 4556975 - DNA, 24 bp, Homo sapiens
ccagaagatcccctcaggactgca

SEQ ID NO: 4556976 - DNA, 16 bp, Homo sapiens
ccagaagcctctggct

SEQ ID NO: 4556977 - DNA, 19 bp, Homo sapiens
ccagaagcctctggctaga

SEQ ID NO: 4556978 - DNA, 20 bp, Homo sapiens
ccagaagcctctggctagag

SEQ ID NO: 4556979 - DNA, 19 bp, Homo sapiens
ccagaagccttggaaccag

SEQ ID NO: 4556980 - DNA, 12 bp, Homo sapiens
ccagaagtgttt

SEQ ID NO: 4556981 - DNA, 20 bp, Homo sapiens
ccagaatctagagcaaagcc

SEQ ID NO: 4556982 - DNA, 21 bp, Homo sapiens
ccagaatgctgtacatctatt

SEQ ID NO: 4556983 - DNA, 22 bp, Homo sapiens
ccagaatgtcagattcctttcc

SEQ ID NO: 4556984 - DNA, 19 bp, Homo sapiens
ccagaatttaccatcatct

SEQ ID NO: 4556985 - DNA, 17 bp, Homo sapiens
ccagacaccatgtgcaa

SEQ ID NO: 4556986 - DNA, 20 bp, Homo sapiens
ccagacaccatgtgcaataa

SEQ ID NO: 4556987 - DNA, 23 bp, Homo sapiens
ccagacactgaccatccactcta

SEQ ID NO: 4556988 - DNA, 12 bp, Homo sapiens
ccagacagcctg

SEQ ID NO: 4556989 - DNA, 13 bp, Homo sapiens
ccagacaggccct

SEQ ID NO: 4556990 - DNA, 21 bp, Homo sapiens
ccagacaggccctccctgtct

SEQ ID NO: 4556991 - DNA, 14 bp, Homo sapiens
ccagacatggtgtc

SEQ ID NO: 4556992 - DNA, 20 bp, Homo sapiens
ccagacatggtgtctcacac

SEQ ID NO: 4556993 - DNA, 22 bp, Homo sapiens
ccagacattctcgcttccctga

SEQ ID NO: 4556994 - DNA, 11 bp, Homo sapiens
ccagacccaga

SEQ ID NO: 4556995 - DNA, 14 bp, Homo sapiens
ccagacccagtggg

SEQ ID NO: 4556996 - DNA, 15 bp, Homo sapiens
ccagaccccacgctg

SEQ ID NO: 4556997 - DNA, 14 bp, Homo sapiens
ccagaccccccagc

SEQ ID NO: 4556998 - DNA, 18 bp, Homo sapiens
ccagacgctgccgctgcc

SEQ ID NO: 4556999 - DNA, 17 bp, Homo sapiens
ccagacgtcaggccctg

SEQ ID NO: 4557000 - DNA, 22 bp, Homo sapiens
ccagacgtcaggccctgactcc

SEQ ID NO: 4557001 - DNA, 23 bp, Homo sapiens
ccagactaaaggatccagagagc

SEQ ID NO: 4557002 - DNA, 14 bp, Homo sapiens
ccagactcaggttc

SEQ ID NO: 4557003 - DNA, 18 bp, Homo sapiens
ccagactcaggttccaga

SEQ ID NO: 4557004 - DNA, 16 bp, Homo sapiens
ccagactgatgagcac

SEQ ID NO: 4557005 - DNA, 17 bp, Homo sapiens
ccagactgatgagcaca

SEQ ID NO: 4557006 - DNA, 15 bp, Homo sapiens
ccagactgtccaggg

SEQ ID NO: 4557007 - DNA, 16 bp, Homo sapiens
ccagactgtccaggga

SEQ ID NO: 4557008 - DNA, 21 bp, Homo sapiens
ccagactgtccagggaaacag

SEQ ID NO: 4557009 - DNA, 18 bp, Homo sapiens
ccagacttgggaggatgt

SEQ ID NO: 4557010 - DNA, 18 bp, Homo sapiens
ccagagaagccccttccc

SEQ ID NO: 4557011 - DNA, 15 bp, Homo sapiens
ccagagacaagcaga

SEQ ID NO: 4557012 - DNA, 13 bp, Homo sapiens
ccagagacactga

SEQ ID NO: 4557013 - DNA, 17 bp, Homo sapiens
ccagagacactgagcca

SEQ ID NO: 4557014 - DNA, 17 bp, Homo sapiens
ccagagacagaggatgt

SEQ ID NO: 4557015 - DNA, 23 bp, Homo sapiens
ccagagagaaagaagatttatta

SEQ ID NO: 4557016 - DNA, 20 bp, Homo sapiens
ccagagatgcctccaccgct

SEQ ID NO: 4557017 - DNA, 13 bp, Homo sapiens
ccagagcaaacag

SEQ ID NO: 4557018 - DNA, 18 bp, Homo sapiens
ccagagcaaacagaaaaa

SEQ ID NO: 4557019 - DNA, 13 bp, Homo sapiens
ccagagcagagcc

SEQ ID NO: 4557020 - DNA, 17 bp, Homo sapiens
ccagagcatctgcccca

SEQ ID NO: 4557021 - DNA, 12 bp, Homo sapiens
ccagagccacct

SEQ ID NO: 4557022 - DNA, 15 bp, Homo sapiens
ccagagccacctgga

SEQ ID NO: 4557023 - DNA, 13 bp, Homo sapiens
ccagagcccaagg

SEQ ID NO: 4557024 - DNA, 13 bp, Homo sapiens
ccagagcctctgg

SEQ ID NO: 4557025 - DNA, 22 bp, Homo sapiens
ccagagcctctggcccctcacc

SEQ ID NO: 4557026 - DNA, 12 bp, Homo sapiens
ccagagccttca

SEQ ID NO: 4557027 - DNA, 18 bp, Homo sapiens
ccagagccttcaagtgcc

SEQ ID NO: 4557028 - DNA, 22 bp, Homo sapiens
ccagagcggtatctctggcacc

SEQ ID NO: 4557029 - DNA, 15 bp, Homo sapiens
ccagagcgtccttgg

SEQ ID NO: 4557030 - DNA, 22 bp, Homo sapiens
ccagagcgtccttggctgccgt

SEQ ID NO: 4557031 - DNA, 23 bp, Homo sapiens
ccagagctcccccgtggtgcctg

SEQ ID NO: 4557032 - DNA, 23 bp, Homo sapiens
ccagagctgtctgaactcacgtg

SEQ ID NO: 4557033 - DNA, 20 bp, Homo sapiens
ccagagctgtttatggcctc

SEQ ID NO: 4557034 - DNA, 22 bp, Homo sapiens
ccagagctgtttatggcctcag

SEQ ID NO: 4557035 - DNA, 17 bp, Homo sapiens
ccagaggagccaccagt

SEQ ID NO: 4557036 - DNA, 19 bp, Homo sapiens
ccagaggagccaccagttc

SEQ ID NO: 4557037 - DNA, 21 bp, Homo sapiens
ccagaggattgctgccccatc

SEQ ID NO: 4557038 - DNA, 11 bp, Homo sapiens
ccagaggcaga

SEQ ID NO: 4557039 - DNA, 15 bp, Homo sapiens
ccagaggcagaggtt

SEQ ID NO: 4557040 - DNA, 12 bp, Homo sapiens
ccagaggccctg

SEQ ID NO: 4557041 - DNA, 21 bp, Homo sapiens
ccagaggccctggagggaagg

SEQ ID NO: 4557042 - DNA, 22 bp, Homo sapiens
ccagaggccctggagggaagga

SEQ ID NO: 4557043 - DNA, 12 bp, Homo sapiens
ccagaggctccc

SEQ ID NO: 4557044 - DNA, 13 bp, Homo sapiens
ccagaggctccca

SEQ ID NO: 4557045 - DNA, 13 bp, Homo sapiens
ccagaggctggga

SEQ ID NO: 4557046 - DNA, 15 bp, Homo sapiens
ccagaggctgggagt

SEQ ID NO: 4557047 - DNA, 17 bp, Homo sapiens
ccagaggctgggagtcc

SEQ ID NO: 4557048 - DNA, 17 bp, Homo sapiens
ccagaggggacgctgag

SEQ ID NO: 4557049 - DNA, 20 bp, Homo sapiens
ccagaggggacgctgaggaa

SEQ ID NO: 4557050 - DNA, 17 bp, Homo sapiens
ccagagggtagggcaca

SEQ ID NO: 4557051 - DNA, 18 bp, Homo sapiens
ccagagggtgtggctttc

SEQ ID NO: 4557052 - DNA, 20 bp, Homo sapiens
ccagagggtgtggctttcca

SEQ ID NO: 4557053 - DNA, 20 bp, Homo sapiens
ccagaggtccaggtcccagc

SEQ ID NO: 4557054 - DNA, 22 bp, Homo sapiens
ccagaggtctcatctcccaggc

SEQ ID NO: 4557055 - DNA, 19 bp, Homo sapiens
ccagaggtgggatcctccc

SEQ ID NO: 4557056 - DNA, 22 bp, Homo sapiens
ccagaggtgggatcctccctca

SEQ ID NO: 4557057 - DNA, 22 bp, Homo sapiens
ccagaggtgtcgggacatggtt

SEQ ID NO: 4557058 - DNA, 16 bp, Homo sapiens
ccagagtccctgcctg

SEQ ID NO: 4557059 - DNA, 22 bp, Homo sapiens
ccagagtccctgcctggaccag

SEQ ID NO: 4557060 - DNA, 19 bp, Homo sapiens
ccagagtcttaagggtcac

SEQ ID NO: 4557061 - DNA, 18 bp, Homo sapiens
ccagagtggagtctgagt

SEQ ID NO: 4557062 - DNA, 14 bp, Homo sapiens
ccagagtggcctgg

SEQ ID NO: 4557063 - DNA, 16 bp, Homo sapiens
ccagagtggcctggcc

SEQ ID NO: 4557064 - DNA, 17 bp, Homo sapiens
ccagatagtgtagctga

SEQ ID NO: 4557065 - DNA, 14 bp, Homo sapiens
ccagatataactgt

SEQ ID NO: 4557066 - DNA, 17 bp, Homo sapiens
ccagatataactgtctt

SEQ ID NO: 4557067 - DNA, 21 bp, Homo sapiens
ccagatataactgtcttgttt

SEQ ID NO: 4557068 - DNA, 13 bp, Homo sapiens
ccagatcctgggt

SEQ ID NO: 4557069 - DNA, 19 bp, Homo sapiens
ccagatctggtcccttgca

SEQ ID NO: 4557070 - DNA, 17 bp, Homo sapiens
ccagatctgtctccaag

SEQ ID NO: 4557071 - DNA, 17 bp, Homo sapiens
ccagatgcaacctcact

SEQ ID NO: 4557072 - DNA, 13 bp, Homo sapiens
ccagatggcccct

SEQ ID NO: 4557073 - DNA, 20 bp, Homo sapiens
ccagatgtaaagaacgcgac

SEQ ID NO: 4557074 - DNA, 14 bp, Homo sapiens
ccagattctgcctc

SEQ ID NO: 4557075 - DNA, 16 bp, Homo sapiens
ccagattctgcctctc

SEQ ID NO: 4557076 - DNA, 19 bp, Homo sapiens
ccagattctgcctctctgg

SEQ ID NO: 4557077 - DNA, 16 bp, Homo sapiens
ccagattggctcacac

SEQ ID NO: 4557078 - DNA, 12 bp, Homo sapiens
ccagatttgtct

SEQ ID NO: 4557079 - DNA, 15 bp, Homo sapiens
ccagatttgtctttt

SEQ ID NO: 4557080 - DNA, 20 bp, Homo sapiens
ccagcaaagtgattccctgc

SEQ ID NO: 4557081 - DNA, 15 bp, Homo sapiens
ccagcaaatgggcat

SEQ ID NO: 4557082 - DNA, 17 bp, Homo sapiens
ccagcaagcgggagccc

SEQ ID NO: 4557083 - DNA, 19 bp, Homo sapiens
ccagcacagcttagatttc

SEQ ID NO: 4557084 - DNA, 22 bp, Homo sapiens
ccagcacagcttagatttcata

SEQ ID NO: 4557085 - DNA, 20 bp, Homo sapiens
ccagcacattatcttcatat

SEQ ID NO: 4557086 - DNA, 20 bp, Homo sapiens
ccagcaccctctcctggggg

SEQ ID NO: 4557087 - DNA, 23 bp, Homo sapiens
ccagcaccctctcctgggggtgg

SEQ ID NO: 4557088 - DNA, 13 bp, Homo sapiens
ccagcactgagga

SEQ ID NO: 4557089 - DNA, 22 bp, Homo sapiens
ccagcactgaggaagaacgggg

SEQ ID NO: 4557090 - DNA, 15 bp, Homo sapiens
ccagcactgcttgag

SEQ ID NO: 4557091 - DNA, 22 bp, Homo sapiens
ccagcactgcttgaggaaaaca

SEQ ID NO: 4557092 - DNA, 19 bp, Homo sapiens
ccagcactttgagaggctg

SEQ ID NO: 4557093 - DNA, 19 bp, Homo sapiens
ccagcactttgggaggcag

SEQ ID NO: 4557094 - DNA, 20 bp, Homo sapiens
ccagcactttgggaggcagg

SEQ ID NO: 4557095 - DNA, 20 bp, Homo sapiens
ccagcactttgggaggccga

SEQ ID NO: 4557096 - DNA, 21 bp, Homo sapiens
ccagcagagccagggcagggc

SEQ ID NO: 4557097 - DNA, 22 bp, Homo sapiens
ccagcagagccagggcagggcg

SEQ ID NO: 4557098 - DNA, 16 bp, Homo sapiens
ccagcagaggcaggct

SEQ ID NO: 4557099 - DNA, 22 bp, Homo sapiens
ccagcagaggcaggctgggacg

SEQ ID NO: 4557100 - DNA, 17 bp, Homo sapiens
ccagcagcaactgaaaa

SEQ ID NO: 4557101 - DNA, 21 bp, Homo sapiens
ccagcagcaactgaaaatgaa

SEQ ID NO: 4557102 - DNA, 12 bp, Homo sapiens
ccagcagcagca

SEQ ID NO: 4557103 - DNA, 13 bp, Homo sapiens
ccagcagcatggc

SEQ ID NO: 4557104 - DNA, 21 bp, Homo sapiens
ccagcagcccctgagagcctg

SEQ ID NO: 4557105 - DNA, 14 bp, Homo sapiens
ccagcagctgtcag

SEQ ID NO: 4557106 - DNA, 21 bp, Homo sapiens
ccagcagcttaagtccagctc

SEQ ID NO: 4557107 - DNA, 21 bp, Homo sapiens
ccagcaggagagactgagcag

SEQ ID NO: 4557108 - DNA, 20 bp, Homo sapiens
ccagcaggccagggactcag

SEQ ID NO: 4557109 - DNA, 17 bp, Homo sapiens
ccagcagtacaataaaa

SEQ ID NO: 4557110 - DNA, 21 bp, Homo sapiens
ccagcagtacaataaaagtaa

SEQ ID NO: 4557111 - DNA, 21 bp, Homo sapiens
ccagcagtgtggagaccctgc

SEQ ID NO: 4557112 - DNA, 16 bp, Homo sapiens
ccagcatccctggagc

SEQ ID NO: 4557113 - DNA, 17 bp, Homo sapiens
ccagcatccctggagca

SEQ ID NO: 4557114 - DNA, 18 bp, Homo sapiens
ccagcatctggaagatgt

SEQ ID NO: 4557115 - DNA, 19 bp, Homo sapiens
ccagcattccagacttcaa

SEQ ID NO: 4557116 - DNA, 15 bp, Homo sapiens
ccagcattccagctc

SEQ ID NO: 4557117 - DNA, 21 bp, Homo sapiens
ccagcattccagctctgcccc

SEQ ID NO: 4557118 - DNA, 20 bp, Homo sapiens
ccagcatttaagtgaccttc

SEQ ID NO: 4557119 - DNA, 22 bp, Homo sapiens
ccagcatttaagtgaccttctg

SEQ ID NO: 4557120 - DNA, 21 bp, Homo sapiens
ccagcatttcccttccttcct

SEQ ID NO: 4557121 - DNA, 18 bp, Homo sapiens
ccagccaagggtcctcac

SEQ ID NO: 4557122 - DNA, 14 bp, Homo sapiens
ccagccacaggcca

SEQ ID NO: 4557123 - DNA, 21 bp, Homo sapiens
ccagccaccccgggctctctg

SEQ ID NO: 4557124 - DNA, 12 bp, Homo sapiens
ccagccagcgcc

SEQ ID NO: 4557125 - DNA, 15 bp, Homo sapiens
ccagccagcgcctcc

SEQ ID NO: 4557126 - DNA, 16 bp, Homo sapiens
ccagccagcgcctccc

SEQ ID NO: 4557127 - DNA, 22 bp, Homo sapiens
ccagccagcgcctccctccacc

SEQ ID NO: 4557128 - DNA, 16 bp, Homo sapiens
ccagccaggccaacag

SEQ ID NO: 4557129 - DNA, 17 bp, Homo sapiens
ccagccaggccaacagc

SEQ ID NO: 4557130 - DNA, 21 bp, Homo sapiens
ccagccatacttatctctctg

SEQ ID NO: 4557131 - DNA, 22 bp, Homo sapiens
ccagccatacttatctctctgt

SEQ ID NO: 4557132 - DNA, 18 bp, Homo sapiens
ccagcccacagagcctga

SEQ ID NO: 4557133 - DNA, 12 bp, Homo sapiens
ccagcccagccc

SEQ ID NO: 4557134 - DNA, 18 bp, Homo sapiens
ccagcccagcccagctgg

SEQ ID NO: 4557135 - DNA, 17 bp, Homo sapiens
ccagcccatggccccca

SEQ ID NO: 4557136 - DNA, 19 bp, Homo sapiens
ccagcccattctctctcct

SEQ ID NO: 4557137 - DNA, 21 bp, Homo sapiens
ccagcccattctctctcctgt

SEQ ID NO: 4557138 - DNA, 22 bp, Homo sapiens
ccagcccattggccgagctcct

SEQ ID NO: 4557139 - DNA, 23 bp, Homo sapiens
ccagcccattggccgagctcctg

SEQ ID NO: 4557140 - DNA, 16 bp, Homo sapiens
ccagccccacccagga

SEQ ID NO: 4557141 - DNA, 18 bp, Homo sapiens
ccagccccacccaggagg

SEQ ID NO: 4557142 - DNA, 17 bp, Homo sapiens
ccagccccagccccttc

SEQ ID NO: 4557143 - DNA, 21 bp, Homo sapiens
ccagcccccacagtgctgtct

SEQ ID NO: 4557144 - DNA, 18 bp, Homo sapiens
ccagcccccgccccagag

SEQ ID NO: 4557145 - DNA, 23 bp, Homo sapiens
ccagccccctcccaccgctgcct

SEQ ID NO: 4557146 - DNA, 21 bp, Homo sapiens
ccagccccctttgggcccagg

SEQ ID NO: 4557147 - DNA, 18 bp, Homo sapiens
ccagccccgactccagcc

SEQ ID NO: 4557148 - DNA, 19 bp, Homo sapiens
ccagccccgactccagcca

SEQ ID NO: 4557149 - DNA, 22 bp, Homo sapiens
ccagccccgactccagccagcg

SEQ ID NO: 4557150 - DNA, 17 bp, Homo sapiens
ccagccccggcaagcca

SEQ ID NO: 4557151 - DNA, 19 bp, Homo sapiens
ccagccccggcaagccaca

SEQ ID NO: 4557152 - DNA, 17 bp, Homo sapiens
ccagccccggccctggg

SEQ ID NO: 4557153 - DNA, 20 bp, Homo sapiens
ccagcccctccccagactct

SEQ ID NO: 4557154 - DNA, 14 bp, Homo sapiens
ccagcccctcctcc

SEQ ID NO: 4557155 - DNA, 15 bp, Homo sapiens
ccagcccctcctccc

SEQ ID NO: 4557156 - DNA, 18 bp, Homo sapiens
ccagcccctcctccctca

SEQ ID NO: 4557157 - DNA, 22 bp, Homo sapiens
ccagcccctcctccctcagacc

SEQ ID NO: 4557158 - DNA, 23 bp, Homo sapiens
ccagcccctcctccctcagaccc

SEQ ID NO: 4557159 - DNA, 15 bp, Homo sapiens
ccagcccctgcagat

SEQ ID NO: 4557160 - DNA, 15 bp, Homo sapiens
ccagcccctggggcc

SEQ ID NO: 4557161 - DNA, 22 bp, Homo sapiens
ccagcccctgtttactggttct

SEQ ID NO: 4557162 - DNA, 13 bp, Homo sapiens
ccagccctcatcc

SEQ ID NO: 4557163 - DNA, 13 bp, Homo sapiens
ccagccctccctg

SEQ ID NO: 4557164 - DNA, 19 bp, Homo sapiens
ccagccctccctgtcctcc

SEQ ID NO: 4557165 - DNA, 22 bp, Homo sapiens
ccagccctccctgtcctcctcg

SEQ ID NO: 4557166 - DNA, 14 bp, Homo sapiens
ccagccctgcagcc

SEQ ID NO: 4557167 - DNA, 11 bp, Homo sapiens
ccagccctgct

SEQ ID NO: 4557168 - DNA, 14 bp, Homo sapiens
ccagccctgctggc

SEQ ID NO: 4557169 - DNA, 16 bp, Homo sapiens
ccagccctggcccagg

SEQ ID NO: 4557170 - DNA, 20 bp, Homo sapiens
ccagccctggtctcagcagc

SEQ ID NO: 4557171 - DNA, 12 bp, Homo sapiens
ccagcccttccc

SEQ ID NO: 4557172 - DNA, 20 bp, Homo sapiens
ccagccgccattgccaccag

SEQ ID NO: 4557173 - DNA, 14 bp, Homo sapiens
ccagccgcccaccc

SEQ ID NO: 4557174 - DNA, 16 bp, Homo sapiens
ccagccgccctgggct

SEQ ID NO: 4557175 - DNA, 13 bp, Homo sapiens
ccagccggcatgg

SEQ ID NO: 4557176 - DNA, 17 bp, Homo sapiens
ccagcctatagcagaag

SEQ ID NO: 4557177 - DNA, 20 bp, Homo sapiens
ccagcctcagaaggccccag

SEQ ID NO: 4557178 - DNA, 13 bp, Homo sapiens
ccagcctcccctc

SEQ ID NO: 4557179 - DNA, 18 bp, Homo sapiens
ccagcctccgagagggag

SEQ ID NO: 4557180 - DNA, 13 bp, Homo sapiens
ccagcctcctctg

SEQ ID NO: 4557181 - DNA, 14 bp, Homo sapiens
ccagcctcctctgg

SEQ ID NO: 4557182 - DNA, 15 bp, Homo sapiens
ccagcctcctctgga

SEQ ID NO: 4557183 - DNA, 16 bp, Homo sapiens
ccagcctcctctggac

SEQ ID NO: 4557184 - DNA, 12 bp, Homo sapiens
ccagcctctgcc

SEQ ID NO: 4557185 - DNA, 15 bp, Homo sapiens
ccagcctctgttccc

SEQ ID NO: 4557186 - DNA, 16 bp, Homo sapiens
ccagcctgagtgacag

SEQ ID NO: 4557187 - DNA, 16 bp, Homo sapiens
ccagcctgcacccctc

SEQ ID NO: 4557188 - DNA, 17 bp, Homo sapiens
ccagcctggatgccatc

SEQ ID NO: 4557189 - DNA, 16 bp, Homo sapiens
ccagcctgggagccca

SEQ ID NO: 4557190 - DNA, 22 bp, Homo sapiens
ccagcctgggcagccaggctgc

SEQ ID NO: 4557191 - DNA, 14 bp, Homo sapiens
ccagcctggtcaac

SEQ ID NO: 4557192 - DNA, 12 bp, Homo sapiens
ccagcctgtcca

SEQ ID NO: 4557193 - DNA, 15 bp, Homo sapiens
ccagccttctctcaa

SEQ ID NO: 4557194 - DNA, 17 bp, Homo sapiens
ccagccttgagccctgg

SEQ ID NO: 4557195 - DNA, 14 bp, Homo sapiens
ccagccttgcccag

SEQ ID NO: 4557196 - DNA, 16 bp, Homo sapiens
ccagccttgcccagct

SEQ ID NO: 4557197 - DNA, 15 bp, Homo sapiens
ccagcgatggtgctg

SEQ ID NO: 4557198 - DNA, 13 bp, Homo sapiens
ccagcgcctccct

SEQ ID NO: 4557199 - DNA, 19 bp, Homo sapiens
ccagcgcctccctccaccc

SEQ ID NO: 4557200 - DNA, 21 bp, Homo sapiens
ccagcgcctccctccacccca

SEQ ID NO: 4557201 - DNA, 15 bp, Homo sapiens
ccagcggctccaact

SEQ ID NO: 4557202 - DNA, 14 bp, Homo sapiens
ccagcggggctgct

SEQ ID NO: 4557203 - DNA, 13 bp, Homo sapiens
ccagcgtcagaag

SEQ ID NO: 4557204 - DNA, 14 bp, Homo sapiens
ccagctaatttttg

SEQ ID NO: 4557205 - DNA, 17 bp, Homo sapiens
ccagctaatttttgtat

SEQ ID NO: 4557206 - DNA, 17 bp, Homo sapiens
ccagctaccaagtcaga

SEQ ID NO: 4557207 - DNA, 22 bp, Homo sapiens
ccagctactcaggaggctgaga

SEQ ID NO: 4557208 - DNA, 23 bp, Homo sapiens
ccagctaggaagagcaggactcc

SEQ ID NO: 4557209 - DNA, 13 bp, Homo sapiens
ccagctcaccccc

SEQ ID NO: 4557210 - DNA, 17 bp, Homo sapiens
ccagctcaccccccaca

SEQ ID NO: 4557211 - DNA, 19 bp, Homo sapiens
ccagctcaccccccacact

SEQ ID NO: 4557212 - DNA, 16 bp, Homo sapiens
ccagctcatttcagtt

SEQ ID NO: 4557213 - DNA, 23 bp, Homo sapiens
ccagctcccacaccgcgtcccag

SEQ ID NO: 4557214 - DNA, 18 bp, Homo sapiens
ccagctcctttctcctgt

SEQ ID NO: 4557215 - DNA, 22 bp, Homo sapiens
ccagctcctttctcctgtgaat

SEQ ID NO: 4557216 - DNA, 23 bp, Homo sapiens
ccagctctccctctggccctgcc

SEQ ID NO: 4557217 - DNA, 20 bp, Homo sapiens
ccagctctgaaaccagtgtt

SEQ ID NO: 4557218 - DNA, 18 bp, Homo sapiens
ccagctctgtatcaggac

SEQ ID NO: 4557219 - DNA, 15 bp, Homo sapiens
ccagctgcaaagtgt

SEQ ID NO: 4557220 - DNA, 16 bp, Homo sapiens
ccagctgcgcttgctt

SEQ ID NO: 4557221 - DNA, 17 bp, Homo sapiens
ccagctgcgcttgcttt

SEQ ID NO: 4557222 - DNA, 20 bp, Homo sapiens
ccagctgcgcttgcttttct

SEQ ID NO: 4557223 - DNA, 16 bp, Homo sapiens
ccagctgcggccaggc

SEQ ID NO: 4557224 - DNA, 21 bp, Homo sapiens
ccagctgctgagatcctggac

SEQ ID NO: 4557225 - DNA, 20 bp, Homo sapiens
ccagctgggaagcccttttt

SEQ ID NO: 4557226 - DNA, 17 bp, Homo sapiens
ccagctgggagcactgg

SEQ ID NO: 4557227 - DNA, 16 bp, Homo sapiens
ccagctggggccagag

SEQ ID NO: 4557228 - DNA, 17 bp, Homo sapiens
ccagctggggccagagg

SEQ ID NO: 4557229 - DNA, 19 bp, Homo sapiens
ccagctggggccagaggct

SEQ ID NO: 4557230 - DNA, 21 bp, Homo sapiens
ccagctggggccagaggctgg

SEQ ID NO: 4557231 - DNA, 17 bp, Homo sapiens
ccagctgtgctgtggag

SEQ ID NO: 4557232 - DNA, 20 bp, Homo sapiens
ccagctgtgggcggctcctg

SEQ ID NO: 4557233 - DNA, 21 bp, Homo sapiens
ccagcttaaacccatacaatg

SEQ ID NO: 4557234 - DNA, 16 bp, Homo sapiens
ccagcttaatagctgt

SEQ ID NO: 4557235 - DNA, 13 bp, Homo sapiens
ccagcttcccgag

SEQ ID NO: 4557236 - DNA, 16 bp, Homo sapiens
ccagcttgctcttcag

SEQ ID NO: 4557237 - DNA, 17 bp, Homo sapiens
ccagcttgtggagcccc

SEQ ID NO: 4557238 - DNA, 19 bp, Homo sapiens
ccagcttgtggagccccac

SEQ ID NO: 4557239 - DNA, 22 bp, Homo sapiens
ccagcttgtggagccccacact

SEQ ID NO: 4557240 - DNA, 23 bp, Homo sapiens
ccagcttgtggagccccacactg

SEQ ID NO: 4557241 - DNA, 14 bp, Homo sapiens
ccagctttccctgc

SEQ ID NO: 4557242 - DNA, 21 bp, Homo sapiens
ccagcttttaaccatctgata

SEQ ID NO: 4557243 - DNA, 19 bp, Homo sapiens
ccaggaaactccacatctg

SEQ ID NO: 4557244 - DNA, 13 bp, Homo sapiens
ccaggaaagaaac

SEQ ID NO: 4557245 - DNA, 23 bp, Homo sapiens
ccaggaaagagcagtcagagtcc

SEQ ID NO: 4557246 - DNA, 19 bp, Homo sapiens
ccaggaaaggacggctgag

SEQ ID NO: 4557247 - DNA, 20 bp, Homo sapiens
ccaggaagattttaaaggac

SEQ ID NO: 4557248 - DNA, 13 bp, Homo sapiens
ccaggaagccaga

SEQ ID NO: 4557249 - DNA, 17 bp, Homo sapiens
ccaggaagccagagccc

SEQ ID NO: 4557250 - DNA, 18 bp, Homo sapiens
ccaggaagccagagcccc

SEQ ID NO: 4557251 - DNA, 11 bp, Homo sapiens
ccaggaagccg

SEQ ID NO: 4557252 - DNA, 22 bp, Homo sapiens
ccaggaaggccaaaatcaagag

SEQ ID NO: 4557253 - DNA, 23 bp, Homo sapiens
ccaggaagggccattttggtgct

SEQ ID NO: 4557254 - DNA, 16 bp, Homo sapiens
ccaggaagtggctcag

SEQ ID NO: 4557255 - DNA, 19 bp, Homo sapiens
ccaggacactaccctgaga

SEQ ID NO: 4557256 - DNA, 20 bp, Homo sapiens
ccaggacccccgaggggagg

SEQ ID NO: 4557257 - DNA, 21 bp, Homo sapiens
ccaggaccctgacctccgccc

SEQ ID NO: 4557258 - DNA, 19 bp, Homo sapiens
ccaggacctcggatgacca

SEQ ID NO: 4557259 - DNA, 14 bp, Homo sapiens
ccaggacgccactc

SEQ ID NO: 4557260 - DNA, 19 bp, Homo sapiens
ccaggacgtctggggtgtg

SEQ ID NO: 4557261 - DNA, 14 bp, Homo sapiens
ccaggactccctcc

SEQ ID NO: 4557262 - DNA, 18 bp, Homo sapiens
ccaggactccctcctcac

SEQ ID NO: 4557263 - DNA, 12 bp, Homo sapiens
ccaggactgggc

SEQ ID NO: 4557264 - DNA, 17 bp, Homo sapiens
ccaggactgggccactt

SEQ ID NO: 4557265 - DNA, 12 bp, Homo sapiens
ccaggagaactg

SEQ ID NO: 4557266 - DNA, 15 bp, Homo sapiens
ccaggagacagacca

SEQ ID NO: 4557267 - DNA, 22 bp, Homo sapiens
ccaggagacagaccacttgcca

SEQ ID NO: 4557268 - DNA, 19 bp, Homo sapiens
ccaggagagccagccctcc

SEQ ID NO: 4557269 - DNA, 20 bp, Homo sapiens
ccaggagagccagccctccc

SEQ ID NO: 4557270 - DNA, 14 bp, Homo sapiens
ccaggagattacaa

SEQ ID NO: 4557271 - DNA, 19 bp, Homo sapiens
ccaggagcagccctggccc

SEQ ID NO: 4557272 - DNA, 22 bp, Homo sapiens
ccaggagcaggacctactagga

SEQ ID NO: 4557273 - DNA, 13 bp, Homo sapiens
ccaggagctaatc

SEQ ID NO: 4557274 - DNA, 23 bp, Homo sapiens
ccaggaggaacaaagagattgtg

SEQ ID NO: 4557275 - DNA, 17 bp, Homo sapiens
ccaggagtccagcccct

SEQ ID NO: 4557276 - DNA, 22 bp, Homo sapiens
ccaggagtccagcccctcctcc

SEQ ID NO: 4557277 - DNA, 15 bp, Homo sapiens
ccaggagtccaggcc

SEQ ID NO: 4557278 - DNA, 16 bp, Homo sapiens
ccaggagtccaggccc

SEQ ID NO: 4557279 - DNA, 17 bp, Homo sapiens
ccaggagtgcccccggg

SEQ ID NO: 4557280 - DNA, 18 bp, Homo sapiens
ccaggagtgcccccggga

SEQ ID NO: 4557281 - DNA, 20 bp, Homo sapiens
ccaggagtttgaggttacag

SEQ ID NO: 4557282 - DNA, 21 bp, Homo sapiens
ccaggatactggcacagaggt

SEQ ID NO: 4557283 - DNA, 20 bp, Homo sapiens
ccaggatctttgactgaaaa

SEQ ID NO: 4557284 - DNA, 15 bp, Homo sapiens
ccaggcacacacagc

SEQ ID NO: 4557285 - DNA, 15 bp, Homo sapiens
ccaggcacacactgt

SEQ ID NO: 4557286 - DNA, 16 bp, Homo sapiens
ccaggcaccctcaggg

SEQ ID NO: 4557287 - DNA, 19 bp, Homo sapiens
ccaggcaccctcagggagc

SEQ ID NO: 4557288 - DNA, 18 bp, Homo sapiens
ccaggcacgaacccacct

SEQ ID NO: 4557289 - DNA, 19 bp, Homo sapiens
ccaggcacgaacccacctg

SEQ ID NO: 4557290 - DNA, 22 bp, Homo sapiens
ccaggcacgaacccacctgctg

SEQ ID NO: 4557291 - DNA, 23 bp, Homo sapiens
ccaggcacgaacccacctgctga

SEQ ID NO: 4557292 - DNA, 20 bp, Homo sapiens
ccaggcagatctgtgcccca

SEQ ID NO: 4557293 - DNA, 23 bp, Homo sapiens
ccaggcagatctgtgccccatgc

SEQ ID NO: 4557294 - DNA, 19 bp, Homo sapiens
ccaggcagcctccgggcgt

SEQ ID NO: 4557295 - DNA, 15 bp, Homo sapiens
ccaggcaggggtggg

SEQ ID NO: 4557296 - DNA, 22 bp, Homo sapiens
ccaggcaggggtgggggtggag

SEQ ID NO: 4557297 - DNA, 21 bp, Homo sapiens
ccaggcatccatcttggaaga

SEQ ID NO: 4557298 - DNA, 16 bp, Homo sapiens
ccaggcattgccaagg

SEQ ID NO: 4557299 - DNA, 15 bp, Homo sapiens
ccaggcattggctca

SEQ ID NO: 4557300 - DNA, 17 bp, Homo sapiens
ccaggccaacagcacct

SEQ ID NO: 4557301 - DNA, 11 bp, Homo sapiens
ccaggccacag

SEQ ID NO: 4557302 - DNA, 12 bp, Homo sapiens
ccaggccacaga

SEQ ID NO: 4557303 - DNA, 13 bp, Homo sapiens
ccaggccagagca

SEQ ID NO: 4557304 - DNA, 11 bp, Homo sapiens
ccaggccagca

SEQ ID NO: 4557305 - DNA, 19 bp, Homo sapiens
ccaggccagcaggcgggct

SEQ ID NO: 4557306 - DNA, 13 bp, Homo sapiens
ccaggccagcctc

SEQ ID NO: 4557307 - DNA, 14 bp, Homo sapiens
ccaggccagcctcc

SEQ ID NO: 4557308 - DNA, 18 bp, Homo sapiens
ccaggccaggtgcccagg

SEQ ID NO: 4557309 - DNA, 15 bp, Homo sapiens
ccaggcccaaggctc

SEQ ID NO: 4557310 - DNA, 13 bp, Homo sapiens
ccaggccccagac

SEQ ID NO: 4557311 - DNA, 16 bp, Homo sapiens
ccaggccccagacagg

SEQ ID NO: 4557312 - DNA, 15 bp, Homo sapiens
ccaggccccagcctc

SEQ ID NO: 4557313 - DNA, 17 bp, Homo sapiens
ccaggccccagcctcca

SEQ ID NO: 4557314 - DNA, 14 bp, Homo sapiens
ccaggccccagggg

SEQ ID NO: 4557315 - DNA, 15 bp, Homo sapiens
ccaggcccccaaccc

SEQ ID NO: 4557316 - DNA, 15 bp, Homo sapiens
ccaggcccccaactc

SEQ ID NO: 4557317 - DNA, 21 bp, Homo sapiens
ccaggccccgaggacccagac

SEQ ID NO: 4557318 - DNA, 15 bp, Homo sapiens
ccaggcccctggagg

SEQ ID NO: 4557319 - DNA, 15 bp, Homo sapiens
ccaggcccggggctg

SEQ ID NO: 4557320 - DNA, 16 bp, Homo sapiens
ccaggcccggggctgg

SEQ ID NO: 4557321 - DNA, 21 bp, Homo sapiens
ccaggcccggggctggcggct

SEQ ID NO: 4557322 - DNA, 14 bp, Homo sapiens
ccaggccggcccag

SEQ ID NO: 4557323 - DNA, 22 bp, Homo sapiens
ccaggccggcccagatgtgtcc

SEQ ID NO: 4557324 - DNA, 17 bp, Homo sapiens
ccaggcctctctctgct

SEQ ID NO: 4557325 - DNA, 13 bp, Homo sapiens
ccaggcctctgct

SEQ ID NO: 4557326 - DNA, 16 bp, Homo sapiens
ccaggcctcttggcag

SEQ ID NO: 4557327 - DNA, 13 bp, Homo sapiens
ccaggcctgcatt

SEQ ID NO: 4557328 - DNA, 22 bp, Homo sapiens
ccaggcctgcgggcccctggtg

SEQ ID NO: 4557329 - DNA, 12 bp, Homo sapiens
ccaggcctggct

SEQ ID NO: 4557330 - DNA, 16 bp, Homo sapiens
ccaggcctgtccaccc

SEQ ID NO: 4557331 - DNA, 21 bp, Homo sapiens
ccaggcctgtccaccctgcca

SEQ ID NO: 4557332 - DNA, 20 bp, Homo sapiens
ccaggcgctgcatacagggg

SEQ ID NO: 4557333 - DNA, 23 bp, Homo sapiens
ccaggcgctgcatacaggggagg

SEQ ID NO: 4557334 - DNA, 23 bp, Homo sapiens
ccaggctcgtggactgagtggga

SEQ ID NO: 4557335 - DNA, 13 bp, Homo sapiens
ccaggctctgtgc

SEQ ID NO: 4557336 - DNA, 15 bp, Homo sapiens
ccaggctctgtgctg

SEQ ID NO: 4557337 - DNA, 20 bp, Homo sapiens
ccaggctctgtgctgaccct

SEQ ID NO: 4557338 - DNA, 22 bp, Homo sapiens
ccaggctctgtgctgaccctcc

SEQ ID NO: 4557339 - DNA, 19 bp, Homo sapiens
ccaggctgccaaggccaga

SEQ ID NO: 4557340 - DNA, 21 bp, Homo sapiens
ccaggctgcctcctgccctta

SEQ ID NO: 4557341 - DNA, 21 bp, Homo sapiens
ccaggctggagtgcagtggca

SEQ ID NO: 4557342 - DNA, 12 bp, Homo sapiens
ccaggctggcca

SEQ ID NO: 4557343 - DNA, 18 bp, Homo sapiens
ccaggctgttctcagcgt

SEQ ID NO: 4557344 - DNA, 23 bp, Homo sapiens
ccaggcttaaggagaggagaaac

SEQ ID NO: 4557345 - DNA, 15 bp, Homo sapiens
ccagggaaacagcct

SEQ ID NO: 4557346 - DNA, 17 bp, Homo sapiens
ccagggaaacagcctct

SEQ ID NO: 4557347 - DNA, 22 bp, Homo sapiens
ccagggaaacagcctctctctt

SEQ ID NO: 4557348 - DNA, 18 bp, Homo sapiens
ccagggaagctggccgag

SEQ ID NO: 4557349 - DNA, 16 bp, Homo sapiens
ccagggaattcttaca

SEQ ID NO: 4557350 - DNA, 15 bp, Homo sapiens
ccagggacaccagcc

SEQ ID NO: 4557351 - DNA, 17 bp, Homo sapiens
ccagggacaccagccag

SEQ ID NO: 4557352 - DNA, 18 bp, Homo sapiens
ccagggacaccagccagg

SEQ ID NO: 4557353 - DNA, 23 bp, Homo sapiens
ccagggacaccagccaggctctg

SEQ ID NO: 4557354 - DNA, 17 bp, Homo sapiens
ccagggactatctttgc

SEQ ID NO: 4557355 - DNA, 22 bp, Homo sapiens
ccagggagcttgaaagttttca

SEQ ID NO: 4557356 - DNA, 16 bp, Homo sapiens
ccagggagtccagggt

SEQ ID NO: 4557357 - DNA, 20 bp, Homo sapiens
ccagggatgattcaagccat

SEQ ID NO: 4557358 - DNA, 13 bp, Homo sapiens
ccagggatgctgg

SEQ ID NO: 4557359 - DNA, 17 bp, Homo sapiens
ccagggatgctgggctg

SEQ ID NO: 4557360 - DNA, 19 bp, Homo sapiens
ccagggatgctgggctggg

SEQ ID NO: 4557361 - DNA, 21 bp, Homo sapiens
ccagggatgggggatgggcca

SEQ ID NO: 4557362 - DNA, 14 bp, Homo sapiens
ccagggcacccagg

SEQ ID NO: 4557363 - DNA, 15 bp, Homo sapiens
ccagggcactgccag

SEQ ID NO: 4557364 - DNA, 19 bp, Homo sapiens
ccagggcactgccagccca

SEQ ID NO: 4557365 - DNA, 11 bp, Homo sapiens
ccagggcaggg

SEQ ID NO: 4557366 - DNA, 20 bp, Homo sapiens
ccagggcagggcgagctgca

SEQ ID NO: 4557367 - DNA, 22 bp, Homo sapiens
ccagggcagggcgagctgcagg

SEQ ID NO: 4557368 - DNA, 15 bp, Homo sapiens
ccagggcatctggga

SEQ ID NO: 4557369 - DNA, 19 bp, Homo sapiens
ccagggccacgctccagct

SEQ ID NO: 4557370 - DNA, 22 bp, Homo sapiens
ccagggccacgtgccaggcccg

SEQ ID NO: 4557371 - DNA, 21 bp, Homo sapiens
ccagggcccccaccgaggttc

SEQ ID NO: 4557372 - DNA, 22 bp, Homo sapiens
ccagggcctgacttgagccact

SEQ ID NO: 4557373 - DNA, 13 bp, Homo sapiens
ccagggctccagg

SEQ ID NO: 4557374 - DNA, 20 bp, Homo sapiens
ccagggctccaggagcctca

SEQ ID NO: 4557375 - DNA, 17 bp, Homo sapiens
ccagggctggagacttc

SEQ ID NO: 4557376 - DNA, 11 bp, Homo sapiens
ccagggctggg

SEQ ID NO: 4557377 - DNA, 18 bp, Homo sapiens
ccagggctggggacagag

SEQ ID NO: 4557378 - DNA, 21 bp, Homo sapiens
ccagggctggggttgccagag

SEQ ID NO: 4557379 - DNA, 23 bp, Homo sapiens
ccagggctggggttgccagaggc

SEQ ID NO: 4557380 - DNA, 13 bp, Homo sapiens
ccaggggaacctg

SEQ ID NO: 4557381 - DNA, 14 bp, Homo sapiens
ccaggggaaggccc

SEQ ID NO: 4557382 - DNA, 20 bp, Homo sapiens
ccaggggaaggccctgaggc

SEQ ID NO: 4557383 - DNA, 19 bp, Homo sapiens
ccaggggaagggtcccttt

SEQ ID NO: 4557384 - DNA, 15 bp, Homo sapiens
ccaggggcagccaca

SEQ ID NO: 4557385 - DNA, 23 bp, Homo sapiens
ccaggggcagccacaccactgcc

SEQ ID NO: 4557386 - DNA, 20 bp, Homo sapiens
ccaggggccaacctcaggct

SEQ ID NO: 4557387 - DNA, 22 bp, Homo sapiens
ccaggggccaacctcaggctcc

SEQ ID NO: 4557388 - DNA, 18 bp, Homo sapiens
ccaggggcccctccagct

SEQ ID NO: 4557389 - DNA, 19 bp, Homo sapiens
ccaggggcccctccagctt

SEQ ID NO: 4557390 - DNA, 22 bp, Homo sapiens
ccagggggatatgggtcctctg

SEQ ID NO: 4557391 - DNA, 23 bp, Homo sapiens
ccagggggatatgggtcctctgg

SEQ ID NO: 4557392 - DNA, 14 bp, Homo sapiens
ccagggtagcccgc

SEQ ID NO: 4557393 - DNA, 21 bp, Homo sapiens
ccagggtagcccgcctgccag

SEQ ID NO: 4557394 - DNA, 22 bp, Homo sapiens
ccagggtcctctcttccacagt

SEQ ID NO: 4557395 - DNA, 17 bp, Homo sapiens
ccagggtggccacacag

SEQ ID NO: 4557396 - DNA, 21 bp, Homo sapiens
ccagggtggccacacaggcag

SEQ ID NO: 4557397 - DNA, 15 bp, Homo sapiens
ccagggtttctctgc

SEQ ID NO: 4557398 - DNA, 15 bp, Homo sapiens
ccaggtacacctccc

SEQ ID NO: 4557399 - DNA, 21 bp, Homo sapiens
ccaggtcccagcccctcctcc

SEQ ID NO: 4557400 - DNA, 23 bp, Homo sapiens
ccaggtcccagcccctcctccct

SEQ ID NO: 4557401 - DNA, 20 bp, Homo sapiens
ccaggtccgtagctcccctg

SEQ ID NO: 4557402 - DNA, 23 bp, Homo sapiens
ccaggtccgtagctcccctggct

SEQ ID NO: 4557403 - DNA, 13 bp, Homo sapiens
ccaggtctgcctg

SEQ ID NO: 4557404 - DNA, 21 bp, Homo sapiens
ccaggtgacacgcttctgagc

SEQ ID NO: 4557405 - DNA, 22 bp, Homo sapiens
ccaggtgacacgcttctgagca

SEQ ID NO: 4557406 - DNA, 17 bp, Homo sapiens
ccaggtgcccaggaaag

SEQ ID NO: 4557407 - DNA, 20 bp, Homo sapiens
ccaggtgccgacactgagct

SEQ ID NO: 4557408 - DNA, 12 bp, Homo sapiens
ccaggtgccttg

SEQ ID NO: 4557409 - DNA, 16 bp, Homo sapiens
ccaggtgcctttcaaa

SEQ ID NO: 4557410 - DNA, 12 bp, Homo sapiens
ccaggtggctca

SEQ ID NO: 4557411 - DNA, 17 bp, Homo sapiens
ccaggtggctgacccag

SEQ ID NO: 4557412 - DNA, 19 bp, Homo sapiens
ccaggtggctgacccagtc

SEQ ID NO: 4557413 - DNA, 23 bp, Homo sapiens
ccaggttaggaaggcagcattcc

SEQ ID NO: 4557414 - DNA, 16 bp, Homo sapiens
ccaggttcccccagca

SEQ ID NO: 4557415 - DNA, 19 bp, Homo sapiens
ccaggttcccccagcaagc

SEQ ID NO: 4557416 - DNA, 22 bp, Homo sapiens
ccaggtttaagtagatttcatg

SEQ ID NO: 4557417 - DNA, 18 bp, Homo sapiens
ccagtacctagctggctc

SEQ ID NO: 4557418 - DNA, 23 bp, Homo sapiens
ccagtacgtcccgctgctgtgct

SEQ ID NO: 4557419 - DNA, 13 bp, Homo sapiens
ccagtacttgtca

SEQ ID NO: 4557420 - DNA, 14 bp, Homo sapiens
ccagtacttgtcat

SEQ ID NO: 4557421 - DNA, 13 bp, Homo sapiens
ccagtagcccaga

SEQ ID NO: 4557422 - DNA, 15 bp, Homo sapiens
ccagtatgagcccta

SEQ ID NO: 4557423 - DNA, 15 bp, Homo sapiens
ccagtattgccccct

SEQ ID NO: 4557424 - DNA, 17 bp, Homo sapiens
ccagtatttagaagcca

SEQ ID NO: 4557425 - DNA, 13 bp, Homo sapiens
ccagtcagcctct

SEQ ID NO: 4557426 - DNA, 14 bp, Homo sapiens
ccagtcagcctctc

SEQ ID NO: 4557427 - DNA, 17 bp, Homo sapiens
ccagtcagcctctctcc

SEQ ID NO: 4557428 - DNA, 22 bp, Homo sapiens
ccagtcagcctctctcccagtc

SEQ ID NO: 4557429 - DNA, 12 bp, Homo sapiens
ccagtcatggta

SEQ ID NO: 4557430 - DNA, 19 bp, Homo sapiens
ccagtcatggtactacccc

SEQ ID NO: 4557431 - DNA, 20 bp, Homo sapiens
ccagtcatggtactacccca

SEQ ID NO: 4557432 - DNA, 21 bp, Homo sapiens
ccagtcattttattttgtaat

SEQ ID NO: 4557433 - DNA, 17 bp, Homo sapiens
ccagtccatgctccagg

SEQ ID NO: 4557434 - DNA, 19 bp, Homo sapiens
ccagtcccagacaattcca

SEQ ID NO: 4557435 - DNA, 17 bp, Homo sapiens
ccagtccccacccctgc

SEQ ID NO: 4557436 - DNA, 18 bp, Homo sapiens
ccagtccccacccctgcc

SEQ ID NO: 4557437 - DNA, 19 bp, Homo sapiens
ccagtccccatttctgcct

SEQ ID NO: 4557438 - DNA, 20 bp, Homo sapiens
ccagtccccatttctgcctc

SEQ ID NO: 4557439 - DNA, 13 bp, Homo sapiens
ccagtcctccact

SEQ ID NO: 4557440 - DNA, 15 bp, Homo sapiens
ccagtcctgcccgcc

SEQ ID NO: 4557441 - DNA, 22 bp, Homo sapiens
ccagtcctgcctggccaggcag

SEQ ID NO: 4557442 - DNA, 20 bp, Homo sapiens
ccagtcgtcatcagatgctt

SEQ ID NO: 4557443 - DNA, 16 bp, Homo sapiens
ccagtctacccagaga

SEQ ID NO: 4557444 - DNA, 23 bp, Homo sapiens
ccagtctcatcctcccattgccc

SEQ ID NO: 4557445 - DNA, 12 bp, Homo sapiens
ccagtctgatta

SEQ ID NO: 4557446 - DNA, 13 bp, Homo sapiens
ccagtcttttgtc

SEQ ID NO: 4557447 - DNA, 15 bp, Homo sapiens
ccagtcttttgtcct

SEQ ID NO: 4557448 - DNA, 14 bp, Homo sapiens
ccagtgaactcctg

SEQ ID NO: 4557449 - DNA, 15 bp, Homo sapiens
ccagtgaactcctgc

SEQ ID NO: 4557450 - DNA, 17 bp, Homo sapiens
ccagtgaactcctgcca

SEQ ID NO: 4557451 - DNA, 17 bp, Homo sapiens
ccagtgaagtccttcag

SEQ ID NO: 4557452 - DNA, 20 bp, Homo sapiens
ccagtgaatttttgcaataa

SEQ ID NO: 4557453 - DNA, 14 bp, Homo sapiens
ccagtgacaacatc

SEQ ID NO: 4557454 - DNA, 17 bp, Homo sapiens
ccagtgacttgcaatcc

SEQ ID NO: 4557455 - DNA, 19 bp, Homo sapiens
ccagtgagactgccccacg

SEQ ID NO: 4557456 - DNA, 12 bp, Homo sapiens
ccagtgagccct

SEQ ID NO: 4557457 - DNA, 16 bp, Homo sapiens
ccagtgagccctgctc

SEQ ID NO: 4557458 - DNA, 18 bp, Homo sapiens
ccagtgagccctgctctt

SEQ ID NO: 4557459 - DNA, 12 bp, Homo sapiens
ccagtgcagcca

SEQ ID NO: 4557460 - DNA, 15 bp, Homo sapiens
ccagtgcagggctgg

SEQ ID NO: 4557461 - DNA, 18 bp, Homo sapiens
ccagtgccactgcccccc

SEQ ID NO: 4557462 - DNA, 13 bp, Homo sapiens
ccagtgccgagga

SEQ ID NO: 4557463 - DNA, 18 bp, Homo sapiens
ccagtgccgaggacatgc

SEQ ID NO: 4557464 - DNA, 16 bp, Homo sapiens
ccagtgcctctccctg

SEQ ID NO: 4557465 - DNA, 19 bp, Homo sapiens
ccagtgcctctccctgctg

SEQ ID NO: 4557466 - DNA, 23 bp, Homo sapiens
ccagtgcctgtgagcatggggcc

SEQ ID NO: 4557467 - DNA, 19 bp, Homo sapiens
ccagtgccttacctcctgc

SEQ ID NO: 4557468 - DNA, 21 bp, Homo sapiens
ccagtgccttacctcctgccc

SEQ ID NO: 4557469 - DNA, 12 bp, Homo sapiens
ccagtgccttat

SEQ ID NO: 4557470 - DNA, 20 bp, Homo sapiens
ccagtgctcaccagccctgc

SEQ ID NO: 4557471 - DNA, 15 bp, Homo sapiens
ccagtgctctgcctc

SEQ ID NO: 4557472 - DNA, 14 bp, Homo sapiens
ccagtgctggattt

SEQ ID NO: 4557473 - DNA, 21 bp, Homo sapiens
ccagtgctgtccatgcttctc

SEQ ID NO: 4557474 - DNA, 16 bp, Homo sapiens
ccagtgggtctgggat

SEQ ID NO: 4557475 - DNA, 19 bp, Homo sapiens
ccagtggtcagcaggtgtc

SEQ ID NO: 4557476 - DNA, 19 bp, Homo sapiens
ccagtgtcaagttgtgctt

SEQ ID NO: 4557477 - DNA, 15 bp, Homo sapiens
ccagtgtgaaccccc

SEQ ID NO: 4557478 - DNA, 13 bp, Homo sapiens
ccagtgttcctga

SEQ ID NO: 4557479 - DNA, 19 bp, Homo sapiens
ccagtgttcctgaagctgc

SEQ ID NO: 4557480 - DNA, 13 bp, Homo sapiens
ccagtgtttaaaa

SEQ ID NO: 4557481 - DNA, 12 bp, Homo sapiens
ccagtgtttcca

SEQ ID NO: 4557482 - DNA, 15 bp, Homo sapiens
ccagttaaagattat

SEQ ID NO: 4557483 - DNA, 21 bp, Homo sapiens
ccagttcacttctttgcagag

SEQ ID NO: 4557484 - DNA, 14 bp, Homo sapiens
ccagttccacagca

SEQ ID NO: 4557485 - DNA, 15 bp, Homo sapiens
ccagttgcctccagg

SEQ ID NO: 4557486 - DNA, 16 bp, Homo sapiens
ccagttgcctccaggg

SEQ ID NO: 4557487 - DNA, 16 bp, Homo sapiens
ccagttgttatttaca

SEQ ID NO: 4557488 - DNA, 20 bp, Homo sapiens
ccagtttcttttcttttgtt

SEQ ID NO: 4557489 - DNA, 23 bp, Homo sapiens
ccagtttgcagaaaagcacctgc

SEQ ID NO: 4557490 - DNA, 12 bp, Homo sapiens
ccagttttccct

SEQ ID NO: 4557491 - DNA, 14 bp, Homo sapiens
ccagttttccctgg

SEQ ID NO: 4557492 - DNA, 16 bp, Homo sapiens
ccagttttccctggaa

SEQ ID NO: 4557493 - DNA, 21 bp, Homo sapiens
ccagtttttgtttttgcatga

SEQ ID NO: 4557494 - DNA, 16 bp, Homo sapiens
ccataagctactgcca

SEQ ID NO: 4557495 - DNA, 14 bp, Homo sapiens
ccataattatgaaa

SEQ ID NO: 4557496 - DNA, 20 bp, Homo sapiens
ccataattgctttgccaaaa

SEQ ID NO: 4557497 - DNA, 14 bp, Homo sapiens
ccatacaatgtatg

SEQ ID NO: 4557498 - DNA, 21 bp, Homo sapiens
ccatacaatgtatgtacaata

SEQ ID NO: 4557499 - DNA, 21 bp, Homo sapiens
ccataccttttctcttttctt

SEQ ID NO: 4557500 - DNA, 20 bp, Homo sapiens
ccatactgcgtccaccctga

SEQ ID NO: 4557501 - DNA, 23 bp, Homo sapiens
ccatactgtttgcccattttcat

SEQ ID NO: 4557502 - DNA, 17 bp, Homo sapiens
ccatacttatctctctg

SEQ ID NO: 4557503 - DNA, 20 bp, Homo sapiens
ccatagaaaaatgtataaaa

SEQ ID NO: 4557504 - DNA, 17 bp, Homo sapiens
ccatagagatgagccca

SEQ ID NO: 4557505 - DNA, 14 bp, Homo sapiens
ccatagccccagta

SEQ ID NO: 4557506 - DNA, 22 bp, Homo sapiens
ccatagggtcggaggtgctgtc

SEQ ID NO: 4557507 - DNA, 16 bp, Homo sapiens
ccatagtcaaagagag

SEQ ID NO: 4557508 - DNA, 20 bp, Homo sapiens
ccatagtgcttcacaaaatg

SEQ ID NO: 4557509 - DNA, 21 bp, Homo sapiens
ccatatataaattattacttt

SEQ ID NO: 4557510 - DNA, 22 bp, Homo sapiens
ccatatataaattattacttta

SEQ ID NO: 4557511 - DNA, 21 bp, Homo sapiens
ccatatatgctgtatttcttt

SEQ ID NO: 4557512 - DNA, 21 bp, Homo sapiens
ccatatcacacacattgctgt

SEQ ID NO: 4557513 - DNA, 14 bp, Homo sapiens
ccatatgcagaaat

SEQ ID NO: 4557514 - DNA, 16 bp, Homo sapiens
ccatattacctggatt

SEQ ID NO: 4557515 - DNA, 22 bp, Homo sapiens
ccatattgtcacctcagcactg

SEQ ID NO: 4557516 - DNA, 17 bp, Homo sapiens
ccatatttagcagtgca

SEQ ID NO: 4557517 - DNA, 21 bp, Homo sapiens
ccatcaaaggaatataagaaa

SEQ ID NO: 4557518 - DNA, 22 bp, Homo sapiens
ccatcaaaggaatataagaaaa

SEQ ID NO: 4557519 - DNA, 18 bp, Homo sapiens
ccatcaacaaaaattgtc

SEQ ID NO: 4557520 - DNA, 23 bp, Homo sapiens
ccatcaactcccaacttcttcct

SEQ ID NO: 4557521 - DNA, 20 bp, Homo sapiens
ccatcaagaacctacagact

SEQ ID NO: 4557522 - DNA, 12 bp, Homo sapiens
ccatcaagcact

SEQ ID NO: 4557523 - DNA, 19 bp, Homo sapiens
ccatcaagcacttcccagg

SEQ ID NO: 4557524 - DNA, 20 bp, Homo sapiens
ccatcaagcacttcccagga

SEQ ID NO: 4557525 - DNA, 15 bp, Homo sapiens
ccatcagccctgcta

SEQ ID NO: 4557526 - DNA, 13 bp, Homo sapiens
ccatcagcctcca

SEQ ID NO: 4557527 - DNA, 12 bp, Homo sapiens
ccatcagtgctc

SEQ ID NO: 4557528 - DNA, 15 bp, Homo sapiens
ccatcatcactgtaa

SEQ ID NO: 4557529 - DNA, 18 bp, Homo sapiens
ccatcatcactgtaaaga

SEQ ID NO: 4557530 - DNA, 16 bp, Homo sapiens
ccatcatcatgtgtgt

SEQ ID NO: 4557531 - DNA, 12 bp, Homo sapiens
ccatcatctctg

SEQ ID NO: 4557532 - DNA, 10 bp, Homo sapiens
ccatcatgtc

SEQ ID NO: 4557533 - DNA, 18 bp, Homo sapiens
ccatccaaccactgtaca

SEQ ID NO: 4557534 - DNA, 17 bp, Homo sapiens
ccatccacatgggagcc

SEQ ID NO: 4557535 - DNA, 17 bp, Homo sapiens
ccatccacctttcccaa

SEQ ID NO: 4557536 - DNA, 19 bp, Homo sapiens
ccatccactctaccctccc

SEQ ID NO: 4557537 - DNA, 20 bp, Homo sapiens
ccatccagccagaccccacg

SEQ ID NO: 4557538 - DNA, 16 bp, Homo sapiens
ccatccccaactccat

SEQ ID NO: 4557539 - DNA, 14 bp, Homo sapiens
ccatccccaccact

SEQ ID NO: 4557540 - DNA, 19 bp, Homo sapiens
ccatcccctccctgcctgc

SEQ ID NO: 4557541 - DNA, 17 bp, Homo sapiens
ccatccctaccactgtg

SEQ ID NO: 4557542 - DNA, 23 bp, Homo sapiens
ccatccctgcttgcccgctccca

SEQ ID NO: 4557543 - DNA, 12 bp, Homo sapiens
ccatccctgggc

SEQ ID NO: 4557544 - DNA, 14 bp, Homo sapiens
ccatccctgggccc

SEQ ID NO: 4557545 - DNA, 16 bp, Homo sapiens
ccatccctgggcccct

SEQ ID NO: 4557546 - DNA, 18 bp, Homo sapiens
ccatccctgggcccctcc

SEQ ID NO: 4557547 - DNA, 16 bp, Homo sapiens
ccatccgactgcccct

SEQ ID NO: 4557548 - DNA, 17 bp, Homo sapiens
ccatcctaccccctgtg

SEQ ID NO: 4557549 - DNA, 14 bp, Homo sapiens
ccatcctccctcca

SEQ ID NO: 4557550 - DNA, 12 bp, Homo sapiens
ccatcctgactg

SEQ ID NO: 4557551 - DNA, 11 bp, Homo sapiens
ccatcctgcca

SEQ ID NO: 4557552 - DNA, 18 bp, Homo sapiens
ccatcctggcccagggca

SEQ ID NO: 4557553 - DNA, 19 bp, Homo sapiens
ccatcctggcccagggcat

SEQ ID NO: 4557554 - DNA, 20 bp, Homo sapiens
ccatcctggcccagggcatc

SEQ ID NO: 4557555 - DNA, 22 bp, Homo sapiens
ccatcctggcccagggcatctg

SEQ ID NO: 4557556 - DNA, 21 bp, Homo sapiens
ccatctagactagcaatctct

SEQ ID NO: 4557557 - DNA, 14 bp, Homo sapiens
ccatctagtcacaa

SEQ ID NO: 4557558 - DNA, 20 bp, Homo sapiens
ccatctagtcacaaagactc

SEQ ID NO: 4557559 - DNA, 23 bp, Homo sapiens
ccatctcaggagatggagggctt

SEQ ID NO: 4557560 - DNA, 21 bp, Homo sapiens
ccatctcttctgcaagcctca

SEQ ID NO: 4557561 - DNA, 14 bp, Homo sapiens
ccatctgcacccct

SEQ ID NO: 4557562 - DNA, 22 bp, Homo sapiens
ccatctgcaccccttctctcct

SEQ ID NO: 4557563 - DNA, 18 bp, Homo sapiens
ccatcttactctgcccta

SEQ ID NO: 4557564 - DNA, 16 bp, Homo sapiens
ccatcttgagccacag

SEQ ID NO: 4557565 - DNA, 13 bp, Homo sapiens
ccatcttgatctt

SEQ ID NO: 4557566 - DNA, 20 bp, Homo sapiens
ccatcttgatctttgagccc

SEQ ID NO: 4557567 - DNA, 17 bp, Homo sapiens
ccatcttggcagggtta

SEQ ID NO: 4557568 - DNA, 21 bp, Homo sapiens
ccatcttggtagttctgtgcc

SEQ ID NO: 4557569 - DNA, 23 bp, Homo sapiens
ccatcttggtagttctgtgcctc

SEQ ID NO: 4557570 - DNA, 12 bp, Homo sapiens
ccatgaagcctt

SEQ ID NO: 4557571 - DNA, 20 bp, Homo sapiens
ccatgaaggctggaaggcag

SEQ ID NO: 4557572 - DNA, 14 bp, Homo sapiens
ccatgacagaggct

SEQ ID NO: 4557573 - DNA, 21 bp, Homo sapiens
ccatgacaggcctgaagatat

SEQ ID NO: 4557574 - DNA, 19 bp, Homo sapiens
ccatgaccttaaggcagta

SEQ ID NO: 4557575 - DNA, 18 bp, Homo sapiens
ccatgaggagttgctgtt

SEQ ID NO: 4557576 - DNA, 17 bp, Homo sapiens
ccatgagggagatgcca

SEQ ID NO: 4557577 - DNA, 19 bp, Homo sapiens
ccatgagggagatgccatg

SEQ ID NO: 4557578 - DNA, 21 bp, Homo sapiens
ccatgagggagatgccatgag

SEQ ID NO: 4557579 - DNA, 19 bp, Homo sapiens
ccatgagttccagaaagta

SEQ ID NO: 4557580 - DNA, 15 bp, Homo sapiens
ccatgatctgtattt

SEQ ID NO: 4557581 - DNA, 19 bp, Homo sapiens
ccatgatctgtatttaatg

SEQ ID NO: 4557582 - DNA, 23 bp, Homo sapiens
ccatgattctatttatatgtaca

SEQ ID NO: 4557583 - DNA, 18 bp, Homo sapiens
ccatgatttcccactgca

SEQ ID NO: 4557584 - DNA, 20 bp, Homo sapiens
ccatgatttcccactgcact

SEQ ID NO: 4557585 - DNA, 12 bp, Homo sapiens
ccatgcagcttt

SEQ ID NO: 4557586 - DNA, 19 bp, Homo sapiens
ccatgcaggggtcagtgca

SEQ ID NO: 4557587 - DNA, 13 bp, Homo sapiens
ccatgcccacctg

SEQ ID NO: 4557588 - DNA, 20 bp, Homo sapiens
ccatgccggtacacagccag

SEQ ID NO: 4557589 - DNA, 13 bp, Homo sapiens
ccatgcctatggg

SEQ ID NO: 4557590 - DNA, 18 bp, Homo sapiens
ccatgcctgtccagcctg

SEQ ID NO: 4557591 - DNA, 20 bp, Homo sapiens
ccatgctcaacccccctccc

SEQ ID NO: 4557592 - DNA, 22 bp, Homo sapiens
ccatgctcaacccccctcccag

SEQ ID NO: 4557593 - DNA, 16 bp, Homo sapiens
ccatgctccagggtca

SEQ ID NO: 4557594 - DNA, 21 bp, Homo sapiens
ccatgctccagggtcaggcgg

SEQ ID NO: 4557595 - DNA, 16 bp, Homo sapiens
ccatgctcctcacctg

SEQ ID NO: 4557596 - DNA, 14 bp, Homo sapiens
ccatgctctctcac

SEQ ID NO: 4557597 - DNA, 19 bp, Homo sapiens
ccatgctctctcacctgct

SEQ ID NO: 4557598 - DNA, 23 bp, Homo sapiens
ccatgctctctcacctgctccca

SEQ ID NO: 4557599 - DNA, 15 bp, Homo sapiens
ccatgctgccttcag

SEQ ID NO: 4557600 - DNA, 19 bp, Homo sapiens
ccatgctgccttcagggag

SEQ ID NO: 4557601 - DNA, 23 bp, Homo sapiens
ccatgctgggtctgaggcccctg

SEQ ID NO: 4557602 - DNA, 22 bp, Homo sapiens
ccatgcttctcatcttgtgaaa

SEQ ID NO: 4557603 - DNA, 18 bp, Homo sapiens
ccatgcttgcctgaagct

SEQ ID NO: 4557604 - DNA, 19 bp, Homo sapiens
ccatgctttatgtgggtta

SEQ ID NO: 4557605 - DNA, 15 bp, Homo sapiens
ccatgctttgagtcc

SEQ ID NO: 4557606 - DNA, 19 bp, Homo sapiens
ccatgctttgagtccacgc

SEQ ID NO: 4557607 - DNA, 16 bp, Homo sapiens
ccatggaaaaatgcca

SEQ ID NO: 4557608 - DNA, 19 bp, Homo sapiens
ccatggaactgtttccttc

SEQ ID NO: 4557609 - DNA, 16 bp, Homo sapiens
ccatggagccccagcc

SEQ ID NO: 4557610 - DNA, 17 bp, Homo sapiens
ccatggagccccagccc

SEQ ID NO: 4557611 - DNA, 20 bp, Homo sapiens
ccatggagtacggctggtgt

SEQ ID NO: 4557612 - DNA, 18 bp, Homo sapiens
ccatggatttccactgct

SEQ ID NO: 4557613 - DNA, 19 bp, Homo sapiens
ccatggcaggacagctcct

SEQ ID NO: 4557614 - DNA, 16 bp, Homo sapiens
ccatggccccaggccc

SEQ ID NO: 4557615 - DNA, 21 bp, Homo sapiens
ccatggcccccaataaaggca

SEQ ID NO: 4557616 - DNA, 16 bp, Homo sapiens
ccatggccctgtccca

SEQ ID NO: 4557617 - DNA, 23 bp, Homo sapiens
ccatggcctcagccctgctccct

SEQ ID NO: 4557618 - DNA, 13 bp, Homo sapiens
ccatgggctctga

SEQ ID NO: 4557619 - DNA, 15 bp, Homo sapiens
ccatgggctgtgtcc

SEQ ID NO: 4557620 - DNA, 16 bp, Homo sapiens
ccatgtagaaaatttg

SEQ ID NO: 4557621 - DNA, 18 bp, Homo sapiens
ccatgtatttgttatata

SEQ ID NO: 4557622 - DNA, 14 bp, Homo sapiens
ccatgtccaaagag

SEQ ID NO: 4557623 - DNA, 17 bp, Homo sapiens
ccatgtccaaagaggct

SEQ ID NO: 4557624 - DNA, 18 bp, Homo sapiens
ccatgtccaaagaggctg

SEQ ID NO: 4557625 - DNA, 16 bp, Homo sapiens
ccatgtcccaccctcc

SEQ ID NO: 4557626 - DNA, 16 bp, Homo sapiens
ccatgtctctcagaat

SEQ ID NO: 4557627 - DNA, 13 bp, Homo sapiens
ccatgtgcaataa

SEQ ID NO: 4557628 - DNA, 16 bp, Homo sapiens
ccatgtgcctctttgt

SEQ ID NO: 4557629 - DNA, 13 bp, Homo sapiens
ccatgtgcctttc

SEQ ID NO: 4557630 - DNA, 16 bp, Homo sapiens
ccatgtgcctttcttt

SEQ ID NO: 4557631 - DNA, 16 bp, Homo sapiens
ccatgtgctgccctgt

SEQ ID NO: 4557632 - DNA, 16 bp, Homo sapiens
ccatgtgtcccctcac

SEQ ID NO: 4557633 - DNA, 17 bp, Homo sapiens
ccatgtgtcccctcact

SEQ ID NO: 4557634 - DNA, 16 bp, Homo sapiens
ccatgtgtgtgccaag

SEQ ID NO: 4557635 - DNA, 23 bp, Homo sapiens
ccatgtgtgtgccaagccctggc

SEQ ID NO: 4557636 - DNA, 20 bp, Homo sapiens
ccatgttaagtcctccctga

SEQ ID NO: 4557637 - DNA, 16 bp, Homo sapiens
ccatgttaatatttga

SEQ ID NO: 4557638 - DNA, 20 bp, Homo sapiens
ccatgttaatcacattccta

SEQ ID NO: 4557639 - DNA, 15 bp, Homo sapiens
ccatgttagccagga

SEQ ID NO: 4557640 - DNA, 21 bp, Homo sapiens
ccatgttatattgcttcctgt

SEQ ID NO: 4557641 - DNA, 16 bp, Homo sapiens
ccatgttatgtttcta

SEQ ID NO: 4557642 - DNA, 17 bp, Homo sapiens
ccatgttctatttttga

SEQ ID NO: 4557643 - DNA, 19 bp, Homo sapiens
ccatgttgcactgtttgca

SEQ ID NO: 4557644 - DNA, 20 bp, Homo sapiens
ccatgttgcactgtttgcat

SEQ ID NO: 4557645 - DNA, 14 bp, Homo sapiens
ccatgttgcgttca

SEQ ID NO: 4557646 - DNA, 22 bp, Homo sapiens
ccatgtttattgttttttaaag

SEQ ID NO: 4557647 - DNA, 22 bp, Homo sapiens
ccatgtttcaaacaagaaacat

SEQ ID NO: 4557648 - DNA, 21 bp, Homo sapiens
ccattaaaaatgagatttctt

SEQ ID NO: 4557649 - DNA, 14 bp, Homo sapiens
ccattaaagtcaga

SEQ ID NO: 4557650 - DNA, 16 bp, Homo sapiens
ccattaaatgaatatt

SEQ ID NO: 4557651 - DNA, 22 bp, Homo sapiens
ccattaactatttttttcaaag

SEQ ID NO: 4557652 - DNA, 12 bp, Homo sapiens
ccattaatttaa

SEQ ID NO: 4557653 - DNA, 14 bp, Homo sapiens
ccattacctgtacc

SEQ ID NO: 4557654 - DNA, 19 bp, Homo sapiens
ccattacttgtataaatac

SEQ ID NO: 4557655 - DNA, 14 bp, Homo sapiens
ccattatccctgaa

SEQ ID NO: 4557656 - DNA, 16 bp, Homo sapiens
ccattcacaagcctcc

SEQ ID NO: 4557657 - DNA, 20 bp, Homo sapiens
ccattcacaataaaagctta

SEQ ID NO: 4557658 - DNA, 15 bp, Homo sapiens
ccattcatgtcctgt

SEQ ID NO: 4557659 - DNA, 13 bp, Homo sapiens
ccattccaaaata

SEQ ID NO: 4557660 - DNA, 15 bp, Homo sapiens
ccattccaaaatatt

SEQ ID NO: 4557661 - DNA, 16 bp, Homo sapiens
ccattccaaagcttta

SEQ ID NO: 4557662 - DNA, 12 bp, Homo sapiens
ccattccaggta

SEQ ID NO: 4557663 - DNA, 19 bp, Homo sapiens
ccattcctgcctggtccag

SEQ ID NO: 4557664 - DNA, 13 bp, Homo sapiens
ccattctaaaaca

SEQ ID NO: 4557665 - DNA, 17 bp, Homo sapiens
ccattctagatcctgca

SEQ ID NO: 4557666 - DNA, 12 bp, Homo sapiens
ccattctatgtg

SEQ ID NO: 4557667 - DNA, 17 bp, Homo sapiens
ccattctattttagaat

SEQ ID NO: 4557668 - DNA, 13 bp, Homo sapiens
ccattctcatgtt

SEQ ID NO: 4557669 - DNA, 13 bp, Homo sapiens
ccattctcccagg

SEQ ID NO: 4557670 - DNA, 19 bp, Homo sapiens
ccattctcctgcctcagcc

SEQ ID NO: 4557671 - DNA, 20 bp, Homo sapiens
ccattctcctgcctcagcct

SEQ ID NO: 4557672 - DNA, 20 bp, Homo sapiens
ccattctgcactcagaaaat

SEQ ID NO: 4557673 - DNA, 19 bp, Homo sapiens
ccattctgtgtcccatgtc

SEQ ID NO: 4557674 - DNA, 15 bp, Homo sapiens
ccattcttctgggtg

SEQ ID NO: 4557675 - DNA, 14 bp, Homo sapiens
ccattcttctggtg

SEQ ID NO: 4557676 - DNA, 13 bp, Homo sapiens
ccattctttgctt

SEQ ID NO: 4557677 - DNA, 21 bp, Homo sapiens
ccattgaaggcttaaacccat

SEQ ID NO: 4557678 - DNA, 17 bp, Homo sapiens
ccattgccaccaggaga

SEQ ID NO: 4557679 - DNA, 17 bp, Homo sapiens
ccattgcctagctcttt

SEQ ID NO: 4557680 - DNA, 21 bp, Homo sapiens
ccattgctcttagtcccaagc

SEQ ID NO: 4557681 - DNA, 22 bp, Homo sapiens
ccattgggcacagtccagaccc

SEQ ID NO: 4557682 - DNA, 17 bp, Homo sapiens
ccattggggctcccagc

SEQ ID NO: 4557683 - DNA, 13 bp, Homo sapiens
ccattggtgttga

SEQ ID NO: 4557684 - DNA, 22 bp, Homo sapiens
ccattgtactccagcctgggca

SEQ ID NO: 4557685 - DNA, 19 bp, Homo sapiens
ccattgtccaatcctatgt

SEQ ID NO: 4557686 - DNA, 12 bp, Homo sapiens
ccatttacactt

SEQ ID NO: 4557687 - DNA, 17 bp, Homo sapiens
ccatttcccatctgcac

SEQ ID NO: 4557688 - DNA, 19 bp, Homo sapiens
ccatttctgaactgttaca

SEQ ID NO: 4557689 - DNA, 20 bp, Homo sapiens
ccatttctgaactgttacaa

SEQ ID NO: 4557690 - DNA, 18 bp, Homo sapiens
ccatttgctactgtacat

SEQ ID NO: 4557691 - DNA, 20 bp, Homo sapiens
ccatttgtattaccattact

SEQ ID NO: 4557692 - DNA, 14 bp, Homo sapiens
ccatttgtcccaga

SEQ ID NO: 4557693 - DNA, 22 bp, Homo sapiens
ccatttgtgttttgaaagccca

SEQ ID NO: 4557694 - DNA, 17 bp, Homo sapiens
ccatttgttaatatcac

SEQ ID NO: 4557695 - DNA, 18 bp, Homo sapiens
ccattttaacgctgccta

SEQ ID NO: 4557696 - DNA, 16 bp, Homo sapiens
ccattttaagtccctg

SEQ ID NO: 4557697 - DNA, 23 bp, Homo sapiens
ccattttatcatcctttcagttt

SEQ ID NO: 4557698 - DNA, 16 bp, Homo sapiens
ccatttttcaaagcaa

SEQ ID NO: 4557699 - DNA, 17 bp, Homo sapiens
ccatttttcaaagcaat

SEQ ID NO: 4557700 - DNA, 14 bp, Homo sapiens
ccatttttgctaat

SEQ ID NO: 4557701 - DNA, 21 bp, Homo sapiens
cccaaaacaatctatttaaaa

SEQ ID NO: 4557702 - DNA, 14 bp, Homo sapiens
cccaaacatctggc

SEQ ID NO: 4557703 - DNA, 13 bp, Homo sapiens
cccaaaccccagc

SEQ ID NO: 4557704 - DNA, 20 bp, Homo sapiens
cccaaacccttaactgacat

SEQ ID NO: 4557705 - DNA, 16 bp, Homo sapiens
cccaaacgccctttcc

SEQ ID NO: 4557706 - DNA, 22 bp, Homo sapiens
cccaaacgccctttcctcctca

SEQ ID NO: 4557707 - DNA, 23 bp, Homo sapiens
cccaaacgccctttcctcctcag

SEQ ID NO: 4557708 - DNA, 19 bp, Homo sapiens
cccaaagcggtccctgtcc

SEQ ID NO: 4557709 - DNA, 15 bp, Homo sapiens
cccaaagctcagact

SEQ ID NO: 4557710 - DNA, 20 bp, Homo sapiens
cccaaaggacgcctgcagga

SEQ ID NO: 4557711 - DNA, 20 bp, Homo sapiens
cccaaagtccccctcctcag

SEQ ID NO: 4557712 - DNA, 12 bp, Homo sapiens
cccaacacctgc

SEQ ID NO: 4557713 - DNA, 21 bp, Homo sapiens
cccaacacctgcctctgaccc

SEQ ID NO: 4557714 - DNA, 12 bp, Homo sapiens
cccaacagttta

SEQ ID NO: 4557715 - DNA, 14 bp, Homo sapiens
cccaacatgggagg

SEQ ID NO: 4557716 - DNA, 19 bp, Homo sapiens
cccaacatgggagggatca

SEQ ID NO: 4557717 - DNA, 16 bp, Homo sapiens
cccaacccctcctccc

SEQ ID NO: 4557718 - DNA, 16 bp, Homo sapiens
cccaacccctccttcc

SEQ ID NO: 4557719 - DNA, 19 bp, Homo sapiens
cccaacctcagggctccca

SEQ ID NO: 4557720 - DNA, 20 bp, Homo sapiens
cccaacctcagggctcccag

SEQ ID NO: 4557721 - DNA, 17 bp, Homo sapiens
cccaacctttccctcac

SEQ ID NO: 4557722 - DNA, 16 bp, Homo sapiens
cccaactccgcccagc

SEQ ID NO: 4557723 - DNA, 18 bp, Homo sapiens
cccaactccgcccagcct

SEQ ID NO: 4557724 - DNA, 13 bp, Homo sapiens
cccaactcctgga

SEQ ID NO: 4557725 - DNA, 15 bp, Homo sapiens
cccaactcctggaag

SEQ ID NO: 4557726 - DNA, 12 bp, Homo sapiens
cccaactctccc

SEQ ID NO: 4557727 - DNA, 17 bp, Homo sapiens
cccaactctccccagtg

SEQ ID NO: 4557728 - DNA, 19 bp, Homo sapiens
cccaactctccccagtgcc

SEQ ID NO: 4557729 - DNA, 22 bp, Homo sapiens
cccaactctccccagtgcctgc

SEQ ID NO: 4557730 - DNA, 14 bp, Homo sapiens
cccaactctttatc

SEQ ID NO: 4557731 - DNA, 17 bp, Homo sapiens
cccaactgctccagcct

SEQ ID NO: 4557732 - DNA, 19 bp, Homo sapiens
cccaactgctccagcctct

SEQ ID NO: 4557733 - DNA, 22 bp, Homo sapiens
cccaactgctccagcctctgcc

SEQ ID NO: 4557734 - DNA, 19 bp, Homo sapiens
cccaactgtggtagctcca

SEQ ID NO: 4557735 - DNA, 22 bp, Homo sapiens
cccaactgtggtagctccagcg

SEQ ID NO: 4557736 - DNA, 15 bp, Homo sapiens
cccaacttcaccacc

SEQ ID NO: 4557737 - DNA, 16 bp, Homo sapiens
cccaacttcaccaccc

SEQ ID NO: 4557738 - DNA, 16 bp, Homo sapiens
cccaagaaacctgact

SEQ ID NO: 4557739 - DNA, 19 bp, Homo sapiens
cccaagaaaggaaaccttt

SEQ ID NO: 4557740 - DNA, 21 bp, Homo sapiens
cccaagacagatgccccagag

SEQ ID NO: 4557741 - DNA, 20 bp, Homo sapiens
cccaagactcccatgaggga

SEQ ID NO: 4557742 - DNA, 20 bp, Homo sapiens
cccaagaggggcgggctcag

SEQ ID NO: 4557743 - DNA, 21 bp, Homo sapiens
cccaagaggggcgggctcaga

SEQ ID NO: 4557744 - DNA, 23 bp, Homo sapiens
cccaagaggggcgggctcagagc

SEQ ID NO: 4557745 - DNA, 20 bp, Homo sapiens
cccaagaggtctgagccctg

SEQ ID NO: 4557746 - DNA, 22 bp, Homo sapiens
cccaagatgggcatcttttgta

SEQ ID NO: 4557747 - DNA, 23 bp, Homo sapiens
cccaagcccacgtcaggcctggc

SEQ ID NO: 4557748 - DNA, 17 bp, Homo sapiens
cccaagcctgctggctg

SEQ ID NO: 4557749 - DNA, 22 bp, Homo sapiens
cccaagcctgctggctgcggcc

SEQ ID NO: 4557750 - DNA, 16 bp, Homo sapiens
cccaagcgttcctggc

SEQ ID NO: 4557751 - DNA, 22 bp, Homo sapiens
cccaagcgttcctggccttctg

SEQ ID NO: 4557752 - DNA, 22 bp, Homo sapiens
cccaagctgggccccagcccac

SEQ ID NO: 4557753 - DNA, 15 bp, Homo sapiens
cccaaggactgaggg

SEQ ID NO: 4557754 - DNA, 18 bp, Homo sapiens
cccaaggattctgttctg

SEQ ID NO: 4557755 - DNA, 23 bp, Homo sapiens
cccaaggccttcccctggcactg

SEQ ID NO: 4557756 - DNA, 16 bp, Homo sapiens
cccaaggtcagggagg

SEQ ID NO: 4557757 - DNA, 16 bp, Homo sapiens
cccaataaaccagtgt

SEQ ID NO: 4557758 - DNA, 21 bp, Homo sapiens
cccaataaaccagtgtgaacc

SEQ ID NO: 4557759 - DNA, 15 bp, Homo sapiens
cccaataaagccttt

SEQ ID NO: 4557760 - DNA, 23 bp, Homo sapiens
cccaataaaggcagctgcctctg

SEQ ID NO: 4557761 - DNA, 15 bp, Homo sapiens
cccaatcagcttttg

SEQ ID NO: 4557762 - DNA, 20 bp, Homo sapiens
cccaatcagcttttgttcta

SEQ ID NO: 4557763 - DNA, 22 bp, Homo sapiens
cccaatcagcttttgttctaga

SEQ ID NO: 4557764 - DNA, 17 bp, Homo sapiens
cccaatccatgcttcac

SEQ ID NO: 4557765 - DNA, 15 bp, Homo sapiens
cccaatcggactgcc

SEQ ID NO: 4557766 - DNA, 16 bp, Homo sapiens
cccaatcgggtccaga

SEQ ID NO: 4557767 - DNA, 19 bp, Homo sapiens
cccaatcgggtccagagac

SEQ ID NO: 4557768 - DNA, 12 bp, Homo sapiens
cccaatcttgcc

SEQ ID NO: 4557769 - DNA, 22 bp, Homo sapiens
cccaatgagactctagggtcca

SEQ ID NO: 4557770 - DNA, 16 bp, Homo sapiens
cccaatgcctataaaa

SEQ ID NO: 4557771 - DNA, 14 bp, Homo sapiens
cccaatgtttaaaa

SEQ ID NO: 4557772 - DNA, 21 bp, Homo sapiens
cccaattacagggtgactcac

SEQ ID NO: 4557773 - DNA, 15 bp, Homo sapiens
cccaattgagaaaaa

SEQ ID NO: 4557774 - DNA, 14 bp, Homo sapiens
cccaattggaggaa

SEQ ID NO: 4557775 - DNA, 14 bp, Homo sapiens
cccacactaacctg

SEQ ID NO: 4557776 - DNA, 17 bp, Homo sapiens
cccacacttgttccagc

SEQ ID NO: 4557777 - DNA, 19 bp, Homo sapiens
cccacagaaagccaggagc

SEQ ID NO: 4557778 - DNA, 20 bp, Homo sapiens
cccacagagtgctggactgt

SEQ ID NO: 4557779 - DNA, 17 bp, Homo sapiens
cccacagcgtccctggc

SEQ ID NO: 4557780 - DNA, 15 bp, Homo sapiens
cccacagctcccacc

SEQ ID NO: 4557781 - DNA, 13 bp, Homo sapiens
cccacagctgggg

SEQ ID NO: 4557782 - DNA, 17 bp, Homo sapiens
cccacagcttcctgagg

SEQ ID NO: 4557783 - DNA, 19 bp, Homo sapiens
cccacagcttcctgagggc

SEQ ID NO: 4557784 - DNA, 20 bp, Homo sapiens
cccacaggacatttctctaa

SEQ ID NO: 4557785 - DNA, 20 bp, Homo sapiens
cccacagtagaggggtctca

SEQ ID NO: 4557786 - DNA, 18 bp, Homo sapiens
cccacatgaggccatctc

SEQ ID NO: 4557787 - DNA, 22 bp, Homo sapiens
cccacatgaggccatctcagga

SEQ ID NO: 4557788 - DNA, 23 bp, Homo sapiens
cccacatgaggccatctcaggag

SEQ ID NO: 4557789 - DNA, 15 bp, Homo sapiens
cccacatgcatgtct

SEQ ID NO: 4557790 - DNA, 21 bp, Homo sapiens
cccaccacaactaacaatgcc

SEQ ID NO: 4557791 - DNA, 16 bp, Homo sapiens
cccaccacctaggcca

SEQ ID NO: 4557792 - DNA, 21 bp, Homo sapiens
cccaccacctaggccactcct

SEQ ID NO: 4557793 - DNA, 22 bp, Homo sapiens
cccaccacctaggccactcctc

SEQ ID NO: 4557794 - DNA, 21 bp, Homo sapiens
cccaccagacgtcaggccctg

SEQ ID NO: 4557795 - DNA, 15 bp, Homo sapiens
cccaccagagccggg

SEQ ID NO: 4557796 - DNA, 20 bp, Homo sapiens
cccaccagagccgggaggaa

SEQ ID NO: 4557797 - DNA, 23 bp, Homo sapiens
cccaccagccttgctctcttcaa

SEQ ID NO: 4557798 - DNA, 22 bp, Homo sapiens
cccaccatttctgggggccgca

SEQ ID NO: 4557799 - DNA, 12 bp, Homo sapiens
cccacccaggag

SEQ ID NO: 4557800 - DNA, 13 bp, Homo sapiens
cccacccaggagg

SEQ ID NO: 4557801 - DNA, 20 bp, Homo sapiens
cccacccagtccatgctcca

SEQ ID NO: 4557802 - DNA, 13 bp, Homo sapiens
cccaccccaactc

SEQ ID NO: 4557803 - DNA, 15 bp, Homo sapiens
cccaccccaccccct

SEQ ID NO: 4557804 - DNA, 17 bp, Homo sapiens
cccaccccctccccagg

SEQ ID NO: 4557805 - DNA, 14 bp, Homo sapiens
cccaccccctgccc

SEQ ID NO: 4557806 - DNA, 16 bp, Homo sapiens
cccaccccctgccctg

SEQ ID NO: 4557807 - DNA, 17 bp, Homo sapiens
cccaccccctgccctgc

SEQ ID NO: 4557808 - DNA, 19 bp, Homo sapiens
cccacccccttctctgctc

SEQ ID NO: 4557809 - DNA, 19 bp, Homo sapiens
cccaccccctttgactctg

SEQ ID NO: 4557810 - DNA, 16 bp, Homo sapiens
cccaccccgctctgca

SEQ ID NO: 4557811 - DNA, 13 bp, Homo sapiens
cccaccccgggga

SEQ ID NO: 4557812 - DNA, 14 bp, Homo sapiens
cccaccccggggac

SEQ ID NO: 4557813 - DNA, 20 bp, Homo sapiens
cccaccccggggaccctgtg

SEQ ID NO: 4557814 - DNA, 21 bp, Homo sapiens
cccaccccggggaccctgtga

SEQ ID NO: 4557815 - DNA, 16 bp, Homo sapiens
cccacccctgccccca

SEQ ID NO: 4557816 - DNA, 13 bp, Homo sapiens
cccaccccttcct

SEQ ID NO: 4557817 - DNA, 21 bp, Homo sapiens
cccacccggccacagctgctg

SEQ ID NO: 4557818 - DNA, 15 bp, Homo sapiens
cccaccctccatgct

SEQ ID NO: 4557819 - DNA, 15 bp, Homo sapiens
cccaccctccctgga

SEQ ID NO: 4557820 - DNA, 14 bp, Homo sapiens
cccaccctccggcg

SEQ ID NO: 4557821 - DNA, 23 bp, Homo sapiens
cccaccctccggcgggtgacagc

SEQ ID NO: 4557822 - DNA, 18 bp, Homo sapiens
cccaccctcctcttggaa

SEQ ID NO: 4557823 - DNA, 13 bp, Homo sapiens
cccaccctcctgt

SEQ ID NO: 4557824 - DNA, 14 bp, Homo sapiens
cccaccctcctgtc

SEQ ID NO: 4557825 - DNA, 17 bp, Homo sapiens
cccaccgaggttcccag

SEQ ID NO: 4557826 - DNA, 18 bp, Homo sapiens
cccacctctcctgccctg

SEQ ID NO: 4557827 - DNA, 12 bp, Homo sapiens
cccacctgctga

SEQ ID NO: 4557828 - DNA, 19 bp, Homo sapiens
cccacctgtggggcctggg

SEQ ID NO: 4557829 - DNA, 12 bp, Homo sapiens
cccaccttccca

SEQ ID NO: 4557830 - DNA, 13 bp, Homo sapiens
cccaccttcccac

SEQ ID NO: 4557831 - DNA, 17 bp, Homo sapiens
cccacgaaactgccctg

SEQ ID NO: 4557832 - DNA, 13 bp, Homo sapiens
cccacgagggctg

SEQ ID NO: 4557833 - DNA, 13 bp, Homo sapiens
cccacgccaggcc

SEQ ID NO: 4557834 - DNA, 15 bp, Homo sapiens
cccacgcccgtctct

SEQ ID NO: 4557835 - DNA, 17 bp, Homo sapiens
cccacgcctcaccagcc

SEQ ID NO: 4557836 - DNA, 24 bp, Homo sapiens
cccacgctgaccatgcgtcagggg

SEQ ID NO: 4557837 - DNA, 13 bp, Homo sapiens
cccacggagacag

SEQ ID NO: 4557838 - DNA, 14 bp, Homo sapiens
cccacggagacaga

SEQ ID NO: 4557839 - DNA, 17 bp, Homo sapiens
cccacggagacagagga

SEQ ID NO: 4557840 - DNA, 18 bp, Homo sapiens
cccacggagacagaggaa

SEQ ID NO: 4557841 - DNA, 19 bp, Homo sapiens
cccacggcacctcggggac

SEQ ID NO: 4557842 - DNA, 23 bp, Homo sapiens
cccacggcacctcggggacacca

SEQ ID NO: 4557843 - DNA, 21 bp, Homo sapiens
cccacggttcggggcttctgc

SEQ ID NO: 4557844 - DNA, 19 bp, Homo sapiens
cccacgtcaggcctggcct

SEQ ID NO: 4557845 - DNA, 20 bp, Homo sapiens
cccacgtcaggcctggcctc

SEQ ID NO: 4557846 - DNA, 16 bp, Homo sapiens
cccacgttgtccctga

SEQ ID NO: 4557847 - DNA, 14 bp, Homo sapiens
cccactccccagcc

SEQ ID NO: 4557848 - DNA, 21 bp, Homo sapiens
cccactcccccgtttctcctt

SEQ ID NO: 4557849 - DNA, 24 bp, Homo sapiens
cccactcccccgtttctccttttc

SEQ ID NO: 4557850 - DNA, 14 bp, Homo sapiens
cccactccggccct

SEQ ID NO: 4557851 - DNA, 13 bp, Homo sapiens
cccactctcattc

SEQ ID NO: 4557852 - DNA, 17 bp, Homo sapiens
cccactctccccacact

SEQ ID NO: 4557853 - DNA, 15 bp, Homo sapiens
cccactctgcttctt

SEQ ID NO: 4557854 - DNA, 15 bp, Homo sapiens
cccactgaggggcca

SEQ ID NO: 4557855 - DNA, 17 bp, Homo sapiens
cccactgaggggccagg

SEQ ID NO: 4557856 - DNA, 14 bp, Homo sapiens
cccactgcactcca

SEQ ID NO: 4557857 - DNA, 15 bp, Homo sapiens
cccactgcactccag

SEQ ID NO: 4557858 - DNA, 15 bp, Homo sapiens
cccactgcaggcccc

SEQ ID NO: 4557859 - DNA, 22 bp, Homo sapiens
cccactgctcgtggactgtgct

SEQ ID NO: 4557860 - DNA, 12 bp, Homo sapiens
cccactggccgc

SEQ ID NO: 4557861 - DNA, 13 bp, Homo sapiens
cccactggccgct

SEQ ID NO: 4557862 - DNA, 12 bp, Homo sapiens
cccacttcactt

SEQ ID NO: 4557863 - DNA, 19 bp, Homo sapiens
cccacttcactttcttcaa

SEQ ID NO: 4557864 - DNA, 15 bp, Homo sapiens
cccagaaagcctcct

SEQ ID NO: 4557865 - DNA, 14 bp, Homo sapiens
cccagaaagtgggg

SEQ ID NO: 4557866 - DNA, 20 bp, Homo sapiens
cccagaactttgggaggcca

SEQ ID NO: 4557867 - DNA, 18 bp, Homo sapiens
cccagaagtccacaggac

SEQ ID NO: 4557868 - DNA, 12 bp, Homo sapiens
cccagaatgaga

SEQ ID NO: 4557869 - DNA, 18 bp, Homo sapiens
cccagaatgagacatcca

SEQ ID NO: 4557870 - DNA, 20 bp, Homo sapiens
cccagaatgagacatccagc

SEQ ID NO: 4557871 - DNA, 11 bp, Homo sapiens
cccagaattca

SEQ ID NO: 4557872 - DNA, 21 bp, Homo sapiens
cccagacaccatgtgcaataa

SEQ ID NO: 4557873 - DNA, 14 bp, Homo sapiens
cccagaccatggga

SEQ ID NO: 4557874 - DNA, 24 bp, Homo sapiens
cccagactaaaggatccagagagc

SEQ ID NO: 4557875 - DNA, 23 bp, Homo sapiens
cccagactagatgtagtattttt

SEQ ID NO: 4557876 - DNA, 13 bp, Homo sapiens
cccagactctcag

SEQ ID NO: 4557877 - DNA, 19 bp, Homo sapiens
cccagactgatgagcacat

SEQ ID NO: 4557878 - DNA, 15 bp, Homo sapiens
cccagagaagcccct

SEQ ID NO: 4557879 - DNA, 22 bp, Homo sapiens
cccagagaagccccttccccat

SEQ ID NO: 4557880 - DNA, 17 bp, Homo sapiens
cccagagacaggaaaat

SEQ ID NO: 4557881 - DNA, 15 bp, Homo sapiens
cccagagaggaatca

SEQ ID NO: 4557882 - DNA, 12 bp, Homo sapiens
cccagagaggca

SEQ ID NO: 4557883 - DNA, 14 bp, Homo sapiens
cccagagatgcctc

SEQ ID NO: 4557884 - DNA, 19 bp, Homo sapiens
cccagagatgcctccaccg

SEQ ID NO: 4557885 - DNA, 20 bp, Homo sapiens
cccagagatgcctccaccgc

SEQ ID NO: 4557886 - DNA, 23 bp, Homo sapiens
cccagagatgcctccaccgctgc

SEQ ID NO: 4557887 - DNA, 19 bp, Homo sapiens
cccagagcaccccctgctc

SEQ ID NO: 4557888 - DNA, 13 bp, Homo sapiens
cccagagcatctg

SEQ ID NO: 4557889 - DNA, 22 bp, Homo sapiens
cccagagcatctgccccaggta

SEQ ID NO: 4557890 - DNA, 13 bp, Homo sapiens
cccagagccacct

SEQ ID NO: 4557891 - DNA, 14 bp, Homo sapiens
cccagagccacctg

SEQ ID NO: 4557892 - DNA, 16 bp, Homo sapiens
cccagagccacctgga

SEQ ID NO: 4557893 - DNA, 20 bp, Homo sapiens
cccagagcgaggaaaggatt

SEQ ID NO: 4557894 - DNA, 21 bp, Homo sapiens
cccagagctgagttgggggtg

SEQ ID NO: 4557895 - DNA, 20 bp, Homo sapiens
cccagagctggcgctcagca

SEQ ID NO: 4557896 - DNA, 13 bp, Homo sapiens
cccagagctgttt

SEQ ID NO: 4557897 - DNA, 22 bp, Homo sapiens
cccagaggaaggggccagaggc

SEQ ID NO: 4557898 - DNA, 13 bp, Homo sapiens
cccagaggctccc

SEQ ID NO: 4557899 - DNA, 16 bp, Homo sapiens
cccagaggctcccaat

SEQ ID NO: 4557900 - DNA, 19 bp, Homo sapiens
cccagaggggacgctgagg

SEQ ID NO: 4557901 - DNA, 17 bp, Homo sapiens
cccagaggtctcatctc

SEQ ID NO: 4557902 - DNA, 22 bp, Homo sapiens
cccagaggtctcatctcccagg

SEQ ID NO: 4557903 - DNA, 23 bp, Homo sapiens
cccagaggtgggatcctccctca

SEQ ID NO: 4557904 - DNA, 20 bp, Homo sapiens
cccagagtcagaggagaaga

SEQ ID NO: 4557905 - DNA, 17 bp, Homo sapiens
cccagagtggagtctga

SEQ ID NO: 4557906 - DNA, 15 bp, Homo sapiens
cccagagtggcccac

SEQ ID NO: 4557907 - DNA, 15 bp, Homo sapiens
cccagatgtaaagaa

SEQ ID NO: 4557908 - DNA, 13 bp, Homo sapiens
cccagatgtgtcc

SEQ ID NO: 4557909 - DNA, 22 bp, Homo sapiens
cccagattggctcacactgaga

SEQ ID NO: 4557910 - DNA, 17 bp, Homo sapiens
cccagcaaatgggcatt

SEQ ID NO: 4557911 - DNA, 17 bp, Homo sapiens
cccagcaagcgggagcc

SEQ ID NO: 4557912 - DNA, 22 bp, Homo sapiens
cccagcaagcgggagcccgtgg

SEQ ID NO: 4557913 - DNA, 12 bp, Homo sapiens
cccagcacgagc

SEQ ID NO: 4557914 - DNA, 16 bp, Homo sapiens
cccagcacgagcctgg

SEQ ID NO: 4557915 - DNA, 20 bp, Homo sapiens
cccagcactaaggccgtgtc

SEQ ID NO: 4557916 - DNA, 21 bp, Homo sapiens
cccagcactgcttgaggaaaa

SEQ ID NO: 4557917 - DNA, 16 bp, Homo sapiens
cccagcagcccctgag

SEQ ID NO: 4557918 - DNA, 17 bp, Homo sapiens
cccagcagcccctgaga

SEQ ID NO: 4557919 - DNA, 22 bp, Homo sapiens
cccagcagcccctgagagcctg

SEQ ID NO: 4557920 - DNA, 14 bp, Homo sapiens
cccagcatccctgg

SEQ ID NO: 4557921 - DNA, 20 bp, Homo sapiens
cccagcatccctggagcagg

SEQ ID NO: 4557922 - DNA, 22 bp, Homo sapiens
cccagcatgacataacagtgca

SEQ ID NO: 4557923 - DNA, 16 bp, Homo sapiens
cccagcattccagctc

SEQ ID NO: 4557924 - DNA, 18 bp, Homo sapiens
cccagcattccagctctg

SEQ ID NO: 4557925 - DNA, 22 bp, Homo sapiens
cccagcattccagctctgcccc

SEQ ID NO: 4557926 - DNA, 13 bp, Homo sapiens
cccagcatttcca

SEQ ID NO: 4557927 - DNA, 20 bp, Homo sapiens
cccagcatttccagagcaga

SEQ ID NO: 4557928 - DNA, 11 bp, Homo sapiens
cccagccacag

SEQ ID NO: 4557929 - DNA, 19 bp, Homo sapiens
cccagccaccccgggctct

SEQ ID NO: 4557930 - DNA, 13 bp, Homo sapiens
cccagccagccct

SEQ ID NO: 4557931 - DNA, 12 bp, Homo sapiens
cccagccaggcc

SEQ ID NO: 4557932 - DNA, 13 bp, Homo sapiens
cccagcccacaga

SEQ ID NO: 4557933 - DNA, 15 bp, Homo sapiens
cccagcccacagagc

SEQ ID NO: 4557934 - DNA, 15 bp, Homo sapiens
cccagcccaccctcc

SEQ ID NO: 4557935 - DNA, 11 bp, Homo sapiens
cccagcccaga

SEQ ID NO: 4557936 - DNA, 12 bp, Homo sapiens
cccagcccagag

SEQ ID NO: 4557937 - DNA, 13 bp, Homo sapiens
cccagcccagctg

SEQ ID NO: 4557938 - DNA, 18 bp, Homo sapiens
cccagcccagctggtggg

SEQ ID NO: 4557939 - DNA, 12 bp, Homo sapiens
cccagcccagga

SEQ ID NO: 4557940 - DNA, 14 bp, Homo sapiens
cccagccccaactc

SEQ ID NO: 4557941 - DNA, 15 bp, Homo sapiens
cccagccccaactcc

SEQ ID NO: 4557942 - DNA, 16 bp, Homo sapiens
cccagccccagcccct

SEQ ID NO: 4557943 - DNA, 24 bp, Homo sapiens
cccagcccccacagtgctgtctga

SEQ ID NO: 4557944 - DNA, 17 bp, Homo sapiens
cccagccccctcccacc

SEQ ID NO: 4557945 - DNA, 21 bp, Homo sapiens
cccagccccctcccaccgctg

SEQ ID NO: 4557946 - DNA, 15 bp, Homo sapiens
cccagcccctcctcc

SEQ ID NO: 4557947 - DNA, 16 bp, Homo sapiens
cccagcccctcctccc

SEQ ID NO: 4557948 - DNA, 20 bp, Homo sapiens
cccagcccctcctccctcaa

SEQ ID NO: 4557949 - DNA, 21 bp, Homo sapiens
cccagcccctcctccctcaga

SEQ ID NO: 4557950 - DNA, 13 bp, Homo sapiens
cccagcccctgca

SEQ ID NO: 4557951 - DNA, 16 bp, Homo sapiens
cccagcccctgcagat

SEQ ID NO: 4557952 - DNA, 16 bp, Homo sapiens
cccagcccggctccca

SEQ ID NO: 4557953 - DNA, 13 bp, Homo sapiens
cccagccctgctg

SEQ ID NO: 4557954 - DNA, 16 bp, Homo sapiens
cccagccctgctggcc

SEQ ID NO: 4557955 - DNA, 15 bp, Homo sapiens
cccagccctggccca

SEQ ID NO: 4557956 - DNA, 16 bp, Homo sapiens
cccagccctggcccag

SEQ ID NO: 4557957 - DNA, 19 bp, Homo sapiens
cccagccctggcccaggtg

SEQ ID NO: 4557958 - DNA, 21 bp, Homo sapiens
cccagccctggtctcagcagc

SEQ ID NO: 4557959 - DNA, 12 bp, Homo sapiens
cccagcctggga

SEQ ID NO: 4557960 - DNA, 20 bp, Homo sapiens
cccagcctgggagcccagag

SEQ ID NO: 4557961 - DNA, 18 bp, Homo sapiens
cccagcctgggccatctc

SEQ ID NO: 4557962 - DNA, 22 bp, Homo sapiens
cccagcctgggccatctcttag

SEQ ID NO: 4557963 - DNA, 12 bp, Homo sapiens
cccagccttgcc

SEQ ID NO: 4557964 - DNA, 21 bp, Homo sapiens
cccagcggtccaatgccacct

SEQ ID NO: 4557965 - DNA, 20 bp, Homo sapiens
cccagctactcaggaggctg

SEQ ID NO: 4557966 - DNA, 14 bp, Homo sapiens
cccagctactcgat

SEQ ID NO: 4557967 - DNA, 21 bp, Homo sapiens
cccagctactggggaggctga

SEQ ID NO: 4557968 - DNA, 15 bp, Homo sapiens
cccagctacttggga

SEQ ID NO: 4557969 - DNA, 23 bp, Homo sapiens
cccagctacttgggaggctgagg

SEQ ID NO: 4557970 - DNA, 10 bp, Homo sapiens
cccagctccc

SEQ ID NO: 4557971 - DNA, 16 bp, Homo sapiens
cccagctctccctctg

SEQ ID NO: 4557972 - DNA, 17 bp, Homo sapiens
cccagctctccctctgg

SEQ ID NO: 4557973 - DNA, 23 bp, Homo sapiens
cccagctctccctctggccctgc

SEQ ID NO: 4557974 - DNA, 14 bp, Homo sapiens
cccagctctgaaac

SEQ ID NO: 4557975 - DNA, 22 bp, Homo sapiens
cccagctctgaaaccagtgtta

SEQ ID NO: 4557976 - DNA, 12 bp, Homo sapiens
cccagctgctcc

SEQ ID NO: 4557977 - DNA, 13 bp, Homo sapiens
cccagctgctccc

SEQ ID NO: 4557978 - DNA, 23 bp, Homo sapiens
cccaggaaaggacggctgagcat

SEQ ID NO: 4557979 - DNA, 23 bp, Homo sapiens
cccaggaatcagtttaaaagcac

SEQ ID NO: 4557980 - DNA, 22 bp, Homo sapiens
cccaggaatgccaaggagacat

SEQ ID NO: 4557981 - DNA, 13 bp, Homo sapiens
cccaggacgccac

SEQ ID NO: 4557982 - DNA, 22 bp, Homo sapiens
cccaggacgccactcatttcat

SEQ ID NO: 4557983 - DNA, 16 bp, Homo sapiens
cccaggagacagacca

SEQ ID NO: 4557984 - DNA, 18 bp, Homo sapiens
cccaggagagccagccct

SEQ ID NO: 4557985 - DNA, 19 bp, Homo sapiens
cccaggagagccagccctc

SEQ ID NO: 4557986 - DNA, 23 bp, Homo sapiens
cccaggagagccagccctccctg

SEQ ID NO: 4557987 - DNA, 19 bp, Homo sapiens
cccaggagatgggtccagg

SEQ ID NO: 4557988 - DNA, 18 bp, Homo sapiens
cccaggaggcagctcagg

SEQ ID NO: 4557989 - DNA, 18 bp, Homo sapiens
cccaggagggagggggct

SEQ ID NO: 4557990 - DNA, 14 bp, Homo sapiens
cccaggagtccaga

SEQ ID NO: 4557991 - DNA, 16 bp, Homo sapiens
cccaggagtccaggcc

SEQ ID NO: 4557992 - DNA, 23 bp, Homo sapiens
cccaggagtccaggcccccagcc

SEQ ID NO: 4557993 - DNA, 17 bp, Homo sapiens
cccaggagtttgaggct

SEQ ID NO: 4557994 - DNA, 19 bp, Homo sapiens
cccaggagtttgaggctgc

SEQ ID NO: 4557995 - DNA, 13 bp, Homo sapiens
cccaggcagcctc

SEQ ID NO: 4557996 - DNA, 15 bp, Homo sapiens
cccaggccacagaga

SEQ ID NO: 4557997 - DNA, 19 bp, Homo sapiens
cccaggccacagagaacct

SEQ ID NO: 4557998 - DNA, 15 bp, Homo sapiens
cccaggccagctgcg

SEQ ID NO: 4557999 - DNA, 17 bp, Homo sapiens
cccaggccagctgcggc

SEQ ID NO: 4558000 - DNA, 18 bp, Homo sapiens
cccaggccaggtgcccag

SEQ ID NO: 4558001 - DNA, 15 bp, Homo sapiens
cccaggccccagggg

SEQ ID NO: 4558002 - DNA, 20 bp, Homo sapiens
cccaggccggcccagatgtg

SEQ ID NO: 4558003 - DNA, 13 bp, Homo sapiens
cccaggcctgcct

SEQ ID NO: 4558004 - DNA, 17 bp, Homo sapiens
cccaggcctgcctgcat

SEQ ID NO: 4558005 - DNA, 14 bp, Homo sapiens
cccaggcctgtcca

SEQ ID NO: 4558006 - DNA, 16 bp, Homo sapiens
cccaggcgctgcatac

SEQ ID NO: 4558007 - DNA, 23 bp, Homo sapiens
cccaggcgctgcatacaggggag

SEQ ID NO: 4558008 - DNA, 15 bp, Homo sapiens
cccaggctggactgc

SEQ ID NO: 4558009 - DNA, 21 bp, Homo sapiens
cccaggctggactgcagtggc

SEQ ID NO: 4558010 - DNA, 19 bp, Homo sapiens
cccaggctggagtgcagtg

SEQ ID NO: 4558011 - DNA, 21 bp, Homo sapiens
cccaggctgggaactcatctg

SEQ ID NO: 4558012 - DNA, 14 bp, Homo sapiens
cccagggcactgcc

SEQ ID NO: 4558013 - DNA, 20 bp, Homo sapiens
cccagggcctgacttgagcc

SEQ ID NO: 4558014 - DNA, 21 bp, Homo sapiens
cccagggcctgacttgagcca

SEQ ID NO: 4558015 - DNA, 21 bp, Homo sapiens
cccaggggaaggccctgaggc

SEQ ID NO: 4558016 - DNA, 21 bp, Homo sapiens
cccaggggagagggtctggag

SEQ ID NO: 4558017 - DNA, 14 bp, Homo sapiens
cccaggggtccagg

SEQ ID NO: 4558018 - DNA, 18 bp, Homo sapiens
cccaggggtccaggcccc

SEQ ID NO: 4558019 - DNA, 15 bp, Homo sapiens
cccaggggtcccagc

SEQ ID NO: 4558020 - DNA, 16 bp, Homo sapiens
cccaggggtcccagcc

SEQ ID NO: 4558021 - DNA, 17 bp, Homo sapiens
cccaggggtctccctgg

SEQ ID NO: 4558022 - DNA, 15 bp, Homo sapiens
cccagggtagcccgc

SEQ ID NO: 4558023 - DNA, 22 bp, Homo sapiens
cccagggtagcccgcctgccag

SEQ ID NO: 4558024 - DNA, 15 bp, Homo sapiens
cccagggtcttccct

SEQ ID NO: 4558025 - DNA, 16 bp, Homo sapiens
cccagggtcttcccta

SEQ ID NO: 4558026 - DNA, 18 bp, Homo sapiens
cccagggtcttccctacc

SEQ ID NO: 4558027 - DNA, 23 bp, Homo sapiens
cccagggtcttccctacctcagg

SEQ ID NO: 4558028 - DNA, 17 bp, Homo sapiens
cccagggtggcgtccac

SEQ ID NO: 4558029 - DNA, 15 bp, Homo sapiens
cccaggtaccagctg

SEQ ID NO: 4558030 - DNA, 17 bp, Homo sapiens
cccaggtaccagctgcg

SEQ ID NO: 4558031 - DNA, 20 bp, Homo sapiens
cccaggtgacacgcttctga

SEQ ID NO: 4558032 - DNA, 13 bp, Homo sapiens
cccaggtgccccg

SEQ ID NO: 4558033 - DNA, 19 bp, Homo sapiens
cccaggtggctgacccagt

SEQ ID NO: 4558034 - DNA, 23 bp, Homo sapiens
cccaggtggctgacccagtccct

SEQ ID NO: 4558035 - DNA, 18 bp, Homo sapiens
cccaggttcccccagcaa

SEQ ID NO: 4558036 - DNA, 13 bp, Homo sapiens
cccagtcagcctc

SEQ ID NO: 4558037 - DNA, 14 bp, Homo sapiens
cccagtcagcctct

SEQ ID NO: 4558038 - DNA, 19 bp, Homo sapiens
cccagtcagcctctctccc

SEQ ID NO: 4558039 - DNA, 13 bp, Homo sapiens
cccagtccatgct

SEQ ID NO: 4558040 - DNA, 15 bp, Homo sapiens
cccagtccccacccc

SEQ ID NO: 4558041 - DNA, 18 bp, Homo sapiens
cccagtccccacccctgc

SEQ ID NO: 4558042 - DNA, 20 bp, Homo sapiens
cccagtccccacccctgccc

SEQ ID NO: 4558043 - DNA, 21 bp, Homo sapiens
cccagtccccacccctgcccc

SEQ ID NO: 4558044 - DNA, 12 bp, Homo sapiens
cccagtccctgg

SEQ ID NO: 4558045 - DNA, 14 bp, Homo sapiens
cccagtccctgggg

SEQ ID NO: 4558046 - DNA, 16 bp, Homo sapiens
cccagtccctggggga

SEQ ID NO: 4558047 - DNA, 23 bp, Homo sapiens
cccagtcgtgatgtggaggaaga

SEQ ID NO: 4558048 - DNA, 17 bp, Homo sapiens
cccagtgaagcctctga

SEQ ID NO: 4558049 - DNA, 23 bp, Homo sapiens
cccagtgagtctctggggcaggc

SEQ ID NO: 4558050 - DNA, 14 bp, Homo sapiens
cccagtgccactgc

SEQ ID NO: 4558051 - DNA, 12 bp, Homo sapiens
cccagtgcctgc

SEQ ID NO: 4558052 - DNA, 14 bp, Homo sapiens
cccagtgcctgcca

SEQ ID NO: 4558053 - DNA, 22 bp, Homo sapiens
cccagtgcttctccaacactga

SEQ ID NO: 4558054 - DNA, 17 bp, Homo sapiens
cccagtggccactcagc

SEQ ID NO: 4558055 - DNA, 22 bp, Homo sapiens
cccagtgtcaagttgtgcttgt

SEQ ID NO: 4558056 - DNA, 18 bp, Homo sapiens
cccagtgtttccacactt

SEQ ID NO: 4558057 - DNA, 14 bp, Homo sapiens
cccagttccacagc

SEQ ID NO: 4558058 - DNA, 19 bp, Homo sapiens
cccagttgcactcaggtga

SEQ ID NO: 4558059 - DNA, 19 bp, Homo sapiens
cccagttgtggcaactaaa

SEQ ID NO: 4558060 - DNA, 23 bp, Homo sapiens
cccagtttgcagaaaagcacctg

SEQ ID NO: 4558061 - DNA, 21 bp, Homo sapiens
cccataattgctttgccaaaa

SEQ ID NO: 4558062 - DNA, 21 bp, Homo sapiens
cccatagggtcggaggtgctg

SEQ ID NO: 4558063 - DNA, 19 bp, Homo sapiens
cccatatataaattattac

SEQ ID NO: 4558064 - DNA, 21 bp, Homo sapiens
cccatcacagggttgggccca

SEQ ID NO: 4558065 - DNA, 14 bp, Homo sapiens
cccatcacccaagc

SEQ ID NO: 4558066 - DNA, 13 bp, Homo sapiens
cccatcactggag

SEQ ID NO: 4558067 - DNA, 15 bp, Homo sapiens
cccatcactggagca

SEQ ID NO: 4558068 - DNA, 14 bp, Homo sapiens
cccatcagcactct

SEQ ID NO: 4558069 - DNA, 15 bp, Homo sapiens
cccatcagcactctg

SEQ ID NO: 4558070 - DNA, 18 bp, Homo sapiens
cccatcagtgctctgtaa

SEQ ID NO: 4558071 - DNA, 20 bp, Homo sapiens
cccatccaaccactgtacac

SEQ ID NO: 4558072 - DNA, 18 bp, Homo sapiens
cccatccagacctggctc

SEQ ID NO: 4558073 - DNA, 14 bp, Homo sapiens
cccatccagccaga

SEQ ID NO: 4558074 - DNA, 13 bp, Homo sapiens
cccatccctgctt

SEQ ID NO: 4558075 - DNA, 16 bp, Homo sapiens
cccatccctgcttgcc

SEQ ID NO: 4558076 - DNA, 14 bp, Homo sapiens
cccatcctagaggc

SEQ ID NO: 4558077 - DNA, 15 bp, Homo sapiens
cccatcctgaccagc

SEQ ID NO: 4558078 - DNA, 17 bp, Homo sapiens
cccatcctgccatcctc

SEQ ID NO: 4558079 - DNA, 14 bp, Homo sapiens
cccatctccctgcc

SEQ ID NO: 4558080 - DNA, 13 bp, Homo sapiens
cccatctctacaa

SEQ ID NO: 4558081 - DNA, 23 bp, Homo sapiens
cccatctgaacacaaccagaggt

SEQ ID NO: 4558082 - DNA, 21 bp, Homo sapiens
cccatctgcgggggcagtgct

SEQ ID NO: 4558083 - DNA, 16 bp, Homo sapiens
cccatctggtcatttg

SEQ ID NO: 4558084 - DNA, 13 bp, Homo sapiens
cccatctgtccag

SEQ ID NO: 4558085 - DNA, 22 bp, Homo sapiens
cccatctgtccagctggggcca

SEQ ID NO: 4558086 - DNA, 21 bp, Homo sapiens
cccatcttgatctttgagccc

SEQ ID NO: 4558087 - DNA, 22 bp, Homo sapiens
cccatcttgatctttgagccca

SEQ ID NO: 4558088 - DNA, 21 bp, Homo sapiens
cccatctttgctgccagctct

SEQ ID NO: 4558089 - DNA, 12 bp, Homo sapiens
cccatgaagcct

SEQ ID NO: 4558090 - DNA, 15 bp, Homo sapiens
cccatgagctcctta

SEQ ID NO: 4558091 - DNA, 14 bp, Homo sapiens
cccatgccccagtc

SEQ ID NO: 4558092 - DNA, 20 bp, Homo sapiens
cccatgccggtacacagcca

SEQ ID NO: 4558093 - DNA, 16 bp, Homo sapiens
cccatgcctgtccagc

SEQ ID NO: 4558094 - DNA, 20 bp, Homo sapiens
cccatgcctgtccagcctgg

SEQ ID NO: 4558095 - DNA, 22 bp, Homo sapiens
cccatgcgccttcgtgcctgag

SEQ ID NO: 4558096 - DNA, 16 bp, Homo sapiens
cccatgctgccttcag

SEQ ID NO: 4558097 - DNA, 13 bp, Homo sapiens
cccatggagcccc

SEQ ID NO: 4558098 - DNA, 21 bp, Homo sapiens
cccatggagccccagccccct

SEQ ID NO: 4558099 - DNA, 15 bp, Homo sapiens
cccatggcattttat

SEQ ID NO: 4558100 - DNA, 19 bp, Homo sapiens
cccatggcccccaataaag

SEQ ID NO: 4558101 - DNA, 20 bp, Homo sapiens
cccatggcccccaataaagg

SEQ ID NO: 4558102 - DNA, 17 bp, Homo sapiens
cccatggcctcagccct

SEQ ID NO: 4558103 - DNA, 20 bp, Homo sapiens
cccatggcctcagccctgct

SEQ ID NO: 4558104 - DNA, 21 bp, Homo sapiens
cccatgggaagacgaggccct

SEQ ID NO: 4558105 - DNA, 14 bp, Homo sapiens
cccatgtaaccact

SEQ ID NO: 4558106 - DNA, 16 bp, Homo sapiens
cccatgtcaccggtca

SEQ ID NO: 4558107 - DNA, 15 bp, Homo sapiens
cccattccctccatt

SEQ ID NO: 4558108 - DNA, 15 bp, Homo sapiens
cccattcctgcctgg

SEQ ID NO: 4558109 - DNA, 22 bp, Homo sapiens
cccattccttgcgcctcagccc

SEQ ID NO: 4558110 - DNA, 13 bp, Homo sapiens
cccattctcatgt

SEQ ID NO: 4558111 - DNA, 17 bp, Homo sapiens
cccattctctctcctgt

SEQ ID NO: 4558112 - DNA, 20 bp, Homo sapiens
cccattctttgcttgaacac

SEQ ID NO: 4558113 - DNA, 23 bp, Homo sapiens
cccattgagatcttcctgctgag

SEQ ID NO: 4558114 - DNA, 17 bp, Homo sapiens
cccattggccgagctcc

SEQ ID NO: 4558115 - DNA, 22 bp, Homo sapiens
cccattggccgagctcctgggg

SEQ ID NO: 4558116 - DNA, 15 bp, Homo sapiens
cccattgtggctcct

SEQ ID NO: 4558117 - DNA, 19 bp, Homo sapiens
cccattgtggctcctatct

SEQ ID NO: 4558118 - DNA, 22 bp, Homo sapiens
cccattgtggtcacaggaagta

SEQ ID NO: 4558119 - DNA, 23 bp, Homo sapiens
cccattgtggtcacaggaagtag

SEQ ID NO: 4558120 - DNA, 16 bp, Homo sapiens
cccatttacacttttg

SEQ ID NO: 4558121 - DNA, 12 bp, Homo sapiens
cccatttcagct

SEQ ID NO: 4558122 - DNA, 14 bp, Homo sapiens
cccatttcccatct

SEQ ID NO: 4558123 - DNA, 15 bp, Homo sapiens
cccatttcccatctg

SEQ ID NO: 4558124 - DNA, 14 bp, Homo sapiens
cccatttctgcctc

SEQ ID NO: 4558125 - DNA, 23 bp, Homo sapiens
cccatttgcaggatctgtctgtg

SEQ ID NO: 4558126 - DNA, 21 bp, Homo sapiens
cccattttcattcttgtatta

SEQ ID NO: 4558127 - DNA, 21 bp, Homo sapiens
ccccaaaggtccgcaccctgt

SEQ ID NO: 4558128 - DNA, 12 bp, Homo sapiens
ccccaaccccgt

SEQ ID NO: 4558129 - DNA, 20 bp, Homo sapiens
ccccaacccctcctccctca

SEQ ID NO: 4558130 - DNA, 14 bp, Homo sapiens
ccccaacctcaggg

SEQ ID NO: 4558131 - DNA, 21 bp, Homo sapiens
ccccaacctcagggctcccag

SEQ ID NO: 4558132 - DNA, 22 bp, Homo sapiens
ccccaacctcagggctcccagg

SEQ ID NO: 4558133 - DNA, 14 bp, Homo sapiens
ccccaactcaggac

SEQ ID NO: 4558134 - DNA, 15 bp, Homo sapiens
ccccaactccagggg

SEQ ID NO: 4558135 - DNA, 23 bp, Homo sapiens
ccccaactccaggggcacctatg

SEQ ID NO: 4558136 - DNA, 14 bp, Homo sapiens
ccccaactccatgg

SEQ ID NO: 4558137 - DNA, 15 bp, Homo sapiens
ccccaactcctggaa

SEQ ID NO: 4558138 - DNA, 19 bp, Homo sapiens
ccccaactctccccagtgc

SEQ ID NO: 4558139 - DNA, 13 bp, Homo sapiens
ccccaactgctcc

SEQ ID NO: 4558140 - DNA, 22 bp, Homo sapiens
ccccaactgtggtagctccagc

SEQ ID NO: 4558141 - DNA, 17 bp, Homo sapiens
ccccaagaggggcgggc

SEQ ID NO: 4558142 - DNA, 14 bp, Homo sapiens
ccccaataaaccag

SEQ ID NO: 4558143 - DNA, 16 bp, Homo sapiens
ccccaataaagccttt

SEQ ID NO: 4558144 - DNA, 18 bp, Homo sapiens
ccccaatcggactgccaa

SEQ ID NO: 4558145 - DNA, 19 bp, Homo sapiens
ccccaatcggactgccaaa

SEQ ID NO: 4558146 - DNA, 19 bp, Homo sapiens
ccccaatcttgcccactgg

SEQ ID NO: 4558147 - DNA, 13 bp, Homo sapiens
ccccacaatctgg

SEQ ID NO: 4558148 - DNA, 15 bp, Homo sapiens
ccccacactcactcc

SEQ ID NO: 4558149 - DNA, 17 bp, Homo sapiens
ccccacagcgtccctgg

SEQ ID NO: 4558150 - DNA, 18 bp, Homo sapiens
ccccacagcgtccctggc

SEQ ID NO: 4558151 - DNA, 10 bp, Homo sapiens
ccccacagct

SEQ ID NO: 4558152 - DNA, 15 bp, Homo sapiens
ccccacagctggggc

SEQ ID NO: 4558153 - DNA, 12 bp, Homo sapiens
ccccaccaccta

SEQ ID NO: 4558154 - DNA, 14 bp, Homo sapiens
ccccaccagtgcct

SEQ ID NO: 4558155 - DNA, 22 bp, Homo sapiens
ccccaccagtgcctctccctgc

SEQ ID NO: 4558156 - DNA, 15 bp, Homo sapiens
ccccacccatgcgcc

SEQ ID NO: 4558157 - DNA, 14 bp, Homo sapiens
ccccaccccacact

SEQ ID NO: 4558158 - DNA, 17 bp, Homo sapiens
ccccaccccaccccacc

SEQ ID NO: 4558159 - DNA, 12 bp, Homo sapiens
ccccaccccctt

SEQ ID NO: 4558160 - DNA, 17 bp, Homo sapiens
ccccacccgctcccaca

SEQ ID NO: 4558161 - DNA, 13 bp, Homo sapiens
ccccaccctccat

SEQ ID NO: 4558162 - DNA, 17 bp, Homo sapiens
ccccaccctccatgctc

SEQ ID NO: 4558163 - DNA, 15 bp, Homo sapiens
ccccaccctccctgg

SEQ ID NO: 4558164 - DNA, 16 bp, Homo sapiens
ccccaccggaactggg

SEQ ID NO: 4558165 - DNA, 19 bp, Homo sapiens
ccccaccggaactgggctg

SEQ ID NO: 4558166 - DNA, 17 bp, Homo sapiens
ccccacctgaagggtgg

SEQ ID NO: 4558167 - DNA, 13 bp, Homo sapiens
ccccacgagggct

SEQ ID NO: 4558168 - DNA, 14 bp, Homo sapiens
ccccacgagggctg

SEQ ID NO: 4558169 - DNA, 21 bp, Homo sapiens
ccccacgagggctggctggcc

SEQ ID NO: 4558170 - DNA, 21 bp, Homo sapiens
ccccacggagacagaggaaag

SEQ ID NO: 4558171 - DNA, 20 bp, Homo sapiens
ccccactccggccctccaga

SEQ ID NO: 4558172 - DNA, 19 bp, Homo sapiens
ccccactcctctcccacag

SEQ ID NO: 4558173 - DNA, 20 bp, Homo sapiens
ccccactctcattccccagg

SEQ ID NO: 4558174 - DNA, 18 bp, Homo sapiens
ccccactctccccacact

SEQ ID NO: 4558175 - DNA, 13 bp, Homo sapiens
ccccactgcccca

SEQ ID NO: 4558176 - DNA, 12 bp, Homo sapiens
ccccacttcact

SEQ ID NO: 4558177 - DNA, 16 bp, Homo sapiens
ccccagaaagcctcct

SEQ ID NO: 4558178 - DNA, 13 bp, Homo sapiens
ccccagaccccgc

SEQ ID NO: 4558179 - DNA, 18 bp, Homo sapiens
ccccagaccgatccttcc

SEQ ID NO: 4558180 - DNA, 15 bp, Homo sapiens
ccccagactagatgt

SEQ ID NO: 4558181 - DNA, 16 bp, Homo sapiens
ccccagactctcaggt

SEQ ID NO: 4558182 - DNA, 12 bp, Homo sapiens
ccccagagagac

SEQ ID NO: 4558183 - DNA, 20 bp, Homo sapiens
ccccagagctggcgctcagc

SEQ ID NO: 4558184 - DNA, 15 bp, Homo sapiens
ccccagaggctccca

SEQ ID NO: 4558185 - DNA, 15 bp, Homo sapiens
ccccagagtggccca

SEQ ID NO: 4558186 - DNA, 16 bp, Homo sapiens
ccccagagtggcccac

SEQ ID NO: 4558187 - DNA, 22 bp, Homo sapiens
ccccagagtgtgggaagggaga

SEQ ID NO: 4558188 - DNA, 15 bp, Homo sapiens
ccccagcagaggcag

SEQ ID NO: 4558189 - DNA, 18 bp, Homo sapiens
ccccagcattccagctct

SEQ ID NO: 4558190 - DNA, 19 bp, Homo sapiens
ccccagcatttccagagca

SEQ ID NO: 4558191 - DNA, 13 bp, Homo sapiens
ccccagccagccc

SEQ ID NO: 4558192 - DNA, 14 bp, Homo sapiens
ccccagccagccct

SEQ ID NO: 4558193 - DNA, 18 bp, Homo sapiens
ccccagccagcccttccc

SEQ ID NO: 4558194 - DNA, 20 bp, Homo sapiens
ccccagcccacagagcctga

SEQ ID NO: 4558195 - DNA, 12 bp, Homo sapiens
ccccagcccacc

SEQ ID NO: 4558196 - DNA, 16 bp, Homo sapiens
ccccagcccaccctcc

SEQ ID NO: 4558197 - DNA, 16 bp, Homo sapiens
ccccagccccctccca

SEQ ID NO: 4558198 - DNA, 18 bp, Homo sapiens
ccccagccccgactccag

SEQ ID NO: 4558199 - DNA, 13 bp, Homo sapiens
ccccagccccggg

SEQ ID NO: 4558200 - DNA, 20 bp, Homo sapiens
ccccagcccctcctccctca

SEQ ID NO: 4558201 - DNA, 16 bp, Homo sapiens
ccccagcctacctctc

SEQ ID NO: 4558202 - DNA, 15 bp, Homo sapiens
ccccagcctccaggc

SEQ ID NO: 4558203 - DNA, 14 bp, Homo sapiens
ccccagcgggctgg

SEQ ID NO: 4558204 - DNA, 22 bp, Homo sapiens
ccccagcgggctggcgggcctt

SEQ ID NO: 4558205 - DNA, 15 bp, Homo sapiens
ccccagctcccacac

SEQ ID NO: 4558206 - DNA, 20 bp, Homo sapiens
ccccaggaggcagctcagga

SEQ ID NO: 4558207 - DNA, 21 bp, Homo sapiens
ccccaggaggcagctcaggat

SEQ ID NO: 4558208 - DNA, 16 bp, Homo sapiens
ccccaggccagctgcg

SEQ ID NO: 4558209 - DNA, 11 bp, Homo sapiens
ccccaggcccc

SEQ ID NO: 4558210 - DNA, 13 bp, Homo sapiens
ccccaggccccga

SEQ ID NO: 4558211 - DNA, 14 bp, Homo sapiens
ccccaggccctccc

SEQ ID NO: 4558212 - DNA, 16 bp, Homo sapiens
ccccaggccctccctg

SEQ ID NO: 4558213 - DNA, 19 bp, Homo sapiens
ccccaggctggagtgcagt

SEQ ID NO: 4558214 - DNA, 19 bp, Homo sapiens
ccccaggggtcccagccac

SEQ ID NO: 4558215 - DNA, 22 bp, Homo sapiens
ccccaggggtcccagccacccc

SEQ ID NO: 4558216 - DNA, 16 bp, Homo sapiens
ccccagggtcttccct

SEQ ID NO: 4558217 - DNA, 21 bp, Homo sapiens
ccccaggtacacctccccctg

SEQ ID NO: 4558218 - DNA, 21 bp, Homo sapiens
ccccaggtggctgacccagtc

SEQ ID NO: 4558219 - DNA, 23 bp, Homo sapiens
ccccaggtggctgacccagtccc

SEQ ID NO: 4558220 - DNA, 14 bp, Homo sapiens
ccccagtcagcctc

SEQ ID NO: 4558221 - DNA, 17 bp, Homo sapiens
ccccagtcagcctctct

SEQ ID NO: 4558222 - DNA, 18 bp, Homo sapiens
ccccagtccccacccctg

SEQ ID NO: 4558223 - DNA, 19 bp, Homo sapiens
ccccagtgcagggctggtc

SEQ ID NO: 4558224 - DNA, 13 bp, Homo sapiens
ccccagtgcctgc

SEQ ID NO: 4558225 - DNA, 14 bp, Homo sapiens
ccccagtgcctgcc

SEQ ID NO: 4558226 - DNA, 19 bp, Homo sapiens
ccccagtgcctgccactct

SEQ ID NO: 4558227 - DNA, 18 bp, Homo sapiens
ccccatatataaattatt

SEQ ID NO: 4558228 - DNA, 18 bp, Homo sapiens
ccccatccagacctggct

SEQ ID NO: 4558229 - DNA, 13 bp, Homo sapiens
ccccatccagcca

SEQ ID NO: 4558230 - DNA, 18 bp, Homo sapiens
ccccatccctaccactgt

SEQ ID NO: 4558231 - DNA, 19 bp, Homo sapiens
ccccatcctcatccctgac

SEQ ID NO: 4558232 - DNA, 17 bp, Homo sapiens
ccccatctccctgcctg

SEQ ID NO: 4558233 - DNA, 15 bp, Homo sapiens
ccccatctctcatcc

SEQ ID NO: 4558234 - DNA, 24 bp, Homo sapiens
ccccatctgcgggggcagtgctca

SEQ ID NO: 4558235 - DNA, 14 bp, Homo sapiens
ccccatctgtccag

SEQ ID NO: 4558236 - DNA, 20 bp, Homo sapiens
ccccatcttgatctttgagc

SEQ ID NO: 4558237 - DNA, 22 bp, Homo sapiens
ccccatcttgatctttgagccc

SEQ ID NO: 4558238 - DNA, 13 bp, Homo sapiens
ccccatgcctgtc

SEQ ID NO: 4558239 - DNA, 20 bp, Homo sapiens
ccccatgcctgtccagcctg

SEQ ID NO: 4558240 - DNA, 21 bp, Homo sapiens
ccccatgcctgtccagcctgg

SEQ ID NO: 4558241 - DNA, 22 bp, Homo sapiens
ccccatgcctgtccagcctggg

SEQ ID NO: 4558242 - DNA, 14 bp, Homo sapiens
ccccatgctgcctt

SEQ ID NO: 4558243 - DNA, 22 bp, Homo sapiens
ccccatgggaagacgaggccct

SEQ ID NO: 4558244 - DNA, 19 bp, Homo sapiens
ccccatggtcagccctagg

SEQ ID NO: 4558245 - DNA, 23 bp, Homo sapiens
ccccattcctgggaaatattccc

SEQ ID NO: 4558246 - DNA, 21 bp, Homo sapiens
ccccattctttgcttgaacac

SEQ ID NO: 4558247 - DNA, 13 bp, Homo sapiens
ccccattgagatc

SEQ ID NO: 4558248 - DNA, 17 bp, Homo sapiens
ccccatttcccatctgc

SEQ ID NO: 4558249 - DNA, 20 bp, Homo sapiens
ccccatttcccatctgcacc

SEQ ID NO: 4558250 - DNA, 14 bp, Homo sapiens
ccccatttctgcct

SEQ ID NO: 4558251 - DNA, 17 bp, Homo sapiens
ccccatttctgcctcgc

SEQ ID NO: 4558252 - DNA, 21 bp, Homo sapiens
cccccaacccctcctccctca

SEQ ID NO: 4558253 - DNA, 14 bp, Homo sapiens
cccccaacctcagg

SEQ ID NO: 4558254 - DNA, 15 bp, Homo sapiens
cccccaacctcaggg

SEQ ID NO: 4558255 - DNA, 19 bp, Homo sapiens
cccccaataaaccagtgtg

SEQ ID NO: 4558256 - DNA, 14 bp, Homo sapiens
cccccaataaaggc

SEQ ID NO: 4558257 - DNA, 15 bp, Homo sapiens
cccccaataaaggca

SEQ ID NO: 4558258 - DNA, 17 bp, Homo sapiens
cccccaataaaggcagc

SEQ ID NO: 4558259 - DNA, 23 bp, Homo sapiens
cccccaataaaggcagctgcctc

SEQ ID NO: 4558260 - DNA, 13 bp, Homo sapiens
cccccaatccatg

SEQ ID NO: 4558261 - DNA, 17 bp, Homo sapiens
cccccacacctcagttc

SEQ ID NO: 4558262 - DNA, 21 bp, Homo sapiens
cccccaccccttcctgtctca

SEQ ID NO: 4558263 - DNA, 15 bp, Homo sapiens
cccccactgcctgga

SEQ ID NO: 4558264 - DNA, 20 bp, Homo sapiens
cccccagaaagcctcctgcc

SEQ ID NO: 4558265 - DNA, 21 bp, Homo sapiens
cccccagaaagcctcctgccc

SEQ ID NO: 4558266 - DNA, 17 bp, Homo sapiens
cccccagagcgtccttg

SEQ ID NO: 4558267 - DNA, 20 bp, Homo sapiens
cccccagatgcagggctgca

SEQ ID NO: 4558268 - DNA, 11 bp, Homo sapiens
cccccagcact

SEQ ID NO: 4558269 - DNA, 15 bp, Homo sapiens
cccccagcactgagg

SEQ ID NO: 4558270 - DNA, 17 bp, Homo sapiens
cccccagcactgaggaa

SEQ ID NO: 4558271 - DNA, 12 bp, Homo sapiens
cccccagcactt

SEQ ID NO: 4558272 - DNA, 19 bp, Homo sapiens
cccccagcccacagagcct

SEQ ID NO: 4558273 - DNA, 21 bp, Homo sapiens
cccccagcccctcctccctca

SEQ ID NO: 4558274 - DNA, 22 bp, Homo sapiens
cccccagcccctcctccctcag

SEQ ID NO: 4558275 - DNA, 23 bp, Homo sapiens
cccccagcccctcctccctcaga

SEQ ID NO: 4558276 - DNA, 13 bp, Homo sapiens
cccccagctccca

SEQ ID NO: 4558277 - DNA, 15 bp, Homo sapiens
cccccagctcccaca

SEQ ID NO: 4558278 - DNA, 14 bp, Homo sapiens
cccccatcagccct

SEQ ID NO: 4558279 - DNA, 18 bp, Homo sapiens
cccccatccctaccactg

SEQ ID NO: 4558280 - DNA, 11 bp, Homo sapiens
cccccatctct

SEQ ID NO: 4558281 - DNA, 19 bp, Homo sapiens
cccccatgctgccttcagg

SEQ ID NO: 4558282 - DNA, 20 bp, Homo sapiens
cccccatgctgccttcaggg

SEQ ID NO: 4558283 - DNA, 11 bp, Homo sapiens
ccccccactct

SEQ ID NO: 4558284 - DNA, 12 bp, Homo sapiens
ccccccactctc

SEQ ID NO: 4558285 - DNA, 13 bp, Homo sapiens
ccccccagcactg

SEQ ID NO: 4558286 - DNA, 11 bp, Homo sapiens
ccccccagctc

SEQ ID NO: 4558287 - DNA, 12 bp, Homo sapiens
cccccctgctca

SEQ ID NO: 4558288 - DNA, 16 bp, Homo sapiens
cccccgagccctgact

SEQ ID NO: 4558289 - DNA, 18 bp, Homo sapiens
cccccgcacagccacccg

SEQ ID NO: 4558290 - DNA, 13 bp, Homo sapiens
cccccgccccaga

SEQ ID NO: 4558291 - DNA, 13 bp, Homo sapiens
cccccgcctgcca

SEQ ID NO: 4558292 - DNA, 18 bp, Homo sapiens
cccccgcgggttctagac

SEQ ID NO: 4558293 - DNA, 15 bp, Homo sapiens
cccccggccaaggac

SEQ ID NO: 4558294 - DNA, 16 bp, Homo sapiens
cccccgtggtgcctgc

SEQ ID NO: 4558295 - DNA, 10 bp, Homo sapiens
ccccctcctc

SEQ ID NO: 4558296 - DNA, 14 bp, Homo sapiens
ccccctgccagtgc

SEQ ID NO: 4558297 - DNA, 19 bp, Homo sapiens
ccccctgccccttctacac

SEQ ID NO: 4558298 - DNA, 19 bp, Homo sapiens
ccccctgctgctgcccgga

SEQ ID NO: 4558299 - DNA, 12 bp, Homo sapiens
ccccctgctggc

SEQ ID NO: 4558300 - DNA, 15 bp, Homo sapiens
ccccctggtctctgg

SEQ ID NO: 4558301 - DNA, 21 bp, Homo sapiens
ccccctgtgcagccgctgagc

SEQ ID NO: 4558302 - DNA, 15 bp, Homo sapiens
cccccttgccacccc

SEQ ID NO: 4558303 - DNA, 18 bp, Homo sapiens
ccccctttcagatgtctt

SEQ ID NO: 4558304 - DNA, 18 bp, Homo sapiens
ccccctttgggcccaggg

SEQ ID NO: 4558305 - DNA, 13 bp, Homo sapiens
ccccgactccagc

SEQ ID NO: 4558306 - DNA, 16 bp, Homo sapiens
ccccgactccagccag

SEQ ID NO: 4558307 - DNA, 19 bp, Homo sapiens
ccccgagccctgactcctg

SEQ ID NO: 4558308 - DNA, 18 bp, Homo sapiens
ccccgcagcccgcctgcc

SEQ ID NO: 4558309 - DNA, 12 bp, Homo sapiens
ccccgccacagc

SEQ ID NO: 4558310 - DNA, 16 bp, Homo sapiens
ccccgccagggctggg

SEQ ID NO: 4558311 - DNA, 15 bp, Homo sapiens
ccccgccccatgggc

SEQ ID NO: 4558312 - DNA, 16 bp, Homo sapiens
ccccgcccctcccacg

SEQ ID NO: 4558313 - DNA, 13 bp, Homo sapiens
ccccgcctccact

SEQ ID NO: 4558314 - DNA, 13 bp, Homo sapiens
ccccgcctgccac

SEQ ID NO: 4558315 - DNA, 22 bp, Homo sapiens
ccccgcctttagttctccactg

SEQ ID NO: 4558316 - DNA, 14 bp, Homo sapiens
ccccgcgcgcccac

SEQ ID NO: 4558317 - DNA, 16 bp, Homo sapiens
ccccgcgggttctaga

SEQ ID NO: 4558318 - DNA, 14 bp, Homo sapiens
ccccgctctgcatg

SEQ ID NO: 4558319 - DNA, 23 bp, Homo sapiens
ccccgctctgcatgcggcccagc

SEQ ID NO: 4558320 - DNA, 12 bp, Homo sapiens
ccccgctctgga

SEQ ID NO: 4558321 - DNA, 18 bp, Homo sapiens
ccccgcttgtccagcgcc

SEQ ID NO: 4558322 - DNA, 22 bp, Homo sapiens
ccccggcaagccacaggaagga

SEQ ID NO: 4558323 - DNA, 13 bp, Homo sapiens
ccccggccaagga

SEQ ID NO: 4558324 - DNA, 19 bp, Homo sapiens
ccccggccaaggacccagg

SEQ ID NO: 4558325 - DNA, 13 bp, Homo sapiens
ccccggccccctg

SEQ ID NO: 4558326 - DNA, 13 bp, Homo sapiens
ccccggccctggg

SEQ ID NO: 4558327 - DNA, 24 bp, Homo sapiens
ccccggctgcttggcagttgcagt

SEQ ID NO: 4558328 - DNA, 15 bp, Homo sapiens
ccccgggatattata

SEQ ID NO: 4558329 - DNA, 17 bp, Homo sapiens
ccccgggatattataga

SEQ ID NO: 4558330 - DNA, 17 bp, Homo sapiens
ccccggggaccctgtga

SEQ ID NO: 4558331 - DNA, 17 bp, Homo sapiens
ccccggggccccctggt

SEQ ID NO: 4558332 - DNA, 19 bp, Homo sapiens
ccccggggccccctggtca

SEQ ID NO: 4558333 - DNA, 16 bp, Homo sapiens
ccccggtcccccagag

SEQ ID NO: 4558334 - DNA, 17 bp, Homo sapiens
ccccgtcggactgcccc

SEQ ID NO: 4558335 - DNA, 19 bp, Homo sapiens
ccccgtcggactgccccca

SEQ ID NO: 4558336 - DNA, 21 bp, Homo sapiens
ccccgtctggggttcagcccc

SEQ ID NO: 4558337 - DNA, 17 bp, Homo sapiens
ccccgtgtttgcgcttg

SEQ ID NO: 4558338 - DNA, 20 bp, Homo sapiens
ccccgtttctccttttccta

SEQ ID NO: 4558339 - DNA, 19 bp, Homo sapiens
cccctagtaagtgccttcc

SEQ ID NO: 4558340 - DNA, 16 bp, Homo sapiens
cccctatcctctgagt

SEQ ID NO: 4558341 - DNA, 15 bp, Homo sapiens
cccctcactctgtca

SEQ ID NO: 4558342 - DNA, 22 bp, Homo sapiens
cccctcactctgtcagccagcc

SEQ ID NO: 4558343 - DNA, 20 bp, Homo sapiens
cccctcagatgatctctcca

SEQ ID NO: 4558344 - DNA, 14 bp, Homo sapiens
cccctcagccccag

SEQ ID NO: 4558345 - DNA, 14 bp, Homo sapiens
cccctcatctgcag

SEQ ID NO: 4558346 - DNA, 14 bp, Homo sapiens
cccctccaacctgg

SEQ ID NO: 4558347 - DNA, 12 bp, Homo sapiens
cccctccactgc

SEQ ID NO: 4558348 - DNA, 13 bp, Homo sapiens
cccctccactgct

SEQ ID NO: 4558349 - DNA, 14 bp, Homo sapiens
cccctccactgctg

SEQ ID NO: 4558350 - DNA, 13 bp, Homo sapiens
cccctccagcttg

SEQ ID NO: 4558351 - DNA, 15 bp, Homo sapiens
cccctccagcttgtg

SEQ ID NO: 4558352 - DNA, 18 bp, Homo sapiens
cccctcccacgcctcacc

SEQ ID NO: 4558353 - DNA, 20 bp, Homo sapiens
cccctcccacgcctcaccag

SEQ ID NO: 4558354 - DNA, 22 bp, Homo sapiens
cccctcccagacaggccctccc

SEQ ID NO: 4558355 - DNA, 15 bp, Homo sapiens
cccctcccccaaccc

SEQ ID NO: 4558356 - DNA, 16 bp, Homo sapiens
cccctcccccaacccc

SEQ ID NO: 4558357 - DNA, 21 bp, Homo sapiens
cccctcccccaacccccaccc

SEQ ID NO: 4558358 - DNA, 17 bp, Homo sapiens
cccctcccgccccttcc

SEQ ID NO: 4558359 - DNA, 12 bp, Homo sapiens
cccctccctacc

SEQ ID NO: 4558360 - DNA, 17 bp, Homo sapiens
cccctccctcttctgcc

SEQ ID NO: 4558361 - DNA, 16 bp, Homo sapiens
cccctccctgcctgct

SEQ ID NO: 4558362 - DNA, 12 bp, Homo sapiens
cccctccctggc

SEQ ID NO: 4558363 - DNA, 13 bp, Homo sapiens
cccctccctggct

SEQ ID NO: 4558364 - DNA, 14 bp, Homo sapiens
cccctccctggctc

SEQ ID NO: 4558365 - DNA, 12 bp, Homo sapiens
cccctcctccag

SEQ ID NO: 4558366 - DNA, 13 bp, Homo sapiens
cccctcctccagg

SEQ ID NO: 4558367 - DNA, 18 bp, Homo sapiens
cccctcctctgaaacagc

SEQ ID NO: 4558368 - DNA, 23 bp, Homo sapiens
cccctcctcttcccttagcctct

SEQ ID NO: 4558369 - DNA, 18 bp, Homo sapiens
cccctccttccccagacc

SEQ ID NO: 4558370 - DNA, 17 bp, Homo sapiens
cccctcgaccctgtgca

SEQ ID NO: 4558371 - DNA, 18 bp, Homo sapiens
cccctctcctccccttcc

SEQ ID NO: 4558372 - DNA, 18 bp, Homo sapiens
cccctctcgccccatccc

SEQ ID NO: 4558373 - DNA, 16 bp, Homo sapiens
cccctctctagggacc

SEQ ID NO: 4558374 - DNA, 19 bp, Homo sapiens
cccctctgcacccagaaca

SEQ ID NO: 4558375 - DNA, 13 bp, Homo sapiens
cccctctgcccct

SEQ ID NO: 4558376 - DNA, 21 bp, Homo sapiens
cccctctgccggtcgggcagc

SEQ ID NO: 4558377 - DNA, 14 bp, Homo sapiens
cccctctgccttgc

SEQ ID NO: 4558378 - DNA, 21 bp, Homo sapiens
cccctgatgacgggatgctct

SEQ ID NO: 4558379 - DNA, 13 bp, Homo sapiens
cccctgcacagtt

SEQ ID NO: 4558380 - DNA, 13 bp, Homo sapiens
cccctgcagctgg

SEQ ID NO: 4558381 - DNA, 17 bp, Homo sapiens
cccctgccagtgcctta

SEQ ID NO: 4558382 - DNA, 12 bp, Homo sapiens
cccctgcccctc

SEQ ID NO: 4558383 - DNA, 13 bp, Homo sapiens
cccctgccctggt

SEQ ID NO: 4558384 - DNA, 15 bp, Homo sapiens
cccctgcctccaccc

SEQ ID NO: 4558385 - DNA, 14 bp, Homo sapiens
cccctgcgtggggg

SEQ ID NO: 4558386 - DNA, 21 bp, Homo sapiens
cccctgcgtgggggccagtca

SEQ ID NO: 4558387 - DNA, 19 bp, Homo sapiens
cccctgctactcctgtgct

SEQ ID NO: 4558388 - DNA, 15 bp, Homo sapiens
cccctgctcccattc

SEQ ID NO: 4558389 - DNA, 13 bp, Homo sapiens
cccctgctgacct

SEQ ID NO: 4558390 - DNA, 14 bp, Homo sapiens
cccctgctgacctt

SEQ ID NO: 4558391 - DNA, 14 bp, Homo sapiens
cccctgctggctct

SEQ ID NO: 4558392 - DNA, 18 bp, Homo sapiens
cccctgctgtgctgctca

SEQ ID NO: 4558393 - DNA, 20 bp, Homo sapiens
cccctggaggctgcctccca

SEQ ID NO: 4558394 - DNA, 21 bp, Homo sapiens
cccctggaggctgcctcccaa

SEQ ID NO: 4558395 - DNA, 14 bp, Homo sapiens
cccctggcactggc

SEQ ID NO: 4558396 - DNA, 12 bp, Homo sapiens
cccctggcctcc

SEQ ID NO: 4558397 - DNA, 15 bp, Homo sapiens
cccctggctggctcc

SEQ ID NO: 4558398 - DNA, 16 bp, Homo sapiens
cccctggctttgcctc

SEQ ID NO: 4558399 - DNA, 17 bp, Homo sapiens
cccctggctttgcctct

SEQ ID NO: 4558400 - DNA, 20 bp, Homo sapiens
cccctggctttgcctcttct

SEQ ID NO: 4558401 - DNA, 18 bp, Homo sapiens
cccctgggcttggcctgc

SEQ ID NO: 4558402 - DNA, 19 bp, Homo sapiens
cccctgggcttggcctgct

SEQ ID NO: 4558403 - DNA, 20 bp, Homo sapiens
cccctgggcttggcctgctg

SEQ ID NO: 4558404 - DNA, 21 bp, Homo sapiens
cccctgggcttggcctgctgt

SEQ ID NO: 4558405 - DNA, 22 bp, Homo sapiens
cccctgggcttggcctgctgtg

SEQ ID NO: 4558406 - DNA, 23 bp, Homo sapiens
cccctgggcttggcctgctgtga

SEQ ID NO: 4558407 - DNA, 21 bp, Homo sapiens
cccctggggctgagtctccag

SEQ ID NO: 4558408 - DNA, 16 bp, Homo sapiens
cccctggtaagcagag

SEQ ID NO: 4558409 - DNA, 15 bp, Homo sapiens
cccctggttctcatc

SEQ ID NO: 4558410 - DNA, 19 bp, Homo sapiens
cccctgtcccattctagat

SEQ ID NO: 4558411 - DNA, 15 bp, Homo sapiens
cccctgtctggaaga

SEQ ID NO: 4558412 - DNA, 18 bp, Homo sapiens
cccctgtctgttcccagc

SEQ ID NO: 4558413 - DNA, 19 bp, Homo sapiens
cccctgtctgttcccagcc

SEQ ID NO: 4558414 - DNA, 19 bp, Homo sapiens
cccctgtgcagccgctgag

SEQ ID NO: 4558415 - DNA, 20 bp, Homo sapiens
cccctgtgcagccgctgagc

SEQ ID NO: 4558416 - DNA, 19 bp, Homo sapiens
cccctgtggatgctgctgc

SEQ ID NO: 4558417 - DNA, 20 bp, Homo sapiens
cccctgtggatgctgctgcc

SEQ ID NO: 4558418 - DNA, 16 bp, Homo sapiens
ccccttcaaacctaaa

SEQ ID NO: 4558419 - DNA, 11 bp, Homo sapiens
ccccttcccct

SEQ ID NO: 4558420 - DNA, 15 bp, Homo sapiens
ccccttcccctgctg

SEQ ID NO: 4558421 - DNA, 11 bp, Homo sapiens
ccccttcctgg

SEQ ID NO: 4558422 - DNA, 12 bp, Homo sapiens
ccccttcctggc

SEQ ID NO: 4558423 - DNA, 13 bp, Homo sapiens
ccccttcctggca

SEQ ID NO: 4558424 - DNA, 23 bp, Homo sapiens
ccccttcctgtctcactcttctg

SEQ ID NO: 4558425 - DNA, 19 bp, Homo sapiens
ccccttctacactctcctg

SEQ ID NO: 4558426 - DNA, 12 bp, Homo sapiens
ccccttctctgc

SEQ ID NO: 4558427 - DNA, 13 bp, Homo sapiens
ccccttctctgct

SEQ ID NO: 4558428 - DNA, 16 bp, Homo sapiens
ccccttctctgctcca

SEQ ID NO: 4558429 - DNA, 20 bp, Homo sapiens
ccccttgccaccccaccctc

SEQ ID NO: 4558430 - DNA, 17 bp, Homo sapiens
cccctttcacactggat

SEQ ID NO: 4558431 - DNA, 24 bp, Homo sapiens
cccctttcagatgtcttctgcctg

SEQ ID NO: 4558432 - DNA, 13 bp, Homo sapiens
cccctttgggccc

SEQ ID NO: 4558433 - DNA, 22 bp, Homo sapiens
ccccttttcggccccatgtatc

SEQ ID NO: 4558434 - DNA, 17 bp, Homo sapiens
cccgaagccatcacttc

SEQ ID NO: 4558435 - DNA, 18 bp, Homo sapiens
cccgaagccatcacttct

SEQ ID NO: 4558436 - DNA, 15 bp, Homo sapiens
cccgactccagccag

SEQ ID NO: 4558437 - DNA, 20 bp, Homo sapiens
cccgactccagccagcgcct

SEQ ID NO: 4558438 - DNA, 14 bp, Homo sapiens
cccgagctgtttat

SEQ ID NO: 4558439 - DNA, 17 bp, Homo sapiens
cccgaggacccagaccc

SEQ ID NO: 4558440 - DNA, 15 bp, Homo sapiens
cccgaggagctgggc

SEQ ID NO: 4558441 - DNA, 21 bp, Homo sapiens
cccgaggagctgggcccctgc

SEQ ID NO: 4558442 - DNA, 22 bp, Homo sapiens
cccgaggcagacgtctgtcagg

SEQ ID NO: 4558443 - DNA, 15 bp, Homo sapiens
cccgaggctgctaga

SEQ ID NO: 4558444 - DNA, 14 bp, Homo sapiens
cccgagtctccggg

SEQ ID NO: 4558445 - DNA, 19 bp, Homo sapiens
cccgagtttggtccctggg

SEQ ID NO: 4558446 - DNA, 16 bp, Homo sapiens
cccgcacagccacccg

SEQ ID NO: 4558447 - DNA, 18 bp, Homo sapiens
cccgcacagccacccgtg

SEQ ID NO: 4558448 - DNA, 19 bp, Homo sapiens
cccgcacgactgcgggagc

SEQ ID NO: 4558449 - DNA, 22 bp, Homo sapiens
cccgcacgactgcgggagccag

SEQ ID NO: 4558450 - DNA, 22 bp, Homo sapiens
cccgcagacggtctgtgtgctg

SEQ ID NO: 4558451 - DNA, 17 bp, Homo sapiens
cccgcagcccgcctgcc

SEQ ID NO: 4558452 - DNA, 21 bp, Homo sapiens
cccgcagcccgcctgccgtgc

SEQ ID NO: 4558453 - DNA, 18 bp, Homo sapiens
cccgcaggaactgggctg

SEQ ID NO: 4558454 - DNA, 13 bp, Homo sapiens
cccgcatgtgtgc

SEQ ID NO: 4558455 - DNA, 20 bp, Homo sapiens
cccgcatgtgtgcctggccg

SEQ ID NO: 4558456 - DNA, 12 bp, Homo sapiens
cccgccagggct

SEQ ID NO: 4558457 - DNA, 13 bp, Homo sapiens
cccgccccagagt

SEQ ID NO: 4558458 - DNA, 19 bp, Homo sapiens
cccgcctccactctagttc

SEQ ID NO: 4558459 - DNA, 13 bp, Homo sapiens
cccgcctccctct

SEQ ID NO: 4558460 - DNA, 15 bp, Homo sapiens
cccgcctccctctca

SEQ ID NO: 4558461 - DNA, 14 bp, Homo sapiens
cccgcctgccaccg

SEQ ID NO: 4558462 - DNA, 12 bp, Homo sapiens
cccgcctgccag

SEQ ID NO: 4558463 - DNA, 14 bp, Homo sapiens
cccgcctgccagtc

SEQ ID NO: 4558464 - DNA, 14 bp, Homo sapiens
cccgcctgccgtgc

SEQ ID NO: 4558465 - DNA, 16 bp, Homo sapiens
cccgcctgccgtgcat

SEQ ID NO: 4558466 - DNA, 14 bp, Homo sapiens
cccgcctgtcacaa

SEQ ID NO: 4558467 - DNA, 19 bp, Homo sapiens
cccgcgctcgcccagcagg

SEQ ID NO: 4558468 - DNA, 14 bp, Homo sapiens
cccgcgttcaagac

SEQ ID NO: 4558469 - DNA, 13 bp, Homo sapiens
cccgctcccacag

SEQ ID NO: 4558470 - DNA, 14 bp, Homo sapiens
cccgctctgcatgc

SEQ ID NO: 4558471 - DNA, 15 bp, Homo sapiens
cccgctgctgtgctc

SEQ ID NO: 4558472 - DNA, 23 bp, Homo sapiens
cccgctgtggccggtgccagctg

SEQ ID NO: 4558473 - DNA, 24 bp, Homo sapiens
cccgctgtggccggtgccagctgc

SEQ ID NO: 4558474 - DNA, 14 bp, Homo sapiens
cccgcttgtccagc

SEQ ID NO: 4558475 - DNA, 18 bp, Homo sapiens
cccgcttgtccagcgcct

SEQ ID NO: 4558476 - DNA, 18 bp, Homo sapiens
cccggccacacccagcgg

SEQ ID NO: 4558477 - DNA, 17 bp, Homo sapiens
cccggccacagctgctg

SEQ ID NO: 4558478 - DNA, 12 bp, Homo sapiens
cccggccccctg

SEQ ID NO: 4558479 - DNA, 14 bp, Homo sapiens
cccggcgccgggca

SEQ ID NO: 4558480 - DNA, 16 bp, Homo sapiens
cccggcgccgggcacc

SEQ ID NO: 4558481 - DNA, 19 bp, Homo sapiens
cccggcgcggtggctcacg

SEQ ID NO: 4558482 - DNA, 20 bp, Homo sapiens
cccggctgagccctgcccca

SEQ ID NO: 4558483 - DNA, 23 bp, Homo sapiens
cccggctgcttggcagttgcagt

SEQ ID NO: 4558484 - DNA, 18 bp, Homo sapiens
cccgggagctgggccctg

SEQ ID NO: 4558485 - DNA, 24 bp, Homo sapiens
cccgggagctgggccctgcctgca

SEQ ID NO: 4558486 - DNA, 14 bp, Homo sapiens
cccgggatattata

SEQ ID NO: 4558487 - DNA, 18 bp, Homo sapiens
cccgggatattatagaaa

SEQ ID NO: 4558488 - DNA, 17 bp, Homo sapiens
cccggggaccctgtgac

SEQ ID NO: 4558489 - DNA, 14 bp, Homo sapiens
cccggggactcaag

SEQ ID NO: 4558490 - DNA, 16 bp, Homo sapiens
cccggggccagcactt

SEQ ID NO: 4558491 - DNA, 12 bp, Homo sapiens
cccggggcctgg

SEQ ID NO: 4558492 - DNA, 13 bp, Homo sapiens
cccggggcctgga

SEQ ID NO: 4558493 - DNA, 14 bp, Homo sapiens
cccggtaccttcca

SEQ ID NO: 4558494 - DNA, 21 bp, Homo sapiens
cccggtccacaggtccaagga

SEQ ID NO: 4558495 - DNA, 16 bp, Homo sapiens
cccggtcccccagagc

SEQ ID NO: 4558496 - DNA, 21 bp, Homo sapiens
cccggtggtgggatccacgct

SEQ ID NO: 4558497 - DNA, 20 bp, Homo sapiens
cccgtaaaaactatctgaaa

SEQ ID NO: 4558498 - DNA, 14 bp, Homo sapiens
cccgtcagcatcac

SEQ ID NO: 4558499 - DNA, 15 bp, Homo sapiens
cccgtccccacacga

SEQ ID NO: 4558500 - DNA, 20 bp, Homo sapiens
cccgtcggactgcccccaga

SEQ ID NO: 4558501 - DNA, 14 bp, Homo sapiens
cccgtctctactaa

SEQ ID NO: 4558502 - DNA, 12 bp, Homo sapiens
cccgtctctctc

SEQ ID NO: 4558503 - DNA, 19 bp, Homo sapiens
cccgtctctcttggaccca

SEQ ID NO: 4558504 - DNA, 20 bp, Homo sapiens
cccgtctggggttcagcccc

SEQ ID NO: 4558505 - DNA, 23 bp, Homo sapiens
cccgtctggggttcagcccctcc

SEQ ID NO: 4558506 - DNA, 20 bp, Homo sapiens
cccgtgcatcccccctgctc

SEQ ID NO: 4558507 - DNA, 21 bp, Homo sapiens
cccgtgcatcccccctgctca

SEQ ID NO: 4558508 - DNA, 21 bp, Homo sapiens
cccgtgcccccgcctgccacc

SEQ ID NO: 4558509 - DNA, 15 bp, Homo sapiens
cccgtgcccgcagga

SEQ ID NO: 4558510 - DNA, 13 bp, Homo sapiens
cccgtgcctggga

SEQ ID NO: 4558511 - DNA, 23 bp, Homo sapiens
cccgtgggtgggcctggccctgc

SEQ ID NO: 4558512 - DNA, 16 bp, Homo sapiens
cccgtggtgcctgcac

SEQ ID NO: 4558513 - DNA, 21 bp, Homo sapiens
cccgtggtggcggtggctgcc

SEQ ID NO: 4558514 - DNA, 15 bp, Homo sapiens
cccgtgtgtgtggcc

SEQ ID NO: 4558515 - DNA, 18 bp, Homo sapiens
ccctaaactttggccttt

SEQ ID NO: 4558516 - DNA, 16 bp, Homo sapiens
ccctaaccccttgtcc

SEQ ID NO: 4558517 - DNA, 20 bp, Homo sapiens
ccctaagtggctgccttctt

SEQ ID NO: 4558518 - DNA, 13 bp, Homo sapiens
ccctacctcaggc

SEQ ID NO: 4558519 - DNA, 22 bp, Homo sapiens
ccctacctgattggtgcaaccc

SEQ ID NO: 4558520 - DNA, 12 bp, Homo sapiens
ccctacctgctt

SEQ ID NO: 4558521 - DNA, 22 bp, Homo sapiens
ccctactgagtactctttctct

SEQ ID NO: 4558522 - DNA, 13 bp, Homo sapiens
ccctacttgcagc

SEQ ID NO: 4558523 - DNA, 21 bp, Homo sapiens
ccctagagcctgcctggagcg

SEQ ID NO: 4558524 - DNA, 13 bp, Homo sapiens
ccctagatccaga

SEQ ID NO: 4558525 - DNA, 17 bp, Homo sapiens
ccctagcaatacaggga

SEQ ID NO: 4558526 - DNA, 18 bp, Homo sapiens
ccctagcaatacagggag

SEQ ID NO: 4558527 - DNA, 19 bp, Homo sapiens
ccctagcaatacagggagg

SEQ ID NO: 4558528 - DNA, 20 bp, Homo sapiens
ccctagcggctgctccttca

SEQ ID NO: 4558529 - DNA, 19 bp, Homo sapiens
ccctagctttagaccctgg

SEQ ID NO: 4558530 - DNA, 16 bp, Homo sapiens
ccctagtcccttcccc

SEQ ID NO: 4558531 - DNA, 19 bp, Homo sapiens
ccctagttagcatccaggc

SEQ ID NO: 4558532 - DNA, 20 bp, Homo sapiens
ccctagttagcatccaggct

SEQ ID NO: 4558533 - DNA, 18 bp, Homo sapiens
ccctatcagttgattttt

SEQ ID NO: 4558534 - DNA, 16 bp, Homo sapiens
ccctatccacccagcc

SEQ ID NO: 4558535 - DNA, 22 bp, Homo sapiens
ccctcaaagaagtcggaatgtc

SEQ ID NO: 4558536 - DNA, 23 bp, Homo sapiens
ccctcaaagaagtcggaatgtca

SEQ ID NO: 4558537 - DNA, 17 bp, Homo sapiens
ccctcaatccaccttca

SEQ ID NO: 4558538 - DNA, 18 bp, Homo sapiens
ccctcaccccctcccacc

SEQ ID NO: 4558539 - DNA, 15 bp, Homo sapiens
ccctcactctgtcag

SEQ ID NO: 4558540 - DNA, 23 bp, Homo sapiens
ccctcactctgtcagccagccgc

SEQ ID NO: 4558541 - DNA, 18 bp, Homo sapiens
ccctcagacatttatata

SEQ ID NO: 4558542 - DNA, 12 bp, Homo sapiens
ccctcagaccca

SEQ ID NO: 4558543 - DNA, 14 bp, Homo sapiens
ccctcagacccagg

SEQ ID NO: 4558544 - DNA, 18 bp, Homo sapiens
ccctcagacccaggagtc

SEQ ID NO: 4558545 - DNA, 22 bp, Homo sapiens
ccctcagacccaggagtccagc

SEQ ID NO: 4558546 - DNA, 22 bp, Homo sapiens
ccctcagactcagaggtccagg

SEQ ID NO: 4558547 - DNA, 18 bp, Homo sapiens
ccctcagccccagcccag

SEQ ID NO: 4558548 - DNA, 16 bp, Homo sapiens
ccctcagctctctggg

SEQ ID NO: 4558549 - DNA, 23 bp, Homo sapiens
ccctcaggcccaggagtccaggc

SEQ ID NO: 4558550 - DNA, 14 bp, Homo sapiens
ccctcatctgtccc

SEQ ID NO: 4558551 - DNA, 17 bp, Homo sapiens
ccctcattcaggaaaac

SEQ ID NO: 4558552 - DNA, 21 bp, Homo sapiens
ccctccaaatgtcctttctca

SEQ ID NO: 4558553 - DNA, 16 bp, Homo sapiens
ccctccaccccacaga

SEQ ID NO: 4558554 - DNA, 18 bp, Homo sapiens
ccctccacgcctcctggc

SEQ ID NO: 4558555 - DNA, 18 bp, Homo sapiens
ccctccactcctcatccc

SEQ ID NO: 4558556 - DNA, 20 bp, Homo sapiens
ccctccagcttgtggagccc

SEQ ID NO: 4558557 - DNA, 21 bp, Homo sapiens
ccctccagggtcctctcttcc

SEQ ID NO: 4558558 - DNA, 16 bp, Homo sapiens
ccctccagtgggctga

SEQ ID NO: 4558559 - DNA, 23 bp, Homo sapiens
ccctccattctgcactcagaaaa

SEQ ID NO: 4558560 - DNA, 22 bp, Homo sapiens
ccctccattgggcacagtccag

SEQ ID NO: 4558561 - DNA, 21 bp, Homo sapiens
ccctcccaagcgttcctggcc

SEQ ID NO: 4558562 - DNA, 13 bp, Homo sapiens
ccctcccacgcct

SEQ ID NO: 4558563 - DNA, 21 bp, Homo sapiens
ccctcccagacaggccctccc

SEQ ID NO: 4558564 - DNA, 11 bp, Homo sapiens
ccctccccact

SEQ ID NO: 4558565 - DNA, 11 bp, Homo sapiens
ccctccccaga

SEQ ID NO: 4558566 - DNA, 12 bp, Homo sapiens
ccctccccagaa

SEQ ID NO: 4558567 - DNA, 18 bp, Homo sapiens
ccctccccagccagccct

SEQ ID NO: 4558568 - DNA, 13 bp, Homo sapiens
ccctccccagggg

SEQ ID NO: 4558569 - DNA, 13 bp, Homo sapiens
ccctcccccactt

SEQ ID NO: 4558570 - DNA, 21 bp, Homo sapiens
ccctcccccattccctccatt

SEQ ID NO: 4558571 - DNA, 13 bp, Homo sapiens
ccctccccctcct

SEQ ID NO: 4558572 - DNA, 16 bp, Homo sapiens
ccctccccgccctttt

SEQ ID NO: 4558573 - DNA, 17 bp, Homo sapiens
ccctccccgcccttttt

SEQ ID NO: 4558574 - DNA, 13 bp, Homo sapiens
ccctccctccagg

SEQ ID NO: 4558575 - DNA, 13 bp, Homo sapiens
ccctccctgactc

SEQ ID NO: 4558576 - DNA, 20 bp, Homo sapiens
ccctccctgcctgagggcag

SEQ ID NO: 4558577 - DNA, 15 bp, Homo sapiens
ccctccctgcctgct

SEQ ID NO: 4558578 - DNA, 15 bp, Homo sapiens
ccctccctgctagca

SEQ ID NO: 4558579 - DNA, 23 bp, Homo sapiens
ccctccctgtctccagggccccc

SEQ ID NO: 4558580 - DNA, 14 bp, Homo sapiens
ccctccctttctcc

SEQ ID NO: 4558581 - DNA, 16 bp, Homo sapiens
ccctccctttctcccc

SEQ ID NO: 4558582 - DNA, 18 bp, Homo sapiens
ccctccggcgggtgacag

SEQ ID NO: 4558583 - DNA, 23 bp, Homo sapiens
ccctccggcgggtgacagctccg

SEQ ID NO: 4558584 - DNA, 12 bp, Homo sapiens
ccctcctagctc

SEQ ID NO: 4558585 - DNA, 13 bp, Homo sapiens
ccctcctcacccc

SEQ ID NO: 4558586 - DNA, 12 bp, Homo sapiens
ccctcctcacct

SEQ ID NO: 4558587 - DNA, 13 bp, Homo sapiens
ccctcctcacctc

SEQ ID NO: 4558588 - DNA, 23 bp, Homo sapiens
ccctcctcacctctggactggct

SEQ ID NO: 4558589 - DNA, 15 bp, Homo sapiens
ccctcctcagccagc

SEQ ID NO: 4558590 - DNA, 13 bp, Homo sapiens
ccctcctccactc

SEQ ID NO: 4558591 - DNA, 14 bp, Homo sapiens
ccctcctccactct

SEQ ID NO: 4558592 - DNA, 15 bp, Homo sapiens
ccctcctccccagag

SEQ ID NO: 4558593 - DNA, 17 bp, Homo sapiens
ccctcctccccagagct

SEQ ID NO: 4558594 - DNA, 16 bp, Homo sapiens
ccctcctccctcaggc

SEQ ID NO: 4558595 - DNA, 13 bp, Homo sapiens
ccctcctctgaaa

SEQ ID NO: 4558596 - DNA, 14 bp, Homo sapiens
ccctcctctgaaac

SEQ ID NO: 4558597 - DNA, 21 bp, Homo sapiens
ccctcctctgaaacagctgcc

SEQ ID NO: 4558598 - DNA, 12 bp, Homo sapiens
ccctcctctgcc

SEQ ID NO: 4558599 - DNA, 15 bp, Homo sapiens
ccctcctgggccctg

SEQ ID NO: 4558600 - DNA, 17 bp, Homo sapiens
ccctcctgggccctggg

SEQ ID NO: 4558601 - DNA, 19 bp, Homo sapiens
ccctcctgggccctgggct

SEQ ID NO: 4558602 - DNA, 18 bp, Homo sapiens
ccctcctgtcttcccagg

SEQ ID NO: 4558603 - DNA, 13 bp, Homo sapiens
ccctcctgttgca

SEQ ID NO: 4558604 - DNA, 14 bp, Homo sapiens
ccctccttccccag

SEQ ID NO: 4558605 - DNA, 19 bp, Homo sapiens
ccctccttggtgcctctgg

SEQ ID NO: 4558606 - DNA, 13 bp, Homo sapiens
ccctccttttaaa

SEQ ID NO: 4558607 - DNA, 19 bp, Homo sapiens
ccctccttttggcctgggg

SEQ ID NO: 4558608 - DNA, 17 bp, Homo sapiens
ccctcgaccctgtgcag

SEQ ID NO: 4558609 - DNA, 16 bp, Homo sapiens
ccctcgccacctttca

SEQ ID NO: 4558610 - DNA, 14 bp, Homo sapiens
ccctcgctgccagc

SEQ ID NO: 4558611 - DNA, 22 bp, Homo sapiens
ccctcgggcccagcccccacag

SEQ ID NO: 4558612 - DNA, 18 bp, Homo sapiens
ccctcgggtctcctcact

SEQ ID NO: 4558613 - DNA, 19 bp, Homo sapiens
ccctcgggtctcctcactc

SEQ ID NO: 4558614 - DNA, 21 bp, Homo sapiens
ccctcgggtctcctcactccc

SEQ ID NO: 4558615 - DNA, 15 bp, Homo sapiens
ccctctaacccagtg

SEQ ID NO: 4558616 - DNA, 16 bp, Homo sapiens
ccctctaacccagtgg

SEQ ID NO: 4558617 - DNA, 14 bp, Homo sapiens
ccctctaatttctc

SEQ ID NO: 4558618 - DNA, 15 bp, Homo sapiens
ccctctacagagctt

SEQ ID NO: 4558619 - DNA, 18 bp, Homo sapiens
ccctctacagagcttccc

SEQ ID NO: 4558620 - DNA, 21 bp, Homo sapiens
ccctctacagagcttccctga

SEQ ID NO: 4558621 - DNA, 14 bp, Homo sapiens
ccctctagtgcctt

SEQ ID NO: 4558622 - DNA, 20 bp, Homo sapiens
ccctctcagaggcctgctgc

SEQ ID NO: 4558623 - DNA, 15 bp, Homo sapiens
ccctctccaagacag

SEQ ID NO: 4558624 - DNA, 21 bp, Homo sapiens
ccctctccaagacagcagcag

SEQ ID NO: 4558625 - DNA, 12 bp, Homo sapiens
ccctctcctgcc

SEQ ID NO: 4558626 - DNA, 12 bp, Homo sapiens
ccctctcctggg

SEQ ID NO: 4558627 - DNA, 13 bp, Homo sapiens
ccctctcctgggg

SEQ ID NO: 4558628 - DNA, 15 bp, Homo sapiens
ccctctctagggacc

SEQ ID NO: 4558629 - DNA, 16 bp, Homo sapiens
ccctctctagggaccc

SEQ ID NO: 4558630 - DNA, 19 bp, Homo sapiens
ccctctctagggacccctc

SEQ ID NO: 4558631 - DNA, 22 bp, Homo sapiens
ccctctctcataccctccctcc

SEQ ID NO: 4558632 - DNA, 18 bp, Homo sapiens
ccctctctccctgcctca

SEQ ID NO: 4558633 - DNA, 13 bp, Homo sapiens
ccctctctctcac

SEQ ID NO: 4558634 - DNA, 18 bp, Homo sapiens
ccctctctcttctgctcc

SEQ ID NO: 4558635 - DNA, 22 bp, Homo sapiens
ccctctctcttctgctccaccc

SEQ ID NO: 4558636 - DNA, 20 bp, Homo sapiens
ccctctctgcagacttccca

SEQ ID NO: 4558637 - DNA, 16 bp, Homo sapiens
ccctctctttctctgg

SEQ ID NO: 4558638 - DNA, 16 bp, Homo sapiens
ccctctgcacccagaa

SEQ ID NO: 4558639 - DNA, 20 bp, Homo sapiens
ccctctgccggtcgggcagc

SEQ ID NO: 4558640 - DNA, 13 bp, Homo sapiens
ccctctggccctg

SEQ ID NO: 4558641 - DNA, 21 bp, Homo sapiens
ccctctgggcacgcctgctgg

SEQ ID NO: 4558642 - DNA, 23 bp, Homo sapiens
ccctctgggcacgcctgctggcc

SEQ ID NO: 4558643 - DNA, 13 bp, Homo sapiens
ccctcttctgccc

SEQ ID NO: 4558644 - DNA, 15 bp, Homo sapiens
ccctctttccctgcg

SEQ ID NO: 4558645 - DNA, 16 bp, Homo sapiens
ccctctttccctgcga

SEQ ID NO: 4558646 - DNA, 18 bp, Homo sapiens
ccctctttccctgcgaga

SEQ ID NO: 4558647 - DNA, 19 bp, Homo sapiens
ccctctttgggcagtgcca

SEQ ID NO: 4558648 - DNA, 14 bp, Homo sapiens
ccctgaaaacccag

SEQ ID NO: 4558649 - DNA, 12 bp, Homo sapiens
ccctgaactcag

SEQ ID NO: 4558650 - DNA, 21 bp, Homo sapiens
ccctgaatctgctgagaggca

SEQ ID NO: 4558651 - DNA, 22 bp, Homo sapiens
ccctgaatctgctgagaggcac

SEQ ID NO: 4558652 - DNA, 18 bp, Homo sapiens
ccctgacctccgcccctg

SEQ ID NO: 4558653 - DNA, 18 bp, Homo sapiens
ccctgaccttagcgttct

SEQ ID NO: 4558654 - DNA, 22 bp, Homo sapiens
ccctgaccttagcgttctggac

SEQ ID NO: 4558655 - DNA, 17 bp, Homo sapiens
ccctgactcctctggct

SEQ ID NO: 4558656 - DNA, 16 bp, Homo sapiens
ccctgactcctggact

SEQ ID NO: 4558657 - DNA, 13 bp, Homo sapiens
ccctgactgggag

SEQ ID NO: 4558658 - DNA, 21 bp, Homo sapiens
ccctgagcactcctggtgcag

SEQ ID NO: 4558659 - DNA, 14 bp, Homo sapiens
ccctgagctgaggc

SEQ ID NO: 4558660 - DNA, 14 bp, Homo sapiens
ccctgaggccctgg

SEQ ID NO: 4558661 - DNA, 17 bp, Homo sapiens
ccctgaggccctgggct

SEQ ID NO: 4558662 - DNA, 17 bp, Homo sapiens
ccctgagtcaccaggaa

SEQ ID NO: 4558663 - DNA, 17 bp, Homo sapiens
ccctgagttgggcagcc

SEQ ID NO: 4558664 - DNA, 19 bp, Homo sapiens
ccctgataacaacctggag

SEQ ID NO: 4558665 - DNA, 16 bp, Homo sapiens
ccctgatggcctttgg

SEQ ID NO: 4558666 - DNA, 18 bp, Homo sapiens
ccctgatggcctttggac

SEQ ID NO: 4558667 - DNA, 20 bp, Homo sapiens
ccctgatgtgtcctcaggga

SEQ ID NO: 4558668 - DNA, 17 bp, Homo sapiens
ccctgcaaaactccagg

SEQ ID NO: 4558669 - DNA, 16 bp, Homo sapiens
ccctgcaactcagccc

SEQ ID NO: 4558670 - DNA, 13 bp, Homo sapiens
ccctgcacagttg

SEQ ID NO: 4558671 - DNA, 13 bp, Homo sapiens
ccctgcacgtcat

SEQ ID NO: 4558672 - DNA, 21 bp, Homo sapiens
ccctgcagacctcaagccatc

SEQ ID NO: 4558673 - DNA, 12 bp, Homo sapiens
ccctgcagccca

SEQ ID NO: 4558674 - DNA, 13 bp, Homo sapiens
ccctgcagcccac

SEQ ID NO: 4558675 - DNA, 14 bp, Homo sapiens
ccctgcagctggaa

SEQ ID NO: 4558676 - DNA, 16 bp, Homo sapiens
ccctgccacagccaga

SEQ ID NO: 4558677 - DNA, 14 bp, Homo sapiens
ccctgccagggcag

SEQ ID NO: 4558678 - DNA, 14 bp, Homo sapiens
ccctgccagtgcct

SEQ ID NO: 4558679 - DNA, 17 bp, Homo sapiens
ccctgcccaaaccctta

SEQ ID NO: 4558680 - DNA, 16 bp, Homo sapiens
ccctgcccagagctga

SEQ ID NO: 4558681 - DNA, 17 bp, Homo sapiens
ccctgcccagagctgag

SEQ ID NO: 4558682 - DNA, 13 bp, Homo sapiens
ccctgcccccacc

SEQ ID NO: 4558683 - DNA, 23 bp, Homo sapiens
ccctgcccccaggactgggccac

SEQ ID NO: 4558684 - DNA, 12 bp, Homo sapiens
ccctgccctggt

SEQ ID NO: 4558685 - DNA, 14 bp, Homo sapiens
ccctgccctggtcc

SEQ ID NO: 4558686 - DNA, 15 bp, Homo sapiens
ccctgcctcagccag

SEQ ID NO: 4558687 - DNA, 23 bp, Homo sapiens
ccctgcctcaggccaagggacca

SEQ ID NO: 4558688 - DNA, 18 bp, Homo sapiens
ccctgcctcccattctgc

SEQ ID NO: 4558689 - DNA, 14 bp, Homo sapiens
ccctgcctcctgcc

SEQ ID NO: 4558690 - DNA, 18 bp, Homo sapiens
ccctgcctcctgcctatg

SEQ ID NO: 4558691 - DNA, 17 bp, Homo sapiens
ccctgcctgcagccagg

SEQ ID NO: 4558692 - DNA, 19 bp, Homo sapiens
ccctgcctgcagccagggc

SEQ ID NO: 4558693 - DNA, 20 bp, Homo sapiens
ccctgcctgcagccagggct

SEQ ID NO: 4558694 - DNA, 18 bp, Homo sapiens
ccctgcctggaccagcct

SEQ ID NO: 4558695 - DNA, 13 bp, Homo sapiens
ccctgcctgtggc

SEQ ID NO: 4558696 - DNA, 14 bp, Homo sapiens
ccctgcctgtggca

SEQ ID NO: 4558697 - DNA, 14 bp, Homo sapiens
ccctgcgccccgca

SEQ ID NO: 4558698 - DNA, 20 bp, Homo sapiens
ccctgcgccccgcacgactg

SEQ ID NO: 4558699 - DNA, 13 bp, Homo sapiens
ccctgcggagacc

SEQ ID NO: 4558700 - DNA, 20 bp, Homo sapiens
ccctgcggcctccacacctg

SEQ ID NO: 4558701 - DNA, 23 bp, Homo sapiens
ccctgcgggcgcgggcagccacc

SEQ ID NO: 4558702 - DNA, 22 bp, Homo sapiens
ccctgcgtgggggccagtcagg

SEQ ID NO: 4558703 - DNA, 22 bp, Homo sapiens
ccctgctactcctgtgctctgg

SEQ ID NO: 4558704 - DNA, 14 bp, Homo sapiens
ccctgctagcacag

SEQ ID NO: 4558705 - DNA, 17 bp, Homo sapiens
ccctgctagcacagagg

SEQ ID NO: 4558706 - DNA, 16 bp, Homo sapiens
ccctgctcactgggcc

SEQ ID NO: 4558707 - DNA, 16 bp, Homo sapiens
ccctgctcagtaaagc

SEQ ID NO: 4558708 - DNA, 18 bp, Homo sapiens
ccctgctccaccagcagc

SEQ ID NO: 4558709 - DNA, 21 bp, Homo sapiens
ccctgctcccattcctccctc

SEQ ID NO: 4558710 - DNA, 14 bp, Homo sapiens
ccctgctccctgcc

SEQ ID NO: 4558711 - DNA, 15 bp, Homo sapiens
ccctgctccctgcct

SEQ ID NO: 4558712 - DNA, 13 bp, Homo sapiens
ccctgctcctagc

SEQ ID NO: 4558713 - DNA, 23 bp, Homo sapiens
ccctgctcttctctccccagccc

SEQ ID NO: 4558714 - DNA, 13 bp, Homo sapiens
ccctgctgacctt

SEQ ID NO: 4558715 - DNA, 17 bp, Homo sapiens
ccctgctggccgcctca

SEQ ID NO: 4558716 - DNA, 14 bp, Homo sapiens
ccctgctggctctt

SEQ ID NO: 4558717 - DNA, 15 bp, Homo sapiens
ccctgctggctcttc

SEQ ID NO: 4558718 - DNA, 11 bp, Homo sapiens
ccctgctgggg

SEQ ID NO: 4558719 - DNA, 19 bp, Homo sapiens
ccctgctggggaagaacag

SEQ ID NO: 4558720 - DNA, 16 bp, Homo sapiens
ccctgctgtgctgctc

SEQ ID NO: 4558721 - DNA, 16 bp, Homo sapiens
ccctgcttccaggaaa

SEQ ID NO: 4558722 - DNA, 16 bp, Homo sapiens
ccctgctttgcatctt

SEQ ID NO: 4558723 - DNA, 19 bp, Homo sapiens
ccctggaaaccttccaccc

SEQ ID NO: 4558724 - DNA, 14 bp, Homo sapiens
ccctggacttctgg

SEQ ID NO: 4558725 - DNA, 22 bp, Homo sapiens
ccctggagaaaaaaattgctct

SEQ ID NO: 4558726 - DNA, 14 bp, Homo sapiens
ccctggagcaggag

SEQ ID NO: 4558727 - DNA, 14 bp, Homo sapiens
ccctggagcctcag

SEQ ID NO: 4558728 - DNA, 23 bp, Homo sapiens
ccctggaggacagagggagacag

SEQ ID NO: 4558729 - DNA, 11 bp, Homo sapiens
ccctggaggat

SEQ ID NO: 4558730 - DNA, 15 bp, Homo sapiens
ccctggaggctgcct

SEQ ID NO: 4558731 - DNA, 17 bp, Homo sapiens
ccctggaggctgcctcc

SEQ ID NO: 4558732 - DNA, 14 bp, Homo sapiens
ccctggagggaagg

SEQ ID NO: 4558733 - DNA, 15 bp, Homo sapiens
ccctggagggcaagc

SEQ ID NO: 4558734 - DNA, 23 bp, Homo sapiens
ccctggagggcaagccctgccca

SEQ ID NO: 4558735 - DNA, 20 bp, Homo sapiens
ccctggagtgtggctgagga

SEQ ID NO: 4558736 - DNA, 21 bp, Homo sapiens
ccctggagtgtggctgaggag

SEQ ID NO: 4558737 - DNA, 23 bp, Homo sapiens
ccctggagtgtggctgaggaggc

SEQ ID NO: 4558738 - DNA, 13 bp, Homo sapiens
ccctggcactggc

SEQ ID NO: 4558739 - DNA, 20 bp, Homo sapiens
ccctggcactggcaaacagg

SEQ ID NO: 4558740 - DNA, 18 bp, Homo sapiens
ccctggcagacacaaccc

SEQ ID NO: 4558741 - DNA, 12 bp, Homo sapiens
ccctggcccagg

SEQ ID NO: 4558742 - DNA, 16 bp, Homo sapiens
ccctggcccaggtgcc

SEQ ID NO: 4558743 - DNA, 11 bp, Homo sapiens
ccctggccccc

SEQ ID NO: 4558744 - DNA, 19 bp, Homo sapiens
ccctggcccccatcagccc

SEQ ID NO: 4558745 - DNA, 22 bp, Homo sapiens
ccctggcccccatcagccctgc

SEQ ID NO: 4558746 - DNA, 21 bp, Homo sapiens
ccctggcctccggcgtcagcc

SEQ ID NO: 4558747 - DNA, 21 bp, Homo sapiens
ccctggcctgctgggctctcc

SEQ ID NO: 4558748 - DNA, 12 bp, Homo sapiens
ccctggctccct

SEQ ID NO: 4558749 - DNA, 16 bp, Homo sapiens
ccctggctccctcctc

SEQ ID NO: 4558750 - DNA, 22 bp, Homo sapiens
ccctggctgttctgtggttcct

SEQ ID NO: 4558751 - DNA, 15 bp, Homo sapiens
ccctggcttctgtgg

SEQ ID NO: 4558752 - DNA, 22 bp, Homo sapiens
ccctggcttctgtggggcccct

SEQ ID NO: 4558753 - DNA, 15 bp, Homo sapiens
ccctggctttgcctc

SEQ ID NO: 4558754 - DNA, 22 bp, Homo sapiens
ccctggctttgcctcttctttg

SEQ ID NO: 4558755 - DNA, 18 bp, Homo sapiens
ccctgggaaggcctcttg

SEQ ID NO: 4558756 - DNA, 14 bp, Homo sapiens
ccctgggagagaag

SEQ ID NO: 4558757 - DNA, 23 bp, Homo sapiens
ccctgggagtgttcccgtgcctg

SEQ ID NO: 4558758 - DNA, 19 bp, Homo sapiens
ccctgggcatcttctggct

SEQ ID NO: 4558759 - DNA, 16 bp, Homo sapiens
ccctgggccccaccac

SEQ ID NO: 4558760 - DNA, 18 bp, Homo sapiens
ccctgggccccaccacct

SEQ ID NO: 4558761 - DNA, 20 bp, Homo sapiens
ccctgggccccaccacctag

SEQ ID NO: 4558762 - DNA, 17 bp, Homo sapiens
ccctgggcccctccacg

SEQ ID NO: 4558763 - DNA, 19 bp, Homo sapiens
ccctgggcccctccacgcc

SEQ ID NO: 4558764 - DNA, 19 bp, Homo sapiens
ccctgggctgggtgctggg

SEQ ID NO: 4558765 - DNA, 17 bp, Homo sapiens
ccctgggcttggcctgc

SEQ ID NO: 4558766 - DNA, 23 bp, Homo sapiens
ccctggggacttcaactgcccag

SEQ ID NO: 4558767 - DNA, 18 bp, Homo sapiens
ccctggggcccagcccct

SEQ ID NO: 4558768 - DNA, 20 bp, Homo sapiens
ccctggggcgtgcagcaggg

SEQ ID NO: 4558769 - DNA, 19 bp, Homo sapiens
ccctggggctgagtctcca

SEQ ID NO: 4558770 - DNA, 19 bp, Homo sapiens
ccctgggggaagccctgga

SEQ ID NO: 4558771 - DNA, 20 bp, Homo sapiens
ccctgggggaagccctggat

SEQ ID NO: 4558772 - DNA, 15 bp, Homo sapiens
ccctggtaagcagag

SEQ ID NO: 4558773 - DNA, 19 bp, Homo sapiens
ccctggtaatagctgtaaa

SEQ ID NO: 4558774 - DNA, 20 bp, Homo sapiens
ccctggtctcagcagcgacc

SEQ ID NO: 4558775 - DNA, 15 bp, Homo sapiens
ccctggtctctggtc

SEQ ID NO: 4558776 - DNA, 14 bp, Homo sapiens
ccctggtgtgtttc

SEQ ID NO: 4558777 - DNA, 12 bp, Homo sapiens
ccctggtgtttc

SEQ ID NO: 4558778 - DNA, 20 bp, Homo sapiens
ccctggtgtttctagcactg

SEQ ID NO: 4558779 - DNA, 22 bp, Homo sapiens
ccctggtgtttctagcactggc

SEQ ID NO: 4558780 - DNA, 15 bp, Homo sapiens
ccctggttctcatct

SEQ ID NO: 4558781 - DNA, 18 bp, Homo sapiens
ccctgtaaaagagagggg

SEQ ID NO: 4558782 - DNA, 19 bp, Homo sapiens
ccctgtaaaagagaggggc

SEQ ID NO: 4558783 - DNA, 20 bp, Homo sapiens
ccctgtacacagtgccccct

SEQ ID NO: 4558784 - DNA, 13 bp, Homo sapiens
ccctgtagctctg

SEQ ID NO: 4558785 - DNA, 18 bp, Homo sapiens
ccctgtagctctgcctcc

SEQ ID NO: 4558786 - DNA, 17 bp, Homo sapiens
ccctgtcaagcttctct

SEQ ID NO: 4558787 - DNA, 14 bp, Homo sapiens
ccctgtcaccaagc

SEQ ID NO: 4558788 - DNA, 22 bp, Homo sapiens
ccctgtccaaaagcgccctcac

SEQ ID NO: 4558789 - DNA, 12 bp, Homo sapiens
ccctgtcccagg

SEQ ID NO: 4558790 - DNA, 21 bp, Homo sapiens
ccctgtcccaggccggcccag

SEQ ID NO: 4558791 - DNA, 16 bp, Homo sapiens
ccctgtcctcctcgga

SEQ ID NO: 4558792 - DNA, 18 bp, Homo sapiens
ccctgtcctgcacaccct

SEQ ID NO: 4558793 - DNA, 22 bp, Homo sapiens
ccctgtcctgcacaccctgggc

SEQ ID NO: 4558794 - DNA, 14 bp, Homo sapiens
ccctgtccttccct

SEQ ID NO: 4558795 - DNA, 16 bp, Homo sapiens
ccctgtccttccctgt

SEQ ID NO: 4558796 - DNA, 19 bp, Homo sapiens
ccctgtcgcccctcctttt

SEQ ID NO: 4558797 - DNA, 20 bp, Homo sapiens
ccctgtctccagggccccca

SEQ ID NO: 4558798 - DNA, 22 bp, Homo sapiens
ccctgtctgtagagggccctgg

SEQ ID NO: 4558799 - DNA, 16 bp, Homo sapiens
ccctgtctgttcccag

SEQ ID NO: 4558800 - DNA, 17 bp, Homo sapiens
ccctgtgacatggtgcc

SEQ ID NO: 4558801 - DNA, 18 bp, Homo sapiens
ccctgtgacatggtgcct

SEQ ID NO: 4558802 - DNA, 21 bp, Homo sapiens
ccctgtgacatggtgcctgag

SEQ ID NO: 4558803 - DNA, 22 bp, Homo sapiens
ccctgtgacatggtgcctgaga

SEQ ID NO: 4558804 - DNA, 22 bp, Homo sapiens
ccctgtgccttgtcacgccaga

SEQ ID NO: 4558805 - DNA, 21 bp, Homo sapiens
ccctgtgcttggaaacctttt

SEQ ID NO: 4558806 - DNA, 17 bp, Homo sapiens
ccctgtgggagccgcag

SEQ ID NO: 4558807 - DNA, 23 bp, Homo sapiens
ccctgtgggggtggccatccctg

SEQ ID NO: 4558808 - DNA, 22 bp, Homo sapiens
ccctgtgttctgggctggggcc

SEQ ID NO: 4558809 - DNA, 15 bp, Homo sapiens
ccctgttcctggagg

SEQ ID NO: 4558810 - DNA, 16 bp, Homo sapiens
ccctgttttttgtaga

SEQ ID NO: 4558811 - DNA, 22 bp, Homo sapiens
cccttaaacacaggctgtcctt

SEQ ID NO: 4558812 - DNA, 17 bp, Homo sapiens
cccttaaggtctccaaa

SEQ ID NO: 4558813 - DNA, 22 bp, Homo sapiens
cccttaccccttagcctccctg

SEQ ID NO: 4558814 - DNA, 14 bp, Homo sapiens
cccttagcctccct

SEQ ID NO: 4558815 - DNA, 17 bp, Homo sapiens
cccttagcctctcccac

SEQ ID NO: 4558816 - DNA, 18 bp, Homo sapiens
cccttagcctctcccacc

SEQ ID NO: 4558817 - DNA, 23 bp, Homo sapiens
cccttaggatggggctcccagct

SEQ ID NO: 4558818 - DNA, 19 bp, Homo sapiens
cccttattgctgtcctgga

SEQ ID NO: 4558819 - DNA, 16 bp, Homo sapiens
cccttccactgagggc

SEQ ID NO: 4558820 - DNA, 21 bp, Homo sapiens
cccttccatgtgcctttcttt

SEQ ID NO: 4558821 - DNA, 23 bp, Homo sapiens
cccttcccacaggacatttctct

SEQ ID NO: 4558822 - DNA, 19 bp, Homo sapiens
cccttcccatttcttccca

SEQ ID NO: 4558823 - DNA, 14 bp, Homo sapiens
cccttccccatggg

SEQ ID NO: 4558824 - DNA, 15 bp, Homo sapiens
cccttccccatggga

SEQ ID NO: 4558825 - DNA, 17 bp, Homo sapiens
cccttcccctccctggc

SEQ ID NO: 4558826 - DNA, 19 bp, Homo sapiens
cccttcccctccctggctc

SEQ ID NO: 4558827 - DNA, 13 bp, Homo sapiens
cccttccccttct

SEQ ID NO: 4558828 - DNA, 19 bp, Homo sapiens
cccttccccttctgtgtca

SEQ ID NO: 4558829 - DNA, 16 bp, Homo sapiens
cccttcccgcctccct

SEQ ID NO: 4558830 - DNA, 13 bp, Homo sapiens
cccttccctgagt

SEQ ID NO: 4558831 - DNA, 15 bp, Homo sapiens
cccttccctggcccc

SEQ ID NO: 4558832 - DNA, 16 bp, Homo sapiens
cccttccctggccccg

SEQ ID NO: 4558833 - DNA, 20 bp, Homo sapiens
cccttcctggcacattgccc

SEQ ID NO: 4558834 - DNA, 10 bp, Homo sapiens
cccttcctgt

SEQ ID NO: 4558835 - DNA, 19 bp, Homo sapiens
cccttccttttccctgctt

SEQ ID NO: 4558836 - DNA, 21 bp, Homo sapiens
cccttccttttccctgcttcc

SEQ ID NO: 4558837 - DNA, 14 bp, Homo sapiens
cccttctacactct

SEQ ID NO: 4558838 - DNA, 13 bp, Homo sapiens
cccttctataccc

SEQ ID NO: 4558839 - DNA, 18 bp, Homo sapiens
cccttctatacccaccca

SEQ ID NO: 4558840 - DNA, 20 bp, Homo sapiens
cccttctcgtgtttgcttaa

SEQ ID NO: 4558841 - DNA, 13 bp, Homo sapiens
cccttctctgctc

SEQ ID NO: 4558842 - DNA, 15 bp, Homo sapiens
cccttctctgctcca

SEQ ID NO: 4558843 - DNA, 16 bp, Homo sapiens
cccttctctgctccac

SEQ ID NO: 4558844 - DNA, 20 bp, Homo sapiens
cccttctctgctccaccaca

SEQ ID NO: 4558845 - DNA, 14 bp, Homo sapiens
cccttgagacctca

SEQ ID NO: 4558846 - DNA, 17 bp, Homo sapiens
cccttgagacctcagcc

SEQ ID NO: 4558847 - DNA, 20 bp, Homo sapiens
cccttgagacctcagccatg

SEQ ID NO: 4558848 - DNA, 16 bp, Homo sapiens
cccttgcagctagttt

SEQ ID NO: 4558849 - DNA, 19 bp, Homo sapiens
cccttgcagctagttttct

SEQ ID NO: 4558850 - DNA, 13 bp, Homo sapiens
cccttgcagggtg

SEQ ID NO: 4558851 - DNA, 15 bp, Homo sapiens
cccttgcagggtggg

SEQ ID NO: 4558852 - DNA, 22 bp, Homo sapiens
cccttgcagggtgggtgagctc

SEQ ID NO: 4558853 - DNA, 12 bp, Homo sapiens
cccttgcctccc

SEQ ID NO: 4558854 - DNA, 13 bp, Homo sapiens
cccttgcctcccc

SEQ ID NO: 4558855 - DNA, 18 bp, Homo sapiens
cccttgcctccccatttc

SEQ ID NO: 4558856 - DNA, 19 bp, Homo sapiens
cccttgcctccccatttcc

SEQ ID NO: 4558857 - DNA, 20 bp, Homo sapiens
cccttgcctctgccctggat

SEQ ID NO: 4558858 - DNA, 12 bp, Homo sapiens
cccttgctgccc

SEQ ID NO: 4558859 - DNA, 13 bp, Homo sapiens
cccttgctgcccg

SEQ ID NO: 4558860 - DNA, 15 bp, Homo sapiens
cccttggacatttta

SEQ ID NO: 4558861 - DNA, 12 bp, Homo sapiens
cccttggcctgt

SEQ ID NO: 4558862 - DNA, 20 bp, Homo sapiens
cccttggggtaagccagagc

SEQ ID NO: 4558863 - DNA, 20 bp, Homo sapiens
cccttgtggcacgttgaccc

SEQ ID NO: 4558864 - DNA, 14 bp, Homo sapiens
cccttgtgtcaaga

SEQ ID NO: 4558865 - DNA, 16 bp, Homo sapiens
cccttgttccagcttt

SEQ ID NO: 4558866 - DNA, 23 bp, Homo sapiens
ccctttagcacgtttaaagttct

SEQ ID NO: 4558867 - DNA, 14 bp, Homo sapiens
ccctttagtgcttt

SEQ ID NO: 4558868 - DNA, 17 bp, Homo sapiens
ccctttcagatgtcttc

SEQ ID NO: 4558869 - DNA, 13 bp, Homo sapiens
ccctttcccctag

SEQ ID NO: 4558870 - DNA, 14 bp, Homo sapiens
ccctttcccctaga

SEQ ID NO: 4558871 - DNA, 22 bp, Homo sapiens
ccctttctctctcctctctgct

SEQ ID NO: 4558872 - DNA, 23 bp, Homo sapiens
ccctttctctctcctctctgctt

SEQ ID NO: 4558873 - DNA, 14 bp, Homo sapiens
ccctttgggcccag

SEQ ID NO: 4558874 - DNA, 18 bp, Homo sapiens
ccctttgggcccagggac

SEQ ID NO: 4558875 - DNA, 12 bp, Homo sapiens
ccctttgtgtat

SEQ ID NO: 4558876 - DNA, 19 bp, Homo sapiens
ccctttgtttcttgtttat

SEQ ID NO: 4558877 - DNA, 23 bp, Homo sapiens
cccttttagtttgatcagacagc

SEQ ID NO: 4558878 - DNA, 15 bp, Homo sapiens
cccttttcccccttc

SEQ ID NO: 4558879 - DNA, 11 bp, Homo sapiens
ccctttttcat

SEQ ID NO: 4558880 - DNA, 18 bp, Homo sapiens
ccctttttttacatttca

SEQ ID NO: 4558881 - DNA, 13 bp, Homo sapiens
ccgaagccatcac

SEQ ID NO: 4558882 - DNA, 16 bp, Homo sapiens
ccgaatctctttccct

SEQ ID NO: 4558883 - DNA, 17 bp, Homo sapiens
ccgaatttggtacacat

SEQ ID NO: 4558884 - DNA, 21 bp, Homo sapiens
ccgaatttggtacacatgtgt

SEQ ID NO: 4558885 - DNA, 17 bp, Homo sapiens
ccgacacgctccctccc

SEQ ID NO: 4558886 - DNA, 22 bp, Homo sapiens
ccgacactgagctgtgacccag

SEQ ID NO: 4558887 - DNA, 19 bp, Homo sapiens
ccgacctcgtcctccccct

SEQ ID NO: 4558888 - DNA, 16 bp, Homo sapiens
ccgactccagccagcg

SEQ ID NO: 4558889 - DNA, 22 bp, Homo sapiens
ccgactgactggaggaggcctg

SEQ ID NO: 4558890 - DNA, 15 bp, Homo sapiens
ccgagactcagcctc

SEQ ID NO: 4558891 - DNA, 13 bp, Homo sapiens
ccgagagcctgct

SEQ ID NO: 4558892 - DNA, 21 bp, Homo sapiens
ccgagagcttggactacacaa

SEQ ID NO: 4558893 - DNA, 20 bp, Homo sapiens
ccgagagtagccgagagcct

SEQ ID NO: 4558894 - DNA, 22 bp, Homo sapiens
ccgagagtagccgagagcctgc

SEQ ID NO: 4558895 - DNA, 14 bp, Homo sapiens
ccgagccctgactc

SEQ ID NO: 4558896 - DNA, 16 bp, Homo sapiens
ccgagccctgactcct

SEQ ID NO: 4558897 - DNA, 22 bp, Homo sapiens
ccgagcctgaactgagccccag

SEQ ID NO: 4558898 - DNA, 13 bp, Homo sapiens
ccgaggacccaga

SEQ ID NO: 4558899 - DNA, 17 bp, Homo sapiens
ccgaggacccaggaaag

SEQ ID NO: 4558900 - DNA, 15 bp, Homo sapiens
ccgaggcagggaagg

SEQ ID NO: 4558901 - DNA, 20 bp, Homo sapiens
ccgaggcgggtggatcacga

SEQ ID NO: 4558902 - DNA, 13 bp, Homo sapiens
ccgaggctacagc

SEQ ID NO: 4558903 - DNA, 14 bp, Homo sapiens
ccgaggctacagct

SEQ ID NO: 4558904 - DNA, 22 bp, Homo sapiens
ccgagggaggggaagcttctgt

SEQ ID NO: 4558905 - DNA, 16 bp, Homo sapiens
ccgaggggagggcagg

SEQ ID NO: 4558906 - DNA, 18 bp, Homo sapiens
ccgaggggagggcaggat

SEQ ID NO: 4558907 - DNA, 21 bp, Homo sapiens
ccgagtctccgggactgccct

SEQ ID NO: 4558908 - DNA, 16 bp, Homo sapiens
ccgatttctgtaaact

SEQ ID NO: 4558909 - DNA, 14 bp, Homo sapiens
ccgcacagccaccc

SEQ ID NO: 4558910 - DNA, 11 bp, Homo sapiens
ccgcaccccag

SEQ ID NO: 4558911 - DNA, 17 bp, Homo sapiens
ccgcaccctgtcctgca

SEQ ID NO: 4558912 - DNA, 23 bp, Homo sapiens
ccgcacgactgcgggagccagac

SEQ ID NO: 4558913 - DNA, 14 bp, Homo sapiens
ccgcactctgcccc

SEQ ID NO: 4558914 - DNA, 14 bp, Homo sapiens
ccgcagaagccctg

SEQ ID NO: 4558915 - DNA, 23 bp, Homo sapiens
ccgcagagactgtgcttgggagc

SEQ ID NO: 4558916 - DNA, 13 bp, Homo sapiens
ccgcagagctggc

SEQ ID NO: 4558917 - DNA, 16 bp, Homo sapiens
ccgcatcttctccatc

SEQ ID NO: 4558918 - DNA, 20 bp, Homo sapiens
ccgcatgtgtgcctggccgc

SEQ ID NO: 4558919 - DNA, 16 bp, Homo sapiens
ccgccacgtcccagca

SEQ ID NO: 4558920 - DNA, 20 bp, Homo sapiens
ccgccactaggtgtccccaa

SEQ ID NO: 4558921 - DNA, 15 bp, Homo sapiens
ccgccagctgggagc

SEQ ID NO: 4558922 - DNA, 13 bp, Homo sapiens
ccgccagggctgg

SEQ ID NO: 4558923 - DNA, 15 bp, Homo sapiens
ccgccagggctgggg

SEQ ID NO: 4558924 - DNA, 19 bp, Homo sapiens
ccgccatacattaaggagc

SEQ ID NO: 4558925 - DNA, 14 bp, Homo sapiens
ccgccattgccacc

SEQ ID NO: 4558926 - DNA, 13 bp, Homo sapiens
ccgcccaccccca

SEQ ID NO: 4558927 - DNA, 13 bp, Homo sapiens
ccgcccactcctg

SEQ ID NO: 4558928 - DNA, 16 bp, Homo sapiens
ccgcccactcctggga

SEQ ID NO: 4558929 - DNA, 14 bp, Homo sapiens
ccgcccagcctctc

SEQ ID NO: 4558930 - DNA, 13 bp, Homo sapiens
ccgccccagagtg

SEQ ID NO: 4558931 - DNA, 21 bp, Homo sapiens
ccgccccatgggcccctcacc

SEQ ID NO: 4558932 - DNA, 19 bp, Homo sapiens
ccgcccccagtccccaccc

SEQ ID NO: 4558933 - DNA, 15 bp, Homo sapiens
ccgccccgcccctcc

SEQ ID NO: 4558934 - DNA, 14 bp, Homo sapiens
ccgcccctggggaa

SEQ ID NO: 4558935 - DNA, 20 bp, Homo sapiens
ccgccctgtgggagccgcag

SEQ ID NO: 4558936 - DNA, 23 bp, Homo sapiens
ccgccctgtgggagccgcagagc

SEQ ID NO: 4558937 - DNA, 14 bp, Homo sapiens
ccgccgccgccgct

SEQ ID NO: 4558938 - DNA, 16 bp, Homo sapiens
ccgccgccgccgctgc

SEQ ID NO: 4558939 - DNA, 14 bp, Homo sapiens
ccgccgcctcccac

SEQ ID NO: 4558940 - DNA, 13 bp, Homo sapiens
ccgcctccactct

SEQ ID NO: 4558941 - DNA, 17 bp, Homo sapiens
ccgcctgaaggcacagc

SEQ ID NO: 4558942 - DNA, 22 bp, Homo sapiens
ccgcctgccagtcctagctgca

SEQ ID NO: 4558943 - DNA, 21 bp, Homo sapiens
ccgcctgccgtgcatggctcc

SEQ ID NO: 4558944 - DNA, 18 bp, Homo sapiens
ccgcctgggtcatgggcc

SEQ ID NO: 4558945 - DNA, 19 bp, Homo sapiens
ccgcctgggtcatgggcct

SEQ ID NO: 4558946 - DNA, 23 bp, Homo sapiens
ccgcctgggtcatgggcctgtgg

SEQ ID NO: 4558947 - DNA, 12 bp, Homo sapiens
ccgcctgtcaca

SEQ ID NO: 4558948 - DNA, 18 bp, Homo sapiens
ccgccttggcctcccaaa

SEQ ID NO: 4558949 - DNA, 16 bp, Homo sapiens
ccgcctttacaaggga

SEQ ID NO: 4558950 - DNA, 23 bp, Homo sapiens
ccgcctttacaagggagaagaca

SEQ ID NO: 4558951 - DNA, 19 bp, Homo sapiens
ccgccttttagttttggtt

SEQ ID NO: 4558952 - DNA, 21 bp, Homo sapiens
ccgcgatgggtcaggtagggg

SEQ ID NO: 4558953 - DNA, 18 bp, Homo sapiens
ccgcgccacccgggcaag

SEQ ID NO: 4558954 - DNA, 23 bp, Homo sapiens
ccgcgcctacccttcccgcctcc

SEQ ID NO: 4558955 - DNA, 14 bp, Homo sapiens
ccgcgcgcccaccc

SEQ ID NO: 4558956 - DNA, 17 bp, Homo sapiens
ccgcgcgcccaccctcc

SEQ ID NO: 4558957 - DNA, 17 bp, Homo sapiens
ccgcgggagacagcttc

SEQ ID NO: 4558958 - DNA, 19 bp, Homo sapiens
ccgcggggaagctggcttt

SEQ ID NO: 4558959 - DNA, 21 bp, Homo sapiens
ccgcgggttctagacgcccct

SEQ ID NO: 4558960 - DNA, 14 bp, Homo sapiens
ccgctaaaagaaac

SEQ ID NO: 4558961 - DNA, 16 bp, Homo sapiens
ccgctcccacacccct

SEQ ID NO: 4558962 - DNA, 22 bp, Homo sapiens
ccgctctgcatgcggcccagcc

SEQ ID NO: 4558963 - DNA, 18 bp, Homo sapiens
ccgctctggatcctgcac

SEQ ID NO: 4558964 - DNA, 22 bp, Homo sapiens
ccgctgagcgcccccgagccct

SEQ ID NO: 4558965 - DNA, 13 bp, Homo sapiens
ccgctgcaccacg

SEQ ID NO: 4558966 - DNA, 19 bp, Homo sapiens
ccgctgccacccgcccacc

SEQ ID NO: 4558967 - DNA, 21 bp, Homo sapiens
ccgctgccacccgcccacccg

SEQ ID NO: 4558968 - DNA, 17 bp, Homo sapiens
ccgctgccatgctttga

SEQ ID NO: 4558969 - DNA, 16 bp, Homo sapiens
ccgctgccgctgcacc

SEQ ID NO: 4558970 - DNA, 19 bp, Homo sapiens
ccgctgcctaagtggctgc

SEQ ID NO: 4558971 - DNA, 20 bp, Homo sapiens
ccgctgcctaagtggctgct

SEQ ID NO: 4558972 - DNA, 13 bp, Homo sapiens
ccgctgctgtgct

SEQ ID NO: 4558973 - DNA, 22 bp, Homo sapiens
ccgctggcccttagagaccccg

SEQ ID NO: 4558974 - DNA, 18 bp, Homo sapiens
ccgctggctggtgggccc

SEQ ID NO: 4558975 - DNA, 15 bp, Homo sapiens
ccgctgtcgccccag

SEQ ID NO: 4558976 - DNA, 18 bp, Homo sapiens
ccgctgtcgccccaggcc

SEQ ID NO: 4558977 - DNA, 20 bp, Homo sapiens
ccgctgtcgccccaggccct

SEQ ID NO: 4558978 - DNA, 21 bp, Homo sapiens
ccgctgtcgccccaggccctc

SEQ ID NO: 4558979 - DNA, 22 bp, Homo sapiens
ccgctgtcgccccaggccctcc

SEQ ID NO: 4558980 - DNA, 18 bp, Homo sapiens
ccgctgttcacccacagg

SEQ ID NO: 4558981 - DNA, 18 bp, Homo sapiens
ccgcttgtccagcgccta

SEQ ID NO: 4558982 - DNA, 17 bp, Homo sapiens
ccggaagatcagatgca

SEQ ID NO: 4558983 - DNA, 17 bp, Homo sapiens
ccggacactcctagaga

SEQ ID NO: 4558984 - DNA, 19 bp, Homo sapiens
ccggagcaggggtctgagc

SEQ ID NO: 4558985 - DNA, 16 bp, Homo sapiens
ccggaggactgagccc

SEQ ID NO: 4558986 - DNA, 16 bp, Homo sapiens
ccggaggtcactccac

SEQ ID NO: 4558987 - DNA, 15 bp, Homo sapiens
ccggcaagccacagg

SEQ ID NO: 4558988 - DNA, 19 bp, Homo sapiens
ccggcaagccacaggaagg

SEQ ID NO: 4558989 - DNA, 19 bp, Homo sapiens
ccggcaagcgagcacagta

SEQ ID NO: 4558990 - DNA, 23 bp, Homo sapiens
ccggcagggcccccaataaacca

SEQ ID NO: 4558991 - DNA, 13 bp, Homo sapiens
ccggccaaggacc

SEQ ID NO: 4558992 - DNA, 16 bp, Homo sapiens
ccggccaaggacccag

SEQ ID NO: 4558993 - DNA, 22 bp, Homo sapiens
ccggccaaggacccaggcgctg

SEQ ID NO: 4558994 - DNA, 15 bp, Homo sapiens
ccggccacacccctc

SEQ ID NO: 4558995 - DNA, 15 bp, Homo sapiens
ccggccatactgcct

SEQ ID NO: 4558996 - DNA, 18 bp, Homo sapiens
ccggcccagatgtgtccc

SEQ ID NO: 4558997 - DNA, 18 bp, Homo sapiens
ccggcccagtgccactgc

SEQ ID NO: 4558998 - DNA, 13 bp, Homo sapiens
ccggccccctggt

SEQ ID NO: 4558999 - DNA, 19 bp, Homo sapiens
ccggccccctggtctctgg

SEQ ID NO: 4559000 - DNA, 15 bp, Homo sapiens
ccggcccgcctgccc

SEQ ID NO: 4559001 - DNA, 22 bp, Homo sapiens
ccggcctcctcggagagcagca

SEQ ID NO: 4559002 - DNA, 16 bp, Homo sapiens
ccggcctctccctgcc

SEQ ID NO: 4559003 - DNA, 20 bp, Homo sapiens
ccggcctgtgggtctctgaa

SEQ ID NO: 4559004 - DNA, 17 bp, Homo sapiens
ccggcgtcagcctccag

SEQ ID NO: 4559005 - DNA, 20 bp, Homo sapiens
ccggcgtcagcctccagcct

SEQ ID NO: 4559006 - DNA, 22 bp, Homo sapiens
ccggcgtcagcctccagcctct

SEQ ID NO: 4559007 - DNA, 22 bp, Homo sapiens
ccggctcttatagaagcttcag

SEQ ID NO: 4559008 - DNA, 21 bp, Homo sapiens
ccggctgctgtgtgtgagcag

SEQ ID NO: 4559009 - DNA, 14 bp, Homo sapiens
ccggctgtttcctg

SEQ ID NO: 4559010 - DNA, 15 bp, Homo sapiens
ccggctgtttcctga

SEQ ID NO: 4559011 - DNA, 22 bp, Homo sapiens
ccgggaccaaactcacggacca

SEQ ID NO: 4559012 - DNA, 21 bp, Homo sapiens
ccgggactgctgctctcccaa

SEQ ID NO: 4559013 - DNA, 15 bp, Homo sapiens
ccgggagcctccccc

SEQ ID NO: 4559014 - DNA, 16 bp, Homo sapiens
ccgggagcctccccct

SEQ ID NO: 4559015 - DNA, 18 bp, Homo sapiens
ccgggagcctccccctca

SEQ ID NO: 4559016 - DNA, 13 bp, Homo sapiens
ccgggagctcagg

SEQ ID NO: 4559017 - DNA, 13 bp, Homo sapiens
ccgggagctgggc

SEQ ID NO: 4559018 - DNA, 14 bp, Homo sapiens
ccgggagctgggcc

SEQ ID NO: 4559019 - DNA, 23 bp, Homo sapiens
ccgggagctgggccctgcctgca

SEQ ID NO: 4559020 - DNA, 19 bp, Homo sapiens
ccgggaggaaaaggcccct

SEQ ID NO: 4559021 - DNA, 15 bp, Homo sapiens
ccgggaggcagccac

SEQ ID NO: 4559022 - DNA, 19 bp, Homo sapiens
ccgggaggcagccacaggg

SEQ ID NO: 4559023 - DNA, 23 bp, Homo sapiens
ccgggatattatagaaaattatt

SEQ ID NO: 4559024 - DNA, 21 bp, Homo sapiens
ccgggcaggtcctgcccatgt

SEQ ID NO: 4559025 - DNA, 14 bp, Homo sapiens
ccgggcatgatggt

SEQ ID NO: 4559026 - DNA, 14 bp, Homo sapiens
ccgggcatggtggc

SEQ ID NO: 4559027 - DNA, 10 bp, Homo sapiens
ccgggcccct

SEQ ID NO: 4559028 - DNA, 14 bp, Homo sapiens
ccgggcccctctct

SEQ ID NO: 4559029 - DNA, 22 bp, Homo sapiens
ccgggcccctctctagggaccc

SEQ ID NO: 4559030 - DNA, 14 bp, Homo sapiens
ccgggcccctgggc

SEQ ID NO: 4559031 - DNA, 23 bp, Homo sapiens
ccgggcccctgggcttggcctgc

SEQ ID NO: 4559032 - DNA, 15 bp, Homo sapiens
ccgggcgcggccagc

SEQ ID NO: 4559033 - DNA, 17 bp, Homo sapiens
ccgggcgcggccagccc

SEQ ID NO: 4559034 - DNA, 16 bp, Homo sapiens
ccgggcgtggtggtga

SEQ ID NO: 4559035 - DNA, 16 bp, Homo sapiens
ccgggcgtgtgaagaa

SEQ ID NO: 4559036 - DNA, 12 bp, Homo sapiens
ccgggctctgac

SEQ ID NO: 4559037 - DNA, 15 bp, Homo sapiens
ccggggccagcactt

SEQ ID NO: 4559038 - DNA, 12 bp, Homo sapiens
ccggggcctgga

SEQ ID NO: 4559039 - DNA, 15 bp, Homo sapiens
ccgggggagcccagt

SEQ ID NO: 4559040 - DNA, 20 bp, Homo sapiens
ccgggtccggcctctccctg

SEQ ID NO: 4559041 - DNA, 23 bp, Homo sapiens
ccgggtccggcctctccctgcct

SEQ ID NO: 4559042 - DNA, 21 bp, Homo sapiens
ccgggtgtggcctcagccctc

SEQ ID NO: 4559043 - DNA, 22 bp, Homo sapiens
ccgggtgtggcctcagccctca

SEQ ID NO: 4559044 - DNA, 15 bp, Homo sapiens
ccggtacacagccag

SEQ ID NO: 4559045 - DNA, 12 bp, Homo sapiens
ccggtcagtgcc

SEQ ID NO: 4559046 - DNA, 16 bp, Homo sapiens
ccggtccacaggtcca

SEQ ID NO: 4559047 - DNA, 19 bp, Homo sapiens
ccggtccacaggtccaagg

SEQ ID NO: 4559048 - DNA, 22 bp, Homo sapiens
ccggtcccccagagcatctgcc

SEQ ID NO: 4559049 - DNA, 20 bp, Homo sapiens
ccggtcccttgagacctcag

SEQ ID NO: 4559050 - DNA, 17 bp, Homo sapiens
ccggtcgggcagccagc

SEQ ID NO: 4559051 - DNA, 19 bp, Homo sapiens
ccggtcgggcagccagcag

SEQ ID NO: 4559052 - DNA, 21 bp, Homo sapiens
ccggtgccagctgcccttgca

SEQ ID NO: 4559053 - DNA, 15 bp, Homo sapiens
ccggtgctgcaggag

SEQ ID NO: 4559054 - DNA, 20 bp, Homo sapiens
ccggtggtgggatccacgct

SEQ ID NO: 4559055 - DNA, 17 bp, Homo sapiens
ccggttttcctcagctc

SEQ ID NO: 4559056 - DNA, 15 bp, Homo sapiens
ccgtaatcccagcta

SEQ ID NO: 4559057 - DNA, 12 bp, Homo sapiens
ccgtaatttaac

SEQ ID NO: 4559058 - DNA, 14 bp, Homo sapiens
ccgtaatttaactt

SEQ ID NO: 4559059 - DNA, 15 bp, Homo sapiens
ccgtagctcccctgg

SEQ ID NO: 4559060 - DNA, 17 bp, Homo sapiens
ccgtagctcccctggct

SEQ ID NO: 4559061 - DNA, 15 bp, Homo sapiens
ccgtaggacaagttt

SEQ ID NO: 4559062 - DNA, 14 bp, Homo sapiens
ccgtagttccctga

SEQ ID NO: 4559063 - DNA, 16 bp, Homo sapiens
ccgtagttccctgaaa

SEQ ID NO: 4559064 - DNA, 21 bp, Homo sapiens
ccgtcaccacgactggccagg

SEQ ID NO: 4559065 - DNA, 18 bp, Homo sapiens
ccgtcagcatcactgatg

SEQ ID NO: 4559066 - DNA, 19 bp, Homo sapiens
ccgtcagcttctcccaagc

SEQ ID NO: 4559067 - DNA, 19 bp, Homo sapiens
ccgtctaggattgggcctc

SEQ ID NO: 4559068 - DNA, 14 bp, Homo sapiens
ccgtctcctccctc

SEQ ID NO: 4559069 - DNA, 17 bp, Homo sapiens
ccgtctcctccctcagc

SEQ ID NO: 4559070 - DNA, 13 bp, Homo sapiens
ccgtctctctccc

SEQ ID NO: 4559071 - DNA, 22 bp, Homo sapiens
ccgtctctctcccatggagccc

SEQ ID NO: 4559072 - DNA, 21 bp, Homo sapiens
ccgtctctcttggacccacct

SEQ ID NO: 4559073 - DNA, 14 bp, Homo sapiens
ccgtctctttctca

SEQ ID NO: 4559074 - DNA, 17 bp, Homo sapiens
ccgtctggcccaccagg

SEQ ID NO: 4559075 - DNA, 21 bp, Homo sapiens
ccgtctggggttcagcccctc

SEQ ID NO: 4559076 - DNA, 22 bp, Homo sapiens
ccgtcttagaagtggaccagga

SEQ ID NO: 4559077 - DNA, 16 bp, Homo sapiens
ccgtcttttcctgttt

SEQ ID NO: 4559078 - DNA, 16 bp, Homo sapiens
ccgtgaactctggtgc

SEQ ID NO: 4559079 - DNA, 19 bp, Homo sapiens
ccgtgaatggtctctgtca

SEQ ID NO: 4559080 - DNA, 13 bp, Homo sapiens
ccgtgagacacaa

SEQ ID NO: 4559081 - DNA, 14 bp, Homo sapiens
ccgtgagacacaag

SEQ ID NO: 4559082 - DNA, 13 bp, Homo sapiens
ccgtgagggtggg

SEQ ID NO: 4559083 - DNA, 24 bp, Homo sapiens
ccgtgatggagaggacagagcagg

SEQ ID NO: 4559084 - DNA, 23 bp, Homo sapiens
ccgtgatgtagggtaaggtgcct

SEQ ID NO: 4559085 - DNA, 20 bp, Homo sapiens
ccgtgcccccgcctgccacc

SEQ ID NO: 4559086 - DNA, 19 bp, Homo sapiens
ccgtgcccgcaggaactgg

SEQ ID NO: 4559087 - DNA, 13 bp, Homo sapiens
ccgtgcctgggag

SEQ ID NO: 4559088 - DNA, 16 bp, Homo sapiens
ccgtggaggaggaagg

SEQ ID NO: 4559089 - DNA, 19 bp, Homo sapiens
ccgtggccatccctgtgag

SEQ ID NO: 4559090 - DNA, 20 bp, Homo sapiens
ccgtggccatccctgtgagg

SEQ ID NO: 4559091 - DNA, 17 bp, Homo sapiens
ccgtgggtgggcctggc

SEQ ID NO: 4559092 - DNA, 23 bp, Homo sapiens
ccgtgggtgggcctggccctgct

SEQ ID NO: 4559093 - DNA, 15 bp, Homo sapiens
ccgtggtcagagtgc

SEQ ID NO: 4559094 - DNA, 19 bp, Homo sapiens
ccgtggtcagagtgccact

SEQ ID NO: 4559095 - DNA, 21 bp, Homo sapiens
ccgtggtcagagtgccactgc

SEQ ID NO: 4559096 - DNA, 14 bp, Homo sapiens
ccgtggtgcctgca

SEQ ID NO: 4559097 - DNA, 15 bp, Homo sapiens
ccgtggtgcctgcac

SEQ ID NO: 4559098 - DNA, 14 bp, Homo sapiens
ccgtgtcctctccc

SEQ ID NO: 4559099 - DNA, 13 bp, Homo sapiens
ccgtgtcgggcag

SEQ ID NO: 4559100 - DNA, 16 bp, Homo sapiens
ccgtgtcgggcaggtc

SEQ ID NO: 4559101 - DNA, 19 bp, Homo sapiens
ccgtgtcgggcaggtcagc

SEQ ID NO: 4559102 - DNA, 14 bp, Homo sapiens
ccgtgtctcagcct

SEQ ID NO: 4559103 - DNA, 12 bp, Homo sapiens
ccgtgtgtttat

SEQ ID NO: 4559104 - DNA, 13 bp, Homo sapiens
ccgttactctcca

SEQ ID NO: 4559105 - DNA, 22 bp, Homo sapiens
ccgttactctccaacctggaca

SEQ ID NO: 4559106 - DNA, 15 bp, Homo sapiens
ccgtttccttacaca

SEQ ID NO: 4559107 - DNA, 13 bp, Homo sapiens
ccgtttctccttt

SEQ ID NO: 4559108 - DNA, 17 bp, Homo sapiens
ccgtttctccttttcct

SEQ ID NO: 4559109 - DNA, 13 bp, Homo sapiens
ccgtttcttgcaa

SEQ ID NO: 4559110 - DNA, 12 bp, Homo sapiens
cctaaaactggg

SEQ ID NO: 4559111 - DNA, 22 bp, Homo sapiens
cctaaaagttcataacagtgcc

SEQ ID NO: 4559112 - DNA, 22 bp, Homo sapiens
cctaaagaaaaatatcttggcc

SEQ ID NO: 4559113 - DNA, 22 bp, Homo sapiens
cctaaagaggaaaagtgcaatg

SEQ ID NO: 4559114 - DNA, 14 bp, Homo sapiens
cctaaatatttatc

SEQ ID NO: 4559115 - DNA, 15 bp, Homo sapiens
cctaaattatttact

SEQ ID NO: 4559116 - DNA, 15 bp, Homo sapiens
cctaacccctttcct

SEQ ID NO: 4559117 - DNA, 15 bp, Homo sapiens
cctaacgaagtatcc

SEQ ID NO: 4559118 - DNA, 13 bp, Homo sapiens
cctaagacatttt

SEQ ID NO: 4559119 - DNA, 14 bp, Homo sapiens
cctaagacattttt

SEQ ID NO: 4559120 - DNA, 20 bp, Homo sapiens
cctaagagatgggactagga

SEQ ID NO: 4559121 - DNA, 19 bp, Homo sapiens
cctaagatgtgttcttatt

SEQ ID NO: 4559122 - DNA, 16 bp, Homo sapiens
cctaagcattgcctgg

SEQ ID NO: 4559123 - DNA, 21 bp, Homo sapiens
cctaagtgcctcttctttttc

SEQ ID NO: 4559124 - DNA, 16 bp, Homo sapiens
cctaagtggctgcctt

SEQ ID NO: 4559125 - DNA, 22 bp, Homo sapiens
cctaatgaaagtgatgacatat

SEQ ID NO: 4559126 - DNA, 18 bp, Homo sapiens
cctaatggctatttttga

SEQ ID NO: 4559127 - DNA, 17 bp, Homo sapiens
cctaatgtgatcatatg

SEQ ID NO: 4559128 - DNA, 17 bp, Homo sapiens
cctaatgtttttctcta

SEQ ID NO: 4559129 - DNA, 13 bp, Homo sapiens
cctaattggaaag

SEQ ID NO: 4559130 - DNA, 20 bp, Homo sapiens
cctaattggaaagtgccagc

SEQ ID NO: 4559131 - DNA, 18 bp, Homo sapiens
cctacaagagcagcctgt

SEQ ID NO: 4559132 - DNA, 13 bp, Homo sapiens
cctacaaggccta

SEQ ID NO: 4559133 - DNA, 16 bp, Homo sapiens
cctacagacaaggagg

SEQ ID NO: 4559134 - DNA, 18 bp, Homo sapiens
cctacagactccatctct

SEQ ID NO: 4559135 - DNA, 20 bp, Homo sapiens
cctacagactccatctcttc

SEQ ID NO: 4559136 - DNA, 15 bp, Homo sapiens
cctacagtgtacagt

SEQ ID NO: 4559137 - DNA, 15 bp, Homo sapiens
cctacagttttaact

SEQ ID NO: 4559138 - DNA, 22 bp, Homo sapiens
cctacagttttaactgtggata

SEQ ID NO: 4559139 - DNA, 14 bp, Homo sapiens
cctaccactctaat

SEQ ID NO: 4559140 - DNA, 20 bp, Homo sapiens
cctaccactgtggccccaag

SEQ ID NO: 4559141 - DNA, 22 bp, Homo sapiens
cctaccactgtggccccaagag

SEQ ID NO: 4559142 - DNA, 19 bp, Homo sapiens
cctaccacttttctgctgt

SEQ ID NO: 4559143 - DNA, 15 bp, Homo sapiens
cctaccatcagctct

SEQ ID NO: 4559144 - DNA, 13 bp, Homo sapiens
cctaccccaccac

SEQ ID NO: 4559145 - DNA, 13 bp, Homo sapiens
cctaccccagttc

SEQ ID NO: 4559146 - DNA, 14 bp, Homo sapiens
cctaccctcccacc

SEQ ID NO: 4559147 - DNA, 23 bp, Homo sapiens
cctaccctgcctcccttgacttt

SEQ ID NO: 4559148 - DNA, 14 bp, Homo sapiens
cctaccctggactt

SEQ ID NO: 4559149 - DNA, 22 bp, Homo sapiens
cctacctcaacctgtaaattat

SEQ ID NO: 4559150 - DNA, 21 bp, Homo sapiens
cctacctgattggtgcaaccc

SEQ ID NO: 4559151 - DNA, 12 bp, Homo sapiens
cctacctgcctt

SEQ ID NO: 4559152 - DNA, 12 bp, Homo sapiens
cctacctgctct

SEQ ID NO: 4559153 - DNA, 12 bp, Homo sapiens
cctacctgcttc

SEQ ID NO: 4559154 - DNA, 16 bp, Homo sapiens
cctactagtcaccaga

SEQ ID NO: 4559155 - DNA, 12 bp, Homo sapiens
cctactattggc

SEQ ID NO: 4559156 - DNA, 22 bp, Homo sapiens
cctactgaaccctgcctcttgt

SEQ ID NO: 4559157 - DNA, 21 bp, Homo sapiens
cctactgagtactctttctct

SEQ ID NO: 4559158 - DNA, 22 bp, Homo sapiens
cctacttacccaggtgggtccc

SEQ ID NO: 4559159 - DNA, 14 bp, Homo sapiens
cctactttctctct

SEQ ID NO: 4559160 - DNA, 22 bp, Homo sapiens
cctagaaatatatcctgtgtac

SEQ ID NO: 4559161 - DNA, 21 bp, Homo sapiens
cctagaagtcttaattgtgtt

SEQ ID NO: 4559162 - DNA, 17 bp, Homo sapiens
cctagactctccctgta

SEQ ID NO: 4559163 - DNA, 20 bp, Homo sapiens
cctagactctgtctacctgg

SEQ ID NO: 4559164 - DNA, 19 bp, Homo sapiens
cctagagcctgcctggagc

SEQ ID NO: 4559165 - DNA, 21 bp, Homo sapiens
cctagaggggcaccttttcat

SEQ ID NO: 4559166 - DNA, 15 bp, Homo sapiens
cctagatatgaatat

SEQ ID NO: 4559167 - DNA, 21 bp, Homo sapiens
cctagatatgaatatatggca

SEQ ID NO: 4559168 - DNA, 23 bp, Homo sapiens
cctagatgcacgtggggcccact

SEQ ID NO: 4559169 - DNA, 21 bp, Homo sapiens
cctagattacatctgccttaa

SEQ ID NO: 4559170 - DNA, 22 bp, Homo sapiens
cctagcaagtaagaatggccaa

SEQ ID NO: 4559171 - DNA, 12 bp, Homo sapiens
cctagccagctg

SEQ ID NO: 4559172 - DNA, 19 bp, Homo sapiens
cctagcccttccctgagtg

SEQ ID NO: 4559173 - DNA, 19 bp, Homo sapiens
cctagcggagcccagcctg

SEQ ID NO: 4559174 - DNA, 18 bp, Homo sapiens
cctagctacactgagcag

SEQ ID NO: 4559175 - DNA, 22 bp, Homo sapiens
cctagctctcccagtgaactcc

SEQ ID NO: 4559176 - DNA, 13 bp, Homo sapiens
cctagctcttaca

SEQ ID NO: 4559177 - DNA, 20 bp, Homo sapiens
cctagctttagaccctgggt

SEQ ID NO: 4559178 - DNA, 21 bp, Homo sapiens
cctagctttagaccctgggtg

SEQ ID NO: 4559179 - DNA, 18 bp, Homo sapiens
cctaggacccgtctccag

SEQ ID NO: 4559180 - DNA, 16 bp, Homo sapiens
cctaggctagggtggg

SEQ ID NO: 4559181 - DNA, 21 bp, Homo sapiens
cctagggtcttgggggtcagg

SEQ ID NO: 4559182 - DNA, 16 bp, Homo sapiens
cctagtaagtgccttc

SEQ ID NO: 4559183 - DNA, 19 bp, Homo sapiens
cctagtaagtgccttccat

SEQ ID NO: 4559184 - DNA, 15 bp, Homo sapiens
cctagtcccttcccc

SEQ ID NO: 4559185 - DNA, 16 bp, Homo sapiens
cctagtccgctgaaga

SEQ ID NO: 4559186 - DNA, 19 bp, Homo sapiens
cctagtgaaggcttctctc

SEQ ID NO: 4559187 - DNA, 21 bp, Homo sapiens
cctagtgaaggcttctctctg

SEQ ID NO: 4559188 - DNA, 18 bp, Homo sapiens
cctagtggggtctccctc

SEQ ID NO: 4559189 - DNA, 21 bp, Homo sapiens
cctagtggggtctccctctcc

SEQ ID NO: 4559190 - DNA, 19 bp, Homo sapiens
cctagttttctttcctcct

SEQ ID NO: 4559191 - DNA, 22 bp, Homo sapiens
cctagttttctttcctcctttc

SEQ ID NO: 4559192 - DNA, 16 bp, Homo sapiens
cctataatcccagcta

SEQ ID NO: 4559193 - DNA, 20 bp, Homo sapiens
cctatacaacctaacttatg

SEQ ID NO: 4559194 - DNA, 17 bp, Homo sapiens
cctatagcactgagctc

SEQ ID NO: 4559195 - DNA, 13 bp, Homo sapiens
cctatatatttct

SEQ ID NO: 4559196 - DNA, 22 bp, Homo sapiens
cctatatcttacaaaatacaca

SEQ ID NO: 4559197 - DNA, 15 bp, Homo sapiens
cctatatgagaagaa

SEQ ID NO: 4559198 - DNA, 14 bp, Homo sapiens
cctatccacccagc

SEQ ID NO: 4559199 - DNA, 17 bp, Homo sapiens
cctatccacccagccca

SEQ ID NO: 4559200 - DNA, 18 bp, Homo sapiens
cctatccacccagcccat

SEQ ID NO: 4559201 - DNA, 15 bp, Homo sapiens
cctatcttccttcct

SEQ ID NO: 4559202 - DNA, 18 bp, Homo sapiens
cctatgataattatttac

SEQ ID NO: 4559203 - DNA, 22 bp, Homo sapiens
cctatgataattatttacaaaa

SEQ ID NO: 4559204 - DNA, 17 bp, Homo sapiens
cctatgatattttctgt

SEQ ID NO: 4559205 - DNA, 12 bp, Homo sapiens
cctatgcaataa

SEQ ID NO: 4559206 - DNA, 18 bp, Homo sapiens
cctatgcactgaagagct

SEQ ID NO: 4559207 - DNA, 19 bp, Homo sapiens
cctatgcactgaagagctc

SEQ ID NO: 4559208 - DNA, 21 bp, Homo sapiens
cctatgcactgaagagctctt

SEQ ID NO: 4559209 - DNA, 21 bp, Homo sapiens
cctatgcatggtgtagatgcc

SEQ ID NO: 4559210 - DNA, 13 bp, Homo sapiens
cctatgcctgtgg

SEQ ID NO: 4559211 - DNA, 14 bp, Homo sapiens
cctatgcctgtggt

SEQ ID NO: 4559212 - DNA, 22 bp, Homo sapiens
cctatgctattgacaataaaat

SEQ ID NO: 4559213 - DNA, 19 bp, Homo sapiens
cctatggaagttgttgcta

SEQ ID NO: 4559214 - DNA, 20 bp, Homo sapiens
cctattaatgtctcacttta

SEQ ID NO: 4559215 - DNA, 11 bp, Homo sapiens
cctatttctat

SEQ ID NO: 4559216 - DNA, 19 bp, Homo sapiens
cctatttttctctcctgtc

SEQ ID NO: 4559217 - DNA, 20 bp, Homo sapiens
cctatttttgacatggaaat

SEQ ID NO: 4559218 - DNA, 14 bp, Homo sapiens
cctatttttgtaaa

SEQ ID NO: 4559219 - DNA, 18 bp, Homo sapiens
cctcaaacgacagaggag

SEQ ID NO: 4559220 - DNA, 15 bp, Homo sapiens
cctcaaactcattgc

SEQ ID NO: 4559221 - DNA, 16 bp, Homo sapiens
cctcaaactcattgca

SEQ ID NO: 4559222 - DNA, 16 bp, Homo sapiens
cctcaaagaaagtgta

SEQ ID NO: 4559223 - DNA, 14 bp, Homo sapiens
cctcaaagcctcaa

SEQ ID NO: 4559224 - DNA, 22 bp, Homo sapiens
cctcaaatcaaaaacaggcagg

SEQ ID NO: 4559225 - DNA, 15 bp, Homo sapiens
cctcaaattttttga

SEQ ID NO: 4559226 - DNA, 22 bp, Homo sapiens
cctcaaattttttgactttttt

SEQ ID NO: 4559227 - DNA, 14 bp, Homo sapiens
cctcaacctgtaaa

SEQ ID NO: 4559228 - DNA, 16 bp, Homo sapiens
cctcaactaaccctta

SEQ ID NO: 4559229 - DNA, 22 bp, Homo sapiens
cctcaagcaatccacctgcctt

SEQ ID NO: 4559230 - DNA, 18 bp, Homo sapiens
cctcaatccagctatgtt

SEQ ID NO: 4559231 - DNA, 20 bp, Homo sapiens
cctcaatgtgaatcagaccc

SEQ ID NO: 4559232 - DNA, 16 bp, Homo sapiens
cctcacagtcccactg

SEQ ID NO: 4559233 - DNA, 23 bp, Homo sapiens
cctcacagtcccactgtgcaggt

SEQ ID NO: 4559234 - DNA, 21 bp, Homo sapiens
cctcaccaaaacgatgaagtt

SEQ ID NO: 4559235 - DNA, 17 bp, Homo sapiens
cctcaccaaggaccttg

SEQ ID NO: 4559236 - DNA, 23 bp, Homo sapiens
cctcacccaccatggaccagccc

SEQ ID NO: 4559237 - DNA, 16 bp, Homo sapiens
cctcacccacccctgc

SEQ ID NO: 4559238 - DNA, 19 bp, Homo sapiens
cctcacccacccctgcaca

SEQ ID NO: 4559239 - DNA, 15 bp, Homo sapiens
cctcaccccctcggg

SEQ ID NO: 4559240 - DNA, 20 bp, Homo sapiens
cctcacccctggttctcatc

SEQ ID NO: 4559241 - DNA, 22 bp, Homo sapiens
cctcacccctggttctcatctt

SEQ ID NO: 4559242 - DNA, 23 bp, Homo sapiens
cctcacccctggttctcatcttt

SEQ ID NO: 4559243 - DNA, 21 bp, Homo sapiens
cctcaccctcctgacccccat

SEQ ID NO: 4559244 - DNA, 14 bp, Homo sapiens
cctcacccttcccg

SEQ ID NO: 4559245 - DNA, 12 bp, Homo sapiens
cctcacctcatg

SEQ ID NO: 4559246 - DNA, 15 bp, Homo sapiens
cctcacctcatgccc

SEQ ID NO: 4559247 - DNA, 23 bp, Homo sapiens
cctcacctcatgcccaccccctg

SEQ ID NO: 4559248 - DNA, 14 bp, Homo sapiens
cctcacctgtctag

SEQ ID NO: 4559249 - DNA, 14 bp, Homo sapiens
cctcactaattttt

SEQ ID NO: 4559250 - DNA, 20 bp, Homo sapiens
cctcactatggtatgctggc

SEQ ID NO: 4559251 - DNA, 20 bp, Homo sapiens
cctcactattacttgaactt

SEQ ID NO: 4559252 - DNA, 14 bp, Homo sapiens
cctcactcccttct

SEQ ID NO: 4559253 - DNA, 21 bp, Homo sapiens
cctcactcccttctacctgcc

SEQ ID NO: 4559254 - DNA, 22 bp, Homo sapiens
cctcactcccttctacctgcca

SEQ ID NO: 4559255 - DNA, 17 bp, Homo sapiens
cctcactctgtcagcca

SEQ ID NO: 4559256 - DNA, 23 bp, Homo sapiens
cctcactctttatagtgcacaaa

SEQ ID NO: 4559257 - DNA, 20 bp, Homo sapiens
cctcactgtatccaggttcc

SEQ ID NO: 4559258 - DNA, 15 bp, Homo sapiens
cctcagaaggcccca

SEQ ID NO: 4559259 - DNA, 13 bp, Homo sapiens
cctcagacattta

SEQ ID NO: 4559260 - DNA, 13 bp, Homo sapiens
cctcagacccagc

SEQ ID NO: 4559261 - DNA, 19 bp, Homo sapiens
cctcagacccagcggtcca

SEQ ID NO: 4559262 - DNA, 20 bp, Homo sapiens
cctcagacgggctgagagga

SEQ ID NO: 4559263 - DNA, 11 bp, Homo sapiens
cctcagactca

SEQ ID NO: 4559264 - DNA, 18 bp, Homo sapiens
cctcagactcagaggtcc

SEQ ID NO: 4559265 - DNA, 20 bp, Homo sapiens
cctcagagatctcccttctc

SEQ ID NO: 4559266 - DNA, 20 bp, Homo sapiens
cctcagcaagctgcccagcc

SEQ ID NO: 4559267 - DNA, 24 bp, Homo sapiens
cctcagcaagctgcccagccctgg

SEQ ID NO: 4559268 - DNA, 14 bp, Homo sapiens
cctcagcagctctg

SEQ ID NO: 4559269 - DNA, 15 bp, Homo sapiens
cctcagccagcctcc

SEQ ID NO: 4559270 - DNA, 13 bp, Homo sapiens
cctcagccaggcc

SEQ ID NO: 4559271 - DNA, 16 bp, Homo sapiens
cctcagccccagccca

SEQ ID NO: 4559272 - DNA, 15 bp, Homo sapiens
cctcagccctgctcc

SEQ ID NO: 4559273 - DNA, 22 bp, Homo sapiens
cctcagccctgctccctgcctc

SEQ ID NO: 4559274 - DNA, 20 bp, Homo sapiens
cctcagcctcccatagctgg

SEQ ID NO: 4559275 - DNA, 19 bp, Homo sapiens
cctcagctctaggctgttc

SEQ ID NO: 4559276 - DNA, 15 bp, Homo sapiens
cctcagctctctggg

SEQ ID NO: 4559277 - DNA, 15 bp, Homo sapiens
cctcagctgcctcac

SEQ ID NO: 4559278 - DNA, 16 bp, Homo sapiens
cctcagctgcctcact

SEQ ID NO: 4559279 - DNA, 14 bp, Homo sapiens
cctcagctgcctcc

SEQ ID NO: 4559280 - DNA, 18 bp, Homo sapiens
cctcagctgcctcctgcg

SEQ ID NO: 4559281 - DNA, 21 bp, Homo sapiens
cctcagcttcttcacaggcac

SEQ ID NO: 4559282 - DNA, 12 bp, Homo sapiens
cctcaggaaaga

SEQ ID NO: 4559283 - DNA, 13 bp, Homo sapiens
cctcaggaaagaa

SEQ ID NO: 4559284 - DNA, 16 bp, Homo sapiens
cctcaggaaagaatag

SEQ ID NO: 4559285 - DNA, 18 bp, Homo sapiens
cctcaggaggtcacctgc

SEQ ID NO: 4559286 - DNA, 19 bp, Homo sapiens
cctcaggccaagggaccag

SEQ ID NO: 4559287 - DNA, 19 bp, Homo sapiens
cctcaggcccaggagtcca

SEQ ID NO: 4559288 - DNA, 23 bp, Homo sapiens
cctcaggcccaggagtccaggcc

SEQ ID NO: 4559289 - DNA, 12 bp, Homo sapiens
cctcaggctccg

SEQ ID NO: 4559290 - DNA, 23 bp, Homo sapiens
cctcagggacagagacacctgca

SEQ ID NO: 4559291 - DNA, 15 bp, Homo sapiens
cctcagggagcctcc

SEQ ID NO: 4559292 - DNA, 16 bp, Homo sapiens
cctcagggctcccagg

SEQ ID NO: 4559293 - DNA, 14 bp, Homo sapiens
cctcagggctgtcc

SEQ ID NO: 4559294 - DNA, 16 bp, Homo sapiens
cctcagggctgtccca

SEQ ID NO: 4559295 - DNA, 18 bp, Homo sapiens
cctcagggctgtcccagc

SEQ ID NO: 4559296 - DNA, 22 bp, Homo sapiens
cctcagggctgtcccagccccg

SEQ ID NO: 4559297 - DNA, 19 bp, Homo sapiens
cctcaggggcctctctcct

SEQ ID NO: 4559298 - DNA, 20 bp, Homo sapiens
cctcaggggcctctctcctg

SEQ ID NO: 4559299 - DNA, 19 bp, Homo sapiens
cctcagggtggggggtgac

SEQ ID NO: 4559300 - DNA, 18 bp, Homo sapiens
cctcagtactattcctta

SEQ ID NO: 4559301 - DNA, 15 bp, Homo sapiens
cctcagtgctcctgg

SEQ ID NO: 4559302 - DNA, 16 bp, Homo sapiens
cctcagtggatcttca

SEQ ID NO: 4559303 - DNA, 14 bp, Homo sapiens
cctcagtggcttct

SEQ ID NO: 4559304 - DNA, 17 bp, Homo sapiens
cctcagtggcttctcca

SEQ ID NO: 4559305 - DNA, 21 bp, Homo sapiens
cctcagtggcttctccaggga

SEQ ID NO: 4559306 - DNA, 15 bp, Homo sapiens
cctcagttcaacctg

SEQ ID NO: 4559307 - DNA, 22 bp, Homo sapiens
cctcagttcaacctggtggcac

SEQ ID NO: 4559308 - DNA, 20 bp, Homo sapiens
cctcagttcccttggcctca

SEQ ID NO: 4559309 - DNA, 15 bp, Homo sapiens
cctcagttccttcat

SEQ ID NO: 4559310 - DNA, 23 bp, Homo sapiens
cctcagttttatgccccattgga

SEQ ID NO: 4559311 - DNA, 23 bp, Homo sapiens
cctcatagccctcagacatttat

SEQ ID NO: 4559312 - DNA, 15 bp, Homo sapiens
cctcatccagcctca

SEQ ID NO: 4559313 - DNA, 13 bp, Homo sapiens
cctcatccctgac

SEQ ID NO: 4559314 - DNA, 15 bp, Homo sapiens
cctcatcctccctga

SEQ ID NO: 4559315 - DNA, 20 bp, Homo sapiens
cctcatctatggttctaaat

SEQ ID NO: 4559316 - DNA, 22 bp, Homo sapiens
cctcatctatggttctaaatat

SEQ ID NO: 4559317 - DNA, 16 bp, Homo sapiens
cctcatctctactaaa

SEQ ID NO: 4559318 - DNA, 18 bp, Homo sapiens
cctcatcttcttcaccat

SEQ ID NO: 4559319 - DNA, 23 bp, Homo sapiens
cctcatgcccaccccctgccctg

SEQ ID NO: 4559320 - DNA, 14 bp, Homo sapiens
cctcatgttgctga

SEQ ID NO: 4559321 - DNA, 21 bp, Homo sapiens
cctcatgttgctgaatttgta

SEQ ID NO: 4559322 - DNA, 20 bp, Homo sapiens
cctcattaatagctgccttc

SEQ ID NO: 4559323 - DNA, 17 bp, Homo sapiens
cctcattcaggaaaact

SEQ ID NO: 4559324 - DNA, 21 bp, Homo sapiens
cctcattctactaatgtgatg

SEQ ID NO: 4559325 - DNA, 11 bp, Homo sapiens
cctccaaagag

SEQ ID NO: 4559326 - DNA, 16 bp, Homo sapiens
cctccaaagagccttc

SEQ ID NO: 4559327 - DNA, 21 bp, Homo sapiens
cctccaaatgtcctttctcag

SEQ ID NO: 4559328 - DNA, 19 bp, Homo sapiens
cctccaacctggggggcag

SEQ ID NO: 4559329 - DNA, 14 bp, Homo sapiens
cctccaagcacaga

SEQ ID NO: 4559330 - DNA, 16 bp, Homo sapiens
cctccaataaagtgcc

SEQ ID NO: 4559331 - DNA, 21 bp, Homo sapiens
cctccacagagaggaggggac

SEQ ID NO: 4559332 - DNA, 17 bp, Homo sapiens
cctccaccaaaccccac

SEQ ID NO: 4559333 - DNA, 15 bp, Homo sapiens
cctccaccccaggac

SEQ ID NO: 4559334 - DNA, 16 bp, Homo sapiens
cctccaccctctgagc

SEQ ID NO: 4559335 - DNA, 20 bp, Homo sapiens
cctccaccctctgagctttg

SEQ ID NO: 4559336 - DNA, 13 bp, Homo sapiens
cctccacctcaag

SEQ ID NO: 4559337 - DNA, 13 bp, Homo sapiens
cctccacgcctcc

SEQ ID NO: 4559338 - DNA, 19 bp, Homo sapiens
cctccactctagttctaga

SEQ ID NO: 4559339 - DNA, 19 bp, Homo sapiens
cctccactctcccccaccc

SEQ ID NO: 4559340 - DNA, 22 bp, Homo sapiens
cctccactctcccccaccccct

SEQ ID NO: 4559341 - DNA, 14 bp, Homo sapiens
cctccactgctggg

SEQ ID NO: 4559342 - DNA, 21 bp, Homo sapiens
cctccagaagcctctggctag

SEQ ID NO: 4559343 - DNA, 22 bp, Homo sapiens
cctccagaagcctctggctaga

SEQ ID NO: 4559344 - DNA, 17 bp, Homo sapiens
cctccagagacaacagg

SEQ ID NO: 4559345 - DNA, 18 bp, Homo sapiens
cctccagagccccacagc

SEQ ID NO: 4559346 - DNA, 18 bp, Homo sapiens
cctccagcctcccctccc

SEQ ID NO: 4559347 - DNA, 22 bp, Homo sapiens
cctccagcctcccctcccctgg

SEQ ID NO: 4559348 - DNA, 13 bp, Homo sapiens
cctccaggcctgc

SEQ ID NO: 4559349 - DNA, 18 bp, Homo sapiens
cctccaggcctgcctccc

SEQ ID NO: 4559350 - DNA, 20 bp, Homo sapiens
cctccaggcctgcctcccac

SEQ ID NO: 4559351 - DNA, 18 bp, Homo sapiens
cctccagggaaggtggcc

SEQ ID NO: 4559352 - DNA, 22 bp, Homo sapiens
cctccagggaaggtggccacag

SEQ ID NO: 4559353 - DNA, 18 bp, Homo sapiens
cctccagggctggactga

SEQ ID NO: 4559354 - DNA, 20 bp, Homo sapiens
cctccagggctggactgagg

SEQ ID NO: 4559355 - DNA, 22 bp, Homo sapiens
cctccagggctggactgaggcc

SEQ ID NO: 4559356 - DNA, 11 bp, Homo sapiens
cctccagggtc

SEQ ID NO: 4559357 - DNA, 16 bp, Homo sapiens
cctccagtgctggatt

SEQ ID NO: 4559358 - DNA, 15 bp, Homo sapiens
cctccagtgggctga

SEQ ID NO: 4559359 - DNA, 22 bp, Homo sapiens
cctccatcctaccccctgtgcc

SEQ ID NO: 4559360 - DNA, 24 bp, Homo sapiens
cctccatctcatgtatcatctgga

SEQ ID NO: 4559361 - DNA, 19 bp, Homo sapiens
cctccatgctcctcacctg

SEQ ID NO: 4559362 - DNA, 23 bp, Homo sapiens
cctccatgctcctcacctgtcta

SEQ ID NO: 4559363 - DNA, 13 bp, Homo sapiens
cctccattgctcc

SEQ ID NO: 4559364 - DNA, 14 bp, Homo sapiens
cctccatttttctc

SEQ ID NO: 4559365 - DNA, 20 bp, Homo sapiens
cctcccaaagtgctgagatt

SEQ ID NO: 4559366 - DNA, 19 bp, Homo sapiens
cctcccaacagagctgggc

SEQ ID NO: 4559367 - DNA, 18 bp, Homo sapiens
cctcccaagcgttcctgg

SEQ ID NO: 4559368 - DNA, 23 bp, Homo sapiens
cctcccaagcgttcctggccttc

SEQ ID NO: 4559369 - DNA, 14 bp, Homo sapiens
cctcccaaggagaa

SEQ ID NO: 4559370 - DNA, 18 bp, Homo sapiens
cctcccaaggagaacaaa

SEQ ID NO: 4559371 - DNA, 15 bp, Homo sapiens
cctcccaaggtcctc

SEQ ID NO: 4559372 - DNA, 18 bp, Homo sapiens
cctcccaaggtcctctca

SEQ ID NO: 4559373 - DNA, 19 bp, Homo sapiens
cctcccaaggtcctctcag

SEQ ID NO: 4559374 - DNA, 12 bp, Homo sapiens
cctcccaccaga

SEQ ID NO: 4559375 - DNA, 15 bp, Homo sapiens
cctcccacccccagc

SEQ ID NO: 4559376 - DNA, 16 bp, Homo sapiens
cctcccacccccagcc

SEQ ID NO: 4559377 - DNA, 16 bp, Homo sapiens
cctcccaccgctgcct

SEQ ID NO: 4559378 - DNA, 19 bp, Homo sapiens
cctcccaccgctgcctcgt

SEQ ID NO: 4559379 - DNA, 13 bp, Homo sapiens
cctcccacgcctc

SEQ ID NO: 4559380 - DNA, 19 bp, Homo sapiens
cctcccacgcctcaccagc

SEQ ID NO: 4559381 - DNA, 14 bp, Homo sapiens
cctcccacggcacc

SEQ ID NO: 4559382 - DNA, 14 bp, Homo sapiens
cctcccagacaggc

SEQ ID NO: 4559383 - DNA, 18 bp, Homo sapiens
cctcccagacaggccctc

SEQ ID NO: 4559384 - DNA, 15 bp, Homo sapiens
cctcccagcccataa

SEQ ID NO: 4559385 - DNA, 16 bp, Homo sapiens
cctcccagtgagactg

SEQ ID NO: 4559386 - DNA, 21 bp, Homo sapiens
cctcccagtgagactgcccca

SEQ ID NO: 4559387 - DNA, 16 bp, Homo sapiens
cctcccataattgctt

SEQ ID NO: 4559388 - DNA, 20 bp, Homo sapiens
cctcccatagatactctctt

SEQ ID NO: 4559389 - DNA, 21 bp, Homo sapiens
cctcccatagatactctcttc

SEQ ID NO: 4559390 - DNA, 21 bp, Homo sapiens
cctcccattgcccagtgagcc

SEQ ID NO: 4559391 - DNA, 14 bp, Homo sapiens
cctccccaactccc

SEQ ID NO: 4559392 - DNA, 19 bp, Homo sapiens
cctccccactcctctccca

SEQ ID NO: 4559393 - DNA, 16 bp, Homo sapiens
cctccccagagctggc

SEQ ID NO: 4559394 - DNA, 14 bp, Homo sapiens
cctccccaggctgg

SEQ ID NO: 4559395 - DNA, 22 bp, Homo sapiens
cctccccaggctggagaccccc

SEQ ID NO: 4559396 - DNA, 14 bp, Homo sapiens
cctccccaggggag

SEQ ID NO: 4559397 - DNA, 21 bp, Homo sapiens
cctccccatttcccatctgca

SEQ ID NO: 4559398 - DNA, 18 bp, Homo sapiens
cctcccccaacccccacc

SEQ ID NO: 4559399 - DNA, 12 bp, Homo sapiens
cctcccccactt

SEQ ID NO: 4559400 - DNA, 16 bp, Homo sapiens
cctcccccatgggctg

SEQ ID NO: 4559401 - DNA, 12 bp, Homo sapiens
cctccccctcct

SEQ ID NO: 4559402 - DNA, 11 bp, Homo sapiens
cctccccctgc

SEQ ID NO: 4559403 - DNA, 17 bp, Homo sapiens
cctccccctgccagtgc

SEQ ID NO: 4559404 - DNA, 14 bp, Homo sapiens
cctccccctgcccc

SEQ ID NO: 4559405 - DNA, 20 bp, Homo sapiens
cctccccctttcacactgga

SEQ ID NO: 4559406 - DNA, 22 bp, Homo sapiens
cctcccctatccacccagccca

SEQ ID NO: 4559407 - DNA, 14 bp, Homo sapiens
cctcccctcccctg

SEQ ID NO: 4559408 - DNA, 13 bp, Homo sapiens
cctcccctgccag

SEQ ID NO: 4559409 - DNA, 16 bp, Homo sapiens
cctcccctgccagggc

SEQ ID NO: 4559410 - DNA, 15 bp, Homo sapiens
cctccccttcctgtt

SEQ ID NO: 4559411 - DNA, 21 bp, Homo sapiens
cctcccgaaaaatgtgtggtt

SEQ ID NO: 4559412 - DNA, 22 bp, Homo sapiens
cctcccgaaaaatgtgtggttc

SEQ ID NO: 4559413 - DNA, 16 bp, Homo sapiens
cctcccgccccgcccc

SEQ ID NO: 4559414 - DNA, 22 bp, Homo sapiens
cctccctaccctaaccaagttc

SEQ ID NO: 4559415 - DNA, 19 bp, Homo sapiens
cctccctacctcaacctgt

SEQ ID NO: 4559416 - DNA, 11 bp, Homo sapiens
cctccctcaga

SEQ ID NO: 4559417 - DNA, 23 bp, Homo sapiens
cctccctcagacccagcggtcca

SEQ ID NO: 4559418 - DNA, 20 bp, Homo sapiens
cctccctcagacccaggagt

SEQ ID NO: 4559419 - DNA, 21 bp, Homo sapiens
cctccctcagacccaggagtc

SEQ ID NO: 4559420 - DNA, 23 bp, Homo sapiens
cctccctcagacccaggagtcca

SEQ ID NO: 4559421 - DNA, 13 bp, Homo sapiens
cctccctcagact

SEQ ID NO: 4559422 - DNA, 21 bp, Homo sapiens
cctccctcaggcccaggagtc

SEQ ID NO: 4559423 - DNA, 12 bp, Homo sapiens
cctccctccagc

SEQ ID NO: 4559424 - DNA, 21 bp, Homo sapiens
cctccctgactccctgtgggg

SEQ ID NO: 4559425 - DNA, 12 bp, Homo sapiens
cctccctgcctg

SEQ ID NO: 4559426 - DNA, 16 bp, Homo sapiens
cctccctgcctgctcc

SEQ ID NO: 4559427 - DNA, 19 bp, Homo sapiens
cctccctgcctgctccttg

SEQ ID NO: 4559428 - DNA, 19 bp, Homo sapiens
cctccctgctagcacagag

SEQ ID NO: 4559429 - DNA, 23 bp, Homo sapiens
cctccctgctgtgccatgctggg

SEQ ID NO: 4559430 - DNA, 14 bp, Homo sapiens
cctccctggctccc

SEQ ID NO: 4559431 - DNA, 11 bp, Homo sapiens
cctccctgtcc

SEQ ID NO: 4559432 - DNA, 14 bp, Homo sapiens
cctccctgtcctcc

SEQ ID NO: 4559433 - DNA, 15 bp, Homo sapiens
cctcccttccttttc

SEQ ID NO: 4559434 - DNA, 21 bp, Homo sapiens
cctcccttccttttccctgct

SEQ ID NO: 4559435 - DNA, 15 bp, Homo sapiens
cctccctttctcccc

SEQ ID NO: 4559436 - DNA, 22 bp, Homo sapiens
cctccgaggctccccgcctcca

SEQ ID NO: 4559437 - DNA, 14 bp, Homo sapiens
cctccgcctccagg

SEQ ID NO: 4559438 - DNA, 18 bp, Homo sapiens
cctccggccatactgcct

SEQ ID NO: 4559439 - DNA, 17 bp, Homo sapiens
cctccggcgtcagcctc

SEQ ID NO: 4559440 - DNA, 22 bp, Homo sapiens
cctccggcgtcagcctccagcc

SEQ ID NO: 4559441 - DNA, 18 bp, Homo sapiens
cctccgggacctggtgct

SEQ ID NO: 4559442 - DNA, 13 bp, Homo sapiens
cctcctaaagctg

SEQ ID NO: 4559443 - DNA, 14 bp, Homo sapiens
cctcctaaagctga

SEQ ID NO: 4559444 - DNA, 13 bp, Homo sapiens
cctcctaccctcc

SEQ ID NO: 4559445 - DNA, 23 bp, Homo sapiens
cctcctaccctcccaccagaacg

SEQ ID NO: 4559446 - DNA, 15 bp, Homo sapiens
cctcctcacctcatg

SEQ ID NO: 4559447 - DNA, 19 bp, Homo sapiens
cctcctcacctcatgccca

SEQ ID NO: 4559448 - DNA, 13 bp, Homo sapiens
cctcctcacctct

SEQ ID NO: 4559449 - DNA, 21 bp, Homo sapiens
cctcctcaggcacacagctac

SEQ ID NO: 4559450 - DNA, 13 bp, Homo sapiens
cctcctcccctcc

SEQ ID NO: 4559451 - DNA, 18 bp, Homo sapiens
cctcctcccctcctcttc

SEQ ID NO: 4559452 - DNA, 15 bp, Homo sapiens
cctcctccctcaaac

SEQ ID NO: 4559453 - DNA, 13 bp, Homo sapiens
cctcctccctcag

SEQ ID NO: 4559454 - DNA, 15 bp, Homo sapiens
cctcctccctcagac

SEQ ID NO: 4559455 - DNA, 19 bp, Homo sapiens
cctcctccctcagactcag

SEQ ID NO: 4559456 - DNA, 15 bp, Homo sapiens
cctcctccctcaggc

SEQ ID NO: 4559457 - DNA, 20 bp, Homo sapiens
cctcctcggagagcagcagc

SEQ ID NO: 4559458 - DNA, 13 bp, Homo sapiens
cctcctctgaaac

SEQ ID NO: 4559459 - DNA, 18 bp, Homo sapiens
cctcctctgaaacagctg

SEQ ID NO: 4559460 - DNA, 12 bp, Homo sapiens
cctcctctgaat

SEQ ID NO: 4559461 - DNA, 18 bp, Homo sapiens
cctcctctgacttgggga

SEQ ID NO: 4559462 - DNA, 21 bp, Homo sapiens
cctcctctgcactcccacctg

SEQ ID NO: 4559463 - DNA, 18 bp, Homo sapiens
cctcctctgccacctccc

SEQ ID NO: 4559464 - DNA, 20 bp, Homo sapiens
cctcctctgccacctcccct

SEQ ID NO: 4559465 - DNA, 13 bp, Homo sapiens
cctcctctgccta

SEQ ID NO: 4559466 - DNA, 21 bp, Homo sapiens
cctcctctgcctacagccagg

SEQ ID NO: 4559467 - DNA, 14 bp, Homo sapiens
cctcctctgtctgc

SEQ ID NO: 4559468 - DNA, 21 bp, Homo sapiens
cctcctcttcccttagcctct

SEQ ID NO: 4559469 - DNA, 17 bp, Homo sapiens
cctcctgaggctgtttt

SEQ ID NO: 4559470 - DNA, 22 bp, Homo sapiens
cctcctgcagacacctggactg

SEQ ID NO: 4559471 - DNA, 12 bp, Homo sapiens
cctcctgcccag

SEQ ID NO: 4559472 - DNA, 19 bp, Homo sapiens
cctcctgcccaggagagcc

SEQ ID NO: 4559473 - DNA, 23 bp, Homo sapiens
cctcctgcccaggagagccagcc

SEQ ID NO: 4559474 - DNA, 13 bp, Homo sapiens
cctcctgccccct

SEQ ID NO: 4559475 - DNA, 17 bp, Homo sapiens
cctcctgccccctgcca

SEQ ID NO: 4559476 - DNA, 12 bp, Homo sapiens
cctcctgcctca

SEQ ID NO: 4559477 - DNA, 17 bp, Homo sapiens
cctcctgcctcagcctt

SEQ ID NO: 4559478 - DNA, 23 bp, Homo sapiens
cctcctgctgcctaataaagaga

SEQ ID NO: 4559479 - DNA, 11 bp, Homo sapiens
cctcctggcca

SEQ ID NO: 4559480 - DNA, 13 bp, Homo sapiens
cctcctggccaga

SEQ ID NO: 4559481 - DNA, 14 bp, Homo sapiens
cctcctggccagac

SEQ ID NO: 4559482 - DNA, 17 bp, Homo sapiens
cctcctggccagacgct

SEQ ID NO: 4559483 - DNA, 19 bp, Homo sapiens
cctcctgtacctcagtgga

SEQ ID NO: 4559484 - DNA, 19 bp, Homo sapiens
cctcctgtcttcccagggt

SEQ ID NO: 4559485 - DNA, 11 bp, Homo sapiens
cctcctgtgcc

SEQ ID NO: 4559486 - DNA, 12 bp, Homo sapiens
cctcctgtgcct

SEQ ID NO: 4559487 - DNA, 19 bp, Homo sapiens
cctcctgtgcctccctttt

SEQ ID NO: 4559488 - DNA, 17 bp, Homo sapiens
cctcctgtgcctggccc

SEQ ID NO: 4559489 - DNA, 18 bp, Homo sapiens
cctcctgtgtactgtgtc

SEQ ID NO: 4559490 - DNA, 15 bp, Homo sapiens
cctcctgtgtcactg

SEQ ID NO: 4559491 - DNA, 20 bp, Homo sapiens
cctcctgtgtggaagaagga

SEQ ID NO: 4559492 - DNA, 18 bp, Homo sapiens
cctcctgttgcacccagc

SEQ ID NO: 4559493 - DNA, 22 bp, Homo sapiens
cctcctgttgcacccagccctg

SEQ ID NO: 4559494 - DNA, 22 bp, Homo sapiens
cctccttccagatgcccgagca

SEQ ID NO: 4559495 - DNA, 20 bp, Homo sapiens
cctccttccccagacccaga

SEQ ID NO: 4559496 - DNA, 18 bp, Homo sapiens
cctccttgtgccttcttt

SEQ ID NO: 4559497 - DNA, 19 bp, Homo sapiens
cctcctttcatcacactgg

SEQ ID NO: 4559498 - DNA, 15 bp, Homo sapiens
cctcctttcctcctc

SEQ ID NO: 4559499 - DNA, 12 bp, Homo sapiens
cctccttttaaa

SEQ ID NO: 4559500 - DNA, 13 bp, Homo sapiens
cctcctttttcca

SEQ ID NO: 4559501 - DNA, 20 bp, Homo sapiens
cctcgaaacacagaaacctt

SEQ ID NO: 4559502 - DNA, 22 bp, Homo sapiens
cctcgacctccccacccgctcc

SEQ ID NO: 4559503 - DNA, 12 bp, Homo sapiens
cctcgagaggca

SEQ ID NO: 4559504 - DNA, 15 bp, Homo sapiens
cctcgagaggcacct

SEQ ID NO: 4559505 - DNA, 18 bp, Homo sapiens
cctcgagtactgtgggca

SEQ ID NO: 4559506 - DNA, 15 bp, Homo sapiens
cctcgcctccccacc

SEQ ID NO: 4559507 - DNA, 14 bp, Homo sapiens
cctcgctcaccgct

SEQ ID NO: 4559508 - DNA, 20 bp, Homo sapiens
cctcgctcaccgctggccct

SEQ ID NO: 4559509 - DNA, 15 bp, Homo sapiens
cctcggacagagccc

SEQ ID NO: 4559510 - DNA, 18 bp, Homo sapiens
cctcggacagagcccccc

SEQ ID NO: 4559511 - DNA, 19 bp, Homo sapiens
cctcggacagagcccccct

SEQ ID NO: 4559512 - DNA, 20 bp, Homo sapiens
cctcggaccccactccggcc

SEQ ID NO: 4559513 - DNA, 12 bp, Homo sapiens
cctcggagaaga

SEQ ID NO: 4559514 - DNA, 16 bp, Homo sapiens
cctcggagacgggacc

SEQ ID NO: 4559515 - DNA, 14 bp, Homo sapiens
cctcggagagcagc

SEQ ID NO: 4559516 - DNA, 18 bp, Homo sapiens
cctcggagagcagcagca

SEQ ID NO: 4559517 - DNA, 22 bp, Homo sapiens
cctcggcctcccaaagtgctgg

SEQ ID NO: 4559518 - DNA, 15 bp, Homo sapiens
cctcgggcccagccc

SEQ ID NO: 4559519 - DNA, 17 bp, Homo sapiens
cctcgggcccagccccc

SEQ ID NO: 4559520 - DNA, 18 bp, Homo sapiens
cctcgggcccagccccca

SEQ ID NO: 4559521 - DNA, 19 bp, Homo sapiens
cctcggggacaccagagct

SEQ ID NO: 4559522 - DNA, 16 bp, Homo sapiens
cctcgtagagtgacct

SEQ ID NO: 4559523 - DNA, 13 bp, Homo sapiens
cctcgtcaagagc

SEQ ID NO: 4559524 - DNA, 21 bp, Homo sapiens
cctcgtcctccccctgccagt

SEQ ID NO: 4559525 - DNA, 19 bp, Homo sapiens
cctctaacagcacagggaa

SEQ ID NO: 4559526 - DNA, 15 bp, Homo sapiens
cctctaacccagtgg

SEQ ID NO: 4559527 - DNA, 17 bp, Homo sapiens
cctctaaccccaggccc

SEQ ID NO: 4559528 - DNA, 18 bp, Homo sapiens
cctctacagagcttccct

SEQ ID NO: 4559529 - DNA, 16 bp, Homo sapiens
cctctagaagccaagg

SEQ ID NO: 4559530 - DNA, 17 bp, Homo sapiens
cctctagagaaaagatg

SEQ ID NO: 4559531 - DNA, 14 bp, Homo sapiens
cctctagagccttc

SEQ ID NO: 4559532 - DNA, 13 bp, Homo sapiens
cctctagtgcctt

SEQ ID NO: 4559533 - DNA, 15 bp, Homo sapiens
cctctagtgccttct

SEQ ID NO: 4559534 - DNA, 19 bp, Homo sapiens
cctctatggaaggaggcct

SEQ ID NO: 4559535 - DNA, 17 bp, Homo sapiens
cctctcaaattcagctc

SEQ ID NO: 4559536 - DNA, 17 bp, Homo sapiens
cctctcaagctagccag

SEQ ID NO: 4559537 - DNA, 13 bp, Homo sapiens
cctctcagctgct

SEQ ID NO: 4559538 - DNA, 20 bp, Homo sapiens
cctctcagctgctggatgac

SEQ ID NO: 4559539 - DNA, 17 bp, Homo sapiens
cctctccaagacagcag

SEQ ID NO: 4559540 - DNA, 18 bp, Homo sapiens
cctctccaagacagcagc

SEQ ID NO: 4559541 - DNA, 20 bp, Homo sapiens
cctctccaagacagcagcag

SEQ ID NO: 4559542 - DNA, 11 bp, Homo sapiens
cctctccacac

SEQ ID NO: 4559543 - DNA, 23 bp, Homo sapiens
cctctccactcatgtgactcttt

SEQ ID NO: 4559544 - DNA, 15 bp, Homo sapiens
cctctccatcctgct

SEQ ID NO: 4559545 - DNA, 17 bp, Homo sapiens
cctctcccacccggcca

SEQ ID NO: 4559546 - DNA, 21 bp, Homo sapiens
cctctcccacccggccacagc

SEQ ID NO: 4559547 - DNA, 14 bp, Homo sapiens
cctctccccaggaa

SEQ ID NO: 4559548 - DNA, 17 bp, Homo sapiens
cctctccccctcctcca

SEQ ID NO: 4559549 - DNA, 18 bp, Homo sapiens
cctctccccctcctccag

SEQ ID NO: 4559550 - DNA, 13 bp, Homo sapiens
cctctccctgcca

SEQ ID NO: 4559551 - DNA, 15 bp, Homo sapiens
cctctccctgcctgt

SEQ ID NO: 4559552 - DNA, 18 bp, Homo sapiens
cctctccctgcctgtggc

SEQ ID NO: 4559553 - DNA, 14 bp, Homo sapiens
cctctccctgctgc

SEQ ID NO: 4559554 - DNA, 20 bp, Homo sapiens
cctctcctccccttcctgtt

SEQ ID NO: 4559555 - DNA, 16 bp, Homo sapiens
cctctcctgccctgtg

SEQ ID NO: 4559556 - DNA, 18 bp, Homo sapiens
cctctcctgccctgtgat

SEQ ID NO: 4559557 - DNA, 12 bp, Homo sapiens
cctctcctgcct

SEQ ID NO: 4559558 - DNA, 12 bp, Homo sapiens
cctctcctggag

SEQ ID NO: 4559559 - DNA, 22 bp, Homo sapiens
cctctcctgggggtggcaggca

SEQ ID NO: 4559560 - DNA, 14 bp, Homo sapiens
cctctcctttgaaa

SEQ ID NO: 4559561 - DNA, 12 bp, Homo sapiens
cctctcctttgt

SEQ ID NO: 4559562 - DNA, 14 bp, Homo sapiens
cctctcctttgtag

SEQ ID NO: 4559563 - DNA, 21 bp, Homo sapiens
cctctcgccccatccctgctt

SEQ ID NO: 4559564 - DNA, 18 bp, Homo sapiens
cctctcggtgctccatct

SEQ ID NO: 4559565 - DNA, 22 bp, Homo sapiens
cctctcggtgctccatctccgc

SEQ ID NO: 4559566 - DNA, 15 bp, Homo sapiens
cctctctagggaccc

SEQ ID NO: 4559567 - DNA, 12 bp, Homo sapiens
cctctctcccag

SEQ ID NO: 4559568 - DNA, 13 bp, Homo sapiens
cctctctccccaa

SEQ ID NO: 4559569 - DNA, 14 bp, Homo sapiens
cctctctccccaaa

SEQ ID NO: 4559570 - DNA, 14 bp, Homo sapiens
cctctctccctgcc

SEQ ID NO: 4559571 - DNA, 15 bp, Homo sapiens
cctctctccttggcc

SEQ ID NO: 4559572 - DNA, 18 bp, Homo sapiens
cctctctccttggccaca

SEQ ID NO: 4559573 - DNA, 21 bp, Homo sapiens
cctctctccttggccacagac

SEQ ID NO: 4559574 - DNA, 13 bp, Homo sapiens
cctctctctaagt

SEQ ID NO: 4559575 - DNA, 19 bp, Homo sapiens
cctctctctaagtttagaa

SEQ ID NO: 4559576 - DNA, 16 bp, Homo sapiens
cctctctctcactccc

SEQ ID NO: 4559577 - DNA, 15 bp, Homo sapiens
cctctctctcttcct

SEQ ID NO: 4559578 - DNA, 12 bp, Homo sapiens
cctctctctgct

SEQ ID NO: 4559579 - DNA, 13 bp, Homo sapiens
cctctctctgctc

SEQ ID NO: 4559580 - DNA, 14 bp, Homo sapiens
cctctctctgctcc

SEQ ID NO: 4559581 - DNA, 13 bp, Homo sapiens
cctctctctgggc

SEQ ID NO: 4559582 - DNA, 17 bp, Homo sapiens
cctctctgcagacttcc

SEQ ID NO: 4559583 - DNA, 15 bp, Homo sapiens
cctctctgctctgcg

SEQ ID NO: 4559584 - DNA, 14 bp, Homo sapiens
cctctcttccacag

SEQ ID NO: 4559585 - DNA, 14 bp, Homo sapiens
cctctctttctctg

SEQ ID NO: 4559586 - DNA, 15 bp, Homo sapiens
cctctctttctctgg

SEQ ID NO: 4559587 - DNA, 14 bp, Homo sapiens
cctctgaaacagct

SEQ ID NO: 4559588 - DNA, 19 bp, Homo sapiens
cctctgacagtccacaggg

SEQ ID NO: 4559589 - DNA, 12 bp, Homo sapiens
cctctgactcag

SEQ ID NO: 4559590 - DNA, 22 bp, Homo sapiens
cctctgactcagggctcctggg

SEQ ID NO: 4559591 - DNA, 20 bp, Homo sapiens
cctctgagaagctctgaaga

SEQ ID NO: 4559592 - DNA, 17 bp, Homo sapiens
cctctgagctttgcatg

SEQ ID NO: 4559593 - DNA, 16 bp, Homo sapiens
cctctgatcaaattgg

SEQ ID NO: 4559594 - DNA, 16 bp, Homo sapiens
cctctgcacccagaac

SEQ ID NO: 4559595 - DNA, 16 bp, Homo sapiens
cctctgcactcccacc

SEQ ID NO: 4559596 - DNA, 17 bp, Homo sapiens
cctctgcagtctcattt

SEQ ID NO: 4559597 - DNA, 18 bp, Homo sapiens
cctctgcagtctcatttc

SEQ ID NO: 4559598 - DNA, 11 bp, Homo sapiens
cctctgccacc

SEQ ID NO: 4559599 - DNA, 13 bp, Homo sapiens
cctctgccacctc

SEQ ID NO: 4559600 - DNA, 13 bp, Homo sapiens
cctctgcccctgc

SEQ ID NO: 4559601 - DNA, 16 bp, Homo sapiens
cctctgcccctgcagc

SEQ ID NO: 4559602 - DNA, 22 bp, Homo sapiens
cctctgcccgggagctcaggaa

SEQ ID NO: 4559603 - DNA, 15 bp, Homo sapiens
cctctgccctggatt

SEQ ID NO: 4559604 - DNA, 15 bp, Homo sapiens
cctctgcccttcctg

SEQ ID NO: 4559605 - DNA, 18 bp, Homo sapiens
cctctgccgctgccatgc

SEQ ID NO: 4559606 - DNA, 23 bp, Homo sapiens
cctctgccgctgccatgctttga

SEQ ID NO: 4559607 - DNA, 22 bp, Homo sapiens
cctctgccggtcgggcagccag

SEQ ID NO: 4559608 - DNA, 23 bp, Homo sapiens
cctctgccggtcgggcagccagc

SEQ ID NO: 4559609 - DNA, 17 bp, Homo sapiens
cctctgcctacagccag

SEQ ID NO: 4559610 - DNA, 11 bp, Homo sapiens
cctctgcctca

SEQ ID NO: 4559611 - DNA, 12 bp, Homo sapiens
cctctgcctcaa

SEQ ID NO: 4559612 - DNA, 14 bp, Homo sapiens
cctctgcctcaatg

SEQ ID NO: 4559613 - DNA, 11 bp, Homo sapiens
cctctgcctgc

SEQ ID NO: 4559614 - DNA, 20 bp, Homo sapiens
cctctgccttgccctcctgg

SEQ ID NO: 4559615 - DNA, 21 bp, Homo sapiens
cctctgccttgccctcctggg

SEQ ID NO: 4559616 - DNA, 23 bp, Homo sapiens
cctctgccttgccctcctgggcc

SEQ ID NO: 4559617 - DNA, 18 bp, Homo sapiens
cctctgctcaccgcccat

SEQ ID NO: 4559618 - DNA, 14 bp, Homo sapiens
cctctgctgctttt

SEQ ID NO: 4559619 - DNA, 22 bp, Homo sapiens
cctctgctggagaaagccacgc

SEQ ID NO: 4559620 - DNA, 18 bp, Homo sapiens
cctctgctggctcaggag

SEQ ID NO: 4559621 - DNA, 18 bp, Homo sapiens
cctctgcttctcatccca

SEQ ID NO: 4559622 - DNA, 15 bp, Homo sapiens
cctctggacggcagg

SEQ ID NO: 4559623 - DNA, 21 bp, Homo sapiens
cctctggacggcaggctcact

SEQ ID NO: 4559624 - DNA, 23 bp, Homo sapiens
cctctggacggcaggctcactgc

SEQ ID NO: 4559625 - DNA, 16 bp, Homo sapiens
cctctggactggctag

SEQ ID NO: 4559626 - DNA, 17 bp, Homo sapiens
cctctggagcaccaggt

SEQ ID NO: 4559627 - DNA, 20 bp, Homo sapiens
cctctggcccctcacccacc

SEQ ID NO: 4559628 - DNA, 12 bp, Homo sapiens
cctctggccctg

SEQ ID NO: 4559629 - DNA, 18 bp, Homo sapiens
cctctggccctgccttct

SEQ ID NO: 4559630 - DNA, 24 bp, Homo sapiens
cctctggctagaggccagccccac

SEQ ID NO: 4559631 - DNA, 19 bp, Homo sapiens
cctctggctttcccaggag

SEQ ID NO: 4559632 - DNA, 14 bp, Homo sapiens
cctctggggccact

SEQ ID NO: 4559633 - DNA, 22 bp, Homo sapiens
cctctggtaaacattcctccag

SEQ ID NO: 4559634 - DNA, 23 bp, Homo sapiens
cctctggtaaacattcctccagc

SEQ ID NO: 4559635 - DNA, 15 bp, Homo sapiens
cctctggtcaggagg

SEQ ID NO: 4559636 - DNA, 17 bp, Homo sapiens
cctctggttgcctcccc

SEQ ID NO: 4559637 - DNA, 20 bp, Homo sapiens
cctctgtccaggcactgaga

SEQ ID NO: 4559638 - DNA, 23 bp, Homo sapiens
cctctgtccgcctttacaaggga

SEQ ID NO: 4559639 - DNA, 22 bp, Homo sapiens
cctctgtctgcccttcacccca

SEQ ID NO: 4559640 - DNA, 14 bp, Homo sapiens
cctctgtgaactgt

SEQ ID NO: 4559641 - DNA, 16 bp, Homo sapiens
cctctgttttctctct

SEQ ID NO: 4559642 - DNA, 18 bp, Homo sapiens
cctctgttttctctctgt

SEQ ID NO: 4559643 - DNA, 14 bp, Homo sapiens
cctcttaaattata

SEQ ID NO: 4559644 - DNA, 23 bp, Homo sapiens
cctcttaaattatatatttattt

SEQ ID NO: 4559645 - DNA, 23 bp, Homo sapiens
cctcttaaggaaaccactgtaca

SEQ ID NO: 4559646 - DNA, 16 bp, Homo sapiens
cctcttcagaggccct

SEQ ID NO: 4559647 - DNA, 12 bp, Homo sapiens
cctcttccagtc

SEQ ID NO: 4559648 - DNA, 18 bp, Homo sapiens
cctcttcccttagcctct

SEQ ID NO: 4559649 - DNA, 20 bp, Homo sapiens
cctcttcctaccctgcctcc

SEQ ID NO: 4559650 - DNA, 13 bp, Homo sapiens
cctcttcctgccc

SEQ ID NO: 4559651 - DNA, 14 bp, Homo sapiens
cctcttctacttgt

SEQ ID NO: 4559652 - DNA, 18 bp, Homo sapiens
cctcttctcttgacagtc

SEQ ID NO: 4559653 - DNA, 21 bp, Homo sapiens
cctcttctcttgacagtctga

SEQ ID NO: 4559654 - DNA, 14 bp, Homo sapiens
cctcttctgctctt

SEQ ID NO: 4559655 - DNA, 16 bp, Homo sapiens
cctcttctgctctttt

SEQ ID NO: 4559656 - DNA, 20 bp, Homo sapiens
cctcttctgctcttttcctg

SEQ ID NO: 4559657 - DNA, 16 bp, Homo sapiens
cctcttctgggcctga

SEQ ID NO: 4559658 - DNA, 12 bp, Homo sapiens
cctcttctttgt

SEQ ID NO: 4559659 - DNA, 16 bp, Homo sapiens
cctcttctttgtgcct

SEQ ID NO: 4559660 - DNA, 21 bp, Homo sapiens
cctcttctttgtgcctttggc

SEQ ID NO: 4559661 - DNA, 15 bp, Homo sapiens
cctcttgcaggctga

SEQ ID NO: 4559662 - DNA, 10 bp, Homo sapiens
cctcttgcct

SEQ ID NO: 4559663 - DNA, 23 bp, Homo sapiens
cctcttggaattacaagccctgg

SEQ ID NO: 4559664 - DNA, 15 bp, Homo sapiens
cctcttggctgcctt

SEQ ID NO: 4559665 - DNA, 15 bp, Homo sapiens
cctctttccctgcga

SEQ ID NO: 4559666 - DNA, 22 bp, Homo sapiens
cctctttccttccttcctcctt

SEQ ID NO: 4559667 - DNA, 15 bp, Homo sapiens
cctcttttacctgct

SEQ ID NO: 4559668 - DNA, 17 bp, Homo sapiens
cctcttttacctgctgc

SEQ ID NO: 4559669 - DNA, 19 bp, Homo sapiens
cctcttttacctgctgctt

SEQ ID NO: 4559670 - DNA, 16 bp, Homo sapiens
cctcttttcctggcag

SEQ ID NO: 4559671 - DNA, 17 bp, Homo sapiens
cctcttttcctggcagc

SEQ ID NO: 4559672 - DNA, 14 bp, Homo sapiens
cctctttttcctcc

SEQ ID NO: 4559673 - DNA, 16 bp, Homo sapiens
cctctttttcctcctg

SEQ ID NO: 4559674 - DNA, 17 bp, Homo sapiens
cctgaaaacactgtgca

SEQ ID NO: 4559675 - DNA, 22 bp, Homo sapiens
cctgaaaaggtttatgaaaaag

SEQ ID NO: 4559676 - DNA, 23 bp, Homo sapiens
cctgaaacccagtaattctaccc

SEQ ID NO: 4559677 - DNA, 18 bp, Homo sapiens
cctgaaacctcttcctag

SEQ ID NO: 4559678 - DNA, 14 bp, Homo sapiens
cctgaaccatgtgg

SEQ ID NO: 4559679 - DNA, 15 bp, Homo sapiens
cctgaaccccagagg

SEQ ID NO: 4559680 - DNA, 17 bp, Homo sapiens
cctgaaccccagaggca

SEQ ID NO: 4559681 - DNA, 16 bp, Homo sapiens
cctgaactccagaggt

SEQ ID NO: 4559682 - DNA, 16 bp, Homo sapiens
cctgaactgagcccca

SEQ ID NO: 4559683 - DNA, 17 bp, Homo sapiens
cctgaactgagccccag

SEQ ID NO: 4559684 - DNA, 13 bp, Homo sapiens
cctgaactgagga

SEQ ID NO: 4559685 - DNA, 13 bp, Homo sapiens
cctgaactttctc

SEQ ID NO: 4559686 - DNA, 16 bp, Homo sapiens
cctgaactttctccct

SEQ ID NO: 4559687 - DNA, 19 bp, Homo sapiens
cctgaactttctccctcat

SEQ ID NO: 4559688 - DNA, 23 bp, Homo sapiens
cctgaagaagcacttctgctgca

SEQ ID NO: 4559689 - DNA, 19 bp, Homo sapiens
cctgaagctgctgtgtcct

SEQ ID NO: 4559690 - DNA, 13 bp, Homo sapiens
cctgaaggcacag

SEQ ID NO: 4559691 - DNA, 14 bp, Homo sapiens
cctgaaggcacagc

SEQ ID NO: 4559692 - DNA, 12 bp, Homo sapiens
cctgaatatttt

SEQ ID NO: 4559693 - DNA, 20 bp, Homo sapiens
cctgaatcccccttgccacc

SEQ ID NO: 4559694 - DNA, 18 bp, Homo sapiens
cctgaatctgtgcaaaca

SEQ ID NO: 4559695 - DNA, 16 bp, Homo sapiens
cctgaatttgtaagca

SEQ ID NO: 4559696 - DNA, 14 bp, Homo sapiens
cctgacacaccagg

SEQ ID NO: 4559697 - DNA, 15 bp, Homo sapiens
cctgacacaccaggc

SEQ ID NO: 4559698 - DNA, 18 bp, Homo sapiens
cctgacacaccaggcgct

SEQ ID NO: 4559699 - DNA, 13 bp, Homo sapiens
cctgacactttaa

SEQ ID NO: 4559700 - DNA, 18 bp, Homo sapiens
cctgacagatgcctggtg

SEQ ID NO: 4559701 - DNA, 12 bp, Homo sapiens
cctgacagctct

SEQ ID NO: 4559702 - DNA, 14 bp, Homo sapiens
cctgacagctctgt

SEQ ID NO: 4559703 - DNA, 23 bp, Homo sapiens
cctgacaggtgaggtctgttcct

SEQ ID NO: 4559704 - DNA, 20 bp, Homo sapiens
cctgaccagctgctccgagg

SEQ ID NO: 4559705 - DNA, 13 bp, Homo sapiens
cctgaccagtcag

SEQ ID NO: 4559706 - DNA, 17 bp, Homo sapiens
cctgacccccatgtaaa

SEQ ID NO: 4559707 - DNA, 18 bp, Homo sapiens
cctgaccctcatctttct

SEQ ID NO: 4559708 - DNA, 19 bp, Homo sapiens
cctgaccctgctcctagca

SEQ ID NO: 4559709 - DNA, 16 bp, Homo sapiens
cctgaccgtgggcggg

SEQ ID NO: 4559710 - DNA, 23 bp, Homo sapiens
cctgacctcgtgatgggcccgcc

SEQ ID NO: 4559711 - DNA, 15 bp, Homo sapiens
cctgaccttgtgatc

SEQ ID NO: 4559712 - DNA, 22 bp, Homo sapiens
cctgacgctcagccccaggcca

SEQ ID NO: 4559713 - DNA, 24 bp, Homo sapiens
cctgacgctcagccccaggccagc

SEQ ID NO: 4559714 - DNA, 21 bp, Homo sapiens
cctgactcaattatttgcata

SEQ ID NO: 4559715 - DNA, 15 bp, Homo sapiens
cctgactcagtgacc

SEQ ID NO: 4559716 - DNA, 13 bp, Homo sapiens
cctgactcattct

SEQ ID NO: 4559717 - DNA, 17 bp, Homo sapiens
cctgactccctgtgggg

SEQ ID NO: 4559718 - DNA, 14 bp, Homo sapiens
cctgactcctctgg

SEQ ID NO: 4559719 - DNA, 18 bp, Homo sapiens
cctgactcctctggcttt

SEQ ID NO: 4559720 - DNA, 15 bp, Homo sapiens
cctgactcctggact

SEQ ID NO: 4559721 - DNA, 17 bp, Homo sapiens
cctgactctgccccctg

SEQ ID NO: 4559722 - DNA, 15 bp, Homo sapiens
cctgactgacttttt

SEQ ID NO: 4559723 - DNA, 16 bp, Homo sapiens
cctgacttgagccact

SEQ ID NO: 4559724 - DNA, 14 bp, Homo sapiens
cctgagaccagggt

SEQ ID NO: 4559725 - DNA, 19 bp, Homo sapiens
cctgagaccagggtggcca

SEQ ID NO: 4559726 - DNA, 23 bp, Homo sapiens
cctgagaccagggtggccacaca

SEQ ID NO: 4559727 - DNA, 15 bp, Homo sapiens
cctgagacccctggc

SEQ ID NO: 4559728 - DNA, 17 bp, Homo sapiens
cctgagacccctggcct

SEQ ID NO: 4559729 - DNA, 18 bp, Homo sapiens
cctgagacccctggcctc

SEQ ID NO: 4559730 - DNA, 19 bp, Homo sapiens
cctgagacccctggcctcc

SEQ ID NO: 4559731 - DNA, 15 bp, Homo sapiens
cctgagaccctggga

SEQ ID NO: 4559732 - DNA, 18 bp, Homo sapiens
cctgagaccctgggagag

SEQ ID NO: 4559733 - DNA, 21 bp, Homo sapiens
cctgagaccctgggagagaag

SEQ ID NO: 4559734 - DNA, 13 bp, Homo sapiens
cctgagagcctgt

SEQ ID NO: 4559735 - DNA, 17 bp, Homo sapiens
cctgagagcctgtggag

SEQ ID NO: 4559736 - DNA, 18 bp, Homo sapiens
cctgagagcctgtggagg

SEQ ID NO: 4559737 - DNA, 22 bp, Homo sapiens
cctgagagcctgtggaggggct

SEQ ID NO: 4559738 - DNA, 12 bp, Homo sapiens
cctgagaggcag

SEQ ID NO: 4559739 - DNA, 13 bp, Homo sapiens
cctgagaggcagg

SEQ ID NO: 4559740 - DNA, 20 bp, Homo sapiens
cctgagaggggaagcggccc

SEQ ID NO: 4559741 - DNA, 18 bp, Homo sapiens
cctgagatctgcacagtc

SEQ ID NO: 4559742 - DNA, 16 bp, Homo sapiens
cctgagatgcaggtga

SEQ ID NO: 4559743 - DNA, 17 bp, Homo sapiens
cctgagattcagatgtc

SEQ ID NO: 4559744 - DNA, 11 bp, Homo sapiens
cctgagatttc

SEQ ID NO: 4559745 - DNA, 16 bp, Homo sapiens
cctgagatttcatctg

SEQ ID NO: 4559746 - DNA, 17 bp, Homo sapiens
cctgagatttcatctgc

SEQ ID NO: 4559747 - DNA, 18 bp, Homo sapiens
cctgagatttcatctgct

SEQ ID NO: 4559748 - DNA, 20 bp, Homo sapiens
cctgagcactcctggtgcag

SEQ ID NO: 4559749 - DNA, 21 bp, Homo sapiens
cctgagcatccagacctgagc

SEQ ID NO: 4559750 - DNA, 17 bp, Homo sapiens
cctgagcattcaggcag

SEQ ID NO: 4559751 - DNA, 18 bp, Homo sapiens
cctgagccaatgggacag

SEQ ID NO: 4559752 - DNA, 14 bp, Homo sapiens
cctgagccagcagg

SEQ ID NO: 4559753 - DNA, 10 bp, Homo sapiens
cctgagcccc

SEQ ID NO: 4559754 - DNA, 17 bp, Homo sapiens
cctgagccggccccagg

SEQ ID NO: 4559755 - DNA, 21 bp, Homo sapiens
cctgagcgggagtcagggacc

SEQ ID NO: 4559756 - DNA, 17 bp, Homo sapiens
cctgagctattttcctc

SEQ ID NO: 4559757 - DNA, 17 bp, Homo sapiens
cctgagctcggggacag

SEQ ID NO: 4559758 - DNA, 19 bp, Homo sapiens
cctgagctcggggacaggt

SEQ ID NO: 4559759 - DNA, 17 bp, Homo sapiens
cctgagctgcagctgag

SEQ ID NO: 4559760 - DNA, 21 bp, Homo sapiens
cctgagctgcagctgagcctg

SEQ ID NO: 4559761 - DNA, 14 bp, Homo sapiens
cctgagctttatgg

SEQ ID NO: 4559762 - DNA, 20 bp, Homo sapiens
cctgaggacctttctgagga

SEQ ID NO: 4559763 - DNA, 21 bp, Homo sapiens
cctgaggccaggacgtctggg

SEQ ID NO: 4559764 - DNA, 22 bp, Homo sapiens
cctgaggccctgggctgggtgc

SEQ ID NO: 4559765 - DNA, 23 bp, Homo sapiens
cctgaggccctgggctgggtgct

SEQ ID NO: 4559766 - DNA, 19 bp, Homo sapiens
cctgaggcctagactctgt

SEQ ID NO: 4559767 - DNA, 13 bp, Homo sapiens
cctgaggcctcca

SEQ ID NO: 4559768 - DNA, 21 bp, Homo sapiens
cctgaggctgtttttggctgt

SEQ ID NO: 4559769 - DNA, 20 bp, Homo sapiens
cctgaggctttggatttgac

SEQ ID NO: 4559770 - DNA, 22 bp, Homo sapiens
cctgagggcagaaaggttctgc

SEQ ID NO: 4559771 - DNA, 12 bp, Homo sapiens
cctgagggcagt

SEQ ID NO: 4559772 - DNA, 20 bp, Homo sapiens
cctgagggctaattctggga

SEQ ID NO: 4559773 - DNA, 22 bp, Homo sapiens
cctgaggttaaacggtgcccat

SEQ ID NO: 4559774 - DNA, 14 bp, Homo sapiens
cctgagtgcgggct

SEQ ID NO: 4559775 - DNA, 15 bp, Homo sapiens
cctgagttcccggga

SEQ ID NO: 4559776 - DNA, 19 bp, Homo sapiens
cctgagttcccgggagctg

SEQ ID NO: 4559777 - DNA, 21 bp, Homo sapiens
cctgagttcccgggagctggg

SEQ ID NO: 4559778 - DNA, 24 bp, Homo sapiens
cctgagttgggcagccaggagtgc

SEQ ID NO: 4559779 - DNA, 19 bp, Homo sapiens
cctgataacaagcaaggat

SEQ ID NO: 4559780 - DNA, 15 bp, Homo sapiens
cctgatcccaccccc

SEQ ID NO: 4559781 - DNA, 21 bp, Homo sapiens
cctgatcccaccccctcctcc

SEQ ID NO: 4559782 - DNA, 20 bp, Homo sapiens
cctgatctctgctccctgca

SEQ ID NO: 4559783 - DNA, 21 bp, Homo sapiens
cctgatctttgggcatcagaa

SEQ ID NO: 4559784 - DNA, 18 bp, Homo sapiens
cctgatgacgggatgctc

SEQ ID NO: 4559785 - DNA, 20 bp, Homo sapiens
cctgatgacgggatgctctt

SEQ ID NO: 4559786 - DNA, 21 bp, Homo sapiens
cctgatgacgggatgctcttt

SEQ ID NO: 4559787 - DNA, 16 bp, Homo sapiens
cctgatgagattttta

SEQ ID NO: 4559788 - DNA, 13 bp, Homo sapiens
cctgatgctccct

SEQ ID NO: 4559789 - DNA, 24 bp, Homo sapiens
cctgatgctggggacacagcatca

SEQ ID NO: 4559790 - DNA, 18 bp, Homo sapiens
cctgatggggaagggact

SEQ ID NO: 4559791 - DNA, 17 bp, Homo sapiens
cctgatgtgggagctga

SEQ ID NO: 4559792 - DNA, 20 bp, Homo sapiens
cctgattaccagtctgatta

SEQ ID NO: 4559793 - DNA, 22 bp, Homo sapiens
cctgattaccagtctgattata

SEQ ID NO: 4559794 - DNA, 21 bp, Homo sapiens
cctgattggccactggatcct

SEQ ID NO: 4559795 - DNA, 17 bp, Homo sapiens
cctgcaaaaggactctc

SEQ ID NO: 4559796 - DNA, 18 bp, Homo sapiens
cctgcaaaccttcctggg

SEQ ID NO: 4559797 - DNA, 20 bp, Homo sapiens
cctgcaaaccttcctgggag

SEQ ID NO: 4559798 - DNA, 22 bp, Homo sapiens
cctgcaaatttagtttgttaaa

SEQ ID NO: 4559799 - DNA, 15 bp, Homo sapiens
cctgcaactcagccc

SEQ ID NO: 4559800 - DNA, 17 bp, Homo sapiens
cctgcaacttccgctga

SEQ ID NO: 4559801 - DNA, 19 bp, Homo sapiens
cctgcaacttccgctgagg

SEQ ID NO: 4559802 - DNA, 18 bp, Homo sapiens
cctgcaagaccacggagg

SEQ ID NO: 4559803 - DNA, 13 bp, Homo sapiens
cctgcaagatgga

SEQ ID NO: 4559804 - DNA, 21 bp, Homo sapiens
cctgcaagatggacacgagcc

SEQ ID NO: 4559805 - DNA, 17 bp, Homo sapiens
cctgcaagccttctaaa

SEQ ID NO: 4559806 - DNA, 15 bp, Homo sapiens
cctgcaagttgctct

SEQ ID NO: 4559807 - DNA, 20 bp, Homo sapiens
cctgcaagttgctctgacct

SEQ ID NO: 4559808 - DNA, 17 bp, Homo sapiens
cctgcacaccagagaca

SEQ ID NO: 4559809 - DNA, 14 bp, Homo sapiens
cctgcacaccctgg

SEQ ID NO: 4559810 - DNA, 16 bp, Homo sapiens
cctgcacaccctgggc

SEQ ID NO: 4559811 - DNA, 17 bp, Homo sapiens
cctgcacagcaggctgc

SEQ ID NO: 4559812 - DNA, 19 bp, Homo sapiens
cctgcacagcaggctgcca

SEQ ID NO: 4559813 - DNA, 20 bp, Homo sapiens
cctgcacaggcacacagggc

SEQ ID NO: 4559814 - DNA, 22 bp, Homo sapiens
cctgcacaggcacacagggccc

SEQ ID NO: 4559815 - DNA, 12 bp, Homo sapiens
cctgcacagttt

SEQ ID NO: 4559816 - DNA, 17 bp, Homo sapiens
cctgcacccctccggcc

SEQ ID NO: 4559817 - DNA, 20 bp, Homo sapiens
cctgcacccctccggccccg

SEQ ID NO: 4559818 - DNA, 23 bp, Homo sapiens
cctgcacccttccacagctggcc

SEQ ID NO: 4559819 - DNA, 17 bp, Homo sapiens
cctgcaccgccccttct

SEQ ID NO: 4559820 - DNA, 14 bp, Homo sapiens
cctgcacctccccc

SEQ ID NO: 4559821 - DNA, 17 bp, Homo sapiens
cctgcacctccccccac

SEQ ID NO: 4559822 - DNA, 18 bp, Homo sapiens
cctgcacctccccccact

SEQ ID NO: 4559823 - DNA, 20 bp, Homo sapiens
cctgcacctccccccactgc

SEQ ID NO: 4559824 - DNA, 22 bp, Homo sapiens
cctgcacctccccccactgcag

SEQ ID NO: 4559825 - DNA, 12 bp, Homo sapiens
cctgcacctgcc

SEQ ID NO: 4559826 - DNA, 17 bp, Homo sapiens
cctgcacggtgggcctt

SEQ ID NO: 4559827 - DNA, 21 bp, Homo sapiens
cctgcacggtgggccttgctg

SEQ ID NO: 4559828 - DNA, 18 bp, Homo sapiens
cctgcacgtcatgggagg

SEQ ID NO: 4559829 - DNA, 18 bp, Homo sapiens
cctgcactttgatgtcat

SEQ ID NO: 4559830 - DNA, 22 bp, Homo sapiens
cctgcagaagtaagcctcatca

SEQ ID NO: 4559831 - DNA, 17 bp, Homo sapiens
cctgcagacacctggac

SEQ ID NO: 4559832 - DNA, 18 bp, Homo sapiens
cctgcagacctcaagcca

SEQ ID NO: 4559833 - DNA, 16 bp, Homo sapiens
cctgcagattctgagc

SEQ ID NO: 4559834 - DNA, 17 bp, Homo sapiens
cctgcagattctgagca

SEQ ID NO: 4559835 - DNA, 13 bp, Homo sapiens
cctgcagccaggg

SEQ ID NO: 4559836 - DNA, 14 bp, Homo sapiens
cctgcagccagggc

SEQ ID NO: 4559837 - DNA, 18 bp, Homo sapiens
cctgcagccagggctggg

SEQ ID NO: 4559838 - DNA, 22 bp, Homo sapiens
cctgcagccagggctggggttg

SEQ ID NO: 4559839 - DNA, 23 bp, Homo sapiens
cctgcagcccaccagacgtcagg

SEQ ID NO: 4559840 - DNA, 17 bp, Homo sapiens
cctgcaggagagagcag

SEQ ID NO: 4559841 - DNA, 18 bp, Homo sapiens
cctgcaggagagagcagc

SEQ ID NO: 4559842 - DNA, 23 bp, Homo sapiens
cctgcaggagagagcagcactcc

SEQ ID NO: 4559843 - DNA, 20 bp, Homo sapiens
cctgcaggtcagttgtaata

SEQ ID NO: 4559844 - DNA, 21 bp, Homo sapiens
cctgcaggtcagttgtaataa

SEQ ID NO: 4559845 - DNA, 19 bp, Homo sapiens
cctgcagtttcttgtgtag

SEQ ID NO: 4559846 - DNA, 16 bp, Homo sapiens
cctgcatgcaactaat

SEQ ID NO: 4559847 - DNA, 19 bp, Homo sapiens
cctgccaagactcctcagg

SEQ ID NO: 4559848 - DNA, 12 bp, Homo sapiens
cctgccacagcc

SEQ ID NO: 4559849 - DNA, 14 bp, Homo sapiens
cctgccacagccag

SEQ ID NO: 4559850 - DNA, 15 bp, Homo sapiens
cctgccacagccaga

SEQ ID NO: 4559851 - DNA, 16 bp, Homo sapiens
cctgccacagccagag

SEQ ID NO: 4559852 - DNA, 19 bp, Homo sapiens
cctgccacagccagaggag

SEQ ID NO: 4559853 - DNA, 16 bp, Homo sapiens
cctgccacatggagcc

SEQ ID NO: 4559854 - DNA, 12 bp, Homo sapiens
cctgccactcac

SEQ ID NO: 4559855 - DNA, 17 bp, Homo sapiens
cctgccactcacacagc

SEQ ID NO: 4559856 - DNA, 16 bp, Homo sapiens
cctgccactctctggg

SEQ ID NO: 4559857 - DNA, 12 bp, Homo sapiens
cctgccagccac

SEQ ID NO: 4559858 - DNA, 12 bp, Homo sapiens
cctgccagctgg

SEQ ID NO: 4559859 - DNA, 19 bp, Homo sapiens
cctgccaggcacacacagc

SEQ ID NO: 4559860 - DNA, 21 bp, Homo sapiens
cctgccaggcacacacagccc

SEQ ID NO: 4559861 - DNA, 13 bp, Homo sapiens
cctgccaggcagg

SEQ ID NO: 4559862 - DNA, 14 bp, Homo sapiens
cctgccaggcaggg

SEQ ID NO: 4559863 - DNA, 17 bp, Homo sapiens
cctgccagtgaagtcct

SEQ ID NO: 4559864 - DNA, 20 bp, Homo sapiens
cctgccagtgaagtccttca

SEQ ID NO: 4559865 - DNA, 18 bp, Homo sapiens
cctgccagtgccttacct

SEQ ID NO: 4559866 - DNA, 20 bp, Homo sapiens
cctgccatcatgtttacaga

SEQ ID NO: 4559867 - DNA, 15 bp, Homo sapiens
cctgccatgccagga

SEQ ID NO: 4559868 - DNA, 20 bp, Homo sapiens
cctgccatggaactgtttcc

SEQ ID NO: 4559869 - DNA, 15 bp, Homo sapiens
cctgcccaaaatgtg

SEQ ID NO: 4559870 - DNA, 23 bp, Homo sapiens
cctgcccaaggcctaccccagtt

SEQ ID NO: 4559871 - DNA, 12 bp, Homo sapiens
cctgcccacaga

SEQ ID NO: 4559872 - DNA, 16 bp, Homo sapiens
cctgcccagactgatg

SEQ ID NO: 4559873 - DNA, 22 bp, Homo sapiens
cctgcccagactgatgagcaca

SEQ ID NO: 4559874 - DNA, 15 bp, Homo sapiens
cctgcccagagctga

SEQ ID NO: 4559875 - DNA, 22 bp, Homo sapiens
cctgcccagagctgagttgggg

SEQ ID NO: 4559876 - DNA, 14 bp, Homo sapiens
cctgcccagcctgc

SEQ ID NO: 4559877 - DNA, 12 bp, Homo sapiens
cctgcccaggag

SEQ ID NO: 4559878 - DNA, 20 bp, Homo sapiens
cctgcccaggagagccagcc

SEQ ID NO: 4559879 - DNA, 13 bp, Homo sapiens
cctgcccaggcca

SEQ ID NO: 4559880 - DNA, 14 bp, Homo sapiens
cctgcccaggccac

SEQ ID NO: 4559881 - DNA, 18 bp, Homo sapiens
cctgcccaggccacagag

SEQ ID NO: 4559882 - DNA, 17 bp, Homo sapiens
cctgcccatgccccagt

SEQ ID NO: 4559883 - DNA, 16 bp, Homo sapiens
cctgcccatgtgtccc

SEQ ID NO: 4559884 - DNA, 22 bp, Homo sapiens
cctgccccacccaactccacag

SEQ ID NO: 4559885 - DNA, 16 bp, Homo sapiens
cctgccccaccccatc

SEQ ID NO: 4559886 - DNA, 23 bp, Homo sapiens
cctgccccaccccatccagccag

SEQ ID NO: 4559887 - DNA, 15 bp, Homo sapiens
cctgcccccaatcca

SEQ ID NO: 4559888 - DNA, 13 bp, Homo sapiens
cctgcccccagcc

SEQ ID NO: 4559889 - DNA, 16 bp, Homo sapiens
cctgcccccaggactg

SEQ ID NO: 4559890 - DNA, 18 bp, Homo sapiens
cctgcccccaggactggg

SEQ ID NO: 4559891 - DNA, 15 bp, Homo sapiens
cctgccccctgccag

SEQ ID NO: 4559892 - DNA, 22 bp, Homo sapiens
cctgccccgtcggactgccccc

SEQ ID NO: 4559893 - DNA, 17 bp, Homo sapiens
cctgcccctgagcccat

SEQ ID NO: 4559894 - DNA, 21 bp, Homo sapiens
cctgccccttctacactctcc

SEQ ID NO: 4559895 - DNA, 22 bp, Homo sapiens
cctgccccttctacactctcct

SEQ ID NO: 4559896 - DNA, 22 bp, Homo sapiens
cctgcccgggcgcggccagccc

SEQ ID NO: 4559897 - DNA, 15 bp, Homo sapiens
cctgccctcccaagt

SEQ ID NO: 4559898 - DNA, 11 bp, Homo sapiens
cctgccctgca

SEQ ID NO: 4559899 - DNA, 15 bp, Homo sapiens
cctgccctgcctcag

SEQ ID NO: 4559900 - DNA, 12 bp, Homo sapiens
cctgccctgtcc

SEQ ID NO: 4559901 - DNA, 17 bp, Homo sapiens
cctgcccttccctctgg

SEQ ID NO: 4559902 - DNA, 19 bp, Homo sapiens
cctgcccttccctctgggc

SEQ ID NO: 4559903 - DNA, 22 bp, Homo sapiens
cctgcccttttttctgcctcct

SEQ ID NO: 4559904 - DNA, 22 bp, Homo sapiens
cctgccgagagtccatcagcct

SEQ ID NO: 4559905 - DNA, 15 bp, Homo sapiens
cctgccgcagagctg

SEQ ID NO: 4559906 - DNA, 14 bp, Homo sapiens
cctgccgcctcaat

SEQ ID NO: 4559907 - DNA, 18 bp, Homo sapiens
cctgccggtgggaccctg

SEQ ID NO: 4559908 - DNA, 18 bp, Homo sapiens
cctgcctatgtctcctct

SEQ ID NO: 4559909 - DNA, 15 bp, Homo sapiens
cctgcctcactcctc

SEQ ID NO: 4559910 - DNA, 12 bp, Homo sapiens
cctgcctcagcc

SEQ ID NO: 4559911 - DNA, 16 bp, Homo sapiens
cctgcctcagcctccc

SEQ ID NO: 4559912 - DNA, 14 bp, Homo sapiens
cctgcctccaccct

SEQ ID NO: 4559913 - DNA, 18 bp, Homo sapiens
cctgcctccaccctctga

SEQ ID NO: 4559914 - DNA, 12 bp, Homo sapiens
cctgcctccagg

SEQ ID NO: 4559915 - DNA, 21 bp, Homo sapiens
cctgcctccagggctggactg

SEQ ID NO: 4559916 - DNA, 17 bp, Homo sapiens
cctgcctcccattctgc

SEQ ID NO: 4559917 - DNA, 18 bp, Homo sapiens
cctgcctcccattctgca

SEQ ID NO: 4559918 - DNA, 17 bp, Homo sapiens
cctgcctcccttgactt

SEQ ID NO: 4559919 - DNA, 15 bp, Homo sapiens
cctgcctcctgccta

SEQ ID NO: 4559920 - DNA, 19 bp, Homo sapiens
cctgcctctgaccccagca

SEQ ID NO: 4559921 - DNA, 16 bp, Homo sapiens
cctgcctgaacagccc

SEQ ID NO: 4559922 - DNA, 12 bp, Homo sapiens
cctgcctgaggg

SEQ ID NO: 4559923 - DNA, 16 bp, Homo sapiens
cctgcctgagggcagt

SEQ ID NO: 4559924 - DNA, 13 bp, Homo sapiens
cctgcctgcagcc

SEQ ID NO: 4559925 - DNA, 14 bp, Homo sapiens
cctgcctgcagcca

SEQ ID NO: 4559926 - DNA, 23 bp, Homo sapiens
cctgcctgccctgcctcagccag

SEQ ID NO: 4559927 - DNA, 11 bp, Homo sapiens
cctgcctggcc

SEQ ID NO: 4559928 - DNA, 13 bp, Homo sapiens
cctgcctggccag

SEQ ID NO: 4559929 - DNA, 22 bp, Homo sapiens
cctgcctggccaggcagatctg

SEQ ID NO: 4559930 - DNA, 18 bp, Homo sapiens
cctgcctggtccagtggg

SEQ ID NO: 4559931 - DNA, 23 bp, Homo sapiens
cctgcctgtgcccgcatgtgtgc

SEQ ID NO: 4559932 - DNA, 13 bp, Homo sapiens
cctgcctgtggca

SEQ ID NO: 4559933 - DNA, 16 bp, Homo sapiens
cctgcctgtggcccct

SEQ ID NO: 4559934 - DNA, 20 bp, Homo sapiens
cctgccttagagccaggcac

SEQ ID NO: 4559935 - DNA, 17 bp, Homo sapiens
cctgccttcctcctggg

SEQ ID NO: 4559936 - DNA, 12 bp, Homo sapiens
cctgccttggag

SEQ ID NO: 4559937 - DNA, 20 bp, Homo sapiens
cctgcgcccaccccgctctg

SEQ ID NO: 4559938 - DNA, 21 bp, Homo sapiens
cctgcgcccaccccgctctgc

SEQ ID NO: 4559939 - DNA, 22 bp, Homo sapiens
cctgcgcccaccccgctctgca

SEQ ID NO: 4559940 - DNA, 20 bp, Homo sapiens
cctgcggagaccctgagtcc

SEQ ID NO: 4559941 - DNA, 20 bp, Homo sapiens
cctgcgggaccatctggggc

SEQ ID NO: 4559942 - DNA, 21 bp, Homo sapiens
cctgcgggcttttccccggtc

SEQ ID NO: 4559943 - DNA, 16 bp, Homo sapiens
cctgcgtcctcctcac

SEQ ID NO: 4559944 - DNA, 17 bp, Homo sapiens
cctgcgtcctcctcacc

SEQ ID NO: 4559945 - DNA, 18 bp, Homo sapiens
cctgcgtcctcctcacct

SEQ ID NO: 4559946 - DNA, 20 bp, Homo sapiens
cctgcgtcctcctcacctca

SEQ ID NO: 4559947 - DNA, 13 bp, Homo sapiens
cctgcgtgggggc

SEQ ID NO: 4559948 - DNA, 22 bp, Homo sapiens
cctgcgttcccagaccatggga

SEQ ID NO: 4559949 - DNA, 16 bp, Homo sapiens
cctgctaaggctcctc

SEQ ID NO: 4559950 - DNA, 15 bp, Homo sapiens
cctgctactcctgtg

SEQ ID NO: 4559951 - DNA, 20 bp, Homo sapiens
cctgctactcctgtgctctg

SEQ ID NO: 4559952 - DNA, 18 bp, Homo sapiens
cctgctagacgcaccgcc

SEQ ID NO: 4559953 - DNA, 13 bp, Homo sapiens
cctgctagcacag

SEQ ID NO: 4559954 - DNA, 18 bp, Homo sapiens
cctgctagcacagaggcc

SEQ ID NO: 4559955 - DNA, 19 bp, Homo sapiens
cctgctagcacagaggcct

SEQ ID NO: 4559956 - DNA, 17 bp, Homo sapiens
cctgctcaactctaccc

SEQ ID NO: 4559957 - DNA, 21 bp, Homo sapiens
cctgctcaactctacccctgc

SEQ ID NO: 4559958 - DNA, 19 bp, Homo sapiens
cctgctcaatccctgagga

SEQ ID NO: 4559959 - DNA, 23 bp, Homo sapiens
cctgctcagtgcttgggctccac

SEQ ID NO: 4559960 - DNA, 13 bp, Homo sapiens
cctgctccaccag

SEQ ID NO: 4559961 - DNA, 16 bp, Homo sapiens
cctgctcccagtcctg

SEQ ID NO: 4559962 - DNA, 18 bp, Homo sapiens
cctgctcccagtcctgcc

SEQ ID NO: 4559963 - DNA, 14 bp, Homo sapiens
cctgctccctgcct

SEQ ID NO: 4559964 - DNA, 22 bp, Homo sapiens
cctgctctccaagtctcagtgg

SEQ ID NO: 4559965 - DNA, 21 bp, Homo sapiens
cctgctcttctctccccagcc

SEQ ID NO: 4559966 - DNA, 23 bp, Homo sapiens
cctgctcttctctccccagcccc

SEQ ID NO: 4559967 - DNA, 14 bp, Homo sapiens
cctgctgaccttgg

SEQ ID NO: 4559968 - DNA, 17 bp, Homo sapiens
cctgctgagagacccaa

SEQ ID NO: 4559969 - DNA, 20 bp, Homo sapiens
cctgctgagagacccaagga

SEQ ID NO: 4559970 - DNA, 14 bp, Homo sapiens
cctgctgccagtgc

SEQ ID NO: 4559971 - DNA, 17 bp, Homo sapiens
cctgctgccagtgcagc

SEQ ID NO: 4559972 - DNA, 19 bp, Homo sapiens
cctgctgccagtgcagcca

SEQ ID NO: 4559973 - DNA, 14 bp, Homo sapiens
cctgctgcttctcc

SEQ ID NO: 4559974 - DNA, 15 bp, Homo sapiens
cctgctggcacccac

SEQ ID NO: 4559975 - DNA, 15 bp, Homo sapiens
cctgctggccgcctc

SEQ ID NO: 4559976 - DNA, 19 bp, Homo sapiens
cctgctggccgcctcaccc

SEQ ID NO: 4559977 - DNA, 19 bp, Homo sapiens
cctgctggctcttctgccc

SEQ ID NO: 4559978 - DNA, 15 bp, Homo sapiens
cctgctgggaatggc

SEQ ID NO: 4559979 - DNA, 16 bp, Homo sapiens
cctgctgggctctcca

SEQ ID NO: 4559980 - DNA, 19 bp, Homo sapiens
cctgctgggctctccacct

SEQ ID NO: 4559981 - DNA, 24 bp, Homo sapiens
cctgctgggctctccacctcagcc

SEQ ID NO: 4559982 - DNA, 22 bp, Homo sapiens
cctgctggggaagaacagcccc

SEQ ID NO: 4559983 - DNA, 23 bp, Homo sapiens
cctgctggggaagaacagccccg

SEQ ID NO: 4559984 - DNA, 15 bp, Homo sapiens
cctgctgtgctgctc

SEQ ID NO: 4559985 - DNA, 18 bp, Homo sapiens
cctgcttaaacttgaccc

SEQ ID NO: 4559986 - DNA, 15 bp, Homo sapiens
cctgcttgcccgctc

SEQ ID NO: 4559987 - DNA, 21 bp, Homo sapiens
cctgcttgcccgctcccacag

SEQ ID NO: 4559988 - DNA, 22 bp, Homo sapiens
cctgcttgcccgctcccacagc

SEQ ID NO: 4559989 - DNA, 13 bp, Homo sapiens
cctgctttctacg

SEQ ID NO: 4559990 - DNA, 12 bp, Homo sapiens
cctgctttgcat

SEQ ID NO: 4559991 - DNA, 15 bp, Homo sapiens
cctgctttgcatctt

SEQ ID NO: 4559992 - DNA, 16 bp, Homo sapiens
cctgctttttgtgttt

SEQ ID NO: 4559993 - DNA, 16 bp, Homo sapiens
cctggaaactgctcag

SEQ ID NO: 4559994 - DNA, 22 bp, Homo sapiens
cctggaaactgctcagacgtct

SEQ ID NO: 4559995 - DNA, 17 bp, Homo sapiens
cctggaagctgtgtcct

SEQ ID NO: 4559996 - DNA, 18 bp, Homo sapiens
cctggaagctgtgtcctt

SEQ ID NO: 4559997 - DNA, 20 bp, Homo sapiens
cctggaagctgtgtccttgc

SEQ ID NO: 4559998 - DNA, 21 bp, Homo sapiens
cctggaagctgtgtccttgca

SEQ ID NO: 4559999 - DNA, 15 bp, Homo sapiens
cctggaaggacacag

SEQ ID NO: 4560000 - DNA, 18 bp, Homo sapiens
cctggaaggacacagtga

SEQ ID NO: 4560001 - DNA, 13 bp, Homo sapiens
cctggaagggcta

SEQ ID NO: 4560002 - DNA, 19 bp, Homo sapiens
cctggacaggcgggctcgg

SEQ ID NO: 4560003 - DNA, 15 bp, Homo sapiens
cctggacctgggaac

SEQ ID NO: 4560004 - DNA, 22 bp, Homo sapiens
cctggactccggaggactgagc

SEQ ID NO: 4560005 - DNA, 13 bp, Homo sapiens
cctggactgaggg

SEQ ID NO: 4560006 - DNA, 21 bp, Homo sapiens
cctggactgagggggcctgga

SEQ ID NO: 4560007 - DNA, 22 bp, Homo sapiens
cctggagaaaaaaattgctctg

SEQ ID NO: 4560008 - DNA, 19 bp, Homo sapiens
cctggagacaaggtgctaa

SEQ ID NO: 4560009 - DNA, 22 bp, Homo sapiens
cctggagagccagaacctggag

SEQ ID NO: 4560010 - DNA, 13 bp, Homo sapiens
cctggagagctag

SEQ ID NO: 4560011 - DNA, 21 bp, Homo sapiens
cctggagagctagaacctgga

SEQ ID NO: 4560012 - DNA, 17 bp, Homo sapiens
cctggagagtgcacatg

SEQ ID NO: 4560013 - DNA, 12 bp, Homo sapiens
cctggagcagag

SEQ ID NO: 4560014 - DNA, 23 bp, Homo sapiens
cctggagcagaggaggggaaagt

SEQ ID NO: 4560015 - DNA, 14 bp, Homo sapiens
cctggagcaggagc

SEQ ID NO: 4560016 - DNA, 15 bp, Homo sapiens
cctggagcaggagcc

SEQ ID NO: 4560017 - DNA, 23 bp, Homo sapiens
cctggagcaggagccccgccaca

SEQ ID NO: 4560018 - DNA, 22 bp, Homo sapiens
cctggagcgtttctagcaagtg

SEQ ID NO: 4560019 - DNA, 14 bp, Homo sapiens
cctggaggacagag

SEQ ID NO: 4560020 - DNA, 21 bp, Homo sapiens
cctggaggctgcctcccaaca

SEQ ID NO: 4560021 - DNA, 22 bp, Homo sapiens
cctggagggaaggacagtccct

SEQ ID NO: 4560022 - DNA, 18 bp, Homo sapiens
cctggagggcaagccctg

SEQ ID NO: 4560023 - DNA, 20 bp, Homo sapiens
cctggagggcaagccctgcc

SEQ ID NO: 4560024 - DNA, 23 bp, Homo sapiens
cctggagggcaagccctgcccac

SEQ ID NO: 4560025 - DNA, 18 bp, Homo sapiens
cctggagggctagaactg

SEQ ID NO: 4560026 - DNA, 20 bp, Homo sapiens
cctggaggggctagaaccta

SEQ ID NO: 4560027 - DNA, 20 bp, Homo sapiens
cctggagtgtggctgaggag

SEQ ID NO: 4560028 - DNA, 21 bp, Homo sapiens
cctggagtgtggctgaggagg

SEQ ID NO: 4560029 - DNA, 17 bp, Homo sapiens
cctggatccagcactgg

SEQ ID NO: 4560030 - DNA, 18 bp, Homo sapiens
cctggatgccatccaagt

SEQ ID NO: 4560031 - DNA, 19 bp, Homo sapiens
cctggatgccccctgtgga

SEQ ID NO: 4560032 - DNA, 19 bp, Homo sapiens
cctggcaaatgcctgactc

SEQ ID NO: 4560033 - DNA, 23 bp, Homo sapiens
cctggcaagctagaacctggagg

SEQ ID NO: 4560034 - DNA, 19 bp, Homo sapiens
cctggcactgggaggcagg

SEQ ID NO: 4560035 - DNA, 13 bp, Homo sapiens
cctggcagacaca

SEQ ID NO: 4560036 - DNA, 12 bp, Homo sapiens
cctggcagctgc

SEQ ID NO: 4560037 - DNA, 17 bp, Homo sapiens
cctggcagctgctgtgg

SEQ ID NO: 4560038 - DNA, 22 bp, Homo sapiens
cctggcagggcgccaagtctgg

SEQ ID NO: 4560039 - DNA, 20 bp, Homo sapiens
cctggcaggttagaacctag

SEQ ID NO: 4560040 - DNA, 21 bp, Homo sapiens
cctggcaggttagaacctaga

SEQ ID NO: 4560041 - DNA, 19 bp, Homo sapiens
cctggcatgtcaacagcgt

SEQ ID NO: 4560042 - DNA, 21 bp, Homo sapiens
cctggccaccagccatcctcc

SEQ ID NO: 4560043 - DNA, 13 bp, Homo sapiens
cctggccagacgc

SEQ ID NO: 4560044 - DNA, 12 bp, Homo sapiens
cctggccaggac

SEQ ID NO: 4560045 - DNA, 15 bp, Homo sapiens
cctggccaggagctc

SEQ ID NO: 4560046 - DNA, 16 bp, Homo sapiens
cctggccaggagctct

SEQ ID NO: 4560047 - DNA, 19 bp, Homo sapiens
cctggccaggagctcttca

SEQ ID NO: 4560048 - DNA, 21 bp, Homo sapiens
cctggccaggagctcttcagg

SEQ ID NO: 4560049 - DNA, 14 bp, Homo sapiens
cctggccaggcaga

SEQ ID NO: 4560050 - DNA, 12 bp, Homo sapiens
cctggcccaggg

SEQ ID NO: 4560051 - DNA, 14 bp, Homo sapiens
cctggcccagggca

SEQ ID NO: 4560052 - DNA, 15 bp, Homo sapiens
cctggcccagggcat

SEQ ID NO: 4560053 - DNA, 16 bp, Homo sapiens
cctggcccagggcatc

SEQ ID NO: 4560054 - DNA, 15 bp, Homo sapiens
cctggcccaggtgcc

SEQ ID NO: 4560055 - DNA, 15 bp, Homo sapiens
cctggccccatgtct

SEQ ID NO: 4560056 - DNA, 23 bp, Homo sapiens
cctggcccccaacctcagggctc

SEQ ID NO: 4560057 - DNA, 18 bp, Homo sapiens
cctggcccccacagcgct

SEQ ID NO: 4560058 - DNA, 16 bp, Homo sapiens
cctggcccccatcagc

SEQ ID NO: 4560059 - DNA, 20 bp, Homo sapiens
cctggccctccactcctcat

SEQ ID NO: 4560060 - DNA, 21 bp, Homo sapiens
cctggcctatccgctgccagc

SEQ ID NO: 4560061 - DNA, 13 bp, Homo sapiens
cctggcctcatct

SEQ ID NO: 4560062 - DNA, 17 bp, Homo sapiens
cctggcctcatctcaga

SEQ ID NO: 4560063 - DNA, 23 bp, Homo sapiens
cctggcctccggcgtcagcctcc

SEQ ID NO: 4560064 - DNA, 18 bp, Homo sapiens
cctggcctgaactgagga

SEQ ID NO: 4560065 - DNA, 16 bp, Homo sapiens
cctggccttctgaact

SEQ ID NO: 4560066 - DNA, 20 bp, Homo sapiens
cctggccttctgaactccat

SEQ ID NO: 4560067 - DNA, 15 bp, Homo sapiens
cctggcgcaggtggg

SEQ ID NO: 4560068 - DNA, 15 bp, Homo sapiens
cctggcgcctggcag

SEQ ID NO: 4560069 - DNA, 16 bp, Homo sapiens
cctggcgtgctcagac

SEQ ID NO: 4560070 - DNA, 21 bp, Homo sapiens
cctggctccactcttgatctc

SEQ ID NO: 4560071 - DNA, 22 bp, Homo sapiens
cctggctccactcttgatctct

SEQ ID NO: 4560072 - DNA, 15 bp, Homo sapiens
cctggctcccatgac

SEQ ID NO: 4560073 - DNA, 15 bp, Homo sapiens
cctggctccctcctc

SEQ ID NO: 4560074 - DNA, 13 bp, Homo sapiens
cctggctccctga

SEQ ID NO: 4560075 - DNA, 14 bp, Homo sapiens
cctggctccctgat

SEQ ID NO: 4560076 - DNA, 13 bp, Homo sapiens
cctggctctgccc

SEQ ID NO: 4560077 - DNA, 18 bp, Homo sapiens
cctggctctgtggcgagc

SEQ ID NO: 4560078 - DNA, 16 bp, Homo sapiens
cctggctgaggttcct

SEQ ID NO: 4560079 - DNA, 23 bp, Homo sapiens
cctggctgaggttcctctgcctg

SEQ ID NO: 4560080 - DNA, 13 bp, Homo sapiens
cctggctgctgcc

SEQ ID NO: 4560081 - DNA, 14 bp, Homo sapiens
cctggctgctgccc

SEQ ID NO: 4560082 - DNA, 13 bp, Homo sapiens
cctggctggagga

SEQ ID NO: 4560083 - DNA, 14 bp, Homo sapiens
cctggctggctcct

SEQ ID NO: 4560084 - DNA, 21 bp, Homo sapiens
cctggctgttctgtggttcct

SEQ ID NO: 4560085 - DNA, 22 bp, Homo sapiens
cctggcttctgtggggcccctc

SEQ ID NO: 4560086 - DNA, 20 bp, Homo sapiens
cctggcttgtaactccacca

SEQ ID NO: 4560087 - DNA, 16 bp, Homo sapiens
cctggctttgcctctt

SEQ ID NO: 4560088 - DNA, 18 bp, Homo sapiens
cctggctttgcctcttct

SEQ ID NO: 4560089 - DNA, 17 bp, Homo sapiens
cctgggaaatattccct

SEQ ID NO: 4560090 - DNA, 18 bp, Homo sapiens
cctgggaaatattcccta

SEQ ID NO: 4560091 - DNA, 20 bp, Homo sapiens
cctgggacacagacccagga

SEQ ID NO: 4560092 - DNA, 14 bp, Homo sapiens
cctgggacccttgg

SEQ ID NO: 4560093 - DNA, 20 bp, Homo sapiens
cctgggagccagtcctccac

SEQ ID NO: 4560094 - DNA, 14 bp, Homo sapiens
cctgggagcccaga

SEQ ID NO: 4560095 - DNA, 16 bp, Homo sapiens
cctgggagcccagagg

SEQ ID NO: 4560096 - DNA, 19 bp, Homo sapiens
cctgggaggacaggcaggc

SEQ ID NO: 4560097 - DNA, 18 bp, Homo sapiens
cctgggatgggaccaggg

SEQ ID NO: 4560098 - DNA, 17 bp, Homo sapiens
cctgggcaacaagagca

SEQ ID NO: 4560099 - DNA, 19 bp, Homo sapiens
cctgggcaacatggtgaaa

SEQ ID NO: 4560100 - DNA, 17 bp, Homo sapiens
cctgggcactccgcgcc

SEQ ID NO: 4560101 - DNA, 17 bp, Homo sapiens
cctgggcagccaggctg

SEQ ID NO: 4560102 - DNA, 12 bp, Homo sapiens
cctgggcaggag

SEQ ID NO: 4560103 - DNA, 14 bp, Homo sapiens
cctgggcaggaggg

SEQ ID NO: 4560104 - DNA, 19 bp, Homo sapiens
cctgggcagtgagtgccat

SEQ ID NO: 4560105 - DNA, 23 bp, Homo sapiens
cctgggcagtgagtgccatgctt

SEQ ID NO: 4560106 - DNA, 18 bp, Homo sapiens
cctgggcatcttctggct

SEQ ID NO: 4560107 - DNA, 21 bp, Homo sapiens
cctgggccagcggggctgctc

SEQ ID NO: 4560108 - DNA, 13 bp, Homo sapiens
cctgggccccacc

SEQ ID NO: 4560109 - DNA, 21 bp, Homo sapiens
cctgggccccaccacctaggc

SEQ ID NO: 4560110 - DNA, 23 bp, Homo sapiens
cctgggccccaccacctaggcca

SEQ ID NO: 4560111 - DNA, 13 bp, Homo sapiens
cctgggcccctcc

SEQ ID NO: 4560112 - DNA, 15 bp, Homo sapiens
cctgggcccctccac

SEQ ID NO: 4560113 - DNA, 21 bp, Homo sapiens
cctgggcccctccacgcctcc

SEQ ID NO: 4560114 - DNA, 23 bp, Homo sapiens
cctgggcccctccacgcctcctg

SEQ ID NO: 4560115 - DNA, 22 bp, Homo sapiens
cctgggcctcagttcaacctgg

SEQ ID NO: 4560116 - DNA, 17 bp, Homo sapiens
cctgggcctgcccctgt

SEQ ID NO: 4560117 - DNA, 19 bp, Homo sapiens
cctgggctattgctgctgc

SEQ ID NO: 4560118 - DNA, 23 bp, Homo sapiens
cctgggctcaagcaatcctcctg

SEQ ID NO: 4560119 - DNA, 22 bp, Homo sapiens
cctgggctcactgtgctggggc

SEQ ID NO: 4560120 - DNA, 14 bp, Homo sapiens
cctgggctcggagg

SEQ ID NO: 4560121 - DNA, 19 bp, Homo sapiens
cctgggctcggaggctgcc

SEQ ID NO: 4560122 - DNA, 21 bp, Homo sapiens
cctgggctcggaggctgcccc

SEQ ID NO: 4560123 - DNA, 22 bp, Homo sapiens
cctgggctcggaggctgccccc

SEQ ID NO: 4560124 - DNA, 18 bp, Homo sapiens
cctgggctgccaccagcc

SEQ ID NO: 4560125 - DNA, 19 bp, Homo sapiens
cctgggctggcacagcccc

SEQ ID NO: 4560126 - DNA, 14 bp, Homo sapiens
cctgggcttggcct

SEQ ID NO: 4560127 - DNA, 19 bp, Homo sapiens
cctgggcttggcctgctgt

SEQ ID NO: 4560128 - DNA, 20 bp, Homo sapiens
cctgggcttggtaagtgaat

SEQ ID NO: 4560129 - DNA, 17 bp, Homo sapiens
cctggggagctcctggg

SEQ ID NO: 4560130 - DNA, 22 bp, Homo sapiens
cctggggagctcctgggaccct

SEQ ID NO: 4560131 - DNA, 21 bp, Homo sapiens
cctggggagtggttaggcagc

SEQ ID NO: 4560132 - DNA, 21 bp, Homo sapiens
cctggggcaggggtgcttcct

SEQ ID NO: 4560133 - DNA, 16 bp, Homo sapiens
cctgggggaggtcaga

SEQ ID NO: 4560134 - DNA, 14 bp, Homo sapiens
cctgggggtgccag

SEQ ID NO: 4560135 - DNA, 15 bp, Homo sapiens
cctgggggtgccagg

SEQ ID NO: 4560136 - DNA, 17 bp, Homo sapiens
cctgggggtggcaggca

SEQ ID NO: 4560137 - DNA, 14 bp, Homo sapiens
cctggggtgcatct

SEQ ID NO: 4560138 - DNA, 16 bp, Homo sapiens
cctggggtgcatctcc

SEQ ID NO: 4560139 - DNA, 18 bp, Homo sapiens
cctggggtgcatctcctc

SEQ ID NO: 4560140 - DNA, 22 bp, Homo sapiens
cctgggtaagaagggtgggagt

SEQ ID NO: 4560141 - DNA, 15 bp, Homo sapiens
cctgggtcagtctgg

SEQ ID NO: 4560142 - DNA, 19 bp, Homo sapiens
cctgggtcagtctggtggg

SEQ ID NO: 4560143 - DNA, 13 bp, Homo sapiens
cctgggtgacaga

SEQ ID NO: 4560144 - DNA, 15 bp, Homo sapiens
cctgggtgacagagt

SEQ ID NO: 4560145 - DNA, 19 bp, Homo sapiens
cctgggtgacttcaggtgg

SEQ ID NO: 4560146 - DNA, 15 bp, Homo sapiens
cctgggtgggctctg

SEQ ID NO: 4560147 - DNA, 16 bp, Homo sapiens
cctgggtgggctctgt

SEQ ID NO: 4560148 - DNA, 15 bp, Homo sapiens
cctgggtggggctgc

SEQ ID NO: 4560149 - DNA, 17 bp, Homo sapiens
cctgggtggggctgctc

SEQ ID NO: 4560150 - DNA, 19 bp, Homo sapiens
cctgggtggggctgctcct

SEQ ID NO: 4560151 - DNA, 22 bp, Homo sapiens
cctgggtggggctgctcctcca

SEQ ID NO: 4560152 - DNA, 17 bp, Homo sapiens
cctgggttttgttccct

SEQ ID NO: 4560153 - DNA, 19 bp, Homo sapiens
cctggtagaggggccggct

SEQ ID NO: 4560154 - DNA, 16 bp, Homo sapiens
cctggtcaccgagact

SEQ ID NO: 4560155 - DNA, 22 bp, Homo sapiens
cctggtcaccgagactcagcct

SEQ ID NO: 4560156 - DNA, 14 bp, Homo sapiens
cctggtccagggaa

SEQ ID NO: 4560157 - DNA, 21 bp, Homo sapiens
cctggtccagggaagctggcc

SEQ ID NO: 4560158 - DNA, 13 bp, Homo sapiens
cctggtcccctcc

SEQ ID NO: 4560159 - DNA, 23 bp, Homo sapiens
cctggtccctcacccccatggcc

SEQ ID NO: 4560160 - DNA, 23 bp, Homo sapiens
cctggtctcagcagcgaccaccc

SEQ ID NO: 4560161 - DNA, 21 bp, Homo sapiens
cctggtgagcaggggaagcag

SEQ ID NO: 4560162 - DNA, 22 bp, Homo sapiens
cctggtgcccctgctcactggg

SEQ ID NO: 4560163 - DNA, 19 bp, Homo sapiens
cctggtgctgccgagggct

SEQ ID NO: 4560164 - DNA, 15 bp, Homo sapiens
cctggtgctgcctct

SEQ ID NO: 4560165 - DNA, 14 bp, Homo sapiens
cctggttcatattt

SEQ ID NO: 4560166 - DNA, 15 bp, Homo sapiens
cctggttgggtggca

SEQ ID NO: 4560167 - DNA, 17 bp, Homo sapiens
cctggtttcctcgagag

SEQ ID NO: 4560168 - DNA, 12 bp, Homo sapiens
cctgtaaacctg

SEQ ID NO: 4560169 - DNA, 13 bp, Homo sapiens
cctgtaaattatt

SEQ ID NO: 4560170 - DNA, 18 bp, Homo sapiens
cctgtaacttgagagtag

SEQ ID NO: 4560171 - DNA, 22 bp, Homo sapiens
cctgtaagaagcggcatagcac

SEQ ID NO: 4560172 - DNA, 16 bp, Homo sapiens
cctgtaagccaaagaa

SEQ ID NO: 4560173 - DNA, 17 bp, Homo sapiens
cctgtaatatatttata

SEQ ID NO: 4560174 - DNA, 18 bp, Homo sapiens
cctgtaatatatttatat

SEQ ID NO: 4560175 - DNA, 18 bp, Homo sapiens
cctgtaatcccagcactt

SEQ ID NO: 4560176 - DNA, 16 bp, Homo sapiens
cctgtaatcccagcag

SEQ ID NO: 4560177 - DNA, 16 bp, Homo sapiens
cctgtaatcccagcta

SEQ ID NO: 4560178 - DNA, 18 bp, Homo sapiens
cctgtaatcccagctact

SEQ ID NO: 4560179 - DNA, 22 bp, Homo sapiens
cctgtacacagtgcccccttgt

SEQ ID NO: 4560180 - DNA, 16 bp, Homo sapiens
cctgtacctcagtgga

SEQ ID NO: 4560181 - DNA, 17 bp, Homo sapiens
cctgtagcaatggccag

SEQ ID NO: 4560182 - DNA, 21 bp, Homo sapiens
cctgtagcaatggccagagcc

SEQ ID NO: 4560183 - DNA, 16 bp, Homo sapiens
cctgtagctctgcctc

SEQ ID NO: 4560184 - DNA, 20 bp, Homo sapiens
cctgtagctttcctggtccc

SEQ ID NO: 4560185 - DNA, 22 bp, Homo sapiens
cctgtagctttcctggtccctc

SEQ ID NO: 4560186 - DNA, 20 bp, Homo sapiens
cctgtagggtttggacagac

SEQ ID NO: 4560187 - DNA, 17 bp, Homo sapiens
cctgtagttttatttta

SEQ ID NO: 4560188 - DNA, 19 bp, Homo sapiens
cctgtagttttattttatg

SEQ ID NO: 4560189 - DNA, 15 bp, Homo sapiens
cctgtatacagtgca

SEQ ID NO: 4560190 - DNA, 21 bp, Homo sapiens
cctgtatacagtgcagagcct

SEQ ID NO: 4560191 - DNA, 21 bp, Homo sapiens
cctgtatcctccctggcagac

SEQ ID NO: 4560192 - DNA, 11 bp, Homo sapiens
cctgtcacaat

SEQ ID NO: 4560193 - DNA, 15 bp, Homo sapiens
cctgtcacaataaag

SEQ ID NO: 4560194 - DNA, 12 bp, Homo sapiens
cctgtcagaata

SEQ ID NO: 4560195 - DNA, 22 bp, Homo sapiens
cctgtccaaaagcgccctcact

SEQ ID NO: 4560196 - DNA, 12 bp, Homo sapiens
cctgtccaacct

SEQ ID NO: 4560197 - DNA, 16 bp, Homo sapiens
cctgtccacacccagc

SEQ ID NO: 4560198 - DNA, 14 bp, Homo sapiens
cctgtccaccctgc

SEQ ID NO: 4560199 - DNA, 17 bp, Homo sapiens
cctgtccaccctgccaa

SEQ ID NO: 4560200 - DNA, 12 bp, Homo sapiens
cctgtccagcct

SEQ ID NO: 4560201 - DNA, 22 bp, Homo sapiens
cctgtccagcctgggcagccag

SEQ ID NO: 4560202 - DNA, 10 bp, Homo sapiens
cctgtcccaa

SEQ ID NO: 4560203 - DNA, 20 bp, Homo sapiens
cctgtcccaggccggcccag

SEQ ID NO: 4560204 - DNA, 17 bp, Homo sapiens
cctgtcccattctagat

SEQ ID NO: 4560205 - DNA, 12 bp, Homo sapiens
cctgtccctgag

SEQ ID NO: 4560206 - DNA, 14 bp, Homo sapiens
cctgtccctgaggt

SEQ ID NO: 4560207 - DNA, 12 bp, Homo sapiens
cctgtccctggg

SEQ ID NO: 4560208 - DNA, 16 bp, Homo sapiens
cctgtcccttgcctct

SEQ ID NO: 4560209 - DNA, 17 bp, Homo sapiens
cctgtcccttgcctctg

SEQ ID NO: 4560210 - DNA, 18 bp, Homo sapiens
cctgtcccttgcctctgc

SEQ ID NO: 4560211 - DNA, 19 bp, Homo sapiens
cctgtcccttgcctctgcc

SEQ ID NO: 4560212 - DNA, 18 bp, Homo sapiens
cctgtcccttttccctta

SEQ ID NO: 4560213 - DNA, 16 bp, Homo sapiens
cctgtccggcccagtg

SEQ ID NO: 4560214 - DNA, 18 bp, Homo sapiens
cctgtcctaaggaacctt

SEQ ID NO: 4560215 - DNA, 20 bp, Homo sapiens
cctgtcctgcacaccctggg

SEQ ID NO: 4560216 - DNA, 21 bp, Homo sapiens
cctgtcctgcacaccctgggc

SEQ ID NO: 4560217 - DNA, 16 bp, Homo sapiens
cctgtcctgcccgtga

SEQ ID NO: 4560218 - DNA, 21 bp, Homo sapiens
cctgtctcaaaaaaaaaaaga

SEQ ID NO: 4560219 - DNA, 12 bp, Homo sapiens
cctgtctcactc

SEQ ID NO: 4560220 - DNA, 13 bp, Homo sapiens
cctgtctccaggg

SEQ ID NO: 4560221 - DNA, 21 bp, Homo sapiens
cctgtctccagggcccccacc

SEQ ID NO: 4560222 - DNA, 14 bp, Homo sapiens
cctgtctctaaaaa

SEQ ID NO: 4560223 - DNA, 16 bp, Homo sapiens
cctgtctctaaaaaga

SEQ ID NO: 4560224 - DNA, 22 bp, Homo sapiens
cctgtctctaaaaagaagccac

SEQ ID NO: 4560225 - DNA, 13 bp, Homo sapiens
cctgtctctgcct

SEQ ID NO: 4560226 - DNA, 18 bp, Homo sapiens
cctgtctgctaggcgctg

SEQ ID NO: 4560227 - DNA, 22 bp, Homo sapiens
cctgtctgctaggcgctgggga

SEQ ID NO: 4560228 - DNA, 21 bp, Homo sapiens
cctgtctgcttgcatctgcac

SEQ ID NO: 4560229 - DNA, 22 bp, Homo sapiens
cctgtctgcttgcatctgcaca

SEQ ID NO: 4560230 - DNA, 19 bp, Homo sapiens
cctgtctggaagacgtggc

SEQ ID NO: 4560231 - DNA, 23 bp, Homo sapiens
cctgtctggaagacgtggctctg

SEQ ID NO: 4560232 - DNA, 20 bp, Homo sapiens
cctgtctgtagagggccctg

SEQ ID NO: 4560233 - DNA, 21 bp, Homo sapiens
cctgtctgtagagggccctgg

SEQ ID NO: 4560234 - DNA, 15 bp, Homo sapiens
cctgtctgttcccag

SEQ ID NO: 4560235 - DNA, 20 bp, Homo sapiens
cctgtctgttcccagcccct

SEQ ID NO: 4560236 - DNA, 22 bp, Homo sapiens
cctgtctgttcccagcccctgc

SEQ ID NO: 4560237 - DNA, 14 bp, Homo sapiens
cctgtctgtttata

SEQ ID NO: 4560238 - DNA, 18 bp, Homo sapiens
cctgtcttcccagggtag

SEQ ID NO: 4560239 - DNA, 15 bp, Homo sapiens
cctgtcttgagtaga

SEQ ID NO: 4560240 - DNA, 22 bp, Homo sapiens
cctgtgaagtttaattgtctca

SEQ ID NO: 4560241 - DNA, 15 bp, Homo sapiens
cctgtgaatggaggc

SEQ ID NO: 4560242 - DNA, 16 bp, Homo sapiens
cctgtgaatggaggca

SEQ ID NO: 4560243 - DNA, 18 bp, Homo sapiens
cctgtgaatggaggcaga

SEQ ID NO: 4560244 - DNA, 23 bp, Homo sapiens
cctgtgaatggaggcagagacct

SEQ ID NO: 4560245 - DNA, 18 bp, Homo sapiens
cctgtgacatggtgcctg

SEQ ID NO: 4560246 - DNA, 19 bp, Homo sapiens
cctgtgacatggtgcctga

SEQ ID NO: 4560247 - DNA, 21 bp, Homo sapiens
cctgtgacatggtgcctgaga

SEQ ID NO: 4560248 - DNA, 15 bp, Homo sapiens
cctgtgaccacaaca

SEQ ID NO: 4560249 - DNA, 13 bp, Homo sapiens
cctgtgaggcagg

SEQ ID NO: 4560250 - DNA, 17 bp, Homo sapiens
cctgtgaggcaggggcg

SEQ ID NO: 4560251 - DNA, 12 bp, Homo sapiens
cctgtgatgtca

SEQ ID NO: 4560252 - DNA, 17 bp, Homo sapiens
cctgtgcaaaaaaatta

SEQ ID NO: 4560253 - DNA, 18 bp, Homo sapiens
cctgtgcagccgctgagc

SEQ ID NO: 4560254 - DNA, 21 bp, Homo sapiens
cctgtgcagccgctgagcgag

SEQ ID NO: 4560255 - DNA, 18 bp, Homo sapiens
cctgtgcccgactgactg

SEQ ID NO: 4560256 - DNA, 21 bp, Homo sapiens
cctgtgccctagatgcacgtg

SEQ ID NO: 4560257 - DNA, 18 bp, Homo sapiens
cctgtgcctcccttttct

SEQ ID NO: 4560258 - DNA, 20 bp, Homo sapiens
cctgtgcctggccccagcct

SEQ ID NO: 4560259 - DNA, 16 bp, Homo sapiens
cctgtgcctttcctat

SEQ ID NO: 4560260 - DNA, 21 bp, Homo sapiens
cctgtgcctttcctatcacct

SEQ ID NO: 4560261 - DNA, 17 bp, Homo sapiens
cctgtgccttttgccat

SEQ ID NO: 4560262 - DNA, 13 bp, Homo sapiens
cctgtgctctgga

SEQ ID NO: 4560263 - DNA, 15 bp, Homo sapiens
cctgtgctgtgagtg

SEQ ID NO: 4560264 - DNA, 22 bp, Homo sapiens
cctgtgcttcgggcccttccca

SEQ ID NO: 4560265 - DNA, 20 bp, Homo sapiens
cctgtggaaggcagagaaat

SEQ ID NO: 4560266 - DNA, 13 bp, Homo sapiens
cctgtggacagga

SEQ ID NO: 4560267 - DNA, 17 bp, Homo sapiens
cctgtggatgctgctgc

SEQ ID NO: 4560268 - DNA, 19 bp, Homo sapiens
cctgtggatgctgctgccc

SEQ ID NO: 4560269 - DNA, 18 bp, Homo sapiens
cctgtggcagtaaagaga

SEQ ID NO: 4560270 - DNA, 23 bp, Homo sapiens
cctgtggcagtaaagagaaactt

SEQ ID NO: 4560271 - DNA, 18 bp, Homo sapiens
cctgtggcatctttgcct

SEQ ID NO: 4560272 - DNA, 15 bp, Homo sapiens
cctgtggccagcagc

SEQ ID NO: 4560273 - DNA, 12 bp, Homo sapiens
cctgtggcctga

SEQ ID NO: 4560274 - DNA, 18 bp, Homo sapiens
cctgtggcggtgcctggg

SEQ ID NO: 4560275 - DNA, 20 bp, Homo sapiens
cctgtggcggtgcctgggtg

SEQ ID NO: 4560276 - DNA, 20 bp, Homo sapiens
cctgtgggagccgcagagcc

SEQ ID NO: 4560277 - DNA, 15 bp, Homo sapiens
cctgtgggggtggcc

SEQ ID NO: 4560278 - DNA, 18 bp, Homo sapiens
cctgtgggggtggccatc

SEQ ID NO: 4560279 - DNA, 18 bp, Homo sapiens
cctgtgggtctctgaagg

SEQ ID NO: 4560280 - DNA, 20 bp, Homo sapiens
cctgtgggtgttctttcctg

SEQ ID NO: 4560281 - DNA, 14 bp, Homo sapiens
cctgtggtgaagtg

SEQ ID NO: 4560282 - DNA, 17 bp, Homo sapiens
cctgtgtaaaaacaaca

SEQ ID NO: 4560283 - DNA, 12 bp, Homo sapiens
cctgtgtacctc

SEQ ID NO: 4560284 - DNA, 18 bp, Homo sapiens
cctgtgttctgggctggg

SEQ ID NO: 4560285 - DNA, 19 bp, Homo sapiens
cctgtgttctgggctgggg

SEQ ID NO: 4560286 - DNA, 21 bp, Homo sapiens
cctgtgttctgggctggggcc

SEQ ID NO: 4560287 - DNA, 23 bp, Homo sapiens
cctgtgtttcattacttgaatgt

SEQ ID NO: 4560288 - DNA, 19 bp, Homo sapiens
cctgtgtttttttctaaaa

SEQ ID NO: 4560289 - DNA, 21 bp, Homo sapiens
cctgttaaaagatgaaaatat

SEQ ID NO: 4560290 - DNA, 12 bp, Homo sapiens
cctgttcagcat

SEQ ID NO: 4560291 - DNA, 22 bp, Homo sapiens
cctgttctccctttctctctcc

SEQ ID NO: 4560292 - DNA, 23 bp, Homo sapiens
cctgttgattaatttctgccatt

SEQ ID NO: 4560293 - DNA, 22 bp, Homo sapiens
cctgttgcacccagccctggtc

SEQ ID NO: 4560294 - DNA, 23 bp, Homo sapiens
cctgttgcacccagccctggtct

SEQ ID NO: 4560295 - DNA, 18 bp, Homo sapiens
cctgttgccgagcccagc

SEQ ID NO: 4560296 - DNA, 18 bp, Homo sapiens
cctgttggcaggcccact

SEQ ID NO: 4560297 - DNA, 19 bp, Homo sapiens
cctgtttctatcctgttta

SEQ ID NO: 4560298 - DNA, 13 bp, Homo sapiens
cctgttttatata

SEQ ID NO: 4560299 - DNA, 23 bp, Homo sapiens
cctgttttcccacgaggaatctg

SEQ ID NO: 4560300 - DNA, 23 bp, Homo sapiens
cctgtttttgtttcttgttttga

SEQ ID NO: 4560301 - DNA, 14 bp, Homo sapiens
ccttaaaaatgcac

SEQ ID NO: 4560302 - DNA, 17 bp, Homo sapiens
ccttaaaaccaaagagg

SEQ ID NO: 4560303 - DNA, 22 bp, Homo sapiens
ccttaaacacaggctgtcctta

SEQ ID NO: 4560304 - DNA, 15 bp, Homo sapiens
ccttaagaactgtgt

SEQ ID NO: 4560305 - DNA, 16 bp, Homo sapiens
ccttaaggcagtagtt

SEQ ID NO: 4560306 - DNA, 16 bp, Homo sapiens
ccttaaggctcttttg

SEQ ID NO: 4560307 - DNA, 18 bp, Homo sapiens
ccttaaggctcttttgta

SEQ ID NO: 4560308 - DNA, 18 bp, Homo sapiens
ccttaaggtctccaaacc

SEQ ID NO: 4560309 - DNA, 11 bp, Homo sapiens
ccttaatattt

SEQ ID NO: 4560310 - DNA, 17 bp, Homo sapiens
ccttaatgacaacactt

SEQ ID NO: 4560311 - DNA, 15 bp, Homo sapiens
ccttaattacttaaa

SEQ ID NO: 4560312 - DNA, 13 bp, Homo sapiens
ccttaatttcctt

SEQ ID NO: 4560313 - DNA, 15 bp, Homo sapiens
ccttaatttcctttt

SEQ ID NO: 4560314 - DNA, 20 bp, Homo sapiens
ccttaatttcctttttgaca

SEQ ID NO: 4560315 - DNA, 23 bp, Homo sapiens
ccttaatttcctttttgacactg

SEQ ID NO: 4560316 - DNA, 15 bp, Homo sapiens
ccttaccccttagcc

SEQ ID NO: 4560317 - DNA, 13 bp, Homo sapiens
ccttaccctggga

SEQ ID NO: 4560318 - DNA, 15 bp, Homo sapiens
ccttaccgtcttgat

SEQ ID NO: 4560319 - DNA, 20 bp, Homo sapiens
ccttacctcctgcccaggag

SEQ ID NO: 4560320 - DNA, 14 bp, Homo sapiens
ccttactaattata

SEQ ID NO: 4560321 - DNA, 16 bp, Homo sapiens
ccttactcttcttgaa

SEQ ID NO: 4560322 - DNA, 12 bp, Homo sapiens
ccttactgcaga

SEQ ID NO: 4560323 - DNA, 13 bp, Homo sapiens
ccttactgtttac

SEQ ID NO: 4560324 - DNA, 18 bp, Homo sapiens
ccttagaaacactgcaaa

SEQ ID NO: 4560325 - DNA, 14 bp, Homo sapiens
ccttagagaccccg

SEQ ID NO: 4560326 - DNA, 15 bp, Homo sapiens
ccttagagccaggca

SEQ ID NO: 4560327 - DNA, 17 bp, Homo sapiens
ccttagagccaggcaca

SEQ ID NO: 4560328 - DNA, 18 bp, Homo sapiens
ccttagcagccctggatg

SEQ ID NO: 4560329 - DNA, 15 bp, Homo sapiens
ccttagccctgtctg

SEQ ID NO: 4560330 - DNA, 15 bp, Homo sapiens
ccttagcctccctga

SEQ ID NO: 4560331 - DNA, 16 bp, Homo sapiens
ccttagcctccctgaa

SEQ ID NO: 4560332 - DNA, 18 bp, Homo sapiens
ccttagcctctcccaccc

SEQ ID NO: 4560333 - DNA, 15 bp, Homo sapiens
ccttagcgttctgga

SEQ ID NO: 4560334 - DNA, 16 bp, Homo sapiens
ccttagcttcaggaac

SEQ ID NO: 4560335 - DNA, 18 bp, Homo sapiens
ccttaggatggggctccc

SEQ ID NO: 4560336 - DNA, 19 bp, Homo sapiens
ccttaggatggggctccca

SEQ ID NO: 4560337 - DNA, 21 bp, Homo sapiens
ccttaggatggggctcccagc

SEQ ID NO: 4560338 - DNA, 16 bp, Homo sapiens
ccttaggcctctgaga

SEQ ID NO: 4560339 - DNA, 15 bp, Homo sapiens
ccttagtagtcaaaa

SEQ ID NO: 4560340 - DNA, 21 bp, Homo sapiens
ccttatagttactgtgtaatt

SEQ ID NO: 4560341 - DNA, 17 bp, Homo sapiens
ccttatccctctcttcc

SEQ ID NO: 4560342 - DNA, 22 bp, Homo sapiens
ccttatgcccggcgccgggcac

SEQ ID NO: 4560343 - DNA, 19 bp, Homo sapiens
ccttatgtgttacattatt

SEQ ID NO: 4560344 - DNA, 19 bp, Homo sapiens
ccttattgctgtcctggag

SEQ ID NO: 4560345 - DNA, 18 bp, Homo sapiens
ccttatttctcattgcct

SEQ ID NO: 4560346 - DNA, 15 bp, Homo sapiens
ccttatttgtctgta

SEQ ID NO: 4560347 - DNA, 14 bp, Homo sapiens
ccttattttgagta

SEQ ID NO: 4560348 - DNA, 15 bp, Homo sapiens
ccttcaagtgccaaa

SEQ ID NO: 4560349 - DNA, 11 bp, Homo sapiens
ccttcacaaat

SEQ ID NO: 4560350 - DNA, 17 bp, Homo sapiens
ccttcaccccagtggcc

SEQ ID NO: 4560351 - DNA, 19 bp, Homo sapiens
ccttcacgattaactgtga

SEQ ID NO: 4560352 - DNA, 13 bp, Homo sapiens
ccttcactctgac

SEQ ID NO: 4560353 - DNA, 16 bp, Homo sapiens
ccttcactgggccagt

SEQ ID NO: 4560354 - DNA, 18 bp, Homo sapiens
ccttcagactttgcttcc

SEQ ID NO: 4560355 - DNA, 24 bp, Homo sapiens
ccttcaggactctgcgggaggctg

SEQ ID NO: 4560356 - DNA, 11 bp, Homo sapiens
ccttcagtgcc

SEQ ID NO: 4560357 - DNA, 12 bp, Homo sapiens
ccttcagtgccc

SEQ ID NO: 4560358 - DNA, 15 bp, Homo sapiens
ccttcagtgcccacc

SEQ ID NO: 4560359 - DNA, 18 bp, Homo sapiens
ccttcagtgcccaccaac

SEQ ID NO: 4560360 - DNA, 23 bp, Homo sapiens
ccttcatatgaaaggtgccatgg

SEQ ID NO: 4560361 - DNA, 18 bp, Homo sapiens
ccttcatgacagcctcca

SEQ ID NO: 4560362 - DNA, 19 bp, Homo sapiens
ccttcattctgagaccaaa

SEQ ID NO: 4560363 - DNA, 17 bp, Homo sapiens
ccttcatttccaccagg

SEQ ID NO: 4560364 - DNA, 21 bp, Homo sapiens
ccttccaactagctgggacta

SEQ ID NO: 4560365 - DNA, 15 bp, Homo sapiens
ccttccaacttcctg

SEQ ID NO: 4560366 - DNA, 16 bp, Homo sapiens
ccttccaacttcctgt

SEQ ID NO: 4560367 - DNA, 21 bp, Homo sapiens
ccttccaacttcctgtggcct

SEQ ID NO: 4560368 - DNA, 17 bp, Homo sapiens
ccttccaatgctgtggg

SEQ ID NO: 4560369 - DNA, 20 bp, Homo sapiens
ccttccacggatccatgtag

SEQ ID NO: 4560370 - DNA, 15 bp, Homo sapiens
ccttccactgagggc

SEQ ID NO: 4560371 - DNA, 15 bp, Homo sapiens
ccttccagtggctcg

SEQ ID NO: 4560372 - DNA, 19 bp, Homo sapiens
ccttccatccctaccccct

SEQ ID NO: 4560373 - DNA, 19 bp, Homo sapiens
ccttccatggtactgtagc

SEQ ID NO: 4560374 - DNA, 16 bp, Homo sapiens
ccttccatgtgccttt

SEQ ID NO: 4560375 - DNA, 15 bp, Homo sapiens
ccttcccactcaccc

SEQ ID NO: 4560376 - DNA, 12 bp, Homo sapiens
ccttcccagctc

SEQ ID NO: 4560377 - DNA, 18 bp, Homo sapiens
ccttcccatttcttccca

SEQ ID NO: 4560378 - DNA, 15 bp, Homo sapiens
ccttccccagaccca

SEQ ID NO: 4560379 - DNA, 19 bp, Homo sapiens
ccttccccagacccagagg

SEQ ID NO: 4560380 - DNA, 15 bp, Homo sapiens
ccttcccctacacct

SEQ ID NO: 4560381 - DNA, 12 bp, Homo sapiens
ccttcccctccc

SEQ ID NO: 4560382 - DNA, 14 bp, Homo sapiens
ccttcccctccctg

SEQ ID NO: 4560383 - DNA, 18 bp, Homo sapiens
ccttcccctgctgacctt

SEQ ID NO: 4560384 - DNA, 13 bp, Homo sapiens
ccttcccctggca

SEQ ID NO: 4560385 - DNA, 12 bp, Homo sapiens
ccttccctccaa

SEQ ID NO: 4560386 - DNA, 13 bp, Homo sapiens
ccttccctccaaa

SEQ ID NO: 4560387 - DNA, 12 bp, Homo sapiens
ccttccctcctt

SEQ ID NO: 4560388 - DNA, 22 bp, Homo sapiens
ccttccctgatggcctttggac

SEQ ID NO: 4560389 - DNA, 11 bp, Homo sapiens
ccttccctggc

SEQ ID NO: 4560390 - DNA, 15 bp, Homo sapiens
ccttccctggccccg

SEQ ID NO: 4560391 - DNA, 18 bp, Homo sapiens
ccttcccttttctgttct

SEQ ID NO: 4560392 - DNA, 18 bp, Homo sapiens
ccttcctaccctcctgca

SEQ ID NO: 4560393 - DNA, 10 bp, Homo sapiens
ccttcctcct

SEQ ID NO: 4560394 - DNA, 12 bp, Homo sapiens
ccttcctcctgg

SEQ ID NO: 4560395 - DNA, 13 bp, Homo sapiens
ccttcctcctggg

SEQ ID NO: 4560396 - DNA, 20 bp, Homo sapiens
ccttcctggagactgcccag

SEQ ID NO: 4560397 - DNA, 21 bp, Homo sapiens
ccttcctggagcccagaggag

SEQ ID NO: 4560398 - DNA, 13 bp, Homo sapiens
ccttcctgtccct

SEQ ID NO: 4560399 - DNA, 14 bp, Homo sapiens
ccttcctgtccctg

SEQ ID NO: 4560400 - DNA, 18 bp, Homo sapiens
ccttcctgtccctgaggt

SEQ ID NO: 4560401 - DNA, 15 bp, Homo sapiens
ccttcctgtgccctg

SEQ ID NO: 4560402 - DNA, 14 bp, Homo sapiens
ccttccttcaggac

SEQ ID NO: 4560403 - DNA, 20 bp, Homo sapiens
ccttccttttccctgcttcc

SEQ ID NO: 4560404 - DNA, 23 bp, Homo sapiens
ccttccttttccctgcttccagg

SEQ ID NO: 4560405 - DNA, 22 bp, Homo sapiens
ccttctacactctcctgggccc

SEQ ID NO: 4560406 - DNA, 13 bp, Homo sapiens
ccttctagaacac

SEQ ID NO: 4560407 - DNA, 19 bp, Homo sapiens
ccttctagaacacctgcct

SEQ ID NO: 4560408 - DNA, 18 bp, Homo sapiens
ccttctcaccagctgcaa

SEQ ID NO: 4560409 - DNA, 18 bp, Homo sapiens
ccttctcagaagcacaga

SEQ ID NO: 4560410 - DNA, 20 bp, Homo sapiens
ccttctccaacaagttgcct

SEQ ID NO: 4560411 - DNA, 16 bp, Homo sapiens
ccttctctgctccacc

SEQ ID NO: 4560412 - DNA, 21 bp, Homo sapiens
ccttctgatgaaatgttaaca

SEQ ID NO: 4560413 - DNA, 17 bp, Homo sapiens
ccttctgggctttttct

SEQ ID NO: 4560414 - DNA, 14 bp, Homo sapiens
ccttctgtggggac

SEQ ID NO: 4560415 - DNA, 19 bp, Homo sapiens
ccttcttattctcactcca

SEQ ID NO: 4560416 - DNA, 17 bp, Homo sapiens
ccttctttctggactgg

SEQ ID NO: 4560417 - DNA, 19 bp, Homo sapiens
ccttctttctggactggcg

SEQ ID NO: 4560418 - DNA, 13 bp, Homo sapiens
ccttctttgtaat

SEQ ID NO: 4560419 - DNA, 13 bp, Homo sapiens
ccttctttgtata

SEQ ID NO: 4560420 - DNA, 23 bp, Homo sapiens
ccttctttttcatatttctacct

SEQ ID NO: 4560421 - DNA, 20 bp, Homo sapiens
ccttgaaatttacacagtga

SEQ ID NO: 4560422 - DNA, 22 bp, Homo sapiens
ccttgaatctttttatcccatt

SEQ ID NO: 4560423 - DNA, 17 bp, Homo sapiens
ccttgagacctcagcca

SEQ ID NO: 4560424 - DNA, 18 bp, Homo sapiens
ccttgagacctcagccat

SEQ ID NO: 4560425 - DNA, 16 bp, Homo sapiens
ccttgagaggagaaat

SEQ ID NO: 4560426 - DNA, 16 bp, Homo sapiens
ccttgagccctggctg

SEQ ID NO: 4560427 - DNA, 23 bp, Homo sapiens
ccttgataatatattgtgttgac

SEQ ID NO: 4560428 - DNA, 13 bp, Homo sapiens
ccttgatcatgtc

SEQ ID NO: 4560429 - DNA, 15 bp, Homo sapiens
ccttgcagctagttt

SEQ ID NO: 4560430 - DNA, 13 bp, Homo sapiens
ccttgcagggtgg

SEQ ID NO: 4560431 - DNA, 19 bp, Homo sapiens
ccttgcagttcagcaccac

SEQ ID NO: 4560432 - DNA, 23 bp, Homo sapiens
ccttgcagttcagcaccacccta

SEQ ID NO: 4560433 - DNA, 17 bp, Homo sapiens
ccttgccaccccaccct

SEQ ID NO: 4560434 - DNA, 13 bp, Homo sapiens
ccttgcccagcct

SEQ ID NO: 4560435 - DNA, 14 bp, Homo sapiens
ccttgcccagcctg

SEQ ID NO: 4560436 - DNA, 17 bp, Homo sapiens
ccttgcccagcctggat

SEQ ID NO: 4560437 - DNA, 13 bp, Homo sapiens
ccttgccctcctg

SEQ ID NO: 4560438 - DNA, 21 bp, Homo sapiens
ccttgccctcctgggccctgg

SEQ ID NO: 4560439 - DNA, 11 bp, Homo sapiens
ccttgcctctg

SEQ ID NO: 4560440 - DNA, 12 bp, Homo sapiens
ccttgcctctgc

SEQ ID NO: 4560441 - DNA, 18 bp, Homo sapiens
ccttgcctctgccctgga

SEQ ID NO: 4560442 - DNA, 19 bp, Homo sapiens
ccttgcctgaactccagag

SEQ ID NO: 4560443 - DNA, 20 bp, Homo sapiens
ccttgctacttgaaggtaca

SEQ ID NO: 4560444 - DNA, 15 bp, Homo sapiens
ccttgctctcctcat

SEQ ID NO: 4560445 - DNA, 15 bp, Homo sapiens
ccttgctctcttcaa

SEQ ID NO: 4560446 - DNA, 12 bp, Homo sapiens
ccttgctgtgaa

SEQ ID NO: 4560447 - DNA, 15 bp, Homo sapiens
ccttgcttttgcttc

SEQ ID NO: 4560448 - DNA, 17 bp, Homo sapiens
ccttgcttttgcttcta

SEQ ID NO: 4560449 - DNA, 18 bp, Homo sapiens
ccttggacattttatgtc

SEQ ID NO: 4560450 - DNA, 21 bp, Homo sapiens
ccttggacattttatgtcttt

SEQ ID NO: 4560451 - DNA, 15 bp, Homo sapiens
ccttggactcatttt

SEQ ID NO: 4560452 - DNA, 20 bp, Homo sapiens
ccttggaggaaatgtgctca

SEQ ID NO: 4560453 - DNA, 19 bp, Homo sapiens
ccttggagtcccaggggca

SEQ ID NO: 4560454 - DNA, 23 bp, Homo sapiens
ccttggataatgctgttgcctca

SEQ ID NO: 4560455 - DNA, 22 bp, Homo sapiens
ccttggatcctgaatctgtgca

SEQ ID NO: 4560456 - DNA, 16 bp, Homo sapiens
ccttggcacccccatg

SEQ ID NO: 4560457 - DNA, 19 bp, Homo sapiens
ccttggcacccccatgctg

SEQ ID NO: 4560458 - DNA, 17 bp, Homo sapiens
ccttggccatgcagaaa

SEQ ID NO: 4560459 - DNA, 13 bp, Homo sapiens
ccttggcctcaga

SEQ ID NO: 4560460 - DNA, 18 bp, Homo sapiens
ccttggcctctccttgga

SEQ ID NO: 4560461 - DNA, 16 bp, Homo sapiens
ccttggcctctttcct

SEQ ID NO: 4560462 - DNA, 22 bp, Homo sapiens
ccttggcctgtctcatccccag

SEQ ID NO: 4560463 - DNA, 20 bp, Homo sapiens
ccttggctgacatgaagctg

SEQ ID NO: 4560464 - DNA, 18 bp, Homo sapiens
ccttggctttcagagcca

SEQ ID NO: 4560465 - DNA, 14 bp, Homo sapiens
ccttgggccctttg

SEQ ID NO: 4560466 - DNA, 17 bp, Homo sapiens
ccttgggccctttgagt

SEQ ID NO: 4560467 - DNA, 15 bp, Homo sapiens
ccttgggctgctcct

SEQ ID NO: 4560468 - DNA, 17 bp, Homo sapiens
ccttggggaatttcctc

SEQ ID NO: 4560469 - DNA, 21 bp, Homo sapiens
ccttgggtgagtggcctgcta

SEQ ID NO: 4560470 - DNA, 14 bp, Homo sapiens
ccttgggtgttcca

SEQ ID NO: 4560471 - DNA, 18 bp, Homo sapiens
ccttggtcccaagcctga

SEQ ID NO: 4560472 - DNA, 15 bp, Homo sapiens
ccttggtgtccacct

SEQ ID NO: 4560473 - DNA, 16 bp, Homo sapiens
ccttggtgtccacctg

SEQ ID NO: 4560474 - DNA, 22 bp, Homo sapiens
ccttggttgtctggcaaggact

SEQ ID NO: 4560475 - DNA, 20 bp, Homo sapiens
ccttgtattctgaggatgtt

SEQ ID NO: 4560476 - DNA, 15 bp, Homo sapiens
ccttgtcacgccaga

SEQ ID NO: 4560477 - DNA, 16 bp, Homo sapiens
ccttgtccacccacct

SEQ ID NO: 4560478 - DNA, 15 bp, Homo sapiens
ccttgtcggccccac

SEQ ID NO: 4560479 - DNA, 19 bp, Homo sapiens
ccttgtgacttacaatttg

SEQ ID NO: 4560480 - DNA, 15 bp, Homo sapiens
ccttgtggttagcaa

SEQ ID NO: 4560481 - DNA, 21 bp, Homo sapiens
ccttgtggttagcaagactgc

SEQ ID NO: 4560482 - DNA, 15 bp, Homo sapiens
ccttgttccagcttt

SEQ ID NO: 4560483 - DNA, 15 bp, Homo sapiens
cctttaaaaatgtat

SEQ ID NO: 4560484 - DNA, 14 bp, Homo sapiens
cctttaaaatattg

SEQ ID NO: 4560485 - DNA, 20 bp, Homo sapiens
cctttaactgacaagccatc

SEQ ID NO: 4560486 - DNA, 19 bp, Homo sapiens
cctttaacttttttttctc

SEQ ID NO: 4560487 - DNA, 19 bp, Homo sapiens
cctttaagaaccttaatga

SEQ ID NO: 4560488 - DNA, 20 bp, Homo sapiens
cctttaatattttgtaatat

SEQ ID NO: 4560489 - DNA, 18 bp, Homo sapiens
cctttaattgtaaagtaa

SEQ ID NO: 4560490 - DNA, 13 bp, Homo sapiens
cctttagtgcttt

SEQ ID NO: 4560491 - DNA, 12 bp, Homo sapiens
cctttatgtgaa

SEQ ID NO: 4560492 - DNA, 17 bp, Homo sapiens
cctttatgtgaattttt

SEQ ID NO: 4560493 - DNA, 22 bp, Homo sapiens
cctttatttattaaacttcagc

SEQ ID NO: 4560494 - DNA, 23 bp, Homo sapiens
cctttatttattaaacttcagca

SEQ ID NO: 4560495 - DNA, 21 bp, Homo sapiens
cctttatttttggcgtggctg

SEQ ID NO: 4560496 - DNA, 16 bp, Homo sapiens
cctttcaaatttagaa

SEQ ID NO: 4560497 - DNA, 18 bp, Homo sapiens
cctttcaccctcatgaaa

SEQ ID NO: 4560498 - DNA, 21 bp, Homo sapiens
cctttcagatgtcttctgcct

SEQ ID NO: 4560499 - DNA, 22 bp, Homo sapiens
cctttcagccacatgccccagg

SEQ ID NO: 4560500 - DNA, 23 bp, Homo sapiens
cctttcagccacatgccccaggc

SEQ ID NO: 4560501 - DNA, 22 bp, Homo sapiens
cctttcagtgcagtttcttttc

SEQ ID NO: 4560502 - DNA, 16 bp, Homo sapiens
cctttccctcaccccc

SEQ ID NO: 4560503 - DNA, 12 bp, Homo sapiens
cctttcccttta

SEQ ID NO: 4560504 - DNA, 20 bp, Homo sapiens
cctttcctatcacctcgaga

SEQ ID NO: 4560505 - DNA, 12 bp, Homo sapiens
cctttccttccc

SEQ ID NO: 4560506 - DNA, 13 bp, Homo sapiens
cctttccttccct

SEQ ID NO: 4560507 - DNA, 15 bp, Homo sapiens
cctttcgtgatctta

SEQ ID NO: 4560508 - DNA, 18 bp, Homo sapiens
cctttctcccctgccccc

SEQ ID NO: 4560509 - DNA, 23 bp, Homo sapiens
cctttctcctgtgaatggaggca

SEQ ID NO: 4560510 - DNA, 15 bp, Homo sapiens
cctttctctctcctc

SEQ ID NO: 4560511 - DNA, 19 bp, Homo sapiens
cctttctctctcctctctg

SEQ ID NO: 4560512 - DNA, 19 bp, Homo sapiens
cctttcttttccccctttg

SEQ ID NO: 4560513 - DNA, 17 bp, Homo sapiens
cctttctttttcttctt

SEQ ID NO: 4560514 - DNA, 17 bp, Homo sapiens
cctttgaaacctgctct

SEQ ID NO: 4560515 - DNA, 14 bp, Homo sapiens
cctttgaatatttt

SEQ ID NO: 4560516 - DNA, 15 bp, Homo sapiens
cctttgacttaaggg

SEQ ID NO: 4560517 - DNA, 20 bp, Homo sapiens
cctttgcaagatgcttggtt

SEQ ID NO: 4560518 - DNA, 23 bp, Homo sapiens
cctttgcaatagcagttataaca

SEQ ID NO: 4560519 - DNA, 18 bp, Homo sapiens
cctttgcagttggactct

SEQ ID NO: 4560520 - DNA, 23 bp, Homo sapiens
cctttgcagttggactctcaggg

SEQ ID NO: 4560521 - DNA, 16 bp, Homo sapiens
cctttgccagcagagc

SEQ ID NO: 4560522 - DNA, 17 bp, Homo sapiens
cctttgccagcagagcc

SEQ ID NO: 4560523 - DNA, 16 bp, Homo sapiens
cctttgcccagaaaga

SEQ ID NO: 4560524 - DNA, 19 bp, Homo sapiens
cctttggacccagggcctg

SEQ ID NO: 4560525 - DNA, 11 bp, Homo sapiens
cctttggcctg

SEQ ID NO: 4560526 - DNA, 12 bp, Homo sapiens
cctttgtctttc

SEQ ID NO: 4560527 - DNA, 16 bp, Homo sapiens
cctttgtgagtcaata

SEQ ID NO: 4560528 - DNA, 23 bp, Homo sapiens
cctttgtgcagcttcgaggacag

SEQ ID NO: 4560529 - DNA, 21 bp, Homo sapiens
cctttgtgctgcgcctgcagg

SEQ ID NO: 4560530 - DNA, 23 bp, Homo sapiens
cctttgttggagtcaaaaagaac

SEQ ID NO: 4560531 - DNA, 18 bp, Homo sapiens
ccttttataaggaaactt

SEQ ID NO: 4560532 - DNA, 16 bp, Homo sapiens
ccttttatctggtgcc

SEQ ID NO: 4560533 - DNA, 17 bp, Homo sapiens
ccttttatgtaatttct

SEQ ID NO: 4560534 - DNA, 16 bp, Homo sapiens
ccttttccacacgcat

SEQ ID NO: 4560535 - DNA, 20 bp, Homo sapiens
ccttttccaggagttctgaa

SEQ ID NO: 4560536 - DNA, 14 bp, Homo sapiens
ccttttccctgctt

SEQ ID NO: 4560537 - DNA, 19 bp, Homo sapiens
ccttttccctgcttccagg

SEQ ID NO: 4560538 - DNA, 10 bp, Homo sapiens
ccttttccta

SEQ ID NO: 4560539 - DNA, 18 bp, Homo sapiens
ccttttcgtttagaatca

SEQ ID NO: 4560540 - DNA, 22 bp, Homo sapiens
ccttttcgtttagaatcagaat

SEQ ID NO: 4560541 - DNA, 14 bp, Homo sapiens
ccttttctcccatt

SEQ ID NO: 4560542 - DNA, 19 bp, Homo sapiens
ccttttctgtggctggctc

SEQ ID NO: 4560543 - DNA, 14 bp, Homo sapiens
ccttttctgttcta

SEQ ID NO: 4560544 - DNA, 21 bp, Homo sapiens
ccttttgaaattaacctctca

SEQ ID NO: 4560545 - DNA, 15 bp, Homo sapiens
ccttttgacactgct

SEQ ID NO: 4560546 - DNA, 15 bp, Homo sapiens
ccttttgcaggaaaa

SEQ ID NO: 4560547 - DNA, 15 bp, Homo sapiens
ccttttggcctgggg

SEQ ID NO: 4560548 - DNA, 12 bp, Homo sapiens
ccttttgggaag

SEQ ID NO: 4560549 - DNA, 15 bp, Homo sapiens
ccttttgtataaagc

SEQ ID NO: 4560550 - DNA, 14 bp, Homo sapiens
ccttttgtcaattg

SEQ ID NO: 4560551 - DNA, 18 bp, Homo sapiens
ccttttgttaatgcattg

SEQ ID NO: 4560552 - DNA, 19 bp, Homo sapiens
ccttttgttaatgcattgt

SEQ ID NO: 4560553 - DNA, 16 bp, Homo sapiens
cctttttccaatgttt

SEQ ID NO: 4560554 - DNA, 12 bp, Homo sapiens
cctttttcctgc

SEQ ID NO: 4560555 - DNA, 21 bp, Homo sapiens
ccttttttcaatatgcaagca

SEQ ID NO: 4560556 - DNA, 24 bp, Homo sapiens
ccttttttcaatatgcaagcagct

SEQ ID NO: 4560557 - DNA, 18 bp, Homo sapiens
ccttttttctatatcaaa

SEQ ID NO: 4560558 - DNA, 16 bp, Homo sapiens
ccttttttttttttcc

SEQ ID NO: 4560559 - DNA, 10 bp, Homo sapiens
cgaaaaatgt

SEQ ID NO: 4560560 - DNA, 17 bp, Homo sapiens
cgaaacacagaaacctt

SEQ ID NO: 4560561 - DNA, 23 bp, Homo sapiens
cgaaaggatgtaaacagtgcctg

SEQ ID NO: 4560562 - DNA, 16 bp, Homo sapiens
cgaaagtatttacttt

SEQ ID NO: 4560563 - DNA, 22 bp, Homo sapiens
cgaaagtatttactttttaaaa

SEQ ID NO: 4560564 - DNA, 12 bp, Homo sapiens
cgaacatgtgtt

SEQ ID NO: 4560565 - DNA, 23 bp, Homo sapiens
cgaacccacctgctgagagaccc

SEQ ID NO: 4560566 - DNA, 19 bp, Homo sapiens
cgaactcaagggttttcca

SEQ ID NO: 4560567 - DNA, 14 bp, Homo sapiens
cgaagaagagaaag

SEQ ID NO: 4560568 - DNA, 18 bp, Homo sapiens
cgaagaccctcttgccca

SEQ ID NO: 4560569 - DNA, 17 bp, Homo sapiens
cgaaggccccgcctggg

SEQ ID NO: 4560570 - DNA, 17 bp, Homo sapiens
cgaagtctttgccttct

SEQ ID NO: 4560571 - DNA, 19 bp, Homo sapiens
cgaagtctttgccttctct

SEQ ID NO: 4560572 - DNA, 19 bp, Homo sapiens
cgaagtggactggcccctg

SEQ ID NO: 4560573 - DNA, 22 bp, Homo sapiens
cgaagtgtttatgtaatagttc

SEQ ID NO: 4560574 - DNA, 12 bp, Homo sapiens
cgaataaatgtt

SEQ ID NO: 4560575 - DNA, 15 bp, Homo sapiens
cgaataaatgttcaa

SEQ ID NO: 4560576 - DNA, 16 bp, Homo sapiens
cgaataaatgttcaaa

SEQ ID NO: 4560577 - DNA, 19 bp, Homo sapiens
cgaatacttttgccctttg

SEQ ID NO: 4560578 - DNA, 17 bp, Homo sapiens
cgaatattgagcaatat

SEQ ID NO: 4560579 - DNA, 15 bp, Homo sapiens
cgaatctcaaaatta

SEQ ID NO: 4560580 - DNA, 13 bp, Homo sapiens
cgaatctctgccc

SEQ ID NO: 4560581 - DNA, 14 bp, Homo sapiens
cgaatctctgcccc

SEQ ID NO: 4560582 - DNA, 17 bp, Homo sapiens
cgaatcttatttttcct

SEQ ID NO: 4560583 - DNA, 18 bp, Homo sapiens
cgaatcttatttttcctg

SEQ ID NO: 4560584 - DNA, 22 bp, Homo sapiens
cgaatcttatttttcctgtcct

SEQ ID NO: 4560585 - DNA, 14 bp, Homo sapiens
cgaatttggtacac

SEQ ID NO: 4560586 - DNA, 17 bp, Homo sapiens
cgacaaagctgctaaat

SEQ ID NO: 4560587 - DNA, 16 bp, Homo sapiens
cgacagggcctggagc

SEQ ID NO: 4560588 - DNA, 19 bp, Homo sapiens
cgaccttgcaacctcacct

SEQ ID NO: 4560589 - DNA, 17 bp, Homo sapiens
cgacgccccgaacctca

SEQ ID NO: 4560590 - DNA, 18 bp, Homo sapiens
cgactacaaaataaaact

SEQ ID NO: 4560591 - DNA, 11 bp, Homo sapiens
cgactccagcc

SEQ ID NO: 4560592 - DNA, 17 bp, Homo sapiens
cgactccagccagcgcc

SEQ ID NO: 4560593 - DNA, 18 bp, Homo sapiens
cgactccagccagcgcct

SEQ ID NO: 4560594 - DNA, 21 bp, Homo sapiens
cgactccagccagcgcctccc

SEQ ID NO: 4560595 - DNA, 10 bp, Homo sapiens
cgactctgct

SEQ ID NO: 4560596 - DNA, 13 bp, Homo sapiens
cgactctgctgct

SEQ ID NO: 4560597 - DNA, 22 bp, Homo sapiens
cgactctttctgagtgccttct

SEQ ID NO: 4560598 - DNA, 17 bp, Homo sapiens
cgactgaaaatattgtt

SEQ ID NO: 4560599 - DNA, 19 bp, Homo sapiens
cgactgactggaggaggcc

SEQ ID NO: 4560600 - DNA, 13 bp, Homo sapiens
cgactgcccagaa

SEQ ID NO: 4560601 - DNA, 17 bp, Homo sapiens
cgactgcccctgctgtg

SEQ ID NO: 4560602 - DNA, 14 bp, Homo sapiens
cgactggccagggc

SEQ ID NO: 4560603 - DNA, 15 bp, Homo sapiens
cgactggccagggcc

SEQ ID NO: 4560604 - DNA, 22 bp, Homo sapiens
cgactgtcagtggggcagcctc

SEQ ID NO: 4560605 - DNA, 19 bp, Homo sapiens
cgacttggagactcctggt

SEQ ID NO: 4560606 - DNA, 21 bp, Homo sapiens
cgagaaagaggcaccaggaag

SEQ ID NO: 4560607 - DNA, 23 bp, Homo sapiens
cgagacaacagcacacaggcagc

SEQ ID NO: 4560608 - DNA, 17 bp, Homo sapiens
cgagacacattgccttc

SEQ ID NO: 4560609 - DNA, 21 bp, Homo sapiens
cgagacgcacacagctgagca

SEQ ID NO: 4560610 - DNA, 14 bp, Homo sapiens
cgagactgcaatgt

SEQ ID NO: 4560611 - DNA, 13 bp, Homo sapiens
cgagagcctgctc

SEQ ID NO: 4560612 - DNA, 14 bp, Homo sapiens
cgagagcctgctcc

SEQ ID NO: 4560613 - DNA, 20 bp, Homo sapiens
cgagagcctgctcccccacc

SEQ ID NO: 4560614 - DNA, 22 bp, Homo sapiens
cgagagcttggactacacaata

SEQ ID NO: 4560615 - DNA, 15 bp, Homo sapiens
cgagatcccaacact

SEQ ID NO: 4560616 - DNA, 22 bp, Homo sapiens
cgagatcccaacactgccagca

SEQ ID NO: 4560617 - DNA, 21 bp, Homo sapiens
cgagatgttcgctcgtgcagt

SEQ ID NO: 4560618 - DNA, 23 bp, Homo sapiens
cgagcacatagagctttttaata

SEQ ID NO: 4560619 - DNA, 14 bp, Homo sapiens
cgagccacaagctg

SEQ ID NO: 4560620 - DNA, 23 bp, Homo sapiens
cgagccatttgtcccaagtgcca

SEQ ID NO: 4560621 - DNA, 13 bp, Homo sapiens
cgagcccattctc

SEQ ID NO: 4560622 - DNA, 13 bp, Homo sapiens
cgagccctgactc

SEQ ID NO: 4560623 - DNA, 14 bp, Homo sapiens
cgagccctgactcc

SEQ ID NO: 4560624 - DNA, 16 bp, Homo sapiens
cgagccctgactcctg

SEQ ID NO: 4560625 - DNA, 15 bp, Homo sapiens
cgagcctccagtcca

SEQ ID NO: 4560626 - DNA, 14 bp, Homo sapiens
cgagctcctgggga

SEQ ID NO: 4560627 - DNA, 17 bp, Homo sapiens
cgagctcctggggagct

SEQ ID NO: 4560628 - DNA, 12 bp, Homo sapiens
cgaggacccaga

SEQ ID NO: 4560629 - DNA, 13 bp, Homo sapiens
cgaggagctgggc

SEQ ID NO: 4560630 - DNA, 19 bp, Homo sapiens
cgaggaggctccagagggc

SEQ ID NO: 4560631 - DNA, 19 bp, Homo sapiens
cgaggccctcgggcccagc

SEQ ID NO: 4560632 - DNA, 13 bp, Homo sapiens
cgaggcctgcaaa

SEQ ID NO: 4560633 - DNA, 19 bp, Homo sapiens
cgaggctacagctccacac

SEQ ID NO: 4560634 - DNA, 14 bp, Homo sapiens
cgaggctccccgcc

SEQ ID NO: 4560635 - DNA, 15 bp, Homo sapiens
cgaggctccccgcct

SEQ ID NO: 4560636 - DNA, 15 bp, Homo sapiens
cgaggctgcagtcag

SEQ ID NO: 4560637 - DNA, 11 bp, Homo sapiens
cgaggctgcta

SEQ ID NO: 4560638 - DNA, 17 bp, Homo sapiens
cgagggaggaacacctg

SEQ ID NO: 4560639 - DNA, 14 bp, Homo sapiens
cgagggctggctgg

SEQ ID NO: 4560640 - DNA, 15 bp, Homo sapiens
cgagggctggctggc

SEQ ID NO: 4560641 - DNA, 23 bp, Homo sapiens
cgagggctggctggcctcaccca

SEQ ID NO: 4560642 - DNA, 14 bp, Homo sapiens
cgaggggagggcag

SEQ ID NO: 4560643 - DNA, 21 bp, Homo sapiens
cgaggtcaacagagaaggcag

SEQ ID NO: 4560644 - DNA, 23 bp, Homo sapiens
cgaggtcaacagagaaggcagga

SEQ ID NO: 4560645 - DNA, 20 bp, Homo sapiens
cgaggtggatcacagaggct

SEQ ID NO: 4560646 - DNA, 21 bp, Homo sapiens
cgaggttcccagggctggaga

SEQ ID NO: 4560647 - DNA, 20 bp, Homo sapiens
cgagtctccgggactgccct

SEQ ID NO: 4560648 - DNA, 13 bp, Homo sapiens
cgagtctggggac

SEQ ID NO: 4560649 - DNA, 22 bp, Homo sapiens
cgagtgcactgcattcctgtgc

SEQ ID NO: 4560650 - DNA, 20 bp, Homo sapiens
cgagttcctctgggtttcta

SEQ ID NO: 4560651 - DNA, 17 bp, Homo sapiens
cgatatcttcagaaaac

SEQ ID NO: 4560652 - DNA, 20 bp, Homo sapiens
cgatcaagttgttgactgtg

SEQ ID NO: 4560653 - DNA, 23 bp, Homo sapiens
cgatcaagttgttgactgtgatt

SEQ ID NO: 4560654 - DNA, 15 bp, Homo sapiens
cgatccttcaaagtc

SEQ ID NO: 4560655 - DNA, 17 bp, Homo sapiens
cgatctctcctggccta

SEQ ID NO: 4560656 - DNA, 15 bp, Homo sapiens
cgatgcaatgaacac

SEQ ID NO: 4560657 - DNA, 16 bp, Homo sapiens
cgatggacctcagcaa

SEQ ID NO: 4560658 - DNA, 20 bp, Homo sapiens
cgatggacctcagcaagctg

SEQ ID NO: 4560659 - DNA, 16 bp, Homo sapiens
cgatgtggccctggcc

SEQ ID NO: 4560660 - DNA, 18 bp, Homo sapiens
cgatgtggtcacagctgt

SEQ ID NO: 4560661 - DNA, 14 bp, Homo sapiens
cgatgttgaacttt

SEQ ID NO: 4560662 - DNA, 16 bp, Homo sapiens
cgatgttgaacttttt

SEQ ID NO: 4560663 - DNA, 11 bp, Homo sapiens
cgattttacta

SEQ ID NO: 4560664 - DNA, 21 bp, Homo sapiens
cgcaagcctgtaatcccagct

SEQ ID NO: 4560665 - DNA, 17 bp, Homo sapiens
cgcaaggtgtgctctga

SEQ ID NO: 4560666 - DNA, 17 bp, Homo sapiens
cgcacacagctgagcac

SEQ ID NO: 4560667 - DNA, 17 bp, Homo sapiens
cgcacagccacccgtgg

SEQ ID NO: 4560668 - DNA, 16 bp, Homo sapiens
cgcaccaatcagcact

SEQ ID NO: 4560669 - DNA, 18 bp, Homo sapiens
cgcaccactgcactccag

SEQ ID NO: 4560670 - DNA, 20 bp, Homo sapiens
cgcaccactgcactccagcc

SEQ ID NO: 4560671 - DNA, 12 bp, Homo sapiens
cgcaccccacag

SEQ ID NO: 4560672 - DNA, 13 bp, Homo sapiens
cgcaccccacagc

SEQ ID NO: 4560673 - DNA, 21 bp, Homo sapiens
cgcaccccacagctggggccg

SEQ ID NO: 4560674 - DNA, 15 bp, Homo sapiens
cgcaccctgtcctgc

SEQ ID NO: 4560675 - DNA, 19 bp, Homo sapiens
cgcacgactgcgggagcca

SEQ ID NO: 4560676 - DNA, 16 bp, Homo sapiens
cgcactggacagcatc

SEQ ID NO: 4560677 - DNA, 17 bp, Homo sapiens
cgcactggacagcatca

SEQ ID NO: 4560678 - DNA, 24 bp, Homo sapiens
cgcagactggcggagaaggagagg

SEQ ID NO: 4560679 - DNA, 12 bp, Homo sapiens
cgcagagactgt

SEQ ID NO: 4560680 - DNA, 21 bp, Homo sapiens
cgcagaggatccatcacagac

SEQ ID NO: 4560681 - DNA, 17 bp, Homo sapiens
cgcagccctagagcctg

SEQ ID NO: 4560682 - DNA, 22 bp, Homo sapiens
cgcagccctagagcctgcctgg

SEQ ID NO: 4560683 - DNA, 17 bp, Homo sapiens
cgcagcctccagggccc

SEQ ID NO: 4560684 - DNA, 12 bp, Homo sapiens
cgcagctgaagt

SEQ ID NO: 4560685 - DNA, 13 bp, Homo sapiens
cgcaggtgggctg

SEQ ID NO: 4560686 - DNA, 14 bp, Homo sapiens
cgcaggtgggctgg

SEQ ID NO: 4560687 - DNA, 16 bp, Homo sapiens
cgcagtgtggaggcca

SEQ ID NO: 4560688 - DNA, 19 bp, Homo sapiens
cgcagttgtgtggcccagc

SEQ ID NO: 4560689 - DNA, 15 bp, Homo sapiens
cgcatccagacagtc

SEQ ID NO: 4560690 - DNA, 21 bp, Homo sapiens
cgcatgcctgtaatcccagaa

SEQ ID NO: 4560691 - DNA, 16 bp, Homo sapiens
cgcatggtcacacact

SEQ ID NO: 4560692 - DNA, 11 bp, Homo sapiens
cgcatgtgtgc

SEQ ID NO: 4560693 - DNA, 18 bp, Homo sapiens
cgcattctaacctggagg

SEQ ID NO: 4560694 - DNA, 18 bp, Homo sapiens
cgcattgctgtccttggg

SEQ ID NO: 4560695 - DNA, 16 bp, Homo sapiens
cgcattggtgactcac

SEQ ID NO: 4560696 - DNA, 18 bp, Homo sapiens
cgccaaggagggaagagt

SEQ ID NO: 4560697 - DNA, 20 bp, Homo sapiens
cgccaagtctggcaccatgt

SEQ ID NO: 4560698 - DNA, 20 bp, Homo sapiens
cgccaatgttatgccagctc

SEQ ID NO: 4560699 - DNA, 22 bp, Homo sapiens
cgccaatgttatgccagctcca

SEQ ID NO: 4560700 - DNA, 19 bp, Homo sapiens
cgccacccgggcaagggtc

SEQ ID NO: 4560701 - DNA, 18 bp, Homo sapiens
cgccacctttcaccctca

SEQ ID NO: 4560702 - DNA, 12 bp, Homo sapiens
cgccactcattt

SEQ ID NO: 4560703 - DNA, 13 bp, Homo sapiens
cgccagcctcctc

SEQ ID NO: 4560704 - DNA, 23 bp, Homo sapiens
cgccagcctcctctggacggcag

SEQ ID NO: 4560705 - DNA, 18 bp, Homo sapiens
cgccaggaagccagagcc

SEQ ID NO: 4560706 - DNA, 12 bp, Homo sapiens
cgccagggctgg

SEQ ID NO: 4560707 - DNA, 13 bp, Homo sapiens
cgccagggctggg

SEQ ID NO: 4560708 - DNA, 14 bp, Homo sapiens
cgccagggctgggg

SEQ ID NO: 4560709 - DNA, 15 bp, Homo sapiens
cgccagtacttgtca

SEQ ID NO: 4560710 - DNA, 14 bp, Homo sapiens
cgccatagccccag

SEQ ID NO: 4560711 - DNA, 14 bp, Homo sapiens
cgccatggtgtccc

SEQ ID NO: 4560712 - DNA, 17 bp, Homo sapiens
cgccattgtactccagc

SEQ ID NO: 4560713 - DNA, 12 bp, Homo sapiens
cgcccaaggcct

SEQ ID NO: 4560714 - DNA, 14 bp, Homo sapiens
cgcccaccagcctt

SEQ ID NO: 4560715 - DNA, 18 bp, Homo sapiens
cgcccaccagccttgctc

SEQ ID NO: 4560716 - DNA, 16 bp, Homo sapiens
cgcccacccgccttgt

SEQ ID NO: 4560717 - DNA, 16 bp, Homo sapiens
cgcccagacaccatgt

SEQ ID NO: 4560718 - DNA, 14 bp, Homo sapiens
cgccccaggccctc

SEQ ID NO: 4560719 - DNA, 13 bp, Homo sapiens
cgccccatgggcc

SEQ ID NO: 4560720 - DNA, 15 bp, Homo sapiens
cgcccccgagccctg

SEQ ID NO: 4560721 - DNA, 16 bp, Homo sapiens
cgccccgcacgactgc

SEQ ID NO: 4560722 - DNA, 18 bp, Homo sapiens
cgcccctcccacgcctca

SEQ ID NO: 4560723 - DNA, 14 bp, Homo sapiens
cgccccttccctct

SEQ ID NO: 4560724 - DNA, 12 bp, Homo sapiens
cgcccgaggcag

SEQ ID NO: 4560725 - DNA, 20 bp, Homo sapiens
cgcccgtctctttctcacct

SEQ ID NO: 4560726 - DNA, 16 bp, Homo sapiens
cgcccgtggggtctgc

SEQ ID NO: 4560727 - DNA, 15 bp, Homo sapiens
cgccctcactattct

SEQ ID NO: 4560728 - DNA, 14 bp, Homo sapiens
cgccctcaggggcc

SEQ ID NO: 4560729 - DNA, 16 bp, Homo sapiens
cgccctccctgctagc

SEQ ID NO: 4560730 - DNA, 12 bp, Homo sapiens
cgccctgggctg

SEQ ID NO: 4560731 - DNA, 15 bp, Homo sapiens
cgcccttccatgtgc

SEQ ID NO: 4560732 - DNA, 12 bp, Homo sapiens
cgccgatgccac

SEQ ID NO: 4560733 - DNA, 16 bp, Homo sapiens
cgccgccgccgctgcc

SEQ ID NO: 4560734 - DNA, 22 bp, Homo sapiens
cgccgctgcccttgggtccccc

SEQ ID NO: 4560735 - DNA, 15 bp, Homo sapiens
cgccggatctgaggg

SEQ ID NO: 4560736 - DNA, 13 bp, Homo sapiens
cgccgggcaccaa

SEQ ID NO: 4560737 - DNA, 22 bp, Homo sapiens
cgccggggacagaggcctgccc

SEQ ID NO: 4560738 - DNA, 17 bp, Homo sapiens
cgcctcaatgtggttgc

SEQ ID NO: 4560739 - DNA, 16 bp, Homo sapiens
cgcctcaccagccccc

SEQ ID NO: 4560740 - DNA, 15 bp, Homo sapiens
cgcctcagccctcag

SEQ ID NO: 4560741 - DNA, 14 bp, Homo sapiens
cgcctccactctag

SEQ ID NO: 4560742 - DNA, 21 bp, Homo sapiens
cgcctccactctagttctaga

SEQ ID NO: 4560743 - DNA, 11 bp, Homo sapiens
cgcctccagga

SEQ ID NO: 4560744 - DNA, 15 bp, Homo sapiens
cgcctcccacggcac

SEQ ID NO: 4560745 - DNA, 19 bp, Homo sapiens
cgcctcccaggttcaagca

SEQ ID NO: 4560746 - DNA, 13 bp, Homo sapiens
cgcctccctccac

SEQ ID NO: 4560747 - DNA, 18 bp, Homo sapiens
cgcctccctccaccccag

SEQ ID NO: 4560748 - DNA, 22 bp, Homo sapiens
cgcctccctctcagaggcctgc

SEQ ID NO: 4560749 - DNA, 14 bp, Homo sapiens
cgcctcctggccag

SEQ ID NO: 4560750 - DNA, 22 bp, Homo sapiens
cgcctctgcaagggcagaacac

SEQ ID NO: 4560751 - DNA, 15 bp, Homo sapiens
cgcctcttgaccagg

SEQ ID NO: 4560752 - DNA, 14 bp, Homo sapiens
cgcctgaaggcaca

SEQ ID NO: 4560753 - DNA, 13 bp, Homo sapiens
cgcctgcaggcag

SEQ ID NO: 4560754 - DNA, 14 bp, Homo sapiens
cgcctgccagtcct

SEQ ID NO: 4560755 - DNA, 11 bp, Homo sapiens
cgcctgccatc

SEQ ID NO: 4560756 - DNA, 16 bp, Homo sapiens
cgcctgcccagactga

SEQ ID NO: 4560757 - DNA, 20 bp, Homo sapiens
cgcctgccgtgcatggctcc

SEQ ID NO: 4560758 - DNA, 19 bp, Homo sapiens
cgcctgtaatcccagcact

SEQ ID NO: 4560759 - DNA, 20 bp, Homo sapiens
cgcctgtaatcccagcactt

SEQ ID NO: 4560760 - DNA, 12 bp, Homo sapiens
cgccttaaactc

SEQ ID NO: 4560761 - DNA, 17 bp, Homo sapiens
cgccttcgtgcctgaga

SEQ ID NO: 4560762 - DNA, 16 bp, Homo sapiens
cgccttgcccagcctg

SEQ ID NO: 4560763 - DNA, 20 bp, Homo sapiens
cgccttgctggggcttgtcc

SEQ ID NO: 4560764 - DNA, 14 bp, Homo sapiens
cgcgccgatgccac

SEQ ID NO: 4560765 - DNA, 14 bp, Homo sapiens
cgcgctcgcccagc

SEQ ID NO: 4560766 - DNA, 16 bp, Homo sapiens
cgcggctgggaggagg

SEQ ID NO: 4560767 - DNA, 14 bp, Homo sapiens
cgcgggttctagac

SEQ ID NO: 4560768 - DNA, 16 bp, Homo sapiens
cgcggtcttgggcact

SEQ ID NO: 4560769 - DNA, 16 bp, Homo sapiens
cgcgtcccagctcccc

SEQ ID NO: 4560770 - DNA, 17 bp, Homo sapiens
cgcgtcccagctcccct

SEQ ID NO: 4560771 - DNA, 18 bp, Homo sapiens
cgcgttgtgtatattaca

SEQ ID NO: 4560772 - DNA, 21 bp, Homo sapiens
cgctaaagagcccttgcctcc

SEQ ID NO: 4560773 - DNA, 20 bp, Homo sapiens
cgctagaaaaaaaaaacact

SEQ ID NO: 4560774 - DNA, 23 bp, Homo sapiens
cgctcaccgctggcccttagaga

SEQ ID NO: 4560775 - DNA, 13 bp, Homo sapiens
cgctcagcagccc

SEQ ID NO: 4560776 - DNA, 15 bp, Homo sapiens
cgctcagcagcccta

SEQ ID NO: 4560777 - DNA, 16 bp, Homo sapiens
cgctcagcagccctag

SEQ ID NO: 4560778 - DNA, 22 bp, Homo sapiens
cgctcagcagccctagcggctg

SEQ ID NO: 4560779 - DNA, 23 bp, Homo sapiens
cgctcagccccaggccagctgcg

SEQ ID NO: 4560780 - DNA, 20 bp, Homo sapiens
cgctcaggggctccatgctg

SEQ ID NO: 4560781 - DNA, 12 bp, Homo sapiens
cgctcagtctgt

SEQ ID NO: 4560782 - DNA, 13 bp, Homo sapiens
cgctccagctgcc

SEQ ID NO: 4560783 - DNA, 15 bp, Homo sapiens
cgctccagctgcccc

SEQ ID NO: 4560784 - DNA, 16 bp, Homo sapiens
cgctccagctgccccg

SEQ ID NO: 4560785 - DNA, 13 bp, Homo sapiens
cgctcccacagct

SEQ ID NO: 4560786 - DNA, 21 bp, Homo sapiens
cgctcccaggttcccccagca

SEQ ID NO: 4560787 - DNA, 23 bp, Homo sapiens
cgctcccaggttcccccagcaag

SEQ ID NO: 4560788 - DNA, 24 bp, Homo sapiens
cgctcccaggttcccccagcaagc

SEQ ID NO: 4560789 - DNA, 15 bp, Homo sapiens
cgctcccgctcccag

SEQ ID NO: 4560790 - DNA, 20 bp, Homo sapiens
cgctcctgccgcagagctgg

SEQ ID NO: 4560791 - DNA, 17 bp, Homo sapiens
cgctcgatggacctcag

SEQ ID NO: 4560792 - DNA, 15 bp, Homo sapiens
cgctcgcccagcagg

SEQ ID NO: 4560793 - DNA, 22 bp, Homo sapiens
cgctcggtctccaccccagggt

SEQ ID NO: 4560794 - DNA, 23 bp, Homo sapiens
cgctcgtgtgttctatccaaaca

SEQ ID NO: 4560795 - DNA, 18 bp, Homo sapiens
cgctctgtcgcccaggct

SEQ ID NO: 4560796 - DNA, 20 bp, Homo sapiens
cgctgaactgacaatgaagg

SEQ ID NO: 4560797 - DNA, 15 bp, Homo sapiens
cgctgagccacctgc

SEQ ID NO: 4560798 - DNA, 21 bp, Homo sapiens
cgctgagcgcccccgagccct

SEQ ID NO: 4560799 - DNA, 23 bp, Homo sapiens
cgctgagtggggggtcgtgggcc

SEQ ID NO: 4560800 - DNA, 19 bp, Homo sapiens
cgctgcacatggcctgagc

SEQ ID NO: 4560801 - DNA, 14 bp, Homo sapiens
cgctgcaccacggc

SEQ ID NO: 4560802 - DNA, 21 bp, Homo sapiens
cgctgcatacaggggaggggc

SEQ ID NO: 4560803 - DNA, 12 bp, Homo sapiens
cgctgccacccg

SEQ ID NO: 4560804 - DNA, 14 bp, Homo sapiens
cgctgccacccgcc

SEQ ID NO: 4560805 - DNA, 20 bp, Homo sapiens
cgctgccacccgcccacccg

SEQ ID NO: 4560806 - DNA, 23 bp, Homo sapiens
cgctgccagccttgagccctggc

SEQ ID NO: 4560807 - DNA, 15 bp, Homo sapiens
cgctgccagctctgt

SEQ ID NO: 4560808 - DNA, 19 bp, Homo sapiens
cgctgccagctctgtatca

SEQ ID NO: 4560809 - DNA, 17 bp, Homo sapiens
cgctgccctgtggacag

SEQ ID NO: 4560810 - DNA, 18 bp, Homo sapiens
cgctgccgcaccccagag

SEQ ID NO: 4560811 - DNA, 15 bp, Homo sapiens
cgctgccgctgcacc

SEQ ID NO: 4560812 - DNA, 16 bp, Homo sapiens
cgctgcgcagcctcca

SEQ ID NO: 4560813 - DNA, 20 bp, Homo sapiens
cgctgcgcagcctccagggc

SEQ ID NO: 4560814 - DNA, 17 bp, Homo sapiens
cgctgctgtgctctggg

SEQ ID NO: 4560815 - DNA, 17 bp, Homo sapiens
cgctggttggaaagagt

SEQ ID NO: 4560816 - DNA, 16 bp, Homo sapiens
cgctgtcctctcgagc

SEQ ID NO: 4560817 - DNA, 15 bp, Homo sapiens
cgctgtgattttaag

SEQ ID NO: 4560818 - DNA, 18 bp, Homo sapiens
cgctgtggccggtgccag

SEQ ID NO: 4560819 - DNA, 14 bp, Homo sapiens
cgctgttcacccac

SEQ ID NO: 4560820 - DNA, 19 bp, Homo sapiens
cgcttctctcttttaaagt

SEQ ID NO: 4560821 - DNA, 13 bp, Homo sapiens
cgcttctgagcag

SEQ ID NO: 4560822 - DNA, 17 bp, Homo sapiens
cgcttgctcgcttgctg

SEQ ID NO: 4560823 - DNA, 12 bp, Homo sapiens
cgcttgctctgt

SEQ ID NO: 4560824 - DNA, 17 bp, Homo sapiens
cgcttgctggaacacag

SEQ ID NO: 4560825 - DNA, 23 bp, Homo sapiens
cgcttgctggaacacaggggcct

SEQ ID NO: 4560826 - DNA, 14 bp, Homo sapiens
cgcttgcttctgca

SEQ ID NO: 4560827 - DNA, 23 bp, Homo sapiens
cgcttgcttctgcagcaactccc

SEQ ID NO: 4560828 - DNA, 18 bp, Homo sapiens
cgcttgcttttctgtatt

SEQ ID NO: 4560829 - DNA, 12 bp, Homo sapiens
cgcttggatctg

SEQ ID NO: 4560830 - DNA, 14 bp, Homo sapiens
cgcttggatctggg

SEQ ID NO: 4560831 - DNA, 16 bp, Homo sapiens
cgctttgattcatagt

SEQ ID NO: 4560832 - DNA, 19 bp, Homo sapiens
cggaacggaggcttcagaa

SEQ ID NO: 4560833 - DNA, 12 bp, Homo sapiens
cggaactgggct

SEQ ID NO: 4560834 - DNA, 17 bp, Homo sapiens
cggaactgggctggcgc

SEQ ID NO: 4560835 - DNA, 19 bp, Homo sapiens
cggaaggcgggctgaggag

SEQ ID NO: 4560836 - DNA, 19 bp, Homo sapiens
cggaattcaccagtgttcc

SEQ ID NO: 4560837 - DNA, 19 bp, Homo sapiens
cggaattcataataaattt

SEQ ID NO: 4560838 - DNA, 12 bp, Homo sapiens
cggacaaaatat

SEQ ID NO: 4560839 - DNA, 13 bp, Homo sapiens
cggacaaagttca

SEQ ID NO: 4560840 - DNA, 18 bp, Homo sapiens
cggacaaagttcagtgtc

SEQ ID NO: 4560841 - DNA, 16 bp, Homo sapiens
cggacaagacccccag

SEQ ID NO: 4560842 - DNA, 18 bp, Homo sapiens
cggacaagacccccagca

SEQ ID NO: 4560843 - DNA, 18 bp, Homo sapiens
cggacactcgtcacccca

SEQ ID NO: 4560844 - DNA, 12 bp, Homo sapiens
cggacagagccc

SEQ ID NO: 4560845 - DNA, 16 bp, Homo sapiens
cggacagagcccccct

SEQ ID NO: 4560846 - DNA, 21 bp, Homo sapiens
cggaccagcatctggaagatg

SEQ ID NO: 4560847 - DNA, 13 bp, Homo sapiens
cggacccacccca

SEQ ID NO: 4560848 - DNA, 21 bp, Homo sapiens
cggacccaccccaactctccc

SEQ ID NO: 4560849 - DNA, 22 bp, Homo sapiens
cggacccaccccaactctcccc

SEQ ID NO: 4560850 - DNA, 23 bp, Homo sapiens
cggacccttctgggtccagggag

SEQ ID NO: 4560851 - DNA, 14 bp, Homo sapiens
cggacgttccagcc

SEQ ID NO: 4560852 - DNA, 20 bp, Homo sapiens
cggactaagcctacctgctc

SEQ ID NO: 4560853 - DNA, 17 bp, Homo sapiens
cggactctcccaggcct

SEQ ID NO: 4560854 - DNA, 21 bp, Homo sapiens
cggactctcccaggcctgcct

SEQ ID NO: 4560855 - DNA, 24 bp, Homo sapiens
cggactctcccaggcctgcctgca

SEQ ID NO: 4560856 - DNA, 12 bp, Homo sapiens
cggactgccaaa

SEQ ID NO: 4560857 - DNA, 15 bp, Homo sapiens
cggactgcccccaga

SEQ ID NO: 4560858 - DNA, 23 bp, Homo sapiens
cggagaagagctgttcacagcca

SEQ ID NO: 4560859 - DNA, 21 bp, Homo sapiens
cggagacagaggaaagggctg

SEQ ID NO: 4560860 - DNA, 19 bp, Homo sapiens
cggagactatggcctcgcc

SEQ ID NO: 4560861 - DNA, 14 bp, Homo sapiens
cggagagcagcagc

SEQ ID NO: 4560862 - DNA, 21 bp, Homo sapiens
cggagccactcctctgactca

SEQ ID NO: 4560863 - DNA, 16 bp, Homo sapiens
cggagccccggctctt

SEQ ID NO: 4560864 - DNA, 21 bp, Homo sapiens
cggagcccgatattctccctg

SEQ ID NO: 4560865 - DNA, 22 bp, Homo sapiens
cggagcgggaggcagcgcccca

SEQ ID NO: 4560866 - DNA, 19 bp, Homo sapiens
cggagctgctgagtgacag

SEQ ID NO: 4560867 - DNA, 13 bp, Homo sapiens
cggaggactgagc

SEQ ID NO: 4560868 - DNA, 14 bp, Homo sapiens
cggaggactgagcc

SEQ ID NO: 4560869 - DNA, 15 bp, Homo sapiens
cggaggactgagccc

SEQ ID NO: 4560870 - DNA, 16 bp, Homo sapiens
cggaggactgagcccc

SEQ ID NO: 4560871 - DNA, 21 bp, Homo sapiens
cggaggctacccgctgtggcc

SEQ ID NO: 4560872 - DNA, 13 bp, Homo sapiens
cggaggctgcccc

SEQ ID NO: 4560873 - DNA, 19 bp, Homo sapiens
cggaggctgcccccggccc

SEQ ID NO: 4560874 - DNA, 18 bp, Homo sapiens
cggaggctgggcccctgg

SEQ ID NO: 4560875 - DNA, 21 bp, Homo sapiens
cggaggctgtgctccgccatg

SEQ ID NO: 4560876 - DNA, 22 bp, Homo sapiens
cggaggttgcagtgagctgaga

SEQ ID NO: 4560877 - DNA, 14 bp, Homo sapiens
cggagtctcgctct

SEQ ID NO: 4560878 - DNA, 23 bp, Homo sapiens
cggagtctcgctctgtcgcccag

SEQ ID NO: 4560879 - DNA, 18 bp, Homo sapiens
cggagtgaatgtggcagt

SEQ ID NO: 4560880 - DNA, 18 bp, Homo sapiens
cggagtgagttttttagt

SEQ ID NO: 4560881 - DNA, 22 bp, Homo sapiens
cggagtggggggacagagactc

SEQ ID NO: 4560882 - DNA, 19 bp, Homo sapiens
cggatctacagaacaaccc

SEQ ID NO: 4560883 - DNA, 18 bp, Homo sapiens
cggatggaccaacctgct

SEQ ID NO: 4560884 - DNA, 14 bp, Homo sapiens
cggatgtataaatg

SEQ ID NO: 4560885 - DNA, 24 bp, Homo sapiens
cggattccaaagagtagaattgca

SEQ ID NO: 4560886 - DNA, 15 bp, Homo sapiens
cggatttggggtgga

SEQ ID NO: 4560887 - DNA, 15 bp, Homo sapiens
cggcaaacctttccc

SEQ ID NO: 4560888 - DNA, 20 bp, Homo sapiens
cggcaacgtagcctgggctc

SEQ ID NO: 4560889 - DNA, 13 bp, Homo sapiens
cggcaagccacag

SEQ ID NO: 4560890 - DNA, 13 bp, Homo sapiens
cggcaccttcccc

SEQ ID NO: 4560891 - DNA, 16 bp, Homo sapiens
cggcagccccacttca

SEQ ID NO: 4560892 - DNA, 14 bp, Homo sapiens
cggcaggctcactg

SEQ ID NO: 4560893 - DNA, 22 bp, Homo sapiens
cggcagggcccccaataaacca

SEQ ID NO: 4560894 - DNA, 23 bp, Homo sapiens
cggcagggcccccaataaaccag

SEQ ID NO: 4560895 - DNA, 22 bp, Homo sapiens
cggcagggcgggcagagggctg

SEQ ID NO: 4560896 - DNA, 23 bp, Homo sapiens
cggcagggcgggcagagggctgg

SEQ ID NO: 4560897 - DNA, 13 bp, Homo sapiens
cggcatggctggg

SEQ ID NO: 4560898 - DNA, 23 bp, Homo sapiens
cggccaagtaaaatgttttttaa

SEQ ID NO: 4560899 - DNA, 16 bp, Homo sapiens
cggccacacccagcgg

SEQ ID NO: 4560900 - DNA, 13 bp, Homo sapiens
cggccacacccct

SEQ ID NO: 4560901 - DNA, 20 bp, Homo sapiens
cggccagccccggccctggg

SEQ ID NO: 4560902 - DNA, 11 bp, Homo sapiens
cggccaggcat

SEQ ID NO: 4560903 - DNA, 21 bp, Homo sapiens
cggccaggcattggctcagcc

SEQ ID NO: 4560904 - DNA, 12 bp, Homo sapiens
cggcccaggcca

SEQ ID NO: 4560905 - DNA, 18 bp, Homo sapiens
cggcccaggccaggtgcc

SEQ ID NO: 4560906 - DNA, 17 bp, Homo sapiens
cggcccagtgccactgc

SEQ ID NO: 4560907 - DNA, 18 bp, Homo sapiens
cggcccagtgccactgcc

SEQ ID NO: 4560908 - DNA, 19 bp, Homo sapiens
cggcccagtgccactgccc

SEQ ID NO: 4560909 - DNA, 20 bp, Homo sapiens
cggcccagtgccactgcccc

SEQ ID NO: 4560910 - DNA, 13 bp, Homo sapiens
cggccccatctct

SEQ ID NO: 4560911 - DNA, 23 bp, Homo sapiens
cggccccccgcgctcgcccagca

SEQ ID NO: 4560912 - DNA, 19 bp, Homo sapiens
cggcccccggccaaggacc

SEQ ID NO: 4560913 - DNA, 21 bp, Homo sapiens
cggcccccggccaaggaccca

SEQ ID NO: 4560914 - DNA, 23 bp, Homo sapiens
cggccccgtctctcttggaccca

SEQ ID NO: 4560915 - DNA, 16 bp, Homo sapiens
cggcccctgtctgttc

SEQ ID NO: 4560916 - DNA, 15 bp, Homo sapiens
cggcccgcctgccca

SEQ ID NO: 4560917 - DNA, 21 bp, Homo sapiens
cggcccgcctgcccagactga

SEQ ID NO: 4560918 - DNA, 16 bp, Homo sapiens
cggcccggctgagccc

SEQ ID NO: 4560919 - DNA, 16 bp, Homo sapiens
cggccctccagagccc

SEQ ID NO: 4560920 - DNA, 20 bp, Homo sapiens
cggccctccagagccccaca

SEQ ID NO: 4560921 - DNA, 13 bp, Homo sapiens
cggccctggagga

SEQ ID NO: 4560922 - DNA, 15 bp, Homo sapiens
cggccgcattccctg

SEQ ID NO: 4560923 - DNA, 13 bp, Homo sapiens
cggccgcgccacc

SEQ ID NO: 4560924 - DNA, 16 bp, Homo sapiens
cggcctccacacctga

SEQ ID NO: 4560925 - DNA, 13 bp, Homo sapiens
cggcctcccaggt

SEQ ID NO: 4560926 - DNA, 16 bp, Homo sapiens
cggcctccgaggctcc

SEQ ID NO: 4560927 - DNA, 17 bp, Homo sapiens
cggcctccgaggctccc

SEQ ID NO: 4560928 - DNA, 18 bp, Homo sapiens
cggcctcctcctcaccct

SEQ ID NO: 4560929 - DNA, 22 bp, Homo sapiens
cggcctcctcggagagcagcag

SEQ ID NO: 4560930 - DNA, 23 bp, Homo sapiens
cggcctcctcggagagcagcagc

SEQ ID NO: 4560931 - DNA, 19 bp, Homo sapiens
cggcctcgtgccatgatct

SEQ ID NO: 4560932 - DNA, 20 bp, Homo sapiens
cggcctctaaccccaggccc

SEQ ID NO: 4560933 - DNA, 14 bp, Homo sapiens
cggcctctccctgc

SEQ ID NO: 4560934 - DNA, 15 bp, Homo sapiens
cggcctctccctgcc

SEQ ID NO: 4560935 - DNA, 18 bp, Homo sapiens
cggcctctccctgcctgt

SEQ ID NO: 4560936 - DNA, 22 bp, Homo sapiens
cggcctctccctgcctgtggcc

SEQ ID NO: 4560937 - DNA, 16 bp, Homo sapiens
cggcctgatgctccct

SEQ ID NO: 4560938 - DNA, 17 bp, Homo sapiens
cggcctgatgctccctc

SEQ ID NO: 4560939 - DNA, 18 bp, Homo sapiens
cggcctgtgggtctctga

SEQ ID NO: 4560940 - DNA, 15 bp, Homo sapiens
cggcctgtgtacaac

SEQ ID NO: 4560941 - DNA, 13 bp, Homo sapiens
cggcgcggtggct

SEQ ID NO: 4560942 - DNA, 18 bp, Homo sapiens
cggcgctgattcctcgtg

SEQ ID NO: 4560943 - DNA, 23 bp, Homo sapiens
cggcgggatcctccacagagagg

SEQ ID NO: 4560944 - DNA, 14 bp, Homo sapiens
cggcgggtgacagc

SEQ ID NO: 4560945 - DNA, 15 bp, Homo sapiens
cggcggtagcagctg

SEQ ID NO: 4560946 - DNA, 14 bp, Homo sapiens
cggcgtcagcctcc

SEQ ID NO: 4560947 - DNA, 18 bp, Homo sapiens
cggcgtcagcctccagcc

SEQ ID NO: 4560948 - DNA, 15 bp, Homo sapiens
cggctactctggaat

SEQ ID NO: 4560949 - DNA, 22 bp, Homo sapiens
cggctccaactcctttcagcca

SEQ ID NO: 4560950 - DNA, 14 bp, Homo sapiens
cggctcccctctgc

SEQ ID NO: 4560951 - DNA, 15 bp, Homo sapiens
cggctcccctctgct

SEQ ID NO: 4560952 - DNA, 12 bp, Homo sapiens
cggctcctcaga

SEQ ID NO: 4560953 - DNA, 14 bp, Homo sapiens
cggctcctcagagc

SEQ ID NO: 4560954 - DNA, 15 bp, Homo sapiens
cggctctagtacctt

SEQ ID NO: 4560955 - DNA, 22 bp, Homo sapiens
cggctctgggggtgggaagtgg

SEQ ID NO: 4560956 - DNA, 11 bp, Homo sapiens
cggctgagcat

SEQ ID NO: 4560957 - DNA, 13 bp, Homo sapiens
cggctgagccctg

SEQ ID NO: 4560958 - DNA, 20 bp, Homo sapiens
cggctgagtcatgatctccc

SEQ ID NO: 4560959 - DNA, 14 bp, Homo sapiens
cggctgccctctgg

SEQ ID NO: 4560960 - DNA, 12 bp, Homo sapiens
cggctgctcctt

SEQ ID NO: 4560961 - DNA, 23 bp, Homo sapiens
cggctgcttggcagttgcagtgc

SEQ ID NO: 4560962 - DNA, 18 bp, Homo sapiens
cggctgggaggagggcag

SEQ ID NO: 4560963 - DNA, 18 bp, Homo sapiens
cggctggggactgctacc

SEQ ID NO: 4560964 - DNA, 14 bp, Homo sapiens
cggctgtttcctga

SEQ ID NO: 4560965 - DNA, 21 bp, Homo sapiens
cggctgtttcctgacagatgc

SEQ ID NO: 4560966 - DNA, 22 bp, Homo sapiens
cggcttctcacgctttgtttac

SEQ ID NO: 4560967 - DNA, 17 bp, Homo sapiens
cggctttaagtgtgctg

SEQ ID NO: 4560968 - DNA, 20 bp, Homo sapiens
cgggaaaaggagaggaaact

SEQ ID NO: 4560969 - DNA, 13 bp, Homo sapiens
cgggaaagaagaa

SEQ ID NO: 4560970 - DNA, 14 bp, Homo sapiens
cgggaaagaagaaa

SEQ ID NO: 4560971 - DNA, 23 bp, Homo sapiens
cgggacatggttgggggaatgca

SEQ ID NO: 4560972 - DNA, 17 bp, Homo sapiens
cgggaccctgcccagag

SEQ ID NO: 4560973 - DNA, 15 bp, Homo sapiens
cgggactgctgctct

SEQ ID NO: 4560974 - DNA, 16 bp, Homo sapiens
cgggactgctgctctc

SEQ ID NO: 4560975 - DNA, 19 bp, Homo sapiens
cgggactgctgctctccca

SEQ ID NO: 4560976 - DNA, 17 bp, Homo sapiens
cgggagcacccagagca

SEQ ID NO: 4560977 - DNA, 18 bp, Homo sapiens
cgggagcacccagagcac

SEQ ID NO: 4560978 - DNA, 14 bp, Homo sapiens
cgggagccagactg

SEQ ID NO: 4560979 - DNA, 15 bp, Homo sapiens
cgggagccagactgt

SEQ ID NO: 4560980 - DNA, 22 bp, Homo sapiens
cgggagccagactgtccaggga

SEQ ID NO: 4560981 - DNA, 12 bp, Homo sapiens
cgggagcctccc

SEQ ID NO: 4560982 - DNA, 17 bp, Homo sapiens
cgggagcctgaccctca

SEQ ID NO: 4560983 - DNA, 16 bp, Homo sapiens
cgggagctcaggaacc

SEQ ID NO: 4560984 - DNA, 13 bp, Homo sapiens
cgggagctctgta

SEQ ID NO: 4560985 - DNA, 13 bp, Homo sapiens
cgggagctgggcc

SEQ ID NO: 4560986 - DNA, 14 bp, Homo sapiens
cgggagctgggccc

SEQ ID NO: 4560987 - DNA, 19 bp, Homo sapiens
cgggagctgggccctgcct

SEQ ID NO: 4560988 - DNA, 22 bp, Homo sapiens
cgggagctgggccctgcctgca

SEQ ID NO: 4560989 - DNA, 19 bp, Homo sapiens
cgggagtcagggacctgct

SEQ ID NO: 4560990 - DNA, 15 bp, Homo sapiens
cgggatattatagaa

SEQ ID NO: 4560991 - DNA, 18 bp, Homo sapiens
cgggatcctccacagaga

SEQ ID NO: 4560992 - DNA, 19 bp, Homo sapiens
cgggatcctccacagagag

SEQ ID NO: 4560993 - DNA, 20 bp, Homo sapiens
cgggatcctccacagagagg

SEQ ID NO: 4560994 - DNA, 24 bp, Homo sapiens
cgggatgattgcttgagctcagga

SEQ ID NO: 4560995 - DNA, 15 bp, Homo sapiens
cgggcaatcatgagc

SEQ ID NO: 4560996 - DNA, 16 bp, Homo sapiens
cgggcagagggctgga

SEQ ID NO: 4560997 - DNA, 13 bp, Homo sapiens
cgggcagccaccc

SEQ ID NO: 4560998 - DNA, 22 bp, Homo sapiens
cgggcagccacccaagcctgct

SEQ ID NO: 4560999 - DNA, 23 bp, Homo sapiens
cgggcagccacccaagcctgctg

SEQ ID NO: 4561000 - DNA, 12 bp, Homo sapiens
cgggcagccagc

SEQ ID NO: 4561001 - DNA, 15 bp, Homo sapiens
cgggcagccagcaga

SEQ ID NO: 4561002 - DNA, 20 bp, Homo sapiens
cgggcaggggtcagagcact

SEQ ID NO: 4561003 - DNA, 17 bp, Homo sapiens
cgggcaggtcctgccca

SEQ ID NO: 4561004 - DNA, 17 bp, Homo sapiens
cgggcagtctgctctgc

SEQ ID NO: 4561005 - DNA, 21 bp, Homo sapiens
cgggcatggtggcgcaagcct

SEQ ID NO: 4561006 - DNA, 15 bp, Homo sapiens
cgggcccagccccca

SEQ ID NO: 4561007 - DNA, 20 bp, Homo sapiens
cgggcccctctctagggacc

SEQ ID NO: 4561008 - DNA, 22 bp, Homo sapiens
cgggcccctctctagggacccc

SEQ ID NO: 4561009 - DNA, 18 bp, Homo sapiens
cgggcgcgggcagccacc

SEQ ID NO: 4561010 - DNA, 17 bp, Homo sapiens
cgggctcagagctttgt

SEQ ID NO: 4561011 - DNA, 15 bp, Homo sapiens
cgggctcgggtctgg

SEQ ID NO: 4561012 - DNA, 14 bp, Homo sapiens
cgggcttccctggc

SEQ ID NO: 4561013 - DNA, 14 bp, Homo sapiens
cggggaactcctgg

SEQ ID NO: 4561014 - DNA, 15 bp, Homo sapiens
cggggaagctggctt

SEQ ID NO: 4561015 - DNA, 16 bp, Homo sapiens
cggggacaccagagct

SEQ ID NO: 4561016 - DNA, 20 bp, Homo sapiens
cggggacaggtgacagtggc

SEQ ID NO: 4561017 - DNA, 21 bp, Homo sapiens
cggggacaggtgacagtggct

SEQ ID NO: 4561018 - DNA, 12 bp, Homo sapiens
cggggaccctgt

SEQ ID NO: 4561019 - DNA, 14 bp, Homo sapiens
cggggcctggacag

SEQ ID NO: 4561020 - DNA, 16 bp, Homo sapiens
cggggcctggacaggc

SEQ ID NO: 4561021 - DNA, 21 bp, Homo sapiens
cggggcctggacaggcgggct

SEQ ID NO: 4561022 - DNA, 17 bp, Homo sapiens
cgggggcagtctgagag

SEQ ID NO: 4561023 - DNA, 14 bp, Homo sapiens
cgggggcagtgctc

SEQ ID NO: 4561024 - DNA, 20 bp, Homo sapiens
cggggggccccagtcagcct

SEQ ID NO: 4561025 - DNA, 23 bp, Homo sapiens
cggggggccccagtcagcctctc

SEQ ID NO: 4561026 - DNA, 13 bp, Homo sapiens
cggggggctcctg

SEQ ID NO: 4561027 - DNA, 15 bp, Homo sapiens
cggggggctcctgcc

SEQ ID NO: 4561028 - DNA, 16 bp, Homo sapiens
cggggggctcctgccc

SEQ ID NO: 4561029 - DNA, 18 bp, Homo sapiens
cggggggctcctgcccag

SEQ ID NO: 4561030 - DNA, 21 bp, Homo sapiens
cggggggctcctgcccaggcc

SEQ ID NO: 4561031 - DNA, 22 bp, Homo sapiens
cggggggtgtcttccctgcctg

SEQ ID NO: 4561032 - DNA, 23 bp, Homo sapiens
cggggggtgtcttccctgcctgt

SEQ ID NO: 4561033 - DNA, 22 bp, Homo sapiens
cggggtgagtccattctcccag

SEQ ID NO: 4561034 - DNA, 14 bp, Homo sapiens
cgggtaaagtgcaa

SEQ ID NO: 4561035 - DNA, 19 bp, Homo sapiens
cgggtccatagagatgagc

SEQ ID NO: 4561036 - DNA, 20 bp, Homo sapiens
cgggtccggcctctccctgc

SEQ ID NO: 4561037 - DNA, 22 bp, Homo sapiens
cgggtccggcctctccctgcct

SEQ ID NO: 4561038 - DNA, 18 bp, Homo sapiens
cgggtgatggccagcccc

SEQ ID NO: 4561039 - DNA, 24 bp, Homo sapiens
cgggtgcccgtaatcccagctact

SEQ ID NO: 4561040 - DNA, 12 bp, Homo sapiens
cgggttctagac

SEQ ID NO: 4561041 - DNA, 22 bp, Homo sapiens
cgggttctagacgcccctccca

SEQ ID NO: 4561042 - DNA, 21 bp, Homo sapiens
cggtacactacgcactggaca

SEQ ID NO: 4561043 - DNA, 12 bp, Homo sapiens
cggtatcctaaa

SEQ ID NO: 4561044 - DNA, 13 bp, Homo sapiens
cggtcagccaagt

SEQ ID NO: 4561045 - DNA, 15 bp, Homo sapiens
cggtccacaggtcca

SEQ ID NO: 4561046 - DNA, 15 bp, Homo sapiens
cggtcccccaggagg

SEQ ID NO: 4561047 - DNA, 16 bp, Homo sapiens
cggtcccccaggaggc

SEQ ID NO: 4561048 - DNA, 17 bp, Homo sapiens
cggtctccaccccaggg

SEQ ID NO: 4561049 - DNA, 12 bp, Homo sapiens
cggtctgtgtgc

SEQ ID NO: 4561050 - DNA, 14 bp, Homo sapiens
cggtgccagctgcc

SEQ ID NO: 4561051 - DNA, 17 bp, Homo sapiens
cggtgcctttatttcca

SEQ ID NO: 4561052 - DNA, 18 bp, Homo sapiens
cggtgctaaaaatgaaaa

SEQ ID NO: 4561053 - DNA, 19 bp, Homo sapiens
cggtgctaaaaatgaaaat

SEQ ID NO: 4561054 - DNA, 22 bp, Homo sapiens
cggtgctccatctccgcctcca

SEQ ID NO: 4561055 - DNA, 23 bp, Homo sapiens
cggtgctccatctccgcctccac

SEQ ID NO: 4561056 - DNA, 15 bp, Homo sapiens
cggtggcgggcacct

SEQ ID NO: 4561057 - DNA, 13 bp, Homo sapiens
cggtggctgcccc

SEQ ID NO: 4561058 - DNA, 17 bp, Homo sapiens
cggtggctgccccggcc

SEQ ID NO: 4561059 - DNA, 21 bp, Homo sapiens
cggtggtgcccgtgcccgcag

SEQ ID NO: 4561060 - DNA, 21 bp, Homo sapiens
cggtggttgggtgtgggcagt

SEQ ID NO: 4561061 - DNA, 14 bp, Homo sapiens
cggttatttaagca

SEQ ID NO: 4561062 - DNA, 20 bp, Homo sapiens
cggttcaggaaaattgaatg

SEQ ID NO: 4561063 - DNA, 15 bp, Homo sapiens
cggttctaaggctca

SEQ ID NO: 4561064 - DNA, 17 bp, Homo sapiens
cggttctaaggctcaga

SEQ ID NO: 4561065 - DNA, 23 bp, Homo sapiens
cggttgttgatattgtttgctgt

SEQ ID NO: 4561066 - DNA, 14 bp, Homo sapiens
cgtaaagaattttc

SEQ ID NO: 4561067 - DNA, 12 bp, Homo sapiens
cgtaaagatttg

SEQ ID NO: 4561068 - DNA, 16 bp, Homo sapiens
cgtaaagctagaaatg

SEQ ID NO: 4561069 - DNA, 13 bp, Homo sapiens
cgtaaccagccag

SEQ ID NO: 4561070 - DNA, 22 bp, Homo sapiens
cgtaagaccaaatgtagttttg

SEQ ID NO: 4561071 - DNA, 20 bp, Homo sapiens
cgtacatctgcaatatgaat

SEQ ID NO: 4561072 - DNA, 11 bp, Homo sapiens
cgtagcctggg

SEQ ID NO: 4561073 - DNA, 13 bp, Homo sapiens
cgtagctctctta

SEQ ID NO: 4561074 - DNA, 21 bp, Homo sapiens
cgtaggacaagttttagttaa

SEQ ID NO: 4561075 - DNA, 20 bp, Homo sapiens
cgtagtccatcaccatttct

SEQ ID NO: 4561076 - DNA, 13 bp, Homo sapiens
cgtagttccctga

SEQ ID NO: 4561077 - DNA, 14 bp, Homo sapiens
cgtagttccctgaa

SEQ ID NO: 4561078 - DNA, 14 bp, Homo sapiens
cgtataaatatcag

SEQ ID NO: 4561079 - DNA, 16 bp, Homo sapiens
cgtataatgctttctg

SEQ ID NO: 4561080 - DNA, 15 bp, Homo sapiens
cgtattggtccagct

SEQ ID NO: 4561081 - DNA, 16 bp, Homo sapiens
cgtcaactttcctcaa

SEQ ID NO: 4561082 - DNA, 18 bp, Homo sapiens
cgtcaccacgactggcca

SEQ ID NO: 4561083 - DNA, 21 bp, Homo sapiens
cgtcacccctgtttctggcac

SEQ ID NO: 4561084 - DNA, 14 bp, Homo sapiens
cgtcagcatcactg

SEQ ID NO: 4561085 - DNA, 14 bp, Homo sapiens
cgtcagcctccagc

SEQ ID NO: 4561086 - DNA, 17 bp, Homo sapiens
cgtcagcctccagcctc

SEQ ID NO: 4561087 - DNA, 19 bp, Homo sapiens
cgtcagctgggacaccccg

SEQ ID NO: 4561088 - DNA, 15 bp, Homo sapiens
cgtcagcttctccca

SEQ ID NO: 4561089 - DNA, 20 bp, Homo sapiens
cgtcatgcacagtatttgta

SEQ ID NO: 4561090 - DNA, 13 bp, Homo sapiens
cgtccaccctgag

SEQ ID NO: 4561091 - DNA, 14 bp, Homo sapiens
cgtccaccctgagc

SEQ ID NO: 4561092 - DNA, 19 bp, Homo sapiens
cgtccaccctgagctcggg

SEQ ID NO: 4561093 - DNA, 19 bp, Homo sapiens
cgtccatccgactgcccct

SEQ ID NO: 4561094 - DNA, 15 bp, Homo sapiens
cgtcccagcatccct

SEQ ID NO: 4561095 - DNA, 12 bp, Homo sapiens
cgtcccagcctg

SEQ ID NO: 4561096 - DNA, 13 bp, Homo sapiens
cgtcccagctccc

SEQ ID NO: 4561097 - DNA, 22 bp, Homo sapiens
cgtccccccccaacctttccct

SEQ ID NO: 4561098 - DNA, 13 bp, Homo sapiens
cgtcccctccgcc

SEQ ID NO: 4561099 - DNA, 19 bp, Homo sapiens
cgtcccgcgttcaagactt

SEQ ID NO: 4561100 - DNA, 14 bp, Homo sapiens
cgtcccgctgctgt

SEQ ID NO: 4561101 - DNA, 21 bp, Homo sapiens
cgtcccgctgctgtgctctgg

SEQ ID NO: 4561102 - DNA, 14 bp, Homo sapiens
cgtccctggcgcag

SEQ ID NO: 4561103 - DNA, 17 bp, Homo sapiens
cgtcctccccctgccag

SEQ ID NO: 4561104 - DNA, 22 bp, Homo sapiens
cgtcctccccctgccagtgcct

SEQ ID NO: 4561105 - DNA, 17 bp, Homo sapiens
cgtcctcctcacctcat

SEQ ID NO: 4561106 - DNA, 12 bp, Homo sapiens
cgtcctcctctg

SEQ ID NO: 4561107 - DNA, 21 bp, Homo sapiens
cgtccttggctgccgtctggc

SEQ ID NO: 4561108 - DNA, 20 bp, Homo sapiens
cgtctaatgggggcagtctc

SEQ ID NO: 4561109 - DNA, 22 bp, Homo sapiens
cgtctagctatgctgtatctgt

SEQ ID NO: 4561110 - DNA, 18 bp, Homo sapiens
cgtctcccttggcccaga

SEQ ID NO: 4561111 - DNA, 12 bp, Homo sapiens
cgtctcctccct

SEQ ID NO: 4561112 - DNA, 16 bp, Homo sapiens
cgtctctactaaaaat

SEQ ID NO: 4561113 - DNA, 14 bp, Homo sapiens
cgtctgccttggca

SEQ ID NO: 4561114 - DNA, 15 bp, Homo sapiens
cgtctggaagtccaa

SEQ ID NO: 4561115 - DNA, 17 bp, Homo sapiens
cgtctggcccaccaggg

SEQ ID NO: 4561116 - DNA, 19 bp, Homo sapiens
cgtctggggttcagcccct

SEQ ID NO: 4561117 - DNA, 23 bp, Homo sapiens
cgtcttagaagtggaccaggaca

SEQ ID NO: 4561118 - DNA, 13 bp, Homo sapiens
cgtcttccttctt

SEQ ID NO: 4561119 - DNA, 22 bp, Homo sapiens
cgtcttggtgtaatttgaagat

SEQ ID NO: 4561120 - DNA, 18 bp, Homo sapiens
cgtcttttcctgtttcct

SEQ ID NO: 4561121 - DNA, 13 bp, Homo sapiens
cgtgaaagccaga

SEQ ID NO: 4561122 - DNA, 10 bp, Homo sapiens
cgtgaaatcc

SEQ ID NO: 4561123 - DNA, 14 bp, Homo sapiens
cgtgaaccagaggg

SEQ ID NO: 4561124 - DNA, 13 bp, Homo sapiens
cgtgactgcccca

SEQ ID NO: 4561125 - DNA, 16 bp, Homo sapiens
cgtgactgccccaact

SEQ ID NO: 4561126 - DNA, 12 bp, Homo sapiens
cgtgagcatgca

SEQ ID NO: 4561127 - DNA, 22 bp, Homo sapiens
cgtgagcatgcacactgagaat

SEQ ID NO: 4561128 - DNA, 15 bp, Homo sapiens
cgtgagctggggact

SEQ ID NO: 4561129 - DNA, 23 bp, Homo sapiens
cgtgatgtagggtaaggtgcctt

SEQ ID NO: 4561130 - DNA, 13 bp, Homo sapiens
cgtgatgtggagg

SEQ ID NO: 4561131 - DNA, 17 bp, Homo sapiens
cgtgatgtggaggaaga

SEQ ID NO: 4561132 - DNA, 23 bp, Homo sapiens
cgtgatgtggaggaagagccacc

SEQ ID NO: 4561133 - DNA, 22 bp, Homo sapiens
cgtgcacgtggagagctggtgc

SEQ ID NO: 4561134 - DNA, 18 bp, Homo sapiens
cgtgcagaaccagcacta

SEQ ID NO: 4561135 - DNA, 18 bp, Homo sapiens
cgtgcatccttgtaatac

SEQ ID NO: 4561136 - DNA, 15 bp, Homo sapiens
cgtgcatgatttact

SEQ ID NO: 4561137 - DNA, 19 bp, Homo sapiens
cgtgccaggcccggggctg

SEQ ID NO: 4561138 - DNA, 14 bp, Homo sapiens
cgtgcccccctcct

SEQ ID NO: 4561139 - DNA, 18 bp, Homo sapiens
cgtgcccccctcctccag

SEQ ID NO: 4561140 - DNA, 20 bp, Homo sapiens
cgtgcccccctcctccagta

SEQ ID NO: 4561141 - DNA, 22 bp, Homo sapiens
cgtgccggcggcagccccactt

SEQ ID NO: 4561142 - DNA, 17 bp, Homo sapiens
cgtgccgttactctcca

SEQ ID NO: 4561143 - DNA, 18 bp, Homo sapiens
cgtgcctgagaccagggt

SEQ ID NO: 4561144 - DNA, 20 bp, Homo sapiens
cgtgcctgagaccagggtgg

SEQ ID NO: 4561145 - DNA, 13 bp, Homo sapiens
cgtggacagcgct

SEQ ID NO: 4561146 - DNA, 14 bp, Homo sapiens
cgtggacagcgctg

SEQ ID NO: 4561147 - DNA, 15 bp, Homo sapiens
cgtggactgagtggg

SEQ ID NO: 4561148 - DNA, 17 bp, Homo sapiens
cgtggagagctggtgcc

SEQ ID NO: 4561149 - DNA, 18 bp, Homo sapiens
cgtggcacgtattgctgt

SEQ ID NO: 4561150 - DNA, 15 bp, Homo sapiens
cgtggcactagaatg

SEQ ID NO: 4561151 - DNA, 16 bp, Homo sapiens
cgtggcatcttaaaag

SEQ ID NO: 4561152 - DNA, 13 bp, Homo sapiens
cgtggccagaggc

SEQ ID NO: 4561153 - DNA, 18 bp, Homo sapiens
cgtgggaccctcagcagc

SEQ ID NO: 4561154 - DNA, 21 bp, Homo sapiens
cgtgggaccctcagcagctct

SEQ ID NO: 4561155 - DNA, 17 bp, Homo sapiens
cgtggggtaacatctgt

SEQ ID NO: 4561156 - DNA, 14 bp, Homo sapiens
cgtgggtcagaaga

SEQ ID NO: 4561157 - DNA, 15 bp, Homo sapiens
cgtggtgcctgcaca

SEQ ID NO: 4561158 - DNA, 21 bp, Homo sapiens
cgtggtggcggtggctgcccc

SEQ ID NO: 4561159 - DNA, 12 bp, Homo sapiens
cgtgtcaggtgg

SEQ ID NO: 4561160 - DNA, 18 bp, Homo sapiens
cgtgtcgggcaggtcagc

SEQ ID NO: 4561161 - DNA, 21 bp, Homo sapiens
cgtgtctggcacagcctggct

SEQ ID NO: 4561162 - DNA, 14 bp, Homo sapiens
cgtgtctgtattta

SEQ ID NO: 4561163 - DNA, 15 bp, Homo sapiens
cgtgtgagtgaggga

SEQ ID NO: 4561164 - DNA, 18 bp, Homo sapiens
cgtgtgagtgagggagac

SEQ ID NO: 4561165 - DNA, 14 bp, Homo sapiens
cgtgtgtgtggccg

SEQ ID NO: 4561166 - DNA, 15 bp, Homo sapiens
cgtgttcaatatttt

SEQ ID NO: 4561167 - DNA, 19 bp, Homo sapiens
cgtgttccagccaaagcat

SEQ ID NO: 4561168 - DNA, 10 bp, Homo sapiens
cgtgttctca

SEQ ID NO: 4561169 - DNA, 18 bp, Homo sapiens
cgtgttgtcattgactcg

SEQ ID NO: 4561170 - DNA, 22 bp, Homo sapiens
cgtgtttcctcatctatggttc

SEQ ID NO: 4561171 - DNA, 20 bp, Homo sapiens
cgtgtttctgactctgagct

SEQ ID NO: 4561172 - DNA, 13 bp, Homo sapiens
cgtgtttgcttaa

SEQ ID NO: 4561173 - DNA, 16 bp, Homo sapiens
cgtgtttgcttaaaat

SEQ ID NO: 4561174 - DNA, 16 bp, Homo sapiens
cgttagaccgctctct

SEQ ID NO: 4561175 - DNA, 13 bp, Homo sapiens
cgttaggaccagg

SEQ ID NO: 4561176 - DNA, 22 bp, Homo sapiens
cgttcacctccaagcatttcat

SEQ ID NO: 4561177 - DNA, 23 bp, Homo sapiens
cgttcacctccaagcatttcatg

SEQ ID NO: 4561178 - DNA, 15 bp, Homo sapiens
cgttcacctccctgc

SEQ ID NO: 4561179 - DNA, 15 bp, Homo sapiens
cgttcatcacctgct

SEQ ID NO: 4561180 - DNA, 10 bp, Homo sapiens
cgttccagcc

SEQ ID NO: 4561181 - DNA, 16 bp, Homo sapiens
cgttccatctgggctt

SEQ ID NO: 4561182 - DNA, 13 bp, Homo sapiens
cgttcctggcctt

SEQ ID NO: 4561183 - DNA, 16 bp, Homo sapiens
cgttcctttcttttcc

SEQ ID NO: 4561184 - DNA, 18 bp, Homo sapiens
cgttctataaatgaatgt

SEQ ID NO: 4561185 - DNA, 22 bp, Homo sapiens
cgttctcaagaatctagaagat

SEQ ID NO: 4561186 - DNA, 16 bp, Homo sapiens
cgttctcccaaagatt

SEQ ID NO: 4561187 - DNA, 17 bp, Homo sapiens
cgttctgatttctgccc

SEQ ID NO: 4561188 - DNA, 17 bp, Homo sapiens
cgttctggactctgccc

SEQ ID NO: 4561189 - DNA, 16 bp, Homo sapiens
cgttcttacaagctta

SEQ ID NO: 4561190 - DNA, 15 bp, Homo sapiens
cgttgacccaacctt

SEQ ID NO: 4561191 - DNA, 13 bp, Homo sapiens
cgttgggagccta

SEQ ID NO: 4561192 - DNA, 12 bp, Homo sapiens
cgttgtccctga

SEQ ID NO: 4561193 - DNA, 16 bp, Homo sapiens
cgttgtcctcagcccc

SEQ ID NO: 4561194 - DNA, 18 bp, Homo sapiens
cgttgtgtatattacacc

SEQ ID NO: 4561195 - DNA, 20 bp, Homo sapiens
cgttgttgcatgtttgaaat

SEQ ID NO: 4561196 - DNA, 15 bp, Homo sapiens
cgtttaaagttctgt

SEQ ID NO: 4561197 - DNA, 20 bp, Homo sapiens
cgtttacttatcttatgcca

SEQ ID NO: 4561198 - DNA, 19 bp, Homo sapiens
cgtttagaatcagaataaa

SEQ ID NO: 4561199 - DNA, 18 bp, Homo sapiens
cgtttccatcatgtctgt

SEQ ID NO: 4561200 - DNA, 17 bp, Homo sapiens
cgtttccttacacattt

SEQ ID NO: 4561201 - DNA, 18 bp, Homo sapiens
cgtttggtgcttctcaga

SEQ ID NO: 4561202 - DNA, 19 bp, Homo sapiens
cgtttggttaaagtatgtc

SEQ ID NO: 4561203 - DNA, 15 bp, Homo sapiens
cgttttacaagaaaa

SEQ ID NO: 4561204 - DNA, 20 bp, Homo sapiens
cgttttgaagctactgtgtg

SEQ ID NO: 4561205 - DNA, 14 bp, Homo sapiens
cgttttgtattgct

SEQ ID NO: 4561206 - DNA, 18 bp, Homo sapiens
cgttttgtattgcttcct

SEQ ID NO: 4561207 - DNA, 11 bp, Homo sapiens
cgttttgtcac

SEQ ID NO: 4561208 - DNA, 13 bp, Homo sapiens
cgtttttgtgctg

SEQ ID NO: 4561209 - DNA, 17 bp, Homo sapiens
cgttttttaaatgtata

SEQ ID NO: 4561210 - DNA, 11 bp, Homo sapiens
ctaaaaacata

SEQ ID NO: 4561211 - DNA, 13 bp, Homo sapiens
ctaaaaacatttg

SEQ ID NO: 4561212 - DNA, 15 bp, Homo sapiens
ctaaaaagatgtaat

SEQ ID NO: 4561213 - DNA, 18 bp, Homo sapiens
ctaaaaagtcagatgttt

SEQ ID NO: 4561214 - DNA, 15 bp, Homo sapiens
ctaaaaatgaaaatt

SEQ ID NO: 4561215 - DNA, 12 bp, Homo sapiens
ctaaaaatgaac

SEQ ID NO: 4561216 - DNA, 23 bp, Homo sapiens
ctaaaaatgagcttgattaaatc

SEQ ID NO: 4561217 - DNA, 14 bp, Homo sapiens
ctaaaagaaacttt

SEQ ID NO: 4561218 - DNA, 17 bp, Homo sapiens
ctaaaagacatgcattt

SEQ ID NO: 4561219 - DNA, 23 bp, Homo sapiens
ctaaaagacatgcatttttaaaa

SEQ ID NO: 4561220 - DNA, 16 bp, Homo sapiens
ctaaaagcatgtatag

SEQ ID NO: 4561221 - DNA, 12 bp, Homo sapiens
ctaaaagttcat

SEQ ID NO: 4561222 - DNA, 23 bp, Homo sapiens
ctaaaagttcataacagtgccat

SEQ ID NO: 4561223 - DNA, 12 bp, Homo sapiens
ctaaaatatata

SEQ ID NO: 4561224 - DNA, 21 bp, Homo sapiens
ctaaaatatataatatactaa

SEQ ID NO: 4561225 - DNA, 13 bp, Homo sapiens
ctaaaatgtatct

SEQ ID NO: 4561226 - DNA, 13 bp, Homo sapiens
ctaaaatgtttta

SEQ ID NO: 4561227 - DNA, 21 bp, Homo sapiens
ctaaaatgttttatgacattt

SEQ ID NO: 4561228 - DNA, 19 bp, Homo sapiens
ctaaaattgagttcttcct

SEQ ID NO: 4561229 - DNA, 15 bp, Homo sapiens
ctaaaatttacacat

SEQ ID NO: 4561230 - DNA, 16 bp, Homo sapiens
ctaaacagacaggaat

SEQ ID NO: 4561231 - DNA, 14 bp, Homo sapiens
ctaaaccaaaaatt

SEQ ID NO: 4561232 - DNA, 16 bp, Homo sapiens
ctaaaccaactctaat

SEQ ID NO: 4561233 - DNA, 20 bp, Homo sapiens
ctaaaccaagattatgtgac

SEQ ID NO: 4561234 - DNA, 15 bp, Homo sapiens
ctaaacggattccaa

SEQ ID NO: 4561235 - DNA, 17 bp, Homo sapiens
ctaaactctctagctta

SEQ ID NO: 4561236 - DNA, 19 bp, Homo sapiens
ctaaactgaatctatggct

SEQ ID NO: 4561237 - DNA, 16 bp, Homo sapiens
ctaaacttccccatct

SEQ ID NO: 4561238 - DNA, 20 bp, Homo sapiens
ctaaacttggtgcttattga

SEQ ID NO: 4561239 - DNA, 15 bp, Homo sapiens
ctaaactttttttct

SEQ ID NO: 4561240 - DNA, 20 bp, Homo sapiens
ctaaagaaaaacaaactcgt

SEQ ID NO: 4561241 - DNA, 21 bp, Homo sapiens
ctaaagaaaaatatcttggcc

SEQ ID NO: 4561242 - DNA, 18 bp, Homo sapiens
ctaaagactaacttgaaa

SEQ ID NO: 4561243 - DNA, 19 bp, Homo sapiens
ctaaagagcccttgcctcc

SEQ ID NO: 4561244 - DNA, 22 bp, Homo sapiens
ctaaagagttattcaaatgaag

SEQ ID NO: 4561245 - DNA, 18 bp, Homo sapiens
ctaaagctggtttaatgt

SEQ ID NO: 4561246 - DNA, 16 bp, Homo sapiens
ctaaaggatccagaga

SEQ ID NO: 4561247 - DNA, 13 bp, Homo sapiens
ctaaagtaaaatt

SEQ ID NO: 4561248 - DNA, 19 bp, Homo sapiens
ctaaagtacagcctggacc

SEQ ID NO: 4561249 - DNA, 19 bp, Homo sapiens
ctaaagtccagactatgga

SEQ ID NO: 4561250 - DNA, 11 bp, Homo sapiens
ctaaagttata

SEQ ID NO: 4561251 - DNA, 16 bp, Homo sapiens
ctaaagttatatttca

SEQ ID NO: 4561252 - DNA, 22 bp, Homo sapiens
ctaaagttatatttcagatgta

SEQ ID NO: 4561253 - DNA, 20 bp, Homo sapiens
ctaaataaacacgattttat

SEQ ID NO: 4561254 - DNA, 16 bp, Homo sapiens
ctaaataaagatattg

SEQ ID NO: 4561255 - DNA, 16 bp, Homo sapiens
ctaaataacacagata

SEQ ID NO: 4561256 - DNA, 22 bp, Homo sapiens
ctaaatactgactgctggacat

SEQ ID NO: 4561257 - DNA, 14 bp, Homo sapiens
ctaaatagtatttt

SEQ ID NO: 4561258 - DNA, 21 bp, Homo sapiens
ctaaatatgaaccctttgttt

SEQ ID NO: 4561259 - DNA, 14 bp, Homo sapiens
ctaaatattgcttc

SEQ ID NO: 4561260 - DNA, 17 bp, Homo sapiens
ctaaatctccagtactt

SEQ ID NO: 4561261 - DNA, 17 bp, Homo sapiens
ctaaatctcctattttt

SEQ ID NO: 4561262 - DNA, 20 bp, Homo sapiens
ctaaatcttttataggattt

SEQ ID NO: 4561263 - DNA, 11 bp, Homo sapiens
ctaaatgcaat

SEQ ID NO: 4561264 - DNA, 23 bp, Homo sapiens
ctaaattatttactgcaaaaaga

SEQ ID NO: 4561265 - DNA, 19 bp, Homo sapiens
ctaaattgacacttaaaaa

SEQ ID NO: 4561266 - DNA, 23 bp, Homo sapiens
ctaaattgacacttaaaaatggt

SEQ ID NO: 4561267 - DNA, 16 bp, Homo sapiens
ctaaattgtctgccat

SEQ ID NO: 4561268 - DNA, 15 bp, Homo sapiens
ctaaatttttcatag

SEQ ID NO: 4561269 - DNA, 22 bp, Homo sapiens
ctaacaatcagctccttcctgg

SEQ ID NO: 4561270 - DNA, 19 bp, Homo sapiens
ctaacagggagaagtagct

SEQ ID NO: 4561271 - DNA, 15 bp, Homo sapiens
ctaacatgttatcaa

SEQ ID NO: 4561272 - DNA, 16 bp, Homo sapiens
ctaaccatccccaact

SEQ ID NO: 4561273 - DNA, 19 bp, Homo sapiens
ctaaccatccccaactcca

SEQ ID NO: 4561274 - DNA, 13 bp, Homo sapiens
ctaaccatttata

SEQ ID NO: 4561275 - DNA, 16 bp, Homo sapiens
ctaaccccaggccccg

SEQ ID NO: 4561276 - DNA, 21 bp, Homo sapiens
ctaaccccagggcactgccag

SEQ ID NO: 4561277 - DNA, 19 bp, Homo sapiens
ctaacccccagcccacaga

SEQ ID NO: 4561278 - DNA, 16 bp, Homo sapiens
ctaaccccgggcgggt

SEQ ID NO: 4561279 - DNA, 16 bp, Homo sapiens
ctaacccctttcctgc

SEQ ID NO: 4561280 - DNA, 20 bp, Homo sapiens
ctaaccctcccatggcacct

SEQ ID NO: 4561281 - DNA, 17 bp, Homo sapiens
ctaacccttaaaaatgc

SEQ ID NO: 4561282 - DNA, 18 bp, Homo sapiens
ctaacctccaacacagtg

SEQ ID NO: 4561283 - DNA, 17 bp, Homo sapiens
ctaacctcgggcctgct

SEQ ID NO: 4561284 - DNA, 11 bp, Homo sapiens
ctaacctgacc

SEQ ID NO: 4561285 - DNA, 19 bp, Homo sapiens
ctaacctgccgagagtcca

SEQ ID NO: 4561286 - DNA, 15 bp, Homo sapiens
ctaaccttatcctgc

SEQ ID NO: 4561287 - DNA, 22 bp, Homo sapiens
ctaaccttatcctgcattgtta

SEQ ID NO: 4561288 - DNA, 20 bp, Homo sapiens
ctaacgaagtatccttcagc

SEQ ID NO: 4561289 - DNA, 15 bp, Homo sapiens
ctaactgcatacact

SEQ ID NO: 4561290 - DNA, 19 bp, Homo sapiens
ctaactgggaggacattct

SEQ ID NO: 4561291 - DNA, 15 bp, Homo sapiens
ctaactgtatatttg

SEQ ID NO: 4561292 - DNA, 16 bp, Homo sapiens
ctaactgtatatttgt

SEQ ID NO: 4561293 - DNA, 19 bp, Homo sapiens
ctaactgtatatttgtatg

SEQ ID NO: 4561294 - DNA, 12 bp, Homo sapiens
ctaactgtgatt

SEQ ID NO: 4561295 - DNA, 13 bp, Homo sapiens
ctaactgtgattt

SEQ ID NO: 4561296 - DNA, 18 bp, Homo sapiens
ctaacttaaaaaactgca

SEQ ID NO: 4561297 - DNA, 14 bp, Homo sapiens
ctaactttggtttt

SEQ ID NO: 4561298 - DNA, 14 bp, Homo sapiens
ctaagaaaaaggaa

SEQ ID NO: 4561299 - DNA, 19 bp, Homo sapiens
ctaagaaatatctgtgaaa

SEQ ID NO: 4561300 - DNA, 21 bp, Homo sapiens
ctaagaaatatctgtgaaata

SEQ ID NO: 4561301 - DNA, 17 bp, Homo sapiens
ctaagaacccatggaaa

SEQ ID NO: 4561302 - DNA, 17 bp, Homo sapiens
ctaagaagacattttgt

SEQ ID NO: 4561303 - DNA, 18 bp, Homo sapiens
ctaagaagacattttgtt

SEQ ID NO: 4561304 - DNA, 20 bp, Homo sapiens
ctaagaagacattttgttac

SEQ ID NO: 4561305 - DNA, 13 bp, Homo sapiens
ctaagaatttttc

SEQ ID NO: 4561306 - DNA, 13 bp, Homo sapiens
ctaagacattttt

SEQ ID NO: 4561307 - DNA, 19 bp, Homo sapiens
ctaagagaagtagaaatca

SEQ ID NO: 4561308 - DNA, 11 bp, Homo sapiens
ctaagagccat

SEQ ID NO: 4561309 - DNA, 18 bp, Homo sapiens
ctaagagctagcgctgcc

SEQ ID NO: 4561310 - DNA, 20 bp, Homo sapiens
ctaagagggcccaaagaatt

SEQ ID NO: 4561311 - DNA, 18 bp, Homo sapiens
ctaagatacactgcactt

SEQ ID NO: 4561312 - DNA, 21 bp, Homo sapiens
ctaagattcttttaaattaga

SEQ ID NO: 4561313 - DNA, 23 bp, Homo sapiens
ctaagattcttttaaattagaaa

SEQ ID NO: 4561314 - DNA, 14 bp, Homo sapiens
ctaagcaaaatgtg

SEQ ID NO: 4561315 - DNA, 15 bp, Homo sapiens
ctaagcaagctaacc

SEQ ID NO: 4561316 - DNA, 23 bp, Homo sapiens
ctaagcagttatggtgatgactt

SEQ ID NO: 4561317 - DNA, 15 bp, Homo sapiens
ctaagcattgcctgg

SEQ ID NO: 4561318 - DNA, 13 bp, Homo sapiens
ctaagccaggcct

SEQ ID NO: 4561319 - DNA, 18 bp, Homo sapiens
ctaagccaggcctggctg

SEQ ID NO: 4561320 - DNA, 17 bp, Homo sapiens
ctaagcctacctgctct

SEQ ID NO: 4561321 - DNA, 15 bp, Homo sapiens
ctaaggaaccttcct

SEQ ID NO: 4561322 - DNA, 13 bp, Homo sapiens
ctaaggagcatga

SEQ ID NO: 4561323 - DNA, 23 bp, Homo sapiens
ctaaggaggggaaaaaaatgttg

SEQ ID NO: 4561324 - DNA, 20 bp, Homo sapiens
ctaaggatttttcaagagat

SEQ ID NO: 4561325 - DNA, 19 bp, Homo sapiens
ctaaggcaggaggatcact

SEQ ID NO: 4561326 - DNA, 22 bp, Homo sapiens
ctaaggccgtgtctctgaggac

SEQ ID NO: 4561327 - DNA, 21 bp, Homo sapiens
ctaaggccttttatgtaattt

SEQ ID NO: 4561328 - DNA, 22 bp, Homo sapiens
ctaaggccttttatgtaatttc

SEQ ID NO: 4561329 - DNA, 16 bp, Homo sapiens
ctaaggctcctccttg

SEQ ID NO: 4561330 - DNA, 16 bp, Homo sapiens
ctaaggctcctgtttt

SEQ ID NO: 4561331 - DNA, 15 bp, Homo sapiens
ctaaggcttttattt

SEQ ID NO: 4561332 - DNA, 22 bp, Homo sapiens
ctaaggtggacagcagacaaga

SEQ ID NO: 4561333 - DNA, 14 bp, Homo sapiens
ctaagtaaaaccac

SEQ ID NO: 4561334 - DNA, 19 bp, Homo sapiens
ctaagtaaaaccacagcag

SEQ ID NO: 4561335 - DNA, 17 bp, Homo sapiens
ctaagtaaataggaatt

SEQ ID NO: 4561336 - DNA, 15 bp, Homo sapiens
ctaagtaatttagaa

SEQ ID NO: 4561337 - DNA, 14 bp, Homo sapiens
ctaagtcattcata

SEQ ID NO: 4561338 - DNA, 16 bp, Homo sapiens
ctaagtctttccattg

SEQ ID NO: 4561339 - DNA, 15 bp, Homo sapiens
ctaagtggctgcctt

SEQ ID NO: 4561340 - DNA, 12 bp, Homo sapiens
ctaagtgggaga

SEQ ID NO: 4561341 - DNA, 16 bp, Homo sapiens
ctaagttattttgtac

SEQ ID NO: 4561342 - DNA, 23 bp, Homo sapiens
ctaagtttagaagcgctcatctg

SEQ ID NO: 4561343 - DNA, 11 bp, Homo sapiens
ctaataaagag

SEQ ID NO: 4561344 - DNA, 20 bp, Homo sapiens
ctaatagaataaaggcagtt

SEQ ID NO: 4561345 - DNA, 21 bp, Homo sapiens
ctaatagaataaaggcagttt

SEQ ID NO: 4561346 - DNA, 23 bp, Homo sapiens
ctaatagaataaaggcagttttc

SEQ ID NO: 4561347 - DNA, 22 bp, Homo sapiens
ctaatataagtttctttgcttc

SEQ ID NO: 4561348 - DNA, 13 bp, Homo sapiens
ctaatatatgaaa

SEQ ID NO: 4561349 - DNA, 14 bp, Homo sapiens
ctaatatatgaaat

SEQ ID NO: 4561350 - DNA, 16 bp, Homo sapiens
ctaatatatttaaaaa

SEQ ID NO: 4561351 - DNA, 22 bp, Homo sapiens
ctaatatccccaaattagggca

SEQ ID NO: 4561352 - DNA, 14 bp, Homo sapiens
ctaatatgattata

SEQ ID NO: 4561353 - DNA, 12 bp, Homo sapiens
ctaatattgctt

SEQ ID NO: 4561354 - DNA, 23 bp, Homo sapiens
ctaatattgcttcttgtgtttta

SEQ ID NO: 4561355 - DNA, 14 bp, Homo sapiens
ctaatccttttcct

SEQ ID NO: 4561356 - DNA, 16 bp, Homo sapiens
ctaatccttttcctta

SEQ ID NO: 4561357 - DNA, 17 bp, Homo sapiens
ctaatccttttccttat

SEQ ID NO: 4561358 - DNA, 17 bp, Homo sapiens
ctaatctaacaatggaa

SEQ ID NO: 4561359 - DNA, 22 bp, Homo sapiens
ctaatctatatgatatgcagcc

SEQ ID NO: 4561360 - DNA, 14 bp, Homo sapiens
ctaatctgaactga

SEQ ID NO: 4561361 - DNA, 18 bp, Homo sapiens
ctaatgaagtattacatg

SEQ ID NO: 4561362 - DNA, 18 bp, Homo sapiens
ctaatgaggagagaaaat

SEQ ID NO: 4561363 - DNA, 20 bp, Homo sapiens
ctaatgaggagagaaaatat

SEQ ID NO: 4561364 - DNA, 21 bp, Homo sapiens
ctaatgaggagagaaaatata

SEQ ID NO: 4561365 - DNA, 23 bp, Homo sapiens
ctaatggttgggttgattgtatg

SEQ ID NO: 4561366 - DNA, 13 bp, Homo sapiens
ctaatgtcacaac

SEQ ID NO: 4561367 - DNA, 19 bp, Homo sapiens
ctaatgtcacaacatggtg

SEQ ID NO: 4561368 - DNA, 23 bp, Homo sapiens
ctaatgtcacaacatggtgctac

SEQ ID NO: 4561369 - DNA, 23 bp, Homo sapiens
ctaatgtgcagggatattgcctt

SEQ ID NO: 4561370 - DNA, 18 bp, Homo sapiens
ctaatgttgctggatcag

SEQ ID NO: 4561371 - DNA, 13 bp, Homo sapiens
ctaatgtttacta

SEQ ID NO: 4561372 - DNA, 14 bp, Homo sapiens
ctaatgtttactat

SEQ ID NO: 4561373 - DNA, 14 bp, Homo sapiens
ctaattaaaattgt

SEQ ID NO: 4561374 - DNA, 17 bp, Homo sapiens
ctaattaaaattgtgca

SEQ ID NO: 4561375 - DNA, 22 bp, Homo sapiens
ctaattaatagccaaagatttc

SEQ ID NO: 4561376 - DNA, 15 bp, Homo sapiens
ctaattaatatatta

SEQ ID NO: 4561377 - DNA, 23 bp, Homo sapiens
ctaattaatatattaaaattcca

SEQ ID NO: 4561378 - DNA, 18 bp, Homo sapiens
ctaattatactactttgt

SEQ ID NO: 4561379 - DNA, 21 bp, Homo sapiens
ctaattatactactttgttag

SEQ ID NO: 4561380 - DNA, 23 bp, Homo sapiens
ctaattattattttaaaatatat

SEQ ID NO: 4561381 - DNA, 16 bp, Homo sapiens
ctaattcaaggaattt

SEQ ID NO: 4561382 - DNA, 22 bp, Homo sapiens
ctaattcacagtgctcttttct

SEQ ID NO: 4561383 - DNA, 21 bp, Homo sapiens
ctaattcccaacatttcttaa

SEQ ID NO: 4561384 - DNA, 21 bp, Homo sapiens
ctaattctttgacctgttggg

SEQ ID NO: 4561385 - DNA, 22 bp, Homo sapiens
ctaattctttgacctgttggga

SEQ ID NO: 4561386 - DNA, 12 bp, Homo sapiens
ctaattgacttt

SEQ ID NO: 4561387 - DNA, 13 bp, Homo sapiens
ctaattgacttta

SEQ ID NO: 4561388 - DNA, 20 bp, Homo sapiens
ctaattgactttagaaagct

SEQ ID NO: 4561389 - DNA, 14 bp, Homo sapiens
ctaatttataaaaa

SEQ ID NO: 4561390 - DNA, 15 bp, Homo sapiens
ctaatttatgtgcta

SEQ ID NO: 4561391 - DNA, 17 bp, Homo sapiens
ctaatttcaaaatgctt

SEQ ID NO: 4561392 - DNA, 20 bp, Homo sapiens
ctaatttctcctcccttcct

SEQ ID NO: 4561393 - DNA, 22 bp, Homo sapiens
ctaatttgcattaaattcacaa

SEQ ID NO: 4561394 - DNA, 19 bp, Homo sapiens
ctaatttgttttggatata

SEQ ID NO: 4561395 - DNA, 19 bp, Homo sapiens
ctaattttacatgtttata

SEQ ID NO: 4561396 - DNA, 20 bp, Homo sapiens
ctaattttacatgtttataa

SEQ ID NO: 4561397 - DNA, 14 bp, Homo sapiens
ctaatttttgtaat

SEQ ID NO: 4561398 - DNA, 20 bp, Homo sapiens
ctaatttttgtaattttagt

SEQ ID NO: 4561399 - DNA, 18 bp, Homo sapiens
ctaatttttgtattattt

SEQ ID NO: 4561400 - DNA, 16 bp, Homo sapiens
ctaatttttgtatttt

SEQ ID NO: 4561401 - DNA, 15 bp, Homo sapiens
ctacaaaaacacagc

SEQ ID NO: 4561402 - DNA, 18 bp, Homo sapiens
ctacaaacgtttgacaaa

SEQ ID NO: 4561403 - DNA, 16 bp, Homo sapiens
ctacaaacttttaaga

SEQ ID NO: 4561404 - DNA, 20 bp, Homo sapiens
ctacaaacttttaagatttc

SEQ ID NO: 4561405 - DNA, 17 bp, Homo sapiens
ctacaaagaaaaattaa

SEQ ID NO: 4561406 - DNA, 14 bp, Homo sapiens
ctacaaatcagtaa

SEQ ID NO: 4561407 - DNA, 15 bp, Homo sapiens
ctacaagagcagcct

SEQ ID NO: 4561408 - DNA, 19 bp, Homo sapiens
ctacaagagcagcctgtgg

SEQ ID NO: 4561409 - DNA, 12 bp, Homo sapiens
ctacaaggccta

SEQ ID NO: 4561410 - DNA, 14 bp, Homo sapiens
ctacaatattctct

SEQ ID NO: 4561411 - DNA, 16 bp, Homo sapiens
ctacaattcattgtgt

SEQ ID NO: 4561412 - DNA, 14 bp, Homo sapiens
ctacacaatacagt

SEQ ID NO: 4561413 - DNA, 14 bp, Homo sapiens
ctacacactcagcc

SEQ ID NO: 4561414 - DNA, 23 bp, Homo sapiens
ctacacattgctacctcagtgct

SEQ ID NO: 4561415 - DNA, 14 bp, Homo sapiens
ctacaccaatgaaa

SEQ ID NO: 4561416 - DNA, 15 bp, Homo sapiens
ctacacctggctgag

SEQ ID NO: 4561417 - DNA, 12 bp, Homo sapiens
ctacactctcct

SEQ ID NO: 4561418 - DNA, 16 bp, Homo sapiens
ctacactctcctgggc

SEQ ID NO: 4561419 - DNA, 23 bp, Homo sapiens
ctacactctcctgggcccctccc

SEQ ID NO: 4561420 - DNA, 17 bp, Homo sapiens
ctacagaatattaaata

SEQ ID NO: 4561421 - DNA, 16 bp, Homo sapiens
ctacagactccatctc

SEQ ID NO: 4561422 - DNA, 23 bp, Homo sapiens
ctacagactccatctcttctgca

SEQ ID NO: 4561423 - DNA, 18 bp, Homo sapiens
ctacagagcttccctgac

SEQ ID NO: 4561424 - DNA, 20 bp, Homo sapiens
ctacagcactactgggtgtc

SEQ ID NO: 4561425 - DNA, 16 bp, Homo sapiens
ctacagctatatttga

SEQ ID NO: 4561426 - DNA, 14 bp, Homo sapiens
ctacagctccacac

SEQ ID NO: 4561427 - DNA, 18 bp, Homo sapiens
ctacaggaagcaccccat

SEQ ID NO: 4561428 - DNA, 17 bp, Homo sapiens
ctacaggcagtctctct

SEQ ID NO: 4561429 - DNA, 18 bp, Homo sapiens
ctacaggcctatttaaca

SEQ ID NO: 4561430 - DNA, 12 bp, Homo sapiens
ctacagggccaa

SEQ ID NO: 4561431 - DNA, 22 bp, Homo sapiens
ctacaggtgaaggctctcaccc

SEQ ID NO: 4561432 - DNA, 22 bp, Homo sapiens
ctacaggtgcgcgccaccgtgc

SEQ ID NO: 4561433 - DNA, 23 bp, Homo sapiens
ctacaggtgcgcgccaccgtgcc

SEQ ID NO: 4561434 - DNA, 14 bp, Homo sapiens
ctacagtaatgaaa

SEQ ID NO: 4561435 - DNA, 15 bp, Homo sapiens
ctacagtaatgaaat

SEQ ID NO: 4561436 - DNA, 16 bp, Homo sapiens
ctacagtaatgaaatg

SEQ ID NO: 4561437 - DNA, 13 bp, Homo sapiens
ctacagtgtacag

SEQ ID NO: 4561438 - DNA, 14 bp, Homo sapiens
ctacagtttttcct

SEQ ID NO: 4561439 - DNA, 15 bp, Homo sapiens
ctacataatttagtt

SEQ ID NO: 4561440 - DNA, 23 bp, Homo sapiens
ctacatactttcatcctgactct

SEQ ID NO: 4561441 - DNA, 17 bp, Homo sapiens
ctacatgatgctaaagg

SEQ ID NO: 4561442 - DNA, 21 bp, Homo sapiens
ctacatgcagcccatgcccac

SEQ ID NO: 4561443 - DNA, 23 bp, Homo sapiens
ctacatggttgaaaccccatctc

SEQ ID NO: 4561444 - DNA, 19 bp, Homo sapiens
ctacatgtgagatagtttt

SEQ ID NO: 4561445 - DNA, 21 bp, Homo sapiens
ctacatgtgagatagttttca

SEQ ID NO: 4561446 - DNA, 23 bp, Homo sapiens
ctacatgtgagatagttttcatt

SEQ ID NO: 4561447 - DNA, 19 bp, Homo sapiens
ctacattataataaaattt

SEQ ID NO: 4561448 - DNA, 13 bp, Homo sapiens
ctacattcttggt

SEQ ID NO: 4561449 - DNA, 22 bp, Homo sapiens
ctacattgagtagacacattta

SEQ ID NO: 4561450 - DNA, 21 bp, Homo sapiens
ctaccactgtggccccaagag

SEQ ID NO: 4561451 - DNA, 23 bp, Homo sapiens
ctaccactgtggccccaagaggg

SEQ ID NO: 4561452 - DNA, 12 bp, Homo sapiens
ctaccagccagc

SEQ ID NO: 4561453 - DNA, 18 bp, Homo sapiens
ctaccagccagcctcaga

SEQ ID NO: 4561454 - DNA, 15 bp, Homo sapiens
ctaccaggacagaac

SEQ ID NO: 4561455 - DNA, 17 bp, Homo sapiens
ctaccaggacagaactt

SEQ ID NO: 4561456 - DNA, 19 bp, Homo sapiens
ctaccatggttctgcctcc

SEQ ID NO: 4561457 - DNA, 20 bp, Homo sapiens
ctaccatggttctgcctcct

SEQ ID NO: 4561458 - DNA, 22 bp, Homo sapiens
ctaccatggttctgcctcctgg

SEQ ID NO: 4561459 - DNA, 16 bp, Homo sapiens
ctacccacacctctgc

SEQ ID NO: 4561460 - DNA, 21 bp, Homo sapiens
ctacccagagaagccccttcc

SEQ ID NO: 4561461 - DNA, 19 bp, Homo sapiens
ctacccagatggaaaaata

SEQ ID NO: 4561462 - DNA, 18 bp, Homo sapiens
ctacccagttgcctccag

SEQ ID NO: 4561463 - DNA, 19 bp, Homo sapiens
ctacccagttgcctccagg

SEQ ID NO: 4561464 - DNA, 15 bp, Homo sapiens
ctaccccaaggccag

SEQ ID NO: 4561465 - DNA, 16 bp, Homo sapiens
ctaccccaaggccagt

SEQ ID NO: 4561466 - DNA, 16 bp, Homo sapiens
ctaccccagttcctag

SEQ ID NO: 4561467 - DNA, 18 bp, Homo sapiens
ctaccccagttcctagca

SEQ ID NO: 4561468 - DNA, 18 bp, Homo sapiens
ctaccccccctcctgctg

SEQ ID NO: 4561469 - DNA, 21 bp, Homo sapiens
ctaccccccctcctgctgcct

SEQ ID NO: 4561470 - DNA, 13 bp, Homo sapiens
ctaccccctgtgc

SEQ ID NO: 4561471 - DNA, 23 bp, Homo sapiens
ctacccctgctcccattcctccc

SEQ ID NO: 4561472 - DNA, 14 bp, Homo sapiens
ctacccgctgtggc

SEQ ID NO: 4561473 - DNA, 13 bp, Homo sapiens
ctaccctcccacc

SEQ ID NO: 4561474 - DNA, 20 bp, Homo sapiens
ctaccctgagatctgcacag

SEQ ID NO: 4561475 - DNA, 12 bp, Homo sapiens
ctaccctgagct

SEQ ID NO: 4561476 - DNA, 13 bp, Homo sapiens
ctaccctggactt

SEQ ID NO: 4561477 - DNA, 14 bp, Homo sapiens
ctaccctgtgtata

SEQ ID NO: 4561478 - DNA, 21 bp, Homo sapiens
ctacctacatgctgaaaaata

SEQ ID NO: 4561479 - DNA, 18 bp, Homo sapiens
ctacctcaacctgtaaat

SEQ ID NO: 4561480 - DNA, 21 bp, Homo sapiens
ctacctcaacctgtaaattat

SEQ ID NO: 4561481 - DNA, 22 bp, Homo sapiens
ctacctcagtgctcctggaaac

SEQ ID NO: 4561482 - DNA, 16 bp, Homo sapiens
ctacctgagcattcag

SEQ ID NO: 4561483 - DNA, 14 bp, Homo sapiens
ctacctgagctaaa

SEQ ID NO: 4561484 - DNA, 15 bp, Homo sapiens
ctacctgaggccagg

SEQ ID NO: 4561485 - DNA, 20 bp, Homo sapiens
ctacctgattggtgcaaccc

SEQ ID NO: 4561486 - DNA, 19 bp, Homo sapiens
ctacctgccactcacacag

SEQ ID NO: 4561487 - DNA, 22 bp, Homo sapiens
ctacctgccactcacacagcca

SEQ ID NO: 4561488 - DNA, 12 bp, Homo sapiens
ctacctgctctc

SEQ ID NO: 4561489 - DNA, 18 bp, Homo sapiens
ctacctgtgtttttttct

SEQ ID NO: 4561490 - DNA, 21 bp, Homo sapiens
ctacctgtgtttttttctaaa

SEQ ID NO: 4561491 - DNA, 12 bp, Homo sapiens
ctaccttcctgt

SEQ ID NO: 4561492 - DNA, 16 bp, Homo sapiens
ctaccttttaaaattg

SEQ ID NO: 4561493 - DNA, 15 bp, Homo sapiens
ctacgccaatcaagg

SEQ ID NO: 4561494 - DNA, 22 bp, Homo sapiens
ctacgtttccccaataaagcct

SEQ ID NO: 4561495 - DNA, 23 bp, Homo sapiens
ctactaacaatcagctccttcct

SEQ ID NO: 4561496 - DNA, 14 bp, Homo sapiens
ctactaaggccttt

SEQ ID NO: 4561497 - DNA, 20 bp, Homo sapiens
ctactacattccaaagaaac

SEQ ID NO: 4561498 - DNA, 18 bp, Homo sapiens
ctactaggagaggggggc

SEQ ID NO: 4561499 - DNA, 12 bp, Homo sapiens
ctactataatca

SEQ ID NO: 4561500 - DNA, 19 bp, Homo sapiens
ctactatttttctttccaa

SEQ ID NO: 4561501 - DNA, 19 bp, Homo sapiens
ctactcagcagccctcctc

SEQ ID NO: 4561502 - DNA, 20 bp, Homo sapiens
ctactcagcagccctcctca

SEQ ID NO: 4561503 - DNA, 13 bp, Homo sapiens
ctactcaggaggc

SEQ ID NO: 4561504 - DNA, 16 bp, Homo sapiens
ctactcaggaggctga

SEQ ID NO: 4561505 - DNA, 21 bp, Homo sapiens
ctactcaggaggctgagacag

SEQ ID NO: 4561506 - DNA, 23 bp, Homo sapiens
ctactcaggaggctgaggcagaa

SEQ ID NO: 4561507 - DNA, 14 bp, Homo sapiens
ctactcccctgggc

SEQ ID NO: 4561508 - DNA, 14 bp, Homo sapiens
ctactcctagaaga

SEQ ID NO: 4561509 - DNA, 15 bp, Homo sapiens
ctactcctctgcagt

SEQ ID NO: 4561510 - DNA, 20 bp, Homo sapiens
ctactcctctgcagtgcctt

SEQ ID NO: 4561511 - DNA, 19 bp, Homo sapiens
ctactcgatagcctgaggt

SEQ ID NO: 4561512 - DNA, 19 bp, Homo sapiens
ctactctaccatggttctg

SEQ ID NO: 4561513 - DNA, 20 bp, Homo sapiens
ctactctagatggcaacatt

SEQ ID NO: 4561514 - DNA, 19 bp, Homo sapiens
ctactctccccacgagggc

SEQ ID NO: 4561515 - DNA, 22 bp, Homo sapiens
ctactctggaggtttgtttaga

SEQ ID NO: 4561516 - DNA, 14 bp, Homo sapiens
ctactctgtgccag

SEQ ID NO: 4561517 - DNA, 20 bp, Homo sapiens
ctactcttaaatgagaaagg

SEQ ID NO: 4561518 - DNA, 15 bp, Homo sapiens
ctactgaatgtcatt

SEQ ID NO: 4561519 - DNA, 14 bp, Homo sapiens
ctactgacagggag

SEQ ID NO: 4561520 - DNA, 16 bp, Homo sapiens
ctactgacagggagca

SEQ ID NO: 4561521 - DNA, 17 bp, Homo sapiens
ctactgagtaaacccta

SEQ ID NO: 4561522 - DNA, 16 bp, Homo sapiens
ctactgattgaatgtt

SEQ ID NO: 4561523 - DNA, 20 bp, Homo sapiens
ctactgcactccagcctggg

SEQ ID NO: 4561524 - DNA, 21 bp, Homo sapiens
ctactgcactccagcctgggg

SEQ ID NO: 4561525 - DNA, 23 bp, Homo sapiens
ctactgcactccagcctggggga

SEQ ID NO: 4561526 - DNA, 14 bp, Homo sapiens
ctactgcatttata

SEQ ID NO: 4561527 - DNA, 20 bp, Homo sapiens
ctactgccatcctggcccag

SEQ ID NO: 4561528 - DNA, 11 bp, Homo sapiens
ctactgccttt

SEQ ID NO: 4561529 - DNA, 15 bp, Homo sapiens
ctactgcctttagaa

SEQ ID NO: 4561530 - DNA, 16 bp, Homo sapiens
ctactgcctttagaaa

SEQ ID NO: 4561531 - DNA, 15 bp, Homo sapiens
ctactgctcagcttc

SEQ ID NO: 4561532 - DNA, 22 bp, Homo sapiens
ctactggaatggtgttttgtca

SEQ ID NO: 4561533 - DNA, 14 bp, Homo sapiens
ctactggattctta

SEQ ID NO: 4561534 - DNA, 20 bp, Homo sapiens
ctactggggaggctgaggca

SEQ ID NO: 4561535 - DNA, 15 bp, Homo sapiens
ctactgtactattta

SEQ ID NO: 4561536 - DNA, 17 bp, Homo sapiens
ctactgtgtgtgtgaat

SEQ ID NO: 4561537 - DNA, 15 bp, Homo sapiens
ctacttaaaaaaaat

SEQ ID NO: 4561538 - DNA, 13 bp, Homo sapiens
ctacttaatgctt

SEQ ID NO: 4561539 - DNA, 13 bp, Homo sapiens
ctacttccaggat

SEQ ID NO: 4561540 - DNA, 18 bp, Homo sapiens
ctacttctgtaattgtgt

SEQ ID NO: 4561541 - DNA, 15 bp, Homo sapiens
ctacttgggaggctg

SEQ ID NO: 4561542 - DNA, 20 bp, Homo sapiens
ctacttgggaggctgaggca

SEQ ID NO: 4561543 - DNA, 14 bp, Homo sapiens
ctacttgtttaaca

SEQ ID NO: 4561544 - DNA, 14 bp, Homo sapiens
ctactttataacta

SEQ ID NO: 4561545 - DNA, 19 bp, Homo sapiens
ctactttataactaacatg

SEQ ID NO: 4561546 - DNA, 22 bp, Homo sapiens
ctactttcatcttaaactaata

SEQ ID NO: 4561547 - DNA, 19 bp, Homo sapiens
ctactttgactttttgcat

SEQ ID NO: 4561548 - DNA, 22 bp, Homo sapiens
ctacttttgttccacattctct

SEQ ID NO: 4561549 - DNA, 21 bp, Homo sapiens
ctagaaagcatccattaatta

SEQ ID NO: 4561550 - DNA, 17 bp, Homo sapiens
ctagaacctagaagggc

SEQ ID NO: 4561551 - DNA, 14 bp, Homo sapiens
ctagaacctggagg

SEQ ID NO: 4561552 - DNA, 20 bp, Homo sapiens
ctagaagaaccaaatacctc

SEQ ID NO: 4561553 - DNA, 20 bp, Homo sapiens
ctagaagccaagggaaaggg

SEQ ID NO: 4561554 - DNA, 20 bp, Homo sapiens
ctagaagggccagtcctgcc

SEQ ID NO: 4561555 - DNA, 20 bp, Homo sapiens
ctagaagtcttaattgtgtt

SEQ ID NO: 4561556 - DNA, 20 bp, Homo sapiens
ctagaagtgggccaggacag

SEQ ID NO: 4561557 - DNA, 21 bp, Homo sapiens
ctagaagtgggccaggacagg

SEQ ID NO: 4561558 - DNA, 22 bp, Homo sapiens
ctagaatgtaaagttatgtatt

SEQ ID NO: 4561559 - DNA, 21 bp, Homo sapiens
ctagaatgtctgaagtacaaa

SEQ ID NO: 4561560 - DNA, 20 bp, Homo sapiens
ctagaatgttattgtgtata

SEQ ID NO: 4561561 - DNA, 17 bp, Homo sapiens
ctagaatgtttcatttg

SEQ ID NO: 4561562 - DNA, 16 bp, Homo sapiens
ctagaattcactgagt

SEQ ID NO: 4561563 - DNA, 21 bp, Homo sapiens
ctagaatttgattattaacat

SEQ ID NO: 4561564 - DNA, 16 bp, Homo sapiens
ctagacacaatttcat

SEQ ID NO: 4561565 - DNA, 19 bp, Homo sapiens
ctagacacaatttcatttc

SEQ ID NO: 4561566 - DNA, 14 bp, Homo sapiens
ctagacacatgaag

SEQ ID NO: 4561567 - DNA, 22 bp, Homo sapiens
ctagacacatgaaggtaaataa

SEQ ID NO: 4561568 - DNA, 18 bp, Homo sapiens
ctagacgcccctcccaag

SEQ ID NO: 4561569 - DNA, 22 bp, Homo sapiens
ctagactaccggacactcgtca

SEQ ID NO: 4561570 - DNA, 14 bp, Homo sapiens
ctagactataaatg

SEQ ID NO: 4561571 - DNA, 16 bp, Homo sapiens
ctagactataaatgtt

SEQ ID NO: 4561572 - DNA, 20 bp, Homo sapiens
ctagactcaaaacctggaga

SEQ ID NO: 4561573 - DNA, 20 bp, Homo sapiens
ctagactgttactttggcaa

SEQ ID NO: 4561574 - DNA, 13 bp, Homo sapiens
ctagacttcccca

SEQ ID NO: 4561575 - DNA, 17 bp, Homo sapiens
ctagacttccccatccc

SEQ ID NO: 4561576 - DNA, 21 bp, Homo sapiens
ctagacttccccatcccgaag

SEQ ID NO: 4561577 - DNA, 23 bp, Homo sapiens
ctagagaacagtattgggcagga

SEQ ID NO: 4561578 - DNA, 18 bp, Homo sapiens
ctagagaacgcagcccta

SEQ ID NO: 4561579 - DNA, 15 bp, Homo sapiens
ctagagaagacaggc

SEQ ID NO: 4561580 - DNA, 18 bp, Homo sapiens
ctagagaagacaggctgg

SEQ ID NO: 4561581 - DNA, 16 bp, Homo sapiens
ctagagaatgcacaga

SEQ ID NO: 4561582 - DNA, 12 bp, Homo sapiens
ctagagacacat

SEQ ID NO: 4561583 - DNA, 13 bp, Homo sapiens
ctagagacacatt

SEQ ID NO: 4561584 - DNA, 17 bp, Homo sapiens
ctagagacacattggac

SEQ ID NO: 4561585 - DNA, 11 bp, Homo sapiens
ctagagcctgc

SEQ ID NO: 4561586 - DNA, 15 bp, Homo sapiens
ctagagcctgcctgg

SEQ ID NO: 4561587 - DNA, 16 bp, Homo sapiens
ctagagccttcagcct

SEQ ID NO: 4561588 - DNA, 17 bp, Homo sapiens
ctagagccttcagcctt

SEQ ID NO: 4561589 - DNA, 17 bp, Homo sapiens
ctagaggaaaagaaaga

SEQ ID NO: 4561590 - DNA, 21 bp, Homo sapiens
ctagaggccagccccacccag

SEQ ID NO: 4561591 - DNA, 23 bp, Homo sapiens
ctagaggccagccccacccagga

SEQ ID NO: 4561592 - DNA, 20 bp, Homo sapiens
ctagaggctccagctctggc

SEQ ID NO: 4561593 - DNA, 15 bp, Homo sapiens
ctagaggtcaggacg

SEQ ID NO: 4561594 - DNA, 19 bp, Homo sapiens
ctagagtcctcactcccag

SEQ ID NO: 4561595 - DNA, 15 bp, Homo sapiens
ctagagtcttaaagc

SEQ ID NO: 4561596 - DNA, 15 bp, Homo sapiens
ctagagttatcttct

SEQ ID NO: 4561597 - DNA, 18 bp, Homo sapiens
ctagatcctgcaccccag

SEQ ID NO: 4561598 - DNA, 14 bp, Homo sapiens
ctagatgatttttt

SEQ ID NO: 4561599 - DNA, 17 bp, Homo sapiens
ctagatgattttttgaa

SEQ ID NO: 4561600 - DNA, 20 bp, Homo sapiens
ctagatgtagtattttttgt

SEQ ID NO: 4561601 - DNA, 22 bp, Homo sapiens
ctagatgtagtattttttgtat

SEQ ID NO: 4561602 - DNA, 19 bp, Homo sapiens
ctagattacatctgcctta

SEQ ID NO: 4561603 - DNA, 20 bp, Homo sapiens
ctagattacatctgccttaa

SEQ ID NO: 4561604 - DNA, 13 bp, Homo sapiens
ctagattaccatg

SEQ ID NO: 4561605 - DNA, 21 bp, Homo sapiens
ctagattgctaaggagctgat

SEQ ID NO: 4561606 - DNA, 18 bp, Homo sapiens
ctagcaagtgagagagat

SEQ ID NO: 4561607 - DNA, 19 bp, Homo sapiens
ctagcaagtgagagagatg

SEQ ID NO: 4561608 - DNA, 16 bp, Homo sapiens
ctagcaatacagggag

SEQ ID NO: 4561609 - DNA, 17 bp, Homo sapiens
ctagcaatacagggagg

SEQ ID NO: 4561610 - DNA, 18 bp, Homo sapiens
ctagcaatacagggaggc

SEQ ID NO: 4561611 - DNA, 23 bp, Homo sapiens
ctagcacactcttctcttgagca

SEQ ID NO: 4561612 - DNA, 12 bp, Homo sapiens
ctagcacagagg

SEQ ID NO: 4561613 - DNA, 20 bp, Homo sapiens
ctagcacagaggcctgactg

SEQ ID NO: 4561614 - DNA, 14 bp, Homo sapiens
ctagcaccctggag

SEQ ID NO: 4561615 - DNA, 21 bp, Homo sapiens
ctagcactgccccacatgcat

SEQ ID NO: 4561616 - DNA, 13 bp, Homo sapiens
ctagcactggcct

SEQ ID NO: 4561617 - DNA, 14 bp, Homo sapiens
ctagcactggcctg

SEQ ID NO: 4561618 - DNA, 20 bp, Homo sapiens
ctagcatttatttctctggc

SEQ ID NO: 4561619 - DNA, 16 bp, Homo sapiens
ctagccaaaccaggac

SEQ ID NO: 4561620 - DNA, 22 bp, Homo sapiens
ctagccatggcaggacagctcc

SEQ ID NO: 4561621 - DNA, 17 bp, Homo sapiens
ctagcccagtgcttctc

SEQ ID NO: 4561622 - DNA, 17 bp, Homo sapiens
ctagcccttccctgagt

SEQ ID NO: 4561623 - DNA, 20 bp, Homo sapiens
ctagcctgatgagattttta

SEQ ID NO: 4561624 - DNA, 22 bp, Homo sapiens
ctagccttggcctctttcctca

SEQ ID NO: 4561625 - DNA, 18 bp, Homo sapiens
ctagcgatctctcctggc

SEQ ID NO: 4561626 - DNA, 12 bp, Homo sapiens
ctagcgctgccg

SEQ ID NO: 4561627 - DNA, 16 bp, Homo sapiens
ctagcggagcccagcc

SEQ ID NO: 4561628 - DNA, 20 bp, Homo sapiens
ctagcggagcccagcctggg

SEQ ID NO: 4561629 - DNA, 18 bp, Homo sapiens
ctagcggctgctccttca

SEQ ID NO: 4561630 - DNA, 13 bp, Homo sapiens
ctagctacactga

SEQ ID NO: 4561631 - DNA, 19 bp, Homo sapiens
ctagctatgctgtatctgt

SEQ ID NO: 4561632 - DNA, 17 bp, Homo sapiens
ctagctcctgccacatg

SEQ ID NO: 4561633 - DNA, 23 bp, Homo sapiens
ctagctgagaagcaatgggtcac

SEQ ID NO: 4561634 - DNA, 21 bp, Homo sapiens
ctagcttaagtgtaaatgaag

SEQ ID NO: 4561635 - DNA, 13 bp, Homo sapiens
ctagcttctgctt

SEQ ID NO: 4561636 - DNA, 14 bp, Homo sapiens
ctagcttctgcttt

SEQ ID NO: 4561637 - DNA, 23 bp, Homo sapiens
ctagcttctgcttttctgccctg

SEQ ID NO: 4561638 - DNA, 18 bp, Homo sapiens
ctagctttagaccctggg

SEQ ID NO: 4561639 - DNA, 19 bp, Homo sapiens
ctaggaagagcaggactcc

SEQ ID NO: 4561640 - DNA, 23 bp, Homo sapiens
ctaggaagagcaggactccaggc

SEQ ID NO: 4561641 - DNA, 22 bp, Homo sapiens
ctaggagatgaaactggttcct

SEQ ID NO: 4561642 - DNA, 20 bp, Homo sapiens
ctaggaggagctagtaggaa

SEQ ID NO: 4561643 - DNA, 23 bp, Homo sapiens
ctaggatgtatattttatataaa

SEQ ID NO: 4561644 - DNA, 14 bp, Homo sapiens
ctaggattgggcct

SEQ ID NO: 4561645 - DNA, 12 bp, Homo sapiens
ctaggcatttca

SEQ ID NO: 4561646 - DNA, 17 bp, Homo sapiens
ctaggccactcctccaa

SEQ ID NO: 4561647 - DNA, 19 bp, Homo sapiens
ctaggcgattttgtctacc

SEQ ID NO: 4561648 - DNA, 17 bp, Homo sapiens
ctaggcgcgatggctgt

SEQ ID NO: 4561649 - DNA, 15 bp, Homo sapiens
ctaggctcagagatg

SEQ ID NO: 4561650 - DNA, 20 bp, Homo sapiens
ctaggctcagagatgtgcac

SEQ ID NO: 4561651 - DNA, 22 bp, Homo sapiens
ctaggctcttatgtgtgccttt

SEQ ID NO: 4561652 - DNA, 22 bp, Homo sapiens
ctagggacatgaaatttacaaa

SEQ ID NO: 4561653 - DNA, 23 bp, Homo sapiens
ctagggacccctcgccccagcct

SEQ ID NO: 4561654 - DNA, 20 bp, Homo sapiens
ctagggactatcaggtaata

SEQ ID NO: 4561655 - DNA, 19 bp, Homo sapiens
ctagggactgccaggctgt

SEQ ID NO: 4561656 - DNA, 13 bp, Homo sapiens
ctagggatccctc

SEQ ID NO: 4561657 - DNA, 17 bp, Homo sapiens
ctagggatccctcatct

SEQ ID NO: 4561658 - DNA, 18 bp, Homo sapiens
ctagggattcaggctgct

SEQ ID NO: 4561659 - DNA, 20 bp, Homo sapiens
ctagggattcaggctgcttg

SEQ ID NO: 4561660 - DNA, 17 bp, Homo sapiens
ctagggccaagcccagc

SEQ ID NO: 4561661 - DNA, 18 bp, Homo sapiens
ctagggtacatgtccaca

SEQ ID NO: 4561662 - DNA, 17 bp, Homo sapiens
ctagggtggcccttgca

SEQ ID NO: 4561663 - DNA, 19 bp, Homo sapiens
ctagggttaggaggtcctt

SEQ ID NO: 4561664 - DNA, 19 bp, Homo sapiens
ctaggtacgatgacagtgt

SEQ ID NO: 4561665 - DNA, 20 bp, Homo sapiens
ctaggtctcctcagggtggg

SEQ ID NO: 4561666 - DNA, 18 bp, Homo sapiens
ctaggtgctatttgtcat

SEQ ID NO: 4561667 - DNA, 16 bp, Homo sapiens
ctaggttaaagctaaa

SEQ ID NO: 4561668 - DNA, 18 bp, Homo sapiens
ctaggttaaagctaaact

SEQ ID NO: 4561669 - DNA, 19 bp, Homo sapiens
ctaggttaaagctaaactg

SEQ ID NO: 4561670 - DNA, 21 bp, Homo sapiens
ctagtaagtaattatgcacta

SEQ ID NO: 4561671 - DNA, 22 bp, Homo sapiens
ctagtaagtaattatgcactaa

SEQ ID NO: 4561672 - DNA, 16 bp, Homo sapiens
ctagtaagtgccttcc

SEQ ID NO: 4561673 - DNA, 13 bp, Homo sapiens
ctagtactattat

SEQ ID NO: 4561674 - DNA, 19 bp, Homo sapiens
ctagtagctgggattacag

SEQ ID NO: 4561675 - DNA, 15 bp, Homo sapiens
ctagtatcaaaagaa

SEQ ID NO: 4561676 - DNA, 14 bp, Homo sapiens
ctagtcaccagaga

SEQ ID NO: 4561677 - DNA, 16 bp, Homo sapiens
ctagtcagagagagtg

SEQ ID NO: 4561678 - DNA, 21 bp, Homo sapiens
ctagtcccttcccctccctgg

SEQ ID NO: 4561679 - DNA, 22 bp, Homo sapiens
ctagtcccttcccctccctggc

SEQ ID NO: 4561680 - DNA, 15 bp, Homo sapiens
ctagtccgctgaaga

SEQ ID NO: 4561681 - DNA, 16 bp, Homo sapiens
ctagtctctcctgtaa

SEQ ID NO: 4561682 - DNA, 23 bp, Homo sapiens
ctagtctttccagtcaacatcgt

SEQ ID NO: 4561683 - DNA, 18 bp, Homo sapiens
ctagtgaaagaggcagct

SEQ ID NO: 4561684 - DNA, 20 bp, Homo sapiens
ctagtgcaaaaactgtaaaa

SEQ ID NO: 4561685 - DNA, 20 bp, Homo sapiens
ctagtgcaattccaagaaaa

SEQ ID NO: 4561686 - DNA, 18 bp, Homo sapiens
ctagtggggtctccctct

SEQ ID NO: 4561687 - DNA, 21 bp, Homo sapiens
ctagtggggtctccctctcct

SEQ ID NO: 4561688 - DNA, 19 bp, Homo sapiens
ctagtggtatggggctgag

SEQ ID NO: 4561689 - DNA, 22 bp, Homo sapiens
ctagtggtatggggctgagccc

SEQ ID NO: 4561690 - DNA, 24 bp, Homo sapiens
ctagtgtaccaagtgcttcctaca

SEQ ID NO: 4561691 - DNA, 14 bp, Homo sapiens
ctagtgtgaattaa

SEQ ID NO: 4561692 - DNA, 21 bp, Homo sapiens
ctagtgtttaagtcatttttt

SEQ ID NO: 4561693 - DNA, 18 bp, Homo sapiens
ctagttaaagaaaggaaa

SEQ ID NO: 4561694 - DNA, 18 bp, Homo sapiens
ctagttactgtggtatgg

SEQ ID NO: 4561695 - DNA, 16 bp, Homo sapiens
ctagttatacttattt

SEQ ID NO: 4561696 - DNA, 23 bp, Homo sapiens
ctagttatacttatttgtatatg

SEQ ID NO: 4561697 - DNA, 13 bp, Homo sapiens
ctagttctagatg

SEQ ID NO: 4561698 - DNA, 13 bp, Homo sapiens
ctagttctcagct

SEQ ID NO: 4561699 - DNA, 13 bp, Homo sapiens
ctagttctttcct

SEQ ID NO: 4561700 - DNA, 16 bp, Homo sapiens
ctagttttctttcctc

SEQ ID NO: 4561701 - DNA, 18 bp, Homo sapiens
ctagttttctttcctcct

SEQ ID NO: 4561702 - DNA, 21 bp, Homo sapiens
ctagttttctttcctcctttc

SEQ ID NO: 4561703 - DNA, 14 bp, Homo sapiens
ctagtttttggaaa

SEQ ID NO: 4561704 - DNA, 15 bp, Homo sapiens
ctataaaaaatatgt

SEQ ID NO: 4561705 - DNA, 16 bp, Homo sapiens
ctataaaatgcccatt

SEQ ID NO: 4561706 - DNA, 20 bp, Homo sapiens
ctataaacctgacctccttt

SEQ ID NO: 4561707 - DNA, 16 bp, Homo sapiens
ctataaagcagtattt

SEQ ID NO: 4561708 - DNA, 12 bp, Homo sapiens
ctataaagggtc

SEQ ID NO: 4561709 - DNA, 13 bp, Homo sapiens
ctataaagggtca

SEQ ID NO: 4561710 - DNA, 20 bp, Homo sapiens
ctataacattatataacaaa

SEQ ID NO: 4561711 - DNA, 20 bp, Homo sapiens
ctataagaataaggcttttt

SEQ ID NO: 4561712 - DNA, 21 bp, Homo sapiens
ctataaggagagttcaagcct

SEQ ID NO: 4561713 - DNA, 22 bp, Homo sapiens
ctataatcaaatgatttcatat

SEQ ID NO: 4561714 - DNA, 15 bp, Homo sapiens
ctataatcccagcta

SEQ ID NO: 4561715 - DNA, 17 bp, Homo sapiens
ctataatgtgaaatgta

SEQ ID NO: 4561716 - DNA, 13 bp, Homo sapiens
ctatacctgcctt

SEQ ID NO: 4561717 - DNA, 19 bp, Homo sapiens
ctatacgcagcgtgcttta

SEQ ID NO: 4561718 - DNA, 19 bp, Homo sapiens
ctatactgcatacttttta

SEQ ID NO: 4561719 - DNA, 15 bp, Homo sapiens
ctatacttgaacaaa

SEQ ID NO: 4561720 - DNA, 20 bp, Homo sapiens
ctatacttgaacaaaagggt

SEQ ID NO: 4561721 - DNA, 14 bp, Homo sapiens
ctatagcactgagc

SEQ ID NO: 4561722 - DNA, 13 bp, Homo sapiens
ctatagccaaaaa

SEQ ID NO: 4561723 - DNA, 14 bp, Homo sapiens
ctatagccaaaaat

SEQ ID NO: 4561724 - DNA, 15 bp, Homo sapiens
ctatagctaagtaca

SEQ ID NO: 4561725 - DNA, 22 bp, Homo sapiens
ctataggtgctacaaaaacaca

SEQ ID NO: 4561726 - DNA, 20 bp, Homo sapiens
ctataggtttttaaatggaa

SEQ ID NO: 4561727 - DNA, 12 bp, Homo sapiens
ctatagtatttg

SEQ ID NO: 4561728 - DNA, 15 bp, Homo sapiens
ctatagtatttgatt

SEQ ID NO: 4561729 - DNA, 23 bp, Homo sapiens
ctatagtatttgattcaaaatat

SEQ ID NO: 4561730 - DNA, 16 bp, Homo sapiens
ctatagttactgtcct

SEQ ID NO: 4561731 - DNA, 16 bp, Homo sapiens
ctatataatttatttc

SEQ ID NO: 4561732 - DNA, 20 bp, Homo sapiens
ctatataatttatttccact

SEQ ID NO: 4561733 - DNA, 17 bp, Homo sapiens
ctatatagaatttcctg

SEQ ID NO: 4561734 - DNA, 19 bp, Homo sapiens
ctatatagaatttcctgta

SEQ ID NO: 4561735 - DNA, 14 bp, Homo sapiens
ctatatatatttct

SEQ ID NO: 4561736 - DNA, 12 bp, Homo sapiens
ctatatatttct

SEQ ID NO: 4561737 - DNA, 14 bp, Homo sapiens
ctatatcttacaaa

SEQ ID NO: 4561738 - DNA, 21 bp, Homo sapiens
ctatatggcaaatagccacaa

SEQ ID NO: 4561739 - DNA, 15 bp, Homo sapiens
ctatattcctttttc

SEQ ID NO: 4561740 - DNA, 18 bp, Homo sapiens
ctatattcctttttctat

SEQ ID NO: 4561741 - DNA, 14 bp, Homo sapiens
ctatcaagcactaa

SEQ ID NO: 4561742 - DNA, 14 bp, Homo sapiens
ctatcaatatttaa

SEQ ID NO: 4561743 - DNA, 15 bp, Homo sapiens
ctatcaatatttaag

SEQ ID NO: 4561744 - DNA, 12 bp, Homo sapiens
ctatcaatttta

SEQ ID NO: 4561745 - DNA, 19 bp, Homo sapiens
ctatcacacatgaataaag

SEQ ID NO: 4561746 - DNA, 19 bp, Homo sapiens
ctatcacctcgagaagtaa

SEQ ID NO: 4561747 - DNA, 17 bp, Homo sapiens
ctatcagttgatttttc

SEQ ID NO: 4561748 - DNA, 17 bp, Homo sapiens
ctatcatagttaacata

SEQ ID NO: 4561749 - DNA, 14 bp, Homo sapiens
ctatcatggtgaaa

SEQ ID NO: 4561750 - DNA, 18 bp, Homo sapiens
ctatcatttttacactat

SEQ ID NO: 4561751 - DNA, 22 bp, Homo sapiens
ctatccacagaacctttgtcaa

SEQ ID NO: 4561752 - DNA, 13 bp, Homo sapiens
ctatccacccagc

SEQ ID NO: 4561753 - DNA, 19 bp, Homo sapiens
ctatccacccagcccattc

SEQ ID NO: 4561754 - DNA, 18 bp, Homo sapiens
ctatccccatctccctgc

SEQ ID NO: 4561755 - DNA, 19 bp, Homo sapiens
ctatccccatctccctgcc

SEQ ID NO: 4561756 - DNA, 22 bp, Homo sapiens
ctatccccatctccctgcctgg

SEQ ID NO: 4561757 - DNA, 22 bp, Homo sapiens
ctatccgctgccagccttgagc

SEQ ID NO: 4561758 - DNA, 14 bp, Homo sapiens
ctatcctgctgaaa

SEQ ID NO: 4561759 - DNA, 17 bp, Homo sapiens
ctatcctgtttaataaa

SEQ ID NO: 4561760 - DNA, 18 bp, Homo sapiens
ctatccttataggcctgt

SEQ ID NO: 4561761 - DNA, 17 bp, Homo sapiens
ctatctaaccctcccat

SEQ ID NO: 4561762 - DNA, 22 bp, Homo sapiens
ctatctaggtattttcttcaaa

SEQ ID NO: 4561763 - DNA, 17 bp, Homo sapiens
ctatctatacctgcctt

SEQ ID NO: 4561764 - DNA, 13 bp, Homo sapiens
ctatctcagccat

SEQ ID NO: 4561765 - DNA, 14 bp, Homo sapiens
ctatctcagccata

SEQ ID NO: 4561766 - DNA, 12 bp, Homo sapiens
ctatctcatcta

SEQ ID NO: 4561767 - DNA, 18 bp, Homo sapiens
ctatctccgttccatctg

SEQ ID NO: 4561768 - DNA, 12 bp, Homo sapiens
ctatctgtattc

SEQ ID NO: 4561769 - DNA, 21 bp, Homo sapiens
ctatctgtcatctctctgggg

SEQ ID NO: 4561770 - DNA, 18 bp, Homo sapiens
ctatcttactatttcaca

SEQ ID NO: 4561771 - DNA, 21 bp, Homo sapiens
ctatcttagtggttccccacc

SEQ ID NO: 4561772 - DNA, 21 bp, Homo sapiens
ctatgaaaatgggatgaattc

SEQ ID NO: 4561773 - DNA, 18 bp, Homo sapiens
ctatgagatggccatgct

SEQ ID NO: 4561774 - DNA, 21 bp, Homo sapiens
ctatgaggaaactgagtcact

SEQ ID NO: 4561775 - DNA, 16 bp, Homo sapiens
ctatgaggagcctctg

SEQ ID NO: 4561776 - DNA, 17 bp, Homo sapiens
ctatgagggtgtttcct

SEQ ID NO: 4561777 - DNA, 22 bp, Homo sapiens
ctatgagggtgtttcctctaaa

SEQ ID NO: 4561778 - DNA, 21 bp, Homo sapiens
ctatgatcagaagaacatgat

SEQ ID NO: 4561779 - DNA, 19 bp, Homo sapiens
ctatgatgtgaaacacttt

SEQ ID NO: 4561780 - DNA, 14 bp, Homo sapiens
ctatgcagtatctc

SEQ ID NO: 4561781 - DNA, 13 bp, Homo sapiens
ctatgcctgtggt

SEQ ID NO: 4561782 - DNA, 14 bp, Homo sapiens
ctatgcctgtggtg

SEQ ID NO: 4561783 - DNA, 16 bp, Homo sapiens
ctatgcctgtggtgaa

SEQ ID NO: 4561784 - DNA, 19 bp, Homo sapiens
ctatgctattgacaataaa

SEQ ID NO: 4561785 - DNA, 15 bp, Homo sapiens
ctatgctgtatctgt

SEQ ID NO: 4561786 - DNA, 13 bp, Homo sapiens
ctatgctgtttgt

SEQ ID NO: 4561787 - DNA, 19 bp, Homo sapiens
ctatggaacataaagttgt

SEQ ID NO: 4561788 - DNA, 17 bp, Homo sapiens
ctatggagactttgctg

SEQ ID NO: 4561789 - DNA, 14 bp, Homo sapiens
ctatggccagtctg

SEQ ID NO: 4561790 - DNA, 17 bp, Homo sapiens
ctatggccagtctgccc

SEQ ID NO: 4561791 - DNA, 13 bp, Homo sapiens
ctatgggagcccc

SEQ ID NO: 4561792 - DNA, 15 bp, Homo sapiens
ctatgggagccccag

SEQ ID NO: 4561793 - DNA, 21 bp, Homo sapiens
ctatggggatagatgtgtgga

SEQ ID NO: 4561794 - DNA, 20 bp, Homo sapiens
ctatggtatgctggccagca

SEQ ID NO: 4561795 - DNA, 21 bp, Homo sapiens
ctatggtatgctggccagcac

SEQ ID NO: 4561796 - DNA, 22 bp, Homo sapiens
ctatggtatgctggccagcacc

SEQ ID NO: 4561797 - DNA, 20 bp, Homo sapiens
ctatggttctaaatattgct

SEQ ID NO: 4561798 - DNA, 15 bp, Homo sapiens
ctatgtaagggtctt

SEQ ID NO: 4561799 - DNA, 14 bp, Homo sapiens
ctatgtatgttaat

SEQ ID NO: 4561800 - DNA, 18 bp, Homo sapiens
ctatgtatgttaatttat

SEQ ID NO: 4561801 - DNA, 17 bp, Homo sapiens
ctatgtcatttttaatg

SEQ ID NO: 4561802 - DNA, 20 bp, Homo sapiens
ctatgtcatttttaatgtat

SEQ ID NO: 4561803 - DNA, 23 bp, Homo sapiens
ctatgtcatttttaatgtatcta

SEQ ID NO: 4561804 - DNA, 15 bp, Homo sapiens
ctatgtcccaggaat

SEQ ID NO: 4561805 - DNA, 11 bp, Homo sapiens
ctatgtctgaa

SEQ ID NO: 4561806 - DNA, 15 bp, Homo sapiens
ctatgtctgaacata

SEQ ID NO: 4561807 - DNA, 19 bp, Homo sapiens
ctatgtgccttatgttgaa

SEQ ID NO: 4561808 - DNA, 18 bp, Homo sapiens
ctatgttctaagaagtga

SEQ ID NO: 4561809 - DNA, 15 bp, Homo sapiens
ctatgtttcatcttg

SEQ ID NO: 4561810 - DNA, 15 bp, Homo sapiens
ctatgtttttaatgt

SEQ ID NO: 4561811 - DNA, 21 bp, Homo sapiens
ctattaacaattaattgtctt

SEQ ID NO: 4561812 - DNA, 12 bp, Homo sapiens
ctattaactctg

SEQ ID NO: 4561813 - DNA, 16 bp, Homo sapiens
ctattaagcaagaatg

SEQ ID NO: 4561814 - DNA, 20 bp, Homo sapiens
ctattaagcaagaatgcagt

SEQ ID NO: 4561815 - DNA, 11 bp, Homo sapiens
ctattaatatt

SEQ ID NO: 4561816 - DNA, 12 bp, Homo sapiens
ctattaatattt

SEQ ID NO: 4561817 - DNA, 15 bp, Homo sapiens
ctattaatcaagaga

SEQ ID NO: 4561818 - DNA, 20 bp, Homo sapiens
ctattaatcaagagaaactt

SEQ ID NO: 4561819 - DNA, 17 bp, Homo sapiens
ctattacattttcagtg

SEQ ID NO: 4561820 - DNA, 17 bp, Homo sapiens
ctattatagcaacttta

SEQ ID NO: 4561821 - DNA, 15 bp, Homo sapiens
ctattatggaaaact

SEQ ID NO: 4561822 - DNA, 19 bp, Homo sapiens
ctattatgtggaataatac

SEQ ID NO: 4561823 - DNA, 21 bp, Homo sapiens
ctattatgtggaataatacat

SEQ ID NO: 4561824 - DNA, 14 bp, Homo sapiens
ctattcatggctac

SEQ ID NO: 4561825 - DNA, 20 bp, Homo sapiens
ctattcatggctacctcaga

SEQ ID NO: 4561826 - DNA, 15 bp, Homo sapiens
ctattcattcactct

SEQ ID NO: 4561827 - DNA, 17 bp, Homo sapiens
ctattcgaatgaaaaga

SEQ ID NO: 4561828 - DNA, 17 bp, Homo sapiens
ctattctagcctgcatt

SEQ ID NO: 4561829 - DNA, 23 bp, Homo sapiens
ctattctagcctgcattgagctt

SEQ ID NO: 4561830 - DNA, 15 bp, Homo sapiens
ctattctccagctga

SEQ ID NO: 4561831 - DNA, 12 bp, Homo sapiens
ctattctctctt

SEQ ID NO: 4561832 - DNA, 19 bp, Homo sapiens
ctattctgtcagtgttaaa

SEQ ID NO: 4561833 - DNA, 12 bp, Homo sapiens
ctattcttaata

SEQ ID NO: 4561834 - DNA, 21 bp, Homo sapiens
ctattcttggaccatgccaga

SEQ ID NO: 4561835 - DNA, 15 bp, Homo sapiens
ctattgaaaatatat

SEQ ID NO: 4561836 - DNA, 17 bp, Homo sapiens
ctattgaaaatatatat

SEQ ID NO: 4561837 - DNA, 23 bp, Homo sapiens
ctattgatgtacagtctgtcatg

SEQ ID NO: 4561838 - DNA, 14 bp, Homo sapiens
ctattgcaaatgag

SEQ ID NO: 4561839 - DNA, 12 bp, Homo sapiens
ctattgtacaga

SEQ ID NO: 4561840 - DNA, 13 bp, Homo sapiens
ctatttaaattct

SEQ ID NO: 4561841 - DNA, 15 bp, Homo sapiens
ctatttaaattcttt

SEQ ID NO: 4561842 - DNA, 16 bp, Homo sapiens
ctatttaacaagatgt

SEQ ID NO: 4561843 - DNA, 14 bp, Homo sapiens
ctatttaacatttt

SEQ ID NO: 4561844 - DNA, 13 bp, Homo sapiens
ctatttaatgttt

SEQ ID NO: 4561845 - DNA, 20 bp, Homo sapiens
ctatttacatagtcatttag

SEQ ID NO: 4561846 - DNA, 13 bp, Homo sapiens
ctatttatatcac

SEQ ID NO: 4561847 - DNA, 23 bp, Homo sapiens
ctatttatatcacacaatatagt

SEQ ID NO: 4561848 - DNA, 15 bp, Homo sapiens
ctatttcaatgagtt

SEQ ID NO: 4561849 - DNA, 13 bp, Homo sapiens
ctatttcagctgc

SEQ ID NO: 4561850 - DNA, 16 bp, Homo sapiens
ctatttgacccccaca

SEQ ID NO: 4561851 - DNA, 16 bp, Homo sapiens
ctatttgccaatgtat

SEQ ID NO: 4561852 - DNA, 23 bp, Homo sapiens
ctatttgccaatgtatattgcaa

SEQ ID NO: 4561853 - DNA, 14 bp, Homo sapiens
ctatttgctaatgt

SEQ ID NO: 4561854 - DNA, 14 bp, Homo sapiens
ctatttgtacaatt

SEQ ID NO: 4561855 - DNA, 14 bp, Homo sapiens
ctatttgtctctta

SEQ ID NO: 4561856 - DNA, 23 bp, Homo sapiens
ctattttaagactgattttaata

SEQ ID NO: 4561857 - DNA, 20 bp, Homo sapiens
ctattttacttttctgccaa

SEQ ID NO: 4561858 - DNA, 21 bp, Homo sapiens
ctattttagaaagctaaatga

SEQ ID NO: 4561859 - DNA, 22 bp, Homo sapiens
ctattttagggttctaaatgca

SEQ ID NO: 4561860 - DNA, 18 bp, Homo sapiens
ctattttattttattgaa

SEQ ID NO: 4561861 - DNA, 22 bp, Homo sapiens
ctattttattttattgaatact

SEQ ID NO: 4561862 - DNA, 18 bp, Homo sapiens
ctattttcagaatctgaa

SEQ ID NO: 4561863 - DNA, 22 bp, Homo sapiens
ctattttcagaatctgaatgta

SEQ ID NO: 4561864 - DNA, 15 bp, Homo sapiens
ctattttgagcatta

SEQ ID NO: 4561865 - DNA, 13 bp, Homo sapiens
ctattttgatgca

SEQ ID NO: 4561866 - DNA, 14 bp, Homo sapiens
ctattttgatgcag

SEQ ID NO: 4561867 - DNA, 17 bp, Homo sapiens
ctattttgtgaagccat

SEQ ID NO: 4561868 - DNA, 22 bp, Homo sapiens
ctatttttgactgtagccacag

SEQ ID NO: 4561869 - DNA, 21 bp, Homo sapiens
ctatttttgtaaactggaatt

SEQ ID NO: 4561870 - DNA, 17 bp, Homo sapiens
ctatttttttaaaatca

SEQ ID NO: 4561871 - DNA, 13 bp, Homo sapiens
ctatttttttaga

SEQ ID NO: 4561872 - DNA, 22 bp, Homo sapiens
ctatttttttagattgagaaat

SEQ ID NO: 4561873 - DNA, 13 bp, Homo sapiens
ctatttttttcct

SEQ ID NO: 4561874 - DNA, 22 bp, Homo sapiens
ctcaaaaaaaaaaaagagagag

SEQ ID NO: 4561875 - DNA, 13 bp, Homo sapiens
ctcaaaaatgatt

SEQ ID NO: 4561876 - DNA, 15 bp, Homo sapiens
ctcaaaacctggaga

SEQ ID NO: 4561877 - DNA, 17 bp, Homo sapiens
ctcaaaactgcactgtc

SEQ ID NO: 4561878 - DNA, 16 bp, Homo sapiens
ctcaaacaacactggt

SEQ ID NO: 4561879 - DNA, 19 bp, Homo sapiens
ctcaaaccaagggtacaga

SEQ ID NO: 4561880 - DNA, 23 bp, Homo sapiens
ctcaaaccaagggtacagatccc

SEQ ID NO: 4561881 - DNA, 16 bp, Homo sapiens
ctcaaacgacagagga

SEQ ID NO: 4561882 - DNA, 13 bp, Homo sapiens
ctcaaactcattg

SEQ ID NO: 4561883 - DNA, 15 bp, Homo sapiens
ctcaaactcattgca

SEQ ID NO: 4561884 - DNA, 17 bp, Homo sapiens
ctcaaactccattctcc

SEQ ID NO: 4561885 - DNA, 16 bp, Homo sapiens
ctcaaagaaagtgtat

SEQ ID NO: 4561886 - DNA, 17 bp, Homo sapiens
ctcaaagaaagtgtatt

SEQ ID NO: 4561887 - DNA, 19 bp, Homo sapiens
ctcaaagcaagcattcaga

SEQ ID NO: 4561888 - DNA, 16 bp, Homo sapiens
ctcaaatacatgcaca

SEQ ID NO: 4561889 - DNA, 21 bp, Homo sapiens
ctcaaatacatgcacagtcat

SEQ ID NO: 4561890 - DNA, 21 bp, Homo sapiens
ctcaaataggctattaaaaaa

SEQ ID NO: 4561891 - DNA, 22 bp, Homo sapiens
ctcaaatcaaaaacaggcaggt

SEQ ID NO: 4561892 - DNA, 19 bp, Homo sapiens
ctcaaatgatcctcccacc

SEQ ID NO: 4561893 - DNA, 20 bp, Homo sapiens
ctcaaatgatcctcccacct

SEQ ID NO: 4561894 - DNA, 11 bp, Homo sapiens
ctcaaatgctg

SEQ ID NO: 4561895 - DNA, 16 bp, Homo sapiens
ctcaaattactaatga

SEQ ID NO: 4561896 - DNA, 15 bp, Homo sapiens
ctcaaattcagctct

SEQ ID NO: 4561897 - DNA, 16 bp, Homo sapiens
ctcaaattcagctctg

SEQ ID NO: 4561898 - DNA, 13 bp, Homo sapiens
ctcaaattttttg

SEQ ID NO: 4561899 - DNA, 21 bp, Homo sapiens
ctcaaattttttgactttttt

SEQ ID NO: 4561900 - DNA, 14 bp, Homo sapiens
ctcaacatactgta

SEQ ID NO: 4561901 - DNA, 16 bp, Homo sapiens
ctcaacattgcatggt

SEQ ID NO: 4561902 - DNA, 18 bp, Homo sapiens
ctcaacccccctcccaga

SEQ ID NO: 4561903 - DNA, 17 bp, Homo sapiens
ctcaacctgtaaattat

SEQ ID NO: 4561904 - DNA, 20 bp, Homo sapiens
ctcaacctgtaaattatttt

SEQ ID NO: 4561905 - DNA, 15 bp, Homo sapiens
ctcaactactcagct

SEQ ID NO: 4561906 - DNA, 20 bp, Homo sapiens
ctcaactctacccctgctcc

SEQ ID NO: 4561907 - DNA, 13 bp, Homo sapiens
ctcaactgcctac

SEQ ID NO: 4561908 - DNA, 23 bp, Homo sapiens
ctcaactgcctactccaaaatgt

SEQ ID NO: 4561909 - DNA, 20 bp, Homo sapiens
ctcaagaggaatctgtttct

SEQ ID NO: 4561910 - DNA, 20 bp, Homo sapiens
ctcaagcaatcctcctgcct

SEQ ID NO: 4561911 - DNA, 23 bp, Homo sapiens
ctcaagcaatcctcctgcctcag

SEQ ID NO: 4561912 - DNA, 17 bp, Homo sapiens
ctcaagccccatttcct

SEQ ID NO: 4561913 - DNA, 17 bp, Homo sapiens
ctcaagcgattctcctg

SEQ ID NO: 4561914 - DNA, 21 bp, Homo sapiens
ctcaaggagaggcaaagaaag

SEQ ID NO: 4561915 - DNA, 18 bp, Homo sapiens
ctcaagggttttccaggt

SEQ ID NO: 4561916 - DNA, 22 bp, Homo sapiens
ctcaagttgattagaaagacca

SEQ ID NO: 4561917 - DNA, 20 bp, Homo sapiens
ctcaataaacagtcactgga

SEQ ID NO: 4561918 - DNA, 23 bp, Homo sapiens
ctcaatcctaatttctcctccct

SEQ ID NO: 4561919 - DNA, 20 bp, Homo sapiens
ctcaatgtggaaaaaatatt

SEQ ID NO: 4561920 - DNA, 14 bp, Homo sapiens
ctcaattagtgtgg

SEQ ID NO: 4561921 - DNA, 13 bp, Homo sapiens
ctcaattatttgc

SEQ ID NO: 4561922 - DNA, 21 bp, Homo sapiens
ctcaattgaaagcttttaaaa

SEQ ID NO: 4561923 - DNA, 12 bp, Homo sapiens
ctcaatttcagc

SEQ ID NO: 4561924 - DNA, 19 bp, Homo sapiens
ctcacacagccaggtgcct

SEQ ID NO: 4561925 - DNA, 20 bp, Homo sapiens
ctcacacagccaggtgcctt

SEQ ID NO: 4561926 - DNA, 17 bp, Homo sapiens
ctcacacatcctgtcag

SEQ ID NO: 4561927 - DNA, 19 bp, Homo sapiens
ctcacacctcactctttat

SEQ ID NO: 4561928 - DNA, 15 bp, Homo sapiens
ctcacacctgaactg

SEQ ID NO: 4561929 - DNA, 12 bp, Homo sapiens
ctcacacctgta

SEQ ID NO: 4561930 - DNA, 22 bp, Homo sapiens
ctcacacgtttaatcccagcac

SEQ ID NO: 4561931 - DNA, 23 bp, Homo sapiens
ctcacacgtttaatcccagcact

SEQ ID NO: 4561932 - DNA, 19 bp, Homo sapiens
ctcacactaagagggcaga

SEQ ID NO: 4561933 - DNA, 12 bp, Homo sapiens
ctcacactgaga

SEQ ID NO: 4561934 - DNA, 18 bp, Homo sapiens
ctcacactggtctgctgt

SEQ ID NO: 4561935 - DNA, 14 bp, Homo sapiens
ctcacaggctgaga

SEQ ID NO: 4561936 - DNA, 14 bp, Homo sapiens
ctcacagtcccact

SEQ ID NO: 4561937 - DNA, 22 bp, Homo sapiens
ctcacagtgaacactcagtggc

SEQ ID NO: 4561938 - DNA, 13 bp, Homo sapiens
ctcacagttcctc

SEQ ID NO: 4561939 - DNA, 23 bp, Homo sapiens
ctcacagttcctcgccctgggtc

SEQ ID NO: 4561940 - DNA, 17 bp, Homo sapiens
ctcacatagccaactct

SEQ ID NO: 4561941 - DNA, 14 bp, Homo sapiens
ctcacatgggactg

SEQ ID NO: 4561942 - DNA, 15 bp, Homo sapiens
ctcacatttttttct

SEQ ID NO: 4561943 - DNA, 23 bp, Homo sapiens
ctcaccaaggatcggactctgcc

SEQ ID NO: 4561944 - DNA, 20 bp, Homo sapiens
ctcaccactaccagccagcc

SEQ ID NO: 4561945 - DNA, 17 bp, Homo sapiens
ctcaccagccctgcagc

SEQ ID NO: 4561946 - DNA, 14 bp, Homo sapiens
ctcaccagctgcaa

SEQ ID NO: 4561947 - DNA, 20 bp, Homo sapiens
ctcaccagtcccatgctggc

SEQ ID NO: 4561948 - DNA, 13 bp, Homo sapiens
ctcacccacacca

SEQ ID NO: 4561949 - DNA, 20 bp, Homo sapiens
ctcacccaccatggaccagc

SEQ ID NO: 4561950 - DNA, 19 bp, Homo sapiens
ctcaccccccacactcact

SEQ ID NO: 4561951 - DNA, 20 bp, Homo sapiens
ctcaccccccacactcactc

SEQ ID NO: 4561952 - DNA, 15 bp, Homo sapiens
ctcaccccctcccac

SEQ ID NO: 4561953 - DNA, 21 bp, Homo sapiens
ctcacccccttctccatccac

SEQ ID NO: 4561954 - DNA, 13 bp, Homo sapiens
ctcaccccggcag

SEQ ID NO: 4561955 - DNA, 14 bp, Homo sapiens
ctcacccctggttc

SEQ ID NO: 4561956 - DNA, 17 bp, Homo sapiens
ctcaccctctcttggtg

SEQ ID NO: 4561957 - DNA, 23 bp, Homo sapiens
ctcaccctgggagccagtcctcc

SEQ ID NO: 4561958 - DNA, 12 bp, Homo sapiens
ctcacccttccc

SEQ ID NO: 4561959 - DNA, 13 bp, Homo sapiens
ctcacccttcccg

SEQ ID NO: 4561960 - DNA, 16 bp, Homo sapiens
ctcaccgctggccctt

SEQ ID NO: 4561961 - DNA, 21 bp, Homo sapiens
ctcaccgctggcccttagaga

SEQ ID NO: 4561962 - DNA, 14 bp, Homo sapiens
ctcacctctctcta

SEQ ID NO: 4561963 - DNA, 12 bp, Homo sapiens
ctcacctctgcc

SEQ ID NO: 4561964 - DNA, 13 bp, Homo sapiens
ctcacctctgcct

SEQ ID NO: 4561965 - DNA, 18 bp, Homo sapiens
ctcacctctgcctcaatg

SEQ ID NO: 4561966 - DNA, 13 bp, Homo sapiens
ctcacctggactt

SEQ ID NO: 4561967 - DNA, 22 bp, Homo sapiens
ctcacctgtctaggtctcctca

SEQ ID NO: 4561968 - DNA, 17 bp, Homo sapiens
ctcaccttcctgtgggt

SEQ ID NO: 4561969 - DNA, 23 bp, Homo sapiens
ctcacgaaagtatttacttttta

SEQ ID NO: 4561970 - DNA, 20 bp, Homo sapiens
ctcacgcctgtaatcccagc

SEQ ID NO: 4561971 - DNA, 17 bp, Homo sapiens
ctcacgctttgtttact

SEQ ID NO: 4561972 - DNA, 16 bp, Homo sapiens
ctcacggggttggctg

SEQ ID NO: 4561973 - DNA, 21 bp, Homo sapiens
ctcacgtgtcagaagcctcca

SEQ ID NO: 4561974 - DNA, 13 bp, Homo sapiens
ctcactatatata

SEQ ID NO: 4561975 - DNA, 16 bp, Homo sapiens
ctcactatatatattt

SEQ ID NO: 4561976 - DNA, 14 bp, Homo sapiens
ctcactattcttgg

SEQ ID NO: 4561977 - DNA, 14 bp, Homo sapiens
ctcactccaccacc

SEQ ID NO: 4561978 - DNA, 20 bp, Homo sapiens
ctcactcccctctcctcccc

SEQ ID NO: 4561979 - DNA, 22 bp, Homo sapiens
ctcactcccttctacctgccac

SEQ ID NO: 4561980 - DNA, 12 bp, Homo sapiens
ctcactctgtca

SEQ ID NO: 4561981 - DNA, 14 bp, Homo sapiens
ctcactctgtcagc

SEQ ID NO: 4561982 - DNA, 20 bp, Homo sapiens
ctcactcttctgtcttgtcc

SEQ ID NO: 4561983 - DNA, 12 bp, Homo sapiens
ctcactgcagcc

SEQ ID NO: 4561984 - DNA, 14 bp, Homo sapiens
ctcactgcagcctc

SEQ ID NO: 4561985 - DNA, 15 bp, Homo sapiens
ctcactgcagcctca

SEQ ID NO: 4561986 - DNA, 18 bp, Homo sapiens
ctcactgccaggccagcc

SEQ ID NO: 4561987 - DNA, 21 bp, Homo sapiens
ctcactgccaggccagcctcc

SEQ ID NO: 4561988 - DNA, 15 bp, Homo sapiens
ctcactgtgtatagg

SEQ ID NO: 4561989 - DNA, 20 bp, Homo sapiens
ctcactgtgtataggaattt

SEQ ID NO: 4561990 - DNA, 19 bp, Homo sapiens
ctcactgtttgtttttatt

SEQ ID NO: 4561991 - DNA, 16 bp, Homo sapiens
ctcacttcaatgtgtc

SEQ ID NO: 4561992 - DNA, 18 bp, Homo sapiens
ctcacttctagatctcag

SEQ ID NO: 4561993 - DNA, 19 bp, Homo sapiens
ctcactttactttcaagta

SEQ ID NO: 4561994 - DNA, 14 bp, Homo sapiens
ctcactttgtaaat

SEQ ID NO: 4561995 - DNA, 16 bp, Homo sapiens
ctcactttgtaaataa

SEQ ID NO: 4561996 - DNA, 21 bp, Homo sapiens
ctcagaaggccccagagagac

SEQ ID NO: 4561997 - DNA, 11 bp, Homo sapiens
ctcagaattcg

SEQ ID NO: 4561998 - DNA, 12 bp, Homo sapiens
ctcagacccagc

SEQ ID NO: 4561999 - DNA, 17 bp, Homo sapiens
ctcagacccaggagtcc

SEQ ID NO: 4562000 - DNA, 19 bp, Homo sapiens
ctcagacccaggagtccag

SEQ ID NO: 4562001 - DNA, 20 bp, Homo sapiens
ctcagacccaggagtccaga

SEQ ID NO: 4562002 - DNA, 21 bp, Homo sapiens
ctcagacccaggagtccagcc

SEQ ID NO: 4562003 - DNA, 22 bp, Homo sapiens
ctcagacccaggagtccagccc

SEQ ID NO: 4562004 - DNA, 17 bp, Homo sapiens
ctcagacccaggggtcc

SEQ ID NO: 4562005 - DNA, 18 bp, Homo sapiens
ctcagacccaggggtcca

SEQ ID NO: 4562006 - DNA, 14 bp, Homo sapiens
ctcagacccccact

SEQ ID NO: 4562007 - DNA, 23 bp, Homo sapiens
ctcagacccccactctcattccc

SEQ ID NO: 4562008 - DNA, 19 bp, Homo sapiens
ctcagacccctcagcccca

SEQ ID NO: 4562009 - DNA, 20 bp, Homo sapiens
ctcagacccctcagccccag

SEQ ID NO: 4562010 - DNA, 17 bp, Homo sapiens
ctcagacgggctgagag

SEQ ID NO: 4562011 - DNA, 16 bp, Homo sapiens
ctcagacgtgtgacct

SEQ ID NO: 4562012 - DNA, 23 bp, Homo sapiens
ctcagacgtgtgacctccatact

SEQ ID NO: 4562013 - DNA, 12 bp, Homo sapiens
ctcagactcaga

SEQ ID NO: 4562014 - DNA, 17 bp, Homo sapiens
ctcagactcagaggtcc

SEQ ID NO: 4562015 - DNA, 19 bp, Homo sapiens
ctcagactcagaggtccag

SEQ ID NO: 4562016 - DNA, 14 bp, Homo sapiens
ctcagactccattt

SEQ ID NO: 4562017 - DNA, 22 bp, Homo sapiens
ctcagactgggcactggggcct

SEQ ID NO: 4562018 - DNA, 19 bp, Homo sapiens
ctcagagaaaaatgctccc

SEQ ID NO: 4562019 - DNA, 17 bp, Homo sapiens
ctcagagaaggaaaaga

SEQ ID NO: 4562020 - DNA, 22 bp, Homo sapiens
ctcagagatgtgcacccatggg

SEQ ID NO: 4562021 - DNA, 18 bp, Homo sapiens
ctcagagcgccaggaagc

SEQ ID NO: 4562022 - DNA, 12 bp, Homo sapiens
ctcagagctttg

SEQ ID NO: 4562023 - DNA, 21 bp, Homo sapiens
ctcagagctttgtcacttgcc

SEQ ID NO: 4562024 - DNA, 22 bp, Homo sapiens
ctcagagctttgtcacttgcca

SEQ ID NO: 4562025 - DNA, 18 bp, Homo sapiens
ctcagaggccacttgctt

SEQ ID NO: 4562026 - DNA, 15 bp, Homo sapiens
ctcagaggcctgctg

SEQ ID NO: 4562027 - DNA, 16 bp, Homo sapiens
ctcagagggtgtcctg

SEQ ID NO: 4562028 - DNA, 21 bp, Homo sapiens
ctcagagtccactgtggcact

SEQ ID NO: 4562029 - DNA, 17 bp, Homo sapiens
ctcagatcagtgtacca

SEQ ID NO: 4562030 - DNA, 16 bp, Homo sapiens
ctcagatgaggacaga

SEQ ID NO: 4562031 - DNA, 13 bp, Homo sapiens
ctcagatgatctc

SEQ ID NO: 4562032 - DNA, 20 bp, Homo sapiens
ctcagatgatctctccacgg

SEQ ID NO: 4562033 - DNA, 21 bp, Homo sapiens
ctcagatgatgccagctgtct

SEQ ID NO: 4562034 - DNA, 13 bp, Homo sapiens
ctcagatgttaaa

SEQ ID NO: 4562035 - DNA, 17 bp, Homo sapiens
ctcagatgttaaaataa

SEQ ID NO: 4562036 - DNA, 19 bp, Homo sapiens
ctcagatgttaaaataaat

SEQ ID NO: 4562037 - DNA, 23 bp, Homo sapiens
ctcagcaactgttagctgggaag

SEQ ID NO: 4562038 - DNA, 13 bp, Homo sapiens
ctcagcaagctgc

SEQ ID NO: 4562039 - DNA, 18 bp, Homo sapiens
ctcagcaagctgcccagc

SEQ ID NO: 4562040 - DNA, 20 bp, Homo sapiens
ctcagcaagctgcccagccc

SEQ ID NO: 4562041 - DNA, 23 bp, Homo sapiens
ctcagcaagctgcccagccctgg

SEQ ID NO: 4562042 - DNA, 18 bp, Homo sapiens
ctcagcagacatttatct

SEQ ID NO: 4562043 - DNA, 20 bp, Homo sapiens
ctcagcagcagagagccctg

SEQ ID NO: 4562044 - DNA, 13 bp, Homo sapiens
ctcagcagcccta

SEQ ID NO: 4562045 - DNA, 15 bp, Homo sapiens
ctcagcagccctcct

SEQ ID NO: 4562046 - DNA, 19 bp, Homo sapiens
ctcagcagccctcctcacc

SEQ ID NO: 4562047 - DNA, 21 bp, Homo sapiens
ctcagcagcgaccacccctgc

SEQ ID NO: 4562048 - DNA, 20 bp, Homo sapiens
ctcagcatagggtcactttg

SEQ ID NO: 4562049 - DNA, 19 bp, Homo sapiens
ctcagcatttccttgtccc

SEQ ID NO: 4562050 - DNA, 20 bp, Homo sapiens
ctcagccacaaagcccccca

SEQ ID NO: 4562051 - DNA, 22 bp, Homo sapiens
ctcagccacaaagccccccagc

SEQ ID NO: 4562052 - DNA, 15 bp, Homo sapiens
ctcagccactgtcac

SEQ ID NO: 4562053 - DNA, 12 bp, Homo sapiens
ctcagccagcct

SEQ ID NO: 4562054 - DNA, 22 bp, Homo sapiens
ctcagccagcctccttgtgaga

SEQ ID NO: 4562055 - DNA, 19 bp, Homo sapiens
ctcagccataggtgcagtt

SEQ ID NO: 4562056 - DNA, 13 bp, Homo sapiens
ctcagcccagaag

SEQ ID NO: 4562057 - DNA, 15 bp, Homo sapiens
ctcagccccagccca

SEQ ID NO: 4562058 - DNA, 16 bp, Homo sapiens
ctcagccccagcccag

SEQ ID NO: 4562059 - DNA, 14 bp, Homo sapiens
ctcagccccaggcc

SEQ ID NO: 4562060 - DNA, 17 bp, Homo sapiens
ctcagccccaggccagc

SEQ ID NO: 4562061 - DNA, 22 bp, Homo sapiens
ctcagccccaggccagctgcgg

SEQ ID NO: 4562062 - DNA, 17 bp, Homo sapiens
ctcagccccgcgtggaa

SEQ ID NO: 4562063 - DNA, 13 bp, Homo sapiens
ctcagccctcaga

SEQ ID NO: 4562064 - DNA, 13 bp, Homo sapiens
ctcagccctcagt

SEQ ID NO: 4562065 - DNA, 13 bp, Homo sapiens
ctcagccctgagg

SEQ ID NO: 4562066 - DNA, 14 bp, Homo sapiens
ctcagccctgaggt

SEQ ID NO: 4562067 - DNA, 16 bp, Homo sapiens
ctcagccctgctccct

SEQ ID NO: 4562068 - DNA, 21 bp, Homo sapiens
ctcagccctgctccctgcctc

SEQ ID NO: 4562069 - DNA, 11 bp, Homo sapiens
ctcagccctgg

SEQ ID NO: 4562070 - DNA, 15 bp, Homo sapiens
ctcagcctcccgagt

SEQ ID NO: 4562071 - DNA, 14 bp, Homo sapiens
ctcagcctctgcca

SEQ ID NO: 4562072 - DNA, 16 bp, Homo sapiens
ctcagcctctgctgga

SEQ ID NO: 4562073 - DNA, 15 bp, Homo sapiens
ctcagccttcctcct

SEQ ID NO: 4562074 - DNA, 11 bp, Homo sapiens
ctcagccttgg

SEQ ID NO: 4562075 - DNA, 15 bp, Homo sapiens
ctcagccttggataa

SEQ ID NO: 4562076 - DNA, 14 bp, Homo sapiens
ctcagcgttttgag

SEQ ID NO: 4562077 - DNA, 16 bp, Homo sapiens
ctcagctctaggctgt

SEQ ID NO: 4562078 - DNA, 16 bp, Homo sapiens
ctcagctctcctgctg

SEQ ID NO: 4562079 - DNA, 16 bp, Homo sapiens
ctcagctgcctcactt

SEQ ID NO: 4562080 - DNA, 20 bp, Homo sapiens
ctcagctgcctcctgcgccc

SEQ ID NO: 4562081 - DNA, 11 bp, Homo sapiens
ctcagctgctg

SEQ ID NO: 4562082 - DNA, 17 bp, Homo sapiens
ctcagcttcttctttca

SEQ ID NO: 4562083 - DNA, 18 bp, Homo sapiens
ctcaggaaccgaggcagg

SEQ ID NO: 4562084 - DNA, 16 bp, Homo sapiens
ctcaggacagaacagt

SEQ ID NO: 4562085 - DNA, 17 bp, Homo sapiens
ctcaggacagaacagtg

SEQ ID NO: 4562086 - DNA, 19 bp, Homo sapiens
ctcaggacagcatcccttc

SEQ ID NO: 4562087 - DNA, 22 bp, Homo sapiens
ctcaggaccaaagctttcatgt

SEQ ID NO: 4562088 - DNA, 16 bp, Homo sapiens
ctcaggagatggaggg

SEQ ID NO: 4562089 - DNA, 18 bp, Homo sapiens
ctcaggagatggagggct

SEQ ID NO: 4562090 - DNA, 22 bp, Homo sapiens
ctcaggagatggagggcttggc

SEQ ID NO: 4562091 - DNA, 16 bp, Homo sapiens
ctcaggagcctctgct

SEQ ID NO: 4562092 - DNA, 15 bp, Homo sapiens
ctcaggaggaggggt

SEQ ID NO: 4562093 - DNA, 19 bp, Homo sapiens
ctcaggaggcgaataaatg

SEQ ID NO: 4562094 - DNA, 22 bp, Homo sapiens
ctcaggaggcgaataaatgttc

SEQ ID NO: 4562095 - DNA, 13 bp, Homo sapiens
ctcaggaggctga

SEQ ID NO: 4562096 - DNA, 14 bp, Homo sapiens
ctcaggaggctgag

SEQ ID NO: 4562097 - DNA, 20 bp, Homo sapiens
ctcaggaggctgagacagga

SEQ ID NO: 4562098 - DNA, 22 bp, Homo sapiens
ctcaggaggctgagacaggaga

SEQ ID NO: 4562099 - DNA, 15 bp, Homo sapiens
ctcaggaggctgagg

SEQ ID NO: 4562100 - DNA, 23 bp, Homo sapiens
ctcaggaggtcacctgccgccct

SEQ ID NO: 4562101 - DNA, 13 bp, Homo sapiens
ctcaggagtctgc

SEQ ID NO: 4562102 - DNA, 15 bp, Homo sapiens
ctcaggagtctgcca

SEQ ID NO: 4562103 - DNA, 19 bp, Homo sapiens
ctcaggagtttgagaccag

SEQ ID NO: 4562104 - DNA, 13 bp, Homo sapiens
ctcaggcacacag

SEQ ID NO: 4562105 - DNA, 20 bp, Homo sapiens
ctcaggccaagaaacgtctt

SEQ ID NO: 4562106 - DNA, 19 bp, Homo sapiens
ctcaggcccagctgctccc

SEQ ID NO: 4562107 - DNA, 20 bp, Homo sapiens
ctcaggcccaggagtccagg

SEQ ID NO: 4562108 - DNA, 15 bp, Homo sapiens
ctcaggccgagagcc

SEQ ID NO: 4562109 - DNA, 17 bp, Homo sapiens
ctcaggccgagagcctt

SEQ ID NO: 4562110 - DNA, 21 bp, Homo sapiens
ctcaggcgggacagtgctgca

SEQ ID NO: 4562111 - DNA, 15 bp, Homo sapiens
ctcaggctcaagttt

SEQ ID NO: 4562112 - DNA, 18 bp, Homo sapiens
ctcaggctcaagttttta

SEQ ID NO: 4562113 - DNA, 22 bp, Homo sapiens
ctcaggctccgggcaccagggg

SEQ ID NO: 4562114 - DNA, 14 bp, Homo sapiens
ctcagggacagaga

SEQ ID NO: 4562115 - DNA, 19 bp, Homo sapiens
ctcagggacagagacacct

SEQ ID NO: 4562116 - DNA, 22 bp, Homo sapiens
ctcagggacagagacacctgca

SEQ ID NO: 4562117 - DNA, 11 bp, Homo sapiens
ctcagggaccg

SEQ ID NO: 4562118 - DNA, 17 bp, Homo sapiens
ctcagggaccggtgctg

SEQ ID NO: 4562119 - DNA, 20 bp, Homo sapiens
ctcagggaccggtgctgcag

SEQ ID NO: 4562120 - DNA, 22 bp, Homo sapiens
ctcagggcattctgttggccta

SEQ ID NO: 4562121 - DNA, 13 bp, Homo sapiens
ctcagggctccca

SEQ ID NO: 4562122 - DNA, 15 bp, Homo sapiens
ctcagggctcccagg

SEQ ID NO: 4562123 - DNA, 15 bp, Homo sapiens
ctcagggctcctggg

SEQ ID NO: 4562124 - DNA, 15 bp, Homo sapiens
ctcagggctgtccca

SEQ ID NO: 4562125 - DNA, 21 bp, Homo sapiens
ctcagggctgtcccagccccg

SEQ ID NO: 4562126 - DNA, 15 bp, Homo sapiens
ctcaggggcctctct

SEQ ID NO: 4562127 - DNA, 16 bp, Homo sapiens
ctcaggggcctctctc

SEQ ID NO: 4562128 - DNA, 20 bp, Homo sapiens
ctcaggggcctctctcctgc

SEQ ID NO: 4562129 - DNA, 14 bp, Homo sapiens
ctcagggtgggggg

SEQ ID NO: 4562130 - DNA, 17 bp, Homo sapiens
ctcagggtggggggtga

SEQ ID NO: 4562131 - DNA, 18 bp, Homo sapiens
ctcaggtaatcattttaa

SEQ ID NO: 4562132 - DNA, 15 bp, Homo sapiens
ctcaggtcctgctgc

SEQ ID NO: 4562133 - DNA, 15 bp, Homo sapiens
ctcaggtttgttttg

SEQ ID NO: 4562134 - DNA, 21 bp, Homo sapiens
ctcagtaacataactgcttct

SEQ ID NO: 4562135 - DNA, 13 bp, Homo sapiens
ctcagtaatttag

SEQ ID NO: 4562136 - DNA, 22 bp, Homo sapiens
ctcagtaatttagaaatcattt

SEQ ID NO: 4562137 - DNA, 13 bp, Homo sapiens
ctcagtaccccat

SEQ ID NO: 4562138 - DNA, 19 bp, Homo sapiens
ctcagtctctcttctctcc

SEQ ID NO: 4562139 - DNA, 23 bp, Homo sapiens
ctcagtgagcctcctgtgcctgg

SEQ ID NO: 4562140 - DNA, 17 bp, Homo sapiens
ctcagtgcatttgtgct

SEQ ID NO: 4562141 - DNA, 21 bp, Homo sapiens
ctcagtgccacctatgcctgt

SEQ ID NO: 4562142 - DNA, 17 bp, Homo sapiens
ctcagtgcttgggctcc

SEQ ID NO: 4562143 - DNA, 19 bp, Homo sapiens
ctcagtgcttgggctccac

SEQ ID NO: 4562144 - DNA, 16 bp, Homo sapiens
ctcagtggatcttcag

SEQ ID NO: 4562145 - DNA, 22 bp, Homo sapiens
ctcagtggcccatggcatttta

SEQ ID NO: 4562146 - DNA, 18 bp, Homo sapiens
ctcagtggcttcatctgt

SEQ ID NO: 4562147 - DNA, 14 bp, Homo sapiens
ctcagtggcttctc

SEQ ID NO: 4562148 - DNA, 23 bp, Homo sapiens
ctcagttcaacctggtggcacca

SEQ ID NO: 4562149 - DNA, 18 bp, Homo sapiens
ctcagttcccttggcctc

SEQ ID NO: 4562150 - DNA, 15 bp, Homo sapiens
ctcagttctctccct

SEQ ID NO: 4562151 - DNA, 22 bp, Homo sapiens
ctcagttctctcccttcctctc

SEQ ID NO: 4562152 - DNA, 14 bp, Homo sapiens
ctcagttgttctga

SEQ ID NO: 4562153 - DNA, 15 bp, Homo sapiens
ctcagttgtttgctt

SEQ ID NO: 4562154 - DNA, 18 bp, Homo sapiens
ctcagttgtttgcttctt

SEQ ID NO: 4562155 - DNA, 19 bp, Homo sapiens
ctcagttgtttgcttcttg

SEQ ID NO: 4562156 - DNA, 15 bp, Homo sapiens
ctcagtttcttgctt

SEQ ID NO: 4562157 - DNA, 16 bp, Homo sapiens
ctcagttttatgcccc

SEQ ID NO: 4562158 - DNA, 13 bp, Homo sapiens
ctcagttttcata

SEQ ID NO: 4562159 - DNA, 18 bp, Homo sapiens
ctcataagtttgtttaaa

SEQ ID NO: 4562160 - DNA, 12 bp, Homo sapiens
ctcataattcct

SEQ ID NO: 4562161 - DNA, 15 bp, Homo sapiens
ctcataattttgcaa

SEQ ID NO: 4562162 - DNA, 22 bp, Homo sapiens
ctcatagaacattgatctgttt

SEQ ID NO: 4562163 - DNA, 14 bp, Homo sapiens
ctcatagaggaaat

SEQ ID NO: 4562164 - DNA, 16 bp, Homo sapiens
ctcatagattgcaaat

SEQ ID NO: 4562165 - DNA, 22 bp, Homo sapiens
ctcataggttaaaaaaaaaagt

SEQ ID NO: 4562166 - DNA, 19 bp, Homo sapiens
ctcataggttgagcaattt

SEQ ID NO: 4562167 - DNA, 13 bp, Homo sapiens
ctcatatggccca

SEQ ID NO: 4562168 - DNA, 14 bp, Homo sapiens
ctcatcaactgaat

SEQ ID NO: 4562169 - DNA, 16 bp, Homo sapiens
ctcatcaactgaatga

SEQ ID NO: 4562170 - DNA, 15 bp, Homo sapiens
ctcatcattctctgt

SEQ ID NO: 4562171 - DNA, 19 bp, Homo sapiens
ctcatcattctctgtctca

SEQ ID NO: 4562172 - DNA, 20 bp, Homo sapiens
ctcatcattctctgtctcat

SEQ ID NO: 4562173 - DNA, 22 bp, Homo sapiens
ctcatcattctctgtctcatcc

SEQ ID NO: 4562174 - DNA, 16 bp, Homo sapiens
ctcatcccaacctctt

SEQ ID NO: 4562175 - DNA, 22 bp, Homo sapiens
ctcatccccaggggtcccagcc

SEQ ID NO: 4562176 - DNA, 23 bp, Homo sapiens
ctcatccccaggggtcccagcca

SEQ ID NO: 4562177 - DNA, 13 bp, Homo sapiens
ctcatccctggac

SEQ ID NO: 4562178 - DNA, 14 bp, Homo sapiens
ctcatcccttgttt

SEQ ID NO: 4562179 - DNA, 20 bp, Homo sapiens
ctcatcctcccattgcccag

SEQ ID NO: 4562180 - DNA, 21 bp, Homo sapiens
ctcatcctcccattgcccagt

SEQ ID NO: 4562181 - DNA, 18 bp, Homo sapiens
ctcatcctgctcttttgt

SEQ ID NO: 4562182 - DNA, 15 bp, Homo sapiens
ctcatctaactgatg

SEQ ID NO: 4562183 - DNA, 20 bp, Homo sapiens
ctcatctcttagctcccctc

SEQ ID NO: 4562184 - DNA, 16 bp, Homo sapiens
ctcatctgcaggacag

SEQ ID NO: 4562185 - DNA, 16 bp, Homo sapiens
ctcatctttcttccaa

SEQ ID NO: 4562186 - DNA, 15 bp, Homo sapiens
ctcatctttcttgat

SEQ ID NO: 4562187 - DNA, 20 bp, Homo sapiens
ctcatgagctgtgttcacag

SEQ ID NO: 4562188 - DNA, 20 bp, Homo sapiens
ctcatgcaaatcaattactg

SEQ ID NO: 4562189 - DNA, 17 bp, Homo sapiens
ctcatgcacccctgagc

SEQ ID NO: 4562190 - DNA, 17 bp, Homo sapiens
ctcatgccagtgcctta

SEQ ID NO: 4562191 - DNA, 19 bp, Homo sapiens
ctcatgcccaccccctgcc

SEQ ID NO: 4562192 - DNA, 15 bp, Homo sapiens
ctcatgctgttgctg

SEQ ID NO: 4562193 - DNA, 23 bp, Homo sapiens
ctcatgggtcctagcccttccct

SEQ ID NO: 4562194 - DNA, 15 bp, Homo sapiens
ctcatgggtggcact

SEQ ID NO: 4562195 - DNA, 23 bp, Homo sapiens
ctcatgggtggcactcagtctct

SEQ ID NO: 4562196 - DNA, 13 bp, Homo sapiens
ctcatgggtggga

SEQ ID NO: 4562197 - DNA, 18 bp, Homo sapiens
ctcatgtgactctttcca

SEQ ID NO: 4562198 - DNA, 17 bp, Homo sapiens
ctcatgttgaaacttta

SEQ ID NO: 4562199 - DNA, 20 bp, Homo sapiens
ctcatgttgctgaatttgta

SEQ ID NO: 4562200 - DNA, 17 bp, Homo sapiens
ctcatgtttacaggggt

SEQ ID NO: 4562201 - DNA, 17 bp, Homo sapiens
ctcattaaaagaatatc

SEQ ID NO: 4562202 - DNA, 15 bp, Homo sapiens
ctcattaatagctgc

SEQ ID NO: 4562203 - DNA, 15 bp, Homo sapiens
ctcattattatctag

SEQ ID NO: 4562204 - DNA, 13 bp, Homo sapiens
ctcattatttcaa

SEQ ID NO: 4562205 - DNA, 12 bp, Homo sapiens
ctcattatttct

SEQ ID NO: 4562206 - DNA, 17 bp, Homo sapiens
ctcattccactgttggt

SEQ ID NO: 4562207 - DNA, 17 bp, Homo sapiens
ctcattctgaaggagcc

SEQ ID NO: 4562208 - DNA, 18 bp, Homo sapiens
ctcattctgaattaatta

SEQ ID NO: 4562209 - DNA, 18 bp, Homo sapiens
ctcattctgcatcctggc

SEQ ID NO: 4562210 - DNA, 21 bp, Homo sapiens
ctcattgcagcagataacttt

SEQ ID NO: 4562211 - DNA, 18 bp, Homo sapiens
ctcattggacccttccat

SEQ ID NO: 4562212 - DNA, 16 bp, Homo sapiens
ctcatttaagggaaaa

SEQ ID NO: 4562213 - DNA, 17 bp, Homo sapiens
ctcatttaagggaaaaa

SEQ ID NO: 4562214 - DNA, 19 bp, Homo sapiens
ctcatttcacccctccctt

SEQ ID NO: 4562215 - DNA, 15 bp, Homo sapiens
ctcatttcatctcat

SEQ ID NO: 4562216 - DNA, 20 bp, Homo sapiens
ctcatttctcataattttgc

SEQ ID NO: 4562217 - DNA, 23 bp, Homo sapiens
ctccaaaaaaaaaaaaaatacaa

SEQ ID NO: 4562218 - DNA, 16 bp, Homo sapiens
ctccaaaaatctgcct

SEQ ID NO: 4562219 - DNA, 17 bp, Homo sapiens
ctccaaaaatctgcctg

SEQ ID NO: 4562220 - DNA, 18 bp, Homo sapiens
ctccaaaaatctgcctgg

SEQ ID NO: 4562221 - DNA, 20 bp, Homo sapiens
ctccaaaccagacggtgacg

SEQ ID NO: 4562222 - DNA, 12 bp, Homo sapiens
ctccaaagaaat

SEQ ID NO: 4562223 - DNA, 14 bp, Homo sapiens
ctccaaaggccccc

SEQ ID NO: 4562224 - DNA, 21 bp, Homo sapiens
ctccaaatgtcctttctcaga

SEQ ID NO: 4562225 - DNA, 23 bp, Homo sapiens
ctccaaatgtcctttctcagagg

SEQ ID NO: 4562226 - DNA, 14 bp, Homo sapiens
ctccaaatttttct

SEQ ID NO: 4562227 - DNA, 15 bp, Homo sapiens
ctccaaccccccagc

SEQ ID NO: 4562228 - DNA, 17 bp, Homo sapiens
ctccaaccccccagcac

SEQ ID NO: 4562229 - DNA, 23 bp, Homo sapiens
ctccaaccccccagcactgagga

SEQ ID NO: 4562230 - DNA, 22 bp, Homo sapiens
ctccaactcctttcagccacat

SEQ ID NO: 4562231 - DNA, 14 bp, Homo sapiens
ctccaagacagcag

SEQ ID NO: 4562232 - DNA, 16 bp, Homo sapiens
ctccaagacagcagca

SEQ ID NO: 4562233 - DNA, 22 bp, Homo sapiens
ctccaagacagcagcagcctgc

SEQ ID NO: 4562234 - DNA, 14 bp, Homo sapiens
ctccaagagctaca

SEQ ID NO: 4562235 - DNA, 22 bp, Homo sapiens
ctccaagcatttcatgaaaaag

SEQ ID NO: 4562236 - DNA, 17 bp, Homo sapiens
ctccaagcctgcctccc

SEQ ID NO: 4562237 - DNA, 23 bp, Homo sapiens
ctccaaggacggtccccacccct

SEQ ID NO: 4562238 - DNA, 19 bp, Homo sapiens
ctccaaggaggggctgtaa

SEQ ID NO: 4562239 - DNA, 22 bp, Homo sapiens
ctccaaggaggggctgtaaaat

SEQ ID NO: 4562240 - DNA, 16 bp, Homo sapiens
ctccaaggcagggacc

SEQ ID NO: 4562241 - DNA, 15 bp, Homo sapiens
ctccaagtctcagtg

SEQ ID NO: 4562242 - DNA, 17 bp, Homo sapiens
ctccaagtctcagtggc

SEQ ID NO: 4562243 - DNA, 19 bp, Homo sapiens
ctccaataaagtgccttct

SEQ ID NO: 4562244 - DNA, 20 bp, Homo sapiens
ctccaataaagtgccttctg

SEQ ID NO: 4562245 - DNA, 19 bp, Homo sapiens
ctccaattctgaaatactt

SEQ ID NO: 4562246 - DNA, 20 bp, Homo sapiens
ctccaattctgaaatacttt

SEQ ID NO: 4562247 - DNA, 14 bp, Homo sapiens
ctccacacaggtgt

SEQ ID NO: 4562248 - DNA, 23 bp, Homo sapiens
ctccacacgccccggtcccccag

SEQ ID NO: 4562249 - DNA, 16 bp, Homo sapiens
ctccacagagaggagg

SEQ ID NO: 4562250 - DNA, 11 bp, Homo sapiens
ctccacagggc

SEQ ID NO: 4562251 - DNA, 14 bp, Homo sapiens
ctccacatcctcca

SEQ ID NO: 4562252 - DNA, 15 bp, Homo sapiens
ctccacatcctccac

SEQ ID NO: 4562253 - DNA, 15 bp, Homo sapiens
ctccacatctgcctt

SEQ ID NO: 4562254 - DNA, 15 bp, Homo sapiens
ctccacattcttcag

SEQ ID NO: 4562255 - DNA, 13 bp, Homo sapiens
ctccaccacatcc

SEQ ID NO: 4562256 - DNA, 13 bp, Homo sapiens
ctccaccagcagc

SEQ ID NO: 4562257 - DNA, 13 bp, Homo sapiens
ctccaccccagga

SEQ ID NO: 4562258 - DNA, 14 bp, Homo sapiens
ctccaccccaggac

SEQ ID NO: 4562259 - DNA, 22 bp, Homo sapiens
ctccaccccaggacgccactca

SEQ ID NO: 4562260 - DNA, 16 bp, Homo sapiens
ctccaccctctgagct

SEQ ID NO: 4562261 - DNA, 12 bp, Homo sapiens
ctccacccttgg

SEQ ID NO: 4562262 - DNA, 13 bp, Homo sapiens
ctccacccttggc

SEQ ID NO: 4562263 - DNA, 13 bp, Homo sapiens
ctccacctcagcc

SEQ ID NO: 4562264 - DNA, 18 bp, Homo sapiens
ctccacctcagccttgga

SEQ ID NO: 4562265 - DNA, 12 bp, Homo sapiens
ctccacctgcac

SEQ ID NO: 4562266 - DNA, 14 bp, Homo sapiens
ctccaccttcatat

SEQ ID NO: 4562267 - DNA, 22 bp, Homo sapiens
ctccacgggcaggggtcagagc

SEQ ID NO: 4562268 - DNA, 15 bp, Homo sapiens
ctccacgttctgctc

SEQ ID NO: 4562269 - DNA, 17 bp, Homo sapiens
ctccactactttactgt

SEQ ID NO: 4562270 - DNA, 19 bp, Homo sapiens
ctccactcgacccagaatg

SEQ ID NO: 4562271 - DNA, 17 bp, Homo sapiens
ctccactctagttctag

SEQ ID NO: 4562272 - DNA, 20 bp, Homo sapiens
ctccactcttgatctctctt

SEQ ID NO: 4562273 - DNA, 23 bp, Homo sapiens
ctccactcttgatctctcttgtc

SEQ ID NO: 4562274 - DNA, 17 bp, Homo sapiens
ctccactggggaatgct

SEQ ID NO: 4562275 - DNA, 23 bp, Homo sapiens
ctccactggggaggaatcctgga

SEQ ID NO: 4562276 - DNA, 23 bp, Homo sapiens
ctccacttgtatatatggatcag

SEQ ID NO: 4562277 - DNA, 14 bp, Homo sapiens
ctccagaagcctct

SEQ ID NO: 4562278 - DNA, 15 bp, Homo sapiens
ctccagaagcctctg

SEQ ID NO: 4562279 - DNA, 20 bp, Homo sapiens
ctccagaagcctctggctag

SEQ ID NO: 4562280 - DNA, 16 bp, Homo sapiens
ctccagagacactgag

SEQ ID NO: 4562281 - DNA, 19 bp, Homo sapiens
ctccagagacactgagcca

SEQ ID NO: 4562282 - DNA, 21 bp, Homo sapiens
ctccagagacactgagccagt

SEQ ID NO: 4562283 - DNA, 18 bp, Homo sapiens
ctccagagccccacagcc

SEQ ID NO: 4562284 - DNA, 23 bp, Homo sapiens
ctccagagggcactcagaagttg

SEQ ID NO: 4562285 - DNA, 14 bp, Homo sapiens
ctccagcaccttct

SEQ ID NO: 4562286 - DNA, 18 bp, Homo sapiens
ctccagcagactcctgct

SEQ ID NO: 4562287 - DNA, 11 bp, Homo sapiens
ctccagccagc

SEQ ID NO: 4562288 - DNA, 12 bp, Homo sapiens
ctccagccagcg

SEQ ID NO: 4562289 - DNA, 17 bp, Homo sapiens
ctccagccagcgcctcc

SEQ ID NO: 4562290 - DNA, 21 bp, Homo sapiens
ctccagccagcgcctccctcc

SEQ ID NO: 4562291 - DNA, 13 bp, Homo sapiens
ctccagcctcccc

SEQ ID NO: 4562292 - DNA, 11 bp, Homo sapiens
ctccagcctct

SEQ ID NO: 4562293 - DNA, 16 bp, Homo sapiens
ctccagcctctgccgc

SEQ ID NO: 4562294 - DNA, 22 bp, Homo sapiens
ctccagcctctgccgctgccat

SEQ ID NO: 4562295 - DNA, 17 bp, Homo sapiens
ctccagcctgcctggca

SEQ ID NO: 4562296 - DNA, 19 bp, Homo sapiens
ctccagcctgcctggcagg

SEQ ID NO: 4562297 - DNA, 15 bp, Homo sapiens
ctccagcctgggcaa

SEQ ID NO: 4562298 - DNA, 13 bp, Homo sapiens
ctccagcctgggg

SEQ ID NO: 4562299 - DNA, 11 bp, Homo sapiens
ctccagctgcc

SEQ ID NO: 4562300 - DNA, 14 bp, Homo sapiens
ctccagctgctgag

SEQ ID NO: 4562301 - DNA, 20 bp, Homo sapiens
ctccagctgctgagatcctg

SEQ ID NO: 4562302 - DNA, 13 bp, Homo sapiens
ctccagcttcccg

SEQ ID NO: 4562303 - DNA, 18 bp, Homo sapiens
ctccagcttcggagggcc

SEQ ID NO: 4562304 - DNA, 21 bp, Homo sapiens
ctccagcttgtggagccccac

SEQ ID NO: 4562305 - DNA, 21 bp, Homo sapiens
ctccaggaaagagcagtcaga

SEQ ID NO: 4562306 - DNA, 22 bp, Homo sapiens
ctccaggagcctcatccagcct

SEQ ID NO: 4562307 - DNA, 23 bp, Homo sapiens
ctccaggagtcacagatgaggcc

SEQ ID NO: 4562308 - DNA, 23 bp, Homo sapiens
ctccaggattttaatttcaggaa

SEQ ID NO: 4562309 - DNA, 12 bp, Homo sapiens
ctccaggcagga

SEQ ID NO: 4562310 - DNA, 14 bp, Homo sapiens
ctccaggcaggact

SEQ ID NO: 4562311 - DNA, 16 bp, Homo sapiens
ctccaggcccaaggct

SEQ ID NO: 4562312 - DNA, 19 bp, Homo sapiens
ctccaggcccaaggctccc

SEQ ID NO: 4562313 - DNA, 17 bp, Homo sapiens
ctccaggcctgcctccc

SEQ ID NO: 4562314 - DNA, 18 bp, Homo sapiens
ctccaggcctgcctccca

SEQ ID NO: 4562315 - DNA, 20 bp, Homo sapiens
ctccagggaattcttacagc

SEQ ID NO: 4562316 - DNA, 16 bp, Homo sapiens
ctccagggccacgtgc

SEQ ID NO: 4562317 - DNA, 13 bp, Homo sapiens
ctccagggccccc

SEQ ID NO: 4562318 - DNA, 14 bp, Homo sapiens
ctccagggctggac

SEQ ID NO: 4562319 - DNA, 22 bp, Homo sapiens
ctccaggggtcctaggcctcaa

SEQ ID NO: 4562320 - DNA, 17 bp, Homo sapiens
ctccagggtcctctctt

SEQ ID NO: 4562321 - DNA, 14 bp, Homo sapiens
ctccagtacgtccc

SEQ ID NO: 4562322 - DNA, 22 bp, Homo sapiens
ctccagtacgtcccgctgctgt

SEQ ID NO: 4562323 - DNA, 14 bp, Homo sapiens
ctccagtcatggta

SEQ ID NO: 4562324 - DNA, 23 bp, Homo sapiens
ctccagtcatggtactaccccag

SEQ ID NO: 4562325 - DNA, 15 bp, Homo sapiens
ctccagtctcatcct

SEQ ID NO: 4562326 - DNA, 18 bp, Homo sapiens
ctccagtctcatcctccc

SEQ ID NO: 4562327 - DNA, 19 bp, Homo sapiens
ctccagtctcatcctccca

SEQ ID NO: 4562328 - DNA, 22 bp, Homo sapiens
ctccagtctcatcctcccattg

SEQ ID NO: 4562329 - DNA, 13 bp, Homo sapiens
ctccagtgaaact

SEQ ID NO: 4562330 - DNA, 15 bp, Homo sapiens
ctccagtgcagtcca

SEQ ID NO: 4562331 - DNA, 16 bp, Homo sapiens
ctccagtgctggattt

SEQ ID NO: 4562332 - DNA, 17 bp, Homo sapiens
ctccagtgctggatttg

SEQ ID NO: 4562333 - DNA, 18 bp, Homo sapiens
ctccagtttgcccaccac

SEQ ID NO: 4562334 - DNA, 12 bp, Homo sapiens
ctccatacagcc

SEQ ID NO: 4562335 - DNA, 21 bp, Homo sapiens
ctccatacagcctctacagcc

SEQ ID NO: 4562336 - DNA, 18 bp, Homo sapiens
ctccatactgggctaagg

SEQ ID NO: 4562337 - DNA, 17 bp, Homo sapiens
ctccatatctccttccc

SEQ ID NO: 4562338 - DNA, 12 bp, Homo sapiens
ctccatcccctc

SEQ ID NO: 4562339 - DNA, 18 bp, Homo sapiens
ctccatcctaccccctgt

SEQ ID NO: 4562340 - DNA, 23 bp, Homo sapiens
ctccatctcatgtatcatctgga

SEQ ID NO: 4562341 - DNA, 15 bp, Homo sapiens
ctccatctcttctgc

SEQ ID NO: 4562342 - DNA, 16 bp, Homo sapiens
ctccatctcttctgca

SEQ ID NO: 4562343 - DNA, 15 bp, Homo sapiens
ctccatgctgggtct

SEQ ID NO: 4562344 - DNA, 13 bp, Homo sapiens
ctccatggaaaag

SEQ ID NO: 4562345 - DNA, 19 bp, Homo sapiens
ctccatggccctgtcccag

SEQ ID NO: 4562346 - DNA, 18 bp, Homo sapiens
ctccatggggttcgagac

SEQ ID NO: 4562347 - DNA, 21 bp, Homo sapiens
ctccatgtagaataaatgaag

SEQ ID NO: 4562348 - DNA, 20 bp, Homo sapiens
ctccatttaagacacattga

SEQ ID NO: 4562349 - DNA, 18 bp, Homo sapiens
ctcccaaacgccctttcc

SEQ ID NO: 4562350 - DNA, 20 bp, Homo sapiens
ctcccaaagctcagacttgc

SEQ ID NO: 4562351 - DNA, 17 bp, Homo sapiens
ctcccaaagtgctggga

SEQ ID NO: 4562352 - DNA, 15 bp, Homo sapiens
ctcccaacccattca

SEQ ID NO: 4562353 - DNA, 14 bp, Homo sapiens
ctcccaagaaacct

SEQ ID NO: 4562354 - DNA, 22 bp, Homo sapiens
ctcccaagcccacgtcaggcct

SEQ ID NO: 4562355 - DNA, 17 bp, Homo sapiens
ctcccaaggtcctctca

SEQ ID NO: 4562356 - DNA, 19 bp, Homo sapiens
ctcccaagtcccaccctct

SEQ ID NO: 4562357 - DNA, 14 bp, Homo sapiens
ctcccaatcagctt

SEQ ID NO: 4562358 - DNA, 17 bp, Homo sapiens
ctcccaatcagcttttg

SEQ ID NO: 4562359 - DNA, 13 bp, Homo sapiens
ctcccacacccct

SEQ ID NO: 4562360 - DNA, 16 bp, Homo sapiens
ctcccacagagtgctg

SEQ ID NO: 4562361 - DNA, 18 bp, Homo sapiens
ctcccacagagtgctgga

SEQ ID NO: 4562362 - DNA, 22 bp, Homo sapiens
ctcccacagagtgctggactgt

SEQ ID NO: 4562363 - DNA, 18 bp, Homo sapiens
ctcccacataagcactag

SEQ ID NO: 4562364 - DNA, 21 bp, Homo sapiens
ctcccacatgaggccatctca

SEQ ID NO: 4562365 - DNA, 22 bp, Homo sapiens
ctcccaccagaacgcaccccac

SEQ ID NO: 4562366 - DNA, 13 bp, Homo sapiens
ctcccaccagagc

SEQ ID NO: 4562367 - DNA, 18 bp, Homo sapiens
ctcccaccagagccggga

SEQ ID NO: 4562368 - DNA, 19 bp, Homo sapiens
ctcccaccccacccccttc

SEQ ID NO: 4562369 - DNA, 22 bp, Homo sapiens
ctcccaccccacccccttcagt

SEQ ID NO: 4562370 - DNA, 14 bp, Homo sapiens
ctcccacccccagc

SEQ ID NO: 4562371 - DNA, 23 bp, Homo sapiens
ctcccacccccttctctgctcca

SEQ ID NO: 4562372 - DNA, 18 bp, Homo sapiens
ctcccacccggccacagc

SEQ ID NO: 4562373 - DNA, 23 bp, Homo sapiens
ctcccacccggccacagctgctg

SEQ ID NO: 4562374 - DNA, 17 bp, Homo sapiens
ctcccaccgctgcctcg

SEQ ID NO: 4562375 - DNA, 14 bp, Homo sapiens
ctcccacctgacac

SEQ ID NO: 4562376 - DNA, 21 bp, Homo sapiens
ctcccacctgacacaccaggc

SEQ ID NO: 4562377 - DNA, 19 bp, Homo sapiens
ctcccacgaactcaagggt

SEQ ID NO: 4562378 - DNA, 18 bp, Homo sapiens
ctcccacggcacctcggg

SEQ ID NO: 4562379 - DNA, 15 bp, Homo sapiens
ctcccagacaggccc

SEQ ID NO: 4562380 - DNA, 14 bp, Homo sapiens
ctcccagatgtaaa

SEQ ID NO: 4562381 - DNA, 14 bp, Homo sapiens
ctcccagctccttt

SEQ ID NO: 4562382 - DNA, 12 bp, Homo sapiens
ctcccaggcccc

SEQ ID NO: 4562383 - DNA, 16 bp, Homo sapiens
ctcccaggggtctccc

SEQ ID NO: 4562384 - DNA, 18 bp, Homo sapiens
ctcccaggggtctccctg

SEQ ID NO: 4562385 - DNA, 20 bp, Homo sapiens
ctcccagggtccctgcccac

SEQ ID NO: 4562386 - DNA, 16 bp, Homo sapiens
ctcccaggtaccagct

SEQ ID NO: 4562387 - DNA, 17 bp, Homo sapiens
ctcccaggtaccagctg

SEQ ID NO: 4562388 - DNA, 18 bp, Homo sapiens
ctcccaggtaccagctgc

SEQ ID NO: 4562389 - DNA, 21 bp, Homo sapiens
ctcccaggtaccagctgcgct

SEQ ID NO: 4562390 - DNA, 22 bp, Homo sapiens
ctcccaggtaccagctgcgctt

SEQ ID NO: 4562391 - DNA, 19 bp, Homo sapiens
ctcccaggttcccccagca

SEQ ID NO: 4562392 - DNA, 21 bp, Homo sapiens
ctcccaggttcccccagcaag

SEQ ID NO: 4562393 - DNA, 22 bp, Homo sapiens
ctcccaggttcccccagcaagc

SEQ ID NO: 4562394 - DNA, 14 bp, Homo sapiens
ctcccagtcctgcc

SEQ ID NO: 4562395 - DNA, 17 bp, Homo sapiens
ctcccagtcctgcctga

SEQ ID NO: 4562396 - DNA, 16 bp, Homo sapiens
ctcccagtctacccag

SEQ ID NO: 4562397 - DNA, 21 bp, Homo sapiens
ctcccagtgaactcctgccag

SEQ ID NO: 4562398 - DNA, 23 bp, Homo sapiens
ctcccatagatactctcttcttc

SEQ ID NO: 4562399 - DNA, 15 bp, Homo sapiens
ctcccattcctccct

SEQ ID NO: 4562400 - DNA, 15 bp, Homo sapiens
ctcccattgcccagt

SEQ ID NO: 4562401 - DNA, 17 bp, Homo sapiens
ctcccattgcccagtga

SEQ ID NO: 4562402 - DNA, 18 bp, Homo sapiens
ctcccattgcccagtgag

SEQ ID NO: 4562403 - DNA, 19 bp, Homo sapiens
ctcccattgcccagtgagc

SEQ ID NO: 4562404 - DNA, 21 bp, Homo sapiens
ctccccaaatcaatacactag

SEQ ID NO: 4562405 - DNA, 16 bp, Homo sapiens
ctccccaattctcccc

SEQ ID NO: 4562406 - DNA, 11 bp, Homo sapiens
ctccccacagc

SEQ ID NO: 4562407 - DNA, 13 bp, Homo sapiens
ctccccacccgct

SEQ ID NO: 4562408 - DNA, 18 bp, Homo sapiens
ctccccacgagggctggc

SEQ ID NO: 4562409 - DNA, 18 bp, Homo sapiens
ctccccacgcccgtctct

SEQ ID NO: 4562410 - DNA, 14 bp, Homo sapiens
ctccccagaaacag

SEQ ID NO: 4562411 - DNA, 11 bp, Homo sapiens
ctccccagaat

SEQ ID NO: 4562412 - DNA, 12 bp, Homo sapiens
ctccccagactc

SEQ ID NO: 4562413 - DNA, 15 bp, Homo sapiens
ctccccagagctggc

SEQ ID NO: 4562414 - DNA, 11 bp, Homo sapiens
ctccccagcca

SEQ ID NO: 4562415 - DNA, 14 bp, Homo sapiens
ctccccagccagcc

SEQ ID NO: 4562416 - DNA, 17 bp, Homo sapiens
ctccccagccagccctt

SEQ ID NO: 4562417 - DNA, 19 bp, Homo sapiens
ctccccagccccctcccac

SEQ ID NO: 4562418 - DNA, 20 bp, Homo sapiens
ctccccaggaagtggctcag

SEQ ID NO: 4562419 - DNA, 16 bp, Homo sapiens
ctccccaggctggaga

SEQ ID NO: 4562420 - DNA, 11 bp, Homo sapiens
ctccccagtgc

SEQ ID NO: 4562421 - DNA, 12 bp, Homo sapiens
ctccccagtgcc

SEQ ID NO: 4562422 - DNA, 14 bp, Homo sapiens
ctccccagtgcctg

SEQ ID NO: 4562423 - DNA, 15 bp, Homo sapiens
ctccccatatataaa

SEQ ID NO: 4562424 - DNA, 17 bp, Homo sapiens
ctccccatatataaatt

SEQ ID NO: 4562425 - DNA, 21 bp, Homo sapiens
ctccccatatataaattatta

SEQ ID NO: 4562426 - DNA, 16 bp, Homo sapiens
ctccccatctgtccag

SEQ ID NO: 4562427 - DNA, 18 bp, Homo sapiens
ctccccatttcccatctg

SEQ ID NO: 4562428 - DNA, 19 bp, Homo sapiens
ctccccatttcccatctgc

SEQ ID NO: 4562429 - DNA, 19 bp, Homo sapiens
ctcccccatccccaccact

SEQ ID NO: 4562430 - DNA, 15 bp, Homo sapiens
ctcccccatgggctg

SEQ ID NO: 4562431 - DNA, 13 bp, Homo sapiens
ctccccccactgc

SEQ ID NO: 4562432 - DNA, 14 bp, Homo sapiens
ctccccccactgca

SEQ ID NO: 4562433 - DNA, 16 bp, Homo sapiens
ctccccccactgcagg

SEQ ID NO: 4562434 - DNA, 13 bp, Homo sapiens
ctccccccagacc

SEQ ID NO: 4562435 - DNA, 14 bp, Homo sapiens
ctccccccagaccc

SEQ ID NO: 4562436 - DNA, 23 bp, Homo sapiens
ctccccccagaccccgcccctgg

SEQ ID NO: 4562437 - DNA, 17 bp, Homo sapiens
ctccccctccttgtgcc

SEQ ID NO: 4562438 - DNA, 14 bp, Homo sapiens
ctccccctgcaact

SEQ ID NO: 4562439 - DNA, 11 bp, Homo sapiens
ctccccctgcc

SEQ ID NO: 4562440 - DNA, 20 bp, Homo sapiens
ctccccctttcacactggat

SEQ ID NO: 4562441 - DNA, 21 bp, Homo sapiens
ctcccctatccacccagccca

SEQ ID NO: 4562442 - DNA, 19 bp, Homo sapiens
ctcccctattttaagacgt

SEQ ID NO: 4562443 - DNA, 15 bp, Homo sapiens
ctcccctccaacctg

SEQ ID NO: 4562444 - DNA, 17 bp, Homo sapiens
ctcccctcctcttccct

SEQ ID NO: 4562445 - DNA, 14 bp, Homo sapiens
ctcccctcggagaa

SEQ ID NO: 4562446 - DNA, 22 bp, Homo sapiens
ctcccctctcgccccatccctg

SEQ ID NO: 4562447 - DNA, 14 bp, Homo sapiens
ctcccctctgcttc

SEQ ID NO: 4562448 - DNA, 15 bp, Homo sapiens
ctcccctgccagggc

SEQ ID NO: 4562449 - DNA, 16 bp, Homo sapiens
ctcccctgccagggca

SEQ ID NO: 4562450 - DNA, 21 bp, Homo sapiens
ctcccctgccagggcagggcc

SEQ ID NO: 4562451 - DNA, 17 bp, Homo sapiens
ctcccctgcccccagga

SEQ ID NO: 4562452 - DNA, 15 bp, Homo sapiens
ctcccctggctggct

SEQ ID NO: 4562453 - DNA, 14 bp, Homo sapiens
ctcccgaaaaatgt

SEQ ID NO: 4562454 - DNA, 17 bp, Homo sapiens
ctcccgaaaaatgtgtg

SEQ ID NO: 4562455 - DNA, 16 bp, Homo sapiens
ctcccgccccttccca

SEQ ID NO: 4562456 - DNA, 22 bp, Homo sapiens
ctcccggaattccgtcaccacg

SEQ ID NO: 4562457 - DNA, 15 bp, Homo sapiens
ctcccggcccgcctg

SEQ ID NO: 4562458 - DNA, 20 bp, Homo sapiens
ctcccggcccgcctgcccag

SEQ ID NO: 4562459 - DNA, 13 bp, Homo sapiens
ctcccggggcctg

SEQ ID NO: 4562460 - DNA, 21 bp, Homo sapiens
ctcccggggcctggacaggcg

SEQ ID NO: 4562461 - DNA, 17 bp, Homo sapiens
ctccctacctcaacctg

SEQ ID NO: 4562462 - DNA, 14 bp, Homo sapiens
ctccctactcccct

SEQ ID NO: 4562463 - DNA, 23 bp, Homo sapiens
ctccctagaggggcaccttttca

SEQ ID NO: 4562464 - DNA, 21 bp, Homo sapiens
ctccctagttagcatccaggc

SEQ ID NO: 4562465 - DNA, 24 bp, Homo sapiens
ctccctagttagcatccaggctgg

SEQ ID NO: 4562466 - DNA, 11 bp, Homo sapiens
ctccctcagac

SEQ ID NO: 4562467 - DNA, 12 bp, Homo sapiens
ctccctcagacc

SEQ ID NO: 4562468 - DNA, 16 bp, Homo sapiens
ctccctcagactcaga

SEQ ID NO: 4562469 - DNA, 17 bp, Homo sapiens
ctccctcagactcagag

SEQ ID NO: 4562470 - DNA, 20 bp, Homo sapiens
ctccctcagactcagaggtc

SEQ ID NO: 4562471 - DNA, 23 bp, Homo sapiens
ctccctcagactcagaggtccag

SEQ ID NO: 4562472 - DNA, 18 bp, Homo sapiens
ctccctcaggcccaggag

SEQ ID NO: 4562473 - DNA, 14 bp, Homo sapiens
ctccctcatcggcc

SEQ ID NO: 4562474 - DNA, 14 bp, Homo sapiens
ctccctccacccca

SEQ ID NO: 4562475 - DNA, 19 bp, Homo sapiens
ctccctccaccccaggacg

SEQ ID NO: 4562476 - DNA, 15 bp, Homo sapiens
ctccctccacctcaa

SEQ ID NO: 4562477 - DNA, 15 bp, Homo sapiens
ctccctccagctgcg

SEQ ID NO: 4562478 - DNA, 14 bp, Homo sapiens
ctccctccagggtc

SEQ ID NO: 4562479 - DNA, 16 bp, Homo sapiens
ctccctcccctgccct

SEQ ID NO: 4562480 - DNA, 21 bp, Homo sapiens
ctccctcccctgccctggtcc

SEQ ID NO: 4562481 - DNA, 23 bp, Homo sapiens
ctccctcccctgccctggtccag

SEQ ID NO: 4562482 - DNA, 17 bp, Homo sapiens
ctccctcctcacctctg

SEQ ID NO: 4562483 - DNA, 19 bp, Homo sapiens
ctccctcctcacctctgga

SEQ ID NO: 4562484 - DNA, 17 bp, Homo sapiens
ctccctcgtcgagctgg

SEQ ID NO: 4562485 - DNA, 15 bp, Homo sapiens
ctccctctccaagac

SEQ ID NO: 4562486 - DNA, 16 bp, Homo sapiens
ctccctctccaagaca

SEQ ID NO: 4562487 - DNA, 15 bp, Homo sapiens
ctccctctctcttct

SEQ ID NO: 4562488 - DNA, 17 bp, Homo sapiens
ctccctctctcttctgc

SEQ ID NO: 4562489 - DNA, 15 bp, Homo sapiens
ctccctctctgtgca

SEQ ID NO: 4562490 - DNA, 14 bp, Homo sapiens
ctccctctggccct

SEQ ID NO: 4562491 - DNA, 15 bp, Homo sapiens
ctccctcttctgccc

SEQ ID NO: 4562492 - DNA, 23 bp, Homo sapiens
ctccctgaaaatgtttttctgcc

SEQ ID NO: 4562493 - DNA, 15 bp, Homo sapiens
ctccctgaccctgct

SEQ ID NO: 4562494 - DNA, 20 bp, Homo sapiens
ctccctgaccctgctcctag

SEQ ID NO: 4562495 - DNA, 23 bp, Homo sapiens
ctccctgaccctgctcctagcac

SEQ ID NO: 4562496 - DNA, 21 bp, Homo sapiens
ctccctgaccttagcgttctg

SEQ ID NO: 4562497 - DNA, 20 bp, Homo sapiens
ctccctgactccctgtgggg

SEQ ID NO: 4562498 - DNA, 16 bp, Homo sapiens
ctccctgacttttctg

SEQ ID NO: 4562499 - DNA, 20 bp, Homo sapiens
ctccctgcaagctccgcctc

SEQ ID NO: 4562500 - DNA, 15 bp, Homo sapiens
ctccctgccgcctca

SEQ ID NO: 4562501 - DNA, 15 bp, Homo sapiens
ctccctgcctcactc

SEQ ID NO: 4562502 - DNA, 23 bp, Homo sapiens
ctccctgcctcactcctccgtga

SEQ ID NO: 4562503 - DNA, 14 bp, Homo sapiens
ctccctgcctcctg

SEQ ID NO: 4562504 - DNA, 17 bp, Homo sapiens
ctccctgcctcctgcct

SEQ ID NO: 4562505 - DNA, 18 bp, Homo sapiens
ctccctgcctcctgccta

SEQ ID NO: 4562506 - DNA, 15 bp, Homo sapiens
ctccctgcctgctcc

SEQ ID NO: 4562507 - DNA, 19 bp, Homo sapiens
ctccctgcctgctccttgg

SEQ ID NO: 4562508 - DNA, 12 bp, Homo sapiens
ctccctgcctgg

SEQ ID NO: 4562509 - DNA, 18 bp, Homo sapiens
ctccctgcctggccccca

SEQ ID NO: 4562510 - DNA, 16 bp, Homo sapiens
ctccctgcctgtggcc

SEQ ID NO: 4562511 - DNA, 17 bp, Homo sapiens
ctccctgcctgtggccc

SEQ ID NO: 4562512 - DNA, 17 bp, Homo sapiens
ctccctgctagcacaga

SEQ ID NO: 4562513 - DNA, 16 bp, Homo sapiens
ctccctgctgctccta

SEQ ID NO: 4562514 - DNA, 22 bp, Homo sapiens
ctccctgctgtgccatgctggg

SEQ ID NO: 4562515 - DNA, 22 bp, Homo sapiens
ctccctggagtgtggctgagga

SEQ ID NO: 4562516 - DNA, 21 bp, Homo sapiens
ctccctggcagcacaggaaaa

SEQ ID NO: 4562517 - DNA, 19 bp, Homo sapiens
ctccctgtacacagtgccc

SEQ ID NO: 4562518 - DNA, 19 bp, Homo sapiens
ctccctgtagctctgcctc

SEQ ID NO: 4562519 - DNA, 20 bp, Homo sapiens
ctccctgtagctctgcctcc

SEQ ID NO: 4562520 - DNA, 16 bp, Homo sapiens
ctccctgtctccaggg

SEQ ID NO: 4562521 - DNA, 19 bp, Homo sapiens
ctccctgtctccagggccc

SEQ ID NO: 4562522 - DNA, 23 bp, Homo sapiens
ctccctgtctccagggcccccac

SEQ ID NO: 4562523 - DNA, 14 bp, Homo sapiens
ctccctgtgttctg

SEQ ID NO: 4562524 - DNA, 16 bp, Homo sapiens
ctccctgtgttctggg

SEQ ID NO: 4562525 - DNA, 19 bp, Homo sapiens
ctccctgtgttctgggctg

SEQ ID NO: 4562526 - DNA, 11 bp, Homo sapiens
ctcccttaccc

SEQ ID NO: 4562527 - DNA, 17 bp, Homo sapiens
ctcccttctacctgcca

SEQ ID NO: 4562528 - DNA, 16 bp, Homo sapiens
ctcccttctcttcaca

SEQ ID NO: 4562529 - DNA, 13 bp, Homo sapiens
ctcccttggccca

SEQ ID NO: 4562530 - DNA, 17 bp, Homo sapiens
ctcccttggcccagaga

SEQ ID NO: 4562531 - DNA, 13 bp, Homo sapiens
ctcccttgggctc

SEQ ID NO: 4562532 - DNA, 18 bp, Homo sapiens
ctcccttgggctccctgt

SEQ ID NO: 4562533 - DNA, 16 bp, Homo sapiens
ctccctttctcttctt

SEQ ID NO: 4562534 - DNA, 14 bp, Homo sapiens
ctccgaggctcccc

SEQ ID NO: 4562535 - DNA, 15 bp, Homo sapiens
ctccgaggctccccg

SEQ ID NO: 4562536 - DNA, 23 bp, Homo sapiens
ctccgaggctccccgcctccact

SEQ ID NO: 4562537 - DNA, 19 bp, Homo sapiens
ctccgagtgaactggtctt

SEQ ID NO: 4562538 - DNA, 14 bp, Homo sapiens
ctccgcatcacctc

SEQ ID NO: 4562539 - DNA, 12 bp, Homo sapiens
ctccgccagcct

SEQ ID NO: 4562540 - DNA, 13 bp, Homo sapiens
ctccgccagcctc

SEQ ID NO: 4562541 - DNA, 14 bp, Homo sapiens
ctccgccagcctcc

SEQ ID NO: 4562542 - DNA, 13 bp, Homo sapiens
ctccgcccctgcc

SEQ ID NO: 4562543 - DNA, 15 bp, Homo sapiens
ctccgccgtgccggc

SEQ ID NO: 4562544 - DNA, 14 bp, Homo sapiens
ctccgcctccacac

SEQ ID NO: 4562545 - DNA, 15 bp, Homo sapiens
ctccgcctccacact

SEQ ID NO: 4562546 - DNA, 16 bp, Homo sapiens
ctccgcctccacactg

SEQ ID NO: 4562547 - DNA, 22 bp, Homo sapiens
ctccgcctccacactgaccaag

SEQ ID NO: 4562548 - DNA, 19 bp, Homo sapiens
ctccgcctgggtcatgggc

SEQ ID NO: 4562549 - DNA, 13 bp, Homo sapiens
ctccgccttttag

SEQ ID NO: 4562550 - DNA, 20 bp, Homo sapiens
ctccgcgccgatgccaccgg

SEQ ID NO: 4562551 - DNA, 12 bp, Homo sapiens
ctccggaggact

SEQ ID NO: 4562552 - DNA, 17 bp, Homo sapiens
ctccggccatactgcct

SEQ ID NO: 4562553 - DNA, 21 bp, Homo sapiens
ctccggctgtgctgggagaaa

SEQ ID NO: 4562554 - DNA, 15 bp, Homo sapiens
ctccgggactgccct

SEQ ID NO: 4562555 - DNA, 17 bp, Homo sapiens
ctccgggcaccaggggc

SEQ ID NO: 4562556 - DNA, 19 bp, Homo sapiens
ctccgggcaccaggggcca

SEQ ID NO: 4562557 - DNA, 19 bp, Homo sapiens
ctccgggtgtggcctcagc

SEQ ID NO: 4562558 - DNA, 22 bp, Homo sapiens
ctccgggtgtggcctcagccct

SEQ ID NO: 4562559 - DNA, 23 bp, Homo sapiens
ctccgggtgtggcctcagccctc

SEQ ID NO: 4562560 - DNA, 13 bp, Homo sapiens
ctccgtcagcttc

SEQ ID NO: 4562561 - DNA, 13 bp, Homo sapiens
ctccgtggagcag

SEQ ID NO: 4562562 - DNA, 15 bp, Homo sapiens
ctccgtgtggagcac

SEQ ID NO: 4562563 - DNA, 15 bp, Homo sapiens
ctccgttccatctgg

SEQ ID NO: 4562564 - DNA, 19 bp, Homo sapiens
ctccgttccatctgggctt

SEQ ID NO: 4562565 - DNA, 19 bp, Homo sapiens
ctcctagaagaaccaaata

SEQ ID NO: 4562566 - DNA, 15 bp, Homo sapiens
ctcctagagaacgca

SEQ ID NO: 4562567 - DNA, 20 bp, Homo sapiens
ctcctagagaacgcagccct

SEQ ID NO: 4562568 - DNA, 14 bp, Homo sapiens
ctcctagcaccctg

SEQ ID NO: 4562569 - DNA, 15 bp, Homo sapiens
ctcctagcaccctgg

SEQ ID NO: 4562570 - DNA, 18 bp, Homo sapiens
ctcctagctctcccagtg

SEQ ID NO: 4562571 - DNA, 17 bp, Homo sapiens
ctcctatatatttctat

SEQ ID NO: 4562572 - DNA, 22 bp, Homo sapiens
ctcctatgggttgtcaccaagc

SEQ ID NO: 4562573 - DNA, 23 bp, Homo sapiens
ctcctattccttcacacagttca

SEQ ID NO: 4562574 - DNA, 16 bp, Homo sapiens
ctcctatttttttaaa

SEQ ID NO: 4562575 - DNA, 18 bp, Homo sapiens
ctcctatttttttaaaat

SEQ ID NO: 4562576 - DNA, 22 bp, Homo sapiens
ctcctcaaacccagtctcagac

SEQ ID NO: 4562577 - DNA, 12 bp, Homo sapiens
ctcctcacctca

SEQ ID NO: 4562578 - DNA, 20 bp, Homo sapiens
ctcctcacctcatgcccacc

SEQ ID NO: 4562579 - DNA, 15 bp, Homo sapiens
ctcctcacctctgga

SEQ ID NO: 4562580 - DNA, 21 bp, Homo sapiens
ctcctcacctctggactggct

SEQ ID NO: 4562581 - DNA, 15 bp, Homo sapiens
ctcctcactctgtcc

SEQ ID NO: 4562582 - DNA, 14 bp, Homo sapiens
ctcctcactgtatc

SEQ ID NO: 4562583 - DNA, 14 bp, Homo sapiens
ctcctcagccagcc

SEQ ID NO: 4562584 - DNA, 18 bp, Homo sapiens
ctcctcagccagcctcct

SEQ ID NO: 4562585 - DNA, 17 bp, Homo sapiens
ctcctcaggcacacagc

SEQ ID NO: 4562586 - DNA, 19 bp, Homo sapiens
ctcctcaggcacacagcta

SEQ ID NO: 4562587 - DNA, 14 bp, Homo sapiens
ctcctcagggtggg

SEQ ID NO: 4562588 - DNA, 17 bp, Homo sapiens
ctcctcagtggcttctc

SEQ ID NO: 4562589 - DNA, 21 bp, Homo sapiens
ctcctcatccccacaatctgg

SEQ ID NO: 4562590 - DNA, 13 bp, Homo sapiens
ctcctcatctcca

SEQ ID NO: 4562591 - DNA, 18 bp, Homo sapiens
ctcctccaaaggaagtct

SEQ ID NO: 4562592 - DNA, 14 bp, Homo sapiens
ctcctccaaaggcc

SEQ ID NO: 4562593 - DNA, 17 bp, Homo sapiens
ctcctccactctccccc

SEQ ID NO: 4562594 - DNA, 21 bp, Homo sapiens
ctcctccaggcctgcctccca

SEQ ID NO: 4562595 - DNA, 19 bp, Homo sapiens
ctcctccagggccacgtgc

SEQ ID NO: 4562596 - DNA, 22 bp, Homo sapiens
ctcctccagggccacgtgccag

SEQ ID NO: 4562597 - DNA, 22 bp, Homo sapiens
ctcctccagtacgtcccgctgc

SEQ ID NO: 4562598 - DNA, 18 bp, Homo sapiens
ctcctccatgggagaaaa

SEQ ID NO: 4562599 - DNA, 13 bp, Homo sapiens
ctcctcccaaagt

SEQ ID NO: 4562600 - DNA, 14 bp, Homo sapiens
ctcctcccagccca

SEQ ID NO: 4562601 - DNA, 11 bp, Homo sapiens
ctcctcccata

SEQ ID NO: 4562602 - DNA, 14 bp, Homo sapiens
ctcctccccaaatc

SEQ ID NO: 4562603 - DNA, 14 bp, Homo sapiens
ctcctccccagagc

SEQ ID NO: 4562604 - DNA, 16 bp, Homo sapiens
ctcctccccagagctg

SEQ ID NO: 4562605 - DNA, 15 bp, Homo sapiens
ctcctccccttcctg

SEQ ID NO: 4562606 - DNA, 15 bp, Homo sapiens
ctcctcccgcccttc

SEQ ID NO: 4562607 - DNA, 16 bp, Homo sapiens
ctcctcccgcccttcc

SEQ ID NO: 4562608 - DNA, 12 bp, Homo sapiens
ctcctccctcag

SEQ ID NO: 4562609 - DNA, 13 bp, Homo sapiens
ctcctccctcaga

SEQ ID NO: 4562610 - DNA, 14 bp, Homo sapiens
ctcctccctcagac

SEQ ID NO: 4562611 - DNA, 16 bp, Homo sapiens
ctcctccctcagaccc

SEQ ID NO: 4562612 - DNA, 20 bp, Homo sapiens
ctcctccctcagacccagga

SEQ ID NO: 4562613 - DNA, 22 bp, Homo sapiens
ctcctccctcagctctctggga

SEQ ID NO: 4562614 - DNA, 17 bp, Homo sapiens
ctcctccctcaggccca

SEQ ID NO: 4562615 - DNA, 16 bp, Homo sapiens
ctcctccctccagctg

SEQ ID NO: 4562616 - DNA, 14 bp, Homo sapiens
ctcctccgtgagca

SEQ ID NO: 4562617 - DNA, 14 bp, Homo sapiens
ctcctcctcaccct

SEQ ID NO: 4562618 - DNA, 14 bp, Homo sapiens
ctcctcctcccctc

SEQ ID NO: 4562619 - DNA, 15 bp, Homo sapiens
ctcctcctttttcca

SEQ ID NO: 4562620 - DNA, 17 bp, Homo sapiens
ctcctcgagatcccaac

SEQ ID NO: 4562621 - DNA, 17 bp, Homo sapiens
ctcctcggagagcagca

SEQ ID NO: 4562622 - DNA, 16 bp, Homo sapiens
ctcctctcctggagga

SEQ ID NO: 4562623 - DNA, 22 bp, Homo sapiens
ctcctctgaaacagctgcctta

SEQ ID NO: 4562624 - DNA, 19 bp, Homo sapiens
ctcctctgactcagggctc

SEQ ID NO: 4562625 - DNA, 12 bp, Homo sapiens
ctcctctgcact

SEQ ID NO: 4562626 - DNA, 22 bp, Homo sapiens
ctcctctgcccgggagctcagg

SEQ ID NO: 4562627 - DNA, 21 bp, Homo sapiens
ctcctctggacggcaggctca

SEQ ID NO: 4562628 - DNA, 18 bp, Homo sapiens
ctcctctggctttcccag

SEQ ID NO: 4562629 - DNA, 16 bp, Homo sapiens
ctcctctgggccctgt

SEQ ID NO: 4562630 - DNA, 18 bp, Homo sapiens
ctcctctgggccctgtcg

SEQ ID NO: 4562631 - DNA, 13 bp, Homo sapiens
ctcctctgtgacc

SEQ ID NO: 4562632 - DNA, 22 bp, Homo sapiens
ctcctctgtgaccaatgtcttg

SEQ ID NO: 4562633 - DNA, 20 bp, Homo sapiens
ctcctcttcccttagcctct

SEQ ID NO: 4562634 - DNA, 14 bp, Homo sapiens
ctcctcttggaatt

SEQ ID NO: 4562635 - DNA, 18 bp, Homo sapiens
ctcctctttaaaacaaaa

SEQ ID NO: 4562636 - DNA, 22 bp, Homo sapiens
ctcctgaaaaggtttatgaaaa

SEQ ID NO: 4562637 - DNA, 16 bp, Homo sapiens
ctcctgacccctgcct

SEQ ID NO: 4562638 - DNA, 17 bp, Homo sapiens
ctcctgaccttgtgatc

SEQ ID NO: 4562639 - DNA, 18 bp, Homo sapiens
ctcctgagacccctggcc

SEQ ID NO: 4562640 - DNA, 19 bp, Homo sapiens
ctcctgagacccctggcct

SEQ ID NO: 4562641 - DNA, 21 bp, Homo sapiens
ctcctgagacccctggcctcc

SEQ ID NO: 4562642 - DNA, 22 bp, Homo sapiens
ctcctgaggggcatctgcccct

SEQ ID NO: 4562643 - DNA, 23 bp, Homo sapiens
ctcctgaggggcatctgcccctc

SEQ ID NO: 4562644 - DNA, 19 bp, Homo sapiens
ctcctgagtagctgggact

SEQ ID NO: 4562645 - DNA, 15 bp, Homo sapiens
ctcctgcactgttta

SEQ ID NO: 4562646 - DNA, 18 bp, Homo sapiens
ctcctgcagacacctgga

SEQ ID NO: 4562647 - DNA, 19 bp, Homo sapiens
ctcctgcagggagccttct

SEQ ID NO: 4562648 - DNA, 20 bp, Homo sapiens
ctcctgcagggagccttctg

SEQ ID NO: 4562649 - DNA, 22 bp, Homo sapiens
ctcctgcagggagccttctgcc

SEQ ID NO: 4562650 - DNA, 21 bp, Homo sapiens
ctcctgccaggcacacacagc

SEQ ID NO: 4562651 - DNA, 23 bp, Homo sapiens
ctcctgccaggcacacacagccc

SEQ ID NO: 4562652 - DNA, 19 bp, Homo sapiens
ctcctgccattcttctggt

SEQ ID NO: 4562653 - DNA, 13 bp, Homo sapiens
ctcctgcccagga

SEQ ID NO: 4562654 - DNA, 13 bp, Homo sapiens
ctcctgccccctg

SEQ ID NO: 4562655 - DNA, 15 bp, Homo sapiens
ctcctgccctgtgat

SEQ ID NO: 4562656 - DNA, 14 bp, Homo sapiens
ctcctgcctactca

SEQ ID NO: 4562657 - DNA, 18 bp, Homo sapiens
ctcctgcctatgtctcct

SEQ ID NO: 4562658 - DNA, 13 bp, Homo sapiens
ctcctgcctcagc

SEQ ID NO: 4562659 - DNA, 16 bp, Homo sapiens
ctcctgcctcagcctc

SEQ ID NO: 4562660 - DNA, 19 bp, Homo sapiens
ctcctgcctcagcctcctg

SEQ ID NO: 4562661 - DNA, 19 bp, Homo sapiens
ctcctgcctcagccttcca

SEQ ID NO: 4562662 - DNA, 17 bp, Homo sapiens
ctcctgctgcctaataa

SEQ ID NO: 4562663 - DNA, 17 bp, Homo sapiens
ctcctggaccaggccca

SEQ ID NO: 4562664 - DNA, 21 bp, Homo sapiens
ctcctggactccggaggactg

SEQ ID NO: 4562665 - DNA, 20 bp, Homo sapiens
ctcctggccaagcaggctgg

SEQ ID NO: 4562666 - DNA, 23 bp, Homo sapiens
ctcctggccagacgctgccgctg

SEQ ID NO: 4562667 - DNA, 20 bp, Homo sapiens
ctcctgggacccttggctat

SEQ ID NO: 4562668 - DNA, 22 bp, Homo sapiens
ctcctgggagggagactcagcc

SEQ ID NO: 4562669 - DNA, 12 bp, Homo sapiens
ctcctgggccct

SEQ ID NO: 4562670 - DNA, 17 bp, Homo sapiens
ctcctgggccctctctg

SEQ ID NO: 4562671 - DNA, 19 bp, Homo sapiens
ctcctgggccctctctgct

SEQ ID NO: 4562672 - DNA, 18 bp, Homo sapiens
ctcctgggccctgggctg

SEQ ID NO: 4562673 - DNA, 14 bp, Homo sapiens
ctcctgggctcaag

SEQ ID NO: 4562674 - DNA, 15 bp, Homo sapiens
ctcctggggagctcc

SEQ ID NO: 4562675 - DNA, 17 bp, Homo sapiens
ctcctgggggtggcagg

SEQ ID NO: 4562676 - DNA, 23 bp, Homo sapiens
ctcctgggttttgtattctctga

SEQ ID NO: 4562677 - DNA, 16 bp, Homo sapiens
ctcctggtgcaggtct

SEQ ID NO: 4562678 - DNA, 18 bp, Homo sapiens
ctcctggtttgatttgat

SEQ ID NO: 4562679 - DNA, 13 bp, Homo sapiens
ctcctgtcaccta

SEQ ID NO: 4562680 - DNA, 14 bp, Homo sapiens
ctcctgtccaacct

SEQ ID NO: 4562681 - DNA, 13 bp, Homo sapiens
ctcctgtcccttt

SEQ ID NO: 4562682 - DNA, 17 bp, Homo sapiens
ctcctgtcccttttccc

SEQ ID NO: 4562683 - DNA, 18 bp, Homo sapiens
ctcctgtcccttttccct

SEQ ID NO: 4562684 - DNA, 19 bp, Homo sapiens
ctcctgtcccttttccctt

SEQ ID NO: 4562685 - DNA, 12 bp, Homo sapiens
ctcctgtctggc

SEQ ID NO: 4562686 - DNA, 13 bp, Homo sapiens
ctcctgtctggct

SEQ ID NO: 4562687 - DNA, 14 bp, Homo sapiens
ctcctgtctggctc

SEQ ID NO: 4562688 - DNA, 17 bp, Homo sapiens
ctcctgtctggctcgga

SEQ ID NO: 4562689 - DNA, 16 bp, Homo sapiens
ctcctgtgaatggagg

SEQ ID NO: 4562690 - DNA, 14 bp, Homo sapiens
ctcctgtgtactgt

SEQ ID NO: 4562691 - DNA, 17 bp, Homo sapiens
ctcctgtgtactgtgtc

SEQ ID NO: 4562692 - DNA, 20 bp, Homo sapiens
ctcctgttgcacccagccct

SEQ ID NO: 4562693 - DNA, 21 bp, Homo sapiens
ctcctgttgcacccagccctg

SEQ ID NO: 4562694 - DNA, 22 bp, Homo sapiens
ctcctgttgcacccagccctgg

SEQ ID NO: 4562695 - DNA, 14 bp, Homo sapiens
ctcctgttggcctt

SEQ ID NO: 4562696 - DNA, 15 bp, Homo sapiens
ctcctgttttatata

SEQ ID NO: 4562697 - DNA, 18 bp, Homo sapiens
ctcctgttttatatatta

SEQ ID NO: 4562698 - DNA, 19 bp, Homo sapiens
ctcctgttttgcacagcca

SEQ ID NO: 4562699 - DNA, 17 bp, Homo sapiens
ctccttagccctgtctg

SEQ ID NO: 4562700 - DNA, 19 bp, Homo sapiens
ctccttatagacacttgct

SEQ ID NO: 4562701 - DNA, 14 bp, Homo sapiens
ctccttcagccctc

SEQ ID NO: 4562702 - DNA, 15 bp, Homo sapiens
ctccttcagccctca

SEQ ID NO: 4562703 - DNA, 20 bp, Homo sapiens
ctccttcagccctcacccct

SEQ ID NO: 4562704 - DNA, 22 bp, Homo sapiens
ctccttcatatgaaaggtgcca

SEQ ID NO: 4562705 - DNA, 22 bp, Homo sapiens
ctccttcattaatgatgatctt

SEQ ID NO: 4562706 - DNA, 15 bp, Homo sapiens
ctccttccagacctt

SEQ ID NO: 4562707 - DNA, 13 bp, Homo sapiens
ctccttccccaga

SEQ ID NO: 4562708 - DNA, 18 bp, Homo sapiens
ctccttccccagacccag

SEQ ID NO: 4562709 - DNA, 20 bp, Homo sapiens
ctccttcctggagcccagag

SEQ ID NO: 4562710 - DNA, 15 bp, Homo sapiens
ctccttgaatatctt

SEQ ID NO: 4562711 - DNA, 20 bp, Homo sapiens
ctccttgaatatctttcgat

SEQ ID NO: 4562712 - DNA, 18 bp, Homo sapiens
ctccttggcacccccatg

SEQ ID NO: 4562713 - DNA, 20 bp, Homo sapiens
ctccttggcacccccatgct

SEQ ID NO: 4562714 - DNA, 12 bp, Homo sapiens
ctccttgggccc

SEQ ID NO: 4562715 - DNA, 17 bp, Homo sapiens
ctccttgggccctttga

SEQ ID NO: 4562716 - DNA, 16 bp, Homo sapiens
ctccttgtccacccac

SEQ ID NO: 4562717 - DNA, 23 bp, Homo sapiens
ctcctttaccagtcctatttttc

SEQ ID NO: 4562718 - DNA, 16 bp, Homo sapiens
ctcctttctcctgtga

SEQ ID NO: 4562719 - DNA, 19 bp, Homo sapiens
ctcctttctcctgtgaatg

SEQ ID NO: 4562720 - DNA, 12 bp, Homo sapiens
ctccttttccta

SEQ ID NO: 4562721 - DNA, 20 bp, Homo sapiens
ctccttttcttcaccctccc

SEQ ID NO: 4562722 - DNA, 14 bp, Homo sapiens
ctccttttggcctg

SEQ ID NO: 4562723 - DNA, 19 bp, Homo sapiens
ctccttttggcctggggga

SEQ ID NO: 4562724 - DNA, 13 bp, Homo sapiens
ctcctttttccat

SEQ ID NO: 4562725 - DNA, 14 bp, Homo sapiens
ctcgaatctgtgtg

SEQ ID NO: 4562726 - DNA, 16 bp, Homo sapiens
ctcgactctgctgctc

SEQ ID NO: 4562727 - DNA, 22 bp, Homo sapiens
ctcgactgtcagtggggcagcc

SEQ ID NO: 4562728 - DNA, 22 bp, Homo sapiens
ctcgagatcccaacactgccag

SEQ ID NO: 4562729 - DNA, 16 bp, Homo sapiens
ctcgaggggcccaggg

SEQ ID NO: 4562730 - DNA, 17 bp, Homo sapiens
ctcgagtactgtgggca

SEQ ID NO: 4562731 - DNA, 19 bp, Homo sapiens
ctcgatccaaattgtgctt

SEQ ID NO: 4562732 - DNA, 13 bp, Homo sapiens
ctcgatctcctga

SEQ ID NO: 4562733 - DNA, 20 bp, Homo sapiens
ctcgcatccagacagtcgct

SEQ ID NO: 4562734 - DNA, 21 bp, Homo sapiens
ctcgcatttgtcaatgacagt

SEQ ID NO: 4562735 - DNA, 17 bp, Homo sapiens
ctcgcccacaaactgat

SEQ ID NO: 4562736 - DNA, 14 bp, Homo sapiens
ctcgccccagcctc

SEQ ID NO: 4562737 - DNA, 15 bp, Homo sapiens
ctcgccccatccctg

SEQ ID NO: 4562738 - DNA, 17 bp, Homo sapiens
ctcgccccatccctgct

SEQ ID NO: 4562739 - DNA, 19 bp, Homo sapiens
ctcgcccctgttttttgta

SEQ ID NO: 4562740 - DNA, 12 bp, Homo sapiens
ctcgccccttcc

SEQ ID NO: 4562741 - DNA, 14 bp, Homo sapiens
ctcgccttcaggag

SEQ ID NO: 4562742 - DNA, 16 bp, Homo sapiens
ctcgccttcaggagaa

SEQ ID NO: 4562743 - DNA, 21 bp, Homo sapiens
ctcgctccctgtagctctgcc

SEQ ID NO: 4562744 - DNA, 19 bp, Homo sapiens
ctcgctgccctgtggacag

SEQ ID NO: 4562745 - DNA, 18 bp, Homo sapiens
ctcgctgcgcagcctcca

SEQ ID NO: 4562746 - DNA, 12 bp, Homo sapiens
ctcggacagagc

SEQ ID NO: 4562747 - DNA, 20 bp, Homo sapiens
ctcggacagagcccccctag

SEQ ID NO: 4562748 - DNA, 14 bp, Homo sapiens
ctcggacccacccc

SEQ ID NO: 4562749 - DNA, 20 bp, Homo sapiens
ctcggacccaccccaactct

SEQ ID NO: 4562750 - DNA, 13 bp, Homo sapiens
ctcggaggctgcc

SEQ ID NO: 4562751 - DNA, 15 bp, Homo sapiens
ctcggcccctgtctg

SEQ ID NO: 4562752 - DNA, 16 bp, Homo sapiens
ctcggcctcccaaagt

SEQ ID NO: 4562753 - DNA, 23 bp, Homo sapiens
ctcggcctcccaaagtgctggga

SEQ ID NO: 4562754 - DNA, 13 bp, Homo sapiens
ctcgggcccagcc

SEQ ID NO: 4562755 - DNA, 18 bp, Homo sapiens
ctcgggcccagcccccac

SEQ ID NO: 4562756 - DNA, 21 bp, Homo sapiens
ctcggtcgccccgtgtttgcg

SEQ ID NO: 4562757 - DNA, 19 bp, Homo sapiens
ctcggtctccaccccaggg

SEQ ID NO: 4562758 - DNA, 14 bp, Homo sapiens
ctcgtcctccccct

SEQ ID NO: 4562759 - DNA, 17 bp, Homo sapiens
ctcgtcctccccctgcc

SEQ ID NO: 4562760 - DNA, 22 bp, Homo sapiens
ctcgtcctccccctgccagtgc

SEQ ID NO: 4562761 - DNA, 23 bp, Homo sapiens
ctcgtgatgggcccgcctcggcc

SEQ ID NO: 4562762 - DNA, 17 bp, Homo sapiens
ctcgtgccatgatctgt

SEQ ID NO: 4562763 - DNA, 19 bp, Homo sapiens
ctcgtgccatgatctgtat

SEQ ID NO: 4562764 - DNA, 23 bp, Homo sapiens
ctcgtgtgtgttatttccccagc

SEQ ID NO: 4562765 - DNA, 20 bp, Homo sapiens
ctcgtgtttgcttaaaatat

SEQ ID NO: 4562766 - DNA, 23 bp, Homo sapiens
ctcgtgtttgcttaaaatatgtg

SEQ ID NO: 4562767 - DNA, 18 bp, Homo sapiens
ctcgttggaagaggaaca

SEQ ID NO: 4562768 - DNA, 17 bp, Homo sapiens
ctctaaaattataaatg

SEQ ID NO: 4562769 - DNA, 13 bp, Homo sapiens
ctctaacccagtg

SEQ ID NO: 4562770 - DNA, 18 bp, Homo sapiens
ctctaatatgattataca

SEQ ID NO: 4562771 - DNA, 15 bp, Homo sapiens
ctctaattcacagtg

SEQ ID NO: 4562772 - DNA, 16 bp, Homo sapiens
ctctaattcacagtgc

SEQ ID NO: 4562773 - DNA, 22 bp, Homo sapiens
ctctacagagcttccctgactc

SEQ ID NO: 4562774 - DNA, 18 bp, Homo sapiens
ctctacaggcctcttcct

SEQ ID NO: 4562775 - DNA, 16 bp, Homo sapiens
ctctaccatggttctg

SEQ ID NO: 4562776 - DNA, 13 bp, Homo sapiens
ctctacccctgct

SEQ ID NO: 4562777 - DNA, 22 bp, Homo sapiens
ctctacccctgctcccattcct

SEQ ID NO: 4562778 - DNA, 16 bp, Homo sapiens
ctctaccctcccaccc

SEQ ID NO: 4562779 - DNA, 19 bp, Homo sapiens
ctctaccttcctgtccctg

SEQ ID NO: 4562780 - DNA, 13 bp, Homo sapiens
ctctaccttttaa

SEQ ID NO: 4562781 - DNA, 20 bp, Homo sapiens
ctctactaaaaatacaaaaa

SEQ ID NO: 4562782 - DNA, 20 bp, Homo sapiens
ctctactgaatgtcattgaa

SEQ ID NO: 4562783 - DNA, 14 bp, Homo sapiens
ctctagaaaaaagg

SEQ ID NO: 4562784 - DNA, 15 bp, Homo sapiens
ctctagaagccaagg

SEQ ID NO: 4562785 - DNA, 19 bp, Homo sapiens
ctctagaagccaagggaaa

SEQ ID NO: 4562786 - DNA, 20 bp, Homo sapiens
ctctagatggcaacattgga

SEQ ID NO: 4562787 - DNA, 15 bp, Homo sapiens
ctctagcaaggctca

SEQ ID NO: 4562788 - DNA, 23 bp, Homo sapiens
ctctagcttaagtgtaaatgaag

SEQ ID NO: 4562789 - DNA, 16 bp, Homo sapiens
ctctaggatgtatatt

SEQ ID NO: 4562790 - DNA, 22 bp, Homo sapiens
ctctaggatgtatattttatat

SEQ ID NO: 4562791 - DNA, 22 bp, Homo sapiens
ctctaggcttcaggttgcattg

SEQ ID NO: 4562792 - DNA, 22 bp, Homo sapiens
ctctagggacccctcgccccag

SEQ ID NO: 4562793 - DNA, 12 bp, Homo sapiens
ctctagggtcca

SEQ ID NO: 4562794 - DNA, 23 bp, Homo sapiens
ctctaggtacgatgacagtgttc

SEQ ID NO: 4562795 - DNA, 16 bp, Homo sapiens
ctctagttctagatga

SEQ ID NO: 4562796 - DNA, 16 bp, Homo sapiens
ctctagttgagtttct

SEQ ID NO: 4562797 - DNA, 15 bp, Homo sapiens
ctctataaaaaatat

SEQ ID NO: 4562798 - DNA, 15 bp, Homo sapiens
ctctataaagggtca

SEQ ID NO: 4562799 - DNA, 22 bp, Homo sapiens
ctctataagcaaattgcttttt

SEQ ID NO: 4562800 - DNA, 19 bp, Homo sapiens
ctctatatgtagtgcattt

SEQ ID NO: 4562801 - DNA, 15 bp, Homo sapiens
ctctatgtctgcctt

SEQ ID NO: 4562802 - DNA, 19 bp, Homo sapiens
ctctatgttctaagaagtg

SEQ ID NO: 4562803 - DNA, 23 bp, Homo sapiens
ctctattgatgtacagtctgtca

SEQ ID NO: 4562804 - DNA, 10 bp, Homo sapiens
ctctatttaa

SEQ ID NO: 4562805 - DNA, 15 bp, Homo sapiens
ctctatttaaattct

SEQ ID NO: 4562806 - DNA, 18 bp, Homo sapiens
ctctatttaaattctttt

SEQ ID NO: 4562807 - DNA, 14 bp, Homo sapiens
ctctatttaagata

SEQ ID NO: 4562808 - DNA, 21 bp, Homo sapiens
ctctatttaagatatatacat

SEQ ID NO: 4562809 - DNA, 17 bp, Homo sapiens
ctctcaaattcagctct

SEQ ID NO: 4562810 - DNA, 20 bp, Homo sapiens
ctctcaaattcagctctgat

SEQ ID NO: 4562811 - DNA, 20 bp, Homo sapiens
ctctcaagctagccagaggg

SEQ ID NO: 4562812 - DNA, 22 bp, Homo sapiens
ctctcaccatgatgtgaagagt

SEQ ID NO: 4562813 - DNA, 16 bp, Homo sapiens
ctctcacccccatccc

SEQ ID NO: 4562814 - DNA, 14 bp, Homo sapiens
ctctcacctgctcc

SEQ ID NO: 4562815 - DNA, 18 bp, Homo sapiens
ctctcacctgctcccagt

SEQ ID NO: 4562816 - DNA, 15 bp, Homo sapiens
ctctcagcccagaag

SEQ ID NO: 4562817 - DNA, 18 bp, Homo sapiens
ctctcagcccagaagaaa

SEQ ID NO: 4562818 - DNA, 15 bp, Homo sapiens
ctctcagcctcccac

SEQ ID NO: 4562819 - DNA, 17 bp, Homo sapiens
ctctcagctgctggatg

SEQ ID NO: 4562820 - DNA, 18 bp, Homo sapiens
ctctcagctgctggatga

SEQ ID NO: 4562821 - DNA, 17 bp, Homo sapiens
ctctcaggccgagagcc

SEQ ID NO: 4562822 - DNA, 22 bp, Homo sapiens
ctctcaggtggaggcaacaggg

SEQ ID NO: 4562823 - DNA, 14 bp, Homo sapiens
ctctcagtctctga

SEQ ID NO: 4562824 - DNA, 23 bp, Homo sapiens
ctctcagtgaaggtggggagaag

SEQ ID NO: 4562825 - DNA, 16 bp, Homo sapiens
ctctcagttctctccc

SEQ ID NO: 4562826 - DNA, 12 bp, Homo sapiens
ctctcatattcg

SEQ ID NO: 4562827 - DNA, 18 bp, Homo sapiens
ctctcatcaactgaatga

SEQ ID NO: 4562828 - DNA, 16 bp, Homo sapiens
ctctcatgcctcctga

SEQ ID NO: 4562829 - DNA, 22 bp, Homo sapiens
ctctcatggtacttcctctgtg

SEQ ID NO: 4562830 - DNA, 13 bp, Homo sapiens
ctctccaacctgg

SEQ ID NO: 4562831 - DNA, 23 bp, Homo sapiens
ctctccaagacagcagcagcctg

SEQ ID NO: 4562832 - DNA, 17 bp, Homo sapiens
ctctccaatgttctatt

SEQ ID NO: 4562833 - DNA, 13 bp, Homo sapiens
ctctccacacagg

SEQ ID NO: 4562834 - DNA, 15 bp, Homo sapiens
ctctccacctcagcc

SEQ ID NO: 4562835 - DNA, 20 bp, Homo sapiens
ctctccacctcagccttgga

SEQ ID NO: 4562836 - DNA, 21 bp, Homo sapiens
ctctccactcatgtgactctt

SEQ ID NO: 4562837 - DNA, 14 bp, Homo sapiens
ctctccagctgact

SEQ ID NO: 4562838 - DNA, 16 bp, Homo sapiens
ctctccagctgactaa

SEQ ID NO: 4562839 - DNA, 10 bp, Homo sapiens
ctctccaggg

SEQ ID NO: 4562840 - DNA, 11 bp, Homo sapiens
ctctccatatc

SEQ ID NO: 4562841 - DNA, 15 bp, Homo sapiens
ctctccatatctcct

SEQ ID NO: 4562842 - DNA, 18 bp, Homo sapiens
ctctcccacagagtgctg

SEQ ID NO: 4562843 - DNA, 22 bp, Homo sapiens
ctctcccacagagtgctggact

SEQ ID NO: 4562844 - DNA, 23 bp, Homo sapiens
ctctcccacagagtgctggactg

SEQ ID NO: 4562845 - DNA, 12 bp, Homo sapiens
ctctcccacccg

SEQ ID NO: 4562846 - DNA, 21 bp, Homo sapiens
ctctcccacccggccacagct

SEQ ID NO: 4562847 - DNA, 22 bp, Homo sapiens
ctctcccacccggccacagctg

SEQ ID NO: 4562848 - DNA, 22 bp, Homo sapiens
ctctcccagtctacccagagaa

SEQ ID NO: 4562849 - DNA, 17 bp, Homo sapiens
ctctcccagtgaactcc

SEQ ID NO: 4562850 - DNA, 13 bp, Homo sapiens
ctctcccatggag

SEQ ID NO: 4562851 - DNA, 16 bp, Homo sapiens
ctctcccatggagccc

SEQ ID NO: 4562852 - DNA, 19 bp, Homo sapiens
ctctccccaatccatgctt

SEQ ID NO: 4562853 - DNA, 13 bp, Homo sapiens
ctctccccacact

SEQ ID NO: 4562854 - DNA, 15 bp, Homo sapiens
ctctccccagccccc

SEQ ID NO: 4562855 - DNA, 16 bp, Homo sapiens
ctctccccagccccct

SEQ ID NO: 4562856 - DNA, 15 bp, Homo sapiens
ctctccccagtgcct

SEQ ID NO: 4562857 - DNA, 18 bp, Homo sapiens
ctctccccagtgcctgcc

SEQ ID NO: 4562858 - DNA, 20 bp, Homo sapiens
ctctccccagtgcctgccac

SEQ ID NO: 4562859 - DNA, 22 bp, Homo sapiens
ctctccccagtgcctgccactc

SEQ ID NO: 4562860 - DNA, 19 bp, Homo sapiens
ctctccccatatataaatt

SEQ ID NO: 4562861 - DNA, 18 bp, Homo sapiens
ctctccccctcctccagg

SEQ ID NO: 4562862 - DNA, 19 bp, Homo sapiens
ctctccccctcctccaggg

SEQ ID NO: 4562863 - DNA, 17 bp, Homo sapiens
ctctccccgctctggat

SEQ ID NO: 4562864 - DNA, 15 bp, Homo sapiens
ctctcccctcctctg

SEQ ID NO: 4562865 - DNA, 12 bp, Homo sapiens
ctctccctgcct

SEQ ID NO: 4562866 - DNA, 13 bp, Homo sapiens
ctctccctgcctc

SEQ ID NO: 4562867 - DNA, 17 bp, Homo sapiens
ctctccctgcctcactc

SEQ ID NO: 4562868 - DNA, 16 bp, Homo sapiens
ctctccctgcctgtgg

SEQ ID NO: 4562869 - DNA, 19 bp, Homo sapiens
ctctccctgctgctcctag

SEQ ID NO: 4562870 - DNA, 20 bp, Homo sapiens
ctctccctgctgctcctagg

SEQ ID NO: 4562871 - DNA, 21 bp, Homo sapiens
ctctccctgtgttctgggctg

SEQ ID NO: 4562872 - DNA, 19 bp, Homo sapiens
ctctcctcatctccaaggc

SEQ ID NO: 4562873 - DNA, 18 bp, Homo sapiens
ctctcctccccttcctgt

SEQ ID NO: 4562874 - DNA, 18 bp, Homo sapiens
ctctcctcccgccccgcc

SEQ ID NO: 4562875 - DNA, 14 bp, Homo sapiens
ctctcctctctgct

SEQ ID NO: 4562876 - DNA, 15 bp, Homo sapiens
ctctcctctctgctt

SEQ ID NO: 4562877 - DNA, 15 bp, Homo sapiens
ctctcctgccctgtg

SEQ ID NO: 4562878 - DNA, 16 bp, Homo sapiens
ctctcctgccctgtga

SEQ ID NO: 4562879 - DNA, 12 bp, Homo sapiens
ctctcctgccta

SEQ ID NO: 4562880 - DNA, 12 bp, Homo sapiens
ctctcctggagg

SEQ ID NO: 4562881 - DNA, 12 bp, Homo sapiens
ctctcctggcct

SEQ ID NO: 4562882 - DNA, 15 bp, Homo sapiens
ctctcctgggcccct

SEQ ID NO: 4562883 - DNA, 21 bp, Homo sapiens
ctctcctgggcccctccctac

SEQ ID NO: 4562884 - DNA, 23 bp, Homo sapiens
ctctcctgggcccctccctacct

SEQ ID NO: 4562885 - DNA, 19 bp, Homo sapiens
ctctcctgggggtggcagg

SEQ ID NO: 4562886 - DNA, 20 bp, Homo sapiens
ctctcctgggggtggcaggc

SEQ ID NO: 4562887 - DNA, 12 bp, Homo sapiens
ctctcctgtaag

SEQ ID NO: 4562888 - DNA, 19 bp, Homo sapiens
ctctcctgtaagccaaaga

SEQ ID NO: 4562889 - DNA, 15 bp, Homo sapiens
ctctcctgtctccct

SEQ ID NO: 4562890 - DNA, 16 bp, Homo sapiens
ctctcctttctttttc

SEQ ID NO: 4562891 - DNA, 23 bp, Homo sapiens
ctctcctttctttttcttcttcc

SEQ ID NO: 4562892 - DNA, 14 bp, Homo sapiens
ctctcggccaggca

SEQ ID NO: 4562893 - DNA, 20 bp, Homo sapiens
ctctcggcccctgtctgttc

SEQ ID NO: 4562894 - DNA, 20 bp, Homo sapiens
ctctcggtgctccatctccg

SEQ ID NO: 4562895 - DNA, 23 bp, Homo sapiens
ctctctaccttttaaaattgaat

SEQ ID NO: 4562896 - DNA, 21 bp, Homo sapiens
ctctctatccaaaataaagat

SEQ ID NO: 4562897 - DNA, 21 bp, Homo sapiens
ctctctattccctcagcctaa

SEQ ID NO: 4562898 - DNA, 18 bp, Homo sapiens
ctctctcacctgctccca

SEQ ID NO: 4562899 - DNA, 12 bp, Homo sapiens
ctctctcatgcc

SEQ ID NO: 4562900 - DNA, 13 bp, Homo sapiens
ctctctcccagtc

SEQ ID NO: 4562901 - DNA, 19 bp, Homo sapiens
ctctctcccagtctaccca

SEQ ID NO: 4562902 - DNA, 11 bp, Homo sapiens
ctctctcctct

SEQ ID NO: 4562903 - DNA, 19 bp, Homo sapiens
ctctctcctgtccaaccta

SEQ ID NO: 4562904 - DNA, 14 bp, Homo sapiens
ctctctctaccttt

SEQ ID NO: 4562905 - DNA, 13 bp, Homo sapiens
ctctctctgctcc

SEQ ID NO: 4562906 - DNA, 14 bp, Homo sapiens
ctctctctgctcca

SEQ ID NO: 4562907 - DNA, 11 bp, Homo sapiens
ctctctctgtc

SEQ ID NO: 4562908 - DNA, 12 bp, Homo sapiens
ctctctcttctg

SEQ ID NO: 4562909 - DNA, 21 bp, Homo sapiens
ctctctcttctgctccaccct

SEQ ID NO: 4562910 - DNA, 18 bp, Homo sapiens
ctctctgcagccagccca

SEQ ID NO: 4562911 - DNA, 19 bp, Homo sapiens
ctctctgcagccagcccag

SEQ ID NO: 4562912 - DNA, 19 bp, Homo sapiens
ctctctgccattctgtgca

SEQ ID NO: 4562913 - DNA, 20 bp, Homo sapiens
ctctctgccattctgtgcag

SEQ ID NO: 4562914 - DNA, 21 bp, Homo sapiens
ctctctggaaagaggctctgg

SEQ ID NO: 4562915 - DNA, 16 bp, Homo sapiens
ctctctgggacctcct

SEQ ID NO: 4562916 - DNA, 21 bp, Homo sapiens
ctctctgggactctcctcctc

SEQ ID NO: 4562917 - DNA, 15 bp, Homo sapiens
ctctctgggcccagg

SEQ ID NO: 4562918 - DNA, 22 bp, Homo sapiens
ctctctggggccctgggcctca

SEQ ID NO: 4562919 - DNA, 17 bp, Homo sapiens
ctctctggggctgtgtt

SEQ ID NO: 4562920 - DNA, 19 bp, Homo sapiens
ctctcttagggacagtcaa

SEQ ID NO: 4562921 - DNA, 13 bp, Homo sapiens
ctctcttccacag

SEQ ID NO: 4562922 - DNA, 16 bp, Homo sapiens
ctctcttccacagtgg

SEQ ID NO: 4562923 - DNA, 17 bp, Homo sapiens
ctctcttccacagtggc

SEQ ID NO: 4562924 - DNA, 19 bp, Homo sapiens
ctctcttccccttccctta

SEQ ID NO: 4562925 - DNA, 13 bp, Homo sapiens
ctctcttctcttt

SEQ ID NO: 4562926 - DNA, 16 bp, Homo sapiens
ctctcttctgctccac

SEQ ID NO: 4562927 - DNA, 17 bp, Homo sapiens
ctctcttctgctccacc

SEQ ID NO: 4562928 - DNA, 13 bp, Homo sapiens
ctctcttgtcaga

SEQ ID NO: 4562929 - DNA, 18 bp, Homo sapiens
ctctgaaacagctgcctt

SEQ ID NO: 4562930 - DNA, 23 bp, Homo sapiens
ctctgaaacagctgccttagctt

SEQ ID NO: 4562931 - DNA, 17 bp, Homo sapiens
ctctgaaaccagtgtta

SEQ ID NO: 4562932 - DNA, 17 bp, Homo sapiens
ctctgaaatatcccggg

SEQ ID NO: 4562933 - DNA, 21 bp, Homo sapiens
ctctgaagccacaaagaccca

SEQ ID NO: 4562934 - DNA, 15 bp, Homo sapiens
ctctgaagcctctgg

SEQ ID NO: 4562935 - DNA, 16 bp, Homo sapiens
ctctgaagcctctggg

SEQ ID NO: 4562936 - DNA, 17 bp, Homo sapiens
ctctgaagcctctggga

SEQ ID NO: 4562937 - DNA, 19 bp, Homo sapiens
ctctgaaggagttacaggg

SEQ ID NO: 4562938 - DNA, 16 bp, Homo sapiens
ctctgaatacacagta

SEQ ID NO: 4562939 - DNA, 15 bp, Homo sapiens
ctctgaattttcaga

SEQ ID NO: 4562940 - DNA, 13 bp, Homo sapiens
ctctgaccccagc

SEQ ID NO: 4562941 - DNA, 18 bp, Homo sapiens
ctctgaccgattccttta

SEQ ID NO: 4562942 - DNA, 20 bp, Homo sapiens
ctctgacctcctctgggccc

SEQ ID NO: 4562943 - DNA, 13 bp, Homo sapiens
ctctgagaagaca

SEQ ID NO: 4562944 - DNA, 16 bp, Homo sapiens
ctctgagaagctctga

SEQ ID NO: 4562945 - DNA, 16 bp, Homo sapiens
ctctgagctgtgcagg

SEQ ID NO: 4562946 - DNA, 19 bp, Homo sapiens
ctctgaggatgatgtactt

SEQ ID NO: 4562947 - DNA, 14 bp, Homo sapiens
ctctgataagagaa

SEQ ID NO: 4562948 - DNA, 15 bp, Homo sapiens
ctctgatacacagta

SEQ ID NO: 4562949 - DNA, 21 bp, Homo sapiens
ctctgatagctgtttcaaatg

SEQ ID NO: 4562950 - DNA, 16 bp, Homo sapiens
ctctgatgtcccagtg

SEQ ID NO: 4562951 - DNA, 18 bp, Homo sapiens
ctctgatttattttgtat

SEQ ID NO: 4562952 - DNA, 13 bp, Homo sapiens
ctctgcaaagact

SEQ ID NO: 4562953 - DNA, 20 bp, Homo sapiens
ctctgcaaagactagatcct

SEQ ID NO: 4562954 - DNA, 17 bp, Homo sapiens
ctctgcaattttactgt

SEQ ID NO: 4562955 - DNA, 20 bp, Homo sapiens
ctctgcaattttactgtgaa

SEQ ID NO: 4562956 - DNA, 22 bp, Homo sapiens
ctctgcaattttactgtgaaaa

SEQ ID NO: 4562957 - DNA, 22 bp, Homo sapiens
ctctgcacaccctccagagaca

SEQ ID NO: 4562958 - DNA, 15 bp, Homo sapiens
ctctgcacccagaac

SEQ ID NO: 4562959 - DNA, 15 bp, Homo sapiens
ctctgcactactcct

SEQ ID NO: 4562960 - DNA, 20 bp, Homo sapiens
ctctgcactactcctctgca

SEQ ID NO: 4562961 - DNA, 19 bp, Homo sapiens
ctctgcactcccacctgac

SEQ ID NO: 4562962 - DNA, 20 bp, Homo sapiens
ctctgcactcccacctgaca

SEQ ID NO: 4562963 - DNA, 23 bp, Homo sapiens
ctctgcactcccacctgacacac

SEQ ID NO: 4562964 - DNA, 17 bp, Homo sapiens
ctctgcagccagcccag

SEQ ID NO: 4562965 - DNA, 19 bp, Homo sapiens
ctctgcagccagcccagcc

SEQ ID NO: 4562966 - DNA, 17 bp, Homo sapiens
ctctgcaggctggggag

SEQ ID NO: 4562967 - DNA, 23 bp, Homo sapiens
ctctgcatactcattaggatggc

SEQ ID NO: 4562968 - DNA, 16 bp, Homo sapiens
ctctgcatagacaaag

SEQ ID NO: 4562969 - DNA, 19 bp, Homo sapiens
ctctgcatgcggcccagcc

SEQ ID NO: 4562970 - DNA, 20 bp, Homo sapiens
ctctgcatgcggcccagccc

SEQ ID NO: 4562971 - DNA, 22 bp, Homo sapiens
ctctgcatgcggcccagcccgg

SEQ ID NO: 4562972 - DNA, 19 bp, Homo sapiens
ctctgcatttgtctattct

SEQ ID NO: 4562973 - DNA, 10 bp, Homo sapiens
ctctgccacc

SEQ ID NO: 4562974 - DNA, 23 bp, Homo sapiens
ctctgccagaagatcccctcagg

SEQ ID NO: 4562975 - DNA, 15 bp, Homo sapiens
ctctgcccagccggg

SEQ ID NO: 4562976 - DNA, 17 bp, Homo sapiens
ctctgcccagccgggca

SEQ ID NO: 4562977 - DNA, 22 bp, Homo sapiens
ctctgccccaatcgggtccaga

SEQ ID NO: 4562978 - DNA, 13 bp, Homo sapiens
ctctgcccctcac

SEQ ID NO: 4562979 - DNA, 12 bp, Homo sapiens
ctctgcccctgc

SEQ ID NO: 4562980 - DNA, 15 bp, Homo sapiens
ctctgcccctgcagc

SEQ ID NO: 4562981 - DNA, 18 bp, Homo sapiens
ctctgcccctgcagctgg

SEQ ID NO: 4562982 - DNA, 15 bp, Homo sapiens
ctctgccccttgccc

SEQ ID NO: 4562983 - DNA, 16 bp, Homo sapiens
ctctgccctctagagc

SEQ ID NO: 4562984 - DNA, 18 bp, Homo sapiens
ctctgccgctgccatgct

SEQ ID NO: 4562985 - DNA, 18 bp, Homo sapiens
ctctgccggtcgggcagc

SEQ ID NO: 4562986 - DNA, 21 bp, Homo sapiens
ctctgccggtcgggcagccag

SEQ ID NO: 4562987 - DNA, 22 bp, Homo sapiens
ctctgcctcagacgttgcctga

SEQ ID NO: 4562988 - DNA, 14 bp, Homo sapiens
ctctgcctccctct

SEQ ID NO: 4562989 - DNA, 17 bp, Homo sapiens
ctctgcctccctctcca

SEQ ID NO: 4562990 - DNA, 11 bp, Homo sapiens
ctctgcctgcc

SEQ ID NO: 4562991 - DNA, 16 bp, Homo sapiens
ctctgccttgcactgt

SEQ ID NO: 4562992 - DNA, 21 bp, Homo sapiens
ctctgcggagcacactggctc

SEQ ID NO: 4562993 - DNA, 23 bp, Homo sapiens
ctctgcggagcacactggctcac

SEQ ID NO: 4562994 - DNA, 22 bp, Homo sapiens
ctctgctcaccgcccatcaggg

SEQ ID NO: 4562995 - DNA, 16 bp, Homo sapiens
ctctgctccaccacat

SEQ ID NO: 4562996 - DNA, 23 bp, Homo sapiens
ctctgctccatccccctgcctcc

SEQ ID NO: 4562997 - DNA, 13 bp, Homo sapiens
ctctgctgcaaca

SEQ ID NO: 4562998 - DNA, 14 bp, Homo sapiens
ctctgctgctctga

SEQ ID NO: 4562999 - DNA, 13 bp, Homo sapiens
ctctgctgctttt

SEQ ID NO: 4563000 - DNA, 14 bp, Homo sapiens
ctctgctgcttttg

SEQ ID NO: 4563001 - DNA, 16 bp, Homo sapiens
ctctgcttctcatccc

SEQ ID NO: 4563002 - DNA, 19 bp, Homo sapiens
ctctggaaagaggctctgg

SEQ ID NO: 4563003 - DNA, 15 bp, Homo sapiens
ctctggaataaagtt

SEQ ID NO: 4563004 - DNA, 21 bp, Homo sapiens
ctctggaataaagttgcagat

SEQ ID NO: 4563005 - DNA, 22 bp, Homo sapiens
ctctggaataaagttgcagatg

SEQ ID NO: 4563006 - DNA, 14 bp, Homo sapiens
ctctggacagcaga

SEQ ID NO: 4563007 - DNA, 20 bp, Homo sapiens
ctctggacagcagaagcctc

SEQ ID NO: 4563008 - DNA, 18 bp, Homo sapiens
ctctggacgttgtgagaa

SEQ ID NO: 4563009 - DNA, 15 bp, Homo sapiens
ctctggactggctag

SEQ ID NO: 4563010 - DNA, 16 bp, Homo sapiens
ctctggactggctaga

SEQ ID NO: 4563011 - DNA, 19 bp, Homo sapiens
ctctggaggctgcagagct

SEQ ID NO: 4563012 - DNA, 15 bp, Homo sapiens
ctctggatcctgcac

SEQ ID NO: 4563013 - DNA, 22 bp, Homo sapiens
ctctggatctgttccttggcag

SEQ ID NO: 4563014 - DNA, 18 bp, Homo sapiens
ctctggcccctcacccac

SEQ ID NO: 4563015 - DNA, 23 bp, Homo sapiens
ctctggcccctcacccaccatgg

SEQ ID NO: 4563016 - DNA, 13 bp, Homo sapiens
ctctggccctgcc

SEQ ID NO: 4563017 - DNA, 14 bp, Homo sapiens
ctctggccctgcct

SEQ ID NO: 4563018 - DNA, 14 bp, Homo sapiens
ctctggctagaggc

SEQ ID NO: 4563019 - DNA, 17 bp, Homo sapiens
ctctggctctgcctcag

SEQ ID NO: 4563020 - DNA, 13 bp, Homo sapiens
ctctggctggcta

SEQ ID NO: 4563021 - DNA, 14 bp, Homo sapiens
ctctggctttccca

SEQ ID NO: 4563022 - DNA, 16 bp, Homo sapiens
ctctggctttcccagg

SEQ ID NO: 4563023 - DNA, 18 bp, Homo sapiens
ctctgggagtaatacttt

SEQ ID NO: 4563024 - DNA, 19 bp, Homo sapiens
ctctgggatttatgctcat

SEQ ID NO: 4563025 - DNA, 22 bp, Homo sapiens
ctctgggcacgcctgctggccg

SEQ ID NO: 4563026 - DNA, 14 bp, Homo sapiens
ctctgggcccaggg

SEQ ID NO: 4563027 - DNA, 14 bp, Homo sapiens
ctctggggccctgg

SEQ ID NO: 4563028 - DNA, 16 bp, Homo sapiens
ctctggggccctgggc

SEQ ID NO: 4563029 - DNA, 17 bp, Homo sapiens
ctctggggccctgggcc

SEQ ID NO: 4563030 - DNA, 21 bp, Homo sapiens
ctctggggccctgggcctcag

SEQ ID NO: 4563031 - DNA, 15 bp, Homo sapiens
ctctggggctgtgtt

SEQ ID NO: 4563032 - DNA, 21 bp, Homo sapiens
ctctggggtgcagcttcaccc

SEQ ID NO: 4563033 - DNA, 17 bp, Homo sapiens
ctctggtggtcttcctt

SEQ ID NO: 4563034 - DNA, 18 bp, Homo sapiens
ctctggtggtcttccttc

SEQ ID NO: 4563035 - DNA, 20 bp, Homo sapiens
ctctggtggtcttccttcta

SEQ ID NO: 4563036 - DNA, 12 bp, Homo sapiens
ctctggttgcct

SEQ ID NO: 4563037 - DNA, 14 bp, Homo sapiens
ctctggttgcctcc

SEQ ID NO: 4563038 - DNA, 17 bp, Homo sapiens
ctctggttgtttctgtt

SEQ ID NO: 4563039 - DNA, 18 bp, Homo sapiens
ctctggttgtttctgttc

SEQ ID NO: 4563040 - DNA, 20 bp, Homo sapiens
ctctggttgtttctgttcca

SEQ ID NO: 4563041 - DNA, 13 bp, Homo sapiens
ctctgtaaaacac

SEQ ID NO: 4563042 - DNA, 15 bp, Homo sapiens
ctctgtaaaacgcac

SEQ ID NO: 4563043 - DNA, 22 bp, Homo sapiens
ctctgtagaaggagtagctgcc

SEQ ID NO: 4563044 - DNA, 16 bp, Homo sapiens
ctctgtagcaaatttg

SEQ ID NO: 4563045 - DNA, 19 bp, Homo sapiens
ctctgtagcaaatttgttt

SEQ ID NO: 4563046 - DNA, 14 bp, Homo sapiens
ctctgtcagccagc

SEQ ID NO: 4563047 - DNA, 18 bp, Homo sapiens
ctctgtccccttctctca

SEQ ID NO: 4563048 - DNA, 16 bp, Homo sapiens
ctctgtccctgtcctt

SEQ ID NO: 4563049 - DNA, 17 bp, Homo sapiens
ctctgtcgcccaggctg

SEQ ID NO: 4563050 - DNA, 15 bp, Homo sapiens
ctctgtctcatccat

SEQ ID NO: 4563051 - DNA, 21 bp, Homo sapiens
ctctgtcttttggagaaccag

SEQ ID NO: 4563052 - DNA, 14 bp, Homo sapiens
ctctgtgaaagctt

SEQ ID NO: 4563053 - DNA, 20 bp, Homo sapiens
ctctgtgctgaccctcctgt

SEQ ID NO: 4563054 - DNA, 15 bp, Homo sapiens
ctctgtgctgtggaa

SEQ ID NO: 4563055 - DNA, 23 bp, Homo sapiens
ctctgttcccctagtaagtgcct

SEQ ID NO: 4563056 - DNA, 13 bp, Homo sapiens
ctctgttttctct

SEQ ID NO: 4563057 - DNA, 16 bp, Homo sapiens
ctctgttttctctctg

SEQ ID NO: 4563058 - DNA, 17 bp, Homo sapiens
ctctgttttctctctgt

SEQ ID NO: 4563059 - DNA, 13 bp, Homo sapiens
ctcttaaatcatt

SEQ ID NO: 4563060 - DNA, 15 bp, Homo sapiens
ctcttaaatcatttg

SEQ ID NO: 4563061 - DNA, 21 bp, Homo sapiens
ctcttaaattatatatttatt

SEQ ID NO: 4563062 - DNA, 22 bp, Homo sapiens
ctcttacaataagctaaacgca

SEQ ID NO: 4563063 - DNA, 22 bp, Homo sapiens
ctcttacgaatattttcagtaa

SEQ ID NO: 4563064 - DNA, 22 bp, Homo sapiens
ctcttagaagaatattgtattg

SEQ ID NO: 4563065 - DNA, 23 bp, Homo sapiens
ctcttagaatttgtttcatctat

SEQ ID NO: 4563066 - DNA, 14 bp, Homo sapiens
ctcttagagatgat

SEQ ID NO: 4563067 - DNA, 21 bp, Homo sapiens
ctcttagagatgattcagagg

SEQ ID NO: 4563068 - DNA, 18 bp, Homo sapiens
ctcttagattcttaattc

SEQ ID NO: 4563069 - DNA, 13 bp, Homo sapiens
ctcttagctatgt

SEQ ID NO: 4563070 - DNA, 16 bp, Homo sapiens
ctcttatgtgtgcctt

SEQ ID NO: 4563071 - DNA, 20 bp, Homo sapiens
ctcttcaaggaggcccactg

SEQ ID NO: 4563072 - DNA, 14 bp, Homo sapiens
ctcttcaataaacc

SEQ ID NO: 4563073 - DNA, 18 bp, Homo sapiens
ctcttcaataaaccacaa

SEQ ID NO: 4563074 - DNA, 17 bp, Homo sapiens
ctcttcagaggccctcg

SEQ ID NO: 4563075 - DNA, 14 bp, Homo sapiens
ctcttcaggcctcc

SEQ ID NO: 4563076 - DNA, 15 bp, Homo sapiens
ctcttcaggcctccc

SEQ ID NO: 4563077 - DNA, 16 bp, Homo sapiens
ctcttcaggcctccct

SEQ ID NO: 4563078 - DNA, 18 bp, Homo sapiens
ctcttcaggcctccctct

SEQ ID NO: 4563079 - DNA, 17 bp, Homo sapiens
ctcttcatgcttgacat

SEQ ID NO: 4563080 - DNA, 11 bp, Homo sapiens
ctcttccacag

SEQ ID NO: 4563081 - DNA, 15 bp, Homo sapiens
ctcttccacagtggc

SEQ ID NO: 4563082 - DNA, 16 bp, Homo sapiens
ctcttccacagtggcg

SEQ ID NO: 4563083 - DNA, 22 bp, Homo sapiens
ctcttccacagtggcgggccca

SEQ ID NO: 4563084 - DNA, 19 bp, Homo sapiens
ctcttccagtcttcctgac

SEQ ID NO: 4563085 - DNA, 22 bp, Homo sapiens
ctcttccagtcttcctgacact

SEQ ID NO: 4563086 - DNA, 23 bp, Homo sapiens
ctcttccagtcttcctgacactt

SEQ ID NO: 4563087 - DNA, 15 bp, Homo sapiens
ctcttcccatgtccc

SEQ ID NO: 4563088 - DNA, 23 bp, Homo sapiens
ctcttcccatgtcccaccctccc

SEQ ID NO: 4563089 - DNA, 21 bp, Homo sapiens
ctcttccccagaaaggagact

SEQ ID NO: 4563090 - DNA, 14 bp, Homo sapiens
ctcttccccagaga

SEQ ID NO: 4563091 - DNA, 15 bp, Homo sapiens
ctcttccccagagag

SEQ ID NO: 4563092 - DNA, 23 bp, Homo sapiens
ctcttcccttagcctctcccacc

SEQ ID NO: 4563093 - DNA, 16 bp, Homo sapiens
ctcttccgactctttc

SEQ ID NO: 4563094 - DNA, 18 bp, Homo sapiens
ctcttcctaccctgcctc

SEQ ID NO: 4563095 - DNA, 16 bp, Homo sapiens
ctcttctaaaatagca

SEQ ID NO: 4563096 - DNA, 11 bp, Homo sapiens
ctcttctcatt

SEQ ID NO: 4563097 - DNA, 17 bp, Homo sapiens
ctcttctcttgacagtc

SEQ ID NO: 4563098 - DNA, 20 bp, Homo sapiens
ctcttctcttgacagtctga

SEQ ID NO: 4563099 - DNA, 13 bp, Homo sapiens
ctcttctgactgc

SEQ ID NO: 4563100 - DNA, 19 bp, Homo sapiens
ctcttctgcaagcctcatg

SEQ ID NO: 4563101 - DNA, 12 bp, Homo sapiens
ctcttctgctcc

SEQ ID NO: 4563102 - DNA, 15 bp, Homo sapiens
ctcttctgctccacc

SEQ ID NO: 4563103 - DNA, 20 bp, Homo sapiens
ctcttctgctccacccttgg

SEQ ID NO: 4563104 - DNA, 15 bp, Homo sapiens
ctcttctgctctttt

SEQ ID NO: 4563105 - DNA, 22 bp, Homo sapiens
ctcttctgggagggcagcaggg

SEQ ID NO: 4563106 - DNA, 15 bp, Homo sapiens
ctcttctgggcctga

SEQ ID NO: 4563107 - DNA, 19 bp, Homo sapiens
ctcttctggggcaggctgg

SEQ ID NO: 4563108 - DNA, 21 bp, Homo sapiens
ctcttctggggcaggctgggc

SEQ ID NO: 4563109 - DNA, 12 bp, Homo sapiens
ctcttctggtgt

SEQ ID NO: 4563110 - DNA, 19 bp, Homo sapiens
ctcttcttatacagataaa

SEQ ID NO: 4563111 - DNA, 20 bp, Homo sapiens
ctcttcttgaaattttaacc

SEQ ID NO: 4563112 - DNA, 18 bp, Homo sapiens
ctcttctttaagccatag

SEQ ID NO: 4563113 - DNA, 14 bp, Homo sapiens
ctcttctttctgaa

SEQ ID NO: 4563114 - DNA, 18 bp, Homo sapiens
ctcttctttgtgcctttg

SEQ ID NO: 4563115 - DNA, 20 bp, Homo sapiens
ctcttctttgtgcctttggc

SEQ ID NO: 4563116 - DNA, 23 bp, Homo sapiens
ctcttctttgtgcctttggcctg

SEQ ID NO: 4563117 - DNA, 18 bp, Homo sapiens
ctcttgaagtcacaccag

SEQ ID NO: 4563118 - DNA, 13 bp, Homo sapiens
ctcttgaattcct

SEQ ID NO: 4563119 - DNA, 17 bp, Homo sapiens
ctcttgaattcctctca

SEQ ID NO: 4563120 - DNA, 15 bp, Homo sapiens
ctcttgacagtctga

SEQ ID NO: 4563121 - DNA, 15 bp, Homo sapiens
ctcttgaccaggctg

SEQ ID NO: 4563122 - DNA, 22 bp, Homo sapiens
ctcttgactccactactttact

SEQ ID NO: 4563123 - DNA, 21 bp, Homo sapiens
ctcttgagcatcaatcttgtt

SEQ ID NO: 4563124 - DNA, 22 bp, Homo sapiens
ctcttgagcatcaatcttgtta

SEQ ID NO: 4563125 - DNA, 18 bp, Homo sapiens
ctcttgatttcacatttc

SEQ ID NO: 4563126 - DNA, 14 bp, Homo sapiens
ctcttgcccatcct

SEQ ID NO: 4563127 - DNA, 11 bp, Homo sapiens
ctcttggaaaa

SEQ ID NO: 4563128 - DNA, 23 bp, Homo sapiens
ctcttggggagtttagggtgggg

SEQ ID NO: 4563129 - DNA, 16 bp, Homo sapiens
ctcttgtaaagactgg

SEQ ID NO: 4563130 - DNA, 22 bp, Homo sapiens
ctcttgtaaagactggttttct

SEQ ID NO: 4563131 - DNA, 21 bp, Homo sapiens
ctcttgtaatccgaatctctt

SEQ ID NO: 4563132 - DNA, 15 bp, Homo sapiens
ctcttgtcctcttct

SEQ ID NO: 4563133 - DNA, 24 bp, Homo sapiens
ctcttgtcctcttctgctcttttc

SEQ ID NO: 4563134 - DNA, 22 bp, Homo sapiens
ctcttgtctggcaaaagaaaaa

SEQ ID NO: 4563135 - DNA, 14 bp, Homo sapiens
ctcttgtgatttct

SEQ ID NO: 4563136 - DNA, 23 bp, Homo sapiens
ctcttgtggtgcattgaaagaag

SEQ ID NO: 4563137 - DNA, 17 bp, Homo sapiens
ctctttaaaacaaaaca

SEQ ID NO: 4563138 - DNA, 20 bp, Homo sapiens
ctctttacatttcttttaaa

SEQ ID NO: 4563139 - DNA, 23 bp, Homo sapiens
ctctttacatttcttttaaaata

SEQ ID NO: 4563140 - DNA, 18 bp, Homo sapiens
ctctttatcaagcaacat

SEQ ID NO: 4563141 - DNA, 22 bp, Homo sapiens
ctctttatcaagcaacattctt

SEQ ID NO: 4563142 - DNA, 14 bp, Homo sapiens
ctctttattgtctg

SEQ ID NO: 4563143 - DNA, 12 bp, Homo sapiens
ctctttccctgc

SEQ ID NO: 4563144 - DNA, 19 bp, Homo sapiens
ctctttccgactgcccaga

SEQ ID NO: 4563145 - DNA, 17 bp, Homo sapiens
ctctttctcacctttcc

SEQ ID NO: 4563146 - DNA, 19 bp, Homo sapiens
ctctttctctcctttcttt

SEQ ID NO: 4563147 - DNA, 20 bp, Homo sapiens
ctctttctgaaggaagagaa

SEQ ID NO: 4563148 - DNA, 16 bp, Homo sapiens
ctctttctgagtgcct

SEQ ID NO: 4563149 - DNA, 17 bp, Homo sapiens
ctctttctgagtgcctt

SEQ ID NO: 4563150 - DNA, 11 bp, Homo sapiens
ctctttctgta

SEQ ID NO: 4563151 - DNA, 15 bp, Homo sapiens
ctctttctgtatata

SEQ ID NO: 4563152 - DNA, 17 bp, Homo sapiens
ctctttgggcagtgcca

SEQ ID NO: 4563153 - DNA, 21 bp, Homo sapiens
ctctttgggcagtgccatgga

SEQ ID NO: 4563154 - DNA, 14 bp, Homo sapiens
ctctttgtgcagtg

SEQ ID NO: 4563155 - DNA, 18 bp, Homo sapiens
ctctttgttatttgaaaa

SEQ ID NO: 4563156 - DNA, 15 bp, Homo sapiens
ctcttttaaagtatt

SEQ ID NO: 4563157 - DNA, 19 bp, Homo sapiens
ctcttttcctggtgctctt

SEQ ID NO: 4563158 - DNA, 20 bp, Homo sapiens
ctcttttcctggtgctcttt

SEQ ID NO: 4563159 - DNA, 22 bp, Homo sapiens
ctcttttctacacactcagcca

SEQ ID NO: 4563160 - DNA, 15 bp, Homo sapiens
ctcttttctttctgt

SEQ ID NO: 4563161 - DNA, 21 bp, Homo sapiens
ctctttttccatcataattct

SEQ ID NO: 4563162 - DNA, 15 bp, Homo sapiens
ctctttttcctcctg

SEQ ID NO: 4563163 - DNA, 20 bp, Homo sapiens
ctcttttttgtttgtttctt

SEQ ID NO: 4563164 - DNA, 17 bp, Homo sapiens
ctgaaaacccagagagg

SEQ ID NO: 4563165 - DNA, 22 bp, Homo sapiens
ctgaaaaggaggtatctagcaa

SEQ ID NO: 4563166 - DNA, 24 bp, Homo sapiens
ctgaaaatattgttttacaatagt

SEQ ID NO: 4563167 - DNA, 12 bp, Homo sapiens
ctgaaaatgtgc

SEQ ID NO: 4563168 - DNA, 13 bp, Homo sapiens
ctgaaaatgtgct

SEQ ID NO: 4563169 - DNA, 14 bp, Homo sapiens
ctgaaacagctgcc

SEQ ID NO: 4563170 - DNA, 16 bp, Homo sapiens
ctgaaacagctgcctt

SEQ ID NO: 4563171 - DNA, 20 bp, Homo sapiens
ctgaaacagctgccttagct

SEQ ID NO: 4563172 - DNA, 13 bp, Homo sapiens
ctgaaacatttca

SEQ ID NO: 4563173 - DNA, 20 bp, Homo sapiens
ctgaaacccgccctcagggg

SEQ ID NO: 4563174 - DNA, 21 bp, Homo sapiens
ctgaaacccgccctcaggggc

SEQ ID NO: 4563175 - DNA, 22 bp, Homo sapiens
ctgaaacccgccctcaggggcc

SEQ ID NO: 4563176 - DNA, 20 bp, Homo sapiens
ctgaaacctagtactgcccc

SEQ ID NO: 4563177 - DNA, 17 bp, Homo sapiens
ctgaaacctcttcctag

SEQ ID NO: 4563178 - DNA, 15 bp, Homo sapiens
ctgaaactgcccact

SEQ ID NO: 4563179 - DNA, 19 bp, Homo sapiens
ctgaaagaagaaaacagta

SEQ ID NO: 4563180 - DNA, 20 bp, Homo sapiens
ctgaaagcattattttttgt

SEQ ID NO: 4563181 - DNA, 11 bp, Homo sapiens
ctgaaagccac

SEQ ID NO: 4563182 - DNA, 21 bp, Homo sapiens
ctgaaagccacgttccttact

SEQ ID NO: 4563183 - DNA, 14 bp, Homo sapiens
ctgaaaggagacat

SEQ ID NO: 4563184 - DNA, 22 bp, Homo sapiens
ctgaaaggagacattgctctat

SEQ ID NO: 4563185 - DNA, 18 bp, Homo sapiens
ctgaaaggtgtgaacagc

SEQ ID NO: 4563186 - DNA, 13 bp, Homo sapiens
ctgaaagttttgt

SEQ ID NO: 4563187 - DNA, 16 bp, Homo sapiens
ctgaaataatatattt

SEQ ID NO: 4563188 - DNA, 18 bp, Homo sapiens
ctgaaatgacatttcact

SEQ ID NO: 4563189 - DNA, 21 bp, Homo sapiens
ctgaaatgacatttcactaaa

SEQ ID NO: 4563190 - DNA, 18 bp, Homo sapiens
ctgaaattcaaaatgctc

SEQ ID NO: 4563191 - DNA, 13 bp, Homo sapiens
ctgaaattttata

SEQ ID NO: 4563192 - DNA, 19 bp, Homo sapiens
ctgaaattttatatgctta

SEQ ID NO: 4563193 - DNA, 17 bp, Homo sapiens
ctgaacaatattttctc

SEQ ID NO: 4563194 - DNA, 18 bp, Homo sapiens
ctgaacaccattgaaggc

SEQ ID NO: 4563195 - DNA, 15 bp, Homo sapiens
ctgaacatattatct

SEQ ID NO: 4563196 - DNA, 15 bp, Homo sapiens
ctgaacattccagag

SEQ ID NO: 4563197 - DNA, 15 bp, Homo sapiens
ctgaaccccagaggc

SEQ ID NO: 4563198 - DNA, 17 bp, Homo sapiens
ctgaaccccagaggcag

SEQ ID NO: 4563199 - DNA, 18 bp, Homo sapiens
ctgaaccccagaggcaga

SEQ ID NO: 4563200 - DNA, 18 bp, Homo sapiens
ctgaaccttaggctttgt

SEQ ID NO: 4563201 - DNA, 17 bp, Homo sapiens
ctgaacggggagaaaag

SEQ ID NO: 4563202 - DNA, 17 bp, Homo sapiens
ctgaactattttaaata

SEQ ID NO: 4563203 - DNA, 20 bp, Homo sapiens
ctgaactattttaaataaaa

SEQ ID NO: 4563204 - DNA, 11 bp, Homo sapiens
ctgaactcagc

SEQ ID NO: 4563205 - DNA, 20 bp, Homo sapiens
ctgaactccatacagcctct

SEQ ID NO: 4563206 - DNA, 16 bp, Homo sapiens
ctgaactcgcagggaa

SEQ ID NO: 4563207 - DNA, 13 bp, Homo sapiens
ctgaactgaacac

SEQ ID NO: 4563208 - DNA, 15 bp, Homo sapiens
ctgaactgacaatga

SEQ ID NO: 4563209 - DNA, 15 bp, Homo sapiens
ctgaactgagcccca

SEQ ID NO: 4563210 - DNA, 22 bp, Homo sapiens
ctgaactggtagaaaaacatct

SEQ ID NO: 4563211 - DNA, 16 bp, Homo sapiens
ctgaactgtcctggag

SEQ ID NO: 4563212 - DNA, 15 bp, Homo sapiens
ctgaactttctccct

SEQ ID NO: 4563213 - DNA, 21 bp, Homo sapiens
ctgaagaagcacttctgctgc

SEQ ID NO: 4563214 - DNA, 17 bp, Homo sapiens
ctgaagaagttaattct

SEQ ID NO: 4563215 - DNA, 19 bp, Homo sapiens
ctgaagaagttaattctta

SEQ ID NO: 4563216 - DNA, 18 bp, Homo sapiens
ctgaagaggaccagagga

SEQ ID NO: 4563217 - DNA, 20 bp, Homo sapiens
ctgaagaggaccagaggagc

SEQ ID NO: 4563218 - DNA, 14 bp, Homo sapiens
ctgaagaggcttct

SEQ ID NO: 4563219 - DNA, 16 bp, Homo sapiens
ctgaagatcaatttct

SEQ ID NO: 4563220 - DNA, 17 bp, Homo sapiens
ctgaagatcaatttctc

SEQ ID NO: 4563221 - DNA, 14 bp, Homo sapiens
ctgaagatccccaa

SEQ ID NO: 4563222 - DNA, 19 bp, Homo sapiens
ctgaagatccccaactgct

SEQ ID NO: 4563223 - DNA, 21 bp, Homo sapiens
ctgaagatccccaactgctcc

SEQ ID NO: 4563224 - DNA, 16 bp, Homo sapiens
ctgaagatgcagctca

SEQ ID NO: 4563225 - DNA, 22 bp, Homo sapiens
ctgaagatggagggggctgggg

SEQ ID NO: 4563226 - DNA, 13 bp, Homo sapiens
ctgaagatggctt

SEQ ID NO: 4563227 - DNA, 22 bp, Homo sapiens
ctgaagattcttaaaaattgaa

SEQ ID NO: 4563228 - DNA, 13 bp, Homo sapiens
ctgaagcctctgg

SEQ ID NO: 4563229 - DNA, 11 bp, Homo sapiens
ctgaaggaaaa

SEQ ID NO: 4563230 - DNA, 21 bp, Homo sapiens
ctgaaggaaaaacacaagcaa

SEQ ID NO: 4563231 - DNA, 22 bp, Homo sapiens
ctgaaggaaaaacacaagcaaa

SEQ ID NO: 4563232 - DNA, 15 bp, Homo sapiens
ctgaaggaagagaag

SEQ ID NO: 4563233 - DNA, 16 bp, Homo sapiens
ctgaaggcacagctaa

SEQ ID NO: 4563234 - DNA, 18 bp, Homo sapiens
ctgaaggcagcatgtata

SEQ ID NO: 4563235 - DNA, 19 bp, Homo sapiens
ctgaaggctaaaaagcaac

SEQ ID NO: 4563236 - DNA, 22 bp, Homo sapiens
ctgaaggctaaaaagcaacagg

SEQ ID NO: 4563237 - DNA, 17 bp, Homo sapiens
ctgaagggtggatgtgc

SEQ ID NO: 4563238 - DNA, 22 bp, Homo sapiens
ctgaagggtggatgtgctggag

SEQ ID NO: 4563239 - DNA, 16 bp, Homo sapiens
ctgaagtacaaacatg

SEQ ID NO: 4563240 - DNA, 20 bp, Homo sapiens
ctgaagtgcttgtatagctt

SEQ ID NO: 4563241 - DNA, 14 bp, Homo sapiens
ctgaagttgctgct

SEQ ID NO: 4563242 - DNA, 21 bp, Homo sapiens
ctgaatagttaaaaattaaat

SEQ ID NO: 4563243 - DNA, 17 bp, Homo sapiens
ctgaatagttcaggaga

SEQ ID NO: 4563244 - DNA, 13 bp, Homo sapiens
ctgaatatttttt

SEQ ID NO: 4563245 - DNA, 14 bp, Homo sapiens
ctgaatattttttg

SEQ ID NO: 4563246 - DNA, 18 bp, Homo sapiens
ctgaatcaccaattaaaa

SEQ ID NO: 4563247 - DNA, 21 bp, Homo sapiens
ctgaatcccccttgccacccc

SEQ ID NO: 4563248 - DNA, 22 bp, Homo sapiens
ctgaatcccccttgccacccca

SEQ ID NO: 4563249 - DNA, 15 bp, Homo sapiens
ctgaatctgctacca

SEQ ID NO: 4563250 - DNA, 17 bp, Homo sapiens
ctgaatctgtgcaaaca

SEQ ID NO: 4563251 - DNA, 23 bp, Homo sapiens
ctgaatgaaattaaatgttgatt

SEQ ID NO: 4563252 - DNA, 14 bp, Homo sapiens
ctgaatgaagcagt

SEQ ID NO: 4563253 - DNA, 13 bp, Homo sapiens
ctgaatgatctat

SEQ ID NO: 4563254 - DNA, 16 bp, Homo sapiens
ctgaatgcataatgtt

SEQ ID NO: 4563255 - DNA, 16 bp, Homo sapiens
ctgaatgtaatttgtg

SEQ ID NO: 4563256 - DNA, 22 bp, Homo sapiens
ctgaatgtcattgaaaaactaa

SEQ ID NO: 4563257 - DNA, 22 bp, Homo sapiens
ctgaatgtgcctaatggagaag

SEQ ID NO: 4563258 - DNA, 23 bp, Homo sapiens
ctgaatgtgcctaatggagaaga

SEQ ID NO: 4563259 - DNA, 15 bp, Homo sapiens
ctgaatgttgcatta

SEQ ID NO: 4563260 - DNA, 19 bp, Homo sapiens
ctgaatgttgggactgcta

SEQ ID NO: 4563261 - DNA, 14 bp, Homo sapiens
ctgaattaaataaa

SEQ ID NO: 4563262 - DNA, 15 bp, Homo sapiens
ctgaattaaataaat

SEQ ID NO: 4563263 - DNA, 16 bp, Homo sapiens
ctgaattaaataaata

SEQ ID NO: 4563264 - DNA, 20 bp, Homo sapiens
ctgaattcctttacaactaa

SEQ ID NO: 4563265 - DNA, 16 bp, Homo sapiens
ctgaattctatttgct

SEQ ID NO: 4563266 - DNA, 23 bp, Homo sapiens
ctgaattctatttgctgggcttt

SEQ ID NO: 4563267 - DNA, 16 bp, Homo sapiens
ctgaattgagaataag

SEQ ID NO: 4563268 - DNA, 21 bp, Homo sapiens
ctgaattgagaataagaattt

SEQ ID NO: 4563269 - DNA, 13 bp, Homo sapiens
ctgaattgctttc

SEQ ID NO: 4563270 - DNA, 22 bp, Homo sapiens
ctgaattgctttctgctcttta

SEQ ID NO: 4563271 - DNA, 21 bp, Homo sapiens
ctgaattgtatcaatttgttt

SEQ ID NO: 4563272 - DNA, 16 bp, Homo sapiens
ctgaattgtccccagt

SEQ ID NO: 4563273 - DNA, 13 bp, Homo sapiens
ctgaatttccctc

SEQ ID NO: 4563274 - DNA, 18 bp, Homo sapiens
ctgaatttgcaaagtact

SEQ ID NO: 4563275 - DNA, 20 bp, Homo sapiens
ctgaatttgcaaagtactgt

SEQ ID NO: 4563276 - DNA, 22 bp, Homo sapiens
ctgaatttgtaagcaacttgct

SEQ ID NO: 4563277 - DNA, 15 bp, Homo sapiens
ctgaattttgggact

SEQ ID NO: 4563278 - DNA, 20 bp, Homo sapiens
ctgaattttgggacttctac

SEQ ID NO: 4563279 - DNA, 20 bp, Homo sapiens
ctgaattttggggattttca

SEQ ID NO: 4563280 - DNA, 21 bp, Homo sapiens
ctgaattttggggattttcaa

SEQ ID NO: 4563281 - DNA, 11 bp, Homo sapiens
ctgaattttta

SEQ ID NO: 4563282 - DNA, 22 bp, Homo sapiens
ctgaatttttaaacaagtattt

SEQ ID NO: 4563283 - DNA, 16 bp, Homo sapiens
ctgaatttttttgtaa

SEQ ID NO: 4563284 - DNA, 17 bp, Homo sapiens
ctgaatttttttgtaat

SEQ ID NO: 4563285 - DNA, 17 bp, Homo sapiens
ctgacaaattttaatta

SEQ ID NO: 4563286 - DNA, 18 bp, Homo sapiens
ctgacaaccattaaagtc

SEQ ID NO: 4563287 - DNA, 22 bp, Homo sapiens
ctgacaaccattaaagtcagaa

SEQ ID NO: 4563288 - DNA, 17 bp, Homo sapiens
ctgacacaccaggcgct

SEQ ID NO: 4563289 - DNA, 20 bp, Homo sapiens
ctgacaccgaccggagtact

SEQ ID NO: 4563290 - DNA, 22 bp, Homo sapiens
ctgacagatgcctggtgagcag

SEQ ID NO: 4563291 - DNA, 15 bp, Homo sapiens
ctgacagcttgagaa

SEQ ID NO: 4563292 - DNA, 12 bp, Homo sapiens
ctgacagggagc

SEQ ID NO: 4563293 - DNA, 21 bp, Homo sapiens
ctgacaggtgaggtctgttcc

SEQ ID NO: 4563294 - DNA, 13 bp, Homo sapiens
ctgacagtccaca

SEQ ID NO: 4563295 - DNA, 14 bp, Homo sapiens
ctgacagtccacag

SEQ ID NO: 4563296 - DNA, 19 bp, Homo sapiens
ctgacatcagaggtatctt

SEQ ID NO: 4563297 - DNA, 20 bp, Homo sapiens
ctgacatgtaagaaaatgtt

SEQ ID NO: 4563298 - DNA, 15 bp, Homo sapiens
ctgacattcactgag

SEQ ID NO: 4563299 - DNA, 16 bp, Homo sapiens
ctgacattgccaaaaa

SEQ ID NO: 4563300 - DNA, 15 bp, Homo sapiens
ctgaccaaacagcca

SEQ ID NO: 4563301 - DNA, 15 bp, Homo sapiens
ctgaccaatattgta

SEQ ID NO: 4563302 - DNA, 16 bp, Homo sapiens
ctgaccagtcagatgg

SEQ ID NO: 4563303 - DNA, 15 bp, Homo sapiens
ctgaccatccactct

SEQ ID NO: 4563304 - DNA, 14 bp, Homo sapiens
ctgaccatgcattt

SEQ ID NO: 4563305 - DNA, 15 bp, Homo sapiens
ctgaccatgcgtcag

SEQ ID NO: 4563306 - DNA, 16 bp, Homo sapiens
ctgacccagagtggag

SEQ ID NO: 4563307 - DNA, 23 bp, Homo sapiens
ctgacccagagtggagtctgagt

SEQ ID NO: 4563308 - DNA, 16 bp, Homo sapiens
ctgacccagtccctgg

SEQ ID NO: 4563309 - DNA, 14 bp, Homo sapiens
ctgacccctgcctg

SEQ ID NO: 4563310 - DNA, 17 bp, Homo sapiens
ctgacccttctctcact

SEQ ID NO: 4563311 - DNA, 21 bp, Homo sapiens
ctgaccgttaaaaaattcttg

SEQ ID NO: 4563312 - DNA, 18 bp, Homo sapiens
ctgacctccgcccctgcc

SEQ ID NO: 4563313 - DNA, 14 bp, Homo sapiens
ctgacctcctctgg

SEQ ID NO: 4563314 - DNA, 20 bp, Homo sapiens
ctgacctcgtgatgggcccg

SEQ ID NO: 4563315 - DNA, 16 bp, Homo sapiens
ctgaccttagcgttct

SEQ ID NO: 4563316 - DNA, 19 bp, Homo sapiens
ctgaccttagcgttctgga

SEQ ID NO: 4563317 - DNA, 20 bp, Homo sapiens
ctgaccttagcgttctggac

SEQ ID NO: 4563318 - DNA, 16 bp, Homo sapiens
ctgaccttggaggaat

SEQ ID NO: 4563319 - DNA, 12 bp, Homo sapiens
ctgacgattctt

SEQ ID NO: 4563320 - DNA, 18 bp, Homo sapiens
ctgacgctcagccccagg

SEQ ID NO: 4563321 - DNA, 14 bp, Homo sapiens
ctgacggactcatg

SEQ ID NO: 4563322 - DNA, 17 bp, Homo sapiens
ctgacgttaggaccagg

SEQ ID NO: 4563323 - DNA, 20 bp, Homo sapiens
ctgacgttaggaccaggaga

SEQ ID NO: 4563324 - DNA, 13 bp, Homo sapiens
ctgactaagaaga

SEQ ID NO: 4563325 - DNA, 17 bp, Homo sapiens
ctgactcaattatttgc

SEQ ID NO: 4563326 - DNA, 20 bp, Homo sapiens
ctgactcaattatttgcata

SEQ ID NO: 4563327 - DNA, 19 bp, Homo sapiens
ctgactcagctaatgtcac

SEQ ID NO: 4563328 - DNA, 20 bp, Homo sapiens
ctgactcagtgaccagtgcc

SEQ ID NO: 4563329 - DNA, 21 bp, Homo sapiens
ctgactcagtgaccagtgcct

SEQ ID NO: 4563330 - DNA, 14 bp, Homo sapiens
ctgactccctgtgg

SEQ ID NO: 4563331 - DNA, 21 bp, Homo sapiens
ctgactccctgtgggggtggc

SEQ ID NO: 4563332 - DNA, 20 bp, Homo sapiens
ctgactcctctggctttccc

SEQ ID NO: 4563333 - DNA, 22 bp, Homo sapiens
ctgactcctctggctttcccag

SEQ ID NO: 4563334 - DNA, 12 bp, Homo sapiens
ctgactctgccc

SEQ ID NO: 4563335 - DNA, 14 bp, Homo sapiens
ctgactctgccccc

SEQ ID NO: 4563336 - DNA, 15 bp, Homo sapiens
ctgactctgccccct

SEQ ID NO: 4563337 - DNA, 21 bp, Homo sapiens
ctgactctgccccctgctggc

SEQ ID NO: 4563338 - DNA, 14 bp, Homo sapiens
ctgactctgttatt

SEQ ID NO: 4563339 - DNA, 19 bp, Homo sapiens
ctgactgatgttgagggaa

SEQ ID NO: 4563340 - DNA, 15 bp, Homo sapiens
ctgactggaggaggc

SEQ ID NO: 4563341 - DNA, 16 bp, Homo sapiens
ctgactggaggaggcc

SEQ ID NO: 4563342 - DNA, 18 bp, Homo sapiens
ctgactggaggaggcctg

SEQ ID NO: 4563343 - DNA, 20 bp, Homo sapiens
ctgactggatggtccagtgt

SEQ ID NO: 4563344 - DNA, 21 bp, Homo sapiens
ctgactggccaaacccttgct

SEQ ID NO: 4563345 - DNA, 19 bp, Homo sapiens
ctgactggtttctcctggt

SEQ ID NO: 4563346 - DNA, 20 bp, Homo sapiens
ctgactggtttctcctggta

SEQ ID NO: 4563347 - DNA, 22 bp, Homo sapiens
ctgactggtttctcctggtaga

SEQ ID NO: 4563348 - DNA, 15 bp, Homo sapiens
ctgacttctaagtaa

SEQ ID NO: 4563349 - DNA, 13 bp, Homo sapiens
ctgacttgagcca

SEQ ID NO: 4563350 - DNA, 14 bp, Homo sapiens
ctgacttgagccac

SEQ ID NO: 4563351 - DNA, 15 bp, Homo sapiens
ctgacttgagccact

SEQ ID NO: 4563352 - DNA, 19 bp, Homo sapiens
ctgacttgagccactcctt

SEQ ID NO: 4563353 - DNA, 13 bp, Homo sapiens
ctgacttgcttta

SEQ ID NO: 4563354 - DNA, 15 bp, Homo sapiens
ctgagaaagactatt

SEQ ID NO: 4563355 - DNA, 19 bp, Homo sapiens
ctgagaaagactattcaaa

SEQ ID NO: 4563356 - DNA, 22 bp, Homo sapiens
ctgagaactgaattttgggact

SEQ ID NO: 4563357 - DNA, 16 bp, Homo sapiens
ctgagaagctctgaag

SEQ ID NO: 4563358 - DNA, 19 bp, Homo sapiens
ctgagaatatacaatgatc

SEQ ID NO: 4563359 - DNA, 19 bp, Homo sapiens
ctgagaatgctaatggttg

SEQ ID NO: 4563360 - DNA, 21 bp, Homo sapiens
ctgagacaggagaatcacctg

SEQ ID NO: 4563361 - DNA, 19 bp, Homo sapiens
ctgagaccagggtggccac

SEQ ID NO: 4563362 - DNA, 22 bp, Homo sapiens
ctgagaccagggtggccacaca

SEQ ID NO: 4563363 - DNA, 19 bp, Homo sapiens
ctgagacccctggcctccg

SEQ ID NO: 4563364 - DNA, 21 bp, Homo sapiens
ctgagacctctagagaaaaga

SEQ ID NO: 4563365 - DNA, 20 bp, Homo sapiens
ctgagactggcacttagccc

SEQ ID NO: 4563366 - DNA, 19 bp, Homo sapiens
ctgagactttctttctgta

SEQ ID NO: 4563367 - DNA, 20 bp, Homo sapiens
ctgagagccctgctgtggga

SEQ ID NO: 4563368 - DNA, 19 bp, Homo sapiens
ctgagagccggccgtggaa

SEQ ID NO: 4563369 - DNA, 15 bp, Homo sapiens
ctgagaggcaccagt

SEQ ID NO: 4563370 - DNA, 12 bp, Homo sapiens
ctgagaggcagg

SEQ ID NO: 4563371 - DNA, 13 bp, Homo sapiens
ctgagaggcaggc

SEQ ID NO: 4563372 - DNA, 14 bp, Homo sapiens
ctgagaggggaagc

SEQ ID NO: 4563373 - DNA, 21 bp, Homo sapiens
ctgagatatgaacatattgtt

SEQ ID NO: 4563374 - DNA, 15 bp, Homo sapiens
ctgagatcctggact

SEQ ID NO: 4563375 - DNA, 19 bp, Homo sapiens
ctgagatcgtgctactgca

SEQ ID NO: 4563376 - DNA, 15 bp, Homo sapiens
ctgagatgcaggtga

SEQ ID NO: 4563377 - DNA, 16 bp, Homo sapiens
ctgagatgtgaacaca

SEQ ID NO: 4563378 - DNA, 14 bp, Homo sapiens
ctgagatttcatct

SEQ ID NO: 4563379 - DNA, 15 bp, Homo sapiens
ctgagatttcatctg

SEQ ID NO: 4563380 - DNA, 21 bp, Homo sapiens
ctgagatttcatctgctctcc

SEQ ID NO: 4563381 - DNA, 15 bp, Homo sapiens
ctgagcaaaggccct

SEQ ID NO: 4563382 - DNA, 17 bp, Homo sapiens
ctgagcaaaggccctgg

SEQ ID NO: 4563383 - DNA, 18 bp, Homo sapiens
ctgagcaaaggccctggg

SEQ ID NO: 4563384 - DNA, 21 bp, Homo sapiens
ctgagcaaaggccctgggtaa

SEQ ID NO: 4563385 - DNA, 14 bp, Homo sapiens
ctgagcaaggagtt

SEQ ID NO: 4563386 - DNA, 17 bp, Homo sapiens
ctgagcacatttgactc

SEQ ID NO: 4563387 - DNA, 22 bp, Homo sapiens
ctgagcacatttgactccactt

SEQ ID NO: 4563388 - DNA, 14 bp, Homo sapiens
ctgagcactcctgg

SEQ ID NO: 4563389 - DNA, 18 bp, Homo sapiens
ctgagcactcctggtgca

SEQ ID NO: 4563390 - DNA, 15 bp, Homo sapiens
ctgagcacttagcag

SEQ ID NO: 4563391 - DNA, 22 bp, Homo sapiens
ctgagcagcatccaccccaccc

SEQ ID NO: 4563392 - DNA, 13 bp, Homo sapiens
ctgagcagccgcc

SEQ ID NO: 4563393 - DNA, 20 bp, Homo sapiens
ctgagcagccgccagctggg

SEQ ID NO: 4563394 - DNA, 16 bp, Homo sapiens
ctgagcaggattttaa

SEQ ID NO: 4563395 - DNA, 18 bp, Homo sapiens
ctgagcattcaggcagca

SEQ ID NO: 4563396 - DNA, 19 bp, Homo sapiens
ctgagccaaggaggcctgg

SEQ ID NO: 4563397 - DNA, 22 bp, Homo sapiens
ctgagccaaggaggcctgggga

SEQ ID NO: 4563398 - DNA, 14 bp, Homo sapiens
ctgagccacagcag

SEQ ID NO: 4563399 - DNA, 20 bp, Homo sapiens
ctgagccacagcagcatttt

SEQ ID NO: 4563400 - DNA, 15 bp, Homo sapiens
ctgagccacctgccc

SEQ ID NO: 4563401 - DNA, 17 bp, Homo sapiens
ctgagccacctgccctt

SEQ ID NO: 4563402 - DNA, 15 bp, Homo sapiens
ctgagccagcagggc

SEQ ID NO: 4563403 - DNA, 12 bp, Homo sapiens
ctgagccagctg

SEQ ID NO: 4563404 - DNA, 12 bp, Homo sapiens
ctgagcccccac

SEQ ID NO: 4563405 - DNA, 13 bp, Homo sapiens
ctgagcccccacc

SEQ ID NO: 4563406 - DNA, 11 bp, Homo sapiens
ctgagccctgc

SEQ ID NO: 4563407 - DNA, 18 bp, Homo sapiens
ctgagccggccccaggct

SEQ ID NO: 4563408 - DNA, 14 bp, Homo sapiens
ctgagcgagctggg

SEQ ID NO: 4563409 - DNA, 22 bp, Homo sapiens
ctgagcgcccccgagccctgac

SEQ ID NO: 4563410 - DNA, 16 bp, Homo sapiens
ctgagcgggagtcagg

SEQ ID NO: 4563411 - DNA, 21 bp, Homo sapiens
ctgagctatttcatctatttt

SEQ ID NO: 4563412 - DNA, 17 bp, Homo sapiens
ctgagctattttcctct

SEQ ID NO: 4563413 - DNA, 20 bp, Homo sapiens
ctgagctattttcctctggc

SEQ ID NO: 4563414 - DNA, 23 bp, Homo sapiens
ctgagctcggggacaggtgacag

SEQ ID NO: 4563415 - DNA, 19 bp, Homo sapiens
ctgagctctgcatttgtct

SEQ ID NO: 4563416 - DNA, 21 bp, Homo sapiens
ctgagctgcagctgagcctga

SEQ ID NO: 4563417 - DNA, 17 bp, Homo sapiens
ctgagctgtgacccaga

SEQ ID NO: 4563418 - DNA, 18 bp, Homo sapiens
ctgagctgtgacccagag

SEQ ID NO: 4563419 - DNA, 22 bp, Homo sapiens
ctgaggaacccttacagtagga

SEQ ID NO: 4563420 - DNA, 19 bp, Homo sapiens
ctgaggagatgaccaggga

SEQ ID NO: 4563421 - DNA, 22 bp, Homo sapiens
ctgaggagatgaccagggatgc

SEQ ID NO: 4563422 - DNA, 11 bp, Homo sapiens
ctgaggatgtt

SEQ ID NO: 4563423 - DNA, 17 bp, Homo sapiens
ctgaggcagcagtgtga

SEQ ID NO: 4563424 - DNA, 13 bp, Homo sapiens
ctgaggcaggaga

SEQ ID NO: 4563425 - DNA, 14 bp, Homo sapiens
ctgaggcaggagaa

SEQ ID NO: 4563426 - DNA, 13 bp, Homo sapiens
ctgaggccagagt

SEQ ID NO: 4563427 - DNA, 17 bp, Homo sapiens
ctgaggccagagtcacc

SEQ ID NO: 4563428 - DNA, 13 bp, Homo sapiens
ctgaggcccctgc

SEQ ID NO: 4563429 - DNA, 15 bp, Homo sapiens
ctgaggcccctgcct

SEQ ID NO: 4563430 - DNA, 16 bp, Homo sapiens
ctgaggcccctgcctc

SEQ ID NO: 4563431 - DNA, 17 bp, Homo sapiens
ctgaggcccctgcctcc

SEQ ID NO: 4563432 - DNA, 16 bp, Homo sapiens
ctgaggccctgcccaa

SEQ ID NO: 4563433 - DNA, 12 bp, Homo sapiens
ctgaggcctcca

SEQ ID NO: 4563434 - DNA, 16 bp, Homo sapiens
ctgaggcggaggctgt

SEQ ID NO: 4563435 - DNA, 19 bp, Homo sapiens
ctgaggcggaggctgtgct

SEQ ID NO: 4563436 - DNA, 20 bp, Homo sapiens
ctgaggcggaggctgtgctc

SEQ ID NO: 4563437 - DNA, 23 bp, Homo sapiens
ctgaggcggaggctgtgctccgc

SEQ ID NO: 4563438 - DNA, 14 bp, Homo sapiens
ctgaggctttggat

SEQ ID NO: 4563439 - DNA, 18 bp, Homo sapiens
ctgagggaccaactgggc

SEQ ID NO: 4563440 - DNA, 23 bp, Homo sapiens
ctgagggactctgaagcctctgg

SEQ ID NO: 4563441 - DNA, 22 bp, Homo sapiens
ctgagggattgaggggccctgg

SEQ ID NO: 4563442 - DNA, 12 bp, Homo sapiens
ctgagggcaaat

SEQ ID NO: 4563443 - DNA, 20 bp, Homo sapiens
ctgagggcagaaaggttctg

SEQ ID NO: 4563444 - DNA, 22 bp, Homo sapiens
ctgagggctaattctgggaagg

SEQ ID NO: 4563445 - DNA, 18 bp, Homo sapiens
ctgagggggcctggatgc

SEQ ID NO: 4563446 - DNA, 17 bp, Homo sapiens
ctgaggtctagaaatag

SEQ ID NO: 4563447 - DNA, 19 bp, Homo sapiens
ctgaggttaaacggtgccc

SEQ ID NO: 4563448 - DNA, 21 bp, Homo sapiens
ctgaggttaaacggtgcccat

SEQ ID NO: 4563449 - DNA, 22 bp, Homo sapiens
ctgaggttaaacggtgcccatc

SEQ ID NO: 4563450 - DNA, 17 bp, Homo sapiens
ctgaggttcctctgcct

SEQ ID NO: 4563451 - DNA, 14 bp, Homo sapiens
ctgagtaaacataa

SEQ ID NO: 4563452 - DNA, 15 bp, Homo sapiens
ctgagtagtggccac

SEQ ID NO: 4563453 - DNA, 18 bp, Homo sapiens
ctgagtagtggccactgg

SEQ ID NO: 4563454 - DNA, 17 bp, Homo sapiens
ctgagtcaccaggaatg

SEQ ID NO: 4563455 - DNA, 22 bp, Homo sapiens
ctgagtcatgatctccctgccg

SEQ ID NO: 4563456 - DNA, 14 bp, Homo sapiens
ctgagtccagctcc

SEQ ID NO: 4563457 - DNA, 15 bp, Homo sapiens
ctgagtccagctccc

SEQ ID NO: 4563458 - DNA, 17 bp, Homo sapiens
ctgagtccctccatgca

SEQ ID NO: 4563459 - DNA, 23 bp, Homo sapiens
ctgagtcctttccaggggccaat

SEQ ID NO: 4563460 - DNA, 21 bp, Homo sapiens
ctgagtcgtacagaaagctgc

SEQ ID NO: 4563461 - DNA, 23 bp, Homo sapiens
ctgagtctcggcatagtccccag

SEQ ID NO: 4563462 - DNA, 19 bp, Homo sapiens
ctgagtctgagtcctgtct

SEQ ID NO: 4563463 - DNA, 14 bp, Homo sapiens
ctgagtgacagagc

SEQ ID NO: 4563464 - DNA, 23 bp, Homo sapiens
ctgagtgccttctgtggggactc

SEQ ID NO: 4563465 - DNA, 23 bp, Homo sapiens
ctgagtgcgggctgaggccagag

SEQ ID NO: 4563466 - DNA, 23 bp, Homo sapiens
ctgagtgtgggagtgcagagaaa

SEQ ID NO: 4563467 - DNA, 22 bp, Homo sapiens
ctgagttctgggtttctagagg

SEQ ID NO: 4563468 - DNA, 23 bp, Homo sapiens
ctgagttctgggtttctagaggt

SEQ ID NO: 4563469 - DNA, 14 bp, Homo sapiens
ctgagttggcctgg

SEQ ID NO: 4563470 - DNA, 16 bp, Homo sapiens
ctgagttgggcagcca

SEQ ID NO: 4563471 - DNA, 17 bp, Homo sapiens
ctgagttgggcagccag

SEQ ID NO: 4563472 - DNA, 19 bp, Homo sapiens
ctgagttgggcagccagga

SEQ ID NO: 4563473 - DNA, 21 bp, Homo sapiens
ctgagttgggcagccaggagt

SEQ ID NO: 4563474 - DNA, 22 bp, Homo sapiens
ctgagttgggggtgtggctctg

SEQ ID NO: 4563475 - DNA, 21 bp, Homo sapiens
ctgagttttgtgtttgttgta

SEQ ID NO: 4563476 - DNA, 13 bp, Homo sapiens
ctgataaaaatga

SEQ ID NO: 4563477 - DNA, 16 bp, Homo sapiens
ctgataacaacctgga

SEQ ID NO: 4563478 - DNA, 22 bp, Homo sapiens
ctgataacaacctggagaccag

SEQ ID NO: 4563479 - DNA, 19 bp, Homo sapiens
ctgatacacagtaattgtg

SEQ ID NO: 4563480 - DNA, 20 bp, Homo sapiens
ctgatactttgacagtgttt

SEQ ID NO: 4563481 - DNA, 19 bp, Homo sapiens
ctgatagctgtttcaaatg

SEQ ID NO: 4563482 - DNA, 22 bp, Homo sapiens
ctgatagctgtttcaaatgtgc

SEQ ID NO: 4563483 - DNA, 22 bp, Homo sapiens
ctgatagtcctttttccaatgt

SEQ ID NO: 4563484 - DNA, 23 bp, Homo sapiens
ctgatagtcctttttccaatgtt

SEQ ID NO: 4563485 - DNA, 21 bp, Homo sapiens
ctgatcaaattggctacaatc

SEQ ID NO: 4563486 - DNA, 22 bp, Homo sapiens
ctgatcagtgggcctccaagga

SEQ ID NO: 4563487 - DNA, 14 bp, Homo sapiens
ctgatcccaccccc

SEQ ID NO: 4563488 - DNA, 23 bp, Homo sapiens
ctgatcccaccccctcctccccc

SEQ ID NO: 4563489 - DNA, 13 bp, Homo sapiens
ctgatccctctac

SEQ ID NO: 4563490 - DNA, 18 bp, Homo sapiens
ctgatctgtactttgtgt

SEQ ID NO: 4563491 - DNA, 20 bp, Homo sapiens
ctgatctgtgctttccagct

SEQ ID NO: 4563492 - DNA, 22 bp, Homo sapiens
ctgatctgtgctttccagctca

SEQ ID NO: 4563493 - DNA, 14 bp, Homo sapiens
ctgatctttgcaaa

SEQ ID NO: 4563494 - DNA, 18 bp, Homo sapiens
ctgatgacgggatgctct

SEQ ID NO: 4563495 - DNA, 20 bp, Homo sapiens
ctgatgacgggatgctcttt

SEQ ID NO: 4563496 - DNA, 17 bp, Homo sapiens
ctgatgagatttttaaa

SEQ ID NO: 4563497 - DNA, 14 bp, Homo sapiens
ctgatgagcacatc

SEQ ID NO: 4563498 - DNA, 21 bp, Homo sapiens
ctgatgagcacatctctctgc

SEQ ID NO: 4563499 - DNA, 22 bp, Homo sapiens
ctgatgagcacatctctctgcc

SEQ ID NO: 4563500 - DNA, 22 bp, Homo sapiens
ctgatgattttcctttttcttc

SEQ ID NO: 4563501 - DNA, 17 bp, Homo sapiens
ctgatgctccctcccct

SEQ ID NO: 4563502 - DNA, 18 bp, Homo sapiens
ctgatgctccctcccctg

SEQ ID NO: 4563503 - DNA, 22 bp, Homo sapiens
ctgatgctccctcccctgccct

SEQ ID NO: 4563504 - DNA, 23 bp, Homo sapiens
ctgatgctccctcccctgccctg

SEQ ID NO: 4563505 - DNA, 16 bp, Homo sapiens
ctgatgctgggaccct

SEQ ID NO: 4563506 - DNA, 22 bp, Homo sapiens
ctgatgctggggacacagcatc

SEQ ID NO: 4563507 - DNA, 15 bp, Homo sapiens
ctgatggagccttcc

SEQ ID NO: 4563508 - DNA, 14 bp, Homo sapiens
ctgatggccttaat

SEQ ID NO: 4563509 - DNA, 21 bp, Homo sapiens
ctgatggcctttggacccagg

SEQ ID NO: 4563510 - DNA, 20 bp, Homo sapiens
ctgatgggaataaaagtatt

SEQ ID NO: 4563511 - DNA, 18 bp, Homo sapiens
ctgatgggcaaaaaacca

SEQ ID NO: 4563512 - DNA, 14 bp, Homo sapiens
ctgatgtcaaagtg

SEQ ID NO: 4563513 - DNA, 12 bp, Homo sapiens
ctgatgtcccag

SEQ ID NO: 4563514 - DNA, 13 bp, Homo sapiens
ctgatgtcccagt

SEQ ID NO: 4563515 - DNA, 20 bp, Homo sapiens
ctgatgtgtcctcagggagc

SEQ ID NO: 4563516 - DNA, 12 bp, Homo sapiens
ctgatgttcatg

SEQ ID NO: 4563517 - DNA, 23 bp, Homo sapiens
ctgatgttcatgatagaaagaat

SEQ ID NO: 4563518 - DNA, 16 bp, Homo sapiens
ctgattaagcattctt

SEQ ID NO: 4563519 - DNA, 18 bp, Homo sapiens
ctgattaccagtctgatt

SEQ ID NO: 4563520 - DNA, 22 bp, Homo sapiens
ctgattagtattcaggcactga

SEQ ID NO: 4563521 - DNA, 12 bp, Homo sapiens
ctgattatgtaa

SEQ ID NO: 4563522 - DNA, 18 bp, Homo sapiens
ctgattatgtaagcattt

SEQ ID NO: 4563523 - DNA, 18 bp, Homo sapiens
ctgattattttagctaaa

SEQ ID NO: 4563524 - DNA, 15 bp, Homo sapiens
ctgattcttgtaaat

SEQ ID NO: 4563525 - DNA, 16 bp, Homo sapiens
ctgattcttttttcag

SEQ ID NO: 4563526 - DNA, 19 bp, Homo sapiens
ctgattgatcacacagtgt

SEQ ID NO: 4563527 - DNA, 23 bp, Homo sapiens
ctgattggaattctttctgttga

SEQ ID NO: 4563528 - DNA, 13 bp, Homo sapiens
ctgattgtattta

SEQ ID NO: 4563529 - DNA, 17 bp, Homo sapiens
ctgattgtgccagtgca

SEQ ID NO: 4563530 - DNA, 17 bp, Homo sapiens
ctgattgttgtcaggcc

SEQ ID NO: 4563531 - DNA, 16 bp, Homo sapiens
ctgatttaacactttt

SEQ ID NO: 4563532 - DNA, 18 bp, Homo sapiens
ctgatttattttgtatga

SEQ ID NO: 4563533 - DNA, 23 bp, Homo sapiens
ctgatttattttgtatgaaatat

SEQ ID NO: 4563534 - DNA, 13 bp, Homo sapiens
ctgatttcataat

SEQ ID NO: 4563535 - DNA, 16 bp, Homo sapiens
ctgatttcataattca

SEQ ID NO: 4563536 - DNA, 17 bp, Homo sapiens
ctgatttcataattcag

SEQ ID NO: 4563537 - DNA, 19 bp, Homo sapiens
ctgatttcataattcagaa

SEQ ID NO: 4563538 - DNA, 11 bp, Homo sapiens
ctgatttctat

SEQ ID NO: 4563539 - DNA, 16 bp, Homo sapiens
ctgatttctatggctt

SEQ ID NO: 4563540 - DNA, 19 bp, Homo sapiens
ctgatttctatggctttca

SEQ ID NO: 4563541 - DNA, 23 bp, Homo sapiens
ctgattttaatggattgttaatt

SEQ ID NO: 4563542 - DNA, 13 bp, Homo sapiens
ctgcaaaaaatac

SEQ ID NO: 4563543 - DNA, 18 bp, Homo sapiens
ctgcaaaaggactctcag

SEQ ID NO: 4563544 - DNA, 21 bp, Homo sapiens
ctgcaaaaggcctcttgtaaa

SEQ ID NO: 4563545 - DNA, 16 bp, Homo sapiens
ctgcaaaatgtagaaa

SEQ ID NO: 4563546 - DNA, 17 bp, Homo sapiens
ctgcaaaatgtagaaat

SEQ ID NO: 4563547 - DNA, 18 bp, Homo sapiens
ctgcaaacctgacccctg

SEQ ID NO: 4563548 - DNA, 20 bp, Homo sapiens
ctgcaaacctgacccctgct

SEQ ID NO: 4563549 - DNA, 23 bp, Homo sapiens
ctgcaaaccttcctgggaggaca

SEQ ID NO: 4563550 - DNA, 19 bp, Homo sapiens
ctgcaaatactgtatattc

SEQ ID NO: 4563551 - DNA, 17 bp, Homo sapiens
ctgcaaatagaaaacag

SEQ ID NO: 4563552 - DNA, 19 bp, Homo sapiens
ctgcaaatagaaaacagga

SEQ ID NO: 4563553 - DNA, 22 bp, Homo sapiens
ctgcaaatattagcaaagaagc

SEQ ID NO: 4563554 - DNA, 19 bp, Homo sapiens
ctgcaaatctgatggcctt

SEQ ID NO: 4563555 - DNA, 17 bp, Homo sapiens
ctgcaaattttaactgt

SEQ ID NO: 4563556 - DNA, 12 bp, Homo sapiens
ctgcaacaaaat

SEQ ID NO: 4563557 - DNA, 20 bp, Homo sapiens
ctgcaacaaagaattatcca

SEQ ID NO: 4563558 - DNA, 21 bp, Homo sapiens
ctgcaacaagctcatccctgg

SEQ ID NO: 4563559 - DNA, 23 bp, Homo sapiens
ctgcaacaagctcatccctggac

SEQ ID NO: 4563560 - DNA, 15 bp, Homo sapiens
ctgcaactccatcct

SEQ ID NO: 4563561 - DNA, 20 bp, Homo sapiens
ctgcaactccatcctcctgt

SEQ ID NO: 4563562 - DNA, 23 bp, Homo sapiens
ctgcaacttccgctgaggggtct

SEQ ID NO: 4563563 - DNA, 22 bp, Homo sapiens
ctgcaagaagaaatcatgatat

SEQ ID NO: 4563564 - DNA, 19 bp, Homo sapiens
ctgcaagaccacggaggga

SEQ ID NO: 4563565 - DNA, 14 bp, Homo sapiens
ctgcaagagccttg

SEQ ID NO: 4563566 - DNA, 15 bp, Homo sapiens
ctgcaagagccttgg

SEQ ID NO: 4563567 - DNA, 17 bp, Homo sapiens
ctgcaagagccttggtg

SEQ ID NO: 4563568 - DNA, 23 bp, Homo sapiens
ctgcaagatggacacgagccaca

SEQ ID NO: 4563569 - DNA, 20 bp, Homo sapiens
ctgcaagcatttttccatct

SEQ ID NO: 4563570 - DNA, 17 bp, Homo sapiens
ctgcaagctccgcctcc

SEQ ID NO: 4563571 - DNA, 16 bp, Homo sapiens
ctgcaagttgctctga

SEQ ID NO: 4563572 - DNA, 17 bp, Homo sapiens
ctgcaattttactgtga

SEQ ID NO: 4563573 - DNA, 14 bp, Homo sapiens
ctgcacacaaatat

SEQ ID NO: 4563574 - DNA, 15 bp, Homo sapiens
ctgcacacacatgca

SEQ ID NO: 4563575 - DNA, 19 bp, Homo sapiens
ctgcacaccagagacaagc

SEQ ID NO: 4563576 - DNA, 12 bp, Homo sapiens
ctgcacaccctg

SEQ ID NO: 4563577 - DNA, 14 bp, Homo sapiens
ctgcacaccctggg

SEQ ID NO: 4563578 - DNA, 15 bp, Homo sapiens
ctgcacaccctgggc

SEQ ID NO: 4563579 - DNA, 20 bp, Homo sapiens
ctgcacaccctgggccacgc

SEQ ID NO: 4563580 - DNA, 16 bp, Homo sapiens
ctgcacagacctggag

SEQ ID NO: 4563581 - DNA, 23 bp, Homo sapiens
ctgcacagagcaagtcctcactc

SEQ ID NO: 4563582 - DNA, 20 bp, Homo sapiens
ctgcacagcaggctgccagt

SEQ ID NO: 4563583 - DNA, 18 bp, Homo sapiens
ctgcacagggcagctggg

SEQ ID NO: 4563584 - DNA, 24 bp, Homo sapiens
ctgcacagtttagaacagagggac

SEQ ID NO: 4563585 - DNA, 22 bp, Homo sapiens
ctgcacatctgtaaatctacac

SEQ ID NO: 4563586 - DNA, 14 bp, Homo sapiens
ctgcacatggcctg

SEQ ID NO: 4563587 - DNA, 16 bp, Homo sapiens
ctgcacatggcctgag

SEQ ID NO: 4563588 - DNA, 18 bp, Homo sapiens
ctgcacccagaacagtgg

SEQ ID NO: 4563589 - DNA, 11 bp, Homo sapiens
ctgcacccagt

SEQ ID NO: 4563590 - DNA, 14 bp, Homo sapiens
ctgcacccagtgaa

SEQ ID NO: 4563591 - DNA, 16 bp, Homo sapiens
ctgcaccccagcattc

SEQ ID NO: 4563592 - DNA, 18 bp, Homo sapiens
ctgcacccctgcccccag

SEQ ID NO: 4563593 - DNA, 20 bp, Homo sapiens
ctgcaccccttctctcctcc

SEQ ID NO: 4563594 - DNA, 19 bp, Homo sapiens
ctgcaccggggcctgggca

SEQ ID NO: 4563595 - DNA, 17 bp, Homo sapiens
ctgcacctccccccact

SEQ ID NO: 4563596 - DNA, 22 bp, Homo sapiens
ctgcacctccccccactgcagg

SEQ ID NO: 4563597 - DNA, 20 bp, Homo sapiens
ctgcacggtgggccttgctg

SEQ ID NO: 4563598 - DNA, 17 bp, Homo sapiens
ctgcactaacagagtgg

SEQ ID NO: 4563599 - DNA, 14 bp, Homo sapiens
ctgcactcagaaaa

SEQ ID NO: 4563600 - DNA, 15 bp, Homo sapiens
ctgcactccagcctg

SEQ ID NO: 4563601 - DNA, 16 bp, Homo sapiens
ctgcactccagcctgg

SEQ ID NO: 4563602 - DNA, 21 bp, Homo sapiens
ctgcactccagcctgggtcac

SEQ ID NO: 4563603 - DNA, 18 bp, Homo sapiens
ctgcactcccacctgaca

SEQ ID NO: 4563604 - DNA, 18 bp, Homo sapiens
ctgcactcctttatctgt

SEQ ID NO: 4563605 - DNA, 23 bp, Homo sapiens
ctgcactcctttatctgtaattg

SEQ ID NO: 4563606 - DNA, 13 bp, Homo sapiens
ctgcactctgtag

SEQ ID NO: 4563607 - DNA, 12 bp, Homo sapiens
ctgcactgtcaa

SEQ ID NO: 4563608 - DNA, 11 bp, Homo sapiens
ctgcactgtga

SEQ ID NO: 4563609 - DNA, 18 bp, Homo sapiens
ctgcactttgatgtcatg

SEQ ID NO: 4563610 - DNA, 19 bp, Homo sapiens
ctgcactttgtttagaaaa

SEQ ID NO: 4563611 - DNA, 21 bp, Homo sapiens
ctgcagaacgtattggtccag

SEQ ID NO: 4563612 - DNA, 23 bp, Homo sapiens
ctgcagaagacagtatggcagct

SEQ ID NO: 4563613 - DNA, 22 bp, Homo sapiens
ctgcagaagggtggggatatca

SEQ ID NO: 4563614 - DNA, 16 bp, Homo sapiens
ctgcagaccccaggtt

SEQ ID NO: 4563615 - DNA, 20 bp, Homo sapiens
ctgcagacctcaagccatca

SEQ ID NO: 4563616 - DNA, 14 bp, Homo sapiens
ctgcagacctgtcc

SEQ ID NO: 4563617 - DNA, 16 bp, Homo sapiens
ctgcagacctgtcctc

SEQ ID NO: 4563618 - DNA, 18 bp, Homo sapiens
ctgcagacgtctgccttg

SEQ ID NO: 4563619 - DNA, 23 bp, Homo sapiens
ctgcagacgtctgccttggcatc

SEQ ID NO: 4563620 - DNA, 17 bp, Homo sapiens
ctgcagacttcccagct

SEQ ID NO: 4563621 - DNA, 18 bp, Homo sapiens
ctgcagacttcccagcta

SEQ ID NO: 4563622 - DNA, 17 bp, Homo sapiens
ctgcagagctgacccag

SEQ ID NO: 4563623 - DNA, 17 bp, Homo sapiens
ctgcagatcttccgtgg

SEQ ID NO: 4563624 - DNA, 19 bp, Homo sapiens
ctgcagatcttccgtggtc

SEQ ID NO: 4563625 - DNA, 22 bp, Homo sapiens
ctgcagattagttctttttgcc

SEQ ID NO: 4563626 - DNA, 23 bp, Homo sapiens
ctgcagattagttctttttgcca

SEQ ID NO: 4563627 - DNA, 22 bp, Homo sapiens
ctgcagattctgagcaaaggcc

SEQ ID NO: 4563628 - DNA, 14 bp, Homo sapiens
ctgcagcagtcgcc

SEQ ID NO: 4563629 - DNA, 15 bp, Homo sapiens
ctgcagcatgaaggc

SEQ ID NO: 4563630 - DNA, 16 bp, Homo sapiens
ctgcagccagcccagc

SEQ ID NO: 4563631 - DNA, 17 bp, Homo sapiens
ctgcagccagcccagcc

SEQ ID NO: 4563632 - DNA, 18 bp, Homo sapiens
ctgcagccagcccagccc

SEQ ID NO: 4563633 - DNA, 12 bp, Homo sapiens
ctgcagccaggg

SEQ ID NO: 4563634 - DNA, 21 bp, Homo sapiens
ctgcagcccaccagacgtcag

SEQ ID NO: 4563635 - DNA, 15 bp, Homo sapiens
ctgcagccccccaga

SEQ ID NO: 4563636 - DNA, 20 bp, Homo sapiens
ctgcagcctcatactcctgg

SEQ ID NO: 4563637 - DNA, 21 bp, Homo sapiens
ctgcagcctcatactcctggg

SEQ ID NO: 4563638 - DNA, 15 bp, Homo sapiens
ctgcagcggctgccc

SEQ ID NO: 4563639 - DNA, 15 bp, Homo sapiens
ctgcagctccctggc

SEQ ID NO: 4563640 - DNA, 16 bp, Homo sapiens
ctgcagctccctggct

SEQ ID NO: 4563641 - DNA, 19 bp, Homo sapiens
ctgcagctccctggcttct

SEQ ID NO: 4563642 - DNA, 15 bp, Homo sapiens
ctgcagctgagcctg

SEQ ID NO: 4563643 - DNA, 16 bp, Homo sapiens
ctgcagctgagcctga

SEQ ID NO: 4563644 - DNA, 12 bp, Homo sapiens
ctgcagctggaa

SEQ ID NO: 4563645 - DNA, 21 bp, Homo sapiens
ctgcagctggaatgtgccaca

SEQ ID NO: 4563646 - DNA, 22 bp, Homo sapiens
ctgcaggaatcacccctctgcc

SEQ ID NO: 4563647 - DNA, 18 bp, Homo sapiens
ctgcaggagagagcagca

SEQ ID NO: 4563648 - DNA, 21 bp, Homo sapiens
ctgcaggcagagctggagccc

SEQ ID NO: 4563649 - DNA, 14 bp, Homo sapiens
ctgcaggccccgct

SEQ ID NO: 4563650 - DNA, 22 bp, Homo sapiens
ctgcaggccccgcttgtccagc

SEQ ID NO: 4563651 - DNA, 16 bp, Homo sapiens
ctgcaggctggggagg

SEQ ID NO: 4563652 - DNA, 19 bp, Homo sapiens
ctgcaggctggggaggtgc

SEQ ID NO: 4563653 - DNA, 21 bp, Homo sapiens
ctgcaggctggggaggtgctg

SEQ ID NO: 4563654 - DNA, 21 bp, Homo sapiens
ctgcaggtcagttgtaataaa

SEQ ID NO: 4563655 - DNA, 19 bp, Homo sapiens
ctgcaggtttgacacgcag

SEQ ID NO: 4563656 - DNA, 15 bp, Homo sapiens
ctgcagtaaaacaca

SEQ ID NO: 4563657 - DNA, 17 bp, Homo sapiens
ctgcagtaaaacacatt

SEQ ID NO: 4563658 - DNA, 20 bp, Homo sapiens
ctgcagtcacatcacaatat

SEQ ID NO: 4563659 - DNA, 13 bp, Homo sapiens
ctgcagtcagccc

SEQ ID NO: 4563660 - DNA, 15 bp, Homo sapiens
ctgcagtcagccctg

SEQ ID NO: 4563661 - DNA, 17 bp, Homo sapiens
ctgcagtctcatttctc

SEQ ID NO: 4563662 - DNA, 13 bp, Homo sapiens
ctgcagtggctcc

SEQ ID NO: 4563663 - DNA, 18 bp, Homo sapiens
ctgcagtggctcccctgc

SEQ ID NO: 4563664 - DNA, 22 bp, Homo sapiens
ctgcagttttgctatctgggct

SEQ ID NO: 4563665 - DNA, 13 bp, Homo sapiens
ctgcatagacaaa

SEQ ID NO: 4563666 - DNA, 15 bp, Homo sapiens
ctgcatagacaaagg

SEQ ID NO: 4563667 - DNA, 21 bp, Homo sapiens
ctgcatatggattgccaagtc

SEQ ID NO: 4563668 - DNA, 13 bp, Homo sapiens
ctgcatatttagc

SEQ ID NO: 4563669 - DNA, 19 bp, Homo sapiens
ctgcatcatctgtttgtaa

SEQ ID NO: 4563670 - DNA, 13 bp, Homo sapiens
ctgcatccagcct

SEQ ID NO: 4563671 - DNA, 21 bp, Homo sapiens
ctgcatccgtagttccctgaa

SEQ ID NO: 4563672 - DNA, 20 bp, Homo sapiens
ctgcatcctggcttgaaaaa

SEQ ID NO: 4563673 - DNA, 22 bp, Homo sapiens
ctgcatcctggcttgaaaaaca

SEQ ID NO: 4563674 - DNA, 14 bp, Homo sapiens
ctgcatgcggccca

SEQ ID NO: 4563675 - DNA, 21 bp, Homo sapiens
ctgcatgcggcccagcccggc

SEQ ID NO: 4563676 - DNA, 21 bp, Homo sapiens
ctgcatgggaaatagcggccc

SEQ ID NO: 4563677 - DNA, 23 bp, Homo sapiens
ctgcatgggaaatagcggccctg

SEQ ID NO: 4563678 - DNA, 15 bp, Homo sapiens
ctgcattcattttta

SEQ ID NO: 4563679 - DNA, 16 bp, Homo sapiens
ctgcattcatttttat

SEQ ID NO: 4563680 - DNA, 19 bp, Homo sapiens
ctgcattcctttttcttca

SEQ ID NO: 4563681 - DNA, 14 bp, Homo sapiens
ctgcattgtaaata

SEQ ID NO: 4563682 - DNA, 16 bp, Homo sapiens
ctgcatttcatattat

SEQ ID NO: 4563683 - DNA, 20 bp, Homo sapiens
ctgcatttcatattatttta

SEQ ID NO: 4563684 - DNA, 22 bp, Homo sapiens
ctgcatttgcctgcttctttcc

SEQ ID NO: 4563685 - DNA, 18 bp, Homo sapiens
ctgcatttttagaccatt

SEQ ID NO: 4563686 - DNA, 16 bp, Homo sapiens
ctgccaagactcctca

SEQ ID NO: 4563687 - DNA, 18 bp, Homo sapiens
ctgccaaggccagagtgg

SEQ ID NO: 4563688 - DNA, 23 bp, Homo sapiens
ctgccaaggccagagtggcctgg

SEQ ID NO: 4563689 - DNA, 19 bp, Homo sapiens
ctgccaagtctcagaagag

SEQ ID NO: 4563690 - DNA, 15 bp, Homo sapiens
ctgccacacccaggg

SEQ ID NO: 4563691 - DNA, 19 bp, Homo sapiens
ctgccacacggaagcaagc

SEQ ID NO: 4563692 - DNA, 12 bp, Homo sapiens
ctgccacagcca

SEQ ID NO: 4563693 - DNA, 15 bp, Homo sapiens
ctgccacagccagag

SEQ ID NO: 4563694 - DNA, 23 bp, Homo sapiens
ctgccacagcctcccctgccagg

SEQ ID NO: 4563695 - DNA, 16 bp, Homo sapiens
ctgccacatggagccc

SEQ ID NO: 4563696 - DNA, 15 bp, Homo sapiens
ctgccaccagccccc

SEQ ID NO: 4563697 - DNA, 21 bp, Homo sapiens
ctgccacccgcccacccgcct

SEQ ID NO: 4563698 - DNA, 16 bp, Homo sapiens
ctgccacctctccatc

SEQ ID NO: 4563699 - DNA, 12 bp, Homo sapiens
ctgccactcaca

SEQ ID NO: 4563700 - DNA, 20 bp, Homo sapiens
ctgccactcacacagccagg

SEQ ID NO: 4563701 - DNA, 24 bp, Homo sapiens
ctgccactcacacagccaggtgcc

SEQ ID NO: 4563702 - DNA, 22 bp, Homo sapiens
ctgccagaagatcccctcagga

SEQ ID NO: 4563703 - DNA, 13 bp, Homo sapiens
ctgccagccactg

SEQ ID NO: 4563704 - DNA, 13 bp, Homo sapiens
ctgccagcccacc

SEQ ID NO: 4563705 - DNA, 17 bp, Homo sapiens
ctgccagcccaccccct

SEQ ID NO: 4563706 - DNA, 24 bp, Homo sapiens
ctgccagctggatcgctgcacatg

SEQ ID NO: 4563707 - DNA, 12 bp, Homo sapiens
ctgccaggcagg

SEQ ID NO: 4563708 - DNA, 17 bp, Homo sapiens
ctgccaggcaggggtgg

SEQ ID NO: 4563709 - DNA, 16 bp, Homo sapiens
ctgccaggccagcctc

SEQ ID NO: 4563710 - DNA, 18 bp, Homo sapiens
ctgccaggccagcctccg

SEQ ID NO: 4563711 - DNA, 22 bp, Homo sapiens
ctgccaggccagcctccgagag

SEQ ID NO: 4563712 - DNA, 19 bp, Homo sapiens
ctgccaggctgcctcctgc

SEQ ID NO: 4563713 - DNA, 15 bp, Homo sapiens
ctgccagggcagggc

SEQ ID NO: 4563714 - DNA, 16 bp, Homo sapiens
ctgccagtcctagctg

SEQ ID NO: 4563715 - DNA, 21 bp, Homo sapiens
ctgccagtcctagctgcacag

SEQ ID NO: 4563716 - DNA, 18 bp, Homo sapiens
ctgccagtctcactgtgg

SEQ ID NO: 4563717 - DNA, 14 bp, Homo sapiens
ctgccagtgcagcc

SEQ ID NO: 4563718 - DNA, 17 bp, Homo sapiens
ctgccagtgcagccact

SEQ ID NO: 4563719 - DNA, 16 bp, Homo sapiens
ctgccagtgcctgggt

SEQ ID NO: 4563720 - DNA, 14 bp, Homo sapiens
ctgccagtgcctta

SEQ ID NO: 4563721 - DNA, 20 bp, Homo sapiens
ctgccagtgccttacctcct

SEQ ID NO: 4563722 - DNA, 23 bp, Homo sapiens
ctgccatcctggcccagggcatc

SEQ ID NO: 4563723 - DNA, 15 bp, Homo sapiens
ctgccatgacagagg

SEQ ID NO: 4563724 - DNA, 16 bp, Homo sapiens
ctgccatgccaggaac

SEQ ID NO: 4563725 - DNA, 18 bp, Homo sapiens
ctgccatgccaggaacct

SEQ ID NO: 4563726 - DNA, 14 bp, Homo sapiens
ctgccatgctttga

SEQ ID NO: 4563727 - DNA, 18 bp, Homo sapiens
ctgccatggaactgtttc

SEQ ID NO: 4563728 - DNA, 22 bp, Homo sapiens
ctgccattctgtgcaggctgca

SEQ ID NO: 4563729 - DNA, 17 bp, Homo sapiens
ctgccattcttctggtg

SEQ ID NO: 4563730 - DNA, 19 bp, Homo sapiens
ctgccattgggaccctcca

SEQ ID NO: 4563731 - DNA, 18 bp, Homo sapiens
ctgccatttatttcctca

SEQ ID NO: 4563732 - DNA, 14 bp, Homo sapiens
ctgcccaaaatgtg

SEQ ID NO: 4563733 - DNA, 14 bp, Homo sapiens
ctgcccagactgat

SEQ ID NO: 4563734 - DNA, 15 bp, Homo sapiens
ctgcccagactgatg

SEQ ID NO: 4563735 - DNA, 12 bp, Homo sapiens
ctgcccagcaac

SEQ ID NO: 4563736 - DNA, 21 bp, Homo sapiens
ctgcccagcagcccctgagag

SEQ ID NO: 4563737 - DNA, 15 bp, Homo sapiens
ctgcccagccctggc

SEQ ID NO: 4563738 - DNA, 15 bp, Homo sapiens
ctgcccagccgggca

SEQ ID NO: 4563739 - DNA, 16 bp, Homo sapiens
ctgcccagccgggcac

SEQ ID NO: 4563740 - DNA, 14 bp, Homo sapiens
ctgcccagcctgct

SEQ ID NO: 4563741 - DNA, 13 bp, Homo sapiens
ctgcccaggagac

SEQ ID NO: 4563742 - DNA, 18 bp, Homo sapiens
ctgcccaggagagccagc

SEQ ID NO: 4563743 - DNA, 11 bp, Homo sapiens
ctgcccaggcc

SEQ ID NO: 4563744 - DNA, 14 bp, Homo sapiens
ctgcccaggccaca

SEQ ID NO: 4563745 - DNA, 16 bp, Homo sapiens
ctgcccaggccacaga

SEQ ID NO: 4563746 - DNA, 17 bp, Homo sapiens
ctgcccaggccacagag

SEQ ID NO: 4563747 - DNA, 18 bp, Homo sapiens
ctgcccaggccacagaga

SEQ ID NO: 4563748 - DNA, 19 bp, Homo sapiens
ctgcccatgagcaagccta

SEQ ID NO: 4563749 - DNA, 21 bp, Homo sapiens
ctgccccaactcctggaagct

SEQ ID NO: 4563750 - DNA, 23 bp, Homo sapiens
ctgccccacatgcatgtctgcct

SEQ ID NO: 4563751 - DNA, 20 bp, Homo sapiens
ctgccccacccaactccaca

SEQ ID NO: 4563752 - DNA, 13 bp, Homo sapiens
ctgccccacccca

SEQ ID NO: 4563753 - DNA, 18 bp, Homo sapiens
ctgccccaccccatccag

SEQ ID NO: 4563754 - DNA, 18 bp, Homo sapiens
ctgccccacgttgtccct

SEQ ID NO: 4563755 - DNA, 13 bp, Homo sapiens
ctgccccagccag

SEQ ID NO: 4563756 - DNA, 10 bp, Homo sapiens
ctgccccagg

SEQ ID NO: 4563757 - DNA, 20 bp, Homo sapiens
ctgccccaggtacacctccc

SEQ ID NO: 4563758 - DNA, 15 bp, Homo sapiens
ctgccccattgagat

SEQ ID NO: 4563759 - DNA, 21 bp, Homo sapiens
ctgcccccaccccttcctgtc

SEQ ID NO: 4563760 - DNA, 23 bp, Homo sapiens
ctgcccccagaaagcctcctgcc

SEQ ID NO: 4563761 - DNA, 14 bp, Homo sapiens
ctgcccccaggact

SEQ ID NO: 4563762 - DNA, 17 bp, Homo sapiens
ctgcccccaggactggg

SEQ ID NO: 4563763 - DNA, 21 bp, Homo sapiens
ctgccccccgaggctgctaga

SEQ ID NO: 4563764 - DNA, 20 bp, Homo sapiens
ctgcccccgcgggttctaga

SEQ ID NO: 4563765 - DNA, 22 bp, Homo sapiens
ctgcccccgctcccgctcccag

SEQ ID NO: 4563766 - DNA, 12 bp, Homo sapiens
ctgccccctccc

SEQ ID NO: 4563767 - DNA, 15 bp, Homo sapiens
ctgccccctccccca

SEQ ID NO: 4563768 - DNA, 19 bp, Homo sapiens
ctgccccctgctggctctt

SEQ ID NO: 4563769 - DNA, 17 bp, Homo sapiens
ctgccccgtgtgtgtgg

SEQ ID NO: 4563770 - DNA, 21 bp, Homo sapiens
ctgcccctaccctggacttgc

SEQ ID NO: 4563771 - DNA, 13 bp, Homo sapiens
ctgcccctcacaa

SEQ ID NO: 4563772 - DNA, 13 bp, Homo sapiens
ctgcccctctcac

SEQ ID NO: 4563773 - DNA, 14 bp, Homo sapiens
ctgcccctgcacag

SEQ ID NO: 4563774 - DNA, 15 bp, Homo sapiens
ctgcccctgcacagc

SEQ ID NO: 4563775 - DNA, 16 bp, Homo sapiens
ctgcccctgcagctgg

SEQ ID NO: 4563776 - DNA, 14 bp, Homo sapiens
ctgcccctgtctgg

SEQ ID NO: 4563777 - DNA, 17 bp, Homo sapiens
ctgcccctgtctggaag

SEQ ID NO: 4563778 - DNA, 18 bp, Homo sapiens
ctgcccctgtctggaaga

SEQ ID NO: 4563779 - DNA, 23 bp, Homo sapiens
ctgccccttaaacacaggctgtc

SEQ ID NO: 4563780 - DNA, 19 bp, Homo sapiens
ctgccccttctacactctc

SEQ ID NO: 4563781 - DNA, 20 bp, Homo sapiens
ctgccccttctacactctcc

SEQ ID NO: 4563782 - DNA, 18 bp, Homo sapiens
ctgcccgggagctcagga

SEQ ID NO: 4563783 - DNA, 19 bp, Homo sapiens
ctgcccgtctctctcccat

SEQ ID NO: 4563784 - DNA, 16 bp, Homo sapiens
ctgccctcccaagtcc

SEQ ID NO: 4563785 - DNA, 23 bp, Homo sapiens
ctgccctctccctgtgttctggg

SEQ ID NO: 4563786 - DNA, 16 bp, Homo sapiens
ctgccctggaggaagt

SEQ ID NO: 4563787 - DNA, 15 bp, Homo sapiens
ctgccctggctccag

SEQ ID NO: 4563788 - DNA, 14 bp, Homo sapiens
ctgccctggctgct

SEQ ID NO: 4563789 - DNA, 17 bp, Homo sapiens
ctgccctggctgctgcc

SEQ ID NO: 4563790 - DNA, 14 bp, Homo sapiens
ctgccctggtccag

SEQ ID NO: 4563791 - DNA, 13 bp, Homo sapiens
ctgccctgtccaa

SEQ ID NO: 4563792 - DNA, 12 bp, Homo sapiens
ctgccctgtgat

SEQ ID NO: 4563793 - DNA, 16 bp, Homo sapiens
ctgcccttcaccccag

SEQ ID NO: 4563794 - DNA, 15 bp, Homo sapiens
ctgcccttccctctg

SEQ ID NO: 4563795 - DNA, 15 bp, Homo sapiens
ctgcccttcctgcag

SEQ ID NO: 4563796 - DNA, 12 bp, Homo sapiens
ctgcccttgcag

SEQ ID NO: 4563797 - DNA, 13 bp, Homo sapiens
ctgcccttgcagg

SEQ ID NO: 4563798 - DNA, 15 bp, Homo sapiens
ctgcccttgcagggt

SEQ ID NO: 4563799 - DNA, 17 bp, Homo sapiens
ctgcccttgcagggtgg

SEQ ID NO: 4563800 - DNA, 18 bp, Homo sapiens
ctgcccttgcagggtggg

SEQ ID NO: 4563801 - DNA, 14 bp, Homo sapiens
ctgcccttgctgcc

SEQ ID NO: 4563802 - DNA, 15 bp, Homo sapiens
ctgcccttttttctg

SEQ ID NO: 4563803 - DNA, 20 bp, Homo sapiens
ctgcccttttttctgcctcc

SEQ ID NO: 4563804 - DNA, 15 bp, Homo sapiens
ctgccgacttggaga

SEQ ID NO: 4563805 - DNA, 15 bp, Homo sapiens
ctgccgagggctggc

SEQ ID NO: 4563806 - DNA, 19 bp, Homo sapiens
ctgccgagggctggccggg

SEQ ID NO: 4563807 - DNA, 20 bp, Homo sapiens
ctgccgagggctggccggga

SEQ ID NO: 4563808 - DNA, 21 bp, Homo sapiens
ctgccgagggctggccgggac

SEQ ID NO: 4563809 - DNA, 23 bp, Homo sapiens
ctgccgagggctggccgggactg

SEQ ID NO: 4563810 - DNA, 14 bp, Homo sapiens
ctgccgcaccccag

SEQ ID NO: 4563811 - DNA, 17 bp, Homo sapiens
ctgccgcaccccagagt

SEQ ID NO: 4563812 - DNA, 16 bp, Homo sapiens
ctgccgcagagctggc

SEQ ID NO: 4563813 - DNA, 16 bp, Homo sapiens
ctgccgccctgtggga

SEQ ID NO: 4563814 - DNA, 23 bp, Homo sapiens
ctgccgccctgtgggagccgcag

SEQ ID NO: 4563815 - DNA, 15 bp, Homo sapiens
ctgccgctgcaccac

SEQ ID NO: 4563816 - DNA, 16 bp, Homo sapiens
ctgccgctgcaccacg

SEQ ID NO: 4563817 - DNA, 21 bp, Homo sapiens
ctgccggtcgggcagccagca

SEQ ID NO: 4563818 - DNA, 18 bp, Homo sapiens
ctgccggtgggaccctgt

SEQ ID NO: 4563819 - DNA, 18 bp, Homo sapiens
ctgccgtgcatggctcct

SEQ ID NO: 4563820 - DNA, 19 bp, Homo sapiens
ctgccgtgcatggctcctg

SEQ ID NO: 4563821 - DNA, 20 bp, Homo sapiens
ctgcctaaatccactctgca

SEQ ID NO: 4563822 - DNA, 15 bp, Homo sapiens
ctgcctaagtgcagc

SEQ ID NO: 4563823 - DNA, 14 bp, Homo sapiens
ctgcctacagccag

SEQ ID NO: 4563824 - DNA, 15 bp, Homo sapiens
ctgcctacagccagg

SEQ ID NO: 4563825 - DNA, 21 bp, Homo sapiens
ctgcctatgcactgaagagct

SEQ ID NO: 4563826 - DNA, 24 bp, Homo sapiens
ctgcctatgcactgaagagctctt

SEQ ID NO: 4563827 - DNA, 15 bp, Homo sapiens
ctgcctatgtctcct

SEQ ID NO: 4563828 - DNA, 16 bp, Homo sapiens
ctgcctatgtctcctc

SEQ ID NO: 4563829 - DNA, 17 bp, Homo sapiens
ctgcctcactcctccgt

SEQ ID NO: 4563830 - DNA, 21 bp, Homo sapiens
ctgcctcagcctcccatagct

SEQ ID NO: 4563831 - DNA, 22 bp, Homo sapiens
ctgcctcagcctcccatagctg

SEQ ID NO: 4563832 - DNA, 16 bp, Homo sapiens
ctgcctcagccttcca

SEQ ID NO: 4563833 - DNA, 17 bp, Homo sapiens
ctgcctcagccttccaa

SEQ ID NO: 4563834 - DNA, 14 bp, Homo sapiens
ctgcctcaggaggt

SEQ ID NO: 4563835 - DNA, 22 bp, Homo sapiens
ctgcctcaggaggtcacctgcc

SEQ ID NO: 4563836 - DNA, 22 bp, Homo sapiens
ctgcctccaagatttaacctgc

SEQ ID NO: 4563837 - DNA, 14 bp, Homo sapiens
ctgcctccagggct

SEQ ID NO: 4563838 - DNA, 20 bp, Homo sapiens
ctgcctccagggctggactg

SEQ ID NO: 4563839 - DNA, 11 bp, Homo sapiens
ctgcctcccaa

SEQ ID NO: 4563840 - DNA, 21 bp, Homo sapiens
ctgcctcccaaggtcctctca

SEQ ID NO: 4563841 - DNA, 23 bp, Homo sapiens
ctgcctcccaaggtcctctcagt

SEQ ID NO: 4563842 - DNA, 17 bp, Homo sapiens
ctgcctcccattctgca

SEQ ID NO: 4563843 - DNA, 14 bp, Homo sapiens
ctgcctcccttgac

SEQ ID NO: 4563844 - DNA, 21 bp, Homo sapiens
ctgcctcccttgtggcagcaa

SEQ ID NO: 4563845 - DNA, 14 bp, Homo sapiens
ctgcctcctgccct

SEQ ID NO: 4563846 - DNA, 15 bp, Homo sapiens
ctgcctcctgccctt

SEQ ID NO: 4563847 - DNA, 13 bp, Homo sapiens
ctgcctcctgcct

SEQ ID NO: 4563848 - DNA, 14 bp, Homo sapiens
ctgcctcgctcacc

SEQ ID NO: 4563849 - DNA, 17 bp, Homo sapiens
ctgcctcgctcaccgct

SEQ ID NO: 4563850 - DNA, 16 bp, Homo sapiens
ctgcctctaagctgct

SEQ ID NO: 4563851 - DNA, 14 bp, Homo sapiens
ctgcctctccaggc

SEQ ID NO: 4563852 - DNA, 17 bp, Homo sapiens
ctgcctcttctgggagg

SEQ ID NO: 4563853 - DNA, 16 bp, Homo sapiens
ctgcctgaacagccct

SEQ ID NO: 4563854 - DNA, 15 bp, Homo sapiens
ctgcctgagggcagt

SEQ ID NO: 4563855 - DNA, 12 bp, Homo sapiens
ctgcctgcagcc

SEQ ID NO: 4563856 - DNA, 16 bp, Homo sapiens
ctgcctgcagccaggg

SEQ ID NO: 4563857 - DNA, 17 bp, Homo sapiens
ctgcctgcagccagggc

SEQ ID NO: 4563858 - DNA, 19 bp, Homo sapiens
ctgcctgcagccagggctg

SEQ ID NO: 4563859 - DNA, 19 bp, Homo sapiens
ctgcctgcatggcatcaga

SEQ ID NO: 4563860 - DNA, 12 bp, Homo sapiens
ctgcctgccacc

SEQ ID NO: 4563861 - DNA, 17 bp, Homo sapiens
ctgcctggaccagcctc

SEQ ID NO: 4563862 - DNA, 20 bp, Homo sapiens
ctgcctggagacaaggtgct

SEQ ID NO: 4563863 - DNA, 12 bp, Homo sapiens
ctgcctggccag

SEQ ID NO: 4563864 - DNA, 15 bp, Homo sapiens
ctgcctggccaggca

SEQ ID NO: 4563865 - DNA, 21 bp, Homo sapiens
ctgcctggccaggcagatctg

SEQ ID NO: 4563866 - DNA, 11 bp, Homo sapiens
ctgcctggccc

SEQ ID NO: 4563867 - DNA, 19 bp, Homo sapiens
ctgcctggcccccaacctc

SEQ ID NO: 4563868 - DNA, 20 bp, Homo sapiens
ctgcctggtatatccaaaag

SEQ ID NO: 4563869 - DNA, 19 bp, Homo sapiens
ctgcctgtaacttgagagt

SEQ ID NO: 4563870 - DNA, 15 bp, Homo sapiens
ctgcctgtctgcttg

SEQ ID NO: 4563871 - DNA, 13 bp, Homo sapiens
ctgcctgtgcccg

SEQ ID NO: 4563872 - DNA, 21 bp, Homo sapiens
ctgcctgtgcccgcatgtgtg

SEQ ID NO: 4563873 - DNA, 13 bp, Homo sapiens
ctgcctgtggcat

SEQ ID NO: 4563874 - DNA, 17 bp, Homo sapiens
ctgcctgttataactct

SEQ ID NO: 4563875 - DNA, 18 bp, Homo sapiens
ctgcctgttataactctg

SEQ ID NO: 4563876 - DNA, 21 bp, Homo sapiens
ctgcctgttataactctgcac

SEQ ID NO: 4563877 - DNA, 20 bp, Homo sapiens
ctgcctgttggcaggcccac

SEQ ID NO: 4563878 - DNA, 17 bp, Homo sapiens
ctgccttagagccaggc

SEQ ID NO: 4563879 - DNA, 18 bp, Homo sapiens
ctgccttagcttcaggaa

SEQ ID NO: 4563880 - DNA, 18 bp, Homo sapiens
ctgccttcacaaatgtca

SEQ ID NO: 4563881 - DNA, 11 bp, Homo sapiens
ctgccttccct

SEQ ID NO: 4563882 - DNA, 12 bp, Homo sapiens
ctgccttcccta

SEQ ID NO: 4563883 - DNA, 13 bp, Homo sapiens
ctgccttcctcct

SEQ ID NO: 4563884 - DNA, 21 bp, Homo sapiens
ctgccttcggagggaaattgt

SEQ ID NO: 4563885 - DNA, 14 bp, Homo sapiens
ctgccttctttcca

SEQ ID NO: 4563886 - DNA, 18 bp, Homo sapiens
ctgccttgcactgtggtc

SEQ ID NO: 4563887 - DNA, 19 bp, Homo sapiens
ctgccttgccctcctgggc

SEQ ID NO: 4563888 - DNA, 18 bp, Homo sapiens
ctgccttggattcctaga

SEQ ID NO: 4563889 - DNA, 13 bp, Homo sapiens
ctgccttggcctc

SEQ ID NO: 4563890 - DNA, 14 bp, Homo sapiens
ctgccttggcctcc

SEQ ID NO: 4563891 - DNA, 19 bp, Homo sapiens
ctgccttggcctcccaaag

SEQ ID NO: 4563892 - DNA, 16 bp, Homo sapiens
ctgcctttagaaaata

SEQ ID NO: 4563893 - DNA, 17 bp, Homo sapiens
ctgcctttcgtgatctt

SEQ ID NO: 4563894 - DNA, 20 bp, Homo sapiens
ctgcctttgcagttggactc

SEQ ID NO: 4563895 - DNA, 20 bp, Homo sapiens
ctgcgcagcctccagggccc

SEQ ID NO: 4563896 - DNA, 22 bp, Homo sapiens
ctgcgcccaccccgctctgcat

SEQ ID NO: 4563897 - DNA, 23 bp, Homo sapiens
ctgcgccccgcacgactgcggga

SEQ ID NO: 4563898 - DNA, 16 bp, Homo sapiens
ctgcgcctgcaggcag

SEQ ID NO: 4563899 - DNA, 18 bp, Homo sapiens
ctgcgcctgcaggcagag

SEQ ID NO: 4563900 - DNA, 23 bp, Homo sapiens
ctgcgcctgcaggcagagctgga

SEQ ID NO: 4563901 - DNA, 16 bp, Homo sapiens
ctgcgcctgctgcctg

SEQ ID NO: 4563902 - DNA, 17 bp, Homo sapiens
ctgcgcttgcttttctg

SEQ ID NO: 4563903 - DNA, 18 bp, Homo sapiens
ctgcggagaccctgagtc

SEQ ID NO: 4563904 - DNA, 19 bp, Homo sapiens
ctgcggagcacactggctc

SEQ ID NO: 4563905 - DNA, 20 bp, Homo sapiens
ctgcggagcacactggctca

SEQ ID NO: 4563906 - DNA, 20 bp, Homo sapiens
ctgcggccaggcctgcgggc

SEQ ID NO: 4563907 - DNA, 13 bp, Homo sapiens
ctgcggctttaaa

SEQ ID NO: 4563908 - DNA, 17 bp, Homo sapiens
ctgcgggagccagactg

SEQ ID NO: 4563909 - DNA, 18 bp, Homo sapiens
ctgcgggagccagactgt

SEQ ID NO: 4563910 - DNA, 19 bp, Homo sapiens
ctgcgggaggctggggccc

SEQ ID NO: 4563911 - DNA, 18 bp, Homo sapiens
ctgcgggggcagtgctca

SEQ ID NO: 4563912 - DNA, 14 bp, Homo sapiens
ctgcgggttttaat

SEQ ID NO: 4563913 - DNA, 17 bp, Homo sapiens
ctgcgtccaccctgagc

SEQ ID NO: 4563914 - DNA, 18 bp, Homo sapiens
ctgcgtccaccctgagct

SEQ ID NO: 4563915 - DNA, 14 bp, Homo sapiens
ctgcgtcctcctca

SEQ ID NO: 4563916 - DNA, 19 bp, Homo sapiens
ctgcgtgtcacctgtgctt

SEQ ID NO: 4563917 - DNA, 13 bp, Homo sapiens
ctgcgttctgcaa

SEQ ID NO: 4563918 - DNA, 15 bp, Homo sapiens
ctgctaaataaaatt

SEQ ID NO: 4563919 - DNA, 20 bp, Homo sapiens
ctgctaaatctcctattttt

SEQ ID NO: 4563920 - DNA, 22 bp, Homo sapiens
ctgctaagtaatttagaagata

SEQ ID NO: 4563921 - DNA, 21 bp, Homo sapiens
ctgctaattcccaacatttct

SEQ ID NO: 4563922 - DNA, 16 bp, Homo sapiens
ctgctacacatacagg

SEQ ID NO: 4563923 - DNA, 16 bp, Homo sapiens
ctgctacatcagactc

SEQ ID NO: 4563924 - DNA, 17 bp, Homo sapiens
ctgctacatcagactct

SEQ ID NO: 4563925 - DNA, 18 bp, Homo sapiens
ctgctacctctgagaaga

SEQ ID NO: 4563926 - DNA, 16 bp, Homo sapiens
ctgctactgtcttact

SEQ ID NO: 4563927 - DNA, 14 bp, Homo sapiens
ctgctagagcagac

SEQ ID NO: 4563928 - DNA, 16 bp, Homo sapiens
ctgctagagcagacag

SEQ ID NO: 4563929 - DNA, 17 bp, Homo sapiens
ctgctagcacagaggcc

SEQ ID NO: 4563930 - DNA, 23 bp, Homo sapiens
ctgctagcacagaggcctgactg

SEQ ID NO: 4563931 - DNA, 17 bp, Homo sapiens
ctgctagctttctcctt

SEQ ID NO: 4563932 - DNA, 12 bp, Homo sapiens
ctgctatatttg

SEQ ID NO: 4563933 - DNA, 21 bp, Homo sapiens
ctgctatggttttctccaaga

SEQ ID NO: 4563934 - DNA, 14 bp, Homo sapiens
ctgctcacccacct

SEQ ID NO: 4563935 - DNA, 19 bp, Homo sapiens
ctgctcacccacctcttgt

SEQ ID NO: 4563936 - DNA, 18 bp, Homo sapiens
ctgctcacgtcaaatgca

SEQ ID NO: 4563937 - DNA, 16 bp, Homo sapiens
ctgctcactgggcccg

SEQ ID NO: 4563938 - DNA, 18 bp, Homo sapiens
ctgctcagtaaagcactt

SEQ ID NO: 4563939 - DNA, 19 bp, Homo sapiens
ctgctcagtgcttgggctc

SEQ ID NO: 4563940 - DNA, 19 bp, Homo sapiens
ctgctcatattgtgattct

SEQ ID NO: 4563941 - DNA, 17 bp, Homo sapiens
ctgctcatcattctctg

SEQ ID NO: 4563942 - DNA, 16 bp, Homo sapiens
ctgctccaatttcccc

SEQ ID NO: 4563943 - DNA, 16 bp, Homo sapiens
ctgctccaccacatcc

SEQ ID NO: 4563944 - DNA, 14 bp, Homo sapiens
ctgctccaccagca

SEQ ID NO: 4563945 - DNA, 22 bp, Homo sapiens
ctgctccaccagcagcatggca

SEQ ID NO: 4563946 - DNA, 13 bp, Homo sapiens
ctgctccaccctt

SEQ ID NO: 4563947 - DNA, 15 bp, Homo sapiens
ctgctccacccttgg

SEQ ID NO: 4563948 - DNA, 18 bp, Homo sapiens
ctgctccacccttggcct

SEQ ID NO: 4563949 - DNA, 21 bp, Homo sapiens
ctgctccacccttggcctgtc

SEQ ID NO: 4563950 - DNA, 13 bp, Homo sapiens
ctgctccagcctc

SEQ ID NO: 4563951 - DNA, 19 bp, Homo sapiens
ctgctccagcctctgccgc

SEQ ID NO: 4563952 - DNA, 23 bp, Homo sapiens
ctgctccagcctctgccgctgcc

SEQ ID NO: 4563953 - DNA, 12 bp, Homo sapiens
ctgctccaggga

SEQ ID NO: 4563954 - DNA, 15 bp, Homo sapiens
ctgctcccacctggc

SEQ ID NO: 4563955 - DNA, 18 bp, Homo sapiens
ctgctcccacctggctct

SEQ ID NO: 4563956 - DNA, 19 bp, Homo sapiens
ctgctcccacctggctctg

SEQ ID NO: 4563957 - DNA, 14 bp, Homo sapiens
ctgctcccagtcct

SEQ ID NO: 4563958 - DNA, 15 bp, Homo sapiens
ctgctcccagtcctg

SEQ ID NO: 4563959 - DNA, 18 bp, Homo sapiens
ctgctcccagtcctgcct

SEQ ID NO: 4563960 - DNA, 15 bp, Homo sapiens
ctgctcccattcctc

SEQ ID NO: 4563961 - DNA, 17 bp, Homo sapiens
ctgctccccaacacctg

SEQ ID NO: 4563962 - DNA, 22 bp, Homo sapiens
ctgctccccaacacctgcctct

SEQ ID NO: 4563963 - DNA, 13 bp, Homo sapiens
ctgctcccccacc

SEQ ID NO: 4563964 - DNA, 14 bp, Homo sapiens
ctgctcccccaccc

SEQ ID NO: 4563965 - DNA, 21 bp, Homo sapiens
ctgctcccccaccccctcccc

SEQ ID NO: 4563966 - DNA, 11 bp, Homo sapiens
ctgctccctgc

SEQ ID NO: 4563967 - DNA, 14 bp, Homo sapiens
ctgctccctgcctc

SEQ ID NO: 4563968 - DNA, 17 bp, Homo sapiens
ctgctccctgcctcctg

SEQ ID NO: 4563969 - DNA, 20 bp, Homo sapiens
ctgctccctgcctcctgcct

SEQ ID NO: 4563970 - DNA, 22 bp, Homo sapiens
ctgctccctggggttctctaca

SEQ ID NO: 4563971 - DNA, 20 bp, Homo sapiens
ctgctccctgtggcactcag

SEQ ID NO: 4563972 - DNA, 20 bp, Homo sapiens
ctgctcctagcaccctggag

SEQ ID NO: 4563973 - DNA, 13 bp, Homo sapiens
ctgctcctccagg

SEQ ID NO: 4563974 - DNA, 13 bp, Homo sapiens
ctgctccttcagg

SEQ ID NO: 4563975 - DNA, 18 bp, Homo sapiens
ctgctccttggcaccccc

SEQ ID NO: 4563976 - DNA, 22 bp, Homo sapiens
ctgctccttggcacccccatgc

SEQ ID NO: 4563977 - DNA, 18 bp, Homo sapiens
ctgctcgtggactgtgct

SEQ ID NO: 4563978 - DNA, 12 bp, Homo sapiens
ctgctctaacag

SEQ ID NO: 4563979 - DNA, 17 bp, Homo sapiens
ctgctctaacagccctc

SEQ ID NO: 4563980 - DNA, 12 bp, Homo sapiens
ctgctctcccaa

SEQ ID NO: 4563981 - DNA, 12 bp, Homo sapiens
ctgctctccttc

SEQ ID NO: 4563982 - DNA, 13 bp, Homo sapiens
ctgctctccttcc

SEQ ID NO: 4563983 - DNA, 15 bp, Homo sapiens
ctgctctccttcctg

SEQ ID NO: 4563984 - DNA, 20 bp, Homo sapiens
ctgctctccttcctggagcc

SEQ ID NO: 4563985 - DNA, 22 bp, Homo sapiens
ctgctctggaataaagttgcag

SEQ ID NO: 4563986 - DNA, 14 bp, Homo sapiens
ctgctctgggaagg

SEQ ID NO: 4563987 - DNA, 18 bp, Homo sapiens
ctgctcttctctccccag

SEQ ID NO: 4563988 - DNA, 19 bp, Homo sapiens
ctgctcttctctccccagc

SEQ ID NO: 4563989 - DNA, 20 bp, Homo sapiens
ctgctcttctctccccagcc

SEQ ID NO: 4563990 - DNA, 23 bp, Homo sapiens
ctgctcttctctccccagccccc

SEQ ID NO: 4563991 - DNA, 12 bp, Homo sapiens
ctgctctttaat

SEQ ID NO: 4563992 - DNA, 23 bp, Homo sapiens
ctgctctttacatttcttttaaa

SEQ ID NO: 4563993 - DNA, 21 bp, Homo sapiens
ctgctctttattgcagaatgt

SEQ ID NO: 4563994 - DNA, 15 bp, Homo sapiens
ctgctcttttgtgat

SEQ ID NO: 4563995 - DNA, 21 bp, Homo sapiens
ctgctcttttgtgatgaacat

SEQ ID NO: 4563996 - DNA, 13 bp, Homo sapiens
ctgctgaaacaac

SEQ ID NO: 4563997 - DNA, 18 bp, Homo sapiens
ctgctgaaacaacaaata

SEQ ID NO: 4563998 - DNA, 17 bp, Homo sapiens
ctgctgaaagtcctgct

SEQ ID NO: 4563999 - DNA, 23 bp, Homo sapiens
ctgctgaatgatttccaaagaga

SEQ ID NO: 4564000 - DNA, 23 bp, Homo sapiens
ctgctgaccttggaggaatgaca

SEQ ID NO: 4564001 - DNA, 15 bp, Homo sapiens
ctgctgagaggcacc

SEQ ID NO: 4564002 - DNA, 23 bp, Homo sapiens
ctgctgagatcctggactgaggg

SEQ ID NO: 4564003 - DNA, 17 bp, Homo sapiens
ctgctgagatctgctgt

SEQ ID NO: 4564004 - DNA, 12 bp, Homo sapiens
ctgctgaggccc

SEQ ID NO: 4564005 - DNA, 18 bp, Homo sapiens
ctgctgagtcctttccag

SEQ ID NO: 4564006 - DNA, 13 bp, Homo sapiens
ctgctgagtgaca

SEQ ID NO: 4564007 - DNA, 16 bp, Homo sapiens
ctgctgagttggcctg

SEQ ID NO: 4564008 - DNA, 12 bp, Homo sapiens
ctgctgatgcag

SEQ ID NO: 4564009 - DNA, 14 bp, Homo sapiens
ctgctgatgcagcc

SEQ ID NO: 4564010 - DNA, 20 bp, Homo sapiens
ctgctgcaacaagctcatcc

SEQ ID NO: 4564011 - DNA, 16 bp, Homo sapiens
ctgctgcatggggtgg

SEQ ID NO: 4564012 - DNA, 14 bp, Homo sapiens
ctgctgccagtgca

SEQ ID NO: 4564013 - DNA, 19 bp, Homo sapiens
ctgctgccagtgcagccac

SEQ ID NO: 4564014 - DNA, 16 bp, Homo sapiens
ctgctgcccctgcaca

SEQ ID NO: 4564015 - DNA, 17 bp, Homo sapiens
ctgctgcctaataaaga

SEQ ID NO: 4564016 - DNA, 16 bp, Homo sapiens
ctgctgcctctctttc

SEQ ID NO: 4564017 - DNA, 14 bp, Homo sapiens
ctgctgcctggcct

SEQ ID NO: 4564018 - DNA, 16 bp, Homo sapiens
ctgctgctactgctgc

SEQ ID NO: 4564019 - DNA, 21 bp, Homo sapiens
ctgctgctaggggctgttgca

SEQ ID NO: 4564020 - DNA, 18 bp, Homo sapiens
ctgctgctcctaggaccc

SEQ ID NO: 4564021 - DNA, 15 bp, Homo sapiens
ctgctgctctcccaa

SEQ ID NO: 4564022 - DNA, 16 bp, Homo sapiens
ctgctgctgccgccgc

SEQ ID NO: 4564023 - DNA, 16 bp, Homo sapiens
ctgctgctgctgccgc

SEQ ID NO: 4564024 - DNA, 19 bp, Homo sapiens
ctgctgctgggacttgaac

SEQ ID NO: 4564025 - DNA, 22 bp, Homo sapiens
ctgctggagaaagccacgccct

SEQ ID NO: 4564026 - DNA, 17 bp, Homo sapiens
ctgctggcacccaccgt

SEQ ID NO: 4564027 - DNA, 15 bp, Homo sapiens
ctgctggcatcaaga

SEQ ID NO: 4564028 - DNA, 13 bp, Homo sapiens
ctgctggccgcct

SEQ ID NO: 4564029 - DNA, 18 bp, Homo sapiens
ctgctggccgcctcaccc

SEQ ID NO: 4564030 - DNA, 15 bp, Homo sapiens
ctgctggcgcctctg

SEQ ID NO: 4564031 - DNA, 20 bp, Homo sapiens
ctgctggcgcctctgcaagg

SEQ ID NO: 4564032 - DNA, 14 bp, Homo sapiens
ctgctggctcagga

SEQ ID NO: 4564033 - DNA, 11 bp, Homo sapiens
ctgctggctgc

SEQ ID NO: 4564034 - DNA, 19 bp, Homo sapiens
ctgctggctgcggccccct

SEQ ID NO: 4564035 - DNA, 16 bp, Homo sapiens
ctgctggcttgcagtg

SEQ ID NO: 4564036 - DNA, 21 bp, Homo sapiens
ctgctgggacttgaacaaaga

SEQ ID NO: 4564037 - DNA, 15 bp, Homo sapiens
ctgctgggctctcca

SEQ ID NO: 4564038 - DNA, 22 bp, Homo sapiens
ctgctgggctctccacctcagc

SEQ ID NO: 4564039 - DNA, 23 bp, Homo sapiens
ctgctgggctctccacctcagcc

SEQ ID NO: 4564040 - DNA, 13 bp, Homo sapiens
ctgctgggctctg

SEQ ID NO: 4564041 - DNA, 11 bp, Homo sapiens
ctgctgggctt

SEQ ID NO: 4564042 - DNA, 17 bp, Homo sapiens
ctgctggggaagaacag

SEQ ID NO: 4564043 - DNA, 20 bp, Homo sapiens
ctgctggggaagaacagccc

SEQ ID NO: 4564044 - DNA, 23 bp, Homo sapiens
ctgctggggaagaacagccccgg

SEQ ID NO: 4564045 - DNA, 21 bp, Homo sapiens
ctgctgggggtgagctgtact

SEQ ID NO: 4564046 - DNA, 11 bp, Homo sapiens
ctgctgtccag

SEQ ID NO: 4564047 - DNA, 22 bp, Homo sapiens
ctgctgtcctgtttctgtcaag

SEQ ID NO: 4564048 - DNA, 13 bp, Homo sapiens
ctgctgtctgagt

SEQ ID NO: 4564049 - DNA, 23 bp, Homo sapiens
ctgctgtgaatttgtgtaaggat

SEQ ID NO: 4564050 - DNA, 12 bp, Homo sapiens
ctgctgtgctct

SEQ ID NO: 4564051 - DNA, 14 bp, Homo sapiens
ctgctgtgctctgg

SEQ ID NO: 4564052 - DNA, 17 bp, Homo sapiens
ctgctgtgctctgggga

SEQ ID NO: 4564053 - DNA, 15 bp, Homo sapiens
ctgctgtgctgctca

SEQ ID NO: 4564054 - DNA, 14 bp, Homo sapiens
ctgctgtgtgtgag

SEQ ID NO: 4564055 - DNA, 23 bp, Homo sapiens
ctgctgtgtgtgagcagtggaca

SEQ ID NO: 4564056 - DNA, 21 bp, Homo sapiens
ctgctgttccagtggtaagct

SEQ ID NO: 4564057 - DNA, 14 bp, Homo sapiens
ctgctgttctcagg

SEQ ID NO: 4564058 - DNA, 19 bp, Homo sapiens
ctgctgttctcaggacagc

SEQ ID NO: 4564059 - DNA, 13 bp, Homo sapiens
ctgctgttgcctc

SEQ ID NO: 4564060 - DNA, 18 bp, Homo sapiens
ctgcttaaacttgaccca

SEQ ID NO: 4564061 - DNA, 22 bp, Homo sapiens
ctgcttaaagttggtattaata

SEQ ID NO: 4564062 - DNA, 16 bp, Homo sapiens
ctgcttctcatcccaa

SEQ ID NO: 4564063 - DNA, 16 bp, Homo sapiens
ctgcttcttgctggtg

SEQ ID NO: 4564064 - DNA, 14 bp, Homo sapiens
ctgcttgaggaaaa

SEQ ID NO: 4564065 - DNA, 16 bp, Homo sapiens
ctgcttgcccgctccc

SEQ ID NO: 4564066 - DNA, 24 bp, Homo sapiens
ctgctttcctatctagcatttatt

SEQ ID NO: 4564067 - DNA, 11 bp, Homo sapiens
ctgctttctgt

SEQ ID NO: 4564068 - DNA, 18 bp, Homo sapiens
ctgctttctgttccaaat

SEQ ID NO: 4564069 - DNA, 15 bp, Homo sapiens
ctgctttgcatcttt

SEQ ID NO: 4564070 - DNA, 21 bp, Homo sapiens
ctgctttgctcttcaagaaat

SEQ ID NO: 4564071 - DNA, 18 bp, Homo sapiens
ctgcttttaaaagtgcac

SEQ ID NO: 4564072 - DNA, 15 bp, Homo sapiens
ctgcttttatctcag

SEQ ID NO: 4564073 - DNA, 16 bp, Homo sapiens
ctgcttttctgccctg

SEQ ID NO: 4564074 - DNA, 18 bp, Homo sapiens
ctgcttttctgccctggc

SEQ ID NO: 4564075 - DNA, 20 bp, Homo sapiens
ctgcttttctgccctggctg

SEQ ID NO: 4564076 - DNA, 19 bp, Homo sapiens
ctggaaaagtgatgtattt

SEQ ID NO: 4564077 - DNA, 20 bp, Homo sapiens
ctggaaacaaaacagaaggg

SEQ ID NO: 4564078 - DNA, 17 bp, Homo sapiens
ctggaaaccttccaccc

SEQ ID NO: 4564079 - DNA, 18 bp, Homo sapiens
ctggaaagaggctctgga

SEQ ID NO: 4564080 - DNA, 16 bp, Homo sapiens
ctggaaaggggagagc

SEQ ID NO: 4564081 - DNA, 18 bp, Homo sapiens
ctggaaaggggagagcct

SEQ ID NO: 4564082 - DNA, 19 bp, Homo sapiens
ctggaaaggggagagcctg

SEQ ID NO: 4564083 - DNA, 22 bp, Homo sapiens
ctggaaaggggagagcctgctg

SEQ ID NO: 4564084 - DNA, 19 bp, Homo sapiens
ctggaaagttttctccact

SEQ ID NO: 4564085 - DNA, 17 bp, Homo sapiens
ctggaaatgtagcactt

SEQ ID NO: 4564086 - DNA, 14 bp, Homo sapiens
ctggaaattgaggt

SEQ ID NO: 4564087 - DNA, 19 bp, Homo sapiens
ctggaacaaattatttttg

SEQ ID NO: 4564088 - DNA, 13 bp, Homo sapiens
ctggaacacaggg

SEQ ID NO: 4564089 - DNA, 18 bp, Homo sapiens
ctggaacacaggggcctt

SEQ ID NO: 4564090 - DNA, 16 bp, Homo sapiens
ctggaacatctcacct

SEQ ID NO: 4564091 - DNA, 16 bp, Homo sapiens
ctggaacctgcaaaaa

SEQ ID NO: 4564092 - DNA, 19 bp, Homo sapiens
ctggaagactgctcccggc

SEQ ID NO: 4564093 - DNA, 17 bp, Homo sapiens
ctggaagatcatggacc

SEQ ID NO: 4564094 - DNA, 15 bp, Homo sapiens
ctggaagccagcttt

SEQ ID NO: 4564095 - DNA, 21 bp, Homo sapiens
ctggaagcccctgggcccagt

SEQ ID NO: 4564096 - DNA, 17 bp, Homo sapiens
ctggaagctaatttgca

SEQ ID NO: 4564097 - DNA, 13 bp, Homo sapiens
ctggaaggaacat

SEQ ID NO: 4564098 - DNA, 19 bp, Homo sapiens
ctggaaggaacatggagct

SEQ ID NO: 4564099 - DNA, 17 bp, Homo sapiens
ctggaatctacaagcca

SEQ ID NO: 4564100 - DNA, 13 bp, Homo sapiens
ctggaatgtgcca

SEQ ID NO: 4564101 - DNA, 20 bp, Homo sapiens
ctggaatgtgccacagaggc

SEQ ID NO: 4564102 - DNA, 22 bp, Homo sapiens
ctggaatgtgccacagaggccc

SEQ ID NO: 4564103 - DNA, 22 bp, Homo sapiens
ctggaatgtttttccctcccca

SEQ ID NO: 4564104 - DNA, 23 bp, Homo sapiens
ctggaatgtttttccctccccag

SEQ ID NO: 4564105 - DNA, 13 bp, Homo sapiens
ctggacaaagaat

SEQ ID NO: 4564106 - DNA, 18 bp, Homo sapiens
ctggacactctatatgta

SEQ ID NO: 4564107 - DNA, 15 bp, Homo sapiens
ctggacagcagaagc

SEQ ID NO: 4564108 - DNA, 16 bp, Homo sapiens
ctggacagcagaagcc

SEQ ID NO: 4564109 - DNA, 22 bp, Homo sapiens
ctggacagcagaagcctccaag

SEQ ID NO: 4564110 - DNA, 22 bp, Homo sapiens
ctggacagccagtgacctttga

SEQ ID NO: 4564111 - DNA, 20 bp, Homo sapiens
ctggacaggcgggctcggag

SEQ ID NO: 4564112 - DNA, 16 bp, Homo sapiens
ctggacatcaccagtc

SEQ ID NO: 4564113 - DNA, 18 bp, Homo sapiens
ctggaccagcctctccac

SEQ ID NO: 4564114 - DNA, 15 bp, Homo sapiens
ctggaccaggcccat

SEQ ID NO: 4564115 - DNA, 13 bp, Homo sapiens
ctggacctgggaa

SEQ ID NO: 4564116 - DNA, 19 bp, Homo sapiens
ctggacgatagcttggagg

SEQ ID NO: 4564117 - DNA, 21 bp, Homo sapiens
ctggacgatagcttggaggga

SEQ ID NO: 4564118 - DNA, 13 bp, Homo sapiens
ctggacggcaggc

SEQ ID NO: 4564119 - DNA, 20 bp, Homo sapiens
ctggacggcaggctcactgc

SEQ ID NO: 4564120 - DNA, 21 bp, Homo sapiens
ctggactattgtgccaactgc

SEQ ID NO: 4564121 - DNA, 15 bp, Homo sapiens
ctggactccggagga

SEQ ID NO: 4564122 - DNA, 23 bp, Homo sapiens
ctggactccggaggactgagccc

SEQ ID NO: 4564123 - DNA, 19 bp, Homo sapiens
ctggactctcagtctctga

SEQ ID NO: 4564124 - DNA, 15 bp, Homo sapiens
ctggactctgcccca

SEQ ID NO: 4564125 - DNA, 18 bp, Homo sapiens
ctggactctgccccaatc

SEQ ID NO: 4564126 - DNA, 15 bp, Homo sapiens
ctggactgaccctgc

SEQ ID NO: 4564127 - DNA, 21 bp, Homo sapiens
ctggactgagggggcctggat

SEQ ID NO: 4564128 - DNA, 22 bp, Homo sapiens
ctggactgagggggcctggatg

SEQ ID NO: 4564129 - DNA, 16 bp, Homo sapiens
ctggactgcagtggcc

SEQ ID NO: 4564130 - DNA, 21 bp, Homo sapiens
ctggactgttactgacttgga

SEQ ID NO: 4564131 - DNA, 23 bp, Homo sapiens
ctggactgttactgacttggatc

SEQ ID NO: 4564132 - DNA, 13 bp, Homo sapiens
ctggactgttcca

SEQ ID NO: 4564133 - DNA, 15 bp, Homo sapiens
ctggactgttccagg

SEQ ID NO: 4564134 - DNA, 22 bp, Homo sapiens
ctggactgttccaggccctcca

SEQ ID NO: 4564135 - DNA, 16 bp, Homo sapiens
ctggacttctgggaga

SEQ ID NO: 4564136 - DNA, 16 bp, Homo sapiens
ctggagaaagccacgc

SEQ ID NO: 4564137 - DNA, 14 bp, Homo sapiens
ctggagaagcagtg

SEQ ID NO: 4564138 - DNA, 19 bp, Homo sapiens
ctggagaatttagaatcag

SEQ ID NO: 4564139 - DNA, 16 bp, Homo sapiens
ctggagacaaggtgct

SEQ ID NO: 4564140 - DNA, 22 bp, Homo sapiens
ctggagagccagaacctggagg

SEQ ID NO: 4564141 - DNA, 23 bp, Homo sapiens
ctggagagccagaacctggaggg

SEQ ID NO: 4564142 - DNA, 18 bp, Homo sapiens
ctggagagtgcacatgcc

SEQ ID NO: 4564143 - DNA, 23 bp, Homo sapiens
ctggagagtgcacatgccccttg

SEQ ID NO: 4564144 - DNA, 14 bp, Homo sapiens
ctggagatgcagct

SEQ ID NO: 4564145 - DNA, 23 bp, Homo sapiens
ctggagcaccaggcacgaaccca

SEQ ID NO: 4564146 - DNA, 13 bp, Homo sapiens
ctggagcaggagc

SEQ ID NO: 4564147 - DNA, 16 bp, Homo sapiens
ctggagcaggagcccc

SEQ ID NO: 4564148 - DNA, 17 bp, Homo sapiens
ctggagcaggagccccg

SEQ ID NO: 4564149 - DNA, 21 bp, Homo sapiens
ctggagcccagaggagggcag

SEQ ID NO: 4564150 - DNA, 13 bp, Homo sapiens
ctggagcccccag

SEQ ID NO: 4564151 - DNA, 21 bp, Homo sapiens
ctggagcccccagcagaggca

SEQ ID NO: 4564152 - DNA, 14 bp, Homo sapiens
ctggagctcatctg

SEQ ID NO: 4564153 - DNA, 18 bp, Homo sapiens
ctggagctcctccctcca

SEQ ID NO: 4564154 - DNA, 21 bp, Homo sapiens
ctggagctcctccctccagct

SEQ ID NO: 4564155 - DNA, 23 bp, Homo sapiens
ctggagctcctccctccagctgc

SEQ ID NO: 4564156 - DNA, 16 bp, Homo sapiens
ctggagctctgcccat

SEQ ID NO: 4564157 - DNA, 21 bp, Homo sapiens
ctggaggaaaaggttaatgaa

SEQ ID NO: 4564158 - DNA, 19 bp, Homo sapiens
ctggaggaatacattttat

SEQ ID NO: 4564159 - DNA, 21 bp, Homo sapiens
ctggaggactagaacctggag

SEQ ID NO: 4564160 - DNA, 18 bp, Homo sapiens
ctggaggatgttagactt

SEQ ID NO: 4564161 - DNA, 20 bp, Homo sapiens
ctggaggccaccaagctgct

SEQ ID NO: 4564162 - DNA, 19 bp, Homo sapiens
ctggaggcccaggctggga

SEQ ID NO: 4564163 - DNA, 16 bp, Homo sapiens
ctggaggctgcagagc

SEQ ID NO: 4564164 - DNA, 18 bp, Homo sapiens
ctggaggctgcctcccaa

SEQ ID NO: 4564165 - DNA, 20 bp, Homo sapiens
ctggagggaaggacagtccc

SEQ ID NO: 4564166 - DNA, 21 bp, Homo sapiens
ctggagggaaggacagtccct

SEQ ID NO: 4564167 - DNA, 21 bp, Homo sapiens
ctggagggaatgaacctggag

SEQ ID NO: 4564168 - DNA, 22 bp, Homo sapiens
ctggagggaatgaacctggagg

SEQ ID NO: 4564169 - DNA, 21 bp, Homo sapiens
ctggagggctagaacctggag

SEQ ID NO: 4564170 - DNA, 22 bp, Homo sapiens
ctggagggctagaacctggcag

SEQ ID NO: 4564171 - DNA, 22 bp, Homo sapiens
ctggagggctagaatctggaga

SEQ ID NO: 4564172 - DNA, 21 bp, Homo sapiens
ctggaggggctagaacctaga

SEQ ID NO: 4564173 - DNA, 13 bp, Homo sapiens
ctggaggggtggc

SEQ ID NO: 4564174 - DNA, 18 bp, Homo sapiens
ctggaggggtggcccaga

SEQ ID NO: 4564175 - DNA, 17 bp, Homo sapiens
ctggaggttgaagccaa

SEQ ID NO: 4564176 - DNA, 19 bp, Homo sapiens
ctggaggttgaagccaagt

SEQ ID NO: 4564177 - DNA, 20 bp, Homo sapiens
ctggagtgtggctgaggagg

SEQ ID NO: 4564178 - DNA, 21 bp, Homo sapiens
ctggagttccttatccctctc

SEQ ID NO: 4564179 - DNA, 13 bp, Homo sapiens
ctggagtttcatg

SEQ ID NO: 4564180 - DNA, 22 bp, Homo sapiens
ctggagtttcatgtacaagatg

SEQ ID NO: 4564181 - DNA, 13 bp, Homo sapiens
ctggatcagtaaa

SEQ ID NO: 4564182 - DNA, 14 bp, Homo sapiens
ctggatcagtaaaa

SEQ ID NO: 4564183 - DNA, 17 bp, Homo sapiens
ctggatccagcactggt

SEQ ID NO: 4564184 - DNA, 21 bp, Homo sapiens
ctggatccatcttgagccaca

SEQ ID NO: 4564185 - DNA, 17 bp, Homo sapiens
ctggatcctgctgcttt

SEQ ID NO: 4564186 - DNA, 18 bp, Homo sapiens
ctggatcctgctgctttg

SEQ ID NO: 4564187 - DNA, 17 bp, Homo sapiens
ctggatcgctgcacatg

SEQ ID NO: 4564188 - DNA, 22 bp, Homo sapiens
ctggatcgctgcacatggcctg

SEQ ID NO: 4564189 - DNA, 23 bp, Homo sapiens
ctggatcgctgcacatggcctga

SEQ ID NO: 4564190 - DNA, 16 bp, Homo sapiens
ctggatctatccctgc

SEQ ID NO: 4564191 - DNA, 16 bp, Homo sapiens
ctggatgatggattcc

SEQ ID NO: 4564192 - DNA, 22 bp, Homo sapiens
ctggatgcatttccatttctct

SEQ ID NO: 4564193 - DNA, 22 bp, Homo sapiens
ctggatgccccctgtggatgct

SEQ ID NO: 4564194 - DNA, 12 bp, Homo sapiens
ctggatggtggc

SEQ ID NO: 4564195 - DNA, 17 bp, Homo sapiens
ctggattcaaatttatt

SEQ ID NO: 4564196 - DNA, 22 bp, Homo sapiens
ctggattgtgctttggttaata

SEQ ID NO: 4564197 - DNA, 23 bp, Homo sapiens
ctggattttttatgtacaaccct

SEQ ID NO: 4564198 - DNA, 22 bp, Homo sapiens
ctggcaaaggacccttgagtaa

SEQ ID NO: 4564199 - DNA, 18 bp, Homo sapiens
ctggcaaatgcctgactc

SEQ ID NO: 4564200 - DNA, 12 bp, Homo sapiens
ctggcacagagg

SEQ ID NO: 4564201 - DNA, 16 bp, Homo sapiens
ctggcacagcccctgg

SEQ ID NO: 4564202 - DNA, 23 bp, Homo sapiens
ctggcacagcccctggagcctca

SEQ ID NO: 4564203 - DNA, 22 bp, Homo sapiens
ctggcacagccgcgggccagga

SEQ ID NO: 4564204 - DNA, 14 bp, Homo sapiens
ctggcacagcctgg

SEQ ID NO: 4564205 - DNA, 18 bp, Homo sapiens
ctggcacagttttctgag

SEQ ID NO: 4564206 - DNA, 21 bp, Homo sapiens
ctggcacagttttctgagaaa

SEQ ID NO: 4564207 - DNA, 17 bp, Homo sapiens
ctggcacattgcccctc

SEQ ID NO: 4564208 - DNA, 23 bp, Homo sapiens
ctggcacattgcccctctgcctt

SEQ ID NO: 4564209 - DNA, 11 bp, Homo sapiens
ctggcaccaca

SEQ ID NO: 4564210 - DNA, 19 bp, Homo sapiens
ctggcaccatgttggcctc

SEQ ID NO: 4564211 - DNA, 13 bp, Homo sapiens
ctggcactgaacc

SEQ ID NO: 4564212 - DNA, 22 bp, Homo sapiens
ctggcactggcaaacagggcct

SEQ ID NO: 4564213 - DNA, 14 bp, Homo sapiens
ctggcactgggagg

SEQ ID NO: 4564214 - DNA, 18 bp, Homo sapiens
ctggcacttagcccaaga

SEQ ID NO: 4564215 - DNA, 21 bp, Homo sapiens
ctggcagagaggtaaagggtg

SEQ ID NO: 4564216 - DNA, 21 bp, Homo sapiens
ctggcagctgagagccctgct

SEQ ID NO: 4564217 - DNA, 22 bp, Homo sapiens
ctggcaggggagacaggagcct

SEQ ID NO: 4564218 - DNA, 12 bp, Homo sapiens
ctggcaggtcct

SEQ ID NO: 4564219 - DNA, 20 bp, Homo sapiens
ctggcagtttatatttaact

SEQ ID NO: 4564220 - DNA, 22 bp, Homo sapiens
ctggcatcaagaggtgggaggg

SEQ ID NO: 4564221 - DNA, 23 bp, Homo sapiens
ctggcatcaagaggtgggagggc

SEQ ID NO: 4564222 - DNA, 22 bp, Homo sapiens
ctggcatcgcagcttcctgtct

SEQ ID NO: 4564223 - DNA, 18 bp, Homo sapiens
ctggcatggtgcagggag

SEQ ID NO: 4564224 - DNA, 19 bp, Homo sapiens
ctggcatggtgcagggaga

SEQ ID NO: 4564225 - DNA, 18 bp, Homo sapiens
ctggcatgtcatttgcac

SEQ ID NO: 4564226 - DNA, 20 bp, Homo sapiens
ctggccaccagccatcctcc

SEQ ID NO: 4564227 - DNA, 14 bp, Homo sapiens
ctggccacccctcc

SEQ ID NO: 4564228 - DNA, 20 bp, Homo sapiens
ctggccacccctccccagta

SEQ ID NO: 4564229 - DNA, 16 bp, Homo sapiens
ctggccagacgctgcc

SEQ ID NO: 4564230 - DNA, 13 bp, Homo sapiens
ctggccagcaccc

SEQ ID NO: 4564231 - DNA, 14 bp, Homo sapiens
ctggccagcaccct

SEQ ID NO: 4564232 - DNA, 16 bp, Homo sapiens
ctggccagcaccctct

SEQ ID NO: 4564233 - DNA, 22 bp, Homo sapiens
ctggccagcaccctctcctggg

SEQ ID NO: 4564234 - DNA, 23 bp, Homo sapiens
ctggccagcaccctctcctgggg

SEQ ID NO: 4564235 - DNA, 12 bp, Homo sapiens
ctggccaggagc

SEQ ID NO: 4564236 - DNA, 13 bp, Homo sapiens
ctggccaggagct

SEQ ID NO: 4564237 - DNA, 13 bp, Homo sapiens
ctggccagggcca

SEQ ID NO: 4564238 - DNA, 14 bp, Homo sapiens
ctggccagggccac

SEQ ID NO: 4564239 - DNA, 18 bp, Homo sapiens
ctggccagggccacgctc

SEQ ID NO: 4564240 - DNA, 20 bp, Homo sapiens
ctggccagggccacgctcca

SEQ ID NO: 4564241 - DNA, 23 bp, Homo sapiens
ctggccagtgctgcccatgagca

SEQ ID NO: 4564242 - DNA, 13 bp, Homo sapiens
ctggcccagggca

SEQ ID NO: 4564243 - DNA, 20 bp, Homo sapiens
ctggcccagggcatctggga

SEQ ID NO: 4564244 - DNA, 15 bp, Homo sapiens
ctggccccaggcccc

SEQ ID NO: 4564245 - DNA, 17 bp, Homo sapiens
ctggccccaggccccag

SEQ ID NO: 4564246 - DNA, 16 bp, Homo sapiens
ctggccccatgtctct

SEQ ID NO: 4564247 - DNA, 17 bp, Homo sapiens
ctggcccccacagcgct

SEQ ID NO: 4564248 - DNA, 18 bp, Homo sapiens
ctggcccccatcagccct

SEQ ID NO: 4564249 - DNA, 18 bp, Homo sapiens
ctggcccctcacccacca

SEQ ID NO: 4564250 - DNA, 12 bp, Homo sapiens
ctggcccctggg

SEQ ID NO: 4564251 - DNA, 22 bp, Homo sapiens
ctggccctccccacaatgccag

SEQ ID NO: 4564252 - DNA, 14 bp, Homo sapiens
ctggccctgccttc

SEQ ID NO: 4564253 - DNA, 20 bp, Homo sapiens
ctggccctggggatcttccc

SEQ ID NO: 4564254 - DNA, 14 bp, Homo sapiens
ctggcccttagaga

SEQ ID NO: 4564255 - DNA, 18 bp, Homo sapiens
ctggcccttagagacccc

SEQ ID NO: 4564256 - DNA, 17 bp, Homo sapiens
ctggccgagggtcctgg

SEQ ID NO: 4564257 - DNA, 21 bp, Homo sapiens
ctggccgagggtcctggctcc

SEQ ID NO: 4564258 - DNA, 17 bp, Homo sapiens
ctggccgctgagcgccc

SEQ ID NO: 4564259 - DNA, 18 bp, Homo sapiens
ctggccgggactgctgct

SEQ ID NO: 4564260 - DNA, 23 bp, Homo sapiens
ctggccgggactgctgctctccc

SEQ ID NO: 4564261 - DNA, 16 bp, Homo sapiens
ctggcctcaaagcaag

SEQ ID NO: 4564262 - DNA, 21 bp, Homo sapiens
ctggcctcatctcagaccctg

SEQ ID NO: 4564263 - DNA, 17 bp, Homo sapiens
ctggcctctccccagga

SEQ ID NO: 4564264 - DNA, 18 bp, Homo sapiens
ctggcctctccccaggaa

SEQ ID NO: 4564265 - DNA, 14 bp, Homo sapiens
ctggcctctgcttt

SEQ ID NO: 4564266 - DNA, 16 bp, Homo sapiens
ctggcctcttgatagt

SEQ ID NO: 4564267 - DNA, 21 bp, Homo sapiens
ctggcctgaactgaggagatg

SEQ ID NO: 4564268 - DNA, 19 bp, Homo sapiens
ctggcctgcacggtgggcc

SEQ ID NO: 4564269 - DNA, 20 bp, Homo sapiens
ctggcctgcggtggagggat

SEQ ID NO: 4564270 - DNA, 20 bp, Homo sapiens
ctggcctgctgggctctcca

SEQ ID NO: 4564271 - DNA, 17 bp, Homo sapiens
ctggcctttttcattta

SEQ ID NO: 4564272 - DNA, 21 bp, Homo sapiens
ctggcctttttcatttatcta

SEQ ID NO: 4564273 - DNA, 13 bp, Homo sapiens
ctggcgacacact

SEQ ID NO: 4564274 - DNA, 14 bp, Homo sapiens
ctggcgacacactc

SEQ ID NO: 4564275 - DNA, 13 bp, Homo sapiens
ctggcgcaggtgg

SEQ ID NO: 4564276 - DNA, 12 bp, Homo sapiens
ctggcgcctctg

SEQ ID NO: 4564277 - DNA, 15 bp, Homo sapiens
ctggcgcctctgcaa

SEQ ID NO: 4564278 - DNA, 15 bp, Homo sapiens
ctggcgctcagcagc

SEQ ID NO: 4564279 - DNA, 15 bp, Homo sapiens
ctggcgcttggatct

SEQ ID NO: 4564280 - DNA, 17 bp, Homo sapiens
ctggcgcttggatctgg

SEQ ID NO: 4564281 - DNA, 19 bp, Homo sapiens
ctggcggtcaagtgtggag

SEQ ID NO: 4564282 - DNA, 13 bp, Homo sapiens
ctggcgtgctcag

SEQ ID NO: 4564283 - DNA, 16 bp, Homo sapiens
ctggctaactggaagc

SEQ ID NO: 4564284 - DNA, 17 bp, Homo sapiens
ctggctaattttctgta

SEQ ID NO: 4564285 - DNA, 16 bp, Homo sapiens
ctggctagagtcctca

SEQ ID NO: 4564286 - DNA, 17 bp, Homo sapiens
ctggctcacccagtcct

SEQ ID NO: 4564287 - DNA, 23 bp, Homo sapiens
ctggctccagtctcatcctccca

SEQ ID NO: 4564288 - DNA, 18 bp, Homo sapiens
ctggctcccaagcaccca

SEQ ID NO: 4564289 - DNA, 15 bp, Homo sapiens
ctggctcccacctgt

SEQ ID NO: 4564290 - DNA, 20 bp, Homo sapiens
ctggctcccacctgtttctg

SEQ ID NO: 4564291 - DNA, 19 bp, Homo sapiens
ctggctccccctccccagg

SEQ ID NO: 4564292 - DNA, 23 bp, Homo sapiens
ctggctccccctccccaggctgg

SEQ ID NO: 4564293 - DNA, 18 bp, Homo sapiens
ctggctccctcctccagg

SEQ ID NO: 4564294 - DNA, 21 bp, Homo sapiens
ctggctccctcctccaggcct

SEQ ID NO: 4564295 - DNA, 12 bp, Homo sapiens
ctggctccctga

SEQ ID NO: 4564296 - DNA, 14 bp, Homo sapiens
ctggctccctgatg

SEQ ID NO: 4564297 - DNA, 18 bp, Homo sapiens
ctggctcctaggggaaga

SEQ ID NO: 4564298 - DNA, 11 bp, Homo sapiens
ctggctcctga

SEQ ID NO: 4564299 - DNA, 19 bp, Homo sapiens
ctggctcggacccacccca

SEQ ID NO: 4564300 - DNA, 20 bp, Homo sapiens
ctggctcggacccaccccaa

SEQ ID NO: 4564301 - DNA, 19 bp, Homo sapiens
ctggctctaattcacagtg

SEQ ID NO: 4564302 - DNA, 22 bp, Homo sapiens
ctggctctaattcacagtgctc

SEQ ID NO: 4564303 - DNA, 23 bp, Homo sapiens
ctggctctaattcacagtgctct

SEQ ID NO: 4564304 - DNA, 16 bp, Homo sapiens
ctggctctaccttcct

SEQ ID NO: 4564305 - DNA, 22 bp, Homo sapiens
ctggctctaccttcctgtccct

SEQ ID NO: 4564306 - DNA, 15 bp, Homo sapiens
ctggctctgcctcag

SEQ ID NO: 4564307 - DNA, 12 bp, Homo sapiens
ctggctctgtgg

SEQ ID NO: 4564308 - DNA, 20 bp, Homo sapiens
ctggctgaagaggaccagag

SEQ ID NO: 4564309 - DNA, 13 bp, Homo sapiens
ctggctgagggga

SEQ ID NO: 4564310 - DNA, 19 bp, Homo sapiens
ctggctgaggttcctctgc

SEQ ID NO: 4564311 - DNA, 12 bp, Homo sapiens
ctggctgctgcc

SEQ ID NO: 4564312 - DNA, 13 bp, Homo sapiens
ctggctggcctca

SEQ ID NO: 4564313 - DNA, 19 bp, Homo sapiens
ctggctggtgggcccccaa

SEQ ID NO: 4564314 - DNA, 21 bp, Homo sapiens
ctggctgtgaatgccaaagcc

SEQ ID NO: 4564315 - DNA, 23 bp, Homo sapiens
ctggctgttctgtggttcctctg

SEQ ID NO: 4564316 - DNA, 21 bp, Homo sapiens
ctggcttagtgccacccacct

SEQ ID NO: 4564317 - DNA, 22 bp, Homo sapiens
ctggcttagtgccacccacctt

SEQ ID NO: 4564318 - DNA, 14 bp, Homo sapiens
ctggcttctgtggg

SEQ ID NO: 4564319 - DNA, 19 bp, Homo sapiens
ctggcttctgtggggcccc

SEQ ID NO: 4564320 - DNA, 17 bp, Homo sapiens
ctggcttgtaactccac

SEQ ID NO: 4564321 - DNA, 14 bp, Homo sapiens
ctggctttcccagg

SEQ ID NO: 4564322 - DNA, 13 bp, Homo sapiens
ctggctttgcctc

SEQ ID NO: 4564323 - DNA, 15 bp, Homo sapiens
ctggctttgcctctt

SEQ ID NO: 4564324 - DNA, 20 bp, Homo sapiens
ctggctttgcctcttctttg

SEQ ID NO: 4564325 - DNA, 22 bp, Homo sapiens
ctggcttttcgcttgcttctgc

SEQ ID NO: 4564326 - DNA, 9 bp, Homo sapiens
ctgggaaac

SEQ ID NO: 4564327 - DNA, 17 bp, Homo sapiens
ctgggaaagcataaagc

SEQ ID NO: 4564328 - DNA, 21 bp, Homo sapiens
ctgggaaatgagaaggcagcc

SEQ ID NO: 4564329 - DNA, 22 bp, Homo sapiens
ctgggaaatgagaaggcagcca

SEQ ID NO: 4564330 - DNA, 20 bp, Homo sapiens
ctgggaactgcagacctgtc

SEQ ID NO: 4564331 - DNA, 23 bp, Homo sapiens
ctgggaagagaagagggcccagc

SEQ ID NO: 4564332 - DNA, 14 bp, Homo sapiens
ctgggaagcccttt

SEQ ID NO: 4564333 - DNA, 15 bp, Homo sapiens
ctgggaagggagagt

SEQ ID NO: 4564334 - DNA, 18 bp, Homo sapiens
ctgggaataagtgccagg

SEQ ID NO: 4564335 - DNA, 14 bp, Homo sapiens
ctgggaatgggaga

SEQ ID NO: 4564336 - DNA, 18 bp, Homo sapiens
ctgggaatgggagagggg

SEQ ID NO: 4564337 - DNA, 16 bp, Homo sapiens
ctgggacacagaccca

SEQ ID NO: 4564338 - DNA, 22 bp, Homo sapiens
ctgggacagtttatcatgaagc

SEQ ID NO: 4564339 - DNA, 15 bp, Homo sapiens
ctgggaccctttcct

SEQ ID NO: 4564340 - DNA, 14 bp, Homo sapiens
ctgggacctcctta

SEQ ID NO: 4564341 - DNA, 20 bp, Homo sapiens
ctgggacctgccaggcaggg

SEQ ID NO: 4564342 - DNA, 16 bp, Homo sapiens
ctgggacggaccagca

SEQ ID NO: 4564343 - DNA, 14 bp, Homo sapiens
ctgggactcctgtc

SEQ ID NO: 4564344 - DNA, 23 bp, Homo sapiens
ctgggactcggagactatggcct

SEQ ID NO: 4564345 - DNA, 16 bp, Homo sapiens
ctgggactctcctcct

SEQ ID NO: 4564346 - DNA, 19 bp, Homo sapiens
ctgggactctcctcctccc

SEQ ID NO: 4564347 - DNA, 23 bp, Homo sapiens
ctgggactctcctcctcccctcc

SEQ ID NO: 4564348 - DNA, 17 bp, Homo sapiens
ctgggactgtgcctggc

SEQ ID NO: 4564349 - DNA, 19 bp, Homo sapiens
ctgggactgtgcctggctc

SEQ ID NO: 4564350 - DNA, 23 bp, Homo sapiens
ctgggagagctggtggtgcagcc

SEQ ID NO: 4564351 - DNA, 20 bp, Homo sapiens
ctgggagccacttctcccca

SEQ ID NO: 4564352 - DNA, 13 bp, Homo sapiens
ctgggagccagtc

SEQ ID NO: 4564353 - DNA, 15 bp, Homo sapiens
ctgggagcccagagg

SEQ ID NO: 4564354 - DNA, 16 bp, Homo sapiens
ctgggaggacaggcag

SEQ ID NO: 4564355 - DNA, 17 bp, Homo sapiens
ctgggaggacaggcagg

SEQ ID NO: 4564356 - DNA, 21 bp, Homo sapiens
ctgggaggacaggcaggccag

SEQ ID NO: 4564357 - DNA, 14 bp, Homo sapiens
ctgggaggagggag

SEQ ID NO: 4564358 - DNA, 16 bp, Homo sapiens
ctgggaggagggagag

SEQ ID NO: 4564359 - DNA, 23 bp, Homo sapiens
ctgggaggagggagagggaggtc

SEQ ID NO: 4564360 - DNA, 19 bp, Homo sapiens
ctgggaggagggcaggcat

SEQ ID NO: 4564361 - DNA, 17 bp, Homo sapiens
ctgggagtcacacagtg

SEQ ID NO: 4564362 - DNA, 21 bp, Homo sapiens
ctgggagtgttcccgtgcctg

SEQ ID NO: 4564363 - DNA, 23 bp, Homo sapiens
ctgggagttgatcgcctttccca

SEQ ID NO: 4564364 - DNA, 12 bp, Homo sapiens
ctgggataactg

SEQ ID NO: 4564365 - DNA, 16 bp, Homo sapiens
ctgggataactgattt

SEQ ID NO: 4564366 - DNA, 21 bp, Homo sapiens
ctgggatatatggaggattct

SEQ ID NO: 4564367 - DNA, 19 bp, Homo sapiens
ctgggatatggctgcccag

SEQ ID NO: 4564368 - DNA, 21 bp, Homo sapiens
ctgggatatggctgcccagga

SEQ ID NO: 4564369 - DNA, 22 bp, Homo sapiens
ctgggatatggctgcccaggag

SEQ ID NO: 4564370 - DNA, 22 bp, Homo sapiens
ctgggatcctgactaagccttt

SEQ ID NO: 4564371 - DNA, 19 bp, Homo sapiens
ctgggatggtgactcctga

SEQ ID NO: 4564372 - DNA, 20 bp, Homo sapiens
ctgggattaagaaaccttgc

SEQ ID NO: 4564373 - DNA, 15 bp, Homo sapiens
ctgggcaaagcctag

SEQ ID NO: 4564374 - DNA, 22 bp, Homo sapiens
ctgggcaaggaaaaagaaaata

SEQ ID NO: 4564375 - DNA, 20 bp, Homo sapiens
ctgggcaccacaaaatatac

SEQ ID NO: 4564376 - DNA, 16 bp, Homo sapiens
ctgggcacgcctgctg

SEQ ID NO: 4564377 - DNA, 18 bp, Homo sapiens
ctgggcactggggcctca

SEQ ID NO: 4564378 - DNA, 18 bp, Homo sapiens
ctgggcagccaggctgcc

SEQ ID NO: 4564379 - DNA, 13 bp, Homo sapiens
ctgggcaggaggg

SEQ ID NO: 4564380 - DNA, 14 bp, Homo sapiens
ctgggcagtgagtg

SEQ ID NO: 4564381 - DNA, 17 bp, Homo sapiens
ctgggcagtgagtgcca

SEQ ID NO: 4564382 - DNA, 18 bp, Homo sapiens
ctgggcagtgagtgccat

SEQ ID NO: 4564383 - DNA, 17 bp, Homo sapiens
ctgggcatggcagggcc

SEQ ID NO: 4564384 - DNA, 18 bp, Homo sapiens
ctgggcatggcagggcca

SEQ ID NO: 4564385 - DNA, 18 bp, Homo sapiens
ctgggcatttggtgagag

SEQ ID NO: 4564386 - DNA, 17 bp, Homo sapiens
ctgggcattttcctcct

SEQ ID NO: 4564387 - DNA, 20 bp, Homo sapiens
ctgggcattttcctcctctg

SEQ ID NO: 4564388 - DNA, 23 bp, Homo sapiens
ctgggccaattcaatacaaacaa

SEQ ID NO: 4564389 - DNA, 15 bp, Homo sapiens
ctgggccactgggga

SEQ ID NO: 4564390 - DNA, 17 bp, Homo sapiens
ctgggccatgtccaaag

SEQ ID NO: 4564391 - DNA, 22 bp, Homo sapiens
ctgggccatgtccaaagaggct

SEQ ID NO: 4564392 - DNA, 23 bp, Homo sapiens
ctgggccatgtccaaagaggctg

SEQ ID NO: 4564393 - DNA, 14 bp, Homo sapiens
ctgggcccaaccct

SEQ ID NO: 4564394 - DNA, 16 bp, Homo sapiens
ctgggccccagcccac

SEQ ID NO: 4564395 - DNA, 12 bp, Homo sapiens
ctgggcccctcc

SEQ ID NO: 4564396 - DNA, 14 bp, Homo sapiens
ctgggcccctccac

SEQ ID NO: 4564397 - DNA, 16 bp, Homo sapiens
ctgggcccctccacgc

SEQ ID NO: 4564398 - DNA, 20 bp, Homo sapiens
ctgggcccctccacgcctcc

SEQ ID NO: 4564399 - DNA, 17 bp, Homo sapiens
ctgggcccctccaggag

SEQ ID NO: 4564400 - DNA, 16 bp, Homo sapiens
ctgggcccctccctac

SEQ ID NO: 4564401 - DNA, 16 bp, Homo sapiens
ctgggcccctgcacag

SEQ ID NO: 4564402 - DNA, 12 bp, Homo sapiens
ctgggcccctgg

SEQ ID NO: 4564403 - DNA, 13 bp, Homo sapiens
ctgggcccgagcc

SEQ ID NO: 4564404 - DNA, 19 bp, Homo sapiens
ctgggcccgagcctgaact

SEQ ID NO: 4564405 - DNA, 14 bp, Homo sapiens
ctgggccctctctg

SEQ ID NO: 4564406 - DNA, 19 bp, Homo sapiens
ctgggccctctttccctgc

SEQ ID NO: 4564407 - DNA, 12 bp, Homo sapiens
ctgggccctgcc

SEQ ID NO: 4564408 - DNA, 17 bp, Homo sapiens
ctgggccctgcctgcag

SEQ ID NO: 4564409 - DNA, 21 bp, Homo sapiens
ctgggccctgcctgcagccag

SEQ ID NO: 4564410 - DNA, 16 bp, Homo sapiens
ctgggccctgggctgg

SEQ ID NO: 4564411 - DNA, 17 bp, Homo sapiens
ctgggccctgggctggc

SEQ ID NO: 4564412 - DNA, 20 bp, Homo sapiens
ctgggcctcagttcaacctg

SEQ ID NO: 4564413 - DNA, 17 bp, Homo sapiens
ctgggcctcggacccca

SEQ ID NO: 4564414 - DNA, 20 bp, Homo sapiens
ctgggcctcgtgcgcccgtg

SEQ ID NO: 4564415 - DNA, 21 bp, Homo sapiens
ctgggcctcgtgcgcccgtgg

SEQ ID NO: 4564416 - DNA, 23 bp, Homo sapiens
ctgggcctttgcaagatgcttgg

SEQ ID NO: 4564417 - DNA, 18 bp, Homo sapiens
ctgggctaggtagaaaaa

SEQ ID NO: 4564418 - DNA, 16 bp, Homo sapiens
ctgggctattgctgct

SEQ ID NO: 4564419 - DNA, 22 bp, Homo sapiens
ctgggctcaaatgatcctccca

SEQ ID NO: 4564420 - DNA, 22 bp, Homo sapiens
ctgggctcaagcaatcctcctg

SEQ ID NO: 4564421 - DNA, 14 bp, Homo sapiens
ctgggctcactgtg

SEQ ID NO: 4564422 - DNA, 22 bp, Homo sapiens
ctgggctcactgtgctggggca

SEQ ID NO: 4564423 - DNA, 13 bp, Homo sapiens
ctgggctcggagg

SEQ ID NO: 4564424 - DNA, 15 bp, Homo sapiens
ctgggctcggaggct

SEQ ID NO: 4564425 - DNA, 16 bp, Homo sapiens
ctgggctcggaggctg

SEQ ID NO: 4564426 - DNA, 13 bp, Homo sapiens
ctgggctctccac

SEQ ID NO: 4564427 - DNA, 16 bp, Homo sapiens
ctgggctgagggagcc

SEQ ID NO: 4564428 - DNA, 20 bp, Homo sapiens
ctgggctggcacagcccctg

SEQ ID NO: 4564429 - DNA, 20 bp, Homo sapiens
ctgggctggcgcttggatct

SEQ ID NO: 4564430 - DNA, 17 bp, Homo sapiens
ctgggctggggccacct

SEQ ID NO: 4564431 - DNA, 15 bp, Homo sapiens
ctgggctgggtgctg

SEQ ID NO: 4564432 - DNA, 20 bp, Homo sapiens
ctgggctgtctgtcaccagc

SEQ ID NO: 4564433 - DNA, 21 bp, Homo sapiens
ctgggctgtctgtcaccagct

SEQ ID NO: 4564434 - DNA, 20 bp, Homo sapiens
ctgggcttatatctggcctc

SEQ ID NO: 4564435 - DNA, 19 bp, Homo sapiens
ctgggcttatatgtacttt

SEQ ID NO: 4564436 - DNA, 15 bp, Homo sapiens
ctgggcttcatctgg

SEQ ID NO: 4564437 - DNA, 17 bp, Homo sapiens
ctgggcttggcctgctg

SEQ ID NO: 4564438 - DNA, 20 bp, Homo sapiens
ctgggcttggcctgctgtga

SEQ ID NO: 4564439 - DNA, 14 bp, Homo sapiens
ctggggacctggca

SEQ ID NO: 4564440 - DNA, 20 bp, Homo sapiens
ctggggacctggcactggga

SEQ ID NO: 4564441 - DNA, 15 bp, Homo sapiens
ctggggacctggttt

SEQ ID NO: 4564442 - DNA, 19 bp, Homo sapiens
ctggggacgttgctgagcc

SEQ ID NO: 4564443 - DNA, 21 bp, Homo sapiens
ctggggacgttgctgagccag

SEQ ID NO: 4564444 - DNA, 15 bp, Homo sapiens
ctggggactcaggga

SEQ ID NO: 4564445 - DNA, 23 bp, Homo sapiens
ctggggacttcaactgcccagca

SEQ ID NO: 4564446 - DNA, 22 bp, Homo sapiens
ctggggagcccactgaggggcc

SEQ ID NO: 4564447 - DNA, 13 bp, Homo sapiens
ctggggagctcct

SEQ ID NO: 4564448 - DNA, 15 bp, Homo sapiens
ctggggagctcctgg

SEQ ID NO: 4564449 - DNA, 22 bp, Homo sapiens
ctggggagctcctgggaccctt

SEQ ID NO: 4564450 - DNA, 18 bp, Homo sapiens
ctggggaggaatcctgga

SEQ ID NO: 4564451 - DNA, 18 bp, Homo sapiens
ctggggaggctgaggcag

SEQ ID NO: 4564452 - DNA, 19 bp, Homo sapiens
ctggggaggctgaggcagg

SEQ ID NO: 4564453 - DNA, 17 bp, Homo sapiens
ctggggaggtgctgggg

SEQ ID NO: 4564454 - DNA, 23 bp, Homo sapiens
ctggggatcttcccacaggaggg

SEQ ID NO: 4564455 - DNA, 17 bp, Homo sapiens
ctggggatgtctctcat

SEQ ID NO: 4564456 - DNA, 15 bp, Homo sapiens
ctggggcagaggaag

SEQ ID NO: 4564457 - DNA, 12 bp, Homo sapiens
ctggggcaggct

SEQ ID NO: 4564458 - DNA, 14 bp, Homo sapiens
ctggggcaggctgg

SEQ ID NO: 4564459 - DNA, 16 bp, Homo sapiens
ctggggcaggctgggc

SEQ ID NO: 4564460 - DNA, 14 bp, Homo sapiens
ctggggcaggggtg

SEQ ID NO: 4564461 - DNA, 12 bp, Homo sapiens
ctggggccagag

SEQ ID NO: 4564462 - DNA, 13 bp, Homo sapiens
ctggggccagagg

SEQ ID NO: 4564463 - DNA, 13 bp, Homo sapiens
ctggggccctggg

SEQ ID NO: 4564464 - DNA, 15 bp, Homo sapiens
ctggggccctgggcc

SEQ ID NO: 4564465 - DNA, 20 bp, Homo sapiens
ctggggccctgggcctcagt

SEQ ID NO: 4564466 - DNA, 17 bp, Homo sapiens
ctggggccggttttcct

SEQ ID NO: 4564467 - DNA, 24 bp, Homo sapiens
ctggggcctagcgatctctcctgg

SEQ ID NO: 4564468 - DNA, 14 bp, Homo sapiens
ctggggcctcagcc

SEQ ID NO: 4564469 - DNA, 22 bp, Homo sapiens
ctggggcgcgatgtcaaaggtc

SEQ ID NO: 4564470 - DNA, 21 bp, Homo sapiens
ctggggctgacacccaggccc

SEQ ID NO: 4564471 - DNA, 14 bp, Homo sapiens
ctgggggaagccct

SEQ ID NO: 4564472 - DNA, 19 bp, Homo sapiens
ctgggggccgcagaggatc

SEQ ID NO: 4564473 - DNA, 19 bp, Homo sapiens
ctgggggccttgggtgagt

SEQ ID NO: 4564474 - DNA, 23 bp, Homo sapiens
ctggggggaaaaagaccaggtct

SEQ ID NO: 4564475 - DNA, 13 bp, Homo sapiens
ctggggggcagtg

SEQ ID NO: 4564476 - DNA, 22 bp, Homo sapiens
ctgggggggattgtaaaatggt

SEQ ID NO: 4564477 - DNA, 15 bp, Homo sapiens
ctgggggtgccagga

SEQ ID NO: 4564478 - DNA, 14 bp, Homo sapiens
ctgggggtggcagg

SEQ ID NO: 4564479 - DNA, 16 bp, Homo sapiens
ctggggtcacagaggc

SEQ ID NO: 4564480 - DNA, 14 bp, Homo sapiens
ctggggtgcagctt

SEQ ID NO: 4564481 - DNA, 15 bp, Homo sapiens
ctggggtggccacca

SEQ ID NO: 4564482 - DNA, 16 bp, Homo sapiens
ctggggtgggcagttt

SEQ ID NO: 4564483 - DNA, 21 bp, Homo sapiens
ctggggttgccagaggccctg

SEQ ID NO: 4564484 - DNA, 23 bp, Homo sapiens
ctgggtaagaagaaagcaaaagc

SEQ ID NO: 4564485 - DNA, 22 bp, Homo sapiens
ctgggtaagaagggtgggagtg

SEQ ID NO: 4564486 - DNA, 18 bp, Homo sapiens
ctgggtactgaaagcctt

SEQ ID NO: 4564487 - DNA, 15 bp, Homo sapiens
ctgggtattggaaat

SEQ ID NO: 4564488 - DNA, 20 bp, Homo sapiens
ctgggtccatatcacacaca

SEQ ID NO: 4564489 - DNA, 21 bp, Homo sapiens
ctgggtcctgccagctggatc

SEQ ID NO: 4564490 - DNA, 17 bp, Homo sapiens
ctgggtctgaggcccct

SEQ ID NO: 4564491 - DNA, 22 bp, Homo sapiens
ctgggtctgaggcccctgcctc

SEQ ID NO: 4564492 - DNA, 14 bp, Homo sapiens
ctgggtcttcagct

SEQ ID NO: 4564493 - DNA, 15 bp, Homo sapiens
ctgggtcttcagctt

SEQ ID NO: 4564494 - DNA, 19 bp, Homo sapiens
ctgggtgataattttgaat

SEQ ID NO: 4564495 - DNA, 21 bp, Homo sapiens
ctgggtgatggaaactgccaa

SEQ ID NO: 4564496 - DNA, 15 bp, Homo sapiens
ctgggtgggctctgt

SEQ ID NO: 4564497 - DNA, 13 bp, Homo sapiens
ctgggtggggctg

SEQ ID NO: 4564498 - DNA, 21 bp, Homo sapiens
ctgggtggggctgctcctcca

SEQ ID NO: 4564499 - DNA, 20 bp, Homo sapiens
ctgggtgtcaagtgcctgca

SEQ ID NO: 4564500 - DNA, 22 bp, Homo sapiens
ctgggtgtcaagtgcctgcacc

SEQ ID NO: 4564501 - DNA, 14 bp, Homo sapiens
ctggtaagactgct

SEQ ID NO: 4564502 - DNA, 19 bp, Homo sapiens
ctggtaagactgctggttg

SEQ ID NO: 4564503 - DNA, 17 bp, Homo sapiens
ctggtaagattgttatt

SEQ ID NO: 4564504 - DNA, 22 bp, Homo sapiens
ctggtaataaatgtgactcagc

SEQ ID NO: 4564505 - DNA, 20 bp, Homo sapiens
ctggtacttagagtttctgt

SEQ ID NO: 4564506 - DNA, 18 bp, Homo sapiens
ctggtagagacccccagg

SEQ ID NO: 4564507 - DNA, 19 bp, Homo sapiens
ctggtagagacccccaggc

SEQ ID NO: 4564508 - DNA, 14 bp, Homo sapiens
ctggtagcagcagg

SEQ ID NO: 4564509 - DNA, 21 bp, Homo sapiens
ctggtagcagcaggctcaggc

SEQ ID NO: 4564510 - DNA, 19 bp, Homo sapiens
ctggtatatccaaaagctt

SEQ ID NO: 4564511 - DNA, 20 bp, Homo sapiens
ctggtatatccaaaagcttt

SEQ ID NO: 4564512 - DNA, 15 bp, Homo sapiens
ctggtattaaatgcc

SEQ ID NO: 4564513 - DNA, 19 bp, Homo sapiens
ctggtattaaatgccaagg

SEQ ID NO: 4564514 - DNA, 18 bp, Homo sapiens
ctggtcacagcctcctct

SEQ ID NO: 4564515 - DNA, 22 bp, Homo sapiens
ctggtcaccgagactcagcctc

SEQ ID NO: 4564516 - DNA, 24 bp, Homo sapiens
ctggtcaccgagactcagcctctg

SEQ ID NO: 4564517 - DNA, 20 bp, Homo sapiens
ctggtccagtggggaacagg

SEQ ID NO: 4564518 - DNA, 12 bp, Homo sapiens
ctggtcccctcc

SEQ ID NO: 4564519 - DNA, 22 bp, Homo sapiens
ctggtccggacactcctagaga

SEQ ID NO: 4564520 - DNA, 19 bp, Homo sapiens
ctggtcctggccgtcccta

SEQ ID NO: 4564521 - DNA, 22 bp, Homo sapiens
ctggtctcagcagcgaccaccc

SEQ ID NO: 4564522 - DNA, 18 bp, Homo sapiens
ctggtctctacataaaat

SEQ ID NO: 4564523 - DNA, 18 bp, Homo sapiens
ctggtcttgaactcctgg

SEQ ID NO: 4564524 - DNA, 16 bp, Homo sapiens
ctggtgcactttgtaa

SEQ ID NO: 4564525 - DNA, 18 bp, Homo sapiens
ctggtgcactttgtaaat

SEQ ID NO: 4564526 - DNA, 22 bp, Homo sapiens
ctggtgcaggtctccacctgca

SEQ ID NO: 4564527 - DNA, 16 bp, Homo sapiens
ctggtgccaatttcaa

SEQ ID NO: 4564528 - DNA, 20 bp, Homo sapiens
ctggtgccaatttcaagttc

SEQ ID NO: 4564529 - DNA, 13 bp, Homo sapiens
ctggtgcccctgc

SEQ ID NO: 4564530 - DNA, 14 bp, Homo sapiens
ctggtgcccggaga

SEQ ID NO: 4564531 - DNA, 21 bp, Homo sapiens
ctggtgcctcaccccttgcca

SEQ ID NO: 4564532 - DNA, 13 bp, Homo sapiens
ctggtgctactgt

SEQ ID NO: 4564533 - DNA, 13 bp, Homo sapiens
ctggtgctcctgc

SEQ ID NO: 4564534 - DNA, 14 bp, Homo sapiens
ctggtgctcctgca

SEQ ID NO: 4564535 - DNA, 16 bp, Homo sapiens
ctggtgctgccgaggg

SEQ ID NO: 4564536 - DNA, 20 bp, Homo sapiens
ctggtgctgccgagggctgg

SEQ ID NO: 4564537 - DNA, 19 bp, Homo sapiens
ctggtgctgcctctacctg

SEQ ID NO: 4564538 - DNA, 14 bp, Homo sapiens
ctggtggaggaagg

SEQ ID NO: 4564539 - DNA, 18 bp, Homo sapiens
ctggtggaggaagggctg

SEQ ID NO: 4564540 - DNA, 22 bp, Homo sapiens
ctggtggaggaagggctgggcc

SEQ ID NO: 4564541 - DNA, 23 bp, Homo sapiens
ctggtggaggaagggctgggcca

SEQ ID NO: 4564542 - DNA, 19 bp, Homo sapiens
ctggtggcaccagatgcaa

SEQ ID NO: 4564543 - DNA, 22 bp, Homo sapiens
ctggtggcaggggcttctagct

SEQ ID NO: 4564544 - DNA, 14 bp, Homo sapiens
ctggtgggccccca

SEQ ID NO: 4564545 - DNA, 16 bp, Homo sapiens
ctggtgggtccagggg

SEQ ID NO: 4564546 - DNA, 17 bp, Homo sapiens
ctggtgggtccaggggc

SEQ ID NO: 4564547 - DNA, 22 bp, Homo sapiens
ctggtgggtccaggggcccctc

SEQ ID NO: 4564548 - DNA, 15 bp, Homo sapiens
ctggtggtcttcctt

SEQ ID NO: 4564549 - DNA, 15 bp, Homo sapiens
ctggtgtcagcccca

SEQ ID NO: 4564550 - DNA, 16 bp, Homo sapiens
ctggtgtcataaactt

SEQ ID NO: 4564551 - DNA, 16 bp, Homo sapiens
ctggtgtccccttccc

SEQ ID NO: 4564552 - DNA, 22 bp, Homo sapiens
ctggtgtccccttcccctgctg

SEQ ID NO: 4564553 - DNA, 17 bp, Homo sapiens
ctggtgtgaactcaccc

SEQ ID NO: 4564554 - DNA, 22 bp, Homo sapiens
ctggtgtgaactcaccctggga

SEQ ID NO: 4564555 - DNA, 16 bp, Homo sapiens
ctggtgtgacctgagg

SEQ ID NO: 4564556 - DNA, 17 bp, Homo sapiens
ctggtgtgacctgaggg

SEQ ID NO: 4564557 - DNA, 22 bp, Homo sapiens
ctggtgtttctagcactggcct

SEQ ID NO: 4564558 - DNA, 13 bp, Homo sapiens
ctggttaatgtag

SEQ ID NO: 4564559 - DNA, 16 bp, Homo sapiens
ctggttatttttctct

SEQ ID NO: 4564560 - DNA, 20 bp, Homo sapiens
ctggttcagaaatagctcct

SEQ ID NO: 4564561 - DNA, 21 bp, Homo sapiens
ctggttcaggctcaaccttcc

SEQ ID NO: 4564562 - DNA, 23 bp, Homo sapiens
ctggttcaggctcaaccttccaa

SEQ ID NO: 4564563 - DNA, 16 bp, Homo sapiens
ctggttcccactgagg

SEQ ID NO: 4564564 - DNA, 21 bp, Homo sapiens
ctggttcggatttggggtgga

SEQ ID NO: 4564565 - DNA, 13 bp, Homo sapiens
ctggttgcctccc

SEQ ID NO: 4564566 - DNA, 19 bp, Homo sapiens
ctggttgctccatttgaga

SEQ ID NO: 4564567 - DNA, 13 bp, Homo sapiens
ctggttgggcagc

SEQ ID NO: 4564568 - DNA, 17 bp, Homo sapiens
ctggttgggcagccaga

SEQ ID NO: 4564569 - DNA, 16 bp, Homo sapiens
ctggttgtttctgttc

SEQ ID NO: 4564570 - DNA, 21 bp, Homo sapiens
ctggttgtttctgttccaaat

SEQ ID NO: 4564571 - DNA, 17 bp, Homo sapiens
ctggtttctcctggtag

SEQ ID NO: 4564572 - DNA, 14 bp, Homo sapiens
ctggttttacacag

SEQ ID NO: 4564573 - DNA, 19 bp, Homo sapiens
ctggttttacacagagaaa

SEQ ID NO: 4564574 - DNA, 15 bp, Homo sapiens
ctgtaaaaataacat

SEQ ID NO: 4564575 - DNA, 12 bp, Homo sapiens
ctgtaaaagaga

SEQ ID NO: 4564576 - DNA, 16 bp, Homo sapiens
ctgtaaaagtgtacag

SEQ ID NO: 4564577 - DNA, 17 bp, Homo sapiens
ctgtaaaagtgtacaga

SEQ ID NO: 4564578 - DNA, 13 bp, Homo sapiens
ctgtaaactgtgt

SEQ ID NO: 4564579 - DNA, 14 bp, Homo sapiens
ctgtaaactgtgta

SEQ ID NO: 4564580 - DNA, 13 bp, Homo sapiens
ctgtaaagataat

SEQ ID NO: 4564581 - DNA, 22 bp, Homo sapiens
ctgtaaagatgtttatttcagg

SEQ ID NO: 4564582 - DNA, 19 bp, Homo sapiens
ctgtaacctcttcagaggc

SEQ ID NO: 4564583 - DNA, 20 bp, Homo sapiens
ctgtaacctcttcagaggcc

SEQ ID NO: 4564584 - DNA, 22 bp, Homo sapiens
ctgtaacctcttcagaggccct

SEQ ID NO: 4564585 - DNA, 16 bp, Homo sapiens
ctgtaactactttata

SEQ ID NO: 4564586 - DNA, 17 bp, Homo sapiens
ctgtaactgagagaaag

SEQ ID NO: 4564587 - DNA, 14 bp, Homo sapiens
ctgtaactgtcagt

SEQ ID NO: 4564588 - DNA, 17 bp, Homo sapiens
ctgtaactgttacagta

SEQ ID NO: 4564589 - DNA, 18 bp, Homo sapiens
ctgtaagaaaaaaaatgt

SEQ ID NO: 4564590 - DNA, 21 bp, Homo sapiens
ctgtaagaagcggcatagcac

SEQ ID NO: 4564591 - DNA, 14 bp, Homo sapiens
ctgtaagccaaaga

SEQ ID NO: 4564592 - DNA, 23 bp, Homo sapiens
ctgtaagccaaagaaatgaacat

SEQ ID NO: 4564593 - DNA, 21 bp, Homo sapiens
ctgtaaggtgcttgctcccca

SEQ ID NO: 4564594 - DNA, 23 bp, Homo sapiens
ctgtaatatacaagcaagcaaaa

SEQ ID NO: 4564595 - DNA, 15 bp, Homo sapiens
ctgtaatatatttat

SEQ ID NO: 4564596 - DNA, 18 bp, Homo sapiens
ctgtaatatatttatata

SEQ ID NO: 4564597 - DNA, 13 bp, Homo sapiens
ctgtaatatttac

SEQ ID NO: 4564598 - DNA, 20 bp, Homo sapiens
ctgtaatcatttgtttacat

SEQ ID NO: 4564599 - DNA, 14 bp, Homo sapiens
ctgtaatcccagca

SEQ ID NO: 4564600 - DNA, 15 bp, Homo sapiens
ctgtaatcccagcag

SEQ ID NO: 4564601 - DNA, 17 bp, Homo sapiens
ctgtaatcttgttgata

SEQ ID NO: 4564602 - DNA, 19 bp, Homo sapiens
ctgtaatgagtcagtgaag

SEQ ID NO: 4564603 - DNA, 16 bp, Homo sapiens
ctgtaatgatactgat

SEQ ID NO: 4564604 - DNA, 18 bp, Homo sapiens
ctgtaatgatactgatta

SEQ ID NO: 4564605 - DNA, 22 bp, Homo sapiens
ctgtaatgatactgattatgaa

SEQ ID NO: 4564606 - DNA, 21 bp, Homo sapiens
ctgtaattaaactagtttaag

SEQ ID NO: 4564607 - DNA, 21 bp, Homo sapiens
ctgtaattgcactttttaagt

SEQ ID NO: 4564608 - DNA, 18 bp, Homo sapiens
ctgtaatttcgccttaaa

SEQ ID NO: 4564609 - DNA, 21 bp, Homo sapiens
ctgtaatttcgccttaaactc

SEQ ID NO: 4564610 - DNA, 17 bp, Homo sapiens
ctgtacaaatcctctgt

SEQ ID NO: 4564611 - DNA, 21 bp, Homo sapiens
ctgtacaaatcctctgttttc

SEQ ID NO: 4564612 - DNA, 16 bp, Homo sapiens
ctgtacacactttatt

SEQ ID NO: 4564613 - DNA, 14 bp, Homo sapiens
ctgtacacatttct

SEQ ID NO: 4564614 - DNA, 15 bp, Homo sapiens
ctgtacacatttctt

SEQ ID NO: 4564615 - DNA, 18 bp, Homo sapiens
ctgtacataattgcatga

SEQ ID NO: 4564616 - DNA, 20 bp, Homo sapiens
ctgtacataattgcatgaaa

SEQ ID NO: 4564617 - DNA, 23 bp, Homo sapiens
ctgtacataattgcatgaaaata

SEQ ID NO: 4564618 - DNA, 14 bp, Homo sapiens
ctgtacattgtgag

SEQ ID NO: 4564619 - DNA, 21 bp, Homo sapiens
ctgtacattgtgagctctggt

SEQ ID NO: 4564620 - DNA, 20 bp, Homo sapiens
ctgtacatttgcaattagaa

SEQ ID NO: 4564621 - DNA, 12 bp, Homo sapiens
ctgtaccagtta

SEQ ID NO: 4564622 - DNA, 15 bp, Homo sapiens
ctgtacctcagtgga

SEQ ID NO: 4564623 - DNA, 14 bp, Homo sapiens
ctgtacctctgcct

SEQ ID NO: 4564624 - DNA, 22 bp, Homo sapiens
ctgtactagtctgtgtgggact

SEQ ID NO: 4564625 - DNA, 23 bp, Homo sapiens
ctgtactatcctgtaaatatatc

SEQ ID NO: 4564626 - DNA, 18 bp, Homo sapiens
ctgtacttttcattctct

SEQ ID NO: 4564627 - DNA, 14 bp, Homo sapiens
ctgtagaatcaatt

SEQ ID NO: 4564628 - DNA, 21 bp, Homo sapiens
ctgtagactctaagatacact

SEQ ID NO: 4564629 - DNA, 16 bp, Homo sapiens
ctgtagagggccctgg

SEQ ID NO: 4564630 - DNA, 17 bp, Homo sapiens
ctgtagagggccctggt

SEQ ID NO: 4564631 - DNA, 17 bp, Homo sapiens
ctgtagcaaatttgttt

SEQ ID NO: 4564632 - DNA, 20 bp, Homo sapiens
ctgtagcaatggccagagcc

SEQ ID NO: 4564633 - DNA, 15 bp, Homo sapiens
ctgtagctctgcctc

SEQ ID NO: 4564634 - DNA, 20 bp, Homo sapiens
ctgtagctctgcctccctct

SEQ ID NO: 4564635 - DNA, 20 bp, Homo sapiens
ctgtagcttatctgcccctc

SEQ ID NO: 4564636 - DNA, 14 bp, Homo sapiens
ctgtagctttcctg

SEQ ID NO: 4564637 - DNA, 16 bp, Homo sapiens
ctgtagctttcctggt

SEQ ID NO: 4564638 - DNA, 18 bp, Homo sapiens
ctgtaggctaaaaggctt

SEQ ID NO: 4564639 - DNA, 22 bp, Homo sapiens
ctgtagggtttggacagaccca

SEQ ID NO: 4564640 - DNA, 20 bp, Homo sapiens
ctgtaggtatgatctcttct

SEQ ID NO: 4564641 - DNA, 14 bp, Homo sapiens
ctgtagtcccagct

SEQ ID NO: 4564642 - DNA, 16 bp, Homo sapiens
ctgtagtgtattaatc

SEQ ID NO: 4564643 - DNA, 23 bp, Homo sapiens
ctgtagtttatggcagaagggaa

SEQ ID NO: 4564644 - DNA, 18 bp, Homo sapiens
ctgtagtttttaattaaa

SEQ ID NO: 4564645 - DNA, 14 bp, Homo sapiens
ctgtataatctatt

SEQ ID NO: 4564646 - DNA, 15 bp, Homo sapiens
ctgtatatacttttt

SEQ ID NO: 4564647 - DNA, 22 bp, Homo sapiens
ctgtatattacagatatttgtc

SEQ ID NO: 4564648 - DNA, 13 bp, Homo sapiens
ctgtatattgcta

SEQ ID NO: 4564649 - DNA, 12 bp, Homo sapiens
ctgtatatttgt

SEQ ID NO: 4564650 - DNA, 16 bp, Homo sapiens
ctgtatatttgtatga

SEQ ID NO: 4564651 - DNA, 22 bp, Homo sapiens
ctgtatattttgtagttaatat

SEQ ID NO: 4564652 - DNA, 16 bp, Homo sapiens
ctgtatcaataaaatt

SEQ ID NO: 4564653 - DNA, 23 bp, Homo sapiens
ctgtatcaataaaattctgtaat

SEQ ID NO: 4564654 - DNA, 16 bp, Homo sapiens
ctgtatcaatttctaa

SEQ ID NO: 4564655 - DNA, 20 bp, Homo sapiens
ctgtatcctccctggcagac

SEQ ID NO: 4564656 - DNA, 18 bp, Homo sapiens
ctgtatgttatagaactt

SEQ ID NO: 4564657 - DNA, 22 bp, Homo sapiens
ctgtatgtttttactgaatgat

SEQ ID NO: 4564658 - DNA, 16 bp, Homo sapiens
ctgtattcgtgcattt

SEQ ID NO: 4564659 - DNA, 20 bp, Homo sapiens
ctgtatttaatggtttttat

SEQ ID NO: 4564660 - DNA, 15 bp, Homo sapiens
ctgtatttaattata

SEQ ID NO: 4564661 - DNA, 18 bp, Homo sapiens
ctgtatttaattataaaa

SEQ ID NO: 4564662 - DNA, 23 bp, Homo sapiens
ctgtatttacagacacacccagt

SEQ ID NO: 4564663 - DNA, 17 bp, Homo sapiens
ctgtatttatgtgtgag

SEQ ID NO: 4564664 - DNA, 15 bp, Homo sapiens
ctgtatttcagtatt

SEQ ID NO: 4564665 - DNA, 16 bp, Homo sapiens
ctgtatttcagtattt

SEQ ID NO: 4564666 - DNA, 18 bp, Homo sapiens
ctgtatttcagtattttc

SEQ ID NO: 4564667 - DNA, 18 bp, Homo sapiens
ctgtatttgaaataagaa

SEQ ID NO: 4564668 - DNA, 22 bp, Homo sapiens
ctgtatttgaaataagaattca

SEQ ID NO: 4564669 - DNA, 14 bp, Homo sapiens
ctgtattttgatat

SEQ ID NO: 4564670 - DNA, 17 bp, Homo sapiens
ctgtattttgatataat

SEQ ID NO: 4564671 - DNA, 14 bp, Homo sapiens
ctgtatttttacag

SEQ ID NO: 4564672 - DNA, 15 bp, Homo sapiens
ctgtatttttacagc

SEQ ID NO: 4564673 - DNA, 13 bp, Homo sapiens
ctgtatttttcag

SEQ ID NO: 4564674 - DNA, 18 bp, Homo sapiens
ctgtatttttttttctaa

SEQ ID NO: 4564675 - DNA, 14 bp, Homo sapiens
ctgtcaaaactact

SEQ ID NO: 4564676 - DNA, 22 bp, Homo sapiens
ctgtcaaaactactgacaggga

SEQ ID NO: 4564677 - DNA, 17 bp, Homo sapiens
ctgtcaaacaataaagg

SEQ ID NO: 4564678 - DNA, 22 bp, Homo sapiens
ctgtcaagagtagttatataat

SEQ ID NO: 4564679 - DNA, 20 bp, Homo sapiens
ctgtcacaataaagtttatt

SEQ ID NO: 4564680 - DNA, 19 bp, Homo sapiens
ctgtcacatacaacttttt

SEQ ID NO: 4564681 - DNA, 23 bp, Homo sapiens
ctgtcacctagaacgtgcatcct

SEQ ID NO: 4564682 - DNA, 13 bp, Homo sapiens
ctgtcacctcttc

SEQ ID NO: 4564683 - DNA, 14 bp, Homo sapiens
ctgtcagatgtcac

SEQ ID NO: 4564684 - DNA, 16 bp, Homo sapiens
ctgtcagattaaatta

SEQ ID NO: 4564685 - DNA, 19 bp, Homo sapiens
ctgtcagattaaattacag

SEQ ID NO: 4564686 - DNA, 21 bp, Homo sapiens
ctgtcagcaagactgaagatg

SEQ ID NO: 4564687 - DNA, 16 bp, Homo sapiens
ctgtcagccagccgcc

SEQ ID NO: 4564688 - DNA, 18 bp, Homo sapiens
ctgtcagccagccgccct

SEQ ID NO: 4564689 - DNA, 12 bp, Homo sapiens
ctgtcagctgca

SEQ ID NO: 4564690 - DNA, 13 bp, Homo sapiens
ctgtcagtgagga

SEQ ID NO: 4564691 - DNA, 21 bp, Homo sapiens
ctgtcagtgaggactctttcc

SEQ ID NO: 4564692 - DNA, 19 bp, Homo sapiens
ctgtcagtggggcagcctc

SEQ ID NO: 4564693 - DNA, 17 bp, Homo sapiens
ctgtcagtgttaaagat

SEQ ID NO: 4564694 - DNA, 18 bp, Homo sapiens
ctgtcagtgttaaagatt

SEQ ID NO: 4564695 - DNA, 22 bp, Homo sapiens
ctgtcagtgttaaagattttgt

SEQ ID NO: 4564696 - DNA, 20 bp, Homo sapiens
ctgtcatcctcaaagaaagt

SEQ ID NO: 4564697 - DNA, 23 bp, Homo sapiens
ctgtcatctaaagtcctggccct

SEQ ID NO: 4564698 - DNA, 16 bp, Homo sapiens
ctgtcatctctctggg

SEQ ID NO: 4564699 - DNA, 15 bp, Homo sapiens
ctgtcatgaacatgt

SEQ ID NO: 4564700 - DNA, 18 bp, Homo sapiens
ctgtcatggtcctttctg

SEQ ID NO: 4564701 - DNA, 14 bp, Homo sapiens
ctgtcattatattc

SEQ ID NO: 4564702 - DNA, 11 bp, Homo sapiens
ctgtcattccc

SEQ ID NO: 4564703 - DNA, 22 bp, Homo sapiens
ctgtcattcccctcttttgtct

SEQ ID NO: 4564704 - DNA, 23 bp, Homo sapiens
ctgtcattcctaaaacacccttc

SEQ ID NO: 4564705 - DNA, 17 bp, Homo sapiens
ctgtccaaaggaggctg

SEQ ID NO: 4564706 - DNA, 18 bp, Homo sapiens
ctgtccaaaggaggctgg

SEQ ID NO: 4564707 - DNA, 20 bp, Homo sapiens
ctgtccaaaggaggctggca

SEQ ID NO: 4564708 - DNA, 23 bp, Homo sapiens
ctgtccaacctaacccctttcct

SEQ ID NO: 4564709 - DNA, 15 bp, Homo sapiens
ctgtccacacccagc

SEQ ID NO: 4564710 - DNA, 14 bp, Homo sapiens
ctgtccaccctgcc

SEQ ID NO: 4564711 - DNA, 12 bp, Homo sapiens
ctgtccagacag

SEQ ID NO: 4564712 - DNA, 21 bp, Homo sapiens
ctgtccagacagcctgtatct

SEQ ID NO: 4564713 - DNA, 18 bp, Homo sapiens
ctgtccagcctgggcagc

SEQ ID NO: 4564714 - DNA, 22 bp, Homo sapiens
ctgtccagctggggccagaggc

SEQ ID NO: 4564715 - DNA, 23 bp, Homo sapiens
ctgtccagctggggccagaggct

SEQ ID NO: 4564716 - DNA, 16 bp, Homo sapiens
ctgtccaggcactgag

SEQ ID NO: 4564717 - DNA, 12 bp, Homo sapiens
ctgtccagggaa

SEQ ID NO: 4564718 - DNA, 22 bp, Homo sapiens
ctgtccagggaaacagcctctc

SEQ ID NO: 4564719 - DNA, 15 bp, Homo sapiens
ctgtcccaccgggag

SEQ ID NO: 4564720 - DNA, 19 bp, Homo sapiens
ctgtcccaccgggagcctc

SEQ ID NO: 4564721 - DNA, 21 bp, Homo sapiens
ctgtcccaccgggagcctccc

SEQ ID NO: 4564722 - DNA, 22 bp, Homo sapiens
ctgtcccaccgggagcctcccc

SEQ ID NO: 4564723 - DNA, 22 bp, Homo sapiens
ctgtcccagctaccaagtcaga

SEQ ID NO: 4564724 - DNA, 21 bp, Homo sapiens
ctgtcccaggccggcccagat

SEQ ID NO: 4564725 - DNA, 17 bp, Homo sapiens
ctgtcccattctagatc

SEQ ID NO: 4564726 - DNA, 17 bp, Homo sapiens
ctgtccccactgcccca

SEQ ID NO: 4564727 - DNA, 15 bp, Homo sapiens
ctgtcccccaggctg

SEQ ID NO: 4564728 - DNA, 14 bp, Homo sapiens
ctgtccccttctct

SEQ ID NO: 4564729 - DNA, 19 bp, Homo sapiens
ctgtccccttctctcatct

SEQ ID NO: 4564730 - DNA, 22 bp, Homo sapiens
ctgtccccttctctcatctctt

SEQ ID NO: 4564731 - DNA, 22 bp, Homo sapiens
ctgtcccgttccccgctccaca

SEQ ID NO: 4564732 - DNA, 12 bp, Homo sapiens
ctgtccctccgg

SEQ ID NO: 4564733 - DNA, 13 bp, Homo sapiens
ctgtccctgaggt

SEQ ID NO: 4564734 - DNA, 14 bp, Homo sapiens
ctgtccctgcctca

SEQ ID NO: 4564735 - DNA, 12 bp, Homo sapiens
ctgtccctggga

SEQ ID NO: 4564736 - DNA, 14 bp, Homo sapiens
ctgtccctgggagt

SEQ ID NO: 4564737 - DNA, 23 bp, Homo sapiens
ctgtccctgggggagtaattctg

SEQ ID NO: 4564738 - DNA, 14 bp, Homo sapiens
ctgtccctgtcctt

SEQ ID NO: 4564739 - DNA, 15 bp, Homo sapiens
ctgtcccttgcctct

SEQ ID NO: 4564740 - DNA, 17 bp, Homo sapiens
ctgtcccttgcctctgc

SEQ ID NO: 4564741 - DNA, 22 bp, Homo sapiens
ctgtcccttgcctctgccctgg

SEQ ID NO: 4564742 - DNA, 20 bp, Homo sapiens
ctgtcctaaggaaccttcct

SEQ ID NO: 4564743 - DNA, 17 bp, Homo sapiens
ctgtcctaatcatacac

SEQ ID NO: 4564744 - DNA, 23 bp, Homo sapiens
ctgtcctaccatcagctctgcct

SEQ ID NO: 4564745 - DNA, 18 bp, Homo sapiens
ctgtcctctcgagcccag

SEQ ID NO: 4564746 - DNA, 20 bp, Homo sapiens
ctgtcctgcacaccctgggc

SEQ ID NO: 4564747 - DNA, 15 bp, Homo sapiens
ctgtcctgcccgtga

SEQ ID NO: 4564748 - DNA, 14 bp, Homo sapiens
ctgtcctgtaactg

SEQ ID NO: 4564749 - DNA, 17 bp, Homo sapiens
ctgtcctgtgatgtcag

SEQ ID NO: 4564750 - DNA, 16 bp, Homo sapiens
ctgtcctgttgattaa

SEQ ID NO: 4564751 - DNA, 21 bp, Homo sapiens
ctgtccttccctgttctccct

SEQ ID NO: 4564752 - DNA, 13 bp, Homo sapiens
ctgtcgcccaggc

SEQ ID NO: 4564753 - DNA, 16 bp, Homo sapiens
ctgtcgcccaggctgg

SEQ ID NO: 4564754 - DNA, 16 bp, Homo sapiens
ctgtcgctctcagttc

SEQ ID NO: 4564755 - DNA, 14 bp, Homo sapiens
ctgtctacctggtc

SEQ ID NO: 4564756 - DNA, 17 bp, Homo sapiens
ctgtctaggtctcctca

SEQ ID NO: 4564757 - DNA, 21 bp, Homo sapiens
ctgtctaggtctcctcagggt

SEQ ID NO: 4564758 - DNA, 17 bp, Homo sapiens
ctgtctaggttaaagct

SEQ ID NO: 4564759 - DNA, 20 bp, Homo sapiens
ctgtctaggttaaagctaaa

SEQ ID NO: 4564760 - DNA, 19 bp, Homo sapiens
ctgtctagtctctcctgta

SEQ ID NO: 4564761 - DNA, 14 bp, Homo sapiens
ctgtctatttaagt

SEQ ID NO: 4564762 - DNA, 21 bp, Homo sapiens
ctgtctcaaaaaaaaaaagaa

SEQ ID NO: 4564763 - DNA, 14 bp, Homo sapiens
ctgtctcacctgga

SEQ ID NO: 4564764 - DNA, 12 bp, Homo sapiens
ctgtctcatcca

SEQ ID NO: 4564765 - DNA, 20 bp, Homo sapiens
ctgtctcatccatcatcatg

SEQ ID NO: 4564766 - DNA, 21 bp, Homo sapiens
ctgtctcatccatcatcatgt

SEQ ID NO: 4564767 - DNA, 15 bp, Homo sapiens
ctgtctcatccccag

SEQ ID NO: 4564768 - DNA, 16 bp, Homo sapiens
ctgtctcatccccagg

SEQ ID NO: 4564769 - DNA, 19 bp, Homo sapiens
ctgtctcatccccaggggt

SEQ ID NO: 4564770 - DNA, 19 bp, Homo sapiens
ctgtctccaagaccttggc

SEQ ID NO: 4564771 - DNA, 15 bp, Homo sapiens
ctgtctccagcttcc

SEQ ID NO: 4564772 - DNA, 20 bp, Homo sapiens
ctgtctccagggcccccacc

SEQ ID NO: 4564773 - DNA, 21 bp, Homo sapiens
ctgtctccagggcccccaccg

SEQ ID NO: 4564774 - DNA, 21 bp, Homo sapiens
ctgtctcccacgtgtgtatta

SEQ ID NO: 4564775 - DNA, 23 bp, Homo sapiens
ctgtctcccacgtgtgtattatg

SEQ ID NO: 4564776 - DNA, 16 bp, Homo sapiens
ctgtctggattaatta

SEQ ID NO: 4564777 - DNA, 14 bp, Homo sapiens
ctgtctggccctgg

SEQ ID NO: 4564778 - DNA, 21 bp, Homo sapiens
ctgtctggctcggacccaccc

SEQ ID NO: 4564779 - DNA, 22 bp, Homo sapiens
ctgtctgtagagggccctggtg

SEQ ID NO: 4564780 - DNA, 16 bp, Homo sapiens
ctgtctgtcaccagct

SEQ ID NO: 4564781 - DNA, 22 bp, Homo sapiens
ctgtctgtgcacatgcctctgt

SEQ ID NO: 4564782 - DNA, 13 bp, Homo sapiens
ctgtctgttccca

SEQ ID NO: 4564783 - DNA, 16 bp, Homo sapiens
ctgtctgttcccagcc

SEQ ID NO: 4564784 - DNA, 21 bp, Homo sapiens
ctgtctgttcccagcccctgc

SEQ ID NO: 4564785 - DNA, 22 bp, Homo sapiens
ctgtctgttcccagcccctgca

SEQ ID NO: 4564786 - DNA, 14 bp, Homo sapiens
ctgtctgtttatat

SEQ ID NO: 4564787 - DNA, 20 bp, Homo sapiens
ctgtcttacgtttttctggt

SEQ ID NO: 4564788 - DNA, 18 bp, Homo sapiens
ctgtcttcacaacagatt

SEQ ID NO: 4564789 - DNA, 16 bp, Homo sapiens
ctgtcttcccagggta

SEQ ID NO: 4564790 - DNA, 13 bp, Homo sapiens
ctgtcttcctcaa

SEQ ID NO: 4564791 - DNA, 14 bp, Homo sapiens
ctgtcttcctcaaa

SEQ ID NO: 4564792 - DNA, 14 bp, Homo sapiens
ctgtcttgactttt

SEQ ID NO: 4564793 - DNA, 14 bp, Homo sapiens
ctgtcttgtcccca

SEQ ID NO: 4564794 - DNA, 16 bp, Homo sapiens
ctgtcttgtccccacc

SEQ ID NO: 4564795 - DNA, 15 bp, Homo sapiens
ctgtcttgtttcagt

SEQ ID NO: 4564796 - DNA, 18 bp, Homo sapiens
ctgtcttgtttcagtgag

SEQ ID NO: 4564797 - DNA, 18 bp, Homo sapiens
ctgtctttcctgaaccat

SEQ ID NO: 4564798 - DNA, 13 bp, Homo sapiens
ctgtctttctgct

SEQ ID NO: 4564799 - DNA, 15 bp, Homo sapiens
ctgtcttttcttgac

SEQ ID NO: 4564800 - DNA, 18 bp, Homo sapiens
ctgtcttttgttctctga

SEQ ID NO: 4564801 - DNA, 19 bp, Homo sapiens
ctgtcttttttctctctta

SEQ ID NO: 4564802 - DNA, 15 bp, Homo sapiens
ctgtgaaaaaaaatt

SEQ ID NO: 4564803 - DNA, 18 bp, Homo sapiens
ctgtgaaaaaaaatttgt

SEQ ID NO: 4564804 - DNA, 24 bp, Homo sapiens
ctgtgaaaaaaaatttgttttcaa

SEQ ID NO: 4564805 - DNA, 12 bp, Homo sapiens
ctgtgaaaatag

SEQ ID NO: 4564806 - DNA, 13 bp, Homo sapiens
ctgtgaaagaagt

SEQ ID NO: 4564807 - DNA, 14 bp, Homo sapiens
ctgtgaaagaagta

SEQ ID NO: 4564808 - DNA, 14 bp, Homo sapiens
ctgtgaaatatcat

SEQ ID NO: 4564809 - DNA, 19 bp, Homo sapiens
ctgtgaacagagagaccct

SEQ ID NO: 4564810 - DNA, 20 bp, Homo sapiens
ctgtgaactgtgtgtgaatc

SEQ ID NO: 4564811 - DNA, 21 bp, Homo sapiens
ctgtgaagagccggtggtgcc

SEQ ID NO: 4564812 - DNA, 15 bp, Homo sapiens
ctgtgaatggaggca

SEQ ID NO: 4564813 - DNA, 19 bp, Homo sapiens
ctgtgacatggtgcctgag

SEQ ID NO: 4564814 - DNA, 20 bp, Homo sapiens
ctgtgacatggtgcctgaga

SEQ ID NO: 4564815 - DNA, 23 bp, Homo sapiens
ctgtgacatggtgcctgagaggc

SEQ ID NO: 4564816 - DNA, 16 bp, Homo sapiens
ctgtgaccaatgtctt

SEQ ID NO: 4564817 - DNA, 17 bp, Homo sapiens
ctgtgaccaatgtcttg

SEQ ID NO: 4564818 - DNA, 14 bp, Homo sapiens
ctgtgaccacaaca

SEQ ID NO: 4564819 - DNA, 19 bp, Homo sapiens
ctgtgacctgtcagaataa

SEQ ID NO: 4564820 - DNA, 14 bp, Homo sapiens
ctgtgagaccccca

SEQ ID NO: 4564821 - DNA, 18 bp, Homo sapiens
ctgtgagacccccacacc

SEQ ID NO: 4564822 - DNA, 19 bp, Homo sapiens
ctgtgagacccccacacct

SEQ ID NO: 4564823 - DNA, 18 bp, Homo sapiens
ctgtgagactcgagaact

SEQ ID NO: 4564824 - DNA, 20 bp, Homo sapiens
ctgtgagactcgagaacttt

SEQ ID NO: 4564825 - DNA, 19 bp, Homo sapiens
ctgtgagcatggggccagg

SEQ ID NO: 4564826 - DNA, 14 bp, Homo sapiens
ctgtgagggagggg

SEQ ID NO: 4564827 - DNA, 19 bp, Homo sapiens
ctgtgaggggctctctcat

SEQ ID NO: 4564828 - DNA, 20 bp, Homo sapiens
ctgtgatatgtctgctgagt

SEQ ID NO: 4564829 - DNA, 14 bp, Homo sapiens
ctgtgatcttaaaa

SEQ ID NO: 4564830 - DNA, 18 bp, Homo sapiens
ctgtgatcttaaaataat

SEQ ID NO: 4564831 - DNA, 12 bp, Homo sapiens
ctgtgatgtcag

SEQ ID NO: 4564832 - DNA, 16 bp, Homo sapiens
ctgtgattcagaaaat

SEQ ID NO: 4564833 - DNA, 22 bp, Homo sapiens
ctgtgattccactacacctggc

SEQ ID NO: 4564834 - DNA, 14 bp, Homo sapiens
ctgtgattttaaga

SEQ ID NO: 4564835 - DNA, 16 bp, Homo sapiens
ctgtgcaactttttaa

SEQ ID NO: 4564836 - DNA, 17 bp, Homo sapiens
ctgtgcaatttctgtac

SEQ ID NO: 4564837 - DNA, 20 bp, Homo sapiens
ctgtgcaatttctgtacatt

SEQ ID NO: 4564838 - DNA, 17 bp, Homo sapiens
ctgtgcacatgcctctg

SEQ ID NO: 4564839 - DNA, 22 bp, Homo sapiens
ctgtgcacatgcctctgtagag

SEQ ID NO: 4564840 - DNA, 21 bp, Homo sapiens
ctgtgcagccgctgagcgagg

SEQ ID NO: 4564841 - DNA, 20 bp, Homo sapiens
ctgtgcaggctgcagtggct

SEQ ID NO: 4564842 - DNA, 18 bp, Homo sapiens
ctgtgcagtcactggagg

SEQ ID NO: 4564843 - DNA, 18 bp, Homo sapiens
ctgtgccaagatttaaaa

SEQ ID NO: 4564844 - DNA, 19 bp, Homo sapiens
ctgtgccaagatttaaaat

SEQ ID NO: 4564845 - DNA, 16 bp, Homo sapiens
ctgtgccagaggccag

SEQ ID NO: 4564846 - DNA, 15 bp, Homo sapiens
ctgtgccatgctggg

SEQ ID NO: 4564847 - DNA, 21 bp, Homo sapiens
ctgtgccccatgcctgtccag

SEQ ID NO: 4564848 - DNA, 18 bp, Homo sapiens
ctgtgcccgcatgtgtgc

SEQ ID NO: 4564849 - DNA, 17 bp, Homo sapiens
ctgtgccctccaaagag

SEQ ID NO: 4564850 - DNA, 15 bp, Homo sapiens
ctgtgccgaggcttg

SEQ ID NO: 4564851 - DNA, 18 bp, Homo sapiens
ctgtgcctccccccagac

SEQ ID NO: 4564852 - DNA, 21 bp, Homo sapiens
ctgtgcctccccccagacccc

SEQ ID NO: 4564853 - DNA, 15 bp, Homo sapiens
ctgtgcctgaatatt

SEQ ID NO: 4564854 - DNA, 17 bp, Homo sapiens
ctgtgcctgattatttt

SEQ ID NO: 4564855 - DNA, 11 bp, Homo sapiens
ctgtgcctggc

SEQ ID NO: 4564856 - DNA, 21 bp, Homo sapiens
ctgtgcctggccccagcctgg

SEQ ID NO: 4564857 - DNA, 16 bp, Homo sapiens
ctgtgcctggctccct

SEQ ID NO: 4564858 - DNA, 20 bp, Homo sapiens
ctgtgccttgtcacgccaga

SEQ ID NO: 4564859 - DNA, 15 bp, Homo sapiens
ctgtgctatgaattt

SEQ ID NO: 4564860 - DNA, 20 bp, Homo sapiens
ctgtgctcaccctctcttgg

SEQ ID NO: 4564861 - DNA, 22 bp, Homo sapiens
ctgtgctccgccatggtgtccc

SEQ ID NO: 4564862 - DNA, 23 bp, Homo sapiens
ctgtgctccgccatggtgtcccg

SEQ ID NO: 4564863 - DNA, 18 bp, Homo sapiens
ctgtgctctggggatttc

SEQ ID NO: 4564864 - DNA, 20 bp, Homo sapiens
ctgtgctctggggatttctg

SEQ ID NO: 4564865 - DNA, 23 bp, Homo sapiens
ctgtgctctggggatttctggga

SEQ ID NO: 4564866 - DNA, 13 bp, Homo sapiens
ctgtgctgaccct

SEQ ID NO: 4564867 - DNA, 14 bp, Homo sapiens
ctgtgctgggagaa

SEQ ID NO: 4564868 - DNA, 15 bp, Homo sapiens
ctgtgctgtattttg

SEQ ID NO: 4564869 - DNA, 21 bp, Homo sapiens
ctgtgcttcgggcccttccca

SEQ ID NO: 4564870 - DNA, 18 bp, Homo sapiens
ctgtggacaggatgagga

SEQ ID NO: 4564871 - DNA, 21 bp, Homo sapiens
ctgtggacaggatgaggacag

SEQ ID NO: 4564872 - DNA, 23 bp, Homo sapiens
ctgtggaggggcttgggcctgca

SEQ ID NO: 4564873 - DNA, 15 bp, Homo sapiens
ctgtggcagtaaaga

SEQ ID NO: 4564874 - DNA, 15 bp, Homo sapiens
ctgtggccagcagcc

SEQ ID NO: 4564875 - DNA, 23 bp, Homo sapiens
ctgtggccatatatgctgtattt

SEQ ID NO: 4564876 - DNA, 22 bp, Homo sapiens
ctgtggccccatccaaccactg

SEQ ID NO: 4564877 - DNA, 20 bp, Homo sapiens
ctgtggcccctcccctgcag

SEQ ID NO: 4564878 - DNA, 18 bp, Homo sapiens
ctgtggcctaacctgccg

SEQ ID NO: 4564879 - DNA, 14 bp, Homo sapiens
ctgtggcggtgcct

SEQ ID NO: 4564880 - DNA, 14 bp, Homo sapiens
ctgtggctggctct

SEQ ID NO: 4564881 - DNA, 23 bp, Homo sapiens
ctgtggctggctctaccttcctg

SEQ ID NO: 4564882 - DNA, 18 bp, Homo sapiens
ctgtggctttttgttcag

SEQ ID NO: 4564883 - DNA, 21 bp, Homo sapiens
ctgtggctttttgttcagaat

SEQ ID NO: 4564884 - DNA, 15 bp, Homo sapiens
ctgtgggaaggccag

SEQ ID NO: 4564885 - DNA, 16 bp, Homo sapiens
ctgtgggaaggccagc

SEQ ID NO: 4564886 - DNA, 18 bp, Homo sapiens
ctgtgggaaggccagctg

SEQ ID NO: 4564887 - DNA, 17 bp, Homo sapiens
ctgtgggagccgcagag

SEQ ID NO: 4564888 - DNA, 13 bp, Homo sapiens
ctgtgggcagcac

SEQ ID NO: 4564889 - DNA, 15 bp, Homo sapiens
ctgtgggcagcaccc

SEQ ID NO: 4564890 - DNA, 17 bp, Homo sapiens
ctgtgggcagcaccctc

SEQ ID NO: 4564891 - DNA, 21 bp, Homo sapiens
ctgtgggcagcaccctccccc

SEQ ID NO: 4564892 - DNA, 18 bp, Homo sapiens
ctgtgggcggctcctggt

SEQ ID NO: 4564893 - DNA, 15 bp, Homo sapiens
ctgtgggcttcccca

SEQ ID NO: 4564894 - DNA, 19 bp, Homo sapiens
ctgtggggactccggctgt

SEQ ID NO: 4564895 - DNA, 14 bp, Homo sapiens
ctgtggggactgaa

SEQ ID NO: 4564896 - DNA, 13 bp, Homo sapiens
ctgtggggcctgg

SEQ ID NO: 4564897 - DNA, 16 bp, Homo sapiens
ctgtggggcctgggga

SEQ ID NO: 4564898 - DNA, 23 bp, Homo sapiens
ctgtgggggtggccatccctggg

SEQ ID NO: 4564899 - DNA, 17 bp, Homo sapiens
ctgtgggtctctgaagg

SEQ ID NO: 4564900 - DNA, 18 bp, Homo sapiens
ctgtgggtctctgaaggg

SEQ ID NO: 4564901 - DNA, 16 bp, Homo sapiens
ctgtgggtctgggagt

SEQ ID NO: 4564902 - DNA, 13 bp, Homo sapiens
ctgtgggtgatgg

SEQ ID NO: 4564903 - DNA, 16 bp, Homo sapiens
ctgtgggtgatgggga

SEQ ID NO: 4564904 - DNA, 18 bp, Homo sapiens
ctgtgggtgatggggagg

SEQ ID NO: 4564905 - DNA, 19 bp, Homo sapiens
ctgtgggtgatggggaggg

SEQ ID NO: 4564906 - DNA, 21 bp, Homo sapiens
ctgtgggtgatggggaggggc

SEQ ID NO: 4564907 - DNA, 22 bp, Homo sapiens
ctgtgggtgttctttcctgccc

SEQ ID NO: 4564908 - DNA, 15 bp, Homo sapiens
ctgtggtagctccag

SEQ ID NO: 4564909 - DNA, 20 bp, Homo sapiens
ctgtggtgacttctgctgct

SEQ ID NO: 4564910 - DNA, 15 bp, Homo sapiens
ctgtggtgtgtcccc

SEQ ID NO: 4564911 - DNA, 15 bp, Homo sapiens
ctgtggttcctctgc

SEQ ID NO: 4564912 - DNA, 19 bp, Homo sapiens
ctgtggtttggttggggct

SEQ ID NO: 4564913 - DNA, 20 bp, Homo sapiens
ctgtggttttattacaaatg

SEQ ID NO: 4564914 - DNA, 22 bp, Homo sapiens
ctgtggttttattacaaatgca

SEQ ID NO: 4564915 - DNA, 13 bp, Homo sapiens
ctgtgtaacatct

SEQ ID NO: 4564916 - DNA, 18 bp, Homo sapiens
ctgtgtaattagtgccac

SEQ ID NO: 4564917 - DNA, 21 bp, Homo sapiens
ctgtgtacaactttttaaata

SEQ ID NO: 4564918 - DNA, 19 bp, Homo sapiens
ctgtgtacataactgaaaa

SEQ ID NO: 4564919 - DNA, 19 bp, Homo sapiens
ctgtgtacctcactgtcca

SEQ ID NO: 4564920 - DNA, 11 bp, Homo sapiens
ctgtgtactgt

SEQ ID NO: 4564921 - DNA, 16 bp, Homo sapiens
ctgtgtataaaaaaga

SEQ ID NO: 4564922 - DNA, 18 bp, Homo sapiens
ctgtgtataggaatttgt

SEQ ID NO: 4564923 - DNA, 22 bp, Homo sapiens
ctgtgtataggaatttgtattt

SEQ ID NO: 4564924 - DNA, 14 bp, Homo sapiens
ctgtgtatatctct

SEQ ID NO: 4564925 - DNA, 16 bp, Homo sapiens
ctgtgtatatctcttg

SEQ ID NO: 4564926 - DNA, 17 bp, Homo sapiens
ctgtgtatatctcttgg

SEQ ID NO: 4564927 - DNA, 16 bp, Homo sapiens
ctgtgtattaaacctt

SEQ ID NO: 4564928 - DNA, 21 bp, Homo sapiens
ctgtgtatttatttaaaactc

SEQ ID NO: 4564929 - DNA, 14 bp, Homo sapiens
ctgtgtcagagccc

SEQ ID NO: 4564930 - DNA, 15 bp, Homo sapiens
ctgtgtcataaacag

SEQ ID NO: 4564931 - DNA, 15 bp, Homo sapiens
ctgtgtcatttcttc

SEQ ID NO: 4564932 - DNA, 16 bp, Homo sapiens
ctgtgtcatttcttca

SEQ ID NO: 4564933 - DNA, 16 bp, Homo sapiens
ctgtgtcccatgtccc

SEQ ID NO: 4564934 - DNA, 18 bp, Homo sapiens
ctgtgtcctaaggcccat

SEQ ID NO: 4564935 - DNA, 17 bp, Homo sapiens
ctgtgtcctctagttga

SEQ ID NO: 4564936 - DNA, 19 bp, Homo sapiens
ctgtgtccttgcacctgca

SEQ ID NO: 4564937 - DNA, 17 bp, Homo sapiens
ctgtgtgaccctgggca

SEQ ID NO: 4564938 - DNA, 14 bp, Homo sapiens
ctgtgtgctgtttg

SEQ ID NO: 4564939 - DNA, 18 bp, Homo sapiens
ctgtgtgctgtttgaaaa

SEQ ID NO: 4564940 - DNA, 14 bp, Homo sapiens
ctgtgtgtatagct

SEQ ID NO: 4564941 - DNA, 17 bp, Homo sapiens
ctgtgtgtcttctgccc

SEQ ID NO: 4564942 - DNA, 16 bp, Homo sapiens
ctgtgtgtgagtgtga

SEQ ID NO: 4564943 - DNA, 21 bp, Homo sapiens
ctgtgtgtgtgaatgaacact

SEQ ID NO: 4564944 - DNA, 14 bp, Homo sapiens
ctgtgtgtgtgtat

SEQ ID NO: 4564945 - DNA, 16 bp, Homo sapiens
ctgtgtgtgtgtatgt

SEQ ID NO: 4564946 - DNA, 18 bp, Homo sapiens
ctgtgtgtgtgtatgtgg

SEQ ID NO: 4564947 - DNA, 20 bp, Homo sapiens
ctgtgtgtgtgtatgtgggg

SEQ ID NO: 4564948 - DNA, 21 bp, Homo sapiens
ctgtgtgtgtgtatgtggggg

SEQ ID NO: 4564949 - DNA, 20 bp, Homo sapiens
ctgtgtgtttatgtgtgtgt

SEQ ID NO: 4564950 - DNA, 22 bp, Homo sapiens
ctgtgttactaaaaaaaagatg

SEQ ID NO: 4564951 - DNA, 14 bp, Homo sapiens
ctgtgttctgggct

SEQ ID NO: 4564952 - DNA, 18 bp, Homo sapiens
ctgtgttctgggctgggg

SEQ ID NO: 4564953 - DNA, 23 bp, Homo sapiens
ctgtgttgccacagtagaactgt

SEQ ID NO: 4564954 - DNA, 11 bp, Homo sapiens
ctgtgtttcaa

SEQ ID NO: 4564955 - DNA, 23 bp, Homo sapiens
ctgtgtttccatctcaaagaagg

SEQ ID NO: 4564956 - DNA, 20 bp, Homo sapiens
ctgtgttttcagactgcctg

SEQ ID NO: 4564957 - DNA, 22 bp, Homo sapiens
ctgtgttttgaaagaatagaac

SEQ ID NO: 4564958 - DNA, 21 bp, Homo sapiens
ctgtgtttttaaattttgtat

SEQ ID NO: 4564959 - DNA, 15 bp, Homo sapiens
ctgttaaaagatgaa

SEQ ID NO: 4564960 - DNA, 20 bp, Homo sapiens
ctgttaaaagatgaaaatat

SEQ ID NO: 4564961 - DNA, 16 bp, Homo sapiens
ctgttaaaataaagct

SEQ ID NO: 4564962 - DNA, 16 bp, Homo sapiens
ctgttaaatacaggaa

SEQ ID NO: 4564963 - DNA, 22 bp, Homo sapiens
ctgttaatttataatgtatttg

SEQ ID NO: 4564964 - DNA, 18 bp, Homo sapiens
ctgttacacgtgcctgta

SEQ ID NO: 4564965 - DNA, 19 bp, Homo sapiens
ctgttacacgtgcctgtag

SEQ ID NO: 4564966 - DNA, 17 bp, Homo sapiens
ctgttacagactgaaag

SEQ ID NO: 4564967 - DNA, 14 bp, Homo sapiens
ctgttacagtaatg

SEQ ID NO: 4564968 - DNA, 22 bp, Homo sapiens
ctgttacctcaacaagaagaat

SEQ ID NO: 4564969 - DNA, 20 bp, Homo sapiens
ctgttacgtttgaagtctga

SEQ ID NO: 4564970 - DNA, 23 bp, Homo sapiens
ctgttactgcttctctttgtgca

SEQ ID NO: 4564971 - DNA, 19 bp, Homo sapiens
ctgttacttgcttcagtgg

SEQ ID NO: 4564972 - DNA, 23 bp, Homo sapiens
ctgttactttggcaatttcctgg

SEQ ID NO: 4564973 - DNA, 13 bp, Homo sapiens
ctgttagaacact

SEQ ID NO: 4564974 - DNA, 15 bp, Homo sapiens
ctgttagaacactat

SEQ ID NO: 4564975 - DNA, 21 bp, Homo sapiens
ctgttagaacactattttcag

SEQ ID NO: 4564976 - DNA, 22 bp, Homo sapiens
ctgttagaacactattttcaga

SEQ ID NO: 4564977 - DNA, 20 bp, Homo sapiens
ctgttaggggccaataaaat

SEQ ID NO: 4564978 - DNA, 23 bp, Homo sapiens
ctgttaggggccaataaaatgta

SEQ ID NO: 4564979 - DNA, 18 bp, Homo sapiens
ctgttattcaaatttgat

SEQ ID NO: 4564980 - DNA, 19 bp, Homo sapiens
ctgttatttattattaatt

SEQ ID NO: 4564981 - DNA, 22 bp, Homo sapiens
ctgttatttcttccctgctttg

SEQ ID NO: 4564982 - DNA, 14 bp, Homo sapiens
ctgttcacccacag

SEQ ID NO: 4564983 - DNA, 15 bp, Homo sapiens
ctgttcactgcattc

SEQ ID NO: 4564984 - DNA, 18 bp, Homo sapiens
ctgttcagcggagctgac

SEQ ID NO: 4564985 - DNA, 20 bp, Homo sapiens
ctgttcagcggagctgactg

SEQ ID NO: 4564986 - DNA, 22 bp, Homo sapiens
ctgttcagcggagctgactggt

SEQ ID NO: 4564987 - DNA, 14 bp, Homo sapiens
ctgttccagactca

SEQ ID NO: 4564988 - DNA, 16 bp, Homo sapiens
ctgttccaggccctcc

SEQ ID NO: 4564989 - DNA, 20 bp, Homo sapiens
ctgttccagtggtaagctat

SEQ ID NO: 4564990 - DNA, 16 bp, Homo sapiens
ctgttccatgcaactg

SEQ ID NO: 4564991 - DNA, 16 bp, Homo sapiens
ctgttcccaagcaaag

SEQ ID NO: 4564992 - DNA, 14 bp, Homo sapiens
ctgttcccagcccc

SEQ ID NO: 4564993 - DNA, 16 bp, Homo sapiens
ctgttcccagcccctc

SEQ ID NO: 4564994 - DNA, 15 bp, Homo sapiens
ctgttcccccaccct

SEQ ID NO: 4564995 - DNA, 16 bp, Homo sapiens
ctgttccccctgtgca

SEQ ID NO: 4564996 - DNA, 22 bp, Homo sapiens
ctgttcccctagtaagtgcctt

SEQ ID NO: 4564997 - DNA, 22 bp, Homo sapiens
ctgttcctcatgttgctgaatt

SEQ ID NO: 4564998 - DNA, 18 bp, Homo sapiens
ctgttcggaaggggttcc

SEQ ID NO: 4564999 - DNA, 15 bp, Homo sapiens
ctgttctaattaaga

SEQ ID NO: 4565000 - DNA, 12 bp, Homo sapiens
ctgttctagttt

SEQ ID NO: 4565001 - DNA, 19 bp, Homo sapiens
ctgttctcaacatactgta

SEQ ID NO: 4565002 - DNA, 11 bp, Homo sapiens
ctgttctcagc

SEQ ID NO: 4565003 - DNA, 19 bp, Homo sapiens
ctgttctcaggacagcatc

SEQ ID NO: 4565004 - DNA, 21 bp, Homo sapiens
ctgttctcttgggaactgaac

SEQ ID NO: 4565005 - DNA, 15 bp, Homo sapiens
ctgttctgcaactcc

SEQ ID NO: 4565006 - DNA, 18 bp, Homo sapiens
ctgttcttaagacgtgat

SEQ ID NO: 4565007 - DNA, 22 bp, Homo sapiens
ctgttcttgaaagccaagtgtt

SEQ ID NO: 4565008 - DNA, 13 bp, Homo sapiens
ctgttcttggtaa

SEQ ID NO: 4565009 - DNA, 22 bp, Homo sapiens
ctgttcttggtaactgattacc

SEQ ID NO: 4565010 - DNA, 20 bp, Homo sapiens
ctgttgaaaagcacacacaa

SEQ ID NO: 4565011 - DNA, 15 bp, Homo sapiens
ctgttgacatattta

SEQ ID NO: 4565012 - DNA, 16 bp, Homo sapiens
ctgttgacatatttaa

SEQ ID NO: 4565013 - DNA, 17 bp, Homo sapiens
ctgttgacatatttaat

SEQ ID NO: 4565014 - DNA, 19 bp, Homo sapiens
ctgttgacatatttaatgt

SEQ ID NO: 4565015 - DNA, 22 bp, Homo sapiens
ctgttgcaagcccctctttctg

SEQ ID NO: 4565016 - DNA, 20 bp, Homo sapiens
ctgttgcacccagccctggt

SEQ ID NO: 4565017 - DNA, 18 bp, Homo sapiens
ctgttgccgagcccagct

SEQ ID NO: 4565018 - DNA, 17 bp, Homo sapiens
ctgttgcctaattggaa

SEQ ID NO: 4565019 - DNA, 12 bp, Homo sapiens
ctgttgcctcat

SEQ ID NO: 4565020 - DNA, 18 bp, Homo sapiens
ctgttgctttaatatgag

SEQ ID NO: 4565021 - DNA, 22 bp, Homo sapiens
ctgttgctttaatatgagcttc

SEQ ID NO: 4565022 - DNA, 20 bp, Homo sapiens
ctgttggcaggcccactccc

SEQ ID NO: 4565023 - DNA, 18 bp, Homo sapiens
ctgttgggtttttgctgt

SEQ ID NO: 4565024 - DNA, 16 bp, Homo sapiens
ctgttgtaactaggct

SEQ ID NO: 4565025 - DNA, 20 bp, Homo sapiens
ctgtttaaaaaaccacatgg

SEQ ID NO: 4565026 - DNA, 19 bp, Homo sapiens
ctgtttaaagtcacatccc

SEQ ID NO: 4565027 - DNA, 21 bp, Homo sapiens
ctgtttaaagtcacatccctg

SEQ ID NO: 4565028 - DNA, 23 bp, Homo sapiens
ctgtttaaagtcacatccctgta

SEQ ID NO: 4565029 - DNA, 12 bp, Homo sapiens
ctgtttatactt

SEQ ID NO: 4565030 - DNA, 14 bp, Homo sapiens
ctgtttatacttga

SEQ ID NO: 4565031 - DNA, 16 bp, Homo sapiens
ctgtttatacttgaga

SEQ ID NO: 4565032 - DNA, 16 bp, Homo sapiens
ctgtttatatgtgttg

SEQ ID NO: 4565033 - DNA, 14 bp, Homo sapiens
ctgtttatggcctc

SEQ ID NO: 4565034 - DNA, 15 bp, Homo sapiens
ctgtttatggcctca

SEQ ID NO: 4565035 - DNA, 16 bp, Homo sapiens
ctgtttatggcctcag

SEQ ID NO: 4565036 - DNA, 22 bp, Homo sapiens
ctgtttatggcctcagctgcct

SEQ ID NO: 4565037 - DNA, 22 bp, Homo sapiens
ctgtttattaaagtacaaccat

SEQ ID NO: 4565038 - DNA, 16 bp, Homo sapiens
ctgtttattaatctta

SEQ ID NO: 4565039 - DNA, 13 bp, Homo sapiens
ctgtttcaaatgt

SEQ ID NO: 4565040 - DNA, 13 bp, Homo sapiens
ctgtttcaagccc

SEQ ID NO: 4565041 - DNA, 15 bp, Homo sapiens
ctgtttcaagccctc

SEQ ID NO: 4565042 - DNA, 16 bp, Homo sapiens
ctgtttcctagctgtg

SEQ ID NO: 4565043 - DNA, 22 bp, Homo sapiens
ctgtttctatcctgtttaataa

SEQ ID NO: 4565044 - DNA, 19 bp, Homo sapiens
ctgtttgacacctcttttt

SEQ ID NO: 4565045 - DNA, 12 bp, Homo sapiens
ctgtttgattct

SEQ ID NO: 4565046 - DNA, 22 bp, Homo sapiens
ctgtttgcatttgatacatttt

SEQ ID NO: 4565047 - DNA, 11 bp, Homo sapiens
ctgtttggaaa

SEQ ID NO: 4565048 - DNA, 17 bp, Homo sapiens
ctgtttggaaaagacag

SEQ ID NO: 4565049 - DNA, 20 bp, Homo sapiens
ctgtttgtttacaaaatcag

SEQ ID NO: 4565050 - DNA, 16 bp, Homo sapiens
ctgttttagaaattgg

SEQ ID NO: 4565051 - DNA, 14 bp, Homo sapiens
ctgttttatatatt

SEQ ID NO: 4565052 - DNA, 12 bp, Homo sapiens
ctgttttccctc

SEQ ID NO: 4565053 - DNA, 17 bp, Homo sapiens
ctgttttccctctgctg

SEQ ID NO: 4565054 - DNA, 13 bp, Homo sapiens
ctgttttctgtaa

SEQ ID NO: 4565055 - DNA, 19 bp, Homo sapiens
ctgttttctgtaaattcat

SEQ ID NO: 4565056 - DNA, 14 bp, Homo sapiens
ctgttttgcctccc

SEQ ID NO: 4565057 - DNA, 18 bp, Homo sapiens
ctgttttgtggtttggaa

SEQ ID NO: 4565058 - DNA, 14 bp, Homo sapiens
ctgtttttactctg

SEQ ID NO: 4565059 - DNA, 14 bp, Homo sapiens
cttaaaaaactgca

SEQ ID NO: 4565060 - DNA, 16 bp, Homo sapiens
cttaaaaaataataca

SEQ ID NO: 4565061 - DNA, 16 bp, Homo sapiens
cttaaaaaatgtgaaa

SEQ ID NO: 4565062 - DNA, 13 bp, Homo sapiens
cttaaaaaggaac

SEQ ID NO: 4565063 - DNA, 15 bp, Homo sapiens
cttaaaaatttatta

SEQ ID NO: 4565064 - DNA, 15 bp, Homo sapiens
cttaaaacacatgat

SEQ ID NO: 4565065 - DNA, 17 bp, Homo sapiens
cttaaaacacatgatac

SEQ ID NO: 4565066 - DNA, 13 bp, Homo sapiens
cttaaaaccaaag

SEQ ID NO: 4565067 - DNA, 21 bp, Homo sapiens
cttaaaagaaatcttgcttca

SEQ ID NO: 4565068 - DNA, 13 bp, Homo sapiens
cttaaaagcattt

SEQ ID NO: 4565069 - DNA, 22 bp, Homo sapiens
cttaaaagcatttttattatat

SEQ ID NO: 4565070 - DNA, 21 bp, Homo sapiens
cttaaaagctatcttcatgta

SEQ ID NO: 4565071 - DNA, 24 bp, Homo sapiens
cttaaaagctatcttcatgtaaat

SEQ ID NO: 4565072 - DNA, 21 bp, Homo sapiens
cttaaaatatatagtgaaaaa

SEQ ID NO: 4565073 - DNA, 21 bp, Homo sapiens
cttaaaatatgtgaagttttc

SEQ ID NO: 4565074 - DNA, 14 bp, Homo sapiens
cttaaaatgcaata

SEQ ID NO: 4565075 - DNA, 21 bp, Homo sapiens
cttaaaatgcaatatttgtaa

SEQ ID NO: 4565076 - DNA, 19 bp, Homo sapiens
cttaaaattgatattatat

SEQ ID NO: 4565077 - DNA, 19 bp, Homo sapiens
cttaaacaaaaattaaaat

SEQ ID NO: 4565078 - DNA, 16 bp, Homo sapiens
cttaaacacaggctgt

SEQ ID NO: 4565079 - DNA, 18 bp, Homo sapiens
cttaaacccatacaatgt

SEQ ID NO: 4565080 - DNA, 19 bp, Homo sapiens
cttaaacccatacaatgta

SEQ ID NO: 4565081 - DNA, 15 bp, Homo sapiens
cttaaactaaatgtg

SEQ ID NO: 4565082 - DNA, 20 bp, Homo sapiens
cttaaactctggacactcta

SEQ ID NO: 4565083 - DNA, 19 bp, Homo sapiens
cttaaactgaaagctttaa

SEQ ID NO: 4565084 - DNA, 13 bp, Homo sapiens
cttaaactttgtc

SEQ ID NO: 4565085 - DNA, 21 bp, Homo sapiens
cttaaactttgtcacttctgc

SEQ ID NO: 4565086 - DNA, 22 bp, Homo sapiens
cttaaagcagaagccccacagc

SEQ ID NO: 4565087 - DNA, 14 bp, Homo sapiens
cttaaagcttgatt

SEQ ID NO: 4565088 - DNA, 20 bp, Homo sapiens
cttaaaggccgtcatttcat

SEQ ID NO: 4565089 - DNA, 22 bp, Homo sapiens
cttaaagggcccaatgaattat

SEQ ID NO: 4565090 - DNA, 18 bp, Homo sapiens
cttaaaggtgtcttcctc

SEQ ID NO: 4565091 - DNA, 17 bp, Homo sapiens
cttaaataagaaacttt

SEQ ID NO: 4565092 - DNA, 19 bp, Homo sapiens
cttaaatgagttacttaga

SEQ ID NO: 4565093 - DNA, 17 bp, Homo sapiens
cttaaattaaacaattt

SEQ ID NO: 4565094 - DNA, 22 bp, Homo sapiens
cttaaattaaacaatttatttt

SEQ ID NO: 4565095 - DNA, 16 bp, Homo sapiens
cttaaattcatttcta

SEQ ID NO: 4565096 - DNA, 18 bp, Homo sapiens
cttaaattcatttctaga

SEQ ID NO: 4565097 - DNA, 22 bp, Homo sapiens
cttaaattcatttctagactca

SEQ ID NO: 4565098 - DNA, 20 bp, Homo sapiens
cttaaattcctcaacagtgt

SEQ ID NO: 4565099 - DNA, 22 bp, Homo sapiens
cttaaattcctcaacagtgttt

SEQ ID NO: 4565100 - DNA, 16 bp, Homo sapiens
cttaaattttaactaa

SEQ ID NO: 4565101 - DNA, 23 bp, Homo sapiens
cttaaattttaactaaattttaa

SEQ ID NO: 4565102 - DNA, 20 bp, Homo sapiens
cttaaattttcttcctttga

SEQ ID NO: 4565103 - DNA, 16 bp, Homo sapiens
cttaacagttgtattt

SEQ ID NO: 4565104 - DNA, 15 bp, Homo sapiens
cttaacatttcatgt

SEQ ID NO: 4565105 - DNA, 22 bp, Homo sapiens
cttaacctcagggagtgcagac

SEQ ID NO: 4565106 - DNA, 12 bp, Homo sapiens
cttaaccttaaa

SEQ ID NO: 4565107 - DNA, 15 bp, Homo sapiens
cttaacctttgctat

SEQ ID NO: 4565108 - DNA, 23 bp, Homo sapiens
cttaacgttctataaatgaatgt

SEQ ID NO: 4565109 - DNA, 12 bp, Homo sapiens
cttaactatgag

SEQ ID NO: 4565110 - DNA, 19 bp, Homo sapiens
cttaactgcatttttagac

SEQ ID NO: 4565111 - DNA, 13 bp, Homo sapiens
cttaactgtattt

SEQ ID NO: 4565112 - DNA, 18 bp, Homo sapiens
cttaactgtatttcagta

SEQ ID NO: 4565113 - DNA, 20 bp, Homo sapiens
cttaacttccatgttctggg

SEQ ID NO: 4565114 - DNA, 22 bp, Homo sapiens
cttaacttcttgcttctttcta

SEQ ID NO: 4565115 - DNA, 14 bp, Homo sapiens
cttaagaactgtgt

SEQ ID NO: 4565116 - DNA, 16 bp, Homo sapiens
cttaagaattcaaatt

SEQ ID NO: 4565117 - DNA, 19 bp, Homo sapiens
cttaagatggaaatacagt

SEQ ID NO: 4565118 - DNA, 21 bp, Homo sapiens
cttaagcagtaatctgtcagt

SEQ ID NO: 4565119 - DNA, 21 bp, Homo sapiens
cttaagcctggaaggtggaag

SEQ ID NO: 4565120 - DNA, 20 bp, Homo sapiens
cttaagcctgtgtataaaaa

SEQ ID NO: 4565121 - DNA, 19 bp, Homo sapiens
cttaaggagaggagaaact

SEQ ID NO: 4565122 - DNA, 21 bp, Homo sapiens
cttaaggggctgggatgcttt

SEQ ID NO: 4565123 - DNA, 16 bp, Homo sapiens
cttaagtataaacctt

SEQ ID NO: 4565124 - DNA, 21 bp, Homo sapiens
cttaagtatttacagggtggc

SEQ ID NO: 4565125 - DNA, 23 bp, Homo sapiens
cttaagtccagaagcctcctgtt

SEQ ID NO: 4565126 - DNA, 17 bp, Homo sapiens
cttaagtgtaaatgaag

SEQ ID NO: 4565127 - DNA, 22 bp, Homo sapiens
cttaagtgttcattttaagtaa

SEQ ID NO: 4565128 - DNA, 19 bp, Homo sapiens
cttaataactgtgtactgt

SEQ ID NO: 4565129 - DNA, 16 bp, Homo sapiens
cttaatactaccttga

SEQ ID NO: 4565130 - DNA, 14 bp, Homo sapiens
cttaatagaggagc

SEQ ID NO: 4565131 - DNA, 13 bp, Homo sapiens
cttaatagcaaca

SEQ ID NO: 4565132 - DNA, 21 bp, Homo sapiens
cttaatataaattcactttca

SEQ ID NO: 4565133 - DNA, 14 bp, Homo sapiens
cttaatatatttga

SEQ ID NO: 4565134 - DNA, 21 bp, Homo sapiens
cttaatcagatagatattcct

SEQ ID NO: 4565135 - DNA, 20 bp, Homo sapiens
cttaatcattttcattccta

SEQ ID NO: 4565136 - DNA, 19 bp, Homo sapiens
cttaatggaaggttggatc

SEQ ID NO: 4565137 - DNA, 21 bp, Homo sapiens
cttaatgtatgttaccaaaaa

SEQ ID NO: 4565138 - DNA, 16 bp, Homo sapiens
cttaattaaaagaata

SEQ ID NO: 4565139 - DNA, 20 bp, Homo sapiens
cttaattaaaagaatatttt

SEQ ID NO: 4565140 - DNA, 14 bp, Homo sapiens
cttaattacttaaa

SEQ ID NO: 4565141 - DNA, 17 bp, Homo sapiens
cttaattattataaaaa

SEQ ID NO: 4565142 - DNA, 16 bp, Homo sapiens
cttaattgtgtttatt

SEQ ID NO: 4565143 - DNA, 16 bp, Homo sapiens
cttaattgttctgctt

SEQ ID NO: 4565144 - DNA, 21 bp, Homo sapiens
cttaattgttctgctttttct

SEQ ID NO: 4565145 - DNA, 17 bp, Homo sapiens
cttaatttaattgcttt

SEQ ID NO: 4565146 - DNA, 13 bp, Homo sapiens
cttaatttactta

SEQ ID NO: 4565147 - DNA, 23 bp, Homo sapiens
cttaatttatttcttaacctttg

SEQ ID NO: 4565148 - DNA, 12 bp, Homo sapiens
cttaatttcctt

SEQ ID NO: 4565149 - DNA, 15 bp, Homo sapiens
cttacaaaaacactt

SEQ ID NO: 4565150 - DNA, 16 bp, Homo sapiens
cttacaagaaaggcct

SEQ ID NO: 4565151 - DNA, 18 bp, Homo sapiens
cttacaagcttaaagctt

SEQ ID NO: 4565152 - DNA, 20 bp, Homo sapiens
cttacaagcttaaagcttga

SEQ ID NO: 4565153 - DNA, 18 bp, Homo sapiens
cttacaataaaccctcct

SEQ ID NO: 4565154 - DNA, 21 bp, Homo sapiens
cttacaataaaccctccttgg

SEQ ID NO: 4565155 - DNA, 22 bp, Homo sapiens
cttacagccctaagtggctgcc

SEQ ID NO: 4565156 - DNA, 23 bp, Homo sapiens
cttacagccctaagtggctgcct

SEQ ID NO: 4565157 - DNA, 16 bp, Homo sapiens
cttacagtaggagccc

SEQ ID NO: 4565158 - DNA, 23 bp, Homo sapiens
cttacagtaggagcccagctctg

SEQ ID NO: 4565159 - DNA, 21 bp, Homo sapiens
cttacatctccttgatcatgt

SEQ ID NO: 4565160 - DNA, 15 bp, Homo sapiens
cttacattcagaaat

SEQ ID NO: 4565161 - DNA, 20 bp, Homo sapiens
cttaccaggcaccaaaagaa

SEQ ID NO: 4565162 - DNA, 21 bp, Homo sapiens
cttacccaggtgggtcccggc

SEQ ID NO: 4565163 - DNA, 14 bp, Homo sapiens
cttacctcctgccc

SEQ ID NO: 4565164 - DNA, 16 bp, Homo sapiens
cttacctcctgcccag

SEQ ID NO: 4565165 - DNA, 18 bp, Homo sapiens
cttacctcctgcccagga

SEQ ID NO: 4565166 - DNA, 20 bp, Homo sapiens
cttacctcctgcccaggaga

SEQ ID NO: 4565167 - DNA, 19 bp, Homo sapiens
cttacctttttatttgcat

SEQ ID NO: 4565168 - DNA, 20 bp, Homo sapiens
cttacctttttatttgcatg

SEQ ID NO: 4565169 - DNA, 16 bp, Homo sapiens
cttacgaatattttca

SEQ ID NO: 4565170 - DNA, 23 bp, Homo sapiens
cttacgtgttagacaagaactat

SEQ ID NO: 4565171 - DNA, 16 bp, Homo sapiens
cttacgtttttctggt

SEQ ID NO: 4565172 - DNA, 17 bp, Homo sapiens
cttacgtttttctggtg

SEQ ID NO: 4565173 - DNA, 15 bp, Homo sapiens
cttactcttcttgaa

SEQ ID NO: 4565174 - DNA, 11 bp, Homo sapiens
cttactgagct

SEQ ID NO: 4565175 - DNA, 12 bp, Homo sapiens
cttactgatata

SEQ ID NO: 4565176 - DNA, 19 bp, Homo sapiens
cttactgatatattttaca

SEQ ID NO: 4565177 - DNA, 16 bp, Homo sapiens
cttactgtcttcttca

SEQ ID NO: 4565178 - DNA, 14 bp, Homo sapiens
cttacttctcacta

SEQ ID NO: 4565179 - DNA, 19 bp, Homo sapiens
cttactttacctctctgtc

SEQ ID NO: 4565180 - DNA, 14 bp, Homo sapiens
cttactttcctgtg

SEQ ID NO: 4565181 - DNA, 20 bp, Homo sapiens
cttacttttattattttaat

SEQ ID NO: 4565182 - DNA, 16 bp, Homo sapiens
cttagaagaatattgt

SEQ ID NO: 4565183 - DNA, 21 bp, Homo sapiens
cttagaagaatattgtattgt

SEQ ID NO: 4565184 - DNA, 21 bp, Homo sapiens
cttagaagtggaccaggacag

SEQ ID NO: 4565185 - DNA, 14 bp, Homo sapiens
cttagaatttgttt

SEQ ID NO: 4565186 - DNA, 15 bp, Homo sapiens
cttagacctgccagc

SEQ ID NO: 4565187 - DNA, 14 bp, Homo sapiens
cttagagtttctgt

SEQ ID NO: 4565188 - DNA, 16 bp, Homo sapiens
cttagagttttattcc

SEQ ID NO: 4565189 - DNA, 17 bp, Homo sapiens
cttagagttttattcct

SEQ ID NO: 4565190 - DNA, 22 bp, Homo sapiens
cttagataacttcttgaaaaag

SEQ ID NO: 4565191 - DNA, 17 bp, Homo sapiens
cttagataatatttctg

SEQ ID NO: 4565192 - DNA, 19 bp, Homo sapiens
cttagataatatttctgaa

SEQ ID NO: 4565193 - DNA, 14 bp, Homo sapiens
cttagatctctcct

SEQ ID NO: 4565194 - DNA, 16 bp, Homo sapiens
cttagattcttaattc

SEQ ID NO: 4565195 - DNA, 15 bp, Homo sapiens
cttagcaccttcagg

SEQ ID NO: 4565196 - DNA, 20 bp, Homo sapiens
cttagcagccctggatggtg

SEQ ID NO: 4565197 - DNA, 21 bp, Homo sapiens
cttagcccaagaggtctgagc

SEQ ID NO: 4565198 - DNA, 22 bp, Homo sapiens
cttagcccaagaggtctgagcc

SEQ ID NO: 4565199 - DNA, 15 bp, Homo sapiens
cttagcctccctgaa

SEQ ID NO: 4565200 - DNA, 16 bp, Homo sapiens
cttagcctctcccacc

SEQ ID NO: 4565201 - DNA, 18 bp, Homo sapiens
cttagcctctcccacccg

SEQ ID NO: 4565202 - DNA, 18 bp, Homo sapiens
cttagcctggatttcctt

SEQ ID NO: 4565203 - DNA, 20 bp, Homo sapiens
cttagcgtcaagacatttgc

SEQ ID NO: 4565204 - DNA, 16 bp, Homo sapiens
cttagcgttctggact

SEQ ID NO: 4565205 - DNA, 23 bp, Homo sapiens
cttagcgttctggactctgcccc

SEQ ID NO: 4565206 - DNA, 16 bp, Homo sapiens
cttagctatccttggc

SEQ ID NO: 4565207 - DNA, 16 bp, Homo sapiens
cttagcttcaggaacc

SEQ ID NO: 4565208 - DNA, 14 bp, Homo sapiens
cttagcttttgatg

SEQ ID NO: 4565209 - DNA, 20 bp, Homo sapiens
cttaggatggggctcccagc

SEQ ID NO: 4565210 - DNA, 22 bp, Homo sapiens
cttaggatggggctcccagctc

SEQ ID NO: 4565211 - DNA, 17 bp, Homo sapiens
cttagggaagctggcct

SEQ ID NO: 4565212 - DNA, 20 bp, Homo sapiens
cttagggaagctggcctgag

SEQ ID NO: 4565213 - DNA, 22 bp, Homo sapiens
cttaggtgagacagttgcccga

SEQ ID NO: 4565214 - DNA, 20 bp, Homo sapiens
cttaggtggctctgggaatg

SEQ ID NO: 4565215 - DNA, 15 bp, Homo sapiens
cttagtcccaagcta

SEQ ID NO: 4565216 - DNA, 11 bp, Homo sapiens
cttagtgttca

SEQ ID NO: 4565217 - DNA, 14 bp, Homo sapiens
cttagttctgtata

SEQ ID NO: 4565218 - DNA, 22 bp, Homo sapiens
cttagttgatattcaaggcttt

SEQ ID NO: 4565219 - DNA, 23 bp, Homo sapiens
cttagttgatattcaaggcttta

SEQ ID NO: 4565220 - DNA, 14 bp, Homo sapiens
cttataataaagga

SEQ ID NO: 4565221 - DNA, 22 bp, Homo sapiens
cttataatctcctctaaaacaa

SEQ ID NO: 4565222 - DNA, 13 bp, Homo sapiens
cttataatgatta

SEQ ID NO: 4565223 - DNA, 18 bp, Homo sapiens
cttatactgtacaataaa

SEQ ID NO: 4565224 - DNA, 19 bp, Homo sapiens
cttatactgtacaataaaa

SEQ ID NO: 4565225 - DNA, 20 bp, Homo sapiens
cttatattttataatcagaa

SEQ ID NO: 4565226 - DNA, 16 bp, Homo sapiens
cttatattttatgaac

SEQ ID NO: 4565227 - DNA, 17 bp, Homo sapiens
cttatattttatgaaca

SEQ ID NO: 4565228 - DNA, 18 bp, Homo sapiens
cttatattttatgaacat

SEQ ID NO: 4565229 - DNA, 22 bp, Homo sapiens
cttatattttatgaacattgta

SEQ ID NO: 4565230 - DNA, 23 bp, Homo sapiens
cttatattttatgaacattgtac

SEQ ID NO: 4565231 - DNA, 17 bp, Homo sapiens
cttatcctgcattgtta

SEQ ID NO: 4565232 - DNA, 18 bp, Homo sapiens
cttatctctcaaaacaat

SEQ ID NO: 4565233 - DNA, 13 bp, Homo sapiens
cttatctctctgt

SEQ ID NO: 4565234 - DNA, 15 bp, Homo sapiens
cttatcttctggatt

SEQ ID NO: 4565235 - DNA, 15 bp, Homo sapiens
cttatgaaaattata

SEQ ID NO: 4565236 - DNA, 15 bp, Homo sapiens
cttatgaactacagt

SEQ ID NO: 4565237 - DNA, 15 bp, Homo sapiens
cttatgaggagggga

SEQ ID NO: 4565238 - DNA, 21 bp, Homo sapiens
cttatggaattgatttgcatt

SEQ ID NO: 4565239 - DNA, 23 bp, Homo sapiens
cttatggaattgatttgcattga

SEQ ID NO: 4565240 - DNA, 21 bp, Homo sapiens
cttatgtatcagtgtcctttc

SEQ ID NO: 4565241 - DNA, 18 bp, Homo sapiens
cttatgttgaaaaaattt

SEQ ID NO: 4565242 - DNA, 16 bp, Homo sapiens
cttattaaaaaatttg

SEQ ID NO: 4565243 - DNA, 17 bp, Homo sapiens
cttattaaaaaatttgt

SEQ ID NO: 4565244 - DNA, 18 bp, Homo sapiens
cttattacctcaggtgcc

SEQ ID NO: 4565245 - DNA, 20 bp, Homo sapiens
cttattagagtgtctttcca

SEQ ID NO: 4565246 - DNA, 16 bp, Homo sapiens
cttattcaaagagaaa

SEQ ID NO: 4565247 - DNA, 15 bp, Homo sapiens
cttattcaaagatga

SEQ ID NO: 4565248 - DNA, 22 bp, Homo sapiens
cttattcccccaaactttttgt

SEQ ID NO: 4565249 - DNA, 14 bp, Homo sapiens
cttattcttaactt

SEQ ID NO: 4565250 - DNA, 15 bp, Homo sapiens
cttattgcttgcttt

SEQ ID NO: 4565251 - DNA, 18 bp, Homo sapiens
cttattggaactctgctt

SEQ ID NO: 4565252 - DNA, 18 bp, Homo sapiens
cttattggcagctctact

SEQ ID NO: 4565253 - DNA, 18 bp, Homo sapiens
cttattgtaaattttaga

SEQ ID NO: 4565254 - DNA, 15 bp, Homo sapiens
cttatttaatctttt

SEQ ID NO: 4565255 - DNA, 15 bp, Homo sapiens
cttatttaccctttt

SEQ ID NO: 4565256 - DNA, 18 bp, Homo sapiens
cttatttacccttttccc

SEQ ID NO: 4565257 - DNA, 19 bp, Homo sapiens
cttatttacctagtgcaaa

SEQ ID NO: 4565258 - DNA, 13 bp, Homo sapiens
cttatttctttcc

SEQ ID NO: 4565259 - DNA, 14 bp, Homo sapiens
cttatttgccttct

SEQ ID NO: 4565260 - DNA, 21 bp, Homo sapiens
cttatttgccttctactcccc

SEQ ID NO: 4565261 - DNA, 23 bp, Homo sapiens
cttatttgctgccacacctgagc

SEQ ID NO: 4565262 - DNA, 16 bp, Homo sapiens
cttatttgtcaaaata

SEQ ID NO: 4565263 - DNA, 13 bp, Homo sapiens
cttatttgtctgt

SEQ ID NO: 4565264 - DNA, 22 bp, Homo sapiens
cttatttgtctgtaaaaaatgg

SEQ ID NO: 4565265 - DNA, 14 bp, Homo sapiens
cttattttagtata

SEQ ID NO: 4565266 - DNA, 22 bp, Homo sapiens
cttatttttagatggttacact

SEQ ID NO: 4565267 - DNA, 14 bp, Homo sapiens
cttatttttcctgt

SEQ ID NO: 4565268 - DNA, 22 bp, Homo sapiens
cttcaaacctaaaaatcaagtt

SEQ ID NO: 4565269 - DNA, 16 bp, Homo sapiens
cttcaacttttctctt

SEQ ID NO: 4565270 - DNA, 18 bp, Homo sapiens
cttcaacttttctcttta

SEQ ID NO: 4565271 - DNA, 23 bp, Homo sapiens
cttcaaggactgtttcagtgtga

SEQ ID NO: 4565272 - DNA, 13 bp, Homo sapiens
cttcaagtgccaa

SEQ ID NO: 4565273 - DNA, 14 bp, Homo sapiens
cttcaataaaccac

SEQ ID NO: 4565274 - DNA, 18 bp, Homo sapiens
cttcaatataagaagcaa

SEQ ID NO: 4565275 - DNA, 16 bp, Homo sapiens
cttcaatttcaaactt

SEQ ID NO: 4565276 - DNA, 21 bp, Homo sapiens
cttcaatttcaaacttttgaa

SEQ ID NO: 4565277 - DNA, 16 bp, Homo sapiens
cttcacaaatgtcatt

SEQ ID NO: 4565278 - DNA, 18 bp, Homo sapiens
cttcacactgcaagagcc

SEQ ID NO: 4565279 - DNA, 14 bp, Homo sapiens
cttcacaggcactc

SEQ ID NO: 4565280 - DNA, 15 bp, Homo sapiens
cttcacaggttttat

SEQ ID NO: 4565281 - DNA, 16 bp, Homo sapiens
cttcacatgtttaact

SEQ ID NO: 4565282 - DNA, 17 bp, Homo sapiens
cttcaccaccccctgtc

SEQ ID NO: 4565283 - DNA, 20 bp, Homo sapiens
cttcaccaccccctgtccca

SEQ ID NO: 4565284 - DNA, 23 bp, Homo sapiens
cttcacccaccaggccagctcag

SEQ ID NO: 4565285 - DNA, 15 bp, Homo sapiens
cttcacccccaactt

SEQ ID NO: 4565286 - DNA, 14 bp, Homo sapiens
cttcacgattctta

SEQ ID NO: 4565287 - DNA, 23 bp, Homo sapiens
cttcactcatgcaaactgcttta

SEQ ID NO: 4565288 - DNA, 14 bp, Homo sapiens
cttcactgggccag

SEQ ID NO: 4565289 - DNA, 15 bp, Homo sapiens
cttcactgggccagt

SEQ ID NO: 4565290 - DNA, 17 bp, Homo sapiens
cttcactgggccagtca

SEQ ID NO: 4565291 - DNA, 18 bp, Homo sapiens
cttcactgggccagtcaa

SEQ ID NO: 4565292 - DNA, 22 bp, Homo sapiens
cttcactggtgagacaatgaaa

SEQ ID NO: 4565293 - DNA, 14 bp, Homo sapiens
cttcacttctccca

SEQ ID NO: 4565294 - DNA, 15 bp, Homo sapiens
cttcactttcttcaa

SEQ ID NO: 4565295 - DNA, 14 bp, Homo sapiens
cttcagaacagagg

SEQ ID NO: 4565296 - DNA, 19 bp, Homo sapiens
cttcagaacagaggcattt

SEQ ID NO: 4565297 - DNA, 15 bp, Homo sapiens
cttcagaactgccct

SEQ ID NO: 4565298 - DNA, 23 bp, Homo sapiens
cttcagaactgcccttgctgccc

SEQ ID NO: 4565299 - DNA, 11 bp, Homo sapiens
cttcagacata

SEQ ID NO: 4565300 - DNA, 14 bp, Homo sapiens
cttcagactctcag

SEQ ID NO: 4565301 - DNA, 14 bp, Homo sapiens
cttcagactttgct

SEQ ID NO: 4565302 - DNA, 18 bp, Homo sapiens
cttcagactttgcttccc

SEQ ID NO: 4565303 - DNA, 19 bp, Homo sapiens
cttcagactttgcttccca

SEQ ID NO: 4565304 - DNA, 13 bp, Homo sapiens
cttcagcaaccct

SEQ ID NO: 4565305 - DNA, 21 bp, Homo sapiens
cttcagcaaccctacagtata

SEQ ID NO: 4565306 - DNA, 15 bp, Homo sapiens
cttcagccctcaccc

SEQ ID NO: 4565307 - DNA, 19 bp, Homo sapiens
cttcagctctggggcagag

SEQ ID NO: 4565308 - DNA, 16 bp, Homo sapiens
cttcagctttgtgtat

SEQ ID NO: 4565309 - DNA, 19 bp, Homo sapiens
cttcagggctgagttctgg

SEQ ID NO: 4565310 - DNA, 18 bp, Homo sapiens
cttcaggggaagagaaga

SEQ ID NO: 4565311 - DNA, 22 bp, Homo sapiens
cttcaggggaagagaagacaaa

SEQ ID NO: 4565312 - DNA, 23 bp, Homo sapiens
cttcaggtaaagggcaaataatg

SEQ ID NO: 4565313 - DNA, 19 bp, Homo sapiens
cttcaggtggagagcacta

SEQ ID NO: 4565314 - DNA, 18 bp, Homo sapiens
cttcaggttggtttaatc

SEQ ID NO: 4565315 - DNA, 15 bp, Homo sapiens
cttcagtcattaaat

SEQ ID NO: 4565316 - DNA, 15 bp, Homo sapiens
cttcagtgggagaaa

SEQ ID NO: 4565317 - DNA, 17 bp, Homo sapiens
cttcagtttcacagaaa

SEQ ID NO: 4565318 - DNA, 12 bp, Homo sapiens
cttcataatcca

SEQ ID NO: 4565319 - DNA, 16 bp, Homo sapiens
cttcatatcatccaca

SEQ ID NO: 4565320 - DNA, 17 bp, Homo sapiens
cttcatatcatccacac

SEQ ID NO: 4565321 - DNA, 23 bp, Homo sapiens
cttcatatgaaaggtgccatgga

SEQ ID NO: 4565322 - DNA, 16 bp, Homo sapiens
cttcatattaatataa

SEQ ID NO: 4565323 - DNA, 22 bp, Homo sapiens
cttcatattaatataagtttct

SEQ ID NO: 4565324 - DNA, 14 bp, Homo sapiens
cttcatccatagac

SEQ ID NO: 4565325 - DNA, 20 bp, Homo sapiens
cttcatccatagacacagta

SEQ ID NO: 4565326 - DNA, 21 bp, Homo sapiens
cttcatccatagacacagtat

SEQ ID NO: 4565327 - DNA, 17 bp, Homo sapiens
cttcatccgttgtgact

SEQ ID NO: 4565328 - DNA, 22 bp, Homo sapiens
cttcatcgacttagcctgagtc

SEQ ID NO: 4565329 - DNA, 16 bp, Homo sapiens
cttcatctaatatgat

SEQ ID NO: 4565330 - DNA, 23 bp, Homo sapiens
cttcatctggcaacatctttatc

SEQ ID NO: 4565331 - DNA, 13 bp, Homo sapiens
cttcatctgggac

SEQ ID NO: 4565332 - DNA, 11 bp, Homo sapiens
cttcatgaaat

SEQ ID NO: 4565333 - DNA, 13 bp, Homo sapiens
cttcatgaaatgt

SEQ ID NO: 4565334 - DNA, 15 bp, Homo sapiens
cttcatgcccttctg

SEQ ID NO: 4565335 - DNA, 19 bp, Homo sapiens
cttcatgcttgacatacct

SEQ ID NO: 4565336 - DNA, 21 bp, Homo sapiens
cttcatggcagaaggcaaacc

SEQ ID NO: 4565337 - DNA, 13 bp, Homo sapiens
cttcatgtaaatt

SEQ ID NO: 4565338 - DNA, 21 bp, Homo sapiens
cttcatgtaattttattttaa

SEQ ID NO: 4565339 - DNA, 16 bp, Homo sapiens
cttcatgtggcttccc

SEQ ID NO: 4565340 - DNA, 14 bp, Homo sapiens
cttcattcagatct

SEQ ID NO: 4565341 - DNA, 12 bp, Homo sapiens
cttcattctcgt

SEQ ID NO: 4565342 - DNA, 15 bp, Homo sapiens
cttcatttaactctt

SEQ ID NO: 4565343 - DNA, 19 bp, Homo sapiens
cttcattttatatttaaaa

SEQ ID NO: 4565344 - DNA, 13 bp, Homo sapiens
cttcattttgtat

SEQ ID NO: 4565345 - DNA, 16 bp, Homo sapiens
cttcattttttaatgt

SEQ ID NO: 4565346 - DNA, 19 bp, Homo sapiens
cttcattttttaatgtgct

SEQ ID NO: 4565347 - DNA, 23 bp, Homo sapiens
cttcattttttaatgtgctctgt

SEQ ID NO: 4565348 - DNA, 24 bp, Homo sapiens
cttcattttttaatgtgctctgta

SEQ ID NO: 4565349 - DNA, 17 bp, Homo sapiens
cttccaaagactaagac

SEQ ID NO: 4565350 - DNA, 20 bp, Homo sapiens
cttccaaatcccctaagcag

SEQ ID NO: 4565351 - DNA, 18 bp, Homo sapiens
cttccaaatcctggaagg

SEQ ID NO: 4565352 - DNA, 23 bp, Homo sapiens
cttccaaatcctggaaggacaca

SEQ ID NO: 4565353 - DNA, 15 bp, Homo sapiens
cttccaacttcctgt

SEQ ID NO: 4565354 - DNA, 16 bp, Homo sapiens
cttccaagctccaaat

SEQ ID NO: 4565355 - DNA, 14 bp, Homo sapiens
cttccacagctggc

SEQ ID NO: 4565356 - DNA, 11 bp, Homo sapiens
cttccacagtg

SEQ ID NO: 4565357 - DNA, 14 bp, Homo sapiens
cttccacccagtgc

SEQ ID NO: 4565358 - DNA, 18 bp, Homo sapiens
cttccactgagggcagtc

SEQ ID NO: 4565359 - DNA, 18 bp, Homo sapiens
cttccactgttaaaataa

SEQ ID NO: 4565360 - DNA, 23 bp, Homo sapiens
cttccagagcccaaggtcaggga

SEQ ID NO: 4565361 - DNA, 18 bp, Homo sapiens
cttccagatgcccgagca

SEQ ID NO: 4565362 - DNA, 22 bp, Homo sapiens
cttccaggaaactccacatctg

SEQ ID NO: 4565363 - DNA, 22 bp, Homo sapiens
cttccaggatggatgcatcaca

SEQ ID NO: 4565364 - DNA, 19 bp, Homo sapiens
cttccagggctcttccaga

SEQ ID NO: 4565365 - DNA, 19 bp, Homo sapiens
cttccaggggaacctgcca

SEQ ID NO: 4565366 - DNA, 15 bp, Homo sapiens
cttccaggtctgcct

SEQ ID NO: 4565367 - DNA, 18 bp, Homo sapiens
cttccaggtctgcctggt

SEQ ID NO: 4565368 - DNA, 20 bp, Homo sapiens
cttccaggtgttactgtaat

SEQ ID NO: 4565369 - DNA, 12 bp, Homo sapiens
cttccagtctgg

SEQ ID NO: 4565370 - DNA, 19 bp, Homo sapiens
cttccagtctggagagctg

SEQ ID NO: 4565371 - DNA, 22 bp, Homo sapiens
cttccagtcttcctgacacttt

SEQ ID NO: 4565372 - DNA, 22 bp, Homo sapiens
cttccagtggctcgctccctgt

SEQ ID NO: 4565373 - DNA, 12 bp, Homo sapiens
cttccagttttg

SEQ ID NO: 4565374 - DNA, 17 bp, Homo sapiens
cttccatacacagagga

SEQ ID NO: 4565375 - DNA, 23 bp, Homo sapiens
cttccatcatcactgtaaagaca

SEQ ID NO: 4565376 - DNA, 15 bp, Homo sapiens
cttccatccctaccc

SEQ ID NO: 4565377 - DNA, 16 bp, Homo sapiens
cttccatccctacccc

SEQ ID NO: 4565378 - DNA, 17 bp, Homo sapiens
cttccatccctaccccc

SEQ ID NO: 4565379 - DNA, 19 bp, Homo sapiens
cttccatccctacccccta

SEQ ID NO: 4565380 - DNA, 16 bp, Homo sapiens
cttccatctcttcctt

SEQ ID NO: 4565381 - DNA, 11 bp, Homo sapiens
cttccatgcct

SEQ ID NO: 4565382 - DNA, 22 bp, Homo sapiens
cttccatgtcggcctctaaccc

SEQ ID NO: 4565383 - DNA, 14 bp, Homo sapiens
cttccatgtgcctt

SEQ ID NO: 4565384 - DNA, 15 bp, Homo sapiens
cttccatgtgccttt

SEQ ID NO: 4565385 - DNA, 22 bp, Homo sapiens
cttccatgtgcctttctttgcc

SEQ ID NO: 4565386 - DNA, 23 bp, Homo sapiens
cttccatgtgcctttctttgcct

SEQ ID NO: 4565387 - DNA, 17 bp, Homo sapiens
cttccattttcattctg

SEQ ID NO: 4565388 - DNA, 16 bp, Homo sapiens
cttcccaaaaacagcc

SEQ ID NO: 4565389 - DNA, 12 bp, Homo sapiens
cttcccacagga

SEQ ID NO: 4565390 - DNA, 22 bp, Homo sapiens
cttcccacaggagggccagcgc

SEQ ID NO: 4565391 - DNA, 16 bp, Homo sapiens
cttcccagctaggaag

SEQ ID NO: 4565392 - DNA, 14 bp, Homo sapiens
cttcccagctctcc

SEQ ID NO: 4565393 - DNA, 21 bp, Homo sapiens
cttcccagctctccctctggc

SEQ ID NO: 4565394 - DNA, 19 bp, Homo sapiens
cttcccaggatctgctcca

SEQ ID NO: 4565395 - DNA, 23 bp, Homo sapiens
cttcccaggatctgctccaacag

SEQ ID NO: 4565396 - DNA, 11 bp, Homo sapiens
cttcccagggc

SEQ ID NO: 4565397 - DNA, 13 bp, Homo sapiens
cttcccagggcac

SEQ ID NO: 4565398 - DNA, 17 bp, Homo sapiens
cttcccagggcacccag

SEQ ID NO: 4565399 - DNA, 11 bp, Homo sapiens
cttcccatcac

SEQ ID NO: 4565400 - DNA, 16 bp, Homo sapiens
cttcccatcactggag

SEQ ID NO: 4565401 - DNA, 15 bp, Homo sapiens
cttcccattaaaaat

SEQ ID NO: 4565402 - DNA, 18 bp, Homo sapiens
cttcccattgtggctcct

SEQ ID NO: 4565403 - DNA, 12 bp, Homo sapiens
cttcccatttct

SEQ ID NO: 4565404 - DNA, 13 bp, Homo sapiens
cttcccatttctt

SEQ ID NO: 4565405 - DNA, 15 bp, Homo sapiens
cttcccatttcttcc

SEQ ID NO: 4565406 - DNA, 20 bp, Homo sapiens
cttcccatttcttcccactt

SEQ ID NO: 4565407 - DNA, 19 bp, Homo sapiens
cttccccagaaaggagact

SEQ ID NO: 4565408 - DNA, 23 bp, Homo sapiens
cttccccagagaggcactcagtg

SEQ ID NO: 4565409 - DNA, 12 bp, Homo sapiens
cttccccatggg

SEQ ID NO: 4565410 - DNA, 16 bp, Homo sapiens
cttcccccatccctac

SEQ ID NO: 4565411 - DNA, 16 bp, Homo sapiens
cttccccgtgcatgat

SEQ ID NO: 4565412 - DNA, 13 bp, Homo sapiens
cttcccctccctg

SEQ ID NO: 4565413 - DNA, 14 bp, Homo sapiens
cttcccctgaggac

SEQ ID NO: 4565414 - DNA, 15 bp, Homo sapiens
cttccccttccctta

SEQ ID NO: 4565415 - DNA, 14 bp, Homo sapiens
cttccccttctgtg

SEQ ID NO: 4565416 - DNA, 18 bp, Homo sapiens
cttccccttctgtgtcac

SEQ ID NO: 4565417 - DNA, 13 bp, Homo sapiens
cttccctacctca

SEQ ID NO: 4565418 - DNA, 21 bp, Homo sapiens
cttccctagctttagaccctg

SEQ ID NO: 4565419 - DNA, 14 bp, Homo sapiens
cttccctcctttta

SEQ ID NO: 4565420 - DNA, 16 bp, Homo sapiens
cttccctccttttaaa

SEQ ID NO: 4565421 - DNA, 19 bp, Homo sapiens
cttccctctctccctgcct

SEQ ID NO: 4565422 - DNA, 12 bp, Homo sapiens
cttccctctggg

SEQ ID NO: 4565423 - DNA, 20 bp, Homo sapiens
cttccctgactcattctgaa

SEQ ID NO: 4565424 - DNA, 14 bp, Homo sapiens
cttccctgcctgtg

SEQ ID NO: 4565425 - DNA, 16 bp, Homo sapiens
cttccctgctttgcat

SEQ ID NO: 4565426 - DNA, 23 bp, Homo sapiens
cttccctggaaaccttccaccca

SEQ ID NO: 4565427 - DNA, 12 bp, Homo sapiens
cttccctggcct

SEQ ID NO: 4565428 - DNA, 11 bp, Homo sapiens
cttccctggct

SEQ ID NO: 4565429 - DNA, 18 bp, Homo sapiens
cttccctgggctgccacc

SEQ ID NO: 4565430 - DNA, 16 bp, Homo sapiens
cttcccttagcctctc

SEQ ID NO: 4565431 - DNA, 20 bp, Homo sapiens
cttcccttagcctctcccac

SEQ ID NO: 4565432 - DNA, 14 bp, Homo sapiens
cttcccttttctgt

SEQ ID NO: 4565433 - DNA, 16 bp, Homo sapiens
cttccgacaggagcac

SEQ ID NO: 4565434 - DNA, 16 bp, Homo sapiens
cttccgctgaggggtc

SEQ ID NO: 4565435 - DNA, 21 bp, Homo sapiens
cttccgctgaggggtctcgga

SEQ ID NO: 4565436 - DNA, 22 bp, Homo sapiens
cttccgtggtcagagtgccact

SEQ ID NO: 4565437 - DNA, 18 bp, Homo sapiens
cttcctacccacacctct

SEQ ID NO: 4565438 - DNA, 22 bp, Homo sapiens
cttcctacccacacctctgcca

SEQ ID NO: 4565439 - DNA, 16 bp, Homo sapiens
cttcctaccctcctgc

SEQ ID NO: 4565440 - DNA, 22 bp, Homo sapiens
cttcctcaaaataaagaagtat

SEQ ID NO: 4565441 - DNA, 21 bp, Homo sapiens
cttcctcaaatacatgcacag

SEQ ID NO: 4565442 - DNA, 18 bp, Homo sapiens
cttcctcagctgcctcct

SEQ ID NO: 4565443 - DNA, 19 bp, Homo sapiens
cttcctcagctgcctcctg

SEQ ID NO: 4565444 - DNA, 20 bp, Homo sapiens
cttcctcagctgcctcctgc

SEQ ID NO: 4565445 - DNA, 21 bp, Homo sapiens
cttcctcccaagtggtgccta

SEQ ID NO: 4565446 - DNA, 17 bp, Homo sapiens
cttcctccgaggccagt

SEQ ID NO: 4565447 - DNA, 12 bp, Homo sapiens
cttcctcctggg

SEQ ID NO: 4565448 - DNA, 19 bp, Homo sapiens
cttcctccttccagatgcc

SEQ ID NO: 4565449 - DNA, 18 bp, Homo sapiens
cttcctctagaagccaag

SEQ ID NO: 4565450 - DNA, 16 bp, Homo sapiens
cttcctgacactttaa

SEQ ID NO: 4565451 - DNA, 12 bp, Homo sapiens
cttcctgagggc

SEQ ID NO: 4565452 - DNA, 20 bp, Homo sapiens
cttcctgcaggcaggaacaa

SEQ ID NO: 4565453 - DNA, 10 bp, Homo sapiens
cttcctgccc

SEQ ID NO: 4565454 - DNA, 16 bp, Homo sapiens
cttcctgcccttccct

SEQ ID NO: 4565455 - DNA, 19 bp, Homo sapiens
cttcctgcccttccctctg

SEQ ID NO: 4565456 - DNA, 16 bp, Homo sapiens
cttcctgcgtcctcct

SEQ ID NO: 4565457 - DNA, 18 bp, Homo sapiens
cttcctgcgtcctcctca

SEQ ID NO: 4565458 - DNA, 20 bp, Homo sapiens
cttcctgcgtcctcctcacc

SEQ ID NO: 4565459 - DNA, 18 bp, Homo sapiens
cttcctgcttaaacttga

SEQ ID NO: 4565460 - DNA, 23 bp, Homo sapiens
cttcctgcttaaacttgacccag

SEQ ID NO: 4565461 - DNA, 19 bp, Homo sapiens
cttcctggcacattgcccc

SEQ ID NO: 4565462 - DNA, 20 bp, Homo sapiens
cttcctggcacattgcccct

SEQ ID NO: 4565463 - DNA, 16 bp, Homo sapiens
cttcctgggaggacag

SEQ ID NO: 4565464 - DNA, 19 bp, Homo sapiens
cttcctgggaggacaggca

SEQ ID NO: 4565465 - DNA, 10 bp, Homo sapiens
cttcctgggt

SEQ ID NO: 4565466 - DNA, 23 bp, Homo sapiens
cttcctgggtcctgttccctacc

SEQ ID NO: 4565467 - DNA, 14 bp, Homo sapiens
cttcctgtccctga

SEQ ID NO: 4565468 - DNA, 16 bp, Homo sapiens
cttcctgtctagtctc

SEQ ID NO: 4565469 - DNA, 20 bp, Homo sapiens
cttcctgtctcactcttctg

SEQ ID NO: 4565470 - DNA, 17 bp, Homo sapiens
cttcctgtctgtttata

SEQ ID NO: 4565471 - DNA, 21 bp, Homo sapiens
cttcctgtgaagtttaattgt

SEQ ID NO: 4565472 - DNA, 22 bp, Homo sapiens
cttcctgtgaagtttaattgtc

SEQ ID NO: 4565473 - DNA, 18 bp, Homo sapiens
cttcctgtgcctttccta

SEQ ID NO: 4565474 - DNA, 15 bp, Homo sapiens
cttcctgtggcctga

SEQ ID NO: 4565475 - DNA, 16 bp, Homo sapiens
cttcctgtggcctgaa

SEQ ID NO: 4565476 - DNA, 21 bp, Homo sapiens
cttcctgtgtaacatctgcca

SEQ ID NO: 4565477 - DNA, 13 bp, Homo sapiens
cttcctgtttctc

SEQ ID NO: 4565478 - DNA, 16 bp, Homo sapiens
cttcctgtttttcaca

SEQ ID NO: 4565479 - DNA, 17 bp, Homo sapiens
cttcctgtttttcacat

SEQ ID NO: 4565480 - DNA, 23 bp, Homo sapiens
cttccttatgtatcagtgtcctt

SEQ ID NO: 4565481 - DNA, 14 bp, Homo sapiens
cttccttcaggact

SEQ ID NO: 4565482 - DNA, 18 bp, Homo sapiens
cttccttcaggactctgc

SEQ ID NO: 4565483 - DNA, 21 bp, Homo sapiens
cttccttctaccccaaggcca

SEQ ID NO: 4565484 - DNA, 20 bp, Homo sapiens
cttccttggactcattttaa

SEQ ID NO: 4565485 - DNA, 18 bp, Homo sapiens
cttcctttaggtctggtt

SEQ ID NO: 4565486 - DNA, 21 bp, Homo sapiens
cttcctttgaaagactgtgct

SEQ ID NO: 4565487 - DNA, 14 bp, Homo sapiens
cttccttttccctg

SEQ ID NO: 4565488 - DNA, 16 bp, Homo sapiens
cttccttttccctgct

SEQ ID NO: 4565489 - DNA, 22 bp, Homo sapiens
cttcgaatatatctgtaaagat

SEQ ID NO: 4565490 - DNA, 23 bp, Homo sapiens
cttcgaggacaggaaaggcccca

SEQ ID NO: 4565491 - DNA, 23 bp, Homo sapiens
cttcgcacacacccatgtaacca

SEQ ID NO: 4565492 - DNA, 13 bp, Homo sapiens
cttcgctggacta

SEQ ID NO: 4565493 - DNA, 21 bp, Homo sapiens
cttcgctggactattgtgcca

SEQ ID NO: 4565494 - DNA, 14 bp, Homo sapiens
cttcggacaaaata

SEQ ID NO: 4565495 - DNA, 17 bp, Homo sapiens
cttcggacagacatatg

SEQ ID NO: 4565496 - DNA, 18 bp, Homo sapiens
cttcggagggcccctgcg

SEQ ID NO: 4565497 - DNA, 16 bp, Homo sapiens
cttcgggaccctgggg

SEQ ID NO: 4565498 - DNA, 17 bp, Homo sapiens
cttcgtaacttcatatt

SEQ ID NO: 4565499 - DNA, 15 bp, Homo sapiens
cttcgtgcctgagac

SEQ ID NO: 4565500 - DNA, 22 bp, Homo sapiens
cttcgtgcctgagaccagggtg

SEQ ID NO: 4565501 - DNA, 13 bp, Homo sapiens
cttcgttcgcaga

SEQ ID NO: 4565502 - DNA, 13 bp, Homo sapiens
cttcgttcttttt

SEQ ID NO: 4565503 - DNA, 19 bp, Homo sapiens
cttcgttctttttaagtta

SEQ ID NO: 4565504 - DNA, 16 bp, Homo sapiens
cttcgtttattttcaa

SEQ ID NO: 4565505 - DNA, 18 bp, Homo sapiens
cttcgtttattttcaaga

SEQ ID NO: 4565506 - DNA, 19 bp, Homo sapiens
cttctaaaatagcaataac

SEQ ID NO: 4565507 - DNA, 19 bp, Homo sapiens
cttctaaacccaatccaaa

SEQ ID NO: 4565508 - DNA, 19 bp, Homo sapiens
cttctaaacttccccatct

SEQ ID NO: 4565509 - DNA, 12 bp, Homo sapiens
cttctaaatgcc

SEQ ID NO: 4565510 - DNA, 18 bp, Homo sapiens
cttctaagaagacatttt

SEQ ID NO: 4565511 - DNA, 23 bp, Homo sapiens
cttctaagtaaaaccacagcagt

SEQ ID NO: 4565512 - DNA, 19 bp, Homo sapiens
cttctaccccaaggccagt

SEQ ID NO: 4565513 - DNA, 22 bp, Homo sapiens
cttctaccccaaggccagtagt

SEQ ID NO: 4565514 - DNA, 17 bp, Homo sapiens
cttctacctcttggctg

SEQ ID NO: 4565515 - DNA, 16 bp, Homo sapiens
cttctacctgccactc

SEQ ID NO: 4565516 - DNA, 16 bp, Homo sapiens
cttctacctgccctca

SEQ ID NO: 4565517 - DNA, 18 bp, Homo sapiens
cttctacctgccctcaag

SEQ ID NO: 4565518 - DNA, 16 bp, Homo sapiens
cttctactcctgcctc

SEQ ID NO: 4565519 - DNA, 19 bp, Homo sapiens
cttctactttcatcttaaa

SEQ ID NO: 4565520 - DNA, 12 bp, Homo sapiens
cttctactttta

SEQ ID NO: 4565521 - DNA, 17 bp, Homo sapiens
cttctagctgacttgca

SEQ ID NO: 4565522 - DNA, 19 bp, Homo sapiens
cttctaggagtcaactggc

SEQ ID NO: 4565523 - DNA, 21 bp, Homo sapiens
cttctaggagtcaactggctg

SEQ ID NO: 4565524 - DNA, 20 bp, Homo sapiens
cttctagtgcttttcagtga

SEQ ID NO: 4565525 - DNA, 19 bp, Homo sapiens
cttctagttctgccaggag

SEQ ID NO: 4565526 - DNA, 18 bp, Homo sapiens
cttctatacccacccaga

SEQ ID NO: 4565527 - DNA, 19 bp, Homo sapiens
cttctattaatcaagagaa

SEQ ID NO: 4565528 - DNA, 23 bp, Homo sapiens
cttctattaatcaagagaaactt

SEQ ID NO: 4565529 - DNA, 21 bp, Homo sapiens
cttctattctagcctgcattg

SEQ ID NO: 4565530 - DNA, 16 bp, Homo sapiens
cttctatttatttatt

SEQ ID NO: 4565531 - DNA, 12 bp, Homo sapiens
cttctcaccagc

SEQ ID NO: 4565532 - DNA, 14 bp, Homo sapiens
cttctcaccagcag

SEQ ID NO: 4565533 - DNA, 19 bp, Homo sapiens
cttctcaccagctgcaaag

SEQ ID NO: 4565534 - DNA, 17 bp, Homo sapiens
cttctcacgctttgttt

SEQ ID NO: 4565535 - DNA, 18 bp, Homo sapiens
cttctcacgctttgttta

SEQ ID NO: 4565536 - DNA, 20 bp, Homo sapiens
cttctcacgctttgtttact

SEQ ID NO: 4565537 - DNA, 15 bp, Homo sapiens
cttctcactcaccac

SEQ ID NO: 4565538 - DNA, 13 bp, Homo sapiens
cttctcacttttt

SEQ ID NO: 4565539 - DNA, 17 bp, Homo sapiens
cttctcagaagcacaga

SEQ ID NO: 4565540 - DNA, 22 bp, Homo sapiens
cttctcagaagcacagaatatt

SEQ ID NO: 4565541 - DNA, 18 bp, Homo sapiens
cttctcatcgaagggatt

SEQ ID NO: 4565542 - DNA, 22 bp, Homo sapiens
cttctccaaaaatctgcctggg

SEQ ID NO: 4565543 - DNA, 18 bp, Homo sapiens
cttctccaacactgaagt

SEQ ID NO: 4565544 - DNA, 17 bp, Homo sapiens
cttctccatctggcagg

SEQ ID NO: 4565545 - DNA, 14 bp, Homo sapiens
cttctccccagaat

SEQ ID NO: 4565546 - DNA, 21 bp, Homo sapiens
cttctcccccaccccctaggg

SEQ ID NO: 4565547 - DNA, 21 bp, Homo sapiens
cttctcccccacggtatccta

SEQ ID NO: 4565548 - DNA, 14 bp, Homo sapiens
cttctccccgcagc

SEQ ID NO: 4565549 - DNA, 23 bp, Homo sapiens
cttctccgccagcctcctctgga

SEQ ID NO: 4565550 - DNA, 15 bp, Homo sapiens
cttctcctgttttat

SEQ ID NO: 4565551 - DNA, 17 bp, Homo sapiens
cttctcctgttttatat

SEQ ID NO: 4565552 - DNA, 23 bp, Homo sapiens
cttctcctgttttatatattatg

SEQ ID NO: 4565553 - DNA, 19 bp, Homo sapiens
cttctccttagacactttg

SEQ ID NO: 4565554 - DNA, 16 bp, Homo sapiens
cttctcgcttttgcca

SEQ ID NO: 4565555 - DNA, 17 bp, Homo sapiens
cttctctataaaaaata

SEQ ID NO: 4565556 - DNA, 14 bp, Homo sapiens
cttctctcacttct

SEQ ID NO: 4565557 - DNA, 16 bp, Homo sapiens
cttctctcatctctta

SEQ ID NO: 4565558 - DNA, 16 bp, Homo sapiens
cttctctccagctgac

SEQ ID NO: 4565559 - DNA, 18 bp, Homo sapiens
cttctctccagctgacta

SEQ ID NO: 4565560 - DNA, 18 bp, Homo sapiens
cttctctccccagccccc

SEQ ID NO: 4565561 - DNA, 12 bp, Homo sapiens
cttctctgcagt

SEQ ID NO: 4565562 - DNA, 15 bp, Homo sapiens
cttctctgcagtaaa

SEQ ID NO: 4565563 - DNA, 15 bp, Homo sapiens
cttctctgctccacc

SEQ ID NO: 4565564 - DNA, 21 bp, Homo sapiens
cttctctgctccaccacatcc

SEQ ID NO: 4565565 - DNA, 18 bp, Homo sapiens
cttctcttgacagtctga

SEQ ID NO: 4565566 - DNA, 23 bp, Homo sapiens
cttctcttgacagtctgaagctc

SEQ ID NO: 4565567 - DNA, 13 bp, Homo sapiens
cttctcttgcttt

SEQ ID NO: 4565568 - DNA, 15 bp, Homo sapiens
cttctcttgctttct

SEQ ID NO: 4565569 - DNA, 17 bp, Homo sapiens
cttctcttgctttctat

SEQ ID NO: 4565570 - DNA, 12 bp, Homo sapiens
cttctctttgtg

SEQ ID NO: 4565571 - DNA, 22 bp, Homo sapiens
cttctgaactcaaactgaggaa

SEQ ID NO: 4565572 - DNA, 23 bp, Homo sapiens
cttctgaactccatacagcctct

SEQ ID NO: 4565573 - DNA, 15 bp, Homo sapiens
cttctgaataaagca

SEQ ID NO: 4565574 - DNA, 16 bp, Homo sapiens
cttctgaataaagcaa

SEQ ID NO: 4565575 - DNA, 19 bp, Homo sapiens
cttctgagcaggggcccct

SEQ ID NO: 4565576 - DNA, 17 bp, Homo sapiens
cttctgagctatttcat

SEQ ID NO: 4565577 - DNA, 20 bp, Homo sapiens
cttctgatgaaatgttaaca

SEQ ID NO: 4565578 - DNA, 23 bp, Homo sapiens
cttctgcaagcctcatgccaacc

SEQ ID NO: 4565579 - DNA, 17 bp, Homo sapiens
cttctgcagcaactccc

SEQ ID NO: 4565580 - DNA, 21 bp, Homo sapiens
cttctgcagcaactcccacga

SEQ ID NO: 4565581 - DNA, 22 bp, Homo sapiens
cttctgcagcaactcccacgac

SEQ ID NO: 4565582 - DNA, 20 bp, Homo sapiens
cttctgccaccagcccctcc

SEQ ID NO: 4565583 - DNA, 23 bp, Homo sapiens
cttctgcccaattggaggaaagc

SEQ ID NO: 4565584 - DNA, 17 bp, Homo sapiens
cttctgcggggctgaga

SEQ ID NO: 4565585 - DNA, 12 bp, Homo sapiens
cttctgctccac

SEQ ID NO: 4565586 - DNA, 21 bp, Homo sapiens
cttctgctccacccttggcct

SEQ ID NO: 4565587 - DNA, 14 bp, Homo sapiens
cttctgctcttttc

SEQ ID NO: 4565588 - DNA, 18 bp, Homo sapiens
cttctgctcttttcctgg

SEQ ID NO: 4565589 - DNA, 16 bp, Homo sapiens
cttctgcttttctgcc

SEQ ID NO: 4565590 - DNA, 22 bp, Homo sapiens
cttctgcttttctgccctggct

SEQ ID NO: 4565591 - DNA, 17 bp, Homo sapiens
cttctggagctgggaga

SEQ ID NO: 4565592 - DNA, 13 bp, Homo sapiens
cttctggccttgt

SEQ ID NO: 4565593 - DNA, 22 bp, Homo sapiens
cttctgggcttcatctggcaac

SEQ ID NO: 4565594 - DNA, 16 bp, Homo sapiens
cttctggggcaggctg

SEQ ID NO: 4565595 - DNA, 17 bp, Homo sapiens
cttctgggtccagggag

SEQ ID NO: 4565596 - DNA, 19 bp, Homo sapiens
cttctgggtccagggaggg

SEQ ID NO: 4565597 - DNA, 15 bp, Homo sapiens
cttctggtgttgact

SEQ ID NO: 4565598 - DNA, 18 bp, Homo sapiens
cttctggtgttgactgga

SEQ ID NO: 4565599 - DNA, 19 bp, Homo sapiens
cttctggtttaaacttgtt

SEQ ID NO: 4565600 - DNA, 22 bp, Homo sapiens
cttctgtatttttttttctaag

SEQ ID NO: 4565601 - DNA, 10 bp, Homo sapiens
cttctgtctc

SEQ ID NO: 4565602 - DNA, 21 bp, Homo sapiens
cttctgtcttcacaacagatt

SEQ ID NO: 4565603 - DNA, 21 bp, Homo sapiens
cttctgtgagacccccacacc

SEQ ID NO: 4565604 - DNA, 21 bp, Homo sapiens
cttcttaaaagaaatcttgct

SEQ ID NO: 4565605 - DNA, 14 bp, Homo sapiens
cttcttaaagtatt

SEQ ID NO: 4565606 - DNA, 17 bp, Homo sapiens
cttcttacagaagtatt

SEQ ID NO: 4565607 - DNA, 14 bp, Homo sapiens
cttcttagagtttt

SEQ ID NO: 4565608 - DNA, 23 bp, Homo sapiens
cttcttatggaattgatttgcat

SEQ ID NO: 4565609 - DNA, 14 bp, Homo sapiens
cttcttattctcac

SEQ ID NO: 4565610 - DNA, 13 bp, Homo sapiens
cttcttcaccatt

SEQ ID NO: 4565611 - DNA, 17 bp, Homo sapiens
cttcttccactgtctca

SEQ ID NO: 4565612 - DNA, 14 bp, Homo sapiens
cttcttccctccct

SEQ ID NO: 4565613 - DNA, 20 bp, Homo sapiens
cttcttccctgtcagcctga

SEQ ID NO: 4565614 - DNA, 17 bp, Homo sapiens
cttcttctaagaagaca

SEQ ID NO: 4565615 - DNA, 19 bp, Homo sapiens
cttcttctaagaagacatt

SEQ ID NO: 4565616 - DNA, 13 bp, Homo sapiens
cttcttctgtaat

SEQ ID NO: 4565617 - DNA, 22 bp, Homo sapiens
cttcttgaaattttaacctatg

SEQ ID NO: 4565618 - DNA, 20 bp, Homo sapiens
cttcttgcttctttctagaa

SEQ ID NO: 4565619 - DNA, 17 bp, Homo sapiens
cttcttggagctttgga

SEQ ID NO: 4565620 - DNA, 18 bp, Homo sapiens
cttcttggagctttggaa

SEQ ID NO: 4565621 - DNA, 16 bp, Homo sapiens
cttcttgttctgagat

SEQ ID NO: 4565622 - DNA, 21 bp, Homo sapiens
cttcttgttctgagattcaat

SEQ ID NO: 4565623 - DNA, 20 bp, Homo sapiens
cttctttaatcacttaacat

SEQ ID NO: 4565624 - DNA, 15 bp, Homo sapiens
cttctttattattcc

SEQ ID NO: 4565625 - DNA, 12 bp, Homo sapiens
cttctttccaga

SEQ ID NO: 4565626 - DNA, 19 bp, Homo sapiens
cttctttccagaaaccaaa

SEQ ID NO: 4565627 - DNA, 16 bp, Homo sapiens
cttctttgcagagcct

SEQ ID NO: 4565628 - DNA, 21 bp, Homo sapiens
cttctttggaaataaaagata

SEQ ID NO: 4565629 - DNA, 13 bp, Homo sapiens
cttctttgtgcct

SEQ ID NO: 4565630 - DNA, 14 bp, Homo sapiens
cttctttgtgcctt

SEQ ID NO: 4565631 - DNA, 15 bp, Homo sapiens
cttctttgtgccttt

SEQ ID NO: 4565632 - DNA, 21 bp, Homo sapiens
cttctttgtgcctttggcctg

SEQ ID NO: 4565633 - DNA, 20 bp, Homo sapiens
cttctttgttattataacat

SEQ ID NO: 4565634 - DNA, 13 bp, Homo sapiens
cttctttttggca

SEQ ID NO: 4565635 - DNA, 20 bp, Homo sapiens
cttgaaaaaaaacagtggat

SEQ ID NO: 4565636 - DNA, 21 bp, Homo sapiens
cttgaaacagattcaggccag

SEQ ID NO: 4565637 - DNA, 16 bp, Homo sapiens
cttgaaatgaaaggga

SEQ ID NO: 4565638 - DNA, 17 bp, Homo sapiens
cttgaaatgaaagggaa

SEQ ID NO: 4565639 - DNA, 19 bp, Homo sapiens
cttgaaatgaaagggaaac

SEQ ID NO: 4565640 - DNA, 15 bp, Homo sapiens
cttgaaatggaaagt

SEQ ID NO: 4565641 - DNA, 20 bp, Homo sapiens
cttgaaattaagaaggcaaa

SEQ ID NO: 4565642 - DNA, 13 bp, Homo sapiens
cttgaaattttaa

SEQ ID NO: 4565643 - DNA, 15 bp, Homo sapiens
cttgaaattttaacc

SEQ ID NO: 4565644 - DNA, 17 bp, Homo sapiens
cttgaaattttaaccta

SEQ ID NO: 4565645 - DNA, 15 bp, Homo sapiens
cttgaacaaaagggt

SEQ ID NO: 4565646 - DNA, 20 bp, Homo sapiens
cttgaacaaaagggtcagag

SEQ ID NO: 4565647 - DNA, 16 bp, Homo sapiens
cttgaacaaagacatt

SEQ ID NO: 4565648 - DNA, 15 bp, Homo sapiens
cttgaacacagtatt

SEQ ID NO: 4565649 - DNA, 20 bp, Homo sapiens
cttgaacccgggaggcagag

SEQ ID NO: 4565650 - DNA, 18 bp, Homo sapiens
cttgaactcctggactca

SEQ ID NO: 4565651 - DNA, 15 bp, Homo sapiens
cttgaacttgcctct

SEQ ID NO: 4565652 - DNA, 18 bp, Homo sapiens
cttgaacttgcctctttt

SEQ ID NO: 4565653 - DNA, 16 bp, Homo sapiens
cttgaactttccaaaa

SEQ ID NO: 4565654 - DNA, 22 bp, Homo sapiens
cttgaagaaacagagtggcctc

SEQ ID NO: 4565655 - DNA, 12 bp, Homo sapiens
cttgaagccaaa

SEQ ID NO: 4565656 - DNA, 16 bp, Homo sapiens
cttgaaggtacacccc

SEQ ID NO: 4565657 - DNA, 19 bp, Homo sapiens
cttgaatactctgccctct

SEQ ID NO: 4565658 - DNA, 14 bp, Homo sapiens
cttgaataggaaga

SEQ ID NO: 4565659 - DNA, 16 bp, Homo sapiens
cttgaatataaaaaat

SEQ ID NO: 4565660 - DNA, 21 bp, Homo sapiens
cttgaatcagcatctcttctt

SEQ ID NO: 4565661 - DNA, 15 bp, Homo sapiens
cttgaatctttttat

SEQ ID NO: 4565662 - DNA, 20 bp, Homo sapiens
cttgaatctttttatcccat

SEQ ID NO: 4565663 - DNA, 18 bp, Homo sapiens
cttgaatggagctggtga

SEQ ID NO: 4565664 - DNA, 20 bp, Homo sapiens
cttgaatgtggcttgagaaa

SEQ ID NO: 4565665 - DNA, 22 bp, Homo sapiens
cttgaatgtggcttgagaaata

SEQ ID NO: 4565666 - DNA, 22 bp, Homo sapiens
cttgaattgtaactgttcttga

SEQ ID NO: 4565667 - DNA, 17 bp, Homo sapiens
cttgacaatcatctcca

SEQ ID NO: 4565668 - DNA, 23 bp, Homo sapiens
cttgacacatagtttttcagtct

SEQ ID NO: 4565669 - DNA, 22 bp, Homo sapiens
cttgacatacctaccagtatta

SEQ ID NO: 4565670 - DNA, 18 bp, Homo sapiens
cttgacctgcattgtaaa

SEQ ID NO: 4565671 - DNA, 19 bp, Homo sapiens
cttgacctgcattgtaaat

SEQ ID NO: 4565672 - DNA, 15 bp, Homo sapiens
cttgaccttgtagag

SEQ ID NO: 4565673 - DNA, 14 bp, Homo sapiens
cttgactctaatat

SEQ ID NO: 4565674 - DNA, 19 bp, Homo sapiens
cttgactctaatatgatta

SEQ ID NO: 4565675 - DNA, 19 bp, Homo sapiens
cttgactgcattgccgctg

SEQ ID NO: 4565676 - DNA, 19 bp, Homo sapiens
cttgagaaccagtctcctc

SEQ ID NO: 4565677 - DNA, 19 bp, Homo sapiens
cttgagaaggtcactactg

SEQ ID NO: 4565678 - DNA, 18 bp, Homo sapiens
cttgagacctcagccatg

SEQ ID NO: 4565679 - DNA, 15 bp, Homo sapiens
cttgagcaggattag

SEQ ID NO: 4565680 - DNA, 19 bp, Homo sapiens
cttgagcatcaatcttgtt

SEQ ID NO: 4565681 - DNA, 18 bp, Homo sapiens
cttgagccactccttcct

SEQ ID NO: 4565682 - DNA, 18 bp, Homo sapiens
cttgagccaggaggcctg

SEQ ID NO: 4565683 - DNA, 13 bp, Homo sapiens
cttgagccctggc

SEQ ID NO: 4565684 - DNA, 20 bp, Homo sapiens
cttgagccctggctgttctg

SEQ ID NO: 4565685 - DNA, 17 bp, Homo sapiens
cttgagccgggcccctg

SEQ ID NO: 4565686 - DNA, 21 bp, Homo sapiens
cttgagcggagcccgatattc

SEQ ID NO: 4565687 - DNA, 19 bp, Homo sapiens
cttgagtataagataaaat

SEQ ID NO: 4565688 - DNA, 19 bp, Homo sapiens
cttgagtgagaagagcttg

SEQ ID NO: 4565689 - DNA, 18 bp, Homo sapiens
cttgataaacataattat

SEQ ID NO: 4565690 - DNA, 14 bp, Homo sapiens
cttgatccagaaga

SEQ ID NO: 4565691 - DNA, 16 bp, Homo sapiens
cttgatccagaagagc

SEQ ID NO: 4565692 - DNA, 18 bp, Homo sapiens
cttgatccagaagagccc

SEQ ID NO: 4565693 - DNA, 15 bp, Homo sapiens
cttgatctctcttgt

SEQ ID NO: 4565694 - DNA, 22 bp, Homo sapiens
cttgatctctcttgtcctcttc

SEQ ID NO: 4565695 - DNA, 13 bp, Homo sapiens
cttgatctttgag

SEQ ID NO: 4565696 - DNA, 16 bp, Homo sapiens
cttgatctttgagccc

SEQ ID NO: 4565697 - DNA, 18 bp, Homo sapiens
cttgatctttgagcccat

SEQ ID NO: 4565698 - DNA, 22 bp, Homo sapiens
cttgatgttttttctgtaatgt

SEQ ID NO: 4565699 - DNA, 16 bp, Homo sapiens
cttgattatccatatt

SEQ ID NO: 4565700 - DNA, 21 bp, Homo sapiens
cttgattctgcagtaaatctt

SEQ ID NO: 4565701 - DNA, 22 bp, Homo sapiens
cttgattctgcagtaaatcttt

SEQ ID NO: 4565702 - DNA, 20 bp, Homo sapiens
cttgcaagggaagagccttt

SEQ ID NO: 4565703 - DNA, 21 bp, Homo sapiens
cttgcaataaagttattcaga

SEQ ID NO: 4565704 - DNA, 22 bp, Homo sapiens
cttgcaatccaggctgttctca

SEQ ID NO: 4565705 - DNA, 22 bp, Homo sapiens
cttgcaatctaatctgaactga

SEQ ID NO: 4565706 - DNA, 17 bp, Homo sapiens
cttgcaatcttctactt

SEQ ID NO: 4565707 - DNA, 14 bp, Homo sapiens
cttgcacagggatt

SEQ ID NO: 4565708 - DNA, 14 bp, Homo sapiens
cttgcacctgcatc

SEQ ID NO: 4565709 - DNA, 16 bp, Homo sapiens
cttgcactcctactga

SEQ ID NO: 4565710 - DNA, 22 bp, Homo sapiens
cttgcagatcatctggggacct

SEQ ID NO: 4565711 - DNA, 20 bp, Homo sapiens
cttgcagcgccaagtggcca

SEQ ID NO: 4565712 - DNA, 18 bp, Homo sapiens
cttgcagcggctcctgca

SEQ ID NO: 4565713 - DNA, 23 bp, Homo sapiens
cttgcaggaaggactatgaaaag

SEQ ID NO: 4565714 - DNA, 23 bp, Homo sapiens
cttgcaggggtcccccctcaaga

SEQ ID NO: 4565715 - DNA, 13 bp, Homo sapiens
cttgcagggtggg

SEQ ID NO: 4565716 - DNA, 18 bp, Homo sapiens
cttgcagggtgggtgagc

SEQ ID NO: 4565717 - DNA, 22 bp, Homo sapiens
cttgcagggtgggtgagctctc

SEQ ID NO: 4565718 - DNA, 23 bp, Homo sapiens
cttgcatcaatttttcttatttc

SEQ ID NO: 4565719 - DNA, 18 bp, Homo sapiens
cttgcatccattgttgtg

SEQ ID NO: 4565720 - DNA, 21 bp, Homo sapiens
cttgcatggtttagaaagctt

SEQ ID NO: 4565721 - DNA, 22 bp, Homo sapiens
cttgcatggtttggagctgatc

SEQ ID NO: 4565722 - DNA, 20 bp, Homo sapiens
cttgccaaagtacagaattt

SEQ ID NO: 4565723 - DNA, 21 bp, Homo sapiens
cttgcccactggccgctgagc

SEQ ID NO: 4565724 - DNA, 17 bp, Homo sapiens
cttgcccagactacagg

SEQ ID NO: 4565725 - DNA, 17 bp, Homo sapiens
cttgcccagcctggatg

SEQ ID NO: 4565726 - DNA, 13 bp, Homo sapiens
cttgcccagcttt

SEQ ID NO: 4565727 - DNA, 14 bp, Homo sapiens
cttgcccatcctga

SEQ ID NO: 4565728 - DNA, 16 bp, Homo sapiens
cttgcccatcctgact

SEQ ID NO: 4565729 - DNA, 19 bp, Homo sapiens
cttgcccgctcccacagct

SEQ ID NO: 4565730 - DNA, 21 bp, Homo sapiens
cttgccctcctgggccctggg

SEQ ID NO: 4565731 - DNA, 23 bp, Homo sapiens
cttgccctcctgggccctgggct

SEQ ID NO: 4565732 - DNA, 20 bp, Homo sapiens
cttgccctgagcactcctgg

SEQ ID NO: 4565733 - DNA, 22 bp, Homo sapiens
cttgccctgagcactcctggtg

SEQ ID NO: 4565734 - DNA, 17 bp, Homo sapiens
cttgcctcatttcccta

SEQ ID NO: 4565735 - DNA, 12 bp, Homo sapiens
cttgcctcccca

SEQ ID NO: 4565736 - DNA, 20 bp, Homo sapiens
cttgcctccccatttcccat

SEQ ID NO: 4565737 - DNA, 23 bp, Homo sapiens
cttgcctctgtccccttctctca

SEQ ID NO: 4565738 - DNA, 20 bp, Homo sapiens
cttgcctcttttacctgctg

SEQ ID NO: 4565739 - DNA, 21 bp, Homo sapiens
cttgcctcttttacctgctgc

SEQ ID NO: 4565740 - DNA, 22 bp, Homo sapiens
cttgcctcttttacctgctgct

SEQ ID NO: 4565741 - DNA, 17 bp, Homo sapiens
cttgcctgaactccaga

SEQ ID NO: 4565742 - DNA, 19 bp, Homo sapiens
cttgccttttgttaatgca

SEQ ID NO: 4565743 - DNA, 16 bp, Homo sapiens
cttgcgagtccaaggc

SEQ ID NO: 4565744 - DNA, 13 bp, Homo sapiens
cttgctaccagta

SEQ ID NO: 4565745 - DNA, 16 bp, Homo sapiens
cttgctatttcaataa

SEQ ID NO: 4565746 - DNA, 16 bp, Homo sapiens
cttgctcaggtgcaag

SEQ ID NO: 4565747 - DNA, 12 bp, Homo sapiens
cttgctccctct

SEQ ID NO: 4565748 - DNA, 15 bp, Homo sapiens
cttgctccctctcca

SEQ ID NO: 4565749 - DNA, 16 bp, Homo sapiens
cttgctccctctccaa

SEQ ID NO: 4565750 - DNA, 17 bp, Homo sapiens
cttgctccctctccaag

SEQ ID NO: 4565751 - DNA, 18 bp, Homo sapiens
cttgctcgcttgctggaa

SEQ ID NO: 4565752 - DNA, 16 bp, Homo sapiens
cttgctctcttcaata

SEQ ID NO: 4565753 - DNA, 18 bp, Homo sapiens
cttgctctcttcaataaa

SEQ ID NO: 4565754 - DNA, 17 bp, Homo sapiens
cttgctctgtcccccag

SEQ ID NO: 4565755 - DNA, 18 bp, Homo sapiens
cttgctctgtttgtgggg

SEQ ID NO: 4565756 - DNA, 19 bp, Homo sapiens
cttgctctgtttgtggggt

SEQ ID NO: 4565757 - DNA, 16 bp, Homo sapiens
cttgctgcactcttgc

SEQ ID NO: 4565758 - DNA, 21 bp, Homo sapiens
cttgctggggcttgtcctaga

SEQ ID NO: 4565759 - DNA, 16 bp, Homo sapiens
cttgctgtatatgcag

SEQ ID NO: 4565760 - DNA, 23 bp, Homo sapiens
cttgctgttgacatatttaatgt

SEQ ID NO: 4565761 - DNA, 20 bp, Homo sapiens
cttgctgtttactcccttct

SEQ ID NO: 4565762 - DNA, 22 bp, Homo sapiens
cttgcttaaatttcttatgtga

SEQ ID NO: 4565763 - DNA, 23 bp, Homo sapiens
cttgcttaaatttcttatgtgac

SEQ ID NO: 4565764 - DNA, 17 bp, Homo sapiens
cttgcttacatcctctg

SEQ ID NO: 4565765 - DNA, 14 bp, Homo sapiens
cttgcttctgcagc

SEQ ID NO: 4565766 - DNA, 20 bp, Homo sapiens
cttgcttctgcagcaactcc

SEQ ID NO: 4565767 - DNA, 21 bp, Homo sapiens
cttgcttctgcagcaactccc

SEQ ID NO: 4565768 - DNA, 22 bp, Homo sapiens
cttgcttctgcagcaactccca

SEQ ID NO: 4565769 - DNA, 15 bp, Homo sapiens
cttgctttcctgcat

SEQ ID NO: 4565770 - DNA, 17 bp, Homo sapiens
cttgctttcctgcatct

SEQ ID NO: 4565771 - DNA, 11 bp, Homo sapiens
cttgctttcta

SEQ ID NO: 4565772 - DNA, 15 bp, Homo sapiens
cttgctttctctctc

SEQ ID NO: 4565773 - DNA, 14 bp, Homo sapiens
cttggaaaaacagc

SEQ ID NO: 4565774 - DNA, 16 bp, Homo sapiens
cttggaaaataagaca

SEQ ID NO: 4565775 - DNA, 19 bp, Homo sapiens
cttggaaacagttggcact

SEQ ID NO: 4565776 - DNA, 19 bp, Homo sapiens
cttggaaatcagtagaaag

SEQ ID NO: 4565777 - DNA, 22 bp, Homo sapiens
cttggaaatcagtagaaagcta

SEQ ID NO: 4565778 - DNA, 16 bp, Homo sapiens
cttggaacaccttggg

SEQ ID NO: 4565779 - DNA, 17 bp, Homo sapiens
cttggaactgtcccagc

SEQ ID NO: 4565780 - DNA, 16 bp, Homo sapiens
cttggaagctgtttgg

SEQ ID NO: 4565781 - DNA, 20 bp, Homo sapiens
cttggaagctgtttggaaaa

SEQ ID NO: 4565782 - DNA, 18 bp, Homo sapiens
cttggaaggtcttttgag

SEQ ID NO: 4565783 - DNA, 16 bp, Homo sapiens
cttggacattttatgt

SEQ ID NO: 4565784 - DNA, 17 bp, Homo sapiens
cttggacattttatgtc

SEQ ID NO: 4565785 - DNA, 19 bp, Homo sapiens
cttggacccacctgtgggg

SEQ ID NO: 4565786 - DNA, 22 bp, Homo sapiens
cttggacccacctgtggggcct

SEQ ID NO: 4565787 - DNA, 15 bp, Homo sapiens
cttggacccttggaa

SEQ ID NO: 4565788 - DNA, 16 bp, Homo sapiens
cttggacccttggaaa

SEQ ID NO: 4565789 - DNA, 16 bp, Homo sapiens
cttggactacacaata

SEQ ID NO: 4565790 - DNA, 16 bp, Homo sapiens
cttggagaccttaccc

SEQ ID NO: 4565791 - DNA, 13 bp, Homo sapiens
cttggagggatgg

SEQ ID NO: 4565792 - DNA, 22 bp, Homo sapiens
cttggagggtcccaagctgggc

SEQ ID NO: 4565793 - DNA, 23 bp, Homo sapiens
cttggagggtcccaagctgggcc

SEQ ID NO: 4565794 - DNA, 14 bp, Homo sapiens
cttggagtcccagg

SEQ ID NO: 4565795 - DNA, 16 bp, Homo sapiens
cttggatcccaaagca

SEQ ID NO: 4565796 - DNA, 20 bp, Homo sapiens
cttggatcccaaagcaagga

SEQ ID NO: 4565797 - DNA, 20 bp, Homo sapiens
cttggatttcgtgtgccgct

SEQ ID NO: 4565798 - DNA, 21 bp, Homo sapiens
cttggatttcgtgtgccgctg

SEQ ID NO: 4565799 - DNA, 19 bp, Homo sapiens
cttggcaaggtcatagaca

SEQ ID NO: 4565800 - DNA, 20 bp, Homo sapiens
cttggcacccccatgctgcc

SEQ ID NO: 4565801 - DNA, 20 bp, Homo sapiens
cttggcagttgcagtgctgc

SEQ ID NO: 4565802 - DNA, 13 bp, Homo sapiens
cttggcatacaaa

SEQ ID NO: 4565803 - DNA, 17 bp, Homo sapiens
cttggcatacaaaatat

SEQ ID NO: 4565804 - DNA, 13 bp, Homo sapiens
cttggccacagac

SEQ ID NO: 4565805 - DNA, 14 bp, Homo sapiens
cttggccacagact

SEQ ID NO: 4565806 - DNA, 18 bp, Homo sapiens
cttggcccagagacggag

SEQ ID NO: 4565807 - DNA, 21 bp, Homo sapiens
cttggcctcccaaagtgttgg

SEQ ID NO: 4565808 - DNA, 13 bp, Homo sapiens
cttggcctctcct

SEQ ID NO: 4565809 - DNA, 15 bp, Homo sapiens
cttggcctgctgtga

SEQ ID NO: 4565810 - DNA, 19 bp, Homo sapiens
cttggctatgaaaatgagc

SEQ ID NO: 4565811 - DNA, 22 bp, Homo sapiens
cttggctatgaaaatgagccct

SEQ ID NO: 4565812 - DNA, 23 bp, Homo sapiens
cttggctatgaaaatgagccctg

SEQ ID NO: 4565813 - DNA, 19 bp, Homo sapiens
cttggcttaatcattttca

SEQ ID NO: 4565814 - DNA, 23 bp, Homo sapiens
cttggctttcagagccagcctgg

SEQ ID NO: 4565815 - DNA, 20 bp, Homo sapiens
cttgggaagtcgaggctgca

SEQ ID NO: 4565816 - DNA, 20 bp, Homo sapiens
cttgggagcctgtggccagc

SEQ ID NO: 4565817 - DNA, 16 bp, Homo sapiens
cttgggaggctgaggc

SEQ ID NO: 4565818 - DNA, 23 bp, Homo sapiens
cttgggaggctgaggcaggagaa

SEQ ID NO: 4565819 - DNA, 17 bp, Homo sapiens
cttgggatttgctgtgt

SEQ ID NO: 4565820 - DNA, 20 bp, Homo sapiens
cttgggcagtgccccaggga

SEQ ID NO: 4565821 - DNA, 18 bp, Homo sapiens
cttgggcccggtccacag

SEQ ID NO: 4565822 - DNA, 19 bp, Homo sapiens
cttgggcccggtccacagg

SEQ ID NO: 4565823 - DNA, 21 bp, Homo sapiens
cttgggcccggtccacaggtc

SEQ ID NO: 4565824 - DNA, 17 bp, Homo sapiens
cttgggccctttgagtg

SEQ ID NO: 4565825 - DNA, 14 bp, Homo sapiens
cttgggcctgcacc

SEQ ID NO: 4565826 - DNA, 20 bp, Homo sapiens
cttgggcctgcacccttcca

SEQ ID NO: 4565827 - DNA, 21 bp, Homo sapiens
cttggggacctgaactgtcct

SEQ ID NO: 4565828 - DNA, 23 bp, Homo sapiens
cttggggagagggatttccctgc

SEQ ID NO: 4565829 - DNA, 22 bp, Homo sapiens
cttgggggacagggctggccca

SEQ ID NO: 4565830 - DNA, 20 bp, Homo sapiens
cttggggggagggggtgtct

SEQ ID NO: 4565831 - DNA, 13 bp, Homo sapiens
cttgggggtcagg

SEQ ID NO: 4565832 - DNA, 23 bp, Homo sapiens
cttgggggttcaggcccggcagg

SEQ ID NO: 4565833 - DNA, 17 bp, Homo sapiens
cttggtaagtgaattta

SEQ ID NO: 4565834 - DNA, 16 bp, Homo sapiens
cttggtagttctgtgc

SEQ ID NO: 4565835 - DNA, 17 bp, Homo sapiens
cttggtgtccacctggc

SEQ ID NO: 4565836 - DNA, 19 bp, Homo sapiens
cttggtgtccacctggccc

SEQ ID NO: 4565837 - DNA, 18 bp, Homo sapiens
cttggtgtttgactgtaa

SEQ ID NO: 4565838 - DNA, 19 bp, Homo sapiens
cttggtgtttgactgtaat

SEQ ID NO: 4565839 - DNA, 13 bp, Homo sapiens
cttggttatattt

SEQ ID NO: 4565840 - DNA, 21 bp, Homo sapiens
cttggttatttgtttaccact

SEQ ID NO: 4565841 - DNA, 13 bp, Homo sapiens
cttggttccccca

SEQ ID NO: 4565842 - DNA, 16 bp, Homo sapiens
cttggttcccccactg

SEQ ID NO: 4565843 - DNA, 14 bp, Homo sapiens
cttggttgaggaaa

SEQ ID NO: 4565844 - DNA, 15 bp, Homo sapiens
cttggttgaggaaac

SEQ ID NO: 4565845 - DNA, 16 bp, Homo sapiens
cttggttgaggaaaca

SEQ ID NO: 4565846 - DNA, 21 bp, Homo sapiens
cttggttggctggcagctgag

SEQ ID NO: 4565847 - DNA, 22 bp, Homo sapiens
cttggttggctggcagctgaga

SEQ ID NO: 4565848 - DNA, 17 bp, Homo sapiens
cttggttgttaatttag

SEQ ID NO: 4565849 - DNA, 15 bp, Homo sapiens
cttggttgttccttt

SEQ ID NO: 4565850 - DNA, 22 bp, Homo sapiens
cttggttgttcctttttctttt

SEQ ID NO: 4565851 - DNA, 14 bp, Homo sapiens
cttggttttatggt

SEQ ID NO: 4565852 - DNA, 15 bp, Homo sapiens
cttgtaaaatgcttt

SEQ ID NO: 4565853 - DNA, 13 bp, Homo sapiens
cttgtaaatcttt

SEQ ID NO: 4565854 - DNA, 14 bp, Homo sapiens
cttgtaactccacc

SEQ ID NO: 4565855 - DNA, 21 bp, Homo sapiens
cttgtaactccaccaacccat

SEQ ID NO: 4565856 - DNA, 14 bp, Homo sapiens
cttgtaagaccctt

SEQ ID NO: 4565857 - DNA, 12 bp, Homo sapiens
cttgtaatatgt

SEQ ID NO: 4565858 - DNA, 13 bp, Homo sapiens
cttgtacaaactt

SEQ ID NO: 4565859 - DNA, 17 bp, Homo sapiens
cttgtaccatagaaaaa

SEQ ID NO: 4565860 - DNA, 22 bp, Homo sapiens
cttgtaccatagaaaaatgtat

SEQ ID NO: 4565861 - DNA, 12 bp, Homo sapiens
cttgtataatat

SEQ ID NO: 4565862 - DNA, 13 bp, Homo sapiens
cttgtatagcttt

SEQ ID NO: 4565863 - DNA, 23 bp, Homo sapiens
cttgtatatatggatcagaggag

SEQ ID NO: 4565864 - DNA, 19 bp, Homo sapiens
cttgtatctggattcaaat

SEQ ID NO: 4565865 - DNA, 17 bp, Homo sapiens
cttgtattaagttgtta

SEQ ID NO: 4565866 - DNA, 18 bp, Homo sapiens
cttgtattctgaggatgt

SEQ ID NO: 4565867 - DNA, 17 bp, Homo sapiens
cttgtattgtaaatgtg

SEQ ID NO: 4565868 - DNA, 17 bp, Homo sapiens
cttgtatttaaaaacat

SEQ ID NO: 4565869 - DNA, 18 bp, Homo sapiens
cttgtatttaaaaacatt

SEQ ID NO: 4565870 - DNA, 13 bp, Homo sapiens
cttgtatttccaa

SEQ ID NO: 4565871 - DNA, 19 bp, Homo sapiens
cttgtcaaagaaggtgctg

SEQ ID NO: 4565872 - DNA, 23 bp, Homo sapiens
cttgtcaaagaaggtgctgatcc

SEQ ID NO: 4565873 - DNA, 21 bp, Homo sapiens
cttgtcaacaaagtgcttttt

SEQ ID NO: 4565874 - DNA, 15 bp, Homo sapiens
cttgtccacccacct

SEQ ID NO: 4565875 - DNA, 17 bp, Homo sapiens
cttgtcccaattaaaat

SEQ ID NO: 4565876 - DNA, 15 bp, Homo sapiens
cttgtccccacccat

SEQ ID NO: 4565877 - DNA, 13 bp, Homo sapiens
cttgtcctcttct

SEQ ID NO: 4565878 - DNA, 17 bp, Homo sapiens
cttgtcctcttctgctc

SEQ ID NO: 4565879 - DNA, 17 bp, Homo sapiens
cttgtcctgggcctgcc

SEQ ID NO: 4565880 - DNA, 21 bp, Homo sapiens
cttgtcggccccaccagtgcc

SEQ ID NO: 4565881 - DNA, 23 bp, Homo sapiens
cttgtcggccccaccagtgcctc

SEQ ID NO: 4565882 - DNA, 14 bp, Homo sapiens
cttgtctggctttg

SEQ ID NO: 4565883 - DNA, 12 bp, Homo sapiens
cttgtctgtgat

SEQ ID NO: 4565884 - DNA, 13 bp, Homo sapiens
cttgtctttattt

SEQ ID NO: 4565885 - DNA, 15 bp, Homo sapiens
cttgtgaatgcttct

SEQ ID NO: 4565886 - DNA, 15 bp, Homo sapiens
cttgtgagcatcaga

SEQ ID NO: 4565887 - DNA, 19 bp, Homo sapiens
cttgtgataggtacctgag

SEQ ID NO: 4565888 - DNA, 21 bp, Homo sapiens
cttgtgcaaaatatttgacta

SEQ ID NO: 4565889 - DNA, 12 bp, Homo sapiens
cttgtgcttctt

SEQ ID NO: 4565890 - DNA, 19 bp, Homo sapiens
cttgtggagccccacactg

SEQ ID NO: 4565891 - DNA, 17 bp, Homo sapiens
cttgtggataagtggct

SEQ ID NO: 4565892 - DNA, 18 bp, Homo sapiens
cttgtggccctctccctt

SEQ ID NO: 4565893 - DNA, 22 bp, Homo sapiens
cttgtggccctctcccttaccc

SEQ ID NO: 4565894 - DNA, 14 bp, Homo sapiens
cttgtgtagatttg

SEQ ID NO: 4565895 - DNA, 17 bp, Homo sapiens
cttgtgtagatttgaaa

SEQ ID NO: 4565896 - DNA, 18 bp, Homo sapiens
cttgtgtcaagacatttc

SEQ ID NO: 4565897 - DNA, 16 bp, Homo sapiens
cttgtgtgcatggaag

SEQ ID NO: 4565898 - DNA, 20 bp, Homo sapiens
cttgtgtgcatggaagtaat

SEQ ID NO: 4565899 - DNA, 22 bp, Homo sapiens
cttgtgtgcatggaagtaatta

SEQ ID NO: 4565900 - DNA, 18 bp, Homo sapiens
cttgttactgctgattct

SEQ ID NO: 4565901 - DNA, 21 bp, Homo sapiens
cttgttactgctgattcttgt

SEQ ID NO: 4565902 - DNA, 18 bp, Homo sapiens
cttgttagagagaaagag

SEQ ID NO: 4565903 - DNA, 18 bp, Homo sapiens
cttgttattaatgtttct

SEQ ID NO: 4565904 - DNA, 18 bp, Homo sapiens
cttgttccaatgccacat

SEQ ID NO: 4565905 - DNA, 15 bp, Homo sapiens
cttgttcctgtgcat

SEQ ID NO: 4565906 - DNA, 16 bp, Homo sapiens
cttgttctgagattca

SEQ ID NO: 4565907 - DNA, 21 bp, Homo sapiens
cttgttggatttttgtcttgt

SEQ ID NO: 4565908 - DNA, 13 bp, Homo sapiens
cttgttgtattcc

SEQ ID NO: 4565909 - DNA, 22 bp, Homo sapiens
cttgttgtttgttgacagcttg

SEQ ID NO: 4565910 - DNA, 22 bp, Homo sapiens
cttgtttacagcactactctgt

SEQ ID NO: 4565911 - DNA, 16 bp, Homo sapiens
cttgtttatgatattt

SEQ ID NO: 4565912 - DNA, 14 bp, Homo sapiens
cttgtttattaaat

SEQ ID NO: 4565913 - DNA, 19 bp, Homo sapiens
cttgtttattgagtttgta

SEQ ID NO: 4565914 - DNA, 18 bp, Homo sapiens
cttgtttgagtttttcct

SEQ ID NO: 4565915 - DNA, 19 bp, Homo sapiens
cttgtttgagtttttcctc

SEQ ID NO: 4565916 - DNA, 22 bp, Homo sapiens
cttgtttgattttagctgcaga

SEQ ID NO: 4565917 - DNA, 19 bp, Homo sapiens
cttgtttggtagttagcca

SEQ ID NO: 4565918 - DNA, 17 bp, Homo sapiens
cttgtttttcttcagca

SEQ ID NO: 4565919 - DNA, 19 bp, Homo sapiens
ctttaaaaaaaaaatgctt

SEQ ID NO: 4565920 - DNA, 17 bp, Homo sapiens
ctttaaaacaaaacaaa

SEQ ID NO: 4565921 - DNA, 15 bp, Homo sapiens
ctttaaaagaatgac

SEQ ID NO: 4565922 - DNA, 22 bp, Homo sapiens
ctttaaacctgtagaatcaatt

SEQ ID NO: 4565923 - DNA, 21 bp, Homo sapiens
ctttaaaggcatctacacaat

SEQ ID NO: 4565924 - DNA, 20 bp, Homo sapiens
ctttaaagggatggcaagat

SEQ ID NO: 4565925 - DNA, 15 bp, Homo sapiens
ctttaaagtatttct

SEQ ID NO: 4565926 - DNA, 10 bp, Homo sapiens
ctttaaataa

SEQ ID NO: 4565927 - DNA, 15 bp, Homo sapiens
ctttaaataaattaa

SEQ ID NO: 4565928 - DNA, 12 bp, Homo sapiens
ctttaaataata

SEQ ID NO: 4565929 - DNA, 14 bp, Homo sapiens
ctttaaataattta

SEQ ID NO: 4565930 - DNA, 15 bp, Homo sapiens
ctttaaatcatttta

SEQ ID NO: 4565931 - DNA, 21 bp, Homo sapiens
ctttaaatgacagtaatattg

SEQ ID NO: 4565932 - DNA, 14 bp, Homo sapiens
ctttaaatgtgtat

SEQ ID NO: 4565933 - DNA, 23 bp, Homo sapiens
ctttaaattatatgatatgcatg

SEQ ID NO: 4565934 - DNA, 12 bp, Homo sapiens
ctttaaattatg

SEQ ID NO: 4565935 - DNA, 19 bp, Homo sapiens
ctttaaccaggaatattaa

SEQ ID NO: 4565936 - DNA, 15 bp, Homo sapiens
ctttaacttaaatag

SEQ ID NO: 4565937 - DNA, 19 bp, Homo sapiens
ctttaagaaccttaatgac

SEQ ID NO: 4565938 - DNA, 14 bp, Homo sapiens
ctttaagacatact

SEQ ID NO: 4565939 - DNA, 15 bp, Homo sapiens
ctttaagagtttaaa

SEQ ID NO: 4565940 - DNA, 18 bp, Homo sapiens
ctttaagtgtgctgggca

SEQ ID NO: 4565941 - DNA, 20 bp, Homo sapiens
ctttaagtgtgctgggcaga

SEQ ID NO: 4565942 - DNA, 19 bp, Homo sapiens
ctttaataagtcattgaaa

SEQ ID NO: 4565943 - DNA, 12 bp, Homo sapiens
ctttaatacagc

SEQ ID NO: 4565944 - DNA, 16 bp, Homo sapiens
ctttaatattttgtaa

SEQ ID NO: 4565945 - DNA, 14 bp, Homo sapiens
ctttaattctgtat

SEQ ID NO: 4565946 - DNA, 18 bp, Homo sapiens
ctttaattctgtatctgt

SEQ ID NO: 4565947 - DNA, 21 bp, Homo sapiens
ctttacaagggagaagacaac

SEQ ID NO: 4565948 - DNA, 21 bp, Homo sapiens
ctttacatctaagaatttttt

SEQ ID NO: 4565949 - DNA, 17 bp, Homo sapiens
ctttacctgtgaagtgt

SEQ ID NO: 4565950 - DNA, 20 bp, Homo sapiens
ctttacgttcatcacctgct

SEQ ID NO: 4565951 - DNA, 16 bp, Homo sapiens
ctttacttatctctca

SEQ ID NO: 4565952 - DNA, 17 bp, Homo sapiens
ctttacttatctctcaa

SEQ ID NO: 4565953 - DNA, 22 bp, Homo sapiens
ctttacttatctctcaaaacaa

SEQ ID NO: 4565954 - DNA, 18 bp, Homo sapiens
ctttactttttccatttg

SEQ ID NO: 4565955 - DNA, 12 bp, Homo sapiens
ctttagaaaata

SEQ ID NO: 4565956 - DNA, 14 bp, Homo sapiens
ctttagaaacagtg

SEQ ID NO: 4565957 - DNA, 13 bp, Homo sapiens
ctttagcacgttt

SEQ ID NO: 4565958 - DNA, 19 bp, Homo sapiens
ctttagcacgtttaaagtt

SEQ ID NO: 4565959 - DNA, 16 bp, Homo sapiens
ctttagccatcataac

SEQ ID NO: 4565960 - DNA, 21 bp, Homo sapiens
ctttaggtaaggagaagaggg

SEQ ID NO: 4565961 - DNA, 21 bp, Homo sapiens
ctttaggtcaaactccctagt

SEQ ID NO: 4565962 - DNA, 13 bp, Homo sapiens
ctttaggtttttt

SEQ ID NO: 4565963 - DNA, 16 bp, Homo sapiens
ctttagtacaatttca

SEQ ID NO: 4565964 - DNA, 22 bp, Homo sapiens
ctttagtagtaacaaaagggtt

SEQ ID NO: 4565965 - DNA, 15 bp, Homo sapiens
ctttagtgttctgtt

SEQ ID NO: 4565966 - DNA, 19 bp, Homo sapiens
ctttagtgttctgtttgaa

SEQ ID NO: 4565967 - DNA, 15 bp, Homo sapiens
ctttagttatattca

SEQ ID NO: 4565968 - DNA, 12 bp, Homo sapiens
ctttatacaatt

SEQ ID NO: 4565969 - DNA, 20 bp, Homo sapiens
ctttatagctgcaagtgtat

SEQ ID NO: 4565970 - DNA, 16 bp, Homo sapiens
ctttatagtgaagtgt

SEQ ID NO: 4565971 - DNA, 17 bp, Homo sapiens
ctttatatctgtaatga

SEQ ID NO: 4565972 - DNA, 18 bp, Homo sapiens
ctttatatctgtaatgat

SEQ ID NO: 4565973 - DNA, 17 bp, Homo sapiens
ctttatatcttgtttac

SEQ ID NO: 4565974 - DNA, 20 bp, Homo sapiens
ctttatatcttgtttacaat

SEQ ID NO: 4565975 - DNA, 13 bp, Homo sapiens
ctttatatgaaga

SEQ ID NO: 4565976 - DNA, 22 bp, Homo sapiens
ctttatatgaagaaaatcactt

SEQ ID NO: 4565977 - DNA, 15 bp, Homo sapiens
ctttatatttgctcc

SEQ ID NO: 4565978 - DNA, 22 bp, Homo sapiens
ctttatccagctagtgccaaat

SEQ ID NO: 4565979 - DNA, 17 bp, Homo sapiens
ctttatccccgtttctt

SEQ ID NO: 4565980 - DNA, 21 bp, Homo sapiens
ctttatccccgtttcttgcaa

SEQ ID NO: 4565981 - DNA, 22 bp, Homo sapiens
ctttatggtcctaaaagcaaaa

SEQ ID NO: 4565982 - DNA, 19 bp, Homo sapiens
ctttatgtagtttttatat

SEQ ID NO: 4565983 - DNA, 21 bp, Homo sapiens
ctttatgtctgtggatttttt

SEQ ID NO: 4565984 - DNA, 12 bp, Homo sapiens
ctttatgtgaat

SEQ ID NO: 4565985 - DNA, 17 bp, Homo sapiens
ctttatgtgaattttta

SEQ ID NO: 4565986 - DNA, 12 bp, Homo sapiens
ctttattattat

SEQ ID NO: 4565987 - DNA, 19 bp, Homo sapiens
ctttattgaattagaaaat

SEQ ID NO: 4565988 - DNA, 20 bp, Homo sapiens
ctttattgaattagaaaatt

SEQ ID NO: 4565989 - DNA, 20 bp, Homo sapiens
ctttattgccccttcttatt

SEQ ID NO: 4565990 - DNA, 14 bp, Homo sapiens
ctttattgtctgta

SEQ ID NO: 4565991 - DNA, 18 bp, Homo sapiens
ctttattgtctgtaaatc

SEQ ID NO: 4565992 - DNA, 22 bp, Homo sapiens
ctttatttacttcgttttggtt

SEQ ID NO: 4565993 - DNA, 19 bp, Homo sapiens
ctttatttattaaacttca

SEQ ID NO: 4565994 - DNA, 16 bp, Homo sapiens
ctttattttatataat

SEQ ID NO: 4565995 - DNA, 20 bp, Homo sapiens
ctttattttatataataaag

SEQ ID NO: 4565996 - DNA, 23 bp, Homo sapiens
ctttattttatataataaagtat

SEQ ID NO: 4565997 - DNA, 15 bp, Homo sapiens
ctttcaaaagcaaac

SEQ ID NO: 4565998 - DNA, 18 bp, Homo sapiens
ctttcaaaccagcttcat

SEQ ID NO: 4565999 - DNA, 16 bp, Homo sapiens
ctttcaaagctaaaat

SEQ ID NO: 4566000 - DNA, 18 bp, Homo sapiens
ctttcaaagctaaaatat

SEQ ID NO: 4566001 - DNA, 11 bp, Homo sapiens
ctttcaaattt

SEQ ID NO: 4566002 - DNA, 16 bp, Homo sapiens
ctttcaagatctaaat

SEQ ID NO: 4566003 - DNA, 20 bp, Homo sapiens
ctttcaattgtcacttttta

SEQ ID NO: 4566004 - DNA, 17 bp, Homo sapiens
ctttcaccctcatgaaa

SEQ ID NO: 4566005 - DNA, 20 bp, Homo sapiens
ctttcactataatgtgaaat

SEQ ID NO: 4566006 - DNA, 16 bp, Homo sapiens
ctttcagatgtcttct

SEQ ID NO: 4566007 - DNA, 20 bp, Homo sapiens
ctttcagatgtcttctgcct

SEQ ID NO: 4566008 - DNA, 22 bp, Homo sapiens
ctttcagatgtcttctgcctgt

SEQ ID NO: 4566009 - DNA, 22 bp, Homo sapiens
ctttcagccacatgccccaggc

SEQ ID NO: 4566010 - DNA, 14 bp, Homo sapiens
ctttcaggctactg

SEQ ID NO: 4566011 - DNA, 18 bp, Homo sapiens
ctttcaggctactgttct

SEQ ID NO: 4566012 - DNA, 23 bp, Homo sapiens
ctttcaggctactgttcttgaca

SEQ ID NO: 4566013 - DNA, 14 bp, Homo sapiens
ctttcagtactttt

SEQ ID NO: 4566014 - DNA, 23 bp, Homo sapiens
ctttcataatttaaaaatctcca

SEQ ID NO: 4566015 - DNA, 17 bp, Homo sapiens
ctttcatcctgactctg

SEQ ID NO: 4566016 - DNA, 19 bp, Homo sapiens
ctttcatcctgactctgcc

SEQ ID NO: 4566017 - DNA, 17 bp, Homo sapiens
ctttcatgtaaactgtg

SEQ ID NO: 4566018 - DNA, 19 bp, Homo sapiens
ctttcattctaatccttgc

SEQ ID NO: 4566019 - DNA, 15 bp, Homo sapiens
ctttcattgccagtg

SEQ ID NO: 4566020 - DNA, 22 bp, Homo sapiens
ctttcattgctaagactaactc

SEQ ID NO: 4566021 - DNA, 16 bp, Homo sapiens
ctttcatttttttcca

SEQ ID NO: 4566022 - DNA, 20 bp, Homo sapiens
ctttcatttttttccaggct

SEQ ID NO: 4566023 - DNA, 22 bp, Homo sapiens
ctttcatttttttccaggctgg

SEQ ID NO: 4566024 - DNA, 13 bp, Homo sapiens
ctttccaaattat

SEQ ID NO: 4566025 - DNA, 16 bp, Homo sapiens
ctttccaatagaaaga

SEQ ID NO: 4566026 - DNA, 19 bp, Homo sapiens
ctttccaatgccacagaca

SEQ ID NO: 4566027 - DNA, 22 bp, Homo sapiens
ctttccacggagccactcctct

SEQ ID NO: 4566028 - DNA, 18 bp, Homo sapiens
ctttccaggcaccctcag

SEQ ID NO: 4566029 - DNA, 21 bp, Homo sapiens
ctttccatttttttctttact

SEQ ID NO: 4566030 - DNA, 22 bp, Homo sapiens
ctttccatttttttctttactt

SEQ ID NO: 4566031 - DNA, 17 bp, Homo sapiens
ctttcccagtctgtcga

SEQ ID NO: 4566032 - DNA, 20 bp, Homo sapiens
ctttcccagtgagtctctgg

SEQ ID NO: 4566033 - DNA, 15 bp, Homo sapiens
ctttcccatgtattt

SEQ ID NO: 4566034 - DNA, 17 bp, Homo sapiens
ctttccccagaggctcc

SEQ ID NO: 4566035 - DNA, 21 bp, Homo sapiens
ctttccccagaggctcccaat

SEQ ID NO: 4566036 - DNA, 13 bp, Homo sapiens
ctttcccctagat

SEQ ID NO: 4566037 - DNA, 16 bp, Homo sapiens
ctttccctaaattgat

SEQ ID NO: 4566038 - DNA, 19 bp, Homo sapiens
ctttccctcaccccctccc

SEQ ID NO: 4566039 - DNA, 16 bp, Homo sapiens
ctttccgactgcccag

SEQ ID NO: 4566040 - DNA, 17 bp, Homo sapiens
ctttccgactgcccaga

SEQ ID NO: 4566041 - DNA, 21 bp, Homo sapiens
ctttccgctgtcgccccaggc

SEQ ID NO: 4566042 - DNA, 19 bp, Homo sapiens
ctttcctatctagcattta

SEQ ID NO: 4566043 - DNA, 18 bp, Homo sapiens
ctttcctcaaaaagcaga

SEQ ID NO: 4566044 - DNA, 19 bp, Homo sapiens
ctttcctcaaaacttcaga

SEQ ID NO: 4566045 - DNA, 16 bp, Homo sapiens
ctttcctcaaatcaaa

SEQ ID NO: 4566046 - DNA, 16 bp, Homo sapiens
ctttcctccccctgca

SEQ ID NO: 4566047 - DNA, 13 bp, Homo sapiens
ctttcctcctctg

SEQ ID NO: 4566048 - DNA, 14 bp, Homo sapiens
ctttcctcctctga

SEQ ID NO: 4566049 - DNA, 15 bp, Homo sapiens
ctttcctcctctgac

SEQ ID NO: 4566050 - DNA, 18 bp, Homo sapiens
ctttcctccttcactgtt

SEQ ID NO: 4566051 - DNA, 22 bp, Homo sapiens
ctttcctgaatccaaactaatc

SEQ ID NO: 4566052 - DNA, 14 bp, Homo sapiens
ctttcctgccctgt

SEQ ID NO: 4566053 - DNA, 13 bp, Homo sapiens
ctttcctgttcag

SEQ ID NO: 4566054 - DNA, 17 bp, Homo sapiens
ctttcctgttcagcatt

SEQ ID NO: 4566055 - DNA, 14 bp, Homo sapiens
ctttccttcatctc

SEQ ID NO: 4566056 - DNA, 15 bp, Homo sapiens
ctttccttccatccc

SEQ ID NO: 4566057 - DNA, 12 bp, Homo sapiens
ctttccttccct

SEQ ID NO: 4566058 - DNA, 12 bp, Homo sapiens
ctttcctttaaa

SEQ ID NO: 4566059 - DNA, 15 bp, Homo sapiens
ctttcctttaaaaat

SEQ ID NO: 4566060 - DNA, 17 bp, Homo sapiens
ctttcctttaaaaatac

SEQ ID NO: 4566061 - DNA, 20 bp, Homo sapiens
ctttcctttaaaaatacata

SEQ ID NO: 4566062 - DNA, 18 bp, Homo sapiens
ctttccttttttgagatt

SEQ ID NO: 4566063 - DNA, 22 bp, Homo sapiens
ctttctagaaagagaaacagtt

SEQ ID NO: 4566064 - DNA, 14 bp, Homo sapiens
ctttctatgtgaca

SEQ ID NO: 4566065 - DNA, 17 bp, Homo sapiens
ctttctcacctttccca

SEQ ID NO: 4566066 - DNA, 21 bp, Homo sapiens
ctttctcagaggggccagcta

SEQ ID NO: 4566067 - DNA, 21 bp, Homo sapiens
ctttctcaggagcttgggcag

SEQ ID NO: 4566068 - DNA, 17 bp, Homo sapiens
ctttctcagttttcata

SEQ ID NO: 4566069 - DNA, 21 bp, Homo sapiens
ctttctcccagtatgttttaa

SEQ ID NO: 4566070 - DNA, 16 bp, Homo sapiens
ctttctcctgtgaatg

SEQ ID NO: 4566071 - DNA, 13 bp, Homo sapiens
ctttctctcagtg

SEQ ID NO: 4566072 - DNA, 16 bp, Homo sapiens
ctttctctctcatgcc

SEQ ID NO: 4566073 - DNA, 23 bp, Homo sapiens
ctttctctctcatgcctcctgag

SEQ ID NO: 4566074 - DNA, 19 bp, Homo sapiens
ctttctctctcctctctgc

SEQ ID NO: 4566075 - DNA, 11 bp, Homo sapiens
ctttctctgca

SEQ ID NO: 4566076 - DNA, 15 bp, Homo sapiens
ctttctctgtgaaag

SEQ ID NO: 4566077 - DNA, 20 bp, Homo sapiens
ctttctcttccttttatata

SEQ ID NO: 4566078 - DNA, 18 bp, Homo sapiens
ctttctgaagatcaattt

SEQ ID NO: 4566079 - DNA, 14 bp, Homo sapiens
ctttctgaaggaag

SEQ ID NO: 4566080 - DNA, 23 bp, Homo sapiens
ctttctgagtgagttttactctt

SEQ ID NO: 4566081 - DNA, 17 bp, Homo sapiens
ctttctgagtgccttct

SEQ ID NO: 4566082 - DNA, 18 bp, Homo sapiens
ctttctgagtgccttctg

SEQ ID NO: 4566083 - DNA, 21 bp, Homo sapiens
ctttctgagtgccttctgtgg

SEQ ID NO: 4566084 - DNA, 16 bp, Homo sapiens
ctttctgcacacaaat

SEQ ID NO: 4566085 - DNA, 19 bp, Homo sapiens
ctttctgcacacaaatatt

SEQ ID NO: 4566086 - DNA, 20 bp, Homo sapiens
ctttctgtatatactttttt

SEQ ID NO: 4566087 - DNA, 12 bp, Homo sapiens
ctttctgtccca

SEQ ID NO: 4566088 - DNA, 13 bp, Homo sapiens
ctttctgtcccac

SEQ ID NO: 4566089 - DNA, 18 bp, Homo sapiens
ctttctgtcttctacaga

SEQ ID NO: 4566090 - DNA, 12 bp, Homo sapiens
ctttctgttcca

SEQ ID NO: 4566091 - DNA, 23 bp, Homo sapiens
ctttctgttccaaattcagtttc

SEQ ID NO: 4566092 - DNA, 21 bp, Homo sapiens
ctttctgttggattccatgct

SEQ ID NO: 4566093 - DNA, 23 bp, Homo sapiens
ctttctgtttggacccatggtca

SEQ ID NO: 4566094 - DNA, 14 bp, Homo sapiens
ctttctgttttgtt

SEQ ID NO: 4566095 - DNA, 22 bp, Homo sapiens
ctttcttcaccaagtgcaatag

SEQ ID NO: 4566096 - DNA, 14 bp, Homo sapiens
ctttctttaatagt

SEQ ID NO: 4566097 - DNA, 18 bp, Homo sapiens
ctttctttgcaccaaaga

SEQ ID NO: 4566098 - DNA, 20 bp, Homo sapiens
ctttctttggtgcctttcct

SEQ ID NO: 4566099 - DNA, 11 bp, Homo sapiens
ctttcttttct

SEQ ID NO: 4566100 - DNA, 15 bp, Homo sapiens
ctttctttttcttct

SEQ ID NO: 4566101 - DNA, 15 bp, Homo sapiens
ctttgaaacctcagg

SEQ ID NO: 4566102 - DNA, 16 bp, Homo sapiens
ctttgaaacctcaggg

SEQ ID NO: 4566103 - DNA, 20 bp, Homo sapiens
ctttgaaacctgctctgtag

SEQ ID NO: 4566104 - DNA, 16 bp, Homo sapiens
ctttgaactgcagcaa

SEQ ID NO: 4566105 - DNA, 21 bp, Homo sapiens
ctttgaataaagaatacttga

SEQ ID NO: 4566106 - DNA, 22 bp, Homo sapiens
ctttgaataaagaatacttgaa

SEQ ID NO: 4566107 - DNA, 24 bp, Homo sapiens
ctttgacaaaatgactggctcctg

SEQ ID NO: 4566108 - DNA, 21 bp, Homo sapiens
ctttgacaattgggagctgcc

SEQ ID NO: 4566109 - DNA, 23 bp, Homo sapiens
ctttgacaattgggagctgccaa

SEQ ID NO: 4566110 - DNA, 16 bp, Homo sapiens
ctttgacacccaggct

SEQ ID NO: 4566111 - DNA, 18 bp, Homo sapiens
ctttgacgtattatctgt

SEQ ID NO: 4566112 - DNA, 19 bp, Homo sapiens
ctttgactctataagcaaa

SEQ ID NO: 4566113 - DNA, 13 bp, Homo sapiens
ctttgactctggg

SEQ ID NO: 4566114 - DNA, 15 bp, Homo sapiens
ctttgactctggggt

SEQ ID NO: 4566115 - DNA, 13 bp, Homo sapiens
ctttgactgtcag

SEQ ID NO: 4566116 - DNA, 23 bp, Homo sapiens
ctttgacttaagggttgcttgct

SEQ ID NO: 4566117 - DNA, 14 bp, Homo sapiens
ctttgactttttgc

SEQ ID NO: 4566118 - DNA, 13 bp, Homo sapiens
ctttgagcccatt

SEQ ID NO: 4566119 - DNA, 22 bp, Homo sapiens
ctttgagcccattcttctgggt

SEQ ID NO: 4566120 - DNA, 21 bp, Homo sapiens
ctttgagcttaatctttgaaa

SEQ ID NO: 4566121 - DNA, 16 bp, Homo sapiens
ctttgagtccacgccc

SEQ ID NO: 4566122 - DNA, 18 bp, Homo sapiens
ctttgatctacttgcctc

SEQ ID NO: 4566123 - DNA, 18 bp, Homo sapiens
ctttgattctccttcagc

SEQ ID NO: 4566124 - DNA, 19 bp, Homo sapiens
ctttgattctccttcagcc

SEQ ID NO: 4566125 - DNA, 15 bp, Homo sapiens
ctttgcaagatgctt

SEQ ID NO: 4566126 - DNA, 17 bp, Homo sapiens
ctttgcaagatgcttgg

SEQ ID NO: 4566127 - DNA, 20 bp, Homo sapiens
ctttgcacactttggcccag

SEQ ID NO: 4566128 - DNA, 14 bp, Homo sapiens
ctttgcaccaaaga

SEQ ID NO: 4566129 - DNA, 15 bp, Homo sapiens
ctttgcaccaaagac

SEQ ID NO: 4566130 - DNA, 18 bp, Homo sapiens
ctttgcaccaaagacatc

SEQ ID NO: 4566131 - DNA, 22 bp, Homo sapiens
ctttgcagaccgcatagtcact

SEQ ID NO: 4566132 - DNA, 12 bp, Homo sapiens
ctttgcagctgc

SEQ ID NO: 4566133 - DNA, 15 bp, Homo sapiens
ctttgcagctgcttt

SEQ ID NO: 4566134 - DNA, 19 bp, Homo sapiens
ctttgcagctgcttttgca

SEQ ID NO: 4566135 - DNA, 20 bp, Homo sapiens
ctttgcagttggactctcag

SEQ ID NO: 4566136 - DNA, 23 bp, Homo sapiens
ctttgcagttggactctcaggga

SEQ ID NO: 4566137 - DNA, 15 bp, Homo sapiens
ctttgccaaaatacc

SEQ ID NO: 4566138 - DNA, 16 bp, Homo sapiens
ctttgccaaggctctc

SEQ ID NO: 4566139 - DNA, 17 bp, Homo sapiens
ctttgccaaggctctcc

SEQ ID NO: 4566140 - DNA, 22 bp, Homo sapiens
ctttgccaaggctctcccctct

SEQ ID NO: 4566141 - DNA, 17 bp, Homo sapiens
ctttgccagcagagcca

SEQ ID NO: 4566142 - DNA, 15 bp, Homo sapiens
ctttgcccagaaaga

SEQ ID NO: 4566143 - DNA, 22 bp, Homo sapiens
ctttgcctcctgtgtactgtgt

SEQ ID NO: 4566144 - DNA, 12 bp, Homo sapiens
ctttgcctctgc

SEQ ID NO: 4566145 - DNA, 12 bp, Homo sapiens
ctttgcctcttc

SEQ ID NO: 4566146 - DNA, 16 bp, Homo sapiens
ctttgcctcttctttg

SEQ ID NO: 4566147 - DNA, 17 bp, Homo sapiens
ctttgcctcttctttgt

SEQ ID NO: 4566148 - DNA, 22 bp, Homo sapiens
ctttgccttgggctgctcctca

SEQ ID NO: 4566149 - DNA, 14 bp, Homo sapiens
ctttgctgttactg

SEQ ID NO: 4566150 - DNA, 18 bp, Homo sapiens
ctttgctgttactgcttc

SEQ ID NO: 4566151 - DNA, 21 bp, Homo sapiens
ctttgctgttactgcttctct

SEQ ID NO: 4566152 - DNA, 23 bp, Homo sapiens
ctttgctgttactgcttctcttt

SEQ ID NO: 4566153 - DNA, 15 bp, Homo sapiens
ctttgcttgaacaca

SEQ ID NO: 4566154 - DNA, 19 bp, Homo sapiens
ctttgcttgaacacagtat

SEQ ID NO: 4566155 - DNA, 12 bp, Homo sapiens
ctttgctttgta

SEQ ID NO: 4566156 - DNA, 13 bp, Homo sapiens
ctttgctttgtag

SEQ ID NO: 4566157 - DNA, 19 bp, Homo sapiens
ctttgctttgtagtttgct

SEQ ID NO: 4566158 - DNA, 22 bp, Homo sapiens
ctttggacccagggcctgactt

SEQ ID NO: 4566159 - DNA, 24 bp, Homo sapiens
ctttggacccagggcctgacttga

SEQ ID NO: 4566160 - DNA, 12 bp, Homo sapiens
ctttggacttgt

SEQ ID NO: 4566161 - DNA, 17 bp, Homo sapiens
ctttggagttaaaatgc

SEQ ID NO: 4566162 - DNA, 15 bp, Homo sapiens
ctttggatttgacat

SEQ ID NO: 4566163 - DNA, 18 bp, Homo sapiens
ctttggcaatttcctggc

SEQ ID NO: 4566164 - DNA, 22 bp, Homo sapiens
ctttggcaatttcctggccctc

SEQ ID NO: 4566165 - DNA, 19 bp, Homo sapiens
ctttggcactctctgccat

SEQ ID NO: 4566166 - DNA, 11 bp, Homo sapiens
ctttggcccaa

SEQ ID NO: 4566167 - DNA, 15 bp, Homo sapiens
ctttggcccaatgcc

SEQ ID NO: 4566168 - DNA, 16 bp, Homo sapiens
ctttggcccagggtgg

SEQ ID NO: 4566169 - DNA, 20 bp, Homo sapiens
ctttgggaggccgaggcggg

SEQ ID NO: 4566170 - DNA, 17 bp, Homo sapiens
ctttgggaggctgaggc

SEQ ID NO: 4566171 - DNA, 16 bp, Homo sapiens
ctttgggcccagggac

SEQ ID NO: 4566172 - DNA, 17 bp, Homo sapiens
ctttgggttaagcatta

SEQ ID NO: 4566173 - DNA, 20 bp, Homo sapiens
ctttgggttaagcattacca

SEQ ID NO: 4566174 - DNA, 13 bp, Homo sapiens
ctttggtgccttt

SEQ ID NO: 4566175 - DNA, 14 bp, Homo sapiens
ctttggtgcctttc

SEQ ID NO: 4566176 - DNA, 15 bp, Homo sapiens
ctttggtgcctttcc

SEQ ID NO: 4566177 - DNA, 19 bp, Homo sapiens
ctttggtgttacacagccc

SEQ ID NO: 4566178 - DNA, 19 bp, Homo sapiens
ctttggttaatacatcttt

SEQ ID NO: 4566179 - DNA, 17 bp, Homo sapiens
ctttggtttttttcttc

SEQ ID NO: 4566180 - DNA, 23 bp, Homo sapiens
ctttggtttttttcttctgtatt

SEQ ID NO: 4566181 - DNA, 20 bp, Homo sapiens
ctttgtaaccagaattatac

SEQ ID NO: 4566182 - DNA, 16 bp, Homo sapiens
ctttgtaatactttct

SEQ ID NO: 4566183 - DNA, 17 bp, Homo sapiens
ctttgtaatgtcaccac

SEQ ID NO: 4566184 - DNA, 22 bp, Homo sapiens
ctttgtaatgtcaccaccttcc

SEQ ID NO: 4566185 - DNA, 13 bp, Homo sapiens
ctttgtaccaaaa

SEQ ID NO: 4566186 - DNA, 16 bp, Homo sapiens
ctttgtacttgtgatg

SEQ ID NO: 4566187 - DNA, 20 bp, Homo sapiens
ctttgtagactgtttcacat

SEQ ID NO: 4566188 - DNA, 23 bp, Homo sapiens
ctttgtataatcccacccacctc

SEQ ID NO: 4566189 - DNA, 19 bp, Homo sapiens
ctttgtatcattcatcttc

SEQ ID NO: 4566190 - DNA, 22 bp, Homo sapiens
ctttgtatctttctttctctaa

SEQ ID NO: 4566191 - DNA, 16 bp, Homo sapiens
ctttgtatgacagtga

SEQ ID NO: 4566192 - DNA, 13 bp, Homo sapiens
ctttgtattcaaa

SEQ ID NO: 4566193 - DNA, 18 bp, Homo sapiens
ctttgtattcttcatgaa

SEQ ID NO: 4566194 - DNA, 21 bp, Homo sapiens
ctttgtcacttctgctgtaca

SEQ ID NO: 4566195 - DNA, 15 bp, Homo sapiens
ctttgtcacttgcca

SEQ ID NO: 4566196 - DNA, 16 bp, Homo sapiens
ctttgtctttcaaact

SEQ ID NO: 4566197 - DNA, 11 bp, Homo sapiens
ctttgtctttt

SEQ ID NO: 4566198 - DNA, 14 bp, Homo sapiens
ctttgtcttttcaa

SEQ ID NO: 4566199 - DNA, 22 bp, Homo sapiens
ctttgtgacaggaaagccctcc

SEQ ID NO: 4566200 - DNA, 18 bp, Homo sapiens
ctttgtgcagcttcgagg

SEQ ID NO: 4566201 - DNA, 14 bp, Homo sapiens
ctttgtgcattctg

SEQ ID NO: 4566202 - DNA, 13 bp, Homo sapiens
ctttgtgcctttg

SEQ ID NO: 4566203 - DNA, 23 bp, Homo sapiens
ctttgtggtttagttataaaagg

SEQ ID NO: 4566204 - DNA, 14 bp, Homo sapiens
ctttgtgttcattt

SEQ ID NO: 4566205 - DNA, 18 bp, Homo sapiens
ctttgtgttcatttcatt

SEQ ID NO: 4566206 - DNA, 20 bp, Homo sapiens
ctttgtgttgggagggatta

SEQ ID NO: 4566207 - DNA, 14 bp, Homo sapiens
ctttgtgtttagct

SEQ ID NO: 4566208 - DNA, 22 bp, Homo sapiens
ctttgttattgcaaattgagga

SEQ ID NO: 4566209 - DNA, 20 bp, Homo sapiens
ctttgttgcaagatgtgaat

SEQ ID NO: 4566210 - DNA, 15 bp, Homo sapiens
ctttgttggagtcaa

SEQ ID NO: 4566211 - DNA, 16 bp, Homo sapiens
ctttgtttaaatgcca

SEQ ID NO: 4566212 - DNA, 13 bp, Homo sapiens
ctttgtttactct

SEQ ID NO: 4566213 - DNA, 13 bp, Homo sapiens
ctttgtttcttgt

SEQ ID NO: 4566214 - DNA, 11 bp, Homo sapiens
cttttaaaatg

SEQ ID NO: 4566215 - DNA, 13 bp, Homo sapiens
cttttaaaatgca

SEQ ID NO: 4566216 - DNA, 14 bp, Homo sapiens
cttttaaaattgaa

SEQ ID NO: 4566217 - DNA, 17 bp, Homo sapiens
cttttaaaattgaatag

SEQ ID NO: 4566218 - DNA, 17 bp, Homo sapiens
cttttaaaatttgtaga

SEQ ID NO: 4566219 - DNA, 21 bp, Homo sapiens
cttttaaactactatttttct

SEQ ID NO: 4566220 - DNA, 12 bp, Homo sapiens
cttttaaactgt

SEQ ID NO: 4566221 - DNA, 13 bp, Homo sapiens
cttttaaagtatt

SEQ ID NO: 4566222 - DNA, 16 bp, Homo sapiens
cttttaaattagaaaa

SEQ ID NO: 4566223 - DNA, 22 bp, Homo sapiens
cttttacaagtggttaaaacat

SEQ ID NO: 4566224 - DNA, 21 bp, Homo sapiens
cttttaccagcttttaaccat

SEQ ID NO: 4566225 - DNA, 18 bp, Homo sapiens
cttttacctgctgcttct

SEQ ID NO: 4566226 - DNA, 21 bp, Homo sapiens
cttttagtttgatcagacagc

SEQ ID NO: 4566227 - DNA, 15 bp, Homo sapiens
cttttagtttttccc

SEQ ID NO: 4566228 - DNA, 13 bp, Homo sapiens
cttttataaatta

SEQ ID NO: 4566229 - DNA, 15 bp, Homo sapiens
cttttataaattaaa

SEQ ID NO: 4566230 - DNA, 21 bp, Homo sapiens
cttttataattctcattaaaa

SEQ ID NO: 4566231 - DNA, 19 bp, Homo sapiens
cttttatactctttctgta

SEQ ID NO: 4566232 - DNA, 12 bp, Homo sapiens
cttttatagtgg

SEQ ID NO: 4566233 - DNA, 20 bp, Homo sapiens
cttttatagtggaaaaacac

SEQ ID NO: 4566234 - DNA, 21 bp, Homo sapiens
cttttatataagtgacttgaa

SEQ ID NO: 4566235 - DNA, 13 bp, Homo sapiens
cttttatattcta

SEQ ID NO: 4566236 - DNA, 14 bp, Homo sapiens
cttttatattctaa

SEQ ID NO: 4566237 - DNA, 19 bp, Homo sapiens
cttttatctggtgcctcct

SEQ ID NO: 4566238 - DNA, 19 bp, Homo sapiens
cttttatgattttgtttat

SEQ ID NO: 4566239 - DNA, 20 bp, Homo sapiens
cttttatggatgattaaatt

SEQ ID NO: 4566240 - DNA, 13 bp, Homo sapiens
cttttatggcaaa

SEQ ID NO: 4566241 - DNA, 16 bp, Homo sapiens
cttttatgtgagattt

SEQ ID NO: 4566242 - DNA, 14 bp, Homo sapiens
cttttattaatgca

SEQ ID NO: 4566243 - DNA, 16 bp, Homo sapiens
cttttattaatgcact

SEQ ID NO: 4566244 - DNA, 16 bp, Homo sapiens
cttttattcctttgaa

SEQ ID NO: 4566245 - DNA, 14 bp, Homo sapiens
cttttattctgtta

SEQ ID NO: 4566246 - DNA, 17 bp, Homo sapiens
cttttattgacacagaa

SEQ ID NO: 4566247 - DNA, 22 bp, Homo sapiens
cttttattgcaccattttcaat

SEQ ID NO: 4566248 - DNA, 15 bp, Homo sapiens
cttttatttaacaaa

SEQ ID NO: 4566249 - DNA, 22 bp, Homo sapiens
cttttcaaatagggtctaactc

SEQ ID NO: 4566250 - DNA, 14 bp, Homo sapiens
cttttcaatcttct

SEQ ID NO: 4566251 - DNA, 15 bp, Homo sapiens
cttttcaatgtgatt

SEQ ID NO: 4566252 - DNA, 19 bp, Homo sapiens
cttttcacattaggctgtt

SEQ ID NO: 4566253 - DNA, 20 bp, Homo sapiens
cttttcagaagcaagccaga

SEQ ID NO: 4566254 - DNA, 16 bp, Homo sapiens
cttttcagattgtgga

SEQ ID NO: 4566255 - DNA, 16 bp, Homo sapiens
cttttcatatcatttc

SEQ ID NO: 4566256 - DNA, 18 bp, Homo sapiens
cttttccaagcaaaatct

SEQ ID NO: 4566257 - DNA, 23 bp, Homo sapiens
cttttccacagatttttttgtaa

SEQ ID NO: 4566258 - DNA, 18 bp, Homo sapiens
cttttccaggagttctga

SEQ ID NO: 4566259 - DNA, 16 bp, Homo sapiens
cttttcccccttccca

SEQ ID NO: 4566260 - DNA, 14 bp, Homo sapiens
cttttccctgcttc

SEQ ID NO: 4566261 - DNA, 15 bp, Homo sapiens
cttttccctgcttcc

SEQ ID NO: 4566262 - DNA, 18 bp, Homo sapiens
cttttccctgcttccagg

SEQ ID NO: 4566263 - DNA, 20 bp, Homo sapiens
cttttccctgcttccaggaa

SEQ ID NO: 4566264 - DNA, 11 bp, Homo sapiens
cttttcccttc

SEQ ID NO: 4566265 - DNA, 12 bp, Homo sapiens
cttttcctatcc

SEQ ID NO: 4566266 - DNA, 19 bp, Homo sapiens
cttttcctattttcgatga

SEQ ID NO: 4566267 - DNA, 15 bp, Homo sapiens
cttttcctcttagaa

SEQ ID NO: 4566268 - DNA, 19 bp, Homo sapiens
cttttcctcttagaagaat

SEQ ID NO: 4566269 - DNA, 16 bp, Homo sapiens
cttttcctggtgctct

SEQ ID NO: 4566270 - DNA, 17 bp, Homo sapiens
cttttccttatttgcct

SEQ ID NO: 4566271 - DNA, 20 bp, Homo sapiens
cttttccttatttgccttct

SEQ ID NO: 4566272 - DNA, 22 bp, Homo sapiens
cttttccttcccttttctgttc

SEQ ID NO: 4566273 - DNA, 19 bp, Homo sapiens
cttttctaaactgcatctg

SEQ ID NO: 4566274 - DNA, 15 bp, Homo sapiens
cttttctaattaata

SEQ ID NO: 4566275 - DNA, 15 bp, Homo sapiens
cttttctagagacac

SEQ ID NO: 4566276 - DNA, 16 bp, Homo sapiens
cttttctagagacaca

SEQ ID NO: 4566277 - DNA, 18 bp, Homo sapiens
cttttctagagacacatt

SEQ ID NO: 4566278 - DNA, 20 bp, Homo sapiens
cttttctcaggagcttcaat

SEQ ID NO: 4566279 - DNA, 20 bp, Homo sapiens
cttttctcttttctttctgt

SEQ ID NO: 4566280 - DNA, 18 bp, Homo sapiens
cttttctgccaaaataaa

SEQ ID NO: 4566281 - DNA, 17 bp, Homo sapiens
cttttctgccctggctg

SEQ ID NO: 4566282 - DNA, 14 bp, Homo sapiens
cttttctgtaattc

SEQ ID NO: 4566283 - DNA, 17 bp, Homo sapiens
cttttctgtcttacaag

SEQ ID NO: 4566284 - DNA, 14 bp, Homo sapiens
cttttctttctttt

SEQ ID NO: 4566285 - DNA, 13 bp, Homo sapiens
cttttctttgtat

SEQ ID NO: 4566286 - DNA, 14 bp, Homo sapiens
cttttctttgtatc

SEQ ID NO: 4566287 - DNA, 18 bp, Homo sapiens
cttttcttttttaaagta

SEQ ID NO: 4566288 - DNA, 23 bp, Homo sapiens
cttttgaaaaaaaagtttttaat

SEQ ID NO: 4566289 - DNA, 17 bp, Homo sapiens
cttttgaaagatgtatg

SEQ ID NO: 4566290 - DNA, 17 bp, Homo sapiens
cttttgacaaaggcaag

SEQ ID NO: 4566291 - DNA, 17 bp, Homo sapiens
cttttgagtatggctat

SEQ ID NO: 4566292 - DNA, 15 bp, Homo sapiens
cttttgatgaaataa

SEQ ID NO: 4566293 - DNA, 21 bp, Homo sapiens
cttttgatttataaaactttg

SEQ ID NO: 4566294 - DNA, 24 bp, Homo sapiens
cttttgcaaccaggaacagcaaat

SEQ ID NO: 4566295 - DNA, 14 bp, Homo sapiens
cttttgcagaaatc

SEQ ID NO: 4566296 - DNA, 16 bp, Homo sapiens
cttttgcctgcaggtc

SEQ ID NO: 4566297 - DNA, 13 bp, Homo sapiens
cttttgcctgtaa

SEQ ID NO: 4566298 - DNA, 23 bp, Homo sapiens
cttttgcggttcaggaaaattga

SEQ ID NO: 4566299 - DNA, 19 bp, Homo sapiens
cttttgctgtttatacttg

SEQ ID NO: 4566300 - DNA, 15 bp, Homo sapiens
cttttggcctggggg

SEQ ID NO: 4566301 - DNA, 17 bp, Homo sapiens
cttttggttaatatgtc

SEQ ID NO: 4566302 - DNA, 12 bp, Homo sapiens
cttttgtaagta

SEQ ID NO: 4566303 - DNA, 17 bp, Homo sapiens
cttttgtattaagaaag

SEQ ID NO: 4566304 - DNA, 16 bp, Homo sapiens
cttttgtccacttgta

SEQ ID NO: 4566305 - DNA, 19 bp, Homo sapiens
cttttgtccacttgtaaga

SEQ ID NO: 4566306 - DNA, 20 bp, Homo sapiens
cttttgtccttcctgtgccc

SEQ ID NO: 4566307 - DNA, 17 bp, Homo sapiens
cttttgtgatgaacata

SEQ ID NO: 4566308 - DNA, 18 bp, Homo sapiens
cttttgtgatgaacatat

SEQ ID NO: 4566309 - DNA, 23 bp, Homo sapiens
cttttgtgtgcctggtagaaact

SEQ ID NO: 4566310 - DNA, 15 bp, Homo sapiens
cttttgttaatgcat

SEQ ID NO: 4566311 - DNA, 16 bp, Homo sapiens
cttttgttaatgcatt

SEQ ID NO: 4566312 - DNA, 20 bp, Homo sapiens
cttttgttaatgcattgttg

SEQ ID NO: 4566313 - DNA, 16 bp, Homo sapiens
cttttgttgtacttta

SEQ ID NO: 4566314 - DNA, 14 bp, Homo sapiens
cttttgttgtttat

SEQ ID NO: 4566315 - DNA, 13 bp, Homo sapiens
cttttgtttattt

SEQ ID NO: 4566316 - DNA, 20 bp, Homo sapiens
cttttgtttccttttttccc

SEQ ID NO: 4566317 - DNA, 14 bp, Homo sapiens
ctttttaaaatact

SEQ ID NO: 4566318 - DNA, 20 bp, Homo sapiens
ctttttaaatgtaaagatat

SEQ ID NO: 4566319 - DNA, 17 bp, Homo sapiens
ctttttaactttaccaa

SEQ ID NO: 4566320 - DNA, 14 bp, Homo sapiens
ctttttaagggatt

SEQ ID NO: 4566321 - DNA, 16 bp, Homo sapiens
ctttttaatagcacta

SEQ ID NO: 4566322 - DNA, 16 bp, Homo sapiens
ctttttaatcatgaat

SEQ ID NO: 4566323 - DNA, 15 bp, Homo sapiens
ctttttataaaaaga

SEQ ID NO: 4566324 - DNA, 18 bp, Homo sapiens
ctttttataaaaagataa

SEQ ID NO: 4566325 - DNA, 19 bp, Homo sapiens
ctttttataaaaagataat

SEQ ID NO: 4566326 - DNA, 20 bp, Homo sapiens
ctttttatatttaaaaaatt

SEQ ID NO: 4566327 - DNA, 23 bp, Homo sapiens
ctttttatgctatttctgtatat

SEQ ID NO: 4566328 - DNA, 19 bp, Homo sapiens
ctttttattccttttaaaa

SEQ ID NO: 4566329 - DNA, 23 bp, Homo sapiens
ctttttattgccttctcaccagc

SEQ ID NO: 4566330 - DNA, 13 bp, Homo sapiens
ctttttatttctg

SEQ ID NO: 4566331 - DNA, 16 bp, Homo sapiens
ctttttatttctgcat

SEQ ID NO: 4566332 - DNA, 16 bp, Homo sapiens
ctttttcataattact

SEQ ID NO: 4566333 - DNA, 13 bp, Homo sapiens
ctttttccaatgt

SEQ ID NO: 4566334 - DNA, 12 bp, Homo sapiens
ctttttccacaa

SEQ ID NO: 4566335 - DNA, 23 bp, Homo sapiens
ctttttccagtgttctatttgct

SEQ ID NO: 4566336 - DNA, 13 bp, Homo sapiens
ctttttcctgcgt

SEQ ID NO: 4566337 - DNA, 12 bp, Homo sapiens
ctttttctacat

SEQ ID NO: 4566338 - DNA, 20 bp, Homo sapiens
ctttttctctttccatgaca

SEQ ID NO: 4566339 - DNA, 22 bp, Homo sapiens
ctttttcttcacttacaagaaa

SEQ ID NO: 4566340 - DNA, 13 bp, Homo sapiens
ctttttctttctt

SEQ ID NO: 4566341 - DNA, 17 bp, Homo sapiens
ctttttctttctttgtt

SEQ ID NO: 4566342 - DNA, 10 bp, Homo sapiens
ctttttgaaa

SEQ ID NO: 4566343 - DNA, 14 bp, Homo sapiens
ctttttgaaatgtc

SEQ ID NO: 4566344 - DNA, 14 bp, Homo sapiens
ctttttgacactga

SEQ ID NO: 4566345 - DNA, 12 bp, Homo sapiens
ctttttgcttct

SEQ ID NO: 4566346 - DNA, 15 bp, Homo sapiens
ctttttgcttctact

SEQ ID NO: 4566347 - DNA, 17 bp, Homo sapiens
ctttttgcttctacttt

SEQ ID NO: 4566348 - DNA, 22 bp, Homo sapiens
ctttttggcattatctctttct

SEQ ID NO: 4566349 - DNA, 12 bp, Homo sapiens
ctttttgtgaat

SEQ ID NO: 4566350 - DNA, 16 bp, Homo sapiens
ctttttgttaacagca

SEQ ID NO: 4566351 - DNA, 19 bp, Homo sapiens
ctttttgtttttatttctt

SEQ ID NO: 4566352 - DNA, 18 bp, Homo sapiens
cttttttaaatattttct

SEQ ID NO: 4566353 - DNA, 14 bp, Homo sapiens
cttttttaaattaa

SEQ ID NO: 4566354 - DNA, 16 bp, Homo sapiens
cttttttaaattaata

SEQ ID NO: 4566355 - DNA, 15 bp, Homo sapiens
cttttttaaattttc

SEQ ID NO: 4566356 - DNA, 22 bp, Homo sapiens
cttttttcctgttggtttcatt

SEQ ID NO: 4566357 - DNA, 13 bp, Homo sapiens
cttttttctctct

SEQ ID NO: 4566358 - DNA, 13 bp, Homo sapiens
cttttttctgcct

SEQ ID NO: 4566359 - DNA, 16 bp, Homo sapiens
cttttttctgcctcct

SEQ ID NO: 4566360 - DNA, 17 bp, Homo sapiens
cttttttgagtcattga

SEQ ID NO: 4566361 - DNA, 18 bp, Homo sapiens
cttttttgtttgtttctt

SEQ ID NO: 4566362 - DNA, 22 bp, Homo sapiens
cttttttgtttgtttctttgtg

SEQ ID NO: 4566363 - DNA, 16 bp, Homo sapiens
cttttttgttttttca

SEQ ID NO: 4566364 - DNA, 21 bp, Homo sapiens
cttttttgttttttcaaaata

SEQ ID NO: 4566365 - DNA, 16 bp, Homo sapiens
ctttttttccttttta

SEQ ID NO: 4566366 - DNA, 19 bp, Homo sapiens
ctttttttctatattattg

SEQ ID NO: 4566367 - DNA, 19 bp, Homo sapiens
ctttttttctgtaccagtt

SEQ ID NO: 4566368 - DNA, 22 bp, Homo sapiens
ctttttttgagcgacatctctg

SEQ ID NO: 4566369 - DNA, 21 bp, Homo sapiens
ctttttttgtgtgtatttgct

SEQ ID NO: 4566370 - DNA, 12 bp, Homo sapiens
ctttttttgtta

SEQ ID NO: 4566371 - DNA, 18 bp, Homo sapiens
ctttttttttctctttct

SEQ ID NO: 4566372 - DNA, 15 bp, Homo sapiens
cttttttttttttcc

SEQ ID NO: 4566373 - DNA, 18 bp, Homo sapiens
cttttttttttttttaca

SEQ ID NO: 4566374 - DNA, 22 bp, Homo sapiens
ctttttttttttttttgtgtag

SEQ ID NO: 4566375 - DNA, 15 bp, Homo sapiens
gaaaaaaaaaaaagc

SEQ ID NO: 4566376 - DNA, 19 bp, Homo sapiens
gaaaaaaaaaaagaagaag

SEQ ID NO: 4566377 - DNA, 15 bp, Homo sapiens
gaaaaaaaaaacact

SEQ ID NO: 4566378 - DNA, 22 bp, Homo sapiens
gaaaaaaaactgaagatgaaat

SEQ ID NO: 4566379 - DNA, 15 bp, Homo sapiens
gaaaaaaaagttttt

SEQ ID NO: 4566380 - DNA, 14 bp, Homo sapiens
gaaaaaaaatttgt

SEQ ID NO: 4566381 - DNA, 22 bp, Homo sapiens
gaaaaaaactgggataactgat

SEQ ID NO: 4566382 - DNA, 14 bp, Homo sapiens
gaaaaaaactttta

SEQ ID NO: 4566383 - DNA, 17 bp, Homo sapiens
gaaaaaaacttttataa

SEQ ID NO: 4566384 - DNA, 14 bp, Homo sapiens
gaaaaaagattttt

SEQ ID NO: 4566385 - DNA, 21 bp, Homo sapiens
gaaaaaatatatgtatataca

SEQ ID NO: 4566386 - DNA, 15 bp, Homo sapiens
gaaaaaatattttaa

SEQ ID NO: 4566387 - DNA, 23 bp, Homo sapiens
gaaaaacaaactcgttttttaca

SEQ ID NO: 4566388 - DNA, 12 bp, Homo sapiens
gaaaaacaataa

SEQ ID NO: 4566389 - DNA, 14 bp, Homo sapiens
gaaaaacacaagca

SEQ ID NO: 4566390 - DNA, 20 bp, Homo sapiens
gaaaaacacatggggaaaaa

SEQ ID NO: 4566391 - DNA, 11 bp, Homo sapiens
gaaaaacaggt

SEQ ID NO: 4566392 - DNA, 15 bp, Homo sapiens
gaaaaacatctgaag

SEQ ID NO: 4566393 - DNA, 20 bp, Homo sapiens
gaaaaacatttaaacttttt

SEQ ID NO: 4566394 - DNA, 22 bp, Homo sapiens
gaaaaacatttaaactttttaa

SEQ ID NO: 4566395 - DNA, 21 bp, Homo sapiens
gaaaaacttttaggttgttac

SEQ ID NO: 4566396 - DNA, 22 bp, Homo sapiens
gaaaaacttttaggttgttacc

SEQ ID NO: 4566397 - DNA, 12 bp, Homo sapiens
gaaaaagaagca

SEQ ID NO: 4566398 - DNA, 22 bp, Homo sapiens
gaaaaagatggcttatgtcatc

SEQ ID NO: 4566399 - DNA, 20 bp, Homo sapiens
gaaaaagctccatgtgcctc

SEQ ID NO: 4566400 - DNA, 13 bp, Homo sapiens
gaaaaaggaaaac

SEQ ID NO: 4566401 - DNA, 20 bp, Homo sapiens
gaaaaagttaagatagcttt

SEQ ID NO: 4566402 - DNA, 14 bp, Homo sapiens
gaaaaagtttgttt

SEQ ID NO: 4566403 - DNA, 19 bp, Homo sapiens
gaaaaatatatactaaaca

SEQ ID NO: 4566404 - DNA, 11 bp, Homo sapiens
gaaaaatctca

SEQ ID NO: 4566405 - DNA, 13 bp, Homo sapiens
gaaaaatctcatt

SEQ ID NO: 4566406 - DNA, 18 bp, Homo sapiens
gaaaaatctcattatttc

SEQ ID NO: 4566407 - DNA, 22 bp, Homo sapiens
gaaaaatgggtcttttatagga

SEQ ID NO: 4566408 - DNA, 17 bp, Homo sapiens
gaaaaatgtgtggttct

SEQ ID NO: 4566409 - DNA, 16 bp, Homo sapiens
gaaaaattattagaac

SEQ ID NO: 4566410 - DNA, 19 bp, Homo sapiens
gaaaaattattagaacatt

SEQ ID NO: 4566411 - DNA, 15 bp, Homo sapiens
gaaaacaaaaaactt

SEQ ID NO: 4566412 - DNA, 16 bp, Homo sapiens
gaaaacaaaaaacttt

SEQ ID NO: 4566413 - DNA, 19 bp, Homo sapiens
gaaaacaaatatttcactt

SEQ ID NO: 4566414 - DNA, 19 bp, Homo sapiens
gaaaacaatggggctggtt

SEQ ID NO: 4566415 - DNA, 13 bp, Homo sapiens
gaaaacagaaaac

SEQ ID NO: 4566416 - DNA, 12 bp, Homo sapiens
gaaaacagaaac

SEQ ID NO: 4566417 - DNA, 18 bp, Homo sapiens
gaaaacagggtccaggaa

SEQ ID NO: 4566418 - DNA, 22 bp, Homo sapiens
gaaaacatctagcccaaaggta

SEQ ID NO: 4566419 - DNA, 23 bp, Homo sapiens
gaaaacatctcatcatgtctatt

SEQ ID NO: 4566420 - DNA, 12 bp, Homo sapiens
gaaaacatgtac

SEQ ID NO: 4566421 - DNA, 17 bp, Homo sapiens
gaaaaccaaaatgacat

SEQ ID NO: 4566422 - DNA, 18 bp, Homo sapiens
gaaaaccaaaatgacatc

SEQ ID NO: 4566423 - DNA, 19 bp, Homo sapiens
gaaaaccaaagggtgctag

SEQ ID NO: 4566424 - DNA, 22 bp, Homo sapiens
gaaaaccagcttgcgaataaca

SEQ ID NO: 4566425 - DNA, 19 bp, Homo sapiens
gaaaacccaagtttttaat

SEQ ID NO: 4566426 - DNA, 12 bp, Homo sapiens
gaaaacctacca

SEQ ID NO: 4566427 - DNA, 13 bp, Homo sapiens
gaaaacctctcct

SEQ ID NO: 4566428 - DNA, 18 bp, Homo sapiens
gaaaacgtcttccttctt

SEQ ID NO: 4566429 - DNA, 18 bp, Homo sapiens
gaaaactaaggatttttc

SEQ ID NO: 4566430 - DNA, 14 bp, Homo sapiens
gaaaactacaaacg

SEQ ID NO: 4566431 - DNA, 19 bp, Homo sapiens
gaaaactacaaacgtttga

SEQ ID NO: 4566432 - DNA, 22 bp, Homo sapiens
gaaaactatcctgcgggtttta

SEQ ID NO: 4566433 - DNA, 21 bp, Homo sapiens
gaaaactgtgcaactttttaa

SEQ ID NO: 4566434 - DNA, 22 bp, Homo sapiens
gaaaactgtgcaactttttaaa

SEQ ID NO: 4566435 - DNA, 23 bp, Homo sapiens
gaaaactgtgcaactttttaaag

SEQ ID NO: 4566436 - DNA, 21 bp, Homo sapiens
gaaaagaaagaagttattttc

SEQ ID NO: 4566437 - DNA, 15 bp, Homo sapiens
gaaaagaaggaaaga

SEQ ID NO: 4566438 - DNA, 22 bp, Homo sapiens
gaaaagaagtgaagtcttgggt

SEQ ID NO: 4566439 - DNA, 14 bp, Homo sapiens
gaaaagaattacag

SEQ ID NO: 4566440 - DNA, 22 bp, Homo sapiens
gaaaagacagggtgggagggag

SEQ ID NO: 4566441 - DNA, 20 bp, Homo sapiens
gaaaagataaagaccagaaa

SEQ ID NO: 4566442 - DNA, 18 bp, Homo sapiens
gaaaagcacacacaataa

SEQ ID NO: 4566443 - DNA, 17 bp, Homo sapiens
gaaaagcacctgccgac

SEQ ID NO: 4566444 - DNA, 15 bp, Homo sapiens
gaaaagcagacattt

SEQ ID NO: 4566445 - DNA, 19 bp, Homo sapiens
gaaaagcagttctggatgg

SEQ ID NO: 4566446 - DNA, 16 bp, Homo sapiens
gaaaagcatttttcaa

SEQ ID NO: 4566447 - DNA, 20 bp, Homo sapiens
gaaaagcgcgttgtgtatat

SEQ ID NO: 4566448 - DNA, 23 bp, Homo sapiens
gaaaagctagaattgagtgttta

SEQ ID NO: 4566449 - DNA, 23 bp, Homo sapiens
gaaaagcttagctttagaaacag

SEQ ID NO: 4566450 - DNA, 12 bp, Homo sapiens
gaaaaggaatca

SEQ ID NO: 4566451 - DNA, 23 bp, Homo sapiens
gaaaaggaatcacgttagaggaa

SEQ ID NO: 4566452 - DNA, 22 bp, Homo sapiens
gaaaaggcttggtgtctgcggg

SEQ ID NO: 4566453 - DNA, 23 bp, Homo sapiens
gaaaagggaaatgtgactggttc

SEQ ID NO: 4566454 - DNA, 18 bp, Homo sapiens
gaaaagggaactgaacat

SEQ ID NO: 4566455 - DNA, 23 bp, Homo sapiens
gaaaaggtagaggagtcacgtta

SEQ ID NO: 4566456 - DNA, 16 bp, Homo sapiens
gaaaaggttgaataat

SEQ ID NO: 4566457 - DNA, 22 bp, Homo sapiens
gaaaaggtttatgaaaaagaag

SEQ ID NO: 4566458 - DNA, 23 bp, Homo sapiens
gaaaaggtttatgaaaaagaaga

SEQ ID NO: 4566459 - DNA, 19 bp, Homo sapiens
gaaaagtaatgaagaatca

SEQ ID NO: 4566460 - DNA, 19 bp, Homo sapiens
gaaaagtgaatcttgctgt

SEQ ID NO: 4566461 - DNA, 12 bp, Homo sapiens
gaaaagtgatgt

SEQ ID NO: 4566462 - DNA, 16 bp, Homo sapiens
gaaaagtgatgtattt

SEQ ID NO: 4566463 - DNA, 16 bp, Homo sapiens
gaaaagttctttcaac

SEQ ID NO: 4566464 - DNA, 18 bp, Homo sapiens
gaaaagttgctcttaaaa

SEQ ID NO: 4566465 - DNA, 18 bp, Homo sapiens
gaaaataaacagacaaaa

SEQ ID NO: 4566466 - DNA, 20 bp, Homo sapiens
gaaaataaagacaaccatat

SEQ ID NO: 4566467 - DNA, 22 bp, Homo sapiens
gaaaataaagacaaccatattt

SEQ ID NO: 4566468 - DNA, 21 bp, Homo sapiens
gaaaataaggcacccatctgt

SEQ ID NO: 4566469 - DNA, 17 bp, Homo sapiens
gaaaatagtgtaagaac

SEQ ID NO: 4566470 - DNA, 21 bp, Homo sapiens
gaaaatataaggactttttga

SEQ ID NO: 4566471 - DNA, 12 bp, Homo sapiens
gaaaatatatat

SEQ ID NO: 4566472 - DNA, 16 bp, Homo sapiens
gaaaatatatgtattt

SEQ ID NO: 4566473 - DNA, 20 bp, Homo sapiens
gaaaatatatgtatttttat

SEQ ID NO: 4566474 - DNA, 15 bp, Homo sapiens
gaaaatcctctggct

SEQ ID NO: 4566475 - DNA, 13 bp, Homo sapiens
gaaaatgaaagct

SEQ ID NO: 4566476 - DNA, 21 bp, Homo sapiens
gaaaatgaaagtgttaatttt

SEQ ID NO: 4566477 - DNA, 22 bp, Homo sapiens
gaaaatgaaagtgttaatttta

SEQ ID NO: 4566478 - DNA, 12 bp, Homo sapiens
gaaaatgactta

SEQ ID NO: 4566479 - DNA, 14 bp, Homo sapiens
gaaaatgacttatt

SEQ ID NO: 4566480 - DNA, 17 bp, Homo sapiens
gaaaatgacttatttct

SEQ ID NO: 4566481 - DNA, 17 bp, Homo sapiens
gaaaatgagccctggct

SEQ ID NO: 4566482 - DNA, 19 bp, Homo sapiens
gaaaatggatatagaaaat

SEQ ID NO: 4566483 - DNA, 18 bp, Homo sapiens
gaaaatggtccaggagaa

SEQ ID NO: 4566484 - DNA, 22 bp, Homo sapiens
gaaaatgttacggcatcacact

SEQ ID NO: 4566485 - DNA, 21 bp, Homo sapiens
gaaaatgttgagaatcccaaa

SEQ ID NO: 4566486 - DNA, 20 bp, Homo sapiens
gaaaatgtttttctgccagg

SEQ ID NO: 4566487 - DNA, 23 bp, Homo sapiens
gaaaattatttaaaccgctaaaa

SEQ ID NO: 4566488 - DNA, 16 bp, Homo sapiens
gaaaattatttgcata

SEQ ID NO: 4566489 - DNA, 17 bp, Homo sapiens
gaaaattatttgtatga

SEQ ID NO: 4566490 - DNA, 14 bp, Homo sapiens
gaaaattattttga

SEQ ID NO: 4566491 - DNA, 14 bp, Homo sapiens
gaaaattcattttt

SEQ ID NO: 4566492 - DNA, 18 bp, Homo sapiens
gaaaattcctataaggaa

SEQ ID NO: 4566493 - DNA, 21 bp, Homo sapiens
gaaaattctaacccaagacat

SEQ ID NO: 4566494 - DNA, 22 bp, Homo sapiens
gaaaattctaacccaggtatcc

SEQ ID NO: 4566495 - DNA, 14 bp, Homo sapiens
gaaaattgtataaa

SEQ ID NO: 4566496 - DNA, 18 bp, Homo sapiens
gaaaatttacaaaattta

SEQ ID NO: 4566497 - DNA, 21 bp, Homo sapiens
gaaaatttacaaaatttattc

SEQ ID NO: 4566498 - DNA, 23 bp, Homo sapiens
gaaaatttacaaaatttattctc

SEQ ID NO: 4566499 - DNA, 12 bp, Homo sapiens
gaaacaaagatg

SEQ ID NO: 4566500 - DNA, 16 bp, Homo sapiens
gaaacaacatttatat

SEQ ID NO: 4566501 - DNA, 20 bp, Homo sapiens
gaaacaactctttgagaaac

SEQ ID NO: 4566502 - DNA, 16 bp, Homo sapiens
gaaacactgaaaagaa

SEQ ID NO: 4566503 - DNA, 16 bp, Homo sapiens
gaaacagcatattagc

SEQ ID NO: 4566504 - DNA, 12 bp, Homo sapiens
gaaacagctgcc

SEQ ID NO: 4566505 - DNA, 13 bp, Homo sapiens
gaaacagctgcct

SEQ ID NO: 4566506 - DNA, 17 bp, Homo sapiens
gaaacagggacaaagaa

SEQ ID NO: 4566507 - DNA, 21 bp, Homo sapiens
gaaacaggttgggatgggata

SEQ ID NO: 4566508 - DNA, 17 bp, Homo sapiens
gaaacagttgcatgtag

SEQ ID NO: 4566509 - DNA, 23 bp, Homo sapiens
gaaacagttggtaacttttgtga

SEQ ID NO: 4566510 - DNA, 16 bp, Homo sapiens
gaaacattttttaaaa

SEQ ID NO: 4566511 - DNA, 17 bp, Homo sapiens
gaaaccaagttgaaaaa

SEQ ID NO: 4566512 - DNA, 22 bp, Homo sapiens
gaaacccccttttcccttcagc

SEQ ID NO: 4566513 - DNA, 17 bp, Homo sapiens
gaaacctagtactgccc

SEQ ID NO: 4566514 - DNA, 17 bp, Homo sapiens
gaaaccttgctctcctc

SEQ ID NO: 4566515 - DNA, 13 bp, Homo sapiens
gaaacctttaaaa

SEQ ID NO: 4566516 - DNA, 22 bp, Homo sapiens
gaaacgcagttgtgtggcccag

SEQ ID NO: 4566517 - DNA, 19 bp, Homo sapiens
gaaacgtgttgtatctaca

SEQ ID NO: 4566518 - DNA, 19 bp, Homo sapiens
gaaactaaacagaaaactc

SEQ ID NO: 4566519 - DNA, 21 bp, Homo sapiens
gaaactaagccaggcctggct

SEQ ID NO: 4566520 - DNA, 13 bp, Homo sapiens
gaaactatgtgtt

SEQ ID NO: 4566521 - DNA, 17 bp, Homo sapiens
gaaactatgtgtttttc

SEQ ID NO: 4566522 - DNA, 21 bp, Homo sapiens
gaaactatgtgtttttctcat

SEQ ID NO: 4566523 - DNA, 19 bp, Homo sapiens
gaaactccacatctgcctt

SEQ ID NO: 4566524 - DNA, 20 bp, Homo sapiens
gaaactccacatctgcctta

SEQ ID NO: 4566525 - DNA, 22 bp, Homo sapiens
gaaactccgtcttagaagtgga

SEQ ID NO: 4566526 - DNA, 23 bp, Homo sapiens
gaaactgagtcactcacattgag

SEQ ID NO: 4566527 - DNA, 15 bp, Homo sapiens
gaaactgccaaacct

SEQ ID NO: 4566528 - DNA, 13 bp, Homo sapiens
gaaactgccagca

SEQ ID NO: 4566529 - DNA, 21 bp, Homo sapiens
gaaactgcccactctgcaaga

SEQ ID NO: 4566530 - DNA, 17 bp, Homo sapiens
gaaactgctgcagatta

SEQ ID NO: 4566531 - DNA, 12 bp, Homo sapiens
gaaactggctga

SEQ ID NO: 4566532 - DNA, 15 bp, Homo sapiens
gaaactgggaaactg

SEQ ID NO: 4566533 - DNA, 19 bp, Homo sapiens
gaaactgggtttctcatta

SEQ ID NO: 4566534 - DNA, 19 bp, Homo sapiens
gaaacttagcttttgatgt

SEQ ID NO: 4566535 - DNA, 15 bp, Homo sapiens
gaaacttgtaaatat

SEQ ID NO: 4566536 - DNA, 15 bp, Homo sapiens
gaaactttttaattg

SEQ ID NO: 4566537 - DNA, 15 bp, Homo sapiens
gaaagaaaaaatttt

SEQ ID NO: 4566538 - DNA, 16 bp, Homo sapiens
gaaagaaagtacccag

SEQ ID NO: 4566539 - DNA, 14 bp, Homo sapiens
gaaagaagagaagt

SEQ ID NO: 4566540 - DNA, 20 bp, Homo sapiens
gaaagaagtgtggggatttt

SEQ ID NO: 4566541 - DNA, 15 bp, Homo sapiens
gaaagaataaaatgt

SEQ ID NO: 4566542 - DNA, 18 bp, Homo sapiens
gaaagaataaaatgtttc

SEQ ID NO: 4566543 - DNA, 12 bp, Homo sapiens
gaaagaatagaa

SEQ ID NO: 4566544 - DNA, 13 bp, Homo sapiens
gaaagacatctgc

SEQ ID NO: 4566545 - DNA, 14 bp, Homo sapiens
gaaagactattcaa

SEQ ID NO: 4566546 - DNA, 15 bp, Homo sapiens
gaaagactattcaaa

SEQ ID NO: 4566547 - DNA, 17 bp, Homo sapiens
gaaagactattcaaaca

SEQ ID NO: 4566548 - DNA, 23 bp, Homo sapiens
gaaagactattcaaacagtctca

SEQ ID NO: 4566549 - DNA, 19 bp, Homo sapiens
gaaagagcagtcagagtcc

SEQ ID NO: 4566550 - DNA, 16 bp, Homo sapiens
gaaagaggcaccagga

SEQ ID NO: 4566551 - DNA, 15 bp, Homo sapiens
gaaagatgtgttttt

SEQ ID NO: 4566552 - DNA, 22 bp, Homo sapiens
gaaagcagaacagtgattacca

SEQ ID NO: 4566553 - DNA, 14 bp, Homo sapiens
gaaagcagggactt

SEQ ID NO: 4566554 - DNA, 21 bp, Homo sapiens
gaaagcatgcattgaaaaatt

SEQ ID NO: 4566555 - DNA, 15 bp, Homo sapiens
gaaagccaccttgtt

SEQ ID NO: 4566556 - DNA, 14 bp, Homo sapiens
gaaagccaggagca

SEQ ID NO: 4566557 - DNA, 18 bp, Homo sapiens
gaaagccctcccccttcc

SEQ ID NO: 4566558 - DNA, 21 bp, Homo sapiens
gaaagccctcccccttcccct

SEQ ID NO: 4566559 - DNA, 17 bp, Homo sapiens
gaaagcgggcagccccg

SEQ ID NO: 4566560 - DNA, 13 bp, Homo sapiens
gaaagctagagat

SEQ ID NO: 4566561 - DNA, 17 bp, Homo sapiens
gaaagctgcctggtata

SEQ ID NO: 4566562 - DNA, 15 bp, Homo sapiens
gaaagctgtgtttat

SEQ ID NO: 4566563 - DNA, 22 bp, Homo sapiens
gaaagctttggaaaaatctttt

SEQ ID NO: 4566564 - DNA, 13 bp, Homo sapiens
gaaaggaaacctt

SEQ ID NO: 4566565 - DNA, 15 bp, Homo sapiens
gaaaggaaacctttt

SEQ ID NO: 4566566 - DNA, 21 bp, Homo sapiens
gaaaggaagcattgtaaaata

SEQ ID NO: 4566567 - DNA, 15 bp, Homo sapiens
gaaaggacagagcca

SEQ ID NO: 4566568 - DNA, 17 bp, Homo sapiens
gaaaggacggctgagca

SEQ ID NO: 4566569 - DNA, 14 bp, Homo sapiens
gaaaggagacattg

SEQ ID NO: 4566570 - DNA, 13 bp, Homo sapiens
gaaaggagactag

SEQ ID NO: 4566571 - DNA, 15 bp, Homo sapiens
gaaaggagagtactt

SEQ ID NO: 4566572 - DNA, 11 bp, Homo sapiens
gaaaggcaggt

SEQ ID NO: 4566573 - DNA, 15 bp, Homo sapiens
gaaaggcaggtttca

SEQ ID NO: 4566574 - DNA, 19 bp, Homo sapiens
gaaaggctcatttaaaaca

SEQ ID NO: 4566575 - DNA, 22 bp, Homo sapiens
gaaagggagctatcaggaacag

SEQ ID NO: 4566576 - DNA, 14 bp, Homo sapiens
gaaagggatcatca

SEQ ID NO: 4566577 - DNA, 17 bp, Homo sapiens
gaaaggggacacctgta

SEQ ID NO: 4566578 - DNA, 20 bp, Homo sapiens
gaaaggggagagcctgctgg

SEQ ID NO: 4566579 - DNA, 15 bp, Homo sapiens
gaaaggggtgctttt

SEQ ID NO: 4566580 - DNA, 18 bp, Homo sapiens
gaaaggtgccatggaaga

SEQ ID NO: 4566581 - DNA, 13 bp, Homo sapiens
gaaagtaaagttg

SEQ ID NO: 4566582 - DNA, 23 bp, Homo sapiens
gaaagtacccagcaaatgggcat

SEQ ID NO: 4566583 - DNA, 21 bp, Homo sapiens
gaaagtagggggctttctggg

SEQ ID NO: 4566584 - DNA, 16 bp, Homo sapiens
gaaagtatttactttt

SEQ ID NO: 4566585 - DNA, 10 bp, Homo sapiens
gaaagtcaga

SEQ ID NO: 4566586 - DNA, 21 bp, Homo sapiens
gaaagtctatctaatgacatg

SEQ ID NO: 4566587 - DNA, 22 bp, Homo sapiens
gaaagtgccagcattccagact

SEQ ID NO: 4566588 - DNA, 17 bp, Homo sapiens
gaaagtgggcaaaagct

SEQ ID NO: 4566589 - DNA, 15 bp, Homo sapiens
gaaagtgtatttgga

SEQ ID NO: 4566590 - DNA, 23 bp, Homo sapiens
gaaagtgtatttggaaataaagt

SEQ ID NO: 4566591 - DNA, 15 bp, Homo sapiens
gaaagtgtgagctct

SEQ ID NO: 4566592 - DNA, 19 bp, Homo sapiens
gaaagttgcttttattgca

SEQ ID NO: 4566593 - DNA, 17 bp, Homo sapiens
gaaagttgtacatgata

SEQ ID NO: 4566594 - DNA, 18 bp, Homo sapiens
gaaagttttgtaaaagaa

SEQ ID NO: 4566595 - DNA, 17 bp, Homo sapiens
gaaagtttttagaatgt

SEQ ID NO: 4566596 - DNA, 16 bp, Homo sapiens
gaaataaaaaagtctc

SEQ ID NO: 4566597 - DNA, 19 bp, Homo sapiens
gaaataaaaaagtctctat

SEQ ID NO: 4566598 - DNA, 14 bp, Homo sapiens
gaaataaactgtgc

SEQ ID NO: 4566599 - DNA, 19 bp, Homo sapiens
gaaataaataaaaatgcat

SEQ ID NO: 4566600 - DNA, 17 bp, Homo sapiens
gaaataaggctaaccat

SEQ ID NO: 4566601 - DNA, 18 bp, Homo sapiens
gaaataatagaatgagca

SEQ ID NO: 4566602 - DNA, 18 bp, Homo sapiens
gaaataatatatttcttc

SEQ ID NO: 4566603 - DNA, 14 bp, Homo sapiens
gaaatacagttatt

SEQ ID NO: 4566604 - DNA, 19 bp, Homo sapiens
gaaatacagttctgctctg

SEQ ID NO: 4566605 - DNA, 19 bp, Homo sapiens
gaaatacgttaggaggaca

SEQ ID NO: 4566606 - DNA, 16 bp, Homo sapiens
gaaatagaattataac

SEQ ID NO: 4566607 - DNA, 13 bp, Homo sapiens
gaaatagacaaaa

SEQ ID NO: 4566608 - DNA, 19 bp, Homo sapiens
gaaatagacaaaaagtata

SEQ ID NO: 4566609 - DNA, 16 bp, Homo sapiens
gaaatagcggccctgg

SEQ ID NO: 4566610 - DNA, 20 bp, Homo sapiens
gaaatagctccgtggagcag

SEQ ID NO: 4566611 - DNA, 19 bp, Homo sapiens
gaaatagtaccttcaatac

SEQ ID NO: 4566612 - DNA, 14 bp, Homo sapiens
gaaatatacagttt

SEQ ID NO: 4566613 - DNA, 17 bp, Homo sapiens
gaaatatacagtttgac

SEQ ID NO: 4566614 - DNA, 20 bp, Homo sapiens
gaaatatcagttactcagcc

SEQ ID NO: 4566615 - DNA, 22 bp, Homo sapiens
gaaatatcagttactcagccct

SEQ ID NO: 4566616 - DNA, 22 bp, Homo sapiens
gaaatatcatcacgtatgttat

SEQ ID NO: 4566617 - DNA, 20 bp, Homo sapiens
gaaatatctgtgaaatatca

SEQ ID NO: 4566618 - DNA, 21 bp, Homo sapiens
gaaatatctgtgaaatatcat

SEQ ID NO: 4566619 - DNA, 15 bp, Homo sapiens
gaaatattcagaaat

SEQ ID NO: 4566620 - DNA, 16 bp, Homo sapiens
gaaatattcagaaatt

SEQ ID NO: 4566621 - DNA, 15 bp, Homo sapiens
gaaatattccctaga

SEQ ID NO: 4566622 - DNA, 21 bp, Homo sapiens
gaaatattgactcaaaccata

SEQ ID NO: 4566623 - DNA, 16 bp, Homo sapiens
gaaatcacagtcaatg

SEQ ID NO: 4566624 - DNA, 18 bp, Homo sapiens
gaaatcacagtcaatgga

SEQ ID NO: 4566625 - DNA, 19 bp, Homo sapiens
gaaatcagtagaaagctaa

SEQ ID NO: 4566626 - DNA, 18 bp, Homo sapiens
gaaatcccatctctacaa

SEQ ID NO: 4566627 - DNA, 21 bp, Homo sapiens
gaaatcctcagccgagaaatt

SEQ ID NO: 4566628 - DNA, 14 bp, Homo sapiens
gaaatcctgccctg

SEQ ID NO: 4566629 - DNA, 20 bp, Homo sapiens
gaaatctactgaattggctt

SEQ ID NO: 4566630 - DNA, 20 bp, Homo sapiens
gaaatctgtgcctgagaaca

SEQ ID NO: 4566631 - DNA, 15 bp, Homo sapiens
gaaatcttttacatt

SEQ ID NO: 4566632 - DNA, 19 bp, Homo sapiens
gaaatcttttacatttttc

SEQ ID NO: 4566633 - DNA, 18 bp, Homo sapiens
gaaatgaaagggaaactg

SEQ ID NO: 4566634 - DNA, 23 bp, Homo sapiens
gaaatgaaagggaaactgggaaa

SEQ ID NO: 4566635 - DNA, 12 bp, Homo sapiens
gaaatgaacatt

SEQ ID NO: 4566636 - DNA, 16 bp, Homo sapiens
gaaatgaacattccaa

SEQ ID NO: 4566637 - DNA, 14 bp, Homo sapiens
gaaatgacatttca

SEQ ID NO: 4566638 - DNA, 18 bp, Homo sapiens
gaaatgacatttcactaa

SEQ ID NO: 4566639 - DNA, 24 bp, Homo sapiens
gaaatgaccttcattctgagacca

SEQ ID NO: 4566640 - DNA, 18 bp, Homo sapiens
gaaatgagaaggcagcca

SEQ ID NO: 4566641 - DNA, 21 bp, Homo sapiens
gaaatgaggtctgtttaaagt

SEQ ID NO: 4566642 - DNA, 14 bp, Homo sapiens
gaaatgataaagac

SEQ ID NO: 4566643 - DNA, 17 bp, Homo sapiens
gaaatgataaagacttt

SEQ ID NO: 4566644 - DNA, 18 bp, Homo sapiens
gaaatgataaagactttt

SEQ ID NO: 4566645 - DNA, 19 bp, Homo sapiens
gaaatgataaagactttta

SEQ ID NO: 4566646 - DNA, 22 bp, Homo sapiens
gaaatgatagagaactgaagga

SEQ ID NO: 4566647 - DNA, 17 bp, Homo sapiens
gaaatgcactaagacaa

SEQ ID NO: 4566648 - DNA, 19 bp, Homo sapiens
gaaatgctgtatttttaca

SEQ ID NO: 4566649 - DNA, 19 bp, Homo sapiens
gaaatggaaagtcatgcaa

SEQ ID NO: 4566650 - DNA, 20 bp, Homo sapiens
gaaatggaacagatttcaaa

SEQ ID NO: 4566651 - DNA, 17 bp, Homo sapiens
gaaatggatgcaaagta

SEQ ID NO: 4566652 - DNA, 18 bp, Homo sapiens
gaaatggctatgaacaga

SEQ ID NO: 4566653 - DNA, 19 bp, Homo sapiens
gaaatgggaaaaaacttaa

SEQ ID NO: 4566654 - DNA, 21 bp, Homo sapiens
gaaatgggaattgcgctcagg

SEQ ID NO: 4566655 - DNA, 16 bp, Homo sapiens
gaaatgtaccttcttt

SEQ ID NO: 4566656 - DNA, 18 bp, Homo sapiens
gaaatgtcccctcaaact

SEQ ID NO: 4566657 - DNA, 18 bp, Homo sapiens
gaaatgtgactggttcag

SEQ ID NO: 4566658 - DNA, 18 bp, Homo sapiens
gaaattaagaaggcaaaa

SEQ ID NO: 4566659 - DNA, 22 bp, Homo sapiens
gaaattaagaaggcaaaaatgt

SEQ ID NO: 4566660 - DNA, 15 bp, Homo sapiens
gaaattacctgtgga

SEQ ID NO: 4566661 - DNA, 18 bp, Homo sapiens
gaaattacctgtggatat

SEQ ID NO: 4566662 - DNA, 15 bp, Homo sapiens
gaaattagatttgtg

SEQ ID NO: 4566663 - DNA, 23 bp, Homo sapiens
gaaattatgtgacattttacatt

SEQ ID NO: 4566664 - DNA, 16 bp, Homo sapiens
gaaattcaaaatgctc

SEQ ID NO: 4566665 - DNA, 15 bp, Homo sapiens
gaaattcgtgtgttt

SEQ ID NO: 4566666 - DNA, 15 bp, Homo sapiens
gaaattctccaggat

SEQ ID NO: 4566667 - DNA, 18 bp, Homo sapiens
gaaattctgaatttgcaa

SEQ ID NO: 4566668 - DNA, 23 bp, Homo sapiens
gaaattctttcccagtctgtcga

SEQ ID NO: 4566669 - DNA, 13 bp, Homo sapiens
gaaattgtatatt

SEQ ID NO: 4566670 - DNA, 14 bp, Homo sapiens
gaaatttacacagt

SEQ ID NO: 4566671 - DNA, 20 bp, Homo sapiens
gaaatttactgtgagactgt

SEQ ID NO: 4566672 - DNA, 22 bp, Homo sapiens
gaaattttatatgcttactgat

SEQ ID NO: 4566673 - DNA, 14 bp, Homo sapiens
gaaattttgtaaga

SEQ ID NO: 4566674 - DNA, 15 bp, Homo sapiens
gaaattttgtaagaa

SEQ ID NO: 4566675 - DNA, 17 bp, Homo sapiens
gaaattttgtaagaagg

SEQ ID NO: 4566676 - DNA, 14 bp, Homo sapiens
gaacaaagacaggc

SEQ ID NO: 4566677 - DNA, 19 bp, Homo sapiens
gaacaaatattcagaatat

SEQ ID NO: 4566678 - DNA, 17 bp, Homo sapiens
gaacaaatttacagaga

SEQ ID NO: 4566679 - DNA, 18 bp, Homo sapiens
gaacaaatttacagagac

SEQ ID NO: 4566680 - DNA, 17 bp, Homo sapiens
gaacaaattttctggtg

SEQ ID NO: 4566681 - DNA, 15 bp, Homo sapiens
gaacaaggaaggaaa

SEQ ID NO: 4566682 - DNA, 13 bp, Homo sapiens
gaacaatgtatac

SEQ ID NO: 4566683 - DNA, 17 bp, Homo sapiens
gaacaatgtatacaatg

SEQ ID NO: 4566684 - DNA, 21 bp, Homo sapiens
gaacaatgtgctatgtgaaga

SEQ ID NO: 4566685 - DNA, 15 bp, Homo sapiens
gaacacatgttttta

SEQ ID NO: 4566686 - DNA, 16 bp, Homo sapiens
gaacaccattgaaggc

SEQ ID NO: 4566687 - DNA, 16 bp, Homo sapiens
gaacacgataaaccat

SEQ ID NO: 4566688 - DNA, 17 bp, Homo sapiens
gaacacgcgtatttaca

SEQ ID NO: 4566689 - DNA, 17 bp, Homo sapiens
gaacactattttcagaa

SEQ ID NO: 4566690 - DNA, 19 bp, Homo sapiens
gaacactattttcagaatc

SEQ ID NO: 4566691 - DNA, 21 bp, Homo sapiens
gaacactattttcagaatctg

SEQ ID NO: 4566692 - DNA, 18 bp, Homo sapiens
gaacactcttttgcttta

SEQ ID NO: 4566693 - DNA, 17 bp, Homo sapiens
gaacagacaggagaaat

SEQ ID NO: 4566694 - DNA, 20 bp, Homo sapiens
gaacagagagacccttgtgg

SEQ ID NO: 4566695 - DNA, 16 bp, Homo sapiens
gaacagccccggggcc

SEQ ID NO: 4566696 - DNA, 18 bp, Homo sapiens
gaacagccccggggcccc

SEQ ID NO: 4566697 - DNA, 16 bp, Homo sapiens
gaacagccctcggcct

SEQ ID NO: 4566698 - DNA, 23 bp, Homo sapiens
gaacagctatgggagccccaggg

SEQ ID NO: 4566699 - DNA, 22 bp, Homo sapiens
gaacaggtcccacgccaggcca

SEQ ID NO: 4566700 - DNA, 15 bp, Homo sapiens
gaacaggtgtttttc

SEQ ID NO: 4566701 - DNA, 17 bp, Homo sapiens
gaacagtattgggcagg

SEQ ID NO: 4566702 - DNA, 19 bp, Homo sapiens
gaacagtattgggcaggag

SEQ ID NO: 4566703 - DNA, 16 bp, Homo sapiens
gaacataaaaaggaca

SEQ ID NO: 4566704 - DNA, 18 bp, Homo sapiens
gaacataaaaaggacatc

SEQ ID NO: 4566705 - DNA, 22 bp, Homo sapiens
gaacataaaaaggacatcagca

SEQ ID NO: 4566706 - DNA, 13 bp, Homo sapiens
gaacatactgttc

SEQ ID NO: 4566707 - DNA, 18 bp, Homo sapiens
gaacatagactagagaaa

SEQ ID NO: 4566708 - DNA, 14 bp, Homo sapiens
gaacatattcatga

SEQ ID NO: 4566709 - DNA, 17 bp, Homo sapiens
gaacatctatagagata

SEQ ID NO: 4566710 - DNA, 21 bp, Homo sapiens
gaacatgaactcatcattttt

SEQ ID NO: 4566711 - DNA, 15 bp, Homo sapiens
gaacatgattttaca

SEQ ID NO: 4566712 - DNA, 15 bp, Homo sapiens
gaacatgcagtttga

SEQ ID NO: 4566713 - DNA, 18 bp, Homo sapiens
gaacatgcagtttgaaat

SEQ ID NO: 4566714 - DNA, 19 bp, Homo sapiens
gaacatgcagtttgaaatt

SEQ ID NO: 4566715 - DNA, 23 bp, Homo sapiens
gaacatgcagtttgaaattctga

SEQ ID NO: 4566716 - DNA, 15 bp, Homo sapiens
gaacatggagagcta

SEQ ID NO: 4566717 - DNA, 15 bp, Homo sapiens
gaacatggagctgtc

SEQ ID NO: 4566718 - DNA, 18 bp, Homo sapiens
gaacatggagctgtcatc

SEQ ID NO: 4566719 - DNA, 19 bp, Homo sapiens
gaacatgtgcttcatctgt

SEQ ID NO: 4566720 - DNA, 22 bp, Homo sapiens
gaacatgtgttttcatcatttc

SEQ ID NO: 4566721 - DNA, 21 bp, Homo sapiens
gaacattaaaatatagagaca

SEQ ID NO: 4566722 - DNA, 13 bp, Homo sapiens
gaacattctctca

SEQ ID NO: 4566723 - DNA, 16 bp, Homo sapiens
gaacattggagctgac

SEQ ID NO: 4566724 - DNA, 19 bp, Homo sapiens
gaacattggagctgactgt

SEQ ID NO: 4566725 - DNA, 21 bp, Homo sapiens
gaacattgtactgttgcttta

SEQ ID NO: 4566726 - DNA, 19 bp, Homo sapiens
gaacattttataaaacata

SEQ ID NO: 4566727 - DNA, 16 bp, Homo sapiens
gaaccaaatacctcaa

SEQ ID NO: 4566728 - DNA, 13 bp, Homo sapiens
gaaccaaccccca

SEQ ID NO: 4566729 - DNA, 12 bp, Homo sapiens
gaaccacagaaa

SEQ ID NO: 4566730 - DNA, 12 bp, Homo sapiens
gaaccaggccag

SEQ ID NO: 4566731 - DNA, 23 bp, Homo sapiens
gaaccatgctcttgttctgttcc

SEQ ID NO: 4566732 - DNA, 18 bp, Homo sapiens
gaaccattatactttata

SEQ ID NO: 4566733 - DNA, 16 bp, Homo sapiens
gaaccatttcacccag

SEQ ID NO: 4566734 - DNA, 14 bp, Homo sapiens
gaacccacctgctg

SEQ ID NO: 4566735 - DNA, 19 bp, Homo sapiens
gaacccatattttaaattc

SEQ ID NO: 4566736 - DNA, 16 bp, Homo sapiens
gaacccgggggacaga

SEQ ID NO: 4566737 - DNA, 14 bp, Homo sapiens
gaaccctgccatgg

SEQ ID NO: 4566738 - DNA, 16 bp, Homo sapiens
gaaccctgccatggaa

SEQ ID NO: 4566739 - DNA, 20 bp, Homo sapiens
gaaccctttgtttcttgttt

SEQ ID NO: 4566740 - DNA, 23 bp, Homo sapiens
gaaccctttgtttcttgtttatt

SEQ ID NO: 4566741 - DNA, 12 bp, Homo sapiens
gaaccgaggcag

SEQ ID NO: 4566742 - DNA, 18 bp, Homo sapiens
gaaccgttttgaagctac

SEQ ID NO: 4566743 - DNA, 19 bp, Homo sapiens
gaaccgttttgaagctact

SEQ ID NO: 4566744 - DNA, 17 bp, Homo sapiens
gaacctaatgcactctg

SEQ ID NO: 4566745 - DNA, 19 bp, Homo sapiens
gaacctaattcaattcaaa

SEQ ID NO: 4566746 - DNA, 19 bp, Homo sapiens
gaacctacagactccatct

SEQ ID NO: 4566747 - DNA, 19 bp, Homo sapiens
gaacctacagttttaactg

SEQ ID NO: 4566748 - DNA, 18 bp, Homo sapiens
gaacctcagattcttcat

SEQ ID NO: 4566749 - DNA, 18 bp, Homo sapiens
gaacctgagctattttcc

SEQ ID NO: 4566750 - DNA, 20 bp, Homo sapiens
gaacctgagttcccgggagc

SEQ ID NO: 4566751 - DNA, 17 bp, Homo sapiens
gaacctgggcactccgc

SEQ ID NO: 4566752 - DNA, 21 bp, Homo sapiens
gaaccttaatgacaacactta

SEQ ID NO: 4566753 - DNA, 15 bp, Homo sapiens
gaaccttccttcctg

SEQ ID NO: 4566754 - DNA, 13 bp, Homo sapiens
gaacctttgtcaa

SEQ ID NO: 4566755 - DNA, 16 bp, Homo sapiens
gaacgaaaatgaaagc

SEQ ID NO: 4566756 - DNA, 15 bp, Homo sapiens
gaacgactgtatatt

SEQ ID NO: 4566757 - DNA, 16 bp, Homo sapiens
gaacgatccttcaaag

SEQ ID NO: 4566758 - DNA, 18 bp, Homo sapiens
gaacgatccttcaaagtc

SEQ ID NO: 4566759 - DNA, 16 bp, Homo sapiens
gaacgcagccctagag

SEQ ID NO: 4566760 - DNA, 22 bp, Homo sapiens
gaacgcagccctagagcctgcc

SEQ ID NO: 4566761 - DNA, 20 bp, Homo sapiens
gaacgcagttgattccttga

SEQ ID NO: 4566762 - DNA, 15 bp, Homo sapiens
gaacggggagaaaag

SEQ ID NO: 4566763 - DNA, 19 bp, Homo sapiens
gaacggggctcttctcatt

SEQ ID NO: 4566764 - DNA, 14 bp, Homo sapiens
gaactaactttggt

SEQ ID NO: 4566765 - DNA, 12 bp, Homo sapiens
gaactaagcact

SEQ ID NO: 4566766 - DNA, 15 bp, Homo sapiens
gaactaatatatgaa

SEQ ID NO: 4566767 - DNA, 23 bp, Homo sapiens
gaactacaaacaaaatttctatt

SEQ ID NO: 4566768 - DNA, 19 bp, Homo sapiens
gaactagaatttgattatt

SEQ ID NO: 4566769 - DNA, 15 bp, Homo sapiens
gaactagtaaacata

SEQ ID NO: 4566770 - DNA, 23 bp, Homo sapiens
gaactatcatttttacactattg

SEQ ID NO: 4566771 - DNA, 13 bp, Homo sapiens
gaactattagagc

SEQ ID NO: 4566772 - DNA, 16 bp, Homo sapiens
gaactattttaaataa

SEQ ID NO: 4566773 - DNA, 16 bp, Homo sapiens
gaactcaccctgggag

SEQ ID NO: 4566774 - DNA, 21 bp, Homo sapiens
gaactcaccctgggagccagt

SEQ ID NO: 4566775 - DNA, 20 bp, Homo sapiens
gaactcatcccttgtttata

SEQ ID NO: 4566776 - DNA, 14 bp, Homo sapiens
gaactccatacagc

SEQ ID NO: 4566777 - DNA, 16 bp, Homo sapiens
gaactccatacagcct

SEQ ID NO: 4566778 - DNA, 19 bp, Homo sapiens
gaactccatacagcctcta

SEQ ID NO: 4566779 - DNA, 13 bp, Homo sapiens
gaactcctgccag

SEQ ID NO: 4566780 - DNA, 12 bp, Homo sapiens
gaactctgaaat

SEQ ID NO: 4566781 - DNA, 19 bp, Homo sapiens
gaactctggtgctcctgca

SEQ ID NO: 4566782 - DNA, 19 bp, Homo sapiens
gaactctggtggcacagga

SEQ ID NO: 4566783 - DNA, 19 bp, Homo sapiens
gaactctgttcccccaccc

SEQ ID NO: 4566784 - DNA, 12 bp, Homo sapiens
gaactgaacacc

SEQ ID NO: 4566785 - DNA, 15 bp, Homo sapiens
gaactgaactgtaac

SEQ ID NO: 4566786 - DNA, 15 bp, Homo sapiens
gaactgagccccagc

SEQ ID NO: 4566787 - DNA, 19 bp, Homo sapiens
gaactgcagacctgtcctc

SEQ ID NO: 4566788 - DNA, 12 bp, Homo sapiens
gaactgcagcaa

SEQ ID NO: 4566789 - DNA, 18 bp, Homo sapiens
gaactgcccttgctgccc

SEQ ID NO: 4566790 - DNA, 14 bp, Homo sapiens
gaactggaataata

SEQ ID NO: 4566791 - DNA, 16 bp, Homo sapiens
gaactggaataatatt

SEQ ID NO: 4566792 - DNA, 23 bp, Homo sapiens
gaactggacacaataggtctttc

SEQ ID NO: 4566793 - DNA, 16 bp, Homo sapiens
gaactggtagaaaaac

SEQ ID NO: 4566794 - DNA, 14 bp, Homo sapiens
gaactgtacattgt

SEQ ID NO: 4566795 - DNA, 23 bp, Homo sapiens
gaactgtacattgtgagctctgg

SEQ ID NO: 4566796 - DNA, 13 bp, Homo sapiens
gaactgtccgtga

SEQ ID NO: 4566797 - DNA, 14 bp, Homo sapiens
gaactgtgtattta

SEQ ID NO: 4566798 - DNA, 17 bp, Homo sapiens
gaactgtgtgtgaatct

SEQ ID NO: 4566799 - DNA, 23 bp, Homo sapiens
gaactgtgtttcaaatggactgt

SEQ ID NO: 4566800 - DNA, 11 bp, Homo sapiens
gaactgttaca

SEQ ID NO: 4566801 - DNA, 23 bp, Homo sapiens
gaacttcaggtgtgactctagca

SEQ ID NO: 4566802 - DNA, 13 bp, Homo sapiens
gaacttcatggat

SEQ ID NO: 4566803 - DNA, 17 bp, Homo sapiens
gaacttgaaagttttct

SEQ ID NO: 4566804 - DNA, 15 bp, Homo sapiens
gaacttgactgggtg

SEQ ID NO: 4566805 - DNA, 23 bp, Homo sapiens
gaacttgccctgagcactcctgg

SEQ ID NO: 4566806 - DNA, 16 bp, Homo sapiens
gaacttgcgagtccaa

SEQ ID NO: 4566807 - DNA, 22 bp, Homo sapiens
gaacttgtctggctttggcact

SEQ ID NO: 4566808 - DNA, 13 bp, Homo sapiens
gaactttcatttt

SEQ ID NO: 4566809 - DNA, 17 bp, Homo sapiens
gaactttccaaaaccta

SEQ ID NO: 4566810 - DNA, 14 bp, Homo sapiens
gaactttctccctc

SEQ ID NO: 4566811 - DNA, 18 bp, Homo sapiens
gaactttctccctcatcg

SEQ ID NO: 4566812 - DNA, 13 bp, Homo sapiens
gaacttttctctt

SEQ ID NO: 4566813 - DNA, 22 bp, Homo sapiens
gaagaaaggccaaggtgctgga

SEQ ID NO: 4566814 - DNA, 14 bp, Homo sapiens
gaagaacagccccg

SEQ ID NO: 4566815 - DNA, 22 bp, Homo sapiens
gaagaacagccccggggccccc

SEQ ID NO: 4566816 - DNA, 18 bp, Homo sapiens
gaagaaccaaatacctca

SEQ ID NO: 4566817 - DNA, 19 bp, Homo sapiens
gaagaagtttcatcatttt

SEQ ID NO: 4566818 - DNA, 16 bp, Homo sapiens
gaagaatccagtatta

SEQ ID NO: 4566819 - DNA, 12 bp, Homo sapiens
gaagaattccag

SEQ ID NO: 4566820 - DNA, 17 bp, Homo sapiens
gaagaattttcagaccc

SEQ ID NO: 4566821 - DNA, 21 bp, Homo sapiens
gaagaattttcagaccccagc

SEQ ID NO: 4566822 - DNA, 14 bp, Homo sapiens
gaagacattttgtt

SEQ ID NO: 4566823 - DNA, 17 bp, Homo sapiens
gaagaccctcttgccca

SEQ ID NO: 4566824 - DNA, 23 bp, Homo sapiens
gaagaccctcttgcccatcctga

SEQ ID NO: 4566825 - DNA, 23 bp, Homo sapiens
gaagacgaggccctcgggcccag

SEQ ID NO: 4566826 - DNA, 20 bp, Homo sapiens
gaagactcaggagtctgcca

SEQ ID NO: 4566827 - DNA, 15 bp, Homo sapiens
gaagactggaagcta

SEQ ID NO: 4566828 - DNA, 16 bp, Homo sapiens
gaagactggaagctaa

SEQ ID NO: 4566829 - DNA, 19 bp, Homo sapiens
gaagactttaattatatat

SEQ ID NO: 4566830 - DNA, 15 bp, Homo sapiens
gaagagaaaggactc

SEQ ID NO: 4566831 - DNA, 15 bp, Homo sapiens
gaagagaagacaaaa

SEQ ID NO: 4566832 - DNA, 17 bp, Homo sapiens
gaagagaagggcagggc

SEQ ID NO: 4566833 - DNA, 15 bp, Homo sapiens
gaagagacagcccag

SEQ ID NO: 4566834 - DNA, 21 bp, Homo sapiens
gaagagatccttccattccat

SEQ ID NO: 4566835 - DNA, 12 bp, Homo sapiens
gaagagccacct

SEQ ID NO: 4566836 - DNA, 15 bp, Homo sapiens
gaagagccacctgca

SEQ ID NO: 4566837 - DNA, 18 bp, Homo sapiens
gaagagccacctgcaaga

SEQ ID NO: 4566838 - DNA, 22 bp, Homo sapiens
gaagagccacctgcaagatgga

SEQ ID NO: 4566839 - DNA, 16 bp, Homo sapiens
gaagagctagagaaat

SEQ ID NO: 4566840 - DNA, 14 bp, Homo sapiens
gaagagcttgcaca

SEQ ID NO: 4566841 - DNA, 17 bp, Homo sapiens
gaagaggaccagaggag

SEQ ID NO: 4566842 - DNA, 16 bp, Homo sapiens
gaagaggcttctcctg

SEQ ID NO: 4566843 - DNA, 19 bp, Homo sapiens
gaagagggaaaacagaaaa

SEQ ID NO: 4566844 - DNA, 22 bp, Homo sapiens
gaagaggttttatttacatttt

SEQ ID NO: 4566845 - DNA, 22 bp, Homo sapiens
gaagagtcccagtgaactcggc

SEQ ID NO: 4566846 - DNA, 14 bp, Homo sapiens
gaagagttgaggaa

SEQ ID NO: 4566847 - DNA, 14 bp, Homo sapiens
gaagagttgtgcac

SEQ ID NO: 4566848 - DNA, 21 bp, Homo sapiens
gaagagttgtgcacgcagatt

SEQ ID NO: 4566849 - DNA, 21 bp, Homo sapiens
gaagatattatttgtcttaaa

SEQ ID NO: 4566850 - DNA, 19 bp, Homo sapiens
gaagatccccaactgctcc

SEQ ID NO: 4566851 - DNA, 20 bp, Homo sapiens
gaagatccccaactgctcca

SEQ ID NO: 4566852 - DNA, 22 bp, Homo sapiens
gaagatggagggggctggggtc

SEQ ID NO: 4566853 - DNA, 18 bp, Homo sapiens
gaagatgtgtaaacaggt

SEQ ID NO: 4566854 - DNA, 21 bp, Homo sapiens
gaagatgtgtaaacaggtatt

SEQ ID NO: 4566855 - DNA, 20 bp, Homo sapiens
gaagattctatgttaatatt

SEQ ID NO: 4566856 - DNA, 23 bp, Homo sapiens
gaagattctatgttaatatttta

SEQ ID NO: 4566857 - DNA, 20 bp, Homo sapiens
gaagattctcgccccttccc

SEQ ID NO: 4566858 - DNA, 14 bp, Homo sapiens
gaagattctttccc

SEQ ID NO: 4566859 - DNA, 14 bp, Homo sapiens
gaagcaaagtgccc

SEQ ID NO: 4566860 - DNA, 22 bp, Homo sapiens
gaagcaacctcagtaatttaga

SEQ ID NO: 4566861 - DNA, 16 bp, Homo sapiens
gaagcaattgaaaagg

SEQ ID NO: 4566862 - DNA, 13 bp, Homo sapiens
gaagcacaactcc

SEQ ID NO: 4566863 - DNA, 20 bp, Homo sapiens
gaagcacagagggctaggga

SEQ ID NO: 4566864 - DNA, 18 bp, Homo sapiens
gaagcacgggggagtgag

SEQ ID NO: 4566865 - DNA, 17 bp, Homo sapiens
gaagcacttctgctgca

SEQ ID NO: 4566866 - DNA, 19 bp, Homo sapiens
gaagcacttgctcaaaatc

SEQ ID NO: 4566867 - DNA, 12 bp, Homo sapiens
gaagcagaggcc

SEQ ID NO: 4566868 - DNA, 14 bp, Homo sapiens
gaagcagaggccct

SEQ ID NO: 4566869 - DNA, 15 bp, Homo sapiens
gaagcagaggccctg

SEQ ID NO: 4566870 - DNA, 23 bp, Homo sapiens
gaagcagaggccctgcccccacc

SEQ ID NO: 4566871 - DNA, 15 bp, Homo sapiens
gaagcaggacagaca

SEQ ID NO: 4566872 - DNA, 23 bp, Homo sapiens
gaagcaggagggagggtggcttt

SEQ ID NO: 4566873 - DNA, 17 bp, Homo sapiens
gaagcagggtttctttt

SEQ ID NO: 4566874 - DNA, 17 bp, Homo sapiens
gaagcatacactatgaa

SEQ ID NO: 4566875 - DNA, 16 bp, Homo sapiens
gaagcatgtaggagaa

SEQ ID NO: 4566876 - DNA, 17 bp, Homo sapiens
gaagcatgtaggagaat

SEQ ID NO: 4566877 - DNA, 15 bp, Homo sapiens
gaagccaagggaaag

SEQ ID NO: 4566878 - DNA, 21 bp, Homo sapiens
gaagccaagggaaaggggtgc

SEQ ID NO: 4566879 - DNA, 23 bp, Homo sapiens
gaagccaagtggggtgctgggag

SEQ ID NO: 4566880 - DNA, 15 bp, Homo sapiens
gaagccacaggcctg

SEQ ID NO: 4566881 - DNA, 17 bp, Homo sapiens
gaagccacctcaccaag

SEQ ID NO: 4566882 - DNA, 18 bp, Homo sapiens
gaagccacgctgtcctct

SEQ ID NO: 4566883 - DNA, 22 bp, Homo sapiens
gaagccagagccccaagcagga

SEQ ID NO: 4566884 - DNA, 17 bp, Homo sapiens
gaagccagtcagggccc

SEQ ID NO: 4566885 - DNA, 22 bp, Homo sapiens
gaagccatatatgaccagaagc

SEQ ID NO: 4566886 - DNA, 17 bp, Homo sapiens
gaagccatcacttctcc

SEQ ID NO: 4566887 - DNA, 19 bp, Homo sapiens
gaagccatcacttctcccc

SEQ ID NO: 4566888 - DNA, 22 bp, Homo sapiens
gaagccatccctttttttacat

SEQ ID NO: 4566889 - DNA, 16 bp, Homo sapiens
gaagcccatcctgacc

SEQ ID NO: 4566890 - DNA, 17 bp, Homo sapiens
gaagcccatcctgacca

SEQ ID NO: 4566891 - DNA, 12 bp, Homo sapiens
gaagccctcctt

SEQ ID NO: 4566892 - DNA, 14 bp, Homo sapiens
gaagccctccttcc

SEQ ID NO: 4566893 - DNA, 19 bp, Homo sapiens
gaagccctggatttcagaa

SEQ ID NO: 4566894 - DNA, 21 bp, Homo sapiens
gaagccctggatttcagaaag

SEQ ID NO: 4566895 - DNA, 19 bp, Homo sapiens
gaagcctctctccttggcc

SEQ ID NO: 4566896 - DNA, 12 bp, Homo sapiens
gaagcctctggc

SEQ ID NO: 4566897 - DNA, 14 bp, Homo sapiens
gaagcctctggcta

SEQ ID NO: 4566898 - DNA, 17 bp, Homo sapiens
gaagcctctggctagag

SEQ ID NO: 4566899 - DNA, 13 bp, Homo sapiens
gaagcctctggga

SEQ ID NO: 4566900 - DNA, 18 bp, Homo sapiens
gaagcctgtggatgatca

SEQ ID NO: 4566901 - DNA, 19 bp, Homo sapiens
gaagccttggaaccagccc

SEQ ID NO: 4566902 - DNA, 14 bp, Homo sapiens
gaagcctttatcta

SEQ ID NO: 4566903 - DNA, 13 bp, Homo sapiens
gaagcctttggga

SEQ ID NO: 4566904 - DNA, 14 bp, Homo sapiens
gaagcgctcatctg

SEQ ID NO: 4566905 - DNA, 16 bp, Homo sapiens
gaagcggcatagcacc

SEQ ID NO: 4566906 - DNA, 13 bp, Homo sapiens
gaagcgttgtcct

SEQ ID NO: 4566907 - DNA, 20 bp, Homo sapiens
gaagctaacgttagaatagt

SEQ ID NO: 4566908 - DNA, 15 bp, Homo sapiens
gaagctactgtgtgt

SEQ ID NO: 4566909 - DNA, 23 bp, Homo sapiens
gaagctactgtgtgtgtgaatga

SEQ ID NO: 4566910 - DNA, 23 bp, Homo sapiens
gaagctagacacatgaaggtaaa

SEQ ID NO: 4566911 - DNA, 19 bp, Homo sapiens
gaagctcgcatccagacag

SEQ ID NO: 4566912 - DNA, 15 bp, Homo sapiens
gaagctgaagatccc

SEQ ID NO: 4566913 - DNA, 14 bp, Homo sapiens
gaagctgagctttt

SEQ ID NO: 4566914 - DNA, 16 bp, Homo sapiens
gaagctgagcttttga

SEQ ID NO: 4566915 - DNA, 12 bp, Homo sapiens
gaagctgctgtg

SEQ ID NO: 4566916 - DNA, 13 bp, Homo sapiens
gaagctgctgtgt

SEQ ID NO: 4566917 - DNA, 17 bp, Homo sapiens
gaagctggccgagggtc

SEQ ID NO: 4566918 - DNA, 20 bp, Homo sapiens
gaagctgtgtccttgcacct

SEQ ID NO: 4566919 - DNA, 22 bp, Homo sapiens
gaagctgtgtccttgcacctgc

SEQ ID NO: 4566920 - DNA, 21 bp, Homo sapiens
gaagcttcagcaggaggcaag

SEQ ID NO: 4566921 - DNA, 16 bp, Homo sapiens
gaagcttccacaaaat

SEQ ID NO: 4566922 - DNA, 15 bp, Homo sapiens
gaagcttctgtctcc

SEQ ID NO: 4566923 - DNA, 15 bp, Homo sapiens
gaaggaaactggaat

SEQ ID NO: 4566924 - DNA, 16 bp, Homo sapiens
gaaggaaataaacatt

SEQ ID NO: 4566925 - DNA, 21 bp, Homo sapiens
gaaggaacttgtctcttcatc

SEQ ID NO: 4566926 - DNA, 14 bp, Homo sapiens
gaaggaattacatt

SEQ ID NO: 4566927 - DNA, 22 bp, Homo sapiens
gaaggacagtccctgctgggga

SEQ ID NO: 4566928 - DNA, 15 bp, Homo sapiens
gaaggagactcacct

SEQ ID NO: 4566929 - DNA, 17 bp, Homo sapiens
gaaggagactcacctct

SEQ ID NO: 4566930 - DNA, 22 bp, Homo sapiens
gaaggagactcacctctgcctc

SEQ ID NO: 4566931 - DNA, 19 bp, Homo sapiens
gaaggagagcaagaaggaa

SEQ ID NO: 4566932 - DNA, 20 bp, Homo sapiens
gaaggagagcaagaaggaaa

SEQ ID NO: 4566933 - DNA, 16 bp, Homo sapiens
gaaggagagcctgctg

SEQ ID NO: 4566934 - DNA, 20 bp, Homo sapiens
gaaggagccccattcctggg

SEQ ID NO: 4566935 - DNA, 21 bp, Homo sapiens
gaaggagccccattcctggga

SEQ ID NO: 4566936 - DNA, 14 bp, Homo sapiens
gaaggaggcctcca

SEQ ID NO: 4566937 - DNA, 19 bp, Homo sapiens
gaaggaggggagagacagg

SEQ ID NO: 4566938 - DNA, 20 bp, Homo sapiens
gaaggaggggagagacaggc

SEQ ID NO: 4566939 - DNA, 14 bp, Homo sapiens
gaaggcaagagggg

SEQ ID NO: 4566940 - DNA, 12 bp, Homo sapiens
gaaggcagaata

SEQ ID NO: 4566941 - DNA, 22 bp, Homo sapiens
gaaggccagctgccccagccag

SEQ ID NO: 4566942 - DNA, 16 bp, Homo sapiens
gaaggccccagagaga

SEQ ID NO: 4566943 - DNA, 14 bp, Homo sapiens
gaaggccctgaggc

SEQ ID NO: 4566944 - DNA, 20 bp, Homo sapiens
gaaggcctgacttctgctgg

SEQ ID NO: 4566945 - DNA, 15 bp, Homo sapiens
gaaggcctgagcccc

SEQ ID NO: 4566946 - DNA, 15 bp, Homo sapiens
gaaggcgagtctggg

SEQ ID NO: 4566947 - DNA, 18 bp, Homo sapiens
gaaggcgagtctggggac

SEQ ID NO: 4566948 - DNA, 20 bp, Homo sapiens
gaaggctggaaggcagcagg

SEQ ID NO: 4566949 - DNA, 21 bp, Homo sapiens
gaaggctgtgtgtcttctgcc

SEQ ID NO: 4566950 - DNA, 20 bp, Homo sapiens
gaaggcttgggatttgctgt

SEQ ID NO: 4566951 - DNA, 20 bp, Homo sapiens
gaagggaaagcgggcagccc

SEQ ID NO: 4566952 - DNA, 23 bp, Homo sapiens
gaagggaaagcgggcagccccgt

SEQ ID NO: 4566953 - DNA, 23 bp, Homo sapiens
gaagggaaattgtttatgtgtta

SEQ ID NO: 4566954 - DNA, 17 bp, Homo sapiens
gaagggaataaggtaca

SEQ ID NO: 4566955 - DNA, 15 bp, Homo sapiens
gaagggacttttatt

SEQ ID NO: 4566956 - DNA, 23 bp, Homo sapiens
gaagggagagttctttgctgccc

SEQ ID NO: 4566957 - DNA, 16 bp, Homo sapiens
gaagggaggggctgtg

SEQ ID NO: 4566958 - DNA, 22 bp, Homo sapiens
gaagggcaggaaggagagcctg

SEQ ID NO: 4566959 - DNA, 19 bp, Homo sapiens
gaagggcagggctgaggcc

SEQ ID NO: 4566960 - DNA, 20 bp, Homo sapiens
gaagggccagtcctgcctgg

SEQ ID NO: 4566961 - DNA, 22 bp, Homo sapiens
gaagggcctgcccagttgcact

SEQ ID NO: 4566962 - DNA, 20 bp, Homo sapiens
gaagggctagaacctggaga

SEQ ID NO: 4566963 - DNA, 15 bp, Homo sapiens
gaagggctgggccac

SEQ ID NO: 4566964 - DNA, 19 bp, Homo sapiens
gaagggctgggccaccagg

SEQ ID NO: 4566965 - DNA, 16 bp, Homo sapiens
gaaggggccagaggct

SEQ ID NO: 4566966 - DNA, 14 bp, Homo sapiens
gaaggggttcctca

SEQ ID NO: 4566967 - DNA, 13 bp, Homo sapiens
gaagggtcctgcc

SEQ ID NO: 4566968 - DNA, 15 bp, Homo sapiens
gaagggtcctgccgg

SEQ ID NO: 4566969 - DNA, 13 bp, Homo sapiens
gaagggtgtgtga

SEQ ID NO: 4566970 - DNA, 13 bp, Homo sapiens
gaaggtaaataaa

SEQ ID NO: 4566971 - DNA, 17 bp, Homo sapiens
gaaggtaaataaaaaga

SEQ ID NO: 4566972 - DNA, 17 bp, Homo sapiens
gaaggtagaatgttttc

SEQ ID NO: 4566973 - DNA, 17 bp, Homo sapiens
gaaggtgataagggaaa

SEQ ID NO: 4566974 - DNA, 19 bp, Homo sapiens
gaaggtgataagggaaaag

SEQ ID NO: 4566975 - DNA, 18 bp, Homo sapiens
gaaggtggccacagcaag

SEQ ID NO: 4566976 - DNA, 23 bp, Homo sapiens
gaaggtgttgggtcagtggccag

SEQ ID NO: 4566977 - DNA, 14 bp, Homo sapiens
gaagtaaaacagtc

SEQ ID NO: 4566978 - DNA, 16 bp, Homo sapiens
gaagtaaaacagtcat

SEQ ID NO: 4566979 - DNA, 19 bp, Homo sapiens
gaagtaaaagcaaaaaaga

SEQ ID NO: 4566980 - DNA, 15 bp, Homo sapiens
gaagtaacagacaca

SEQ ID NO: 4566981 - DNA, 13 bp, Homo sapiens
gaagtaacttatt

SEQ ID NO: 4566982 - DNA, 23 bp, Homo sapiens
gaagtaattaaggtacatcatta

SEQ ID NO: 4566983 - DNA, 22 bp, Homo sapiens
gaagtaattatcagttggtttg

SEQ ID NO: 4566984 - DNA, 17 bp, Homo sapiens
gaagtacaaacatgaaa

SEQ ID NO: 4566985 - DNA, 18 bp, Homo sapiens
gaagtacaaacatgaaaa

SEQ ID NO: 4566986 - DNA, 21 bp, Homo sapiens
gaagtacgaatcttatttttc

SEQ ID NO: 4566987 - DNA, 23 bp, Homo sapiens
gaagtacgaatcttatttttcct

SEQ ID NO: 4566988 - DNA, 20 bp, Homo sapiens
gaagtagaaacaaaatacaa

SEQ ID NO: 4566989 - DNA, 15 bp, Homo sapiens
gaagtagctagtagc

SEQ ID NO: 4566990 - DNA, 23 bp, Homo sapiens
gaagtagtgtctggatcagtaaa

SEQ ID NO: 4566991 - DNA, 14 bp, Homo sapiens
gaagtatacctgat

SEQ ID NO: 4566992 - DNA, 20 bp, Homo sapiens
gaagtattacatgatttaaa

SEQ ID NO: 4566993 - DNA, 19 bp, Homo sapiens
gaagtattttgctggaata

SEQ ID NO: 4566994 - DNA, 23 bp, Homo sapiens
gaagtatttttttaatttctgaa

SEQ ID NO: 4566995 - DNA, 15 bp, Homo sapiens
gaagtcatcttgcta

SEQ ID NO: 4566996 - DNA, 15 bp, Homo sapiens
gaagtccggccccag

SEQ ID NO: 4566997 - DNA, 21 bp, Homo sapiens
gaagtccttcagtgagcccct

SEQ ID NO: 4566998 - DNA, 22 bp, Homo sapiens
gaagtccttcagtgagcccctc

SEQ ID NO: 4566999 - DNA, 16 bp, Homo sapiens
gaagtctaggagctgg

SEQ ID NO: 4567000 - DNA, 16 bp, Homo sapiens
gaagtcttaattgtgt

SEQ ID NO: 4567001 - DNA, 19 bp, Homo sapiens
gaagtcttaattgtgttta

SEQ ID NO: 4567002 - DNA, 21 bp, Homo sapiens
gaagtcttaattgtgtttatt

SEQ ID NO: 4567003 - DNA, 18 bp, Homo sapiens
gaagtgaacccatatttt

SEQ ID NO: 4567004 - DNA, 23 bp, Homo sapiens
gaagtgagcagtcgcctgcctgc

SEQ ID NO: 4567005 - DNA, 23 bp, Homo sapiens
gaagtgcatctggagagaacagg

SEQ ID NO: 4567006 - DNA, 16 bp, Homo sapiens
gaagtggaaggaagaa

SEQ ID NO: 4567007 - DNA, 22 bp, Homo sapiens
gaagtggaccaggacaggacca

SEQ ID NO: 4567008 - DNA, 17 bp, Homo sapiens
gaagtggactggcccct

SEQ ID NO: 4567009 - DNA, 20 bp, Homo sapiens
gaagtggactggcccctggg

SEQ ID NO: 4567010 - DNA, 13 bp, Homo sapiens
gaagtggctcaga

SEQ ID NO: 4567011 - DNA, 14 bp, Homo sapiens
gaagtggctcagac

SEQ ID NO: 4567012 - DNA, 19 bp, Homo sapiens
gaagtgggccaggacaggc

SEQ ID NO: 4567013 - DNA, 20 bp, Homo sapiens
gaagtggtttcctgataaca

SEQ ID NO: 4567014 - DNA, 18 bp, Homo sapiens
gaagtgtggctggtgtcc

SEQ ID NO: 4567015 - DNA, 17 bp, Homo sapiens
gaagtgtgggtctgtgt

SEQ ID NO: 4567016 - DNA, 18 bp, Homo sapiens
gaagtgtgggtctgtgtg

SEQ ID NO: 4567017 - DNA, 24 bp, Homo sapiens
gaagtgtgggtctgtgtgtgtgta

SEQ ID NO: 4567018 - DNA, 14 bp, Homo sapiens
gaagtgtgtttgcc

SEQ ID NO: 4567019 - DNA, 17 bp, Homo sapiens
gaagtgttaatacatca

SEQ ID NO: 4567020 - DNA, 22 bp, Homo sapiens
gaagttaaactattttgagcat

SEQ ID NO: 4567021 - DNA, 15 bp, Homo sapiens
gaagttattttccag

SEQ ID NO: 4567022 - DNA, 19 bp, Homo sapiens
gaagttgtgctaaaccaag

SEQ ID NO: 4567023 - DNA, 14 bp, Homo sapiens
gaagttgtttatca

SEQ ID NO: 4567024 - DNA, 17 bp, Homo sapiens
gaagttgtttatcaact

SEQ ID NO: 4567025 - DNA, 22 bp, Homo sapiens
gaagtttcaagttttaaagttc

SEQ ID NO: 4567026 - DNA, 19 bp, Homo sapiens
gaagtttccagaaaagaag

SEQ ID NO: 4567027 - DNA, 13 bp, Homo sapiens
gaagttttacatt

SEQ ID NO: 4567028 - DNA, 11 bp, Homo sapiens
gaagtttttaa

SEQ ID NO: 4567029 - DNA, 11 bp, Homo sapiens
gaataaagaat

SEQ ID NO: 4567030 - DNA, 11 bp, Homo sapiens
gaataaagcaa

SEQ ID NO: 4567031 - DNA, 15 bp, Homo sapiens
gaataaaggcagttt

SEQ ID NO: 4567032 - DNA, 19 bp, Homo sapiens
gaataaaggcagttttcta

SEQ ID NO: 4567033 - DNA, 15 bp, Homo sapiens
gaataaatggtttct

SEQ ID NO: 4567034 - DNA, 14 bp, Homo sapiens
gaataaatgttcaa

SEQ ID NO: 4567035 - DNA, 15 bp, Homo sapiens
gaataaatgttcaaa

SEQ ID NO: 4567036 - DNA, 20 bp, Homo sapiens
gaataaattcccaacttctc

SEQ ID NO: 4567037 - DNA, 21 bp, Homo sapiens
gaataaattttcaaatcctta

SEQ ID NO: 4567038 - DNA, 19 bp, Homo sapiens
gaataacatatcaaatgaa

SEQ ID NO: 4567039 - DNA, 22 bp, Homo sapiens
gaataagacaagagatctacac

SEQ ID NO: 4567040 - DNA, 15 bp, Homo sapiens
gaataagcagaacat

SEQ ID NO: 4567041 - DNA, 16 bp, Homo sapiens
gaataagcagaacata

SEQ ID NO: 4567042 - DNA, 19 bp, Homo sapiens
gaataaggtacaagaagca

SEQ ID NO: 4567043 - DNA, 14 bp, Homo sapiens
gaataagttattgc

SEQ ID NO: 4567044 - DNA, 16 bp, Homo sapiens
gaataagttattgcag

SEQ ID NO: 4567045 - DNA, 18 bp, Homo sapiens
gaataagttattgcagtt

SEQ ID NO: 4567046 - DNA, 14 bp, Homo sapiens
gaataataagcagg

SEQ ID NO: 4567047 - DNA, 19 bp, Homo sapiens
gaataatcaaatacatttt

SEQ ID NO: 4567048 - DNA, 18 bp, Homo sapiens
gaataatcacgctttcct

SEQ ID NO: 4567049 - DNA, 12 bp, Homo sapiens
gaataatcctgt

SEQ ID NO: 4567050 - DNA, 16 bp, Homo sapiens
gaataatgcctttgta

SEQ ID NO: 4567051 - DNA, 17 bp, Homo sapiens
gaataatgcctttgtaa

SEQ ID NO: 4567052 - DNA, 19 bp, Homo sapiens
gaataatttatagtaatga

SEQ ID NO: 4567053 - DNA, 22 bp, Homo sapiens
gaatacaatatatagctggcaa

SEQ ID NO: 4567054 - DNA, 12 bp, Homo sapiens
gaatacacagta

SEQ ID NO: 4567055 - DNA, 21 bp, Homo sapiens
gaatacattaacggtgctaaa

SEQ ID NO: 4567056 - DNA, 12 bp, Homo sapiens
gaatacatttta

SEQ ID NO: 4567057 - DNA, 13 bp, Homo sapiens
gaatacattttat

SEQ ID NO: 4567058 - DNA, 13 bp, Homo sapiens
gaatacctgctca

SEQ ID NO: 4567059 - DNA, 17 bp, Homo sapiens
gaatactgcatttacag

SEQ ID NO: 4567060 - DNA, 15 bp, Homo sapiens
gaatactgtctgtat

SEQ ID NO: 4567061 - DNA, 16 bp, Homo sapiens
gaatactgtctgtatc

SEQ ID NO: 4567062 - DNA, 15 bp, Homo sapiens
gaatacttgaacttg

SEQ ID NO: 4567063 - DNA, 14 bp, Homo sapiens
gaatactttttaca

SEQ ID NO: 4567064 - DNA, 19 bp, Homo sapiens
gaatagaaacgtaaactat

SEQ ID NO: 4567065 - DNA, 16 bp, Homo sapiens
gaatagaaagaaagtc

SEQ ID NO: 4567066 - DNA, 23 bp, Homo sapiens
gaatagaaataaaggatgtgatt

SEQ ID NO: 4567067 - DNA, 22 bp, Homo sapiens
gaatagcctagatatgaatata

SEQ ID NO: 4567068 - DNA, 13 bp, Homo sapiens
gaatagcctggcc

SEQ ID NO: 4567069 - DNA, 22 bp, Homo sapiens
gaatagtgctgcaataaacata

SEQ ID NO: 4567070 - DNA, 20 bp, Homo sapiens
gaatagtggaacattttcat

SEQ ID NO: 4567071 - DNA, 17 bp, Homo sapiens
gaatagtggttaacaga

SEQ ID NO: 4567072 - DNA, 17 bp, Homo sapiens
gaatagttaaaaattaa

SEQ ID NO: 4567073 - DNA, 19 bp, Homo sapiens
gaatagttaaaaattaaat

SEQ ID NO: 4567074 - DNA, 23 bp, Homo sapiens
gaatagttaaaaattaaatattt

SEQ ID NO: 4567075 - DNA, 15 bp, Homo sapiens
gaatagtttatttct

SEQ ID NO: 4567076 - DNA, 21 bp, Homo sapiens
gaatagtttatttctgtgaaa

SEQ ID NO: 4567077 - DNA, 15 bp, Homo sapiens
gaatataaaacagtc

SEQ ID NO: 4567078 - DNA, 17 bp, Homo sapiens
gaatataaatgtgtgta

SEQ ID NO: 4567079 - DNA, 11 bp, Homo sapiens
gaatataagaa

SEQ ID NO: 4567080 - DNA, 12 bp, Homo sapiens
gaatataagaaa

SEQ ID NO: 4567081 - DNA, 19 bp, Homo sapiens
gaatataattgttttatct

SEQ ID NO: 4567082 - DNA, 20 bp, Homo sapiens
gaatatactcattagaatta

SEQ ID NO: 4567083 - DNA, 15 bp, Homo sapiens
gaatatatatatata

SEQ ID NO: 4567084 - DNA, 17 bp, Homo sapiens
gaatatatctgtaaaga

SEQ ID NO: 4567085 - DNA, 23 bp, Homo sapiens
gaatatatggcatttgcagattt

SEQ ID NO: 4567086 - DNA, 16 bp, Homo sapiens
gaatatcatctgtcat

SEQ ID NO: 4567087 - DNA, 20 bp, Homo sapiens
gaatatctgttcccagcccc

SEQ ID NO: 4567088 - DNA, 23 bp, Homo sapiens
gaatatggccaaggctctctctg

SEQ ID NO: 4567089 - DNA, 20 bp, Homo sapiens
gaatattgagcaatatgtca

SEQ ID NO: 4567090 - DNA, 12 bp, Homo sapiens
gaatatttaaag

SEQ ID NO: 4567091 - DNA, 22 bp, Homo sapiens
gaatatttgttatgtagataac

SEQ ID NO: 4567092 - DNA, 18 bp, Homo sapiens
gaatatttgttttaatac

SEQ ID NO: 4567093 - DNA, 20 bp, Homo sapiens
gaatattttcaagtttttca

SEQ ID NO: 4567094 - DNA, 23 bp, Homo sapiens
gaatattttcaagtttttcatac

SEQ ID NO: 4567095 - DNA, 21 bp, Homo sapiens
gaatattttcagtaatgttat

SEQ ID NO: 4567096 - DNA, 15 bp, Homo sapiens
gaatattttgatgca

SEQ ID NO: 4567097 - DNA, 20 bp, Homo sapiens
gaatatttttatatttcctt

SEQ ID NO: 4567098 - DNA, 16 bp, Homo sapiens
gaatcaagagctgccc

SEQ ID NO: 4567099 - DNA, 19 bp, Homo sapiens
gaatcaagagctgccctcc

SEQ ID NO: 4567100 - DNA, 18 bp, Homo sapiens
gaatcaaggtaagctcag

SEQ ID NO: 4567101 - DNA, 17 bp, Homo sapiens
gaatcaatctggcttct

SEQ ID NO: 4567102 - DNA, 18 bp, Homo sapiens
gaatcacagtatcagtat

SEQ ID NO: 4567103 - DNA, 19 bp, Homo sapiens
gaatcacccctctgcccct

SEQ ID NO: 4567104 - DNA, 20 bp, Homo sapiens
gaatcacccctctgcccctg

SEQ ID NO: 4567105 - DNA, 21 bp, Homo sapiens
gaatcacccctctgcccctgc

SEQ ID NO: 4567106 - DNA, 22 bp, Homo sapiens
gaatcacccctctgcccctgca

SEQ ID NO: 4567107 - DNA, 17 bp, Homo sapiens
gaatcacctgaacccca

SEQ ID NO: 4567108 - DNA, 19 bp, Homo sapiens
gaatcactgctccaggcct

SEQ ID NO: 4567109 - DNA, 19 bp, Homo sapiens
gaatcactgttgctttgaa

SEQ ID NO: 4567110 - DNA, 18 bp, Homo sapiens
gaatcacttaagcctgga

SEQ ID NO: 4567111 - DNA, 21 bp, Homo sapiens
gaatcagaataaagttgtatt

SEQ ID NO: 4567112 - DNA, 18 bp, Homo sapiens
gaatcagaccctacccca

SEQ ID NO: 4567113 - DNA, 18 bp, Homo sapiens
gaatcagtcctagaatgt

SEQ ID NO: 4567114 - DNA, 20 bp, Homo sapiens
gaatcagtcctagaatgttt

SEQ ID NO: 4567115 - DNA, 20 bp, Homo sapiens
gaatcatacttaacatttca

SEQ ID NO: 4567116 - DNA, 22 bp, Homo sapiens
gaatcattaatttcaaaattta

SEQ ID NO: 4567117 - DNA, 16 bp, Homo sapiens
gaatcattatttatta

SEQ ID NO: 4567118 - DNA, 12 bp, Homo sapiens
gaatccaagatt

SEQ ID NO: 4567119 - DNA, 22 bp, Homo sapiens
gaatccaagggttgagagccag

SEQ ID NO: 4567120 - DNA, 14 bp, Homo sapiens
gaatccgtattgaa

SEQ ID NO: 4567121 - DNA, 21 bp, Homo sapiens
gaatccgtattgaatttgtgt

SEQ ID NO: 4567122 - DNA, 14 bp, Homo sapiens
gaatcgaagtgttt

SEQ ID NO: 4567123 - DNA, 17 bp, Homo sapiens
gaatcgaagtgtttatg

SEQ ID NO: 4567124 - DNA, 20 bp, Homo sapiens
gaatcgaagtgtttatgtaa

SEQ ID NO: 4567125 - DNA, 14 bp, Homo sapiens
gaatcgcaagttaa

SEQ ID NO: 4567126 - DNA, 16 bp, Homo sapiens
gaatcgcaagttaact

SEQ ID NO: 4567127 - DNA, 15 bp, Homo sapiens
gaatctactaattcc

SEQ ID NO: 4567128 - DNA, 16 bp, Homo sapiens
gaatctattagatttt

SEQ ID NO: 4567129 - DNA, 17 bp, Homo sapiens
gaatctcttcatgcttg

SEQ ID NO: 4567130 - DNA, 12 bp, Homo sapiens
gaatctctttcc

SEQ ID NO: 4567131 - DNA, 23 bp, Homo sapiens
gaatctgagagatgctgtagaca

SEQ ID NO: 4567132 - DNA, 18 bp, Homo sapiens
gaatctgctgagaggcac

SEQ ID NO: 4567133 - DNA, 18 bp, Homo sapiens
gaatctgcttttcctctg

SEQ ID NO: 4567134 - DNA, 13 bp, Homo sapiens
gaatctgtgcaaa

SEQ ID NO: 4567135 - DNA, 14 bp, Homo sapiens
gaatctgtgtgaaa

SEQ ID NO: 4567136 - DNA, 18 bp, Homo sapiens
gaatctgtttctctgctg

SEQ ID NO: 4567137 - DNA, 21 bp, Homo sapiens
gaatcttatttttcctgtcct

SEQ ID NO: 4567138 - DNA, 13 bp, Homo sapiens
gaatgaaaagaca

SEQ ID NO: 4567139 - DNA, 12 bp, Homo sapiens
gaatgaaaataa

SEQ ID NO: 4567140 - DNA, 23 bp, Homo sapiens
gaatgaaaataactgaatttgga

SEQ ID NO: 4567141 - DNA, 11 bp, Homo sapiens
gaatgaaatga

SEQ ID NO: 4567142 - DNA, 20 bp, Homo sapiens
gaatgaacactcttttgctt

SEQ ID NO: 4567143 - DNA, 16 bp, Homo sapiens
gaatgaagcagtattt

SEQ ID NO: 4567144 - DNA, 15 bp, Homo sapiens
gaatgaatggctaag

SEQ ID NO: 4567145 - DNA, 20 bp, Homo sapiens
gaatgaatggctaagcaaaa

SEQ ID NO: 4567146 - DNA, 16 bp, Homo sapiens
gaatgaatttatcttt

SEQ ID NO: 4567147 - DNA, 13 bp, Homo sapiens
gaatgagacatcc

SEQ ID NO: 4567148 - DNA, 14 bp, Homo sapiens
gaatgagagtgtga

SEQ ID NO: 4567149 - DNA, 20 bp, Homo sapiens
gaatgattggttaaaatgtg

SEQ ID NO: 4567150 - DNA, 22 bp, Homo sapiens
gaatgatttccaaagagaaaaa

SEQ ID NO: 4567151 - DNA, 14 bp, Homo sapiens
gaatgcacctcccc

SEQ ID NO: 4567152 - DNA, 17 bp, Homo sapiens
gaatgcacctccccaaa

SEQ ID NO: 4567153 - DNA, 13 bp, Homo sapiens
gaatgcagcagga

SEQ ID NO: 4567154 - DNA, 16 bp, Homo sapiens
gaatgcagcaggaagg

SEQ ID NO: 4567155 - DNA, 15 bp, Homo sapiens
gaatgcataatgttt

SEQ ID NO: 4567156 - DNA, 16 bp, Homo sapiens
gaatgccatttctcac

SEQ ID NO: 4567157 - DNA, 19 bp, Homo sapiens
gaatgccgaatttggtaca

SEQ ID NO: 4567158 - DNA, 23 bp, Homo sapiens
gaatgccgaatttggtacacatg

SEQ ID NO: 4567159 - DNA, 18 bp, Homo sapiens
gaatgccgcgatgggtca

SEQ ID NO: 4567160 - DNA, 13 bp, Homo sapiens
gaatgccttggaa

SEQ ID NO: 4567161 - DNA, 21 bp, Homo sapiens
gaatgctgagacccccggagc

SEQ ID NO: 4567162 - DNA, 17 bp, Homo sapiens
gaatgctgtacatctat

SEQ ID NO: 4567163 - DNA, 21 bp, Homo sapiens
gaatgcttttagtgtgtgcat

SEQ ID NO: 4567164 - DNA, 14 bp, Homo sapiens
gaatggagcctgct

SEQ ID NO: 4567165 - DNA, 13 bp, Homo sapiens
gaatggaggcaga

SEQ ID NO: 4567166 - DNA, 19 bp, Homo sapiens
gaatggaggcagagacctc

SEQ ID NO: 4567167 - DNA, 21 bp, Homo sapiens
gaatggcaaacgattttacta

SEQ ID NO: 4567168 - DNA, 20 bp, Homo sapiens
gaatgggagaggcaataaat

SEQ ID NO: 4567169 - DNA, 19 bp, Homo sapiens
gaatggtgtgaacccggga

SEQ ID NO: 4567170 - DNA, 19 bp, Homo sapiens
gaatgtaaagttatgtatt

SEQ ID NO: 4567171 - DNA, 14 bp, Homo sapiens
gaatgtcagattcc

SEQ ID NO: 4567172 - DNA, 19 bp, Homo sapiens
gaatgtcagattcctttcc

SEQ ID NO: 4567173 - DNA, 13 bp, Homo sapiens
gaatgtcagtatg

SEQ ID NO: 4567174 - DNA, 17 bp, Homo sapiens
gaatgtcagttgttatt

SEQ ID NO: 4567175 - DNA, 21 bp, Homo sapiens
gaatgtcagttgttatttatt

SEQ ID NO: 4567176 - DNA, 18 bp, Homo sapiens
gaatgtcgcagactcctc

SEQ ID NO: 4567177 - DNA, 18 bp, Homo sapiens
gaatgtctgaagtacaaa

SEQ ID NO: 4567178 - DNA, 12 bp, Homo sapiens
gaatgtgaaaca

SEQ ID NO: 4567179 - DNA, 13 bp, Homo sapiens
gaatgtgccacag

SEQ ID NO: 4567180 - DNA, 15 bp, Homo sapiens
gaatgtggcagttta

SEQ ID NO: 4567181 - DNA, 16 bp, Homo sapiens
gaatgttaaagtcagt

SEQ ID NO: 4567182 - DNA, 13 bp, Homo sapiens
gaatgttaatttt

SEQ ID NO: 4567183 - DNA, 23 bp, Homo sapiens
gaatgttatcggattactgaatt

SEQ ID NO: 4567184 - DNA, 14 bp, Homo sapiens
gaatgttgggactg

SEQ ID NO: 4567185 - DNA, 23 bp, Homo sapiens
gaatgttgggactgctaaataaa

SEQ ID NO: 4567186 - DNA, 17 bp, Homo sapiens
gaatgttttcaaatgtt

SEQ ID NO: 4567187 - DNA, 15 bp, Homo sapiens
gaatgtttttccctc

SEQ ID NO: 4567188 - DNA, 16 bp, Homo sapiens
gaatgtttttccctcc

SEQ ID NO: 4567189 - DNA, 19 bp, Homo sapiens
gaatgtttttccctcccca

SEQ ID NO: 4567190 - DNA, 21 bp, Homo sapiens
gaatgtttttccctccccaga

SEQ ID NO: 4567191 - DNA, 22 bp, Homo sapiens
gaatgtttttccctccccagaa

SEQ ID NO: 4567192 - DNA, 14 bp, Homo sapiens
gaattaaagtactt

SEQ ID NO: 4567193 - DNA, 13 bp, Homo sapiens
gaattaagcagaa

SEQ ID NO: 4567194 - DNA, 22 bp, Homo sapiens
gaattaccatagagtaatgatg

SEQ ID NO: 4567195 - DNA, 22 bp, Homo sapiens
gaattactttattataaaatgc

SEQ ID NO: 4567196 - DNA, 15 bp, Homo sapiens
gaattagaaaattag

SEQ ID NO: 4567197 - DNA, 19 bp, Homo sapiens
gaattaggctgtaactact

SEQ ID NO: 4567198 - DNA, 13 bp, Homo sapiens
gaattataactgt

SEQ ID NO: 4567199 - DNA, 15 bp, Homo sapiens
gaattatcagcaaag

SEQ ID NO: 4567200 - DNA, 17 bp, Homo sapiens
gaattatcagcaaagaa

SEQ ID NO: 4567201 - DNA, 14 bp, Homo sapiens
gaattatttctgtc

SEQ ID NO: 4567202 - DNA, 23 bp, Homo sapiens
gaattcaaatttgtaataaaact

SEQ ID NO: 4567203 - DNA, 13 bp, Homo sapiens
gaattcagacatc

SEQ ID NO: 4567204 - DNA, 19 bp, Homo sapiens
gaattcataataaattttc

SEQ ID NO: 4567205 - DNA, 17 bp, Homo sapiens
gaattcggtgtgcacca

SEQ ID NO: 4567206 - DNA, 18 bp, Homo sapiens
gaattcggtgtgctgcca

SEQ ID NO: 4567207 - DNA, 12 bp, Homo sapiens
gaattctactgg

SEQ ID NO: 4567208 - DNA, 15 bp, Homo sapiens
gaattctactggaaa

SEQ ID NO: 4567209 - DNA, 12 bp, Homo sapiens
gaattcttacag

SEQ ID NO: 4567210 - DNA, 12 bp, Homo sapiens
gaattcttctgc

SEQ ID NO: 4567211 - DNA, 18 bp, Homo sapiens
gaattcttctgcaacatt

SEQ ID NO: 4567212 - DNA, 17 bp, Homo sapiens
gaattctttctgttgaa

SEQ ID NO: 4567213 - DNA, 15 bp, Homo sapiens
gaattgagtgtttaa

SEQ ID NO: 4567214 - DNA, 19 bp, Homo sapiens
gaattgagtgtttaaagtt

SEQ ID NO: 4567215 - DNA, 18 bp, Homo sapiens
gaattgatgatgcagttt

SEQ ID NO: 4567216 - DNA, 17 bp, Homo sapiens
gaattgatttgcattga

SEQ ID NO: 4567217 - DNA, 22 bp, Homo sapiens
gaattgatttgcattgaacaca

SEQ ID NO: 4567218 - DNA, 15 bp, Homo sapiens
gaattgcgctcaggg

SEQ ID NO: 4567219 - DNA, 16 bp, Homo sapiens
gaattgcgctcagggg

SEQ ID NO: 4567220 - DNA, 15 bp, Homo sapiens
gaattggcataattt

SEQ ID NO: 4567221 - DNA, 20 bp, Homo sapiens
gaattgttagcaaatgacag

SEQ ID NO: 4567222 - DNA, 14 bp, Homo sapiens
gaatttaagaattt

SEQ ID NO: 4567223 - DNA, 16 bp, Homo sapiens
gaatttaagaatttgt

SEQ ID NO: 4567224 - DNA, 17 bp, Homo sapiens
gaatttaagaatttgtt

SEQ ID NO: 4567225 - DNA, 16 bp, Homo sapiens
gaatttaattctttca

SEQ ID NO: 4567226 - DNA, 19 bp, Homo sapiens
gaatttactttcttcacca

SEQ ID NO: 4567227 - DNA, 15 bp, Homo sapiens
gaatttagatcttat

SEQ ID NO: 4567228 - DNA, 18 bp, Homo sapiens
gaatttagatcttatatt

SEQ ID NO: 4567229 - DNA, 22 bp, Homo sapiens
gaatttatcacacttctgtgag

SEQ ID NO: 4567230 - DNA, 14 bp, Homo sapiens
gaatttatctttac

SEQ ID NO: 4567231 - DNA, 19 bp, Homo sapiens
gaatttatctttaccaaaa

SEQ ID NO: 4567232 - DNA, 21 bp, Homo sapiens
gaatttatgagatttactgct

SEQ ID NO: 4567233 - DNA, 20 bp, Homo sapiens
gaatttatgtgaaatgcttt

SEQ ID NO: 4567234 - DNA, 16 bp, Homo sapiens
gaatttcatgtgaatc

SEQ ID NO: 4567235 - DNA, 14 bp, Homo sapiens
gaatttccctctct

SEQ ID NO: 4567236 - DNA, 13 bp, Homo sapiens
gaatttcctctat

SEQ ID NO: 4567237 - DNA, 21 bp, Homo sapiens
gaatttcctctattgatgtac

SEQ ID NO: 4567238 - DNA, 21 bp, Homo sapiens
gaatttctcctttcctacagt

SEQ ID NO: 4567239 - DNA, 16 bp, Homo sapiens
gaatttcttaacttct

SEQ ID NO: 4567240 - DNA, 13 bp, Homo sapiens
gaatttgcaaagt

SEQ ID NO: 4567241 - DNA, 15 bp, Homo sapiens
gaatttgcaaagtac

SEQ ID NO: 4567242 - DNA, 17 bp, Homo sapiens
gaatttgcaaagtactg

SEQ ID NO: 4567243 - DNA, 18 bp, Homo sapiens
gaatttgcaaagtactgt

SEQ ID NO: 4567244 - DNA, 20 bp, Homo sapiens
gaatttgcctgctgggattc

SEQ ID NO: 4567245 - DNA, 13 bp, Homo sapiens
gaattttaaagta

SEQ ID NO: 4567246 - DNA, 16 bp, Homo sapiens
gaatttttaagcaaat

SEQ ID NO: 4567247 - DNA, 22 bp, Homo sapiens
gaatttttcctatgctattgac

SEQ ID NO: 4567248 - DNA, 20 bp, Homo sapiens
gaatttttgcaataatgcag

SEQ ID NO: 4567249 - DNA, 18 bp, Homo sapiens
gacaaaaacagcctcaca

SEQ ID NO: 4567250 - DNA, 20 bp, Homo sapiens
gacaaaaacagcctcacaga

SEQ ID NO: 4567251 - DNA, 18 bp, Homo sapiens
gacaaaaagtatattaaa

SEQ ID NO: 4567252 - DNA, 17 bp, Homo sapiens
gacaaaatggatacata

SEQ ID NO: 4567253 - DNA, 18 bp, Homo sapiens
gacaaagctgctaaatct

SEQ ID NO: 4567254 - DNA, 23 bp, Homo sapiens
gacaaaggaggaatttactttct

SEQ ID NO: 4567255 - DNA, 15 bp, Homo sapiens
gacaaaggccacagg

SEQ ID NO: 4567256 - DNA, 18 bp, Homo sapiens
gacaaatcacatatttta

SEQ ID NO: 4567257 - DNA, 21 bp, Homo sapiens
gacaaatgttgtcctgttaat

SEQ ID NO: 4567258 - DNA, 22 bp, Homo sapiens
gacaaattactgataaaaatga

SEQ ID NO: 4567259 - DNA, 12 bp, Homo sapiens
gacaaattttgc

SEQ ID NO: 4567260 - DNA, 18 bp, Homo sapiens
gacaacaccttcctcctg

SEQ ID NO: 4567261 - DNA, 18 bp, Homo sapiens
gacaacagaaagagggac

SEQ ID NO: 4567262 - DNA, 14 bp, Homo sapiens
gacaacagttctga

SEQ ID NO: 4567263 - DNA, 18 bp, Homo sapiens
gacaaccattaaagtcag

SEQ ID NO: 4567264 - DNA, 15 bp, Homo sapiens
gacaagaacattctc

SEQ ID NO: 4567265 - DNA, 22 bp, Homo sapiens
gacaagaacattctctcataga

SEQ ID NO: 4567266 - DNA, 14 bp, Homo sapiens
gacaagagggcaag

SEQ ID NO: 4567267 - DNA, 14 bp, Homo sapiens
gacaaggtgctaac

SEQ ID NO: 4567268 - DNA, 22 bp, Homo sapiens
gacaagttttagttaaaactca

SEQ ID NO: 4567269 - DNA, 16 bp, Homo sapiens
gacaataattctacat

SEQ ID NO: 4567270 - DNA, 16 bp, Homo sapiens
gacaatactgctgcct

SEQ ID NO: 4567271 - DNA, 12 bp, Homo sapiens
gacaatagtatt

SEQ ID NO: 4567272 - DNA, 16 bp, Homo sapiens
gacaatagtatttctc

SEQ ID NO: 4567273 - DNA, 21 bp, Homo sapiens
gacaatatgtgccaatcaata

SEQ ID NO: 4567274 - DNA, 14 bp, Homo sapiens
gacaatcatctcca

SEQ ID NO: 4567275 - DNA, 14 bp, Homo sapiens
gacaatcattgttt

SEQ ID NO: 4567276 - DNA, 20 bp, Homo sapiens
gacaatcattgttttgaata

SEQ ID NO: 4567277 - DNA, 18 bp, Homo sapiens
gacaattcctccagagac

SEQ ID NO: 4567278 - DNA, 21 bp, Homo sapiens
gacaattcctccagagacact

SEQ ID NO: 4567279 - DNA, 15 bp, Homo sapiens
gacaattttttttca

SEQ ID NO: 4567280 - DNA, 19 bp, Homo sapiens
gacacaaggtgatttcaga

SEQ ID NO: 4567281 - DNA, 15 bp, Homo sapiens
gacacaataggtctt

SEQ ID NO: 4567282 - DNA, 20 bp, Homo sapiens
gacacaataggtctttctct

SEQ ID NO: 4567283 - DNA, 14 bp, Homo sapiens
gacacaatttcatt

SEQ ID NO: 4567284 - DNA, 15 bp, Homo sapiens
gacacaccaggcgct

SEQ ID NO: 4567285 - DNA, 11 bp, Homo sapiens
gacacagaaaa

SEQ ID NO: 4567286 - DNA, 21 bp, Homo sapiens
gacacagaaaatgttgagaat

SEQ ID NO: 4567287 - DNA, 20 bp, Homo sapiens
gacacagaatagtttacaca

SEQ ID NO: 4567288 - DNA, 17 bp, Homo sapiens
gacacagcatcagctca

SEQ ID NO: 4567289 - DNA, 18 bp, Homo sapiens
gacacagcatcagctcaa

SEQ ID NO: 4567290 - DNA, 16 bp, Homo sapiens
gacacagtattgactt

SEQ ID NO: 4567291 - DNA, 14 bp, Homo sapiens
gacacagttcctgg

SEQ ID NO: 4567292 - DNA, 19 bp, Homo sapiens
gacacatactcatttttca

SEQ ID NO: 4567293 - DNA, 16 bp, Homo sapiens
gacacattgactcctt

SEQ ID NO: 4567294 - DNA, 15 bp, Homo sapiens
gacacattgccttct

SEQ ID NO: 4567295 - DNA, 21 bp, Homo sapiens
gacacattgccttctggagct

SEQ ID NO: 4567296 - DNA, 20 bp, Homo sapiens
gacacattggaatgccttgg

SEQ ID NO: 4567297 - DNA, 13 bp, Homo sapiens
gacaccagagctg

SEQ ID NO: 4567298 - DNA, 14 bp, Homo sapiens
gacaccagccaggc

SEQ ID NO: 4567299 - DNA, 15 bp, Homo sapiens
gacaccagccaggct

SEQ ID NO: 4567300 - DNA, 14 bp, Homo sapiens
gacaccatgtgcaa

SEQ ID NO: 4567301 - DNA, 14 bp, Homo sapiens
gacaccattcattc

SEQ ID NO: 4567302 - DNA, 20 bp, Homo sapiens
gacacccaggctggagtgca

SEQ ID NO: 4567303 - DNA, 10 bp, Homo sapiens
gacacccggc

SEQ ID NO: 4567304 - DNA, 22 bp, Homo sapiens
gacaccctccctccagggtcct

SEQ ID NO: 4567305 - DNA, 23 bp, Homo sapiens
gacaccctggcctgaactgagga

SEQ ID NO: 4567306 - DNA, 16 bp, Homo sapiens
gacacctaaccccagg

SEQ ID NO: 4567307 - DNA, 16 bp, Homo sapiens
gacacctaggctaggg

SEQ ID NO: 4567308 - DNA, 13 bp, Homo sapiens
gacacctcttttt

SEQ ID NO: 4567309 - DNA, 13 bp, Homo sapiens
gacacctgcacct

SEQ ID NO: 4567310 - DNA, 15 bp, Homo sapiens
gacacctgcacctcc

SEQ ID NO: 4567311 - DNA, 20 bp, Homo sapiens
gacacctgcacctcccccca

SEQ ID NO: 4567312 - DNA, 13 bp, Homo sapiens
gacacctggactg

SEQ ID NO: 4567313 - DNA, 16 bp, Homo sapiens
gacacctgtacattct

SEQ ID NO: 4567314 - DNA, 15 bp, Homo sapiens
gacacgcttctgagc

SEQ ID NO: 4567315 - DNA, 19 bp, Homo sapiens
gacacgcttctgagcaggg

SEQ ID NO: 4567316 - DNA, 17 bp, Homo sapiens
gacactaaatgcagaca

SEQ ID NO: 4567317 - DNA, 16 bp, Homo sapiens
gacactccccgaagtc

SEQ ID NO: 4567318 - DNA, 18 bp, Homo sapiens
gacactcgtcaccccagc

SEQ ID NO: 4567319 - DNA, 17 bp, Homo sapiens
gacactctatatgtagt

SEQ ID NO: 4567320 - DNA, 22 bp, Homo sapiens
gacacttgtaaattgttgtttc

SEQ ID NO: 4567321 - DNA, 14 bp, Homo sapiens
gacacttttatgtt

SEQ ID NO: 4567322 - DNA, 14 bp, Homo sapiens
gacagaaagcagaa

SEQ ID NO: 4567323 - DNA, 21 bp, Homo sapiens
gacagaaagcagaacagtgat

SEQ ID NO: 4567324 - DNA, 13 bp, Homo sapiens
gacagacgagaca

SEQ ID NO: 4567325 - DNA, 16 bp, Homo sapiens
gacagagacacctgca

SEQ ID NO: 4567326 - DNA, 13 bp, Homo sapiens
gacagagactcag

SEQ ID NO: 4567327 - DNA, 16 bp, Homo sapiens
gacagagccagcggct

SEQ ID NO: 4567328 - DNA, 13 bp, Homo sapiens
gacagaggaaagg

SEQ ID NO: 4567329 - DNA, 13 bp, Homo sapiens
gacagaggcctgc

SEQ ID NO: 4567330 - DNA, 20 bp, Homo sapiens
gacagagggagacagggctg

SEQ ID NO: 4567331 - DNA, 19 bp, Homo sapiens
gacagatcaggctagccct

SEQ ID NO: 4567332 - DNA, 15 bp, Homo sapiens
gacagatgagcagga

SEQ ID NO: 4567333 - DNA, 21 bp, Homo sapiens
gacagatgagcaggagcttgg

SEQ ID NO: 4567334 - DNA, 21 bp, Homo sapiens
gacagatgcctggtgagcagg

SEQ ID NO: 4567335 - DNA, 14 bp, Homo sapiens
gacagcagaagcct

SEQ ID NO: 4567336 - DNA, 17 bp, Homo sapiens
gacagcagaagcctcca

SEQ ID NO: 4567337 - DNA, 24 bp, Homo sapiens
gacagcagacaagagggcaagcct

SEQ ID NO: 4567338 - DNA, 12 bp, Homo sapiens
gacagcagcagc

SEQ ID NO: 4567339 - DNA, 12 bp, Homo sapiens
gacagcaggtgt

SEQ ID NO: 4567340 - DNA, 20 bp, Homo sapiens
gacagcatcccttcccacat

SEQ ID NO: 4567341 - DNA, 21 bp, Homo sapiens
gacagcatcccttcccacatg

SEQ ID NO: 4567342 - DNA, 19 bp, Homo sapiens
gacagccaggtggcacctg

SEQ ID NO: 4567343 - DNA, 21 bp, Homo sapiens
gacagccaggtggcacctgca

SEQ ID NO: 4567344 - DNA, 23 bp, Homo sapiens
gacagcctgtggcggtgcctggg

SEQ ID NO: 4567345 - DNA, 19 bp, Homo sapiens
gacagcctgtttctatcct

SEQ ID NO: 4567346 - DNA, 19 bp, Homo sapiens
gacagcgataagctttcaa

SEQ ID NO: 4567347 - DNA, 15 bp, Homo sapiens
gacagctccgggatc

SEQ ID NO: 4567348 - DNA, 14 bp, Homo sapiens
gacagctgtccctg

SEQ ID NO: 4567349 - DNA, 16 bp, Homo sapiens
gacagctgtgccggga

SEQ ID NO: 4567350 - DNA, 15 bp, Homo sapiens
gacagcttgagccgg

SEQ ID NO: 4567351 - DNA, 13 bp, Homo sapiens
gacagcttggaaa

SEQ ID NO: 4567352 - DNA, 18 bp, Homo sapiens
gacagcttgggaggaaac

SEQ ID NO: 4567353 - DNA, 18 bp, Homo sapiens
gacaggaaaatcctctgg

SEQ ID NO: 4567354 - DNA, 16 bp, Homo sapiens
gacaggaaagccctcc

SEQ ID NO: 4567355 - DNA, 13 bp, Homo sapiens
gacaggaacggct

SEQ ID NO: 4567356 - DNA, 18 bp, Homo sapiens
gacaggagaatcacctga

SEQ ID NO: 4567357 - DNA, 12 bp, Homo sapiens
gacaggagcact

SEQ ID NO: 4567358 - DNA, 13 bp, Homo sapiens
gacaggagcactg

SEQ ID NO: 4567359 - DNA, 12 bp, Homo sapiens
gacaggagcctg

SEQ ID NO: 4567360 - DNA, 16 bp, Homo sapiens
gacaggagcctggtcc

SEQ ID NO: 4567361 - DNA, 17 bp, Homo sapiens
gacaggagcctggtcct

SEQ ID NO: 4567362 - DNA, 16 bp, Homo sapiens
gacaggatgaggacag

SEQ ID NO: 4567363 - DNA, 22 bp, Homo sapiens
gacaggatgaggacagagggca

SEQ ID NO: 4567364 - DNA, 10 bp, Homo sapiens
gacaggcagc

SEQ ID NO: 4567365 - DNA, 23 bp, Homo sapiens
gacaggcagccacgtctcaacat

SEQ ID NO: 4567366 - DNA, 15 bp, Homo sapiens
gacaggcagcccagc

SEQ ID NO: 4567367 - DNA, 20 bp, Homo sapiens
gacaggcaggccagatggcc

SEQ ID NO: 4567368 - DNA, 21 bp, Homo sapiens
gacaggcaggccagatggccc

SEQ ID NO: 4567369 - DNA, 22 bp, Homo sapiens
gacaggcaggccagatggcccc

SEQ ID NO: 4567370 - DNA, 23 bp, Homo sapiens
gacaggcaggccagatggcccct

SEQ ID NO: 4567371 - DNA, 18 bp, Homo sapiens
gacaggcagggagggctt

SEQ ID NO: 4567372 - DNA, 13 bp, Homo sapiens
gacaggccctccc

SEQ ID NO: 4567373 - DNA, 15 bp, Homo sapiens
gacaggccctccctg

SEQ ID NO: 4567374 - DNA, 20 bp, Homo sapiens
gacaggccctccctgtctcc

SEQ ID NO: 4567375 - DNA, 19 bp, Homo sapiens
gacaggcctgaagatatta

SEQ ID NO: 4567376 - DNA, 15 bp, Homo sapiens
gacaggcgcctgcca

SEQ ID NO: 4567377 - DNA, 15 bp, Homo sapiens
gacaggcgggctcgg

SEQ ID NO: 4567378 - DNA, 22 bp, Homo sapiens
gacaggctctcctggctgtcct

SEQ ID NO: 4567379 - DNA, 22 bp, Homo sapiens
gacaggctggaagatagctgtg

SEQ ID NO: 4567380 - DNA, 19 bp, Homo sapiens
gacaggctgggtcctgcca

SEQ ID NO: 4567381 - DNA, 21 bp, Homo sapiens
gacaggctgggtcctgccagc

SEQ ID NO: 4567382 - DNA, 17 bp, Homo sapiens
gacagggagcagccccc

SEQ ID NO: 4567383 - DNA, 15 bp, Homo sapiens
gacagggcctggagc

SEQ ID NO: 4567384 - DNA, 16 bp, Homo sapiens
gacagggcctggagcc

SEQ ID NO: 4567385 - DNA, 17 bp, Homo sapiens
gacagggctggcccagc

SEQ ID NO: 4567386 - DNA, 21 bp, Homo sapiens
gacagggctggcccagccctg

SEQ ID NO: 4567387 - DNA, 17 bp, Homo sapiens
gacagggtgggagggag

SEQ ID NO: 4567388 - DNA, 22 bp, Homo sapiens
gacagggtgggagggaggaggg

SEQ ID NO: 4567389 - DNA, 14 bp, Homo sapiens
gacagggtgggctt

SEQ ID NO: 4567390 - DNA, 21 bp, Homo sapiens
gacagggtgggcttcctgccc

SEQ ID NO: 4567391 - DNA, 17 bp, Homo sapiens
gacaggtcttttcaaat

SEQ ID NO: 4567392 - DNA, 17 bp, Homo sapiens
gacaggtgacagtggct

SEQ ID NO: 4567393 - DNA, 17 bp, Homo sapiens
gacagtacctgattgta

SEQ ID NO: 4567394 - DNA, 20 bp, Homo sapiens
gacagtatggcagctttcct

SEQ ID NO: 4567395 - DNA, 15 bp, Homo sapiens
gacagtatttgtggg

SEQ ID NO: 4567396 - DNA, 18 bp, Homo sapiens
gacagtcataaatactgt

SEQ ID NO: 4567397 - DNA, 18 bp, Homo sapiens
gacagtccacaggggcca

SEQ ID NO: 4567398 - DNA, 17 bp, Homo sapiens
gacagtccattcatctt

SEQ ID NO: 4567399 - DNA, 15 bp, Homo sapiens
gacagtccctgctgg

SEQ ID NO: 4567400 - DNA, 18 bp, Homo sapiens
gacagtccctgctgggga

SEQ ID NO: 4567401 - DNA, 13 bp, Homo sapiens
gacagtctcactt

SEQ ID NO: 4567402 - DNA, 13 bp, Homo sapiens
gacagtggctgct

SEQ ID NO: 4567403 - DNA, 19 bp, Homo sapiens
gacagtggctgctctggga

SEQ ID NO: 4567404 - DNA, 21 bp, Homo sapiens
gacagtggctgctctgggaag

SEQ ID NO: 4567405 - DNA, 13 bp, Homo sapiens
gacagttctctgt

SEQ ID NO: 4567406 - DNA, 18 bp, Homo sapiens
gacagtttatcatgaagc

SEQ ID NO: 4567407 - DNA, 19 bp, Homo sapiens
gacagtttatcatgaagcc

SEQ ID NO: 4567408 - DNA, 23 bp, Homo sapiens
gacagtttatcatgaagcctgtg

SEQ ID NO: 4567409 - DNA, 20 bp, Homo sapiens
gacataaagttgataaagat

SEQ ID NO: 4567410 - DNA, 15 bp, Homo sapiens
gacataacagtgcag

SEQ ID NO: 4567411 - DNA, 20 bp, Homo sapiens
gacatacatattatctcatt

SEQ ID NO: 4567412 - DNA, 16 bp, Homo sapiens
gacatacgcttttaat

SEQ ID NO: 4567413 - DNA, 14 bp, Homo sapiens
gacatcaaaacttg

SEQ ID NO: 4567414 - DNA, 23 bp, Homo sapiens
gacatcaaagtggtaaatactgt

SEQ ID NO: 4567415 - DNA, 14 bp, Homo sapiens
gacatcaacagata

SEQ ID NO: 4567416 - DNA, 14 bp, Homo sapiens
gacatcagcaaaca

SEQ ID NO: 4567417 - DNA, 13 bp, Homo sapiens
gacatcattgtca

SEQ ID NO: 4567418 - DNA, 17 bp, Homo sapiens
gacatcattgtcagcct

SEQ ID NO: 4567419 - DNA, 19 bp, Homo sapiens
gacatcattgtcagccttg

SEQ ID NO: 4567420 - DNA, 22 bp, Homo sapiens
gacatcattgtcagccttgcta

SEQ ID NO: 4567421 - DNA, 20 bp, Homo sapiens
gacatccgtcccacatcagg

SEQ ID NO: 4567422 - DNA, 17 bp, Homo sapiens
gacatctgcctgtaatt

SEQ ID NO: 4567423 - DNA, 19 bp, Homo sapiens
gacatctttttaaagctta

SEQ ID NO: 4567424 - DNA, 13 bp, Homo sapiens
gacatgaagccac

SEQ ID NO: 4567425 - DNA, 22 bp, Homo sapiens
gacatgaagccacgggtgccag

SEQ ID NO: 4567426 - DNA, 22 bp, Homo sapiens
gacatgacgtggtaaaatgtga

SEQ ID NO: 4567427 - DNA, 24 bp, Homo sapiens
gacatgatttccttgaatgtggct

SEQ ID NO: 4567428 - DNA, 18 bp, Homo sapiens
gacatgcatgacacttcc

SEQ ID NO: 4567429 - DNA, 17 bp, Homo sapiens
gacatgcatttttaaaa

SEQ ID NO: 4567430 - DNA, 16 bp, Homo sapiens
gacatgccctgtgtgg

SEQ ID NO: 4567431 - DNA, 18 bp, Homo sapiens
gacatgcctatatgagaa

SEQ ID NO: 4567432 - DNA, 23 bp, Homo sapiens
gacatgctttccatttttttctt

SEQ ID NO: 4567433 - DNA, 14 bp, Homo sapiens
gacatggtgcctga

SEQ ID NO: 4567434 - DNA, 18 bp, Homo sapiens
gacatggtgcctgagagg

SEQ ID NO: 4567435 - DNA, 19 bp, Homo sapiens
gacatggtgcctgagaggc

SEQ ID NO: 4567436 - DNA, 22 bp, Homo sapiens
gacatggtgcctgagaggcagg

SEQ ID NO: 4567437 - DNA, 21 bp, Homo sapiens
gacatggttgggggaatgcac

SEQ ID NO: 4567438 - DNA, 15 bp, Homo sapiens
gacatgtctgttcta

SEQ ID NO: 4567439 - DNA, 13 bp, Homo sapiens
gacattagaaaaa

SEQ ID NO: 4567440 - DNA, 21 bp, Homo sapiens
gacattcaaaaaactctctcc

SEQ ID NO: 4567441 - DNA, 12 bp, Homo sapiens
gacattcactga

SEQ ID NO: 4567442 - DNA, 14 bp, Homo sapiens
gacattcactgagt

SEQ ID NO: 4567443 - DNA, 20 bp, Homo sapiens
gacattctcgcttccctgaa

SEQ ID NO: 4567444 - DNA, 23 bp, Homo sapiens
gacattcttagctgtaacttaac

SEQ ID NO: 4567445 - DNA, 12 bp, Homo sapiens
gacattctttta

SEQ ID NO: 4567446 - DNA, 18 bp, Homo sapiens
gacattgccaaaaaggat

SEQ ID NO: 4567447 - DNA, 19 bp, Homo sapiens
gacattgctctatgtctgc

SEQ ID NO: 4567448 - DNA, 13 bp, Homo sapiens
gacattggagatg

SEQ ID NO: 4567449 - DNA, 15 bp, Homo sapiens
gacatttatctttgt

SEQ ID NO: 4567450 - DNA, 21 bp, Homo sapiens
gacatttctctaactcctgcc

SEQ ID NO: 4567451 - DNA, 22 bp, Homo sapiens
gacatttctctaactcctgcca

SEQ ID NO: 4567452 - DNA, 15 bp, Homo sapiens
gacatttctttctgt

SEQ ID NO: 4567453 - DNA, 22 bp, Homo sapiens
gacatttgctgaactcagcaca

SEQ ID NO: 4567454 - DNA, 13 bp, Homo sapiens
gacatttttcatt

SEQ ID NO: 4567455 - DNA, 18 bp, Homo sapiens
gaccaaatctcagttgtt

SEQ ID NO: 4567456 - DNA, 16 bp, Homo sapiens
gaccaaattgcttcta

SEQ ID NO: 4567457 - DNA, 21 bp, Homo sapiens
gaccaacaaagtcacagtcgt

SEQ ID NO: 4567458 - DNA, 18 bp, Homo sapiens
gaccaacctgctctgtcc

SEQ ID NO: 4567459 - DNA, 14 bp, Homo sapiens
gaccaactgggccc

SEQ ID NO: 4567460 - DNA, 18 bp, Homo sapiens
gaccaataaacagctccc

SEQ ID NO: 4567461 - DNA, 16 bp, Homo sapiens
gaccaattattgatat

SEQ ID NO: 4567462 - DNA, 20 bp, Homo sapiens
gaccaattattgatatatat

SEQ ID NO: 4567463 - DNA, 14 bp, Homo sapiens
gaccacaacatgag

SEQ ID NO: 4567464 - DNA, 17 bp, Homo sapiens
gaccaccccacagagga

SEQ ID NO: 4567465 - DNA, 19 bp, Homo sapiens
gaccacccctgcctccacc

SEQ ID NO: 4567466 - DNA, 15 bp, Homo sapiens
gaccaccctgagccg

SEQ ID NO: 4567467 - DNA, 16 bp, Homo sapiens
gaccactcgaggcctg

SEQ ID NO: 4567468 - DNA, 17 bp, Homo sapiens
gaccactcgaggcctgc

SEQ ID NO: 4567469 - DNA, 18 bp, Homo sapiens
gaccactcgaggcctgca

SEQ ID NO: 4567470 - DNA, 15 bp, Homo sapiens
gaccactcttcttta

SEQ ID NO: 4567471 - DNA, 17 bp, Homo sapiens
gaccactgggtgagaga

SEQ ID NO: 4567472 - DNA, 22 bp, Homo sapiens
gaccagaaacagggacaaagaa

SEQ ID NO: 4567473 - DNA, 15 bp, Homo sapiens
gaccagagctgtctg

SEQ ID NO: 4567474 - DNA, 13 bp, Homo sapiens
gaccagcccattg

SEQ ID NO: 4567475 - DNA, 14 bp, Homo sapiens
gaccagcctctcca

SEQ ID NO: 4567476 - DNA, 18 bp, Homo sapiens
gaccagcctgtccaacat

SEQ ID NO: 4567477 - DNA, 13 bp, Homo sapiens
gaccagctgctcc

SEQ ID NO: 4567478 - DNA, 15 bp, Homo sapiens
gaccagctgctccga

SEQ ID NO: 4567479 - DNA, 19 bp, Homo sapiens
gaccagctgctccgaggac

SEQ ID NO: 4567480 - DNA, 21 bp, Homo sapiens
gaccagctgctccgaggaccc

SEQ ID NO: 4567481 - DNA, 17 bp, Homo sapiens
gaccaggactccctcct

SEQ ID NO: 4567482 - DNA, 19 bp, Homo sapiens
gaccaggactccctcctca

SEQ ID NO: 4567483 - DNA, 20 bp, Homo sapiens
gaccaggagaaatcaacagg

SEQ ID NO: 4567484 - DNA, 20 bp, Homo sapiens
gaccagggatgctgggctgg

SEQ ID NO: 4567485 - DNA, 22 bp, Homo sapiens
gaccagggtggccacacaggca

SEQ ID NO: 4567486 - DNA, 18 bp, Homo sapiens
gaccaggtctacagtgat

SEQ ID NO: 4567487 - DNA, 12 bp, Homo sapiens
gaccagtgcctg

SEQ ID NO: 4567488 - DNA, 14 bp, Homo sapiens
gaccagtttcttaa

SEQ ID NO: 4567489 - DNA, 13 bp, Homo sapiens
gaccatactcaga

SEQ ID NO: 4567490 - DNA, 19 bp, Homo sapiens
gaccatatagattttatta

SEQ ID NO: 4567491 - DNA, 17 bp, Homo sapiens
gaccatattacctggat

SEQ ID NO: 4567492 - DNA, 19 bp, Homo sapiens
gaccatccactctaccctc

SEQ ID NO: 4567493 - DNA, 21 bp, Homo sapiens
gaccatccactctaccctccc

SEQ ID NO: 4567494 - DNA, 18 bp, Homo sapiens
gaccatcgtccttcctct

SEQ ID NO: 4567495 - DNA, 14 bp, Homo sapiens
gaccatgccagatt

SEQ ID NO: 4567496 - DNA, 22 bp, Homo sapiens
gaccatgccagattctgcctct

SEQ ID NO: 4567497 - DNA, 23 bp, Homo sapiens
gaccatgccagattctgcctctc

SEQ ID NO: 4567498 - DNA, 18 bp, Homo sapiens
gaccatgcgtcaggggcc

SEQ ID NO: 4567499 - DNA, 17 bp, Homo sapiens
gaccatgttatattgct

SEQ ID NO: 4567500 - DNA, 15 bp, Homo sapiens
gaccatgttgcactg

SEQ ID NO: 4567501 - DNA, 19 bp, Homo sapiens
gacccaaaaatgttccctt

SEQ ID NO: 4567502 - DNA, 16 bp, Homo sapiens
gacccaaaaggcagaa

SEQ ID NO: 4567503 - DNA, 19 bp, Homo sapiens
gacccaaaaggcagaagca

SEQ ID NO: 4567504 - DNA, 19 bp, Homo sapiens
gacccaagagaactttctt

SEQ ID NO: 4567505 - DNA, 22 bp, Homo sapiens
gacccacaagaaatgaaagcag

SEQ ID NO: 4567506 - DNA, 16 bp, Homo sapiens
gacccaccccaactct

SEQ ID NO: 4567507 - DNA, 20 bp, Homo sapiens
gacccaccccaactctcccc

SEQ ID NO: 4567508 - DNA, 21 bp, Homo sapiens
gacccaccccaactctcccca

SEQ ID NO: 4567509 - DNA, 17 bp, Homo sapiens
gacccagaatggagcct

SEQ ID NO: 4567510 - DNA, 19 bp, Homo sapiens
gacccagaatggagcctgc

SEQ ID NO: 4567511 - DNA, 10 bp, Homo sapiens
gacccagacc

SEQ ID NO: 4567512 - DNA, 14 bp, Homo sapiens
gacccagacccagt

SEQ ID NO: 4567513 - DNA, 20 bp, Homo sapiens
gacccagaggggacgctgag

SEQ ID NO: 4567514 - DNA, 13 bp, Homo sapiens
gacccagaggtcc

SEQ ID NO: 4567515 - DNA, 13 bp, Homo sapiens
gacccagagtgga

SEQ ID NO: 4567516 - DNA, 17 bp, Homo sapiens
gacccagccctcatccc

SEQ ID NO: 4567517 - DNA, 16 bp, Homo sapiens
gacccaggagtccagc

SEQ ID NO: 4567518 - DNA, 15 bp, Homo sapiens
gacccaggcgctgca

SEQ ID NO: 4567519 - DNA, 17 bp, Homo sapiens
gacccagggcctgactt

SEQ ID NO: 4567520 - DNA, 23 bp, Homo sapiens
gacccagggcctgacttgagcca

SEQ ID NO: 4567521 - DNA, 14 bp, Homo sapiens
gacccagtccctgg

SEQ ID NO: 4567522 - DNA, 14 bp, Homo sapiens
gacccagtggtcag

SEQ ID NO: 4567523 - DNA, 22 bp, Homo sapiens
gaccccactccggccctccaga

SEQ ID NO: 4567524 - DNA, 11 bp, Homo sapiens
gaccccagcat

SEQ ID NO: 4567525 - DNA, 18 bp, Homo sapiens
gaccccagcggctgagtc

SEQ ID NO: 4567526 - DNA, 20 bp, Homo sapiens
gaccccagtcgtgatgtgga

SEQ ID NO: 4567527 - DNA, 18 bp, Homo sapiens
gacccccactctcattcc

SEQ ID NO: 4567528 - DNA, 14 bp, Homo sapiens
gacccccaggcctg

SEQ ID NO: 4567529 - DNA, 22 bp, Homo sapiens
gaccccccagcccctcctccct

SEQ ID NO: 4567530 - DNA, 23 bp, Homo sapiens
gaccccccagcccctcctccctc

SEQ ID NO: 4567531 - DNA, 21 bp, Homo sapiens
gacccccgaggggagggcagg

SEQ ID NO: 4567532 - DNA, 21 bp, Homo sapiens
gacccctcagccccagcccag

SEQ ID NO: 4567533 - DNA, 21 bp, Homo sapiens
gacccctcctgcccctctctc

SEQ ID NO: 4567534 - DNA, 17 bp, Homo sapiens
gacccctcgccccagcc

SEQ ID NO: 4567535 - DNA, 13 bp, Homo sapiens
gacccctgcctgg

SEQ ID NO: 4567536 - DNA, 23 bp, Homo sapiens
gacccctgctcagtaaagcactt

SEQ ID NO: 4567537 - DNA, 18 bp, Homo sapiens
gaccctatgggtctagga

SEQ ID NO: 4567538 - DNA, 12 bp, Homo sapiens
gaccctcagcag

SEQ ID NO: 4567539 - DNA, 17 bp, Homo sapiens
gaccctcagcagctctg

SEQ ID NO: 4567540 - DNA, 23 bp, Homo sapiens
gaccctcagcagctctggctctg

SEQ ID NO: 4567541 - DNA, 19 bp, Homo sapiens
gaccctcatctttcttcca

SEQ ID NO: 4567542 - DNA, 20 bp, Homo sapiens
gaccctcctgttgcacccag

SEQ ID NO: 4567543 - DNA, 23 bp, Homo sapiens
gaccctcctgttgcacccagccc

SEQ ID NO: 4567544 - DNA, 20 bp, Homo sapiens
gaccctcttgcccatcctga

SEQ ID NO: 4567545 - DNA, 22 bp, Homo sapiens
gaccctcttgcccatcctgact

SEQ ID NO: 4567546 - DNA, 19 bp, Homo sapiens
gaccctgaggccctgggct

SEQ ID NO: 4567547 - DNA, 20 bp, Homo sapiens
gaccctgaggccctgggctg

SEQ ID NO: 4567548 - DNA, 20 bp, Homo sapiens
gaccctgagtccgggaggca

SEQ ID NO: 4567549 - DNA, 13 bp, Homo sapiens
gaccctgccacag

SEQ ID NO: 4567550 - DNA, 15 bp, Homo sapiens
gaccctgccacagcc

SEQ ID NO: 4567551 - DNA, 18 bp, Homo sapiens
gaccctgccacagccaga

SEQ ID NO: 4567552 - DNA, 13 bp, Homo sapiens
gaccctgcccaga

SEQ ID NO: 4567553 - DNA, 16 bp, Homo sapiens
gaccctgcccagagct

SEQ ID NO: 4567554 - DNA, 21 bp, Homo sapiens
gaccctgctcctagcaccctg

SEQ ID NO: 4567555 - DNA, 13 bp, Homo sapiens
gaccctgggcagt

SEQ ID NO: 4567556 - DNA, 10 bp, Homo sapiens
gaccctgggg

SEQ ID NO: 4567557 - DNA, 11 bp, Homo sapiens
gaccctggggc

SEQ ID NO: 4567558 - DNA, 18 bp, Homo sapiens
gaccctggggcgtgcagc

SEQ ID NO: 4567559 - DNA, 23 bp, Homo sapiens
gaccctggggcgtgcagcaggga

SEQ ID NO: 4567560 - DNA, 18 bp, Homo sapiens
gaccctgggtgggctctg

SEQ ID NO: 4567561 - DNA, 21 bp, Homo sapiens
gaccctgggtgggctctgtgc

SEQ ID NO: 4567562 - DNA, 20 bp, Homo sapiens
gaccctgtgacatggtgcct

SEQ ID NO: 4567563 - DNA, 23 bp, Homo sapiens
gacccttaggatggggctcccag

SEQ ID NO: 4567564 - DNA, 20 bp, Homo sapiens
gacccttattgctgtcctgg

SEQ ID NO: 4567565 - DNA, 21 bp, Homo sapiens
gaccctttccttccttccctg

SEQ ID NO: 4567566 - DNA, 22 bp, Homo sapiens
gaccctttccttccttccctgg

SEQ ID NO: 4567567 - DNA, 23 bp, Homo sapiens
gaccctttccttccttccctggc

SEQ ID NO: 4567568 - DNA, 16 bp, Homo sapiens
gaccgaaatctgtatt

SEQ ID NO: 4567569 - DNA, 19 bp, Homo sapiens
gaccgaggctacagctcca

SEQ ID NO: 4567570 - DNA, 17 bp, Homo sapiens
gaccgggctctgacagc

SEQ ID NO: 4567571 - DNA, 14 bp, Homo sapiens
gaccgttaaaaaat

SEQ ID NO: 4567572 - DNA, 17 bp, Homo sapiens
gaccgttttgtattgct

SEQ ID NO: 4567573 - DNA, 18 bp, Homo sapiens
gaccgttttgtattgctt

SEQ ID NO: 4567574 - DNA, 16 bp, Homo sapiens
gacctaccaggacaga

SEQ ID NO: 4567575 - DNA, 18 bp, Homo sapiens
gacctaccaggacagaac

SEQ ID NO: 4567576 - DNA, 21 bp, Homo sapiens
gacctactaggagaggggggc

SEQ ID NO: 4567577 - DNA, 15 bp, Homo sapiens
gacctagcaggctgt

SEQ ID NO: 4567578 - DNA, 16 bp, Homo sapiens
gacctagcaggctgtt

SEQ ID NO: 4567579 - DNA, 16 bp, Homo sapiens
gacctaggggtttctg

SEQ ID NO: 4567580 - DNA, 18 bp, Homo sapiens
gacctaggggtttctgtt

SEQ ID NO: 4567581 - DNA, 13 bp, Homo sapiens
gacctcaagccat

SEQ ID NO: 4567582 - DNA, 15 bp, Homo sapiens
gacctcagcaagctg

SEQ ID NO: 4567583 - DNA, 16 bp, Homo sapiens
gacctcagcagggcat

SEQ ID NO: 4567584 - DNA, 11 bp, Homo sapiens
gacctcagcca

SEQ ID NO: 4567585 - DNA, 18 bp, Homo sapiens
gacctcagtgactcagaa

SEQ ID NO: 4567586 - DNA, 17 bp, Homo sapiens
gacctccatactgggct

SEQ ID NO: 4567587 - DNA, 13 bp, Homo sapiens
gacctccccaccc

SEQ ID NO: 4567588 - DNA, 19 bp, Homo sapiens
gacctccccacccgctccc

SEQ ID NO: 4567589 - DNA, 18 bp, Homo sapiens
gacctccgcccctgcccc

SEQ ID NO: 4567590 - DNA, 21 bp, Homo sapiens
gacctccgcccctgcccccgc

SEQ ID NO: 4567591 - DNA, 19 bp, Homo sapiens
gacctcctctgggccctgt

SEQ ID NO: 4567592 - DNA, 18 bp, Homo sapiens
gacctcggacagagcccc

SEQ ID NO: 4567593 - DNA, 22 bp, Homo sapiens
gacctcggatgaccatactcag

SEQ ID NO: 4567594 - DNA, 18 bp, Homo sapiens
gacctcgtcctccccctg

SEQ ID NO: 4567595 - DNA, 22 bp, Homo sapiens
gacctcgtcctccccctgccag

SEQ ID NO: 4567596 - DNA, 17 bp, Homo sapiens
gacctctacttgctgaa

SEQ ID NO: 4567597 - DNA, 13 bp, Homo sapiens
gacctcttgcctc

SEQ ID NO: 4567598 - DNA, 14 bp, Homo sapiens
gacctgacagcttg

SEQ ID NO: 4567599 - DNA, 12 bp, Homo sapiens
gacctgcatatt

SEQ ID NO: 4567600 - DNA, 16 bp, Homo sapiens
gacctgcatatttagc

SEQ ID NO: 4567601 - DNA, 19 bp, Homo sapiens
gacctgcatatttagctgt

SEQ ID NO: 4567602 - DNA, 22 bp, Homo sapiens
gacctgccagccactgtcaccg

SEQ ID NO: 4567603 - DNA, 16 bp, Homo sapiens
gacctgccaggcaggg

SEQ ID NO: 4567604 - DNA, 17 bp, Homo sapiens
gacctgccaggcagggg

SEQ ID NO: 4567605 - DNA, 18 bp, Homo sapiens
gacctgccaggcaggggt

SEQ ID NO: 4567606 - DNA, 19 bp, Homo sapiens
gacctgccaggcaggggtg

SEQ ID NO: 4567607 - DNA, 15 bp, Homo sapiens
gacctggttcccact

SEQ ID NO: 4567608 - DNA, 18 bp, Homo sapiens
gacctggttcccactgag

SEQ ID NO: 4567609 - DNA, 16 bp, Homo sapiens
gacctgtatttaagca

SEQ ID NO: 4567610 - DNA, 22 bp, Homo sapiens
gacctgtatttaagcaaatact

SEQ ID NO: 4567611 - DNA, 14 bp, Homo sapiens
gacctgtcctcctg

SEQ ID NO: 4567612 - DNA, 16 bp, Homo sapiens
gacctgtcctcctggt

SEQ ID NO: 4567613 - DNA, 19 bp, Homo sapiens
gacctgtggccaagttctt

SEQ ID NO: 4567614 - DNA, 15 bp, Homo sapiens
gaccttagcgttctg

SEQ ID NO: 4567615 - DNA, 17 bp, Homo sapiens
gaccttagcgttctgga

SEQ ID NO: 4567616 - DNA, 16 bp, Homo sapiens
gaccttccctccgcct

SEQ ID NO: 4567617 - DNA, 22 bp, Homo sapiens
gaccttgcaacctcaccttcct

SEQ ID NO: 4567618 - DNA, 21 bp, Homo sapiens
gacctttaggtcaaactccct

SEQ ID NO: 4567619 - DNA, 12 bp, Homo sapiens
gacctttatcca

SEQ ID NO: 4567620 - DNA, 21 bp, Homo sapiens
gacctttatttattaaacttc

SEQ ID NO: 4567621 - DNA, 23 bp, Homo sapiens
gacctttatttattaaacttcag

SEQ ID NO: 4567622 - DNA, 17 bp, Homo sapiens
gacctttcctgaggaag

SEQ ID NO: 4567623 - DNA, 18 bp, Homo sapiens
gaccttttttttttttcc

SEQ ID NO: 4567624 - DNA, 16 bp, Homo sapiens
gacgaaaaagaggcat

SEQ ID NO: 4567625 - DNA, 19 bp, Homo sapiens
gacgcaaggtgtgctctga

SEQ ID NO: 4567626 - DNA, 17 bp, Homo sapiens
gacgccaaggaggtggg

SEQ ID NO: 4567627 - DNA, 16 bp, Homo sapiens
gacgccactcatttca

SEQ ID NO: 4567628 - DNA, 19 bp, Homo sapiens
gacgccactcatttcatct

SEQ ID NO: 4567629 - DNA, 17 bp, Homo sapiens
gacgcctgcaggagaga

SEQ ID NO: 4567630 - DNA, 19 bp, Homo sapiens
gacgcctgggggtgccagg

SEQ ID NO: 4567631 - DNA, 17 bp, Homo sapiens
gacgctaataaaaattt

SEQ ID NO: 4567632 - DNA, 13 bp, Homo sapiens
gacgctcagcccc

SEQ ID NO: 4567633 - DNA, 16 bp, Homo sapiens
gacgctcagccccagg

SEQ ID NO: 4567634 - DNA, 19 bp, Homo sapiens
gacgctcagccccaggcca

SEQ ID NO: 4567635 - DNA, 23 bp, Homo sapiens
gacgctcagccccaggccagctg

SEQ ID NO: 4567636 - DNA, 18 bp, Homo sapiens
gacgctgccgctgccgct

SEQ ID NO: 4567637 - DNA, 21 bp, Homo sapiens
gacggatgcccattcctgcct

SEQ ID NO: 4567638 - DNA, 20 bp, Homo sapiens
gacggattccttggcagccg

SEQ ID NO: 4567639 - DNA, 23 bp, Homo sapiens
gacggcaacctgcggaaggaggt

SEQ ID NO: 4567640 - DNA, 20 bp, Homo sapiens
gacggcaggctcactgccag

SEQ ID NO: 4567641 - DNA, 15 bp, Homo sapiens
gacggcctgatgctc

SEQ ID NO: 4567642 - DNA, 13 bp, Homo sapiens
gacggctgagcat

SEQ ID NO: 4567643 - DNA, 12 bp, Homo sapiens
gacgggaccctg

SEQ ID NO: 4567644 - DNA, 17 bp, Homo sapiens
gacggggcctcactatg

SEQ ID NO: 4567645 - DNA, 22 bp, Homo sapiens
gacggggggccccagtcagcct

SEQ ID NO: 4567646 - DNA, 23 bp, Homo sapiens
gacggggggccccagtcagcctc

SEQ ID NO: 4567647 - DNA, 15 bp, Homo sapiens
gacggtctgtgtgct

SEQ ID NO: 4567648 - DNA, 23 bp, Homo sapiens
gacggtgttttgccatgttggcc

SEQ ID NO: 4567649 - DNA, 20 bp, Homo sapiens
gacgtcactttttggccatg

SEQ ID NO: 4567650 - DNA, 23 bp, Homo sapiens
gacgtcatcggaggctgggcccc

SEQ ID NO: 4567651 - DNA, 17 bp, Homo sapiens
gacgtctggggtgtggg

SEQ ID NO: 4567652 - DNA, 13 bp, Homo sapiens
gacgtgaaagcca

SEQ ID NO: 4567653 - DNA, 19 bp, Homo sapiens
gacgtgaatgtctcagcga

SEQ ID NO: 4567654 - DNA, 16 bp, Homo sapiens
gacgtgattttgctgt

SEQ ID NO: 4567655 - DNA, 15 bp, Homo sapiens
gacgttccagccggc

SEQ ID NO: 4567656 - DNA, 18 bp, Homo sapiens
gacgttgctgagccagct

SEQ ID NO: 4567657 - DNA, 17 bp, Homo sapiens
gacgtttttgtgctgtg

SEQ ID NO: 4567658 - DNA, 19 bp, Homo sapiens
gacgtttttgtgctgtggg

SEQ ID NO: 4567659 - DNA, 23 bp, Homo sapiens
gactaaaagggcttcggccacag

SEQ ID NO: 4567660 - DNA, 20 bp, Homo sapiens
gactaaactttttttctgta

SEQ ID NO: 4567661 - DNA, 23 bp, Homo sapiens
gactaaaggatccagagagcagc

SEQ ID NO: 4567662 - DNA, 18 bp, Homo sapiens
gactaaatgatctctgaa

SEQ ID NO: 4567663 - DNA, 14 bp, Homo sapiens
gactaaattcgtga

SEQ ID NO: 4567664 - DNA, 16 bp, Homo sapiens
gactaagagaagttgt

SEQ ID NO: 4567665 - DNA, 18 bp, Homo sapiens
gactaagcctacctgctc

SEQ ID NO: 4567666 - DNA, 21 bp, Homo sapiens
gactaagcctacctgctctcc

SEQ ID NO: 4567667 - DNA, 13 bp, Homo sapiens
gactaatttcaaa

SEQ ID NO: 4567668 - DNA, 12 bp, Homo sapiens
gactacaataaa

SEQ ID NO: 4567669 - DNA, 18 bp, Homo sapiens
gactacagtcaggaaagg

SEQ ID NO: 4567670 - DNA, 19 bp, Homo sapiens
gactacttggaactaggct

SEQ ID NO: 4567671 - DNA, 15 bp, Homo sapiens
gactagaacctggag

SEQ ID NO: 4567672 - DNA, 12 bp, Homo sapiens
gactagagaaac

SEQ ID NO: 4567673 - DNA, 14 bp, Homo sapiens
gactagatgatgga

SEQ ID NO: 4567674 - DNA, 21 bp, Homo sapiens
gactagatgatggatgccaat

SEQ ID NO: 4567675 - DNA, 18 bp, Homo sapiens
gactagatgtagtatttt

SEQ ID NO: 4567676 - DNA, 17 bp, Homo sapiens
gactagggattcaggct

SEQ ID NO: 4567677 - DNA, 13 bp, Homo sapiens
gactatcaggtaa

SEQ ID NO: 4567678 - DNA, 17 bp, Homo sapiens
gactatcttactatttc

SEQ ID NO: 4567679 - DNA, 15 bp, Homo sapiens
gactattatgtggaa

SEQ ID NO: 4567680 - DNA, 16 bp, Homo sapiens
gactattcaaacagtc

SEQ ID NO: 4567681 - DNA, 20 bp, Homo sapiens
gactattgtgccaactgcca

SEQ ID NO: 4567682 - DNA, 19 bp, Homo sapiens
gactatttgacccccacaa

SEQ ID NO: 4567683 - DNA, 23 bp, Homo sapiens
gactcaagaggaatctgtttctc

SEQ ID NO: 4567684 - DNA, 12 bp, Homo sapiens
gactcacccaag

SEQ ID NO: 4567685 - DNA, 19 bp, Homo sapiens
gactcacttcaatgtgtca

SEQ ID NO: 4567686 - DNA, 22 bp, Homo sapiens
gactcagatttatttactcttg

SEQ ID NO: 4567687 - DNA, 15 bp, Homo sapiens
gactcagccctgagg

SEQ ID NO: 4567688 - DNA, 18 bp, Homo sapiens
gactcagcctctgctgga

SEQ ID NO: 4567689 - DNA, 20 bp, Homo sapiens
gactcaggagtctgccactt

SEQ ID NO: 4567690 - DNA, 15 bp, Homo sapiens
gactcaggttccaga

SEQ ID NO: 4567691 - DNA, 20 bp, Homo sapiens
gactcaggttccagaacagc

SEQ ID NO: 4567692 - DNA, 15 bp, Homo sapiens
gactcagtgaccagt

SEQ ID NO: 4567693 - DNA, 18 bp, Homo sapiens
gactcatggtgtgttaca

SEQ ID NO: 4567694 - DNA, 16 bp, Homo sapiens
gactccaaagaaatgt

SEQ ID NO: 4567695 - DNA, 18 bp, Homo sapiens
gactccaaagaaatgtaa

SEQ ID NO: 4567696 - DNA, 12 bp, Homo sapiens
gactccagccag

SEQ ID NO: 4567697 - DNA, 19 bp, Homo sapiens
gactccagccagcgcctcc

SEQ ID NO: 4567698 - DNA, 23 bp, Homo sapiens
gactccagccagcgcctccctcc

SEQ ID NO: 4567699 - DNA, 18 bp, Homo sapiens
gactccaggcccaaggct

SEQ ID NO: 4567700 - DNA, 19 bp, Homo sapiens
gactccaggcccaaggctc

SEQ ID NO: 4567701 - DNA, 16 bp, Homo sapiens
gactccatctcttctg

SEQ ID NO: 4567702 - DNA, 13 bp, Homo sapiens
gactcccatgaag

SEQ ID NO: 4567703 - DNA, 14 bp, Homo sapiens
gactcccatgaagc

SEQ ID NO: 4567704 - DNA, 16 bp, Homo sapiens
gactccggaggactga

SEQ ID NO: 4567705 - DNA, 18 bp, Homo sapiens
gactccggaggactgagc

SEQ ID NO: 4567706 - DNA, 20 bp, Homo sapiens
gactccggaggactgagccc

SEQ ID NO: 4567707 - DNA, 15 bp, Homo sapiens
gactccgtcaagctg

SEQ ID NO: 4567708 - DNA, 20 bp, Homo sapiens
gactcctctggctttcccag

SEQ ID NO: 4567709 - DNA, 13 bp, Homo sapiens
gactcctggactc

SEQ ID NO: 4567710 - DNA, 20 bp, Homo sapiens
gactcctggactccggagga

SEQ ID NO: 4567711 - DNA, 14 bp, Homo sapiens
gactcctggtctgt

SEQ ID NO: 4567712 - DNA, 17 bp, Homo sapiens
gactcctggtctgtgaa

SEQ ID NO: 4567713 - DNA, 19 bp, Homo sapiens
gactcgagaactttcattt

SEQ ID NO: 4567714 - DNA, 15 bp, Homo sapiens
gactcgggggctggt

SEQ ID NO: 4567715 - DNA, 23 bp, Homo sapiens
gactctaagatacactgcacttt

SEQ ID NO: 4567716 - DNA, 21 bp, Homo sapiens
gactctacctgcaagatttca

SEQ ID NO: 4567717 - DNA, 14 bp, Homo sapiens
gactctagtattta

SEQ ID NO: 4567718 - DNA, 17 bp, Homo sapiens
gactctcagcccagaag

SEQ ID NO: 4567719 - DNA, 12 bp, Homo sapiens
gactctcaggga

SEQ ID NO: 4567720 - DNA, 14 bp, Homo sapiens
gactctcagtctct

SEQ ID NO: 4567721 - DNA, 20 bp, Homo sapiens
gactctcagtctctgagcag

SEQ ID NO: 4567722 - DNA, 16 bp, Homo sapiens
gactctcctcctcccc

SEQ ID NO: 4567723 - DNA, 19 bp, Homo sapiens
gactctgaaatatcccggg

SEQ ID NO: 4567724 - DNA, 17 bp, Homo sapiens
gactctgaagcctctgg

SEQ ID NO: 4567725 - DNA, 18 bp, Homo sapiens
gactctgaagcctctggg

SEQ ID NO: 4567726 - DNA, 20 bp, Homo sapiens
gactctgattctacagtgat

SEQ ID NO: 4567727 - DNA, 14 bp, Homo sapiens
gactctgccccctg

SEQ ID NO: 4567728 - DNA, 18 bp, Homo sapiens
gactctgccccctgctgg

SEQ ID NO: 4567729 - DNA, 21 bp, Homo sapiens
gactctgcgggaggctggggc

SEQ ID NO: 4567730 - DNA, 19 bp, Homo sapiens
gactctgctgctcatggga

SEQ ID NO: 4567731 - DNA, 16 bp, Homo sapiens
gactctggggtgcagc

SEQ ID NO: 4567732 - DNA, 17 bp, Homo sapiens
gactctggggtgcagct

SEQ ID NO: 4567733 - DNA, 13 bp, Homo sapiens
gactctgttattg

SEQ ID NO: 4567734 - DNA, 21 bp, Homo sapiens
gactctttattgtctgtaaat

SEQ ID NO: 4567735 - DNA, 19 bp, Homo sapiens
gactctttctgaaggaaga

SEQ ID NO: 4567736 - DNA, 22 bp, Homo sapiens
gactctttctgaaggaagagaa

SEQ ID NO: 4567737 - DNA, 23 bp, Homo sapiens
gactctttctgaaggaagagaag

SEQ ID NO: 4567738 - DNA, 19 bp, Homo sapiens
gactgaaaatattgtttta

SEQ ID NO: 4567739 - DNA, 22 bp, Homo sapiens
gactgaccaatattgtacagtt

SEQ ID NO: 4567740 - DNA, 16 bp, Homo sapiens
gactgagactggcact

SEQ ID NO: 4567741 - DNA, 12 bp, Homo sapiens
gactgagcagcc

SEQ ID NO: 4567742 - DNA, 20 bp, Homo sapiens
gactgagcagccgccagctg

SEQ ID NO: 4567743 - DNA, 17 bp, Homo sapiens
gactgagccaaggaggc

SEQ ID NO: 4567744 - DNA, 20 bp, Homo sapiens
gactgagccaaggaggcctg

SEQ ID NO: 4567745 - DNA, 11 bp, Homo sapiens
gactgagcccc

SEQ ID NO: 4567746 - DNA, 16 bp, Homo sapiens
gactgagcccccaccg

SEQ ID NO: 4567747 - DNA, 17 bp, Homo sapiens
gactgagcccccaccgg

SEQ ID NO: 4567748 - DNA, 23 bp, Homo sapiens
gactgagcccccaccggaactgg

SEQ ID NO: 4567749 - DNA, 13 bp, Homo sapiens
gactgaggcctga

SEQ ID NO: 4567750 - DNA, 12 bp, Homo sapiens
gactgatgagca

SEQ ID NO: 4567751 - DNA, 23 bp, Homo sapiens
gactgatgttcatgatagaaaga

SEQ ID NO: 4567752 - DNA, 21 bp, Homo sapiens
gactgcacagcgtcctgtcca

SEQ ID NO: 4567753 - DNA, 19 bp, Homo sapiens
gactgcatggtaatttata

SEQ ID NO: 4567754 - DNA, 14 bp, Homo sapiens
gactgcattgccgc

SEQ ID NO: 4567755 - DNA, 23 bp, Homo sapiens
gactgcccagaaagtgggggtgg

SEQ ID NO: 4567756 - DNA, 22 bp, Homo sapiens
gactgccccacggagacagagg

SEQ ID NO: 4567757 - DNA, 22 bp, Homo sapiens
gactgcccctgctgtgctgctc

SEQ ID NO: 4567758 - DNA, 23 bp, Homo sapiens
gactgcccctgctgtgctgctca

SEQ ID NO: 4567759 - DNA, 15 bp, Homo sapiens
gactgcgggagccag

SEQ ID NO: 4567760 - DNA, 16 bp, Homo sapiens
gactgcgggagccaga

SEQ ID NO: 4567761 - DNA, 15 bp, Homo sapiens
gactgcgttctgcaa

SEQ ID NO: 4567762 - DNA, 17 bp, Homo sapiens
gactgctaaataaaatt

SEQ ID NO: 4567763 - DNA, 16 bp, Homo sapiens
gactgctacctctgag

SEQ ID NO: 4567764 - DNA, 21 bp, Homo sapiens
gactgctacctctgagaagac

SEQ ID NO: 4567765 - DNA, 23 bp, Homo sapiens
gactgctcccggcccgcctgccc

SEQ ID NO: 4567766 - DNA, 13 bp, Homo sapiens
gactgctgctctc

SEQ ID NO: 4567767 - DNA, 14 bp, Homo sapiens
gactgctgctctcc

SEQ ID NO: 4567768 - DNA, 16 bp, Homo sapiens
gactgctgctctccca

SEQ ID NO: 4567769 - DNA, 22 bp, Homo sapiens
gactggaaaagtgatgtatttt

SEQ ID NO: 4567770 - DNA, 21 bp, Homo sapiens
gactggaagctaatttgcatt

SEQ ID NO: 4567771 - DNA, 19 bp, Homo sapiens
gactggaaggtccttgcct

SEQ ID NO: 4567772 - DNA, 22 bp, Homo sapiens
gactggcacagttttctgagaa

SEQ ID NO: 4567773 - DNA, 14 bp, Homo sapiens
gactggcccctggg

SEQ ID NO: 4567774 - DNA, 17 bp, Homo sapiens
gactggctagagtcctc

SEQ ID NO: 4567775 - DNA, 21 bp, Homo sapiens
gactggctagagtcctcactc

SEQ ID NO: 4567776 - DNA, 21 bp, Homo sapiens
gactgggagccacttctcccc

SEQ ID NO: 4567777 - DNA, 19 bp, Homo sapiens
gactggtgtcataaacttt

SEQ ID NO: 4567778 - DNA, 22 bp, Homo sapiens
gactggtgttatcaccgtgggc

SEQ ID NO: 4567779 - DNA, 18 bp, Homo sapiens
gactggtttctcctggta

SEQ ID NO: 4567780 - DNA, 16 bp, Homo sapiens
gactggttttctgcca

SEQ ID NO: 4567781 - DNA, 19 bp, Homo sapiens
gactgtacataattgcatg

SEQ ID NO: 4567782 - DNA, 14 bp, Homo sapiens
gactgtagccacag

SEQ ID NO: 4567783 - DNA, 15 bp, Homo sapiens
gactgtagccacagc

SEQ ID NO: 4567784 - DNA, 18 bp, Homo sapiens
gactgtatctaggcattt

SEQ ID NO: 4567785 - DNA, 16 bp, Homo sapiens
gactgtccaggagcta

SEQ ID NO: 4567786 - DNA, 23 bp, Homo sapiens
gactgtcccaccgggagcctccc

SEQ ID NO: 4567787 - DNA, 22 bp, Homo sapiens
gactgtctatatcataactata

SEQ ID NO: 4567788 - DNA, 14 bp, Homo sapiens
gactgtgccagagg

SEQ ID NO: 4567789 - DNA, 12 bp, Homo sapiens
gactgtgcctgg

SEQ ID NO: 4567790 - DNA, 17 bp, Homo sapiens
gactgtgcctggctccc

SEQ ID NO: 4567791 - DNA, 17 bp, Homo sapiens
gactgtggaaatgccaa

SEQ ID NO: 4567792 - DNA, 22 bp, Homo sapiens
gactgtggccatatatgctgta

SEQ ID NO: 4567793 - DNA, 17 bp, Homo sapiens
gactgtggtgacttctg

SEQ ID NO: 4567794 - DNA, 20 bp, Homo sapiens
gactgtggtgacttctgctg

SEQ ID NO: 4567795 - DNA, 22 bp, Homo sapiens
gactgtgtattctagttttgtc

SEQ ID NO: 4567796 - DNA, 21 bp, Homo sapiens
gactgttacagactgaaaggt

SEQ ID NO: 4567797 - DNA, 13 bp, Homo sapiens
gactgttccaggc

SEQ ID NO: 4567798 - DNA, 20 bp, Homo sapiens
gactgttccaggccctccag

SEQ ID NO: 4567799 - DNA, 21 bp, Homo sapiens
gactgttcttggtaactgatt

SEQ ID NO: 4567800 - DNA, 13 bp, Homo sapiens
gactgtttattgg

SEQ ID NO: 4567801 - DNA, 15 bp, Homo sapiens
gactgtttcagtgtg

SEQ ID NO: 4567802 - DNA, 20 bp, Homo sapiens
gacttaaaattagtcttttg

SEQ ID NO: 4567803 - DNA, 20 bp, Homo sapiens
gacttaaccttgaaatggaa

SEQ ID NO: 4567804 - DNA, 12 bp, Homo sapiens
gacttacaattt

SEQ ID NO: 4567805 - DNA, 14 bp, Homo sapiens
gacttacaatttgc

SEQ ID NO: 4567806 - DNA, 21 bp, Homo sapiens
gacttactttaattactggaa

SEQ ID NO: 4567807 - DNA, 13 bp, Homo sapiens
gacttagaaactg

SEQ ID NO: 4567808 - DNA, 19 bp, Homo sapiens
gacttagcgtcaagacatt

SEQ ID NO: 4567809 - DNA, 16 bp, Homo sapiens
gacttatagtacatga

SEQ ID NO: 4567810 - DNA, 12 bp, Homo sapiens
gacttatttctg

SEQ ID NO: 4567811 - DNA, 17 bp, Homo sapiens
gacttcaaaatattgag

SEQ ID NO: 4567812 - DNA, 21 bp, Homo sapiens
gacttcaagcatggctatttt

SEQ ID NO: 4567813 - DNA, 16 bp, Homo sapiens
gacttcacactgcaag

SEQ ID NO: 4567814 - DNA, 20 bp, Homo sapiens
gacttcactgtatataaaca

SEQ ID NO: 4567815 - DNA, 12 bp, Homo sapiens
gacttcatttta

SEQ ID NO: 4567816 - DNA, 15 bp, Homo sapiens
gacttcattttatat

SEQ ID NO: 4567817 - DNA, 16 bp, Homo sapiens
gacttcattttatatt

SEQ ID NO: 4567818 - DNA, 17 bp, Homo sapiens
gacttcattttatattt

SEQ ID NO: 4567819 - DNA, 20 bp, Homo sapiens
gacttcattttatatttaaa

SEQ ID NO: 4567820 - DNA, 14 bp, Homo sapiens
gacttccatctagt

SEQ ID NO: 4567821 - DNA, 12 bp, Homo sapiens
gacttccccatc

SEQ ID NO: 4567822 - DNA, 12 bp, Homo sapiens
gacttcctctgg

SEQ ID NO: 4567823 - DNA, 17 bp, Homo sapiens
gacttctaagtaaaacc

SEQ ID NO: 4567824 - DNA, 23 bp, Homo sapiens
gacttctaagtaaaaccacagca

SEQ ID NO: 4567825 - DNA, 24 bp, Homo sapiens
gacttctaagtaaaaccacagcag

SEQ ID NO: 4567826 - DNA, 17 bp, Homo sapiens
gacttctgctgctggcc

SEQ ID NO: 4567827 - DNA, 23 bp, Homo sapiens
gacttctgtcttcacaacagatt

SEQ ID NO: 4567828 - DNA, 17 bp, Homo sapiens
gacttgaagcacagagg

SEQ ID NO: 4567829 - DNA, 16 bp, Homo sapiens
gacttgcaatccaggc

SEQ ID NO: 4567830 - DNA, 17 bp, Homo sapiens
gacttgcacagggattc

SEQ ID NO: 4567831 - DNA, 12 bp, Homo sapiens
gacttgctccct

SEQ ID NO: 4567832 - DNA, 14 bp, Homo sapiens
gacttgctccctct

SEQ ID NO: 4567833 - DNA, 15 bp, Homo sapiens
gacttgctccctctc

SEQ ID NO: 4567834 - DNA, 16 bp, Homo sapiens
gacttgctccctctcc

SEQ ID NO: 4567835 - DNA, 21 bp, Homo sapiens
gacttggagactcctggtctg

SEQ ID NO: 4567836 - DNA, 17 bp, Homo sapiens
gacttgtacaaacagta

SEQ ID NO: 4567837 - DNA, 14 bp, Homo sapiens
gacttgtgtgcatg

SEQ ID NO: 4567838 - DNA, 16 bp, Homo sapiens
gacttgtgtgcatgga

SEQ ID NO: 4567839 - DNA, 17 bp, Homo sapiens
gactttacaaacctttg

SEQ ID NO: 4567840 - DNA, 16 bp, Homo sapiens
gactttatttatttct

SEQ ID NO: 4567841 - DNA, 22 bp, Homo sapiens
gactttctttttctacatgtga

SEQ ID NO: 4567842 - DNA, 13 bp, Homo sapiens
gactttgctgtta

SEQ ID NO: 4567843 - DNA, 15 bp, Homo sapiens
gactttgcttcccat

SEQ ID NO: 4567844 - DNA, 18 bp, Homo sapiens
gactttgtatactttaaa

SEQ ID NO: 4567845 - DNA, 12 bp, Homo sapiens
gacttttaaaat

SEQ ID NO: 4567846 - DNA, 12 bp, Homo sapiens
gacttttctgta

SEQ ID NO: 4567847 - DNA, 13 bp, Homo sapiens
gacttttgaaaaa

SEQ ID NO: 4567848 - DNA, 17 bp, Homo sapiens
gacttttggtagagaag

SEQ ID NO: 4567849 - DNA, 18 bp, Homo sapiens
gacttttggtagagaagg

SEQ ID NO: 4567850 - DNA, 19 bp, Homo sapiens
gagaaaaaaattgctctgt

SEQ ID NO: 4567851 - DNA, 18 bp, Homo sapiens
gagaaaacgccagtgtgt

SEQ ID NO: 4567852 - DNA, 23 bp, Homo sapiens
gagaaaactgaccatcagtatat

SEQ ID NO: 4567853 - DNA, 14 bp, Homo sapiens
gagaaaagaaaaat

SEQ ID NO: 4567854 - DNA, 22 bp, Homo sapiens
gagaaactgagaaatgaatgct

SEQ ID NO: 4567855 - DNA, 14 bp, Homo sapiens
gagaaacttcaaag

SEQ ID NO: 4567856 - DNA, 15 bp, Homo sapiens
gagaaagaaagggaa

SEQ ID NO: 4567857 - DNA, 14 bp, Homo sapiens
gagaaagaaagtac

SEQ ID NO: 4567858 - DNA, 21 bp, Homo sapiens
gagaaagaaagtacccagcaa

SEQ ID NO: 4567859 - DNA, 12 bp, Homo sapiens
gagaaaggacag

SEQ ID NO: 4567860 - DNA, 11 bp, Homo sapiens
gagaaatgcca

SEQ ID NO: 4567861 - DNA, 15 bp, Homo sapiens
gagaacaaatattca

SEQ ID NO: 4567862 - DNA, 22 bp, Homo sapiens
gagaacacctccagcttttctt

SEQ ID NO: 4567863 - DNA, 22 bp, Homo sapiens
gagaacagtattgggcaggagg

SEQ ID NO: 4567864 - DNA, 15 bp, Homo sapiens
gagaacgcagcccta

SEQ ID NO: 4567865 - DNA, 16 bp, Homo sapiens
gagaactttcattttt

SEQ ID NO: 4567866 - DNA, 18 bp, Homo sapiens
gagaagaacaagaaatgg

SEQ ID NO: 4567867 - DNA, 11 bp, Homo sapiens
gagaagaatag

SEQ ID NO: 4567868 - DNA, 21 bp, Homo sapiens
gagaagaattttcagacccca

SEQ ID NO: 4567869 - DNA, 14 bp, Homo sapiens
gagaagacaacaga

SEQ ID NO: 4567870 - DNA, 15 bp, Homo sapiens
gagaagagctgttca

SEQ ID NO: 4567871 - DNA, 15 bp, Homo sapiens
gagaagagcttgcac

SEQ ID NO: 4567872 - DNA, 20 bp, Homo sapiens
gagaagagggaaaacagaaa

SEQ ID NO: 4567873 - DNA, 20 bp, Homo sapiens
gagaagagggcccagcccag

SEQ ID NO: 4567874 - DNA, 13 bp, Homo sapiens
gagaagccacagg

SEQ ID NO: 4567875 - DNA, 17 bp, Homo sapiens
gagaagccacaggcctg

SEQ ID NO: 4567876 - DNA, 18 bp, Homo sapiens
gagaagccacaggcctga

SEQ ID NO: 4567877 - DNA, 20 bp, Homo sapiens
gagaagccacaggcctgaga

SEQ ID NO: 4567878 - DNA, 22 bp, Homo sapiens
gagaagccacaggcctgagatt

SEQ ID NO: 4567879 - DNA, 14 bp, Homo sapiens
gagaagccacgctg

SEQ ID NO: 4567880 - DNA, 20 bp, Homo sapiens
gagaagccacgctgtcctct

SEQ ID NO: 4567881 - DNA, 22 bp, Homo sapiens
gagaagccagctttcctcatca

SEQ ID NO: 4567882 - DNA, 15 bp, Homo sapiens
gagaagccccttccc

SEQ ID NO: 4567883 - DNA, 13 bp, Homo sapiens
gagaaggaacagg

SEQ ID NO: 4567884 - DNA, 14 bp, Homo sapiens
gagaaggaaggaga

SEQ ID NO: 4567885 - DNA, 13 bp, Homo sapiens
gagaaggcaggaa

SEQ ID NO: 4567886 - DNA, 20 bp, Homo sapiens
gagaaggggctttgtgacca

SEQ ID NO: 4567887 - DNA, 20 bp, Homo sapiens
gagaagtcttctatttattt

SEQ ID NO: 4567888 - DNA, 12 bp, Homo sapiens
gagaagtgcttt

SEQ ID NO: 4567889 - DNA, 20 bp, Homo sapiens
gagaataaattgatttttat

SEQ ID NO: 4567890 - DNA, 16 bp, Homo sapiens
gagaataaatttggga

SEQ ID NO: 4567891 - DNA, 15 bp, Homo sapiens
gagaatagaaacgta

SEQ ID NO: 4567892 - DNA, 21 bp, Homo sapiens
gagaatataccttatttattt

SEQ ID NO: 4567893 - DNA, 13 bp, Homo sapiens
gagaatgaattca

SEQ ID NO: 4567894 - DNA, 23 bp, Homo sapiens
gagaatgctaatggttgggttga

SEQ ID NO: 4567895 - DNA, 17 bp, Homo sapiens
gagaatgtcagtatgtg

SEQ ID NO: 4567896 - DNA, 18 bp, Homo sapiens
gagaattcaaatcctctt

SEQ ID NO: 4567897 - DNA, 15 bp, Homo sapiens
gagaattgcacacag

SEQ ID NO: 4567898 - DNA, 18 bp, Homo sapiens
gagaattgtatgtcatgt

SEQ ID NO: 4567899 - DNA, 20 bp, Homo sapiens
gagaattgtgctttcaccag

SEQ ID NO: 4567900 - DNA, 13 bp, Homo sapiens
gagaatttctaaa

SEQ ID NO: 4567901 - DNA, 13 bp, Homo sapiens
gagacacattgcc

SEQ ID NO: 4567902 - DNA, 14 bp, Homo sapiens
gagacacattggac

SEQ ID NO: 4567903 - DNA, 19 bp, Homo sapiens
gagacacctgcacctcccc

SEQ ID NO: 4567904 - DNA, 11 bp, Homo sapiens
gagacactgag

SEQ ID NO: 4567905 - DNA, 18 bp, Homo sapiens
gagacactgagccagtct

SEQ ID NO: 4567906 - DNA, 15 bp, Homo sapiens
gagacagacattcac

SEQ ID NO: 4567907 - DNA, 21 bp, Homo sapiens
gagacagaccacttgccacgc

SEQ ID NO: 4567908 - DNA, 9 bp, Homo sapiens
gagacagag

SEQ ID NO: 4567909 - DNA, 19 bp, Homo sapiens
gagacagaggaaagggctg

SEQ ID NO: 4567910 - DNA, 23 bp, Homo sapiens
gagacagaggaaagggctggctc

SEQ ID NO: 4567911 - DNA, 20 bp, Homo sapiens
gagacagagtcttgctctgt

SEQ ID NO: 4567912 - DNA, 18 bp, Homo sapiens
gagacagatgctggtgga

SEQ ID NO: 4567913 - DNA, 23 bp, Homo sapiens
gagacagatgctggtggaggaag

SEQ ID NO: 4567914 - DNA, 18 bp, Homo sapiens
gagacagctctgcatact

SEQ ID NO: 4567915 - DNA, 16 bp, Homo sapiens
gagacagcttctctgc

SEQ ID NO: 4567916 - DNA, 17 bp, Homo sapiens
gagacagcttctctgca

SEQ ID NO: 4567917 - DNA, 21 bp, Homo sapiens
gagacaggaaaatcctctggc

SEQ ID NO: 4567918 - DNA, 17 bp, Homo sapiens
gagacaggacagaatgt

SEQ ID NO: 4567919 - DNA, 12 bp, Homo sapiens
gagacaggcagc

SEQ ID NO: 4567920 - DNA, 14 bp, Homo sapiens
gagacaggctgggt

SEQ ID NO: 4567921 - DNA, 15 bp, Homo sapiens
gagacagggctgctc

SEQ ID NO: 4567922 - DNA, 19 bp, Homo sapiens
gagacagggtttcaccatg

SEQ ID NO: 4567923 - DNA, 13 bp, Homo sapiens
gagacagtgaatt

SEQ ID NO: 4567924 - DNA, 13 bp, Homo sapiens
gagacatgtacct

SEQ ID NO: 4567925 - DNA, 15 bp, Homo sapiens
gagacattagaaaaa

SEQ ID NO: 4567926 - DNA, 21 bp, Homo sapiens
gagacattagaaaaaaatgaa

SEQ ID NO: 4567927 - DNA, 22 bp, Homo sapiens
gagacattagaaaaaaatgaaa

SEQ ID NO: 4567928 - DNA, 13 bp, Homo sapiens
gagacatttcaaa

SEQ ID NO: 4567929 - DNA, 14 bp, Homo sapiens
gagacatttcaaaa

SEQ ID NO: 4567930 - DNA, 21 bp, Homo sapiens
gagacattttccgcccactcc

SEQ ID NO: 4567931 - DNA, 16 bp, Homo sapiens
gagaccaacctgacca

SEQ ID NO: 4567932 - DNA, 19 bp, Homo sapiens
gagaccaacttttcaatgt

SEQ ID NO: 4567933 - DNA, 14 bp, Homo sapiens
gagaccaggctggg

SEQ ID NO: 4567934 - DNA, 15 bp, Homo sapiens
gagaccagggtggcc

SEQ ID NO: 4567935 - DNA, 21 bp, Homo sapiens
gagaccatccattctcctcag

SEQ ID NO: 4567936 - DNA, 22 bp, Homo sapiens
gagacccaaagcggtccctgtc

SEQ ID NO: 4567937 - DNA, 18 bp, Homo sapiens
gagacccagccctcatcc

SEQ ID NO: 4567938 - DNA, 23 bp, Homo sapiens
gagacccccccccaactccagga

SEQ ID NO: 4567939 - DNA, 19 bp, Homo sapiens
gagaccctgccacagccag

SEQ ID NO: 4567940 - DNA, 20 bp, Homo sapiens
gagaccctgccacagccaga

SEQ ID NO: 4567941 - DNA, 14 bp, Homo sapiens
gagaccctgggaga

SEQ ID NO: 4567942 - DNA, 18 bp, Homo sapiens
gagaccctgggagagaag

SEQ ID NO: 4567943 - DNA, 11 bp, Homo sapiens
gagacctcagc

SEQ ID NO: 4567944 - DNA, 13 bp, Homo sapiens
gagacctcagcca

SEQ ID NO: 4567945 - DNA, 15 bp, Homo sapiens
gagacctcagccatg

SEQ ID NO: 4567946 - DNA, 15 bp, Homo sapiens
gagacctgctcaggc

SEQ ID NO: 4567947 - DNA, 18 bp, Homo sapiens
gagaccttacccctggct

SEQ ID NO: 4567948 - DNA, 22 bp, Homo sapiens
gagaccttacccctggctgttt

SEQ ID NO: 4567949 - DNA, 15 bp, Homo sapiens
gagactactaagagg

SEQ ID NO: 4567950 - DNA, 16 bp, Homo sapiens
gagactcacctctgcc

SEQ ID NO: 4567951 - DNA, 21 bp, Homo sapiens
gagactcagcctctgctggag

SEQ ID NO: 4567952 - DNA, 22 bp, Homo sapiens
gagactcagcctctgctggaga

SEQ ID NO: 4567953 - DNA, 13 bp, Homo sapiens
gagactccatctt

SEQ ID NO: 4567954 - DNA, 17 bp, Homo sapiens
gagactcccatgaagcc

SEQ ID NO: 4567955 - DNA, 14 bp, Homo sapiens
gagactcctggtct

SEQ ID NO: 4567956 - DNA, 16 bp, Homo sapiens
gagactcctggtctgt

SEQ ID NO: 4567957 - DNA, 16 bp, Homo sapiens
gagactctagggtcca

SEQ ID NO: 4567958 - DNA, 20 bp, Homo sapiens
gagactctagggtccagtgg

SEQ ID NO: 4567959 - DNA, 14 bp, Homo sapiens
gagactgagcagcc

SEQ ID NO: 4567960 - DNA, 16 bp, Homo sapiens
gagactgagcagccgc

SEQ ID NO: 4567961 - DNA, 17 bp, Homo sapiens
gagactggcacttagcc

SEQ ID NO: 4567962 - DNA, 22 bp, Homo sapiens
gagactgggaaggcttgggatt

SEQ ID NO: 4567963 - DNA, 17 bp, Homo sapiens
gagactgggctgaggga

SEQ ID NO: 4567964 - DNA, 12 bp, Homo sapiens
gagactgtacat

SEQ ID NO: 4567965 - DNA, 22 bp, Homo sapiens
gagactgtccctgaaacctagt

SEQ ID NO: 4567966 - DNA, 15 bp, Homo sapiens
gagacttcctctggt

SEQ ID NO: 4567967 - DNA, 13 bp, Homo sapiens
gagactttgctgt

SEQ ID NO: 4567968 - DNA, 14 bp, Homo sapiens
gagactttgctgtt

SEQ ID NO: 4567969 - DNA, 13 bp, Homo sapiens
gagagaaaatata

SEQ ID NO: 4567970 - DNA, 21 bp, Homo sapiens
gagagaaaatatatgtatttt

SEQ ID NO: 4567971 - DNA, 14 bp, Homo sapiens
gagagaaagagaac

SEQ ID NO: 4567972 - DNA, 14 bp, Homo sapiens
gagagacaggcagc

SEQ ID NO: 4567973 - DNA, 19 bp, Homo sapiens
gagagacaggcagctcgga

SEQ ID NO: 4567974 - DNA, 14 bp, Homo sapiens
gagagaccctgcaa

SEQ ID NO: 4567975 - DNA, 16 bp, Homo sapiens
gagagacctgctcagg

SEQ ID NO: 4567976 - DNA, 19 bp, Homo sapiens
gagagacctgctcaggcgt

SEQ ID NO: 4567977 - DNA, 21 bp, Homo sapiens
gagagacgccactccctggga

SEQ ID NO: 4567978 - DNA, 13 bp, Homo sapiens
gagagacgggccc

SEQ ID NO: 4567979 - DNA, 10 bp, Homo sapiens
gagagagaca

SEQ ID NO: 4567980 - DNA, 13 bp, Homo sapiens
gagagagagaaag

SEQ ID NO: 4567981 - DNA, 14 bp, Homo sapiens
gagagagagagagg

SEQ ID NO: 4567982 - DNA, 22 bp, Homo sapiens
gagagagcccttcccagggcac

SEQ ID NO: 4567983 - DNA, 23 bp, Homo sapiens
gagagagcccttcccagggcacc

SEQ ID NO: 4567984 - DNA, 13 bp, Homo sapiens
gagagaggacagc

SEQ ID NO: 4567985 - DNA, 13 bp, Homo sapiens
gagagaggccatt

SEQ ID NO: 4567986 - DNA, 21 bp, Homo sapiens
gagagaggccattctttccca

SEQ ID NO: 4567987 - DNA, 21 bp, Homo sapiens
gagagagttgttttaataact

SEQ ID NO: 4567988 - DNA, 14 bp, Homo sapiens
gagagatcaaagat

SEQ ID NO: 4567989 - DNA, 11 bp, Homo sapiens
gagagatgaga

SEQ ID NO: 4567990 - DNA, 18 bp, Homo sapiens
gagagatgggagctcctc

SEQ ID NO: 4567991 - DNA, 17 bp, Homo sapiens
gagagcactagaagtgg

SEQ ID NO: 4567992 - DNA, 14 bp, Homo sapiens
gagagcagcactcc

SEQ ID NO: 4567993 - DNA, 13 bp, Homo sapiens
gagagcagctccc

SEQ ID NO: 4567994 - DNA, 16 bp, Homo sapiens
gagagccagaacctgg

SEQ ID NO: 4567995 - DNA, 11 bp, Homo sapiens
gagagccagcc

SEQ ID NO: 4567996 - DNA, 13 bp, Homo sapiens
gagagccagccct

SEQ ID NO: 4567997 - DNA, 12 bp, Homo sapiens
gagagccctgct

SEQ ID NO: 4567998 - DNA, 14 bp, Homo sapiens
gagagccctgctgt

SEQ ID NO: 4567999 - DNA, 17 bp, Homo sapiens
gagagcccttcccaggg

SEQ ID NO: 4568000 - DNA, 18 bp, Homo sapiens
gagagcccttcccagggc

SEQ ID NO: 4568001 - DNA, 20 bp, Homo sapiens
gagagcccttcccagggcac

SEQ ID NO: 4568002 - DNA, 14 bp, Homo sapiens
gagagcctgctccc

SEQ ID NO: 4568003 - DNA, 17 bp, Homo sapiens
gagagcctgctccccca

SEQ ID NO: 4568004 - DNA, 21 bp, Homo sapiens
gagagcctgctcccccacccc

SEQ ID NO: 4568005 - DNA, 22 bp, Homo sapiens
gagagcctgctcccccaccccc

SEQ ID NO: 4568006 - DNA, 12 bp, Homo sapiens
gagagcctgctg

SEQ ID NO: 4568007 - DNA, 14 bp, Homo sapiens
gagagcctgctgca

SEQ ID NO: 4568008 - DNA, 13 bp, Homo sapiens
gagagcctgctgg

SEQ ID NO: 4568009 - DNA, 15 bp, Homo sapiens
gagagcctgctggca

SEQ ID NO: 4568010 - DNA, 14 bp, Homo sapiens
gagagcctgtggag

SEQ ID NO: 4568011 - DNA, 15 bp, Homo sapiens
gagagcgagaccctg

SEQ ID NO: 4568012 - DNA, 19 bp, Homo sapiens
gagagctagaacccggcag

SEQ ID NO: 4568013 - DNA, 20 bp, Homo sapiens
gagagctagaacccggcagg

SEQ ID NO: 4568014 - DNA, 19 bp, Homo sapiens
gagagctagaacctggagg

SEQ ID NO: 4568015 - DNA, 14 bp, Homo sapiens
gagagctggtgccc

SEQ ID NO: 4568016 - DNA, 17 bp, Homo sapiens
gagagctggtgcccgga

SEQ ID NO: 4568017 - DNA, 12 bp, Homo sapiens
gagaggacagag

SEQ ID NO: 4568018 - DNA, 15 bp, Homo sapiens
gagaggacagcttga

SEQ ID NO: 4568019 - DNA, 19 bp, Homo sapiens
gagaggagaaactgagaaa

SEQ ID NO: 4568020 - DNA, 15 bp, Homo sapiens
gagaggatacattta

SEQ ID NO: 4568021 - DNA, 23 bp, Homo sapiens
gagaggcaataaataaatgtttt

SEQ ID NO: 4568022 - DNA, 14 bp, Homo sapiens
gagaggcacctccc

SEQ ID NO: 4568023 - DNA, 19 bp, Homo sapiens
gagaggcactcagtgagcc

SEQ ID NO: 4568024 - DNA, 21 bp, Homo sapiens
gagaggcaggcatagaggctt

SEQ ID NO: 4568025 - DNA, 12 bp, Homo sapiens
gagaggcggcct

SEQ ID NO: 4568026 - DNA, 14 bp, Homo sapiens
gagagggagagaga

SEQ ID NO: 4568027 - DNA, 17 bp, Homo sapiens
gagagggatttccctgc

SEQ ID NO: 4568028 - DNA, 18 bp, Homo sapiens
gagagggctggtccttat

SEQ ID NO: 4568029 - DNA, 17 bp, Homo sapiens
gagaggggtggaggctg

SEQ ID NO: 4568030 - DNA, 22 bp, Homo sapiens
gagagtagccgagagcctgctc

SEQ ID NO: 4568031 - DNA, 17 bp, Homo sapiens
gagagtctgaatatttt

SEQ ID NO: 4568032 - DNA, 12 bp, Homo sapiens
gagagtgcactg

SEQ ID NO: 4568033 - DNA, 16 bp, Homo sapiens
gagagttcaagcctgt

SEQ ID NO: 4568034 - DNA, 13 bp, Homo sapiens
gagataaaaatca

SEQ ID NO: 4568035 - DNA, 19 bp, Homo sapiens
gagataaaccaataaatcc

SEQ ID NO: 4568036 - DNA, 18 bp, Homo sapiens
gagataaatagaaatttt

SEQ ID NO: 4568037 - DNA, 12 bp, Homo sapiens
gagataaatgtt

SEQ ID NO: 4568038 - DNA, 16 bp, Homo sapiens
gagatacaaggcccag

SEQ ID NO: 4568039 - DNA, 20 bp, Homo sapiens
gagatacaaggcccagaagc

SEQ ID NO: 4568040 - DNA, 21 bp, Homo sapiens
gagatagtgccaggtggctca

SEQ ID NO: 4568041 - DNA, 13 bp, Homo sapiens
gagatagttttca

SEQ ID NO: 4568042 - DNA, 14 bp, Homo sapiens
gagatagttttcat

SEQ ID NO: 4568043 - DNA, 13 bp, Homo sapiens
gagatattatttt

SEQ ID NO: 4568044 - DNA, 23 bp, Homo sapiens
gagatattattttaaatttcttt

SEQ ID NO: 4568045 - DNA, 20 bp, Homo sapiens
gagatatttaggaaaatgct

SEQ ID NO: 4568046 - DNA, 22 bp, Homo sapiens
gagatatttatggggggagaac

SEQ ID NO: 4568047 - DNA, 22 bp, Homo sapiens
gagatattttgtaaaatgtatt

SEQ ID NO: 4568048 - DNA, 15 bp, Homo sapiens
gagatcaaagatgaa

SEQ ID NO: 4568049 - DNA, 22 bp, Homo sapiens
gagatcgagaccatcctggcta

SEQ ID NO: 4568050 - DNA, 12 bp, Homo sapiens
gagatctacaca

SEQ ID NO: 4568051 - DNA, 13 bp, Homo sapiens
gagatctacacat

SEQ ID NO: 4568052 - DNA, 16 bp, Homo sapiens
gagatctcccttctca

SEQ ID NO: 4568053 - DNA, 23 bp, Homo sapiens
gagatctgcacagtcagaaggac

SEQ ID NO: 4568054 - DNA, 21 bp, Homo sapiens
gagatctttctttccaaaaca

SEQ ID NO: 4568055 - DNA, 16 bp, Homo sapiens
gagatgaccagggatg

SEQ ID NO: 4568056 - DNA, 18 bp, Homo sapiens
gagatgaccagggatgct

SEQ ID NO: 4568057 - DNA, 23 bp, Homo sapiens
gagatgagaaagcttttattcct

SEQ ID NO: 4568058 - DNA, 12 bp, Homo sapiens
gagatgagccca

SEQ ID NO: 4568059 - DNA, 13 bp, Homo sapiens
gagatgagcccac

SEQ ID NO: 4568060 - DNA, 18 bp, Homo sapiens
gagatgaggaggggagcg

SEQ ID NO: 4568061 - DNA, 20 bp, Homo sapiens
gagatgcttggagcaatcag

SEQ ID NO: 4568062 - DNA, 16 bp, Homo sapiens
gagatggagggcttgg

SEQ ID NO: 4568063 - DNA, 15 bp, Homo sapiens
gagatggccatgctc

SEQ ID NO: 4568064 - DNA, 14 bp, Homo sapiens
gagatgggagctcc

SEQ ID NO: 4568065 - DNA, 22 bp, Homo sapiens
gagatgggagctcctctcctgg

SEQ ID NO: 4568066 - DNA, 22 bp, Homo sapiens
gagatgtaaaatgagtttgtat

SEQ ID NO: 4568067 - DNA, 15 bp, Homo sapiens
gagatgtagaaagtt

SEQ ID NO: 4568068 - DNA, 18 bp, Homo sapiens
gagattaagaatattgcc

SEQ ID NO: 4568069 - DNA, 14 bp, Homo sapiens
gagattgaatttca

SEQ ID NO: 4568070 - DNA, 17 bp, Homo sapiens
gagattggacggcctga

SEQ ID NO: 4568071 - DNA, 18 bp, Homo sapiens
gagattgtggtggtgcta

SEQ ID NO: 4568072 - DNA, 13 bp, Homo sapiens
gagatttcatctg

SEQ ID NO: 4568073 - DNA, 17 bp, Homo sapiens
gagatttcatctgctct

SEQ ID NO: 4568074 - DNA, 22 bp, Homo sapiens
gagatttcatctgctctccttc

SEQ ID NO: 4568075 - DNA, 18 bp, Homo sapiens
gagatttcttgttgctca

SEQ ID NO: 4568076 - DNA, 16 bp, Homo sapiens
gagattttattttgac

SEQ ID NO: 4568077 - DNA, 19 bp, Homo sapiens
gagatttttaaaaaatatt

SEQ ID NO: 4568078 - DNA, 14 bp, Homo sapiens
gagattttttttcc

SEQ ID NO: 4568079 - DNA, 17 bp, Homo sapiens
gagcaaagatggcttcc

SEQ ID NO: 4568080 - DNA, 13 bp, Homo sapiens
gagcaaaggccct

SEQ ID NO: 4568081 - DNA, 16 bp, Homo sapiens
gagcaaaggccctggg

SEQ ID NO: 4568082 - DNA, 13 bp, Homo sapiens
gagcaagccggca

SEQ ID NO: 4568083 - DNA, 18 bp, Homo sapiens
gagcacatagagcttttt

SEQ ID NO: 4568084 - DNA, 23 bp, Homo sapiens
gagcacatagagctttttaatag

SEQ ID NO: 4568085 - DNA, 23 bp, Homo sapiens
gagcacatctctctgccctctcc

SEQ ID NO: 4568086 - DNA, 15 bp, Homo sapiens
gagcaccaccagggc

SEQ ID NO: 4568087 - DNA, 16 bp, Homo sapiens
gagcaccaccagggct

SEQ ID NO: 4568088 - DNA, 23 bp, Homo sapiens
gagcaccaggcacgaacccacct

SEQ ID NO: 4568089 - DNA, 17 bp, Homo sapiens
gagcacccagagcaccc

SEQ ID NO: 4568090 - DNA, 16 bp, Homo sapiens
gagcacccattccaaa

SEQ ID NO: 4568091 - DNA, 19 bp, Homo sapiens
gagcacccattccaaagct

SEQ ID NO: 4568092 - DNA, 16 bp, Homo sapiens
gagcaccccctgctcc

SEQ ID NO: 4568093 - DNA, 19 bp, Homo sapiens
gagcacctccacatcctcc

SEQ ID NO: 4568094 - DNA, 20 bp, Homo sapiens
gagcacggtcccccaggagg

SEQ ID NO: 4568095 - DNA, 21 bp, Homo sapiens
gagcactgcatgtcagagcac

SEQ ID NO: 4568096 - DNA, 14 bp, Homo sapiens
gagcacttgctgta

SEQ ID NO: 4568097 - DNA, 19 bp, Homo sapiens
gagcactttaaaaacaggc

SEQ ID NO: 4568098 - DNA, 23 bp, Homo sapiens
gagcagagaggtggatcctgtag

SEQ ID NO: 4568099 - DNA, 15 bp, Homo sapiens
gagcagagcctacag

SEQ ID NO: 4568100 - DNA, 15 bp, Homo sapiens
gagcagaggggctga

SEQ ID NO: 4568101 - DNA, 21 bp, Homo sapiens
gagcagcagcaccaaccacag

SEQ ID NO: 4568102 - DNA, 15 bp, Homo sapiens
gagcagcagcttggg

SEQ ID NO: 4568103 - DNA, 21 bp, Homo sapiens
gagcagcattcccagggacct

SEQ ID NO: 4568104 - DNA, 21 bp, Homo sapiens
gagcagcctctggacagccag

SEQ ID NO: 4568105 - DNA, 13 bp, Homo sapiens
gagcagcctgtgg

SEQ ID NO: 4568106 - DNA, 16 bp, Homo sapiens
gagcagctccctttct

SEQ ID NO: 4568107 - DNA, 18 bp, Homo sapiens
gagcagctccctttctca

SEQ ID NO: 4568108 - DNA, 20 bp, Homo sapiens
gagcagctccctttctcagg

SEQ ID NO: 4568109 - DNA, 16 bp, Homo sapiens
gagcaggactccaggc

SEQ ID NO: 4568110 - DNA, 11 bp, Homo sapiens
gagcaggagcc

SEQ ID NO: 4568111 - DNA, 13 bp, Homo sapiens
gagcaggagcccc

SEQ ID NO: 4568112 - DNA, 16 bp, Homo sapiens
gagcagggaaggcctg

SEQ ID NO: 4568113 - DNA, 17 bp, Homo sapiens
gagcagggaaggcctga

SEQ ID NO: 4568114 - DNA, 18 bp, Homo sapiens
gagcagggaaggcctgac

SEQ ID NO: 4568115 - DNA, 16 bp, Homo sapiens
gagcaggggtctgagc

SEQ ID NO: 4568116 - DNA, 17 bp, Homo sapiens
gagcaggggtctgagcc

SEQ ID NO: 4568117 - DNA, 13 bp, Homo sapiens
gagcagggtcctg

SEQ ID NO: 4568118 - DNA, 18 bp, Homo sapiens
gagcagtcagagtccagt

SEQ ID NO: 4568119 - DNA, 18 bp, Homo sapiens
gagcagtccatgcatgac

SEQ ID NO: 4568120 - DNA, 21 bp, Homo sapiens
gagcagtgaatgattcagtgt

SEQ ID NO: 4568121 - DNA, 23 bp, Homo sapiens
gagcatattttcttacttttatt

SEQ ID NO: 4568122 - DNA, 17 bp, Homo sapiens
gagcatcactagtgaca

SEQ ID NO: 4568123 - DNA, 14 bp, Homo sapiens
gagcatcagagggc

SEQ ID NO: 4568124 - DNA, 18 bp, Homo sapiens
gagcatccagacctgagc

SEQ ID NO: 4568125 - DNA, 14 bp, Homo sapiens
gagcatctgcccca

SEQ ID NO: 4568126 - DNA, 15 bp, Homo sapiens
gagcatctgccccag

SEQ ID NO: 4568127 - DNA, 16 bp, Homo sapiens
gagcatctgccccagg

SEQ ID NO: 4568128 - DNA, 16 bp, Homo sapiens
gagcatggatgcattt

SEQ ID NO: 4568129 - DNA, 14 bp, Homo sapiens
gagcatggctgtga

SEQ ID NO: 4568130 - DNA, 21 bp, Homo sapiens
gagcatggctgtgaggatggg

SEQ ID NO: 4568131 - DNA, 15 bp, Homo sapiens
gagcatggggccagg

SEQ ID NO: 4568132 - DNA, 13 bp, Homo sapiens
gagcatgtggagc

SEQ ID NO: 4568133 - DNA, 19 bp, Homo sapiens
gagcatgtttcacagtggc

SEQ ID NO: 4568134 - DNA, 19 bp, Homo sapiens
gagcatttctcatcagtag

SEQ ID NO: 4568135 - DNA, 20 bp, Homo sapiens
gagccaaggaggaaatgtgg

SEQ ID NO: 4568136 - DNA, 16 bp, Homo sapiens
gagccaaggaggcctg

SEQ ID NO: 4568137 - DNA, 20 bp, Homo sapiens
gagccaaggaggcctgggga

SEQ ID NO: 4568138 - DNA, 13 bp, Homo sapiens
gagccacaagctg

SEQ ID NO: 4568139 - DNA, 14 bp, Homo sapiens
gagccaccgtgcct

SEQ ID NO: 4568140 - DNA, 16 bp, Homo sapiens
gagccaccgtgcctgg

SEQ ID NO: 4568141 - DNA, 15 bp, Homo sapiens
gagccactccttcct

SEQ ID NO: 4568142 - DNA, 19 bp, Homo sapiens
gagccactgcgcccggccc

SEQ ID NO: 4568143 - DNA, 20 bp, Homo sapiens
gagccactgcgcccggccca

SEQ ID NO: 4568144 - DNA, 15 bp, Homo sapiens
gagccacttctcccc

SEQ ID NO: 4568145 - DNA, 17 bp, Homo sapiens
gagccagactgtccagg

SEQ ID NO: 4568146 - DNA, 12 bp, Homo sapiens
gagccagcaggg

SEQ ID NO: 4568147 - DNA, 15 bp, Homo sapiens
gagccagccctccct

SEQ ID NO: 4568148 - DNA, 16 bp, Homo sapiens
gagccagccctccctg

SEQ ID NO: 4568149 - DNA, 15 bp, Homo sapiens
gagccagcctgctcc

SEQ ID NO: 4568150 - DNA, 14 bp, Homo sapiens
gagccagcctggct

SEQ ID NO: 4568151 - DNA, 20 bp, Homo sapiens
gagccagcctggctctgccc

SEQ ID NO: 4568152 - DNA, 22 bp, Homo sapiens
gagccagcctggctctgccccc

SEQ ID NO: 4568153 - DNA, 17 bp, Homo sapiens
gagccagcggctccaac

SEQ ID NO: 4568154 - DNA, 14 bp, Homo sapiens
gagccagggcaggg

SEQ ID NO: 4568155 - DNA, 22 bp, Homo sapiens
gagccagggcagggcgagctgc

SEQ ID NO: 4568156 - DNA, 23 bp, Homo sapiens
gagccagtcctccactcgaccca

SEQ ID NO: 4568157 - DNA, 19 bp, Homo sapiens
gagccatgatttcccactg

SEQ ID NO: 4568158 - DNA, 17 bp, Homo sapiens
gagccatgctacagtta

SEQ ID NO: 4568159 - DNA, 22 bp, Homo sapiens
gagccatggaccacgcaggaag

SEQ ID NO: 4568160 - DNA, 19 bp, Homo sapiens
gagccatttgtcccaagtg

SEQ ID NO: 4568161 - DNA, 22 bp, Homo sapiens
gagccatttgtcccaagtgcca

SEQ ID NO: 4568162 - DNA, 14 bp, Homo sapiens
gagcccaagggaat

SEQ ID NO: 4568163 - DNA, 16 bp, Homo sapiens
gagcccacactgccac

SEQ ID NO: 4568164 - DNA, 12 bp, Homo sapiens
gagcccaccctg

SEQ ID NO: 4568165 - DNA, 19 bp, Homo sapiens
gagcccagagggtggcaag

SEQ ID NO: 4568166 - DNA, 16 bp, Homo sapiens
gagcccagcctgggag

SEQ ID NO: 4568167 - DNA, 12 bp, Homo sapiens
gagcccagctct

SEQ ID NO: 4568168 - DNA, 18 bp, Homo sapiens
gagcccattcttctgggt

SEQ ID NO: 4568169 - DNA, 12 bp, Homo sapiens
gagccccagggt

SEQ ID NO: 4568170 - DNA, 19 bp, Homo sapiens
gagccccagggtcttccct

SEQ ID NO: 4568171 - DNA, 23 bp, Homo sapiens
gagcccccaccggaactgggctg

SEQ ID NO: 4568172 - DNA, 13 bp, Homo sapiens
gagcccccagcag

SEQ ID NO: 4568173 - DNA, 17 bp, Homo sapiens
gagcccccagcagaggc

SEQ ID NO: 4568174 - DNA, 14 bp, Homo sapiens
gagcccccctagca

SEQ ID NO: 4568175 - DNA, 15 bp, Homo sapiens
gagcccctccccagc

SEQ ID NO: 4568176 - DNA, 16 bp, Homo sapiens
gagcccctccccagcc

SEQ ID NO: 4568177 - DNA, 17 bp, Homo sapiens
gagcccctccccagcca

SEQ ID NO: 4568178 - DNA, 21 bp, Homo sapiens
gagcccctccccagccagccc

SEQ ID NO: 4568179 - DNA, 18 bp, Homo sapiens
gagcccgatattctccct

SEQ ID NO: 4568180 - DNA, 12 bp, Homo sapiens
gagccctcctga

SEQ ID NO: 4568181 - DNA, 19 bp, Homo sapiens
gagccctcctgagggccgg

SEQ ID NO: 4568182 - DNA, 13 bp, Homo sapiens
gagccctgactcc

SEQ ID NO: 4568183 - DNA, 17 bp, Homo sapiens
gagccctgactcctgga

SEQ ID NO: 4568184 - DNA, 20 bp, Homo sapiens
gagccctgactcctggactc

SEQ ID NO: 4568185 - DNA, 17 bp, Homo sapiens
gagccctgaggcctaga

SEQ ID NO: 4568186 - DNA, 9 bp, Homo sapiens
gagccctgc

SEQ ID NO: 4568187 - DNA, 14 bp, Homo sapiens
gagccctgctcttc

SEQ ID NO: 4568188 - DNA, 21 bp, Homo sapiens
gagccctgctcttctctcccc

SEQ ID NO: 4568189 - DNA, 22 bp, Homo sapiens
gagccctgctcttctctcccca

SEQ ID NO: 4568190 - DNA, 13 bp, Homo sapiens
gagccctggctcc

SEQ ID NO: 4568191 - DNA, 13 bp, Homo sapiens
gagccctgggtga

SEQ ID NO: 4568192 - DNA, 13 bp, Homo sapiens
gagcccttcccag

SEQ ID NO: 4568193 - DNA, 23 bp, Homo sapiens
gagcccttcccagggcacccagg

SEQ ID NO: 4568194 - DNA, 12 bp, Homo sapiens
gagccgcagagc

SEQ ID NO: 4568195 - DNA, 16 bp, Homo sapiens
gagccgcccaaggcct

SEQ ID NO: 4568196 - DNA, 17 bp, Homo sapiens
gagccgcggggaagctg

SEQ ID NO: 4568197 - DNA, 16 bp, Homo sapiens
gagccgggcccctggg

SEQ ID NO: 4568198 - DNA, 20 bp, Homo sapiens
gagccgggtctgcctcttct

SEQ ID NO: 4568199 - DNA, 16 bp, Homo sapiens
gagcctagctcctgcc

SEQ ID NO: 4568200 - DNA, 17 bp, Homo sapiens
gagcctcccaaggagaa

SEQ ID NO: 4568201 - DNA, 12 bp, Homo sapiens
gagcctcccacc

SEQ ID NO: 4568202 - DNA, 11 bp, Homo sapiens
gagcctcccca

SEQ ID NO: 4568203 - DNA, 21 bp, Homo sapiens
gagcctccccatctgtccagc

SEQ ID NO: 4568204 - DNA, 17 bp, Homo sapiens
gagcctcctgtgcctgg

SEQ ID NO: 4568205 - DNA, 17 bp, Homo sapiens
gagcctctggcccctca

SEQ ID NO: 4568206 - DNA, 15 bp, Homo sapiens
gagcctgaactgagc

SEQ ID NO: 4568207 - DNA, 15 bp, Homo sapiens
gagcctgacgctcag

SEQ ID NO: 4568208 - DNA, 19 bp, Homo sapiens
gagcctgacgctcagcccc

SEQ ID NO: 4568209 - DNA, 22 bp, Homo sapiens
gagcctgacgctcagccccagg

SEQ ID NO: 4568210 - DNA, 10 bp, Homo sapiens
gagcctgctg

SEQ ID NO: 4568211 - DNA, 12 bp, Homo sapiens
gagcctgctggc

SEQ ID NO: 4568212 - DNA, 15 bp, Homo sapiens
gagcctgctggcacc

SEQ ID NO: 4568213 - DNA, 14 bp, Homo sapiens
gagcctggccccag

SEQ ID NO: 4568214 - DNA, 23 bp, Homo sapiens
gagcctggccccaggccccagac

SEQ ID NO: 4568215 - DNA, 17 bp, Homo sapiens
gagcctggtccttccct

SEQ ID NO: 4568216 - DNA, 17 bp, Homo sapiens
gagccttagcagccctg

SEQ ID NO: 4568217 - DNA, 18 bp, Homo sapiens
gagccttagcagccctgg

SEQ ID NO: 4568218 - DNA, 13 bp, Homo sapiens
gagccttcaagtg

SEQ ID NO: 4568219 - DNA, 13 bp, Homo sapiens
gagccttcagcct

SEQ ID NO: 4568220 - DNA, 18 bp, Homo sapiens
gagccttctcagaagcac

SEQ ID NO: 4568221 - DNA, 21 bp, Homo sapiens
gagccttctgccaccagcccc

SEQ ID NO: 4568222 - DNA, 13 bp, Homo sapiens
gagcgaaactccg

SEQ ID NO: 4568223 - DNA, 17 bp, Homo sapiens
gagcgagagatcaaaga

SEQ ID NO: 4568224 - DNA, 20 bp, Homo sapiens
gagcgagagatcaaagatga

SEQ ID NO: 4568225 - DNA, 15 bp, Homo sapiens
gagcgaggaaaggat

SEQ ID NO: 4568226 - DNA, 21 bp, Homo sapiens
gagcgcacagggagtgcacat

SEQ ID NO: 4568227 - DNA, 14 bp, Homo sapiens
gagcgccaggaagc

SEQ ID NO: 4568228 - DNA, 16 bp, Homo sapiens
gagcgccaggaagcca

SEQ ID NO: 4568229 - DNA, 21 bp, Homo sapiens
gagcgccaggaagccagagcc

SEQ ID NO: 4568230 - DNA, 14 bp, Homo sapiens
gagcgcccccgagc

SEQ ID NO: 4568231 - DNA, 17 bp, Homo sapiens
gagcgcccccgagccct

SEQ ID NO: 4568232 - DNA, 18 bp, Homo sapiens
gagcgcccccgagccctg

SEQ ID NO: 4568233 - DNA, 20 bp, Homo sapiens
gagcgcctgcgttcccagac

SEQ ID NO: 4568234 - DNA, 21 bp, Homo sapiens
gagcgctcctgccgcagagct

SEQ ID NO: 4568235 - DNA, 13 bp, Homo sapiens
gagcggagcccga

SEQ ID NO: 4568236 - DNA, 13 bp, Homo sapiens
gagcggaggttgc

SEQ ID NO: 4568237 - DNA, 17 bp, Homo sapiens
gagcgggaggcagcgcc

SEQ ID NO: 4568238 - DNA, 16 bp, Homo sapiens
gagcgggagtcaggga

SEQ ID NO: 4568239 - DNA, 13 bp, Homo sapiens
gagcgtgcgcact

SEQ ID NO: 4568240 - DNA, 14 bp, Homo sapiens
gagcgtgcgcactg

SEQ ID NO: 4568241 - DNA, 16 bp, Homo sapiens
gagcgtgcgcactgca

SEQ ID NO: 4568242 - DNA, 15 bp, Homo sapiens
gagctacataattta

SEQ ID NO: 4568243 - DNA, 20 bp, Homo sapiens
gagctacgtatttaatagca

SEQ ID NO: 4568244 - DNA, 22 bp, Homo sapiens
gagctagaacctagaagggcta

SEQ ID NO: 4568245 - DNA, 17 bp, Homo sapiens
gagctagaacctggaga

SEQ ID NO: 4568246 - DNA, 14 bp, Homo sapiens
gagctagcgctgcc

SEQ ID NO: 4568247 - DNA, 19 bp, Homo sapiens
gagctagttctcagcttgc

SEQ ID NO: 4568248 - DNA, 17 bp, Homo sapiens
gagctatcctttcaaac

SEQ ID NO: 4568249 - DNA, 16 bp, Homo sapiens
gagctattaaaactca

SEQ ID NO: 4568250 - DNA, 21 bp, Homo sapiens
gagctattttagaaagctaaa

SEQ ID NO: 4568251 - DNA, 22 bp, Homo sapiens
gagctattttagaaagctaaat

SEQ ID NO: 4568252 - DNA, 17 bp, Homo sapiens
gagctcacatgggactg

SEQ ID NO: 4568253 - DNA, 15 bp, Homo sapiens
gagctcagaccccca

SEQ ID NO: 4568254 - DNA, 22 bp, Homo sapiens
gagctcaggaaccgaggcaggg

SEQ ID NO: 4568255 - DNA, 23 bp, Homo sapiens
gagctcaggaaccgaggcaggga

SEQ ID NO: 4568256 - DNA, 23 bp, Homo sapiens
gagctcaggagtttgagaccagg

SEQ ID NO: 4568257 - DNA, 19 bp, Homo sapiens
gagctccgtcagcttctcc

SEQ ID NO: 4568258 - DNA, 14 bp, Homo sapiens
gagctcctccctcc

SEQ ID NO: 4568259 - DNA, 18 bp, Homo sapiens
gagctcctccctccagct

SEQ ID NO: 4568260 - DNA, 23 bp, Homo sapiens
gagctcctccctccagctgcgac

SEQ ID NO: 4568261 - DNA, 19 bp, Homo sapiens
gagctcctctcctggagga

SEQ ID NO: 4568262 - DNA, 12 bp, Homo sapiens
gagctcctggga

SEQ ID NO: 4568263 - DNA, 13 bp, Homo sapiens
gagctcctgggga

SEQ ID NO: 4568264 - DNA, 15 bp, Homo sapiens
gagctcctggggagc

SEQ ID NO: 4568265 - DNA, 21 bp, Homo sapiens
gagctcctggggagctcctgg

SEQ ID NO: 4568266 - DNA, 20 bp, Homo sapiens
gagctccttaaggctctttt

SEQ ID NO: 4568267 - DNA, 15 bp, Homo sapiens
gagctctcaggccga

SEQ ID NO: 4568268 - DNA, 15 bp, Homo sapiens
gagctctcgaggaaa

SEQ ID NO: 4568269 - DNA, 13 bp, Homo sapiens
gagctcttggccc

SEQ ID NO: 4568270 - DNA, 15 bp, Homo sapiens
gagctcttgggtcag

SEQ ID NO: 4568271 - DNA, 21 bp, Homo sapiens
gagctgagatcgtgctactgc

SEQ ID NO: 4568272 - DNA, 18 bp, Homo sapiens
gagctgagcagcctctgg

SEQ ID NO: 4568273 - DNA, 19 bp, Homo sapiens
gagctgagcagcctctgga

SEQ ID NO: 4568274 - DNA, 20 bp, Homo sapiens
gagctgagcagcctctggac

SEQ ID NO: 4568275 - DNA, 14 bp, Homo sapiens
gagctgcagccccc

SEQ ID NO: 4568276 - DNA, 20 bp, Homo sapiens
gagctgcaggaatcacccct

SEQ ID NO: 4568277 - DNA, 21 bp, Homo sapiens
gagctgcaggaatcacccctc

SEQ ID NO: 4568278 - DNA, 11 bp, Homo sapiens
gagctgccctc

SEQ ID NO: 4568279 - DNA, 19 bp, Homo sapiens
gagctgccgacttggagac

SEQ ID NO: 4568280 - DNA, 22 bp, Homo sapiens
gagctgctgagtgacagctttc

SEQ ID NO: 4568281 - DNA, 12 bp, Homo sapiens
gagctgctggct

SEQ ID NO: 4568282 - DNA, 21 bp, Homo sapiens
gagctgctggcttgcagtgcg

SEQ ID NO: 4568283 - DNA, 15 bp, Homo sapiens
gagctggagccccca

SEQ ID NO: 4568284 - DNA, 17 bp, Homo sapiens
gagctggcgctcagcag

SEQ ID NO: 4568285 - DNA, 24 bp, Homo sapiens
gagctggcgctcagcagccctagc

SEQ ID NO: 4568286 - DNA, 12 bp, Homo sapiens
gagctgggcccc

SEQ ID NO: 4568287 - DNA, 13 bp, Homo sapiens
gagctgggccctg

SEQ ID NO: 4568288 - DNA, 15 bp, Homo sapiens
gagctgggccctgcc

SEQ ID NO: 4568289 - DNA, 16 bp, Homo sapiens
gagctggggactcagg

SEQ ID NO: 4568290 - DNA, 17 bp, Homo sapiens
gagctggtgcccggaga

SEQ ID NO: 4568291 - DNA, 14 bp, Homo sapiens
gagctgtcacctct

SEQ ID NO: 4568292 - DNA, 16 bp, Homo sapiens
gagctgtccagtggag

SEQ ID NO: 4568293 - DNA, 15 bp, Homo sapiens
gagctgtgccgaggc

SEQ ID NO: 4568294 - DNA, 20 bp, Homo sapiens
gagctgttcacagccagact

SEQ ID NO: 4568295 - DNA, 22 bp, Homo sapiens
gagctgttcacagccagactgg

SEQ ID NO: 4568296 - DNA, 16 bp, Homo sapiens
gagctgtttatggcct

SEQ ID NO: 4568297 - DNA, 17 bp, Homo sapiens
gagctgtttatggcctc

SEQ ID NO: 4568298 - DNA, 16 bp, Homo sapiens
gagcttagcatatctg

SEQ ID NO: 4568299 - DNA, 20 bp, Homo sapiens
gagcttattgtttttattct

SEQ ID NO: 4568300 - DNA, 15 bp, Homo sapiens
gagcttcaatataag

SEQ ID NO: 4568301 - DNA, 16 bp, Homo sapiens
gagcttcaatataaga

SEQ ID NO: 4568302 - DNA, 15 bp, Homo sapiens
gagcttgattaaatc

SEQ ID NO: 4568303 - DNA, 23 bp, Homo sapiens
gagcttgcacagccaacgagaca

SEQ ID NO: 4568304 - DNA, 16 bp, Homo sapiens
gagcttggactacaca

SEQ ID NO: 4568305 - DNA, 12 bp, Homo sapiens
gcaagatgtggg

SEQ ID NO: 4568306 - DNA, 22 bp, Homo sapiens
gcaagatgtttcttgccttttg

SEQ ID NO: 4568307 - DNA, 12 bp, Homo sapiens
gcaagcagcttt

SEQ ID NO: 4568308 - DNA, 23 bp, Homo sapiens
gcaagcagctttttattccctgc

SEQ ID NO: 4568309 - DNA, 17 bp, Homo sapiens
gcaagcattcagaagaa

SEQ ID NO: 4568310 - DNA, 11 bp, Homo sapiens
gcaagccacag

SEQ ID NO: 4568311 - DNA, 16 bp, Homo sapiens
gcaagccatcatcctc

SEQ ID NO: 4568312 - DNA, 16 bp, Homo sapiens
gcaagcccctctttct

SEQ ID NO: 4568313 - DNA, 18 bp, Homo sapiens
gcaagccctgcccacaga

SEQ ID NO: 4568314 - DNA, 15 bp, Homo sapiens
gcaagcgagcacagt

SEQ ID NO: 4568315 - DNA, 19 bp, Homo sapiens
gcaagcgagcacagtatta

SEQ ID NO: 4568316 - DNA, 17 bp, Homo sapiens
gcaagcgtgttctcagc

SEQ ID NO: 4568317 - DNA, 14 bp, Homo sapiens
gcaagctaacctta

SEQ ID NO: 4568318 - DNA, 19 bp, Homo sapiens
gcaagctagaacctggagg

SEQ ID NO: 4568319 - DNA, 14 bp, Homo sapiens
gcaagctgaaattt

SEQ ID NO: 4568320 - DNA, 13 bp, Homo sapiens
gcaagctgcccag

SEQ ID NO: 4568321 - DNA, 15 bp, Homo sapiens
gcaagctgcccagcc

SEQ ID NO: 4568322 - DNA, 21 bp, Homo sapiens
gcaagctgcccagccctggcc

SEQ ID NO: 4568323 - DNA, 11 bp, Homo sapiens
gcaaggaaaaa

SEQ ID NO: 4568324 - DNA, 16 bp, Homo sapiens
gcaaggaaaaagaaaa

SEQ ID NO: 4568325 - DNA, 18 bp, Homo sapiens
gcaaggaaaaagaaaata

SEQ ID NO: 4568326 - DNA, 14 bp, Homo sapiens
gcaaggaccaggac

SEQ ID NO: 4568327 - DNA, 16 bp, Homo sapiens
gcaaggagaaaatata

SEQ ID NO: 4568328 - DNA, 15 bp, Homo sapiens
gcaaggggtgatggc

SEQ ID NO: 4568329 - DNA, 22 bp, Homo sapiens
gcaagggttggaggcaatgtgg

SEQ ID NO: 4568330 - DNA, 17 bp, Homo sapiens
gcaaggtcatagacaat

SEQ ID NO: 4568331 - DNA, 22 bp, Homo sapiens
gcaaggtggcctttgtgctgcg

SEQ ID NO: 4568332 - DNA, 15 bp, Homo sapiens
gcaaggtgtgctctg

SEQ ID NO: 4568333 - DNA, 13 bp, Homo sapiens
gcaagtctgccga

SEQ ID NO: 4568334 - DNA, 21 bp, Homo sapiens
gcaagtctgccgattttgtaa

SEQ ID NO: 4568335 - DNA, 21 bp, Homo sapiens
gcaagtctgtggccccacaac

SEQ ID NO: 4568336 - DNA, 15 bp, Homo sapiens
gcaagtgaactcatc

SEQ ID NO: 4568337 - DNA, 16 bp, Homo sapiens
gcaataactctgggag

SEQ ID NO: 4568338 - DNA, 14 bp, Homo sapiens
gcaataactgaaaa

SEQ ID NO: 4568339 - DNA, 16 bp, Homo sapiens
gcaataactgaaaatg

SEQ ID NO: 4568340 - DNA, 17 bp, Homo sapiens
gcaataactgaaaatga

SEQ ID NO: 4568341 - DNA, 13 bp, Homo sapiens
gcaataagattta

SEQ ID NO: 4568342 - DNA, 12 bp, Homo sapiens
gcaataatgcag

SEQ ID NO: 4568343 - DNA, 15 bp, Homo sapiens
gcaatacagggaggc

SEQ ID NO: 4568344 - DNA, 20 bp, Homo sapiens
gcaatatcttcgttagtaat

SEQ ID NO: 4568345 - DNA, 20 bp, Homo sapiens
gcaatccaggctgttctcag

SEQ ID NO: 4568346 - DNA, 13 bp, Homo sapiens
gcaatccatttat

SEQ ID NO: 4568347 - DNA, 20 bp, Homo sapiens
gcaatcctcctgcctcagcc

SEQ ID NO: 4568348 - DNA, 17 bp, Homo sapiens
gcaatcgttctgctggc

SEQ ID NO: 4568349 - DNA, 12 bp, Homo sapiens
gcaatctcagct

SEQ ID NO: 4568350 - DNA, 23 bp, Homo sapiens
gcaatctcttcattattctctgc

SEQ ID NO: 4568351 - DNA, 22 bp, Homo sapiens
gcaatctgaccctatgggtcta

SEQ ID NO: 4568352 - DNA, 23 bp, Homo sapiens
gcaatgaaaagtcgttttccaaa

SEQ ID NO: 4568353 - DNA, 14 bp, Homo sapiens
gcaatgaaaatttt

SEQ ID NO: 4568354 - DNA, 13 bp, Homo sapiens
gcaatgaaggaaa

SEQ ID NO: 4568355 - DNA, 16 bp, Homo sapiens
gcaatgatgaatgaga

SEQ ID NO: 4568356 - DNA, 15 bp, Homo sapiens
gcaatggccagagcc

SEQ ID NO: 4568357 - DNA, 19 bp, Homo sapiens
gcaatggccagagcctctg

SEQ ID NO: 4568358 - DNA, 20 bp, Homo sapiens
gcaatggccagagcctctgg

SEQ ID NO: 4568359 - DNA, 18 bp, Homo sapiens
gcaatgggtaagggaggg

SEQ ID NO: 4568360 - DNA, 19 bp, Homo sapiens
gcaatgggtaagggaggga

SEQ ID NO: 4568361 - DNA, 21 bp, Homo sapiens
gcaatgggtaagggagggaag

SEQ ID NO: 4568362 - DNA, 22 bp, Homo sapiens
gcaatggtgtcagtatccaggc

SEQ ID NO: 4568363 - DNA, 23 bp, Homo sapiens
gcaatggtgtcagtatccaggct

SEQ ID NO: 4568364 - DNA, 18 bp, Homo sapiens
gcaatgtaaatattttaa

SEQ ID NO: 4568365 - DNA, 19 bp, Homo sapiens
gcaatgtaaatattttaaa

SEQ ID NO: 4568366 - DNA, 23 bp, Homo sapiens
gcaatgtaaatattttaaagaat

SEQ ID NO: 4568367 - DNA, 15 bp, Homo sapiens
gcaatgtgccttgat

SEQ ID NO: 4568368 - DNA, 17 bp, Homo sapiens
gcaatgtgggatctcag

SEQ ID NO: 4568369 - DNA, 22 bp, Homo sapiens
gcaattaaacttccaaagaaag

SEQ ID NO: 4568370 - DNA, 16 bp, Homo sapiens
gcaattatattgtcct

SEQ ID NO: 4568371 - DNA, 15 bp, Homo sapiens
gcaattctgactgtc

SEQ ID NO: 4568372 - DNA, 13 bp, Homo sapiens
gcaatttaaatgt

SEQ ID NO: 4568373 - DNA, 14 bp, Homo sapiens
gcaatttcctggcc

SEQ ID NO: 4568374 - DNA, 13 bp, Homo sapiens
gcaatttctgtac

SEQ ID NO: 4568375 - DNA, 21 bp, Homo sapiens
gcacaaaactacttttctaaa

SEQ ID NO: 4568376 - DNA, 14 bp, Homo sapiens
gcacaaaagcagat

SEQ ID NO: 4568377 - DNA, 21 bp, Homo sapiens
gcacaaaagcagatacttgag

SEQ ID NO: 4568378 - DNA, 15 bp, Homo sapiens
gcacaaggattgaaa

SEQ ID NO: 4568379 - DNA, 18 bp, Homo sapiens
gcacacaacgattatagt

SEQ ID NO: 4568380 - DNA, 14 bp, Homo sapiens
gcacacacatgcat

SEQ ID NO: 4568381 - DNA, 12 bp, Homo sapiens
gcacacacccat

SEQ ID NO: 4568382 - DNA, 15 bp, Homo sapiens
gcacacaccctgagc

SEQ ID NO: 4568383 - DNA, 21 bp, Homo sapiens
gcacacagagtgagggaggag

SEQ ID NO: 4568384 - DNA, 14 bp, Homo sapiens
gcacacagcagccc

SEQ ID NO: 4568385 - DNA, 18 bp, Homo sapiens
gcacacagctgagcactt

SEQ ID NO: 4568386 - DNA, 23 bp, Homo sapiens
gcacacagctgagcacttagcag

SEQ ID NO: 4568387 - DNA, 13 bp, Homo sapiens
gcacacagggccc

SEQ ID NO: 4568388 - DNA, 19 bp, Homo sapiens
gcacacagggcccggccac

SEQ ID NO: 4568389 - DNA, 23 bp, Homo sapiens
gcacacagggcccggccacaccc

SEQ ID NO: 4568390 - DNA, 16 bp, Homo sapiens
gcacaccagagacaag

SEQ ID NO: 4568391 - DNA, 22 bp, Homo sapiens
gcacaccagagacaagcagagt

SEQ ID NO: 4568392 - DNA, 23 bp, Homo sapiens
gcacaccagagacaagcagagta

SEQ ID NO: 4568393 - DNA, 17 bp, Homo sapiens
gcacacgagttccagac

SEQ ID NO: 4568394 - DNA, 20 bp, Homo sapiens
gcacactcttctcttgagca

SEQ ID NO: 4568395 - DNA, 13 bp, Homo sapiens
gcacactggctca

SEQ ID NO: 4568396 - DNA, 22 bp, Homo sapiens
gcacactggctcacccagtcct

SEQ ID NO: 4568397 - DNA, 13 bp, Homo sapiens
gcacagagcaagt

SEQ ID NO: 4568398 - DNA, 11 bp, Homo sapiens
gcacagagcct

SEQ ID NO: 4568399 - DNA, 14 bp, Homo sapiens
gcacagagcctggc

SEQ ID NO: 4568400 - DNA, 19 bp, Homo sapiens
gcacagagcctggccccag

SEQ ID NO: 4568401 - DNA, 19 bp, Homo sapiens
gcacagatatactttgtgg

SEQ ID NO: 4568402 - DNA, 17 bp, Homo sapiens
gcacagatgctccaggg

SEQ ID NO: 4568403 - DNA, 19 bp, Homo sapiens
gcacagccaacgagacaca

SEQ ID NO: 4568404 - DNA, 15 bp, Homo sapiens
gcacagccaaggact

SEQ ID NO: 4568405 - DNA, 22 bp, Homo sapiens
gcacagccgcgggccaggaggc

SEQ ID NO: 4568406 - DNA, 16 bp, Homo sapiens
gcacaggctaattttt

SEQ ID NO: 4568407 - DNA, 22 bp, Homo sapiens
gcacagggagtgcacatatcca

SEQ ID NO: 4568408 - DNA, 17 bp, Homo sapiens
gcacagggcagctgggc

SEQ ID NO: 4568409 - DNA, 19 bp, Homo sapiens
gcacagggcagctgggccc

SEQ ID NO: 4568410 - DNA, 20 bp, Homo sapiens
gcacagggcagctgggccca

SEQ ID NO: 4568411 - DNA, 23 bp, Homo sapiens
gcacagtattatttctccatccc

SEQ ID NO: 4568412 - DNA, 15 bp, Homo sapiens
gcacagtcagaagga

SEQ ID NO: 4568413 - DNA, 12 bp, Homo sapiens
gcacagtccaga

SEQ ID NO: 4568414 - DNA, 15 bp, Homo sapiens
gcacagtccagaccc

SEQ ID NO: 4568415 - DNA, 13 bp, Homo sapiens
gcacagtggctca

SEQ ID NO: 4568416 - DNA, 14 bp, Homo sapiens
gcacagtgtgagcc

SEQ ID NO: 4568417 - DNA, 21 bp, Homo sapiens
gcacatagagctttttaatag

SEQ ID NO: 4568418 - DNA, 23 bp, Homo sapiens
gcacatatggaattttgcaaaga

SEQ ID NO: 4568419 - DNA, 19 bp, Homo sapiens
gcacatattagtgcagcca

SEQ ID NO: 4568420 - DNA, 20 bp, Homo sapiens
gcacatattagtgcagccaa

SEQ ID NO: 4568421 - DNA, 22 bp, Homo sapiens
gcacatattagtgcagccaagt

SEQ ID NO: 4568422 - DNA, 14 bp, Homo sapiens
gcacatattgagca

SEQ ID NO: 4568423 - DNA, 20 bp, Homo sapiens
gcacatctctctgccctctc

SEQ ID NO: 4568424 - DNA, 21 bp, Homo sapiens
gcacatctgtaaatctacaca

SEQ ID NO: 4568425 - DNA, 17 bp, Homo sapiens
gcacatctgtgtcttgt

SEQ ID NO: 4568426 - DNA, 15 bp, Homo sapiens
gcacatctgttttgt

SEQ ID NO: 4568427 - DNA, 16 bp, Homo sapiens
gcacatgctgtctggc

SEQ ID NO: 4568428 - DNA, 13 bp, Homo sapiens
gcacatggcctga

SEQ ID NO: 4568429 - DNA, 17 bp, Homo sapiens
gcacatgtgccactgtt

SEQ ID NO: 4568430 - DNA, 18 bp, Homo sapiens
gcacattcgggaccaata

SEQ ID NO: 4568431 - DNA, 20 bp, Homo sapiens
gcacattgggtggggctcct

SEQ ID NO: 4568432 - DNA, 23 bp, Homo sapiens
gcacattgggtggggctcctggg

SEQ ID NO: 4568433 - DNA, 16 bp, Homo sapiens
gcaccaaaagaagtaa

SEQ ID NO: 4568434 - DNA, 18 bp, Homo sapiens
gcaccaaaagaagtaaaa

SEQ ID NO: 4568435 - DNA, 10 bp, Homo sapiens
gcaccaaaga

SEQ ID NO: 4568436 - DNA, 12 bp, Homo sapiens
gcaccaaagaca

SEQ ID NO: 4568437 - DNA, 16 bp, Homo sapiens
gcaccaccagggctcc

SEQ ID NO: 4568438 - DNA, 19 bp, Homo sapiens
gcaccaccatgccaggcta

SEQ ID NO: 4568439 - DNA, 14 bp, Homo sapiens
gcaccaccatttaa

SEQ ID NO: 4568440 - DNA, 18 bp, Homo sapiens
gcaccactgcactccagc

SEQ ID NO: 4568441 - DNA, 21 bp, Homo sapiens
gcaccactgcactccagcctg

SEQ ID NO: 4568442 - DNA, 21 bp, Homo sapiens
gcaccaggcacgaacccacct

SEQ ID NO: 4568443 - DNA, 22 bp, Homo sapiens
gcaccatggtatcatatattaa

SEQ ID NO: 4568444 - DNA, 22 bp, Homo sapiens
gcaccattttcaatttggagca

SEQ ID NO: 4568445 - DNA, 18 bp, Homo sapiens
gcacccaccgtggaggag

SEQ ID NO: 4568446 - DNA, 15 bp, Homo sapiens
gcacccagagcaccc

SEQ ID NO: 4568447 - DNA, 22 bp, Homo sapiens
gcacccagagcaccccctgctc

SEQ ID NO: 4568448 - DNA, 14 bp, Homo sapiens
gcacccagccctgg

SEQ ID NO: 4568449 - DNA, 13 bp, Homo sapiens
gcaccccacagct

SEQ ID NO: 4568450 - DNA, 15 bp, Homo sapiens
gcaccccactgggag

SEQ ID NO: 4568451 - DNA, 19 bp, Homo sapiens
gcaccccagcattccagct

SEQ ID NO: 4568452 - DNA, 23 bp, Homo sapiens
gcaccccctgctccaccagcagc

SEQ ID NO: 4568453 - DNA, 19 bp, Homo sapiens
gcacccctgagccagcagg

SEQ ID NO: 4568454 - DNA, 12 bp, Homo sapiens
gcaccccttctc

SEQ ID NO: 4568455 - DNA, 13 bp, Homo sapiens
gcacccgtcccca

SEQ ID NO: 4568456 - DNA, 16 bp, Homo sapiens
gcaccctcccccgcag

SEQ ID NO: 4568457 - DNA, 17 bp, Homo sapiens
gcaccctctcctggggg

SEQ ID NO: 4568458 - DNA, 12 bp, Homo sapiens
gcaccgccacgt

SEQ ID NO: 4568459 - DNA, 20 bp, Homo sapiens
gcaccgccacgtcccagcat

SEQ ID NO: 4568460 - DNA, 16 bp, Homo sapiens
gcaccgtgatggagag

SEQ ID NO: 4568461 - DNA, 24 bp, Homo sapiens
gcaccgtgatggagaggacagagc

SEQ ID NO: 4568462 - DNA, 19 bp, Homo sapiens
gcacctacagtgtacagtc

SEQ ID NO: 4568463 - DNA, 14 bp, Homo sapiens
gcacctacgggggc

SEQ ID NO: 4568464 - DNA, 16 bp, Homo sapiens
gcacctatctcagcca

SEQ ID NO: 4568465 - DNA, 17 bp, Homo sapiens
gcacctatctcagccat

SEQ ID NO: 4568466 - DNA, 14 bp, Homo sapiens
gcacctcctaccct

SEQ ID NO: 4568467 - DNA, 21 bp, Homo sapiens
gcacctcctaccctcccacca

SEQ ID NO: 4568468 - DNA, 15 bp, Homo sapiens
gcacctgcagcggct

SEQ ID NO: 4568469 - DNA, 15 bp, Homo sapiens
gcacctgtagtccca

SEQ ID NO: 4568470 - DNA, 16 bp, Homo sapiens
gcacctgtagtcccag

SEQ ID NO: 4568471 - DNA, 18 bp, Homo sapiens
gcacctgtagtcccagct

SEQ ID NO: 4568472 - DNA, 18 bp, Homo sapiens
gcaccttcccctgaggac

SEQ ID NO: 4568473 - DNA, 20 bp, Homo sapiens
gcaccttctttctggactgg

SEQ ID NO: 4568474 - DNA, 21 bp, Homo sapiens
gcaccttctttctggactggc

SEQ ID NO: 4568475 - DNA, 19 bp, Homo sapiens
gcacgaacccacctgctga

SEQ ID NO: 4568476 - DNA, 13 bp, Homo sapiens
gcacgacagtgga

SEQ ID NO: 4568477 - DNA, 13 bp, Homo sapiens
gcacgactgcggg

SEQ ID NO: 4568478 - DNA, 22 bp, Homo sapiens
gcacgactgcgggagccagact

SEQ ID NO: 4568479 - DNA, 15 bp, Homo sapiens
gcacgagcctgggcg

SEQ ID NO: 4568480 - DNA, 16 bp, Homo sapiens
gcacgattttgcacaa

SEQ ID NO: 4568481 - DNA, 13 bp, Homo sapiens
gcacgcctgctgg

SEQ ID NO: 4568482 - DNA, 12 bp, Homo sapiens
gcacggactctt

SEQ ID NO: 4568483 - DNA, 16 bp, Homo sapiens
gcacgggggagtgaga

SEQ ID NO: 4568484 - DNA, 20 bp, Homo sapiens
gcacgggggagtgagacagg

SEQ ID NO: 4568485 - DNA, 18 bp, Homo sapiens
gcacggtcccccaggagg

SEQ ID NO: 4568486 - DNA, 14 bp, Homo sapiens
gcacggtgggcctt

SEQ ID NO: 4568487 - DNA, 16 bp, Homo sapiens
gcacggtgggccttgc

SEQ ID NO: 4568488 - DNA, 20 bp, Homo sapiens
gcacggtgggccttgctggg

SEQ ID NO: 4568489 - DNA, 16 bp, Homo sapiens
gcacgtggggcccact

SEQ ID NO: 4568490 - DNA, 17 bp, Homo sapiens
gcacgtggggcccactg

SEQ ID NO: 4568491 - DNA, 17 bp, Homo sapiens
gcactaaagttagtaaa

SEQ ID NO: 4568492 - DNA, 19 bp, Homo sapiens
gcactaaggccgtgtctct

SEQ ID NO: 4568493 - DNA, 23 bp, Homo sapiens
gcactaaggccgtgtctctgagg

SEQ ID NO: 4568494 - DNA, 13 bp, Homo sapiens
gcactactcctct

SEQ ID NO: 4568495 - DNA, 17 bp, Homo sapiens
gcactactcctctgcag

SEQ ID NO: 4568496 - DNA, 16 bp, Homo sapiens
gcactactgggtgtca

SEQ ID NO: 4568497 - DNA, 20 bp, Homo sapiens
gcactagaagtggtttcctg

SEQ ID NO: 4568498 - DNA, 24 bp, Homo sapiens
gcactagactggtggcaggggctt

SEQ ID NO: 4568499 - DNA, 17 bp, Homo sapiens
gcactatgctttccttc

SEQ ID NO: 4568500 - DNA, 19 bp, Homo sapiens
gcactcagaagttgtgcta

SEQ ID NO: 4568501 - DNA, 18 bp, Homo sapiens
gcactcagtgagcctcct

SEQ ID NO: 4568502 - DNA, 20 bp, Homo sapiens
gcactcagtgagcctcctgt

SEQ ID NO: 4568503 - DNA, 22 bp, Homo sapiens
gcactccgcgccgatgccaccg

SEQ ID NO: 4568504 - DNA, 16 bp, Homo sapiens
gcactccggcctgggt

SEQ ID NO: 4568505 - DNA, 16 bp, Homo sapiens
gcactcctttatctgt

SEQ ID NO: 4568506 - DNA, 22 bp, Homo sapiens
gcactctctgccattctgtgca

SEQ ID NO: 4568507 - DNA, 23 bp, Homo sapiens
gcactctctgccattctgtgcag

SEQ ID NO: 4568508 - DNA, 22 bp, Homo sapiens
gcactctggatgatggattcca

SEQ ID NO: 4568509 - DNA, 17 bp, Homo sapiens
gcactctgtagcaaatt

SEQ ID NO: 4568510 - DNA, 12 bp, Homo sapiens
gcactgaacagg

SEQ ID NO: 4568511 - DNA, 19 bp, Homo sapiens
gcactgaaccttaggcttt

SEQ ID NO: 4568512 - DNA, 19 bp, Homo sapiens
gcactgaagagctcttggc

SEQ ID NO: 4568513 - DNA, 22 bp, Homo sapiens
gcactgagctcacatgggactg

SEQ ID NO: 4568514 - DNA, 11 bp, Homo sapiens
gcactgaggaa

SEQ ID NO: 4568515 - DNA, 17 bp, Homo sapiens
gcactgatctttgcaaa

SEQ ID NO: 4568516 - DNA, 17 bp, Homo sapiens
gcactgatgttgtgttt

SEQ ID NO: 4568517 - DNA, 19 bp, Homo sapiens
gcactgcatgtcagagcac

SEQ ID NO: 4568518 - DNA, 19 bp, Homo sapiens
gcactgcattcctgtgccc

SEQ ID NO: 4568519 - DNA, 20 bp, Homo sapiens
gcactgccccacatgcatgt

SEQ ID NO: 4568520 - DNA, 19 bp, Homo sapiens
gcactggcaaacagggcct

SEQ ID NO: 4568521 - DNA, 17 bp, Homo sapiens
gcactggccttctgatg

SEQ ID NO: 4568522 - DNA, 16 bp, Homo sapiens
gcactggcgaggagag

SEQ ID NO: 4568523 - DNA, 17 bp, Homo sapiens
gcactggcggtcaagtg

SEQ ID NO: 4568524 - DNA, 15 bp, Homo sapiens
gcactggggcagggg

SEQ ID NO: 4568525 - DNA, 20 bp, Homo sapiens
gcactggtgtgaactcaccc

SEQ ID NO: 4568526 - DNA, 14 bp, Homo sapiens
gcactgtaaatatc

SEQ ID NO: 4568527 - DNA, 15 bp, Homo sapiens
gcactgtcaagatga

SEQ ID NO: 4568528 - DNA, 16 bp, Homo sapiens
gcactgtgatacagtt

SEQ ID NO: 4568529 - DNA, 19 bp, Homo sapiens
gcactgtgatacagttttg

SEQ ID NO: 4568530 - DNA, 12 bp, Homo sapiens
gcactgtgccaa

SEQ ID NO: 4568531 - DNA, 18 bp, Homo sapiens
gcactgtgccaagattta

SEQ ID NO: 4568532 - DNA, 15 bp, Homo sapiens
gcactgttccccctg

SEQ ID NO: 4568533 - DNA, 23 bp, Homo sapiens
gcactgtttgcatgcgcccgagg

SEQ ID NO: 4568534 - DNA, 18 bp, Homo sapiens
gcacttaaacagaagcag

SEQ ID NO: 4568535 - DNA, 21 bp, Homo sapiens
gcacttaaacagaagcagagg

SEQ ID NO: 4568536 - DNA, 16 bp, Homo sapiens
gcacttagacctgcca

SEQ ID NO: 4568537 - DNA, 17 bp, Homo sapiens
gcacttagacctgccag

SEQ ID NO: 4568538 - DNA, 20 bp, Homo sapiens
gcacttagacctgccagcca

SEQ ID NO: 4568539 - DNA, 23 bp, Homo sapiens
gcacttagacctgccagccactg

SEQ ID NO: 4568540 - DNA, 16 bp, Homo sapiens
gcacttattgtaaatt

SEQ ID NO: 4568541 - DNA, 12 bp, Homo sapiens
gcacttctagaa

SEQ ID NO: 4568542 - DNA, 13 bp, Homo sapiens
gcacttctagaat

SEQ ID NO: 4568543 - DNA, 16 bp, Homo sapiens
gcacttctgctgcatc

SEQ ID NO: 4568544 - DNA, 22 bp, Homo sapiens
gcacttgagaaccagtctcctc

SEQ ID NO: 4568545 - DNA, 21 bp, Homo sapiens
gcactttcattgccagtgtct

SEQ ID NO: 4568546 - DNA, 16 bp, Homo sapiens
gcactttccaatgcca

SEQ ID NO: 4568547 - DNA, 18 bp, Homo sapiens
gcactttccaatgccaca

SEQ ID NO: 4568548 - DNA, 21 bp, Homo sapiens
gcactttccaatgccacagac

SEQ ID NO: 4568549 - DNA, 16 bp, Homo sapiens
gcactttgagaggctg

SEQ ID NO: 4568550 - DNA, 19 bp, Homo sapiens
gcactttgagaggctgagg

SEQ ID NO: 4568551 - DNA, 15 bp, Homo sapiens
gcactttgatgtcat

SEQ ID NO: 4568552 - DNA, 21 bp, Homo sapiens
gcactttgatgtcatgtgttc

SEQ ID NO: 4568553 - DNA, 22 bp, Homo sapiens
gcactttgggaggccgaggcgg

SEQ ID NO: 4568554 - DNA, 18 bp, Homo sapiens
gcacttttattttcattg

SEQ ID NO: 4568555 - DNA, 20 bp, Homo sapiens
gcacttttttgtttgaatgt

SEQ ID NO: 4568556 - DNA, 15 bp, Homo sapiens
gcagaaaagcacctg

SEQ ID NO: 4568557 - DNA, 18 bp, Homo sapiens
gcagaaaagcacctgccg

SEQ ID NO: 4568558 - DNA, 20 bp, Homo sapiens
gcagaaaagcacctgccgac

SEQ ID NO: 4568559 - DNA, 15 bp, Homo sapiens
gcagaacactaacct

SEQ ID NO: 4568560 - DNA, 16 bp, Homo sapiens
gcagaacactgcagtc

SEQ ID NO: 4568561 - DNA, 19 bp, Homo sapiens
gcagaacccaccaaccaga

SEQ ID NO: 4568562 - DNA, 14 bp, Homo sapiens
gcagaagacagtat

SEQ ID NO: 4568563 - DNA, 18 bp, Homo sapiens
gcagaaggagagtgagtg

SEQ ID NO: 4568564 - DNA, 13 bp, Homo sapiens
gcagaagggaatt

SEQ ID NO: 4568565 - DNA, 14 bp, Homo sapiens
gcagaattcattca

SEQ ID NO: 4568566 - DNA, 21 bp, Homo sapiens
gcagacaacaccttcctcctg

SEQ ID NO: 4568567 - DNA, 24 bp, Homo sapiens
gcagacaacaccttcctcctgcag

SEQ ID NO: 4568568 - DNA, 13 bp, Homo sapiens
gcagacaagaggg

SEQ ID NO: 4568569 - DNA, 22 bp, Homo sapiens
gcagacaagagggcaagcctct

SEQ ID NO: 4568570 - DNA, 23 bp, Homo sapiens
gcagacaagagggcaagcctcta

SEQ ID NO: 4568571 - DNA, 17 bp, Homo sapiens
gcagacaataaaccctc

SEQ ID NO: 4568572 - DNA, 21 bp, Homo sapiens
gcagacaataaaccctcagag

SEQ ID NO: 4568573 - DNA, 18 bp, Homo sapiens
gcagacacctaaccccag

SEQ ID NO: 4568574 - DNA, 17 bp, Homo sapiens
gcagacattttaaaaaa

SEQ ID NO: 4568575 - DNA, 17 bp, Homo sapiens
gcagaccagcacttcaa

SEQ ID NO: 4568576 - DNA, 20 bp, Homo sapiens
gcagaccattggggctccca

SEQ ID NO: 4568577 - DNA, 14 bp, Homo sapiens
gcagacctgtcctc

SEQ ID NO: 4568578 - DNA, 19 bp, Homo sapiens
gcagacggtctgtgtgctg

SEQ ID NO: 4568579 - DNA, 13 bp, Homo sapiens
gcagactcctcca

SEQ ID NO: 4568580 - DNA, 17 bp, Homo sapiens
gcagactcctccacgtg

SEQ ID NO: 4568581 - DNA, 19 bp, Homo sapiens
gcagactggcggagaagga

SEQ ID NO: 4568582 - DNA, 22 bp, Homo sapiens
gcagactggcggagaaggagag

SEQ ID NO: 4568583 - DNA, 23 bp, Homo sapiens
gcagactggcggagaaggagagg

SEQ ID NO: 4568584 - DNA, 17 bp, Homo sapiens
gcagactgtgaacttga

SEQ ID NO: 4568585 - DNA, 15 bp, Homo sapiens
gcagacttcccagct

SEQ ID NO: 4568586 - DNA, 13 bp, Homo sapiens
gcagagaaagaaa

SEQ ID NO: 4568587 - DNA, 18 bp, Homo sapiens
gcagagagccctgggtga

SEQ ID NO: 4568588 - DNA, 17 bp, Homo sapiens
gcagagccagggcaggg

SEQ ID NO: 4568589 - DNA, 14 bp, Homo sapiens
gcagagccttctca

SEQ ID NO: 4568590 - DNA, 23 bp, Homo sapiens
gcagagccttctcagaagcacag

SEQ ID NO: 4568591 - DNA, 22 bp, Homo sapiens
gcagaggacagtctggagaagg

SEQ ID NO: 4568592 - DNA, 10 bp, Homo sapiens
gcagaggccc

SEQ ID NO: 4568593 - DNA, 19 bp, Homo sapiens
gcagaggccctgcccccac

SEQ ID NO: 4568594 - DNA, 16 bp, Homo sapiens
gcagagggcagaggct

SEQ ID NO: 4568595 - DNA, 19 bp, Homo sapiens
gcagagggcagaggctgga

SEQ ID NO: 4568596 - DNA, 16 bp, Homo sapiens
gcagagggctggaggc

SEQ ID NO: 4568597 - DNA, 19 bp, Homo sapiens
gcagagggctggaggccca

SEQ ID NO: 4568598 - DNA, 23 bp, Homo sapiens
gcagaggggcgttctcccaaaga

SEQ ID NO: 4568599 - DNA, 18 bp, Homo sapiens
gcagagggggagtagcca

SEQ ID NO: 4568600 - DNA, 23 bp, Homo sapiens
gcagagggggagtagccaagctg

SEQ ID NO: 4568601 - DNA, 14 bp, Homo sapiens
gcagaggtggaaaa

SEQ ID NO: 4568602 - DNA, 23 bp, Homo sapiens
gcagaggttgcagtgagccgaga

SEQ ID NO: 4568603 - DNA, 21 bp, Homo sapiens
gcagaggttgcagtgagctga

SEQ ID NO: 4568604 - DNA, 16 bp, Homo sapiens
gcagagtaacaggatc

SEQ ID NO: 4568605 - DNA, 21 bp, Homo sapiens
gcagagttaaatctcaaatag

SEQ ID NO: 4568606 - DNA, 14 bp, Homo sapiens
gcagataaaatatt

SEQ ID NO: 4568607 - DNA, 18 bp, Homo sapiens
gcagataaacagtagtga

SEQ ID NO: 4568608 - DNA, 19 bp, Homo sapiens
gcagatctacatgtctaga

SEQ ID NO: 4568609 - DNA, 17 bp, Homo sapiens
gcagatgtcttccctgg

SEQ ID NO: 4568610 - DNA, 18 bp, Homo sapiens
gcagatgtcttccctggg

SEQ ID NO: 4568611 - DNA, 20 bp, Homo sapiens
gcagatgtcttccctgggct

SEQ ID NO: 4568612 - DNA, 15 bp, Homo sapiens
gcagattacactgat

SEQ ID NO: 4568613 - DNA, 23 bp, Homo sapiens
gcagattctgagcaaaggccctg

SEQ ID NO: 4568614 - DNA, 20 bp, Homo sapiens
gcagatttagtgaaagctag

SEQ ID NO: 4568615 - DNA, 21 bp, Homo sapiens
gcagattttcagcaaactctt

SEQ ID NO: 4568616 - DNA, 23 bp, Homo sapiens
gcagatttttatattagttgctt

SEQ ID NO: 4568617 - DNA, 14 bp, Homo sapiens
gcagcaaattttca

SEQ ID NO: 4568618 - DNA, 13 bp, Homo sapiens
gcagcaactccca

SEQ ID NO: 4568619 - DNA, 14 bp, Homo sapiens
gcagcaactcccac

SEQ ID NO: 4568620 - DNA, 20 bp, Homo sapiens
gcagcaagttcatacaacat

SEQ ID NO: 4568621 - DNA, 20 bp, Homo sapiens
gcagcaatattttgtatatt

SEQ ID NO: 4568622 - DNA, 13 bp, Homo sapiens
gcagcaccctccc

SEQ ID NO: 4568623 - DNA, 21 bp, Homo sapiens
gcagcactccgcatcacctca

SEQ ID NO: 4568624 - DNA, 21 bp, Homo sapiens
gcagcacttagacctgccagc

SEQ ID NO: 4568625 - DNA, 23 bp, Homo sapiens
gcagcacttagacctgccagcca

SEQ ID NO: 4568626 - DNA, 13 bp, Homo sapiens
gcagcagaagggg

SEQ ID NO: 4568627 - DNA, 17 bp, Homo sapiens
gcagcagagagccctgg

SEQ ID NO: 4568628 - DNA, 18 bp, Homo sapiens
gcagcagataactttttt

SEQ ID NO: 4568629 - DNA, 15 bp, Homo sapiens
gcagcagcaccaacc

SEQ ID NO: 4568630 - DNA, 14 bp, Homo sapiens
gcagcagcctgcac

SEQ ID NO: 4568631 - DNA, 19 bp, Homo sapiens
gcagcagcctgcacctgcc

SEQ ID NO: 4568632 - DNA, 19 bp, Homo sapiens
gcagcagctctgagccaga

SEQ ID NO: 4568633 - DNA, 17 bp, Homo sapiens
gcagcagcttggggaga

SEQ ID NO: 4568634 - DNA, 16 bp, Homo sapiens
gcagcaggaaggaaca

SEQ ID NO: 4568635 - DNA, 21 bp, Homo sapiens
gcagcaggaaggaacaaagac

SEQ ID NO: 4568636 - DNA, 23 bp, Homo sapiens
gcagcaggcctctggttgcctcc

SEQ ID NO: 4568637 - DNA, 16 bp, Homo sapiens
gcagcaggctcaggca

SEQ ID NO: 4568638 - DNA, 22 bp, Homo sapiens
gcagcagggaaggcccaactgg

SEQ ID NO: 4568639 - DNA, 12 bp, Homo sapiens
gcagcagggcta

SEQ ID NO: 4568640 - DNA, 17 bp, Homo sapiens
gcagcagggctaccctg

SEQ ID NO: 4568641 - DNA, 18 bp, Homo sapiens
gcagcaggtagcctgctg

SEQ ID NO: 4568642 - DNA, 22 bp, Homo sapiens
gcagcagtcgcccaagcagaca

SEQ ID NO: 4568643 - DNA, 18 bp, Homo sapiens
gcagcagtgtccagagac

SEQ ID NO: 4568644 - DNA, 23 bp, Homo sapiens
gcagcatcggacaagacccccag

SEQ ID NO: 4568645 - DNA, 22 bp, Homo sapiens
gcagcattcccagggaccttgg

SEQ ID NO: 4568646 - DNA, 20 bp, Homo sapiens
gcagccaagtagcctctcct

SEQ ID NO: 4568647 - DNA, 15 bp, Homo sapiens
gcagccacaccactg

SEQ ID NO: 4568648 - DNA, 11 bp, Homo sapiens
gcagccaccca

SEQ ID NO: 4568649 - DNA, 19 bp, Homo sapiens
gcagccagaccagcaggct

SEQ ID NO: 4568650 - DNA, 12 bp, Homo sapiens
gcagccagcaga

SEQ ID NO: 4568651 - DNA, 21 bp, Homo sapiens
gcagccagcccagcccagctg

SEQ ID NO: 4568652 - DNA, 14 bp, Homo sapiens
gcagccagccgtgg

SEQ ID NO: 4568653 - DNA, 15 bp, Homo sapiens
gcagccagggctggg

SEQ ID NO: 4568654 - DNA, 17 bp, Homo sapiens
gcagccagggctggggt

SEQ ID NO: 4568655 - DNA, 15 bp, Homo sapiens
gcagcccatgcccac

SEQ ID NO: 4568656 - DNA, 13 bp, Homo sapiens
gcagccccacttc

SEQ ID NO: 4568657 - DNA, 14 bp, Homo sapiens
gcagccccaggaga

SEQ ID NO: 4568658 - DNA, 15 bp, Homo sapiens
gcagccccaggagaa

SEQ ID NO: 4568659 - DNA, 16 bp, Homo sapiens
gcagccccaggagaag

SEQ ID NO: 4568660 - DNA, 16 bp, Homo sapiens
gcagccccccagcact

SEQ ID NO: 4568661 - DNA, 19 bp, Homo sapiens
gcagcccgcctgccgtgca

SEQ ID NO: 4568662 - DNA, 23 bp, Homo sapiens
gcagcccgcctgccgtgcatggc

SEQ ID NO: 4568663 - DNA, 22 bp, Homo sapiens
gcagcccgtcctctctcttggg

SEQ ID NO: 4568664 - DNA, 13 bp, Homo sapiens
gcagccctagagc

SEQ ID NO: 4568665 - DNA, 18 bp, Homo sapiens
gcagccctcctcaccccg

SEQ ID NO: 4568666 - DNA, 14 bp, Homo sapiens
gcagccctggcccc

SEQ ID NO: 4568667 - DNA, 17 bp, Homo sapiens
gcagccctggcccccat

SEQ ID NO: 4568668 - DNA, 16 bp, Homo sapiens
gcagccgctgagcgag

SEQ ID NO: 4568669 - DNA, 21 bp, Homo sapiens
gcagcctcatactcctgggct

SEQ ID NO: 4568670 - DNA, 14 bp, Homo sapiens
gcagcctccagggc

SEQ ID NO: 4568671 - DNA, 12 bp, Homo sapiens
gcagcctctgga

SEQ ID NO: 4568672 - DNA, 20 bp, Homo sapiens
gcagcctctggacagccagt

SEQ ID NO: 4568673 - DNA, 16 bp, Homo sapiens
gcagcctgcacctgcc

SEQ ID NO: 4568674 - DNA, 17 bp, Homo sapiens
gcagcctgcacctgccc

SEQ ID NO: 4568675 - DNA, 22 bp, Homo sapiens
gcagcctgtggcatctttgcct

SEQ ID NO: 4568676 - DNA, 15 bp, Homo sapiens
gcagcgaccacccct

SEQ ID NO: 4568677 - DNA, 12 bp, Homo sapiens
gcagcggctcct

SEQ ID NO: 4568678 - DNA, 13 bp, Homo sapiens
gcagcggctcctg

SEQ ID NO: 4568679 - DNA, 16 bp, Homo sapiens
gcagcgtgtgggtccc

SEQ ID NO: 4568680 - DNA, 20 bp, Homo sapiens
gcagcgtgtgggtcccgcac

SEQ ID NO: 4568681 - DNA, 13 bp, Homo sapiens
gcagctactggaa

SEQ ID NO: 4568682 - DNA, 14 bp, Homo sapiens
gcagctactggaat

SEQ ID NO: 4568683 - DNA, 15 bp, Homo sapiens
gcagctagtgccttt

SEQ ID NO: 4568684 - DNA, 22 bp, Homo sapiens
gcagctatgcgcaatgtggcat

SEQ ID NO: 4568685 - DNA, 16 bp, Homo sapiens
gcagctcactacccta

SEQ ID NO: 4568686 - DNA, 18 bp, Homo sapiens
gcagctccctttctcagg

SEQ ID NO: 4568687 - DNA, 19 bp, Homo sapiens
gcagctccctttctcagga

SEQ ID NO: 4568688 - DNA, 13 bp, Homo sapiens
gcagctctgagcc

SEQ ID NO: 4568689 - DNA, 14 bp, Homo sapiens
gcagctgagagccc

SEQ ID NO: 4568690 - DNA, 15 bp, Homo sapiens
gcagctgagagccct

SEQ ID NO: 4568691 - DNA, 21 bp, Homo sapiens
gcagctgagagccctgctgtg

SEQ ID NO: 4568692 - DNA, 23 bp, Homo sapiens
gcagctgagagccctgctgtggg

SEQ ID NO: 4568693 - DNA, 15 bp, Homo sapiens
gcagctgagcctgag

SEQ ID NO: 4568694 - DNA, 13 bp, Homo sapiens
gcagctgcctctg

SEQ ID NO: 4568695 - DNA, 15 bp, Homo sapiens
gcagctgcctctgct

SEQ ID NO: 4568696 - DNA, 13 bp, Homo sapiens
gcagctgctgtct

SEQ ID NO: 4568697 - DNA, 19 bp, Homo sapiens
gcagctgctgtctgagtag

SEQ ID NO: 4568698 - DNA, 13 bp, Homo sapiens
gcagctgctgtgg

SEQ ID NO: 4568699 - DNA, 20 bp, Homo sapiens
gcagctggaatgtgccacag

SEQ ID NO: 4568700 - DNA, 15 bp, Homo sapiens
gcagctgggcccaac

SEQ ID NO: 4568701 - DNA, 16 bp, Homo sapiens
gcagctgggcccaacc

SEQ ID NO: 4568702 - DNA, 19 bp, Homo sapiens
gcagctgggcccaaccctg

SEQ ID NO: 4568703 - DNA, 23 bp, Homo sapiens
gcagctgggcccaaccctgtctg

SEQ ID NO: 4568704 - DNA, 18 bp, Homo sapiens
gcagctgtcctgtgatgt

SEQ ID NO: 4568705 - DNA, 20 bp, Homo sapiens
gcagctgtcctgtgatgtca

SEQ ID NO: 4568706 - DNA, 15 bp, Homo sapiens
gcagcttattcacaa

SEQ ID NO: 4568707 - DNA, 17 bp, Homo sapiens
gcagcttcctgtctgtt

SEQ ID NO: 4568708 - DNA, 16 bp, Homo sapiens
gcagcttcgaggacag

SEQ ID NO: 4568709 - DNA, 19 bp, Homo sapiens
gcagcttcgaggacaggaa

SEQ ID NO: 4568710 - DNA, 17 bp, Homo sapiens
gcagcttctactcctgc

SEQ ID NO: 4568711 - DNA, 12 bp, Homo sapiens
gcaggaaaaaag

SEQ ID NO: 4568712 - DNA, 22 bp, Homo sapiens
gcaggaaagcatgcattgaaaa

SEQ ID NO: 4568713 - DNA, 16 bp, Homo sapiens
gcaggaacaaacaggg

SEQ ID NO: 4568714 - DNA, 18 bp, Homo sapiens
gcaggaactgggctgggc

SEQ ID NO: 4568715 - DNA, 20 bp, Homo sapiens
gcaggaactgggctgggcct

SEQ ID NO: 4568716 - DNA, 13 bp, Homo sapiens
gcaggaaggagag

SEQ ID NO: 4568717 - DNA, 21 bp, Homo sapiens
gcaggaatcacccctctgccc

SEQ ID NO: 4568718 - DNA, 17 bp, Homo sapiens
gcaggaatgtgtggcag

SEQ ID NO: 4568719 - DNA, 15 bp, Homo sapiens
gcaggacagctcctg

SEQ ID NO: 4568720 - DNA, 17 bp, Homo sapiens
gcaggacgaaaaagagg

SEQ ID NO: 4568721 - DNA, 17 bp, Homo sapiens
gcaggactccaggccca

SEQ ID NO: 4568722 - DNA, 19 bp, Homo sapiens
gcaggactgcacagcgtcc

SEQ ID NO: 4568723 - DNA, 22 bp, Homo sapiens
gcaggagagactgagcagccgc

SEQ ID NO: 4568724 - DNA, 14 bp, Homo sapiens
gcaggagccccgcc

SEQ ID NO: 4568725 - DNA, 22 bp, Homo sapiens
gcaggagcttctgggagatttt

SEQ ID NO: 4568726 - DNA, 17 bp, Homo sapiens
gcaggagcttgggtctc

SEQ ID NO: 4568727 - DNA, 18 bp, Homo sapiens
gcaggaggatcacttgag

SEQ ID NO: 4568728 - DNA, 14 bp, Homo sapiens
gcaggagggcagat

SEQ ID NO: 4568729 - DNA, 15 bp, Homo sapiens
gcaggagtgtcctgc

SEQ ID NO: 4568730 - DNA, 17 bp, Homo sapiens
gcaggagtgtcctgccc

SEQ ID NO: 4568731 - DNA, 21 bp, Homo sapiens
gcaggagtgtcctgcccatgc

SEQ ID NO: 4568732 - DNA, 20 bp, Homo sapiens
gcaggagtgtcctggctgtg

SEQ ID NO: 4568733 - DNA, 14 bp, Homo sapiens
gcaggatctgtctg

SEQ ID NO: 4568734 - DNA, 14 bp, Homo sapiens
gcaggatggccttt

SEQ ID NO: 4568735 - DNA, 15 bp, Homo sapiens
gcaggcaagggctct

SEQ ID NO: 4568736 - DNA, 16 bp, Homo sapiens
gcaggcacacagcagc

SEQ ID NO: 4568737 - DNA, 19 bp, Homo sapiens
gcaggcacacagcagcccc

SEQ ID NO: 4568738 - DNA, 23 bp, Homo sapiens
gcaggcaccgccacgtcccagca

SEQ ID NO: 4568739 - DNA, 23 bp, Homo sapiens
gcaggcatcggggagccgggagc

SEQ ID NO: 4568740 - DNA, 18 bp, Homo sapiens
gcaggccagatggcccct

SEQ ID NO: 4568741 - DNA, 18 bp, Homo sapiens
gcaggcctgtccctggga

SEQ ID NO: 4568742 - DNA, 14 bp, Homo sapiens
gcaggctcactgcc

SEQ ID NO: 4568743 - DNA, 15 bp, Homo sapiens
gcaggctcactgcca

SEQ ID NO: 4568744 - DNA, 14 bp, Homo sapiens
gcaggctgcagtgg

SEQ ID NO: 4568745 - DNA, 19 bp, Homo sapiens
gcaggctgcagtggctccc

SEQ ID NO: 4568746 - DNA, 10 bp, Homo sapiens
gcaggctggg

SEQ ID NO: 4568747 - DNA, 14 bp, Homo sapiens
gcaggctgggccat

SEQ ID NO: 4568748 - DNA, 21 bp, Homo sapiens
gcagggaaaattatttgcata

SEQ ID NO: 4568749 - DNA, 15 bp, Homo sapiens
gcagggaatgcagca

SEQ ID NO: 4568750 - DNA, 16 bp, Homo sapiens
gcagggaatgcagcag

SEQ ID NO: 4568751 - DNA, 21 bp, Homo sapiens
gcagggagcatggctgtgagg

SEQ ID NO: 4568752 - DNA, 17 bp, Homo sapiens
gcagggagggcttgggg

SEQ ID NO: 4568753 - DNA, 14 bp, Homo sapiens
gcagggaggggagg

SEQ ID NO: 4568754 - DNA, 19 bp, Homo sapiens
gcagggccaggcctctgct

SEQ ID NO: 4568755 - DNA, 21 bp, Homo sapiens
gcagggcccccaataaaccag

SEQ ID NO: 4568756 - DNA, 17 bp, Homo sapiens
gcagggcctggctccag

SEQ ID NO: 4568757 - DNA, 19 bp, Homo sapiens
gcagggcctggctccagtc

SEQ ID NO: 4568758 - DNA, 15 bp, Homo sapiens
gcagggcgagctgca

SEQ ID NO: 4568759 - DNA, 18 bp, Homo sapiens
gcagggcgagctgcagga

SEQ ID NO: 4568760 - DNA, 21 bp, Homo sapiens
gcagggcgccaagtctggcac

SEQ ID NO: 4568761 - DNA, 17 bp, Homo sapiens
gcagggcgggcagaggg

SEQ ID NO: 4568762 - DNA, 21 bp, Homo sapiens
gcagggctaccctgagctgag

SEQ ID NO: 4568763 - DNA, 16 bp, Homo sapiens
gcagggctctcccgtg

SEQ ID NO: 4568764 - DNA, 13 bp, Homo sapiens
gcagggctggtct

SEQ ID NO: 4568765 - DNA, 20 bp, Homo sapiens
gcaggggaattccctccccc

SEQ ID NO: 4568766 - DNA, 14 bp, Homo sapiens
gcaggggcccctgg

SEQ ID NO: 4568767 - DNA, 16 bp, Homo sapiens
gcaggggcccctgggg

SEQ ID NO: 4568768 - DNA, 15 bp, Homo sapiens
gcagggtgggatgga

SEQ ID NO: 4568769 - DNA, 23 bp, Homo sapiens
gcagggtgggtgagctctcaggc

SEQ ID NO: 4568770 - DNA, 13 bp, Homo sapiens
gcaggtcacagaa

SEQ ID NO: 4568771 - DNA, 14 bp, Homo sapiens
gcaggtcacagaaa

SEQ ID NO: 4568772 - DNA, 17 bp, Homo sapiens
gcaggtggacgctgcag

SEQ ID NO: 4568773 - DNA, 17 bp, Homo sapiens
gcaggtgggctggactt

SEQ ID NO: 4568774 - DNA, 12 bp, Homo sapiens
gcaggttcccac

SEQ ID NO: 4568775 - DNA, 16 bp, Homo sapiens
gcaggtttcatttctt

SEQ ID NO: 4568776 - DNA, 18 bp, Homo sapiens
gcaggtttcatttcttat

SEQ ID NO: 4568777 - DNA, 20 bp, Homo sapiens
gcaggtttgttttcagcact

SEQ ID NO: 4568778 - DNA, 15 bp, Homo sapiens
gcagtaaaacacatt

SEQ ID NO: 4568779 - DNA, 16 bp, Homo sapiens
gcagtaaaacacattt

SEQ ID NO: 4568780 - DNA, 14 bp, Homo sapiens
gcagtaaagagaaa

SEQ ID NO: 4568781 - DNA, 21 bp, Homo sapiens
gcagtaatctgtcagtgtttg

SEQ ID NO: 4568782 - DNA, 23 bp, Homo sapiens
gcagtaatctgtcagtgtttgta

SEQ ID NO: 4568783 - DNA, 23 bp, Homo sapiens
gcagtaccctccattgggcacag

SEQ ID NO: 4568784 - DNA, 13 bp, Homo sapiens
gcagtagcctcct

SEQ ID NO: 4568785 - DNA, 12 bp, Homo sapiens
gcagtatatttc

SEQ ID NO: 4568786 - DNA, 13 bp, Homo sapiens
gcagtattgagca

SEQ ID NO: 4568787 - DNA, 18 bp, Homo sapiens
gcagtcacatcacaatat

SEQ ID NO: 4568788 - DNA, 17 bp, Homo sapiens
gcagtcacatctcttcc

SEQ ID NO: 4568789 - DNA, 13 bp, Homo sapiens
gcagtcagagtcc

SEQ ID NO: 4568790 - DNA, 15 bp, Homo sapiens
gcagtcagagtccag

SEQ ID NO: 4568791 - DNA, 14 bp, Homo sapiens
gcagtcatctactt

SEQ ID NO: 4568792 - DNA, 17 bp, Homo sapiens
gcagtcatctacttttt

SEQ ID NO: 4568793 - DNA, 20 bp, Homo sapiens
gcagtccaggcctctctctg

SEQ ID NO: 4568794 - DNA, 23 bp, Homo sapiens
gcagtccaggcctctctctgctc

SEQ ID NO: 4568795 - DNA, 14 bp, Homo sapiens
gcagtccatgcatg

SEQ ID NO: 4568796 - DNA, 15 bp, Homo sapiens
gcagtcgcctgcctg

SEQ ID NO: 4568797 - DNA, 23 bp, Homo sapiens
gcagtcgcctgcctgcagcaggc

SEQ ID NO: 4568798 - DNA, 15 bp, Homo sapiens
gcagtctccccttcc

SEQ ID NO: 4568799 - DNA, 17 bp, Homo sapiens
gcagtctccccttcctg

SEQ ID NO: 4568800 - DNA, 18 bp, Homo sapiens
gcagtctccccttcctgg

SEQ ID NO: 4568801 - DNA, 20 bp, Homo sapiens
gcagtctccccttcctggca

SEQ ID NO: 4568802 - DNA, 21 bp, Homo sapiens
gcagtctccccttcctggcac

SEQ ID NO: 4568803 - DNA, 22 bp, Homo sapiens
gcagtctcctctttaaaacaaa

SEQ ID NO: 4568804 - DNA, 17 bp, Homo sapiens
gcagtctgataaactga

SEQ ID NO: 4568805 - DNA, 16 bp, Homo sapiens
gcagtctgctctgctg

SEQ ID NO: 4568806 - DNA, 14 bp, Homo sapiens
gcagtcttgctctg

SEQ ID NO: 4568807 - DNA, 21 bp, Homo sapiens
gcagtgagccgcatcttctcc

SEQ ID NO: 4568808 - DNA, 13 bp, Homo sapiens
gcagtgccccagg

SEQ ID NO: 4568809 - DNA, 22 bp, Homo sapiens
gcagtggactcagaaagccaac

SEQ ID NO: 4568810 - DNA, 12 bp, Homo sapiens
gcagtggcctta

SEQ ID NO: 4568811 - DNA, 16 bp, Homo sapiens
gcagtggctcccctgc

SEQ ID NO: 4568812 - DNA, 18 bp, Homo sapiens
gcagtgtctgtgttttga

SEQ ID NO: 4568813 - DNA, 15 bp, Homo sapiens
gcagtgtgaggccag

SEQ ID NO: 4568814 - DNA, 23 bp, Homo sapiens
gcagtgtggagaccctgccacag

SEQ ID NO: 4568815 - DNA, 17 bp, Homo sapiens
gcagttcagcaccaccc

SEQ ID NO: 4568816 - DNA, 21 bp, Homo sapiens
gcagttctcctgcctcagcct

SEQ ID NO: 4568817 - DNA, 19 bp, Homo sapiens
gcagttctgcaaatagaaa

SEQ ID NO: 4568818 - DNA, 15 bp, Homo sapiens
gcagttgaaaagact

SEQ ID NO: 4568819 - DNA, 16 bp, Homo sapiens
gcagttgaaaagactc

SEQ ID NO: 4568820 - DNA, 19 bp, Homo sapiens
gcagttgaaaagactccaa

SEQ ID NO: 4568821 - DNA, 19 bp, Homo sapiens
gcagttgattccttgagtt

SEQ ID NO: 4568822 - DNA, 17 bp, Homo sapiens
gcagttgtgtggcccag

SEQ ID NO: 4568823 - DNA, 14 bp, Homo sapiens
gcagtttatcattc

SEQ ID NO: 4568824 - DNA, 20 bp, Homo sapiens
gcagtttcattcaacacatt

SEQ ID NO: 4568825 - DNA, 18 bp, Homo sapiens
gcagtttgaaattctgaa

SEQ ID NO: 4568826 - DNA, 13 bp, Homo sapiens
gcagtttgcaaaa

SEQ ID NO: 4568827 - DNA, 16 bp, Homo sapiens
gcagtttgcaaaaaat

SEQ ID NO: 4568828 - DNA, 13 bp, Homo sapiens
gcataaaacctaa

SEQ ID NO: 4568829 - DNA, 19 bp, Homo sapiens
gcataaagctcaaatgaaa

SEQ ID NO: 4568830 - DNA, 14 bp, Homo sapiens
gcataacctgtctc

SEQ ID NO: 4568831 - DNA, 19 bp, Homo sapiens
gcataataagccatggctg

SEQ ID NO: 4568832 - DNA, 17 bp, Homo sapiens
gcataatctgaaaacat

SEQ ID NO: 4568833 - DNA, 13 bp, Homo sapiens
gcataatgctttg

SEQ ID NO: 4568834 - DNA, 16 bp, Homo sapiens
gcataatgctttggaa

SEQ ID NO: 4568835 - DNA, 18 bp, Homo sapiens
gcataatgctttggaaaa

SEQ ID NO: 4568836 - DNA, 11 bp, Homo sapiens
gcatacaaaat

SEQ ID NO: 4568837 - DNA, 14 bp, Homo sapiens
gcatacaaaatatt

SEQ ID NO: 4568838 - DNA, 16 bp, Homo sapiens
gcatacaaaatattta

SEQ ID NO: 4568839 - DNA, 18 bp, Homo sapiens
gcatacctcctatgggtt

SEQ ID NO: 4568840 - DNA, 18 bp, Homo sapiens
gcatactgagaatataca

SEQ ID NO: 4568841 - DNA, 14 bp, Homo sapiens
gcatactttgtaaa

SEQ ID NO: 4568842 - DNA, 16 bp, Homo sapiens
gcatactttgtaaata

SEQ ID NO: 4568843 - DNA, 13 bp, Homo sapiens
gcatactttttaa

SEQ ID NO: 4568844 - DNA, 19 bp, Homo sapiens
gcatagcacccgtggtgca

SEQ ID NO: 4568845 - DNA, 17 bp, Homo sapiens
gcatagctacaatttgt

SEQ ID NO: 4568846 - DNA, 22 bp, Homo sapiens
gcatagctactaaaatcagtga

SEQ ID NO: 4568847 - DNA, 14 bp, Homo sapiens
gcatagctctgggg

SEQ ID NO: 4568848 - DNA, 14 bp, Homo sapiens
gcatagtccccaga

SEQ ID NO: 4568849 - DNA, 16 bp, Homo sapiens
gcatagtccccagagc

SEQ ID NO: 4568850 - DNA, 16 bp, Homo sapiens
gcatataaatgtttat

SEQ ID NO: 4568851 - DNA, 18 bp, Homo sapiens
gcatatgttgaatacttt

SEQ ID NO: 4568852 - DNA, 21 bp, Homo sapiens
gcatattccctgcacacacat

SEQ ID NO: 4568853 - DNA, 21 bp, Homo sapiens
gcatattgaaaagcacagagg

SEQ ID NO: 4568854 - DNA, 14 bp, Homo sapiens
gcatatttagctgt

SEQ ID NO: 4568855 - DNA, 22 bp, Homo sapiens
gcatatttattgcattgctggt

SEQ ID NO: 4568856 - DNA, 23 bp, Homo sapiens
gcatcaagaggtgggagggccct

SEQ ID NO: 4568857 - DNA, 13 bp, Homo sapiens
gcatcaatacaac

SEQ ID NO: 4568858 - DNA, 19 bp, Homo sapiens
gcatcacactcaaggacag

SEQ ID NO: 4568859 - DNA, 23 bp, Homo sapiens
gcatcacactcaaggacaggagc

SEQ ID NO: 4568860 - DNA, 18 bp, Homo sapiens
gcatcacacttatatttt

SEQ ID NO: 4568861 - DNA, 12 bp, Homo sapiens
gcatcagctgct

SEQ ID NO: 4568862 - DNA, 23 bp, Homo sapiens
gcatcagctgctgaaacaacaaa

SEQ ID NO: 4568863 - DNA, 16 bp, Homo sapiens
gcatcatctgtttgta

SEQ ID NO: 4568864 - DNA, 21 bp, Homo sapiens
gcatcatcttgaacattaatc

SEQ ID NO: 4568865 - DNA, 12 bp, Homo sapiens
gcatccagcagc

SEQ ID NO: 4568866 - DNA, 13 bp, Homo sapiens
gcatccagcagca

SEQ ID NO: 4568867 - DNA, 19 bp, Homo sapiens
gcatccagcagcagcactt

SEQ ID NO: 4568868 - DNA, 17 bp, Homo sapiens
gcatcccacgttctgtt

SEQ ID NO: 4568869 - DNA, 18 bp, Homo sapiens
gcatcccacgttctgtta

SEQ ID NO: 4568870 - DNA, 21 bp, Homo sapiens
gcatccctcacccatcctaga

SEQ ID NO: 4568871 - DNA, 13 bp, Homo sapiens
gcatcccttccca

SEQ ID NO: 4568872 - DNA, 14 bp, Homo sapiens
gcatcccttcccac

SEQ ID NO: 4568873 - DNA, 17 bp, Homo sapiens
gcatcccttcccacatg

SEQ ID NO: 4568874 - DNA, 22 bp, Homo sapiens
gcatcccttcccacatgcctgc

SEQ ID NO: 4568875 - DNA, 18 bp, Homo sapiens
gcatccgcaggtgctggt

SEQ ID NO: 4568876 - DNA, 20 bp, Homo sapiens
gcatccgcaggtgctggtcc

SEQ ID NO: 4568877 - DNA, 17 bp, Homo sapiens
gcatccgtagttccctg

SEQ ID NO: 4568878 - DNA, 18 bp, Homo sapiens
gcatccgtagttccctga

SEQ ID NO: 4568879 - DNA, 19 bp, Homo sapiens
gcatccgtagttccctgaa

SEQ ID NO: 4568880 - DNA, 23 bp, Homo sapiens
gcatcctgccttagagccaggca

SEQ ID NO: 4568881 - DNA, 17 bp, Homo sapiens
gcatcgggaaagaagaa

SEQ ID NO: 4568882 - DNA, 18 bp, Homo sapiens
gcatcgggagcacccaga

SEQ ID NO: 4568883 - DNA, 19 bp, Homo sapiens
gcatcggggtggcccactg

SEQ ID NO: 4568884 - DNA, 18 bp, Homo sapiens
gcatctatctggtgattt

SEQ ID NO: 4568885 - DNA, 21 bp, Homo sapiens
gcatctctccccatatataaa

SEQ ID NO: 4568886 - DNA, 20 bp, Homo sapiens
gcatctcttccccagagagg

SEQ ID NO: 4568887 - DNA, 22 bp, Homo sapiens
gcatctcttccccagagaggca

SEQ ID NO: 4568888 - DNA, 21 bp, Homo sapiens
gcatctcttcttccctgtcag

SEQ ID NO: 4568889 - DNA, 16 bp, Homo sapiens
gcatctgacaggtgaa

SEQ ID NO: 4568890 - DNA, 17 bp, Homo sapiens
gcatctgagtccagctc

SEQ ID NO: 4568891 - DNA, 15 bp, Homo sapiens
gcatctgccccaggt

SEQ ID NO: 4568892 - DNA, 24 bp, Homo sapiens
gcatctgccccaggtacacctccc

SEQ ID NO: 4568893 - DNA, 17 bp, Homo sapiens
gcatctgcccctccccc

SEQ ID NO: 4568894 - DNA, 18 bp, Homo sapiens
gcatctgcccctccccca

SEQ ID NO: 4568895 - DNA, 13 bp, Homo sapiens
gcatcttctccat

SEQ ID NO: 4568896 - DNA, 23 bp, Homo sapiens
gcatctttgccttgggctgctcc

SEQ ID NO: 4568897 - DNA, 21 bp, Homo sapiens
gcatcttttctagagacacat

SEQ ID NO: 4568898 - DNA, 12 bp, Homo sapiens
gcatcttttgta

SEQ ID NO: 4568899 - DNA, 19 bp, Homo sapiens
gcatcttttgtattaagaa

SEQ ID NO: 4568900 - DNA, 21 bp, Homo sapiens
gcatgaaaatagctatttttt

SEQ ID NO: 4568901 - DNA, 15 bp, Homo sapiens
gcatgaaagagaaag

SEQ ID NO: 4568902 - DNA, 20 bp, Homo sapiens
gcatgaaattgtatctcagt

SEQ ID NO: 4568903 - DNA, 24 bp, Homo sapiens
gcatgaaattgtatctcagtctaa

SEQ ID NO: 4568904 - DNA, 15 bp, Homo sapiens
gcatgacagcctcta

SEQ ID NO: 4568905 - DNA, 23 bp, Homo sapiens
gcatgacctaccaggacagaact

SEQ ID NO: 4568906 - DNA, 15 bp, Homo sapiens
gcatgatggagctga

SEQ ID NO: 4568907 - DNA, 16 bp, Homo sapiens
gcatgatggagctgat

SEQ ID NO: 4568908 - DNA, 23 bp, Homo sapiens
gcatgattttaagaggctttggc

SEQ ID NO: 4568909 - DNA, 15 bp, Homo sapiens
gcatgcaatttgaag

SEQ ID NO: 4568910 - DNA, 17 bp, Homo sapiens
gcatgcactgttccccc

SEQ ID NO: 4568911 - DNA, 21 bp, Homo sapiens
gcatgcactgttccccctgtg

SEQ ID NO: 4568912 - DNA, 23 bp, Homo sapiens
gcatgcactgttccccctgtgca

SEQ ID NO: 4568913 - DNA, 22 bp, Homo sapiens
gcatgcctgtagtctcagctag

SEQ ID NO: 4568914 - DNA, 17 bp, Homo sapiens
gcatgcgcccgaggcag

SEQ ID NO: 4568915 - DNA, 14 bp, Homo sapiens
gcatgcggcccagc

SEQ ID NO: 4568916 - DNA, 16 bp, Homo sapiens
gcatgcggcccagccc

SEQ ID NO: 4568917 - DNA, 20 bp, Homo sapiens
gcatgcggcccagcccggct

SEQ ID NO: 4568918 - DNA, 22 bp, Homo sapiens
gcatgctctctgcagccagccc

SEQ ID NO: 4568919 - DNA, 18 bp, Homo sapiens
gcatggagctgtcacctc

SEQ ID NO: 4568920 - DNA, 15 bp, Homo sapiens
gcatggatgcatttc

SEQ ID NO: 4568921 - DNA, 18 bp, Homo sapiens
gcatggatgcatttcaaa

SEQ ID NO: 4568922 - DNA, 16 bp, Homo sapiens
gcatggcagggccagg

SEQ ID NO: 4568923 - DNA, 17 bp, Homo sapiens
gcatggcagggccaggc

SEQ ID NO: 4568924 - DNA, 15 bp, Homo sapiens
gcatggctgtgagga

SEQ ID NO: 4568925 - DNA, 21 bp, Homo sapiens
gcatgggaaatagcggccctg

SEQ ID NO: 4568926 - DNA, 13 bp, Homo sapiens
gcatggggccagg

SEQ ID NO: 4568927 - DNA, 18 bp, Homo sapiens
gcatggtcacacactgat

SEQ ID NO: 4568928 - DNA, 16 bp, Homo sapiens
gcatggtggctcatgc

SEQ ID NO: 4568929 - DNA, 21 bp, Homo sapiens
gcatggtggctcatgcctgta

SEQ ID NO: 4568930 - DNA, 21 bp, Homo sapiens
gcatgtacggattttcagtta

SEQ ID NO: 4568931 - DNA, 17 bp, Homo sapiens
gcatgtagcatataaat

SEQ ID NO: 4568932 - DNA, 15 bp, Homo sapiens
gcatgtaggagaatc

SEQ ID NO: 4568933 - DNA, 21 bp, Homo sapiens
gcatgtagtaacactaatata

SEQ ID NO: 4568934 - DNA, 13 bp, Homo sapiens
gcatgtcccaccc

SEQ ID NO: 4568935 - DNA, 23 bp, Homo sapiens
gcatgtggtaaggtgtgtactca

SEQ ID NO: 4568936 - DNA, 22 bp, Homo sapiens
gcatgttctcctctatcttaga

SEQ ID NO: 4568937 - DNA, 22 bp, Homo sapiens
gcattaaattcacaaactttta

SEQ ID NO: 4568938 - DNA, 15 bp, Homo sapiens
gcattaactaaatgc

SEQ ID NO: 4568939 - DNA, 12 bp, Homo sapiens
gcattacattat

SEQ ID NO: 4568940 - DNA, 15 bp, Homo sapiens
gcattacccccaacc

SEQ ID NO: 4568941 - DNA, 16 bp, Homo sapiens
gcattagaatggagga

SEQ ID NO: 4568942 - DNA, 21 bp, Homo sapiens
gcattagagtcaactacacaa

SEQ ID NO: 4568943 - DNA, 18 bp, Homo sapiens
gcattatatttgtaaatt

SEQ ID NO: 4568944 - DNA, 14 bp, Homo sapiens
gcattattcataaa

SEQ ID NO: 4568945 - DNA, 23 bp, Homo sapiens
gcattattggaatataattgttt

SEQ ID NO: 4568946 - DNA, 20 bp, Homo sapiens
gcattcaaaaagacagcaga

SEQ ID NO: 4568947 - DNA, 17 bp, Homo sapiens
gcattcagcagtttctg

SEQ ID NO: 4568948 - DNA, 14 bp, Homo sapiens
gcattcatttttat

SEQ ID NO: 4568949 - DNA, 15 bp, Homo sapiens
gcattcatttttata

SEQ ID NO: 4568950 - DNA, 17 bp, Homo sapiens
gcattcatttttatagc

SEQ ID NO: 4568951 - DNA, 22 bp, Homo sapiens
gcattcatttttatagcaacaa

SEQ ID NO: 4568952 - DNA, 23 bp, Homo sapiens
gcattccagacttcaaaaataaa

SEQ ID NO: 4568953 - DNA, 17 bp, Homo sapiens
gcattccagctctgccc

SEQ ID NO: 4568954 - DNA, 21 bp, Homo sapiens
gcattccctgagtcaccagga

SEQ ID NO: 4568955 - DNA, 14 bp, Homo sapiens
gcattcttctctgt

SEQ ID NO: 4568956 - DNA, 22 bp, Homo sapiens
gcattgaccgcgactaatttca

SEQ ID NO: 4568957 - DNA, 23 bp, Homo sapiens
gcattgaccgcgactaatttcaa

SEQ ID NO: 4568958 - DNA, 16 bp, Homo sapiens
gcattgccaagggctt

SEQ ID NO: 4568959 - DNA, 20 bp, Homo sapiens
gcattgccgctgtataaagc

SEQ ID NO: 4568960 - DNA, 12 bp, Homo sapiens
gcattgcctggc

SEQ ID NO: 4568961 - DNA, 16 bp, Homo sapiens
gcattgctctggatct

SEQ ID NO: 4568962 - DNA, 16 bp, Homo sapiens
gcattgctgtccttgg

SEQ ID NO: 4568963 - DNA, 13 bp, Homo sapiens
gcattggaattct

SEQ ID NO: 4568964 - DNA, 22 bp, Homo sapiens
gcattggaattctactggaaaa

SEQ ID NO: 4568965 - DNA, 18 bp, Homo sapiens
gcattggggttcctctgt

SEQ ID NO: 4568966 - DNA, 20 bp, Homo sapiens
gcattggggttcctctgtac

SEQ ID NO: 4568967 - DNA, 15 bp, Homo sapiens
gcattggtgactcac

SEQ ID NO: 4568968 - DNA, 22 bp, Homo sapiens
gcattggtggcatcacagaccc

SEQ ID NO: 4568969 - DNA, 17 bp, Homo sapiens
gcattggttttccatga

SEQ ID NO: 4568970 - DNA, 14 bp, Homo sapiens
gcatttaagaattg

SEQ ID NO: 4568971 - DNA, 17 bp, Homo sapiens
gcatttaatggcagcta

SEQ ID NO: 4568972 - DNA, 23 bp, Homo sapiens
gcatttagtgctcagtccctact

SEQ ID NO: 4568973 - DNA, 12 bp, Homo sapiens
gcatttcatatt

SEQ ID NO: 4568974 - DNA, 22 bp, Homo sapiens
gcatttcatgaaaaagctgctt

SEQ ID NO: 4568975 - DNA, 16 bp, Homo sapiens
gcatttccttgtcccg

SEQ ID NO: 4568976 - DNA, 21 bp, Homo sapiens
gcatttctatgcaggcagcac

SEQ ID NO: 4568977 - DNA, 15 bp, Homo sapiens
gcatttggtgagagt

SEQ ID NO: 4568978 - DNA, 12 bp, Homo sapiens
gcatttgtatta

SEQ ID NO: 4568979 - DNA, 11 bp, Homo sapiens
gcatttgtcta

SEQ ID NO: 4568980 - DNA, 20 bp, Homo sapiens
gcatttgtggtaatctacac

SEQ ID NO: 4568981 - DNA, 21 bp, Homo sapiens
gcatttgtggtaatctacacc

SEQ ID NO: 4568982 - DNA, 19 bp, Homo sapiens
gcatttgttccattaaaaa

SEQ ID NO: 4568983 - DNA, 22 bp, Homo sapiens
gcattttaaaagcaattatatt

SEQ ID NO: 4568984 - DNA, 13 bp, Homo sapiens
gcattttaagtaa

SEQ ID NO: 4568985 - DNA, 12 bp, Homo sapiens
gcattttcctcc

SEQ ID NO: 4568986 - DNA, 19 bp, Homo sapiens
gcatttttccatctgtgtg

SEQ ID NO: 4568987 - DNA, 21 bp, Homo sapiens
gcatttttgttttgaaagttt

SEQ ID NO: 4568988 - DNA, 16 bp, Homo sapiens
gccaaaaaaaaataca

SEQ ID NO: 4568989 - DNA, 19 bp, Homo sapiens
gccaaaaaggatacataat

SEQ ID NO: 4568990 - DNA, 13 bp, Homo sapiens
gccaaaaatagct

SEQ ID NO: 4568991 - DNA, 23 bp, Homo sapiens
gccaaaacaatgtttaaaccttt

SEQ ID NO: 4568992 - DNA, 14 bp, Homo sapiens
gccaaaaggaaaaa

SEQ ID NO: 4568993 - DNA, 19 bp, Homo sapiens
gccaaaagtccctccctgc

SEQ ID NO: 4568994 - DNA, 23 bp, Homo sapiens
gccaaaagtccctccctgcctga

SEQ ID NO: 4568995 - DNA, 15 bp, Homo sapiens
gccaaaatcaagagt

SEQ ID NO: 4568996 - DNA, 15 bp, Homo sapiens
gccaaaatgtactta

SEQ ID NO: 4568997 - DNA, 20 bp, Homo sapiens
gccaaacccttgctttcctg

SEQ ID NO: 4568998 - DNA, 23 bp, Homo sapiens
gccaaacccttgctttcctgggc

SEQ ID NO: 4568999 - DNA, 14 bp, Homo sapiens
gccaaacctcctgt

SEQ ID NO: 4569000 - DNA, 18 bp, Homo sapiens
gccaaagaaatgaacatt

SEQ ID NO: 4569001 - DNA, 15 bp, Homo sapiens
gccaaagatttcata

SEQ ID NO: 4569002 - DNA, 16 bp, Homo sapiens
gccaaaggaagtttta

SEQ ID NO: 4569003 - DNA, 16 bp, Homo sapiens
gccaaaggttcagaaa

SEQ ID NO: 4569004 - DNA, 22 bp, Homo sapiens
gccaaataatgtctctgtgaga

SEQ ID NO: 4569005 - DNA, 18 bp, Homo sapiens
gccaaatttcctgtttga

SEQ ID NO: 4569006 - DNA, 14 bp, Homo sapiens
gccaaccctgggct

SEQ ID NO: 4569007 - DNA, 17 bp, Homo sapiens
gccaacctcaggctcct

SEQ ID NO: 4569008 - DNA, 15 bp, Homo sapiens
gccaacgagacacat

SEQ ID NO: 4569009 - DNA, 21 bp, Homo sapiens
gccaacgagacacattgcctt

SEQ ID NO: 4569010 - DNA, 22 bp, Homo sapiens
gccaacgagacacattgccttc

SEQ ID NO: 4569011 - DNA, 22 bp, Homo sapiens
gccaactctcccaaagggcaca

SEQ ID NO: 4569012 - DNA, 12 bp, Homo sapiens
gccaactgttgt

SEQ ID NO: 4569013 - DNA, 19 bp, Homo sapiens
gccaagaagcagtggcctt

SEQ ID NO: 4569014 - DNA, 14 bp, Homo sapiens
gccaagaatacttg

SEQ ID NO: 4569015 - DNA, 17 bp, Homo sapiens
gccaagactcctcaggc

SEQ ID NO: 4569016 - DNA, 20 bp, Homo sapiens
gccaagatttaaaattaaat

SEQ ID NO: 4569017 - DNA, 14 bp, Homo sapiens
gccaagcaggctgg

SEQ ID NO: 4569018 - DNA, 12 bp, Homo sapiens
gccaagccctgg

SEQ ID NO: 4569019 - DNA, 16 bp, Homo sapiens
gccaagctttaaatta

SEQ ID NO: 4569020 - DNA, 13 bp, Homo sapiens
gccaaggacccag

SEQ ID NO: 4569021 - DNA, 20 bp, Homo sapiens
gccaaggccagagtggcctg

SEQ ID NO: 4569022 - DNA, 15 bp, Homo sapiens
gccaaggctctctct

SEQ ID NO: 4569023 - DNA, 18 bp, Homo sapiens
gccaagggaaaggggtgc

SEQ ID NO: 4569024 - DNA, 16 bp, Homo sapiens
gccaaggtcctgctca

SEQ ID NO: 4569025 - DNA, 16 bp, Homo sapiens
gccaaggtctgagcca

SEQ ID NO: 4569026 - DNA, 19 bp, Homo sapiens
gccaagtaatcctgcacag

SEQ ID NO: 4569027 - DNA, 14 bp, Homo sapiens
gccaagtctcagaa

SEQ ID NO: 4569028 - DNA, 23 bp, Homo sapiens
gccaagtctggcaccatgttggc

SEQ ID NO: 4569029 - DNA, 18 bp, Homo sapiens
gccaagtggggtgctggg

SEQ ID NO: 4569030 - DNA, 12 bp, Homo sapiens
gccaagttctta

SEQ ID NO: 4569031 - DNA, 15 bp, Homo sapiens
gccaatgaacatctc

SEQ ID NO: 4569032 - DNA, 23 bp, Homo sapiens
gccaatgagtctgtaattttacg

SEQ ID NO: 4569033 - DNA, 19 bp, Homo sapiens
gccaatgcacctaaagaaa

SEQ ID NO: 4569034 - DNA, 20 bp, Homo sapiens
gccaatttcaagttccaagt

SEQ ID NO: 4569035 - DNA, 22 bp, Homo sapiens
gccaatttcaccccattttctg

SEQ ID NO: 4569036 - DNA, 13 bp, Homo sapiens
gccaattttggat

SEQ ID NO: 4569037 - DNA, 13 bp, Homo sapiens
gccacaagctgca

SEQ ID NO: 4569038 - DNA, 19 bp, Homo sapiens
gccacaagctgcactgtga

SEQ ID NO: 4569039 - DNA, 21 bp, Homo sapiens
gccacaatgaacatccctttt

SEQ ID NO: 4569040 - DNA, 18 bp, Homo sapiens
gccacacaaacgtttact

SEQ ID NO: 4569041 - DNA, 22 bp, Homo sapiens
gccacacactgagttgcacata

SEQ ID NO: 4569042 - DNA, 13 bp, Homo sapiens
gccacacaggcag

SEQ ID NO: 4569043 - DNA, 19 bp, Homo sapiens
gccacacaggcagggcctg

SEQ ID NO: 4569044 - DNA, 20 bp, Homo sapiens
gccacacattgtgcttggcc

SEQ ID NO: 4569045 - DNA, 17 bp, Homo sapiens
gccacacccagcggccc

SEQ ID NO: 4569046 - DNA, 16 bp, Homo sapiens
gccacacccaggaagg

SEQ ID NO: 4569047 - DNA, 17 bp, Homo sapiens
gccacacccaggaaggg

SEQ ID NO: 4569048 - DNA, 18 bp, Homo sapiens
gccacacccaggaaggga

SEQ ID NO: 4569049 - DNA, 14 bp, Homo sapiens
gccacacctgagcc

SEQ ID NO: 4569050 - DNA, 23 bp, Homo sapiens
gccacacggaagcaagcagatga

SEQ ID NO: 4569051 - DNA, 17 bp, Homo sapiens
gccacactggggctgac

SEQ ID NO: 4569052 - DNA, 15 bp, Homo sapiens
gccacagacaactca

SEQ ID NO: 4569053 - DNA, 24 bp, Homo sapiens
gccacagacaactcacattgttca

SEQ ID NO: 4569054 - DNA, 13 bp, Homo sapiens
gccacagaggccc

SEQ ID NO: 4569055 - DNA, 17 bp, Homo sapiens
gccacagaggccccacc

SEQ ID NO: 4569056 - DNA, 12 bp, Homo sapiens
gccacagccaga

SEQ ID NO: 4569057 - DNA, 17 bp, Homo sapiens
gccacagccagaggagg

SEQ ID NO: 4569058 - DNA, 23 bp, Homo sapiens
gccacagccagaggagggcagag

SEQ ID NO: 4569059 - DNA, 23 bp, Homo sapiens
gccacagccttcggacagacata

SEQ ID NO: 4569060 - DNA, 15 bp, Homo sapiens
gccacaggaaggagg

SEQ ID NO: 4569061 - DNA, 15 bp, Homo sapiens
gccacaggcagtcca

SEQ ID NO: 4569062 - DNA, 12 bp, Homo sapiens
gccacaggcctg

SEQ ID NO: 4569063 - DNA, 22 bp, Homo sapiens
gccacaggcctgagatttcatc

SEQ ID NO: 4569064 - DNA, 19 bp, Homo sapiens
gccacagggaagctcacac

SEQ ID NO: 4569065 - DNA, 16 bp, Homo sapiens
gccacatgccccaggc

SEQ ID NO: 4569066 - DNA, 18 bp, Homo sapiens
gccacatgccccaggctc

SEQ ID NO: 4569067 - DNA, 15 bp, Homo sapiens
gccacatggagcccc

SEQ ID NO: 4569068 - DNA, 16 bp, Homo sapiens
gccacatggagccccc

SEQ ID NO: 4569069 - DNA, 22 bp, Homo sapiens
gccacatggtgtctcccaacat

SEQ ID NO: 4569070 - DNA, 19 bp, Homo sapiens
gccacatttggaatacttt

SEQ ID NO: 4569071 - DNA, 11 bp, Homo sapiens
gccacattttc

SEQ ID NO: 4569072 - DNA, 19 bp, Homo sapiens
gccacattttttgaggtat

SEQ ID NO: 4569073 - DNA, 19 bp, Homo sapiens
gccaccacctttggctggt

SEQ ID NO: 4569074 - DNA, 11 bp, Homo sapiens
gccaccagttc

SEQ ID NO: 4569075 - DNA, 22 bp, Homo sapiens
gccacccaagcctgctggctgc

SEQ ID NO: 4569076 - DNA, 16 bp, Homo sapiens
gccaccccaaacccca

SEQ ID NO: 4569077 - DNA, 19 bp, Homo sapiens
gccaccccaaaccccagcc

SEQ ID NO: 4569078 - DNA, 22 bp, Homo sapiens
gccaccccaaaccccagcccca

SEQ ID NO: 4569079 - DNA, 18 bp, Homo sapiens
gccacccctaaactccag

SEQ ID NO: 4569080 - DNA, 21 bp, Homo sapiens
gccacccgtggggtgctgccc

SEQ ID NO: 4569081 - DNA, 19 bp, Homo sapiens
gccaccggcctgtgggtct

SEQ ID NO: 4569082 - DNA, 23 bp, Homo sapiens
gccaccggcctgtgggtctctga

SEQ ID NO: 4569083 - DNA, 19 bp, Homo sapiens
gccaccgtgcctggccaga

SEQ ID NO: 4569084 - DNA, 18 bp, Homo sapiens
gccacctagactctccct

SEQ ID NO: 4569085 - DNA, 12 bp, Homo sapiens
gccacctatgcc

SEQ ID NO: 4569086 - DNA, 15 bp, Homo sapiens
gccacctatgcctgt

SEQ ID NO: 4569087 - DNA, 15 bp, Homo sapiens
gccacctcccctatc

SEQ ID NO: 4569088 - DNA, 16 bp, Homo sapiens
gccacctgaataaaga

SEQ ID NO: 4569089 - DNA, 11 bp, Homo sapiens
gccacctgcaa

SEQ ID NO: 4569090 - DNA, 17 bp, Homo sapiens
gccacctgcaagatgga

SEQ ID NO: 4569091 - DNA, 22 bp, Homo sapiens
gccaccttgttacaaatttttt

SEQ ID NO: 4569092 - DNA, 15 bp, Homo sapiens
gccacctttgtgcag

SEQ ID NO: 4569093 - DNA, 15 bp, Homo sapiens
gccacgattgcagga

SEQ ID NO: 4569094 - DNA, 13 bp, Homo sapiens
gccacgccctccc

SEQ ID NO: 4569095 - DNA, 13 bp, Homo sapiens
gccacgctccagc

SEQ ID NO: 4569096 - DNA, 13 bp, Homo sapiens
gccacgctgtcct

SEQ ID NO: 4569097 - DNA, 18 bp, Homo sapiens
gccacgctgtcctctcga

SEQ ID NO: 4569098 - DNA, 19 bp, Homo sapiens
gccacgctgtcctctcgag

SEQ ID NO: 4569099 - DNA, 17 bp, Homo sapiens
gccacggagcgggaggc

SEQ ID NO: 4569100 - DNA, 23 bp, Homo sapiens
gccacgggtgccagaagctactg

SEQ ID NO: 4569101 - DNA, 15 bp, Homo sapiens
gccacgtccaggtcc

SEQ ID NO: 4569102 - DNA, 15 bp, Homo sapiens
gccacgtcccagcat

SEQ ID NO: 4569103 - DNA, 16 bp, Homo sapiens
gccacgtcccagcatc

SEQ ID NO: 4569104 - DNA, 16 bp, Homo sapiens
gccacgtgccaggccc

SEQ ID NO: 4569105 - DNA, 16 bp, Homo sapiens
gccacgttccttactg

SEQ ID NO: 4569106 - DNA, 22 bp, Homo sapiens
gccacgttccttactgcagaat

SEQ ID NO: 4569107 - DNA, 22 bp, Homo sapiens
gccacgttcttactagtttccc

SEQ ID NO: 4569108 - DNA, 16 bp, Homo sapiens
gccactaggtgtcccc

SEQ ID NO: 4569109 - DNA, 17 bp, Homo sapiens
gccactcacacagccag

SEQ ID NO: 4569110 - DNA, 12 bp, Homo sapiens
gccactcatttc

SEQ ID NO: 4569111 - DNA, 18 bp, Homo sapiens
gccactcatttcatctca

SEQ ID NO: 4569112 - DNA, 19 bp, Homo sapiens
gccactccttccttcagga

SEQ ID NO: 4569113 - DNA, 15 bp, Homo sapiens
gccactctatgagtt

SEQ ID NO: 4569114 - DNA, 22 bp, Homo sapiens
gccactctctgggactctcctc

SEQ ID NO: 4569115 - DNA, 15 bp, Homo sapiens
gccactgaaatctgt

SEQ ID NO: 4569116 - DNA, 22 bp, Homo sapiens
gccactgccccccgaggctgct

SEQ ID NO: 4569117 - DNA, 21 bp, Homo sapiens
gccactgcgggagctctgtat

SEQ ID NO: 4569118 - DNA, 15 bp, Homo sapiens
gccactggaaggaac

SEQ ID NO: 4569119 - DNA, 23 bp, Homo sapiens
gccactggggactttatttattt

SEQ ID NO: 4569120 - DNA, 15 bp, Homo sapiens
gccactggggtgcct

SEQ ID NO: 4569121 - DNA, 15 bp, Homo sapiens
gccactgtcacaggc

SEQ ID NO: 4569122 - DNA, 24 bp, Homo sapiens
gccactgttcagcggagctgactg

SEQ ID NO: 4569123 - DNA, 16 bp, Homo sapiens
gccacttaatgtatgt

SEQ ID NO: 4569124 - DNA, 24 bp, Homo sapiens
gccacttctcactcaccactacca

SEQ ID NO: 4569125 - DNA, 13 bp, Homo sapiens
gccacttctcccc

SEQ ID NO: 4569126 - DNA, 15 bp, Homo sapiens
gccacttctccccag

SEQ ID NO: 4569127 - DNA, 17 bp, Homo sapiens
gccagaacctggagggc

SEQ ID NO: 4569128 - DNA, 17 bp, Homo sapiens
gccagaagatcccctca

SEQ ID NO: 4569129 - DNA, 18 bp, Homo sapiens
gccagaagatcccctcag

SEQ ID NO: 4569130 - DNA, 19 bp, Homo sapiens
gccagaagatcccctcagg

SEQ ID NO: 4569131 - DNA, 14 bp, Homo sapiens
gccagaagctactg

SEQ ID NO: 4569132 - DNA, 21 bp, Homo sapiens
gccagaagtttgtcaagtcaa

SEQ ID NO: 4569133 - DNA, 20 bp, Homo sapiens
gccagaccccacgctgacca

SEQ ID NO: 4569134 - DNA, 15 bp, Homo sapiens
gccagacctagcagg

SEQ ID NO: 4569135 - DNA, 22 bp, Homo sapiens
gccagacctagcaggctgttcc

SEQ ID NO: 4569136 - DNA, 19 bp, Homo sapiens
gccagacgctgccgctgcc

SEQ ID NO: 4569137 - DNA, 15 bp, Homo sapiens
gccagactgtccagg

SEQ ID NO: 4569138 - DNA, 18 bp, Homo sapiens
gccagagcaaacagaaaa

SEQ ID NO: 4569139 - DNA, 19 bp, Homo sapiens
gccagagcaaacagaaaaa

SEQ ID NO: 4569140 - DNA, 14 bp, Homo sapiens
gccagagcctctgg

SEQ ID NO: 4569141 - DNA, 22 bp, Homo sapiens
gccagagcctctggcccctcac

SEQ ID NO: 4569142 - DNA, 13 bp, Homo sapiens
gccagaggagggc

SEQ ID NO: 4569143 - DNA, 13 bp, Homo sapiens
gccagaggccaga

SEQ ID NO: 4569144 - DNA, 22 bp, Homo sapiens
gccagaggctcgttgactggct

SEQ ID NO: 4569145 - DNA, 20 bp, Homo sapiens
gccagaggctgggagtccct

SEQ ID NO: 4569146 - DNA, 19 bp, Homo sapiens
gccagagtcaccttttctg

SEQ ID NO: 4569147 - DNA, 18 bp, Homo sapiens
gccagagtggcctggcca

SEQ ID NO: 4569148 - DNA, 22 bp, Homo sapiens
gccagatggactccagcctgcc

SEQ ID NO: 4569149 - DNA, 14 bp, Homo sapiens
gccagatttgtctt

SEQ ID NO: 4569150 - DNA, 12 bp, Homo sapiens
gccagcaccctc

SEQ ID NO: 4569151 - DNA, 15 bp, Homo sapiens
gccagcaccctctcc

SEQ ID NO: 4569152 - DNA, 21 bp, Homo sapiens
gccagcaccctctcctggggg

SEQ ID NO: 4569153 - DNA, 11 bp, Homo sapiens
gccagcagagc

SEQ ID NO: 4569154 - DNA, 14 bp, Homo sapiens
gccagcagagccag

SEQ ID NO: 4569155 - DNA, 15 bp, Homo sapiens
gccagcagagccagg

SEQ ID NO: 4569156 - DNA, 16 bp, Homo sapiens
gccagcagagccaggg

SEQ ID NO: 4569157 - DNA, 17 bp, Homo sapiens
gccagcagagccagggc

SEQ ID NO: 4569158 - DNA, 18 bp, Homo sapiens
gccagcagagccagggca

SEQ ID NO: 4569159 - DNA, 23 bp, Homo sapiens
gccagcagcttaagtccagctca

SEQ ID NO: 4569160 - DNA, 19 bp, Homo sapiens
gccagcaggcgggctcctt

SEQ ID NO: 4569161 - DNA, 23 bp, Homo sapiens
gccagcagggcatcttggaaaag

SEQ ID NO: 4569162 - DNA, 16 bp, Homo sapiens
gccagcattccagact

SEQ ID NO: 4569163 - DNA, 17 bp, Homo sapiens
gccagcattccagactt

SEQ ID NO: 4569164 - DNA, 20 bp, Homo sapiens
gccagcattccagacttcaa

SEQ ID NO: 4569165 - DNA, 22 bp, Homo sapiens
gccagccaagctttaaattatg

SEQ ID NO: 4569166 - DNA, 17 bp, Homo sapiens
gccagcccagccaggcc

SEQ ID NO: 4569167 - DNA, 18 bp, Homo sapiens
gccagcccatggccccca

SEQ ID NO: 4569168 - DNA, 11 bp, Homo sapiens
gccagcccctg

SEQ ID NO: 4569169 - DNA, 17 bp, Homo sapiens
gccagcccctggggccc

SEQ ID NO: 4569170 - DNA, 18 bp, Homo sapiens
gccagcccctggggccca

SEQ ID NO: 4569171 - DNA, 10 bp, Homo sapiens
gccagccctc

SEQ ID NO: 4569172 - DNA, 13 bp, Homo sapiens
gccagccctccct

SEQ ID NO: 4569173 - DNA, 21 bp, Homo sapiens
gccagccctccctgtcctcct

SEQ ID NO: 4569174 - DNA, 16 bp, Homo sapiens
gccagccgccctgggc

SEQ ID NO: 4569175 - DNA, 17 bp, Homo sapiens
gccagccgccctgggct

SEQ ID NO: 4569176 - DNA, 19 bp, Homo sapiens
gccagccgccctgggctgt

SEQ ID NO: 4569177 - DNA, 20 bp, Homo sapiens
gccagcctccgagagggaga

SEQ ID NO: 4569178 - DNA, 16 bp, Homo sapiens
gccagcctcctctgga

SEQ ID NO: 4569179 - DNA, 20 bp, Homo sapiens
gccagcctccttgtgagagt

SEQ ID NO: 4569180 - DNA, 18 bp, Homo sapiens
gccagccttgagccctgg

SEQ ID NO: 4569181 - DNA, 14 bp, Homo sapiens
gccagcgcctccct

SEQ ID NO: 4569182 - DNA, 16 bp, Homo sapiens
gccagcgcctccctcc

SEQ ID NO: 4569183 - DNA, 20 bp, Homo sapiens
gccagcgcctccctccaccc

SEQ ID NO: 4569184 - DNA, 21 bp, Homo sapiens
gccagcgcctccctccacccc

SEQ ID NO: 4569185 - DNA, 23 bp, Homo sapiens
gccagcgcctccctccaccccag

SEQ ID NO: 4569186 - DNA, 14 bp, Homo sapiens
gccagcggggctgc

SEQ ID NO: 4569187 - DNA, 12 bp, Homo sapiens
gccagcgtcctc

SEQ ID NO: 4569188 - DNA, 22 bp, Homo sapiens
gccagctcaggaattccctgga

SEQ ID NO: 4569189 - DNA, 16 bp, Homo sapiens
gccagctctagttttc

SEQ ID NO: 4569190 - DNA, 13 bp, Homo sapiens
gccagctctgtat

SEQ ID NO: 4569191 - DNA, 18 bp, Homo sapiens
gccagctgccccagccag

SEQ ID NO: 4569192 - DNA, 13 bp, Homo sapiens
gccagctgccctt

SEQ ID NO: 4569193 - DNA, 22 bp, Homo sapiens
gccagctgcccttgcagggtgg

SEQ ID NO: 4569194 - DNA, 23 bp, Homo sapiens
gccagctgcccttgcagggtggg

SEQ ID NO: 4569195 - DNA, 19 bp, Homo sapiens
gccagctggatcgctgcac

SEQ ID NO: 4569196 - DNA, 15 bp, Homo sapiens
gccagctttccctgc

SEQ ID NO: 4569197 - DNA, 13 bp, Homo sapiens
gccaggaagccag

SEQ ID NO: 4569198 - DNA, 15 bp, Homo sapiens
gccaggaagccagag

SEQ ID NO: 4569199 - DNA, 16 bp, Homo sapiens
gccaggaagccagagc

SEQ ID NO: 4569200 - DNA, 14 bp, Homo sapiens
gccaggacaggccc

SEQ ID NO: 4569201 - DNA, 13 bp, Homo sapiens
gccaggagcagcc

SEQ ID NO: 4569202 - DNA, 16 bp, Homo sapiens
gccaggagcagccctg

SEQ ID NO: 4569203 - DNA, 19 bp, Homo sapiens
gccaggagtgcccccggga

SEQ ID NO: 4569204 - DNA, 17 bp, Homo sapiens
gccaggcacacacagcc

SEQ ID NO: 4569205 - DNA, 14 bp, Homo sapiens
gccaggcagatctg

SEQ ID NO: 4569206 - DNA, 15 bp, Homo sapiens
gccaggcaggggtgg

SEQ ID NO: 4569207 - DNA, 17 bp, Homo sapiens
gccaggcaggggtgggg

SEQ ID NO: 4569208 - DNA, 22 bp, Homo sapiens
gccaggccaacagcacctcccc

SEQ ID NO: 4569209 - DNA, 17 bp, Homo sapiens
gccaggcctcttggcag

SEQ ID NO: 4569210 - DNA, 12 bp, Homo sapiens
gccaggctctgt

SEQ ID NO: 4569211 - DNA, 15 bp, Homo sapiens
gccaggctgcctcct

SEQ ID NO: 4569212 - DNA, 19 bp, Homo sapiens
gccaggctgcctcctgccc

SEQ ID NO: 4569213 - DNA, 17 bp, Homo sapiens
gccaggcttttctcagg

SEQ ID NO: 4569214 - DNA, 21 bp, Homo sapiens
gccaggcttttctcaggagct

SEQ ID NO: 4569215 - DNA, 17 bp, Homo sapiens
gccagggcaagagagcg

SEQ ID NO: 4569216 - DNA, 15 bp, Homo sapiens
gccagggcagagtga

SEQ ID NO: 4569217 - DNA, 13 bp, Homo sapiens
gccagggcagggc

SEQ ID NO: 4569218 - DNA, 14 bp, Homo sapiens
gccagggcagggcc

SEQ ID NO: 4569219 - DNA, 15 bp, Homo sapiens
gccagggcagggcga

SEQ ID NO: 4569220 - DNA, 12 bp, Homo sapiens
gccagggctggg

SEQ ID NO: 4569221 - DNA, 21 bp, Homo sapiens
gccagggctggggacagaggg

SEQ ID NO: 4569222 - DNA, 21 bp, Homo sapiens
gccaggtaatgtgaataaatt

SEQ ID NO: 4569223 - DNA, 14 bp, Homo sapiens
gccaggtgcccagg

SEQ ID NO: 4569224 - DNA, 23 bp, Homo sapiens
gccagtcaacggggggctcctgc

SEQ ID NO: 4569225 - DNA, 20 bp, Homo sapiens
gccagtccccatttctgcct

SEQ ID NO: 4569226 - DNA, 23 bp, Homo sapiens
gccagtccccatttctgcctcgc

SEQ ID NO: 4569227 - DNA, 16 bp, Homo sapiens
gccagtcctgcctggc

SEQ ID NO: 4569228 - DNA, 22 bp, Homo sapiens
gccagtctcactgtgggaaggc

SEQ ID NO: 4569229 - DNA, 12 bp, Homo sapiens
gccagtctgccc

SEQ ID NO: 4569230 - DNA, 14 bp, Homo sapiens
gccagtctgcccga

SEQ ID NO: 4569231 - DNA, 23 bp, Homo sapiens
gccagtctgggtctgggtttgga

SEQ ID NO: 4569232 - DNA, 18 bp, Homo sapiens
gccagtgaagtccttcag

SEQ ID NO: 4569233 - DNA, 23 bp, Homo sapiens
gccagtgacctttgacctcggtg

SEQ ID NO: 4569234 - DNA, 17 bp, Homo sapiens
gccagtgcagccactgg

SEQ ID NO: 4569235 - DNA, 10 bp, Homo sapiens
gccagtgcct

SEQ ID NO: 4569236 - DNA, 13 bp, Homo sapiens
gccagtgcctggg

SEQ ID NO: 4569237 - DNA, 11 bp, Homo sapiens
gccagtgcctt

SEQ ID NO: 4569238 - DNA, 19 bp, Homo sapiens
gccagtgccttacctcctg

SEQ ID NO: 4569239 - DNA, 20 bp, Homo sapiens
gccagtgccttacctcctgc

SEQ ID NO: 4569240 - DNA, 21 bp, Homo sapiens
gccagtgccttacctcctgcc

SEQ ID NO: 4569241 - DNA, 23 bp, Homo sapiens
gccagtgccttacctcctgccca

SEQ ID NO: 4569242 - DNA, 14 bp, Homo sapiens
gccagtggaagaaa

SEQ ID NO: 4569243 - DNA, 19 bp, Homo sapiens
gccagtggtgatgtaaaaa

SEQ ID NO: 4569244 - DNA, 14 bp, Homo sapiens
gccagtgtctttct

SEQ ID NO: 4569245 - DNA, 15 bp, Homo sapiens
gccagtgtctttctt

SEQ ID NO: 4569246 - DNA, 22 bp, Homo sapiens
gccagttatggctataggtgct

SEQ ID NO: 4569247 - DNA, 15 bp, Homo sapiens
gccagttttccctgg

SEQ ID NO: 4569248 - DNA, 15 bp, Homo sapiens
gccataattatgaaa

SEQ ID NO: 4569249 - DNA, 19 bp, Homo sapiens
gccataattatgaaaactc

SEQ ID NO: 4569250 - DNA, 18 bp, Homo sapiens
gccatacattaaggagca

SEQ ID NO: 4569251 - DNA, 21 bp, Homo sapiens
gccatactgcgtccaccctga

SEQ ID NO: 4569252 - DNA, 17 bp, Homo sapiens
gccatagaccctgaggc

SEQ ID NO: 4569253 - DNA, 19 bp, Homo sapiens
gccatagccccagtaggac

SEQ ID NO: 4569254 - DNA, 15 bp, Homo sapiens
gccataggtgcagtt

SEQ ID NO: 4569255 - DNA, 20 bp, Homo sapiens
gccatatatgaccagaagcc

SEQ ID NO: 4569256 - DNA, 14 bp, Homo sapiens
gccatcaaaatgct

SEQ ID NO: 4569257 - DNA, 15 bp, Homo sapiens
gccatcaaaatgctt

SEQ ID NO: 4569258 - DNA, 19 bp, Homo sapiens
gccatcaaaatgcttttta

SEQ ID NO: 4569259 - DNA, 16 bp, Homo sapiens
gccatcactggtccag

SEQ ID NO: 4569260 - DNA, 16 bp, Homo sapiens
gccatcacttctcccc

SEQ ID NO: 4569261 - DNA, 15 bp, Homo sapiens
gccatcatgcccagc

SEQ ID NO: 4569262 - DNA, 12 bp, Homo sapiens
gccatccctggg

SEQ ID NO: 4569263 - DNA, 21 bp, Homo sapiens
gccatccctgggcccctccac

SEQ ID NO: 4569264 - DNA, 18 bp, Homo sapiens
gccatccctttttttaca

SEQ ID NO: 4569265 - DNA, 21 bp, Homo sapiens
gccatcctcaaacgacagagg

SEQ ID NO: 4569266 - DNA, 19 bp, Homo sapiens
gccatcctctttctctttt

SEQ ID NO: 4569267 - DNA, 22 bp, Homo sapiens
gccatctcaggagatggagggc

SEQ ID NO: 4569268 - DNA, 21 bp, Homo sapiens
gccatgagccgcccaaggcct

SEQ ID NO: 4569269 - DNA, 15 bp, Homo sapiens
gccatgctgggccac

SEQ ID NO: 4569270 - DNA, 17 bp, Homo sapiens
gccatgctttttggtga

SEQ ID NO: 4569271 - DNA, 17 bp, Homo sapiens
gccatggaactgtttcc

SEQ ID NO: 4569272 - DNA, 14 bp, Homo sapiens
gccatgggtgcttg

SEQ ID NO: 4569273 - DNA, 16 bp, Homo sapiens
gccatgtaaaggcctt

SEQ ID NO: 4569274 - DNA, 14 bp, Homo sapiens
gccatgtccaaaga

SEQ ID NO: 4569275 - DNA, 15 bp, Homo sapiens
gccatgtccaaagag

SEQ ID NO: 4569276 - DNA, 18 bp, Homo sapiens
gccatgtccaaagaggct

SEQ ID NO: 4569277 - DNA, 17 bp, Homo sapiens
gccatgtgctgccctgt

SEQ ID NO: 4569278 - DNA, 19 bp, Homo sapiens
gccatgttccccagttcag

SEQ ID NO: 4569279 - DNA, 21 bp, Homo sapiens
gccattaaatgaatattttga

SEQ ID NO: 4569280 - DNA, 22 bp, Homo sapiens
gccattatccctgaatccccct

SEQ ID NO: 4569281 - DNA, 21 bp, Homo sapiens
gccattcacttcataatccag

SEQ ID NO: 4569282 - DNA, 16 bp, Homo sapiens
gccattccaaaatatt

SEQ ID NO: 4569283 - DNA, 17 bp, Homo sapiens
gccattctcctgcctca

SEQ ID NO: 4569284 - DNA, 15 bp, Homo sapiens
gccattctgattatt

SEQ ID NO: 4569285 - DNA, 19 bp, Homo sapiens
gccattctttcccaacacc

SEQ ID NO: 4569286 - DNA, 18 bp, Homo sapiens
gccattgggaccctccag

SEQ ID NO: 4569287 - DNA, 17 bp, Homo sapiens
gccattgtactccagcc

SEQ ID NO: 4569288 - DNA, 12 bp, Homo sapiens
gccattgtcttt

SEQ ID NO: 4569289 - DNA, 14 bp, Homo sapiens
gccattgtctttat

SEQ ID NO: 4569290 - DNA, 19 bp, Homo sapiens
gccattgtgaaccaatgca

SEQ ID NO: 4569291 - DNA, 22 bp, Homo sapiens
gccatttaagtatcttgtgctt

SEQ ID NO: 4569292 - DNA, 15 bp, Homo sapiens
gccatttatttcctc

SEQ ID NO: 4569293 - DNA, 11 bp, Homo sapiens
gccatttcatg

SEQ ID NO: 4569294 - DNA, 14 bp, Homo sapiens
gccatttcatgtcc

SEQ ID NO: 4569295 - DNA, 13 bp, Homo sapiens
gccatttccgtgg

SEQ ID NO: 4569296 - DNA, 21 bp, Homo sapiens
gccatttccgtggtttctcat

SEQ ID NO: 4569297 - DNA, 18 bp, Homo sapiens
gccatttgtcccaagtgc

SEQ ID NO: 4569298 - DNA, 18 bp, Homo sapiens
gccatttttcaaagcaat

SEQ ID NO: 4569299 - DNA, 19 bp, Homo sapiens
gccatttttcaaagcaatt

SEQ ID NO: 4569300 - DNA, 19 bp, Homo sapiens
gcccaaacagctgtattta

SEQ ID NO: 4569301 - DNA, 21 bp, Homo sapiens
gcccaaacagctgtatttata

SEQ ID NO: 4569302 - DNA, 16 bp, Homo sapiens
gcccaaacccttaact

SEQ ID NO: 4569303 - DNA, 13 bp, Homo sapiens
gcccaaccctgtc

SEQ ID NO: 4569304 - DNA, 15 bp, Homo sapiens
gcccaaccctgtctg

SEQ ID NO: 4569305 - DNA, 16 bp, Homo sapiens
gcccaaccctgtctgt

SEQ ID NO: 4569306 - DNA, 20 bp, Homo sapiens
gcccaactggttcaggctca

SEQ ID NO: 4569307 - DNA, 20 bp, Homo sapiens
gcccaagacagatgccccag

SEQ ID NO: 4569308 - DNA, 18 bp, Homo sapiens
gcccaagaggtctgagcc

SEQ ID NO: 4569309 - DNA, 15 bp, Homo sapiens
gcccaaggcggcccc

SEQ ID NO: 4569310 - DNA, 18 bp, Homo sapiens
gcccaaggcggcccctcc

SEQ ID NO: 4569311 - DNA, 18 bp, Homo sapiens
gcccaaggttgcacagca

SEQ ID NO: 4569312 - DNA, 19 bp, Homo sapiens
gcccaaggttgcacagcaa

SEQ ID NO: 4569313 - DNA, 20 bp, Homo sapiens
gcccaaggttgcacagcaag

SEQ ID NO: 4569314 - DNA, 12 bp, Homo sapiens
gcccaatatatt

SEQ ID NO: 4569315 - DNA, 22 bp, Homo sapiens
gcccacaagccttactcacctc

SEQ ID NO: 4569316 - DNA, 11 bp, Homo sapiens
gcccacagagc

SEQ ID NO: 4569317 - DNA, 13 bp, Homo sapiens
gcccacagagcct

SEQ ID NO: 4569318 - DNA, 14 bp, Homo sapiens
gcccacagagcctg

SEQ ID NO: 4569319 - DNA, 13 bp, Homo sapiens
gcccacagctccc

SEQ ID NO: 4569320 - DNA, 14 bp, Homo sapiens
gcccacagctccca

SEQ ID NO: 4569321 - DNA, 19 bp, Homo sapiens
gcccacagctcccacccca

SEQ ID NO: 4569322 - DNA, 21 bp, Homo sapiens
gcccaccaacatcccattgcc

SEQ ID NO: 4569323 - DNA, 13 bp, Homo sapiens
gcccaccagcctt

SEQ ID NO: 4569324 - DNA, 16 bp, Homo sapiens
gcccaccagccttgct

SEQ ID NO: 4569325 - DNA, 14 bp, Homo sapiens
gcccacccagtcca

SEQ ID NO: 4569326 - DNA, 23 bp, Homo sapiens
gcccacccagtccatgctccagg

SEQ ID NO: 4569327 - DNA, 23 bp, Homo sapiens
gcccacccccctccccaactccc

SEQ ID NO: 4569328 - DNA, 15 bp, Homo sapiens
gcccaccccctgccc

SEQ ID NO: 4569329 - DNA, 16 bp, Homo sapiens
gcccaccccctgccct

SEQ ID NO: 4569330 - DNA, 18 bp, Homo sapiens
gcccaccccctgccctgc

SEQ ID NO: 4569331 - DNA, 15 bp, Homo sapiens
gcccacccgccttgt

SEQ ID NO: 4569332 - DNA, 16 bp, Homo sapiens
gcccacccgccttgtg

SEQ ID NO: 4569333 - DNA, 18 bp, Homo sapiens
gcccacccgccttgtgag

SEQ ID NO: 4569334 - DNA, 13 bp, Homo sapiens
gcccacctgccca

SEQ ID NO: 4569335 - DNA, 23 bp, Homo sapiens
gcccacggttcggggcttctgcg

SEQ ID NO: 4569336 - DNA, 16 bp, Homo sapiens
gcccacgtcaggcctg

SEQ ID NO: 4569337 - DNA, 21 bp, Homo sapiens
gcccacgtcaggcctggcctc

SEQ ID NO: 4569338 - DNA, 12 bp, Homo sapiens
gcccactcccca

SEQ ID NO: 4569339 - DNA, 15 bp, Homo sapiens
gcccactccccagcc

SEQ ID NO: 4569340 - DNA, 20 bp, Homo sapiens
gcccactccccagccccagc

SEQ ID NO: 4569341 - DNA, 19 bp, Homo sapiens
gcccactgaggggccaggg

SEQ ID NO: 4569342 - DNA, 17 bp, Homo sapiens
gcccactggccgctgag

SEQ ID NO: 4569343 - DNA, 19 bp, Homo sapiens
gcccactggccgctgagcg

SEQ ID NO: 4569344 - DNA, 21 bp, Homo sapiens
gcccactggccgctgagcgcc

SEQ ID NO: 4569345 - DNA, 22 bp, Homo sapiens
gcccactggccgctgagcgccc

SEQ ID NO: 4569346 - DNA, 15 bp, Homo sapiens
gcccagaaagtgggg

SEQ ID NO: 4569347 - DNA, 23 bp, Homo sapiens
gcccagaagcctgatctttgggc

SEQ ID NO: 4569348 - DNA, 21 bp, Homo sapiens
gcccagacaccatgtgcaata

SEQ ID NO: 4569349 - DNA, 16 bp, Homo sapiens
gcccagactgatgagc

SEQ ID NO: 4569350 - DNA, 20 bp, Homo sapiens
gcccagagatgcctccaccg

SEQ ID NO: 4569351 - DNA, 14 bp, Homo sapiens
gcccagagccacct

SEQ ID NO: 4569352 - DNA, 15 bp, Homo sapiens
gcccagagccacctg

SEQ ID NO: 4569353 - DNA, 22 bp, Homo sapiens
gcccagagccatactgcgtcca

SEQ ID NO: 4569354 - DNA, 18 bp, Homo sapiens
gcccagagggtggcaaga

SEQ ID NO: 4569355 - DNA, 20 bp, Homo sapiens
gcccagatgtgtccccccca

SEQ ID NO: 4569356 - DNA, 17 bp, Homo sapiens
gcccagcacgagcctgg

SEQ ID NO: 4569357 - DNA, 19 bp, Homo sapiens
gcccagcacgagcctgggc

SEQ ID NO: 4569358 - DNA, 18 bp, Homo sapiens
gcccagcagcccctgaga

SEQ ID NO: 4569359 - DNA, 17 bp, Homo sapiens
gcccagccaggccaaca

SEQ ID NO: 4569360 - DNA, 13 bp, Homo sapiens
gcccagcccaagc

SEQ ID NO: 4569361 - DNA, 14 bp, Homo sapiens
gcccagcccagagc

SEQ ID NO: 4569362 - DNA, 18 bp, Homo sapiens
gcccagcccagagccacc

SEQ ID NO: 4569363 - DNA, 14 bp, Homo sapiens
gcccagcccagctg

SEQ ID NO: 4569364 - DNA, 16 bp, Homo sapiens
gcccagcccagctggt

SEQ ID NO: 4569365 - DNA, 15 bp, Homo sapiens
gcccagcccccacag

SEQ ID NO: 4569366 - DNA, 23 bp, Homo sapiens
gcccagcccccacagtgctgtct

SEQ ID NO: 4569367 - DNA, 13 bp, Homo sapiens
gcccagcccggct

SEQ ID NO: 4569368 - DNA, 14 bp, Homo sapiens
gcccagcccggctc

SEQ ID NO: 4569369 - DNA, 16 bp, Homo sapiens
gcccagccctaaacat

SEQ ID NO: 4569370 - DNA, 17 bp, Homo sapiens
gcccagccctggcccag

SEQ ID NO: 4569371 - DNA, 18 bp, Homo sapiens
gcccagccctggcccagg

SEQ ID NO: 4569372 - DNA, 15 bp, Homo sapiens
gcccagccgggcaca

SEQ ID NO: 4569373 - DNA, 16 bp, Homo sapiens
gcccagccgggcacag

SEQ ID NO: 4569374 - DNA, 11 bp, Homo sapiens
gcccagcctct

SEQ ID NO: 4569375 - DNA, 22 bp, Homo sapiens
gcccagcctctccccgctctgg

SEQ ID NO: 4569376 - DNA, 20 bp, Homo sapiens
gcccagcctgggagcccaga

SEQ ID NO: 4569377 - DNA, 15 bp, Homo sapiens
gcccagcgccaagta

SEQ ID NO: 4569378 - DNA, 23 bp, Homo sapiens
gcccagcgtcagaagtctagttt

SEQ ID NO: 4569379 - DNA, 17 bp, Homo sapiens
gcccagctaatttttgt

SEQ ID NO: 4569380 - DNA, 10 bp, Homo sapiens
gcccaggaga

SEQ ID NO: 4569381 - DNA, 18 bp, Homo sapiens
gcccaggagacagaccac

SEQ ID NO: 4569382 - DNA, 15 bp, Homo sapiens
gcccaggagcctcac

SEQ ID NO: 4569383 - DNA, 14 bp, Homo sapiens
gcccaggagtccag

SEQ ID NO: 4569384 - DNA, 17 bp, Homo sapiens
gcccaggagtccaggcc

SEQ ID NO: 4569385 - DNA, 18 bp, Homo sapiens
gcccaggagtccaggccc

SEQ ID NO: 4569386 - DNA, 21 bp, Homo sapiens
gcccaggagtttgaggctgca

SEQ ID NO: 4569387 - DNA, 23 bp, Homo sapiens
gcccaggatactggcacagaggt

SEQ ID NO: 4569388 - DNA, 13 bp, Homo sapiens
gcccaggccaggt

SEQ ID NO: 4569389 - DNA, 16 bp, Homo sapiens
gcccaggccaggtgcc

SEQ ID NO: 4569390 - DNA, 19 bp, Homo sapiens
gcccaggcctctcggtgct

SEQ ID NO: 4569391 - DNA, 18 bp, Homo sapiens
gcccaggctggactgcag

SEQ ID NO: 4569392 - DNA, 15 bp, Homo sapiens
gcccagggaagcctg

SEQ ID NO: 4569393 - DNA, 16 bp, Homo sapiens
gcccagggaagcctgg

SEQ ID NO: 4569394 - DNA, 23 bp, Homo sapiens
gcccagggacaccagccaggctc

SEQ ID NO: 4569395 - DNA, 12 bp, Homo sapiens
gcccaggggctg

SEQ ID NO: 4569396 - DNA, 19 bp, Homo sapiens
gcccaggttggagtgcagt

SEQ ID NO: 4569397 - DNA, 19 bp, Homo sapiens
gcccagtacatttaaattt

SEQ ID NO: 4569398 - DNA, 22 bp, Homo sapiens
gcccagtacatttaaatttttt

SEQ ID NO: 4569399 - DNA, 22 bp, Homo sapiens
gcccagtacctagctggctctg

SEQ ID NO: 4569400 - DNA, 17 bp, Homo sapiens
gcccagtgagccctgct

SEQ ID NO: 4569401 - DNA, 19 bp, Homo sapiens
gcccagtgagccctgctct

SEQ ID NO: 4569402 - DNA, 20 bp, Homo sapiens
gcccagtgagccctgctctt

SEQ ID NO: 4569403 - DNA, 14 bp, Homo sapiens
gcccatcctgacca

SEQ ID NO: 4569404 - DNA, 19 bp, Homo sapiens
gcccatgcccacctgccca

SEQ ID NO: 4569405 - DNA, 18 bp, Homo sapiens
gcccatggcccccaataa

SEQ ID NO: 4569406 - DNA, 16 bp, Homo sapiens
gcccatgtgtcccctc

SEQ ID NO: 4569407 - DNA, 23 bp, Homo sapiens
gcccatgtgtcccctcactctgt

SEQ ID NO: 4569408 - DNA, 13 bp, Homo sapiens
gcccattcctgcc

SEQ ID NO: 4569409 - DNA, 14 bp, Homo sapiens
gcccattcctgcct

SEQ ID NO: 4569410 - DNA, 13 bp, Homo sapiens
gcccattcttctg

SEQ ID NO: 4569411 - DNA, 15 bp, Homo sapiens
gcccattcttctggg

SEQ ID NO: 4569412 - DNA, 21 bp, Homo sapiens
gcccatttacacttttgagac

SEQ ID NO: 4569413 - DNA, 19 bp, Homo sapiens
gccccaactccaggggcac

SEQ ID NO: 4569414 - DNA, 16 bp, Homo sapiens
gccccaactcctggaa

SEQ ID NO: 4569415 - DNA, 16 bp, Homo sapiens
gccccacactggggtg

SEQ ID NO: 4569416 - DNA, 13 bp, Homo sapiens
gccccacatgcat

SEQ ID NO: 4569417 - DNA, 14 bp, Homo sapiens
gccccaccacctag

SEQ ID NO: 4569418 - DNA, 18 bp, Homo sapiens
gccccaccagtgcctctc

SEQ ID NO: 4569419 - DNA, 22 bp, Homo sapiens
gccccaccagtgcctctccctg

SEQ ID NO: 4569420 - DNA, 11 bp, Homo sapiens
gccccacccag

SEQ ID NO: 4569421 - DNA, 18 bp, Homo sapiens
gccccacgttgtccctga

SEQ ID NO: 4569422 - DNA, 12 bp, Homo sapiens
gccccagacagg

SEQ ID NO: 4569423 - DNA, 12 bp, Homo sapiens
gccccagagaga

SEQ ID NO: 4569424 - DNA, 15 bp, Homo sapiens
gccccagagagaccc

SEQ ID NO: 4569425 - DNA, 13 bp, Homo sapiens
gccccagagctgt

SEQ ID NO: 4569426 - DNA, 14 bp, Homo sapiens
gccccagagctgtt

SEQ ID NO: 4569427 - DNA, 16 bp, Homo sapiens
gccccagagtggccca

SEQ ID NO: 4569428 - DNA, 16 bp, Homo sapiens
gccccagcccaccctc

SEQ ID NO: 4569429 - DNA, 12 bp, Homo sapiens
gccccagcccag

SEQ ID NO: 4569430 - DNA, 14 bp, Homo sapiens
gccccagcccagac

SEQ ID NO: 4569431 - DNA, 21 bp, Homo sapiens
gccccagcgggctggcgggcc

SEQ ID NO: 4569432 - DNA, 22 bp, Homo sapiens
gccccagcgggctggcgggcct

SEQ ID NO: 4569433 - DNA, 12 bp, Homo sapiens
gccccaggagaa

SEQ ID NO: 4569434 - DNA, 16 bp, Homo sapiens
gccccaggccagctgc

SEQ ID NO: 4569435 - DNA, 19 bp, Homo sapiens
gccccaggccagctgcggc

SEQ ID NO: 4569436 - DNA, 20 bp, Homo sapiens
gccccagggggcggggtgca

SEQ ID NO: 4569437 - DNA, 23 bp, Homo sapiens
gccccaggtacacctccccctgc

SEQ ID NO: 4569438 - DNA, 14 bp, Homo sapiens
gccccagtcagcct

SEQ ID NO: 4569439 - DNA, 18 bp, Homo sapiens
gccccagtcagcctctct

SEQ ID NO: 4569440 - DNA, 20 bp, Homo sapiens
gccccagtcggccccatctc

SEQ ID NO: 4569441 - DNA, 19 bp, Homo sapiens
gccccatccagacctggct

SEQ ID NO: 4569442 - DNA, 14 bp, Homo sapiens
gccccatccctgct

SEQ ID NO: 4569443 - DNA, 20 bp, Homo sapiens
gccccatcctcatccctgac

SEQ ID NO: 4569444 - DNA, 15 bp, Homo sapiens
gccccatctgcgggg

SEQ ID NO: 4569445 - DNA, 21 bp, Homo sapiens
gccccatcttgatctttgagc

SEQ ID NO: 4569446 - DNA, 23 bp, Homo sapiens
gccccatcttgatctttgagccc

SEQ ID NO: 4569447 - DNA, 14 bp, Homo sapiens
gccccatgcctgtc

SEQ ID NO: 4569448 - DNA, 20 bp, Homo sapiens
gccccatgcctgtccagcct

SEQ ID NO: 4569449 - DNA, 21 bp, Homo sapiens
gccccattccttgcgcctcag

SEQ ID NO: 4569450 - DNA, 23 bp, Homo sapiens
gccccattgagatcttcctgctg

SEQ ID NO: 4569451 - DNA, 18 bp, Homo sapiens
gcccccaacccctcctcc

SEQ ID NO: 4569452 - DNA, 19 bp, Homo sapiens
gcccccaacccctcctccc

SEQ ID NO: 4569453 - DNA, 22 bp, Homo sapiens
gcccccaacccctcctccctca

SEQ ID NO: 4569454 - DNA, 13 bp, Homo sapiens
gcccccaataaac

SEQ ID NO: 4569455 - DNA, 14 bp, Homo sapiens
gcccccaataaacc

SEQ ID NO: 4569456 - DNA, 19 bp, Homo sapiens
gcccccaataaaccagtgt

SEQ ID NO: 4569457 - DNA, 14 bp, Homo sapiens
gcccccaataaagg

SEQ ID NO: 4569458 - DNA, 16 bp, Homo sapiens
gcccccaataaaggca

SEQ ID NO: 4569459 - DNA, 17 bp, Homo sapiens
gcccccaataaaggcag

SEQ ID NO: 4569460 - DNA, 18 bp, Homo sapiens
gcccccaataaaggcagc

SEQ ID NO: 4569461 - DNA, 20 bp, Homo sapiens
gcccccaataaaggcagctg

SEQ ID NO: 4569462 - DNA, 21 bp, Homo sapiens
gcccccaataaaggcagctgc

SEQ ID NO: 4569463 - DNA, 22 bp, Homo sapiens
gcccccaataaaggcagctgcc

SEQ ID NO: 4569464 - DNA, 24 bp, Homo sapiens
gcccccaataaaggcagctgcctc

SEQ ID NO: 4569465 - DNA, 15 bp, Homo sapiens
gcccccacagcgctc

SEQ ID NO: 4569466 - DNA, 22 bp, Homo sapiens
gcccccaccccggggaccctgt

SEQ ID NO: 4569467 - DNA, 16 bp, Homo sapiens
gcccccaccccttcct

SEQ ID NO: 4569468 - DNA, 18 bp, Homo sapiens
gcccccaccccttcctgt

SEQ ID NO: 4569469 - DNA, 21 bp, Homo sapiens
gcccccaccggaactgggctg

SEQ ID NO: 4569470 - DNA, 16 bp, Homo sapiens
gcccccagaaagcctc

SEQ ID NO: 4569471 - DNA, 17 bp, Homo sapiens
gcccccagaaagcctcc

SEQ ID NO: 4569472 - DNA, 21 bp, Homo sapiens
gcccccagaaagcctcctgcc

SEQ ID NO: 4569473 - DNA, 17 bp, Homo sapiens
gcccccagcagaggcag

SEQ ID NO: 4569474 - DNA, 21 bp, Homo sapiens
gcccccagcccctcctccctc

SEQ ID NO: 4569475 - DNA, 13 bp, Homo sapiens
gcccccaggactg

SEQ ID NO: 4569476 - DNA, 14 bp, Homo sapiens
gcccccaggactgg

SEQ ID NO: 4569477 - DNA, 15 bp, Homo sapiens
gcccccaggactggg

SEQ ID NO: 4569478 - DNA, 18 bp, Homo sapiens
gcccccaggactgggcca

SEQ ID NO: 4569479 - DNA, 23 bp, Homo sapiens
gcccccaggtgacacgcttctga

SEQ ID NO: 4569480 - DNA, 20 bp, Homo sapiens
gcccccagtccccacccctg

SEQ ID NO: 4569481 - DNA, 21 bp, Homo sapiens
gcccccagtccccacccctgc

SEQ ID NO: 4569482 - DNA, 16 bp, Homo sapiens
gcccccatcagccctg

SEQ ID NO: 4569483 - DNA, 20 bp, Homo sapiens
gccccccagagagagctctg

SEQ ID NO: 4569484 - DNA, 23 bp, Homo sapiens
gccccccagagagagctctgcac

SEQ ID NO: 4569485 - DNA, 12 bp, Homo sapiens
gccccccagcac

SEQ ID NO: 4569486 - DNA, 12 bp, Homo sapiens
gccccccagctc

SEQ ID NO: 4569487 - DNA, 18 bp, Homo sapiens
gccccccagctcccacac

SEQ ID NO: 4569488 - DNA, 16 bp, Homo sapiens
gccccccgaggctgct

SEQ ID NO: 4569489 - DNA, 17 bp, Homo sapiens
gccccccgcacagccac

SEQ ID NO: 4569490 - DNA, 18 bp, Homo sapiens
gccccccgcacagccacc

SEQ ID NO: 4569491 - DNA, 22 bp, Homo sapiens
gccccccgcacagccacccgtg

SEQ ID NO: 4569492 - DNA, 18 bp, Homo sapiens
gccccccgcgcgcccacc

SEQ ID NO: 4569493 - DNA, 21 bp, Homo sapiens
gccccccgcgcgcccaccctc

SEQ ID NO: 4569494 - DNA, 23 bp, Homo sapiens
gcccccctagcaatacagggagg

SEQ ID NO: 4569495 - DNA, 13 bp, Homo sapiens
gcccccctcctcc

SEQ ID NO: 4569496 - DNA, 15 bp, Homo sapiens
gcccccgagccctga

SEQ ID NO: 4569497 - DNA, 14 bp, Homo sapiens
gcccccgccccaga

SEQ ID NO: 4569498 - DNA, 16 bp, Homo sapiens
gcccccgccccagagt

SEQ ID NO: 4569499 - DNA, 16 bp, Homo sapiens
gcccccgcgggttcta

SEQ ID NO: 4569500 - DNA, 22 bp, Homo sapiens
gcccccgcgggttctagacgcc

SEQ ID NO: 4569501 - DNA, 14 bp, Homo sapiens
gcccccggccaagg

SEQ ID NO: 4569502 - DNA, 21 bp, Homo sapiens
gcccccggccaaggacccagg

SEQ ID NO: 4569503 - DNA, 22 bp, Homo sapiens
gcccccggccaaggacccaggc

SEQ ID NO: 4569504 - DNA, 15 bp, Homo sapiens
gccccctcccaccgc

SEQ ID NO: 4569505 - DNA, 23 bp, Homo sapiens
gccccctcccaccgctgcctcgt

SEQ ID NO: 4569506 - DNA, 16 bp, Homo sapiens
gccccctcccccatgg

SEQ ID NO: 4569507 - DNA, 20 bp, Homo sapiens
gccccctctcggccaggcat

SEQ ID NO: 4569508 - DNA, 13 bp, Homo sapiens
gccccctgccagt

SEQ ID NO: 4569509 - DNA, 16 bp, Homo sapiens
gccccctggtctctgg

SEQ ID NO: 4569510 - DNA, 17 bp, Homo sapiens
gccccctggtctctggt

SEQ ID NO: 4569511 - DNA, 13 bp, Homo sapiens
gccccctgtggat

SEQ ID NO: 4569512 - DNA, 16 bp, Homo sapiens
gccccctttcagatgt

SEQ ID NO: 4569513 - DNA, 23 bp, Homo sapiens
gccccctttcagatgtcttctgc

SEQ ID NO: 4569514 - DNA, 15 bp, Homo sapiens
gccccgactccagcc

SEQ ID NO: 4569515 - DNA, 16 bp, Homo sapiens
gccccgactccagcca

SEQ ID NO: 4569516 - DNA, 18 bp, Homo sapiens
gccccgactccagccagc

SEQ ID NO: 4569517 - DNA, 19 bp, Homo sapiens
gccccgactccagccagcg

SEQ ID NO: 4569518 - DNA, 20 bp, Homo sapiens
gccccgactccagccagcgc

SEQ ID NO: 4569519 - DNA, 20 bp, Homo sapiens
gccccgcagacggtctgtgt

SEQ ID NO: 4569520 - DNA, 16 bp, Homo sapiens
gccccgccagggctgg

SEQ ID NO: 4569521 - DNA, 17 bp, Homo sapiens
gccccgccagggctggg

SEQ ID NO: 4569522 - DNA, 19 bp, Homo sapiens
gccccgccagggctgggga

SEQ ID NO: 4569523 - DNA, 21 bp, Homo sapiens
gccccgcccccagtccccacc

SEQ ID NO: 4569524 - DNA, 12 bp, Homo sapiens
gccccgcccctc

SEQ ID NO: 4569525 - DNA, 23 bp, Homo sapiens
gccccgcccctcccacgcctcac

SEQ ID NO: 4569526 - DNA, 16 bp, Homo sapiens
gccccgcttgtccagc

SEQ ID NO: 4569527 - DNA, 18 bp, Homo sapiens
gccccggcaagccacagg

SEQ ID NO: 4569528 - DNA, 14 bp, Homo sapiens
gccccggccctggg

SEQ ID NO: 4569529 - DNA, 21 bp, Homo sapiens
gccccggccctgggctcggag

SEQ ID NO: 4569530 - DNA, 13 bp, Homo sapiens
gccccgggatatt

SEQ ID NO: 4569531 - DNA, 22 bp, Homo sapiens
gccccgggatattatagaaaat

SEQ ID NO: 4569532 - DNA, 20 bp, Homo sapiens
gccccggggccccctggtca

SEQ ID NO: 4569533 - DNA, 16 bp, Homo sapiens
gccccggtcccccaga

SEQ ID NO: 4569534 - DNA, 22 bp, Homo sapiens
gccccggtcccccagagcatct

SEQ ID NO: 4569535 - DNA, 21 bp, Homo sapiens
gccccgtcggactgcccccag

SEQ ID NO: 4569536 - DNA, 22 bp, Homo sapiens
gccccgtcggactgcccccaga

SEQ ID NO: 4569537 - DNA, 13 bp, Homo sapiens
gccccgtctctct

SEQ ID NO: 4569538 - DNA, 12 bp, Homo sapiens
gccccgtgggtg

SEQ ID NO: 4569539 - DNA, 17 bp, Homo sapiens
gccccgtgtgtgtggcc

SEQ ID NO: 4569540 - DNA, 21 bp, Homo sapiens
gcccctatagcactgagctca

SEQ ID NO: 4569541 - DNA, 14 bp, Homo sapiens
gcccctcacaacag

SEQ ID NO: 4569542 - DNA, 14 bp, Homo sapiens
gcccctcacccacc

SEQ ID NO: 4569543 - DNA, 15 bp, Homo sapiens
gcccctcacccacca

SEQ ID NO: 4569544 - DNA, 22 bp, Homo sapiens
gcccctcacccaccatggacca

SEQ ID NO: 4569545 - DNA, 20 bp, Homo sapiens
gcccctcacttgaggaggag

SEQ ID NO: 4569546 - DNA, 16 bp, Homo sapiens
gcccctccacgcctcc

SEQ ID NO: 4569547 - DNA, 17 bp, Homo sapiens
gcccctccacgcctcct

SEQ ID NO: 4569548 - DNA, 20 bp, Homo sapiens
gcccctccacgcctcctggc

SEQ ID NO: 4569549 - DNA, 23 bp, Homo sapiens
gcccctccacgcctcctggccag

SEQ ID NO: 4569550 - DNA, 13 bp, Homo sapiens
gcccctccagctt

SEQ ID NO: 4569551 - DNA, 22 bp, Homo sapiens
gcccctcccaagcgttcctggc

SEQ ID NO: 4569552 - DNA, 17 bp, Homo sapiens
gcccctccccagactct

SEQ ID NO: 4569553 - DNA, 18 bp, Homo sapiens
gcccctccccagactctc

SEQ ID NO: 4569554 - DNA, 12 bp, Homo sapiens
gcccctccccca

SEQ ID NO: 4569555 - DNA, 23 bp, Homo sapiens
gcccctcccccaacccccacccc

SEQ ID NO: 4569556 - DNA, 13 bp, Homo sapiens
gcccctcccgccc

SEQ ID NO: 4569557 - DNA, 16 bp, Homo sapiens
gcccctccctacctca

SEQ ID NO: 4569558 - DNA, 14 bp, Homo sapiens
gcccctcctccctc

SEQ ID NO: 4569559 - DNA, 15 bp, Homo sapiens
gcccctcctccctca

SEQ ID NO: 4569560 - DNA, 16 bp, Homo sapiens
gcccctcctccctcaa

SEQ ID NO: 4569561 - DNA, 20 bp, Homo sapiens
gcccctcctccctcagaccc

SEQ ID NO: 4569562 - DNA, 17 bp, Homo sapiens
gcccctcctccctcagg

SEQ ID NO: 4569563 - DNA, 12 bp, Homo sapiens
gcccctcctctg

SEQ ID NO: 4569564 - DNA, 15 bp, Homo sapiens
gcccctcctctgcca

SEQ ID NO: 4569565 - DNA, 20 bp, Homo sapiens
gcccctcctctgccacctcc

SEQ ID NO: 4569566 - DNA, 17 bp, Homo sapiens
gcccctcgaccctgtgc

SEQ ID NO: 4569567 - DNA, 18 bp, Homo sapiens
gcccctcgaccctgtgca

SEQ ID NO: 4569568 - DNA, 19 bp, Homo sapiens
gcccctcgaccctgtgcag

SEQ ID NO: 4569569 - DNA, 15 bp, Homo sapiens
gcccctctctaggga

SEQ ID NO: 4569570 - DNA, 17 bp, Homo sapiens
gcccctctctagggacc

SEQ ID NO: 4569571 - DNA, 14 bp, Homo sapiens
gcccctctgccttg

SEQ ID NO: 4569572 - DNA, 15 bp, Homo sapiens
gcccctgagagcctg

SEQ ID NO: 4569573 - DNA, 17 bp, Homo sapiens
gcccctgcacagcaggc

SEQ ID NO: 4569574 - DNA, 23 bp, Homo sapiens
gcccctgcacagcaggctgccag

SEQ ID NO: 4569575 - DNA, 12 bp, Homo sapiens
gcccctgcagct

SEQ ID NO: 4569576 - DNA, 12 bp, Homo sapiens
gcccctgcctcc

SEQ ID NO: 4569577 - DNA, 21 bp, Homo sapiens
gcccctgcgtgggggccagtc

SEQ ID NO: 4569578 - DNA, 19 bp, Homo sapiens
gcccctgctcactgggccc

SEQ ID NO: 4569579 - DNA, 15 bp, Homo sapiens
gcccctggagcctca

SEQ ID NO: 4569580 - DNA, 17 bp, Homo sapiens
gcccctggagcctcaga

SEQ ID NO: 4569581 - DNA, 11 bp, Homo sapiens
gcccctggctt

SEQ ID NO: 4569582 - DNA, 17 bp, Homo sapiens
gcccctggctttgcctc

SEQ ID NO: 4569583 - DNA, 12 bp, Homo sapiens
gcccctgggctt

SEQ ID NO: 4569584 - DNA, 19 bp, Homo sapiens
gcccctgggcttggcctgc

SEQ ID NO: 4569585 - DNA, 12 bp, Homo sapiens
gcccctggggaa

SEQ ID NO: 4569586 - DNA, 21 bp, Homo sapiens
gcccctggggtggccaccagt

SEQ ID NO: 4569587 - DNA, 18 bp, Homo sapiens
gcccctggtaagcagagg

SEQ ID NO: 4569588 - DNA, 15 bp, Homo sapiens
gcccctgtctggaag

SEQ ID NO: 4569589 - DNA, 12 bp, Homo sapiens
gcccctgtctgt

SEQ ID NO: 4569590 - DNA, 19 bp, Homo sapiens
gcccctgtctgttcccagc

SEQ ID NO: 4569591 - DNA, 21 bp, Homo sapiens
gcccctgtgtattcaccacca

SEQ ID NO: 4569592 - DNA, 22 bp, Homo sapiens
gccccttccatggtactgtagc

SEQ ID NO: 4569593 - DNA, 19 bp, Homo sapiens
gccccttcccactcacccc

SEQ ID NO: 4569594 - DNA, 15 bp, Homo sapiens
gccccttccccatgg

SEQ ID NO: 4569595 - DNA, 13 bp, Homo sapiens
gccccttccctct

SEQ ID NO: 4569596 - DNA, 15 bp, Homo sapiens
gccccttccctctct

SEQ ID NO: 4569597 - DNA, 21 bp, Homo sapiens
gccccttccctctctccctgc

SEQ ID NO: 4569598 - DNA, 22 bp, Homo sapiens
gccccttccctctctccctgcc

SEQ ID NO: 4569599 - DNA, 20 bp, Homo sapiens
gccccttctacactctcctg

SEQ ID NO: 4569600 - DNA, 14 bp, Homo sapiens
gcccctttgcctgt

SEQ ID NO: 4569601 - DNA, 19 bp, Homo sapiens
gcccgaaactaagccaggc

SEQ ID NO: 4569602 - DNA, 21 bp, Homo sapiens
gcccgaaactaagccaggcct

SEQ ID NO: 4569603 - DNA, 22 bp, Homo sapiens
gcccgagggaggggaagcttct

SEQ ID NO: 4569604 - DNA, 15 bp, Homo sapiens
gcccgatattctccc

SEQ ID NO: 4569605 - DNA, 19 bp, Homo sapiens
gcccgcaggaactgggctg

SEQ ID NO: 4569606 - DNA, 20 bp, Homo sapiens
gcccgcaggaactgggctgg

SEQ ID NO: 4569607 - DNA, 19 bp, Homo sapiens
gcccgcatgtgtgcctggc

SEQ ID NO: 4569608 - DNA, 22 bp, Homo sapiens
gcccgcctgccagtcctagctg

SEQ ID NO: 4569609 - DNA, 23 bp, Homo sapiens
gcccgcctgccagtcctagctgc

SEQ ID NO: 4569610 - DNA, 12 bp, Homo sapiens
gcccgcctgccg

SEQ ID NO: 4569611 - DNA, 20 bp, Homo sapiens
gcccgcctgccgtgcatggc

SEQ ID NO: 4569612 - DNA, 12 bp, Homo sapiens
gcccgctcccac

SEQ ID NO: 4569613 - DNA, 13 bp, Homo sapiens
gcccgctcccaca

SEQ ID NO: 4569614 - DNA, 22 bp, Homo sapiens
gcccggccacacccagcggccc

SEQ ID NO: 4569615 - DNA, 16 bp, Homo sapiens
gcccggcgccgggcac

SEQ ID NO: 4569616 - DNA, 20 bp, Homo sapiens
gcccggcgccgggcaccaac

SEQ ID NO: 4569617 - DNA, 18 bp, Homo sapiens
gcccgggaaggtcaccag

SEQ ID NO: 4569618 - DNA, 23 bp, Homo sapiens
gcccgggaaggtcaccagcacca

SEQ ID NO: 4569619 - DNA, 19 bp, Homo sapiens
gcccgggcgcggccagccc

SEQ ID NO: 4569620 - DNA, 18 bp, Homo sapiens
gcccgtaatcccagctac

SEQ ID NO: 4569621 - DNA, 20 bp, Homo sapiens
gcccgtcagcatcactgatg

SEQ ID NO: 4569622 - DNA, 13 bp, Homo sapiens
gcccgtctctctc

SEQ ID NO: 4569623 - DNA, 17 bp, Homo sapiens
gcccgtctctctcccat

SEQ ID NO: 4569624 - DNA, 23 bp, Homo sapiens
gcccgtggtggcggtggctgccc

SEQ ID NO: 4569625 - DNA, 17 bp, Homo sapiens
gcccgtgtgacccgttc

SEQ ID NO: 4569626 - DNA, 18 bp, Homo sapiens
gccctacttccaggatgg

SEQ ID NO: 4569627 - DNA, 13 bp, Homo sapiens
gccctagagcctg

SEQ ID NO: 4569628 - DNA, 15 bp, Homo sapiens
gccctagagcctgcc

SEQ ID NO: 4569629 - DNA, 16 bp, Homo sapiens
gccctagagcctgcct

SEQ ID NO: 4569630 - DNA, 17 bp, Homo sapiens
gccctagagcctgcctg

SEQ ID NO: 4569631 - DNA, 20 bp, Homo sapiens
gccctagatgcacgtggggc

SEQ ID NO: 4569632 - DNA, 16 bp, Homo sapiens
gccctagcggctgctc

SEQ ID NO: 4569633 - DNA, 15 bp, Homo sapiens
gccctcacatcttcc

SEQ ID NO: 4569634 - DNA, 21 bp, Homo sapiens
gccctcacccctggttctcat

SEQ ID NO: 4569635 - DNA, 22 bp, Homo sapiens
gccctcacccctggttctcatc

SEQ ID NO: 4569636 - DNA, 16 bp, Homo sapiens
gccctcagttccttca

SEQ ID NO: 4569637 - DNA, 22 bp, Homo sapiens
gccctcatgggtcctagccctt

SEQ ID NO: 4569638 - DNA, 23 bp, Homo sapiens
gccctcatgggtcctagcccttc

SEQ ID NO: 4569639 - DNA, 13 bp, Homo sapiens
gccctccaaagag

SEQ ID NO: 4569640 - DNA, 13 bp, Homo sapiens
gccctccaaatgt

SEQ ID NO: 4569641 - DNA, 12 bp, Homo sapiens
gccctccagagc

SEQ ID NO: 4569642 - DNA, 16 bp, Homo sapiens
gccctccagagcccca

SEQ ID NO: 4569643 - DNA, 16 bp, Homo sapiens
gccctcccaagtccca

SEQ ID NO: 4569644 - DNA, 20 bp, Homo sapiens
gccctcccccttccccttct

SEQ ID NO: 4569645 - DNA, 21 bp, Homo sapiens
gccctcccctgcccctcacaa

SEQ ID NO: 4569646 - DNA, 22 bp, Homo sapiens
gccctccctgactccctgtggg

SEQ ID NO: 4569647 - DNA, 23 bp, Homo sapiens
gccctccctgactccctgtgggg

SEQ ID NO: 4569648 - DNA, 13 bp, Homo sapiens
gccctccctgcta

SEQ ID NO: 4569649 - DNA, 15 bp, Homo sapiens
gccctccctgctagc

SEQ ID NO: 4569650 - DNA, 19 bp, Homo sapiens
gccctccctgctagcacag

SEQ ID NO: 4569651 - DNA, 22 bp, Homo sapiens
gccctccctgctagcacagagg

SEQ ID NO: 4569652 - DNA, 14 bp, Homo sapiens
gccctccctgtcct

SEQ ID NO: 4569653 - DNA, 19 bp, Homo sapiens
gccctccctgtctccaggg

SEQ ID NO: 4569654 - DNA, 22 bp, Homo sapiens
gccctccgaccacttccagggg

SEQ ID NO: 4569655 - DNA, 21 bp, Homo sapiens
gccctcctcaccccgtctggg

SEQ ID NO: 4569656 - DNA, 19 bp, Homo sapiens
gccctcctccccagagctg

SEQ ID NO: 4569657 - DNA, 16 bp, Homo sapiens
gccctcctctgcactc

SEQ ID NO: 4569658 - DNA, 17 bp, Homo sapiens
gccctcctgagggccgg

SEQ ID NO: 4569659 - DNA, 15 bp, Homo sapiens
gccctccttgtccac

SEQ ID NO: 4569660 - DNA, 19 bp, Homo sapiens
gccctccttgtccacccac

SEQ ID NO: 4569661 - DNA, 17 bp, Homo sapiens
gccctcgctgccagctc

SEQ ID NO: 4569662 - DNA, 13 bp, Homo sapiens
gccctcggcctcc

SEQ ID NO: 4569663 - DNA, 18 bp, Homo sapiens
gccctcgggcccagcccc

SEQ ID NO: 4569664 - DNA, 20 bp, Homo sapiens
gccctctctctcactcccct

SEQ ID NO: 4569665 - DNA, 16 bp, Homo sapiens
gccctctctgctctgc

SEQ ID NO: 4569666 - DNA, 15 bp, Homo sapiens
gccctctttccctgc

SEQ ID NO: 4569667 - DNA, 19 bp, Homo sapiens
gccctctttccctgcgaga

SEQ ID NO: 4569668 - DNA, 17 bp, Homo sapiens
gccctgactcctctggc

SEQ ID NO: 4569669 - DNA, 13 bp, Homo sapiens
gccctgactcctg

SEQ ID NO: 4569670 - DNA, 17 bp, Homo sapiens
gccctgactcctggact

SEQ ID NO: 4569671 - DNA, 17 bp, Homo sapiens
gccctgagcactcctgg

SEQ ID NO: 4569672 - DNA, 22 bp, Homo sapiens
gccctgatgtgtcctcagggag

SEQ ID NO: 4569673 - DNA, 17 bp, Homo sapiens
gccctgattgtgccagt

SEQ ID NO: 4569674 - DNA, 19 bp, Homo sapiens
gccctgattgtgccagtgc

SEQ ID NO: 4569675 - DNA, 21 bp, Homo sapiens
gccctgcaaaaggactctcag

SEQ ID NO: 4569676 - DNA, 23 bp, Homo sapiens
gccctgcacgacccctgaatctg

SEQ ID NO: 4569677 - DNA, 19 bp, Homo sapiens
gccctgcagcccaccagac

SEQ ID NO: 4569678 - DNA, 14 bp, Homo sapiens
gccctgcccccacc

SEQ ID NO: 4569679 - DNA, 19 bp, Homo sapiens
gccctgcccccaccccttc

SEQ ID NO: 4569680 - DNA, 18 bp, Homo sapiens
gccctgccctcccaagtc

SEQ ID NO: 4569681 - DNA, 18 bp, Homo sapiens
gccctgcctgcagccagg

SEQ ID NO: 4569682 - DNA, 20 bp, Homo sapiens
gccctgcctgcagccagggc

SEQ ID NO: 4569683 - DNA, 13 bp, Homo sapiens
gccctgctccctg

SEQ ID NO: 4569684 - DNA, 14 bp, Homo sapiens
gccctgctccctgc

SEQ ID NO: 4569685 - DNA, 21 bp, Homo sapiens
gccctgctccctgcctcctgc

SEQ ID NO: 4569686 - DNA, 22 bp, Homo sapiens
gccctgctccctgcctcctgcc

SEQ ID NO: 4569687 - DNA, 21 bp, Homo sapiens
gccctgctcttctctccccag

SEQ ID NO: 4569688 - DNA, 23 bp, Homo sapiens
gccctgctcttctctccccagcc

SEQ ID NO: 4569689 - DNA, 11 bp, Homo sapiens
gccctgctggc

SEQ ID NO: 4569690 - DNA, 14 bp, Homo sapiens
gccctgctggccgc

SEQ ID NO: 4569691 - DNA, 22 bp, Homo sapiens
gccctgctgtgggagagcgaag

SEQ ID NO: 4569692 - DNA, 13 bp, Homo sapiens
gccctggaggatg

SEQ ID NO: 4569693 - DNA, 23 bp, Homo sapiens
gccctggattggttggcaaacta

SEQ ID NO: 4569694 - DNA, 18 bp, Homo sapiens
gccctggatttcagaaag

SEQ ID NO: 4569695 - DNA, 13 bp, Homo sapiens
gccctggccagga

SEQ ID NO: 4569696 - DNA, 19 bp, Homo sapiens
gccctggcccccacagcgc

SEQ ID NO: 4569697 - DNA, 21 bp, Homo sapiens
gccctggcccccacagcgctc

SEQ ID NO: 4569698 - DNA, 21 bp, Homo sapiens
gccctggcccccatcagccct

SEQ ID NO: 4569699 - DNA, 23 bp, Homo sapiens
gccctggcccccatcagccctgc

SEQ ID NO: 4569700 - DNA, 14 bp, Homo sapiens
gccctggcctgctg

SEQ ID NO: 4569701 - DNA, 17 bp, Homo sapiens
gccctggctcccacctg

SEQ ID NO: 4569702 - DNA, 18 bp, Homo sapiens
gccctggctcccacctgt

SEQ ID NO: 4569703 - DNA, 12 bp, Homo sapiens
gccctggctgct

SEQ ID NO: 4569704 - DNA, 14 bp, Homo sapiens
gccctggctgctgc

SEQ ID NO: 4569705 - DNA, 15 bp, Homo sapiens
gccctggctgttctg

SEQ ID NO: 4569706 - DNA, 23 bp, Homo sapiens
gccctggctgttctgtggttcct

SEQ ID NO: 4569707 - DNA, 18 bp, Homo sapiens
gccctgggccccaccacc

SEQ ID NO: 4569708 - DNA, 19 bp, Homo sapiens
gccctgggccccaccacct

SEQ ID NO: 4569709 - DNA, 16 bp, Homo sapiens
gccctgggctcggagg

SEQ ID NO: 4569710 - DNA, 23 bp, Homo sapiens
gccctgggctcggaggctgcccc

SEQ ID NO: 4569711 - DNA, 20 bp, Homo sapiens
gccctgggctgggtgctggg

SEQ ID NO: 4569712 - DNA, 22 bp, Homo sapiens
gccctgggctgtctgtcaccag

SEQ ID NO: 4569713 - DNA, 21 bp, Homo sapiens
gccctggggtttgaagctgac

SEQ ID NO: 4569714 - DNA, 20 bp, Homo sapiens
gccctgggtaagaagggtgg

SEQ ID NO: 4569715 - DNA, 22 bp, Homo sapiens
gccctgggtaagaagggtggga

SEQ ID NO: 4569716 - DNA, 14 bp, Homo sapiens
gccctggtctcagc

SEQ ID NO: 4569717 - DNA, 23 bp, Homo sapiens
gccctggtggtggctcgggaggc

SEQ ID NO: 4569718 - DNA, 11 bp, Homo sapiens
gccctgtccaa

SEQ ID NO: 4569719 - DNA, 16 bp, Homo sapiens
gccctgtcccaggccg

SEQ ID NO: 4569720 - DNA, 22 bp, Homo sapiens
gccctgtcccaggccggcccag

SEQ ID NO: 4569721 - DNA, 14 bp, Homo sapiens
gccctgtcgcccct

SEQ ID NO: 4569722 - DNA, 20 bp, Homo sapiens
gccctgtgcccgactgactg

SEQ ID NO: 4569723 - DNA, 13 bp, Homo sapiens
gccctgttaaaag

SEQ ID NO: 4569724 - DNA, 15 bp, Homo sapiens
gcccttaataataat

SEQ ID NO: 4569725 - DNA, 17 bp, Homo sapiens
gcccttccatgtgcctt

SEQ ID NO: 4569726 - DNA, 19 bp, Homo sapiens
gcccttccatgtgcctttc

SEQ ID NO: 4569727 - DNA, 20 bp, Homo sapiens
gcccttccatgtgcctttct

SEQ ID NO: 4569728 - DNA, 12 bp, Homo sapiens
gcccttcccagg

SEQ ID NO: 4569729 - DNA, 14 bp, Homo sapiens
gcccttcccagggc

SEQ ID NO: 4569730 - DNA, 23 bp, Homo sapiens
gcccttcccagggcacccaggca

SEQ ID NO: 4569731 - DNA, 14 bp, Homo sapiens
gcccttccctctgg

SEQ ID NO: 4569732 - DNA, 21 bp, Homo sapiens
gcccttctatacccacccaga

SEQ ID NO: 4569733 - DNA, 19 bp, Homo sapiens
gcccttctgattcccctcc

SEQ ID NO: 4569734 - DNA, 22 bp, Homo sapiens
gcccttctttgtcccctgggtc

SEQ ID NO: 4569735 - DNA, 20 bp, Homo sapiens
gcccttgcaatcttctactt

SEQ ID NO: 4569736 - DNA, 13 bp, Homo sapiens
gcccttgcactcc

SEQ ID NO: 4569737 - DNA, 22 bp, Homo sapiens
gcccttgcagttcagcaccacc

SEQ ID NO: 4569738 - DNA, 16 bp, Homo sapiens
gcccttgcctccccat

SEQ ID NO: 4569739 - DNA, 16 bp, Homo sapiens
gcccttgtcggcccca

SEQ ID NO: 4569740 - DNA, 16 bp, Homo sapiens
gccctttcctcctcag

SEQ ID NO: 4569741 - DNA, 17 bp, Homo sapiens
gcccttttttctgcctc

SEQ ID NO: 4569742 - DNA, 20 bp, Homo sapiens
gccgacctcgtcctccccct

SEQ ID NO: 4569743 - DNA, 22 bp, Homo sapiens
gccgaccttccctccgccttct

SEQ ID NO: 4569744 - DNA, 12 bp, Homo sapiens
gccgagagcctt

SEQ ID NO: 4569745 - DNA, 21 bp, Homo sapiens
gccgagagtccatcagcctcc

SEQ ID NO: 4569746 - DNA, 23 bp, Homo sapiens
gccgagcccagctgtgggcggct

SEQ ID NO: 4569747 - DNA, 22 bp, Homo sapiens
gccgagctcctggggagctcct

SEQ ID NO: 4569748 - DNA, 23 bp, Homo sapiens
gccgagctcctggggagctcctg

SEQ ID NO: 4569749 - DNA, 24 bp, Homo sapiens
gccgagctcctggggagctcctgg

SEQ ID NO: 4569750 - DNA, 18 bp, Homo sapiens
gccgagggctggccggga

SEQ ID NO: 4569751 - DNA, 16 bp, Homo sapiens
gccgagggtcctggct

SEQ ID NO: 4569752 - DNA, 17 bp, Homo sapiens
gccgatatactctagat

SEQ ID NO: 4569753 - DNA, 17 bp, Homo sapiens
gccgatttctgtaaact

SEQ ID NO: 4569754 - DNA, 18 bp, Homo sapiens
gccgattttgtaaatgtt

SEQ ID NO: 4569755 - DNA, 16 bp, Homo sapiens
gccgcaccccagagtg

SEQ ID NO: 4569756 - DNA, 12 bp, Homo sapiens
gccgcagagctg

SEQ ID NO: 4569757 - DNA, 21 bp, Homo sapiens
gccgcaggaaggcagaataaa

SEQ ID NO: 4569758 - DNA, 17 bp, Homo sapiens
gccgcatcttctccatc

SEQ ID NO: 4569759 - DNA, 17 bp, Homo sapiens
gccgcattggtgactca

SEQ ID NO: 4569760 - DNA, 17 bp, Homo sapiens
gccgccactaggtgtcc

SEQ ID NO: 4569761 - DNA, 19 bp, Homo sapiens
gccgccactaggtgtcccc

SEQ ID NO: 4569762 - DNA, 22 bp, Homo sapiens
gccgccactaggtgtccccaac

SEQ ID NO: 4569763 - DNA, 16 bp, Homo sapiens
gccgccattgccacca

SEQ ID NO: 4569764 - DNA, 21 bp, Homo sapiens
gccgccattgccaccaggaga

SEQ ID NO: 4569765 - DNA, 13 bp, Homo sapiens
gccgcccaaggcc

SEQ ID NO: 4569766 - DNA, 15 bp, Homo sapiens
gccgccctgggctgt

SEQ ID NO: 4569767 - DNA, 14 bp, Homo sapiens
gccgccgctgccct

SEQ ID NO: 4569768 - DNA, 13 bp, Homo sapiens
gccgcctcaatgt

SEQ ID NO: 4569769 - DNA, 16 bp, Homo sapiens
gccgcctcaccccctc

SEQ ID NO: 4569770 - DNA, 16 bp, Homo sapiens
gccgcctcccacggca

SEQ ID NO: 4569771 - DNA, 14 bp, Homo sapiens
gccgcgggccagga

SEQ ID NO: 4569772 - DNA, 17 bp, Homo sapiens
gccgctgccgctgcacc

SEQ ID NO: 4569773 - DNA, 16 bp, Homo sapiens
gccgctgttcacccac

SEQ ID NO: 4569774 - DNA, 17 bp, Homo sapiens
gccgctgttcacccaca

SEQ ID NO: 4569775 - DNA, 23 bp, Homo sapiens
gccggccacacccctctgctgca

SEQ ID NO: 4569776 - DNA, 14 bp, Homo sapiens
gccggcccagatgt

SEQ ID NO: 4569777 - DNA, 15 bp, Homo sapiens
gccggcccagatgtg

SEQ ID NO: 4569778 - DNA, 19 bp, Homo sapiens
gccggcccagatgtgtccc

SEQ ID NO: 4569779 - DNA, 12 bp, Homo sapiens
gccggccccagg

SEQ ID NO: 4569780 - DNA, 16 bp, Homo sapiens
gccggccgtggaagga

SEQ ID NO: 4569781 - DNA, 13 bp, Homo sapiens
gccggcctcctcc

SEQ ID NO: 4569782 - DNA, 19 bp, Homo sapiens
gccggctggttgtgggcac

SEQ ID NO: 4569783 - DNA, 23 bp, Homo sapiens
gccggcttcctccttccagatgc

SEQ ID NO: 4569784 - DNA, 16 bp, Homo sapiens
gccgggactgctgctc

SEQ ID NO: 4569785 - DNA, 21 bp, Homo sapiens
gccgggactgctgctctccca

SEQ ID NO: 4569786 - DNA, 21 bp, Homo sapiens
gccgggcacagtggctcacgc

SEQ ID NO: 4569787 - DNA, 17 bp, Homo sapiens
gccgggcccctgggctt

SEQ ID NO: 4569788 - DNA, 16 bp, Homo sapiens
gccggggacagaggcc

SEQ ID NO: 4569789 - DNA, 19 bp, Homo sapiens
gccggggacagaggcctgc

SEQ ID NO: 4569790 - DNA, 17 bp, Homo sapiens
gccggtcgggcagccag

SEQ ID NO: 4569791 - DNA, 18 bp, Homo sapiens
gccggtcgggcagccagc

SEQ ID NO: 4569792 - DNA, 17 bp, Homo sapiens
gccggtgccagctgccc

SEQ ID NO: 4569793 - DNA, 19 bp, Homo sapiens
gccggtgccagctgccctt

SEQ ID NO: 4569794 - DNA, 22 bp, Homo sapiens
gccggttctgctagagcagaca

SEQ ID NO: 4569795 - DNA, 13 bp, Homo sapiens
gccgtcatttcat

SEQ ID NO: 4569796 - DNA, 17 bp, Homo sapiens
gccgtccttgtctctgg

SEQ ID NO: 4569797 - DNA, 21 bp, Homo sapiens
gccgtgcatggctcctgtctg

SEQ ID NO: 4569798 - DNA, 13 bp, Homo sapiens
gccgtggccagag

SEQ ID NO: 4569799 - DNA, 15 bp, Homo sapiens
gccgtggccagaggc

SEQ ID NO: 4569800 - DNA, 15 bp, Homo sapiens
gccgtgtctctgagg

SEQ ID NO: 4569801 - DNA, 23 bp, Homo sapiens
gccgtttgaatatattttatctt

SEQ ID NO: 4569802 - DNA, 18 bp, Homo sapiens
gcctaactaactggcagg

SEQ ID NO: 4569803 - DNA, 21 bp, Homo sapiens
gcctaagcattgcctggcctt

SEQ ID NO: 4569804 - DNA, 15 bp, Homo sapiens
gcctaagtgcctctt

SEQ ID NO: 4569805 - DNA, 17 bp, Homo sapiens
gcctaagtggctgctga

SEQ ID NO: 4569806 - DNA, 22 bp, Homo sapiens
gcctaatgagagtgcactgctc

SEQ ID NO: 4569807 - DNA, 21 bp, Homo sapiens
gcctaattggaaagtgccagc

SEQ ID NO: 4569808 - DNA, 12 bp, Homo sapiens
gcctacagccag

SEQ ID NO: 4569809 - DNA, 14 bp, Homo sapiens
gcctacagccaggt

SEQ ID NO: 4569810 - DNA, 14 bp, Homo sapiens
gcctaccccagttc

SEQ ID NO: 4569811 - DNA, 16 bp, Homo sapiens
gcctaccccagttcct

SEQ ID NO: 4569812 - DNA, 16 bp, Homo sapiens
gcctacctcagcctcc

SEQ ID NO: 4569813 - DNA, 15 bp, Homo sapiens
gcctagactgttact

SEQ ID NO: 4569814 - DNA, 20 bp, Homo sapiens
gcctagactgttactttggc

SEQ ID NO: 4569815 - DNA, 14 bp, Homo sapiens
gcctagcctggctc

SEQ ID NO: 4569816 - DNA, 16 bp, Homo sapiens
gcctagcctggctctg

SEQ ID NO: 4569817 - DNA, 17 bp, Homo sapiens
gcctagcgatctctcct

SEQ ID NO: 4569818 - DNA, 18 bp, Homo sapiens
gcctagcggagcccagcc

SEQ ID NO: 4569819 - DNA, 16 bp, Homo sapiens
gcctagctcctgccac

SEQ ID NO: 4569820 - DNA, 20 bp, Homo sapiens
gcctagctcctgccacatgg

SEQ ID NO: 4569821 - DNA, 20 bp, Homo sapiens
gcctagggtcttgggggtca

SEQ ID NO: 4569822 - DNA, 22 bp, Homo sapiens
gcctagtgaaggcttctctctg

SEQ ID NO: 4569823 - DNA, 19 bp, Homo sapiens
gcctagtggggtctccctc

SEQ ID NO: 4569824 - DNA, 16 bp, Homo sapiens
gcctataatcccagct

SEQ ID NO: 4569825 - DNA, 20 bp, Homo sapiens
gcctatcagagttgctgcaa

SEQ ID NO: 4569826 - DNA, 21 bp, Homo sapiens
gcctatctaatttctttagtt

SEQ ID NO: 4569827 - DNA, 19 bp, Homo sapiens
gcctatgcactgaagagct

SEQ ID NO: 4569828 - DNA, 18 bp, Homo sapiens
gcctatgtggtctaaggt

SEQ ID NO: 4569829 - DNA, 21 bp, Homo sapiens
gcctattgtaatatagaaaaa

SEQ ID NO: 4569830 - DNA, 22 bp, Homo sapiens
gcctcaaagcaagcattcagaa

SEQ ID NO: 4569831 - DNA, 21 bp, Homo sapiens
gcctcaagcaatccacctgcc

SEQ ID NO: 4569832 - DNA, 15 bp, Homo sapiens
gcctcacagaagaat

SEQ ID NO: 4569833 - DNA, 15 bp, Homo sapiens
gcctcacccacccct

SEQ ID NO: 4569834 - DNA, 17 bp, Homo sapiens
gcctcacccacccctgc

SEQ ID NO: 4569835 - DNA, 20 bp, Homo sapiens
gcctcacccacccctgcaca

SEQ ID NO: 4569836 - DNA, 15 bp, Homo sapiens
gcctcaccccctcgg

SEQ ID NO: 4569837 - DNA, 23 bp, Homo sapiens
gcctcaccccctcgggtctcctc

SEQ ID NO: 4569838 - DNA, 20 bp, Homo sapiens
gcctcactatgttgcctagg

SEQ ID NO: 4569839 - DNA, 19 bp, Homo sapiens
gcctcactattacttgaac

SEQ ID NO: 4569840 - DNA, 13 bp, Homo sapiens
gcctcactcctcc

SEQ ID NO: 4569841 - DNA, 20 bp, Homo sapiens
gcctcagaaggccccagaga

SEQ ID NO: 4569842 - DNA, 23 bp, Homo sapiens
gcctcagaaggccccagagagac

SEQ ID NO: 4569843 - DNA, 13 bp, Homo sapiens
gcctcagaagtgc

SEQ ID NO: 4569844 - DNA, 23 bp, Homo sapiens
gcctcagagatctcccttctcat

SEQ ID NO: 4569845 - DNA, 14 bp, Homo sapiens
gcctcagccaggcc

SEQ ID NO: 4569846 - DNA, 13 bp, Homo sapiens
gcctcagccctca

SEQ ID NO: 4569847 - DNA, 16 bp, Homo sapiens
gcctcagccctcagaa

SEQ ID NO: 4569848 - DNA, 19 bp, Homo sapiens
gcctcagccctcagttcct

SEQ ID NO: 4569849 - DNA, 13 bp, Homo sapiens
gcctcagccctgc

SEQ ID NO: 4569850 - DNA, 22 bp, Homo sapiens
gcctcagccctgctccctgcct

SEQ ID NO: 4569851 - DNA, 20 bp, Homo sapiens
gcctcagcctcccatagctg

SEQ ID NO: 4569852 - DNA, 23 bp, Homo sapiens
gcctcagcctcccatagctggga

SEQ ID NO: 4569853 - DNA, 21 bp, Homo sapiens
gcctcagcctgctttcctgca

SEQ ID NO: 4569854 - DNA, 22 bp, Homo sapiens
gcctcagcctgctttcctgcag

SEQ ID NO: 4569855 - DNA, 15 bp, Homo sapiens
gcctcagctgcctca

SEQ ID NO: 4569856 - DNA, 19 bp, Homo sapiens
gcctcagctgcctcacttc

SEQ ID NO: 4569857 - DNA, 12 bp, Homo sapiens
gcctcaggctcc

SEQ ID NO: 4569858 - DNA, 22 bp, Homo sapiens
gcctcagtaagtatctggagga

SEQ ID NO: 4569859 - DNA, 22 bp, Homo sapiens
gcctcagttcaacctggtggca

SEQ ID NO: 4569860 - DNA, 15 bp, Homo sapiens
gcctcatactcctgg

SEQ ID NO: 4569861 - DNA, 17 bp, Homo sapiens
gcctcatactcctgggc

SEQ ID NO: 4569862 - DNA, 19 bp, Homo sapiens
gcctcatactcctgggctc

SEQ ID NO: 4569863 - DNA, 15 bp, Homo sapiens
gcctcatccagcctc

SEQ ID NO: 4569864 - DNA, 19 bp, Homo sapiens
gcctcatccagcctcagag

SEQ ID NO: 4569865 - DNA, 23 bp, Homo sapiens
gcctccaagatttaacctgcaag

SEQ ID NO: 4569866 - DNA, 20 bp, Homo sapiens
gcctccaagcctgcctccca

SEQ ID NO: 4569867 - DNA, 23 bp, Homo sapiens
gcctccaaggaggggctgtaaaa

SEQ ID NO: 4569868 - DNA, 12 bp, Homo sapiens
gcctccacactg

SEQ ID NO: 4569869 - DNA, 16 bp, Homo sapiens
gcctccaccctctgag

SEQ ID NO: 4569870 - DNA, 12 bp, Homo sapiens
gcctccaccgct

SEQ ID NO: 4569871 - DNA, 18 bp, Homo sapiens
gcctccaccgctgcctaa

SEQ ID NO: 4569872 - DNA, 12 bp, Homo sapiens
gcctccactcta

SEQ ID NO: 4569873 - DNA, 20 bp, Homo sapiens
gcctccactctagttctaga

SEQ ID NO: 4569874 - DNA, 11 bp, Homo sapiens
gcctccagcct

SEQ ID NO: 4569875 - DNA, 12 bp, Homo sapiens
gcctccagcctc

SEQ ID NO: 4569876 - DNA, 13 bp, Homo sapiens
gcctccagggctg

SEQ ID NO: 4569877 - DNA, 16 bp, Homo sapiens
gcctccagggctggac

SEQ ID NO: 4569878 - DNA, 17 bp, Homo sapiens
gcctccagggctggact

SEQ ID NO: 4569879 - DNA, 20 bp, Homo sapiens
gcctccagggctggactgag

SEQ ID NO: 4569880 - DNA, 24 bp, Homo sapiens
gcctccagggctggactgaggcct

SEQ ID NO: 4569881 - DNA, 21 bp, Homo sapiens
gcctccagtccaaagccggct

SEQ ID NO: 4569882 - DNA, 21 bp, Homo sapiens
gcctcccaaggagaacaaata

SEQ ID NO: 4569883 - DNA, 16 bp, Homo sapiens
gcctcccaccagagcc

SEQ ID NO: 4569884 - DNA, 17 bp, Homo sapiens
gcctcccaccagagccg

SEQ ID NO: 4569885 - DNA, 22 bp, Homo sapiens
gcctcccaccagagccgggagg

SEQ ID NO: 4569886 - DNA, 12 bp, Homo sapiens
gcctcccaggtc

SEQ ID NO: 4569887 - DNA, 18 bp, Homo sapiens
gcctccccaccctcctct

SEQ ID NO: 4569888 - DNA, 21 bp, Homo sapiens
gcctccccaccctcctcttgg

SEQ ID NO: 4569889 - DNA, 16 bp, Homo sapiens
gcctccccatttccca

SEQ ID NO: 4569890 - DNA, 20 bp, Homo sapiens
gcctccccatttcccatctg

SEQ ID NO: 4569891 - DNA, 13 bp, Homo sapiens
gcctccccccaga

SEQ ID NO: 4569892 - DNA, 13 bp, Homo sapiens
gcctccccctcag

SEQ ID NO: 4569893 - DNA, 17 bp, Homo sapiens
gcctcccctcccctggg

SEQ ID NO: 4569894 - DNA, 17 bp, Homo sapiens
gcctcccctgccagggc

SEQ ID NO: 4569895 - DNA, 17 bp, Homo sapiens
gcctcccgccactcgcc

SEQ ID NO: 4569896 - DNA, 23 bp, Homo sapiens
gcctccctagttagcatccaggc

SEQ ID NO: 4569897 - DNA, 19 bp, Homo sapiens
gcctccctccaccccagga

SEQ ID NO: 4569898 - DNA, 21 bp, Homo sapiens
gcctccctctcagaggcctgc

SEQ ID NO: 4569899 - DNA, 22 bp, Homo sapiens
gcctccctctcagaggcctgct

SEQ ID NO: 4569900 - DNA, 24 bp, Homo sapiens
gcctccctctcagaggcctgctgc

SEQ ID NO: 4569901 - DNA, 13 bp, Homo sapiens
gcctccctctcca

SEQ ID NO: 4569902 - DNA, 16 bp, Homo sapiens
gcctccctctctcttc

SEQ ID NO: 4569903 - DNA, 22 bp, Homo sapiens
gcctccctgaaaatgtttttct

SEQ ID NO: 4569904 - DNA, 23 bp, Homo sapiens
gcctccctgctgtgccatgctgg

SEQ ID NO: 4569905 - DNA, 14 bp, Homo sapiens
gcctcccttgtggc

SEQ ID NO: 4569906 - DNA, 16 bp, Homo sapiens
gcctcccttttctcct

SEQ ID NO: 4569907 - DNA, 15 bp, Homo sapiens
gcctccgagagggag

SEQ ID NO: 4569908 - DNA, 14 bp, Homo sapiens
gcctccgaggctcc

SEQ ID NO: 4569909 - DNA, 16 bp, Homo sapiens
gcctccgaggctcccc

SEQ ID NO: 4569910 - DNA, 21 bp, Homo sapiens
gcctccgaggctccccgcctc

SEQ ID NO: 4569911 - DNA, 17 bp, Homo sapiens
gcctccgcctgctgtgt

SEQ ID NO: 4569912 - DNA, 19 bp, Homo sapiens
gcctccggcgtcagcctcc

SEQ ID NO: 4569913 - DNA, 21 bp, Homo sapiens
gcctccggcgtcagcctccag

SEQ ID NO: 4569914 - DNA, 21 bp, Homo sapiens
gcctccgggcgtgtgaagaac

SEQ ID NO: 4569915 - DNA, 22 bp, Homo sapiens
gcctcctcctgggctccagagg

SEQ ID NO: 4569916 - DNA, 22 bp, Homo sapiens
gcctcctcggagagcagcagca

SEQ ID NO: 4569917 - DNA, 17 bp, Homo sapiens
gcctcctctggacggca

SEQ ID NO: 4569918 - DNA, 20 bp, Homo sapiens
gcctcctctggacggcaggc

SEQ ID NO: 4569919 - DNA, 14 bp, Homo sapiens
gcctcctctggact

SEQ ID NO: 4569920 - DNA, 19 bp, Homo sapiens
gcctcctctgtctgccctt

SEQ ID NO: 4569921 - DNA, 22 bp, Homo sapiens
gcctcctgaaagtcatttaaaa

SEQ ID NO: 4569922 - DNA, 19 bp, Homo sapiens
gcctcctgccccctgccag

SEQ ID NO: 4569923 - DNA, 24 bp, Homo sapiens
gcctcctgccccctgccagtgaag

SEQ ID NO: 4569924 - DNA, 21 bp, Homo sapiens
gcctcctgcgccctgtgcccg

SEQ ID NO: 4569925 - DNA, 11 bp, Homo sapiens
gcctcctggcc

SEQ ID NO: 4569926 - DNA, 12 bp, Homo sapiens
gcctcctggcca

SEQ ID NO: 4569927 - DNA, 13 bp, Homo sapiens
gcctcctggccag

SEQ ID NO: 4569928 - DNA, 16 bp, Homo sapiens
gcctcctggccagacg

SEQ ID NO: 4569929 - DNA, 13 bp, Homo sapiens
gcctcctgtgcct

SEQ ID NO: 4569930 - DNA, 16 bp, Homo sapiens
gcctcctgtgtactgt

SEQ ID NO: 4569931 - DNA, 19 bp, Homo sapiens
gcctcctgtgtactgtgtc

SEQ ID NO: 4569932 - DNA, 10 bp, Homo sapiens
gcctccttta

SEQ ID NO: 4569933 - DNA, 13 bp, Homo sapiens
gcctcgtgccatg

SEQ ID NO: 4569934 - DNA, 18 bp, Homo sapiens
gcctctaaccccaggccc

SEQ ID NO: 4569935 - DNA, 20 bp, Homo sapiens
gcctctaaccccaggccccg

SEQ ID NO: 4569936 - DNA, 16 bp, Homo sapiens
gcctctacagccgtcc

SEQ ID NO: 4569937 - DNA, 20 bp, Homo sapiens
gcctctagtgtaccaagtgc

SEQ ID NO: 4569938 - DNA, 10 bp, Homo sapiens
gcctctccca

SEQ ID NO: 4569939 - DNA, 12 bp, Homo sapiens
gcctctcccacc

SEQ ID NO: 4569940 - DNA, 13 bp, Homo sapiens
gcctctcccaccc

SEQ ID NO: 4569941 - DNA, 12 bp, Homo sapiens
gcctctccccag

SEQ ID NO: 4569942 - DNA, 14 bp, Homo sapiens
gcctctccccagga

SEQ ID NO: 4569943 - DNA, 19 bp, Homo sapiens
gcctctccctgcctgtggc

SEQ ID NO: 4569944 - DNA, 18 bp, Homo sapiens
gcctctccctgctgctcc

SEQ ID NO: 4569945 - DNA, 20 bp, Homo sapiens
gcctctccctgctgctccta

SEQ ID NO: 4569946 - DNA, 17 bp, Homo sapiens
gcctctccttggaaggt

SEQ ID NO: 4569947 - DNA, 20 bp, Homo sapiens
gcctctccttggaaggtctt

SEQ ID NO: 4569948 - DNA, 12 bp, Homo sapiens
gcctctctccca

SEQ ID NO: 4569949 - DNA, 16 bp, Homo sapiens
gcctctctcccagtct

SEQ ID NO: 4569950 - DNA, 14 bp, Homo sapiens
gcctctctcctgcc

SEQ ID NO: 4569951 - DNA, 23 bp, Homo sapiens
gcctctctccttggccacagact

SEQ ID NO: 4569952 - DNA, 13 bp, Homo sapiens
gcctctctctgct

SEQ ID NO: 4569953 - DNA, 13 bp, Homo sapiens
gcctctctctttt

SEQ ID NO: 4569954 - DNA, 15 bp, Homo sapiens
gcctctgacagtcca

SEQ ID NO: 4569955 - DNA, 20 bp, Homo sapiens
gcctctgacagtccacaggg

SEQ ID NO: 4569956 - DNA, 23 bp, Homo sapiens
gcctctgacagtccacaggggcc

SEQ ID NO: 4569957 - DNA, 14 bp, Homo sapiens
gcctctgaccccag

SEQ ID NO: 4569958 - DNA, 12 bp, Homo sapiens
gcctctgcagtc

SEQ ID NO: 4569959 - DNA, 17 bp, Homo sapiens
gcctctgcagtctcatt

SEQ ID NO: 4569960 - DNA, 18 bp, Homo sapiens
gcctctgcagtctcattt

SEQ ID NO: 4569961 - DNA, 21 bp, Homo sapiens
gcctctgcagtctcatttctc

SEQ ID NO: 4569962 - DNA, 17 bp, Homo sapiens
gcctctgccctggattg

SEQ ID NO: 4569963 - DNA, 15 bp, Homo sapiens
gcctctgccgctgcc

SEQ ID NO: 4569964 - DNA, 16 bp, Homo sapiens
gcctctgccgctgcca

SEQ ID NO: 4569965 - DNA, 17 bp, Homo sapiens
gcctctgccgctgccat

SEQ ID NO: 4569966 - DNA, 18 bp, Homo sapiens
gcctctgccgctgccatg

SEQ ID NO: 4569967 - DNA, 20 bp, Homo sapiens
gcctctgccgctgccatgct

SEQ ID NO: 4569968 - DNA, 21 bp, Homo sapiens
gcctctgcggagcacactggc

SEQ ID NO: 4569969 - DNA, 16 bp, Homo sapiens
gcctctgctccctctg

SEQ ID NO: 4569970 - DNA, 12 bp, Homo sapiens
gcctctgctgga

SEQ ID NO: 4569971 - DNA, 13 bp, Homo sapiens
gcctctgctggct

SEQ ID NO: 4569972 - DNA, 14 bp, Homo sapiens
gcctctgctggctc

SEQ ID NO: 4569973 - DNA, 22 bp, Homo sapiens
gcctctggacagccagtgacct

SEQ ID NO: 4569974 - DNA, 24 bp, Homo sapiens
gcctctggcccctcacccaccatg

SEQ ID NO: 4569975 - DNA, 12 bp, Homo sapiens
gcctctggctag

SEQ ID NO: 4569976 - DNA, 13 bp, Homo sapiens
gcctctggctaga

SEQ ID NO: 4569977 - DNA, 18 bp, Homo sapiens
gcctctggctagaggcca

SEQ ID NO: 4569978 - DNA, 15 bp, Homo sapiens
gcctctggttgcctc

SEQ ID NO: 4569979 - DNA, 21 bp, Homo sapiens
gcctctgtccccttctctcat

SEQ ID NO: 4569980 - DNA, 15 bp, Homo sapiens
gcctcttcaggcctg

SEQ ID NO: 4569981 - DNA, 20 bp, Homo sapiens
gcctcttctacttgtaaaat

SEQ ID NO: 4569982 - DNA, 22 bp, Homo sapiens
gcctcttctacttgtaaaatgc

SEQ ID NO: 4569983 - DNA, 18 bp, Homo sapiens
gcctcttctgggagggca

SEQ ID NO: 4569984 - DNA, 15 bp, Homo sapiens
gcctcttgaccaggc

SEQ ID NO: 4569985 - DNA, 16 bp, Homo sapiens
gcctcttgaccaggct

SEQ ID NO: 4569986 - DNA, 20 bp, Homo sapiens
gcctcttgaccaggctgcct

SEQ ID NO: 4569987 - DNA, 16 bp, Homo sapiens
gcctcttgcaggctga

SEQ ID NO: 4569988 - DNA, 16 bp, Homo sapiens
gcctcttgtaaagact

SEQ ID NO: 4569989 - DNA, 16 bp, Homo sapiens
gcctcttttacctgct

SEQ ID NO: 4569990 - DNA, 18 bp, Homo sapiens
gcctcttttacctgctgc

SEQ ID NO: 4569991 - DNA, 20 bp, Homo sapiens
gcctcttttacctgctgctt

SEQ ID NO: 4569992 - DNA, 22 bp, Homo sapiens
gcctgaaatgacatttcactaa

SEQ ID NO: 4569993 - DNA, 14 bp, Homo sapiens
gcctgaactccaga

SEQ ID NO: 4569994 - DNA, 14 bp, Homo sapiens
gcctgaactgagcc

SEQ ID NO: 4569995 - DNA, 18 bp, Homo sapiens
gcctgaattgctttctgc

SEQ ID NO: 4569996 - DNA, 13 bp, Homo sapiens
gcctgacagctct

SEQ ID NO: 4569997 - DNA, 14 bp, Homo sapiens
gcctgacagctctg

SEQ ID NO: 4569998 - DNA, 15 bp, Homo sapiens
gcctgaccaaacagc

SEQ ID NO: 4569999 - DNA, 17 bp, Homo sapiens
gcctgaccctcatcttt

SEQ ID NO: 4570000 - DNA, 13 bp, Homo sapiens
gcctgacttgagc

SEQ ID NO: 4570001 - DNA, 14 bp, Homo sapiens
gcctgacttgagcc

SEQ ID NO: 4570002 - DNA, 16 bp, Homo sapiens
gcctgacttgagccac

SEQ ID NO: 4570003 - DNA, 18 bp, Homo sapiens
gcctgacttgagccactc

SEQ ID NO: 4570004 - DNA, 19 bp, Homo sapiens
gcctgagaagaagtggctg

SEQ ID NO: 4570005 - DNA, 17 bp, Homo sapiens
gcctgagaccagggtgg

SEQ ID NO: 4570006 - DNA, 22 bp, Homo sapiens
gcctgagaccagggtggccaca

SEQ ID NO: 4570007 - DNA, 16 bp, Homo sapiens
gcctgagaggggaagc

SEQ ID NO: 4570008 - DNA, 22 bp, Homo sapiens
gcctgagatacaaggcccagaa

SEQ ID NO: 4570009 - DNA, 22 bp, Homo sapiens
gcctgagatttcatctgctctc

SEQ ID NO: 4570010 - DNA, 11 bp, Homo sapiens
gcctgagcccc

SEQ ID NO: 4570011 - DNA, 21 bp, Homo sapiens
gcctgagcccctttgcctgtc

SEQ ID NO: 4570012 - DNA, 10 bp, Homo sapiens
gcctgaggga

SEQ ID NO: 4570013 - DNA, 21 bp, Homo sapiens
gcctgatactttagccatcat

SEQ ID NO: 4570014 - DNA, 13 bp, Homo sapiens
gcctgatctctgc

SEQ ID NO: 4570015 - DNA, 16 bp, Homo sapiens
gcctgatctctgctcc

SEQ ID NO: 4570016 - DNA, 16 bp, Homo sapiens
gcctgatgctccctcc

SEQ ID NO: 4570017 - DNA, 15 bp, Homo sapiens
gcctgattattttag

SEQ ID NO: 4570018 - DNA, 19 bp, Homo sapiens
gcctgcaaaccttcctggg

SEQ ID NO: 4570019 - DNA, 15 bp, Homo sapiens
gcctgcacacagagt

SEQ ID NO: 4570020 - DNA, 17 bp, Homo sapiens
gcctgcacccctccggc

SEQ ID NO: 4570021 - DNA, 23 bp, Homo sapiens
gcctgcacccttccacagctggc

SEQ ID NO: 4570022 - DNA, 21 bp, Homo sapiens
gcctgcacggtgggccttgct

SEQ ID NO: 4570023 - DNA, 19 bp, Homo sapiens
gcctgcagaagtaagcctc

SEQ ID NO: 4570024 - DNA, 13 bp, Homo sapiens
gcctgcagcaggc

SEQ ID NO: 4570025 - DNA, 16 bp, Homo sapiens
gcctgcagcaggcagc

SEQ ID NO: 4570026 - DNA, 15 bp, Homo sapiens
gcctgcagccagggc

SEQ ID NO: 4570027 - DNA, 19 bp, Homo sapiens
gcctgcagccagggctggg

SEQ ID NO: 4570028 - DNA, 20 bp, Homo sapiens
gcctgcagccagggctgggg

SEQ ID NO: 4570029 - DNA, 14 bp, Homo sapiens
gcctgcaggagaga

SEQ ID NO: 4570030 - DNA, 22 bp, Homo sapiens
gcctgcaggagagagcagcact

SEQ ID NO: 4570031 - DNA, 14 bp, Homo sapiens
gcctgcaggcagag

SEQ ID NO: 4570032 - DNA, 16 bp, Homo sapiens
gcctgcattgagcttg

SEQ ID NO: 4570033 - DNA, 14 bp, Homo sapiens
gcctgccactctct

SEQ ID NO: 4570034 - DNA, 15 bp, Homo sapiens
gcctgccactctctg

SEQ ID NO: 4570035 - DNA, 16 bp, Homo sapiens
gcctgccactctctgg

SEQ ID NO: 4570036 - DNA, 18 bp, Homo sapiens
gcctgccactctctggga

SEQ ID NO: 4570037 - DNA, 21 bp, Homo sapiens
gcctgccactctctgggactc

SEQ ID NO: 4570038 - DNA, 14 bp, Homo sapiens
gcctgccagtccta

SEQ ID NO: 4570039 - DNA, 16 bp, Homo sapiens
gcctgccagtcctagc

SEQ ID NO: 4570040 - DNA, 19 bp, Homo sapiens
gcctgccagtcctagctgc

SEQ ID NO: 4570041 - DNA, 15 bp, Homo sapiens
gcctgcccagactga

SEQ ID NO: 4570042 - DNA, 19 bp, Homo sapiens
gcctgcccagactgatgag

SEQ ID NO: 4570043 - DNA, 21 bp, Homo sapiens
gcctgcccagactgatgagca

SEQ ID NO: 4570044 - DNA, 22 bp, Homo sapiens
gcctgcccctaccctggacttg

SEQ ID NO: 4570045 - DNA, 20 bp, Homo sapiens
gcctgcccgtctctctccca

SEQ ID NO: 4570046 - DNA, 14 bp, Homo sapiens
gcctgccctgcctc

SEQ ID NO: 4570047 - DNA, 22 bp, Homo sapiens
gcctgccctgcctcagccaggc

SEQ ID NO: 4570048 - DNA, 22 bp, Homo sapiens
gcctgccgtgcatggctcctgt

SEQ ID NO: 4570049 - DNA, 22 bp, Homo sapiens
gcctgcctccagggctggactg

SEQ ID NO: 4570050 - DNA, 13 bp, Homo sapiens
gcctgcctcccaa

SEQ ID NO: 4570051 - DNA, 13 bp, Homo sapiens
gcctgcctgcagc

SEQ ID NO: 4570052 - DNA, 14 bp, Homo sapiens
gcctgcctggagcg

SEQ ID NO: 4570053 - DNA, 18 bp, Homo sapiens
gcctgcgcccaccccgct

SEQ ID NO: 4570054 - DNA, 15 bp, Homo sapiens
gcctgcggtggaggg

SEQ ID NO: 4570055 - DNA, 19 bp, Homo sapiens
gcctgctaaggctcctcct

SEQ ID NO: 4570056 - DNA, 13 bp, Homo sapiens
gcctgctggcacc

SEQ ID NO: 4570057 - DNA, 16 bp, Homo sapiens
gcctgctggcacccac

SEQ ID NO: 4570058 - DNA, 19 bp, Homo sapiens
gcctgctggcacccaccgt

SEQ ID NO: 4570059 - DNA, 22 bp, Homo sapiens
gcctgctggctcccttacttta

SEQ ID NO: 4570060 - DNA, 13 bp, Homo sapiens
gcctgctgggctc

SEQ ID NO: 4570061 - DNA, 17 bp, Homo sapiens
gcctgctgggctctcca

SEQ ID NO: 4570062 - DNA, 17 bp, Homo sapiens
gcctgctggtcacagcc

SEQ ID NO: 4570063 - DNA, 14 bp, Homo sapiens
gcctggacaggcgg

SEQ ID NO: 4570064 - DNA, 15 bp, Homo sapiens
gcctggacaggcggg

SEQ ID NO: 4570065 - DNA, 16 bp, Homo sapiens
gcctggaccagcctct

SEQ ID NO: 4570066 - DNA, 20 bp, Homo sapiens
gcctggagacaaggtgctaa

SEQ ID NO: 4570067 - DNA, 12 bp, Homo sapiens
gcctggagcccc

SEQ ID NO: 4570068 - DNA, 13 bp, Homo sapiens
gcctggagcccca

SEQ ID NO: 4570069 - DNA, 21 bp, Homo sapiens
gcctggccagatttttctttt

SEQ ID NO: 4570070 - DNA, 17 bp, Homo sapiens
gcctggccaggcagatc

SEQ ID NO: 4570071 - DNA, 14 bp, Homo sapiens
gcctggccatttcc

SEQ ID NO: 4570072 - DNA, 20 bp, Homo sapiens
gcctggccccagcctgggcc

SEQ ID NO: 4570073 - DNA, 22 bp, Homo sapiens
gcctggccccaggccccagaca

SEQ ID NO: 4570074 - DNA, 22 bp, Homo sapiens
gcctggcctcatctcagaccct

SEQ ID NO: 4570075 - DNA, 23 bp, Homo sapiens
gcctgggagagtggacctgtgct

SEQ ID NO: 4570076 - DNA, 20 bp, Homo sapiens
gcctgggcagccaggctgcc

SEQ ID NO: 4570077 - DNA, 17 bp, Homo sapiens
gcctgggggtgccagga

SEQ ID NO: 4570078 - DNA, 17 bp, Homo sapiens
gcctggggtgcatctcc

SEQ ID NO: 4570079 - DNA, 18 bp, Homo sapiens
gcctggggtgcatctcct

SEQ ID NO: 4570080 - DNA, 16 bp, Homo sapiens
gcctgggtcatgggcc

SEQ ID NO: 4570081 - DNA, 20 bp, Homo sapiens
gcctgggtcatgggcctgtg

SEQ ID NO: 4570082 - DNA, 23 bp, Homo sapiens
gcctgggtgacagagtgagaccc

SEQ ID NO: 4570083 - DNA, 19 bp, Homo sapiens
gcctgggtggggctgctcc

SEQ ID NO: 4570084 - DNA, 23 bp, Homo sapiens
gcctgggtggggctgctcctcca

SEQ ID NO: 4570085 - DNA, 20 bp, Homo sapiens
gcctggtatatccaaaagct

SEQ ID NO: 4570086 - DNA, 22 bp, Homo sapiens
gcctggtccttccctgatggcc

SEQ ID NO: 4570087 - DNA, 18 bp, Homo sapiens
gcctggtttcctcgagag

SEQ ID NO: 4570088 - DNA, 18 bp, Homo sapiens
gcctgtaatcccagaact

SEQ ID NO: 4570089 - DNA, 18 bp, Homo sapiens
gcctgtaatcccagcagt

SEQ ID NO: 4570090 - DNA, 17 bp, Homo sapiens
gcctgtaatcccagcta

SEQ ID NO: 4570091 - DNA, 21 bp, Homo sapiens
gcctgtagcaatggccagagc

SEQ ID NO: 4570092 - DNA, 19 bp, Homo sapiens
gcctgtagctttcctggtc

SEQ ID NO: 4570093 - DNA, 15 bp, Homo sapiens
gcctgtcacaataaa

SEQ ID NO: 4570094 - DNA, 18 bp, Homo sapiens
gcctgtccaccctgccaa

SEQ ID NO: 4570095 - DNA, 21 bp, Homo sapiens
gcctgtccaccctgccaagac

SEQ ID NO: 4570096 - DNA, 15 bp, Homo sapiens
gcctgtccagcctgg

SEQ ID NO: 4570097 - DNA, 17 bp, Homo sapiens
gcctgtccagcctgggc

SEQ ID NO: 4570098 - DNA, 11 bp, Homo sapiens
gcctgtcccaa

SEQ ID NO: 4570099 - DNA, 17 bp, Homo sapiens
gcctgtcccttgcctct

SEQ ID NO: 4570100 - DNA, 17 bp, Homo sapiens
gcctgtctcatccccag

SEQ ID NO: 4570101 - DNA, 18 bp, Homo sapiens
gcctgtcttgagtagact

SEQ ID NO: 4570102 - DNA, 18 bp, Homo sapiens
gcctgtgagcatggggcc

SEQ ID NO: 4570103 - DNA, 21 bp, Homo sapiens
gcctgtgcccgcatgtgtgcc

SEQ ID NO: 4570104 - DNA, 22 bp, Homo sapiens
gcctgtggatgatcaatccttt

SEQ ID NO: 4570105 - DNA, 14 bp, Homo sapiens
gcctgtggccagca

SEQ ID NO: 4570106 - DNA, 13 bp, Homo sapiens
gcctgtggcccct

SEQ ID NO: 4570107 - DNA, 19 bp, Homo sapiens
gcctgtggcccctcccctg

SEQ ID NO: 4570108 - DNA, 19 bp, Homo sapiens
gcctgtggcggtgcctggg

SEQ ID NO: 4570109 - DNA, 11 bp, Homo sapiens
gcctgtgggag

SEQ ID NO: 4570110 - DNA, 19 bp, Homo sapiens
gcctgtgggtctctgaagg

SEQ ID NO: 4570111 - DNA, 14 bp, Homo sapiens
gcctgtggtgaagt

SEQ ID NO: 4570112 - DNA, 20 bp, Homo sapiens
gcctgtggtgaagtgtggct

SEQ ID NO: 4570113 - DNA, 13 bp, Homo sapiens
gcctgtgtacaac

SEQ ID NO: 4570114 - DNA, 14 bp, Homo sapiens
gcctgttggcaggc

SEQ ID NO: 4570115 - DNA, 15 bp, Homo sapiens
gcctgtttgggatgt

SEQ ID NO: 4570116 - DNA, 16 bp, Homo sapiens
gccttaagcacaatta

SEQ ID NO: 4570117 - DNA, 21 bp, Homo sapiens
gccttaagcacaattaattaa

SEQ ID NO: 4570118 - DNA, 19 bp, Homo sapiens
gccttaataaaaaatgaaa

SEQ ID NO: 4570119 - DNA, 14 bp, Homo sapiens
gccttaatttcctt

SEQ ID NO: 4570120 - DNA, 19 bp, Homo sapiens
gccttaatttcctttttga

SEQ ID NO: 4570121 - DNA, 23 bp, Homo sapiens
gccttaatttcctttttgacact

SEQ ID NO: 4570122 - DNA, 12 bp, Homo sapiens
gccttacctcct

SEQ ID NO: 4570123 - DNA, 13 bp, Homo sapiens
gccttacctcctg

SEQ ID NO: 4570124 - DNA, 19 bp, Homo sapiens
gccttacctcctgcccagg

SEQ ID NO: 4570125 - DNA, 20 bp, Homo sapiens
gccttacctcctgcccagga

SEQ ID NO: 4570126 - DNA, 22 bp, Homo sapiens
gccttacctcctgcccaggaga

SEQ ID NO: 4570127 - DNA, 17 bp, Homo sapiens
gccttactcacctctct

SEQ ID NO: 4570128 - DNA, 13 bp, Homo sapiens
gccttagagccag

SEQ ID NO: 4570129 - DNA, 14 bp, Homo sapiens
gccttagagccagg

SEQ ID NO: 4570130 - DNA, 15 bp, Homo sapiens
gccttagggaagctg

SEQ ID NO: 4570131 - DNA, 16 bp, Homo sapiens
gccttagggctggcaa

SEQ ID NO: 4570132 - DNA, 13 bp, Homo sapiens
gccttatgtgtta

SEQ ID NO: 4570133 - DNA, 16 bp, Homo sapiens
gccttatgtgttacat

SEQ ID NO: 4570134 - DNA, 19 bp, Homo sapiens
gccttatgtgttacattat

SEQ ID NO: 4570135 - DNA, 17 bp, Homo sapiens
gccttatgttgaaaaaa

SEQ ID NO: 4570136 - DNA, 23 bp, Homo sapiens
gccttcaaggactgtttcagtgt

SEQ ID NO: 4570137 - DNA, 14 bp, Homo sapiens
gccttcaagtgcca

SEQ ID NO: 4570138 - DNA, 22 bp, Homo sapiens
gccttcacacagatagaccttt

SEQ ID NO: 4570139 - DNA, 18 bp, Homo sapiens
gccttcatctgggacaaa

SEQ ID NO: 4570140 - DNA, 21 bp, Homo sapiens
gccttcatctgggacaaaact

SEQ ID NO: 4570141 - DNA, 20 bp, Homo sapiens
gccttccaactagctgggac

SEQ ID NO: 4570142 - DNA, 12 bp, Homo sapiens
gccttccagatc

SEQ ID NO: 4570143 - DNA, 16 bp, Homo sapiens
gccttccagttttgtg

SEQ ID NO: 4570144 - DNA, 17 bp, Homo sapiens
gccttccatgtcggcct

SEQ ID NO: 4570145 - DNA, 18 bp, Homo sapiens
gccttccatgtcggcctc

SEQ ID NO: 4570146 - DNA, 19 bp, Homo sapiens
gccttcccaagttgtgctt

SEQ ID NO: 4570147 - DNA, 19 bp, Homo sapiens
gccttcccctggcactggc

SEQ ID NO: 4570148 - DNA, 24 bp, Homo sapiens
gccttccctagctttagaccctgg

SEQ ID NO: 4570149 - DNA, 15 bp, Homo sapiens
gccttcctcagctgc

SEQ ID NO: 4570150 - DNA, 13 bp, Homo sapiens
gccttcctcctgg

SEQ ID NO: 4570151 - DNA, 17 bp, Homo sapiens
gccttcctcctgggccc

SEQ ID NO: 4570152 - DNA, 18 bp, Homo sapiens
gccttcgaccacagcaag

SEQ ID NO: 4570153 - DNA, 19 bp, Homo sapiens
gccttcgtgcctgagacca

SEQ ID NO: 4570154 - DNA, 13 bp, Homo sapiens
gccttctcaccag

SEQ ID NO: 4570155 - DNA, 16 bp, Homo sapiens
gccttctcaccagctg

SEQ ID NO: 4570156 - DNA, 19 bp, Homo sapiens
gccttctcaccagctgcaa

SEQ ID NO: 4570157 - DNA, 22 bp, Homo sapiens
gccttctcaccagctgcaaagt

SEQ ID NO: 4570158 - DNA, 23 bp, Homo sapiens
gccttctcaccagctgcaaagtg

SEQ ID NO: 4570159 - DNA, 15 bp, Homo sapiens
gccttctccatatct

SEQ ID NO: 4570160 - DNA, 23 bp, Homo sapiens
gccttctccatatctccatggcc

SEQ ID NO: 4570161 - DNA, 18 bp, Homo sapiens
gccttctgaactccatac

SEQ ID NO: 4570162 - DNA, 17 bp, Homo sapiens
gccttctgatgaaatgt

SEQ ID NO: 4570163 - DNA, 18 bp, Homo sapiens
gccttctggagctgggag

SEQ ID NO: 4570164 - DNA, 14 bp, Homo sapiens
gccttctgtgggga

SEQ ID NO: 4570165 - DNA, 20 bp, Homo sapiens
gccttcttattctcactcca

SEQ ID NO: 4570166 - DNA, 21 bp, Homo sapiens
gccttcttattctcactccac

SEQ ID NO: 4570167 - DNA, 23 bp, Homo sapiens
gccttcttattctcactccacca

SEQ ID NO: 4570168 - DNA, 22 bp, Homo sapiens
gccttcttcggggaactcctgg

SEQ ID NO: 4570169 - DNA, 20 bp, Homo sapiens
gccttgaaatttacacagtg

SEQ ID NO: 4570170 - DNA, 21 bp, Homo sapiens
gccttgaaatttacacagtga

SEQ ID NO: 4570171 - DNA, 23 bp, Homo sapiens
gccttgaaatttacacagtgaga

SEQ ID NO: 4570172 - DNA, 14 bp, Homo sapiens
gccttgaataataa

SEQ ID NO: 4570173 - DNA, 16 bp, Homo sapiens
gccttgagccctggct

SEQ ID NO: 4570174 - DNA, 19 bp, Homo sapiens
gccttgcagcggctcctgc

SEQ ID NO: 4570175 - DNA, 16 bp, Homo sapiens
gccttgcccagagatg

SEQ ID NO: 4570176 - DNA, 22 bp, Homo sapiens
gccttgcccagagatgcctcca

SEQ ID NO: 4570177 - DNA, 13 bp, Homo sapiens
gccttgcccagcc

SEQ ID NO: 4570178 - DNA, 15 bp, Homo sapiens
gccttgcccagcctg

SEQ ID NO: 4570179 - DNA, 18 bp, Homo sapiens
gccttgcccagcctggat

SEQ ID NO: 4570180 - DNA, 14 bp, Homo sapiens
gccttgcccagctt

SEQ ID NO: 4570181 - DNA, 14 bp, Homo sapiens
gccttgccctcctg

SEQ ID NO: 4570182 - DNA, 16 bp, Homo sapiens
gccttgccctcctggg

SEQ ID NO: 4570183 - DNA, 18 bp, Homo sapiens
gccttgcggtatccgccc

SEQ ID NO: 4570184 - DNA, 22 bp, Homo sapiens
gccttgcggtatccgcccccaa

SEQ ID NO: 4570185 - DNA, 23 bp, Homo sapiens
gccttggaaatagaaagaagcca

SEQ ID NO: 4570186 - DNA, 20 bp, Homo sapiens
gccttggaatatggccaagg

SEQ ID NO: 4570187 - DNA, 19 bp, Homo sapiens
gccttggagggtcccaagc

SEQ ID NO: 4570188 - DNA, 21 bp, Homo sapiens
gccttggagggtcccaagctg

SEQ ID NO: 4570189 - DNA, 14 bp, Homo sapiens
gccttggcctccca

SEQ ID NO: 4570190 - DNA, 15 bp, Homo sapiens
gccttgggctgctcc

SEQ ID NO: 4570191 - DNA, 22 bp, Homo sapiens
gccttgggctgctcctcatggt

SEQ ID NO: 4570192 - DNA, 18 bp, Homo sapiens
gccttggggaatttcctc

SEQ ID NO: 4570193 - DNA, 16 bp, Homo sapiens
gccttggtgtccacct

SEQ ID NO: 4570194 - DNA, 19 bp, Homo sapiens
gccttggtgtccacctggc

SEQ ID NO: 4570195 - DNA, 21 bp, Homo sapiens
gccttggtgtccacctggccc

SEQ ID NO: 4570196 - DNA, 19 bp, Homo sapiens
gccttgtataatattgaaa

SEQ ID NO: 4570197 - DNA, 15 bp, Homo sapiens
gccttgtcacgccag

SEQ ID NO: 4570198 - DNA, 17 bp, Homo sapiens
gccttgtcacgccagac

SEQ ID NO: 4570199 - DNA, 22 bp, Homo sapiens
gccttgtcctacgtccaaggtg

SEQ ID NO: 4570200 - DNA, 15 bp, Homo sapiens
gccttgtttaatggt

SEQ ID NO: 4570201 - DNA, 14 bp, Homo sapiens
gcctttatacaatt

SEQ ID NO: 4570202 - DNA, 19 bp, Homo sapiens
gcctttcatggcaatgaaa

SEQ ID NO: 4570203 - DNA, 23 bp, Homo sapiens
gcctttcatggcaatgaaaattt

SEQ ID NO: 4570204 - DNA, 21 bp, Homo sapiens
gcctttccctcctaaagctga

SEQ ID NO: 4570205 - DNA, 14 bp, Homo sapiens
gcctttcctcaaaa

SEQ ID NO: 4570206 - DNA, 21 bp, Homo sapiens
gcctttcctcaaaactggagt

SEQ ID NO: 4570207 - DNA, 19 bp, Homo sapiens
gcctttcctgttcagcatt

SEQ ID NO: 4570208 - DNA, 16 bp, Homo sapiens
gcctttccttccctct

SEQ ID NO: 4570209 - DNA, 12 bp, Homo sapiens
gcctttctttgc

SEQ ID NO: 4570210 - DNA, 14 bp, Homo sapiens
gcctttgaatgtta

SEQ ID NO: 4570211 - DNA, 16 bp, Homo sapiens
gcctttgccagcagag

SEQ ID NO: 4570212 - DNA, 17 bp, Homo sapiens
gcctttgccagcagagc

SEQ ID NO: 4570213 - DNA, 19 bp, Homo sapiens
gcctttgccagcagagcca

SEQ ID NO: 4570214 - DNA, 15 bp, Homo sapiens
gcctttgccgtgagc

SEQ ID NO: 4570215 - DNA, 21 bp, Homo sapiens
gcctttggacccagggcctga

SEQ ID NO: 4570216 - DNA, 22 bp, Homo sapiens
gcctttgtaaccacaactttca

SEQ ID NO: 4570217 - DNA, 23 bp, Homo sapiens
gcctttgtatctttctttctcta

SEQ ID NO: 4570218 - DNA, 23 bp, Homo sapiens
gccttttatgtaatttctttaaa

SEQ ID NO: 4570219 - DNA, 21 bp, Homo sapiens
gccttttccacacgcattaat

SEQ ID NO: 4570220 - DNA, 18 bp, Homo sapiens
gccttttgctctctgtga

SEQ ID NO: 4570221 - DNA, 19 bp, Homo sapiens
gccttttgttaatgcattg

SEQ ID NO: 4570222 - DNA, 20 bp, Homo sapiens
gccttttgttaatgcattgt

SEQ ID NO: 4570223 - DNA, 18 bp, Homo sapiens
gcctttttagatgtattt

SEQ ID NO: 4570224 - DNA, 20 bp, Homo sapiens
gcctttttagatgtattttt

SEQ ID NO: 4570225 - DNA, 14 bp, Homo sapiens
gcctttttcattta

SEQ ID NO: 4570226 - DNA, 22 bp, Homo sapiens
gcctttttcatttatctataat

SEQ ID NO: 4570227 - DNA, 23 bp, Homo sapiens
gcctttttcctgcgtcccagcct

SEQ ID NO: 4570228 - DNA, 17 bp, Homo sapiens
gcgaaacccccttttcc

SEQ ID NO: 4570229 - DNA, 21 bp, Homo sapiens
gcgaaacccccttttcccttc

SEQ ID NO: 4570230 - DNA, 23 bp, Homo sapiens
gcgaaaggatgtaaacagtgcct

SEQ ID NO: 4570231 - DNA, 17 bp, Homo sapiens
gcgaagcgttgtcctca

SEQ ID NO: 4570232 - DNA, 20 bp, Homo sapiens
gcgaagtctttgccttctct

SEQ ID NO: 4570233 - DNA, 11 bp, Homo sapiens
gcgaataaatg

SEQ ID NO: 4570234 - DNA, 21 bp, Homo sapiens
gcgaataaatgttcaaactgt

SEQ ID NO: 4570235 - DNA, 18 bp, Homo sapiens
gcgacatctctgactttc

SEQ ID NO: 4570236 - DNA, 22 bp, Homo sapiens
gcgacctcagttgtcctgccct

SEQ ID NO: 4570237 - DNA, 21 bp, Homo sapiens
gcgactaatttcaaaatgctt

SEQ ID NO: 4570238 - DNA, 19 bp, Homo sapiens
gcgacttccacaaacctgg

SEQ ID NO: 4570239 - DNA, 19 bp, Homo sapiens
gcgagagatcaaagatgaa

SEQ ID NO: 4570240 - DNA, 20 bp, Homo sapiens
gcgagccatttgtcccaagt

SEQ ID NO: 4570241 - DNA, 14 bp, Homo sapiens
gcgagctgcaggaa

SEQ ID NO: 4570242 - DNA, 19 bp, Homo sapiens
gcgaggagatgctccttgg

SEQ ID NO: 4570243 - DNA, 14 bp, Homo sapiens
gcgaggtgtaaagt

SEQ ID NO: 4570244 - DNA, 16 bp, Homo sapiens
gcgatctctcctggcc

SEQ ID NO: 4570245 - DNA, 18 bp, Homo sapiens
gcgatctctcctggccta

SEQ ID NO: 4570246 - DNA, 21 bp, Homo sapiens
gcgatggctgtcttttcttga

SEQ ID NO: 4570247 - DNA, 12 bp, Homo sapiens
gcgatgggtcag

SEQ ID NO: 4570248 - DNA, 12 bp, Homo sapiens
gcgcaagcctgt

SEQ ID NO: 4570249 - DNA, 21 bp, Homo sapiens
gcgcaatctcggctcactgca

SEQ ID NO: 4570250 - DNA, 11 bp, Homo sapiens
gcgcaccccac

SEQ ID NO: 4570251 - DNA, 13 bp, Homo sapiens
gcgcactgcatgg

SEQ ID NO: 4570252 - DNA, 19 bp, Homo sapiens
gcgcattctaacctggagg

SEQ ID NO: 4570253 - DNA, 15 bp, Homo sapiens
gcgccaggaagccag

SEQ ID NO: 4570254 - DNA, 16 bp, Homo sapiens
gcgccaggaagccaga

SEQ ID NO: 4570255 - DNA, 18 bp, Homo sapiens
gcgccaggaagccagagc

SEQ ID NO: 4570256 - DNA, 14 bp, Homo sapiens
gcgcccccgagccc

SEQ ID NO: 4570257 - DNA, 20 bp, Homo sapiens
gcgcccccgagccctgactc

SEQ ID NO: 4570258 - DNA, 18 bp, Homo sapiens
gcgcccctgcctgtgccc

SEQ ID NO: 4570259 - DNA, 21 bp, Homo sapiens
gcgccctcactattcttggac

SEQ ID NO: 4570260 - DNA, 17 bp, Homo sapiens
gcgccgatgccaccggc

SEQ ID NO: 4570261 - DNA, 18 bp, Homo sapiens
gcgccgatgccaccggcc

SEQ ID NO: 4570262 - DNA, 21 bp, Homo sapiens
gcgcctagtggggtctccctc

SEQ ID NO: 4570263 - DNA, 17 bp, Homo sapiens
gcgcctataatcccagc

SEQ ID NO: 4570264 - DNA, 12 bp, Homo sapiens
gcgcctcagccc

SEQ ID NO: 4570265 - DNA, 22 bp, Homo sapiens
gcgcctccctccaccccaggac

SEQ ID NO: 4570266 - DNA, 21 bp, Homo sapiens
gcgcctcgccggatctgaggg

SEQ ID NO: 4570267 - DNA, 16 bp, Homo sapiens
gcgcctgcaggcagag

SEQ ID NO: 4570268 - DNA, 18 bp, Homo sapiens
gcgcctgcaggcagagct

SEQ ID NO: 4570269 - DNA, 17 bp, Homo sapiens
gcgcctgctgcctgctg

SEQ ID NO: 4570270 - DNA, 18 bp, Homo sapiens
gcgcctgctgcctgctga

SEQ ID NO: 4570271 - DNA, 20 bp, Homo sapiens
gcgcctgctgcctgctgaga

SEQ ID NO: 4570272 - DNA, 21 bp, Homo sapiens
gcgcggccagccccggccctg

SEQ ID NO: 4570273 - DNA, 18 bp, Homo sapiens
gcgcgggcagccacccaa

SEQ ID NO: 4570274 - DNA, 14 bp, Homo sapiens
gcgcgttgtgtata

SEQ ID NO: 4570275 - DNA, 14 bp, Homo sapiens
gcgctcagcagccc

SEQ ID NO: 4570276 - DNA, 17 bp, Homo sapiens
gcgctcagcagccctag

SEQ ID NO: 4570277 - DNA, 20 bp, Homo sapiens
gcgctcctgccgcagagctg

SEQ ID NO: 4570278 - DNA, 19 bp, Homo sapiens
gcgctgacactggcagaga

SEQ ID NO: 4570279 - DNA, 19 bp, Homo sapiens
gcgctgcatacaggggagg

SEQ ID NO: 4570280 - DNA, 21 bp, Homo sapiens
gcgctgcatacaggggagggg

SEQ ID NO: 4570281 - DNA, 16 bp, Homo sapiens
gcgctgccgcacccca

SEQ ID NO: 4570282 - DNA, 21 bp, Homo sapiens
gcgctgccgcaccccagagtg

SEQ ID NO: 4570283 - DNA, 20 bp, Homo sapiens
gcgctgctctgcaggctggg

SEQ ID NO: 4570284 - DNA, 22 bp, Homo sapiens
gcgctggacgatagcttggagg

SEQ ID NO: 4570285 - DNA, 17 bp, Homo sapiens
gcgctgggtattggaaa

SEQ ID NO: 4570286 - DNA, 19 bp, Homo sapiens
gcgctgtatttacagacac

SEQ ID NO: 4570287 - DNA, 15 bp, Homo sapiens
gcggaaggaggttct

SEQ ID NO: 4570288 - DNA, 21 bp, Homo sapiens
gcggaattcaccagtgttcct

SEQ ID NO: 4570289 - DNA, 18 bp, Homo sapiens
gcggacccttctgggtcc

SEQ ID NO: 4570290 - DNA, 15 bp, Homo sapiens
gcggacgttccagcc

SEQ ID NO: 4570291 - DNA, 14 bp, Homo sapiens
gcggagcccagcct

SEQ ID NO: 4570292 - DNA, 16 bp, Homo sapiens
gcggagctgctgagtg

SEQ ID NO: 4570293 - DNA, 14 bp, Homo sapiens
gcggcaaaaggaaa

SEQ ID NO: 4570294 - DNA, 17 bp, Homo sapiens
gcggcaaacctttcccc

SEQ ID NO: 4570295 - DNA, 23 bp, Homo sapiens
gcggcaaacctttcccccttagc

SEQ ID NO: 4570296 - DNA, 23 bp, Homo sapiens
gcggcagccccacttcaccccca

SEQ ID NO: 4570297 - DNA, 15 bp, Homo sapiens
gcggccaggcctgcg

SEQ ID NO: 4570298 - DNA, 19 bp, Homo sapiens
gcggcccagaagtttccct

SEQ ID NO: 4570299 - DNA, 15 bp, Homo sapiens
gcggcccagcccggc

SEQ ID NO: 4570300 - DNA, 16 bp, Homo sapiens
gcggcccagcccggct

SEQ ID NO: 4570301 - DNA, 20 bp, Homo sapiens
gcggccccccgcacagccac

SEQ ID NO: 4570302 - DNA, 22 bp, Homo sapiens
gcggccccccgcacagccaccc

SEQ ID NO: 4570303 - DNA, 13 bp, Homo sapiens
gcggcccctcccg

SEQ ID NO: 4570304 - DNA, 12 bp, Homo sapiens
gcggccctggag

SEQ ID NO: 4570305 - DNA, 15 bp, Homo sapiens
gcggccgcattccct

SEQ ID NO: 4570306 - DNA, 12 bp, Homo sapiens
gcggcctccaca

SEQ ID NO: 4570307 - DNA, 13 bp, Homo sapiens
gcggcctcccagg

SEQ ID NO: 4570308 - DNA, 14 bp, Homo sapiens
gcggcctcccaggt

SEQ ID NO: 4570309 - DNA, 20 bp, Homo sapiens
gcggctactcagcagccctc

SEQ ID NO: 4570310 - DNA, 21 bp, Homo sapiens
gcggctactcagcagccctcc

SEQ ID NO: 4570311 - DNA, 22 bp, Homo sapiens
gcggctactcagcagccctcct

SEQ ID NO: 4570312 - DNA, 22 bp, Homo sapiens
gcggctcccctctgcttctcat

SEQ ID NO: 4570313 - DNA, 12 bp, Homo sapiens
gcggctcctggt

SEQ ID NO: 4570314 - DNA, 19 bp, Homo sapiens
gcggctgggaggagggcag

SEQ ID NO: 4570315 - DNA, 20 bp, Homo sapiens
gcgggaccggtacagaaagg

SEQ ID NO: 4570316 - DNA, 14 bp, Homo sapiens
gcgggagccagact

SEQ ID NO: 4570317 - DNA, 16 bp, Homo sapiens
gcgggagccagactgt

SEQ ID NO: 4570318 - DNA, 22 bp, Homo sapiens
gcgggaggctggggccccatct

SEQ ID NO: 4570319 - DNA, 15 bp, Homo sapiens
gcgggatacagctga

SEQ ID NO: 4570320 - DNA, 16 bp, Homo sapiens
gcgggatacagctgag

SEQ ID NO: 4570321 - DNA, 19 bp, Homo sapiens
gcgggatcctccacagaga

SEQ ID NO: 4570322 - DNA, 20 bp, Homo sapiens
gcgggatcctccacagagag

SEQ ID NO: 4570323 - DNA, 18 bp, Homo sapiens
gcgggcagagggctggag

SEQ ID NO: 4570324 - DNA, 18 bp, Homo sapiens
gcgggccaggaggctgcc

SEQ ID NO: 4570325 - DNA, 20 bp, Homo sapiens
gcgggccgtctcccttggcc

SEQ ID NO: 4570326 - DNA, 12 bp, Homo sapiens
gcgggctcagag

SEQ ID NO: 4570327 - DNA, 13 bp, Homo sapiens
gcgggctcagagc

SEQ ID NO: 4570328 - DNA, 23 bp, Homo sapiens
gcggggatcagagcgcacaggga

SEQ ID NO: 4570329 - DNA, 21 bp, Homo sapiens
gcggggcccaggcagcctccg

SEQ ID NO: 4570330 - DNA, 13 bp, Homo sapiens
gcgggttctagac

SEQ ID NO: 4570331 - DNA, 23 bp, Homo sapiens
gcgggttctagacgcccctccca

SEQ ID NO: 4570332 - DNA, 12 bp, Homo sapiens
gcggttcaggaa

SEQ ID NO: 4570333 - DNA, 12 bp, Homo sapiens
gcgtagaagtgg

SEQ ID NO: 4570334 - DNA, 19 bp, Homo sapiens
gcgtatgcagtgtagattt

SEQ ID NO: 4570335 - DNA, 22 bp, Homo sapiens
gcgtatttagactgtggccata

SEQ ID NO: 4570336 - DNA, 14 bp, Homo sapiens
gcgtcaagacattt

SEQ ID NO: 4570337 - DNA, 11 bp, Homo sapiens
gcgtcagcctc

SEQ ID NO: 4570338 - DNA, 16 bp, Homo sapiens
gcgtcagcctccagcc

SEQ ID NO: 4570339 - DNA, 17 bp, Homo sapiens
gcgtcagcctccagcct

SEQ ID NO: 4570340 - DNA, 14 bp, Homo sapiens
gcgtccagaaatgg

SEQ ID NO: 4570341 - DNA, 15 bp, Homo sapiens
gcgtcccagctcccc

SEQ ID NO: 4570342 - DNA, 17 bp, Homo sapiens
gcgtcccagctcccctc

SEQ ID NO: 4570343 - DNA, 11 bp, Homo sapiens
gcgtccctggc

SEQ ID NO: 4570344 - DNA, 12 bp, Homo sapiens
gcgtccctggcg

SEQ ID NO: 4570345 - DNA, 20 bp, Homo sapiens
gcgtcctcctcacctcatgc

SEQ ID NO: 4570346 - DNA, 21 bp, Homo sapiens
gcgtcctgtccacacccagct

SEQ ID NO: 4570347 - DNA, 11 bp, Homo sapiens
gcgtgcagatg

SEQ ID NO: 4570348 - DNA, 21 bp, Homo sapiens
gcgtggaactcgtgtctggca

SEQ ID NO: 4570349 - DNA, 17 bp, Homo sapiens
gcgtgtcacctgtgctt

SEQ ID NO: 4570350 - DNA, 13 bp, Homo sapiens
gcgtgtgcacgtg

SEQ ID NO: 4570351 - DNA, 22 bp, Homo sapiens
gcgtgttccagccaaagcatgc

SEQ ID NO: 4570352 - DNA, 13 bp, Homo sapiens
gcgtgttctcagc

SEQ ID NO: 4570353 - DNA, 11 bp, Homo sapiens
gcgttcctggc

SEQ ID NO: 4570354 - DNA, 19 bp, Homo sapiens
gcgttgtgtatattacacc

SEQ ID NO: 4570355 - DNA, 17 bp, Homo sapiens
gcgtttattgtagtaaa

SEQ ID NO: 4570356 - DNA, 14 bp, Homo sapiens
gcgtttttttacaa

SEQ ID NO: 4570357 - DNA, 16 bp, Homo sapiens
gctaaaaatattactc

SEQ ID NO: 4570358 - DNA, 18 bp, Homo sapiens
gctaaaaatgagcttgat

SEQ ID NO: 4570359 - DNA, 12 bp, Homo sapiens
gctaaaagaaac

SEQ ID NO: 4570360 - DNA, 16 bp, Homo sapiens
gctaaaagaaactttc

SEQ ID NO: 4570361 - DNA, 17 bp, Homo sapiens
gctaaaagcatgtatag

SEQ ID NO: 4570362 - DNA, 15 bp, Homo sapiens
gctaaaaggcttcca

SEQ ID NO: 4570363 - DNA, 21 bp, Homo sapiens
gctaaactgaatctatggctt

SEQ ID NO: 4570364 - DNA, 23 bp, Homo sapiens
gctaaactgaatctatggcttta

SEQ ID NO: 4570365 - DNA, 14 bp, Homo sapiens
gctaaagagccctt

SEQ ID NO: 4570366 - DNA, 23 bp, Homo sapiens
gctaaagagcccttgcctcccca

SEQ ID NO: 4570367 - DNA, 17 bp, Homo sapiens
gctaaagcaatatgcat

SEQ ID NO: 4570368 - DNA, 20 bp, Homo sapiens
gctaaagggagaaatgccag

SEQ ID NO: 4570369 - DNA, 17 bp, Homo sapiens
gctaaatgtttaaagaa

SEQ ID NO: 4570370 - DNA, 14 bp, Homo sapiens
gctaacaaagacaa

SEQ ID NO: 4570371 - DNA, 20 bp, Homo sapiens
gctaacatggtgaaaccccg

SEQ ID NO: 4570372 - DNA, 22 bp, Homo sapiens
gctaaccttatcctgcattgtt

SEQ ID NO: 4570373 - DNA, 14 bp, Homo sapiens
gctaactgtaaatc

SEQ ID NO: 4570374 - DNA, 16 bp, Homo sapiens
gctaactgtaaatcat

SEQ ID NO: 4570375 - DNA, 15 bp, Homo sapiens
gctaagaaaaaggaa

SEQ ID NO: 4570376 - DNA, 23 bp, Homo sapiens
gctaagaaaaaggaaaaccattc

SEQ ID NO: 4570377 - DNA, 15 bp, Homo sapiens
gctaagacacactcc

SEQ ID NO: 4570378 - DNA, 14 bp, Homo sapiens
gctaagagaagtag

SEQ ID NO: 4570379 - DNA, 18 bp, Homo sapiens
gctaagagctagcgctgc

SEQ ID NO: 4570380 - DNA, 17 bp, Homo sapiens
gctaagcaaaatgtgat

SEQ ID NO: 4570381 - DNA, 21 bp, Homo sapiens
gctaaggaagtatcagcacta

SEQ ID NO: 4570382 - DNA, 22 bp, Homo sapiens
gctaaggaggggaaaaaaatgt

SEQ ID NO: 4570383 - DNA, 21 bp, Homo sapiens
gctaagtaatttagaagatat

SEQ ID NO: 4570384 - DNA, 14 bp, Homo sapiens
gctaatatactttt

SEQ ID NO: 4570385 - DNA, 22 bp, Homo sapiens
gctaatgttgctggatcaggaa

SEQ ID NO: 4570386 - DNA, 22 bp, Homo sapiens
gctaattcaaggaatttcttaa

SEQ ID NO: 4570387 - DNA, 14 bp, Homo sapiens
gctaatttaacacc

SEQ ID NO: 4570388 - DNA, 22 bp, Homo sapiens
gctaatttagagataggaaact

SEQ ID NO: 4570389 - DNA, 23 bp, Homo sapiens
gctaatttagagataggaaactg

SEQ ID NO: 4570390 - DNA, 15 bp, Homo sapiens
gctaatttttgtaat

SEQ ID NO: 4570391 - DNA, 17 bp, Homo sapiens
gctaatttttgtatttt

SEQ ID NO: 4570392 - DNA, 20 bp, Homo sapiens
gctaattttttgttgtttct

SEQ ID NO: 4570393 - DNA, 14 bp, Homo sapiens
gctacaaaaattga

SEQ ID NO: 4570394 - DNA, 13 bp, Homo sapiens
gctacaaactttt

SEQ ID NO: 4570395 - DNA, 14 bp, Homo sapiens
gctacagctccaca

SEQ ID NO: 4570396 - DNA, 16 bp, Homo sapiens
gctacagctccacacg

SEQ ID NO: 4570397 - DNA, 20 bp, Homo sapiens
gctacaggaagcaccccatg

SEQ ID NO: 4570398 - DNA, 13 bp, Homo sapiens
gctacataattta

SEQ ID NO: 4570399 - DNA, 15 bp, Homo sapiens
gctacatcagactct

SEQ ID NO: 4570400 - DNA, 23 bp, Homo sapiens
gctacatgacgacaaagctgcta

SEQ ID NO: 4570401 - DNA, 22 bp, Homo sapiens
gctaccaagtcagacaccaagg

SEQ ID NO: 4570402 - DNA, 15 bp, Homo sapiens
gctaccagtatttag

SEQ ID NO: 4570403 - DNA, 21 bp, Homo sapiens
gctaccagtatttagaagcca

SEQ ID NO: 4570404 - DNA, 15 bp, Homo sapiens
gctacccgctgtggc

SEQ ID NO: 4570405 - DNA, 16 bp, Homo sapiens
gctacccgctgtggcc

SEQ ID NO: 4570406 - DNA, 13 bp, Homo sapiens
gctacctcagaaa

SEQ ID NO: 4570407 - DNA, 14 bp, Homo sapiens
gctacgtatttaat

SEQ ID NO: 4570408 - DNA, 15 bp, Homo sapiens
gctactataatcaaa

SEQ ID NO: 4570409 - DNA, 19 bp, Homo sapiens
gctactataatcaaatgat

SEQ ID NO: 4570410 - DNA, 23 bp, Homo sapiens
gctactataatcaaatgatttca

SEQ ID NO: 4570411 - DNA, 16 bp, Homo sapiens
gctactattttggaaa

SEQ ID NO: 4570412 - DNA, 18 bp, Homo sapiens
gctactattttggaaaat

SEQ ID NO: 4570413 - DNA, 11 bp, Homo sapiens
gctactcagca

SEQ ID NO: 4570414 - DNA, 16 bp, Homo sapiens
gctactcctgtgctct

SEQ ID NO: 4570415 - DNA, 22 bp, Homo sapiens
gctactctccccacgagggctg

SEQ ID NO: 4570416 - DNA, 16 bp, Homo sapiens
gctactgctcagcttc

SEQ ID NO: 4570417 - DNA, 22 bp, Homo sapiens
gctactggggaggctgaggcag

SEQ ID NO: 4570418 - DNA, 23 bp, Homo sapiens
gctactggggaggctgaggcagg

SEQ ID NO: 4570419 - DNA, 15 bp, Homo sapiens
gctactgtcagctcc

SEQ ID NO: 4570420 - DNA, 18 bp, Homo sapiens
gctactgtgtgtgtgaat

SEQ ID NO: 4570421 - DNA, 16 bp, Homo sapiens
gctacttgggaggctg

SEQ ID NO: 4570422 - DNA, 16 bp, Homo sapiens
gctactttgctgctat

SEQ ID NO: 4570423 - DNA, 18 bp, Homo sapiens
gctagaacctggaagggc

SEQ ID NO: 4570424 - DNA, 19 bp, Homo sapiens
gctagaacctggaagggct

SEQ ID NO: 4570425 - DNA, 15 bp, Homo sapiens
gctagaacctggagg

SEQ ID NO: 4570426 - DNA, 19 bp, Homo sapiens
gctagaacctggagggctg

SEQ ID NO: 4570427 - DNA, 21 bp, Homo sapiens
gctagaattgagtgtttaaag

SEQ ID NO: 4570428 - DNA, 15 bp, Homo sapiens
gctagacaggaaccc

SEQ ID NO: 4570429 - DNA, 20 bp, Homo sapiens
gctagagaaatcagctgcta

SEQ ID NO: 4570430 - DNA, 18 bp, Homo sapiens
gctagagaaattcttgtt

SEQ ID NO: 4570431 - DNA, 23 bp, Homo sapiens
gctagagacagatgctggtggag

SEQ ID NO: 4570432 - DNA, 21 bp, Homo sapiens
gctagagatatggcagcgaaa

SEQ ID NO: 4570433 - DNA, 18 bp, Homo sapiens
gctagagcagacaggcct

SEQ ID NO: 4570434 - DNA, 20 bp, Homo sapiens
gctagagtcctcactcccag

SEQ ID NO: 4570435 - DNA, 17 bp, Homo sapiens
gctagcacagaggcctg
